United States Patent 11,421,016 (CANCER NEOEPITOPES) - sequence listing, part 11

SEQ ID NO: 462711 - protein, 9 aa, Homo Sapiens
PDSLKDEAN

SEQ ID NO: 462712 - protein, 9 aa, Homo Sapiens
SKDTLEPEA

SEQ ID NO: 462713 - protein, 9 aa, Homo Sapiens
VSSGLGGLF

SEQ ID NO: 462714 - protein, 9 aa, Homo Sapiens
FVSSSSRSI

SEQ ID NO: 462715 - protein, 9 aa, Homo Sapiens
MFFGLKCKN

SEQ ID NO: 462716 - protein, 9 aa, Homo Sapiens
KILEKHLRY

SEQ ID NO: 462717 - protein, 9 aa, Homo Sapiens
SETFIVWKS

SEQ ID NO: 462718 - protein, 9 aa, Homo Sapiens
GNKTKDLST

SEQ ID NO: 462719 - protein, 9 aa, Homo Sapiens
ISWVQMNFL

SEQ ID NO: 462720 - protein, 9 aa, Homo Sapiens
FAISWVQMN

SEQ ID NO: 462721 - protein, 9 aa, Homo Sapiens
LQSSETCVQ

SEQ ID NO: 462722 - protein, 9 aa, Homo Sapiens
SYVELASTK

SEQ ID NO: 462723 - protein, 9 aa, Homo Sapiens
QSHCFVILC

SEQ ID NO: 462724 - protein, 9 aa, Homo Sapiens
DSETFIVWK

SEQ ID NO: 462725 - protein, 9 aa, Homo Sapiens
RPKPMADGG

SEQ ID NO: 462726 - protein, 9 aa, Homo Sapiens
TKVRPQANI

SEQ ID NO: 462727 - protein, 9 aa, Homo Sapiens
TLILRNARK

SEQ ID NO: 462728 - protein, 9 aa, Homo Sapiens
PGEMCGLIL

SEQ ID NO: 462729 - protein, 9 aa, Homo Sapiens
QTLASRGAE

SEQ ID NO: 462730 - protein, 9 aa, Homo Sapiens
VRTRVQHRS

SEQ ID NO: 462731 - protein, 9 aa, Homo Sapiens
VGASCSDPV

SEQ ID NO: 462732 - protein, 9 aa, Homo Sapiens
ITGMSCHAQ

SEQ ID NO: 462733 - protein, 9 aa, Homo Sapiens
ERPKPMADG

SEQ ID NO: 462734 - protein, 9 aa, Homo Sapiens
GFQMTRTVT

SEQ ID NO: 462735 - protein, 9 aa, Homo Sapiens
SHFLIQSVK

SEQ ID NO: 462736 - protein, 9 aa, Homo Sapiens
DSLKDEANA

SEQ ID NO: 462737 - protein, 9 aa, Homo Sapiens
SVVAIREQG

SEQ ID NO: 462738 - protein, 9 aa, Homo Sapiens
PSLRVSAPG

SEQ ID NO: 462739 - protein, 9 aa, Homo Sapiens
GITGMSCHA

SEQ ID NO: 462740 - protein, 9 aa, Homo Sapiens
LGTAIVETH

SEQ ID NO: 462741 - protein, 9 aa, Homo Sapiens
GMFFGLKCK

SEQ ID NO: 462742 - protein, 9 aa, Homo Sapiens
DTLEPEAEL

SEQ ID NO: 462743 - protein, 9 aa, Homo Sapiens
GEMCGLILE

SEQ ID NO: 462744 - protein, 9 aa, Homo Sapiens
PPTIYLLHY

SEQ ID NO: 462745 - protein, 9 aa, Homo Sapiens
IGSDTFNCC

SEQ ID NO: 462746 - protein, 9 aa, Homo Sapiens
LRSYSPNNA

SEQ ID NO: 462747 - protein, 9 aa, Homo Sapiens
QGLLQAFEL

SEQ ID NO: 462748 - protein, 9 aa, Homo Sapiens
LVWKQHLPL

SEQ ID NO: 462749 - protein, 9 aa, Homo Sapiens
HYFQTCGNV

SEQ ID NO: 462750 - protein, 9 aa, Homo Sapiens
KDLIRSHFL

SEQ ID NO: 462751 - protein, 9 aa, Homo Sapiens
QGKELVWKQ

SEQ ID NO: 462752 - protein, 9 aa, Homo Sapiens
QHRSNKRRD

SEQ ID NO: 462753 - protein, 9 aa, Homo Sapiens
ETCVQGLLS

SEQ ID NO: 462754 - protein, 9 aa, Homo Sapiens
YEFIIVTTL

SEQ ID NO: 462755 - protein, 9 aa, Homo Sapiens
IWVAGFQMT

SEQ ID NO: 462756 - protein, 9 aa, Homo Sapiens
RTRVQHRSN

SEQ ID NO: 462757 - protein, 9 aa, Homo Sapiens
RMYGITDFQ

SEQ ID NO: 462758 - protein, 9 aa, Homo Sapiens
CGKGMFFGL

SEQ ID NO: 462759 - protein, 9 aa, Homo Sapiens
TFNCCTFLS

SEQ ID NO: 462760 - protein, 9 aa, Homo Sapiens
VFLFIGSDT

SEQ ID NO: 462761 - protein, 9 aa, Homo Sapiens
QNLAALVSE

SEQ ID NO: 462762 - protein, 9 aa, Homo Sapiens
GTAIVETHD

SEQ ID NO: 462763 - protein, 9 aa, Homo Sapiens
FNDVKINVC

SEQ ID NO: 462764 - protein, 9 aa, Homo Sapiens
SQGPYPTVR

SEQ ID NO: 462765 - protein, 9 aa, Homo Sapiens
PFQAETVAK

SEQ ID NO: 462766 - protein, 9 aa, Homo Sapiens
GNNASDYLV

SEQ ID NO: 462767 - protein, 9 aa, Homo Sapiens
VTGITQQNQ

SEQ ID NO: 462768 - protein, 9 aa, Homo Sapiens
LCKFNRENS

SEQ ID NO: 462769 - protein, 9 aa, Homo Sapiens
DVKINVCLN

SEQ ID NO: 462770 - protein, 9 aa, Homo Sapiens
SSCYFFLPL

SEQ ID NO: 462771 - protein, 9 aa, Homo Sapiens
KIWEHFRPY

SEQ ID NO: 462772 - protein, 9 aa, Homo Sapiens
AGAELSYRI

SEQ ID NO: 462773 - protein, 9 aa, Homo Sapiens
DITVEWESS

SEQ ID NO: 462774 - protein, 9 aa, Homo Sapiens
SEAWDSEGM

SEQ ID NO: 462775 - protein, 9 aa, Homo Sapiens
SHVCSRTPV

SEQ ID NO: 462776 - protein, 9 aa, Homo Sapiens
GLRGAGNIP

SEQ ID NO: 462777 - protein, 9 aa, Homo Sapiens
GPETSSDKY

SEQ ID NO: 462778 - protein, 9 aa, Homo Sapiens
ILLNLQSKT

SEQ ID NO: 462779 - protein, 9 aa, Homo Sapiens
AAAAAIPSS

SEQ ID NO: 462780 - protein, 9 aa, Homo Sapiens
REFRLLLLF

SEQ ID NO: 462781 - protein, 9 aa, Homo Sapiens
PLQCWGRRR

SEQ ID NO: 462782 - protein, 9 aa, Homo Sapiens
KLGAAHLFA

SEQ ID NO: 462783 - protein, 9 aa, Homo Sapiens
RNAAICPYC

SEQ ID NO: 462784 - protein, 9 aa, Homo Sapiens
KRYPSESTS

SEQ ID NO: 462785 - protein, 9 aa, Homo Sapiens
ALCGFGELG

SEQ ID NO: 462786 - protein, 9 aa, Homo Sapiens
IHRFCSGGR

SEQ ID NO: 462787 - protein, 9 aa, Homo Sapiens
PETSSDKYL

SEQ ID NO: 462788 - protein, 9 aa, Homo Sapiens
DLCMRLLRP

SEQ ID NO: 462789 - protein, 9 aa, Homo Sapiens
HWAVQLLLV

SEQ ID NO: 462790 - protein, 9 aa, Homo Sapiens
TACFEQRTF

SEQ ID NO: 462791 - protein, 9 aa, Homo Sapiens
GLSLAALRK

SEQ ID NO: 462792 - protein, 9 aa, Homo Sapiens
ITKPVIVDK

SEQ ID NO: 462793 - protein, 9 aa, Homo Sapiens
FRSCSWDSA

SEQ ID NO: 462794 - protein, 9 aa, Homo Sapiens
PPAPGSSCY

SEQ ID NO: 462795 - protein, 9 aa, Homo Sapiens
EADPGAGAE

SEQ ID NO: 462796 - protein, 9 aa, Homo Sapiens
DYNMCLVHN

SEQ ID NO: 462797 - protein, 9 aa, Homo Sapiens
FYPSDITVE

SEQ ID NO: 462798 - protein, 9 aa, Homo Sapiens
FICDELDHK

SEQ ID NO: 462799 - protein, 9 aa, Homo Sapiens
KMPKADLKG

SEQ ID NO: 462800 - protein, 9 aa, Homo Sapiens
NLKHHLEDM

SEQ ID NO: 462801 - protein, 9 aa, Homo Sapiens
HFLVNTLCL

SEQ ID NO: 462802 - protein, 9 aa, Homo Sapiens
ALRLWEGPV

SEQ ID NO: 462803 - protein, 9 aa, Homo Sapiens
VHCVICQKV

SEQ ID NO: 462804 - protein, 9 aa, Homo Sapiens
LAESKRYPS

SEQ ID NO: 462805 - protein, 9 aa, Homo Sapiens
LSPEPAKPK

SEQ ID NO: 462806 - protein, 9 aa, Homo Sapiens
TFMLARFGT

SEQ ID NO: 462807 - protein, 9 aa, Homo Sapiens
FMLARFGTL

SEQ ID NO: 462808 - protein, 9 aa, Homo Sapiens
FISDTISPY

SEQ ID NO: 462809 - protein, 9 aa, Homo Sapiens
PLCGPNELD

SEQ ID NO: 462810 - protein, 9 aa, Homo Sapiens
CSDCRKAFI

SEQ ID NO: 462811 - protein, 9 aa, Homo Sapiens
CMGSMNRRP

SEQ ID NO: 462812 - protein, 9 aa, Homo Sapiens
IAKRQTPKI

SEQ ID NO: 462813 - protein, 9 aa, Homo Sapiens
FQQWERWGE

SEQ ID NO: 462814 - protein, 9 aa, Homo Sapiens
RFMRSDNLA

SEQ ID NO: 462815 - protein, 9 aa, Homo Sapiens
PTACFEQRT

SEQ ID NO: 462816 - protein, 9 aa, Homo Sapiens
VSGITLLSS

SEQ ID NO: 462817 - protein, 9 aa, Homo Sapiens
AKRQTPKIQ

SEQ ID NO: 462818 - protein, 9 aa, Homo Sapiens
LMGNMDHHH

SEQ ID NO: 462819 - protein, 9 aa, Homo Sapiens
GNMDHHHYE

SEQ ID NO: 462820 - protein, 9 aa, Homo Sapiens
VPTILTDVD

SEQ ID NO: 462821 - protein, 9 aa, Homo Sapiens
SSHPLVLPN

SEQ ID NO: 462822 - protein, 9 aa, Homo Sapiens
LNLQSKTSV

SEQ ID NO: 462823 - protein, 9 aa, Homo Sapiens
STEEYDQYE

SEQ ID NO: 462824 - protein, 9 aa, Homo Sapiens
SKRYPSEST

SEQ ID NO: 462825 - protein, 9 aa, Homo Sapiens
WGSFPQHCA

SEQ ID NO: 462826 - protein, 9 aa, Homo Sapiens
SDQPLLHVV

SEQ ID NO: 462827 - protein, 9 aa, Homo Sapiens
YIVPTILTD

SEQ ID NO: 462828 - protein, 9 aa, Homo Sapiens
HGCFICDEL

SEQ ID NO: 462829 - protein, 9 aa, Homo Sapiens
ASEFDEWGP

SEQ ID NO: 462830 - protein, 9 aa, Homo Sapiens
LMSKILKSI

SEQ ID NO: 462831 - protein, 9 aa, Homo Sapiens
ILKSIANHV

SEQ ID NO: 462832 - protein, 9 aa, Homo Sapiens
KSIANHVLF

SEQ ID NO: 462833 - protein, 9 aa, Homo Sapiens
QHCAGRRRQ

SEQ ID NO: 462834 - protein, 9 aa, Homo Sapiens
YDVTDISNV

SEQ ID NO: 462835 - protein, 9 aa, Homo Sapiens
RIGRGSSSA

SEQ ID NO: 462836 - protein, 9 aa, Homo Sapiens
SSLAIFSVG

SEQ ID NO: 462837 - protein, 9 aa, Homo Sapiens
CPEKPCGEE

SEQ ID NO: 462838 - protein, 9 aa, Homo Sapiens
STLTCHHRL

SEQ ID NO: 462839 - protein, 9 aa, Homo Sapiens
AVVLLIHLR

SEQ ID NO: 462840 - protein, 9 aa, Homo Sapiens
LPLCGPNEL

SEQ ID NO: 462841 - protein, 9 aa, Homo Sapiens
LYFSVEVIR

SEQ ID NO: 462842 - protein, 9 aa, Homo Sapiens
GGYGSWKSR

SEQ ID NO: 462843 - protein, 9 aa, Homo Sapiens
SLAALRKAL

SEQ ID NO: 462844 - protein, 9 aa, Homo Sapiens
ISNVHDDEL

SEQ ID NO: 462845 - protein, 9 aa, Homo Sapiens
PCALGAAIP

SEQ ID NO: 462846 - protein, 9 aa, Homo Sapiens
YFFLPLAPA

SEQ ID NO: 462847 - protein, 9 aa, Homo Sapiens
CSWDSALRL

SEQ ID NO: 462848 - protein, 9 aa, Homo Sapiens
VTWLKYGLP

SEQ ID NO: 462849 - protein, 9 aa, Homo Sapiens
IYKQAARAE

SEQ ID NO: 462850 - protein, 9 aa, Homo Sapiens
LFPAMKKGL

SEQ ID NO: 462851 - protein, 9 aa, Homo Sapiens
EGNNASDYL

SEQ ID NO: 462852 - protein, 9 aa, Homo Sapiens
AHQWIHRFC

SEQ ID NO: 462853 - protein, 9 aa, Homo Sapiens
LTGSPYESQ

SEQ ID NO: 462854 - protein, 9 aa, Homo Sapiens
ESKRYPSES

SEQ ID NO: 462855 - protein, 9 aa, Homo Sapiens
LSYRIGRGS

SEQ ID NO: 462856 - protein, 9 aa, Homo Sapiens
QFVSYFQQW

SEQ ID NO: 462857 - protein, 9 aa, Homo Sapiens
NGLSLAALR

SEQ ID NO: 462858 - protein, 9 aa, Homo Sapiens
GFYPSDITV

SEQ ID NO: 462859 - protein, 9 aa, Homo Sapiens
ICDELDHKR

SEQ ID NO: 462860 - protein, 9 aa, Homo Sapiens
KHHLEDMEQ

SEQ ID NO: 462861 - protein, 9 aa, Homo Sapiens
DAVVLLIHL

SEQ ID NO: 462862 - protein, 9 aa, Homo Sapiens
CWGRRRRQW

SEQ ID NO: 462863 - protein, 9 aa, Homo Sapiens
EVTWLKYGL

SEQ ID NO: 462864 - protein, 9 aa, Homo Sapiens
PEGNNASDY

SEQ ID NO: 462865 - protein, 9 aa, Homo Sapiens
INGGYGSWK

SEQ ID NO: 462866 - protein, 9 aa, Homo Sapiens
QFVCLECLV

SEQ ID NO: 462867 - protein, 9 aa, Homo Sapiens
GASIPPPRL

SEQ ID NO: 462868 - protein, 9 aa, Homo Sapiens
TTFMLARFG

SEQ ID NO: 462869 - protein, 9 aa, Homo Sapiens
RRKPRGTLP

SEQ ID NO: 462870 - protein, 9 aa, Homo Sapiens
GSQIPLFPA

SEQ ID NO: 462871 - protein, 9 aa, Homo Sapiens
ENLAGPWSS

SEQ ID NO: 462872 - protein, 9 aa, Homo Sapiens
AGVMISLAW

SEQ ID NO: 462873 - protein, 9 aa, Homo Sapiens
QQIRLTLCK

SEQ ID NO: 462874 - protein, 9 aa, Homo Sapiens
SQACPCGRG

SEQ ID NO: 462875 - protein, 9 aa, Homo Sapiens
IRVKHPELC

SEQ ID NO: 462876 - protein, 9 aa, Homo Sapiens
SRPRPMALP

SEQ ID NO: 462877 - protein, 9 aa, Homo Sapiens
AICHNKTTV

SEQ ID NO: 462878 - protein, 9 aa, Homo Sapiens
PSPSRTPYG

SEQ ID NO: 462879 - protein, 9 aa, Homo Sapiens
LGSQSPRLS

SEQ ID NO: 462880 - protein, 9 aa, Homo Sapiens
RGAGNIPSA

SEQ ID NO: 462881 - protein, 9 aa, Homo Sapiens
RLKTIRVKH

SEQ ID NO: 462882 - protein, 9 aa, Homo Sapiens
DHHHYETFE

SEQ ID NO: 462883 - protein, 9 aa, Homo Sapiens
TKRAGVMIS

SEQ ID NO: 462884 - protein, 9 aa, Homo Sapiens
MLARFGTLL

SEQ ID NO: 462885 - protein, 9 aa, Homo Sapiens
REKVEEEEA

SEQ ID NO: 462886 - protein, 9 aa, Homo Sapiens
EHRPPAPGS

SEQ ID NO: 462887 - protein, 9 aa, Homo Sapiens
TVSHTAAAA

SEQ ID NO: 462888 - protein, 9 aa, Homo Sapiens
ERDTEATRG

SEQ ID NO: 462889 - protein, 9 aa, Homo Sapiens
EGCGKAFIW

SEQ ID NO: 462890 - protein, 9 aa, Homo Sapiens
PSSLSTRAA

SEQ ID NO: 462891 - protein, 9 aa, Homo Sapiens
PVQELRKLR

SEQ ID NO: 462892 - protein, 9 aa, Homo Sapiens
WIHAVCTPV

SEQ ID NO: 462893 - protein, 9 aa, Homo Sapiens
SQFTIYEVV

SEQ ID NO: 462894 - protein, 9 aa, Homo Sapiens
RKALAAGGY

SEQ ID NO: 462895 - protein, 9 aa, Homo Sapiens
LAEDMTLCV

SEQ ID NO: 462896 - protein, 9 aa, Homo Sapiens
NAAICPYCS

SEQ ID NO: 462897 - protein, 9 aa, Homo Sapiens
ESASTSSSG

SEQ ID NO: 462898 - protein, 9 aa, Homo Sapiens
HQWIHRFCS

SEQ ID NO: 462899 - protein, 9 aa, Homo Sapiens
SLAICHNKT

SEQ ID NO: 462900 - protein, 9 aa, Homo Sapiens
ACFEQRTFS

SEQ ID NO: 462901 - protein, 9 aa, Homo Sapiens
RLSNMVSSS

SEQ ID NO: 462902 - protein, 9 aa, Homo Sapiens
SDNLAKHVK

SEQ ID NO: 462903 - protein, 9 aa, Homo Sapiens
QLIHDRNTV

SEQ ID NO: 462904 - protein, 9 aa, Homo Sapiens
DCARPSPSW

SEQ ID NO: 462905 - protein, 9 aa, Homo Sapiens
RKPRGTLPG

SEQ ID NO: 462906 - protein, 9 aa, Homo Sapiens
DCRKAFIHS

SEQ ID NO: 462907 - protein, 9 aa, Homo Sapiens
NLQSKTSVN

SEQ ID NO: 462908 - protein, 9 aa, Homo Sapiens
AESKRYPSE

SEQ ID NO: 462909 - protein, 9 aa, Homo Sapiens
PYPTVRQKL

SEQ ID NO: 462910 - protein, 9 aa, Homo Sapiens
FKSAGQFLR

SEQ ID NO: 462911 - protein, 9 aa, Homo Sapiens
QRLKTIRVK

SEQ ID NO: 462912 - protein, 9 aa, Homo Sapiens
SDITVEWES

SEQ ID NO: 462913 - protein, 9 aa, Homo Sapiens
APLFAARAV

SEQ ID NO: 462914 - protein, 9 aa, Homo Sapiens
VTGTMPFQA

SEQ ID NO: 462915 - protein, 9 aa, Homo Sapiens
HPLRCSAEE

SEQ ID NO: 462916 - protein, 9 aa, Homo Sapiens
YTQLLLVKE

SEQ ID NO: 462917 - protein, 9 aa, Homo Sapiens
KYGLPLPKR

SEQ ID NO: 462918 - protein, 9 aa, Homo Sapiens
GDAATRYIV

SEQ ID NO: 462919 - protein, 9 aa, Homo Sapiens
SLAWVISFV

SEQ ID NO: 462920 - protein, 9 aa, Homo Sapiens
STSQTQSLA

SEQ ID NO: 462921 - protein, 9 aa, Homo Sapiens
RYIVPTILT

SEQ ID NO: 462922 - protein, 9 aa, Homo Sapiens
VIAQSTNSE

SEQ ID NO: 462923 - protein, 9 aa, Homo Sapiens
AGQFLRLSL

SEQ ID NO: 462924 - protein, 9 aa, Homo Sapiens
LSTRAASGA

SEQ ID NO: 462925 - protein, 9 aa, Homo Sapiens
TPYGGTRSM

SEQ ID NO: 462926 - protein, 9 aa, Homo Sapiens
IGRGSSSAS

SEQ ID NO: 462927 - protein, 9 aa, Homo Sapiens
SQFVCLECL

SEQ ID NO: 462928 - protein, 9 aa, Homo Sapiens
KEMIRRFWY

SEQ ID NO: 462929 - protein, 9 aa, Homo Sapiens
HIMKNRNGG

SEQ ID NO: 462930 - protein, 9 aa, Homo Sapiens
GITLLSSKH

SEQ ID NO: 462931 - protein, 9 aa, Homo Sapiens
MCLVHNGRM

SEQ ID NO: 462932 - protein, 9 aa, Homo Sapiens
CMKVRHPVQ

SEQ ID NO: 462933 - protein, 9 aa, Homo Sapiens
LIGYDVTDI

SEQ ID NO: 462934 - protein, 9 aa, Homo Sapiens
GHLQVGQGQ

SEQ ID NO: 462935 - protein, 9 aa, Homo Sapiens
SHRYTQLLL

SEQ ID NO: 462936 - protein, 9 aa, Homo Sapiens
LAGPWSSEA

SEQ ID NO: 462937 - protein, 9 aa, Homo Sapiens
GSMNRRPIL

SEQ ID NO: 462938 - protein, 9 aa, Homo Sapiens
AEDMTLCVA

SEQ ID NO: 462939 - protein, 9 aa, Homo Sapiens
EHNPPQLEL

SEQ ID NO: 462940 - protein, 9 aa, Homo Sapiens
KPCGEEPPV

SEQ ID NO: 462941 - protein, 9 aa, Homo Sapiens
LKHHLEDME

SEQ ID NO: 462942 - protein, 9 aa, Homo Sapiens
EETCQALLP

SEQ ID NO: 462943 - protein, 9 aa, Homo Sapiens
HARGSSLAI

SEQ ID NO: 462944 - protein, 9 aa, Homo Sapiens
YRKDVIWHA

SEQ ID NO: 462945 - protein, 9 aa, Homo Sapiens
SGWIHAVCT

SEQ ID NO: 462946 - protein, 9 aa, Homo Sapiens
SMNRRPILT

SEQ ID NO: 462947 - protein, 9 aa, Homo Sapiens
KTIRVKHPE

SEQ ID NO: 462948 - protein, 9 aa, Homo Sapiens
LLVTGITQQ

SEQ ID NO: 462949 - protein, 9 aa, Homo Sapiens
LCPEKPCGE

SEQ ID NO: 462950 - protein, 9 aa, Homo Sapiens
SGSQIPLFP

SEQ ID NO: 462951 - protein, 9 aa, Homo Sapiens
CEGCGKAFI

SEQ ID NO: 462952 - protein, 9 aa, Homo Sapiens
AQYPFEEHN

SEQ ID NO: 462953 - protein, 9 aa, Homo Sapiens
VSTVHIMKN

SEQ ID NO: 462954 - protein, 9 aa, Homo Sapiens
ARPRPGVPA

SEQ ID NO: 462955 - protein, 9 aa, Homo Sapiens
FSVEVIRLG

SEQ ID NO: 462956 - protein, 9 aa, Homo Sapiens
GTPGRLRVI

SEQ ID NO: 462957 - protein, 9 aa, Homo Sapiens
SWFRSCSWD

SEQ ID NO: 462958 - protein, 9 aa, Homo Sapiens
SDCRKAFIH

SEQ ID NO: 462959 - protein, 9 aa, Homo Sapiens
TTCSSHMTV

SEQ ID NO: 462960 - protein, 9 aa, Homo Sapiens
FVCLECLVT

SEQ ID NO: 462961 - protein, 9 aa, Homo Sapiens
AAAAIPSSL

SEQ ID NO: 462962 - protein, 9 aa, Homo Sapiens
DQERTPALS

SEQ ID NO: 462963 - protein, 9 aa, Homo Sapiens
RRCTREFRL

SEQ ID NO: 462964 - protein, 9 aa, Homo Sapiens
LPLAPASSH

SEQ ID NO: 462965 - protein, 9 aa, Homo Sapiens
GMMPGTPRS

SEQ ID NO: 462966 - protein, 9 aa, Homo Sapiens
GPEGTTLEG

SEQ ID NO: 462967 - protein, 9 aa, Homo Sapiens
WHFLVNTLC

SEQ ID NO: 462968 - protein, 9 aa, Homo Sapiens
WERWGEDNH

SEQ ID NO: 462969 - protein, 9 aa, Homo Sapiens
LLIHLRLKL

SEQ ID NO: 462970 - protein, 9 aa, Homo Sapiens
RGSSSASPS

SEQ ID NO: 462971 - protein, 9 aa, Homo Sapiens
TGTMPFQAE

SEQ ID NO: 462972 - protein, 9 aa, Homo Sapiens
PYECSDCRK

SEQ ID NO: 462973 - protein, 9 aa, Homo Sapiens
FQAETVAKL

SEQ ID NO: 462974 - protein, 9 aa, Homo Sapiens
GLDSQFVCL

SEQ ID NO: 462975 - protein, 9 aa, Homo Sapiens
LKTIRVKHP

SEQ ID NO: 462976 - protein, 9 aa, Homo Sapiens
GHSGLDRVA

SEQ ID NO: 462977 - protein, 9 aa, Homo Sapiens
SLAIFSVGP

SEQ ID NO: 462978 - protein, 9 aa, Homo Sapiens
RRQRCQRRW

SEQ ID NO: 462979 - protein, 9 aa, Homo Sapiens
RYTQLLLVK

SEQ ID NO: 462980 - protein, 9 aa, Homo Sapiens
KPEEEEEEL

SEQ ID NO: 462981 - protein, 9 aa, Homo Sapiens
PINGGYGSW

SEQ ID NO: 462982 - protein, 9 aa, Homo Sapiens
VLLIHLRLK

SEQ ID NO: 462983 - protein, 9 aa, Homo Sapiens
EHQTWHFLV

SEQ ID NO: 462984 - protein, 9 aa, Homo Sapiens
THKIWEHFR

SEQ ID NO: 462985 - protein, 9 aa, Homo Sapiens
VNLSHRYTQ

SEQ ID NO: 462986 - protein, 9 aa, Homo Sapiens
YNMCLVHNG

SEQ ID NO: 462987 - protein, 9 aa, Homo Sapiens
YPEGNNASD

SEQ ID NO: 462988 - protein, 9 aa, Homo Sapiens
SAGQFLRLS

SEQ ID NO: 462989 - protein, 9 aa, Homo Sapiens
STVHIMKNR

SEQ ID NO: 462990 - protein, 9 aa, Homo Sapiens
QQWERWGED

SEQ ID NO: 462991 - protein, 9 aa, Homo Sapiens
NASDYLVQT

SEQ ID NO: 462992 - protein, 9 aa, Homo Sapiens
RLLLLFLCV

SEQ ID NO: 462993 - protein, 9 aa, Homo Sapiens
IQLPLCGPN

SEQ ID NO: 462994 - protein, 9 aa, Homo Sapiens
WDECPGSCP

SEQ ID NO: 462995 - protein, 9 aa, Homo Sapiens
CTPVDSLVF

SEQ ID NO: 462996 - protein, 9 aa, Homo Sapiens
LVKLICPVF

SEQ ID NO: 462997 - protein, 9 aa, Homo Sapiens
GDGHLSRPI

SEQ ID NO: 462998 - protein, 9 aa, Homo Sapiens
DSQFVCLEC

SEQ ID NO: 462999 - protein, 9 aa, Homo Sapiens
TRAASGASI

SEQ ID NO: 463000 - protein, 9 aa, Homo Sapiens
GPYPTVRQK

SEQ ID NO: 463001 - protein, 9 aa, Homo Sapiens
KSRKDQIQW

SEQ ID NO: 463002 - protein, 9 aa, Homo Sapiens
WGSFPLQCV

SEQ ID NO: 463003 - protein, 9 aa, Homo Sapiens
LYWACMKVR

SEQ ID NO: 463004 - protein, 9 aa, Homo Sapiens
EPAKPKARP

SEQ ID NO: 463005 - protein, 9 aa, Homo Sapiens
KAKLGAAHL

SEQ ID NO: 463006 - protein, 9 aa, Homo Sapiens
YWACMKVRH

SEQ ID NO: 463007 - protein, 9 aa, Homo Sapiens
HFRPYKKHH

SEQ ID NO: 463008 - protein, 9 aa, Homo Sapiens
KIPAERLRG

SEQ ID NO: 463009 - protein, 9 aa, Homo Sapiens
RPINGGYGS

SEQ ID NO: 463010 - protein, 9 aa, Homo Sapiens
QDCARPSPS

SEQ ID NO: 463011 - protein, 9 aa, Homo Sapiens
GQEADPGAG

SEQ ID NO: 463012 - protein, 9 aa, Homo Sapiens
MPKADLKGP

SEQ ID NO: 463013 - protein, 9 aa, Homo Sapiens
MGSMNRRPI

SEQ ID NO: 463014 - protein, 9 aa, Homo Sapiens
SSKHKYKSG

SEQ ID NO: 463015 - protein, 9 aa, Homo Sapiens
LLHVVSQSN

SEQ ID NO: 463016 - protein, 9 aa, Homo Sapiens
KSRPRPMAL

SEQ ID NO: 463017 - protein, 9 aa, Homo Sapiens
RADSSGHLQ

SEQ ID NO: 463018 - protein, 9 aa, Homo Sapiens
GRRRQWGSF

SEQ ID NO: 463019 - protein, 9 aa, Homo Sapiens
DECPGSCPT

SEQ ID NO: 463020 - protein, 9 aa, Homo Sapiens
PKADLKGPQ

SEQ ID NO: 463021 - protein, 9 aa, Homo Sapiens
MTLCVADFG

SEQ ID NO: 463022 - protein, 9 aa, Homo Sapiens
LCMRLLRPA

SEQ ID NO: 463023 - protein, 9 aa, Homo Sapiens
GHLSRPIFT

SEQ ID NO: 463024 - protein, 9 aa, Homo Sapiens
GNIPSALPS

SEQ ID NO: 463025 - protein, 9 aa, Homo Sapiens
EEVPGVFSR

SEQ ID NO: 463026 - protein, 9 aa, Homo Sapiens
IRLTLCKFN

SEQ ID NO: 463027 - protein, 9 aa, Homo Sapiens
ISLAWVISF

SEQ ID NO: 463028 - protein, 9 aa, Homo Sapiens
VLLFLNQRK

SEQ ID NO: 463029 - protein, 9 aa, Homo Sapiens
GSFPLQCWG

SEQ ID NO: 463030 - protein, 9 aa, Homo Sapiens
LCWDECPGS

SEQ ID NO: 463031 - protein, 9 aa, Homo Sapiens
RPGVPATWV

SEQ ID NO: 463032 - protein, 9 aa, Homo Sapiens
RKDQIQWLV

SEQ ID NO: 463033 - protein, 9 aa, Homo Sapiens
VKLGVHCVI

SEQ ID NO: 463034 - protein, 9 aa, Homo Sapiens
AILLNLQSK

SEQ ID NO: 463035 - protein, 9 aa, Homo Sapiens
DELCPEKPC

SEQ ID NO: 463036 - protein, 9 aa, Homo Sapiens
DAKDYNMCL

SEQ ID NO: 463037 - protein, 9 aa, Homo Sapiens
FCSGGRRGR

SEQ ID NO: 463038 - protein, 9 aa, Homo Sapiens
RVAQYPFEE

SEQ ID NO: 463039 - protein, 9 aa, Homo Sapiens
ALGEDVVLP

SEQ ID NO: 463040 - protein, 9 aa, Homo Sapiens
PGLRGAGNI

SEQ ID NO: 463041 - protein, 9 aa, Homo Sapiens
RPFKEMIRR

SEQ ID NO: 463042 - protein, 9 aa, Homo Sapiens
KLMSKILKS

SEQ ID NO: 463043 - protein, 9 aa, Homo Sapiens
RRRQWGSFP

SEQ ID NO: 463044 - protein, 9 aa, Homo Sapiens
WEGPVQELR

SEQ ID NO: 463045 - protein, 9 aa, Homo Sapiens
RNTVSHTAA

SEQ ID NO: 463046 - protein, 9 aa, Homo Sapiens
GYDVTDISN

SEQ ID NO: 463047 - protein, 9 aa, Homo Sapiens
QNLKHHLED

SEQ ID NO: 463048 - protein, 9 aa, Homo Sapiens
VPQNLKHHL

SEQ ID NO: 463049 - protein, 9 aa, Homo Sapiens
AQLLGCSHV

SEQ ID NO: 463050 - protein, 9 aa, Homo Sapiens
NEDAAHRIA

SEQ ID NO: 463051 - protein, 9 aa, Homo Sapiens
FFLPLAPAS

SEQ ID NO: 463052 - protein, 9 aa, Homo Sapiens
LQCWGRRRR

SEQ ID NO: 463053 - protein, 9 aa, Homo Sapiens
APEYSKAKL

SEQ ID NO: 463054 - protein, 9 aa, Homo Sapiens
QLLLVKEHS

SEQ ID NO: 463055 - protein, 9 aa, Homo Sapiens
PKHGCFICD

SEQ ID NO: 463056 - protein, 9 aa, Homo Sapiens
ASIPPPRLP

SEQ ID NO: 463057 - protein, 9 aa, Homo Sapiens
SSDSESAST

SEQ ID NO: 463058 - protein, 9 aa, Homo Sapiens
PFIAKRQTP

SEQ ID NO: 463059 - protein, 9 aa, Homo Sapiens
LRSRAITKP

SEQ ID NO: 463060 - protein, 9 aa, Homo Sapiens
WKSRPRPMA

SEQ ID NO: 463061 - protein, 9 aa, Homo Sapiens
REEVPGVFS

SEQ ID NO: 463062 - protein, 9 aa, Homo Sapiens
WHAAVHSRD

SEQ ID NO: 463063 - protein, 9 aa, Homo Sapiens
GQSQFTIYE

SEQ ID NO: 463064 - protein, 9 aa, Homo Sapiens
RAASGASIP

SEQ ID NO: 463065 - protein, 9 aa, Homo Sapiens
KILKSIANH

SEQ ID NO: 463066 - protein, 9 aa, Homo Sapiens
TCQALLPPR

SEQ ID NO: 463067 - protein, 9 aa, Homo Sapiens
HLSRPIFTQ

SEQ ID NO: 463068 - protein, 9 aa, Homo Sapiens
LPTPTACFE

SEQ ID NO: 463069 - protein, 9 aa, Homo Sapiens
TPGRLRVIA

SEQ ID NO: 463070 - protein, 9 aa, Homo Sapiens
PSRTPYGGT

SEQ ID NO: 463071 - protein, 9 aa, Homo Sapiens
LMAASRDQV

SEQ ID NO: 463072 - protein, 9 aa, Homo Sapiens
KGFYPSDIT

SEQ ID NO: 463073 - protein, 9 aa, Homo Sapiens
GKRFMRSDN

SEQ ID NO: 463074 - protein, 9 aa, Homo Sapiens
TREFRLLLL

SEQ ID NO: 463075 - protein, 9 aa, Homo Sapiens
AAIPSSLST

SEQ ID NO: 463076 - protein, 9 aa, Homo Sapiens
VKLICPVFP

SEQ ID NO: 463077 - protein, 9 aa, Homo Sapiens
DAAHRIASE

SEQ ID NO: 463078 - protein, 9 aa, Homo Sapiens
SGASIPPPR

SEQ ID NO: 463079 - protein, 9 aa, Homo Sapiens
LLQRLKTIR

SEQ ID NO: 463080 - protein, 9 aa, Homo Sapiens
QTQSLAICH

SEQ ID NO: 463081 - protein, 9 aa, Homo Sapiens
QLGSQSPRL

SEQ ID NO: 463082 - protein, 9 aa, Homo Sapiens
MDALCGFGE

SEQ ID NO: 463083 - protein, 9 aa, Homo Sapiens
NLAKHVKTH

SEQ ID NO: 463084 - protein, 9 aa, Homo Sapiens
PLLHVVSQS

SEQ ID NO: 463085 - protein, 9 aa, Homo Sapiens
GRGTRDQER

SEQ ID NO: 463086 - protein, 9 aa, Homo Sapiens
SFKMPKADL

SEQ ID NO: 463087 - protein, 9 aa, Homo Sapiens
IMKNRNGGG

SEQ ID NO: 463088 - protein, 9 aa, Homo Sapiens
IKIPAERLR

SEQ ID NO: 463089 - protein, 9 aa, Homo Sapiens
DLGQEADPG

SEQ ID NO: 463090 - protein, 9 aa, Homo Sapiens
IEATPGDRS

SEQ ID NO: 463091 - protein, 9 aa, Homo Sapiens
PFKEMIRRF

SEQ ID NO: 463092 - protein, 9 aa, Homo Sapiens
SHPLVLPNK

SEQ ID NO: 463093 - protein, 9 aa, Homo Sapiens
ACMKVRHPV

SEQ ID NO: 463094 - protein, 9 aa, Homo Sapiens
SWKSRPRPM

SEQ ID NO: 463095 - protein, 9 aa, Homo Sapiens
EKPCGEEPP

SEQ ID NO: 463096 - protein, 9 aa, Homo Sapiens
GSSLAIFSV

SEQ ID NO: 463097 - protein, 9 aa, Homo Sapiens
LCGPNELDN

SEQ ID NO: 463098 - protein, 9 aa, Homo Sapiens
FTIYEVVNP

SEQ ID NO: 463099 - protein, 9 aa, Homo Sapiens
ASDYLVQTT

SEQ ID NO: 463100 - protein, 9 aa, Homo Sapiens
PRPMALPSF

SEQ ID NO: 463101 - protein, 9 aa, Homo Sapiens
YFQQWERWG

SEQ ID NO: 463102 - protein, 9 aa, Homo Sapiens
QTWHFLVNT

SEQ ID NO: 463103 - protein, 9 aa, Homo Sapiens
SSDKYLRSN

SEQ ID NO: 463104 - protein, 9 aa, Homo Sapiens
SARPRPGVP

SEQ ID NO: 463105 - protein, 9 aa, Homo Sapiens
PGRLRVIAQ

SEQ ID NO: 463106 - protein, 9 aa, Homo Sapiens
TIRVKHPEL

SEQ ID NO: 463107 - protein, 9 aa, Homo Sapiens
RAPLFAARA

SEQ ID NO: 463108 - protein, 9 aa, Homo Sapiens
SKILKSIAN

SEQ ID NO: 463109 - protein, 9 aa, Homo Sapiens
TLCVADFGL

SEQ ID NO: 463110 - protein, 9 aa, Homo Sapiens
MKRSSTLEH

SEQ ID NO: 463111 - protein, 9 aa, Homo Sapiens
DRNTVSHTA

SEQ ID NO: 463112 - protein, 9 aa, Homo Sapiens
RYPSESTSL

SEQ ID NO: 463113 - protein, 9 aa, Homo Sapiens
MASHWAVQL

SEQ ID NO: 463114 - protein, 9 aa, Homo Sapiens
EARRQRCQR

SEQ ID NO: 463115 - protein, 9 aa, Homo Sapiens
EASEFDEWG

SEQ ID NO: 463116 - protein, 9 aa, Homo Sapiens
EGPVQELRK

SEQ ID NO: 463117 - protein, 9 aa, Homo Sapiens
CPGSCPTCP

SEQ ID NO: 463118 - protein, 9 aa, Homo Sapiens
QFLRLSLHF

SEQ ID NO: 463119 - protein, 9 aa, Homo Sapiens
LARFGTLLT

SEQ ID NO: 463120 - protein, 9 aa, Homo Sapiens
SDSESASTS

SEQ ID NO: 463121 - protein, 9 aa, Homo Sapiens
RRQDCARPS

SEQ ID NO: 463122 - protein, 9 aa, Homo Sapiens
STHKIWEHF

SEQ ID NO: 463123 - protein, 9 aa, Homo Sapiens
GRRKPRGTL

SEQ ID NO: 463124 - protein, 9 aa, Homo Sapiens
GSSSASPST

SEQ ID NO: 463125 - protein, 9 aa, Homo Sapiens
SVYRKDVIW

SEQ ID NO: 463126 - protein, 9 aa, Homo Sapiens
KPKARPING

SEQ ID NO: 463127 - protein, 9 aa, Homo Sapiens
ICPVFPGKN

SEQ ID NO: 463128 - protein, 9 aa, Homo Sapiens
AVLLFLNQR

SEQ ID NO: 463129 - protein, 9 aa, Homo Sapiens
CMRLLRPAL

SEQ ID NO: 463130 - protein, 9 aa, Homo Sapiens
WLKYGLPLP

SEQ ID NO: 463131 - protein, 9 aa, Homo Sapiens
MMPGTPRSS

SEQ ID NO: 463132 - protein, 9 aa, Homo Sapiens
KLICPVFPG

SEQ ID NO: 463133 - protein, 9 aa, Homo Sapiens
VCSRTPVET

SEQ ID NO: 463134 - protein, 9 aa, Homo Sapiens
ISRPSSGLM

SEQ ID NO: 463135 - protein, 9 aa, Homo Sapiens
GSQACPCGR

SEQ ID NO: 463136 - protein, 9 aa, Homo Sapiens
LPCALGAAI

SEQ ID NO: 463137 - protein, 9 aa, Homo Sapiens
PKARPINGG

SEQ ID NO: 463138 - protein, 9 aa, Homo Sapiens
FMRSDNLAK

SEQ ID NO: 463139 - protein, 9 aa, Homo Sapiens
IPSSLSTRA

SEQ ID NO: 463140 - protein, 9 aa, Homo Sapiens
SLTGSPYES

SEQ ID NO: 463141 - protein, 9 aa, Homo Sapiens
PCGEEPPVE

SEQ ID NO: 463142 - protein, 9 aa, Homo Sapiens
PQNLKHHLE

SEQ ID NO: 463143 - protein, 9 aa, Homo Sapiens
CTREFRLLL

SEQ ID NO: 463144 - protein, 9 aa, Homo Sapiens
RAITKPVIV

SEQ ID NO: 463145 - protein, 9 aa, Homo Sapiens
GCSHVCSRT

SEQ ID NO: 463146 - protein, 9 aa, Homo Sapiens
GLMAASRDQ

SEQ ID NO: 463147 - protein, 9 aa, Homo Sapiens
SQIPLFPAM

SEQ ID NO: 463148 - protein, 9 aa, Homo Sapiens
ARPINGGYG

SEQ ID NO: 463149 - protein, 9 aa, Homo Sapiens
PGMMPGTPR

SEQ ID NO: 463150 - protein, 9 aa, Homo Sapiens
ARGSSLAIF

SEQ ID NO: 463151 - protein, 9 aa, Homo Sapiens
RVKHPELCK

SEQ ID NO: 463152 - protein, 9 aa, Homo Sapiens
ADSSGHLQV

SEQ ID NO: 463153 - protein, 9 aa, Homo Sapiens
LKSIANHVL

SEQ ID NO: 463154 - protein, 9 aa, Homo Sapiens
IPLFPAMKK

SEQ ID NO: 463155 - protein, 9 aa, Homo Sapiens
ESTHKIWEH

SEQ ID NO: 463156 - protein, 9 aa, Homo Sapiens
MSTLTCHHR

SEQ ID NO: 463157 - protein, 9 aa, Homo Sapiens
VIQLPLCGP

SEQ ID NO: 463158 - protein, 9 aa, Homo Sapiens
TPTACFEQR

SEQ ID NO: 463159 - protein, 9 aa, Homo Sapiens
AGNIPSALP

SEQ ID NO: 463160 - protein, 9 aa, Homo Sapiens
DISNVHDDE

SEQ ID NO: 463161 - protein, 9 aa, Homo Sapiens
SFPLQCWGR

SEQ ID NO: 463162 - protein, 9 aa, Homo Sapiens
SPRLSNMVS

SEQ ID NO: 463163 - protein, 9 aa, Homo Sapiens
QWLVLSTVV

SEQ ID NO: 463164 - protein, 9 aa, Homo Sapiens
FRLLLLFLC

SEQ ID NO: 463165 - protein, 9 aa, Homo Sapiens
TMVPISLYF

SEQ ID NO: 463166 - protein, 9 aa, Homo Sapiens
VSCIEATPG

SEQ ID NO: 463167 - protein, 9 aa, Homo Sapiens
AWDSEGMKR

SEQ ID NO: 463168 - protein, 9 aa, Homo Sapiens
PSWFRSCSW

SEQ ID NO: 463169 - protein, 9 aa, Homo Sapiens
YPSDITVEW

SEQ ID NO: 463170 - protein, 9 aa, Homo Sapiens
ELAILLNLQ

SEQ ID NO: 463171 - protein, 9 aa, Homo Sapiens
VILVIQLPL

SEQ ID NO: 463172 - protein, 9 aa, Homo Sapiens
AICPYCSLR

SEQ ID NO: 463173 - protein, 9 aa, Homo Sapiens
SEGMKRSST

SEQ ID NO: 463174 - protein, 9 aa, Homo Sapiens
GYGSWKSRP

SEQ ID NO: 463175 - protein, 9 aa, Homo Sapiens
LQRLKTIRV

SEQ ID NO: 463176 - protein, 9 aa, Homo Sapiens
MPFQAETVA

SEQ ID NO: 463177 - protein, 9 aa, Homo Sapiens
RAAAAAIPS

SEQ ID NO: 463178 - protein, 9 aa, Homo Sapiens
AKPKARPIN

SEQ ID NO: 463179 - protein, 9 aa, Homo Sapiens
IHDRNTVSH

SEQ ID NO: 463180 - protein, 9 aa, Homo Sapiens
YECSDCRKA

SEQ ID NO: 463181 - protein, 9 aa, Homo Sapiens
LEARRQRCQ

SEQ ID NO: 463182 - protein, 9 aa, Homo Sapiens
HRIASEDAA

SEQ ID NO: 463183 - protein, 9 aa, Homo Sapiens
LTLCKFNRE

SEQ ID NO: 463184 - protein, 9 aa, Homo Sapiens
QCVGRRRQW

SEQ ID NO: 463185 - protein, 9 aa, Homo Sapiens
LSHRYTQLL

SEQ ID NO: 463186 - protein, 9 aa, Homo Sapiens
ATPGDRSWH

SEQ ID NO: 463187 - protein, 9 aa, Homo Sapiens
TLCKFNREN

SEQ ID NO: 463188 - protein, 9 aa, Homo Sapiens
FPAMKKGLV

SEQ ID NO: 463189 - protein, 9 aa, Homo Sapiens
RTPYGGTRS

SEQ ID NO: 463190 - protein, 9 aa, Homo Sapiens
LRLSLHFHL

SEQ ID NO: 463191 - protein, 9 aa, Homo Sapiens
SESTSLPYC

SEQ ID NO: 463192 - protein, 9 aa, Homo Sapiens
SSNLTATTM

SEQ ID NO: 463193 - protein, 9 aa, Homo Sapiens
SPSRTPYGG

SEQ ID NO: 463194 - protein, 9 aa, Homo Sapiens
WFRSCSWDS

SEQ ID NO: 463195 - protein, 9 aa, Homo Sapiens
NIPSALPSS

SEQ ID NO: 463196 - protein, 9 aa, Homo Sapiens
LIHDRNTVS

SEQ ID NO: 463197 - protein, 9 aa, Homo Sapiens
VGRRRQWGS

SEQ ID NO: 463198 - protein, 9 aa, Homo Sapiens
SLSTRAASG

SEQ ID NO: 463199 - protein, 9 aa, Homo Sapiens
YGSWKSRPR

SEQ ID NO: 463200 - protein, 9 aa, Homo Sapiens
SSEAWDSEG

SEQ ID NO: 463201 - protein, 9 aa, Homo Sapiens
MPSFKMPKA

SEQ ID NO: 463202 - protein, 9 aa, Homo Sapiens
PEKPCGEEP

SEQ ID NO: 463203 - protein, 9 aa, Homo Sapiens
EKQKDAVVL

SEQ ID NO: 463204 - protein, 9 aa, Homo Sapiens
LGAAIPRWM

SEQ ID NO: 463205 - protein, 9 aa, Homo Sapiens
INVCLNLQR

SEQ ID NO: 463206 - protein, 9 aa, Homo Sapiens
YPTVRQKLW

SEQ ID NO: 463207 - protein, 9 aa, Homo Sapiens
GRRRRQWGS

SEQ ID NO: 463208 - protein, 9 aa, Homo Sapiens
AATRYIVPT

SEQ ID NO: 463209 - protein, 9 aa, Homo Sapiens
CTASSNLTA

SEQ ID NO: 463210 - protein, 9 aa, Homo Sapiens
SRPSSGLMA

SEQ ID NO: 463211 - protein, 9 aa, Homo Sapiens
VICQKVAIK

SEQ ID NO: 463212 - protein, 9 aa, Homo Sapiens
RRQWGSFPL

SEQ ID NO: 463213 - protein, 9 aa, Homo Sapiens
GCFICDELD

SEQ ID NO: 463214 - protein, 9 aa, Homo Sapiens
ASTSSSGSE

SEQ ID NO: 463215 - protein, 9 aa, Homo Sapiens
TQSLAICHN

SEQ ID NO: 463216 - protein, 9 aa, Homo Sapiens
SGHLQVGQG

SEQ ID NO: 463217 - protein, 9 aa, Homo Sapiens
DSALRLWEG

SEQ ID NO: 463218 - protein, 9 aa, Homo Sapiens
ALRKALAAG

SEQ ID NO: 463219 - protein, 9 aa, Homo Sapiens
SGHSGLDRV

SEQ ID NO: 463220 - protein, 9 aa, Homo Sapiens
LARGQSQFT

SEQ ID NO: 463221 - protein, 9 aa, Homo Sapiens
CRKAFIHSS

SEQ ID NO: 463222 - protein, 9 aa, Homo Sapiens
CCTASSNLT

SEQ ID NO: 463223 - protein, 9 aa, Homo Sapiens
HQTWHFLVN

SEQ ID NO: 463224 - protein, 9 aa, Homo Sapiens
QYPFEEHNP

SEQ ID NO: 463225 - protein, 9 aa, Homo Sapiens
VLVKLICPV

SEQ ID NO: 463226 - protein, 9 aa, Homo Sapiens
SSASPSTER

SEQ ID NO: 463227 - protein, 9 aa, Homo Sapiens
RRQWGSFPQ

SEQ ID NO: 463228 - protein, 9 aa, Homo Sapiens
QSLAICHNK

SEQ ID NO: 463229 - protein, 9 aa, Homo Sapiens
WDSEGMKRS

SEQ ID NO: 463230 - protein, 9 aa, Homo Sapiens
NLTATTMRA

SEQ ID NO: 463231 - protein, 9 aa, Homo Sapiens
LPEENQDFP

SEQ ID NO: 463232 - protein, 9 aa, Homo Sapiens
VAQYPFEEH

SEQ ID NO: 463233 - protein, 9 aa, Homo Sapiens
IGYDVTDIS

SEQ ID NO: 463234 - protein, 9 aa, Homo Sapiens
TISPYTSPC

SEQ ID NO: 463235 - protein, 9 aa, Homo Sapiens
SEFDEWGPE

SEQ ID NO: 463236 - protein, 9 aa, Homo Sapiens
MGNMDHHHY

SEQ ID NO: 463237 - protein, 9 aa, Homo Sapiens
KDVIWHAAV

SEQ ID NO: 463238 - protein, 9 aa, Homo Sapiens
LCGFGELGS

SEQ ID NO: 463239 - protein, 9 aa, Homo Sapiens
LQVGQGQSE

SEQ ID NO: 463240 - protein, 9 aa, Homo Sapiens
RTPALSPEP

SEQ ID NO: 463241 - protein, 9 aa, Homo Sapiens
TSSDKYLRS

SEQ ID NO: 463242 - protein, 9 aa, Homo Sapiens
RTLRSMALG

SEQ ID NO: 463243 - protein, 9 aa, Homo Sapiens
PSALPSSSG

SEQ ID NO: 463244 - protein, 9 aa, Homo Sapiens
LRKALAAGG

SEQ ID NO: 463245 - protein, 9 aa, Homo Sapiens
AGRRRQDCA

SEQ ID NO: 463246 - protein, 9 aa, Homo Sapiens
LPGLRGAGN

SEQ ID NO: 463247 - protein, 9 aa, Homo Sapiens
TVEWESSGQ

SEQ ID NO: 463248 - protein, 9 aa, Homo Sapiens
CYFFLPLAP

SEQ ID NO: 463249 - protein, 9 aa, Homo Sapiens
GVHCVICQK

SEQ ID NO: 463250 - protein, 9 aa, Homo Sapiens
ITLLSSKHK

SEQ ID NO: 463251 - protein, 9 aa, Homo Sapiens
SDTISPYTS

SEQ ID NO: 463252 - protein, 9 aa, Homo Sapiens
FPQHCAGRR

SEQ ID NO: 463253 - protein, 9 aa, Homo Sapiens
TVHIMKNRN

SEQ ID NO: 463254 - protein, 9 aa, Homo Sapiens
MPGTPRSSG

SEQ ID NO: 463255 - protein, 9 aa, Homo Sapiens
ATELAHPLR

SEQ ID NO: 463256 - protein, 9 aa, Homo Sapiens
HRPPAPGSS

SEQ ID NO: 463257 - protein, 9 aa, Homo Sapiens
AKLGAAHLF

SEQ ID NO: 463258 - protein, 9 aa, Homo Sapiens
RLRVIAQST

SEQ ID NO: 463259 - protein, 9 aa, Homo Sapiens
AGPWSSEAW

SEQ ID NO: 463260 - protein, 9 aa, Homo Sapiens
AGDGHLSRP

SEQ ID NO: 463261 - protein, 9 aa, Homo Sapiens
PRGTLPGLR

SEQ ID NO: 463262 - protein, 9 aa, Homo Sapiens
DVIWHAAVH

SEQ ID NO: 463263 - protein, 9 aa, Homo Sapiens
NYTTFMLAR

SEQ ID NO: 463264 - protein, 9 aa, Homo Sapiens
ASGASIPPP

SEQ ID NO: 463265 - protein, 9 aa, Homo Sapiens
LAHPLRCSA

SEQ ID NO: 463266 - protein, 9 aa, Homo Sapiens
CGFGELGSK

SEQ ID NO: 463267 - protein, 9 aa, Homo Sapiens
MPPSPSRTP

SEQ ID NO: 463268 - protein, 9 aa, Homo Sapiens
PSPGMMPGT

SEQ ID NO: 463269 - protein, 9 aa, Homo Sapiens
WGRRRRQWG

SEQ ID NO: 463270 - protein, 9 aa, Homo Sapiens
SSGHLQVGQ

SEQ ID NO: 463271 - protein, 9 aa, Homo Sapiens
WLVLSTVVI

SEQ ID NO: 463272 - protein, 9 aa, Homo Sapiens
MDHHHYETF

SEQ ID NO: 463273 - protein, 9 aa, Homo Sapiens
PLNYTTFML

SEQ ID NO: 463274 - protein, 9 aa, Homo Sapiens
WEHFRPYKK

SEQ ID NO: 463275 - protein, 9 aa, Homo Sapiens
AKDYNMCLV

SEQ ID NO: 463276 - protein, 9 aa, Homo Sapiens
VMISLAWVI

SEQ ID NO: 463277 - protein, 9 aa, Homo Sapiens
WGSFPLQCW

SEQ ID NO: 463278 - protein, 9 aa, Homo Sapiens
LLGCSHVCS

SEQ ID NO: 463279 - protein, 9 aa, Homo Sapiens
NSSAGDGHL

SEQ ID NO: 463280 - protein, 9 aa, Homo Sapiens
MATELAHPL

SEQ ID NO: 463281 - protein, 9 aa, Homo Sapiens
SEVWHPIYK

SEQ ID NO: 463282 - protein, 9 aa, Homo Sapiens
FFTLTDLCM

SEQ ID NO: 463283 - protein, 9 aa, Homo Sapiens
RGSSLAIFS

SEQ ID NO: 463284 - protein, 9 aa, Homo Sapiens
EEYESTEEY

SEQ ID NO: 463285 - protein, 9 aa, Homo Sapiens
RQDCARPSP

SEQ ID NO: 463286 - protein, 9 aa, Homo Sapiens
SSGLMAASR

SEQ ID NO: 463287 - protein, 9 aa, Homo Sapiens
KVRHPVQNF

SEQ ID NO: 463288 - protein, 9 aa, Homo Sapiens
EFFTLTDLC

SEQ ID NO: 463289 - protein, 9 aa, Homo Sapiens
QRCQRRWED

SEQ ID NO: 463290 - protein, 9 aa, Homo Sapiens
ADLKGPQVD

SEQ ID NO: 463291 - protein, 9 aa, Homo Sapiens
LNYTTFMLA

SEQ ID NO: 463292 - protein, 9 aa, Homo Sapiens
EFDEWGPEG

SEQ ID NO: 463293 - protein, 9 aa, Homo Sapiens
ASSNLTATT

SEQ ID NO: 463294 - protein, 9 aa, Homo Sapiens
QGPYPTVRQ

SEQ ID NO: 463295 - protein, 9 aa, Homo Sapiens
KLDPQKAFL

SEQ ID NO: 463296 - protein, 9 aa, Homo Sapiens
YESTEEYDQ

SEQ ID NO: 463297 - protein, 9 aa, Homo Sapiens
PPPRLPCAL

SEQ ID NO: 463298 - protein, 9 aa, Homo Sapiens
EDMTLCVAD

SEQ ID NO: 463299 - protein, 9 aa, Homo Sapiens
ATRYIVPTI

SEQ ID NO: 463300 - protein, 9 aa, Homo Sapiens
LSSKHKYKS

SEQ ID NO: 463301 - protein, 9 aa, Homo Sapiens
RLTLCKFNR

SEQ ID NO: 463302 - protein, 9 aa, Homo Sapiens
CVICQKVAI

SEQ ID NO: 463303 - protein, 9 aa, Homo Sapiens
MSKILKSIA

SEQ ID NO: 463304 - protein, 9 aa, Homo Sapiens
WDSALRLWE

SEQ ID NO: 463305 - protein, 9 aa, Homo Sapiens
MRSDNLAKH

SEQ ID NO: 463306 - protein, 9 aa, Homo Sapiens
IPAERLRGP

SEQ ID NO: 463307 - protein, 9 aa, Homo Sapiens
EMIRRFWYN

SEQ ID NO: 463308 - protein, 9 aa, Homo Sapiens
GPVQELRKL

SEQ ID NO: 463309 - protein, 9 aa, Homo Sapiens
NFKSAGQFL

SEQ ID NO: 463310 - protein, 9 aa, Homo Sapiens
DFVLVKLIC

SEQ ID NO: 463311 - protein, 9 aa, Homo Sapiens
KPYECSDCR

SEQ ID NO: 463312 - protein, 9 aa, Homo Sapiens
GAELSYRIG

SEQ ID NO: 463313 - protein, 9 aa, Homo Sapiens
SPEPAKPKA

SEQ ID NO: 463314 - protein, 9 aa, Homo Sapiens
CVGRRRQWG

SEQ ID NO: 463315 - protein, 9 aa, Homo Sapiens
RVIAQSTNS

SEQ ID NO: 463316 - protein, 9 aa, Homo Sapiens
GLPTPTACF

SEQ ID NO: 463317 - protein, 9 aa, Homo Sapiens
KRAGVMISL

SEQ ID NO: 463318 - protein, 9 aa, Homo Sapiens
CMLAEDMTL

SEQ ID NO: 463319 - protein, 9 aa, Homo Sapiens
NQDFPPGRN

SEQ ID NO: 463320 - protein, 9 aa, Homo Sapiens
EYSKAKLGA

SEQ ID NO: 463321 - protein, 9 aa, Homo Sapiens
LECLVTASI

SEQ ID NO: 463322 - protein, 9 aa, Homo Sapiens
QQLGSQSPR

SEQ ID NO: 463323 - protein, 9 aa, Homo Sapiens
RDTEATRGR

SEQ ID NO: 463324 - protein, 9 aa, Homo Sapiens
SSAGDGHLS

SEQ ID NO: 463325 - protein, 9 aa, Homo Sapiens
DSESASTSS

SEQ ID NO: 463326 - protein, 9 aa, Homo Sapiens
VPGVFSRSV

SEQ ID NO: 463327 - protein, 9 aa, Homo Sapiens
QERDTEATR

SEQ ID NO: 463328 - protein, 9 aa, Homo Sapiens
QPHARGSSL

SEQ ID NO: 463329 - protein, 9 aa, Homo Sapiens
RDQERTPAL

SEQ ID NO: 463330 - protein, 9 aa, Homo Sapiens
VQELRKLRE

SEQ ID NO: 463331 - protein, 9 aa, Homo Sapiens
APGSSCYFF

SEQ ID NO: 463332 - protein, 9 aa, Homo Sapiens
NMCLVHNGR

SEQ ID NO: 463333 - protein, 9 aa, Homo Sapiens
ELCPEKPCG

SEQ ID NO: 463334 - protein, 9 aa, Homo Sapiens
EVWHPIYKQ

SEQ ID NO: 463335 - protein, 9 aa, Homo Sapiens
DYPEGNNAS

SEQ ID NO: 463336 - protein, 9 aa, Homo Sapiens
ERSVSCIEA

SEQ ID NO: 463337 - protein, 9 aa, Homo Sapiens
TWHFLVNTL

SEQ ID NO: 463338 - protein, 9 aa, Homo Sapiens
ARRQRCQRR

SEQ ID NO: 463339 - protein, 9 aa, Homo Sapiens
EAIDLGQEA

SEQ ID NO: 463340 - protein, 9 aa, Homo Sapiens
SKAKLGAAH

SEQ ID NO: 463341 - protein, 9 aa, Homo Sapiens
RENLAGPWS

SEQ ID NO: 463342 - protein, 9 aa, Homo Sapiens
LVIQLPLCG

SEQ ID NO: 463343 - protein, 9 aa, Homo Sapiens
HLEDMEQAL

SEQ ID NO: 463344 - protein, 9 aa, Homo Sapiens
PGSSCYFFL

SEQ ID NO: 463345 - protein, 9 aa, Homo Sapiens
KRFMRSDNL

SEQ ID NO: 463346 - protein, 9 aa, Homo Sapiens
DSEGMKRSS

SEQ ID NO: 463347 - protein, 9 aa, Homo Sapiens
CLECLVTAS

SEQ ID NO: 463348 - protein, 9 aa, Homo Sapiens
TASSNLTAT

SEQ ID NO: 463349 - protein, 9 aa, Homo Sapiens
LAPFIAKRQ

SEQ ID NO: 463350 - protein, 9 aa, Homo Sapiens
QDFPPGRNC

SEQ ID NO: 463351 - protein, 9 aa, Homo Sapiens
HVVSQSNLR

SEQ ID NO: 463352 - protein, 9 aa, Homo Sapiens
ECPGSCPTC

SEQ ID NO: 463353 - protein, 9 aa, Homo Sapiens
KQKDAVVLL

SEQ ID NO: 463354 - protein, 9 aa, Homo Sapiens
RGTRDQERT

SEQ ID NO: 463355 - protein, 9 aa, Homo Sapiens
FQQIRLTLC

SEQ ID NO: 463356 - protein, 9 aa, Homo Sapiens
HAVCTPVDS

SEQ ID NO: 463357 - protein, 9 aa, Homo Sapiens
EEHNPPQLE

SEQ ID NO: 463358 - protein, 9 aa, Homo Sapiens
QFTIYEVVN

SEQ ID NO: 463359 - protein, 9 aa, Homo Sapiens
QIQWLVLST

SEQ ID NO: 463360 - protein, 9 aa, Homo Sapiens
SVSCIEATP

SEQ ID NO: 463361 - protein, 9 aa, Homo Sapiens
STSSSGSER

SEQ ID NO: 463362 - protein, 9 aa, Homo Sapiens
EQDFSQGPY

SEQ ID NO: 463363 - protein, 9 aa, Homo Sapiens
ELRKLRENL

SEQ ID NO: 463364 - protein, 9 aa, Homo Sapiens
HLQVGQGQS

SEQ ID NO: 463365 - protein, 9 aa, Homo Sapiens
SQTQSLAIC

SEQ ID NO: 463366 - protein, 9 aa, Homo Sapiens
PLRCSAEEA

SEQ ID NO: 463367 - protein, 9 aa, Homo Sapiens
YESQLRAPL

SEQ ID NO: 463368 - protein, 9 aa, Homo Sapiens
LRSMALGED

SEQ ID NO: 463369 - protein, 9 aa, Homo Sapiens
LTATTMRAA

SEQ ID NO: 463370 - protein, 9 aa, Homo Sapiens
DKYLRSNSE

SEQ ID NO: 463371 - protein, 9 aa, Homo Sapiens
DVTDISNVH

SEQ ID NO: 463372 - protein, 9 aa, Homo Sapiens
GTRDQERTP

SEQ ID NO: 463373 - protein, 9 aa, Homo Sapiens
RQTPKIQEQ

SEQ ID NO: 463374 - protein, 9 aa, Homo Sapiens
SASTSSSGS

SEQ ID NO: 463375 - protein, 9 aa, Homo Sapiens
GPWSSEAWD

SEQ ID NO: 463376 - protein, 9 aa, Homo Sapiens
PQHCAGRRR

SEQ ID NO: 463377 - protein, 9 aa, Homo Sapiens
MKVRHPVQN

SEQ ID NO: 463378 - protein, 9 aa, Homo Sapiens
CLVHNGRML

SEQ ID NO: 463379 - protein, 9 aa, Homo Sapiens
LKLMSKILK

SEQ ID NO: 463380 - protein, 9 aa, Homo Sapiens
SKHKYKSGI

SEQ ID NO: 463381 - protein, 9 aa, Homo Sapiens
ALGAAIPRW

SEQ ID NO: 463382 - protein, 9 aa, Homo Sapiens
EGMKRSSTL

SEQ ID NO: 463383 - protein, 9 aa, Homo Sapiens
RGTLPGLRG

SEQ ID NO: 463384 - protein, 9 aa, Homo Sapiens
ENQDFPPGR

SEQ ID NO: 463385 - protein, 9 aa, Homo Sapiens
AVCTPVDSL

SEQ ID NO: 463386 - protein, 9 aa, Homo Sapiens
CRNAAICPY

SEQ ID NO: 463387 - protein, 9 aa, Homo Sapiens
CGRGTRDQE

SEQ ID NO: 463388 - protein, 9 aa, Homo Sapiens
TRYIVPTIL

SEQ ID NO: 463389 - protein, 9 aa, Homo Sapiens
QWGSFPQHC

SEQ ID NO: 463390 - protein, 9 aa, Homo Sapiens
TSQTQSLAI

SEQ ID NO: 463391 - protein, 9 aa, Homo Sapiens
KPRGTLPGL

SEQ ID NO: 463392 - protein, 9 aa, Homo Sapiens
ASARPRPGV

SEQ ID NO: 463393 - protein, 9 aa, Homo Sapiens
SFISDTISP

SEQ ID NO: 463394 - protein, 9 aa, Homo Sapiens
LRLWEGPVQ

SEQ ID NO: 463395 - protein, 9 aa, Homo Sapiens
VDAKDYNMC

SEQ ID NO: 463396 - protein, 9 aa, Homo Sapiens
TIYEVVNPK

SEQ ID NO: 463397 - protein, 9 aa, Homo Sapiens
LAALRKALA

SEQ ID NO: 463398 - protein, 9 aa, Homo Sapiens
QELRKLREN

SEQ ID NO: 463399 - protein, 9 aa, Homo Sapiens
SIPPPRLPC

SEQ ID NO: 463400 - protein, 9 aa, Homo Sapiens
PGSCPTCPE

SEQ ID NO: 463401 - protein, 9 aa, Homo Sapiens
KLGVHCVIC

SEQ ID NO: 463402 - protein, 9 aa, Homo Sapiens
RPSPSWFRS

SEQ ID NO: 463403 - protein, 9 aa, Homo Sapiens
SCYFFLPLA

SEQ ID NO: 463404 - protein, 9 aa, Homo Sapiens
HPLVLPNKL

SEQ ID NO: 463405 - protein, 9 aa, Homo Sapiens
LVPQNLKHH

SEQ ID NO: 463406 - protein, 9 aa, Homo Sapiens
PFEEHNPPQ

SEQ ID NO: 463407 - protein, 9 aa, Homo Sapiens
CNSSCMGSM

SEQ ID NO: 463408 - protein, 9 aa, Homo Sapiens
ETSSDKYLR

SEQ ID NO: 463409 - protein, 9 aa, Homo Sapiens
HRYTQLLLV

SEQ ID NO: 463410 - protein, 9 aa, Homo Sapiens
SWDSALRLW

SEQ ID NO: 463411 - protein, 9 aa, Homo Sapiens
QWERWGEDN

SEQ ID NO: 463412 - protein, 9 aa, Homo Sapiens
TQLLLVKEH

SEQ ID NO: 463413 - protein, 9 aa, Homo Sapiens
GWIHAVCTP

SEQ ID NO: 463414 - protein, 9 aa, Homo Sapiens
VPISLYFSV

SEQ ID NO: 463415 - protein, 9 aa, Homo Sapiens
SGITLLSSK

SEQ ID NO: 463416 - protein, 9 aa, Homo Sapiens
SMALGEDVV

SEQ ID NO: 463417 - protein, 9 aa, Homo Sapiens
GSEVWHPIY

SEQ ID NO: 463418 - protein, 9 aa, Homo Sapiens
IAQSTNSEE

SEQ ID NO: 463419 - protein, 9 aa, Homo Sapiens
ETCQALLPP

SEQ ID NO: 463420 - protein, 9 aa, Homo Sapiens
RIASEDAAQ

SEQ ID NO: 463421 - protein, 9 aa, Homo Sapiens
ADPGAGAEL

SEQ ID NO: 463422 - protein, 9 aa, Homo Sapiens
RVAGSQACP

SEQ ID NO: 463423 - protein, 9 aa, Homo Sapiens
ELSYRIGRG

SEQ ID NO: 463424 - protein, 9 aa, Homo Sapiens
KLRENLAGP

SEQ ID NO: 463425 - protein, 9 aa, Homo Sapiens
VCLNLQRAS

SEQ ID NO: 463426 - protein, 9 aa, Homo Sapiens
EAHQWIHRF

SEQ ID NO: 463427 - protein, 9 aa, Homo Sapiens
FEEYESTEE

SEQ ID NO: 463428 - protein, 9 aa, Homo Sapiens
AARAVLLFL

SEQ ID NO: 463429 - protein, 9 aa, Homo Sapiens
PRLPCALGA

SEQ ID NO: 463430 - protein, 9 aa, Homo Sapiens
SALRLWEGP

SEQ ID NO: 463431 - protein, 9 aa, Homo Sapiens
RGLPTPTAC

SEQ ID NO: 463432 - protein, 9 aa, Homo Sapiens
QALLPPRAA

SEQ ID NO: 463433 - protein, 9 aa, Homo Sapiens
KSAGQFLRL

SEQ ID NO: 463434 - protein, 9 aa, Homo Sapiens
PSGWIHAVC

SEQ ID NO: 463435 - protein, 9 aa, Homo Sapiens
TELAHPLRC

SEQ ID NO: 463436 - protein, 9 aa, Homo Sapiens
AITKPVIVD

SEQ ID NO: 463437 - protein, 9 aa, Homo Sapiens
APASSHPLV

SEQ ID NO: 463438 - protein, 9 aa, Homo Sapiens
GRLRVIAQS

SEQ ID NO: 463439 - protein, 9 aa, Homo Sapiens
EAWDSEGMK

SEQ ID NO: 463440 - protein, 9 aa, Homo Sapiens
LFAARAVLL

SEQ ID NO: 463441 - protein, 9 aa, Homo Sapiens
SSTLEHRPP

SEQ ID NO: 463442 - protein, 9 aa, Homo Sapiens
CALGAAIPR

SEQ ID NO: 463443 - protein, 9 aa, Homo Sapiens
ARAVLLFLN

SEQ ID NO: 463444 - protein, 9 aa, Homo Sapiens
MVPISLYFS

SEQ ID NO: 463445 - protein, 9 aa, Homo Sapiens
MVTGTMPFQ

SEQ ID NO: 463446 - protein, 9 aa, Homo Sapiens
SPSTERNRK

SEQ ID NO: 463447 - protein, 9 aa, Homo Sapiens
PRLSNMVSS

SEQ ID NO: 463448 - protein, 9 aa, Homo Sapiens
TPALSPEPA

SEQ ID NO: 463449 - protein, 9 aa, Homo Sapiens
QDFSQGPYP

SEQ ID NO: 463450 - protein, 9 aa, Homo Sapiens
ERTPALSPE

SEQ ID NO: 463451 - protein, 9 aa, Homo Sapiens
RPRPGVPAT

SEQ ID NO: 463452 - protein, 9 aa, Homo Sapiens
ELAHPLRCS

SEQ ID NO: 463453 - protein, 9 aa, Homo Sapiens
LPPRAARTA

SEQ ID NO: 463454 - protein, 9 aa, Homo Sapiens
VSHTAAAAR

SEQ ID NO: 463455 - protein, 9 aa, Homo Sapiens
WIHRFCSGG

SEQ ID NO: 463456 - protein, 9 aa, Homo Sapiens
GITQQNQEH

SEQ ID NO: 463457 - protein, 9 aa, Homo Sapiens
QSPRLSNMV

SEQ ID NO: 463458 - protein, 9 aa, Homo Sapiens
LEHRPPAPG

SEQ ID NO: 463459 - protein, 9 aa, Homo Sapiens
ISPYTSPCV

SEQ ID NO: 463460 - protein, 9 aa, Homo Sapiens
LAILLNLQS

SEQ ID NO: 463461 - protein, 9 aa, Homo Sapiens
CQALLPPRA

SEQ ID NO: 463462 - protein, 9 aa, Homo Sapiens
RKDVIWHAA

SEQ ID NO: 463463 - protein, 9 aa, Homo Sapiens
RPSSGLMAA

SEQ ID NO: 463464 - protein, 9 aa, Homo Sapiens
TLASARPRP

SEQ ID NO: 463465 - protein, 9 aa, Homo Sapiens
VEEEHQTWH

SEQ ID NO: 463466 - protein, 9 aa, Homo Sapiens
RSMALGEDV

SEQ ID NO: 463467 - protein, 9 aa, Homo Sapiens
DFPPGRNCS

SEQ ID NO: 463468 - protein, 9 aa, Homo Sapiens
PLFAARAVL

SEQ ID NO: 463469 - protein, 9 aa, Homo Sapiens
PEVTWLKYG

SEQ ID NO: 463470 - protein, 9 aa, Homo Sapiens
RIKSQERDT

SEQ ID NO: 463471 - protein, 9 aa, Homo Sapiens
DAATRYIVP

SEQ ID NO: 463472 - protein, 9 aa, Homo Sapiens
STERNRKAL

SEQ ID NO: 463473 - protein, 9 aa, Homo Sapiens
SNLTATTMR

SEQ ID NO: 463474 - protein, 9 aa, Homo Sapiens
HHHYETFEK

SEQ ID NO: 463475 - protein, 9 aa, Homo Sapiens
DFLMGNMDH

SEQ ID NO: 463476 - protein, 9 aa, Homo Sapiens
TMRAAAAAI

SEQ ID NO: 463477 - protein, 9 aa, Homo Sapiens
DTISPYTSP

SEQ ID NO: 463478 - protein, 9 aa, Homo Sapiens
SMPPSPSRT

SEQ ID NO: 463479 - protein, 9 aa, Homo Sapiens
EDAAHRIAS

SEQ ID NO: 463480 - protein, 9 aa, Homo Sapiens
FLMGNMDHH

SEQ ID NO: 463481 - protein, 9 aa, Homo Sapiens
TSSSGSERD

SEQ ID NO: 463482 - protein, 9 aa, Homo Sapiens
SALPSSSGH

SEQ ID NO: 463483 - protein, 9 aa, Homo Sapiens
LLPPRAART

SEQ ID NO: 463484 - protein, 9 aa, Homo Sapiens
SRADSSGHL

SEQ ID NO: 463485 - protein, 9 aa, Homo Sapiens
LVTGITQQN

SEQ ID NO: 463486 - protein, 9 aa, Homo Sapiens
ATTMRAAAA

SEQ ID NO: 463487 - protein, 9 aa, Homo Sapiens
GSWKSRPRP

SEQ ID NO: 463488 - protein, 9 aa, Homo Sapiens
GRTLRSMAL

SEQ ID NO: 463489 - protein, 9 aa, Homo Sapiens
AAHRIASED

SEQ ID NO: 463490 - protein, 9 aa, Homo Sapiens
GVMISLAWV

SEQ ID NO: 463491 - protein, 9 aa, Homo Sapiens
LDRVAGSQA

SEQ ID NO: 463492 - protein, 9 aa, Homo Sapiens
PYESQLRAP

SEQ ID NO: 463493 - protein, 9 aa, Homo Sapiens
QPLLHVVSQ

SEQ ID NO: 463494 - protein, 9 aa, Homo Sapiens
IWEHFRPYK

SEQ ID NO: 463495 - protein, 9 aa, Homo Sapiens
CWDECPGSC

SEQ ID NO: 463496 - protein, 9 aa, Homo Sapiens
TGITQQNQE

SEQ ID NO: 463497 - protein, 9 aa, Homo Sapiens
PPRAARTAL

SEQ ID NO: 463498 - protein, 9 aa, Homo Sapiens
CIEATPGDR

SEQ ID NO: 463499 - protein, 9 aa, Homo Sapiens
GSDQPLLHV

SEQ ID NO: 463500 - protein, 9 aa, Homo Sapiens
DLEARRQRC

SEQ ID NO: 463501 - protein, 9 aa, Homo Sapiens
LREEVPGVF

SEQ ID NO: 463502 - protein, 9 aa, Homo Sapiens
GAGAELSYR

SEQ ID NO: 463503 - protein, 9 aa, Homo Sapiens
PRPGVPATW

SEQ ID NO: 463504 - protein, 9 aa, Homo Sapiens
TTMRAAAAA

SEQ ID NO: 463505 - protein, 9 aa, Homo Sapiens
LGCSHVCSR

SEQ ID NO: 463506 - protein, 9 aa, Homo Sapiens
TLLSSKHKY

SEQ ID NO: 463507 - protein, 9 aa, Homo Sapiens
GSFPQHCAG

SEQ ID NO: 463508 - protein, 9 aa, Homo Sapiens
RAVLLFLNQ

SEQ ID NO: 463509 - protein, 9 aa, Homo Sapiens
LRKLRENLA

SEQ ID NO: 463510 - protein, 9 aa, Homo Sapiens
RSVSCIEAT

SEQ ID NO: 463511 - protein, 9 aa, Homo Sapiens
YRIGRGSSS

SEQ ID NO: 463512 - protein, 9 aa, Homo Sapiens
LRENLAGPW

SEQ ID NO: 463513 - protein, 9 aa, Homo Sapiens
MRAAAAAIP

SEQ ID NO: 463514 - protein, 9 aa, Homo Sapiens
LPSSSGHSG

SEQ ID NO: 463515 - protein, 9 aa, Homo Sapiens
QCWGRRRRQ

SEQ ID NO: 463516 - protein, 9 aa, Homo Sapiens
LICPVFPGK

SEQ ID NO: 463517 - protein, 9 aa, Homo Sapiens
RDFVLVKLI

SEQ ID NO: 463518 - protein, 9 aa, Homo Sapiens
RSCSWDSAL

SEQ ID NO: 463519 - protein, 9 aa, Homo Sapiens
FKMPKADLK

SEQ ID NO: 463520 - protein, 9 aa, Homo Sapiens
PEENQDFPP

SEQ ID NO: 463521 - protein, 9 aa, Homo Sapiens
SCSWDSALR

SEQ ID NO: 463522 - protein, 9 aa, Homo Sapiens
QIPLFPAMK

SEQ ID NO: 463523 - protein, 9 aa, Homo Sapiens
VYRKDVIWH

SEQ ID NO: 463524 - protein, 9 aa, Homo Sapiens
KYLRSNSER

SEQ ID NO: 463525 - protein, 9 aa, Homo Sapiens
RQWGSFPQH

SEQ ID NO: 463526 - protein, 9 aa, Homo Sapiens
ARRCTREFR

SEQ ID NO: 463527 - protein, 9 aa, Homo Sapiens
RSRAITKPV

SEQ ID NO: 463528 - protein, 9 aa, Homo Sapiens
ANEDAAHRI

SEQ ID NO: 463529 - protein, 9 aa, Homo Sapiens
SRKDQIQWL

SEQ ID NO: 463530 - protein, 9 aa, Homo Sapiens
YKEFEEYES

SEQ ID NO: 463531 - protein, 9 aa, Homo Sapiens
EEEHQTWHF

SEQ ID NO: 463532 - protein, 9 aa, Homo Sapiens
ALSPEPAKP

SEQ ID NO: 463533 - protein, 9 aa, Homo Sapiens
LHVVSQSNL

SEQ ID NO: 463534 - protein, 9 aa, Homo Sapiens
YSKAKLGAA

SEQ ID NO: 463535 - protein, 9 aa, Homo Sapiens
EHFRPYKKH

SEQ ID NO: 463536 - protein, 9 aa, Homo Sapiens
DSSGHLQVG

SEQ ID NO: 463537 - protein, 9 aa, Homo Sapiens
IQWLVLSTV

SEQ ID NO: 463538 - protein, 9 aa, Homo Sapiens
DQIQWLVLS

SEQ ID NO: 463539 - protein, 9 aa, Homo Sapiens
GSFPLQCVG

SEQ ID NO: 463540 - protein, 9 aa, Homo Sapiens
DELDHKRST

SEQ ID NO: 463541 - protein, 9 aa, Homo Sapiens
DRVAGSQAC

SEQ ID NO: 463542 - protein, 9 aa, Homo Sapiens
YTTFMLARF

SEQ ID NO: 463543 - protein, 9 aa, Homo Sapiens
ARPSPSWFR

SEQ ID NO: 463544 - protein, 9 aa, Homo Sapiens
GAAIPRWMK

SEQ ID NO: 463545 - protein, 9 aa, Homo Sapiens
PSSGLMAAS

SEQ ID NO: 463546 - protein, 9 aa, Homo Sapiens
MIRRFWYNY

SEQ ID NO: 463547 - protein, 9 aa, Homo Sapiens
FTTCSSHMT

SEQ ID NO: 463548 - protein, 9 aa, Homo Sapiens
AHRIASEDA

SEQ ID NO: 463549 - protein, 9 aa, Homo Sapiens
NGGYGSWKS

SEQ ID NO: 463550 - protein, 9 aa, Homo Sapiens
GRRRQDCAR

SEQ ID NO: 463551 - protein, 9 aa, Homo Sapiens
PSTERNRKA

SEQ ID NO: 463552 - protein, 9 aa, Homo Sapiens
QKDAVVLLI

SEQ ID NO: 463553 - protein, 9 aa, Homo Sapiens
HSGLDRVAG

SEQ ID NO: 463554 - protein, 9 aa, Homo Sapiens
SYFQQWERW

SEQ ID NO: 463555 - protein, 9 aa, Homo Sapiens
SHWAVQLLL

SEQ ID NO: 463556 - protein, 9 aa, Homo Sapiens
EATPGDRSW

SEQ ID NO: 463557 - protein, 9 aa, Homo Sapiens
PMALPSFWP

SEQ ID NO: 463558 - protein, 9 aa, Homo Sapiens
SQSPRLSNM

SEQ ID NO: 463559 - protein, 9 aa, Homo Sapiens
PLCWDECPG

SEQ ID NO: 463560 - protein, 9 aa, Homo Sapiens
ASSHPLVLP

SEQ ID NO: 463561 - protein, 9 aa, Homo Sapiens
FPLQCWGRR

SEQ ID NO: 463562 - protein, 9 aa, Homo Sapiens
RFCSGGRRG

SEQ ID NO: 463563 - protein, 9 aa, Homo Sapiens
GSPYESQLR

SEQ ID NO: 463564 - protein, 9 aa, Homo Sapiens
FAARAVLLF

SEQ ID NO: 463565 - protein, 9 aa, Homo Sapiens
IWHAAVHSR

SEQ ID NO: 463566 - protein, 9 aa, Homo Sapiens
SRTPYGGTR

SEQ ID NO: 463567 - protein, 9 aa, Homo Sapiens
KDYNMCLVH

SEQ ID NO: 463568 - protein, 9 aa, Homo Sapiens
FLPLAPASS

SEQ ID NO: 463569 - protein, 9 aa, Homo Sapiens
CFEQRTFSV

SEQ ID NO: 463570 - protein, 9 aa, Homo Sapiens
GLDRVAGSQ

SEQ ID NO: 463571 - protein, 9 aa, Homo Sapiens
RRFWYNYRQ

SEQ ID NO: 463572 - protein, 9 aa, Homo Sapiens
SPSWFRSCS

SEQ ID NO: 463573 - protein, 9 aa, Homo Sapiens
QEADPGAGA

SEQ ID NO: 463574 - protein, 9 aa, Homo Sapiens
VCLECLVTA

SEQ ID NO: 463575 - protein, 9 aa, Homo Sapiens
AASGASIPP

SEQ ID NO: 463576 - protein, 9 aa, Homo Sapiens
LASARPRPG

SEQ ID NO: 463577 - protein, 9 aa, Homo Sapiens
APFIAKRQT

SEQ ID NO: 463578 - protein, 9 aa, Homo Sapiens
MCNSSCMGS

SEQ ID NO: 463579 - protein, 9 aa, Homo Sapiens
IRRFWYNYR

SEQ ID NO: 463580 - protein, 9 aa, Homo Sapiens
YPFEEHNPP

SEQ ID NO: 463581 - protein, 9 aa, Homo Sapiens
CFICDELDH

SEQ ID NO: 463582 - protein, 9 aa, Homo Sapiens
RLPCALGAA

SEQ ID NO: 463583 - protein, 9 aa, Homo Sapiens
CLPEENQDF

SEQ ID NO: 463584 - protein, 9 aa, Homo Sapiens
RKAFIHSSH

SEQ ID NO: 463585 - protein, 9 aa, Homo Sapiens
PLAPASSHP

SEQ ID NO: 463586 - protein, 9 aa, Homo Sapiens
TDLCMRLLR

SEQ ID NO: 463587 - protein, 9 aa, Homo Sapiens
EWGPEGTTL

SEQ ID NO: 463588 - protein, 9 aa, Homo Sapiens
PLQCVGRRR

SEQ ID NO: 463589 - protein, 9 aa, Homo Sapiens
KINVCLNLQ

SEQ ID NO: 463590 - protein, 9 aa, Homo Sapiens
VEEEEAERE

SEQ ID NO: 463591 - protein, 9 aa, Homo Sapiens
KSQERDTEA

SEQ ID NO: 463592 - protein, 9 aa, Homo Sapiens
ICLPEENQD

SEQ ID NO: 463593 - protein, 9 aa, Homo Sapiens
GQFLRLSLH

SEQ ID NO: 463594 - protein, 9 aa, Homo Sapiens
ALLPPRAAR

SEQ ID NO: 463595 - protein, 9 aa, Homo Sapiens
SSSGHSGLD

SEQ ID NO: 463596 - protein, 9 aa, Homo Sapiens
TKPVIVDKD

SEQ ID NO: 463597 - protein, 9 aa, Homo Sapiens
AFTTCSSHM

SEQ ID NO: 463598 - protein, 9 aa, Homo Sapiens
DTEATRGRG

SEQ ID NO: 463599 - protein, 9 aa, Homo Sapiens
SPGMMPGTP

SEQ ID NO: 463600 - protein, 9 aa, Homo Sapiens
FVLVKLICP

SEQ ID NO: 463601 - protein, 9 aa, Homo Sapiens
ACPCGRGTR

SEQ ID NO: 463602 - protein, 9 aa, Homo Sapiens
LSLAALRKA

SEQ ID NO: 463603 - protein, 9 aa, Homo Sapiens
STLEHRPPA

SEQ ID NO: 463604 - protein, 9 aa, Homo Sapiens
LQCVGRRRQ

SEQ ID NO: 463605 - protein, 9 aa, Homo Sapiens
VTLASARPR

SEQ ID NO: 463606 - protein, 9 aa, Homo Sapiens
SASFISDTI

SEQ ID NO: 463607 - protein, 9 aa, Homo Sapiens
FTLTDLCMR

SEQ ID NO: 463608 - protein, 9 aa, Homo Sapiens
SCMGSMNRR

SEQ ID NO: 463609 - protein, 9 aa, Homo Sapiens
IPPPRLPCA

SEQ ID NO: 463610 - protein, 9 aa, Homo Sapiens
KARPINGGY

SEQ ID NO: 463611 - protein, 9 aa, Homo Sapiens
QSQFTIYEV

SEQ ID NO: 463612 - protein, 9 aa, Homo Sapiens
LGAAHLFAL

SEQ ID NO: 463613 - protein, 9 aa, Homo Sapiens
AALRKALAA

SEQ ID NO: 463614 - protein, 9 aa, Homo Sapiens
SFPQHCAGR

SEQ ID NO: 463615 - protein, 9 aa, Homo Sapiens
LGSDQPLLH

SEQ ID NO: 463616 - protein, 9 aa, Homo Sapiens
HVCSRTPVE

SEQ ID NO: 463617 - protein, 9 aa, Homo Sapiens
QWIHRFCSG

SEQ ID NO: 463618 - protein, 9 aa, Homo Sapiens
KDQIQWLVL

SEQ ID NO: 463619 - protein, 9 aa, Homo Sapiens
RGQSQFTIY

SEQ ID NO: 463620 - protein, 9 aa, Homo Sapiens
AIPSSLSTR

SEQ ID NO: 463621 - protein, 9 aa, Homo Sapiens
NIKIPAERL

SEQ ID NO: 463622 - protein, 9 aa, Homo Sapiens
WHPIYKQAA

SEQ ID NO: 463623 - protein, 9 aa, Homo Sapiens
GPSPGMMPG

SEQ ID NO: 463624 - protein, 9 aa, Homo Sapiens
DNLAKHVKT

SEQ ID NO: 463625 - protein, 9 aa, Homo Sapiens
EALRSRAIT

SEQ ID NO: 463626 - protein, 9 aa, Homo Sapiens
LDSQFVCLE

SEQ ID NO: 463627 - protein, 9 aa, Homo Sapiens
RPRPMALPS

SEQ ID NO: 463628 - protein, 9 aa, Homo Sapiens
PSPSWFRSC

SEQ ID NO: 463629 - protein, 9 aa, Homo Sapiens
EFRLLLLFL

SEQ ID NO: 463630 - protein, 9 aa, Homo Sapiens
NSSCMGSMN

SEQ ID NO: 463631 - protein, 9 aa, Homo Sapiens
EENQDFPPG

SEQ ID NO: 463632 - protein, 9 aa, Homo Sapiens
AGSQACPCG

SEQ ID NO: 463633 - protein, 9 aa, Homo Sapiens
WSSEAWDSE

SEQ ID NO: 463634 - protein, 9 aa, Homo Sapiens
KEFEEYEST

SEQ ID NO: 463635 - protein, 9 aa, Homo Sapiens
ILVIQLPLC

SEQ ID NO: 463636 - protein, 9 aa, Homo Sapiens
PAKPKARPI

SEQ ID NO: 463637 - protein, 9 aa, Homo Sapiens
MLAEDMTLC

SEQ ID NO: 463638 - protein, 9 aa, Homo Sapiens
LAPASSHPL

SEQ ID NO: 463639 - protein, 9 aa, Homo Sapiens
LRAPLFAAR

SEQ ID NO: 463640 - protein, 9 aa, Homo Sapiens
PSFKMPKAD

SEQ ID NO: 463641 - protein, 9 aa, Homo Sapiens
DPLCWDECP

SEQ ID NO: 463642 - protein, 9 aa, Homo Sapiens
PEPAKPKAR

SEQ ID NO: 463643 - protein, 9 aa, Homo Sapiens
CGEEPPVEA

SEQ ID NO: 463644 - protein, 9 aa, Homo Sapiens
MPEVTWLKY

SEQ ID NO: 463645 - protein, 9 aa, Homo Sapiens
LRGAGNIPS

SEQ ID NO: 463646 - protein, 9 aa, Homo Sapiens
LAIFSVGPV

SEQ ID NO: 463647 - protein, 9 aa, Homo Sapiens
KADLKGPQV

SEQ ID NO: 463648 - protein, 9 aa, Homo Sapiens
SPYESQLRA

SEQ ID NO: 463649 - protein, 9 aa, Homo Sapiens
TDISNVHDD

SEQ ID NO: 463650 - protein, 9 aa, Homo Sapiens
VHIMKNRNG

SEQ ID NO: 463651 - protein, 9 aa, Homo Sapiens
VIWHAAVHS

SEQ ID NO: 463652 - protein, 9 aa, Homo Sapiens
VSYFQQWER

SEQ ID NO: 463653 - protein, 9 aa, Homo Sapiens
AELSYRIGR

SEQ ID NO: 463654 - protein, 9 aa, Homo Sapiens
RLWEGPVQE

SEQ ID NO: 463655 - protein, 9 aa, Homo Sapiens
HMSTLTCHH

SEQ ID NO: 463656 - protein, 9 aa, Homo Sapiens
GMKRSSTLE

SEQ ID NO: 463657 - protein, 9 aa, Homo Sapiens
LGEDVVLPQ

SEQ ID NO: 463658 - protein, 9 aa, Homo Sapiens
ITVEWESSG

SEQ ID NO: 463659 - protein, 9 aa, Homo Sapiens
QRIKSQERD

SEQ ID NO: 463660 - protein, 9 aa, Homo Sapiens
LGQEADPGA

SEQ ID NO: 463661 - protein, 9 aa, Homo Sapiens
PEYSKAKLG

SEQ ID NO: 463662 - protein, 9 aa, Homo Sapiens
TGSPYESQL

SEQ ID NO: 463663 - protein, 9 aa, Homo Sapiens
NLSHRYTQL

SEQ ID NO: 463664 - protein, 9 aa, Homo Sapiens
SPGPSPGMM

SEQ ID NO: 463665 - protein, 9 aa, Homo Sapiens
HPIYKQAAR

SEQ ID NO: 463666 - protein, 9 aa, Homo Sapiens
YLRSNSERD

SEQ ID NO: 463667 - protein, 9 aa, Homo Sapiens
FKEMIRRFW

SEQ ID NO: 463668 - protein, 9 aa, Homo Sapiens
DMTLCVADF

SEQ ID NO: 463669 - protein, 9 aa, Homo Sapiens
SSSASPSTE

SEQ ID NO: 463670 - protein, 9 aa, Homo Sapiens
GRGSSSASP

SEQ ID NO: 463671 - protein, 9 aa, Homo Sapiens
VKINVCLNL

SEQ ID NO: 463672 - protein, 9 aa, Homo Sapiens
CAGRRRQDC

SEQ ID NO: 463673 - protein, 9 aa, Homo Sapiens
LLFLNQRKV

SEQ ID NO: 463674 - protein, 9 aa, Homo Sapiens
LKYGLPLPK

SEQ ID NO: 463675 - protein, 9 aa, Homo Sapiens
RRRRQWGSF

SEQ ID NO: 463676 - protein, 9 aa, Homo Sapiens
WGPEGTTLE

SEQ ID NO: 463677 - protein, 9 aa, Homo Sapiens
FSQGPYPTV

SEQ ID NO: 463678 - protein, 9 aa, Homo Sapiens
DEWGPEGTT

SEQ ID NO: 463679 - protein, 9 aa, Homo Sapiens
PCGRGTRDQ

SEQ ID NO: 463680 - protein, 9 aa, Homo Sapiens
AAICPYCSL

SEQ ID NO: 463681 - protein, 9 aa, Homo Sapiens
LRVIAQSTN

SEQ ID NO: 463682 - protein, 9 aa, Homo Sapiens
CPCGRGTRD

SEQ ID NO: 463683 - protein, 9 aa, Homo Sapiens
MALGEDVVL

SEQ ID NO: 463684 - protein, 9 aa, Homo Sapiens
VCTPVDSLV

SEQ ID NO: 463685 - protein, 9 aa, Homo Sapiens
SRAITKPVI

SEQ ID NO: 463686 - protein, 9 aa, Homo Sapiens
QIRLTLCKF

SEQ ID NO: 463687 - protein, 9 aa, Homo Sapiens
LGVHCVICQ

SEQ ID NO: 463688 - protein, 9 aa, Homo Sapiens
MKNRNGGGS

SEQ ID NO: 463689 - protein, 9 aa, Homo Sapiens
GSSCYFFLP

SEQ ID NO: 463690 - protein, 9 aa, Homo Sapiens
VWHPIYKQA

SEQ ID NO: 463691 - protein, 9 aa, Homo Sapiens
DPGAGAELS

SEQ ID NO: 463692 - protein, 9 aa, Homo Sapiens
RRRQDCARP

SEQ ID NO: 463693 - protein, 9 aa, Homo Sapiens
FPLQCVGRR

SEQ ID NO: 463694 - protein, 9 aa, Homo Sapiens
FGELGSKFW

SEQ ID NO: 463695 - protein, 9 aa, Homo Sapiens
TWLKYGLPL

SEQ ID NO: 463696 - protein, 9 aa, Homo Sapiens
ISDTISPYT

SEQ ID NO: 463697 - protein, 9 aa, Homo Sapiens
FVSYFQQWE

SEQ ID NO: 463698 - protein, 9 aa, Homo Sapiens
RCTREFRLL

SEQ ID NO: 463699 - protein, 9 aa, Homo Sapiens
HCAGRRRQD

SEQ ID NO: 463700 - protein, 9 aa, Homo Sapiens
SSCMGSMNR

SEQ ID NO: 463701 - protein, 9 aa, Homo Sapiens
KRSSTLEHR

SEQ ID NO: 463702 - protein, 9 aa, Homo Sapiens
RCQRRWEDI

SEQ ID NO: 463703 - protein, 9 aa, Homo Sapiens
LCVADFGLS

SEQ ID NO: 463704 - protein, 9 aa, Homo Sapiens
FEEHNPPQL

SEQ ID NO: 463705 - protein, 9 aa, Homo Sapiens
RSDNLAKHV

SEQ ID NO: 463706 - protein, 9 aa, Homo Sapiens
DNIKIPAER

SEQ ID NO: 463707 - protein, 9 aa, Homo Sapiens
WACMKVRHP

SEQ ID NO: 463708 - protein, 9 aa, Homo Sapiens
ESTEEYDQY

SEQ ID NO: 463709 - protein, 9 aa, Homo Sapiens
DFSQGPYPT

SEQ ID NO: 463710 - protein, 9 aa, Homo Sapiens
NNASDYLVQ

SEQ ID NO: 463711 - protein, 9 aa, Homo Sapiens
QLLGCSHVC

SEQ ID NO: 463712 - protein, 9 aa, Homo Sapiens
STRAASGAS

SEQ ID NO: 463713 - protein, 9 aa, Homo Sapiens
ASHWAVQLL

SEQ ID NO: 463714 - protein, 9 aa, Homo Sapiens
NMDHHHYET

SEQ ID NO: 463715 - protein, 9 aa, Homo Sapiens
LLNLQSKTS

SEQ ID NO: 463716 - protein, 9 aa, Homo Sapiens
FDEWGPEGT

SEQ ID NO: 463717 - protein, 9 aa, Homo Sapiens
PSSSGHSGL

SEQ ID NO: 463718 - protein, 9 aa, Homo Sapiens
YPSESTSLP

SEQ ID NO: 463719 - protein, 9 aa, Homo Sapiens
HDRNTVSHT

SEQ ID NO: 463720 - protein, 9 aa, Homo Sapiens
GSQSPRLSN

SEQ ID NO: 463721 - protein, 9 aa, Homo Sapiens
SGLDRVAGS

SEQ ID NO: 463722 - protein, 9 aa, Homo Sapiens
ICPYCSLRF

SEQ ID NO: 463723 - protein, 9 aa, Homo Sapiens
PGPSPGMMP

SEQ ID NO: 463724 - protein, 9 aa, Homo Sapiens
TLTDLCMRL

SEQ ID NO: 463725 - protein, 9 aa, Homo Sapiens
DGHLSRPIF

SEQ ID NO: 463726 - protein, 9 aa, Homo Sapiens
YKQAARAEK

SEQ ID NO: 463727 - protein, 9 aa, Homo Sapiens
HHLEDMEQA

SEQ ID NO: 463728 - protein, 9 aa, Homo Sapiens
ERLCRNAAI

SEQ ID NO: 463729 - protein, 9 aa, Homo Sapiens
TLEHRPPAP

SEQ ID NO: 463730 - protein, 9 aa, Homo Sapiens
AIDLGQEAD

SEQ ID NO: 463731 - protein, 9 aa, Homo Sapiens
RQRCQRRWE

SEQ ID NO: 463732 - protein, 9 aa, Homo Sapiens
LLSSKHKYK

SEQ ID NO: 463733 - protein, 9 aa, Homo Sapiens
RKLRENLAG

SEQ ID NO: 463734 - protein, 9 aa, Homo Sapiens
ASPSTERNR

SEQ ID NO: 463735 - protein, 9 aa, Homo Sapiens
CDELDHKRS

SEQ ID NO: 463736 - protein, 9 aa, Homo Sapiens
TRPFKEMIR

SEQ ID NO: 463737 - protein, 9 aa, Homo Sapiens
QACPCGRGT

SEQ ID NO: 463738 - protein, 9 aa, Homo Sapiens
PPRLPCALG

SEQ ID NO: 463739 - protein, 9 aa, Homo Sapiens
TDYPEGNNA

SEQ ID NO: 463740 - protein, 9 aa, Homo Sapiens
PPSPSRTPY

SEQ ID NO: 463741 - protein, 9 aa, Homo Sapiens
EKVEEEEAE

SEQ ID NO: 463742 - protein, 9 aa, Homo Sapiens
EVPGVFSRS

SEQ ID NO: 463743 - protein, 9 aa, Homo Sapiens
ESQLRAPLF

SEQ ID NO: 463744 - protein, 9 aa, Homo Sapiens
QLPLCGPNE

SEQ ID NO: 463745 - protein, 9 aa, Homo Sapiens
SAGDGHLSR

SEQ ID NO: 463746 - protein, 9 aa, Homo Sapiens
ISLYFSVEV

SEQ ID NO: 463747 - protein, 9 aa, Homo Sapiens
GCGKAFIWS

SEQ ID NO: 463748 - protein, 9 aa, Homo Sapiens
EEHQTWHFL

SEQ ID NO: 463749 - protein, 9 aa, Homo Sapiens
LWEGPVQEL

SEQ ID NO: 463750 - protein, 9 aa, Homo Sapiens
TMPFQAETV

SEQ ID NO: 463751 - protein, 9 aa, Homo Sapiens
AHPLRCSAE

SEQ ID NO: 463752 - protein, 9 aa, Homo Sapiens
QAETVAKLK

SEQ ID NO: 463753 - protein, 9 aa, Homo Sapiens
PASSHPLVL

SEQ ID NO: 463754 - protein, 9 aa, Homo Sapiens
DDNIKIPAE

SEQ ID NO: 463755 - protein, 9 aa, Homo Sapiens
VMATELAHP

SEQ ID NO: 463756 - protein, 9 aa, Homo Sapiens
ALRSRAITK

SEQ ID NO: 463757 - protein, 9 aa, Homo Sapiens
VRHPVQNFS

SEQ ID NO: 463758 - protein, 9 aa, Homo Sapiens
GTMPFQAET

SEQ ID NO: 463759 - protein, 9 aa, Homo Sapiens
CSHVCSRTP

SEQ ID NO: 463760 - protein, 9 aa, Homo Sapiens
PWSSEAWDS

SEQ ID NO: 463761 - protein, 9 aa, Homo Sapiens
IKSQERDTE

SEQ ID NO: 463762 - protein, 9 aa, Homo Sapiens
KVEEEEAER

SEQ ID NO: 463763 - protein, 9 aa, Homo Sapiens
PAMKKGLVD

SEQ ID NO: 463764 - protein, 9 aa, Homo Sapiens
PIYKQAARA

SEQ ID NO: 463765 - protein, 9 aa, Homo Sapiens
EFEEYESTE

SEQ ID NO: 463766 - protein, 9 aa, Homo Sapiens
KRMCERKKI

SEQ ID NO: 463767 - protein, 9 aa, Homo Sapiens
FIAKRQTPK

SEQ ID NO: 463768 - protein, 9 aa, Homo Sapiens
PSDITVEWE

SEQ ID NO: 463769 - protein, 9 aa, Homo Sapiens
CQRRWEDIF

SEQ ID NO: 463770 - protein, 9 aa, Homo Sapiens
MISLAWVIS

SEQ ID NO: 463771 - protein, 9 aa, Homo Sapiens
NVCLNLQRA

SEQ ID NO: 463772 - protein, 9 aa, Homo Sapiens
SSGHSGLDR

SEQ ID NO: 463773 - protein, 9 aa, Homo Sapiens
INSSAGDGH

SEQ ID NO: 463774 - protein, 9 aa, Homo Sapiens
IHAVCTPVD

SEQ ID NO: 463775 - protein, 9 aa, Homo Sapiens
IPSALPSSS

SEQ ID NO: 463776 - protein, 9 aa, Homo Sapiens
CKFNRENSS

SEQ ID NO: 463777 - protein, 9 aa, Homo Sapiens
EYESTEEYD

SEQ ID NO: 463778 - protein, 9 aa, Homo Sapiens
PAPGSSCYF

SEQ ID NO: 463779 - protein, 9 aa, Homo Sapiens
IVPTILTDV

SEQ ID NO: 463780 - protein, 9 aa, Homo Sapiens
YFSVEVIRL

SEQ ID NO: 463781 - protein, 9 aa, Homo Sapiens
HKIWEHFRP

SEQ ID NO: 463782 - protein, 9 aa, Homo Sapiens
KRQTPKIQE

SEQ ID NO: 463783 - protein, 9 aa, Homo Sapiens
PALSPEPAK

SEQ ID NO: 463784 - protein, 9 aa, Homo Sapiens
PISLYFSVE

SEQ ID NO: 463785 - protein, 9 aa, Homo Sapiens
TLRSMALGE

SEQ ID NO: 463786 - protein, 9 aa, Homo Sapiens
RAGVMISLA

SEQ ID NO: 463787 - protein, 9 aa, Homo Sapiens
CARPSPSWF

SEQ ID NO: 463788 - protein, 9 aa, Homo Sapiens
LCRNAAICP

SEQ ID NO: 463789 - protein, 9 aa, Homo Sapiens
SFPLQCVGR

SEQ ID NO: 463790 - protein, 9 aa, Homo Sapiens
ALPSSSGHS

SEQ ID NO: 463791 - protein, 9 aa, Homo Sapiens
ICQKVAIKI

SEQ ID NO: 463792 - protein, 9 aa, Homo Sapiens
PLFPAMKKG

SEQ ID NO: 463793 - protein, 9 aa, Homo Sapiens
QTPKIQEQY

SEQ ID NO: 463794 - protein, 9 aa, Homo Sapiens
VVLLIHLRL

SEQ ID NO: 463795 - protein, 9 aa, Homo Sapiens
GAGNIPSAL

SEQ ID NO: 463796 - protein, 9 aa, Homo Sapiens
SDKYLRSNS

SEQ ID NO: 463797 - protein, 9 aa, Homo Sapiens
VTDISNVHD

SEQ ID NO: 463798 - protein, 9 aa, Homo Sapiens
NLAGPWSSE

SEQ ID NO: 463799 - protein, 9 aa, Homo Sapiens
SGLMAASRD

SEQ ID NO: 463800 - protein, 9 aa, Homo Sapiens
GFGELGSKF

SEQ ID NO: 463801 - protein, 9 aa, Homo Sapiens
HRFCSGGRR

SEQ ID NO: 463802 - protein, 9 aa, Homo Sapiens
PHARGSSLA

SEQ ID NO: 463803 - protein, 9 aa, Homo Sapiens
SCIEATPGD

SEQ ID NO: 463804 - protein, 9 aa, Homo Sapiens
QWGSFPLQC

SEQ ID NO: 463805 - protein, 9 aa, Homo Sapiens
ASFISDTIS

SEQ ID NO: 463806 - protein, 9 aa, Homo Sapiens
KDAVVLLIH

SEQ ID NO: 463807 - protein, 9 aa, Homo Sapiens
PTPTACFEQ

SEQ ID NO: 463808 - protein, 9 aa, Homo Sapiens
RSSTLEHRP

SEQ ID NO: 463809 - protein, 9 aa, Homo Sapiens
RPPAPGSSC

SEQ ID NO: 463810 - protein, 9 aa, Homo Sapiens
IDLGQEADP

SEQ ID NO: 463811 - protein, 9 aa, Homo Sapiens
CLNLQRAST

SEQ ID NO: 463812 - protein, 9 aa, Homo Sapiens
TRDQERTPA

SEQ ID NO: 463813 - protein, 9 aa, Homo Sapiens
QERTPALSP

SEQ ID NO: 463814 - protein, 9 aa, Homo Sapiens
QLRAPLFAA

SEQ ID NO: 463815 - protein, 9 aa, Homo Sapiens
SSLSTRAAS

SEQ ID NO: 463816 - protein, 9 aa, Homo Sapiens
KHGCFICDE

SEQ ID NO: 463817 - protein, 9 aa, Homo Sapiens
NDVKINVCL

SEQ ID NO: 463818 - protein, 9 aa, Homo Sapiens
RLCRNAAIC

SEQ ID NO: 463819 - protein, 9 aa, Homo Sapiens
ECSDCRKAF

SEQ ID NO: 463820 - protein, 9 aa, Homo Sapiens
SQERDTEAT

SEQ ID NO: 463821 - protein, 9 aa, Homo Sapiens
HCVICQKVA

SEQ ID NO: 463822 - protein, 9 aa, Homo Sapiens
TATTMRAAA

SEQ ID NO: 463823 - protein, 9 aa, Homo Sapiens
MAASRDQVP

SEQ ID NO: 463824 - protein, 9 aa, Homo Sapiens
GTLPGLRGA

SEQ ID NO: 463825 - protein, 9 aa, Homo Sapiens
SYRIGRGSS

SEQ ID NO: 463826 - protein, 9 aa, Homo Sapiens
IANEDAAHR

SEQ ID NO: 463827 - protein, 9 aa, Homo Sapiens
SASPSTERN

SEQ ID NO: 463828 - protein, 9 aa, Homo Sapiens
ARGQSQFTI

SEQ ID NO: 463829 - protein, 9 aa, Homo Sapiens
PGAGAELSY

SEQ ID NO: 463830 - protein, 9 aa, Homo Sapiens
LAICHNKTT

SEQ ID NO: 463831 - protein, 9 aa, Homo Sapiens
VAGSQACPC

SEQ ID NO: 463832 - protein, 9 aa, Homo Sapiens
DQPLLHVVS

SEQ ID NO: 463833 - protein, 9 aa, Homo Sapiens
AAAIPSSLS

SEQ ID NO: 463834 - protein, 9 aa, Homo Sapiens
SESASTSSS

SEQ ID NO: 463835 - protein, 9 aa, Homo Sapiens
PSESTSLPY

SEQ ID NO: 463836 - protein, 9 aa, Homo Sapiens
DALCGFGEL

SEQ ID NO: 463837 - protein, 9 aa, Homo Sapiens
NTVSHTAAA

SEQ ID NO: 463838 - protein, 9 aa, Homo Sapiens
FLRLSLHFH

SEQ ID NO: 463839 - protein, 9 aa, Homo Sapiens
RQWGSFPLQ

SEQ ID NO: 463840 - protein, 9 aa, Homo Sapiens
LTDLCMRLL

SEQ ID NO: 463841 - protein, 9 aa, Homo Sapiens
YGLPLPKRS

SEQ ID NO: 463842 - protein, 9 aa, Homo Sapiens
SQLRAPLFA

SEQ ID NO: 463843 - protein, 9 aa, Homo Sapiens
RPMALPSFW

SEQ ID NO: 463844 - protein, 9 aa, Homo Sapiens
SLYFSVEVI

SEQ ID NO: 463845 - protein, 9 aa, Homo Sapiens
VDSFGQVSH

SEQ ID NO: 463846 - protein, 9 aa, Homo Sapiens
KSVDSFGQV

SEQ ID NO: 463847 - protein, 9 aa, Homo Sapiens
SVDSFGQVS

SEQ ID NO: 463848 - protein, 9 aa, Homo Sapiens
IVLVGRPVY

SEQ ID NO: 463849 - protein, 9 aa, Homo Sapiens
LVGRPVYQD

SEQ ID NO: 463850 - protein, 9 aa, Homo Sapiens
ETLKKSVDS

SEQ ID NO: 463851 - protein, 9 aa, Homo Sapiens
VGRPVYQDE

SEQ ID NO: 463852 - protein, 9 aa, Homo Sapiens
VIVLVGRPV

SEQ ID NO: 463853 - protein, 9 aa, Homo Sapiens
DVETLKKSV

SEQ ID NO: 463854 - protein, 9 aa, Homo Sapiens
LRMLVIVLV

SEQ ID NO: 463855 - protein, 9 aa, Homo Sapiens
RMLVIVLVG

SEQ ID NO: 463856 - protein, 9 aa, Homo Sapiens
LVIVLVGRP

SEQ ID NO: 463857 - protein, 9 aa, Homo Sapiens
LKKSVDSFG

SEQ ID NO: 463858 - protein, 9 aa, Homo Sapiens
MLVIVLVGR

SEQ ID NO: 463859 - protein, 9 aa, Homo Sapiens
VETLKKSVD

SEQ ID NO: 463860 - protein, 9 aa, Homo Sapiens
KKSVDSFGQ

SEQ ID NO: 463861 - protein, 9 aa, Homo Sapiens
VLVGRPVYQ

SEQ ID NO: 463862 - protein, 9 aa, Homo Sapiens
TLKKSVDSF

SEQ ID NO: 463863 - protein, 9 aa, Homo Sapiens
SCREWARAS

SEQ ID NO: 463864 - protein, 9 aa, Homo Sapiens
HSQTNNKTG

SEQ ID NO: 463865 - protein, 9 aa, Homo Sapiens
EKAQSQPCF

SEQ ID NO: 463866 - protein, 9 aa, Homo Sapiens
SPKSGAGVH

SEQ ID NO: 463867 - protein, 9 aa, Homo Sapiens
QVGDDLILV

SEQ ID NO: 463868 - protein, 9 aa, Homo Sapiens
ESFNLFSAT

SEQ ID NO: 463869 - protein, 9 aa, Homo Sapiens
KILNLCVFE

SEQ ID NO: 463870 - protein, 9 aa, Homo Sapiens
VDTKAKEAP

SEQ ID NO: 463871 - protein, 9 aa, Homo Sapiens
KSFSRGSLA

SEQ ID NO: 463872 - protein, 9 aa, Homo Sapiens
GSYIHMAAW

SEQ ID NO: 463873 - protein, 9 aa, Homo Sapiens
LWGQSIFST

SEQ ID NO: 463874 - protein, 9 aa, Homo Sapiens
GDLEELEGT

SEQ ID NO: 463875 - protein, 9 aa, Homo Sapiens
PAIRGATAH

SEQ ID NO: 463876 - protein, 9 aa, Homo Sapiens
PRPRWPPQM

SEQ ID NO: 463877 - protein, 9 aa, Homo Sapiens
AQCPNPSSY

SEQ ID NO: 463878 - protein, 9 aa, Homo Sapiens
SCEVIREWK

SEQ ID NO: 463879 - protein, 9 aa, Homo Sapiens
HLCEPIAVD

SEQ ID NO: 463880 - protein, 9 aa, Homo Sapiens
EWKTGESLC

SEQ ID NO: 463881 - protein, 9 aa, Homo Sapiens
QLPRPRWPP

SEQ ID NO: 463882 - protein, 9 aa, Homo Sapiens
EPEVLQDSQ

SEQ ID NO: 463883 - protein, 9 aa, Homo Sapiens
CPMPGMVPS

SEQ ID NO: 463884 - protein, 9 aa, Homo Sapiens
VLANEMLFC

SEQ ID NO: 463885 - protein, 9 aa, Homo Sapiens
FNHRRCRAA

SEQ ID NO: 463886 - protein, 9 aa, Homo Sapiens
AVREDVIVE

SEQ ID NO: 463887 - protein, 9 aa, Homo Sapiens
ILPMAWLLS

SEQ ID NO: 463888 - protein, 9 aa, Homo Sapiens
NLKELQERV

SEQ ID NO: 463889 - protein, 9 aa, Homo Sapiens
TNIQTLDCP

SEQ ID NO: 463890 - protein, 9 aa, Homo Sapiens
SYDHYVAVC

SEQ ID NO: 463891 - protein, 9 aa, Homo Sapiens
GLCRSPYAR

SEQ ID NO: 463892 - protein, 9 aa, Homo Sapiens
QAAAAVPTW

SEQ ID NO: 463893 - protein, 9 aa, Homo Sapiens
GCPSPKDTL

SEQ ID NO: 463894 - protein, 9 aa, Homo Sapiens
PMPGMVPSS

SEQ ID NO: 463895 - protein, 9 aa, Homo Sapiens
QRSEGEKVQ

SEQ ID NO: 463896 - protein, 9 aa, Homo Sapiens
PIFPGAPGF

SEQ ID NO: 463897 - protein, 9 aa, Homo Sapiens
MAWLLSRYP

SEQ ID NO: 463898 - protein, 9 aa, Homo Sapiens
WLLLPQALN

SEQ ID NO: 463899 - protein, 9 aa, Homo Sapiens
SSRDSHGFF

SEQ ID NO: 463900 - protein, 9 aa, Homo Sapiens
VPYVVTPLS

SEQ ID NO: 463901 - protein, 9 aa, Homo Sapiens
KIQLPRPRW

SEQ ID NO: 463902 - protein, 9 aa, Homo Sapiens
DCPIKKGPV

SEQ ID NO: 463903 - protein, 9 aa, Homo Sapiens
IQLPRPRWP

SEQ ID NO: 463904 - protein, 9 aa, Homo Sapiens
LLLPQALNA

SEQ ID NO: 463905 - protein, 9 aa, Homo Sapiens
VVLDPRMPS

SEQ ID NO: 463906 - protein, 9 aa, Homo Sapiens
LCEPIAVDP

SEQ ID NO: 463907 - protein, 9 aa, Homo Sapiens
GLAMLWGMG

SEQ ID NO: 463908 - protein, 9 aa, Homo Sapiens
NPSCREWAR

SEQ ID NO: 463909 - protein, 9 aa, Homo Sapiens
CSGSCFSKF

SEQ ID NO: 463910 - protein, 9 aa, Homo Sapiens
AAAVPTWKM

SEQ ID NO: 463911 - protein, 9 aa, Homo Sapiens
MLWGMGWKP

SEQ ID NO: 463912 - protein, 9 aa, Homo Sapiens
PCDLDFKGA

SEQ ID NO: 463913 - protein, 9 aa, Homo Sapiens
LRGCCKPRS

SEQ ID NO: 463914 - protein, 9 aa, Homo Sapiens
EEEGKDGPT

SEQ ID NO: 463915 - protein, 9 aa, Homo Sapiens
LAILALHRL

SEQ ID NO: 463916 - protein, 9 aa, Homo Sapiens
PVFQVQPGL

SEQ ID NO: 463917 - protein, 9 aa, Homo Sapiens
LPMAWLLSR

SEQ ID NO: 463918 - protein, 9 aa, Homo Sapiens
LDLDLSMLD

SEQ ID NO: 463919 - protein, 9 aa, Homo Sapiens
LCVFEDESG

SEQ ID NO: 463920 - protein, 9 aa, Homo Sapiens
AGLLSGLCR

SEQ ID NO: 463921 - protein, 9 aa, Homo Sapiens
ALHRLGRQR

SEQ ID NO: 463922 - protein, 9 aa, Homo Sapiens
KSGAGVHAK

SEQ ID NO: 463923 - protein, 9 aa, Homo Sapiens
RSCEVIREW

SEQ ID NO: 463924 - protein, 9 aa, Homo Sapiens
FKGAQCPNP

SEQ ID NO: 463925 - protein, 9 aa, Homo Sapiens
NFRHLSEGD

SEQ ID NO: 463926 - protein, 9 aa, Homo Sapiens
NKTGCRLQN

SEQ ID NO: 463927 - protein, 9 aa, Homo Sapiens
AGVHAKWLM

SEQ ID NO: 463928 - protein, 9 aa, Homo Sapiens
PQHTEEMVQ

SEQ ID NO: 463929 - protein, 9 aa, Homo Sapiens
WRLCLVNLC

SEQ ID NO: 463930 - protein, 9 aa, Homo Sapiens
DLEELEGTR

SEQ ID NO: 463931 - protein, 9 aa, Homo Sapiens
EEEEEGKDG

SEQ ID NO: 463932 - protein, 9 aa, Homo Sapiens
DTKAKEAPR

SEQ ID NO: 463933 - protein, 9 aa, Homo Sapiens
EGEKVQVGD

SEQ ID NO: 463934 - protein, 9 aa, Homo Sapiens
TPLSVINAV

SEQ ID NO: 463935 - protein, 9 aa, Homo Sapiens
FRKNFCSIL

SEQ ID NO: 463936 - protein, 9 aa, Homo Sapiens
HRLCSGSCF

SEQ ID NO: 463937 - protein, 9 aa, Homo Sapiens
GWDGGGLAP

SEQ ID NO: 463938 - protein, 9 aa, Homo Sapiens
GKKAASKGP

SEQ ID NO: 463939 - protein, 9 aa, Homo Sapiens
GPLVYVLYD

SEQ ID NO: 463940 - protein, 9 aa, Homo Sapiens
EDEENTWSK

SEQ ID NO: 463941 - protein, 9 aa, Homo Sapiens
NHRRCRAAV

SEQ ID NO: 463942 - protein, 9 aa, Homo Sapiens
ELQSMSPIL

SEQ ID NO: 463943 - protein, 9 aa, Homo Sapiens
ATREKAQSQ

SEQ ID NO: 463944 - protein, 9 aa, Homo Sapiens
VHRLCSGSC

SEQ ID NO: 463945 - protein, 9 aa, Homo Sapiens
LDSWTELQS

SEQ ID NO: 463946 - protein, 9 aa, Homo Sapiens
IREWKTGES

SEQ ID NO: 463947 - protein, 9 aa, Homo Sapiens
KNFCSILRC

SEQ ID NO: 463948 - protein, 9 aa, Homo Sapiens
TCPAVVMGE

SEQ ID NO: 463949 - protein, 9 aa, Homo Sapiens
PAVVMGENN

SEQ ID NO: 463950 - protein, 9 aa, Homo Sapiens
LSRYPMEQL

SEQ ID NO: 463951 - protein, 9 aa, Homo Sapiens
DVKTIYETE

SEQ ID NO: 463952 - protein, 9 aa, Homo Sapiens
ILGVVLANE

SEQ ID NO: 463953 - protein, 9 aa, Homo Sapiens
VPAIRGATA

SEQ ID NO: 463954 - protein, 9 aa, Homo Sapiens
SIAVQRSKD

SEQ ID NO: 463955 - protein, 9 aa, Homo Sapiens
LVIKCVLIN

SEQ ID NO: 463956 - protein, 9 aa, Homo Sapiens
GVVLANEML

SEQ ID NO: 463957 - protein, 9 aa, Homo Sapiens
LQDSQDRCY

SEQ ID NO: 463958 - protein, 9 aa, Homo Sapiens
PGMVPSSQV

SEQ ID NO: 463959 - protein, 9 aa, Homo Sapiens
AILALHRLG

SEQ ID NO: 463960 - protein, 9 aa, Homo Sapiens
TWLLLPQAL

SEQ ID NO: 463961 - protein, 9 aa, Homo Sapiens
SPILPMAWL

SEQ ID NO: 463962 - protein, 9 aa, Homo Sapiens
AYLVFSPSR

SEQ ID NO: 463963 - protein, 9 aa, Homo Sapiens
LSIAVQRSK

SEQ ID NO: 463964 - protein, 9 aa, Homo Sapiens
DDNFRKNFC

SEQ ID NO: 463965 - protein, 9 aa, Homo Sapiens
PPVFQVQPG

SEQ ID NO: 463966 - protein, 9 aa, Homo Sapiens
EDVIVELEF

SEQ ID NO: 463967 - protein, 9 aa, Homo Sapiens
SWTELQSMS

SEQ ID NO: 463968 - protein, 9 aa, Homo Sapiens
SMNNNRDLD

SEQ ID NO: 463969 - protein, 9 aa, Homo Sapiens
GANLADLGA

SEQ ID NO: 463970 - protein, 9 aa, Homo Sapiens
LVLMSYDHY

SEQ ID NO: 463971 - protein, 9 aa, Homo Sapiens
IHMAAWGLP

SEQ ID NO: 463972 - protein, 9 aa, Homo Sapiens
FSATEGKER

SEQ ID NO: 463973 - protein, 9 aa, Homo Sapiens
VIREWKTGE

SEQ ID NO: 463974 - protein, 9 aa, Homo Sapiens
RRGWTYYSV

SEQ ID NO: 463975 - protein, 9 aa, Homo Sapiens
GSLATRHQR

SEQ ID NO: 463976 - protein, 9 aa, Homo Sapiens
ARCRETSRS

SEQ ID NO: 463977 - protein, 9 aa, Homo Sapiens
PLNVPAIRG

SEQ ID NO: 463978 - protein, 9 aa, Homo Sapiens
IVELEFCAS

SEQ ID NO: 463979 - protein, 9 aa, Homo Sapiens
NLCVFEDES

SEQ ID NO: 463980 - protein, 9 aa, Homo Sapiens
YSWKVDFLR

SEQ ID NO: 463981 - protein, 9 aa, Homo Sapiens
SPKDTLVCR

SEQ ID NO: 463982 - protein, 9 aa, Homo Sapiens
YGCPSPKDT

SEQ ID NO: 463983 - protein, 9 aa, Homo Sapiens
GGGGWDGGG

SEQ ID NO: 463984 - protein, 9 aa, Homo Sapiens
TVEGQGANL

SEQ ID NO: 463985 - protein, 9 aa, Homo Sapiens
SHELPKSEA

SEQ ID NO: 463986 - protein, 9 aa, Homo Sapiens
KFLNDVKTI

SEQ ID NO: 463987 - protein, 9 aa, Homo Sapiens
VADPIIYML

SEQ ID NO: 463988 - protein, 9 aa, Homo Sapiens
PSPKDTLVC

SEQ ID NO: 463989 - protein, 9 aa, Homo Sapiens
ILQNLDLWG

SEQ ID NO: 463990 - protein, 9 aa, Homo Sapiens
DLWGQSIFS

SEQ ID NO: 463991 - protein, 9 aa, Homo Sapiens
FARRGWTYY

SEQ ID NO: 463992 - protein, 9 aa, Homo Sapiens
EEEEGKDGP

SEQ ID NO: 463993 - protein, 9 aa, Homo Sapiens
FFGSRMTLV

SEQ ID NO: 463994 - protein, 9 aa, Homo Sapiens
TGCRLQNQL

SEQ ID NO: 463995 - protein, 9 aa, Homo Sapiens
GGWDGGGLA

SEQ ID NO: 463996 - protein, 9 aa, Homo Sapiens
NPQHTEEMV

SEQ ID NO: 463997 - protein, 9 aa, Homo Sapiens
KDSGYPFII

SEQ ID NO: 463998 - protein, 9 aa, Homo Sapiens
PPQMTHMKA

SEQ ID NO: 463999 - protein, 9 aa, Homo Sapiens
DLDLSMLDS

SEQ ID NO: 464000 - protein, 9 aa, Homo Sapiens
LGVVLANEM

SEQ ID NO: 464001 - protein, 9 aa, Homo Sapiens
SHGFFGSRM

SEQ ID NO: 464002 - protein, 9 aa, Homo Sapiens
YIHMAAWGL

SEQ ID NO: 464003 - protein, 9 aa, Homo Sapiens
AAVPTWKMA

SEQ ID NO: 464004 - protein, 9 aa, Homo Sapiens
KGPNSVSEI

SEQ ID NO: 464005 - protein, 9 aa, Homo Sapiens
PRWPPQMTH

SEQ ID NO: 464006 - protein, 9 aa, Homo Sapiens
QHPQQQPQQ

SEQ ID NO: 464007 - protein, 9 aa, Homo Sapiens
YVVTPLSVI

SEQ ID NO: 464008 - protein, 9 aa, Homo Sapiens
PREAVRVLV

SEQ ID NO: 464009 - protein, 9 aa, Homo Sapiens
GLMGAQGPP

SEQ ID NO: 464010 - protein, 9 aa, Homo Sapiens
WRRWNRFNH

SEQ ID NO: 464011 - protein, 9 aa, Homo Sapiens
AAAAVPTWK

SEQ ID NO: 464012 - protein, 9 aa, Homo Sapiens
LWGMGWKPG

SEQ ID NO: 464013 - protein, 9 aa, Homo Sapiens
GEDEENTWS

SEQ ID NO: 464014 - protein, 9 aa, Homo Sapiens
QPGGGGWDG

SEQ ID NO: 464015 - protein, 9 aa, Homo Sapiens
LAKENPQHT

SEQ ID NO: 464016 - protein, 9 aa, Homo Sapiens
IDSVKTNQI

SEQ ID NO: 464017 - protein, 9 aa, Homo Sapiens
RTYTLYRIT

SEQ ID NO: 464018 - protein, 9 aa, Homo Sapiens
SKGPNSVSE

SEQ ID NO: 464019 - protein, 9 aa, Homo Sapiens
DVLVHAGWS

SEQ ID NO: 464020 - protein, 9 aa, Homo Sapiens
HCVKTCPAV

SEQ ID NO: 464021 - protein, 9 aa, Homo Sapiens
LSGLCRSPY

SEQ ID NO: 464022 - protein, 9 aa, Homo Sapiens
LNLCVFEDE

SEQ ID NO: 464023 - protein, 9 aa, Homo Sapiens
NFRKNFCSI

SEQ ID NO: 464024 - protein, 9 aa, Homo Sapiens
FLNDVKTIY

SEQ ID NO: 464025 - protein, 9 aa, Homo Sapiens
HGRVGEEGG

SEQ ID NO: 464026 - protein, 9 aa, Homo Sapiens
FSRGSLATR

SEQ ID NO: 464027 - protein, 9 aa, Homo Sapiens
LATRHQRIH

SEQ ID NO: 464028 - protein, 9 aa, Homo Sapiens
SGYPFIIFS

SEQ ID NO: 464029 - protein, 9 aa, Homo Sapiens
SATEGKERE

SEQ ID NO: 464030 - protein, 9 aa, Homo Sapiens
DPIIYMLAT

SEQ ID NO: 464031 - protein, 9 aa, Homo Sapiens
QLAGSDDSK

SEQ ID NO: 464032 - protein, 9 aa, Homo Sapiens
KVQVGDDLI

SEQ ID NO: 464033 - protein, 9 aa, Homo Sapiens
FARCRETSR

SEQ ID NO: 464034 - protein, 9 aa, Homo Sapiens
PSCREWARA

SEQ ID NO: 464035 - protein, 9 aa, Homo Sapiens
SPREAVRVL

SEQ ID NO: 464036 - protein, 9 aa, Homo Sapiens
CFLFPFQYL

SEQ ID NO: 464037 - protein, 9 aa, Homo Sapiens
GEKVQVGDD

SEQ ID NO: 464038 - protein, 9 aa, Homo Sapiens
VKTCPAVVM

SEQ ID NO: 464039 - protein, 9 aa, Homo Sapiens
LDLWGQSIF

SEQ ID NO: 464040 - protein, 9 aa, Homo Sapiens
VLYDVLVHA

SEQ ID NO: 464041 - protein, 9 aa, Homo Sapiens
SGKRTYTLY

SEQ ID NO: 464042 - protein, 9 aa, Homo Sapiens
EGKDGPTET

SEQ ID NO: 464043 - protein, 9 aa, Homo Sapiens
CLVNLCQRC

SEQ ID NO: 464044 - protein, 9 aa, Homo Sapiens
WNRFNHRRC

SEQ ID NO: 464045 - protein, 9 aa, Homo Sapiens
MSTPSHELP

SEQ ID NO: 464046 - protein, 9 aa, Homo Sapiens
HRLGRQRNQ

SEQ ID NO: 464047 - protein, 9 aa, Homo Sapiens
SCSSPSTKN

SEQ ID NO: 464048 - protein, 9 aa, Homo Sapiens
ILAILALHR

SEQ ID NO: 464049 - protein, 9 aa, Homo Sapiens
VSPREAVRV

SEQ ID NO: 464050 - protein, 9 aa, Homo Sapiens
PHTAPPHLQ

SEQ ID NO: 464051 - protein, 9 aa, Homo Sapiens
FRHLSEGDL

SEQ ID NO: 464052 - protein, 9 aa, Homo Sapiens
MSPILPMAW

SEQ ID NO: 464053 - protein, 9 aa, Homo Sapiens
SGQPGGGGW

SEQ ID NO: 464054 - protein, 9 aa, Homo Sapiens
ATASKHLCE

SEQ ID NO: 464055 - protein, 9 aa, Homo Sapiens
TGEGNFNWC

SEQ ID NO: 464056 - protein, 9 aa, Homo Sapiens
KHLCEPIAV

SEQ ID NO: 464057 - protein, 9 aa, Homo Sapiens
ARVDTKAKE

SEQ ID NO: 464058 - protein, 9 aa, Homo Sapiens
SMSPILPMA

SEQ ID NO: 464059 - protein, 9 aa, Homo Sapiens
PHLQEAGGP

SEQ ID NO: 464060 - protein, 9 aa, Homo Sapiens
KENPQHTEE

SEQ ID NO: 464061 - protein, 9 aa, Homo Sapiens
FNWCFLFPF

SEQ ID NO: 464062 - protein, 9 aa, Homo Sapiens
WLLSRYPME

SEQ ID NO: 464063 - protein, 9 aa, Homo Sapiens
VVTPLSVIN

SEQ ID NO: 464064 - protein, 9 aa, Homo Sapiens
LMGAQGPPG

SEQ ID NO: 464065 - protein, 9 aa, Homo Sapiens
EGTRTVLNA

SEQ ID NO: 464066 - protein, 9 aa, Homo Sapiens
SWKVDFLRG

SEQ ID NO: 464067 - protein, 9 aa, Homo Sapiens
SGSCFSKFR

SEQ ID NO: 464068 - protein, 9 aa, Homo Sapiens
LKELQERVL

SEQ ID NO: 464069 - protein, 9 aa, Homo Sapiens
LTLKCHHRL

SEQ ID NO: 464070 - protein, 9 aa, Homo Sapiens
GQAAAAVPT

SEQ ID NO: 464071 - protein, 9 aa, Homo Sapiens
PGGGGWDGG

SEQ ID NO: 464072 - protein, 9 aa, Homo Sapiens
FNPSCREWA

SEQ ID NO: 464073 - protein, 9 aa, Homo Sapiens
NLFSATEGK

SEQ ID NO: 464074 - protein, 9 aa, Homo Sapiens
VDKSTWLLL

SEQ ID NO: 464075 - protein, 9 aa, Homo Sapiens
ASKGPNSVS

SEQ ID NO: 464076 - protein, 9 aa, Homo Sapiens
SRSFVHLEP

SEQ ID NO: 464077 - protein, 9 aa, Homo Sapiens
HLQEAGGPT

SEQ ID NO: 464078 - protein, 9 aa, Homo Sapiens
RSEGEKVQV

SEQ ID NO: 464079 - protein, 9 aa, Homo Sapiens
PGLMGAQGP

SEQ ID NO: 464080 - protein, 9 aa, Homo Sapiens
SSRLHSCSS

SEQ ID NO: 464081 - protein, 9 aa, Homo Sapiens
TKDSGYPFI

SEQ ID NO: 464082 - protein, 9 aa, Homo Sapiens
PGIPRPIFP

SEQ ID NO: 464083 - protein, 9 aa, Homo Sapiens
ANLADLGAT

SEQ ID NO: 464084 - protein, 9 aa, Homo Sapiens
RSFVHLEPM

SEQ ID NO: 464085 - protein, 9 aa, Homo Sapiens
PQSWRLCLV

SEQ ID NO: 464086 - protein, 9 aa, Homo Sapiens
PLVYVLYDV

SEQ ID NO: 464087 - protein, 9 aa, Homo Sapiens
LEGTRTVLN

SEQ ID NO: 464088 - protein, 9 aa, Homo Sapiens
QSMSPILPM

SEQ ID NO: 464089 - protein, 9 aa, Homo Sapiens
PFIIFSHGL

SEQ ID NO: 464090 - protein, 9 aa, Homo Sapiens
MNNNRDLDL

SEQ ID NO: 464091 - protein, 9 aa, Homo Sapiens
EEEEEEGKD

SEQ ID NO: 464092 - protein, 9 aa, Homo Sapiens
NRGLKKKKQ

SEQ ID NO: 464093 - protein, 9 aa, Homo Sapiens
DPRMPSDHY

SEQ ID NO: 464094 - protein, 9 aa, Homo Sapiens
SYIHMAAWG

SEQ ID NO: 464095 - protein, 9 aa, Homo Sapiens
LDFKGAQCP

SEQ ID NO: 464096 - protein, 9 aa, Homo Sapiens
ATRHQRIHT

SEQ ID NO: 464097 - protein, 9 aa, Homo Sapiens
TLVVLDPRM

SEQ ID NO: 464098 - protein, 9 aa, Homo Sapiens
PKDTLVCRR

SEQ ID NO: 464099 - protein, 9 aa, Homo Sapiens
LVFSPSRSF

SEQ ID NO: 464100 - protein, 9 aa, Homo Sapiens
PLSVINAVI

SEQ ID NO: 464101 - protein, 9 aa, Homo Sapiens
KMEDEAEPP

SEQ ID NO: 464102 - protein, 9 aa, Homo Sapiens
EVIREWKTG

SEQ ID NO: 464103 - protein, 9 aa, Homo Sapiens
LLPQALNAY

SEQ ID NO: 464104 - protein, 9 aa, Homo Sapiens
KLSFQKILP

SEQ ID NO: 464105 - protein, 9 aa, Homo Sapiens
FQLDSWTEL

SEQ ID NO: 464106 - protein, 9 aa, Homo Sapiens
RLCKRDSQV

SEQ ID NO: 464107 - protein, 9 aa, Homo Sapiens
NIQTLDCPI

SEQ ID NO: 464108 - protein, 9 aa, Homo Sapiens
VTSQTKKLS

SEQ ID NO: 464109 - protein, 9 aa, Homo Sapiens
GWTYYSVKT

SEQ ID NO: 464110 - protein, 9 aa, Homo Sapiens
KTGCRLQNQ

SEQ ID NO: 464111 - protein, 9 aa, Homo Sapiens
RDSHGFFGS

SEQ ID NO: 464112 - protein, 9 aa, Homo Sapiens
AGSDDSKME

SEQ ID NO: 464113 - protein, 9 aa, Homo Sapiens
STPSHELPK

SEQ ID NO: 464114 - protein, 9 aa, Homo Sapiens
VFSPSRSFV

SEQ ID NO: 464115 - protein, 9 aa, Homo Sapiens
KCHHRLHTG

SEQ ID NO: 464116 - protein, 9 aa, Homo Sapiens
REDVIVELE

SEQ ID NO: 464117 - protein, 9 aa, Homo Sapiens
ILSMNNNRD

SEQ ID NO: 464118 - protein, 9 aa, Homo Sapiens
DEENTWSKP

SEQ ID NO: 464119 - protein, 9 aa, Homo Sapiens
MTHMKASSV

SEQ ID NO: 464120 - protein, 9 aa, Homo Sapiens
YSVKTPIQR

SEQ ID NO: 464121 - protein, 9 aa, Homo Sapiens
CRSPYARRS

SEQ ID NO: 464122 - protein, 9 aa, Homo Sapiens
RWPPQMTHM

SEQ ID NO: 464123 - protein, 9 aa, Homo Sapiens
TSVILSMNN

SEQ ID NO: 464124 - protein, 9 aa, Homo Sapiens
MKASSVTSE

SEQ ID NO: 464125 - protein, 9 aa, Homo Sapiens
GGQAAAAVP

SEQ ID NO: 464126 - protein, 9 aa, Homo Sapiens
RHVSPREAV

SEQ ID NO: 464127 - protein, 9 aa, Homo Sapiens
VDFLRGCCK

SEQ ID NO: 464128 - protein, 9 aa, Homo Sapiens
QTNIQTLDC

SEQ ID NO: 464129 - protein, 9 aa, Homo Sapiens
SSQVIIIAG

SEQ ID NO: 464130 - protein, 9 aa, Homo Sapiens
FRYGCPSPK

SEQ ID NO: 464131 - protein, 9 aa, Homo Sapiens
SMRLPFARC

SEQ ID NO: 464132 - protein, 9 aa, Homo Sapiens
LAMLWGMGW

SEQ ID NO: 464133 - protein, 9 aa, Homo Sapiens
VHAKWLMMA

SEQ ID NO: 464134 - protein, 9 aa, Homo Sapiens
INFRHLSEG

SEQ ID NO: 464135 - protein, 9 aa, Homo Sapiens
YYSVKTPIQ

SEQ ID NO: 464136 - protein, 9 aa, Homo Sapiens
STWLLLPQA

SEQ ID NO: 464137 - protein, 9 aa, Homo Sapiens
KVDFLRGCC

SEQ ID NO: 464138 - protein, 9 aa, Homo Sapiens
SGAGVHAKW

SEQ ID NO: 464139 - protein, 9 aa, Homo Sapiens
VQVGDDLIL

SEQ ID NO: 464140 - protein, 9 aa, Homo Sapiens
TNQIRKAML

SEQ ID NO: 464141 - protein, 9 aa, Homo Sapiens
KDMELSIAV

SEQ ID NO: 464142 - protein, 9 aa, Homo Sapiens
TLKCHHRLH

SEQ ID NO: 464143 - protein, 9 aa, Homo Sapiens
TITNQDLLV

SEQ ID NO: 464144 - protein, 9 aa, Homo Sapiens
KIPPRKRLC

SEQ ID NO: 464145 - protein, 9 aa, Homo Sapiens
RCRETSRSH

SEQ ID NO: 464146 - protein, 9 aa, Homo Sapiens
NQIRKAMLS

SEQ ID NO: 464147 - protein, 9 aa, Homo Sapiens
WLHGARKVK

SEQ ID NO: 464148 - protein, 9 aa, Homo Sapiens
ESMRLPFAR

SEQ ID NO: 464149 - protein, 9 aa, Homo Sapiens
PPHLQEAGG

SEQ ID NO: 464150 - protein, 9 aa, Homo Sapiens
THGRVGEEG

SEQ ID NO: 464151 - protein, 9 aa, Homo Sapiens
IAVQRSKDM

SEQ ID NO: 464152 - protein, 9 aa, Homo Sapiens
QLAKENPQH

SEQ ID NO: 464153 - protein, 9 aa, Homo Sapiens
LNDVKTIYE

SEQ ID NO: 464154 - protein, 9 aa, Homo Sapiens
VRKILNLCV

SEQ ID NO: 464155 - protein, 9 aa, Homo Sapiens
PYVVTPLSV

SEQ ID NO: 464156 - protein, 9 aa, Homo Sapiens
WGQSIFSTI

SEQ ID NO: 464157 - protein, 9 aa, Homo Sapiens
RLCLVNLCQ

SEQ ID NO: 464158 - protein, 9 aa, Homo Sapiens
GLPGIPRPI

SEQ ID NO: 464159 - protein, 9 aa, Homo Sapiens
WTYYSVKTP

SEQ ID NO: 464160 - protein, 9 aa, Homo Sapiens
KGAQCPNPS

SEQ ID NO: 464161 - protein, 9 aa, Homo Sapiens
HRRCRAAVK

SEQ ID NO: 464162 - protein, 9 aa, Homo Sapiens
RETSRSHTR

SEQ ID NO: 464163 - protein, 9 aa, Homo Sapiens
VREDVIVEL

SEQ ID NO: 464164 - protein, 9 aa, Homo Sapiens
DKSTWLLLP

SEQ ID NO: 464165 - protein, 9 aa, Homo Sapiens
LNRGLKKKK

SEQ ID NO: 464166 - protein, 9 aa, Homo Sapiens
SLATRHQRI

SEQ ID NO: 464167 - protein, 9 aa, Homo Sapiens
TIYETEVFS

SEQ ID NO: 464168 - protein, 9 aa, Homo Sapiens
YVLYDVLVH

SEQ ID NO: 464169 - protein, 9 aa, Homo Sapiens
AVPTWKMAA

SEQ ID NO: 464170 - protein, 9 aa, Homo Sapiens
TASKHLCEP

SEQ ID NO: 464171 - protein, 9 aa, Homo Sapiens
GVADPIIYM

SEQ ID NO: 464172 - protein, 9 aa, Homo Sapiens
PSHELPKSE

SEQ ID NO: 464173 - protein, 9 aa, Homo Sapiens
LQERVLRGK

SEQ ID NO: 464174 - protein, 9 aa, Homo Sapiens
RGLKKKKQY

SEQ ID NO: 464175 - protein, 9 aa, Homo Sapiens
CDLDFKGAQ

SEQ ID NO: 464176 - protein, 9 aa, Homo Sapiens
DSHGFFGSR

SEQ ID NO: 464177 - protein, 9 aa, Homo Sapiens
MARVDTKAK

SEQ ID NO: 464178 - protein, 9 aa, Homo Sapiens
SVKTNQIRK

SEQ ID NO: 464179 - protein, 9 aa, Homo Sapiens
TELQSMSPI

SEQ ID NO: 464180 - protein, 9 aa, Homo Sapiens
LQSMSPILP

SEQ ID NO: 464181 - protein, 9 aa, Homo Sapiens
IEAHGSYIH

SEQ ID NO: 464182 - protein, 9 aa, Homo Sapiens
SRLHSCSSP

SEQ ID NO: 464183 - protein, 9 aa, Homo Sapiens
EAVRVLVRS

SEQ ID NO: 464184 - protein, 9 aa, Homo Sapiens
GKIQLPRPR

SEQ ID NO: 464185 - protein, 9 aa, Homo Sapiens
GLLSGLCRS

SEQ ID NO: 464186 - protein, 9 aa, Homo Sapiens
VEGQGANLA

SEQ ID NO: 464187 - protein, 9 aa, Homo Sapiens
PRPIFPGAP

SEQ ID NO: 464188 - protein, 9 aa, Homo Sapiens
ELTLKCHHR

SEQ ID NO: 464189 - protein, 9 aa, Homo Sapiens
TKAKEAPRA

SEQ ID NO: 464190 - protein, 9 aa, Homo Sapiens
AWLLSRYPM

SEQ ID NO: 464191 - protein, 9 aa, Homo Sapiens
TPSHELPKS

SEQ ID NO: 464192 - protein, 9 aa, Homo Sapiens
PRKRLCKRD

SEQ ID NO: 464193 - protein, 9 aa, Homo Sapiens
FSPSRSFVH

SEQ ID NO: 464194 - protein, 9 aa, Homo Sapiens
RGSLATRHQ

SEQ ID NO: 464195 - protein, 9 aa, Homo Sapiens
AHGSYIHMA

SEQ ID NO: 464196 - protein, 9 aa, Homo Sapiens
DHYVAVCQP

SEQ ID NO: 464197 - protein, 9 aa, Homo Sapiens
RPRWPPQMT

SEQ ID NO: 464198 - protein, 9 aa, Homo Sapiens
QPGLPPTPV

SEQ ID NO: 464199 - protein, 9 aa, Homo Sapiens
QNLDLWGQS

SEQ ID NO: 464200 - protein, 9 aa, Homo Sapiens
DSKMEDEAE

SEQ ID NO: 464201 - protein, 9 aa, Homo Sapiens
PILPMAWLL

SEQ ID NO: 464202 - protein, 9 aa, Homo Sapiens
CPAVVMGEN

SEQ ID NO: 464203 - protein, 9 aa, Homo Sapiens
LHSNYGDAR

SEQ ID NO: 464204 - protein, 9 aa, Homo Sapiens
GAGVHAKWL

SEQ ID NO: 464205 - protein, 9 aa, Homo Sapiens
TFPQILGVV

SEQ ID NO: 464206 - protein, 9 aa, Homo Sapiens
DGHNLKELQ

SEQ ID NO: 464207 - protein, 9 aa, Homo Sapiens
EENTWSKPE

SEQ ID NO: 464208 - protein, 9 aa, Homo Sapiens
RKNFCSILR

SEQ ID NO: 464209 - protein, 9 aa, Homo Sapiens
AVRVLVRST

SEQ ID NO: 464210 - protein, 9 aa, Homo Sapiens
GTITNQDLL

SEQ ID NO: 464211 - protein, 9 aa, Homo Sapiens
LAGSDDSKM

SEQ ID NO: 464212 - protein, 9 aa, Homo Sapiens
LGFPLNVPA

SEQ ID NO: 464213 - protein, 9 aa, Homo Sapiens
LMSYDHYVA

SEQ ID NO: 464214 - protein, 9 aa, Homo Sapiens
IPPRKRLCK

SEQ ID NO: 464215 - protein, 9 aa, Homo Sapiens
SPSRSFVHL

SEQ ID NO: 464216 - protein, 9 aa, Homo Sapiens
CKRDSQVKS

SEQ ID NO: 464217 - protein, 9 aa, Homo Sapiens
HLSEGDLFT

SEQ ID NO: 464218 - protein, 9 aa, Homo Sapiens
CVKTCPAVV

SEQ ID NO: 464219 - protein, 9 aa, Homo Sapiens
LPFARCRET

SEQ ID NO: 464220 - protein, 9 aa, Homo Sapiens
GVPHTAPPH

SEQ ID NO: 464221 - protein, 9 aa, Homo Sapiens
RLPFARCRE

SEQ ID NO: 464222 - protein, 9 aa, Homo Sapiens
NVPAIRGAT

SEQ ID NO: 464223 - protein, 9 aa, Homo Sapiens
DLLVIKCVL

SEQ ID NO: 464224 - protein, 9 aa, Homo Sapiens
KSTWLLLPQ

SEQ ID NO: 464225 - protein, 9 aa, Homo Sapiens
VWWLHGARK

SEQ ID NO: 464226 - protein, 9 aa, Homo Sapiens
GIPRPIFPG

SEQ ID NO: 464227 - protein, 9 aa, Homo Sapiens
AVVMGENNT

SEQ ID NO: 464228 - protein, 9 aa, Homo Sapiens
SRDSHGFFG

SEQ ID NO: 464229 - protein, 9 aa, Homo Sapiens
ELPKSEADT

SEQ ID NO: 464230 - protein, 9 aa, Homo Sapiens
GSCFSKFRA

SEQ ID NO: 464231 - protein, 9 aa, Homo Sapiens
YMLATDHSR

SEQ ID NO: 464232 - protein, 9 aa, Homo Sapiens
CSSPSTKNS

SEQ ID NO: 464233 - protein, 9 aa, Homo Sapiens
HMKASSVTS

SEQ ID NO: 464234 - protein, 9 aa, Homo Sapiens
EEGKDGPTE

SEQ ID NO: 464235 - protein, 9 aa, Homo Sapiens
TYTLYRITV

SEQ ID NO: 464236 - protein, 9 aa, Homo Sapiens
GVHAKWLMM

SEQ ID NO: 464237 - protein, 9 aa, Homo Sapiens
LHGARKVKE

SEQ ID NO: 464238 - protein, 9 aa, Homo Sapiens
IIYMLATDH

SEQ ID NO: 464239 - protein, 9 aa, Homo Sapiens
YDGILHSNY

SEQ ID NO: 464240 - protein, 9 aa, Homo Sapiens
YLVFSPSRS

SEQ ID NO: 464241 - protein, 9 aa, Homo Sapiens
GNFNWCFLF

SEQ ID NO: 464242 - protein, 9 aa, Homo Sapiens
ESTHGRVGE

SEQ ID NO: 464243 - protein, 9 aa, Homo Sapiens
LCRSPYARR

SEQ ID NO: 464244 - protein, 9 aa, Homo Sapiens
TPPVFQVQP

SEQ ID NO: 464245 - protein, 9 aa, Homo Sapiens
VIVELEFCA

SEQ ID NO: 464246 - protein, 9 aa, Homo Sapiens
WSKPEYGTE

SEQ ID NO: 464247 - protein, 9 aa, Homo Sapiens
GFFGSRMTL

SEQ ID NO: 464248 - protein, 9 aa, Homo Sapiens
WDGGGLAPP

SEQ ID NO: 464249 - protein, 9 aa, Homo Sapiens
DNVPYVVTP

SEQ ID NO: 464250 - protein, 9 aa, Homo Sapiens
LGAVREDVI

SEQ ID NO: 464251 - protein, 9 aa, Homo Sapiens
VKTIYETEV

SEQ ID NO: 464252 - protein, 9 aa, Homo Sapiens
FNLFSATEG

SEQ ID NO: 464253 - protein, 9 aa, Homo Sapiens
VKTNQIRKA

SEQ ID NO: 464254 - protein, 9 aa, Homo Sapiens
DMELSIAVQ

SEQ ID NO: 464255 - protein, 9 aa, Homo Sapiens
DSGYPFIIF

SEQ ID NO: 464256 - protein, 9 aa, Homo Sapiens
NFNWCFLFP

SEQ ID NO: 464257 - protein, 9 aa, Homo Sapiens
APPHLQEAG

SEQ ID NO: 464258 - protein, 9 aa, Homo Sapiens
LALHRLGRQ

SEQ ID NO: 464259 - protein, 9 aa, Homo Sapiens
LDPRMPSDH

SEQ ID NO: 464260 - protein, 9 aa, Homo Sapiens
HVSPREAVR

SEQ ID NO: 464261 - protein, 9 aa, Homo Sapiens
PDDSLDLDL

SEQ ID NO: 464262 - protein, 9 aa, Homo Sapiens
VVINFRHLS

SEQ ID NO: 464263 - protein, 9 aa, Homo Sapiens
VVLANEMLF

SEQ ID NO: 464264 - protein, 9 aa, Homo Sapiens
MPGMVPSSQ

SEQ ID NO: 464265 - protein, 9 aa, Homo Sapiens
CPSPKDTLV

SEQ ID NO: 464266 - protein, 9 aa, Homo Sapiens
SKHLCEPIA

SEQ ID NO: 464267 - protein, 9 aa, Homo Sapiens
SQTKKLSFQ

SEQ ID NO: 464268 - protein, 9 aa, Homo Sapiens
SNYGDARKI

SEQ ID NO: 464269 - protein, 9 aa, Homo Sapiens
LFSATEGKE

SEQ ID NO: 464270 - protein, 9 aa, Homo Sapiens
MVRKILNLC

SEQ ID NO: 464271 - protein, 9 aa, Homo Sapiens
TLDCPIKKG

SEQ ID NO: 464272 - protein, 9 aa, Homo Sapiens
AIEAHGSYI

SEQ ID NO: 464273 - protein, 9 aa, Homo Sapiens
MLATDHSRQ

SEQ ID NO: 464274 - protein, 9 aa, Homo Sapiens
QTKKLSFQK

SEQ ID NO: 464275 - protein, 9 aa, Homo Sapiens
EAHGSYIHM

SEQ ID NO: 464276 - protein, 9 aa, Homo Sapiens
IRSCEVIRE

SEQ ID NO: 464277 - protein, 9 aa, Homo Sapiens
AVWWLHGAR

SEQ ID NO: 464278 - protein, 9 aa, Homo Sapiens
DSVKTNQIR

SEQ ID NO: 464279 - protein, 9 aa, Homo Sapiens
EGNFNWCFL

SEQ ID NO: 464280 - protein, 9 aa, Homo Sapiens
TWSKPEYGT

SEQ ID NO: 464281 - protein, 9 aa, Homo Sapiens
PKSGAGVHA

SEQ ID NO: 464282 - protein, 9 aa, Homo Sapiens
QLDSWTELQ

SEQ ID NO: 464283 - protein, 9 aa, Homo Sapiens
QVQPGLPPT

SEQ ID NO: 464284 - protein, 9 aa, Homo Sapiens
YPFIIFSHG

SEQ ID NO: 464285 - protein, 9 aa, Homo Sapiens
AAGLLSGLC

SEQ ID NO: 464286 - protein, 9 aa, Homo Sapiens
PIIDSVKTN

SEQ ID NO: 464287 - protein, 9 aa, Homo Sapiens
GGEDEENTW

SEQ ID NO: 464288 - protein, 9 aa, Homo Sapiens
RVDTKAKEA

SEQ ID NO: 464289 - protein, 9 aa, Homo Sapiens
SRGSLATRH

SEQ ID NO: 464290 - protein, 9 aa, Homo Sapiens
SQTNNKTGC

SEQ ID NO: 464291 - protein, 9 aa, Homo Sapiens
SFSRGSLAT

SEQ ID NO: 464292 - protein, 9 aa, Homo Sapiens
IYETEVFST

SEQ ID NO: 464293 - protein, 9 aa, Homo Sapiens
TSQTKKLSF

SEQ ID NO: 464294 - protein, 9 aa, Homo Sapiens
GCRLQNQLF

SEQ ID NO: 464295 - protein, 9 aa, Homo Sapiens
VINFRHLSE

SEQ ID NO: 464296 - protein, 9 aa, Homo Sapiens
TAPPHLQEA

SEQ ID NO: 464297 - protein, 9 aa, Homo Sapiens
VLDPRMPSD

SEQ ID NO: 464298 - protein, 9 aa, Homo Sapiens
EAGAPESTH

SEQ ID NO: 464299 - protein, 9 aa, Homo Sapiens
PQMTHMKAS

SEQ ID NO: 464300 - protein, 9 aa, Homo Sapiens
APESTHGRV

SEQ ID NO: 464301 - protein, 9 aa, Homo Sapiens
SESMRLPFA

SEQ ID NO: 464302 - protein, 9 aa, Homo Sapiens
VTSESMRLP

SEQ ID NO: 464303 - protein, 9 aa, Homo Sapiens
KKLSFQKIL

SEQ ID NO: 464304 - protein, 9 aa, Homo Sapiens
FIIFSHGLG

SEQ ID NO: 464305 - protein, 9 aa, Homo Sapiens
EELEGTRTV

SEQ ID NO: 464306 - protein, 9 aa, Homo Sapiens
MSYDHYVAV

SEQ ID NO: 464307 - protein, 9 aa, Homo Sapiens
KAASKGPNS

SEQ ID NO: 464308 - protein, 9 aa, Homo Sapiens
RWNRFNHRR

SEQ ID NO: 464309 - protein, 9 aa, Homo Sapiens
ASKHLCEPI

SEQ ID NO: 464310 - protein, 9 aa, Homo Sapiens
DFKGAQCPN

SEQ ID NO: 464311 - protein, 9 aa, Homo Sapiens
PFARCRETS

SEQ ID NO: 464312 - protein, 9 aa, Homo Sapiens
QTLDCPIKK

SEQ ID NO: 464313 - protein, 9 aa, Homo Sapiens
CREWARASQ

SEQ ID NO: 464314 - protein, 9 aa, Homo Sapiens
LQNLDLWGQ

SEQ ID NO: 464315 - protein, 9 aa, Homo Sapiens
GEGNFNWCF

SEQ ID NO: 464316 - protein, 9 aa, Homo Sapiens
ITNQDLLVI

SEQ ID NO: 464317 - protein, 9 aa, Homo Sapiens
QTNNKTGCR

SEQ ID NO: 464318 - protein, 9 aa, Homo Sapiens
GAQCPNPSS

SEQ ID NO: 464319 - protein, 9 aa, Homo Sapiens
AASKGPNSV

SEQ ID NO: 464320 - protein, 9 aa, Homo Sapiens
ASSRDSHGF

SEQ ID NO: 464321 - protein, 9 aa, Homo Sapiens
ELSIAVQRS

SEQ ID NO: 464322 - protein, 9 aa, Homo Sapiens
WWLHGARKV

SEQ ID NO: 464323 - protein, 9 aa, Homo Sapiens
NTWSKPEYG

SEQ ID NO: 464324 - protein, 9 aa, Homo Sapiens
PIIYMLATD

SEQ ID NO: 464325 - protein, 9 aa, Homo Sapiens
HYVAVCQPL

SEQ ID NO: 464326 - protein, 9 aa, Homo Sapiens
YDHYVAVCQ

SEQ ID NO: 464327 - protein, 9 aa, Homo Sapiens
LLVLMSYDH

SEQ ID NO: 464328 - protein, 9 aa, Homo Sapiens
DVIVELEFC

SEQ ID NO: 464329 - protein, 9 aa, Homo Sapiens
SKMEDEAEP

SEQ ID NO: 464330 - protein, 9 aa, Homo Sapiens
DDSLDLDLS

SEQ ID NO: 464331 - protein, 9 aa, Homo Sapiens
NVPYVVTPL

SEQ ID NO: 464332 - protein, 9 aa, Homo Sapiens
VLMSYDHYV

SEQ ID NO: 464333 - protein, 9 aa, Homo Sapiens
VRVLVRSTT

SEQ ID NO: 464334 - protein, 9 aa, Homo Sapiens
LCKRDSQVK

SEQ ID NO: 464335 - protein, 9 aa, Homo Sapiens
LPKSEADTS

SEQ ID NO: 464336 - protein, 9 aa, Homo Sapiens
HPQQQPQQQ

SEQ ID NO: 464337 - protein, 9 aa, Homo Sapiens
PMAWLLSRY

SEQ ID NO: 464338 - protein, 9 aa, Homo Sapiens
LVVLDPRMP

SEQ ID NO: 464339 - protein, 9 aa, Homo Sapiens
NWCFLFPFQ

SEQ ID NO: 464340 - protein, 9 aa, Homo Sapiens
GAPESTHGR

SEQ ID NO: 464341 - protein, 9 aa, Homo Sapiens
ALGFPLNVP

SEQ ID NO: 464342 - protein, 9 aa, Homo Sapiens
NRFNHRRCR

SEQ ID NO: 464343 - protein, 9 aa, Homo Sapiens
IQTLDCPIK

SEQ ID NO: 464344 - protein, 9 aa, Homo Sapiens
CPIKKGPVQ

SEQ ID NO: 464345 - protein, 9 aa, Homo Sapiens
VVRFNPSCR

SEQ ID NO: 464346 - protein, 9 aa, Homo Sapiens
DDSKMEDEA

SEQ ID NO: 464347 - protein, 9 aa, Homo Sapiens
MVPSSQVII

SEQ ID NO: 464348 - protein, 9 aa, Homo Sapiens
HSNYGDARK

SEQ ID NO: 464349 - protein, 9 aa, Homo Sapiens
AVTSQTKKL

SEQ ID NO: 464350 - protein, 9 aa, Homo Sapiens
MRLPFARCR

SEQ ID NO: 464351 - protein, 9 aa, Homo Sapiens
LSMNNNRDL

SEQ ID NO: 464352 - protein, 9 aa, Homo Sapiens
LDLSMLDSI

SEQ ID NO: 464353 - protein, 9 aa, Homo Sapiens
ASSVTSESM

SEQ ID NO: 464354 - protein, 9 aa, Homo Sapiens
RYGCPSPKD

SEQ ID NO: 464355 - protein, 9 aa, Homo Sapiens
IPRPIFPGA

SEQ ID NO: 464356 - protein, 9 aa, Homo Sapiens
LVYVLYDVL

SEQ ID NO: 464357 - protein, 9 aa, Homo Sapiens
CVFEDESGK

SEQ ID NO: 464358 - protein, 9 aa, Homo Sapiens
QQHPQQQPQ

SEQ ID NO: 464359 - protein, 9 aa, Homo Sapiens
SWRLCLVNL

SEQ ID NO: 464360 - protein, 9 aa, Homo Sapiens
ILHSNYGDA

SEQ ID NO: 464361 - protein, 9 aa, Homo Sapiens
GMVPSSQVI

SEQ ID NO: 464362 - protein, 9 aa, Homo Sapiens
LHRLGRQRN

SEQ ID NO: 464363 - protein, 9 aa, Homo Sapiens
PPRKRLCKR

SEQ ID NO: 464364 - protein, 9 aa, Homo Sapiens
SKGKKAASK

SEQ ID NO: 464365 - protein, 9 aa, Homo Sapiens
RGWTYYSVK

SEQ ID NO: 464366 - protein, 9 aa, Homo Sapiens
CEPIAVDPK

SEQ ID NO: 464367 - protein, 9 aa, Homo Sapiens
DLDFKGAQC

SEQ ID NO: 464368 - protein, 9 aa, Homo Sapiens
DGILHSNYG

SEQ ID NO: 464369 - protein, 9 aa, Homo Sapiens
VYVLYDVLV

SEQ ID NO: 464370 - protein, 9 aa, Homo Sapiens
IYDGILHSN

SEQ ID NO: 464371 - protein, 9 aa, Homo Sapiens
NQDLLVIKC

SEQ ID NO: 464372 - protein, 9 aa, Homo Sapiens
DSWTELQSM

SEQ ID NO: 464373 - protein, 9 aa, Homo Sapiens
EKDMELSIA

SEQ ID NO: 464374 - protein, 9 aa, Homo Sapiens
QERVLRGKY

SEQ ID NO: 464375 - protein, 9 aa, Homo Sapiens
AGGQAAAAV

SEQ ID NO: 464376 - protein, 9 aa, Homo Sapiens
VILSMNNNR

SEQ ID NO: 464377 - protein, 9 aa, Homo Sapiens
DFLRGCCKP

SEQ ID NO: 464378 - protein, 9 aa, Homo Sapiens
GQPGGGGWD

SEQ ID NO: 464379 - protein, 9 aa, Homo Sapiens
KRTYTLYRI

SEQ ID NO: 464380 - protein, 9 aa, Homo Sapiens
SVILSMNNN

SEQ ID NO: 464381 - protein, 9 aa, Homo Sapiens
LCSGSCFSK

SEQ ID NO: 464382 - protein, 9 aa, Homo Sapiens
MPSDHYNWQ

SEQ ID NO: 464383 - protein, 9 aa, Homo Sapiens
AKENPQHTE

SEQ ID NO: 464384 - protein, 9 aa, Homo Sapiens
QQQHPQQQP

SEQ ID NO: 464385 - protein, 9 aa, Homo Sapiens
ATEGKERET

SEQ ID NO: 464386 - protein, 9 aa, Homo Sapiens
VVVRFNPSC

SEQ ID NO: 464387 - protein, 9 aa, Homo Sapiens
LPQALNAYY

SEQ ID NO: 464388 - protein, 9 aa, Homo Sapiens
HGARKVKET

SEQ ID NO: 464389 - protein, 9 aa, Homo Sapiens
RLHSCSSPS

SEQ ID NO: 464390 - protein, 9 aa, Homo Sapiens
GQGANLADL

SEQ ID NO: 464391 - protein, 9 aa, Homo Sapiens
TKKLSFQKI

SEQ ID NO: 464392 - protein, 9 aa, Homo Sapiens
IFPGAPGFW

SEQ ID NO: 464393 - protein, 9 aa, Homo Sapiens
LPGIPRPIF

SEQ ID NO: 464394 - protein, 9 aa, Homo Sapiens
REAVRVLVR

SEQ ID NO: 464395 - protein, 9 aa, Homo Sapiens
GFPLNVPAI

SEQ ID NO: 464396 - protein, 9 aa, Homo Sapiens
SFNLFSATE

SEQ ID NO: 464397 - protein, 9 aa, Homo Sapiens
YDVLVHAGW

SEQ ID NO: 464398 - protein, 9 aa, Homo Sapiens
IYMLATDHS

SEQ ID NO: 464399 - protein, 9 aa, Homo Sapiens
GIPQSWRLC

SEQ ID NO: 464400 - protein, 9 aa, Homo Sapiens
WKVDFLRGC

SEQ ID NO: 464401 - protein, 9 aa, Homo Sapiens
TYYSVKTPI

SEQ ID NO: 464402 - protein, 9 aa, Homo Sapiens
ELQERVLRG

SEQ ID NO: 464403 - protein, 9 aa, Homo Sapiens
FQVQPGLPP

SEQ ID NO: 464404 - protein, 9 aa, Homo Sapiens
STHGRVGEE

SEQ ID NO: 464405 - protein, 9 aa, Homo Sapiens
CEVIREWKT

SEQ ID NO: 464406 - protein, 9 aa, Homo Sapiens
QMTHMKASS

SEQ ID NO: 464407 - protein, 9 aa, Homo Sapiens
LLSGLCRSP

SEQ ID NO: 464408 - protein, 9 aa, Homo Sapiens
RFNHRRCRA

SEQ ID NO: 464409 - protein, 9 aa, Homo Sapiens
WPPQMTHMK

SEQ ID NO: 464410 - protein, 9 aa, Homo Sapiens
LLVIKCVLI

SEQ ID NO: 464411 - protein, 9 aa, Homo Sapiens
PSRSFVHLE

SEQ ID NO: 464412 - protein, 9 aa, Homo Sapiens
MGAQGPPGP

SEQ ID NO: 464413 - protein, 9 aa, Homo Sapiens
KELQERVLR

SEQ ID NO: 464414 - protein, 9 aa, Homo Sapiens
RFNPSCREW

SEQ ID NO: 464415 - protein, 9 aa, Homo Sapiens
LEELEGTRT

SEQ ID NO: 464416 - protein, 9 aa, Homo Sapiens
KGKKAASKG

SEQ ID NO: 464417 - protein, 9 aa, Homo Sapiens
SGLCRSPYA

SEQ ID NO: 464418 - protein, 9 aa, Homo Sapiens
MAVWWLHGA

SEQ ID NO: 464419 - protein, 9 aa, Homo Sapiens
FPQILGVVL

SEQ ID NO: 464420 - protein, 9 aa, Homo Sapiens
HGSYIHMAA

SEQ ID NO: 464421 - protein, 9 aa, Homo Sapiens
LDVVINFRH

SEQ ID NO: 464422 - protein, 9 aa, Homo Sapiens
QGPPGPAGA

SEQ ID NO: 464423 - protein, 9 aa, Homo Sapiens
KTNQIRKAM

SEQ ID NO: 464424 - protein, 9 aa, Homo Sapiens
TNQDLLVIK

SEQ ID NO: 464425 - protein, 9 aa, Homo Sapiens
ADPIIYMLA

SEQ ID NO: 464426 - protein, 9 aa, Homo Sapiens
HILAILALH

SEQ ID NO: 464427 - protein, 9 aa, Homo Sapiens
HNLKELQER

SEQ ID NO: 464428 - protein, 9 aa, Homo Sapiens
PRMPSDHYN

SEQ ID NO: 464429 - protein, 9 aa, Homo Sapiens
EAYGLAMLW

SEQ ID NO: 464430 - protein, 9 aa, Homo Sapiens
AYGLAMLWG

SEQ ID NO: 464431 - protein, 9 aa, Homo Sapiens
SSVTSESMR

SEQ ID NO: 464432 - protein, 9 aa, Homo Sapiens
YTLYRITVA

SEQ ID NO: 464433 - protein, 9 aa, Homo Sapiens
PSSQVIIIA

SEQ ID NO: 464434 - protein, 9 aa, Homo Sapiens
MELSIAVQR

SEQ ID NO: 464435 - protein, 9 aa, Homo Sapiens
QSWRLCLVN

SEQ ID NO: 464436 - protein, 9 aa, Homo Sapiens
GHNLKELQE

SEQ ID NO: 464437 - protein, 9 aa, Homo Sapiens
ARRGWTYYS

SEQ ID NO: 464438 - protein, 9 aa, Homo Sapiens
DLSMLDSIW

SEQ ID NO: 464439 - protein, 9 aa, Homo Sapiens
PESTHGRVG

SEQ ID NO: 464440 - protein, 9 aa, Homo Sapiens
EKVQVGDDL

SEQ ID NO: 464441 - protein, 9 aa, Homo Sapiens
IPQSWRLCL

SEQ ID NO: 464442 - protein, 9 aa, Homo Sapiens
KASSVTSES

SEQ ID NO: 464443 - protein, 9 aa, Homo Sapiens
GAVREDVIV

SEQ ID NO: 464444 - protein, 9 aa, Homo Sapiens
PQILGVVLA

SEQ ID NO: 464445 - protein, 9 aa, Homo Sapiens
LCLVNLCQR

SEQ ID NO: 464446 - protein, 9 aa, Homo Sapiens
YGLAMLWGM

SEQ ID NO: 464447 - protein, 9 aa, Homo Sapiens
RLCSGSCFS

SEQ ID NO: 464448 - protein, 9 aa, Homo Sapiens
ILALHRLGR

SEQ ID NO: 464449 - protein, 9 aa, Homo Sapiens
EGQGANLAD

SEQ ID NO: 464450 - protein, 9 aa, Homo Sapiens
RKILNLCVF

SEQ ID NO: 464451 - protein, 9 aa, Homo Sapiens
SSSSRLHSC

SEQ ID NO: 464452 - protein, 9 aa, Homo Sapiens
GGGWDGGGL

SEQ ID NO: 464453 - protein, 9 aa, Homo Sapiens
LSMLDSIWK

SEQ ID NO: 464454 - protein, 9 aa, Homo Sapiens
SILQNLDLW

SEQ ID NO: 464455 - protein, 9 aa, Homo Sapiens
LPRPRWPPQ

SEQ ID NO: 464456 - protein, 9 aa, Homo Sapiens
KTKDSGYPF

SEQ ID NO: 464457 - protein, 9 aa, Homo Sapiens
VQPGLPPTP

SEQ ID NO: 464458 - protein, 9 aa, Homo Sapiens
FPLNVPAIR

SEQ ID NO: 464459 - protein, 9 aa, Homo Sapiens
KKAASKGPN

SEQ ID NO: 464460 - protein, 9 aa, Homo Sapiens
RKRLCKRDS

SEQ ID NO: 464461 - protein, 9 aa, Homo Sapiens
HSCSSPSTK

SEQ ID NO: 464462 - protein, 9 aa, Homo Sapiens
GTRTVLNAR

SEQ ID NO: 464463 - protein, 9 aa, Homo Sapiens
AGAPESTHG

SEQ ID NO: 464464 - protein, 9 aa, Homo Sapiens
QDLLVIKCV

SEQ ID NO: 464465 - protein, 9 aa, Homo Sapiens
NYGDARKII

SEQ ID NO: 464466 - protein, 9 aa, Homo Sapiens
PKSEADTSA

SEQ ID NO: 464467 - protein, 9 aa, Homo Sapiens
DNFRKNFCS

SEQ ID NO: 464468 - protein, 9 aa, Homo Sapiens
THMKASSVT

SEQ ID NO: 464469 - protein, 9 aa, Homo Sapiens
LNVPAIRGA

SEQ ID NO: 464470 - protein, 9 aa, Homo Sapiens
TTVEGQGAN

SEQ ID NO: 464471 - protein, 9 aa, Homo Sapiens
VFQVQPGLP

SEQ ID NO: 464472 - protein, 9 aa, Homo Sapiens
EVLQDSQDR

SEQ ID NO: 464473 - protein, 9 aa, Homo Sapiens
KTCPAVVMG

SEQ ID NO: 464474 - protein, 9 aa, Homo Sapiens
EATASKHLC

SEQ ID NO: 464475 - protein, 9 aa, Homo Sapiens
APGLMGAQG

SEQ ID NO: 464476 - protein, 9 aa, Homo Sapiens
KTIYETEVF

SEQ ID NO: 464477 - protein, 9 aa, Homo Sapiens
TRTVLNARV

SEQ ID NO: 464478 - protein, 9 aa, Homo Sapiens
HAKWLMMAE

SEQ ID NO: 464479 - protein, 9 aa, Homo Sapiens
GKRTYTLYR

SEQ ID NO: 464480 - protein, 9 aa, Homo Sapiens
VVHRLCSGS

SEQ ID NO: 464481 - protein, 9 aa, Homo Sapiens
KRLCKRDSQ

SEQ ID NO: 464482 - protein, 9 aa, Homo Sapiens
LYDVLVHAG

SEQ ID NO: 464483 - protein, 9 aa, Homo Sapiens
HGFFGSRMT

SEQ ID NO: 464484 - protein, 9 aa, Homo Sapiens
DSLDLDLSM

SEQ ID NO: 464485 - protein, 9 aa, Homo Sapiens
QILGVVLAN

SEQ ID NO: 464486 - protein, 9 aa, Homo Sapiens
WTELQSMSP

SEQ ID NO: 464487 - protein, 9 aa, Homo Sapiens
NSGKRTYTL

SEQ ID NO: 464488 - protein, 9 aa, Homo Sapiens
WGMGWKPGE

SEQ ID NO: 464489 - protein, 9 aa, Homo Sapiens
TNNKTGCRL

SEQ ID NO: 464490 - protein, 9 aa, Homo Sapiens
VPTWKMAAR

SEQ ID NO: 464491 - protein, 9 aa, Homo Sapiens
SEGEKVQVG

SEQ ID NO: 464492 - protein, 9 aa, Homo Sapiens
GAPGLMGAQ

SEQ ID NO: 464493 - protein, 9 aa, Homo Sapiens
NLDLWGQSI

SEQ ID NO: 464494 - protein, 9 aa, Homo Sapiens
LKCHHRLHT

SEQ ID NO: 464495 - protein, 9 aa, Homo Sapiens
QHTEEMVQD

SEQ ID NO: 464496 - protein, 9 aa, Homo Sapiens
NNKTGCRLQ

SEQ ID NO: 464497 - protein, 9 aa, Homo Sapiens
PEVLQDSQD

SEQ ID NO: 464498 - protein, 9 aa, Homo Sapiens
LLSRYPMEQ

SEQ ID NO: 464499 - protein, 9 aa, Homo Sapiens
ELEGTRTVL

SEQ ID NO: 464500 - protein, 9 aa, Homo Sapiens
TLYRITVAL

SEQ ID NO: 464501 - protein, 9 aa, Homo Sapiens
DVVINFRHL

SEQ ID NO: 464502 - protein, 9 aa, Homo Sapiens
ETSVILSMN

SEQ ID NO: 464503 - protein, 9 aa, Homo Sapiens
CRETSRSHT

SEQ ID NO: 464504 - protein, 9 aa, Homo Sapiens
QELTLKCHH

SEQ ID NO: 464505 - protein, 9 aa, Homo Sapiens
VLQDSQDRC

SEQ ID NO: 464506 - protein, 9 aa, Homo Sapiens
LHSCSSPST

SEQ ID NO: 464507 - protein, 9 aa, Homo Sapiens
NDVKTIYET

SEQ ID NO: 464508 - protein, 9 aa, Homo Sapiens
VPHTAPPHL

SEQ ID NO: 464509 - protein, 8 aa, Homo Sapiens
AQRQPHSP

SEQ ID NO: 464510 - protein, 9 aa, Homo Sapiens
RRWNRFNHR

SEQ ID NO: 464511 - protein, 9 aa, Homo Sapiens
HEKDMELSI

SEQ ID NO: 464512 - protein, 9 aa, Homo Sapiens
HTAPPHLQE

SEQ ID NO: 464513 - protein, 9 aa, Homo Sapiens
RMPSDHYNW

SEQ ID NO: 464514 - protein, 9 aa, Homo Sapiens
AMLWGMGWK

SEQ ID NO: 464515 - protein, 9 aa, Homo Sapiens
TSESMRLPF

SEQ ID NO: 464516 - protein, 9 aa, Homo Sapiens
QGANLADLG

SEQ ID NO: 464517 - protein, 9 aa, Homo Sapiens
NNNRDLDLD

SEQ ID NO: 464518 - protein, 9 aa, Homo Sapiens
SVTSESMRL

SEQ ID NO: 464519 - protein, 9 aa, Homo Sapiens
REWKTGESL

SEQ ID NO: 464520 - protein, 9 aa, Homo Sapiens
RPIFPGAPG

SEQ ID NO: 464521 - protein, 9 aa, Homo Sapiens
HTEEMVQDF

SEQ ID NO: 464522 - protein, 9 aa, Homo Sapiens
SSSRLHSCS

SEQ ID NO: 464523 - protein, 9 aa, Homo Sapiens
SVVHRLCSG

SEQ ID NO: 464524 - protein, 9 aa, Homo Sapiens
TREKAQSQP

SEQ ID NO: 464525 - protein, 9 aa, Homo Sapiens
KDTLVCRRD

SEQ ID NO: 464526 - protein, 9 aa, Homo Sapiens
ENTWSKPEY

SEQ ID NO: 464527 - protein, 9 aa, Homo Sapiens
GMAVWWLHG

SEQ ID NO: 464528 - protein, 9 aa, Homo Sapiens
HELPKSEAD

SEQ ID NO: 464529 - protein, 9 aa, Homo Sapiens
ETSRSHTRK

SEQ ID NO: 464530 - protein, 9 aa, Homo Sapiens
VPSSQVIII

SEQ ID NO: 464531 - protein, 9 aa, Homo Sapiens
WCFLFPFQY

SEQ ID NO: 464532 - protein, 9 aa, Homo Sapiens
GILHSNYGD

SEQ ID NO: 464533 - protein, 9 aa, Homo Sapiens
IIDSVKTNQ

SEQ ID NO: 464534 - protein, 9 aa, Homo Sapiens
VTPLSVINA

SEQ ID NO: 464535 - protein, 9 aa, Homo Sapiens
FESFNLFSA

SEQ ID NO: 464536 - protein, 9 aa, Homo Sapiens
ILNLCVFED

SEQ ID NO: 464537 - protein, 9 aa, Homo Sapiens
ENPQHTEEM

SEQ ID NO: 464538 - protein, 9 aa, Homo Sapiens
PTPPVFQVQ

SEQ ID NO: 464539 - protein, 9 aa, Homo Sapiens
VVMGENNTL

SEQ ID NO: 464540 - protein, 9 aa, Homo Sapiens
LYRITVALT

SEQ ID NO: 464541 - protein, 9 aa, Homo Sapiens
GSDDSKMED

SEQ ID NO: 464542 - protein, 9 aa, Homo Sapiens
VRFNPSCRE

SEQ ID NO: 464543 - protein, 9 aa, Homo Sapiens
REKAQSQPC

SEQ ID NO: 464544 - protein, 9 aa, Homo Sapiens
FLRGCCKPR

SEQ ID NO: 464545 - protein, 9 aa, Homo Sapiens
GYPFIIFSH

SEQ ID NO: 464546 - protein, 9 aa, Homo Sapiens
LDCPIKKGP

SEQ ID NO: 464547 - protein, 9 aa, Homo Sapiens
LSFQKILPD

SEQ ID NO: 464548 - protein, 9 aa, Homo Sapiens
SLDLDLSML

SEQ ID NO: 464549 - protein, 9 aa, Homo Sapiens
LGMAVWWLH

SEQ ID NO: 464550 - protein, 9 aa, Homo Sapiens
RHLSEGDLF

SEQ ID NO: 464551 - protein, 9 aa, Homo Sapiens
SDDSKMEDE

SEQ ID NO: 464552 - protein, 9 aa, Homo Sapiens
NLADLGATK

SEQ ID NO: 464553 - protein, 9 aa, Homo Sapiens
ECGSHGWGV

SEQ ID NO: 464554 - protein, 9 aa, Homo Sapiens
HKQQRVIDL

SEQ ID NO: 464555 - protein, 9 aa, Homo Sapiens
SFITQTPGE

SEQ ID NO: 464556 - protein, 9 aa, Homo Sapiens
HAKLQSTRR

SEQ ID NO: 464557 - protein, 9 aa, Homo Sapiens
VLENLEITY

SEQ ID NO: 464558 - protein, 9 aa, Homo Sapiens
ERWHKQQRV

SEQ ID NO: 464559 - protein, 9 aa, Homo Sapiens
SNIDSLKEG

SEQ ID NO: 464560 - protein, 9 aa, Homo Sapiens
PWDRRGACS

SEQ ID NO: 464561 - protein, 9 aa, Homo Sapiens
RPQPGDGEW

SEQ ID NO: 464562 - protein, 9 aa, Homo Sapiens
QKPSFFFFS

SEQ ID NO: 464563 - protein, 9 aa, Homo Sapiens
GARRALLLA

SEQ ID NO: 464564 - protein, 9 aa, Homo Sapiens
CDSRINHFF

SEQ ID NO: 464565 - protein, 9 aa, Homo Sapiens
ALPAMMQWD

SEQ ID NO: 464566 - protein, 9 aa, Homo Sapiens
LSSMFSGRF

SEQ ID NO: 464567 - protein, 9 aa, Homo Sapiens
FPDAWDSDE

SEQ ID NO: 464568 - protein, 9 aa, Homo Sapiens
AETKSGVML

SEQ ID NO: 464569 - protein, 9 aa, Homo Sapiens
WDRTQKPGE

SEQ ID NO: 464570 - protein, 9 aa, Homo Sapiens
ATREPGGYA

SEQ ID NO: 464571 - protein, 9 aa, Homo Sapiens
AALSECGSH

SEQ ID NO: 464572 - protein, 9 aa, Homo Sapiens
NKTEICYQL

SEQ ID NO: 464573 - protein, 9 aa, Homo Sapiens
ALHLACASD

SEQ ID NO: 464574 - protein, 9 aa, Homo Sapiens
RINHFFCDT

SEQ ID NO: 464575 - protein, 9 aa, Homo Sapiens
GACSQGKGR

SEQ ID NO: 464576 - protein, 9 aa, Homo Sapiens
EASFSNPKT

SEQ ID NO: 464577 - protein, 9 aa, Homo Sapiens
RFKDSMLSS

SEQ ID NO: 464578 - protein, 9 aa, Homo Sapiens
SFFSHHFGE

SEQ ID NO: 464579 - protein, 9 aa, Homo Sapiens
KKKKNPLLQ

SEQ ID NO: 464580 - protein, 9 aa, Homo Sapiens
GSRSLSGYG

SEQ ID NO: 464581 - protein, 9 aa, Homo Sapiens
IFPDAWDSD

SEQ ID NO: 464582 - protein, 9 aa, Homo Sapiens
HNLEKQITT

SEQ ID NO: 464583 - protein, 9 aa, Homo Sapiens
LHLACASDH

SEQ ID NO: 464584 - protein, 9 aa, Homo Sapiens
INKTEICYQ

SEQ ID NO: 464585 - protein, 9 aa, Homo Sapiens
PQPGDGEWR

SEQ ID NO: 464586 - protein, 9 aa, Homo Sapiens
PMNPKSTRA

SEQ ID NO: 464587 - protein, 9 aa, Homo Sapiens
TFRSCSEIR

SEQ ID NO: 464588 - protein, 9 aa, Homo Sapiens
LGNLKINVP

SEQ ID NO: 464589 - protein, 9 aa, Homo Sapiens
GAPPRAAHG

SEQ ID NO: 464590 - protein, 9 aa, Homo Sapiens
EALQGAPSA

SEQ ID NO: 464591 - protein, 9 aa, Homo Sapiens
NLKINVPTL

SEQ ID NO: 464592 - protein, 9 aa, Homo Sapiens
RARGPPSRG

SEQ ID NO: 464593 - protein, 9 aa, Homo Sapiens
FPDELTFRS

SEQ ID NO: 464594 - protein, 9 aa, Homo Sapiens
DAILTSATM

SEQ ID NO: 464595 - protein, 9 aa, Homo Sapiens
HQGFPDELT

SEQ ID NO: 464596 - protein, 9 aa, Homo Sapiens
ATMGCLLLG

SEQ ID NO: 464597 - protein, 9 aa, Homo Sapiens
KTQDHLRQQ

SEQ ID NO: 464598 - protein, 9 aa, Homo Sapiens
MANGATREP

SEQ ID NO: 464599 - protein, 9 aa, Homo Sapiens
SGYGYGCGS

SEQ ID NO: 464600 - protein, 9 aa, Homo Sapiens
REKVRKETN

SEQ ID NO: 464601 - protein, 9 aa, Homo Sapiens
SRGPPGPNE

SEQ ID NO: 464602 - protein, 9 aa, Homo Sapiens
LQGAPSATN

SEQ ID NO: 464603 - protein, 9 aa, Homo Sapiens
FHAKLQSTR

SEQ ID NO: 464604 - protein, 9 aa, Homo Sapiens
AMMQWDRTQ

SEQ ID NO: 464605 - protein, 9 aa, Homo Sapiens
DELTFRSCS

SEQ ID NO: 464606 - protein, 9 aa, Homo Sapiens
FFFSRPSPK

SEQ ID NO: 464607 - protein, 9 aa, Homo Sapiens
DHVKVVTLL

SEQ ID NO: 464608 - protein, 9 aa, Homo Sapiens
NPLLQMFSF

SEQ ID NO: 464609 - protein, 9 aa, Homo Sapiens
KETNTRSFD

SEQ ID NO: 464610 - protein, 9 aa, Homo Sapiens
SHHFGEHII

SEQ ID NO: 464611 - protein, 9 aa, Homo Sapiens
HGNEVISVM

SEQ ID NO: 464612 - protein, 9 aa, Homo Sapiens
LLLGNLKIN

SEQ ID NO: 464613 - protein, 9 aa, Homo Sapiens
ITTLHAQVA

SEQ ID NO: 464614 - protein, 9 aa, Homo Sapiens
PSATNAIAP

SEQ ID NO: 464615 - protein, 9 aa, Homo Sapiens
YGSRSLSGY

SEQ ID NO: 464616 - protein, 9 aa, Homo Sapiens
SRINHFFCD

SEQ ID NO: 464617 - protein, 9 aa, Homo Sapiens
LACASDHVK

SEQ ID NO: 464618 - protein, 9 aa, Homo Sapiens
MIFPDAWDS

SEQ ID NO: 464619 - protein, 9 aa, Homo Sapiens
FFSFFSHHF

SEQ ID NO: 464620 - protein, 9 aa, Homo Sapiens
GIVMPMNPK

SEQ ID NO: 464621 - protein, 9 aa, Homo Sapiens
ETKSGVMLQ

SEQ ID NO: 464622 - protein, 9 aa, Homo Sapiens
RSLSGYGYG

SEQ ID NO: 464623 - protein, 9 aa, Homo Sapiens
SLKEGFKMV

SEQ ID NO: 464624 - protein, 9 aa, Homo Sapiens
EEQIAAETK

SEQ ID NO: 464625 - protein, 9 aa, Homo Sapiens
ELTFRSCSE

SEQ ID NO: 464626 - protein, 9 aa, Homo Sapiens
QGFPDELTF

SEQ ID NO: 464627 - protein, 9 aa, Homo Sapiens
EGFKMVNRL

SEQ ID NO: 464628 - protein, 9 aa, Homo Sapiens
SSLAFCDSR

SEQ ID NO: 464629 - protein, 9 aa, Homo Sapiens
WRYREASAR

SEQ ID NO: 464630 - protein, 9 aa, Homo Sapiens
CMIFPDAWD

SEQ ID NO: 464631 - protein, 9 aa, Homo Sapiens
PFHAKLQST

SEQ ID NO: 464632 - protein, 9 aa, Homo Sapiens
KSGVMLQSM

SEQ ID NO: 464633 - protein, 9 aa, Homo Sapiens
AHKLITTER

SEQ ID NO: 464634 - protein, 9 aa, Homo Sapiens
GPPGPNEAP

SEQ ID NO: 464635 - protein, 9 aa, Homo Sapiens
MDVNVLTGF

SEQ ID NO: 464636 - protein, 9 aa, Homo Sapiens
RGPPSRGPP

SEQ ID NO: 464637 - protein, 9 aa, Homo Sapiens
WHKQQRVID

SEQ ID NO: 464638 - protein, 9 aa, Homo Sapiens
VGSMDVNVL

SEQ ID NO: 464639 - protein, 9 aa, Homo Sapiens
RRGACSQGK

SEQ ID NO: 464640 - protein, 9 aa, Homo Sapiens
HKLITTERA

SEQ ID NO: 464641 - protein, 9 aa, Homo Sapiens
PGPNEAPPP

SEQ ID NO: 464642 - protein, 9 aa, Homo Sapiens
ACSQGKGRR

SEQ ID NO: 464643 - protein, 9 aa, Homo Sapiens
LEKQITTLH

SEQ ID NO: 464644 - protein, 9 aa, Homo Sapiens
CGSHGWGVH

SEQ ID NO: 464645 - protein, 9 aa, Homo Sapiens
PPSRGPPGP

SEQ ID NO: 464646 - protein, 9 aa, Homo Sapiens
HFGEHIIPP

SEQ ID NO: 464647 - protein, 9 aa, Homo Sapiens
GNSLHPIVH

SEQ ID NO: 464648 - protein, 9 aa, Homo Sapiens
DGEWRYREA

SEQ ID NO: 464649 - protein, 9 aa, Homo Sapiens
PLLQMFSFK

SEQ ID NO: 464650 - protein, 9 aa, Homo Sapiens
YGYGSRSLS

SEQ ID NO: 464651 - protein, 9 aa, Homo Sapiens
NLEKQITTL

SEQ ID NO: 464652 - protein, 9 aa, Homo Sapiens
SMDVNVLTG

SEQ ID NO: 464653 - protein, 9 aa, Homo Sapiens
KHNLEKQIT

SEQ ID NO: 464654 - protein, 9 aa, Homo Sapiens
THGNEVISV

SEQ ID NO: 464655 - protein, 9 aa, Homo Sapiens
NVPTLGPKE

SEQ ID NO: 464656 - protein, 9 aa, Homo Sapiens
SLAFCDSRI

SEQ ID NO: 464657 - protein, 9 aa, Homo Sapiens
DHLRQQRAS

SEQ ID NO: 464658 - protein, 9 aa, Homo Sapiens
MGARRALLL

SEQ ID NO: 464659 - protein, 9 aa, Homo Sapiens
PDAWDSDEV

SEQ ID NO: 464660 - protein, 9 aa, Homo Sapiens
KINSDQGTP

SEQ ID NO: 464661 - protein, 9 aa, Homo Sapiens
NYERWHKQQ

SEQ ID NO: 464662 - protein, 9 aa, Homo Sapiens
SATNAIAPV

SEQ ID NO: 464663 - protein, 9 aa, Homo Sapiens
NVLTGFVLI

SEQ ID NO: 464664 - protein, 9 aa, Homo Sapiens
PGDGEWRYR

SEQ ID NO: 464665 - protein, 9 aa, Homo Sapiens
VSFITQTPG

SEQ ID NO: 464666 - protein, 9 aa, Homo Sapiens
RGPPGPNEA

SEQ ID NO: 464667 - protein, 9 aa, Homo Sapiens
EKEASFSNP

SEQ ID NO: 464668 - protein, 9 aa, Homo Sapiens
SMLSSMFSG

SEQ ID NO: 464669 - protein, 9 aa, Homo Sapiens
LKEGFKMVN

SEQ ID NO: 464670 - protein, 9 aa, Homo Sapiens
LSGYGYGCG

SEQ ID NO: 464671 - protein, 9 aa, Homo Sapiens
HLACASDHV

SEQ ID NO: 464672 - protein, 9 aa, Homo Sapiens
RESSVQEDV

SEQ ID NO: 464673 - protein, 9 aa, Homo Sapiens
FHVREKVRK

SEQ ID NO: 464674 - protein, 9 aa, Homo Sapiens
PSFFFFSRP

SEQ ID NO: 464675 - protein, 9 aa, Homo Sapiens
EAPPPSWTP

SEQ ID NO: 464676 - protein, 9 aa, Homo Sapiens
CRFKDSMLS

SEQ ID NO: 464677 - protein, 9 aa, Homo Sapiens
KQQRVIDLA

SEQ ID NO: 464678 - protein, 9 aa, Homo Sapiens
PAMMQWDRT

SEQ ID NO: 464679 - protein, 9 aa, Homo Sapiens
DVNVLTGFV

SEQ ID NO: 464680 - protein, 9 aa, Homo Sapiens
CRVSFITQT

SEQ ID NO: 464681 - protein, 9 aa, Homo Sapiens
EQIAAETKS

SEQ ID NO: 464682 - protein, 9 aa, Homo Sapiens
IDSLKEGFK

SEQ ID NO: 464683 - protein, 9 aa, Homo Sapiens
TQDHLRQQR

SEQ ID NO: 464684 - protein, 9 aa, Homo Sapiens
LENLEITYV

SEQ ID NO: 464685 - protein, 9 aa, Homo Sapiens
CNTTHGNEV

SEQ ID NO: 464686 - protein, 9 aa, Homo Sapiens
SISGAQKGR

SEQ ID NO: 464687 - protein, 9 aa, Homo Sapiens
IVHVVMGDI

SEQ ID NO: 464688 - protein, 9 aa, Homo Sapiens
LGCMIFPDA

SEQ ID NO: 464689 - protein, 9 aa, Homo Sapiens
LQMFSFKAP

SEQ ID NO: 464690 - protein, 9 aa, Homo Sapiens
ILHPFHAKL

SEQ ID NO: 464691 - protein, 9 aa, Homo Sapiens
QGTPCHLRS

SEQ ID NO: 464692 - protein, 9 aa, Homo Sapiens
LPAMMQWDR

SEQ ID NO: 464693 - protein, 9 aa, Homo Sapiens
IRESSVQED

SEQ ID NO: 464694 - protein, 9 aa, Homo Sapiens
QDHLRQQRA

SEQ ID NO: 464695 - protein, 9 aa, Homo Sapiens
ISGAQKGRK

SEQ ID NO: 464696 - protein, 9 aa, Homo Sapiens
EVVLENLEI

SEQ ID NO: 464697 - protein, 9 aa, Homo Sapiens
QMFSFKAPT

SEQ ID NO: 464698 - protein, 9 aa, Homo Sapiens
FKDSMLSSM

SEQ ID NO: 464699 - protein, 9 aa, Homo Sapiens
GFPDELTFR

SEQ ID NO: 464700 - protein, 9 aa, Homo Sapiens
GPPSRGPPG

SEQ ID NO: 464701 - protein, 9 aa, Homo Sapiens
ANGATREPG

SEQ ID NO: 464702 - protein, 9 aa, Homo Sapiens
QRVIDLAFS

SEQ ID NO: 464703 - protein, 9 aa, Homo Sapiens
KVRKETNTR

SEQ ID NO: 464704 - protein, 9 aa, Homo Sapiens
RWHKQQRVI

SEQ ID NO: 464705 - protein, 9 aa, Homo Sapiens
ARGPPSRGP

SEQ ID NO: 464706 - protein, 9 aa, Homo Sapiens
NTTHGNEVI

SEQ ID NO: 464707 - protein, 9 aa, Homo Sapiens
VQEDVEWYQ

SEQ ID NO: 464708 - protein, 9 aa, Homo Sapiens
VLTGFVLIP

SEQ ID NO: 464709 - protein, 9 aa, Homo Sapiens
SCRVSFITQ

SEQ ID NO: 464710 - protein, 9 aa, Homo Sapiens
VEKEASFSN

SEQ ID NO: 464711 - protein, 9 aa, Homo Sapiens
TSATMGCLL

SEQ ID NO: 464712 - protein, 9 aa, Homo Sapiens
DGIVMPMNP

SEQ ID NO: 464713 - protein, 9 aa, Homo Sapiens
ENLEITYVQ

SEQ ID NO: 464714 - protein, 9 aa, Homo Sapiens
SATMGCLLL

SEQ ID NO: 464715 - protein, 9 aa, Homo Sapiens
GATREPGGY

SEQ ID NO: 464716 - protein, 9 aa, Homo Sapiens
LRQQRASAR

SEQ ID NO: 464717 - protein, 9 aa, Homo Sapiens
VMPMNPKST

SEQ ID NO: 464718 - protein, 9 aa, Homo Sapiens
LTSATMGCL

SEQ ID NO: 464719 - protein, 9 aa, Homo Sapiens
FKINSDQGT

SEQ ID NO: 464720 - protein, 9 aa, Homo Sapiens
PPMANGATR

SEQ ID NO: 464721 - protein, 9 aa, Homo Sapiens
TRARGPPSR

SEQ ID NO: 464722 - protein, 9 aa, Homo Sapiens
SDHVKVVTL

SEQ ID NO: 464723 - protein, 9 aa, Homo Sapiens
NNCEVVLEN

SEQ ID NO: 464724 - protein, 9 aa, Homo Sapiens
KDSMLSSMF

SEQ ID NO: 464725 - protein, 9 aa, Homo Sapiens
SPKTQDHLR

SEQ ID NO: 464726 - protein, 9 aa, Homo Sapiens
INSDQGTPC

SEQ ID NO: 464727 - protein, 9 aa, Homo Sapiens
GDGEWRYRE

SEQ ID NO: 464728 - protein, 9 aa, Homo Sapiens
AAETKSGVM

SEQ ID NO: 464729 - protein, 9 aa, Homo Sapiens
LTFRSCSEI

SEQ ID NO: 464730 - protein, 9 aa, Homo Sapiens
KKNPLLQMF

SEQ ID NO: 464731 - protein, 9 aa, Homo Sapiens
ESSVQEDVE

SEQ ID NO: 464732 - protein, 9 aa, Homo Sapiens
LSECGSHGW

SEQ ID NO: 464733 - protein, 9 aa, Homo Sapiens
EKQITTLHA

SEQ ID NO: 464734 - protein, 9 aa, Homo Sapiens
NDIRESSVQ

SEQ ID NO: 464735 - protein, 9 aa, Homo Sapiens
MLSSMFSGR

SEQ ID NO: 464736 - protein, 9 aa, Homo Sapiens
SHGWGVHNC

SEQ ID NO: 464737 - protein, 9 aa, Homo Sapiens
QQRVIDLAF

SEQ ID NO: 464738 - protein, 9 aa, Homo Sapiens
YVAILHPFH

SEQ ID NO: 464739 - protein, 9 aa, Homo Sapiens
EKVRKETNT

SEQ ID NO: 464740 - protein, 9 aa, Homo Sapiens
RVSFITQTP

SEQ ID NO: 464741 - protein, 9 aa, Homo Sapiens
PPPSWTPAS

SEQ ID NO: 464742 - protein, 9 aa, Homo Sapiens
AILTSATMG

SEQ ID NO: 464743 - protein, 9 aa, Homo Sapiens
GPNEAPPPS

SEQ ID NO: 464744 - protein, 9 aa, Homo Sapiens
LSKEQTSIS

SEQ ID NO: 464745 - protein, 9 aa, Homo Sapiens
KKKNPLLQM

SEQ ID NO: 464746 - protein, 9 aa, Homo Sapiens
KLITTERAK

SEQ ID NO: 464747 - protein, 9 aa, Homo Sapiens
ASFSNPKTT

SEQ ID NO: 464748 - protein, 9 aa, Homo Sapiens
EWRYREASA

SEQ ID NO: 464749 - protein, 9 aa, Homo Sapiens
VRKETNTRS

SEQ ID NO: 464750 - protein, 9 aa, Homo Sapiens
AERKAHKLI

SEQ ID NO: 464751 - protein, 9 aa, Homo Sapiens
IVMPMNPKS

SEQ ID NO: 464752 - protein, 9 aa, Homo Sapiens
FSFFSHHFG

SEQ ID NO: 464753 - protein, 9 aa, Homo Sapiens
PDELTFRSC

SEQ ID NO: 464754 - protein, 9 aa, Homo Sapiens
HHFGEHIIP

SEQ ID NO: 464755 - protein, 9 aa, Homo Sapiens
GSMDVNVLT

SEQ ID NO: 464756 - protein, 9 aa, Homo Sapiens
CASDHVKVV

SEQ ID NO: 464757 - protein, 9 aa, Homo Sapiens
FFSRPSPKT

SEQ ID NO: 464758 - protein, 9 aa, Homo Sapiens
HPFHAKLQS

SEQ ID NO: 464759 - protein, 9 aa, Homo Sapiens
VVLENLEIT

SEQ ID NO: 464760 - protein, 9 aa, Homo Sapiens
SGAPPRAAH

SEQ ID NO: 464761 - protein, 9 aa, Homo Sapiens
FSHHFGEHI

SEQ ID NO: 464762 - protein, 9 aa, Homo Sapiens
SFSNPKTTS

SEQ ID NO: 464763 - protein, 9 aa, Homo Sapiens
RRALLLALL

SEQ ID NO: 464764 - protein, 9 aa, Homo Sapiens
PPGPNEAPP

SEQ ID NO: 464765 - protein, 9 aa, Homo Sapiens
ERKAHKLIT

SEQ ID NO: 464766 - protein, 9 aa, Homo Sapiens
GTPCHLRSP

SEQ ID NO: 464767 - protein, 9 aa, Homo Sapiens
YERWHKQQR

SEQ ID NO: 464768 - protein, 9 aa, Homo Sapiens
HPIVHVVMG

SEQ ID NO: 464769 - protein, 9 aa, Homo Sapiens
ARRALLLAL

SEQ ID NO: 464770 - protein, 9 aa, Homo Sapiens
TQTPGERSH

SEQ ID NO: 464771 - protein, 9 aa, Homo Sapiens
TSISGAQKG

SEQ ID NO: 464772 - protein, 9 aa, Homo Sapiens
LGTVEKEAS

SEQ ID NO: 464773 - protein, 9 aa, Homo Sapiens
QIAAETKSG

SEQ ID NO: 464774 - protein, 9 aa, Homo Sapiens
GPWDRRGAC

SEQ ID NO: 464775 - protein, 9 aa, Homo Sapiens
RGACSQGKG

SEQ ID NO: 464776 - protein, 9 aa, Homo Sapiens
TTLHAQVAD

SEQ ID NO: 464777 - protein, 9 aa, Homo Sapiens
DAERKAHKL

SEQ ID NO: 464778 - protein, 9 aa, Homo Sapiens
GLSKEQTSI

SEQ ID NO: 464779 - protein, 9 aa, Homo Sapiens
NQCNTTHGN

SEQ ID NO: 464780 - protein, 9 aa, Homo Sapiens
HGWGVHNCF

SEQ ID NO: 464781 - protein, 9 aa, Homo Sapiens
GEWRYREAS

SEQ ID NO: 464782 - protein, 9 aa, Homo Sapiens
FNQCNTTHG

SEQ ID NO: 464783 - protein, 9 aa, Homo Sapiens
ASDHVKVVT

SEQ ID NO: 464784 - protein, 9 aa, Homo Sapiens
QWDRTQKPG

SEQ ID NO: 464785 - protein, 9 aa, Homo Sapiens
PIVHVVMGD

SEQ ID NO: 464786 - protein, 9 aa, Homo Sapiens
MPMNPKSTR

SEQ ID NO: 464787 - protein, 9 aa, Homo Sapiens
SPPMANGAT

SEQ ID NO: 464788 - protein, 9 aa, Homo Sapiens
RPSPKTQDH

SEQ ID NO: 464789 - protein, 9 aa, Homo Sapiens
NCEVVLENL

SEQ ID NO: 464790 - protein, 9 aa, Homo Sapiens
KDGIVMPMN

SEQ ID NO: 464791 - protein, 9 aa, Homo Sapiens
MGCLLLGAL

SEQ ID NO: 464792 - protein, 9 aa, Homo Sapiens
RFNQCNTTH

SEQ ID NO: 464793 - protein, 9 aa, Homo Sapiens
LHPFHAKLQ

SEQ ID NO: 464794 - protein, 9 aa, Homo Sapiens
NIDSLKEGF

SEQ ID NO: 464795 - protein, 9 aa, Homo Sapiens
PKTQDHLRQ

SEQ ID NO: 464796 - protein, 9 aa, Homo Sapiens
QITTLHAQV

SEQ ID NO: 464797 - protein, 9 aa, Homo Sapiens
MQWDRTQKP

SEQ ID NO: 464798 - protein, 9 aa, Homo Sapiens
NSDQGTPCH

SEQ ID NO: 464799 - protein, 9 aa, Homo Sapiens
ATNAIAPVS

SEQ ID NO: 464800 - protein, 9 aa, Homo Sapiens
TGDSGAPPR

SEQ ID NO: 464801 - protein, 9 aa, Homo Sapiens
VREKVRKET

SEQ ID NO: 464802 - protein, 9 aa, Homo Sapiens
NEAPPPSWT

SEQ ID NO: 464803 - protein, 9 aa, Homo Sapiens
VAILHPFHA

SEQ ID NO: 464804 - protein, 9 aa, Homo Sapiens
FFSHHFGEH

SEQ ID NO: 464805 - protein, 9 aa, Homo Sapiens
FKDGIVMPM

SEQ ID NO: 464806 - protein, 9 aa, Homo Sapiens
WDRRGACSQ

SEQ ID NO: 464807 - protein, 9 aa, Homo Sapiens
LLGNLKINV

SEQ ID NO: 464808 - protein, 9 aa, Homo Sapiens
LHPIVHVVM

SEQ ID NO: 464809 - protein, 9 aa, Homo Sapiens
AFFSFFSHH

SEQ ID NO: 464810 - protein, 9 aa, Homo Sapiens
TKSGVMLQS

SEQ ID NO: 464811 - protein, 9 aa, Homo Sapiens
INVPTLGPK

SEQ ID NO: 464812 - protein, 9 aa, Homo Sapiens
LLQMFSFKA

SEQ ID NO: 464813 - protein, 9 aa, Homo Sapiens
DSRINHFFC

SEQ ID NO: 464814 - protein, 9 aa, Homo Sapiens
SDQGTPCHL

SEQ ID NO: 464815 - protein, 9 aa, Homo Sapiens
YVGSMDVNV

SEQ ID NO: 464816 - protein, 9 aa, Homo Sapiens
LKINVPTLG

SEQ ID NO: 464817 - protein, 9 aa, Homo Sapiens
GTVEKEASF

SEQ ID NO: 464818 - protein, 9 aa, Homo Sapiens
VNVLTGFVL

SEQ ID NO: 464819 - protein, 9 aa, Homo Sapiens
GNLKINVPT

SEQ ID NO: 464820 - protein, 9 aa, Homo Sapiens
DRTQKPGES

SEQ ID NO: 464821 - protein, 9 aa, Homo Sapiens
NSLHPIVHV

SEQ ID NO: 464822 - protein, 9 aa, Homo Sapiens
FNNCEVVLE

SEQ ID NO: 464823 - protein, 9 aa, Homo Sapiens
APPPSWTPA

SEQ ID NO: 464824 - protein, 9 aa, Homo Sapiens
ITQTPGERS

SEQ ID NO: 464825 - protein, 9 aa, Homo Sapiens
KAHKLITTE

SEQ ID NO: 464826 - protein, 9 aa, Homo Sapiens
PSRGPPGPN

SEQ ID NO: 464827 - protein, 9 aa, Homo Sapiens
KINKTEICY

SEQ ID NO: 464828 - protein, 9 aa, Homo Sapiens
RKAHKLITT

SEQ ID NO: 464829 - protein, 9 aa, Homo Sapiens
PNEAPPPSW

SEQ ID NO: 464830 - protein, 9 aa, Homo Sapiens
KPSFFFFSR

SEQ ID NO: 464831 - protein, 9 aa, Homo Sapiens
LAFCDSRIN

SEQ ID NO: 464832 - protein, 9 aa, Homo Sapiens
DAWDSDEVK

SEQ ID NO: 464833 - protein, 9 aa, Homo Sapiens
QTSISGAQK

SEQ ID NO: 464834 - protein, 9 aa, Homo Sapiens
SDAERKAHK

SEQ ID NO: 464835 - protein, 9 aa, Homo Sapiens
KEASFSNPK

SEQ ID NO: 464836 - protein, 9 aa, Homo Sapiens
MMQWDRTQK

SEQ ID NO: 464837 - protein, 9 aa, Homo Sapiens
SRSLSGYGY

SEQ ID NO: 464838 - protein, 9 aa, Homo Sapiens
GFKMVNRLN

SEQ ID NO: 464839 - protein, 9 aa, Homo Sapiens
QGAPSATNA

SEQ ID NO: 464840 - protein, 9 aa, Homo Sapiens
QEDVEWYQA

SEQ ID NO: 464841 - protein, 9 aa, Homo Sapiens
HLRQQRASA

SEQ ID NO: 464842 - protein, 9 aa, Homo Sapiens
QTPGERSHP

SEQ ID NO: 464843 - protein, 9 aa, Homo Sapiens
TTHGNEVIS

SEQ ID NO: 464844 - protein, 9 aa, Homo Sapiens
RKETNTRSF

SEQ ID NO: 464845 - protein, 9 aa, Homo Sapiens
SSVQEDVEW

SEQ ID NO: 464846 - protein, 9 aa, Homo Sapiens
SLHPIVHVV

SEQ ID NO: 464847 - protein, 9 aa, Homo Sapiens
AFCDSRINH

SEQ ID NO: 464848 - protein, 9 aa, Homo Sapiens
PSPKTQDHL

SEQ ID NO: 464849 - protein, 9 aa, Homo Sapiens
IAAETKSGV

SEQ ID NO: 464850 - protein, 9 aa, Homo Sapiens
KQITTLHAQ

SEQ ID NO: 464851 - protein, 9 aa, Homo Sapiens
DRRGACSQG

SEQ ID NO: 464852 - protein, 9 aa, Homo Sapiens
RALLLALLL

SEQ ID NO: 464853 - protein, 9 aa, Homo Sapiens
NGATREPGG

SEQ ID NO: 464854 - protein, 9 aa, Homo Sapiens
SVQEDVEWY

SEQ ID NO: 464855 - protein, 9 aa, Homo Sapiens
FITQTPGER

SEQ ID NO: 464856 - protein, 9 aa, Homo Sapiens
GDSGAPPRA

SEQ ID NO: 464857 - protein, 9 aa, Homo Sapiens
TVEKEASFS

SEQ ID NO: 464858 - protein, 9 aa, Homo Sapiens
DIRESSVQE

SEQ ID NO: 464859 - protein, 9 aa, Homo Sapiens
CEVVLENLE

SEQ ID NO: 464860 - protein, 9 aa, Homo Sapiens
APSATNAIA

SEQ ID NO: 464861 - protein, 9 aa, Homo Sapiens
QPGDGEWRY

SEQ ID NO: 464862 - protein, 9 aa, Homo Sapiens
GAPSATNAI

SEQ ID NO: 464863 - protein, 9 aa, Homo Sapiens
SECGSHGWG

SEQ ID NO: 464864 - protein, 9 aa, Homo Sapiens
KEGFKMVNR

SEQ ID NO: 464865 - protein, 9 aa, Homo Sapiens
ACASDHVKV

SEQ ID NO: 464866 - protein, 9 aa, Homo Sapiens
KINVPTLGP

SEQ ID NO: 464867 - protein, 9 aa, Homo Sapiens
HVVMGDIYL

SEQ ID NO: 464868 - protein, 9 aa, Homo Sapiens
PFKINSDQG

SEQ ID NO: 464869 - protein, 9 aa, Homo Sapiens
KNPLLQMFS

SEQ ID NO: 464870 - protein, 9 aa, Homo Sapiens
AWDSDEVKR

SEQ ID NO: 464871 - protein, 9 aa, Homo Sapiens
FCDSRINHF

SEQ ID NO: 464872 - protein, 9 aa, Homo Sapiens
ALSECGSHG

SEQ ID NO: 464873 - protein, 9 aa, Homo Sapiens
GYGSRSLSG

SEQ ID NO: 464874 - protein, 9 aa, Homo Sapiens
SKEQTSISG

SEQ ID NO: 464875 - protein, 9 aa, Homo Sapiens
PMANGATRE

SEQ ID NO: 464876 - protein, 9 aa, Homo Sapiens
DQGTPCHLR

SEQ ID NO: 464877 - protein, 9 aa, Homo Sapiens
EQTSISGAQ

SEQ ID NO: 464878 - protein, 9 aa, Homo Sapiens
DSGAPPRAA

SEQ ID NO: 464879 - protein, 9 aa, Homo Sapiens
KEQTSISGA

SEQ ID NO: 464880 - protein, 9 aa, Homo Sapiens
GSHGWGVHN

SEQ ID NO: 464881 - protein, 9 aa, Homo Sapiens
AILHPFHAK

SEQ ID NO: 464882 - protein, 9 aa, Homo Sapiens
DSMLSSMFS

SEQ ID NO: 464883 - protein, 9 aa, Homo Sapiens
ALQGAPSAT

SEQ ID NO: 464884 - protein, 9 aa, Homo Sapiens
SFFFFSRPS

SEQ ID NO: 464885 - protein, 9 aa, Homo Sapiens
ILTSATMGC

SEQ ID NO: 464886 - protein, 9 aa, Homo Sapiens
FSRPSPKTQ

SEQ ID NO: 464887 - protein, 9 aa, Homo Sapiens
DSLKEGFKM

SEQ ID NO: 464888 - protein, 9 aa, Homo Sapiens
TMGCLLLGA

SEQ ID NO: 464889 - protein, 9 aa, Homo Sapiens
SRPSPKTQD

SEQ ID NO: 464890 - protein, 9 aa, Homo Sapiens
HVREKVRKE

SEQ ID NO: 464891 - protein, 9 aa, Homo Sapiens
FFFFSRPSP

SEQ ID NO: 464892 - protein, 9 aa, Homo Sapiens
GCMIFPDAW

SEQ ID NO: 464893 - protein, 9 aa, Homo Sapiens
CSQGKGRRA

SEQ ID NO: 464894 - protein, 9 aa, Homo Sapiens
VHVVMGDIY

SEQ ID NO: 464895 - protein, 9 aa, Homo Sapiens
MNPKSTRAF

SEQ ID NO: 464896 - protein, 9 aa, Homo Sapiens
SSMFSGRFP

SEQ ID NO: 464897 - protein, 9 aa, Homo Sapiens
SLSGYGYGC

SEQ ID NO: 464898 - protein, 9 aa, Homo Sapiens
TREPGGYAA

SEQ ID NO: 464899 - protein, 9 aa, Homo Sapiens
QCNTTHGNE

SEQ ID NO: 464900 - protein, 9 aa, Homo Sapiens
LTRARGPPS

SEQ ID NO: 464901 - protein, 9 aa, Homo Sapiens
TAADKAAQI

SEQ ID NO: 464902 - protein, 9 aa, Homo Sapiens
RKQLAVTSP

SEQ ID NO: 464903 - protein, 9 aa, Homo Sapiens
KQLAVTSPE

SEQ ID NO: 464904 - protein, 9 aa, Homo Sapiens
QLAVTSPER

SEQ ID NO: 464905 - protein, 9 aa, Homo Sapiens
LAVTSPERE

SEQ ID NO: 464906 - protein, 9 aa, Homo Sapiens
LRRRQPKKT

SEQ ID NO: 464907 - protein, 9 aa, Homo Sapiens
AVTSPEREI

SEQ ID NO: 464908 - protein, 9 aa, Homo Sapiens
ADKAAQITQ

SEQ ID NO: 464909 - protein, 9 aa, Homo Sapiens
TNELPQANR

SEQ ID NO: 464910 - protein, 9 aa, Homo Sapiens
AADKAAQIT

SEQ ID NO: 464911 - protein, 9 aa, Homo Sapiens
QPKKTNELP

SEQ ID NO: 464912 - protein, 9 aa, Homo Sapiens
PKKTNELPQ

SEQ ID NO: 464913 - protein, 9 aa, Homo Sapiens
RQPKKTNEL

SEQ ID NO: 464914 - protein, 9 aa, Homo Sapiens
SWTAADKAA

SEQ ID NO: 464915 - protein, 9 aa, Homo Sapiens
WTAADKAAQ

SEQ ID NO: 464916 - protein, 9 aa, Homo Sapiens
VTSPEREIP

SEQ ID NO: 464917 - protein, 9 aa, Homo Sapiens
KKTNELPQA

SEQ ID NO: 464918 - protein, 9 aa, Homo Sapiens
LRSWTAADK

SEQ ID NO: 464919 - protein, 9 aa, Homo Sapiens
RRQPKKTNE

SEQ ID NO: 464920 - protein, 9 aa, Homo Sapiens
TSPEREIPE

SEQ ID NO: 464921 - protein, 9 aa, Homo Sapiens
DKAAQITQR

SEQ ID NO: 464922 - protein, 9 aa, Homo Sapiens
KAAQITQRK

SEQ ID NO: 464923 - protein, 9 aa, Homo Sapiens
RRRQPKKTN

SEQ ID NO: 464924 - protein, 9 aa, Homo Sapiens
RQRKQLAVT

SEQ ID NO: 464925 - protein, 9 aa, Homo Sapiens
KTNELPQAN

SEQ ID NO: 464926 - protein, 9 aa, Homo Sapiens
QRKQLAVTS

SEQ ID NO: 464927 - protein, 9 aa, Homo Sapiens
RSWTAADKA

SEQ ID NO: 464928 - protein, 9 aa, Homo Sapiens
SWKLQTKEE

SEQ ID NO: 464929 - protein, 9 aa, Homo Sapiens
MGRIYELRL

SEQ ID NO: 464930 - protein, 9 aa, Homo Sapiens
EDLYKCYGG

SEQ ID NO: 464931 - protein, 9 aa, Homo Sapiens
TLSALPLAA

SEQ ID NO: 464932 - protein, 9 aa, Homo Sapiens
KKYMDAETS

SEQ ID NO: 464933 - protein, 9 aa, Homo Sapiens
TWLQFSDGF

SEQ ID NO: 464934 - protein, 9 aa, Homo Sapiens
RHLLAPWTL

SEQ ID NO: 464935 - protein, 9 aa, Homo Sapiens
GQAFTMAEM

SEQ ID NO: 464936 - protein, 9 aa, Homo Sapiens
RHLLHARCD

SEQ ID NO: 464937 - protein, 9 aa, Homo Sapiens
ICFNSISCS

SEQ ID NO: 464938 - protein, 9 aa, Homo Sapiens
LLRGLDAEA

SEQ ID NO: 464939 - protein, 9 aa, Homo Sapiens
AALSPPSWD

SEQ ID NO: 464940 - protein, 9 aa, Homo Sapiens
WLQFSDGFV

SEQ ID NO: 464941 - protein, 9 aa, Homo Sapiens
DEPRKKYMD

SEQ ID NO: 464942 - protein, 9 aa, Homo Sapiens
RKLLAKSKI

SEQ ID NO: 464943 - protein, 9 aa, Homo Sapiens
LQKADPSYP

SEQ ID NO: 464944 - protein, 9 aa, Homo Sapiens
QGRPGTKDV

SEQ ID NO: 464945 - protein, 9 aa, Homo Sapiens
RIIEDPYKV

SEQ ID NO: 464946 - protein, 9 aa, Homo Sapiens
QPNIRKFLI

SEQ ID NO: 464947 - protein, 9 aa, Homo Sapiens
LWQRHLLAP

SEQ ID NO: 464948 - protein, 9 aa, Homo Sapiens
KGAQPNIRK

SEQ ID NO: 464949 - protein, 9 aa, Homo Sapiens
LQQKLLHEA

SEQ ID NO: 464950 - protein, 9 aa, Homo Sapiens
PDVKVFLES

SEQ ID NO: 464951 - protein, 9 aa, Homo Sapiens
RNCIGQAFT

SEQ ID NO: 464952 - protein, 9 aa, Homo Sapiens
LLHEAYMTP

SEQ ID NO: 464953 - protein, 9 aa, Homo Sapiens
RQVEGGARY

SEQ ID NO: 464954 - protein, 9 aa, Homo Sapiens
TATTTIGIS

SEQ ID NO: 464955 - protein, 9 aa, Homo Sapiens
VDKPLRIIE

SEQ ID NO: 464956 - protein, 9 aa, Homo Sapiens
CIGQAFTMA

SEQ ID NO: 464957 - protein, 9 aa, Homo Sapiens
PRKKYMDAE

SEQ ID NO: 464958 - protein, 9 aa, Homo Sapiens
RGLDAEASR

SEQ ID NO: 464959 - protein, 9 aa, Homo Sapiens
LLAPWTLSA

SEQ ID NO: 464960 - protein, 9 aa, Homo Sapiens
MLECDGLKT

SEQ ID NO: 464961 - protein, 9 aa, Homo Sapiens
PSRSHCPSA

SEQ ID NO: 464962 - protein, 9 aa, Homo Sapiens
HCPSARRYA

SEQ ID NO: 464963 - protein, 9 aa, Homo Sapiens
KPLRIIEDP

SEQ ID NO: 464964 - protein, 9 aa, Homo Sapiens
TISRMDRHH

SEQ ID NO: 464965 - protein, 9 aa, Homo Sapiens
YNMDKDGYI

SEQ ID NO: 464966 - protein, 9 aa, Homo Sapiens
SGPGWRMKP

SEQ ID NO: 464967 - protein, 9 aa, Homo Sapiens
LLLRGLDAE

SEQ ID NO: 464968 - protein, 9 aa, Homo Sapiens
RHHVMDDHY

SEQ ID NO: 464969 - protein, 9 aa, Homo Sapiens
DKPLRIIED

SEQ ID NO: 464970 - protein, 9 aa, Homo Sapiens
LGLELTTIS

SEQ ID NO: 464971 - protein, 9 aa, Homo Sapiens
KICFNSISC

SEQ ID NO: 464972 - protein, 9 aa, Homo Sapiens
WQRHLLAPW

SEQ ID NO: 464973 - protein, 9 aa, Homo Sapiens
GLELTTISN

SEQ ID NO: 464974 - protein, 9 aa, Homo Sapiens
KNGQSASPE

SEQ ID NO: 464975 - protein, 9 aa, Homo Sapiens
PIEPPSATA

SEQ ID NO: 464976 - protein, 9 aa, Homo Sapiens
VLKKRHNKE

SEQ ID NO: 464977 - protein, 9 aa, Homo Sapiens
CPSARRYAT

SEQ ID NO: 464978 - protein, 9 aa, Homo Sapiens
IIEDPYKVQ

SEQ ID NO: 464979 - protein, 9 aa, Homo Sapiens
VRKDSVSKN

SEQ ID NO: 464980 - protein, 9 aa, Homo Sapiens
RQESDKNGQ

SEQ ID NO: 464981 - protein, 9 aa, Homo Sapiens
HVMDDHYSP

SEQ ID NO: 464982 - protein, 9 aa, Homo Sapiens
SKNIDSSDR

SEQ ID NO: 464983 - protein, 9 aa, Homo Sapiens
HEDLYKCYG

SEQ ID NO: 464984 - protein, 9 aa, Homo Sapiens
EAMGRIYEL

SEQ ID NO: 464985 - protein, 9 aa, Homo Sapiens
EVFHSEKEM

SEQ ID NO: 464986 - protein, 9 aa, Homo Sapiens
TRTPDVKVF

SEQ ID NO: 464987 - protein, 9 aa, Homo Sapiens
PPSATATTT

SEQ ID NO: 464988 - protein, 9 aa, Homo Sapiens
YRLRHLLHA

SEQ ID NO: 464989 - protein, 9 aa, Homo Sapiens
GTKDVLIQL

SEQ ID NO: 464990 - protein, 9 aa, Homo Sapiens
HHVMDDHYS

SEQ ID NO: 464991 - protein, 9 aa, Homo Sapiens
WRMKPGQDQ

SEQ ID NO: 464992 - protein, 9 aa, Homo Sapiens
ADPSYPFES

SEQ ID NO: 464993 - protein, 9 aa, Homo Sapiens
GKKNSPHEE

SEQ ID NO: 464994 - protein, 9 aa, Homo Sapiens
KSYKICFNS

SEQ ID NO: 464995 - protein, 9 aa, Homo Sapiens
GRPGTKDVL

SEQ ID NO: 464996 - protein, 9 aa, Homo Sapiens
HARCDASPV

SEQ ID NO: 464997 - protein, 9 aa, Homo Sapiens
HKSYKICFN

SEQ ID NO: 464998 - protein, 9 aa, Homo Sapiens
PSATATTTI

SEQ ID NO: 464999 - protein, 9 aa, Homo Sapiens
QRHLLAPWT

SEQ ID NO: 465000 - protein, 9 aa, Homo Sapiens
AMGRIYELR

SEQ ID NO: 465001 - protein, 9 aa, Homo Sapiens
KATMWQVGI

SEQ ID NO: 465002 - protein, 9 aa, Homo Sapiens
EEQGRPGTK

SEQ ID NO: 465003 - protein, 9 aa, Homo Sapiens
KNIDSSDRK

SEQ ID NO: 465004 - protein, 9 aa, Homo Sapiens
QLGLELTTI

SEQ ID NO: 465005 - protein, 9 aa, Homo Sapiens
TDSNKEFVT

SEQ ID NO: 465006 - protein, 9 aa, Homo Sapiens
ISRMDRHHV

SEQ ID NO: 465007 - protein, 9 aa, Homo Sapiens
GGARYSSCI

SEQ ID NO: 465008 - protein, 9 aa, Homo Sapiens
QKLLHEAYM

SEQ ID NO: 465009 - protein, 9 aa, Homo Sapiens
AFSIYNMDK

SEQ ID NO: 465010 - protein, 9 aa, Homo Sapiens
VEKATMWQV

SEQ ID NO: 465011 - protein, 9 aa, Homo Sapiens
LSALPLAAL

SEQ ID NO: 465012 - protein, 9 aa, Homo Sapiens
KKNSPHEEV

SEQ ID NO: 465013 - protein, 9 aa, Homo Sapiens
LECDGLKTD

SEQ ID NO: 465014 - protein, 9 aa, Homo Sapiens
FVTPLDIYD

SEQ ID NO: 465015 - protein, 9 aa, Homo Sapiens
ESDKNGQSA

SEQ ID NO: 465016 - protein, 9 aa, Homo Sapiens
LSGPGWRMK

SEQ ID NO: 465017 - protein, 9 aa, Homo Sapiens
KQVNDAHHG

SEQ ID NO: 465018 - protein, 9 aa, Homo Sapiens
KEMKSSRIK

SEQ ID NO: 465019 - protein, 9 aa, Homo Sapiens
DVEKATMWQ

SEQ ID NO: 465020 - protein, 9 aa, Homo Sapiens
LLQQKLLHE

SEQ ID NO: 465021 - protein, 9 aa, Homo Sapiens
LQFSDGFVT

SEQ ID NO: 465022 - protein, 9 aa, Homo Sapiens
PGTKDVLIQ

SEQ ID NO: 465023 - protein, 9 aa, Homo Sapiens
QAHGVTSAP

SEQ ID NO: 465024 - protein, 9 aa, Homo Sapiens
ECDGLKTDS

SEQ ID NO: 465025 - protein, 9 aa, Homo Sapiens
WTLSALPLA

SEQ ID NO: 465026 - protein, 9 aa, Homo Sapiens
ATATTTIGI

SEQ ID NO: 465027 - protein, 9 aa, Homo Sapiens
IGQAFTMAE

SEQ ID NO: 465028 - protein, 9 aa, Homo Sapiens
LRGLDAEAS

SEQ ID NO: 465029 - protein, 9 aa, Homo Sapiens
SIYNMDKDG

SEQ ID NO: 465030 - protein, 9 aa, Homo Sapiens
TISNFFMNA

SEQ ID NO: 465031 - protein, 9 aa, Homo Sapiens
GLKTDSNKE

SEQ ID NO: 465032 - protein, 9 aa, Homo Sapiens
DSVSKNIDS

SEQ ID NO: 465033 - protein, 9 aa, Homo Sapiens
LLHARCDAS

SEQ ID NO: 465034 - protein, 9 aa, Homo Sapiens
KRHNKEKVL

SEQ ID NO: 465035 - protein, 9 aa, Homo Sapiens
PGWRMKPGQ

SEQ ID NO: 465036 - protein, 9 aa, Homo Sapiens
QSLETAMLF

SEQ ID NO: 465037 - protein, 9 aa, Homo Sapiens
SRMDRHHVM

SEQ ID NO: 465038 - protein, 9 aa, Homo Sapiens
LRIIEDPYK

SEQ ID NO: 465039 - protein, 9 aa, Homo Sapiens
RKKYMDAET

SEQ ID NO: 465040 - protein, 9 aa, Homo Sapiens
LAALSPPSW

SEQ ID NO: 465041 - protein, 9 aa, Homo Sapiens
EKATMWQVG

SEQ ID NO: 465042 - protein, 9 aa, Homo Sapiens
QHKSYKICF

SEQ ID NO: 465043 - protein, 9 aa, Homo Sapiens
PLWQRHLLA

SEQ ID NO: 465044 - protein, 9 aa, Homo Sapiens
LETAMLFVA

SEQ ID NO: 465045 - protein, 9 aa, Homo Sapiens
EDEPRKKYM

SEQ ID NO: 465046 - protein, 9 aa, Homo Sapiens
EDPYKVQQA

SEQ ID NO: 465047 - protein, 9 aa, Homo Sapiens
PLAALSPPS

SEQ ID NO: 465048 - protein, 9 aa, Homo Sapiens
KCYGGFLRR

SEQ ID NO: 465049 - protein, 9 aa, Homo Sapiens
VFEAMGRIY

SEQ ID NO: 465050 - protein, 9 aa, Homo Sapiens
AMLFVARNT

SEQ ID NO: 465051 - protein, 9 aa, Homo Sapiens
EYFMKQVND

SEQ ID NO: 465052 - protein, 9 aa, Homo Sapiens
KTDSNKEFV

SEQ ID NO: 465053 - protein, 9 aa, Homo Sapiens
EPPSATATT

SEQ ID NO: 465054 - protein, 9 aa, Homo Sapiens
AQPNIRKFL

SEQ ID NO: 465055 - protein, 9 aa, Homo Sapiens
ALPLAALSP

SEQ ID NO: 465056 - protein, 9 aa, Homo Sapiens
YSSCIPLWQ

SEQ ID NO: 465057 - protein, 9 aa, Homo Sapiens
FVSDGGELR

SEQ ID NO: 465058 - protein, 9 aa, Homo Sapiens
GTRTPDVKV

SEQ ID NO: 465059 - protein, 9 aa, Homo Sapiens
GFVTPLDIY

SEQ ID NO: 465060 - protein, 9 aa, Homo Sapiens
TPDVKVFLE

SEQ ID NO: 465061 - protein, 9 aa, Homo Sapiens
KLLHEAYMT

SEQ ID NO: 465062 - protein, 9 aa, Homo Sapiens
LHEAYMTPK

SEQ ID NO: 465063 - protein, 9 aa, Homo Sapiens
WDLMPSRSH

SEQ ID NO: 465064 - protein, 9 aa, Homo Sapiens
PSARRYATA

SEQ ID NO: 465065 - protein, 9 aa, Homo Sapiens
RDFDRKLLA

SEQ ID NO: 465066 - protein, 9 aa, Homo Sapiens
DGFVTPLDI

SEQ ID NO: 465067 - protein, 9 aa, Homo Sapiens
VKVFLESPW

SEQ ID NO: 465068 - protein, 9 aa, Homo Sapiens
GAQPNIRKF

SEQ ID NO: 465069 - protein, 9 aa, Homo Sapiens
SEKEMKSSR

SEQ ID NO: 465070 - protein, 9 aa, Homo Sapiens
NKEKVLRRA

SEQ ID NO: 465071 - protein, 9 aa, Homo Sapiens
EQHKSYKIC

SEQ ID NO: 465072 - protein, 9 aa, Homo Sapiens
SYKICFNSI

SEQ ID NO: 465073 - protein, 9 aa, Homo Sapiens
AIFVSDGGE

SEQ ID NO: 465074 - protein, 9 aa, Homo Sapiens
SLETAMLFV

SEQ ID NO: 465075 - protein, 9 aa, Homo Sapiens
PQAHGVTSA

SEQ ID NO: 465076 - protein, 9 aa, Homo Sapiens
GPGWRMKPG

SEQ ID NO: 465077 - protein, 9 aa, Homo Sapiens
AFQQYKKKS

SEQ ID NO: 465078 - protein, 9 aa, Homo Sapiens
LTTISNFFM

SEQ ID NO: 465079 - protein, 9 aa, Homo Sapiens
RHNKEKVLR

SEQ ID NO: 465080 - protein, 9 aa, Homo Sapiens
SWDLMPSRS

SEQ ID NO: 465081 - protein, 9 aa, Homo Sapiens
VRQVEGGAR

SEQ ID NO: 465082 - protein, 9 aa, Homo Sapiens
LKTDSNKEF

SEQ ID NO: 465083 - protein, 9 aa, Homo Sapiens
RMKPGQDQA

SEQ ID NO: 465084 - protein, 9 aa, Homo Sapiens
VSKNIDSSD

SEQ ID NO: 465085 - protein, 9 aa, Homo Sapiens
QESDKNGQS

SEQ ID NO: 465086 - protein, 9 aa, Homo Sapiens
FEAMGRIYE

SEQ ID NO: 465087 - protein, 9 aa, Homo Sapiens
ICVRQVEGG

SEQ ID NO: 465088 - protein, 9 aa, Homo Sapiens
QAFTMAEMK

SEQ ID NO: 465089 - protein, 9 aa, Homo Sapiens
MKSSRIKAE

SEQ ID NO: 465090 - protein, 9 aa, Homo Sapiens
LEEQGRPGT

SEQ ID NO: 465091 - protein, 9 aa, Homo Sapiens
MDRHHVMDD

SEQ ID NO: 465092 - protein, 9 aa, Homo Sapiens
QFSDGFVTP

SEQ ID NO: 465093 - protein, 9 aa, Homo Sapiens
RAHAIFVSD

SEQ ID NO: 465094 - protein, 9 aa, Homo Sapiens
KLLAKSKIE

SEQ ID NO: 465095 - protein, 9 aa, Homo Sapiens
PSYPFESPV

SEQ ID NO: 465096 - protein, 9 aa, Homo Sapiens
LRHLLHARC

SEQ ID NO: 465097 - protein, 9 aa, Homo Sapiens
FSIYNMDKD

SEQ ID NO: 465098 - protein, 9 aa, Homo Sapiens
LRAHAIFVS

SEQ ID NO: 465099 - protein, 9 aa, Homo Sapiens
YFSPTKGAQ

SEQ ID NO: 465100 - protein, 9 aa, Homo Sapiens
RGSLLLRGL

SEQ ID NO: 465101 - protein, 9 aa, Homo Sapiens
KYMDAETSL

SEQ ID NO: 465102 - protein, 9 aa, Homo Sapiens
LELTTISNF

SEQ ID NO: 465103 - protein, 9 aa, Homo Sapiens
TKGAQPNIR

SEQ ID NO: 465104 - protein, 9 aa, Homo Sapiens
HLLAPWTLS

SEQ ID NO: 465105 - protein, 9 aa, Homo Sapiens
LYKCYGGFL

SEQ ID NO: 465106 - protein, 9 aa, Homo Sapiens
TKEEVSWPC

SEQ ID NO: 465107 - protein, 9 aa, Homo Sapiens
QQSLETAML

SEQ ID NO: 465108 - protein, 9 aa, Homo Sapiens
SDGFVTPLD

SEQ ID NO: 465109 - protein, 9 aa, Homo Sapiens
PWTLSALPL

SEQ ID NO: 465110 - protein, 9 aa, Homo Sapiens
DKNGQSASP

SEQ ID NO: 465111 - protein, 9 aa, Homo Sapiens
PHEEVELKK

SEQ ID NO: 465112 - protein, 9 aa, Homo Sapiens
VDVEKATMW

SEQ ID NO: 465113 - protein, 9 aa, Homo Sapiens
APWTLSALP

SEQ ID NO: 465114 - protein, 9 aa, Homo Sapiens
RLRHLLHAR

SEQ ID NO: 465115 - protein, 9 aa, Homo Sapiens
PTKGAQPNI

SEQ ID NO: 465116 - protein, 9 aa, Homo Sapiens
RMDRHHVMD

SEQ ID NO: 465117 - protein, 9 aa, Homo Sapiens
ARYSSCIPL

SEQ ID NO: 465118 - protein, 9 aa, Homo Sapiens
MLFVARNTF

SEQ ID NO: 465119 - protein, 9 aa, Homo Sapiens
FTMAEMKVV

SEQ ID NO: 465120 - protein, 9 aa, Homo Sapiens
TTISNFFMN

SEQ ID NO: 465121 - protein, 9 aa, Homo Sapiens
DLYKCYGGF

SEQ ID NO: 465122 - protein, 9 aa, Homo Sapiens
RPGTKDVLI

SEQ ID NO: 465123 - protein, 9 aa, Homo Sapiens
SSCIPLWQR

SEQ ID NO: 465124 - protein, 9 aa, Homo Sapiens
WKLQTKEEV

SEQ ID NO: 465125 - protein, 9 aa, Homo Sapiens
RSHCPSARR

SEQ ID NO: 465126 - protein, 9 aa, Homo Sapiens
SPTKGAQPN

SEQ ID NO: 465127 - protein, 9 aa, Homo Sapiens
ISNFFMNAR

SEQ ID NO: 465128 - protein, 9 aa, Homo Sapiens
PVFEAMGRI

SEQ ID NO: 465129 - protein, 9 aa, Homo Sapiens
AFTMAEMKV

SEQ ID NO: 465130 - protein, 9 aa, Homo Sapiens
EPRGSLLLR

SEQ ID NO: 465131 - protein, 9 aa, Homo Sapiens
KLQTKEEVS

SEQ ID NO: 465132 - protein, 9 aa, Homo Sapiens
SALPLAALS

SEQ ID NO: 465133 - protein, 9 aa, Homo Sapiens
EPRKKYMDA

SEQ ID NO: 465134 - protein, 9 aa, Homo Sapiens
SEEEEEEMA

SEQ ID NO: 465135 - protein, 9 aa, Homo Sapiens
NIDSSDRKS

SEQ ID NO: 465136 - protein, 9 aa, Homo Sapiens
EQGRPGTKD

SEQ ID NO: 465137 - protein, 9 aa, Homo Sapiens
FSDGFVTPL

SEQ ID NO: 465138 - protein, 9 aa, Homo Sapiens
DVKVFLESP

SEQ ID NO: 465139 - protein, 9 aa, Homo Sapiens
YKICFNSIS

SEQ ID NO: 465140 - protein, 9 aa, Homo Sapiens
LHARCDASP

SEQ ID NO: 465141 - protein, 9 aa, Homo Sapiens
DLMPSRSHC

SEQ ID NO: 465142 - protein, 9 aa, Homo Sapiens
LIGKKNSPH

SEQ ID NO: 465143 - protein, 9 aa, Homo Sapiens
DGLKTDSNK

SEQ ID NO: 465144 - protein, 9 aa, Homo Sapiens
EVDVEKATM

SEQ ID NO: 465145 - protein, 9 aa, Homo Sapiens
LMPSRSHCP

SEQ ID NO: 465146 - protein, 9 aa, Homo Sapiens
KKRHNKEKV

SEQ ID NO: 465147 - protein, 9 aa, Homo Sapiens
LRFAFSIYN

SEQ ID NO: 465148 - protein, 9 aa, Homo Sapiens
IPLWQRHLL

SEQ ID NO: 465149 - protein, 9 aa, Homo Sapiens
PRGSLLLRG

SEQ ID NO: 465150 - protein, 9 aa, Homo Sapiens
VFHSEKEMK

SEQ ID NO: 465151 - protein, 9 aa, Homo Sapiens
HSEKEMKSS

SEQ ID NO: 465152 - protein, 9 aa, Homo Sapiens
EKEMKSSRI

SEQ ID NO: 465153 - protein, 9 aa, Homo Sapiens
PLRIIEDPY

SEQ ID NO: 465154 - protein, 9 aa, Homo Sapiens
ALEYFMKQV

SEQ ID NO: 465155 - protein, 9 aa, Homo Sapiens
IEPPSATAT

SEQ ID NO: 465156 - protein, 9 aa, Homo Sapiens
MGHEDLYKC

SEQ ID NO: 465157 - protein, 9 aa, Homo Sapiens
FSPTKGAQP

SEQ ID NO: 465158 - protein, 9 aa, Homo Sapiens
IYNMDKDGY

SEQ ID NO: 465159 - protein, 9 aa, Homo Sapiens
HLLHARCDA

SEQ ID NO: 465160 - protein, 9 aa, Homo Sapiens
VNDAHHGGW

SEQ ID NO: 465161 - protein, 9 aa, Homo Sapiens
GQSASPERD

SEQ ID NO: 465162 - protein, 9 aa, Homo Sapiens
HEEVELKKL

SEQ ID NO: 465163 - protein, 9 aa, Homo Sapiens
GHEDLYKCY

SEQ ID NO: 465164 - protein, 9 aa, Homo Sapiens
KVFLESPWS

SEQ ID NO: 465165 - protein, 9 aa, Homo Sapiens
ATMWQVGIY

SEQ ID NO: 465166 - protein, 9 aa, Homo Sapiens
LAPWTLSAL

SEQ ID NO: 465167 - protein, 9 aa, Homo Sapiens
DFDRKLLAK

SEQ ID NO: 465168 - protein, 9 aa, Homo Sapiens
AHAIFVSDG

SEQ ID NO: 465169 - protein, 9 aa, Homo Sapiens
FMKQVNDAH

SEQ ID NO: 465170 - protein, 9 aa, Homo Sapiens
VEGGARYSS

SEQ ID NO: 465171 - protein, 9 aa, Homo Sapiens
TAMLFVARN

SEQ ID NO: 465172 - protein, 9 aa, Homo Sapiens
CIPLWQRHL

SEQ ID NO: 465173 - protein, 9 aa, Homo Sapiens
FHSEKEMKS

SEQ ID NO: 465174 - protein, 9 aa, Homo Sapiens
DSEEEEEEM

SEQ ID NO: 465175 - protein, 9 aa, Homo Sapiens
KNSPHEEVE

SEQ ID NO: 465176 - protein, 9 aa, Homo Sapiens
RYSSCIPLW

SEQ ID NO: 465177 - protein, 9 aa, Homo Sapiens
VFLESPWSL

SEQ ID NO: 465178 - protein, 9 aa, Homo Sapiens
SHCPSARRY

SEQ ID NO: 465179 - protein, 9 aa, Homo Sapiens
ASWKLQTKE

SEQ ID NO: 465180 - protein, 9 aa, Homo Sapiens
IGKKNSPHE

SEQ ID NO: 465181 - protein, 9 aa, Homo Sapiens
MKQVNDAHH

SEQ ID NO: 465182 - protein, 9 aa, Homo Sapiens
ELQKADPSY

SEQ ID NO: 465183 - protein, 9 aa, Homo Sapiens
GSLLLRGLD

SEQ ID NO: 465184 - protein, 9 aa, Homo Sapiens
KDSVSKNID

SEQ ID NO: 465185 - protein, 9 aa, Homo Sapiens
FQQYKKKSG

SEQ ID NO: 465186 - protein, 9 aa, Homo Sapiens
NGQSASPER

SEQ ID NO: 465187 - protein, 9 aa, Homo Sapiens
SPHEEVELK

SEQ ID NO: 465188 - protein, 9 aa, Homo Sapiens
GARYSSCIP

SEQ ID NO: 465189 - protein, 9 aa, Homo Sapiens
PSWDLMPSR

SEQ ID NO: 465190 - protein, 9 aa, Homo Sapiens
NSPHEEVEL

SEQ ID NO: 465191 - protein, 9 aa, Homo Sapiens
APQAHGVTS

SEQ ID NO: 465192 - protein, 9 aa, Homo Sapiens
CVRQVEGGA

SEQ ID NO: 465193 - protein, 9 aa, Homo Sapiens
TMWQVGIYH

SEQ ID NO: 465194 - protein, 9 aa, Homo Sapiens
ATTTIGISA

SEQ ID NO: 465195 - protein, 9 aa, Homo Sapiens
MKPGQDQAH

SEQ ID NO: 465196 - protein, 9 aa, Homo Sapiens
IELRAHAIF

SEQ ID NO: 465197 - protein, 9 aa, Homo Sapiens
KVLKKRHNK

SEQ ID NO: 465198 - protein, 9 aa, Homo Sapiens
ELTTISNFF

SEQ ID NO: 465199 - protein, 9 aa, Homo Sapiens
TYRLRHLLH

SEQ ID NO: 465200 - protein, 9 aa, Homo Sapiens
LQTKEEVSW

SEQ ID NO: 465201 - protein, 9 aa, Homo Sapiens
HNKEKVLRR

SEQ ID NO: 465202 - protein, 9 aa, Homo Sapiens
IEDPYKVQQ

SEQ ID NO: 465203 - protein, 9 aa, Homo Sapiens
QKADPSYPF

SEQ ID NO: 465204 - protein, 9 aa, Homo Sapiens
SRSHCPSAR

SEQ ID NO: 465205 - protein, 9 aa, Homo Sapiens
CDGLKTDSN

SEQ ID NO: 465206 - protein, 9 aa, Homo Sapiens
CYGGFLRRI

SEQ ID NO: 465207 - protein, 9 aa, Homo Sapiens
SDKNGQSAS

SEQ ID NO: 465208 - protein, 9 aa, Homo Sapiens
LEYFMKQVN

SEQ ID NO: 465209 - protein, 9 aa, Homo Sapiens
GWRMKPGQD

SEQ ID NO: 465210 - protein, 9 aa, Homo Sapiens
TKDVLIQLP

SEQ ID NO: 465211 - protein, 9 aa, Homo Sapiens
PASWKLQTK

SEQ ID NO: 465212 - protein, 9 aa, Homo Sapiens
QVEGGARYS

SEQ ID NO: 465213 - protein, 9 aa, Homo Sapiens
ELVPVFEAM

SEQ ID NO: 465214 - protein, 9 aa, Homo Sapiens
SCIPLWQRH

SEQ ID NO: 465215 - protein, 9 aa, Homo Sapiens
LVPVFEAMG

SEQ ID NO: 465216 - protein, 9 aa, Homo Sapiens
YLSGPGWRM

SEQ ID NO: 465217 - protein, 9 aa, Homo Sapiens
HEAYMTPKD

SEQ ID NO: 465218 - protein, 9 aa, Homo Sapiens
PPSWDLMPS

SEQ ID NO: 465219 - protein, 9 aa, Homo Sapiens
LFVARNTFK

SEQ ID NO: 465220 - protein, 9 aa, Homo Sapiens
ALSPPSWDL

SEQ ID NO: 465221 - protein, 9 aa, Homo Sapiens
FDRKLLAKS

SEQ ID NO: 465222 - protein, 9 aa, Homo Sapiens
KADPSYPFE

SEQ ID NO: 465223 - protein, 9 aa, Homo Sapiens
EGGARYSSC

SEQ ID NO: 465224 - protein, 9 aa, Homo Sapiens
SVSKNIDSS

SEQ ID NO: 465225 - protein, 9 aa, Homo Sapiens
SLLLRGLDA

SEQ ID NO: 465226 - protein, 9 aa, Homo Sapiens
HAIFVSDGG

SEQ ID NO: 465227 - protein, 9 aa, Homo Sapiens
DRHHVMDDH

SEQ ID NO: 465228 - protein, 9 aa, Homo Sapiens
LSPPSWDLM

SEQ ID NO: 465229 - protein, 9 aa, Homo Sapiens
CFNSISCSD

SEQ ID NO: 465230 - protein, 9 aa, Homo Sapiens
IFVSDGGEL

SEQ ID NO: 465231 - protein, 9 aa, Homo Sapiens
NMDKDGYIS

SEQ ID NO: 465232 - protein, 9 aa, Homo Sapiens
ETAMLFVAR

SEQ ID NO: 465233 - protein, 9 aa, Homo Sapiens
QVNDAHHGG

SEQ ID NO: 465234 - protein, 9 aa, Homo Sapiens
YPFESPVMA

SEQ ID NO: 465235 - protein, 9 aa, Homo Sapiens
LKKRHNKEK

SEQ ID NO: 465236 - protein, 9 aa, Homo Sapiens
DPSYPFESP

SEQ ID NO: 465237 - protein, 9 aa, Homo Sapiens
QTKEEVSWP

SEQ ID NO: 465238 - protein, 9 aa, Homo Sapiens
YKCYGGFLR

SEQ ID NO: 465239 - protein, 9 aa, Homo Sapiens
TKVLKKRHN

SEQ ID NO: 465240 - protein, 9 aa, Homo Sapiens
RKDSVSKNI

SEQ ID NO: 465241 - protein, 9 aa, Homo Sapiens
QSASPERDR

SEQ ID NO: 465242 - protein, 9 aa, Homo Sapiens
NCIGQAFTM

SEQ ID NO: 465243 - protein, 9 aa, Homo Sapiens
RTPDVKVFL

SEQ ID NO: 465244 - protein, 9 aa, Homo Sapiens
FAFSIYNMD

SEQ ID NO: 465245 - protein, 9 aa, Homo Sapiens
MPSRSHCPS

SEQ ID NO: 465246 - protein, 9 aa, Homo Sapiens
SPPSWDLMP

SEQ ID NO: 465247 - protein, 9 aa, Homo Sapiens
LPLAALSPP

SEQ ID NO: 465248 - protein, 9 aa, Homo Sapiens
TLLQQKLLH

SEQ ID NO: 465249 - protein, 9 aa, Homo Sapiens
DRKLLAKSK

SEQ ID NO: 465250 - protein, 9 aa, Homo Sapiens
ELRAHAIFV

SEQ ID NO: 465251 - protein, 9 aa, Homo Sapiens
TMAEMKVVL

SEQ ID NO: 465252 - protein, 9 aa, Homo Sapiens
SATATTTIG

SEQ ID NO: 465253 - protein, 9 aa, Homo Sapiens
SYPFESPVM

SEQ ID NO: 465254 - protein, 9 aa, Homo Sapiens
YFMKQVNDA

SEQ ID NO: 465255 - protein, 9 aa, Homo Sapiens
VPVFEAMGR

SEQ ID NO: 465256 - protein, 9 aa, Homo Sapiens
RFAFSIYNM

SEQ ID NO: 465257 - protein, 9 aa, Homo Sapiens
EMKSSRIKA

SEQ ID NO: 465258 - protein, 9 aa, Homo Sapiens
QQKLLHEAY

SEQ ID NO: 465259 - protein, 9 aa, Homo Sapiens
MWQVGIYHG

SEQ ID NO: 465260 - protein, 9 aa, Homo Sapiens
QCPPCLHVQ

SEQ ID NO: 465261 - protein, 9 aa, Homo Sapiens
LMPGSLEWG

SEQ ID NO: 465262 - protein, 9 aa, Homo Sapiens
TLHYLSTLN

SEQ ID NO: 465263 - protein, 9 aa, Homo Sapiens
FLSATKIEE

SEQ ID NO: 465264 - protein, 9 aa, Homo Sapiens
ATKIEEFIQ

SEQ ID NO: 465265 - protein, 9 aa, Homo Sapiens
LEWGFCMAV

SEQ ID NO: 465266 - protein, 9 aa, Homo Sapiens
GAFDTLHYL

SEQ ID NO: 465267 - protein, 9 aa, Homo Sapiens
IEEFIQWLL

SEQ ID NO: 465268 - protein, 9 aa, Homo Sapiens
PPCLHVQFL

SEQ ID NO: 465269 - protein, 9 aa, Homo Sapiens
KIEEFIQWL

SEQ ID NO: 465270 - protein, 9 aa, Homo Sapiens
DTLHYLSTL

SEQ ID NO: 465271 - protein, 9 aa, Homo Sapiens
YLSTLNLLA

SEQ ID NO: 465272 - protein, 9 aa, Homo Sapiens
FDTLHYLST

SEQ ID NO: 465273 - protein, 9 aa, Homo Sapiens
MPGSLEWGF

SEQ ID NO: 465274 - protein, 9 aa, Homo Sapiens
LRRKDSSQT

SEQ ID NO: 465275 - protein, 9 aa, Homo Sapiens
LHYLSTLNL

SEQ ID NO: 465276 - protein, 9 aa, Homo Sapiens
PVPQCPPCL

SEQ ID NO: 465277 - protein, 9 aa, Homo Sapiens
RKDSSQTTL

SEQ ID NO: 465278 - protein, 9 aa, Homo Sapiens
SLEWGFCMA

SEQ ID NO: 465279 - protein, 9 aa, Homo Sapiens
TFFLSATKI

SEQ ID NO: 465280 - protein, 9 aa, Homo Sapiens
TKIEEFIQW

SEQ ID NO: 465281 - protein, 9 aa, Homo Sapiens
VPQCPPCLH

SEQ ID NO: 465282 - protein, 9 aa, Homo Sapiens
PGSLEWGFC

SEQ ID NO: 465283 - protein, 9 aa, Homo Sapiens
FFLSATKIE

SEQ ID NO: 465284 - protein, 9 aa, Homo Sapiens
DSSQTTLGR

SEQ ID NO: 465285 - protein, 9 aa, Homo Sapiens
SATKIEEFI

SEQ ID NO: 465286 - protein, 9 aa, Homo Sapiens
PQCPPCLHV

SEQ ID NO: 465287 - protein, 9 aa, Homo Sapiens
HYLSTLNLL

SEQ ID NO: 465288 - protein, 9 aa, Homo Sapiens
WGFCMAVRE

SEQ ID NO: 465289 - protein, 9 aa, Homo Sapiens
PCLHVQFLS

SEQ ID NO: 465290 - protein, 9 aa, Homo Sapiens
RRKDSSQTT

SEQ ID NO: 465291 - protein, 9 aa, Homo Sapiens
PGAFDTLHY

SEQ ID NO: 465292 - protein, 9 aa, Homo Sapiens
CLHVQFLSH

SEQ ID NO: 465293 - protein, 9 aa, Homo Sapiens
KDSSQTTLG

SEQ ID NO: 465294 - protein, 9 aa, Homo Sapiens
QTTLGRILN

SEQ ID NO: 465295 - protein, 9 aa, Homo Sapiens
GSLEWGFCM

SEQ ID NO: 465296 - protein, 9 aa, Homo Sapiens
SLMPGSLEW

SEQ ID NO: 465297 - protein, 9 aa, Homo Sapiens
SSQTTLGRI

SEQ ID NO: 465298 - protein, 9 aa, Homo Sapiens
AFDTLHYLS

SEQ ID NO: 465299 - protein, 9 aa, Homo Sapiens
SQTTLGRIL

SEQ ID NO: 465300 - protein, 9 aa, Homo Sapiens
LSATKIEEF

SEQ ID NO: 465301 - protein, 9 aa, Homo Sapiens
NPVPQCPPC

SEQ ID NO: 465302 - protein, 9 aa, Homo Sapiens
CPPCLHVQF

SEQ ID NO: 465303 - protein, 9 aa, Homo Sapiens
EWGFCMAVR

SEQ ID NO: 465304 - protein, 9 aa, Homo Sapiens
SLRRKDSSQ

SEQ ID NO: 465305 - protein, 9 aa, Homo Sapiens
NPEEDPLHT

SEQ ID NO: 465306 - protein, 9 aa, Homo Sapiens
ATGFWNPQM

SEQ ID NO: 465307 - protein, 9 aa, Homo Sapiens
HTFLQYIED

SEQ ID NO: 465308 - protein, 9 aa, Homo Sapiens
GFWNPQMEA

SEQ ID NO: 465309 - protein, 9 aa, Homo Sapiens
EEDPLHTFL

SEQ ID NO: 465310 - protein, 9 aa, Homo Sapiens
SNPEEDPLH

SEQ ID NO: 465311 - protein, 9 aa, Homo Sapiens
PHRGMFRTV

SEQ ID NO: 465312 - protein, 9 aa, Homo Sapiens
IYIYTHIYI

SEQ ID NO: 465313 - protein, 9 aa, Homo Sapiens
HIYIHTHTF

SEQ ID NO: 465314 - protein, 9 aa, Homo Sapiens
MEAHVGAMK

SEQ ID NO: 465315 - protein, 9 aa, Homo Sapiens
GHYVCVAVN

SEQ ID NO: 465316 - protein, 9 aa, Homo Sapiens
PEEDPLHTF

SEQ ID NO: 465317 - protein, 9 aa, Homo Sapiens
ALLTHRASV

SEQ ID NO: 465318 - protein, 9 aa, Homo Sapiens
LVRALLTHR

SEQ ID NO: 465319 - protein, 9 aa, Homo Sapiens
DTGHYVCVA

SEQ ID NO: 465320 - protein, 9 aa, Homo Sapiens
HYVCVAVNV

SEQ ID NO: 465321 - protein, 9 aa, Homo Sapiens
FWNPQMEAH

SEQ ID NO: 465322 - protein, 9 aa, Homo Sapiens
NLVRALLTH

SEQ ID NO: 465323 - protein, 9 aa, Homo Sapiens
YTHIYIHTH

SEQ ID NO: 465324 - protein, 9 aa, Homo Sapiens
PLHTFLQYI

SEQ ID NO: 465325 - protein, 9 aa, Homo Sapiens
LLTHRASVS

SEQ ID NO: 465326 - protein, 9 aa, Homo Sapiens
YIYTHIYIH

SEQ ID NO: 465327 - protein, 9 aa, Homo Sapiens
IHVSDTGHY

SEQ ID NO: 465328 - protein, 9 aa, Homo Sapiens
IHTHTFYVS

SEQ ID NO: 465329 - protein, 9 aa, Homo Sapiens
LHTFLQYIE

SEQ ID NO: 465330 - protein, 9 aa, Homo Sapiens
THIYIHTHT

SEQ ID NO: 465331 - protein, 9 aa, Homo Sapiens
TGHYVCVAV

SEQ ID NO: 465332 - protein, 9 aa, Homo Sapiens
HVSDTGHYV

SEQ ID NO: 465333 - protein, 9 aa, Homo Sapiens
PGGRPHRGM

SEQ ID NO: 465334 - protein, 9 aa, Homo Sapiens
DGPPGGRPH

SEQ ID NO: 465335 - protein, 9 aa, Homo Sapiens
QMEAHVGAM

SEQ ID NO: 465336 - protein, 9 aa, Homo Sapiens
NPQMEAHVG

SEQ ID NO: 465337 - protein, 9 aa, Homo Sapiens
LTHRASVSA

SEQ ID NO: 465338 - protein, 9 aa, Homo Sapiens
NIHVSDTGH

SEQ ID NO: 465339 - protein, 9 aa, Homo Sapiens
EDPLHTFLQ

SEQ ID NO: 465340 - protein, 9 aa, Homo Sapiens
YIHTHTFYV

SEQ ID NO: 465341 - protein, 9 aa, Homo Sapiens
SDTGHYVCV

SEQ ID NO: 465342 - protein, 9 aa, Homo Sapiens
TGFWNPQME

SEQ ID NO: 465343 - protein, 9 aa, Homo Sapiens
GPPGGRPHR

SEQ ID NO: 465344 - protein, 9 aa, Homo Sapiens
IYIHTHTFY

SEQ ID NO: 465345 - protein, 9 aa, Homo Sapiens
HRASVSARA

SEQ ID NO: 465346 - protein, 9 aa, Homo Sapiens
DPLHTFLQY

SEQ ID NO: 465347 - protein, 9 aa, Homo Sapiens
IYTHIYIHT

SEQ ID NO: 465348 - protein, 9 aa, Homo Sapiens
VRALLTHRA

SEQ ID NO: 465349 - protein, 9 aa, Homo Sapiens
RPHRGMFRT

SEQ ID NO: 465350 - protein, 9 aa, Homo Sapiens
VSDTGHYVC

SEQ ID NO: 465351 - protein, 9 aa, Homo Sapiens
WNPQMEAHV

SEQ ID NO: 465352 - protein, 9 aa, Homo Sapiens
THRASVSAR

SEQ ID NO: 465353 - protein, 9 aa, Homo Sapiens
PPGGRPHRG

SEQ ID NO: 465354 - protein, 9 aa, Homo Sapiens
GRPHRGMFR

SEQ ID NO: 465355 - protein, 9 aa, Homo Sapiens
RALLTHRAS

SEQ ID NO: 465356 - protein, 9 aa, Homo Sapiens
GGRPHRGMF

SEQ ID NO: 465357 - protein, 9 aa, Homo Sapiens
PQMEAHVGA

SEQ ID NO: 465358 - protein, 9 aa, Homo Sapiens
HRGMFRTVG

SEQ ID NO: 465359 - protein, 9 aa, Homo Sapiens
HKFAMKLAG

SEQ ID NO: 465360 - protein, 9 aa, Homo Sapiens
THTHTGTQA

SEQ ID NO: 465361 - protein, 9 aa, Homo Sapiens
TDTLACTGT

SEQ ID NO: 465362 - protein, 9 aa, Homo Sapiens
VDSVLQVGF

SEQ ID NO: 465363 - protein, 9 aa, Homo Sapiens
DNGYLLEKK

SEQ ID NO: 465364 - protein, 9 aa, Homo Sapiens
GHWYDLKHT

SEQ ID NO: 465365 - protein, 9 aa, Homo Sapiens
KDNSVVPSN

SEQ ID NO: 465366 - protein, 9 aa, Homo Sapiens
GRVPCTLLL

SEQ ID NO: 465367 - protein, 9 aa, Homo Sapiens
YPCVFFCEE

SEQ ID NO: 465368 - protein, 9 aa, Homo Sapiens
HFRKVDFII

SEQ ID NO: 465369 - protein, 9 aa, Homo Sapiens
TYSDNIIFW

SEQ ID NO: 465370 - protein, 9 aa, Homo Sapiens
SSNFFGLEQ

SEQ ID NO: 465371 - protein, 9 aa, Homo Sapiens
IDCERHLER

SEQ ID NO: 465372 - protein, 9 aa, Homo Sapiens
VRQWAETLR

SEQ ID NO: 465373 - protein, 9 aa, Homo Sapiens
IITMDRRLH

SEQ ID NO: 465374 - protein, 9 aa, Homo Sapiens
TFYECPSTT

SEQ ID NO: 465375 - protein, 9 aa, Homo Sapiens
QTHTGIHRH

SEQ ID NO: 465376 - protein, 9 aa, Homo Sapiens
ECNACCNPD

SEQ ID NO: 465377 - protein, 9 aa, Homo Sapiens
HKSLRKLEP

SEQ ID NO: 465378 - protein, 9 aa, Homo Sapiens
GIFVLMVDV

SEQ ID NO: 465379 - protein, 9 aa, Homo Sapiens
PSPPEKPGV

SEQ ID NO: 465380 - protein, 9 aa, Homo Sapiens
DIDEDELLG

SEQ ID NO: 465381 - protein, 9 aa, Homo Sapiens
GGCPLVLGL

SEQ ID NO: 465382 - protein, 9 aa, Homo Sapiens
LQRLTWVCR

SEQ ID NO: 465383 - protein, 9 aa, Homo Sapiens
FQTLTPEVV

SEQ ID NO: 465384 - protein, 9 aa, Homo Sapiens
NMTEISKEG

SEQ ID NO: 465385 - protein, 9 aa, Homo Sapiens
PRGQKSKLH

SEQ ID NO: 465386 - protein, 9 aa, Homo Sapiens
GTHTVVVMG

SEQ ID NO: 465387 - protein, 9 aa, Homo Sapiens
LEKYKDIDE

SEQ ID NO: 465388 - protein, 9 aa, Homo Sapiens
QLKINCSAN

SEQ ID NO: 465389 - protein, 9 aa, Homo Sapiens
CVDSVLQVG

SEQ ID NO: 465390 - protein, 9 aa, Homo Sapiens
HTQAYTLTY

SEQ ID NO: 465391 - protein, 9 aa, Homo Sapiens
WGCLCRDWD

SEQ ID NO: 465392 - protein, 9 aa, Homo Sapiens
IRNESFLPE

SEQ ID NO: 465393 - protein, 9 aa, Homo Sapiens
RHTHTQAYT

SEQ ID NO: 465394 - protein, 9 aa, Homo Sapiens
SLSQGQGSQ

SEQ ID NO: 465395 - protein, 9 aa, Homo Sapiens
HTVVVMGGK

SEQ ID NO: 465396 - protein, 9 aa, Homo Sapiens
ASAEREREW

SEQ ID NO: 465397 - protein, 9 aa, Homo Sapiens
AYTLTYTGT

SEQ ID NO: 465398 - protein, 9 aa, Homo Sapiens
QAYTQTQTH

SEQ ID NO: 465399 - protein, 9 aa, Homo Sapiens
LCAFSRRED

SEQ ID NO: 465400 - protein, 9 aa, Homo Sapiens
GVSSNMTEI

SEQ ID NO: 465401 - protein, 9 aa, Homo Sapiens
RECLGTHTV

SEQ ID NO: 465402 - protein, 9 aa, Homo Sapiens
GYYYHTQRQ

SEQ ID NO: 465403 - protein, 9 aa, Homo Sapiens
LRGSPGSCG

SEQ ID NO: 465404 - protein, 9 aa, Homo Sapiens
ELQGRLVTK

SEQ ID NO: 465405 - protein, 9 aa, Homo Sapiens
LHQLKINCS

SEQ ID NO: 465406 - protein, 9 aa, Homo Sapiens
FKDRHFWHK

SEQ ID NO: 465407 - protein, 9 aa, Homo Sapiens
GAALYTYML

SEQ ID NO: 465408 - protein, 9 aa, Homo Sapiens
MENALNGSQ

SEQ ID NO: 465409 - protein, 9 aa, Homo Sapiens
QAYTLTYTG

SEQ ID NO: 465410 - protein, 9 aa, Homo Sapiens
TTLSGSEKK

SEQ ID NO: 465411 - protein, 9 aa, Homo Sapiens
MHGRVFRGL

SEQ ID NO: 465412 - protein, 9 aa, Homo Sapiens
WGIVTEDVF

SEQ ID NO: 465413 - protein, 9 aa, Homo Sapiens
KMSSPYMNK

SEQ ID NO: 465414 - protein, 9 aa, Homo Sapiens
TQTHTHTGI

SEQ ID NO: 465415 - protein, 9 aa, Homo Sapiens
MPSPEARVL

SEQ ID NO: 465416 - protein, 9 aa, Homo Sapiens
NQLETMHGR

SEQ ID NO: 465417 - protein, 9 aa, Homo Sapiens
RAMPSPEAR

SEQ ID NO: 465418 - protein, 9 aa, Homo Sapiens
HSGIFVLMV

SEQ ID NO: 465419 - protein, 9 aa, Homo Sapiens
THRHTHTHT

SEQ ID NO: 465420 - protein, 9 aa, Homo Sapiens
GTAIALIKT

SEQ ID NO: 465421 - protein, 9 aa, Homo Sapiens
KNIDTTINI

SEQ ID NO: 465422 - protein, 9 aa, Homo Sapiens
CGLRAMPSP

SEQ ID NO: 465423 - protein, 9 aa, Homo Sapiens
AELGTAIAL

SEQ ID NO: 465424 - protein, 9 aa, Homo Sapiens
LVHHCIQKG

SEQ ID NO: 465425 - protein, 9 aa, Homo Sapiens
SRQRALDLS

SEQ ID NO: 465426 - protein, 9 aa, Homo Sapiens
VPGPWGCLC

SEQ ID NO: 465427 - protein, 9 aa, Homo Sapiens
TSCSTMSCL

SEQ ID NO: 465428 - protein, 9 aa, Homo Sapiens
VTCVKKCPR

SEQ ID NO: 465429 - protein, 9 aa, Homo Sapiens
CNTSKDEHE

SEQ ID NO: 465430 - protein, 9 aa, Homo Sapiens
LMAPLSPGA

SEQ ID NO: 465431 - protein, 9 aa, Homo Sapiens
EDFQTLTPE

SEQ ID NO: 465432 - protein, 9 aa, Homo Sapiens
GLVVESTPS

SEQ ID NO: 465433 - protein, 9 aa, Homo Sapiens
TMDRRLHSP

SEQ ID NO: 465434 - protein, 9 aa, Homo Sapiens
GTHRHTHTH

SEQ ID NO: 465435 - protein, 9 aa, Homo Sapiens
LTGNQLETM

SEQ ID NO: 465436 - protein, 9 aa, Homo Sapiens
LYTYMLPQS

SEQ ID NO: 465437 - protein, 9 aa, Homo Sapiens
RPGWAALQR

SEQ ID NO: 465438 - protein, 9 aa, Homo Sapiens
GCVDSVLQV

SEQ ID NO: 465439 - protein, 9 aa, Homo Sapiens
RHLERGQDI

SEQ ID NO: 465440 - protein, 9 aa, Homo Sapiens
HHLPCFYSL

SEQ ID NO: 465441 - protein, 9 aa, Homo Sapiens
HCIQKGGNV

SEQ ID NO: 465442 - protein, 9 aa, Homo Sapiens
HLVPGPWGC

SEQ ID NO: 465443 - protein, 9 aa, Homo Sapiens
TIITMDRRL

SEQ ID NO: 465444 - protein, 9 aa, Homo Sapiens
SFIRNESFL

SEQ ID NO: 465445 - protein, 9 aa, Homo Sapiens
EVTSFRLGL

SEQ ID NO: 465446 - protein, 9 aa, Homo Sapiens
AALYTYMLP

SEQ ID NO: 465447 - protein, 9 aa, Homo Sapiens
QRGPNPIFR

SEQ ID NO: 465448 - protein, 9 aa, Homo Sapiens
FRLGLCGAY

SEQ ID NO: 465449 - protein, 9 aa, Homo Sapiens
FCEEETQQR

SEQ ID NO: 465450 - protein, 9 aa, Homo Sapiens
MSSPYMNKL

SEQ ID NO: 465451 - protein, 9 aa, Homo Sapiens
RECNACCNP

SEQ ID NO: 465452 - protein, 9 aa, Homo Sapiens
LVPGPWGCL

SEQ ID NO: 465453 - protein, 9 aa, Homo Sapiens
VVDLAANQV

SEQ ID NO: 465454 - protein, 9 aa, Homo Sapiens
LGLCGAYFR

SEQ ID NO: 465455 - protein, 9 aa, Homo Sapiens
QVQSVFPLC

SEQ ID NO: 465456 - protein, 9 aa, Homo Sapiens
TQAYTQTHI

SEQ ID NO: 465457 - protein, 9 aa, Homo Sapiens
YTQTQTHTH

SEQ ID NO: 465458 - protein, 9 aa, Homo Sapiens
VTGSLLEEM

SEQ ID NO: 465459 - protein, 9 aa, Homo Sapiens
LHSGIFVLM

SEQ ID NO: 465460 - protein, 9 aa, Homo Sapiens
GGYQAVRQW

SEQ ID NO: 465461 - protein, 9 aa, Homo Sapiens
KSKLHAREK

SEQ ID NO: 465462 - protein, 9 aa, Homo Sapiens
LLESGCVDS

SEQ ID NO: 465463 - protein, 9 aa, Homo Sapiens
KTKKYIKKY

SEQ ID NO: 465464 - protein, 9 aa, Homo Sapiens
KNSFAGQTG

SEQ ID NO: 465465 - protein, 9 aa, Homo Sapiens
AVESQGGCP

SEQ ID NO: 465466 - protein, 9 aa, Homo Sapiens
LALGHVAAF

SEQ ID NO: 465467 - protein, 9 aa, Homo Sapiens
TLNFIISNL

SEQ ID NO: 465468 - protein, 9 aa, Homo Sapiens
NCSANLIAQ

SEQ ID NO: 465469 - protein, 9 aa, Homo Sapiens
RCKDNSVVP

SEQ ID NO: 465470 - protein, 9 aa, Homo Sapiens
QESGLRYDK

SEQ ID NO: 465471 - protein, 9 aa, Homo Sapiens
DTLACTGTH

SEQ ID NO: 465472 - protein, 9 aa, Homo Sapiens
NTGLFSRSK

SEQ ID NO: 465473 - protein, 9 aa, Homo Sapiens
THRHTGMHR

SEQ ID NO: 465474 - protein, 9 aa, Homo Sapiens
EKPSPPEKP

SEQ ID NO: 465475 - protein, 9 aa, Homo Sapiens
EDAELGTAI

SEQ ID NO: 465476 - protein, 9 aa, Homo Sapiens
ETMHGRVFR

SEQ ID NO: 465477 - protein, 9 aa, Homo Sapiens
YHTQRQECI

SEQ ID NO: 465478 - protein, 9 aa, Homo Sapiens
SFSLHHLPC

SEQ ID NO: 465479 - protein, 9 aa, Homo Sapiens
GKYSFGVTC

SEQ ID NO: 465480 - protein, 9 aa, Homo Sapiens
DTHADTPTS

SEQ ID NO: 465481 - protein, 9 aa, Homo Sapiens
LKHTSKITL

SEQ ID NO: 465482 - protein, 9 aa, Homo Sapiens
IDTTINISC

SEQ ID NO: 465483 - protein, 9 aa, Homo Sapiens
SRHLPSICG

SEQ ID NO: 465484 - protein, 9 aa, Homo Sapiens
YTGTHRHTH

SEQ ID NO: 465485 - protein, 9 aa, Homo Sapiens
PGWAALQRL

SEQ ID NO: 465486 - protein, 9 aa, Homo Sapiens
HYQQQQVAG

SEQ ID NO: 465487 - protein, 9 aa, Homo Sapiens
QWNYACMPM

SEQ ID NO: 465488 - protein, 9 aa, Homo Sapiens
GWGIVTEDV

SEQ ID NO: 465489 - protein, 9 aa, Homo Sapiens
NILLHSGIF

SEQ ID NO: 465490 - protein, 9 aa, Homo Sapiens
RPRSKQEAW

SEQ ID NO: 465491 - protein, 9 aa, Homo Sapiens
RTHAYTREC

SEQ ID NO: 465492 - protein, 9 aa, Homo Sapiens
RSKQEAWST

SEQ ID NO: 465493 - protein, 9 aa, Homo Sapiens
NIDTTINIS

SEQ ID NO: 465494 - protein, 9 aa, Homo Sapiens
CGQDGETLL

SEQ ID NO: 465495 - protein, 9 aa, Homo Sapiens
EESASRAQE

SEQ ID NO: 465496 - protein, 9 aa, Homo Sapiens
QTGTHRHIH

SEQ ID NO: 465497 - protein, 9 aa, Homo Sapiens
MPYAGGVGA

SEQ ID NO: 465498 - protein, 9 aa, Homo Sapiens
LGSRQRALD

SEQ ID NO: 465499 - protein, 9 aa, Homo Sapiens
LACTGTHRH

SEQ ID NO: 465500 - protein, 9 aa, Homo Sapiens
VSSNMTEIS

SEQ ID NO: 465501 - protein, 9 aa, Homo Sapiens
TLTLNFIIS

SEQ ID NO: 465502 - protein, 9 aa, Homo Sapiens
EDMENALNG

SEQ ID NO: 465503 - protein, 9 aa, Homo Sapiens
MTRKWAQYK

SEQ ID NO: 465504 - protein, 9 aa, Homo Sapiens
VFFCEEETQ

SEQ ID NO: 465505 - protein, 9 aa, Homo Sapiens
KEDNGYLLE

SEQ ID NO: 465506 - protein, 9 aa, Homo Sapiens
GSQTELPNP

SEQ ID NO: 465507 - protein, 9 aa, Homo Sapiens
TQRQECIDN

SEQ ID NO: 465508 - protein, 9 aa, Homo Sapiens
IQKGGNVNQ

SEQ ID NO: 465509 - protein, 9 aa, Homo Sapiens
HTDTLACTG

SEQ ID NO: 465510 - protein, 9 aa, Homo Sapiens
ITMDRRLHS

SEQ ID NO: 465511 - protein, 9 aa, Homo Sapiens
IFREKVTFA

SEQ ID NO: 465512 - protein, 9 aa, Homo Sapiens
SSPYMNKLI

SEQ ID NO: 465513 - protein, 9 aa, Homo Sapiens
NISCLPNEG

SEQ ID NO: 465514 - protein, 9 aa, Homo Sapiens
ESASRAQES

SEQ ID NO: 465515 - protein, 9 aa, Homo Sapiens
CIQKGGNVN

SEQ ID NO: 465516 - protein, 9 aa, Homo Sapiens
GWAALQRLT

SEQ ID NO: 465517 - protein, 9 aa, Homo Sapiens
TSFRLGLCG

SEQ ID NO: 465518 - protein, 9 aa, Homo Sapiens
EGVLNPACA

SEQ ID NO: 465519 - protein, 9 aa, Homo Sapiens
MEGSSAMAE

SEQ ID NO: 465520 - protein, 9 aa, Homo Sapiens
PLCAFSRRE

SEQ ID NO: 465521 - protein, 9 aa, Homo Sapiens
YTRECLGTH

SEQ ID NO: 465522 - protein, 9 aa, Homo Sapiens
PICGLRAMP

SEQ ID NO: 465523 - protein, 9 aa, Homo Sapiens
TYMLPQSYH

SEQ ID NO: 465524 - protein, 9 aa, Homo Sapiens
SYPRANTGL

SEQ ID NO: 465525 - protein, 9 aa, Homo Sapiens
EMPYAGGVG

SEQ ID NO: 465526 - protein, 9 aa, Homo Sapiens
GYQAVRQWA

SEQ ID NO: 465527 - protein, 9 aa, Homo Sapiens
TINISCLPN

SEQ ID NO: 465528 - protein, 9 aa, Homo Sapiens
LTLNFIISN

SEQ ID NO: 465529 - protein, 9 aa, Homo Sapiens
GLRAMPSPE

SEQ ID NO: 465530 - protein, 9 aa, Homo Sapiens
SSNMTEISK

SEQ ID NO: 465531 - protein, 9 aa, Homo Sapiens
LGHFRKVDF

SEQ ID NO: 465532 - protein, 9 aa, Homo Sapiens
KTLTLNFII

SEQ ID NO: 465533 - protein, 9 aa, Homo Sapiens
HVAAFSDDC

SEQ ID NO: 465534 - protein, 9 aa, Homo Sapiens
DKIRYSYLP

SEQ ID NO: 465535 - protein, 9 aa, Homo Sapiens
SRPGWAALQ

SEQ ID NO: 465536 - protein, 9 aa, Homo Sapiens
VDLAANQVM

SEQ ID NO: 465537 - protein, 9 aa, Homo Sapiens
WISGWGIVT

SEQ ID NO: 465538 - protein, 9 aa, Homo Sapiens
HKHTHKHTD

SEQ ID NO: 465539 - protein, 9 aa, Homo Sapiens
SKLHAREKR

SEQ ID NO: 465540 - protein, 9 aa, Homo Sapiens
VTSFRLGLC

SEQ ID NO: 465541 - protein, 9 aa, Homo Sapiens
VESQGGCPL

SEQ ID NO: 465542 - protein, 9 aa, Homo Sapiens
CAFSRREDM

SEQ ID NO: 465543 - protein, 9 aa, Homo Sapiens
HLPSICGER

SEQ ID NO: 465544 - protein, 9 aa, Homo Sapiens
LNGSQSSHA

SEQ ID NO: 465545 - protein, 9 aa, Homo Sapiens
TMHGRVFRG

SEQ ID NO: 465546 - protein, 9 aa, Homo Sapiens
IQAQTGTHR

SEQ ID NO: 465547 - protein, 9 aa, Homo Sapiens
FFGLEQLEH

SEQ ID NO: 465548 - protein, 9 aa, Homo Sapiens
ICNTSKDEH

SEQ ID NO: 465549 - protein, 9 aa, Homo Sapiens
TSGLVVEST

SEQ ID NO: 465550 - protein, 9 aa, Homo Sapiens
PIFREKVTF

SEQ ID NO: 465551 - protein, 9 aa, Homo Sapiens
YVVEEGVLN

SEQ ID NO: 465552 - protein, 9 aa, Homo Sapiens
NIQRGPNPI

SEQ ID NO: 465553 - protein, 9 aa, Homo Sapiens
YEMPYAGGV

SEQ ID NO: 465554 - protein, 9 aa, Homo Sapiens
HTGIHRHTQ

SEQ ID NO: 465555 - protein, 9 aa, Homo Sapiens
DTPTSTHKH

SEQ ID NO: 465556 - protein, 9 aa, Homo Sapiens
RAQESGLRY

SEQ ID NO: 465557 - protein, 9 aa, Homo Sapiens
PEVVHQSLF

SEQ ID NO: 465558 - protein, 9 aa, Homo Sapiens
LVTTLSGSE

SEQ ID NO: 465559 - protein, 9 aa, Homo Sapiens
TRECLGTHT

SEQ ID NO: 465560 - protein, 9 aa, Homo Sapiens
HTGMHRHTH

SEQ ID NO: 465561 - protein, 9 aa, Homo Sapiens
DFQTLTPEV

SEQ ID NO: 465562 - protein, 9 aa, Homo Sapiens
LPSICGERL

SEQ ID NO: 465563 - protein, 9 aa, Homo Sapiens
MDRRLHSPM

SEQ ID NO: 465564 - protein, 9 aa, Homo Sapiens
HAREKRRKA

SEQ ID NO: 465565 - protein, 9 aa, Homo Sapiens
GLGNSFIRN

SEQ ID NO: 465566 - protein, 9 aa, Homo Sapiens
PRANTGLFS

SEQ ID NO: 465567 - protein, 9 aa, Homo Sapiens
EGKYSFGVT

SEQ ID NO: 465568 - protein, 9 aa, Homo Sapiens
YGAALYTYM

SEQ ID NO: 465569 - protein, 9 aa, Homo Sapiens
SKQEAWSTH

SEQ ID NO: 465570 - protein, 9 aa, Homo Sapiens
QEAWSTHNT

SEQ ID NO: 465571 - protein, 9 aa, Homo Sapiens
TGTHRHTHK

SEQ ID NO: 465572 - protein, 9 aa, Homo Sapiens
TGTQAYTQT

SEQ ID NO: 465573 - protein, 9 aa, Homo Sapiens
AQTGTHRHI

SEQ ID NO: 465574 - protein, 9 aa, Homo Sapiens
ESQGGCPLV

SEQ ID NO: 465575 - protein, 9 aa, Homo Sapiens
STHKHTHKH

SEQ ID NO: 465576 - protein, 9 aa, Homo Sapiens
GMHRHTHTQ

SEQ ID NO: 465577 - protein, 9 aa, Homo Sapiens
EKYKDIDED

SEQ ID NO: 465578 - protein, 9 aa, Homo Sapiens
QECIDNDEC

SEQ ID NO: 465579 - protein, 9 aa, Homo Sapiens
CLCRDWDQM

SEQ ID NO: 465580 - protein, 9 aa, Homo Sapiens
WEREKERER

SEQ ID NO: 465581 - protein, 9 aa, Homo Sapiens
TSTSCSTMS

SEQ ID NO: 465582 - protein, 9 aa, Homo Sapiens
THKHTHKHT

SEQ ID NO: 465583 - protein, 9 aa, Homo Sapiens
TGTHRHTHT

SEQ ID NO: 465584 - protein, 9 aa, Homo Sapiens
LCGAYFRCQ

SEQ ID NO: 465585 - protein, 9 aa, Homo Sapiens
TLSGSEKKQ

SEQ ID NO: 465586 - protein, 9 aa, Homo Sapiens
FGLEQLEHL

SEQ ID NO: 465587 - protein, 9 aa, Homo Sapiens
PQVTMEGSS

SEQ ID NO: 465588 - protein, 9 aa, Homo Sapiens
HGSTPQVTM

SEQ ID NO: 465589 - protein, 9 aa, Homo Sapiens
LGHVAAFSD

SEQ ID NO: 465590 - protein, 9 aa, Homo Sapiens
HRYTHRHTQ

SEQ ID NO: 465591 - protein, 9 aa, Homo Sapiens
KGLGNSFIR

SEQ ID NO: 465592 - protein, 9 aa, Homo Sapiens
GRPRSKQEA

SEQ ID NO: 465593 - protein, 9 aa, Homo Sapiens
FLPRSLRVV

SEQ ID NO: 465594 - protein, 9 aa, Homo Sapiens
YTHRHTQAY

SEQ ID NO: 465595 - protein, 9 aa, Homo Sapiens
LIDCERHLE

SEQ ID NO: 465596 - protein, 9 aa, Homo Sapiens
GCPLVLGLL

SEQ ID NO: 465597 - protein, 9 aa, Homo Sapiens
QGVSSNMTE

SEQ ID NO: 465598 - protein, 9 aa, Homo Sapiens
HRHTGMHRH

SEQ ID NO: 465599 - protein, 9 aa, Homo Sapiens
QRLTWVCRR

SEQ ID NO: 465600 - protein, 9 aa, Homo Sapiens
IGDKIRYSY

SEQ ID NO: 465601 - protein, 9 aa, Homo Sapiens
GPWGCLCRD

SEQ ID NO: 465602 - protein, 9 aa, Homo Sapiens
ITLVTTLSG

SEQ ID NO: 465603 - protein, 9 aa, Homo Sapiens
PMPQSLGEP

SEQ ID NO: 465604 - protein, 9 aa, Homo Sapiens
QTLTPEVVH

SEQ ID NO: 465605 - protein, 9 aa, Homo Sapiens
NPIFREKVT

SEQ ID NO: 465606 - protein, 9 aa, Homo Sapiens
GGKEDNGYL

SEQ ID NO: 465607 - protein, 9 aa, Homo Sapiens
LTPEVVHQS

SEQ ID NO: 465608 - protein, 9 aa, Homo Sapiens
LPGLCALWD

SEQ ID NO: 465609 - protein, 9 aa, Homo Sapiens
TDTHADTPT

SEQ ID NO: 465610 - protein, 9 aa, Homo Sapiens
PYMNKLIIL

SEQ ID NO: 465611 - protein, 9 aa, Homo Sapiens
KHKTKKYIK

SEQ ID NO: 465612 - protein, 9 aa, Homo Sapiens
YSYLPGYIL

SEQ ID NO: 465613 - protein, 9 aa, Homo Sapiens
NGYLLEKKI

SEQ ID NO: 465614 - protein, 9 aa, Homo Sapiens
DLEKYKDID

SEQ ID NO: 465615 - protein, 9 aa, Homo Sapiens
KQEAWSTHN

SEQ ID NO: 465616 - protein, 9 aa, Homo Sapiens
RSTTSGLVV

SEQ ID NO: 465617 - protein, 9 aa, Homo Sapiens
RANTGLFSR

SEQ ID NO: 465618 - protein, 9 aa, Homo Sapiens
LNFIISNLQ

SEQ ID NO: 465619 - protein, 9 aa, Homo Sapiens
HADTPTSTH

SEQ ID NO: 465620 - protein, 9 aa, Homo Sapiens
IRYSYLPGY

SEQ ID NO: 465621 - protein, 9 aa, Homo Sapiens
CMPMPQSLG

SEQ ID NO: 465622 - protein, 9 aa, Homo Sapiens
NFFGLEQLE

SEQ ID NO: 465623 - protein, 9 aa, Homo Sapiens
HTHKHTHRH

SEQ ID NO: 465624 - protein, 9 aa, Homo Sapiens
DLKHTSKIT

SEQ ID NO: 465625 - protein, 9 aa, Homo Sapiens
ICGERLRGP

SEQ ID NO: 465626 - protein, 9 aa, Homo Sapiens
RKVDFIIIV

SEQ ID NO: 465627 - protein, 9 aa, Homo Sapiens
ACMPMPQSL

SEQ ID NO: 465628 - protein, 9 aa, Homo Sapiens
HTHTQAYTL

SEQ ID NO: 465629 - protein, 9 aa, Homo Sapiens
TVVVMGGKE

SEQ ID NO: 465630 - protein, 9 aa, Homo Sapiens
VEEGVLNPA

SEQ ID NO: 465631 - protein, 9 aa, Homo Sapiens
VVESTPSRL

SEQ ID NO: 465632 - protein, 9 aa, Homo Sapiens
QTHTHTGIH

SEQ ID NO: 465633 - protein, 9 aa, Homo Sapiens
THTGTQAYT

SEQ ID NO: 465634 - protein, 9 aa, Homo Sapiens
VVEEGVLNP

SEQ ID NO: 465635 - protein, 9 aa, Homo Sapiens
RHIHSRTHA

SEQ ID NO: 465636 - protein, 9 aa, Homo Sapiens
HHCIQKGGN

SEQ ID NO: 465637 - protein, 9 aa, Homo Sapiens
ACTGTHRHT

SEQ ID NO: 465638 - protein, 9 aa, Homo Sapiens
LIITIITMD

SEQ ID NO: 465639 - protein, 9 aa, Homo Sapiens
GPNPIFREK

SEQ ID NO: 465640 - protein, 9 aa, Homo Sapiens
QAQTGTHRH

SEQ ID NO: 465641 - protein, 9 aa, Homo Sapiens
KYSFGVTCV

SEQ ID NO: 465642 - protein, 9 aa, Homo Sapiens
WMEDGHHQV

SEQ ID NO: 465643 - protein, 9 aa, Homo Sapiens
RVVDLAANQ

SEQ ID NO: 465644 - protein, 9 aa, Homo Sapiens
RNSYPRANT

SEQ ID NO: 465645 - protein, 9 aa, Homo Sapiens
TEISKEGNR

SEQ ID NO: 465646 - protein, 9 aa, Homo Sapiens
TQAYTLTYT

SEQ ID NO: 465647 - protein, 9 aa, Homo Sapiens
WNYACMPMP

SEQ ID NO: 465648 - protein, 9 aa, Homo Sapiens
SRAQESGLR

SEQ ID NO: 465649 - protein, 9 aa, Homo Sapiens
LKTLTLNFI

SEQ ID NO: 465650 - protein, 9 aa, Homo Sapiens
YAGGVGAQL

SEQ ID NO: 465651 - protein, 9 aa, Homo Sapiens
SLHHLPCFY

SEQ ID NO: 465652 - protein, 9 aa, Homo Sapiens
IELHQLKIN

SEQ ID NO: 465653 - protein, 9 aa, Homo Sapiens
QGGCPLVLG

SEQ ID NO: 465654 - protein, 9 aa, Homo Sapiens
EKPGVTSIS

SEQ ID NO: 465655 - protein, 9 aa, Homo Sapiens
ITIITMDRR

SEQ ID NO: 465656 - protein, 9 aa, Homo Sapiens
PVKNSFAGQ

SEQ ID NO: 465657 - protein, 9 aa, Homo Sapiens
EREWEREKE

SEQ ID NO: 465658 - protein, 9 aa, Homo Sapiens
FIISNLQYS

SEQ ID NO: 465659 - protein, 9 aa, Homo Sapiens
GSPGSCGLP

SEQ ID NO: 465660 - protein, 9 aa, Homo Sapiens
APLSPGATL

SEQ ID NO: 465661 - protein, 9 aa, Homo Sapiens
THTGIHTHR

SEQ ID NO: 465662 - protein, 9 aa, Homo Sapiens
THTHTGIHT

SEQ ID NO: 465663 - protein, 9 aa, Homo Sapiens
LHHLPCFYS

SEQ ID NO: 465664 - protein, 9 aa, Homo Sapiens
ADLVHHCIQ

SEQ ID NO: 465665 - protein, 9 aa, Homo Sapiens
LPRSLRVVD

SEQ ID NO: 465666 - protein, 9 aa, Homo Sapiens
HTGIHTHRY

SEQ ID NO: 465667 - protein, 9 aa, Homo Sapiens
HLERGQDIR

SEQ ID NO: 465668 - protein, 9 aa, Homo Sapiens
ALYTYMLPQ

SEQ ID NO: 465669 - protein, 9 aa, Homo Sapiens
LRAMPSPEA

SEQ ID NO: 465670 - protein, 9 aa, Homo Sapiens
GTHRHIHSR

SEQ ID NO: 465671 - protein, 9 aa, Homo Sapiens
IALIKTHDL

SEQ ID NO: 465672 - protein, 9 aa, Homo Sapiens
THADTPTST

SEQ ID NO: 465673 - protein, 9 aa, Homo Sapiens
GDKIRYSYL

SEQ ID NO: 465674 - protein, 9 aa, Homo Sapiens
SDNIIFWME

SEQ ID NO: 465675 - protein, 9 aa, Homo Sapiens
TPQVTMEGS

SEQ ID NO: 465676 - protein, 9 aa, Homo Sapiens
HTHTGTQAY

SEQ ID NO: 465677 - protein, 9 aa, Homo Sapiens
SNMTEISKE

SEQ ID NO: 465678 - protein, 9 aa, Homo Sapiens
HTQAYTQTQ

SEQ ID NO: 465679 - protein, 9 aa, Homo Sapiens
PGSCGLPGA

SEQ ID NO: 465680 - protein, 9 aa, Homo Sapiens
HTSKITLVD

SEQ ID NO: 465681 - protein, 9 aa, Homo Sapiens
HTHTGIHTH

SEQ ID NO: 465682 - protein, 9 aa, Homo Sapiens
HTQAYTQTH

SEQ ID NO: 465683 - protein, 9 aa, Homo Sapiens
LSRPGWAAL

SEQ ID NO: 465684 - protein, 9 aa, Homo Sapiens
PGPWGCLCR

SEQ ID NO: 465685 - protein, 9 aa, Homo Sapiens
MPQSLGEPT

SEQ ID NO: 465686 - protein, 9 aa, Homo Sapiens
TLACTGTHR

SEQ ID NO: 465687 - protein, 9 aa, Homo Sapiens
ITMSSNFFG

SEQ ID NO: 465688 - protein, 9 aa, Homo Sapiens
GHVAAFSDD

SEQ ID NO: 465689 - protein, 9 aa, Homo Sapiens
KIRYSYLPG

SEQ ID NO: 465690 - protein, 9 aa, Homo Sapiens
HLPCFYSLF

SEQ ID NO: 465691 - protein, 9 aa, Homo Sapiens
KHTDTLACT

SEQ ID NO: 465692 - protein, 9 aa, Homo Sapiens
NELQGRLVT

SEQ ID NO: 465693 - protein, 9 aa, Homo Sapiens
KHTSKITLV

SEQ ID NO: 465694 - protein, 9 aa, Homo Sapiens
RSLRVVDLA

SEQ ID NO: 465695 - protein, 9 aa, Homo Sapiens
WPKDHVYIC

SEQ ID NO: 465696 - protein, 9 aa, Homo Sapiens
ENALNGSQS

SEQ ID NO: 465697 - protein, 9 aa, Homo Sapiens
KFAMKLAGA

SEQ ID NO: 465698 - protein, 9 aa, Homo Sapiens
RHTQAYTQT

SEQ ID NO: 465699 - protein, 9 aa, Homo Sapiens
CERHLERGQ

SEQ ID NO: 465700 - protein, 9 aa, Homo Sapiens
RAENRLGSR

SEQ ID NO: 465701 - protein, 9 aa, Homo Sapiens
TTLALGHVA

SEQ ID NO: 465702 - protein, 9 aa, Homo Sapiens
YYYHTQRQE

SEQ ID NO: 465703 - protein, 9 aa, Homo Sapiens
FIRNESFLP

SEQ ID NO: 465704 - protein, 9 aa, Homo Sapiens
TMEGSSAMA

SEQ ID NO: 465705 - protein, 9 aa, Homo Sapiens
GVTCVKKCP

SEQ ID NO: 465706 - protein, 9 aa, Homo Sapiens
CRECNACCN

SEQ ID NO: 465707 - protein, 9 aa, Homo Sapiens
QDGETLLPG

SEQ ID NO: 465708 - protein, 9 aa, Homo Sapiens
VHKFAMKLA

SEQ ID NO: 465709 - protein, 9 aa, Homo Sapiens
QGQGSQTEL

SEQ ID NO: 465710 - protein, 9 aa, Homo Sapiens
NRLGSRQRA

SEQ ID NO: 465711 - protein, 9 aa, Homo Sapiens
GVGAQLMAP

SEQ ID NO: 465712 - protein, 9 aa, Homo Sapiens
SPYPCVFFC

SEQ ID NO: 465713 - protein, 9 aa, Homo Sapiens
KDIDEDELL

SEQ ID NO: 465714 - protein, 9 aa, Homo Sapiens
GITLVTTLS

SEQ ID NO: 465715 - protein, 9 aa, Homo Sapiens
EEMTRKWAQ

SEQ ID NO: 465716 - protein, 9 aa, Homo Sapiens
KPSPPEKPG

SEQ ID NO: 465717 - protein, 9 aa, Homo Sapiens
SICGERLRG

SEQ ID NO: 465718 - protein, 9 aa, Homo Sapiens
LSPVKNSFA

SEQ ID NO: 465719 - protein, 9 aa, Homo Sapiens
YPRANTGLF

SEQ ID NO: 465720 - protein, 9 aa, Homo Sapiens
DLGHFRKVD

SEQ ID NO: 465721 - protein, 9 aa, Homo Sapiens
FWMEDGHHQ

SEQ ID NO: 465722 - protein, 9 aa, Homo Sapiens
FLSLSQGQG

SEQ ID NO: 465723 - protein, 9 aa, Homo Sapiens
VGAQLMAPL

SEQ ID NO: 465724 - protein, 9 aa, Homo Sapiens
IQRGPNPIF

SEQ ID NO: 465725 - protein, 9 aa, Homo Sapiens
GQKSKLHAR

SEQ ID NO: 465726 - protein, 9 aa, Homo Sapiens
SLRVVDLAA

SEQ ID NO: 465727 - protein, 9 aa, Homo Sapiens
EIKNRCKDN

SEQ ID NO: 465728 - protein, 9 aa, Homo Sapiens
DMENALNGS

SEQ ID NO: 465729 - protein, 9 aa, Homo Sapiens
YQHYQQQQV

SEQ ID NO: 465730 - protein, 9 aa, Homo Sapiens
CSTMSCLSR

SEQ ID NO: 465731 - protein, 9 aa, Homo Sapiens
GSTPQVTME

SEQ ID NO: 465732 - protein, 9 aa, Homo Sapiens
AMPSPEARV

SEQ ID NO: 465733 - protein, 9 aa, Homo Sapiens
TLTPEVVHQ

SEQ ID NO: 465734 - protein, 9 aa, Homo Sapiens
PEGKYSFGV

SEQ ID NO: 465735 - protein, 9 aa, Homo Sapiens
LETMHGRVF

SEQ ID NO: 465736 - protein, 9 aa, Homo Sapiens
EEGVLNPAC

SEQ ID NO: 465737 - protein, 9 aa, Homo Sapiens
THTGIHRHT

SEQ ID NO: 465738 - protein, 9 aa, Homo Sapiens
RHFWHKSLR

SEQ ID NO: 465739 - protein, 9 aa, Homo Sapiens
GETLLPGLC

SEQ ID NO: 465740 - protein, 9 aa, Homo Sapiens
THTQAYTLT

SEQ ID NO: 465741 - protein, 9 aa, Homo Sapiens
STTPWEPVG

SEQ ID NO: 465742 - protein, 9 aa, Homo Sapiens
RVHKFAMKL

SEQ ID NO: 465743 - protein, 9 aa, Homo Sapiens
LLEEMTRKW

SEQ ID NO: 465744 - protein, 9 aa, Homo Sapiens
THRHIHSRT

SEQ ID NO: 465745 - protein, 9 aa, Homo Sapiens
RHLPSICGE

SEQ ID NO: 465746 - protein, 9 aa, Homo Sapiens
VHHCIQKGG

SEQ ID NO: 465747 - protein, 9 aa, Homo Sapiens
SQGQGSQTE

SEQ ID NO: 465748 - protein, 9 aa, Homo Sapiens
THTVVVMGG

SEQ ID NO: 465749 - protein, 9 aa, Homo Sapiens
SNFFGLEQL

SEQ ID NO: 465750 - protein, 9 aa, Homo Sapiens
KYIKKYMQK

SEQ ID NO: 465751 - protein, 9 aa, Homo Sapiens
SQGGCPLVL

SEQ ID NO: 465752 - protein, 9 aa, Homo Sapiens
SPGATLTST

SEQ ID NO: 465753 - protein, 9 aa, Homo Sapiens
AIALIKTHD

SEQ ID NO: 465754 - protein, 9 aa, Homo Sapiens
YTQTHTGIH

SEQ ID NO: 465755 - protein, 9 aa, Homo Sapiens
LGTHTVVVM

SEQ ID NO: 465756 - protein, 9 aa, Homo Sapiens
FFCEEETQQ

SEQ ID NO: 465757 - protein, 9 aa, Homo Sapiens
PGRPRSKQE

SEQ ID NO: 465758 - protein, 9 aa, Homo Sapiens
THRHTQAYT

SEQ ID NO: 465759 - protein, 9 aa, Homo Sapiens
AQESGLRYD

SEQ ID NO: 465760 - protein, 9 aa, Homo Sapiens
SVYYVVEEG

SEQ ID NO: 465761 - protein, 9 aa, Homo Sapiens
EMTRKWAQY

SEQ ID NO: 465762 - protein, 9 aa, Homo Sapiens
YMLPQSYHT

SEQ ID NO: 465763 - protein, 9 aa, Homo Sapiens
DAELGTAIA

SEQ ID NO: 465764 - protein, 9 aa, Homo Sapiens
IFWMEDGHH

SEQ ID NO: 465765 - protein, 9 aa, Homo Sapiens
PYPCVFFCE

SEQ ID NO: 465766 - protein, 9 aa, Homo Sapiens
LGTAIALIK

SEQ ID NO: 465767 - protein, 9 aa, Homo Sapiens
LDLGHFRKV

SEQ ID NO: 465768 - protein, 9 aa, Homo Sapiens
HRHTQAYTQ

SEQ ID NO: 465769 - protein, 9 aa, Homo Sapiens
NYACMPMPQ

SEQ ID NO: 465770 - protein, 9 aa, Homo Sapiens
MAVESQGGC

SEQ ID NO: 465771 - protein, 9 aa, Homo Sapiens
NACCNPDGN

SEQ ID NO: 465772 - protein, 9 aa, Homo Sapiens
AALQRLTWV

SEQ ID NO: 465773 - protein, 9 aa, Homo Sapiens
SVFPLCAFS

SEQ ID NO: 465774 - protein, 9 aa, Homo Sapiens
NGSQSSHAS

SEQ ID NO: 465775 - protein, 9 aa, Homo Sapiens
MTEISKEGN

SEQ ID NO: 465776 - protein, 9 aa, Homo Sapiens
MGGKEDNGY

SEQ ID NO: 465777 - protein, 9 aa, Homo Sapiens
KINCSANLI

SEQ ID NO: 465778 - protein, 9 aa, Homo Sapiens
HAYTRECLG

SEQ ID NO: 465779 - protein, 9 aa, Homo Sapiens
CLGTHTVVV

SEQ ID NO: 465780 - protein, 9 aa, Homo Sapiens
CGLPGADGR

SEQ ID NO: 465781 - protein, 9 aa, Homo Sapiens
AQLMAPLSP

SEQ ID NO: 465782 - protein, 9 aa, Homo Sapiens
QCRECNACC

SEQ ID NO: 465783 - protein, 9 aa, Homo Sapiens
YTQTHIQAQ

SEQ ID NO: 465784 - protein, 9 aa, Homo Sapiens
LLIITIITM

SEQ ID NO: 465785 - protein, 9 aa, Homo Sapiens
SVLQVGFHL

SEQ ID NO: 465786 - protein, 9 aa, Homo Sapiens
GAQLMAPLS

SEQ ID NO: 465787 - protein, 9 aa, Homo Sapiens
QAVRQWAET

SEQ ID NO: 465788 - protein, 9 aa, Homo Sapiens
QSVFPLCAF

SEQ ID NO: 465789 - protein, 9 aa, Homo Sapiens
LTYTGTHRH

SEQ ID NO: 465790 - protein, 9 aa, Homo Sapiens
HWYDLKHTS

SEQ ID NO: 465791 - protein, 9 aa, Homo Sapiens
GTQAYTQTH

SEQ ID NO: 465792 - protein, 9 aa, Homo Sapiens
LTSTSCSTM

SEQ ID NO: 465793 - protein, 9 aa, Homo Sapiens
YLPGYILEG

SEQ ID NO: 465794 - protein, 9 aa, Homo Sapiens
GLRGSPGSC

SEQ ID NO: 465795 - protein, 9 aa, Homo Sapiens
ISGWGIVTE

SEQ ID NO: 465796 - protein, 9 aa, Homo Sapiens
TLLPGLCAL

SEQ ID NO: 465797 - protein, 9 aa, Homo Sapiens
TTSGLVVES

SEQ ID NO: 465798 - protein, 9 aa, Homo Sapiens
TPEVVHQSL

SEQ ID NO: 465799 - protein, 9 aa, Homo Sapiens
KPGVTSISK

SEQ ID NO: 465800 - protein, 9 aa, Homo Sapiens
RGQKSKLHA

SEQ ID NO: 465801 - protein, 9 aa, Homo Sapiens
TPWEPVGAR

SEQ ID NO: 465802 - protein, 9 aa, Homo Sapiens
RQRALDLSV

SEQ ID NO: 465803 - protein, 9 aa, Homo Sapiens
VQSVFPLCA

SEQ ID NO: 465804 - protein, 9 aa, Homo Sapiens
KHTHKHTDT

SEQ ID NO: 465805 - protein, 9 aa, Homo Sapiens
IITIITMDR

SEQ ID NO: 465806 - protein, 9 aa, Homo Sapiens
IHSRTHAYT

SEQ ID NO: 465807 - protein, 9 aa, Homo Sapiens
ESGCVDSVL

SEQ ID NO: 465808 - protein, 9 aa, Homo Sapiens
SGIFVLMVD

SEQ ID NO: 465809 - protein, 9 aa, Homo Sapiens
MNKLIILGG

SEQ ID NO: 465810 - protein, 9 aa, Homo Sapiens
ATLTSTSCS

SEQ ID NO: 465811 - protein, 9 aa, Homo Sapiens
RLGLCGAYF

SEQ ID NO: 465812 - protein, 9 aa, Homo Sapiens
SLDLGHFRK

SEQ ID NO: 465813 - protein, 9 aa, Homo Sapiens
KHTHRHTGM

SEQ ID NO: 465814 - protein, 9 aa, Homo Sapiens
GSCGLPGAD

SEQ ID NO: 465815 - protein, 9 aa, Homo Sapiens
GQGVSSNMT

SEQ ID NO: 465816 - protein, 9 aa, Homo Sapiens
LLHSGIFVL

SEQ ID NO: 465817 - protein, 9 aa, Homo Sapiens
QKSKLHARE

SEQ ID NO: 465818 - protein, 9 aa, Homo Sapiens
SPYMNKLII

SEQ ID NO: 465819 - protein, 9 aa, Homo Sapiens
WAALQRLTW

SEQ ID NO: 465820 - protein, 9 aa, Homo Sapiens
SFRLGLCGA

SEQ ID NO: 465821 - protein, 9 aa, Homo Sapiens
RLCGRVPCT

SEQ ID NO: 465822 - protein, 9 aa, Homo Sapiens
NYLIDCERH

SEQ ID NO: 465823 - protein, 9 aa, Homo Sapiens
RGSPGSCGL

SEQ ID NO: 465824 - protein, 9 aa, Homo Sapiens
CGRVPCTLL

SEQ ID NO: 465825 - protein, 9 aa, Homo Sapiens
HSRTHAYTR

SEQ ID NO: 465826 - protein, 9 aa, Homo Sapiens
STSCSTMSC

SEQ ID NO: 465827 - protein, 9 aa, Homo Sapiens
KDRHFWHKS

SEQ ID NO: 465828 - protein, 9 aa, Homo Sapiens
TSVYYVVEE

SEQ ID NO: 465829 - protein, 9 aa, Homo Sapiens
KYKDIDEDE

SEQ ID NO: 465830 - protein, 9 aa, Homo Sapiens
LESGCVDSV

SEQ ID NO: 465831 - protein, 9 aa, Homo Sapiens
ILLHSGIFV

SEQ ID NO: 465832 - protein, 9 aa, Homo Sapiens
IISNLQYSP

SEQ ID NO: 465833 - protein, 9 aa, Homo Sapiens
IIFWMEDGH

SEQ ID NO: 465834 - protein, 9 aa, Homo Sapiens
YECPSTTPW

SEQ ID NO: 465835 - protein, 9 aa, Homo Sapiens
IISRHLPSI

SEQ ID NO: 465836 - protein, 9 aa, Homo Sapiens
FYECPSTTP

SEQ ID NO: 465837 - protein, 9 aa, Homo Sapiens
DRHFWHKSL

SEQ ID NO: 465838 - protein, 9 aa, Homo Sapiens
YKDIDEDEL

SEQ ID NO: 465839 - protein, 9 aa, Homo Sapiens
HTHRYTHRH

SEQ ID NO: 465840 - protein, 9 aa, Homo Sapiens
SRTHAYTRE

SEQ ID NO: 465841 - protein, 9 aa, Homo Sapiens
QLETMHGRV

SEQ ID NO: 465842 - protein, 9 aa, Homo Sapiens
SGWGIVTED

SEQ ID NO: 465843 - protein, 9 aa, Homo Sapiens
HSFSLHHLP

SEQ ID NO: 465844 - protein, 9 aa, Homo Sapiens
PRSKQEAWS

SEQ ID NO: 465845 - protein, 9 aa, Homo Sapiens
GSRQRALDL

SEQ ID NO: 465846 - protein, 9 aa, Homo Sapiens
FWHKSLRKL

SEQ ID NO: 465847 - protein, 9 aa, Homo Sapiens
ERHLERGQD

SEQ ID NO: 465848 - protein, 9 aa, Homo Sapiens
KNRCKDNSV

SEQ ID NO: 465849 - protein, 9 aa, Homo Sapiens
SGGYQAVRQ

SEQ ID NO: 465850 - protein, 9 aa, Homo Sapiens
HTHTHTGTQ

SEQ ID NO: 465851 - protein, 9 aa, Homo Sapiens
YDLKHTSKI

SEQ ID NO: 465852 - protein, 9 aa, Homo Sapiens
CTGTHRHTH

SEQ ID NO: 465853 - protein, 9 aa, Homo Sapiens
RYTHRHTQA

SEQ ID NO: 465854 - protein, 9 aa, Homo Sapiens
YLIDCERHL

SEQ ID NO: 465855 - protein, 9 aa, Homo Sapiens
NALNGSQSS

SEQ ID NO: 465856 - protein, 9 aa, Homo Sapiens
YYHTQRQEC

SEQ ID NO: 465857 - protein, 9 aa, Homo Sapiens
YTLTYTGTH

SEQ ID NO: 465858 - protein, 9 aa, Homo Sapiens
EPICGLRAM

SEQ ID NO: 465859 - protein, 9 aa, Homo Sapiens
NSYPRANTG

SEQ ID NO: 465860 - protein, 9 aa, Homo Sapiens
MARLCGRVP

SEQ ID NO: 465861 - protein, 9 aa, Homo Sapiens
GIHRHTQAY

SEQ ID NO: 465862 - protein, 9 aa, Homo Sapiens
PNPIFREKV

SEQ ID NO: 465863 - protein, 9 aa, Homo Sapiens
MPMPQSLGE

SEQ ID NO: 465864 - protein, 9 aa, Homo Sapiens
PGVTSISKD

SEQ ID NO: 465865 - protein, 9 aa, Homo Sapiens
ENRLGSRQR

SEQ ID NO: 465866 - protein, 9 aa, Homo Sapiens
LSLSQGQGS

SEQ ID NO: 465867 - protein, 9 aa, Homo Sapiens
RLTWVCRRP

SEQ ID NO: 465868 - protein, 9 aa, Homo Sapiens
FGVTCVKKC

SEQ ID NO: 465869 - protein, 9 aa, Homo Sapiens
AEREREWER

SEQ ID NO: 465870 - protein, 9 aa, Homo Sapiens
TGMHRHTHT

SEQ ID NO: 465871 - protein, 9 aa, Homo Sapiens
PSICGERLR

SEQ ID NO: 465872 - protein, 9 aa, Homo Sapiens
AHSFSLHHL

SEQ ID NO: 465873 - protein, 9 aa, Homo Sapiens
DCERHLERG

SEQ ID NO: 465874 - protein, 9 aa, Homo Sapiens
GNQLETMHG

SEQ ID NO: 465875 - protein, 9 aa, Homo Sapiens
MSSNFFGLE

SEQ ID NO: 465876 - protein, 9 aa, Homo Sapiens
HKTKKYIKK

SEQ ID NO: 465877 - protein, 9 aa, Homo Sapiens
SFGVTCVKK

SEQ ID NO: 465878 - protein, 9 aa, Homo Sapiens
RHTHTHTGT

SEQ ID NO: 465879 - protein, 9 aa, Homo Sapiens
ECPSTTPWE

SEQ ID NO: 465880 - protein, 9 aa, Homo Sapiens
IDEDELLGN

SEQ ID NO: 465881 - protein, 9 aa, Homo Sapiens
GTHRHTHKH

SEQ ID NO: 465882 - protein, 9 aa, Homo Sapiens
NIIFWMEDG

SEQ ID NO: 465883 - protein, 9 aa, Homo Sapiens
IKNRCKDNS

SEQ ID NO: 465884 - protein, 9 aa, Homo Sapiens
SPPEKPGVT

SEQ ID NO: 465885 - protein, 9 aa, Homo Sapiens
HRHTHTHTG

SEQ ID NO: 465886 - protein, 9 aa, Homo Sapiens
QHYQQQQVA

SEQ ID NO: 465887 - protein, 9 aa, Homo Sapiens
HKHTHRHTG

SEQ ID NO: 465888 - protein, 9 aa, Homo Sapiens
VYYVVEEGV

SEQ ID NO: 465889 - protein, 9 aa, Homo Sapiens
RLGSRQRAL

SEQ ID NO: 465890 - protein, 9 aa, Homo Sapiens
NRCKDNSVV

SEQ ID NO: 465891 - protein, 9 aa, Homo Sapiens
TGIHRHTQA

SEQ ID NO: 465892 - protein, 9 aa, Homo Sapiens
IFKDRHFWH

SEQ ID NO: 465893 - protein, 9 aa, Homo Sapiens
DSVLQVGFH

SEQ ID NO: 465894 - protein, 9 aa, Homo Sapiens
TSPYPCVFF

SEQ ID NO: 465895 - protein, 9 aa, Homo Sapiens
IFVLMVDVF

SEQ ID NO: 465896 - protein, 9 aa, Homo Sapiens
GYLLEKKIY

SEQ ID NO: 465897 - protein, 9 aa, Homo Sapiens
PCVFFCEEE

SEQ ID NO: 465898 - protein, 9 aa, Homo Sapiens
PWGCLCRDW

SEQ ID NO: 465899 - protein, 9 aa, Homo Sapiens
DLVHHCIQK

SEQ ID NO: 465900 - protein, 9 aa, Homo Sapiens
QSLDLGHFR

SEQ ID NO: 465901 - protein, 9 aa, Homo Sapiens
VFPLCAFSR

SEQ ID NO: 465902 - protein, 9 aa, Homo Sapiens
LQGRLVTKF

SEQ ID NO: 465903 - protein, 9 aa, Homo Sapiens
ARLCGRVPC

SEQ ID NO: 465904 - protein, 9 aa, Homo Sapiens
INCSANLIA

SEQ ID NO: 465905 - protein, 9 aa, Homo Sapiens
VAAFSDDCD

SEQ ID NO: 465906 - protein, 9 aa, Homo Sapiens
ETLLPGLCA

SEQ ID NO: 465907 - protein, 9 aa, Homo Sapiens
GIHTHRYTH

SEQ ID NO: 465908 - protein, 9 aa, Homo Sapiens
GQGSQTELP

SEQ ID NO: 465909 - protein, 9 aa, Homo Sapiens
TKKYIKKYM

SEQ ID NO: 465910 - protein, 9 aa, Homo Sapiens
VVMGGKEDN

SEQ ID NO: 465911 - protein, 9 aa, Homo Sapiens
HTQRQECID

SEQ ID NO: 465912 - protein, 9 aa, Homo Sapiens
WAGERVHKF

SEQ ID NO: 465913 - protein, 9 aa, Homo Sapiens
REREWEREK

SEQ ID NO: 465914 - protein, 9 aa, Homo Sapiens
LCGRVPCTL

SEQ ID NO: 465915 - protein, 9 aa, Homo Sapiens
HTHRHTGMH

SEQ ID NO: 465916 - protein, 9 aa, Homo Sapiens
LKINCSANL

SEQ ID NO: 465917 - protein, 9 aa, Homo Sapiens
TQTQTHTHT

SEQ ID NO: 465918 - protein, 9 aa, Homo Sapiens
HGITLVTTL

SEQ ID NO: 465919 - protein, 9 aa, Homo Sapiens
STPQVTMEG

SEQ ID NO: 465920 - protein, 9 aa, Homo Sapiens
AYTRECLGT

SEQ ID NO: 465921 - protein, 9 aa, Homo Sapiens
CGHWYDLKH

SEQ ID NO: 465922 - protein, 9 aa, Homo Sapiens
ISRHLPSIC

SEQ ID NO: 465923 - protein, 9 aa, Homo Sapiens
INISCLPNE

SEQ ID NO: 465924 - protein, 9 aa, Homo Sapiens
SCSTMSCLS

SEQ ID NO: 465925 - protein, 9 aa, Homo Sapiens
PPEKPGVTS

SEQ ID NO: 465926 - protein, 9 aa, Homo Sapiens
EDNGYLLEK

SEQ ID NO: 465927 - protein, 9 aa, Homo Sapiens
EVVHQSLFM

SEQ ID NO: 465928 - protein, 9 aa, Homo Sapiens
NSFAGQTGV

SEQ ID NO: 465929 - protein, 9 aa, Homo Sapiens
IHTHRYTHR

SEQ ID NO: 465930 - protein, 9 aa, Homo Sapiens
TGNQLETMH

SEQ ID NO: 465931 - protein, 9 aa, Homo Sapiens
HRHIHSRTH

SEQ ID NO: 465932 - protein, 9 aa, Homo Sapiens
AYTQTHTGI

SEQ ID NO: 465933 - protein, 9 aa, Homo Sapiens
CNPDGNLCI

SEQ ID NO: 465934 - protein, 9 aa, Homo Sapiens
AENRLGSRQ

SEQ ID NO: 465935 - protein, 9 aa, Homo Sapiens
TQAYTQTHT

SEQ ID NO: 465936 - protein, 9 aa, Homo Sapiens
MAPLSPGAT

SEQ ID NO: 465937 - protein, 9 aa, Homo Sapiens
ENVKHKTKK

SEQ ID NO: 465938 - protein, 9 aa, Homo Sapiens
AYTQTHIQA

SEQ ID NO: 465939 - protein, 9 aa, Homo Sapiens
ECLGTHTVV

SEQ ID NO: 465940 - protein, 9 aa, Homo Sapiens
THRYTHRHT

SEQ ID NO: 465941 - protein, 9 aa, Homo Sapiens
VKHKTKKYI

SEQ ID NO: 465942 - protein, 9 aa, Homo Sapiens
TTPWEPVGA

SEQ ID NO: 465943 - protein, 9 aa, Homo Sapiens
CVFFCEEET

SEQ ID NO: 465944 - protein, 9 aa, Homo Sapiens
GQDGETLLP

SEQ ID NO: 465945 - protein, 9 aa, Homo Sapiens
ALGHVAAFS

SEQ ID NO: 465946 - protein, 9 aa, Homo Sapiens
TAHSFSLHH

SEQ ID NO: 465947 - protein, 9 aa, Homo Sapiens
HEIKNRCKD

SEQ ID NO: 465948 - protein, 9 aa, Homo Sapiens
AGGVGAQLM

SEQ ID NO: 465949 - protein, 9 aa, Homo Sapiens
NVKHKTKKY

SEQ ID NO: 465950 - protein, 9 aa, Homo Sapiens
QAYTQTHTG

SEQ ID NO: 465951 - protein, 9 aa, Homo Sapiens
GGVGAQLMA

SEQ ID NO: 465952 - protein, 9 aa, Homo Sapiens
NSFIRNESF

SEQ ID NO: 465953 - protein, 9 aa, Homo Sapiens
CNACCNPDG

SEQ ID NO: 465954 - protein, 9 aa, Homo Sapiens
PKDHVYICN

SEQ ID NO: 465955 - protein, 9 aa, Homo Sapiens
YTYMLPQSY

SEQ ID NO: 465956 - protein, 9 aa, Homo Sapiens
DTTLALGHV

SEQ ID NO: 465957 - protein, 9 aa, Homo Sapiens
YQAVRQWAE

SEQ ID NO: 465958 - protein, 9 aa, Homo Sapiens
TAIALIKTH

SEQ ID NO: 465959 - protein, 9 aa, Homo Sapiens
MHRHTHTQA

SEQ ID NO: 465960 - protein, 9 aa, Homo Sapiens
ELHQLKINC

SEQ ID NO: 465961 - protein, 9 aa, Homo Sapiens
HFWHKSLRK

SEQ ID NO: 465962 - protein, 9 aa, Homo Sapiens
GERVHKFAM

SEQ ID NO: 465963 - protein, 9 aa, Homo Sapiens
GHFRKVDFI

SEQ ID NO: 465964 - protein, 9 aa, Homo Sapiens
EAWSTHNTV

SEQ ID NO: 465965 - protein, 9 aa, Homo Sapiens
NFIISNLQY

SEQ ID NO: 465966 - protein, 9 aa, Homo Sapiens
QGSQTELPN

SEQ ID NO: 465967 - protein, 9 aa, Homo Sapiens
GIVTEDVFL

SEQ ID NO: 465968 - protein, 9 aa, Homo Sapiens
YACMPMPQS

SEQ ID NO: 465969 - protein, 9 aa, Homo Sapiens
RHTHKHTHR

SEQ ID NO: 465970 - protein, 9 aa, Homo Sapiens
KLHAREKRR

SEQ ID NO: 465971 - protein, 9 aa, Homo Sapiens
QTHIQAQTG

SEQ ID NO: 465972 - protein, 9 aa, Homo Sapiens
YQQQQVAGG

SEQ ID NO: 465973 - protein, 9 aa, Homo Sapiens
SCLSRPGWA

SEQ ID NO: 465974 - protein, 9 aa, Homo Sapiens
VMGGKEDNG

SEQ ID NO: 465975 - protein, 9 aa, Homo Sapiens
GKEDNGYLL

SEQ ID NO: 465976 - protein, 9 aa, Homo Sapiens
IVTEDVFLP

SEQ ID NO: 465977 - protein, 9 aa, Homo Sapiens
SLLEEMTRK

SEQ ID NO: 465978 - protein, 9 aa, Homo Sapiens
MSCLSRPGW

SEQ ID NO: 465979 - protein, 9 aa, Homo Sapiens
DTTINISCL

SEQ ID NO: 465980 - protein, 9 aa, Homo Sapiens
YSFGVTCVK

SEQ ID NO: 465981 - protein, 9 aa, Homo Sapiens
TGSLLEEMT

SEQ ID NO: 465982 - protein, 9 aa, Homo Sapiens
STMSCLSRP

SEQ ID NO: 465983 - protein, 9 aa, Homo Sapiens
DNIIFWMED

SEQ ID NO: 465984 - protein, 9 aa, Homo Sapiens
RQECIDNDE

SEQ ID NO: 465985 - protein, 9 aa, Homo Sapiens
AGQTGVSSF

SEQ ID NO: 465986 - protein, 9 aa, Homo Sapiens
DGETLLPGL

SEQ ID NO: 465987 - protein, 9 aa, Homo Sapiens
NKLIILGGM

SEQ ID NO: 465988 - protein, 9 aa, Homo Sapiens
TQTHTGIHR

SEQ ID NO: 465989 - protein, 9 aa, Homo Sapiens
RGPNPIFRE

SEQ ID NO: 465990 - protein, 9 aa, Homo Sapiens
ALQRLTWVC

SEQ ID NO: 465991 - protein, 9 aa, Homo Sapiens
HIQAQTGTH

SEQ ID NO: 465992 - protein, 9 aa, Homo Sapiens
SCWISGWGI

SEQ ID NO: 465993 - protein, 9 aa, Homo Sapiens
IHRHTQAYT

SEQ ID NO: 465994 - protein, 9 aa, Homo Sapiens
TSTHKHTHK

SEQ ID NO: 465995 - protein, 9 aa, Homo Sapiens
PSTTPWEPV

SEQ ID NO: 465996 - protein, 9 aa, Homo Sapiens
QGRLVTKFS

SEQ ID NO: 465997 - protein, 9 aa, Homo Sapiens
GLCGAYFRC

SEQ ID NO: 465998 - protein, 9 aa, Homo Sapiens
HQLKINCSA

SEQ ID NO: 465999 - protein, 9 aa, Homo Sapiens
IKNIDTTIN

SEQ ID NO: 466000 - protein, 9 aa, Homo Sapiens
HVYICNTSK

SEQ ID NO: 466001 - protein, 9 aa, Homo Sapiens
LRVVDLAAN

SEQ ID NO: 466002 - protein, 9 aa, Homo Sapiens
SGCVDSVLQ

SEQ ID NO: 466003 - protein, 9 aa, Homo Sapiens
ELGTAIALI

SEQ ID NO: 466004 - protein, 9 aa, Homo Sapiens
SFAGQTGVS

SEQ ID NO: 466005 - protein, 9 aa, Homo Sapiens
VKNSFAGQT

SEQ ID NO: 466006 - protein, 9 aa, Homo Sapiens
GATLTSTSC

SEQ ID NO: 466007 - protein, 9 aa, Homo Sapiens
YSDNIIFWM

SEQ ID NO: 466008 - protein, 9 aa, Homo Sapiens
FRKVDFIII

SEQ ID NO: 466009 - protein, 9 aa, Homo Sapiens
DHVYICNTS

SEQ ID NO: 466010 - protein, 9 aa, Homo Sapiens
GCLCRDWDQ

SEQ ID NO: 466011 - protein, 9 aa, Homo Sapiens
ANTGLFSRS

SEQ ID NO: 466012 - protein, 9 aa, Homo Sapiens
PYAGGVGAQ

SEQ ID NO: 466013 - protein, 9 aa, Homo Sapiens
REWEREKER

SEQ ID NO: 466014 - protein, 9 aa, Homo Sapiens
LLPGLCALW

SEQ ID NO: 466015 - protein, 9 aa, Homo Sapiens
RYSYLPGYI

SEQ ID NO: 466016 - protein, 9 aa, Homo Sapiens
CKDNSVVPS

SEQ ID NO: 466017 - protein, 9 aa, Homo Sapiens
LGNSFIRNE

SEQ ID NO: 466018 - protein, 9 aa, Homo Sapiens
ALNGSQSSH

SEQ ID NO: 466019 - protein, 9 aa, Homo Sapiens
TLVTTLSGS

SEQ ID NO: 466020 - protein, 9 aa, Homo Sapiens
SYLPGYILE

SEQ ID NO: 466021 - protein, 9 aa, Homo Sapiens
SCGLPGADG

SEQ ID NO: 466022 - protein, 9 aa, Homo Sapiens
HRHTHTQAY

SEQ ID NO: 466023 - protein, 9 aa, Homo Sapiens
RHTGMHRHT

SEQ ID NO: 466024 - protein, 9 aa, Homo Sapiens
SSGGYQAVR

SEQ ID NO: 466025 - protein, 9 aa, Homo Sapiens
PEKPGVTSI

SEQ ID NO: 466026 - protein, 9 aa, Homo Sapiens
QRQECIDND

SEQ ID NO: 466027 - protein, 9 aa, Homo Sapiens
TLTSTSCST

SEQ ID NO: 466028 - protein, 9 aa, Homo Sapiens
TQAYTQTQT

SEQ ID NO: 466029 - protein, 9 aa, Homo Sapiens
TPTSTHKHT

SEQ ID NO: 466030 - protein, 9 aa, Homo Sapiens
TGIHTHRYT

SEQ ID NO: 466031 - protein, 9 aa, Homo Sapiens
QAYTQTHIQ

SEQ ID NO: 466032 - protein, 9 aa, Homo Sapiens
LEESASRAQ

SEQ ID NO: 466033 - protein, 9 aa, Homo Sapiens
SGLVVESTP

SEQ ID NO: 466034 - protein, 9 aa, Homo Sapiens
SPVKNSFAG

SEQ ID NO: 466035 - protein, 9 aa, Homo Sapiens
RQWAETLRL

SEQ ID NO: 466036 - protein, 9 aa, Homo Sapiens
AGERVHKFA

SEQ ID NO: 466037 - protein, 9 aa, Homo Sapiens
SASRAQESG

SEQ ID NO: 466038 - protein, 9 aa, Homo Sapiens
CPSTTPWEP

SEQ ID NO: 466039 - protein, 9 aa, Homo Sapiens
ICGLRAMPS

SEQ ID NO: 466040 - protein, 9 aa, Homo Sapiens
SAEREREWE

SEQ ID NO: 466041 - protein, 9 aa, Homo Sapiens
PTSTHKHTH

SEQ ID NO: 466042 - protein, 9 aa, Homo Sapiens
TMSCLSRPG

SEQ ID NO: 466043 - protein, 9 aa, Homo Sapiens
STTSGLVVE

SEQ ID NO: 466044 - protein, 9 aa, Homo Sapiens
PEDMENALN

SEQ ID NO: 466045 - protein, 9 aa, Homo Sapiens
ADTPTSTHK

SEQ ID NO: 466046 - protein, 9 aa, Homo Sapiens
WYDLKHTSK

SEQ ID NO: 466047 - protein, 9 aa, Homo Sapiens
KLIILGGML

SEQ ID NO: 466048 - protein, 9 aa, Homo Sapiens
FSLHHLPCF

SEQ ID NO: 466049 - protein, 9 aa, Homo Sapiens
THKHTHRHT

SEQ ID NO: 466050 - protein, 9 aa, Homo Sapiens
ERVHKFAMK

SEQ ID NO: 466051 - protein, 9 aa, Homo Sapiens
AYTQTQTHT

SEQ ID NO: 466052 - protein, 9 aa, Homo Sapiens
FVLMVDVFS

SEQ ID NO: 466053 - protein, 9 aa, Homo Sapiens
THRHTHKHT

SEQ ID NO: 466054 - protein, 9 aa, Homo Sapiens
QVTMEGSSA

SEQ ID NO: 466055 - protein, 9 aa, Homo Sapiens
CWISGWGIV

SEQ ID NO: 466056 - protein, 9 aa, Homo Sapiens
RRNSYPRAN

SEQ ID NO: 466057 - protein, 9 aa, Homo Sapiens
EWEREKERE

SEQ ID NO: 466058 - protein, 9 aa, Homo Sapiens
PRSLRVVDL

SEQ ID NO: 466059 - protein, 9 aa, Homo Sapiens
HKHTDTLAC

SEQ ID NO: 466060 - protein, 9 aa, Homo Sapiens
HRHTHKHTH

SEQ ID NO: 466061 - protein, 9 aa, Homo Sapiens
VITMSSNFF

SEQ ID NO: 466062 - protein, 9 aa, Homo Sapiens
TYTGTHRHT

SEQ ID NO: 466063 - protein, 9 aa, Homo Sapiens
YYVVEEGVL

SEQ ID NO: 466064 - protein, 9 aa, Homo Sapiens
LSPGATLTS

SEQ ID NO: 466065 - protein, 9 aa, Homo Sapiens
KDLEKYKDI

SEQ ID NO: 466066 - protein, 9 aa, Homo Sapiens
VTTLSGSEK

SEQ ID NO: 466067 - protein, 9 aa, Homo Sapiens
TLALGHVAA

SEQ ID NO: 466068 - protein, 9 aa, Homo Sapiens
LSQGQGSQT

SEQ ID NO: 466069 - protein, 9 aa, Homo Sapiens
TLTYTGTHR

SEQ ID NO: 466070 - protein, 9 aa, Homo Sapiens
MLPQSYHTP

SEQ ID NO: 466071 - protein, 9 aa, Homo Sapiens
VTMEGSSAM

SEQ ID NO: 466072 - protein, 9 aa, Homo Sapiens
LEEMTRKWA

SEQ ID NO: 466073 - protein, 9 aa, Homo Sapiens
FAGQTGVSS

SEQ ID NO: 466074 - protein, 9 aa, Homo Sapiens
HTGTQAYTQ

SEQ ID NO: 466075 - protein, 9 aa, Homo Sapiens
YMNKLIILG

SEQ ID NO: 466076 - protein, 9 aa, Homo Sapiens
DNSVVPSNK

SEQ ID NO: 466077 - protein, 9 aa, Homo Sapiens
THAYTRECL

SEQ ID NO: 466078 - protein, 9 aa, Homo Sapiens
GSLLEEMTR

SEQ ID NO: 466079 - protein, 9 aa, Homo Sapiens
PGATLTSTS

SEQ ID NO: 466080 - protein, 9 aa, Homo Sapiens
LHAREKRRK

SEQ ID NO: 466081 - protein, 9 aa, Homo Sapiens
QKGGNVNQP

SEQ ID NO: 466082 - protein, 9 aa, Homo Sapiens
CCNPDGNLC

SEQ ID NO: 466083 - protein, 9 aa, Homo Sapiens
ASRAQESGL

SEQ ID NO: 466084 - protein, 9 aa, Homo Sapiens
VESTPSRLS

SEQ ID NO: 466085 - protein, 9 aa, Homo Sapiens
THIQAQTGT

SEQ ID NO: 466086 - protein, 9 aa, Homo Sapiens
QLMAPLSPG

SEQ ID NO: 466087 - protein, 9 aa, Homo Sapiens
CLSRPGWAA

SEQ ID NO: 466088 - protein, 9 aa, Homo Sapiens
HIHSRTHAY

SEQ ID NO: 466089 - protein, 9 aa, Homo Sapiens
VYICNTSKD

SEQ ID NO: 466090 - protein, 9 aa, Homo Sapiens
FPLCAFSRR

SEQ ID NO: 466091 - protein, 9 aa, Homo Sapiens
THKHTDTLA

SEQ ID NO: 466092 - protein, 9 aa, Homo Sapiens
TGTHRHIHS

SEQ ID NO: 466093 - protein, 9 aa, Homo Sapiens
TQTHIQAQT

SEQ ID NO: 466094 - protein, 9 aa, Homo Sapiens
PLSPGATLT

SEQ ID NO: 466095 - protein, 9 aa, Homo Sapiens
TMSSNFFGL

SEQ ID NO: 466096 - protein, 9 aa, Homo Sapiens
RNESFLPEF

SEQ ID NO: 466097 - protein, 9 aa, Homo Sapiens
KDHVYICNT

SEQ ID NO: 466098 - protein, 9 aa, Homo Sapiens
VWAGERVHK

SEQ ID NO: 466099 - protein, 9 aa, Homo Sapiens
HTHKHTDTL

SEQ ID NO: 466100 - protein, 9 aa, Homo Sapiens
SPGSCGLPG

SEQ ID NO: 466101 - protein, 9 aa, Homo Sapiens
YICNTSKDE

SEQ ID NO: 466102 - protein, 9 aa, Homo Sapiens
SHGITLVTT

SEQ ID NO: 466103 - protein, 9 aa, Homo Sapiens
KKYIKKYMQ

SEQ ID NO: 466104 - protein, 9 aa, Homo Sapiens
TTINISCLP

SEQ ID NO: 466105 - protein, 9 aa, Homo Sapiens
ACCNPDGNL

SEQ ID NO: 466106 - protein, 9 aa, Homo Sapiens
LVVESTPSR

SEQ ID NO: 466107 - protein, 9 aa, Homo Sapiens
GNSFIRNES

SEQ ID NO: 466108 - protein, 9 aa, Homo Sapiens
AVRQWAETL

SEQ ID NO: 466109 - protein, 9 aa, Homo Sapiens
QTQTHTHTG

SEQ ID NO: 466110 - protein, 9 aa, Homo Sapiens
WHKSLRKLE

SEQ ID NO: 466111 - protein, 9 aa, Homo Sapiens
EREREWERE

SEQ ID NO: 466112 - protein, 9 aa, Homo Sapiens
VVVMGGKED

SEQ ID NO: 466113 - protein, 9 aa, Homo Sapiens
CPLVLGLLL

SEQ ID NO: 466114 - protein, 9 aa, Homo Sapiens
AAAKPSNTG

SEQ ID NO: 466115 - protein, 9 aa, Homo Sapiens
KQKSVRGVR

SEQ ID NO: 466116 - protein, 9 aa, Homo Sapiens
DNKDNTVGI

SEQ ID NO: 466117 - protein, 9 aa, Homo Sapiens
RAAAKPSNT

SEQ ID NO: 466118 - protein, 9 aa, Homo Sapiens
KHGEGRPLE

SEQ ID NO: 466119 - protein, 9 aa, Homo Sapiens
EGETMVRLL

SEQ ID NO: 466120 - protein, 9 aa, Homo Sapiens
FCELLIHRR

SEQ ID NO: 466121 - protein, 9 aa, Homo Sapiens
SRWQKQLCR

SEQ ID NO: 466122 - protein, 9 aa, Homo Sapiens
REEGAPGHP

SEQ ID NO: 466123 - protein, 9 aa, Homo Sapiens
RAARGRPPR

SEQ ID NO: 466124 - protein, 9 aa, Homo Sapiens
RTAPSPQEA

SEQ ID NO: 466125 - protein, 9 aa, Homo Sapiens
GWGCALQYQ

SEQ ID NO: 466126 - protein, 9 aa, Homo Sapiens
GMMSDPNFL

SEQ ID NO: 466127 - protein, 9 aa, Homo Sapiens
APGHPEAAL

SEQ ID NO: 466128 - protein, 9 aa, Homo Sapiens
GCGPPGLPV

SEQ ID NO: 466129 - protein, 9 aa, Homo Sapiens
ASGPCWGPC

SEQ ID NO: 466130 - protein, 9 aa, Homo Sapiens
TEAHYRFIY

SEQ ID NO: 466131 - protein, 9 aa, Homo Sapiens
PPCLVTANL

SEQ ID NO: 466132 - protein, 9 aa, Homo Sapiens
YRLPTIANF

SEQ ID NO: 466133 - protein, 9 aa, Homo Sapiens
LLKLSRWQK

SEQ ID NO: 466134 - protein, 9 aa, Homo Sapiens
ASTLIAHKT

SEQ ID NO: 466135 - protein, 9 aa, Homo Sapiens
LEQGQVGPA

SEQ ID NO: 466136 - protein, 9 aa, Homo Sapiens
TEARLWSSL

SEQ ID NO: 466137 - protein, 9 aa, Homo Sapiens
NDFTEARLW

SEQ ID NO: 466138 - protein, 9 aa, Homo Sapiens
DAVDRIVAH

SEQ ID NO: 466139 - protein, 9 aa, Homo Sapiens
EEFWRRPDE

SEQ ID NO: 466140 - protein, 9 aa, Homo Sapiens
TVVRHPNLH

SEQ ID NO: 466141 - protein, 9 aa, Homo Sapiens
SGPCWGPCC

SEQ ID NO: 466142 - protein, 9 aa, Homo Sapiens
HNFRCDACL

SEQ ID NO: 466143 - protein, 9 aa, Homo Sapiens
MKQVTNVFI

SEQ ID NO: 466144 - protein, 9 aa, Homo Sapiens
PRAARGRPP

SEQ ID NO: 466145 - protein, 9 aa, Homo Sapiens
DYELQVGIV

SEQ ID NO: 466146 - protein, 9 aa, Homo Sapiens
PGLPVAAAP

SEQ ID NO: 466147 - protein, 9 aa, Homo Sapiens
CRSTGCCRG

SEQ ID NO: 466148 - protein, 9 aa, Homo Sapiens
EERRGWGCA

SEQ ID NO: 466149 - protein, 9 aa, Homo Sapiens
IIIAKKNGK

SEQ ID NO: 466150 - protein, 9 aa, Homo Sapiens
MWRTCCATG

SEQ ID NO: 466151 - protein, 9 aa, Homo Sapiens
TRMALEQEV

SEQ ID NO: 466152 - protein, 9 aa, Homo Sapiens
SGEPRIQQE

SEQ ID NO: 466153 - protein, 9 aa, Homo Sapiens
CRPTEFVVR

SEQ ID NO: 466154 - protein, 9 aa, Homo Sapiens
KHALLSSML

SEQ ID NO: 466155 - protein, 9 aa, Homo Sapiens
THMLQQQQA

SEQ ID NO: 466156 - protein, 9 aa, Homo Sapiens
FHPATLTVT

SEQ ID NO: 466157 - protein, 9 aa, Homo Sapiens
YYLIGQTVS

SEQ ID NO: 466158 - protein, 9 aa, Homo Sapiens
RPPAFEEEL

SEQ ID NO: 466159 - protein, 9 aa, Homo Sapiens
PDTETKITI

SEQ ID NO: 466160 - protein, 9 aa, Homo Sapiens
KDNDMNNIR

SEQ ID NO: 466161 - protein, 9 aa, Homo Sapiens
SYQFRLCAI

SEQ ID NO: 466162 - protein, 9 aa, Homo Sapiens
QKDIICRVY

SEQ ID NO: 466163 - protein, 9 aa, Homo Sapiens
VAAAPASTG

SEQ ID NO: 466164 - protein, 9 aa, Homo Sapiens
DHNFRCDAC

SEQ ID NO: 466165 - protein, 9 aa, Homo Sapiens
PPGLPVAAA

SEQ ID NO: 466166 - protein, 9 aa, Homo Sapiens
LKLSRWQKQ

SEQ ID NO: 466167 - protein, 9 aa, Homo Sapiens
CSFSGFHPA

SEQ ID NO: 466168 - protein, 9 aa, Homo Sapiens
VSLLGSVPG

SEQ ID NO: 466169 - protein, 9 aa, Homo Sapiens
GQVGPAVQE

SEQ ID NO: 466170 - protein, 9 aa, Homo Sapiens
ESILLAVMA

SEQ ID NO: 466171 - protein, 9 aa, Homo Sapiens
GLHQLMLHC

SEQ ID NO: 466172 - protein, 9 aa, Homo Sapiens
HYRFIYMAV

SEQ ID NO: 466173 - protein, 9 aa, Homo Sapiens
DRIVAHRLG

SEQ ID NO: 466174 - protein, 9 aa, Homo Sapiens
MNLNNFISM

SEQ ID NO: 466175 - protein, 9 aa, Homo Sapiens
TCPAVVMGE

SEQ ID NO: 466176 - protein, 9 aa, Homo Sapiens
PAVVMGENN

SEQ ID NO: 466177 - protein, 9 aa, Homo Sapiens
TVGIMTRKD

SEQ ID NO: 466178 - protein, 9 aa, Homo Sapiens
LNGTKITDS

SEQ ID NO: 466179 - protein, 9 aa, Homo Sapiens
ITDSGEPRI

SEQ ID NO: 466180 - protein, 9 aa, Homo Sapiens
RVHCPRLIG

SEQ ID NO: 466181 - protein, 9 aa, Homo Sapiens
WQKQLCRRE

SEQ ID NO: 466182 - protein, 9 aa, Homo Sapiens
AGDYELQVG

SEQ ID NO: 466183 - protein, 9 aa, Homo Sapiens
KKYEEFKQL

SEQ ID NO: 466184 - protein, 9 aa, Homo Sapiens
SKKKDGEQR

SEQ ID NO: 466185 - protein, 9 aa, Homo Sapiens
KLSRWQKQL

SEQ ID NO: 466186 - protein, 9 aa, Homo Sapiens
LNWKTAKGM

SEQ ID NO: 466187 - protein, 9 aa, Homo Sapiens
MALEQEVGL

SEQ ID NO: 466188 - protein, 9 aa, Homo Sapiens
AELEMLKIA

SEQ ID NO: 466189 - protein, 9 aa, Homo Sapiens
FCPPCLVTA

SEQ ID NO: 466190 - protein, 9 aa, Homo Sapiens
PVAAAPAST

SEQ ID NO: 466191 - protein, 9 aa, Homo Sapiens
GFHPATLTV

SEQ ID NO: 466192 - protein, 9 aa, Homo Sapiens
HSCRRYRLP

SEQ ID NO: 466193 - protein, 9 aa, Homo Sapiens
YLPGMHPSM

SEQ ID NO: 466194 - protein, 9 aa, Homo Sapiens
SRTAPSPQE

SEQ ID NO: 466195 - protein, 9 aa, Homo Sapiens
CTFVVTESI

SEQ ID NO: 466196 - protein, 9 aa, Homo Sapiens
EEGEGETMV

SEQ ID NO: 466197 - protein, 9 aa, Homo Sapiens
LLGSVPGGK

SEQ ID NO: 466198 - protein, 9 aa, Homo Sapiens
VPVSWTALM

SEQ ID NO: 466199 - protein, 9 aa, Homo Sapiens
RSTGCCRGG

SEQ ID NO: 466200 - protein, 9 aa, Homo Sapiens
AKGMMSDPN

SEQ ID NO: 466201 - protein, 9 aa, Homo Sapiens
RRELICSQA

SEQ ID NO: 466202 - protein, 9 aa, Homo Sapiens
NPKDNDMNN

SEQ ID NO: 466203 - protein, 9 aa, Homo Sapiens
FALFTILKQ

SEQ ID NO: 466204 - protein, 9 aa, Homo Sapiens
TAVEFGTSW

SEQ ID NO: 466205 - protein, 9 aa, Homo Sapiens
RFQPSHFHR

SEQ ID NO: 466206 - protein, 9 aa, Homo Sapiens
NTGHLPLLP

SEQ ID NO: 466207 - protein, 9 aa, Homo Sapiens
SMRPGWGRI

SEQ ID NO: 466208 - protein, 9 aa, Homo Sapiens
TEDDIIIAK

SEQ ID NO: 466209 - protein, 9 aa, Homo Sapiens
WKTAKGMMS

SEQ ID NO: 466210 - protein, 9 aa, Homo Sapiens
LEGDHNFRC

SEQ ID NO: 466211 - protein, 9 aa, Homo Sapiens
RYEPAGGDT

SEQ ID NO: 466212 - protein, 9 aa, Homo Sapiens
PVVCSYFAQ

SEQ ID NO: 466213 - protein, 9 aa, Homo Sapiens
HGDDFRFQP

SEQ ID NO: 466214 - protein, 9 aa, Homo Sapiens
LEMLKIAKP

SEQ ID NO: 466215 - protein, 9 aa, Homo Sapiens
MLQQQQAQQ

SEQ ID NO: 466216 - protein, 9 aa, Homo Sapiens
VVCSYFAQD

SEQ ID NO: 466217 - protein, 9 aa, Homo Sapiens
LMHVKAEYF

SEQ ID NO: 466218 - protein, 9 aa, Homo Sapiens
FNKKKYEEF

SEQ ID NO: 466219 - protein, 9 aa, Homo Sapiens
RPRSKQEAW

SEQ ID NO: 466220 - protein, 9 aa, Homo Sapiens
SCRRYRLPT

SEQ ID NO: 466221 - protein, 9 aa, Homo Sapiens
YGVHMKQVT

SEQ ID NO: 466222 - protein, 9 aa, Homo Sapiens
RSKQEAWST

SEQ ID NO: 466223 - protein, 9 aa, Homo Sapiens
RGDKGCCGD

SEQ ID NO: 466224 - protein, 9 aa, Homo Sapiens
DNDMNNIRA

SEQ ID NO: 466225 - protein, 9 aa, Homo Sapiens
FVVTESILL

SEQ ID NO: 466226 - protein, 9 aa, Homo Sapiens
ALYYLPGMH

SEQ ID NO: 466227 - protein, 9 aa, Homo Sapiens
NDMNNIRAT

SEQ ID NO: 466228 - protein, 9 aa, Homo Sapiens
WRMWRTCCA

SEQ ID NO: 466229 - protein, 9 aa, Homo Sapiens
KGERGDKGC

SEQ ID NO: 466230 - protein, 9 aa, Homo Sapiens
GCPRAARGR

SEQ ID NO: 466231 - protein, 9 aa, Homo Sapiens
AVSVYKHGE

SEQ ID NO: 466232 - protein, 9 aa, Homo Sapiens
QLCREELNQ

SEQ ID NO: 466233 - protein, 9 aa, Homo Sapiens
RLWSSLSAR

SEQ ID NO: 466234 - protein, 9 aa, Homo Sapiens
EMGEKGERG

SEQ ID NO: 466235 - protein, 9 aa, Homo Sapiens
HCVKTCPAV

SEQ ID NO: 466236 - protein, 9 aa, Homo Sapiens
VGIMTRKDG

SEQ ID NO: 466237 - protein, 9 aa, Homo Sapiens
DNTVGIMTR

SEQ ID NO: 466238 - protein, 9 aa, Homo Sapiens
ERRGWGCAL

SEQ ID NO: 466239 - protein, 9 aa, Homo Sapiens
GFCPPCLVT

SEQ ID NO: 466240 - protein, 9 aa, Homo Sapiens
EKERRELIC

SEQ ID NO: 466241 - protein, 9 aa, Homo Sapiens
MEEPPPPDC

SEQ ID NO: 466242 - protein, 9 aa, Homo Sapiens
EQPATREHL

SEQ ID NO: 466243 - protein, 9 aa, Homo Sapiens
MHVKAEYFR

SEQ ID NO: 466244 - protein, 9 aa, Homo Sapiens
EMLKIAKPP

SEQ ID NO: 466245 - protein, 9 aa, Homo Sapiens
CWGPCCRST

SEQ ID NO: 466246 - protein, 9 aa, Homo Sapiens
LPVAAAPAS

SEQ ID NO: 466247 - protein, 9 aa, Homo Sapiens
GDYELQVGI

SEQ ID NO: 466248 - protein, 9 aa, Homo Sapiens
PSMRPGWGR

SEQ ID NO: 466249 - protein, 9 aa, Homo Sapiens
SRVHCPRLI

SEQ ID NO: 466250 - protein, 9 aa, Homo Sapiens
PYNATLSVR

SEQ ID NO: 466251 - protein, 9 aa, Homo Sapiens
KASTLIAHK

SEQ ID NO: 466252 - protein, 9 aa, Homo Sapiens
IEDWRGQVG

SEQ ID NO: 466253 - protein, 9 aa, Homo Sapiens
TFVVTESIL

SEQ ID NO: 466254 - protein, 9 aa, Homo Sapiens
TGCCRGGWR

SEQ ID NO: 466255 - protein, 9 aa, Homo Sapiens
KKDGEQRGQ

SEQ ID NO: 466256 - protein, 9 aa, Homo Sapiens
RPTEFVVRS

SEQ ID NO: 466257 - protein, 9 aa, Homo Sapiens
SHPPTVVRH

SEQ ID NO: 466258 - protein, 9 aa, Homo Sapiens
PVWRPPAFE

SEQ ID NO: 466259 - protein, 9 aa, Homo Sapiens
VKTCPAVVM

SEQ ID NO: 466260 - protein, 9 aa, Homo Sapiens
QPSHFHRDQ

SEQ ID NO: 466261 - protein, 9 aa, Homo Sapiens
GGDTNRLRR

SEQ ID NO: 466262 - protein, 9 aa, Homo Sapiens
TILKQKSVR

SEQ ID NO: 466263 - protein, 9 aa, Homo Sapiens
PTVVRHPNL

SEQ ID NO: 466264 - protein, 9 aa, Homo Sapiens
EGEGETMVR

SEQ ID NO: 466265 - protein, 9 aa, Homo Sapiens
STGCCRGGW

SEQ ID NO: 466266 - protein, 9 aa, Homo Sapiens
WRTCCATGT

SEQ ID NO: 466267 - protein, 9 aa, Homo Sapiens
PDEQPATRE

SEQ ID NO: 466268 - protein, 9 aa, Homo Sapiens
GLPVAAAPA

SEQ ID NO: 466269 - protein, 9 aa, Homo Sapiens
LICSQAVKK

SEQ ID NO: 466270 - protein, 9 aa, Homo Sapiens
LPTIANFSA

SEQ ID NO: 466271 - protein, 9 aa, Homo Sapiens
LLIHRRAHI

SEQ ID NO: 466272 - protein, 9 aa, Homo Sapiens
ELQVGIVEA

SEQ ID NO: 466273 - protein, 9 aa, Homo Sapiens
ALPVWRPPA

SEQ ID NO: 466274 - protein, 9 aa, Homo Sapiens
IGFCPPCLV

SEQ ID NO: 466275 - protein, 9 aa, Homo Sapiens
PTIANFSAL

SEQ ID NO: 466276 - protein, 9 aa, Homo Sapiens
VPGGKVEFK

SEQ ID NO: 466277 - protein, 9 aa, Homo Sapiens
LTRMALEQE

SEQ ID NO: 466278 - protein, 9 aa, Homo Sapiens
WGPCCRSTG

SEQ ID NO: 466279 - protein, 9 aa, Homo Sapiens
SEEGEGETM

SEQ ID NO: 466280 - protein, 9 aa, Homo Sapiens
VRHPNLHPS

SEQ ID NO: 466281 - protein, 9 aa, Homo Sapiens
RMWRTCCAT

SEQ ID NO: 466282 - protein, 9 aa, Homo Sapiens
LQQQQAQQQ

SEQ ID NO: 466283 - protein, 9 aa, Homo Sapiens
VEPDTETKI

SEQ ID NO: 466284 - protein, 9 aa, Homo Sapiens
YLTRMALEQ

SEQ ID NO: 466285 - protein, 9 aa, Homo Sapiens
IVAHRLGIR

SEQ ID NO: 466286 - protein, 9 aa, Homo Sapiens
AGGDTNRLR

SEQ ID NO: 466287 - protein, 9 aa, Homo Sapiens
GVVIEDWRG

SEQ ID NO: 466288 - protein, 9 aa, Homo Sapiens
MMSDPNFLR

SEQ ID NO: 466289 - protein, 9 aa, Homo Sapiens
LNNFISMDP

SEQ ID NO: 466290 - protein, 9 aa, Homo Sapiens
ILDAGDYEL

SEQ ID NO: 466291 - protein, 9 aa, Homo Sapiens
EAHYRFIYM

SEQ ID NO: 466292 - protein, 9 aa, Homo Sapiens
NATLSVRQL

SEQ ID NO: 466293 - protein, 9 aa, Homo Sapiens
EEGAPGHPE

SEQ ID NO: 466294 - protein, 9 aa, Homo Sapiens
RQLIENADE

SEQ ID NO: 466295 - protein, 9 aa, Homo Sapiens
SVSKKKDGE

SEQ ID NO: 466296 - protein, 9 aa, Homo Sapiens
WRRPDEQPA

SEQ ID NO: 466297 - protein, 9 aa, Homo Sapiens
CAINDVGKG

SEQ ID NO: 466298 - protein, 9 aa, Homo Sapiens
GRPRSKQEA

SEQ ID NO: 466299 - protein, 9 aa, Homo Sapiens
GTSGSCGCP

SEQ ID NO: 466300 - protein, 9 aa, Homo Sapiens
EVSLLGSVP

SEQ ID NO: 466301 - protein, 9 aa, Homo Sapiens
NTVGIMTRK

SEQ ID NO: 466302 - protein, 9 aa, Homo Sapiens
HFNKKKYEE

SEQ ID NO: 466303 - protein, 9 aa, Homo Sapiens
QPGPHSVHP

SEQ ID NO: 466304 - protein, 9 aa, Homo Sapiens
TEFVVRSGL

SEQ ID NO: 466305 - protein, 9 aa, Homo Sapiens
MVTEPPVVC

SEQ ID NO: 466306 - protein, 9 aa, Homo Sapiens
IVDNKDNTV

SEQ ID NO: 466307 - protein, 9 aa, Homo Sapiens
HPEAALEDN

SEQ ID NO: 466308 - protein, 9 aa, Homo Sapiens
VHPLLKHIK

SEQ ID NO: 466309 - protein, 9 aa, Homo Sapiens
VVIEDWRGQ

SEQ ID NO: 466310 - protein, 9 aa, Homo Sapiens
LSRWQKQLC

SEQ ID NO: 466311 - protein, 9 aa, Homo Sapiens
PAFEEELAD

SEQ ID NO: 466312 - protein, 9 aa, Homo Sapiens
ERRELICSQ

SEQ ID NO: 466313 - protein, 9 aa, Homo Sapiens
DSSYLTRMA

SEQ ID NO: 466314 - protein, 9 aa, Homo Sapiens
FSGFHPATL

SEQ ID NO: 466315 - protein, 9 aa, Homo Sapiens
KQEAWSTHN

SEQ ID NO: 466316 - protein, 9 aa, Homo Sapiens
DIICRVYLK

SEQ ID NO: 466317 - protein, 9 aa, Homo Sapiens
CLRKLQLCR

SEQ ID NO: 466318 - protein, 9 aa, Homo Sapiens
GGSSKSRTA

SEQ ID NO: 466319 - protein, 9 aa, Homo Sapiens
MVQTEAHYR

SEQ ID NO: 466320 - protein, 9 aa, Homo Sapiens
LDAGDYELQ

SEQ ID NO: 466321 - protein, 9 aa, Homo Sapiens
GGWRMWRTC

SEQ ID NO: 466322 - protein, 9 aa, Homo Sapiens
KKVEPDTET

SEQ ID NO: 466323 - protein, 9 aa, Homo Sapiens
RRGWGCALQ

SEQ ID NO: 466324 - protein, 9 aa, Homo Sapiens
SKASTLIAH

SEQ ID NO: 466325 - protein, 9 aa, Homo Sapiens
RGWGCALQY

SEQ ID NO: 466326 - protein, 9 aa, Homo Sapiens
PKDNDMNNI

SEQ ID NO: 466327 - protein, 9 aa, Homo Sapiens
RDHFNKKKY

SEQ ID NO: 466328 - protein, 9 aa, Homo Sapiens
LCAFELTLQ

SEQ ID NO: 466329 - protein, 9 aa, Homo Sapiens
WRPPAFEEE

SEQ ID NO: 466330 - protein, 9 aa, Homo Sapiens
KIGFCPPCL

SEQ ID NO: 466331 - protein, 9 aa, Homo Sapiens
AHRLGIRQA

SEQ ID NO: 466332 - protein, 9 aa, Homo Sapiens
RHPNLHPSF

SEQ ID NO: 466333 - protein, 9 aa, Homo Sapiens
TAKGMMSDP

SEQ ID NO: 466334 - protein, 9 aa, Homo Sapiens
ALLSSMLPS

SEQ ID NO: 466335 - protein, 9 aa, Homo Sapiens
INDVGKGQF

SEQ ID NO: 466336 - protein, 9 aa, Homo Sapiens
DDIIIAKKN

SEQ ID NO: 466337 - protein, 9 aa, Homo Sapiens
QLCAFELTL

SEQ ID NO: 466338 - protein, 9 aa, Homo Sapiens
KTAKGMMSD

SEQ ID NO: 466339 - protein, 9 aa, Homo Sapiens
EKGERGDKG

SEQ ID NO: 466340 - protein, 9 aa, Homo Sapiens
GVHMKQVTN

SEQ ID NO: 466341 - protein, 9 aa, Homo Sapiens
ICSQAVKKN

SEQ ID NO: 466342 - protein, 9 aa, Homo Sapiens
DFRFQPSHF

SEQ ID NO: 466343 - protein, 9 aa, Homo Sapiens
CSQAVKKNP

SEQ ID NO: 466344 - protein, 9 aa, Homo Sapiens
GGGSSKSRT

SEQ ID NO: 466345 - protein, 9 aa, Homo Sapiens
GHPEAALED

SEQ ID NO: 466346 - protein, 9 aa, Homo Sapiens
KGMMSDPNF

SEQ ID NO: 466347 - protein, 9 aa, Homo Sapiens
EARLWSSLS

SEQ ID NO: 466348 - protein, 9 aa, Homo Sapiens
PCLVTANLI

SEQ ID NO: 466349 - protein, 9 aa, Homo Sapiens
GCNDFTEAR

SEQ ID NO: 466350 - protein, 9 aa, Homo Sapiens
VDNKDNTVG

SEQ ID NO: 466351 - protein, 9 aa, Homo Sapiens
CAFELTLQA

SEQ ID NO: 466352 - protein, 9 aa, Homo Sapiens
KDGEQRGQE

SEQ ID NO: 466353 - protein, 9 aa, Homo Sapiens
VQTEAHYRF

SEQ ID NO: 466354 - protein, 9 aa, Homo Sapiens
EAELEMLKI

SEQ ID NO: 466355 - protein, 9 aa, Homo Sapiens
GSSKSRTAP

SEQ ID NO: 466356 - protein, 9 aa, Homo Sapiens
VLEGDHNFR

SEQ ID NO: 466357 - protein, 9 aa, Homo Sapiens
PPTVVRHPN

SEQ ID NO: 466358 - protein, 9 aa, Homo Sapiens
HGEGRPLEV

SEQ ID NO: 466359 - protein, 9 aa, Homo Sapiens
EDEEERRGW

SEQ ID NO: 466360 - protein, 9 aa, Homo Sapiens
RYRLPTIAN

SEQ ID NO: 466361 - protein, 9 aa, Homo Sapiens
PDCSPTDIT

SEQ ID NO: 466362 - protein, 9 aa, Homo Sapiens
CATGTSGSC

SEQ ID NO: 466363 - protein, 9 aa, Homo Sapiens
HPNLHPSFI

SEQ ID NO: 466364 - protein, 9 aa, Homo Sapiens
GAPGHPEAA

SEQ ID NO: 466365 - protein, 9 aa, Homo Sapiens
PAGGDTNRL

SEQ ID NO: 466366 - protein, 9 aa, Homo Sapiens
ICRVYLKQI

SEQ ID NO: 466367 - protein, 9 aa, Homo Sapiens
WRASGPCWG

SEQ ID NO: 466368 - protein, 9 aa, Homo Sapiens
CPRAARGRP

SEQ ID NO: 466369 - protein, 9 aa, Homo Sapiens
ADAVSVYKH

SEQ ID NO: 466370 - protein, 9 aa, Homo Sapiens
HPLLKHIKK

SEQ ID NO: 466371 - protein, 9 aa, Homo Sapiens
TCVLEGDHN

SEQ ID NO: 466372 - protein, 9 aa, Homo Sapiens
RMALEQEVG

SEQ ID NO: 466373 - protein, 9 aa, Homo Sapiens
GRNLKKVEP

SEQ ID NO: 466374 - protein, 9 aa, Homo Sapiens
RRYRLPTIA

SEQ ID NO: 466375 - protein, 9 aa, Homo Sapiens
MLKIAKPPS

SEQ ID NO: 466376 - protein, 9 aa, Homo Sapiens
ETMVRLLWL

SEQ ID NO: 466377 - protein, 9 aa, Homo Sapiens
NKKKYEEFK

SEQ ID NO: 466378 - protein, 9 aa, Homo Sapiens
PTEFVVRSG

SEQ ID NO: 466379 - protein, 9 aa, Homo Sapiens
DMNNIRATC

SEQ ID NO: 466380 - protein, 9 aa, Homo Sapiens
VHMKQVTNV

SEQ ID NO: 466381 - protein, 9 aa, Homo Sapiens
YFGSRVHCP

SEQ ID NO: 466382 - protein, 9 aa, Homo Sapiens
VEQKDIICR

SEQ ID NO: 466383 - protein, 9 aa, Homo Sapiens
ALMHVKAEY

SEQ ID NO: 466384 - protein, 9 aa, Homo Sapiens
VEFGTSWRA

SEQ ID NO: 466385 - protein, 9 aa, Homo Sapiens
DEEERRGWG

SEQ ID NO: 466386 - protein, 9 aa, Homo Sapiens
EDWRGQVGC

SEQ ID NO: 466387 - protein, 9 aa, Homo Sapiens
HPPTVVRHP

SEQ ID NO: 466388 - protein, 9 aa, Homo Sapiens
HVEQKDIIC

SEQ ID NO: 466389 - protein, 9 aa, Homo Sapiens
MVRLLWLSM

SEQ ID NO: 466390 - protein, 9 aa, Homo Sapiens
TLSVRQLIE

SEQ ID NO: 466391 - protein, 9 aa, Homo Sapiens
HPATLTVTN

SEQ ID NO: 466392 - protein, 9 aa, Homo Sapiens
SKSRTAPSP

SEQ ID NO: 466393 - protein, 9 aa, Homo Sapiens
FVVRSGLLT

SEQ ID NO: 466394 - protein, 9 aa, Homo Sapiens
SGSCGCPRA

SEQ ID NO: 466395 - protein, 9 aa, Homo Sapiens
CPAVVMGEN

SEQ ID NO: 466396 - protein, 9 aa, Homo Sapiens
PVSWTALMH

SEQ ID NO: 466397 - protein, 9 aa, Homo Sapiens
CPPCLVTAN

SEQ ID NO: 466398 - protein, 9 aa, Homo Sapiens
GSCGCPRAA

SEQ ID NO: 466399 - protein, 9 aa, Homo Sapiens
WTALMHVKA

SEQ ID NO: 466400 - protein, 9 aa, Homo Sapiens
GKHALLSSM

SEQ ID NO: 466401 - protein, 9 aa, Homo Sapiens
HMKQVTNVF

SEQ ID NO: 466402 - protein, 9 aa, Homo Sapiens
EEPPPPDCS

SEQ ID NO: 466403 - protein, 9 aa, Homo Sapiens
VWRPPAFEE

SEQ ID NO: 466404 - protein, 9 aa, Homo Sapiens
IAKPPSDIQ

SEQ ID NO: 466405 - protein, 9 aa, Homo Sapiens
CVKTCPAVV

SEQ ID NO: 466406 - protein, 9 aa, Homo Sapiens
GEMGEKGER

SEQ ID NO: 466407 - protein, 9 aa, Homo Sapiens
NLKKVEPDT

SEQ ID NO: 466408 - protein, 9 aa, Homo Sapiens
VSKKKDGEQ

SEQ ID NO: 466409 - protein, 9 aa, Homo Sapiens
SVRQLIENA

SEQ ID NO: 466410 - protein, 9 aa, Homo Sapiens
LRKLQLCRE

SEQ ID NO: 466411 - protein, 9 aa, Homo Sapiens
DIIIAKKNG

SEQ ID NO: 466412 - protein, 9 aa, Homo Sapiens
CLVTANLIT

SEQ ID NO: 466413 - protein, 9 aa, Homo Sapiens
AHYRFIYMA

SEQ ID NO: 466414 - protein, 9 aa, Homo Sapiens
PGMHPSMRP

SEQ ID NO: 466415 - protein, 9 aa, Homo Sapiens
PHSVHPLLK

SEQ ID NO: 466416 - protein, 9 aa, Homo Sapiens
LCAINDVGK

SEQ ID NO: 466417 - protein, 9 aa, Homo Sapiens
GPPGLPVAA

SEQ ID NO: 466418 - protein, 9 aa, Homo Sapiens
ARLWSSLSA

SEQ ID NO: 466419 - protein, 9 aa, Homo Sapiens
VIEDWRGQV

SEQ ID NO: 466420 - protein, 9 aa, Homo Sapiens
AVVMGENNT

SEQ ID NO: 466421 - protein, 9 aa, Homo Sapiens
VSVYKHGEG

SEQ ID NO: 466422 - protein, 9 aa, Homo Sapiens
SSSLLQYYL

SEQ ID NO: 466423 - protein, 9 aa, Homo Sapiens
GDHNFRCDA

SEQ ID NO: 466424 - protein, 9 aa, Homo Sapiens
AKKNGKVRG

SEQ ID NO: 466425 - protein, 9 aa, Homo Sapiens
PGRPRSKQE

SEQ ID NO: 466426 - protein, 9 aa, Homo Sapiens
VIPNPKDND

SEQ ID NO: 466427 - protein, 9 aa, Homo Sapiens
KKKYEEFKQ

SEQ ID NO: 466428 - protein, 9 aa, Homo Sapiens
GEKGERGDK

SEQ ID NO: 466429 - protein, 9 aa, Homo Sapiens
DGEQRGQEN

SEQ ID NO: 466430 - protein, 9 aa, Homo Sapiens
EFVVRSGLL

SEQ ID NO: 466431 - protein, 9 aa, Homo Sapiens
EFWRRPDEQ

SEQ ID NO: 466432 - protein, 9 aa, Homo Sapiens
SKMNLNNFI

SEQ ID NO: 466433 - protein, 9 aa, Homo Sapiens
VVRHPNLHP

SEQ ID NO: 466434 - protein, 9 aa, Homo Sapiens
SFSGFHPAT

SEQ ID NO: 466435 - protein, 9 aa, Homo Sapiens
CELLIHRRA

SEQ ID NO: 466436 - protein, 9 aa, Homo Sapiens
IDSSYLTRM

SEQ ID NO: 466437 - protein, 9 aa, Homo Sapiens
PPPDCSPTD

SEQ ID NO: 466438 - protein, 9 aa, Homo Sapiens
PSNTGHLPL

SEQ ID NO: 466439 - protein, 9 aa, Homo Sapiens
LSSMLPSLF

SEQ ID NO: 466440 - protein, 9 aa, Homo Sapiens
ACSFSGFHP

SEQ ID NO: 466441 - protein, 9 aa, Homo Sapiens
NGTKITDSG

SEQ ID NO: 466442 - protein, 9 aa, Homo Sapiens
KMNLNNFIS

SEQ ID NO: 466443 - protein, 9 aa, Homo Sapiens
SLLGSVPGG

SEQ ID NO: 466444 - protein, 9 aa, Homo Sapiens
DWRGQVGCE

SEQ ID NO: 466445 - protein, 9 aa, Homo Sapiens
ALFTILKQK

SEQ ID NO: 466446 - protein, 9 aa, Homo Sapiens
DSGEPRIQQ

SEQ ID NO: 466447 - protein, 9 aa, Homo Sapiens
PCWGPCCRS

SEQ ID NO: 466448 - protein, 9 aa, Homo Sapiens
DCSPTDITP

SEQ ID NO: 466449 - protein, 9 aa, Homo Sapiens
GDDFRFQPS

SEQ ID NO: 466450 - protein, 9 aa, Homo Sapiens
SNTGHLPLL

SEQ ID NO: 466451 - protein, 9 aa, Homo Sapiens
SLLQYYLIG

SEQ ID NO: 466452 - protein, 9 aa, Homo Sapiens
LKIAKPPSD

SEQ ID NO: 466453 - protein, 9 aa, Homo Sapiens
CPRLIGIGG

SEQ ID NO: 466454 - protein, 9 aa, Homo Sapiens
AINDVGKGQ

SEQ ID NO: 466455 - protein, 9 aa, Homo Sapiens
GQVGCEITC

SEQ ID NO: 466456 - protein, 9 aa, Homo Sapiens
HALLSSMLP

SEQ ID NO: 466457 - protein, 9 aa, Homo Sapiens
KYEEFKQLA

SEQ ID NO: 466458 - protein, 9 aa, Homo Sapiens
ILKQKSVRG

SEQ ID NO: 466459 - protein, 9 aa, Homo Sapiens
YELQVGIVE

SEQ ID NO: 466460 - protein, 9 aa, Homo Sapiens
ARGRPPRCP

SEQ ID NO: 466461 - protein, 9 aa, Homo Sapiens
ERGDKGCCG

SEQ ID NO: 466462 - protein, 9 aa, Homo Sapiens
RRPDEQPAT

SEQ ID NO: 466463 - protein, 9 aa, Homo Sapiens
QTEAHYRFI

SEQ ID NO: 466464 - protein, 9 aa, Homo Sapiens
KLQLCREEL

SEQ ID NO: 466465 - protein, 9 aa, Homo Sapiens
LFTILKQKS

SEQ ID NO: 466466 - protein, 9 aa, Homo Sapiens
WGCALQYQH

SEQ ID NO: 466467 - protein, 9 aa, Homo Sapiens
QVGPAVQEG

SEQ ID NO: 466468 - protein, 9 aa, Homo Sapiens
AKPSNTGHL

SEQ ID NO: 466469 - protein, 9 aa, Homo Sapiens
SSMLPSLFM

SEQ ID NO: 466470 - protein, 9 aa, Homo Sapiens
KPSNTGHLP

SEQ ID NO: 466471 - protein, 9 aa, Homo Sapiens
CSPTDITPP

SEQ ID NO: 466472 - protein, 9 aa, Homo Sapiens
VSWTALMHV

SEQ ID NO: 466473 - protein, 9 aa, Homo Sapiens
KYGVHMKQV

SEQ ID NO: 466474 - protein, 9 aa, Homo Sapiens
ELPDNLKAV

SEQ ID NO: 466475 - protein, 9 aa, Homo Sapiens
GTKITDSGE

SEQ ID NO: 466476 - protein, 9 aa, Homo Sapiens
CRRYRLPTI

SEQ ID NO: 466477 - protein, 9 aa, Homo Sapiens
VYKHGEGRP

SEQ ID NO: 466478 - protein, 9 aa, Homo Sapiens
PPPPDCSPT

SEQ ID NO: 466479 - protein, 9 aa, Homo Sapiens
AFSKASTLI

SEQ ID NO: 466480 - protein, 9 aa, Homo Sapiens
MKYGVHMKQ

SEQ ID NO: 466481 - protein, 9 aa, Homo Sapiens
LYYLPGMHP

SEQ ID NO: 466482 - protein, 9 aa, Homo Sapiens
LKQKSVRGV

SEQ ID NO: 466483 - protein, 9 aa, Homo Sapiens
ATLSVRQLI

SEQ ID NO: 466484 - protein, 9 aa, Homo Sapiens
FTILKQKSV

SEQ ID NO: 466485 - protein, 9 aa, Homo Sapiens
SQPGPHSVH

SEQ ID NO: 466486 - protein, 9 aa, Homo Sapiens
DEQPATREH

SEQ ID NO: 466487 - protein, 9 aa, Homo Sapiens
DLLKLSRWQ

SEQ ID NO: 466488 - protein, 9 aa, Homo Sapiens
RRAHIDVRN

SEQ ID NO: 466489 - protein, 9 aa, Homo Sapiens
GSRVHCPRL

SEQ ID NO: 466490 - protein, 9 aa, Homo Sapiens
LRDHFNKKK

SEQ ID NO: 466491 - protein, 9 aa, Homo Sapiens
RLPTIANFS

SEQ ID NO: 466492 - protein, 9 aa, Homo Sapiens
RTCCATGTS

SEQ ID NO: 466493 - protein, 9 aa, Homo Sapiens
QYYLIGQTV

SEQ ID NO: 466494 - protein, 9 aa, Homo Sapiens
PRSKQEAWS

SEQ ID NO: 466495 - protein, 9 aa, Homo Sapiens
IMKYGVHMK

SEQ ID NO: 466496 - protein, 9 aa, Homo Sapiens
TALMHVKAE

SEQ ID NO: 466497 - protein, 9 aa, Homo Sapiens
CCATGTSGS

SEQ ID NO: 466498 - protein, 9 aa, Homo Sapiens
DFTEARLWS

SEQ ID NO: 466499 - protein, 9 aa, Homo Sapiens
QKIGFCPPC

SEQ ID NO: 466500 - protein, 9 aa, Homo Sapiens
LCREELNQS

SEQ ID NO: 466501 - protein, 9 aa, Homo Sapiens
PCCRSTGCC

SEQ ID NO: 466502 - protein, 9 aa, Homo Sapiens
TKITDSGEP

SEQ ID NO: 466503 - protein, 9 aa, Homo Sapiens
LQLCREELN

SEQ ID NO: 466504 - protein, 9 aa, Homo Sapiens
ECRPTEFVV

SEQ ID NO: 466505 - protein, 9 aa, Homo Sapiens
SMLPSLFMT

SEQ ID NO: 466506 - protein, 9 aa, Homo Sapiens
IAKKNGKVR

SEQ ID NO: 466507 - protein, 9 aa, Homo Sapiens
QKSVRGVRK

SEQ ID NO: 466508 - protein, 9 aa, Homo Sapiens
VRQLIENAD

SEQ ID NO: 466509 - protein, 9 aa, Homo Sapiens
DAVSVYKHG

SEQ ID NO: 466510 - protein, 9 aa, Homo Sapiens
TEPPVVCSY

SEQ ID NO: 466511 - protein, 9 aa, Homo Sapiens
SGFHPATLT

SEQ ID NO: 466512 - protein, 9 aa, Homo Sapiens
SVYKHGEGR

SEQ ID NO: 466513 - protein, 9 aa, Homo Sapiens
ELICSQAVK

SEQ ID NO: 466514 - protein, 9 aa, Homo Sapiens
GEQRGQENT

SEQ ID NO: 466515 - protein, 9 aa, Homo Sapiens
EPAGGDTNR

SEQ ID NO: 466516 - protein, 9 aa, Homo Sapiens
SWTALMHVK

SEQ ID NO: 466517 - protein, 9 aa, Homo Sapiens
GPCCRSTGC

SEQ ID NO: 466518 - protein, 9 aa, Homo Sapiens
RLCAINDVG

SEQ ID NO: 466519 - protein, 9 aa, Homo Sapiens
NLKAVFRTV

SEQ ID NO: 466520 - protein, 9 aa, Homo Sapiens
SILLAVMAY

SEQ ID NO: 466521 - protein, 9 aa, Homo Sapiens
RILDAGDYE

SEQ ID NO: 466522 - protein, 9 aa, Homo Sapiens
CVLEGDHNF

SEQ ID NO: 466523 - protein, 9 aa, Homo Sapiens
GEGETMVRL

SEQ ID NO: 466524 - protein, 9 aa, Homo Sapiens
LLSSMLPSL

SEQ ID NO: 466525 - protein, 9 aa, Homo Sapiens
FGSRVHCPR

SEQ ID NO: 466526 - protein, 9 aa, Homo Sapiens
LLQYYLIGQ

SEQ ID NO: 466527 - protein, 9 aa, Homo Sapiens
HCPRLIGIG

SEQ ID NO: 466528 - protein, 9 aa, Homo Sapiens
ERLEQGQVG

SEQ ID NO: 466529 - protein, 9 aa, Homo Sapiens
LIAHKTIHA

SEQ ID NO: 466530 - protein, 9 aa, Homo Sapiens
HRRAHIDVR

SEQ ID NO: 466531 - protein, 9 aa, Homo Sapiens
VGPAVQEGL

SEQ ID NO: 466532 - protein, 9 aa, Homo Sapiens
AVEFGTSWR

SEQ ID NO: 466533 - protein, 9 aa, Homo Sapiens
KERRELICS

SEQ ID NO: 466534 - protein, 9 aa, Homo Sapiens
IIAKKNGKV

SEQ ID NO: 466535 - protein, 9 aa, Homo Sapiens
AAKPSNTGH

SEQ ID NO: 466536 - protein, 9 aa, Homo Sapiens
GPCWGPCCR

SEQ ID NO: 466537 - protein, 9 aa, Homo Sapiens
KIAKPPSDI

SEQ ID NO: 466538 - protein, 9 aa, Homo Sapiens
GETMVRLLW

SEQ ID NO: 466539 - protein, 9 aa, Homo Sapiens
LKKVEPDTE

SEQ ID NO: 466540 - protein, 9 aa, Homo Sapiens
PSHFHRDQL

SEQ ID NO: 466541 - protein, 9 aa, Homo Sapiens
EGAPGHPEA

SEQ ID NO: 466542 - protein, 9 aa, Homo Sapiens
ATGTSGSCG

SEQ ID NO: 466543 - protein, 9 aa, Homo Sapiens
CGPPGLPVA

SEQ ID NO: 466544 - protein, 9 aa, Homo Sapiens
YNATLSVRQ

SEQ ID NO: 466545 - protein, 9 aa, Homo Sapiens
PGHPEAALE

SEQ ID NO: 466546 - protein, 9 aa, Homo Sapiens
QFRLCAIND

SEQ ID NO: 466547 - protein, 9 aa, Homo Sapiens
RASGPCWGP

SEQ ID NO: 466548 - protein, 9 aa, Homo Sapiens
EGDHNFRCD

SEQ ID NO: 466549 - protein, 9 aa, Homo Sapiens
DNLKAVFRT

SEQ ID NO: 466550 - protein, 9 aa, Homo Sapiens
AVFRTVAMM

SEQ ID NO: 466551 - protein, 9 aa, Homo Sapiens
CRVYLKQII

SEQ ID NO: 466552 - protein, 9 aa, Homo Sapiens
TAPSPQEAL

SEQ ID NO: 466553 - protein, 9 aa, Homo Sapiens
VTEPPVVCS

SEQ ID NO: 466554 - protein, 9 aa, Homo Sapiens
YEPAGGDTN

SEQ ID NO: 466555 - protein, 9 aa, Homo Sapiens
PDNLKAVFR

SEQ ID NO: 466556 - protein, 9 aa, Homo Sapiens
SWRASGPCW

SEQ ID NO: 466557 - protein, 9 aa, Homo Sapiens
QEAWSTHNT

SEQ ID NO: 466558 - protein, 9 aa, Homo Sapiens
RNLKKVEPD

SEQ ID NO: 466559 - protein, 9 aa, Homo Sapiens
TGHLPLLPN

SEQ ID NO: 466560 - protein, 9 aa, Homo Sapiens
TSVSKKKDG

SEQ ID NO: 466561 - protein, 9 aa, Homo Sapiens
FSKASTLIA

SEQ ID NO: 466562 - protein, 9 aa, Homo Sapiens
KTCPAVVMG

SEQ ID NO: 466563 - protein, 9 aa, Homo Sapiens
VCSYFAQDL

SEQ ID NO: 466564 - protein, 9 aa, Homo Sapiens
MHPSMRPGW

SEQ ID NO: 466565 - protein, 9 aa, Homo Sapiens
CCRGGWRMW

SEQ ID NO: 466566 - protein, 9 aa, Homo Sapiens
FRLCAINDV

SEQ ID NO: 466567 - protein, 9 aa, Homo Sapiens
LPDNLKAVF

SEQ ID NO: 466568 - protein, 9 aa, Homo Sapiens
AARGRPPRC

SEQ ID NO: 466569 - protein, 9 aa, Homo Sapiens
CCRSTGCCR

SEQ ID NO: 466570 - protein, 9 aa, Homo Sapiens
TDSGEPRIQ

SEQ ID NO: 466571 - protein, 9 aa, Homo Sapiens
NFISMDPKV

SEQ ID NO: 466572 - protein, 9 aa, Homo Sapiens
EQKDIICRV

SEQ ID NO: 466573 - protein, 9 aa, Homo Sapiens
RKLQLCREE

SEQ ID NO: 466574 - protein, 9 aa, Homo Sapiens
VVTESILLA

SEQ ID NO: 466575 - protein, 9 aa, Homo Sapiens
LSVRQLIEN

SEQ ID NO: 466576 - protein, 9 aa, Homo Sapiens
SVHPLLKHI

SEQ ID NO: 466577 - protein, 9 aa, Homo Sapiens
KDNTVGIMT

SEQ ID NO: 466578 - protein, 9 aa, Homo Sapiens
GSVPGGKVE

SEQ ID NO: 466579 - protein, 9 aa, Homo Sapiens
EAWSTHNTV

SEQ ID NO: 466580 - protein, 9 aa, Homo Sapiens
TERLEQGQV

SEQ ID NO: 466581 - protein, 9 aa, Homo Sapiens
LSCLRKLQL

SEQ ID NO: 466582 - protein, 9 aa, Homo Sapiens
RWQKQLCRR

SEQ ID NO: 466583 - protein, 9 aa, Homo Sapiens
RIVAHRLGI

SEQ ID NO: 466584 - protein, 9 aa, Homo Sapiens
NFRCDACLL

SEQ ID NO: 466585 - protein, 9 aa, Homo Sapiens
SSLLQYYLI

SEQ ID NO: 466586 - protein, 9 aa, Homo Sapiens
TSGSCGCPR

SEQ ID NO: 466587 - protein, 9 aa, Homo Sapiens
EQGQVGPAV

SEQ ID NO: 466588 - protein, 9 aa, Homo Sapiens
KITDSGEPR

SEQ ID NO: 466589 - protein, 9 aa, Homo Sapiens
NECRPTEFV

SEQ ID NO: 466590 - protein, 9 aa, Homo Sapiens
FGTSWRASG

SEQ ID NO: 466591 - protein, 9 aa, Homo Sapiens
VDRIVAHRL

SEQ ID NO: 466592 - protein, 9 aa, Homo Sapiens
LIHRRAHID

SEQ ID NO: 466593 - protein, 9 aa, Homo Sapiens
CDLLKLSRW

SEQ ID NO: 466594 - protein, 9 aa, Homo Sapiens
ESSSLLQYY

SEQ ID NO: 466595 - protein, 9 aa, Homo Sapiens
CGCPRAARG

SEQ ID NO: 466596 - protein, 9 aa, Homo Sapiens
PPAFEEELA

SEQ ID NO: 466597 - protein, 9 aa, Homo Sapiens
SVPGGKVEF

SEQ ID NO: 466598 - protein, 9 aa, Homo Sapiens
WRGQVGCEI

SEQ ID NO: 466599 - protein, 9 aa, Homo Sapiens
GMVQTEAHY

SEQ ID NO: 466600 - protein, 9 aa, Homo Sapiens
KDIICRVYL

SEQ ID NO: 466601 - protein, 9 aa, Homo Sapiens
EFGTSWRAS

SEQ ID NO: 466602 - protein, 9 aa, Homo Sapiens
PGPHSVHPL

SEQ ID NO: 466603 - protein, 9 aa, Homo Sapiens
RLEQGQVGP

SEQ ID NO: 466604 - protein, 9 aa, Homo Sapiens
QGQVGPAVQ

SEQ ID NO: 466605 - protein, 9 aa, Homo Sapiens
LHCWQKERA

SEQ ID NO: 466606 - protein, 9 aa, Homo Sapiens
TNRLRRPGG

SEQ ID NO: 466607 - protein, 9 aa, Homo Sapiens
IAHKTIHAG

SEQ ID NO: 466608 - protein, 9 aa, Homo Sapiens
EEERRGWGC

SEQ ID NO: 466609 - protein, 9 aa, Homo Sapiens
HRLGIRQAG

SEQ ID NO: 466610 - protein, 9 aa, Homo Sapiens
GTSWRASGP

SEQ ID NO: 466611 - protein, 9 aa, Homo Sapiens
EKTAVEFGT

SEQ ID NO: 466612 - protein, 9 aa, Homo Sapiens
TLIAHKTIH

SEQ ID NO: 466613 - protein, 9 aa, Homo Sapiens
SSKSRTAPS

SEQ ID NO: 466614 - protein, 9 aa, Homo Sapiens
TMVRLLWLS

SEQ ID NO: 466615 - protein, 9 aa, Homo Sapiens
GDTNRLRRP

SEQ ID NO: 466616 - protein, 9 aa, Homo Sapiens
NWKTAKGMM

SEQ ID NO: 466617 - protein, 9 aa, Homo Sapiens
HCWQKERAE

SEQ ID NO: 466618 - protein, 9 aa, Homo Sapiens
TSWRASGPC

SEQ ID NO: 466619 - protein, 9 aa, Homo Sapiens
HPSMRPGWG

SEQ ID NO: 466620 - protein, 9 aa, Homo Sapiens
DSKMNLNNF

SEQ ID NO: 466621 - protein, 9 aa, Homo Sapiens
GPHSVHPLL

SEQ ID NO: 466622 - protein, 9 aa, Homo Sapiens
PPDCSPTDI

SEQ ID NO: 466623 - protein, 9 aa, Homo Sapiens
VAHRLGIRQ

SEQ ID NO: 466624 - protein, 9 aa, Homo Sapiens
RGQVGCEIT

SEQ ID NO: 466625 - protein, 9 aa, Homo Sapiens
RGGWRMWRT

SEQ ID NO: 466626 - protein, 9 aa, Homo Sapiens
MGEKGERGD

SEQ ID NO: 466627 - protein, 9 aa, Homo Sapiens
FTEARLWSS

SEQ ID NO: 466628 - protein, 9 aa, Homo Sapiens
NKDNTVGIM

SEQ ID NO: 466629 - protein, 9 aa, Homo Sapiens
KVEPDTETK

SEQ ID NO: 466630 - protein, 9 aa, Homo Sapiens
CSYFAQDLW

SEQ ID NO: 466631 - protein, 9 aa, Homo Sapiens
DHFNKKKYE

SEQ ID NO: 466632 - protein, 9 aa, Homo Sapiens
VTESILLAV

SEQ ID NO: 466633 - protein, 9 aa, Homo Sapiens
GWRMWRTCC

SEQ ID NO: 466634 - protein, 9 aa, Homo Sapiens
KAVFRTVAM

SEQ ID NO: 466635 - protein, 9 aa, Homo Sapiens
DDFRFQPSH

SEQ ID NO: 466636 - protein, 9 aa, Homo Sapiens
SGMVQTEAH

SEQ ID NO: 466637 - protein, 9 aa, Homo Sapiens
MLPSLFMTS

SEQ ID NO: 466638 - protein, 9 aa, Homo Sapiens
VVRSGLLTV

SEQ ID NO: 466639 - protein, 9 aa, Homo Sapiens
LKAVFRTVA

SEQ ID NO: 466640 - protein, 9 aa, Homo Sapiens
KSRTAPSPQ

SEQ ID NO: 466641 - protein, 9 aa, Homo Sapiens
GDSKMNLNN

SEQ ID NO: 466642 - protein, 9 aa, Homo Sapiens
FRFQPSHFH

SEQ ID NO: 466643 - protein, 9 aa, Homo Sapiens
KKKDGEQRG

SEQ ID NO: 466644 - protein, 9 aa, Homo Sapiens
RAHIDVRNK

SEQ ID NO: 466645 - protein, 9 aa, Homo Sapiens
YYLPGMHPS

SEQ ID NO: 466646 - protein, 9 aa, Homo Sapiens
ELEMLKIAK

SEQ ID NO: 466647 - protein, 9 aa, Homo Sapiens
KKNGKVRGM

SEQ ID NO: 466648 - protein, 9 aa, Homo Sapiens
YIMKYGVHM

SEQ ID NO: 466649 - protein, 9 aa, Homo Sapiens
NEVSLLGSV

SEQ ID NO: 466650 - protein, 9 aa, Homo Sapiens
LGSVPGGKV

SEQ ID NO: 466651 - protein, 9 aa, Homo Sapiens
IHRRAHIDV

SEQ ID NO: 466652 - protein, 9 aa, Homo Sapiens
NNFISMDPK

SEQ ID NO: 466653 - protein, 9 aa, Homo Sapiens
SYLTRMALE

SEQ ID NO: 466654 - protein, 9 aa, Homo Sapiens
NLNNFISMD

SEQ ID NO: 466655 - protein, 9 aa, Homo Sapiens
LPGMHPSMR

SEQ ID NO: 466656 - protein, 9 aa, Homo Sapiens
VFRTVAMMV

SEQ ID NO: 466657 - protein, 9 aa, Homo Sapiens
EPPPPDCSP

SEQ ID NO: 466658 - protein, 9 aa, Homo Sapiens
AVDRIVAHR

SEQ ID NO: 466659 - protein, 9 aa, Homo Sapiens
CNDFTEARL

SEQ ID NO: 466660 - protein, 9 aa, Homo Sapiens
AGLHQLMLH

SEQ ID NO: 466661 - protein, 9 aa, Homo Sapiens
YQFRLCAIN

SEQ ID NO: 466662 - protein, 9 aa, Homo Sapiens
SCGCPRAAR

SEQ ID NO: 466663 - protein, 9 aa, Homo Sapiens
CRGGWRMWR

SEQ ID NO: 466664 - protein, 9 aa, Homo Sapiens
DTNRLRRPG

SEQ ID NO: 466665 - protein, 9 aa, Homo Sapiens
HSVHPLLKH

SEQ ID NO: 466666 - protein, 9 aa, Homo Sapiens
TCCATGTSG

SEQ ID NO: 466667 - protein, 9 aa, Homo Sapiens
YKHGEGRPL

SEQ ID NO: 466668 - protein, 9 aa, Homo Sapiens
GERGDKGCC

SEQ ID NO: 466669 - protein, 9 aa, Homo Sapiens
RELICSQAV

SEQ ID NO: 466670 - protein, 9 aa, Homo Sapiens
DAGDYELQV

SEQ ID NO: 466671 - protein, 9 aa, Homo Sapiens
LQYYLIGQT

SEQ ID NO: 466672 - protein, 9 aa, Homo Sapiens
GMHPSMRPG

SEQ ID NO: 466673 - protein, 9 aa, Homo Sapiens
RREEGAPGH

SEQ ID NO: 466674 - protein, 9 aa, Homo Sapiens
FWRRPDEQP

SEQ ID NO: 466675 - protein, 9 aa, Homo Sapiens
DACSFSGFH

SEQ ID NO: 466676 - protein, 9 aa, Homo Sapiens
IICRVYLKQ

SEQ ID NO: 466677 - protein, 9 aa, Homo Sapiens
TESILLAVM

SEQ ID NO: 466678 - protein, 9 aa, Homo Sapiens
SKQEAWSTH

SEQ ID NO: 466679 - protein, 9 aa, Homo Sapiens
SCLRKLQLC

SEQ ID NO: 466680 - protein, 9 aa, Homo Sapiens
VHCPRLIGI

SEQ ID NO: 466681 - protein, 9 aa, Homo Sapiens
GCCRGGWRM

SEQ ID NO: 466682 - protein, 9 aa, Homo Sapiens
SSYLTRMAL

SEQ ID NO: 466683 - protein, 9 aa, Homo Sapiens
EPDTETKIT

SEQ ID NO: 466684 - protein, 9 aa, Homo Sapiens
EDDIIIAKK

SEQ ID NO: 466685 - protein, 9 aa, Homo Sapiens
PNPKDNDMN

SEQ ID NO: 466686 - protein, 9 aa, Homo Sapiens
STLIAHKTI

SEQ ID NO: 466687 - protein, 9 aa, Homo Sapiens
FQPSHFHRD

SEQ ID NO: 466688 - protein, 9 aa, Homo Sapiens
HMLQQQQAQ

SEQ ID NO: 466689 - protein, 9 aa, Homo Sapiens
RPDEQPATR

SEQ ID NO: 466690 - protein, 9 aa, Homo Sapiens
KTAVEFGTS

SEQ ID NO: 466691 - protein, 9 aa, Homo Sapiens
VVMGENNTL

SEQ ID NO: 466692 - protein, 9 aa, Homo Sapiens
AFEEELADC

SEQ ID NO: 466693 - protein, 9 aa, Homo Sapiens
YLIGQTVSS

SEQ ID NO: 466694 - protein, 9 aa, Homo Sapiens
SYFGSRVHC

SEQ ID NO: 466695 - protein, 9 aa, Homo Sapiens
ELLIHRRAH

SEQ ID NO: 466696 - protein, 9 aa, Homo Sapiens
LPVWRPPAF

SEQ ID NO: 466697 - protein, 9 aa, Homo Sapiens
TGTSGSCGC

SEQ ID NO: 466698 - protein, 9 aa, Homo Sapiens
IPNPKDNDM

SEQ ID NO: 466699 - protein, 9 aa, Homo Sapiens
FNLIAPLEG

SEQ ID NO: 466700 - protein, 9 aa, Homo Sapiens
DPVHSHHVP

SEQ ID NO: 466701 - protein, 9 aa, Homo Sapiens
IKSSLYKRW

SEQ ID NO: 466702 - protein, 9 aa, Homo Sapiens
LFHGEACEQ

SEQ ID NO: 466703 - protein, 9 aa, Homo Sapiens
ESFGCEDPR

SEQ ID NO: 466704 - protein, 9 aa, Homo Sapiens
RRRSRDRRH

SEQ ID NO: 466705 - protein, 9 aa, Homo Sapiens
MREEKLLME

SEQ ID NO: 466706 - protein, 9 aa, Homo Sapiens
RNFDGRELL

SEQ ID NO: 466707 - protein, 9 aa, Homo Sapiens
AQPTRNFSI

SEQ ID NO: 466708 - protein, 9 aa, Homo Sapiens
FEELLLAET

SEQ ID NO: 466709 - protein, 9 aa, Homo Sapiens
HTVEKPYVC

SEQ ID NO: 466710 - protein, 9 aa, Homo Sapiens
IPDEEVLWL

SEQ ID NO: 466711 - protein, 9 aa, Homo Sapiens
TMTFGWHHS

SEQ ID NO: 466712 - protein, 9 aa, Homo Sapiens
DIGENALQK

SEQ ID NO: 466713 - protein, 9 aa, Homo Sapiens
GAEAGARAE

SEQ ID NO: 466714 - protein, 9 aa, Homo Sapiens
GKVFSHSTL

SEQ ID NO: 466715 - protein, 9 aa, Homo Sapiens
GVLWVCVAA

SEQ ID NO: 466716 - protein, 9 aa, Homo Sapiens
EEEVKNSVS

SEQ ID NO: 466717 - protein, 9 aa, Homo Sapiens
TGLQLAAVV

SEQ ID NO: 466718 - protein, 9 aa, Homo Sapiens
GIGSDYFDA

SEQ ID NO: 466719 - protein, 9 aa, Homo Sapiens
ELSAAYTLV

SEQ ID NO: 466720 - protein, 9 aa, Homo Sapiens
HQGLLLDTS

SEQ ID NO: 466721 - protein, 9 aa, Homo Sapiens
FPHQGLLLD

SEQ ID NO: 466722 - protein, 9 aa, Homo Sapiens
GRNFDGREL

SEQ ID NO: 466723 - protein, 9 aa, Homo Sapiens
SKYGIYTKV

SEQ ID NO: 466724 - protein, 9 aa, Homo Sapiens
ESPGTRDAP

SEQ ID NO: 466725 - protein, 9 aa, Homo Sapiens
VSANWTIQY

SEQ ID NO: 466726 - protein, 9 aa, Homo Sapiens
GMSYMMILR

SEQ ID NO: 466727 - protein, 9 aa, Homo Sapiens
HCKAGKGGT

SEQ ID NO: 466728 - protein, 9 aa, Homo Sapiens
CYSIQSLYL

SEQ ID NO: 466729 - protein, 9 aa, Homo Sapiens
VIGMSYMMI

SEQ ID NO: 466730 - protein, 9 aa, Homo Sapiens
IRFEELLLA

SEQ ID NO: 466731 - protein, 9 aa, Homo Sapiens
ELLLAETDT

SEQ ID NO: 466732 - protein, 9 aa, Homo Sapiens
KPPAYSRPT

SEQ ID NO: 466733 - protein, 9 aa, Homo Sapiens
MLAAFISHV

SEQ ID NO: 466734 - protein, 9 aa, Homo Sapiens
NSEGMAASP

SEQ ID NO: 466735 - protein, 9 aa, Homo Sapiens
THGVSANWT

SEQ ID NO: 466736 - protein, 9 aa, Homo Sapiens
RAEAGAGAE

SEQ ID NO: 466737 - protein, 9 aa, Homo Sapiens
GAQAEFLFC

SEQ ID NO: 466738 - protein, 9 aa, Homo Sapiens
VLWLLYEEA

SEQ ID NO: 466739 - protein, 9 aa, Homo Sapiens
EVKNSVSSR

SEQ ID NO: 466740 - protein, 9 aa, Homo Sapiens
VIAHMGMAD

SEQ ID NO: 466741 - protein, 9 aa, Homo Sapiens
KPYVFPDCG

SEQ ID NO: 466742 - protein, 9 aa, Homo Sapiens
LFAVIAHMG

SEQ ID NO: 466743 - protein, 9 aa, Homo Sapiens
LMEREVAAL

SEQ ID NO: 466744 - protein, 9 aa, Homo Sapiens
GGTMANNSE

SEQ ID NO: 466745 - protein, 9 aa, Homo Sapiens
IVIGMSYMM

SEQ ID NO: 466746 - protein, 9 aa, Homo Sapiens
ELTHGVSAN

SEQ ID NO: 466747 - protein, 9 aa, Homo Sapiens
QSVVVVLLL

SEQ ID NO: 466748 - protein, 9 aa, Homo Sapiens
TAICKNKEA

SEQ ID NO: 466749 - protein, 9 aa, Homo Sapiens
EQASQNFLE

SEQ ID NO: 466750 - protein, 9 aa, Homo Sapiens
HSHHVPVDV

SEQ ID NO: 466751 - protein, 9 aa, Homo Sapiens
PNETPSQRP

SEQ ID NO: 466752 - protein, 9 aa, Homo Sapiens
RTYSIGRNF

SEQ ID NO: 466753 - protein, 9 aa, Homo Sapiens
PAYSRPTVL

SEQ ID NO: 466754 - protein, 9 aa, Homo Sapiens
PLPQESPGT

SEQ ID NO: 466755 - protein, 9 aa, Homo Sapiens
AQPSTSGKR

SEQ ID NO: 466756 - protein, 9 aa, Homo Sapiens
RHQRTHTVE

SEQ ID NO: 466757 - protein, 9 aa, Homo Sapiens
PRFPHQGLL

SEQ ID NO: 466758 - protein, 9 aa, Homo Sapiens
PVHSHHVPV

SEQ ID NO: 466759 - protein, 9 aa, Homo Sapiens
IFPQSVVVV

SEQ ID NO: 466760 - protein, 9 aa, Homo Sapiens
VLVVGDIAQ

SEQ ID NO: 466761 - protein, 9 aa, Homo Sapiens
SAAYTLVMK

SEQ ID NO: 466762 - protein, 9 aa, Homo Sapiens
YHVQDGKIF

SEQ ID NO: 466763 - protein, 9 aa, Homo Sapiens
IWIGGSILA

SEQ ID NO: 466764 - protein, 9 aa, Homo Sapiens
TVEKPYVCR

SEQ ID NO: 466765 - protein, 9 aa, Homo Sapiens
AGKGGTGVM

SEQ ID NO: 466766 - protein, 9 aa, Homo Sapiens
KRFSFHSDL

SEQ ID NO: 466767 - protein, 9 aa, Homo Sapiens
LLFHGEACE

SEQ ID NO: 466768 - protein, 9 aa, Homo Sapiens
HGCTANDGN

SEQ ID NO: 466769 - protein, 9 aa, Homo Sapiens
KKAIQTAIC

SEQ ID NO: 466770 - protein, 9 aa, Homo Sapiens
VLPPVFNLI

SEQ ID NO: 466771 - protein, 9 aa, Homo Sapiens
TKDDVATNV

SEQ ID NO: 466772 - protein, 9 aa, Homo Sapiens
FLFCTETQS

SEQ ID NO: 466773 - protein, 9 aa, Homo Sapiens
KFQECRKAF

SEQ ID NO: 466774 - protein, 9 aa, Homo Sapiens
FTAELTHGV

SEQ ID NO: 466775 - protein, 9 aa, Homo Sapiens
LQLAAVVCT

SEQ ID NO: 466776 - protein, 9 aa, Homo Sapiens
AQAEFLFCT

SEQ ID NO: 466777 - protein, 9 aa, Homo Sapiens
IVPTNTQNI

SEQ ID NO: 466778 - protein, 9 aa, Homo Sapiens
HGEACEQLR

SEQ ID NO: 466779 - protein, 9 aa, Homo Sapiens
KEYHVQDGK

SEQ ID NO: 466780 - protein, 9 aa, Homo Sapiens
RHRRRSRDR

SEQ ID NO: 466781 - protein, 9 aa, Homo Sapiens
PTRNFSIWI

SEQ ID NO: 466782 - protein, 9 aa, Homo Sapiens
SFGCEDPRP

SEQ ID NO: 466783 - protein, 9 aa, Homo Sapiens
LLAETDTPL

SEQ ID NO: 466784 - protein, 9 aa, Homo Sapiens
RNSSCCNLS

SEQ ID NO: 466785 - protein, 9 aa, Homo Sapiens
YSIGRNFDG

SEQ ID NO: 466786 - protein, 9 aa, Homo Sapiens
NLLFHGEAC

SEQ ID NO: 466787 - protein, 9 aa, Homo Sapiens
CDKIKSSLY

SEQ ID NO: 466788 - protein, 9 aa, Homo Sapiens
HSTLTNYKR

SEQ ID NO: 466789 - protein, 9 aa, Homo Sapiens
GNTKYNSRA

SEQ ID NO: 466790 - protein, 9 aa, Homo Sapiens
LLMEREVAA

SEQ ID NO: 466791 - protein, 9 aa, Homo Sapiens
SQGSQQYRA

SEQ ID NO: 466792 - protein, 9 aa, Homo Sapiens
DYFDATPHG

SEQ ID NO: 466793 - protein, 9 aa, Homo Sapiens
GEKPYKFQE

SEQ ID NO: 466794 - protein, 9 aa, Homo Sapiens
MPFQLPPGV

SEQ ID NO: 466795 - protein, 9 aa, Homo Sapiens
VTRALVEER

SEQ ID NO: 466796 - protein, 9 aa, Homo Sapiens
RRSRDRRHR

SEQ ID NO: 466797 - protein, 9 aa, Homo Sapiens
YLGILSVML

SEQ ID NO: 466798 - protein, 9 aa, Homo Sapiens
DTVEAPGGQ

SEQ ID NO: 466799 - protein, 9 aa, Homo Sapiens
GSDYFDATP

SEQ ID NO: 466800 - protein, 9 aa, Homo Sapiens
GLQLAAVVC

SEQ ID NO: 466801 - protein, 9 aa, Homo Sapiens
TRALVEERI

SEQ ID NO: 466802 - protein, 9 aa, Homo Sapiens
HMRGHSPFA

SEQ ID NO: 466803 - protein, 9 aa, Homo Sapiens
SPRRHRRRS

SEQ ID NO: 466804 - protein, 9 aa, Homo Sapiens
VAVLVVGDI

SEQ ID NO: 466805 - protein, 9 aa, Homo Sapiens
NHYHMRGHS

SEQ ID NO: 466806 - protein, 9 aa, Homo Sapiens
STVINHYHM

SEQ ID NO: 466807 - protein, 9 aa, Homo Sapiens
VEELSAAYT

SEQ ID NO: 466808 - protein, 9 aa, Homo Sapiens
RRYNESKKR

SEQ ID NO: 466809 - protein, 9 aa, Homo Sapiens
ADIGENALQ

SEQ ID NO: 466810 - protein, 9 aa, Homo Sapiens
VCTNGRRHL

SEQ ID NO: 466811 - protein, 9 aa, Homo Sapiens
LTSQGSQQY

SEQ ID NO: 466812 - protein, 9 aa, Homo Sapiens
YHMRGHSPF

SEQ ID NO: 466813 - protein, 9 aa, Homo Sapiens
SSCCNLSIQ

SEQ ID NO: 466814 - protein, 9 aa, Homo Sapiens
PTNTQNIFF

SEQ ID NO: 466815 - protein, 9 aa, Homo Sapiens
SKKRFSFHS

SEQ ID NO: 466816 - protein, 9 aa, Homo Sapiens
VEKPYVCRE

SEQ ID NO: 466817 - protein, 9 aa, Homo Sapiens
GTRDAPNLV

SEQ ID NO: 466818 - protein, 9 aa, Homo Sapiens
DFERMKEYH

SEQ ID NO: 466819 - protein, 9 aa, Homo Sapiens
SSCMGGMNQ

SEQ ID NO: 466820 - protein, 9 aa, Homo Sapiens
SKSPRRHRR

SEQ ID NO: 466821 - protein, 9 aa, Homo Sapiens
QWKAAAVFL

SEQ ID NO: 466822 - protein, 9 aa, Homo Sapiens
NLESFGCED

SEQ ID NO: 466823 - protein, 9 aa, Homo Sapiens
ANNSEGMAA

SEQ ID NO: 466824 - protein, 9 aa, Homo Sapiens
WGVLWVCVA

SEQ ID NO: 466825 - protein, 9 aa, Homo Sapiens
VINHYHMRG

SEQ ID NO: 466826 - protein, 9 aa, Homo Sapiens
CAMKSKYGI

SEQ ID NO: 466827 - protein, 9 aa, Homo Sapiens
GEKPYVFPD

SEQ ID NO: 466828 - protein, 9 aa, Homo Sapiens
VHSHHVPVD

SEQ ID NO: 466829 - protein, 9 aa, Homo Sapiens
MIVIGMSYM

SEQ ID NO: 466830 - protein, 9 aa, Homo Sapiens
TGEKPYKFQ

SEQ ID NO: 466831 - protein, 9 aa, Homo Sapiens
KSPRRHRRR

SEQ ID NO: 466832 - protein, 9 aa, Homo Sapiens
SIGRNFDGR

SEQ ID NO: 466833 - protein, 9 aa, Homo Sapiens
EIDLPVKRQ

SEQ ID NO: 466834 - protein, 9 aa, Homo Sapiens
SVHDGVPMP

SEQ ID NO: 466835 - protein, 9 aa, Homo Sapiens
GKRPREGEA

SEQ ID NO: 466836 - protein, 9 aa, Homo Sapiens
HVLRRVAQK

SEQ ID NO: 466837 - protein, 9 aa, Homo Sapiens
VHDGVPMPF

SEQ ID NO: 466838 - protein, 9 aa, Homo Sapiens
NFSIWIGGS

SEQ ID NO: 466839 - protein, 9 aa, Homo Sapiens
CTETQSEKL

SEQ ID NO: 466840 - protein, 9 aa, Homo Sapiens
AAHRPEAVA

SEQ ID NO: 466841 - protein, 9 aa, Homo Sapiens
HDTVEAPGG

SEQ ID NO: 466842 - protein, 9 aa, Homo Sapiens
CEQLRTRGA

SEQ ID NO: 466843 - protein, 9 aa, Homo Sapiens
GAETEEEVK

SEQ ID NO: 466844 - protein, 9 aa, Homo Sapiens
SYMMILRAV

SEQ ID NO: 466845 - protein, 9 aa, Homo Sapiens
SCMGGMNQR

SEQ ID NO: 466846 - protein, 9 aa, Homo Sapiens
SHSTLTNYK

SEQ ID NO: 466847 - protein, 9 aa, Homo Sapiens
QRTHTVEKP

SEQ ID NO: 466848 - protein, 9 aa, Homo Sapiens
TSDGKETKD

SEQ ID NO: 466849 - protein, 9 aa, Homo Sapiens
WLLYEEAKG

SEQ ID NO: 466850 - protein, 9 aa, Homo Sapiens
ETKDDVATN

SEQ ID NO: 466851 - protein, 9 aa, Homo Sapiens
HSETLGALA

SEQ ID NO: 466852 - protein, 9 aa, Homo Sapiens
SGKRPREGE

SEQ ID NO: 466853 - protein, 9 aa, Homo Sapiens
EELSAAYTL

SEQ ID NO: 466854 - protein, 9 aa, Homo Sapiens
MANNSEGMA

SEQ ID NO: 466855 - protein, 9 aa, Homo Sapiens
RSDPGPPNE

SEQ ID NO: 466856 - protein, 9 aa, Homo Sapiens
TRDAPNLVA

SEQ ID NO: 466857 - protein, 9 aa, Homo Sapiens
LDCDKIKSS

SEQ ID NO: 466858 - protein, 9 aa, Homo Sapiens
GTGVMICAY

SEQ ID NO: 466859 - protein, 9 aa, Homo Sapiens
NSSCCNLSI

SEQ ID NO: 466860 - protein, 9 aa, Homo Sapiens
PKPPAYSRP

SEQ ID NO: 466861 - protein, 9 aa, Homo Sapiens
LLDCDKIKS

SEQ ID NO: 466862 - protein, 9 aa, Homo Sapiens
KLKEHDTVE

SEQ ID NO: 466863 - protein, 9 aa, Homo Sapiens
IGENALQKY

SEQ ID NO: 466864 - protein, 9 aa, Homo Sapiens
FTYLKLHRP

SEQ ID NO: 466865 - protein, 9 aa, Homo Sapiens
FVLPPVFNL

SEQ ID NO: 466866 - protein, 9 aa, Homo Sapiens
EECAMKSKY

SEQ ID NO: 466867 - protein, 9 aa, Homo Sapiens
PLTSQGSQQ

SEQ ID NO: 466868 - protein, 9 aa, Homo Sapiens
LKEHDTVEA

SEQ ID NO: 466869 - protein, 9 aa, Homo Sapiens
LHRPTIALC

SEQ ID NO: 466870 - protein, 9 aa, Homo Sapiens
LTHGVSANW

SEQ ID NO: 466871 - protein, 9 aa, Homo Sapiens
SIQSLYLGI

SEQ ID NO: 466872 - protein, 9 aa, Homo Sapiens
ACEQLRTRG

SEQ ID NO: 466873 - protein, 9 aa, Homo Sapiens
GWGVLWVCV

SEQ ID NO: 466874 - protein, 9 aa, Homo Sapiens
MRNSSCCNL

SEQ ID NO: 466875 - protein, 9 aa, Homo Sapiens
FQECRKAFS

SEQ ID NO: 466876 - protein, 9 aa, Homo Sapiens
FAPLTSQGS

SEQ ID NO: 466877 - protein, 9 aa, Homo Sapiens
PQLLDCDKI

SEQ ID NO: 466878 - protein, 9 aa, Homo Sapiens
LQVPVAVLV

SEQ ID NO: 466879 - protein, 9 aa, Homo Sapiens
LWLLYEEAK

SEQ ID NO: 466880 - protein, 9 aa, Homo Sapiens
KVFSHSTLT

SEQ ID NO: 466881 - protein, 9 aa, Homo Sapiens
KMRNSSCCN

SEQ ID NO: 466882 - protein, 9 aa, Homo Sapiens
CTANDGNTK

SEQ ID NO: 466883 - protein, 9 aa, Homo Sapiens
VSQWKAAAV

SEQ ID NO: 466884 - protein, 9 aa, Homo Sapiens
PPVFNLIAP

SEQ ID NO: 466885 - protein, 9 aa, Homo Sapiens
NFDGRELLV

SEQ ID NO: 466886 - protein, 9 aa, Homo Sapiens
QIPDEEVLW

SEQ ID NO: 466887 - protein, 9 aa, Homo Sapiens
GAYNPMFTY

SEQ ID NO: 466888 - protein, 9 aa, Homo Sapiens
SCCNLSIQY

SEQ ID NO: 466889 - protein, 9 aa, Homo Sapiens
VFNLIAPLE

SEQ ID NO: 466890 - protein, 9 aa, Homo Sapiens
HRPEAVARI

SEQ ID NO: 466891 - protein, 9 aa, Homo Sapiens
SVEELSAAY

SEQ ID NO: 466892 - protein, 9 aa, Homo Sapiens
EKPYKFQEC

SEQ ID NO: 466893 - protein, 9 aa, Homo Sapiens
ASVEQASQN

SEQ ID NO: 466894 - protein, 9 aa, Homo Sapiens
GPPNETPSQ

SEQ ID NO: 466895 - protein, 9 aa, Homo Sapiens
PENCSGHSE

SEQ ID NO: 466896 - protein, 9 aa, Homo Sapiens
AAVVCTNGR

SEQ ID NO: 466897 - protein, 9 aa, Homo Sapiens
DPGPPNETP

SEQ ID NO: 466898 - protein, 9 aa, Homo Sapiens
FTYVNRGRR

SEQ ID NO: 466899 - protein, 9 aa, Homo Sapiens
LAQPSTSGK

SEQ ID NO: 466900 - protein, 9 aa, Homo Sapiens
AIQTAICKN

SEQ ID NO: 466901 - protein, 9 aa, Homo Sapiens
TYLKLHRPT

SEQ ID NO: 466902 - protein, 9 aa, Homo Sapiens
YKFQECRKA

SEQ ID NO: 466903 - protein, 9 aa, Homo Sapiens
HMGMADSGH

SEQ ID NO: 466904 - protein, 9 aa, Homo Sapiens
YMMILRAVL

SEQ ID NO: 466905 - protein, 9 aa, Homo Sapiens
KAAAVFLFC

SEQ ID NO: 466906 - protein, 9 aa, Homo Sapiens
TSGKRPREG

SEQ ID NO: 466907 - protein, 9 aa, Homo Sapiens
NDGNTKYNS

SEQ ID NO: 466908 - protein, 9 aa, Homo Sapiens
FCTETQSEK

SEQ ID NO: 466909 - protein, 9 aa, Homo Sapiens
AAAVFLFCV

SEQ ID NO: 466910 - protein, 9 aa, Homo Sapiens
MGGMNQRPI

SEQ ID NO: 466911 - protein, 9 aa, Homo Sapiens
YTLVMKINA

SEQ ID NO: 466912 - protein, 9 aa, Homo Sapiens
FISHVLRRV

SEQ ID NO: 466913 - protein, 9 aa, Homo Sapiens
RFVTRALVE

SEQ ID NO: 466914 - protein, 9 aa, Homo Sapiens
ARAAHRPEA

SEQ ID NO: 466915 - protein, 9 aa, Homo Sapiens
STSGKRPRE

SEQ ID NO: 466916 - protein, 9 aa, Homo Sapiens
PANLESFGC

SEQ ID NO: 466917 - protein, 9 aa, Homo Sapiens
QTAICKNKE

SEQ ID NO: 466918 - protein, 9 aa, Homo Sapiens
HSECVRGVC

SEQ ID NO: 466919 - protein, 9 aa, Homo Sapiens
NCSGHSECV

SEQ ID NO: 466920 - protein, 9 aa, Homo Sapiens
AAYTLVMKI

SEQ ID NO: 466921 - protein, 9 aa, Homo Sapiens
LPPVFNLIA

SEQ ID NO: 466922 - protein, 9 aa, Homo Sapiens
PRRHRRRSR

SEQ ID NO: 466923 - protein, 9 aa, Homo Sapiens
QKLKEHDTV

SEQ ID NO: 466924 - protein, 9 aa, Homo Sapiens
EKPYVFPDC

SEQ ID NO: 466925 - protein, 9 aa, Homo Sapiens
MEREVAALR

SEQ ID NO: 466926 - protein, 9 aa, Homo Sapiens
EQKLKEHDT

SEQ ID NO: 466927 - protein, 9 aa, Homo Sapiens
SVEQASQNF

SEQ ID NO: 466928 - protein, 9 aa, Homo Sapiens
AEFLFCTET

SEQ ID NO: 466929 - protein, 9 aa, Homo Sapiens
VPVAVLVVG

SEQ ID NO: 466930 - protein, 9 aa, Homo Sapiens
LKLHRPTIA

SEQ ID NO: 466931 - protein, 9 aa, Homo Sapiens
HSTVINHYH

SEQ ID NO: 466932 - protein, 9 aa, Homo Sapiens
YNPMFTYVN

SEQ ID NO: 466933 - protein, 9 aa, Homo Sapiens
FDATPHGFE

SEQ ID NO: 466934 - protein, 9 aa, Homo Sapiens
HVPVDVAYR

SEQ ID NO: 466935 - protein, 9 aa, Homo Sapiens
QLLDCDKIK

SEQ ID NO: 466936 - protein, 9 aa, Homo Sapiens
VGAEAGARA

SEQ ID NO: 466937 - protein, 9 aa, Homo Sapiens
LKNAHDADI

SEQ ID NO: 466938 - protein, 9 aa, Homo Sapiens
AYNPMFTYV

SEQ ID NO: 466939 - protein, 9 aa, Homo Sapiens
LAASVEQAS

SEQ ID NO: 466940 - protein, 9 aa, Homo Sapiens
DFPRFPHQG

SEQ ID NO: 466941 - protein, 9 aa, Homo Sapiens
SHVLRRVAQ

SEQ ID NO: 466942 - protein, 9 aa, Homo Sapiens
WHHSETLGA

SEQ ID NO: 466943 - protein, 9 aa, Homo Sapiens
HQRTHTVEK

SEQ ID NO: 466944 - protein, 9 aa, Homo Sapiens
ENCSGHSEC

SEQ ID NO: 466945 - protein, 9 aa, Homo Sapiens
GEECAMKSK

SEQ ID NO: 466946 - protein, 9 aa, Homo Sapiens
SHHVPVDVA

SEQ ID NO: 466947 - protein, 9 aa, Homo Sapiens
LYLGILSVM

SEQ ID NO: 466948 - protein, 9 aa, Homo Sapiens
TFGWHHSET

SEQ ID NO: 466949 - protein, 9 aa, Homo Sapiens
PQESPGTRD

SEQ ID NO: 466950 - protein, 9 aa, Homo Sapiens
LPQESPGTR

SEQ ID NO: 466951 - protein, 9 aa, Homo Sapiens
QVPVAVLVV

SEQ ID NO: 466952 - protein, 9 aa, Homo Sapiens
AELTHGVSA

SEQ ID NO: 466953 - protein, 9 aa, Homo Sapiens
MFTYVNRGR

SEQ ID NO: 466954 - protein, 9 aa, Homo Sapiens
EERGKVFSH

SEQ ID NO: 466955 - protein, 9 aa, Homo Sapiens
MMILRAVLQ

SEQ ID NO: 466956 - protein, 9 aa, Homo Sapiens
NTQNIFFMS

SEQ ID NO: 466957 - protein, 9 aa, Homo Sapiens
AVIAHMGMA

SEQ ID NO: 466958 - protein, 9 aa, Homo Sapiens
PGPPNETPS

SEQ ID NO: 466959 - protein, 9 aa, Homo Sapiens
FVTRALVEE

SEQ ID NO: 466960 - protein, 9 aa, Homo Sapiens
INHYHMRGH

SEQ ID NO: 466961 - protein, 9 aa, Homo Sapiens
HDADIGENA

SEQ ID NO: 466962 - protein, 9 aa, Homo Sapiens
AVFLFCVMV

SEQ ID NO: 466963 - protein, 9 aa, Homo Sapiens
KLLMEREVA

SEQ ID NO: 466964 - protein, 9 aa, Homo Sapiens
ERMKEYHVQ

SEQ ID NO: 466965 - protein, 9 aa, Homo Sapiens
KPYKFQECR

SEQ ID NO: 466966 - protein, 9 aa, Homo Sapiens
KAIQTAICK

SEQ ID NO: 466967 - protein, 9 aa, Homo Sapiens
AAFISHVLR

SEQ ID NO: 466968 - protein, 9 aa, Homo Sapiens
VFSHSTLTN

SEQ ID NO: 466969 - protein, 9 aa, Homo Sapiens
QPTRNFSIW

SEQ ID NO: 466970 - protein, 9 aa, Homo Sapiens
AMKSKYGIY

SEQ ID NO: 466971 - protein, 9 aa, Homo Sapiens
FPRFPHQGL

SEQ ID NO: 466972 - protein, 9 aa, Homo Sapiens
GGMNQRPIL

SEQ ID NO: 466973 - protein, 9 aa, Homo Sapiens
CKNKEANAV

SEQ ID NO: 466974 - protein, 9 aa, Homo Sapiens
TGAYNPMFT

SEQ ID NO: 466975 - protein, 9 aa, Homo Sapiens
SPGTRDAPN

SEQ ID NO: 466976 - protein, 9 aa, Homo Sapiens
ANLESFGCE

SEQ ID NO: 466977 - protein, 9 aa, Homo Sapiens
FHGEACEQL

SEQ ID NO: 466978 - protein, 9 aa, Homo Sapiens
IDLPVKRQT

SEQ ID NO: 466979 - protein, 9 aa, Homo Sapiens
KKRFSFHSD

SEQ ID NO: 466980 - protein, 9 aa, Homo Sapiens
NETPSQRPS

SEQ ID NO: 466981 - protein, 9 aa, Homo Sapiens
VKNSVSSRS

SEQ ID NO: 466982 - protein, 9 aa, Homo Sapiens
RGWGVLWVC

SEQ ID NO: 466983 - protein, 9 aa, Homo Sapiens
FLMIIVPTN

SEQ ID NO: 466984 - protein, 9 aa, Homo Sapiens
YVFPDCGKA

SEQ ID NO: 466985 - protein, 9 aa, Homo Sapiens
MKEYHVQDG

SEQ ID NO: 466986 - protein, 9 aa, Homo Sapiens
PGFAPLTSQ

SEQ ID NO: 466987 - protein, 9 aa, Homo Sapiens
EIRFEELLL

SEQ ID NO: 466988 - protein, 9 aa, Homo Sapiens
RFEELLLAE

SEQ ID NO: 466989 - protein, 9 aa, Homo Sapiens
KETKDDVAT

SEQ ID NO: 466990 - protein, 9 aa, Homo Sapiens
IAHMGMADS

SEQ ID NO: 466991 - protein, 9 aa, Homo Sapiens
RAAHRPEAV

SEQ ID NO: 466992 - protein, 9 aa, Homo Sapiens
RGKVFSHST

SEQ ID NO: 466993 - protein, 9 aa, Homo Sapiens
EVLWLLYEE

SEQ ID NO: 466994 - protein, 9 aa, Homo Sapiens
LRHQRTHTV

SEQ ID NO: 466995 - protein, 9 aa, Homo Sapiens
LVEERITQV

SEQ ID NO: 466996 - protein, 9 aa, Homo Sapiens
TGEKPYVFP

SEQ ID NO: 466997 - protein, 9 aa, Homo Sapiens
VVVLLLVFC

SEQ ID NO: 466998 - protein, 9 aa, Homo Sapiens
MGMADSGHY

SEQ ID NO: 466999 - protein, 9 aa, Homo Sapiens
GTGAYNPMF

SEQ ID NO: 467000 - protein, 9 aa, Homo Sapiens
EACEQLRTR

SEQ ID NO: 467001 - protein, 9 aa, Homo Sapiens
NLIAPLEGY

SEQ ID NO: 467002 - protein, 9 aa, Homo Sapiens
AETEEEVKN

SEQ ID NO: 467003 - protein, 9 aa, Homo Sapiens
LAAVVCTNG

SEQ ID NO: 467004 - protein, 9 aa, Homo Sapiens
PDEEVLWLL

SEQ ID NO: 467005 - protein, 9 aa, Homo Sapiens
TYSIGRNFD

SEQ ID NO: 467006 - protein, 9 aa, Homo Sapiens
PVAVLVVGD

SEQ ID NO: 467007 - protein, 9 aa, Homo Sapiens
TMANNSEGM

SEQ ID NO: 467008 - protein, 9 aa, Homo Sapiens
TAELTHGVS

SEQ ID NO: 467009 - protein, 9 aa, Homo Sapiens
LSAAYTLVM

SEQ ID NO: 467010 - protein, 9 aa, Homo Sapiens
VVVVLLLVF

SEQ ID NO: 467011 - protein, 9 aa, Homo Sapiens
GCTANDGNT

SEQ ID NO: 467012 - protein, 9 aa, Homo Sapiens
SLYLGILSV

SEQ ID NO: 467013 - protein, 9 aa, Homo Sapiens
PMPFQLPPG

SEQ ID NO: 467014 - protein, 9 aa, Homo Sapiens
PYVFPDCGK

SEQ ID NO: 467015 - protein, 9 aa, Homo Sapiens
QLLQVPVAV

SEQ ID NO: 467016 - protein, 9 aa, Homo Sapiens
EEVKNSVSS

SEQ ID NO: 467017 - protein, 9 aa, Homo Sapiens
IDPVHSHHV

SEQ ID NO: 467018 - protein, 9 aa, Homo Sapiens
WKAAAVFLF

SEQ ID NO: 467019 - protein, 9 aa, Homo Sapiens
APKPPAYSR

SEQ ID NO: 467020 - protein, 9 aa, Homo Sapiens
PMFTYVNRG

SEQ ID NO: 467021 - protein, 9 aa, Homo Sapiens
SEGMAASPE

SEQ ID NO: 467022 - protein, 9 aa, Homo Sapiens
RFSFHSDLV

SEQ ID NO: 467023 - protein, 9 aa, Homo Sapiens
EYHVQDGKI

SEQ ID NO: 467024 - protein, 9 aa, Homo Sapiens
AEAPKPPAY

SEQ ID NO: 467025 - protein, 9 aa, Homo Sapiens
MAGRGWGVL

SEQ ID NO: 467026 - protein, 9 aa, Homo Sapiens
CKMRNSSCC

SEQ ID NO: 467027 - protein, 9 aa, Homo Sapiens
LAAFISHVL

SEQ ID NO: 467028 - protein, 9 aa, Homo Sapiens
PCKMRNSSC

SEQ ID NO: 467029 - protein, 9 aa, Homo Sapiens
DGKETKDDV

SEQ ID NO: 467030 - protein, 9 aa, Homo Sapiens
AAVFLFCVM

SEQ ID NO: 467031 - protein, 9 aa, Homo Sapiens
GHSECVRGV

SEQ ID NO: 467032 - protein, 9 aa, Homo Sapiens
ARAEAGAGA

SEQ ID NO: 467033 - protein, 9 aa, Homo Sapiens
GRGWGVLWV

SEQ ID NO: 467034 - protein, 9 aa, Homo Sapiens
EEKLLMERE

SEQ ID NO: 467035 - protein, 9 aa, Homo Sapiens
HVQDGKIFI

SEQ ID NO: 467036 - protein, 9 aa, Homo Sapiens
SIWIGGSIL

SEQ ID NO: 467037 - protein, 9 aa, Homo Sapiens
TRNFSIWIG

SEQ ID NO: 467038 - protein, 9 aa, Homo Sapiens
PGTRDAPNL

SEQ ID NO: 467039 - protein, 9 aa, Homo Sapiens
AHMGMADSG

SEQ ID NO: 467040 - protein, 9 aa, Homo Sapiens
KSKYGIYTK

SEQ ID NO: 467041 - protein, 9 aa, Homo Sapiens
AGRGWGVLW

SEQ ID NO: 467042 - protein, 9 aa, Homo Sapiens
RYNESKKRF

SEQ ID NO: 467043 - protein, 9 aa, Homo Sapiens
GKETKDDVA

SEQ ID NO: 467044 - protein, 9 aa, Homo Sapiens
IGRNFDGRE

SEQ ID NO: 467045 - protein, 9 aa, Homo Sapiens
VLWVCVAAA

SEQ ID NO: 467046 - protein, 9 aa, Homo Sapiens
WGEECAMKS

SEQ ID NO: 467047 - protein, 9 aa, Homo Sapiens
ANDGNTKYN

SEQ ID NO: 467048 - protein, 9 aa, Homo Sapiens
FGWHHSETL

SEQ ID NO: 467049 - protein, 9 aa, Homo Sapiens
VVLLLVFCI

SEQ ID NO: 467050 - protein, 9 aa, Homo Sapiens
DKIKSSLYK

SEQ ID NO: 467051 - protein, 9 aa, Homo Sapiens
CMGGMNQRP

SEQ ID NO: 467052 - protein, 9 aa, Homo Sapiens
GWHHSETLG

SEQ ID NO: 467053 - protein, 9 aa, Homo Sapiens
LESFGCEDP

SEQ ID NO: 467054 - protein, 9 aa, Homo Sapiens
QRPILTIIT

SEQ ID NO: 467055 - protein, 9 aa, Homo Sapiens
PPNETPSQR

SEQ ID NO: 467056 - protein, 9 aa, Homo Sapiens
NESKKRFSF

SEQ ID NO: 467057 - protein, 9 aa, Homo Sapiens
LSFTYLKLH

SEQ ID NO: 467058 - protein, 9 aa, Homo Sapiens
LRSDPGPPN

SEQ ID NO: 467059 - protein, 9 aa, Homo Sapiens
SHRTPKVTR

SEQ ID NO: 467060 - protein, 9 aa, Homo Sapiens
DGVPMPFQL

SEQ ID NO: 467061 - protein, 9 aa, Homo Sapiens
YNESKKRFS

SEQ ID NO: 467062 - protein, 9 aa, Homo Sapiens
QEQKLKEHD

SEQ ID NO: 467063 - protein, 9 aa, Homo Sapiens
AYTLVMKIN

SEQ ID NO: 467064 - protein, 9 aa, Homo Sapiens
VIDPVHSHH

SEQ ID NO: 467065 - protein, 9 aa, Homo Sapiens
VEQASQNFL

SEQ ID NO: 467066 - protein, 9 aa, Homo Sapiens
RNFSIWIGG

SEQ ID NO: 467067 - protein, 9 aa, Homo Sapiens
MKSKYGIYT

SEQ ID NO: 467068 - protein, 9 aa, Homo Sapiens
ESKKRFSFH

SEQ ID NO: 467069 - protein, 9 aa, Homo Sapiens
VPTNTQNIF

SEQ ID NO: 467070 - protein, 9 aa, Homo Sapiens
NAHDADIGE

SEQ ID NO: 467071 - protein, 9 aa, Homo Sapiens
GCEDPRPEL

SEQ ID NO: 467072 - protein, 9 aa, Homo Sapiens
HDGVPMPFQ

SEQ ID NO: 467073 - protein, 9 aa, Homo Sapiens
HHSETLGAL

SEQ ID NO: 467074 - protein, 9 aa, Homo Sapiens
YRFVTRALV

SEQ ID NO: 467075 - protein, 9 aa, Homo Sapiens
EHDTVEAPG

SEQ ID NO: 467076 - protein, 9 aa, Homo Sapiens
RALVEERIT

SEQ ID NO: 467077 - protein, 9 aa, Homo Sapiens
ASQNFLEKG

SEQ ID NO: 467078 - protein, 9 aa, Homo Sapiens
SRGQSQFNI

SEQ ID NO: 467079 - protein, 9 aa, Homo Sapiens
YFDATPHGF

SEQ ID NO: 467080 - protein, 9 aa, Homo Sapiens
YLKLHRPTI

SEQ ID NO: 467081 - protein, 9 aa, Homo Sapiens
PYKFQECRK

SEQ ID NO: 467082 - protein, 9 aa, Homo Sapiens
QHGCTANDG

SEQ ID NO: 467083 - protein, 9 aa, Homo Sapiens
NFVLPPVFN

SEQ ID NO: 467084 - protein, 9 aa, Homo Sapiens
GGTGVMICA

SEQ ID NO: 467085 - protein, 9 aa, Homo Sapiens
KAGKGGTGV

SEQ ID NO: 467086 - protein, 9 aa, Homo Sapiens
THTVEKPYV

SEQ ID NO: 467087 - protein, 9 aa, Homo Sapiens
ICKNKEANA

SEQ ID NO: 467088 - protein, 9 aa, Homo Sapiens
PSTSGKRPR

SEQ ID NO: 467089 - protein, 9 aa, Homo Sapiens
LLLAETDTP

SEQ ID NO: 467090 - protein, 9 aa, Homo Sapiens
GKGGTGVMI

SEQ ID NO: 467091 - protein, 9 aa, Homo Sapiens
SECVRGVCQ

SEQ ID NO: 467092 - protein, 9 aa, Homo Sapiens
VFPDCGKAF

SEQ ID NO: 467093 - protein, 9 aa, Homo Sapiens
YSIQSLYLG

SEQ ID NO: 467094 - protein, 9 aa, Homo Sapiens
QSLYLGILS

SEQ ID NO: 467095 - protein, 9 aa, Homo Sapiens
PVFNLIAPL

SEQ ID NO: 467096 - protein, 9 aa, Homo Sapiens
REEKLLMER

SEQ ID NO: 467097 - protein, 9 aa, Homo Sapiens
EKLLMEREV

SEQ ID NO: 467098 - protein, 9 aa, Homo Sapiens
AHDADIGEN

SEQ ID NO: 467099 - protein, 9 aa, Homo Sapiens
QGLLLDTSR

SEQ ID NO: 467100 - protein, 9 aa, Homo Sapiens
ALVEERITQ

SEQ ID NO: 467101 - protein, 9 aa, Homo Sapiens
KLHRPTIAL

SEQ ID NO: 467102 - protein, 9 aa, Homo Sapiens
MTFGWHHSE

SEQ ID NO: 467103 - protein, 9 aa, Homo Sapiens
GEACEQLRT

SEQ ID NO: 467104 - protein, 9 aa, Homo Sapiens
FSHSTLTNY

SEQ ID NO: 467105 - protein, 9 aa, Homo Sapiens
AYSRPTVLM

SEQ ID NO: 467106 - protein, 9 aa, Homo Sapiens
CPENCSGHS

SEQ ID NO: 467107 - protein, 9 aa, Homo Sapiens
SQNFLEKGE

SEQ ID NO: 467108 - protein, 9 aa, Homo Sapiens
HRRRSRDRR

SEQ ID NO: 467109 - protein, 9 aa, Homo Sapiens
EFLFCTETQ

SEQ ID NO: 467110 - protein, 9 aa, Homo Sapiens
ERGKVFSHS

SEQ ID NO: 467111 - protein, 9 aa, Homo Sapiens
CSGHSECVR

SEQ ID NO: 467112 - protein, 9 aa, Homo Sapiens
YCYSIQSLY

SEQ ID NO: 467113 - protein, 9 aa, Homo Sapiens
MSYMMILRA

SEQ ID NO: 467114 - protein, 9 aa, Homo Sapiens
PAEAPKPPA

SEQ ID NO: 467115 - protein, 9 aa, Homo Sapiens
HHVPVDVAY

SEQ ID NO: 467116 - protein, 9 aa, Homo Sapiens
NQRPILTII

SEQ ID NO: 467117 - protein, 9 aa, Homo Sapiens
ATPHGFETH

SEQ ID NO: 467118 - protein, 9 aa, Homo Sapiens
CEVAARAAH

SEQ ID NO: 467119 - protein, 9 aa, Homo Sapiens
RRHRRRSRD

SEQ ID NO: 467120 - protein, 9 aa, Homo Sapiens
EAPKPPAYS

SEQ ID NO: 467121 - protein, 9 aa, Homo Sapiens
IQSLYLGIL

SEQ ID NO: 467122 - protein, 9 aa, Homo Sapiens
IGMSYMMIL

SEQ ID NO: 467123 - protein, 9 aa, Homo Sapiens
MNQRPILTI

SEQ ID NO: 467124 - protein, 9 aa, Homo Sapiens
SFTYLKLHR

SEQ ID NO: 467125 - protein, 9 aa, Homo Sapiens
LMIIVPTNT

SEQ ID NO: 467126 - protein, 9 aa, Homo Sapiens
DATPHGFET

SEQ ID NO: 467127 - protein, 9 aa, Homo Sapiens
FPQSVVVVL

SEQ ID NO: 467128 - protein, 9 aa, Homo Sapiens
QPSTSGKRP

SEQ ID NO: 467129 - protein, 9 aa, Homo Sapiens
FAVIAHMGM

SEQ ID NO: 467130 - protein, 9 aa, Homo Sapiens
SGHSECVRG

SEQ ID NO: 467131 - protein, 9 aa, Homo Sapiens
AFISHVLRR

SEQ ID NO: 467132 - protein, 9 aa, Homo Sapiens
PPAYSRPTV

SEQ ID NO: 467133 - protein, 9 aa, Homo Sapiens
EGMAASPEM

SEQ ID NO: 467134 - protein, 9 aa, Homo Sapiens
IIVPTNTQN

SEQ ID NO: 467135 - protein, 9 aa, Homo Sapiens
ISHVLRRVA

SEQ ID NO: 467136 - protein, 9 aa, Homo Sapiens
RMKEYHVQD

SEQ ID NO: 467137 - protein, 9 aa, Homo Sapiens
ARTYSIGRN

SEQ ID NO: 467138 - protein, 9 aa, Homo Sapiens
APLTSQGSQ

SEQ ID NO: 467139 - protein, 9 aa, Homo Sapiens
DCDKIKSSL

SEQ ID NO: 467140 - protein, 9 aa, Homo Sapiens
LLQVPVAVL

SEQ ID NO: 467141 - protein, 9 aa, Homo Sapiens
IQTAICKNK

SEQ ID NO: 467142 - protein, 9 aa, Homo Sapiens
IHCKAGKGG

SEQ ID NO: 467143 - protein, 9 aa, Homo Sapiens
PQSVVVVLL

SEQ ID NO: 467144 - protein, 9 aa, Homo Sapiens
CEDPRPELQ

SEQ ID NO: 467145 - protein, 9 aa, Homo Sapiens
SDGKETKDD

SEQ ID NO: 467146 - protein, 9 aa, Homo Sapiens
EDFPRFPHQ

SEQ ID NO: 467147 - protein, 9 aa, Homo Sapiens
NNSEGMAAS

SEQ ID NO: 467148 - protein, 9 aa, Homo Sapiens
AVVCTNGRR

SEQ ID NO: 467149 - protein, 9 aa, Homo Sapiens
HGVSANWTI

SEQ ID NO: 467150 - protein, 9 aa, Homo Sapiens
TANDGNTKY

SEQ ID NO: 467151 - protein, 9 aa, Homo Sapiens
SSVHDGVPM

SEQ ID NO: 467152 - protein, 9 aa, Homo Sapiens
TVINHYHMR

SEQ ID NO: 467153 - protein, 9 aa, Homo Sapiens
ELFAVIAHM

SEQ ID NO: 467154 - protein, 9 aa, Homo Sapiens
HYHMRGHSP

SEQ ID NO: 467155 - protein, 9 aa, Homo Sapiens
CVGAEAGAR

SEQ ID NO: 467156 - protein, 9 aa, Homo Sapiens
CKAGKGGTG

SEQ ID NO: 467157 - protein, 9 aa, Homo Sapiens
VVCTNGRRH

SEQ ID NO: 467158 - protein, 9 aa, Homo Sapiens
FPDCGKAFS

SEQ ID NO: 467159 - protein, 9 aa, Homo Sapiens
MIIVPTNTQ

SEQ ID NO: 467160 - protein, 9 aa, Homo Sapiens
EEVLWLLYE

SEQ ID NO: 467161 - protein, 9 aa, Homo Sapiens
PTSDGKETK

SEQ ID NO: 467162 - protein, 9 aa, Homo Sapiens
GARAEAGAG

SEQ ID NO: 467163 - protein, 9 aa, Homo Sapiens
GTMANNSEG

SEQ ID NO: 467164 - protein, 9 aa, Homo Sapiens
SVVVVLLLV

SEQ ID NO: 467165 - protein, 9 aa, Homo Sapiens
GVSANWTIQ

SEQ ID NO: 467166 - protein, 9 aa, Homo Sapiens
LFCTETQSE

SEQ ID NO: 467167 - protein, 9 aa, Homo Sapiens
KNAHDADIG

SEQ ID NO: 467168 - protein, 9 aa, Homo Sapiens
HTGEKPYVF

SEQ ID NO: 467169 - protein, 9 aa, Homo Sapiens
IYRFVTRAL

SEQ ID NO: 467170 - protein, 9 aa, Homo Sapiens
AICKNKEAN

SEQ ID NO: 467171 - protein, 9 aa, Homo Sapiens
VFLFCVMVF

SEQ ID NO: 467172 - protein, 9 aa, Homo Sapiens
PHQGLLLDT

SEQ ID NO: 467173 - protein, 9 aa, Homo Sapiens
CCNLSIQYL

SEQ ID NO: 467174 - protein, 9 aa, Homo Sapiens
GFAPLTSQG

SEQ ID NO: 467175 - protein, 9 aa, Homo Sapiens
AARAAHRPE

SEQ ID NO: 467176 - protein, 9 aa, Homo Sapiens
FERMKEYHV

SEQ ID NO: 467177 - protein, 9 aa, Homo Sapiens
AVLVVGDIA

SEQ ID NO: 467178 - protein, 9 aa, Homo Sapiens
HRPTIALCY

SEQ ID NO: 467179 - protein, 9 aa, Homo Sapiens
EVAARAAHR

SEQ ID NO: 467180 - protein, 9 aa, Homo Sapiens
VAARAAHRP

SEQ ID NO: 467181 - protein, 9 aa, Homo Sapiens
NPMFTYVNR

SEQ ID NO: 467182 - protein, 9 aa, Homo Sapiens
AASVEQASQ

SEQ ID NO: 467183 - protein, 9 aa, Homo Sapiens
GVPMPFQLP

SEQ ID NO: 467184 - protein, 9 aa, Homo Sapiens
LAETDTPLL

SEQ ID NO: 467185 - protein, 9 aa, Homo Sapiens
GMNQRPILT

SEQ ID NO: 467186 - protein, 9 aa, Homo Sapiens
VLAQPSTSG

SEQ ID NO: 467187 - protein, 9 aa, Homo Sapiens
TNTQNIFFM

SEQ ID NO: 467188 - protein, 9 aa, Homo Sapiens
GMREEKLLM

SEQ ID NO: 467189 - protein, 9 aa, Homo Sapiens
HRTPKVTRP

SEQ ID NO: 467190 - protein, 9 aa, Homo Sapiens
QASQNFLEK

SEQ ID NO: 467191 - protein, 9 aa, Homo Sapiens
VPMPFQLPP

SEQ ID NO: 467192 - protein, 9 aa, Homo Sapiens
EELLLAETD

SEQ ID NO: 467193 - protein, 9 aa, Homo Sapiens
SQWKAAAVF

SEQ ID NO: 467194 - protein, 9 aa, Homo Sapiens
RFPHQGLLL

SEQ ID NO: 467195 - protein, 9 aa, Homo Sapiens
KIKSSLYKR

SEQ ID NO: 467196 - protein, 9 aa, Homo Sapiens
VLLLVFCIC

SEQ ID NO: 467197 - protein, 9 aa, Homo Sapiens
SDYFDATPH

SEQ ID NO: 467198 - protein, 9 aa, Homo Sapiens
SGAETEEEV

SEQ ID NO: 467199 - protein, 9 aa, Homo Sapiens
KGGTGVMIC

SEQ ID NO: 467200 - protein, 9 aa, Homo Sapiens
FGCEDPRPE

SEQ ID NO: 467201 - protein, 9 aa, Homo Sapiens
TSQGSQQYR

SEQ ID NO: 467202 - protein, 9 aa, Homo Sapiens
KPTSDGKET

SEQ ID NO: 467203 - protein, 9 aa, Homo Sapiens
SDPGPPNET

SEQ ID NO: 467204 - protein, 9 aa, Homo Sapiens
DGNTKYNSR

SEQ ID NO: 467205 - protein, 9 aa, Homo Sapiens
KEHDTVEAP

SEQ ID NO: 467206 - protein, 9 aa, Homo Sapiens
RTMTFGWHH

SEQ ID NO: 467207 - protein, 9 aa, Homo Sapiens
ETEEEVKNS

SEQ ID NO: 467208 - protein, 9 aa, Homo Sapiens
AHRPEAVAR

SEQ ID NO: 467209 - protein, 9 aa, Homo Sapiens
QAEFLFCTE

SEQ ID NO: 467210 - protein, 9 aa, Homo Sapiens
IGSDYFDAT

SEQ ID NO: 467211 - protein, 9 aa, Homo Sapiens
QLAAVVCTN

SEQ ID NO: 467212 - protein, 9 aa, Homo Sapiens
FSIWIGGSI

SEQ ID NO: 467213 - protein, 9 aa, Homo Sapiens
ECAMKSKYG

SEQ ID NO: 467214 - protein, 9 aa, Homo Sapiens
QESPGTRDA

SEQ ID NO: 467215 - protein, 9 aa, Homo Sapiens
DEEVLWLLY

SEQ ID NO: 467216 - protein, 9 aa, Homo Sapiens
EGIPVQPLP

SEQ ID NO: 467217 - protein, 9 aa, Homo Sapiens
AEVDVPPVG

SEQ ID NO: 467218 - protein, 9 aa, Homo Sapiens
EHMSREQIR

SEQ ID NO: 467219 - protein, 9 aa, Homo Sapiens
TQGLCTCMV

SEQ ID NO: 467220 - protein, 9 aa, Homo Sapiens
VSSDAVLQR

SEQ ID NO: 467221 - protein, 9 aa, Homo Sapiens
VGGCALQGS

SEQ ID NO: 467222 - protein, 9 aa, Homo Sapiens
IGAELIWCI

SEQ ID NO: 467223 - protein, 9 aa, Homo Sapiens
HFVIHEEML

SEQ ID NO: 467224 - protein, 9 aa, Homo Sapiens
LHQSWWDSR

SEQ ID NO: 467225 - protein, 9 aa, Homo Sapiens
VITRAEVDV

SEQ ID NO: 467226 - protein, 9 aa, Homo Sapiens
YRICVKVQD

SEQ ID NO: 467227 - protein, 9 aa, Homo Sapiens
NWGTFIKVG

SEQ ID NO: 467228 - protein, 9 aa, Homo Sapiens
LCICEEGYQ

SEQ ID NO: 467229 - protein, 9 aa, Homo Sapiens
ITRAEVDVP

SEQ ID NO: 467230 - protein, 9 aa, Homo Sapiens
GGPSHRRAC

SEQ ID NO: 467231 - protein, 9 aa, Homo Sapiens
GDAGSQGPM

SEQ ID NO: 467232 - protein, 9 aa, Homo Sapiens
RRTLHALLL

SEQ ID NO: 467233 - protein, 9 aa, Homo Sapiens
DSYAHFVIH

SEQ ID NO: 467234 - protein, 9 aa, Homo Sapiens
LNLNAFVTG

SEQ ID NO: 467235 - protein, 9 aa, Homo Sapiens
HIRKSNRPA

SEQ ID NO: 467236 - protein, 9 aa, Homo Sapiens
SMAPGGPMR

SEQ ID NO: 467237 - protein, 9 aa, Homo Sapiens
TMSPQLSLS

SEQ ID NO: 467238 - protein, 9 aa, Homo Sapiens
MAPGGPMRC

SEQ ID NO: 467239 - protein, 9 aa, Homo Sapiens
GGPMRCGTS

SEQ ID NO: 467240 - protein, 9 aa, Homo Sapiens
CGLWSFTRQ

SEQ ID NO: 467241 - protein, 9 aa, Homo Sapiens
RTFHHHRFY

SEQ ID NO: 467242 - protein, 9 aa, Homo Sapiens
RIVGALECI

SEQ ID NO: 467243 - protein, 9 aa, Homo Sapiens
ECWIHSKYE

SEQ ID NO: 467244 - protein, 9 aa, Homo Sapiens
VTGSWWVAL

SEQ ID NO: 467245 - protein, 9 aa, Homo Sapiens
GPMRCGTSR

SEQ ID NO: 467246 - protein, 9 aa, Homo Sapiens
STQTGGLCY

SEQ ID NO: 467247 - protein, 9 aa, Homo Sapiens
IRVEVNLRV

SEQ ID NO: 467248 - protein, 9 aa, Homo Sapiens
AELIWCIVP

SEQ ID NO: 467249 - protein, 9 aa, Homo Sapiens
RTLHALLLS

SEQ ID NO: 467250 - protein, 9 aa, Homo Sapiens
IKATFSEKQ

SEQ ID NO: 467251 - protein, 9 aa, Homo Sapiens
GPRSMAPGG

SEQ ID NO: 467252 - protein, 9 aa, Homo Sapiens
YPIVKPGSN

SEQ ID NO: 467253 - protein, 9 aa, Homo Sapiens
RPRASCSSC

SEQ ID NO: 467254 - protein, 9 aa, Homo Sapiens
DSDTVKLLI

SEQ ID NO: 467255 - protein, 9 aa, Homo Sapiens
GYPIVKPGS

SEQ ID NO: 467256 - protein, 9 aa, Homo Sapiens
EIGSTMGML

SEQ ID NO: 467257 - protein, 9 aa, Homo Sapiens
AFPFLNLNA

SEQ ID NO: 467258 - protein, 9 aa, Homo Sapiens
TGSWWVALK

SEQ ID NO: 467259 - protein, 9 aa, Homo Sapiens
SNGIIKEYQ

SEQ ID NO: 467260 - protein, 9 aa, Homo Sapiens
LDYVSGEDD

SEQ ID NO: 467261 - protein, 9 aa, Homo Sapiens
VNIGAELIW

SEQ ID NO: 467262 - protein, 9 aa, Homo Sapiens
WSESGQDVT

SEQ ID NO: 467263 - protein, 9 aa, Homo Sapiens
PNKFCVEQL

SEQ ID NO: 467264 - protein, 9 aa, Homo Sapiens
TPPHPGKPE

SEQ ID NO: 467265 - protein, 9 aa, Homo Sapiens
GTSGDTCNL

SEQ ID NO: 467266 - protein, 9 aa, Homo Sapiens
EVGFGLEHM

SEQ ID NO: 467267 - protein, 9 aa, Homo Sapiens
DDLAPLTGR

SEQ ID NO: 467268 - protein, 9 aa, Homo Sapiens
SRPGRAWRA

SEQ ID NO: 467269 - protein, 9 aa, Homo Sapiens
YAHFVIHEE

SEQ ID NO: 467270 - protein, 9 aa, Homo Sapiens
TTQQMIYRI

SEQ ID NO: 467271 - protein, 9 aa, Homo Sapiens
LVSQDRIQR

SEQ ID NO: 467272 - protein, 9 aa, Homo Sapiens
RAAGGPSHR

SEQ ID NO: 467273 - protein, 9 aa, Homo Sapiens
GPKGDAGSQ

SEQ ID NO: 467274 - protein, 9 aa, Homo Sapiens
CQRKHMENP

SEQ ID NO: 467275 - protein, 9 aa, Homo Sapiens
HTCFGIYPH

SEQ ID NO: 467276 - protein, 9 aa, Homo Sapiens
EAETSSPKG

SEQ ID NO: 467277 - protein, 9 aa, Homo Sapiens
ERYDAALAQ

SEQ ID NO: 467278 - protein, 9 aa, Homo Sapiens
NGKQHGKGS

SEQ ID NO: 467279 - protein, 9 aa, Homo Sapiens
IAPSVGLHG

SEQ ID NO: 467280 - protein, 9 aa, Homo Sapiens
ELLIGYLDT

SEQ ID NO: 467281 - protein, 9 aa, Homo Sapiens
CELCCANWG

SEQ ID NO: 467282 - protein, 9 aa, Homo Sapiens
ASCSSCVRP

SEQ ID NO: 467283 - protein, 9 aa, Homo Sapiens
EKSNGIIKE

SEQ ID NO: 467284 - protein, 9 aa, Homo Sapiens
AKYVSLHIR

SEQ ID NO: 467285 - protein, 9 aa, Homo Sapiens
YSKFKMSEV

SEQ ID NO: 467286 - protein, 9 aa, Homo Sapiens
ALKLVWNPE

SEQ ID NO: 467287 - protein, 9 aa, Homo Sapiens
AFILNNTIP

SEQ ID NO: 467288 - protein, 9 aa, Homo Sapiens
SHELVINLV

SEQ ID NO: 467289 - protein, 9 aa, Homo Sapiens
QGLCTCMVV

SEQ ID NO: 467290 - protein, 9 aa, Homo Sapiens
QMIYRICVK

SEQ ID NO: 467291 - protein, 9 aa, Homo Sapiens
LQQPDLIAP

SEQ ID NO: 467292 - protein, 9 aa, Homo Sapiens
QIIKGNMYY

SEQ ID NO: 467293 - protein, 9 aa, Homo Sapiens
ALECIGGAA

SEQ ID NO: 467294 - protein, 9 aa, Homo Sapiens
ESGQDVTAR

SEQ ID NO: 467295 - protein, 9 aa, Homo Sapiens
CALQGSTQT

SEQ ID NO: 467296 - protein, 9 aa, Homo Sapiens
FDDLAPLTG

SEQ ID NO: 467297 - protein, 9 aa, Homo Sapiens
TFSEKQEKE

SEQ ID NO: 467298 - protein, 9 aa, Homo Sapiens
ALEDRTVSS

SEQ ID NO: 467299 - protein, 9 aa, Homo Sapiens
KPGSNCGFG

SEQ ID NO: 467300 - protein, 9 aa, Homo Sapiens
RPGRAWRAA

SEQ ID NO: 467301 - protein, 9 aa, Homo Sapiens
VCFLGITTK

SEQ ID NO: 467302 - protein, 9 aa, Homo Sapiens
CDCGLWSFT

SEQ ID NO: 467303 - protein, 9 aa, Homo Sapiens
EVRPPPLLG

SEQ ID NO: 467304 - protein, 9 aa, Homo Sapiens
KGNMYYENS

SEQ ID NO: 467305 - protein, 9 aa, Homo Sapiens
QPDLIAPSV

SEQ ID NO: 467306 - protein, 9 aa, Homo Sapiens
FAFLEICYI

SEQ ID NO: 467307 - protein, 9 aa, Homo Sapiens
EFILLWLTQ

SEQ ID NO: 467308 - protein, 9 aa, Homo Sapiens
SCGSGSGSS

SEQ ID NO: 467309 - protein, 9 aa, Homo Sapiens
LEICYISST

SEQ ID NO: 467310 - protein, 9 aa, Homo Sapiens
QTGGLCYVV

SEQ ID NO: 467311 - protein, 9 aa, Homo Sapiens
PRPQDHDTD

SEQ ID NO: 467312 - protein, 9 aa, Homo Sapiens
QQPDLIAPS

SEQ ID NO: 467313 - protein, 9 aa, Homo Sapiens
GESDTIIWN

SEQ ID NO: 467314 - protein, 9 aa, Homo Sapiens
KQHGKGSIY

SEQ ID NO: 467315 - protein, 9 aa, Homo Sapiens
LSWPALARH

SEQ ID NO: 467316 - protein, 9 aa, Homo Sapiens
ATFSEKQEK

SEQ ID NO: 467317 - protein, 9 aa, Homo Sapiens
HMSREQIRE

SEQ ID NO: 467318 - protein, 9 aa, Homo Sapiens
TLHALLLSW

SEQ ID NO: 467319 - protein, 9 aa, Homo Sapiens
FLHQSWWDS

SEQ ID NO: 467320 - protein, 9 aa, Homo Sapiens
YTSFKPPPF

SEQ ID NO: 467321 - protein, 9 aa, Homo Sapiens
EKDCDCGLW

SEQ ID NO: 467322 - protein, 9 aa, Homo Sapiens
QCEEGLCIC

SEQ ID NO: 467323 - protein, 9 aa, Homo Sapiens
IIELGGLVS

SEQ ID NO: 467324 - protein, 9 aa, Homo Sapiens
DTIIWNEVH

SEQ ID NO: 467325 - protein, 9 aa, Homo Sapiens
VLVSQDRIQ

SEQ ID NO: 467326 - protein, 9 aa, Homo Sapiens
QDRIQRPPF

SEQ ID NO: 467327 - protein, 9 aa, Homo Sapiens
GEAEAETSS

SEQ ID NO: 467328 - protein, 9 aa, Homo Sapiens
TCMVVGAYV

SEQ ID NO: 467329 - protein, 9 aa, Homo Sapiens
FILLWLTQN

SEQ ID NO: 467330 - protein, 9 aa, Homo Sapiens
FVTGSWWVA

SEQ ID NO: 467331 - protein, 9 aa, Homo Sapiens
NAKYVSLHI

SEQ ID NO: 467332 - protein, 9 aa, Homo Sapiens
GTMSPQLSL

SEQ ID NO: 467333 - protein, 9 aa, Homo Sapiens
GQCEEGLCI

SEQ ID NO: 467334 - protein, 9 aa, Homo Sapiens
GLCTCMVVG

SEQ ID NO: 467335 - protein, 9 aa, Homo Sapiens
PQHLIRVEV

SEQ ID NO: 467336 - protein, 9 aa, Homo Sapiens
VDGISHELV

SEQ ID NO: 467337 - protein, 9 aa, Homo Sapiens
LEGEAEAET

SEQ ID NO: 467338 - protein, 9 aa, Homo Sapiens
SNPGIIELG

SEQ ID NO: 467339 - protein, 9 aa, Homo Sapiens
QHYTSFKPP

SEQ ID NO: 467340 - protein, 9 aa, Homo Sapiens
RKHMENPRG

SEQ ID NO: 467341 - protein, 9 aa, Homo Sapiens
GIYPHASVW

SEQ ID NO: 467342 - protein, 9 aa, Homo Sapiens
KLVWNPEPD

SEQ ID NO: 467343 - protein, 9 aa, Homo Sapiens
GRVITRAEV

SEQ ID NO: 467344 - protein, 9 aa, Homo Sapiens
LFDDLAPLT

SEQ ID NO: 467345 - protein, 9 aa, Homo Sapiens
CTCMVVGAY

SEQ ID NO: 467346 - protein, 9 aa, Homo Sapiens
LWSFTRQAR

SEQ ID NO: 467347 - protein, 9 aa, Homo Sapiens
ANWGTFIKV

SEQ ID NO: 467348 - protein, 9 aa, Homo Sapiens
SDAFPFLNL

SEQ ID NO: 467349 - protein, 9 aa, Homo Sapiens
PGSNCGFGK

SEQ ID NO: 467350 - protein, 9 aa, Homo Sapiens
LHIRKSNRP

SEQ ID NO: 467351 - protein, 9 aa, Homo Sapiens
PSASSGPRS

SEQ ID NO: 467352 - protein, 9 aa, Homo Sapiens
TSFKPPPFQ

SEQ ID NO: 467353 - protein, 9 aa, Homo Sapiens
VSQDRIQRP

SEQ ID NO: 467354 - protein, 9 aa, Homo Sapiens
TRRDLTLEL

SEQ ID NO: 467355 - protein, 9 aa, Homo Sapiens
SVPEKSNGI

SEQ ID NO: 467356 - protein, 9 aa, Homo Sapiens
LSGLGALPT

SEQ ID NO: 467357 - protein, 9 aa, Homo Sapiens
RSSTRPRAS

SEQ ID NO: 467358 - protein, 9 aa, Homo Sapiens
VGLHGRVIT

SEQ ID NO: 467359 - protein, 9 aa, Homo Sapiens
HQEKQTELK

SEQ ID NO: 467360 - protein, 9 aa, Homo Sapiens
LCCANWGTF

SEQ ID NO: 467361 - protein, 9 aa, Homo Sapiens
ESDTIIWNE

SEQ ID NO: 467362 - protein, 9 aa, Homo Sapiens
LCTCMVVGA

SEQ ID NO: 467363 - protein, 9 aa, Homo Sapiens
CLQQPDLIA

SEQ ID NO: 467364 - protein, 9 aa, Homo Sapiens
RRACRSSTR

SEQ ID NO: 467365 - protein, 9 aa, Homo Sapiens
REEKECWIH

SEQ ID NO: 467366 - protein, 9 aa, Homo Sapiens
LHAEIGSTM

SEQ ID NO: 467367 - protein, 9 aa, Homo Sapiens
CGSGSGSSG

SEQ ID NO: 467368 - protein, 9 aa, Homo Sapiens
CMVVGAYVG

SEQ ID NO: 467369 - protein, 9 aa, Homo Sapiens
VPPVGGCAL

SEQ ID NO: 467370 - protein, 9 aa, Homo Sapiens
ENPYEGIPV

SEQ ID NO: 467371 - protein, 9 aa, Homo Sapiens
FDSYAHFVI

SEQ ID NO: 467372 - protein, 9 aa, Homo Sapiens
SEKQEKELE

SEQ ID NO: 467373 - protein, 9 aa, Homo Sapiens
CANWGTFIK

SEQ ID NO: 467374 - protein, 9 aa, Homo Sapiens
TRAEVDVPP

SEQ ID NO: 467375 - protein, 9 aa, Homo Sapiens
FLNLNAFVT

SEQ ID NO: 467376 - protein, 9 aa, Homo Sapiens
NLQIIKGNM

SEQ ID NO: 467377 - protein, 9 aa, Homo Sapiens
SEQALTEQR

SEQ ID NO: 467378 - protein, 9 aa, Homo Sapiens
QEKQTELKV

SEQ ID NO: 467379 - protein, 9 aa, Homo Sapiens
SGLGALPTR

SEQ ID NO: 467380 - protein, 9 aa, Homo Sapiens
AEEKPHSGT

SEQ ID NO: 467381 - protein, 9 aa, Homo Sapiens
PPPLDYVSG

SEQ ID NO: 467382 - protein, 9 aa, Homo Sapiens
SSASSMDSI

SEQ ID NO: 467383 - protein, 9 aa, Homo Sapiens
KATFSEKQE

SEQ ID NO: 467384 - protein, 9 aa, Homo Sapiens
MRCGTSRPG

SEQ ID NO: 467385 - protein, 9 aa, Homo Sapiens
ISHELVINL

SEQ ID NO: 467386 - protein, 9 aa, Homo Sapiens
GALPTRRDL

SEQ ID NO: 467387 - protein, 9 aa, Homo Sapiens
SASSMDSIV

SEQ ID NO: 467388 - protein, 9 aa, Homo Sapiens
ACRSSTRPR

SEQ ID NO: 467389 - protein, 9 aa, Homo Sapiens
EEMKGQINN

SEQ ID NO: 467390 - protein, 9 aa, Homo Sapiens
VIHEEMLKD

SEQ ID NO: 467391 - protein, 9 aa, Homo Sapiens
LLIDLELSY

SEQ ID NO: 467392 - protein, 9 aa, Homo Sapiens
SRIVGALEC

SEQ ID NO: 467393 - protein, 9 aa, Homo Sapiens
CICEEGYQG

SEQ ID NO: 467394 - protein, 9 aa, Homo Sapiens
VRPPPLLGQ

SEQ ID NO: 467395 - protein, 9 aa, Homo Sapiens
LHGRVITRA

SEQ ID NO: 467396 - protein, 9 aa, Homo Sapiens
DLRGTSGDT

SEQ ID NO: 467397 - protein, 9 aa, Homo Sapiens
LIRVEVNLR

SEQ ID NO: 467398 - protein, 9 aa, Homo Sapiens
NPGIIELGG

SEQ ID NO: 467399 - protein, 9 aa, Homo Sapiens
PRASCSSCV

SEQ ID NO: 467400 - protein, 9 aa, Homo Sapiens
QRKHMENPR

SEQ ID NO: 467401 - protein, 9 aa, Homo Sapiens
AHAEEKPHS

SEQ ID NO: 467402 - protein, 9 aa, Homo Sapiens
QLMRIKEAL

SEQ ID NO: 467403 - protein, 9 aa, Homo Sapiens
KSNPGIIEL

SEQ ID NO: 467404 - protein, 9 aa, Homo Sapiens
PMRCGTSRP

SEQ ID NO: 467405 - protein, 9 aa, Homo Sapiens
TFHHHRFYL

SEQ ID NO: 467406 - protein, 9 aa, Homo Sapiens
DNMAGVFML

SEQ ID NO: 467407 - protein, 9 aa, Homo Sapiens
SCSSCVRPH

SEQ ID NO: 467408 - protein, 9 aa, Homo Sapiens
NIGAELIWC

SEQ ID NO: 467409 - protein, 9 aa, Homo Sapiens
LERYDAALA

SEQ ID NO: 467410 - protein, 9 aa, Homo Sapiens
ILNNTIPGT

SEQ ID NO: 467411 - protein, 9 aa, Homo Sapiens
LTAIFLFDD

SEQ ID NO: 467412 - protein, 9 aa, Homo Sapiens
DVPPVGGCA

SEQ ID NO: 467413 - protein, 9 aa, Homo Sapiens
LYNMAAQTS

SEQ ID NO: 467414 - protein, 9 aa, Homo Sapiens
CFGIYPHAS

SEQ ID NO: 467415 - protein, 9 aa, Homo Sapiens
DAALAQARE

SEQ ID NO: 467416 - protein, 9 aa, Homo Sapiens
MAMGTMSPQ

SEQ ID NO: 467417 - protein, 9 aa, Homo Sapiens
QLSQGRYRV

SEQ ID NO: 467418 - protein, 9 aa, Homo Sapiens
LICLHAEIG

SEQ ID NO: 467419 - protein, 9 aa, Homo Sapiens
IIKGNMYYE

SEQ ID NO: 467420 - protein, 9 aa, Homo Sapiens
FVIHEEMLK

SEQ ID NO: 467421 - protein, 9 aa, Homo Sapiens
HELVINLVT

SEQ ID NO: 467422 - protein, 9 aa, Homo Sapiens
KDCDCGLWS

SEQ ID NO: 467423 - protein, 9 aa, Homo Sapiens
IKEALGDKA

SEQ ID NO: 467424 - protein, 9 aa, Homo Sapiens
SLMAMGTMS

SEQ ID NO: 467425 - protein, 9 aa, Homo Sapiens
DCGLWSFTR

SEQ ID NO: 467426 - protein, 9 aa, Homo Sapiens
MRIKEALGD

SEQ ID NO: 467427 - protein, 9 aa, Homo Sapiens
CIGGAALSP

SEQ ID NO: 467428 - protein, 9 aa, Homo Sapiens
DCDCGLWSF

SEQ ID NO: 467429 - protein, 9 aa, Homo Sapiens
VINLVTKGI

SEQ ID NO: 467430 - protein, 9 aa, Homo Sapiens
GTPPHPGKP

SEQ ID NO: 467431 - protein, 9 aa, Homo Sapiens
KECWIHSKY

SEQ ID NO: 467432 - protein, 9 aa, Homo Sapiens
IFQLHQEKQ

SEQ ID NO: 467433 - protein, 9 aa, Homo Sapiens
GIPVQPLPM

SEQ ID NO: 467434 - protein, 9 aa, Homo Sapiens
TGESDTIIW

SEQ ID NO: 467435 - protein, 9 aa, Homo Sapiens
WGTFIKVGQ

SEQ ID NO: 467436 - protein, 9 aa, Homo Sapiens
NVTEFILLW

SEQ ID NO: 467437 - protein, 9 aa, Homo Sapiens
YVSGEDDGK

SEQ ID NO: 467438 - protein, 9 aa, Homo Sapiens
TKLHGIDSD

SEQ ID NO: 467439 - protein, 9 aa, Homo Sapiens
RVITRAEVD

SEQ ID NO: 467440 - protein, 9 aa, Homo Sapiens
PTRRDLTLE

SEQ ID NO: 467441 - protein, 9 aa, Homo Sapiens
DLIAPSVGL

SEQ ID NO: 467442 - protein, 9 aa, Homo Sapiens
IWCIVPTGN

SEQ ID NO: 467443 - protein, 9 aa, Homo Sapiens
HMKSWEYFI

SEQ ID NO: 467444 - protein, 9 aa, Homo Sapiens
SQGTPPHPG

SEQ ID NO: 467445 - protein, 9 aa, Homo Sapiens
CVEQLSQGR

SEQ ID NO: 467446 - protein, 9 aa, Homo Sapiens
MGTMSPQLS

SEQ ID NO: 467447 - protein, 9 aa, Homo Sapiens
LAQAREWEE

SEQ ID NO: 467448 - protein, 9 aa, Homo Sapiens
LGLRTFHHH

SEQ ID NO: 467449 - protein, 9 aa, Homo Sapiens
STTGESDTI

SEQ ID NO: 467450 - protein, 9 aa, Homo Sapiens
KLLIDLELS

SEQ ID NO: 467451 - protein, 9 aa, Homo Sapiens
QDVTARNFP

SEQ ID NO: 467452 - protein, 9 aa, Homo Sapiens
TTKLHGIDS

SEQ ID NO: 467453 - protein, 9 aa, Homo Sapiens
YNQLMRIKE

SEQ ID NO: 467454 - protein, 9 aa, Homo Sapiens
SGDTCNLEQ

SEQ ID NO: 467455 - protein, 9 aa, Homo Sapiens
GLCYVVCFL

SEQ ID NO: 467456 - protein, 9 aa, Homo Sapiens
SASSGPRSM

SEQ ID NO: 467457 - protein, 9 aa, Homo Sapiens
ASLMAMGTM

SEQ ID NO: 467458 - protein, 9 aa, Homo Sapiens
HSGTKEKKH

SEQ ID NO: 467459 - protein, 9 aa, Homo Sapiens
QGPMGMRGP

SEQ ID NO: 467460 - protein, 9 aa, Homo Sapiens
FTPRPQDHD

SEQ ID NO: 467461 - protein, 9 aa, Homo Sapiens
LTEQRPGVQ

SEQ ID NO: 467462 - protein, 9 aa, Homo Sapiens
QSWWDSRLS

SEQ ID NO: 467463 - protein, 9 aa, Homo Sapiens
TSTTQQMIY

SEQ ID NO: 467464 - protein, 9 aa, Homo Sapiens
EPPPLDYVS

SEQ ID NO: 467465 - protein, 9 aa, Homo Sapiens
ILLWLTQNP

SEQ ID NO: 467466 - protein, 9 aa, Homo Sapiens
EDRTVSSDA

SEQ ID NO: 467467 - protein, 9 aa, Homo Sapiens
HYTSFKPPP

SEQ ID NO: 467468 - protein, 9 aa, Homo Sapiens
DKPSLSVRY

SEQ ID NO: 467469 - protein, 9 aa, Homo Sapiens
APSEQALTE

SEQ ID NO: 467470 - protein, 9 aa, Homo Sapiens
VAFILNNTI

SEQ ID NO: 467471 - protein, 9 aa, Homo Sapiens
EKPHSGTKE

SEQ ID NO: 467472 - protein, 9 aa, Homo Sapiens
LGLNQHYTS

SEQ ID NO: 467473 - protein, 9 aa, Homo Sapiens
PSHRRACRS

SEQ ID NO: 467474 - protein, 9 aa, Homo Sapiens
HGRVITRAE

SEQ ID NO: 467475 - protein, 9 aa, Homo Sapiens
TVKLLIDLE

SEQ ID NO: 467476 - protein, 9 aa, Homo Sapiens
LIGYLDTDM

SEQ ID NO: 467477 - protein, 9 aa, Homo Sapiens
CNGKQHGKG

SEQ ID NO: 467478 - protein, 9 aa, Homo Sapiens
PGRAWRAAG

SEQ ID NO: 467479 - protein, 9 aa, Homo Sapiens
AEAETSSPK

SEQ ID NO: 467480 - protein, 9 aa, Homo Sapiens
EGLCICEEG

SEQ ID NO: 467481 - protein, 9 aa, Homo Sapiens
REQRRHMKS

SEQ ID NO: 467482 - protein, 9 aa, Homo Sapiens
VHTCFGIYP

SEQ ID NO: 467483 - protein, 9 aa, Homo Sapiens
RYDAALAQA

SEQ ID NO: 467484 - protein, 9 aa, Homo Sapiens
TVFLHQSWW

SEQ ID NO: 467485 - protein, 9 aa, Homo Sapiens
SLSSSASSM

SEQ ID NO: 467486 - protein, 9 aa, Homo Sapiens
TTGESDTII

SEQ ID NO: 467487 - protein, 9 aa, Homo Sapiens
ALPTRRDLT

SEQ ID NO: 467488 - protein, 9 aa, Homo Sapiens
DVTARNFPP

SEQ ID NO: 467489 - protein, 9 aa, Homo Sapiens
EAEAETSSP

SEQ ID NO: 467490 - protein, 9 aa, Homo Sapiens
CPNKFCVEQ

SEQ ID NO: 467491 - protein, 9 aa, Homo Sapiens
IYRICVKVQ

SEQ ID NO: 467492 - protein, 9 aa, Homo Sapiens
LCYVVCFLG

SEQ ID NO: 467493 - protein, 9 aa, Homo Sapiens
RAWRAAGGP

SEQ ID NO: 467494 - protein, 9 aa, Homo Sapiens
HMENPRGKG

SEQ ID NO: 467495 - protein, 9 aa, Homo Sapiens
YLDTDMEAE

SEQ ID NO: 467496 - protein, 9 aa, Homo Sapiens
EKECWIHSK

SEQ ID NO: 467497 - protein, 9 aa, Homo Sapiens
TIIWNEVHH

SEQ ID NO: 467498 - protein, 9 aa, Homo Sapiens
IIWNEVHHK

SEQ ID NO: 467499 - protein, 9 aa, Homo Sapiens
LENLQIIKG

SEQ ID NO: 467500 - protein, 9 aa, Homo Sapiens
VPEKSNGII

SEQ ID NO: 467501 - protein, 9 aa, Homo Sapiens
RVEVNLRVE

SEQ ID NO: 467502 - protein, 9 aa, Homo Sapiens
RYIFQLHQE

SEQ ID NO: 467503 - protein, 9 aa, Homo Sapiens
HRRACRSST

SEQ ID NO: 467504 - protein, 9 aa, Homo Sapiens
EQALTEQRP

SEQ ID NO: 467505 - protein, 9 aa, Homo Sapiens
KGDAGSQGP

SEQ ID NO: 467506 - protein, 9 aa, Homo Sapiens
RSMAPGGPM

SEQ ID NO: 467507 - protein, 9 aa, Homo Sapiens
SCLQQPDLI

SEQ ID NO: 467508 - protein, 9 aa, Homo Sapiens
VSLHIRKSN

SEQ ID NO: 467509 - protein, 9 aa, Homo Sapiens
VALKLVWNP

SEQ ID NO: 467510 - protein, 9 aa, Homo Sapiens
ELGGLVSSI

SEQ ID NO: 467511 - protein, 9 aa, Homo Sapiens
SPLICLHAE

SEQ ID NO: 467512 - protein, 9 aa, Homo Sapiens
LIWCIVPTG

SEQ ID NO: 467513 - protein, 9 aa, Homo Sapiens
PIVKPGSNC

SEQ ID NO: 467514 - protein, 9 aa, Homo Sapiens
GLEHMSREQ

SEQ ID NO: 467515 - protein, 9 aa, Homo Sapiens
FGIYPHASV

SEQ ID NO: 467516 - protein, 9 aa, Homo Sapiens
LIAPSVGLH

SEQ ID NO: 467517 - protein, 9 aa, Homo Sapiens
GSSGSSPFV

SEQ ID NO: 467518 - protein, 9 aa, Homo Sapiens
ALAQAREWE

SEQ ID NO: 467519 - protein, 9 aa, Homo Sapiens
EECQRKHME

SEQ ID NO: 467520 - protein, 9 aa, Homo Sapiens
RHMKSWEYF

SEQ ID NO: 467521 - protein, 9 aa, Homo Sapiens
KLEEMKGQI

SEQ ID NO: 467522 - protein, 9 aa, Homo Sapiens
QGTPPHPGK

SEQ ID NO: 467523 - protein, 9 aa, Homo Sapiens
KQPSASSGP

SEQ ID NO: 467524 - protein, 9 aa, Homo Sapiens
TWSESGQDV

SEQ ID NO: 467525 - protein, 9 aa, Homo Sapiens
DRIQRPPFR

SEQ ID NO: 467526 - protein, 9 aa, Homo Sapiens
MIYRICVKV

SEQ ID NO: 467527 - protein, 9 aa, Homo Sapiens
FILNNTIPG

SEQ ID NO: 467528 - protein, 9 aa, Homo Sapiens
IFLFDDLAP

SEQ ID NO: 467529 - protein, 9 aa, Homo Sapiens
TCFGIYPHA

SEQ ID NO: 467530 - protein, 9 aa, Homo Sapiens
LGITTKLHG

SEQ ID NO: 467531 - protein, 9 aa, Homo Sapiens
FKDKLEEMK

SEQ ID NO: 467532 - protein, 9 aa, Homo Sapiens
RRYIFQLHQ

SEQ ID NO: 467533 - protein, 9 aa, Homo Sapiens
AAGGPSHRR

SEQ ID NO: 467534 - protein, 9 aa, Homo Sapiens
YDAALAQAR

SEQ ID NO: 467535 - protein, 9 aa, Homo Sapiens
VGFGLEHMS

SEQ ID NO: 467536 - protein, 9 aa, Homo Sapiens
NLNAFVTGS

SEQ ID NO: 467537 - protein, 9 aa, Homo Sapiens
KYVSLHIRK

SEQ ID NO: 467538 - protein, 9 aa, Homo Sapiens
ECIGGAALS

SEQ ID NO: 467539 - protein, 9 aa, Homo Sapiens
GSTQTGGLC

SEQ ID NO: 467540 - protein, 9 aa, Homo Sapiens
SSGSSPFVP

SEQ ID NO: 467541 - protein, 9 aa, Homo Sapiens
CYISSTVPN

SEQ ID NO: 467542 - protein, 9 aa, Homo Sapiens
NQHYTSFKP

SEQ ID NO: 467543 - protein, 9 aa, Homo Sapiens
LCELCCANW

SEQ ID NO: 467544 - protein, 9 aa, Homo Sapiens
CYVVCFLGI

SEQ ID NO: 467545 - protein, 9 aa, Homo Sapiens
FGLEHMSRE

SEQ ID NO: 467546 - protein, 9 aa, Homo Sapiens
LDTDMEAEE

SEQ ID NO: 467547 - protein, 9 aa, Homo Sapiens
EQLSQGRYR

SEQ ID NO: 467548 - protein, 9 aa, Homo Sapiens
GSNCGFGKT

SEQ ID NO: 467549 - protein, 9 aa, Homo Sapiens
AALAQAREW

SEQ ID NO: 467550 - protein, 9 aa, Homo Sapiens
PPVGGCALQ

SEQ ID NO: 467551 - protein, 9 aa, Homo Sapiens
LARRLYNMA

SEQ ID NO: 467552 - protein, 9 aa, Homo Sapiens
AFLEICYIS

SEQ ID NO: 467553 - protein, 9 aa, Homo Sapiens
ETSSPKGKF

SEQ ID NO: 467554 - protein, 9 aa, Homo Sapiens
SGQDVTARN

SEQ ID NO: 467555 - protein, 9 aa, Homo Sapiens
QQMIYRICV

SEQ ID NO: 467556 - protein, 9 aa, Homo Sapiens
IGYLDTDME

SEQ ID NO: 467557 - protein, 9 aa, Homo Sapiens
AGSQGPMGM

SEQ ID NO: 467558 - protein, 9 aa, Homo Sapiens
GDTCNLEQG

SEQ ID NO: 467559 - protein, 9 aa, Homo Sapiens
GYLDTDMEA

SEQ ID NO: 467560 - protein, 9 aa, Homo Sapiens
ATLTFDNMA

SEQ ID NO: 467561 - protein, 9 aa, Homo Sapiens
EKQEKELEN

SEQ ID NO: 467562 - protein, 9 aa, Homo Sapiens
VSGEDDGKS

SEQ ID NO: 467563 - protein, 9 aa, Homo Sapiens
ASSMDSIVS

SEQ ID NO: 467564 - protein, 9 aa, Homo Sapiens
LEDRTVSSD

SEQ ID NO: 467565 - protein, 9 aa, Homo Sapiens
PRSMAPGGP

SEQ ID NO: 467566 - protein, 9 aa, Homo Sapiens
QHLIRVEVN

SEQ ID NO: 467567 - protein, 9 aa, Homo Sapiens
GIIELGGLV

SEQ ID NO: 467568 - protein, 9 aa, Homo Sapiens
GQDVTARNF

SEQ ID NO: 467569 - protein, 9 aa, Homo Sapiens
IDSDAFPFL

SEQ ID NO: 467570 - protein, 9 aa, Homo Sapiens
ICLHAEIGS

SEQ ID NO: 467571 - protein, 9 aa, Homo Sapiens
TDMEAEEEE

SEQ ID NO: 467572 - protein, 9 aa, Homo Sapiens
QHGKGSIYY

SEQ ID NO: 467573 - protein, 9 aa, Homo Sapiens
QALTEQRPG

SEQ ID NO: 467574 - protein, 9 aa, Homo Sapiens
CLHAEIGST

SEQ ID NO: 467575 - protein, 9 aa, Homo Sapiens
PEECQRKHM

SEQ ID NO: 467576 - protein, 9 aa, Homo Sapiens
IGHWCNGKQ

SEQ ID NO: 467577 - protein, 9 aa, Homo Sapiens
AFVTGSWWV

SEQ ID NO: 467578 - protein, 9 aa, Homo Sapiens
FLGITTKLH

SEQ ID NO: 467579 - protein, 9 aa, Homo Sapiens
GSGSSGSSP

SEQ ID NO: 467580 - protein, 9 aa, Homo Sapiens
SGSSGSSPF

SEQ ID NO: 467581 - protein, 9 aa, Homo Sapiens
YFDSYAHFV

SEQ ID NO: 467582 - protein, 9 aa, Homo Sapiens
NKFCVEQLS

SEQ ID NO: 467583 - protein, 9 aa, Homo Sapiens
KAHAEEKPH

SEQ ID NO: 467584 - protein, 9 aa, Homo Sapiens
ALLLSWPAL

SEQ ID NO: 467585 - protein, 9 aa, Homo Sapiens
IKGNMYYEN

SEQ ID NO: 467586 - protein, 9 aa, Homo Sapiens
PSEQALTEQ

SEQ ID NO: 467587 - protein, 9 aa, Homo Sapiens
DAGSQGPMG

SEQ ID NO: 467588 - protein, 9 aa, Homo Sapiens
EEKECWIHS

SEQ ID NO: 467589 - protein, 9 aa, Homo Sapiens
GDKPSLSVR

SEQ ID NO: 467590 - protein, 9 aa, Homo Sapiens
ARRLYNMAA

SEQ ID NO: 467591 - protein, 9 aa, Homo Sapiens
HQSWWDSRL

SEQ ID NO: 467592 - protein, 9 aa, Homo Sapiens
VNLRVEYLD

SEQ ID NO: 467593 - protein, 9 aa, Homo Sapiens
AIFLFDDLA

SEQ ID NO: 467594 - protein, 9 aa, Homo Sapiens
SWWVALKLV

SEQ ID NO: 467595 - protein, 9 aa, Homo Sapiens
NQSQGTPPH

SEQ ID NO: 467596 - protein, 9 aa, Homo Sapiens
PGGPMRCGT

SEQ ID NO: 467597 - protein, 9 aa, Homo Sapiens
MDSIVSSET

SEQ ID NO: 467598 - protein, 9 aa, Homo Sapiens
TEFILLWLT

SEQ ID NO: 467599 - protein, 9 aa, Homo Sapiens
TSSPKGKFS

SEQ ID NO: 467600 - protein, 9 aa, Homo Sapiens
KPHSGTKEK

SEQ ID NO: 467601 - protein, 9 aa, Homo Sapiens
RTVSSDAVL

SEQ ID NO: 467602 - protein, 9 aa, Homo Sapiens
APATLTFDN

SEQ ID NO: 467603 - protein, 9 aa, Homo Sapiens
GLHGRVITR

SEQ ID NO: 467604 - protein, 9 aa, Homo Sapiens
DKLEEMKGQ

SEQ ID NO: 467605 - protein, 9 aa, Homo Sapiens
VGALECIGG

SEQ ID NO: 467606 - protein, 9 aa, Homo Sapiens
AMGTMSPQL

SEQ ID NO: 467607 - protein, 9 aa, Homo Sapiens
FLGLRTFHH

SEQ ID NO: 467608 - protein, 9 aa, Homo Sapiens
LVWNPEPDF

SEQ ID NO: 467609 - protein, 9 aa, Homo Sapiens
GNFAFLEIC

SEQ ID NO: 467610 - protein, 9 aa, Homo Sapiens
KYNQLMRIK

SEQ ID NO: 467611 - protein, 9 aa, Homo Sapiens
HAEIGSTMG

SEQ ID NO: 467612 - protein, 9 aa, Homo Sapiens
LLLSWPALA

SEQ ID NO: 467613 - protein, 9 aa, Homo Sapiens
GLCICEEGY

SEQ ID NO: 467614 - protein, 9 aa, Homo Sapiens
TFDNMAGVF

SEQ ID NO: 467615 - protein, 9 aa, Homo Sapiens
GLGALPTRR

SEQ ID NO: 467616 - protein, 9 aa, Homo Sapiens
CSSCVRPHS

SEQ ID NO: 467617 - protein, 9 aa, Homo Sapiens
ELCCANWGT

SEQ ID NO: 467618 - protein, 9 aa, Homo Sapiens
LQGSTQTGG

SEQ ID NO: 467619 - protein, 9 aa, Homo Sapiens
IHLARRLYN

SEQ ID NO: 467620 - protein, 9 aa, Homo Sapiens
GIIKEYQIR

SEQ ID NO: 467621 - protein, 9 aa, Homo Sapiens
DYVSGEDDG

SEQ ID NO: 467622 - protein, 9 aa, Homo Sapiens
TSRPGRAWR

SEQ ID NO: 467623 - protein, 9 aa, Homo Sapiens
KENPYEGIP

SEQ ID NO: 467624 - protein, 9 aa, Homo Sapiens
ELERYDAAL

SEQ ID NO: 467625 - protein, 9 aa, Homo Sapiens
HALLLSWPA

SEQ ID NO: 467626 - protein, 9 aa, Homo Sapiens
LEEMKGQIN

SEQ ID NO: 467627 - protein, 9 aa, Homo Sapiens
LSSSASSMD

SEQ ID NO: 467628 - protein, 9 aa, Homo Sapiens
TSGDTCNLE

SEQ ID NO: 467629 - protein, 9 aa, Homo Sapiens
GHWCNGKQH

SEQ ID NO: 467630 - protein, 9 aa, Homo Sapiens
VVLVSQDRI

SEQ ID NO: 467631 - protein, 9 aa, Homo Sapiens
PSVGLHGRV

SEQ ID NO: 467632 - protein, 9 aa, Homo Sapiens
SQDRIQRPP

SEQ ID NO: 467633 - protein, 9 aa, Homo Sapiens
TRPRASCSS

SEQ ID NO: 467634 - protein, 9 aa, Homo Sapiens
SQGPMGMRG

SEQ ID NO: 467635 - protein, 9 aa, Homo Sapiens
NFAFLEICY

SEQ ID NO: 467636 - protein, 9 aa, Homo Sapiens
PDLIAPSVG

SEQ ID NO: 467637 - protein, 9 aa, Homo Sapiens
NQLMRIKEA

SEQ ID NO: 467638 - protein, 9 aa, Homo Sapiens
CCANWGTFI

SEQ ID NO: 467639 - protein, 9 aa, Homo Sapiens
MSEVRPPPL

SEQ ID NO: 467640 - protein, 9 aa, Homo Sapiens
LHQEKQTEL

SEQ ID NO: 467641 - protein, 9 aa, Homo Sapiens
LEAPSEQAL

SEQ ID NO: 467642 - protein, 9 aa, Homo Sapiens
LLIGYLDTD

SEQ ID NO: 467643 - protein, 9 aa, Homo Sapiens
WRAAGGPSH

SEQ ID NO: 467644 - protein, 9 aa, Homo Sapiens
LQIIKGNMY

SEQ ID NO: 467645 - protein, 9 aa, Homo Sapiens
DEPPPLDYV

SEQ ID NO: 467646 - protein, 9 aa, Homo Sapiens
TVSSDAVLQ

SEQ ID NO: 467647 - protein, 9 aa, Homo Sapiens
SSCVRPHSC

SEQ ID NO: 467648 - protein, 9 aa, Homo Sapiens
SNCGFGKTG

SEQ ID NO: 467649 - protein, 9 aa, Homo Sapiens
KFCVEQLSQ

SEQ ID NO: 467650 - protein, 9 aa, Homo Sapiens
NAPATLTFD

SEQ ID NO: 467651 - protein, 9 aa, Homo Sapiens
PPLDYVSGE

SEQ ID NO: 467652 - protein, 9 aa, Homo Sapiens
PKGDAGSQG

SEQ ID NO: 467653 - protein, 9 aa, Homo Sapiens
GSWWVALKL

SEQ ID NO: 467654 - protein, 9 aa, Homo Sapiens
RGTSGDTCN

SEQ ID NO: 467655 - protein, 9 aa, Homo Sapiens
SYAHFVIHE

SEQ ID NO: 467656 - protein, 9 aa, Homo Sapiens
RPQDHDTDL

SEQ ID NO: 467657 - protein, 9 aa, Homo Sapiens
GGLCYVVCF

SEQ ID NO: 467658 - protein, 9 aa, Homo Sapiens
TPRPQDHDT

SEQ ID NO: 467659 - protein, 9 aa, Homo Sapiens
VFLHQSWWD

SEQ ID NO: 467660 - protein, 9 aa, Homo Sapiens
NAFVTGSWW

SEQ ID NO: 467661 - protein, 9 aa, Homo Sapiens
EEGLCICEE

SEQ ID NO: 467662 - protein, 9 aa, Homo Sapiens
YNMAAQTSP

SEQ ID NO: 467663 - protein, 9 aa, Homo Sapiens
KFKMSEVRP

SEQ ID NO: 467664 - protein, 9 aa, Homo Sapiens
AGGPSHRRA

SEQ ID NO: 467665 - protein, 9 aa, Homo Sapiens
FRALEDRTV

SEQ ID NO: 467666 - protein, 9 aa, Homo Sapiens
LNQHYTSFK

SEQ ID NO: 467667 - protein, 9 aa, Homo Sapiens
EMKGQINNS

SEQ ID NO: 467668 - protein, 9 aa, Homo Sapiens
LPTRRDLTL

SEQ ID NO: 467669 - protein, 9 aa, Homo Sapiens
AEIGSTMGM

SEQ ID NO: 467670 - protein, 9 aa, Homo Sapiens
TGGLCYVVC

SEQ ID NO: 467671 - protein, 9 aa, Homo Sapiens
NMAAQTSPD

SEQ ID NO: 467672 - protein, 9 aa, Homo Sapiens
TLTFDNMAG

SEQ ID NO: 467673 - protein, 9 aa, Homo Sapiens
SGSSPFVPH

SEQ ID NO: 467674 - protein, 9 aa, Homo Sapiens
GGCALQGST

SEQ ID NO: 467675 - protein, 9 aa, Homo Sapiens
SEVRPPPLL

SEQ ID NO: 467676 - protein, 9 aa, Homo Sapiens
SSSASSMDS

SEQ ID NO: 467677 - protein, 9 aa, Homo Sapiens
YKSNPGIIE

SEQ ID NO: 467678 - protein, 9 aa, Homo Sapiens
CGTSRPGRA

SEQ ID NO: 467679 - protein, 9 aa, Homo Sapiens
PFLNLNAFV

SEQ ID NO: 467680 - protein, 9 aa, Homo Sapiens
LQVHTCFGI

SEQ ID NO: 467681 - protein, 9 aa, Homo Sapiens
ICYISSTVP

SEQ ID NO: 467682 - protein, 9 aa, Homo Sapiens
LTFDNMAGV

SEQ ID NO: 467683 - protein, 9 aa, Homo Sapiens
CVRPHSCRG

SEQ ID NO: 467684 - protein, 9 aa, Homo Sapiens
CEEGLCICE

SEQ ID NO: 467685 - protein, 9 aa, Homo Sapiens
HLARRLYNM

SEQ ID NO: 467686 - protein, 9 aa, Homo Sapiens
GFGLEHMSR

SEQ ID NO: 467687 - protein, 9 aa, Homo Sapiens
SWWDSRLSY

SEQ ID NO: 467688 - protein, 9 aa, Homo Sapiens
PLENLQIIK

SEQ ID NO: 467689 - protein, 9 aa, Homo Sapiens
DRTVSSDAV

SEQ ID NO: 467690 - protein, 9 aa, Homo Sapiens
LVINLVTKG

SEQ ID NO: 467691 - protein, 9 aa, Homo Sapiens
SESGQDVTA

SEQ ID NO: 467692 - protein, 9 aa, Homo Sapiens
GAELIWCIV

SEQ ID NO: 467693 - protein, 9 aa, Homo Sapiens
QRRHMKSWE

SEQ ID NO: 467694 - protein, 9 aa, Homo Sapiens
GTSRPGRAW

SEQ ID NO: 467695 - protein, 9 aa, Homo Sapiens
NGIIKEYQI

SEQ ID NO: 467696 - protein, 9 aa, Homo Sapiens
YVVCFLGIT

SEQ ID NO: 467697 - protein, 9 aa, Homo Sapiens
AWRAAGGPS

SEQ ID NO: 467698 - protein, 9 aa, Homo Sapiens
KMSEVRPPP

SEQ ID NO: 467699 - protein, 9 aa, Homo Sapiens
KSWEYFIAA

SEQ ID NO: 467700 - protein, 9 aa, Homo Sapiens
DTSKQPSAS

SEQ ID NO: 467701 - protein, 9 aa, Homo Sapiens
VTWSESGQD

SEQ ID NO: 467702 - protein, 9 aa, Homo Sapiens
FPFLNLNAF

SEQ ID NO: 467703 - protein, 9 aa, Homo Sapiens
QPSASSGPR

SEQ ID NO: 467704 - protein, 9 aa, Homo Sapiens
KSTREEKEC

SEQ ID NO: 467705 - protein, 9 aa, Homo Sapiens
APSVGLHGR

SEQ ID NO: 467706 - protein, 9 aa, Homo Sapiens
WWDSRLSYN

SEQ ID NO: 467707 - protein, 9 aa, Homo Sapiens
RLTAIFLFD

SEQ ID NO: 467708 - protein, 9 aa, Homo Sapiens
LNAFVTGSW

SEQ ID NO: 467709 - protein, 9 aa, Homo Sapiens
VKLLIDLEL

SEQ ID NO: 467710 - protein, 9 aa, Homo Sapiens
RIQRPPFRF

SEQ ID NO: 467711 - protein, 9 aa, Homo Sapiens
QGSTQTGGL

SEQ ID NO: 467712 - protein, 9 aa, Homo Sapiens
LIDLELSYG

SEQ ID NO: 467713 - protein, 9 aa, Homo Sapiens
ITTKLHGID

SEQ ID NO: 467714 - protein, 9 aa, Homo Sapiens
DTCNLEQGL

SEQ ID NO: 467715 - protein, 9 aa, Homo Sapiens
WCNGKQHGK

SEQ ID NO: 467716 - protein, 9 aa, Homo Sapiens
YEGIPVQPL

SEQ ID NO: 467717 - protein, 9 aa, Homo Sapiens
DAFPFLNLN

SEQ ID NO: 467718 - protein, 9 aa, Homo Sapiens
KHMENPRGK

SEQ ID NO: 467719 - protein, 9 aa, Homo Sapiens
DSDAFPFLN

SEQ ID NO: 467720 - protein, 9 aa, Homo Sapiens
GIDSDAFPF

SEQ ID NO: 467721 - protein, 9 aa, Homo Sapiens
RIKEALGDK

SEQ ID NO: 467722 - protein, 9 aa, Homo Sapiens
QSQGTPPHP

SEQ ID NO: 467723 - protein, 9 aa, Homo Sapiens
KPSLSVRYV

SEQ ID NO: 467724 - protein, 9 aa, Homo Sapiens
AETSSPKGK

SEQ ID NO: 467725 - protein, 9 aa, Homo Sapiens
TKENPYEGI

SEQ ID NO: 467726 - protein, 9 aa, Homo Sapiens
CVAFILNNT

SEQ ID NO: 467727 - protein, 9 aa, Homo Sapiens
SPEECQRKH

SEQ ID NO: 467728 - protein, 9 aa, Homo Sapiens
VTEFILLWL

SEQ ID NO: 467729 - protein, 9 aa, Homo Sapiens
LMAMGTMSP

SEQ ID NO: 467730 - protein, 9 aa, Homo Sapiens
IELGGLVSS

SEQ ID NO: 467731 - protein, 9 aa, Homo Sapiens
SGPRSMAPG

SEQ ID NO: 467732 - protein, 9 aa, Homo Sapiens
PLDTSKQPS

SEQ ID NO: 467733 - protein, 9 aa, Homo Sapiens
VEVNLRVEY

SEQ ID NO: 467734 - protein, 9 aa, Homo Sapiens
LHGIDSDAF

SEQ ID NO: 467735 - protein, 9 aa, Homo Sapiens
PLDYVSGED

SEQ ID NO: 467736 - protein, 9 aa, Homo Sapiens
LRTFHHHRF

SEQ ID NO: 467737 - protein, 9 aa, Homo Sapiens
GGCVAFILN

SEQ ID NO: 467738 - protein, 9 aa, Homo Sapiens
CWIHSKYEE

SEQ ID NO: 467739 - protein, 9 aa, Homo Sapiens
IVKPGSNCG

SEQ ID NO: 467740 - protein, 9 aa, Homo Sapiens
PGIIELGGL

SEQ ID NO: 467741 - protein, 9 aa, Homo Sapiens
EEKPHSGTK

SEQ ID NO: 467742 - protein, 9 aa, Homo Sapiens
TSKQPSASS

SEQ ID NO: 467743 - protein, 9 aa, Homo Sapiens
SDTIIWNEV

SEQ ID NO: 467744 - protein, 9 aa, Homo Sapiens
LHALLLSWP

SEQ ID NO: 467745 - protein, 9 aa, Homo Sapiens
RCGTSRPGR

SEQ ID NO: 467746 - protein, 9 aa, Homo Sapiens
MSPQLSLSS

SEQ ID NO: 467747 - protein, 9 aa, Homo Sapiens
GLRTFHHHR

SEQ ID NO: 467748 - protein, 9 aa, Homo Sapiens
IDLELSYGF

SEQ ID NO: 467749 - protein, 9 aa, Homo Sapiens
CFLGITTKL

SEQ ID NO: 467750 - protein, 9 aa, Homo Sapiens
GCVAFILNN

SEQ ID NO: 467751 - protein, 9 aa, Homo Sapiens
LKLVWNPEP

SEQ ID NO: 467752 - protein, 9 aa, Homo Sapiens
PYEGIPVQP

SEQ ID NO: 467753 - protein, 9 aa, Homo Sapiens
ENLQIIKGN

SEQ ID NO: 467754 - protein, 9 aa, Homo Sapiens
WVALKLVWN

SEQ ID NO: 467755 - protein, 9 aa, Homo Sapiens
WCIVPTGNG

SEQ ID NO: 467756 - protein, 9 aa, Homo Sapiens
IMTQGLCTC

SEQ ID NO: 467757 - protein, 9 aa, Homo Sapiens
RAEVDVPPV

SEQ ID NO: 467758 - protein, 9 aa, Homo Sapiens
LLWLTQNPE

SEQ ID NO: 467759 - protein, 9 aa, Homo Sapiens
SLCFLGLRT

SEQ ID NO: 467760 - protein, 9 aa, Homo Sapiens
SWEYFIAAE

SEQ ID NO: 467761 - protein, 9 aa, Homo Sapiens
ECQRKHMEN

SEQ ID NO: 467762 - protein, 9 aa, Homo Sapiens
PTKENPYEG

SEQ ID NO: 467763 - protein, 9 aa, Homo Sapiens
LWLTQNPEG

SEQ ID NO: 467764 - protein, 9 aa, Homo Sapiens
MSREQIREV

SEQ ID NO: 467765 - protein, 9 aa, Homo Sapiens
RRLYNMAAQ

SEQ ID NO: 467766 - protein, 9 aa, Homo Sapiens
FKMSEVRPP

SEQ ID NO: 467767 - protein, 9 aa, Homo Sapiens
RLYNMAAQT

SEQ ID NO: 467768 - protein, 9 aa, Homo Sapiens
EVDVPPVGG

SEQ ID NO: 467769 - protein, 9 aa, Homo Sapiens
GCALQGSTQ

SEQ ID NO: 467770 - protein, 9 aa, Homo Sapiens
HLIRVEVNL

SEQ ID NO: 467771 - protein, 9 aa, Homo Sapiens
MKSWEYFIA

SEQ ID NO: 467772 - protein, 9 aa, Homo Sapiens
YIFQLHQEK

SEQ ID NO: 467773 - protein, 9 aa, Homo Sapiens
LDTSKQPSA

SEQ ID NO: 467774 - protein, 9 aa, Homo Sapiens
YVSLHIRKS

SEQ ID NO: 467775 - protein, 9 aa, Homo Sapiens
GKQHGKGSI

SEQ ID NO: 467776 - protein, 9 aa, Homo Sapiens
IYPHASVWH

SEQ ID NO: 467777 - protein, 9 aa, Homo Sapiens
MTQGLCTCM

SEQ ID NO: 467778 - protein, 9 aa, Homo Sapiens
SVGLHGRVI

SEQ ID NO: 467779 - protein, 9 aa, Homo Sapiens
RACRSSTRP

SEQ ID NO: 467780 - protein, 9 aa, Homo Sapiens
FQLHQEKQT

SEQ ID NO: 467781 - protein, 9 aa, Homo Sapiens
SSMDSIVSS

SEQ ID NO: 467782 - protein, 9 aa, Homo Sapiens
IIKEYQIRQ

SEQ ID NO: 467783 - protein, 9 aa, Homo Sapiens
MKGQINNSI

SEQ ID NO: 467784 - protein, 9 aa, Homo Sapiens
ALTEQRPGV

SEQ ID NO: 467785 - protein, 9 aa, Homo Sapiens
DFKDKLEEM

SEQ ID NO: 467786 - protein, 9 aa, Homo Sapiens
LCFLGLRTF

SEQ ID NO: 467787 - protein, 9 aa, Homo Sapiens
IVGALECIG

SEQ ID NO: 467788 - protein, 9 aa, Homo Sapiens
GLNQHYTSF

SEQ ID NO: 467789 - protein, 9 aa, Homo Sapiens
EAPSEQALT

SEQ ID NO: 467790 - protein, 9 aa, Homo Sapiens
TAIFLFDDL

SEQ ID NO: 467791 - protein, 9 aa, Homo Sapiens
QVHTCFGIY

SEQ ID NO: 467792 - protein, 9 aa, Homo Sapiens
LEHMSREQI

SEQ ID NO: 467793 - protein, 9 aa, Homo Sapiens
SMDSIVSSE

SEQ ID NO: 467794 - protein, 9 aa, Homo Sapiens
STRPRASCS

SEQ ID NO: 467795 - protein, 9 aa, Homo Sapiens
GITTKLHGI

SEQ ID NO: 467796 - protein, 9 aa, Homo Sapiens
QLHQEKQTE

SEQ ID NO: 467797 - protein, 9 aa, Homo Sapiens
SGDKPSLSV

SEQ ID NO: 467798 - protein, 9 aa, Homo Sapiens
SSGPRSMAP

SEQ ID NO: 467799 - protein, 9 aa, Homo Sapiens
NNTIPGTPE

SEQ ID NO: 467800 - protein, 9 aa, Homo Sapiens
GISHELVIN

SEQ ID NO: 467801 - protein, 9 aa, Homo Sapiens
HGIDSDAFP

SEQ ID NO: 467802 - protein, 9 aa, Homo Sapiens
KEALGDKAI

SEQ ID NO: 467803 - protein, 9 aa, Homo Sapiens
TQTGGLCYV

SEQ ID NO: 467804 - protein, 9 aa, Homo Sapiens
FSEKQEKEL

SEQ ID NO: 467805 - protein, 9 aa, Homo Sapiens
WLTQNPEGQ

SEQ ID NO: 467806 - protein, 9 aa, Homo Sapiens
KDKLEEMKG

SEQ ID NO: 467807 - protein, 9 aa, Homo Sapiens
WWVALKLVW

SEQ ID NO: 467808 - protein, 9 aa, Homo Sapiens
VVCFLGITT

SEQ ID NO: 467809 - protein, 9 aa, Homo Sapiens
EQRRHMKSW

SEQ ID NO: 467810 - protein, 9 aa, Homo Sapiens
RASCSSCVR

SEQ ID NO: 467811 - protein, 9 aa, Homo Sapiens
DTDMEAEEE

SEQ ID NO: 467812 - protein, 9 aa, Homo Sapiens
SKFKMSEVR

SEQ ID NO: 467813 - protein, 9 aa, Homo Sapiens
EICYISSTV

SEQ ID NO: 467814 - protein, 9 aa, Homo Sapiens
GRAWRAAGG

SEQ ID NO: 467815 - protein, 9 aa, Homo Sapiens
WSFTRQARV

SEQ ID NO: 467816 - protein, 9 aa, Homo Sapiens
GALECIGGA

SEQ ID NO: 467817 - protein, 9 aa, Homo Sapiens
PHSGTKEKK

SEQ ID NO: 467818 - protein, 9 aa, Homo Sapiens
RLGLNQHYT

SEQ ID NO: 467819 - protein, 9 aa, Homo Sapiens
PATLTFDNM

SEQ ID NO: 467820 - protein, 9 aa, Homo Sapiens
SSTRPRASC

SEQ ID NO: 467821 - protein, 9 aa, Homo Sapiens
VEQLSQGRY

SEQ ID NO: 467822 - protein, 9 aa, Homo Sapiens
SHRRACRSS

SEQ ID NO: 467823 - protein, 9 aa, Homo Sapiens
TVVLVSQDR

SEQ ID NO: 467824 - protein, 9 aa, Homo Sapiens
FCVEQLSQG

SEQ ID NO: 467825 - protein, 9 aa, Homo Sapiens
LNNTIPGTP

SEQ ID NO: 467826 - protein, 9 aa, Homo Sapiens
CRSSTRPRA

SEQ ID NO: 467827 - protein, 9 aa, Homo Sapiens
TREEKECWI

SEQ ID NO: 467828 - protein, 9 aa, Homo Sapiens
DGISHELVI

SEQ ID NO: 467829 - protein, 9 aa, Homo Sapiens
SCVRPHSCR

SEQ ID NO: 467830 - protein, 9 aa, Homo Sapiens
ASSGPRSMA

SEQ ID NO: 467831 - protein, 9 aa, Homo Sapiens
HWCNGKQHG

SEQ ID NO: 467832 - protein, 9 aa, Homo Sapiens
SKQPSASSG

SEQ ID NO: 467833 - protein, 9 aa, Homo Sapiens
GSQGPMGMR

SEQ ID NO: 467834 - protein, 9 aa, Homo Sapiens
AHFVIHEEM

SEQ ID NO: 467835 - protein, 9 aa, Homo Sapiens
VKPGSNCGF

SEQ ID NO: 467836 - protein, 9 aa, Homo Sapiens
ELVINLVTK

SEQ ID NO: 467837 - protein, 9 aa, Homo Sapiens
EVNLRVEYL

SEQ ID NO: 467838 - protein, 9 aa, Homo Sapiens
GPSHRRACR

SEQ ID NO: 467839 - protein, 9 aa, Homo Sapiens
VDVPPVGGC

SEQ ID NO: 467840 - protein, 9 aa, Homo Sapiens
ALQGSTQTG

SEQ ID NO: 467841 - protein, 9 aa, Homo Sapiens
EGEAEAETS

SEQ ID NO: 467842 - protein, 9 aa, Homo Sapiens
SDTVKLLID

SEQ ID NO: 467843 - protein, 9 aa, Homo Sapiens
KSNGIIKEY

SEQ ID NO: 467844 - protein, 9 aa, Homo Sapiens
TCNLEQGLC

SEQ ID NO: 467845 - protein, 9 aa, Homo Sapiens
FLEICYISS

SEQ ID NO: 467846 - protein, 9 aa, Homo Sapiens
LGALPTRRD

SEQ ID NO: 467847 - protein, 9 aa, Homo Sapiens
KLHGIDSDA

SEQ ID NO: 467848 - protein, 9 aa, Homo Sapiens
LMRIKEALG

SEQ ID NO: 467849 - protein, 9 aa, Homo Sapiens
ICEEGYQGP

SEQ ID NO: 467850 - protein, 9 aa, Homo Sapiens
KQEKELENK

SEQ ID NO: 467851 - protein, 9 aa, Homo Sapiens
SLHIRKSNR

SEQ ID NO: 467852 - protein, 9 aa, Homo Sapiens
PLICLHAEI

SEQ ID NO: 467853 - protein, 9 aa, Homo Sapiens
WDSRLSYNH

SEQ ID NO: 467854 - protein, 9 aa, Homo Sapiens
LLSWPALAR

SEQ ID NO: 467855 - protein, 9 aa, Homo Sapiens
TQQMIYRIC

SEQ ID NO: 467856 - protein, 9 aa, Homo Sapiens
CFLGLRTFH

SEQ ID NO: 467857 - protein, 9 aa, Homo Sapiens
GLWSFTRQA

SEQ ID NO: 467858 - protein, 9 aa, Homo Sapiens
RRHMKSWEY

SEQ ID NO: 467859 - protein, 9 aa, Homo Sapiens
APGGPMRCG

SEQ ID NO: 467860 - protein, 9 aa, Homo Sapiens
FLFDDLAPL

SEQ ID NO: 467861 - protein, 9 aa, Homo Sapiens
IRKSNRPAL

SEQ ID NO: 467862 - protein, 9 aa, Homo Sapiens
FDNMAGVFM

SEQ ID NO: 467863 - protein, 9 aa, Homo Sapiens
DTVKLLIDL

SEQ ID NO: 467864 - protein, 9 aa, Homo Sapiens
LECIGGAAL

SEQ ID NO: 467865 - protein, 9 aa, Homo Sapiens
PEKSNGIIK

SEQ ID NO: 467866 - protein, 9 aa, Homo Sapiens
HAEEKPHSG

SEQ ID NO: 467867 - protein, 9 aa, Homo Sapiens
STREEKECW

SEQ ID NO: 467868 - protein, 9 aa, Homo Sapiens
LRGTSGDTC

SEQ ID NO: 467869 - protein, 9 aa, Homo Sapiens
RALEDRTVS

SEQ ID NO: 467870 - protein, 9 aa, Homo Sapiens
ELIWCIVPT

SEQ ID NO: 467871 - protein, 9 aa, Homo Sapiens
NPYEGIPVQ

SEQ ID NO: 467872 - protein, 9 aa, Homo Sapiens
PVGGCALQG

SEQ ID NO: 467873 - protein, 9 aa, Homo Sapiens
STTQQMIYR

SEQ ID NO: 467874 - protein, 9 aa, Homo Sapiens
FSQICVLFP

SEQ ID NO: 467875 - protein, 9 aa, Homo Sapiens
TDNFLTLTQ

SEQ ID NO: 467876 - protein, 9 aa, Homo Sapiens
RVSSMIWRW

SEQ ID NO: 467877 - protein, 9 aa, Homo Sapiens
SEKMSKSTD

SEQ ID NO: 467878 - protein, 9 aa, Homo Sapiens
LITISASNV

SEQ ID NO: 467879 - protein, 9 aa, Homo Sapiens
KRRYTRNGF

SEQ ID NO: 467880 - protein, 9 aa, Homo Sapiens
SKSTDNFLT

SEQ ID NO: 467881 - protein, 9 aa, Homo Sapiens
ITISASNVS

SEQ ID NO: 467882 - protein, 9 aa, Homo Sapiens
ASNVSILST

SEQ ID NO: 467883 - protein, 9 aa, Homo Sapiens
CSYRVSSMI

SEQ ID NO: 467884 - protein, 9 aa, Homo Sapiens
SQICVLFPF

SEQ ID NO: 467885 - protein, 9 aa, Homo Sapiens
QICVLFPFC

SEQ ID NO: 467886 - protein, 9 aa, Homo Sapiens
PCLCSYRVS

SEQ ID NO: 467887 - protein, 9 aa, Homo Sapiens
EKMSKSTDN

SEQ ID NO: 467888 - protein, 9 aa, Homo Sapiens
SYRVSSMIW

SEQ ID NO: 467889 - protein, 9 aa, Homo Sapiens
YRVSSMIWR

SEQ ID NO: 467890 - protein, 9 aa, Homo Sapiens
NGFDLDLTY

SEQ ID NO: 467891 - protein, 9 aa, Homo Sapiens
YTRNGFDLD

SEQ ID NO: 467892 - protein, 9 aa, Homo Sapiens
GFSQICVLF

SEQ ID NO: 467893 - protein, 9 aa, Homo Sapiens
TAGFSQICV

SEQ ID NO: 467894 - protein, 9 aa, Homo Sapiens
RYTRNGFDL

SEQ ID NO: 467895 - protein, 9 aa, Homo Sapiens
AGFSQICVL

SEQ ID NO: 467896 - protein, 9 aa, Homo Sapiens
NKRRYTRNG

SEQ ID NO: 467897 - protein, 9 aa, Homo Sapiens
QPPCLCSYR

SEQ ID NO: 467898 - protein, 9 aa, Homo Sapiens
IQGFSQICV

SEQ ID NO: 467899 - protein, 9 aa, Homo Sapiens
SLITISASN

SEQ ID NO: 467900 - protein, 9 aa, Homo Sapiens
KSTDNFLTL

SEQ ID NO: 467901 - protein, 9 aa, Homo Sapiens
SASNVSILS

SEQ ID NO: 467902 - protein, 9 aa, Homo Sapiens
SIQGFSQIC

SEQ ID NO: 467903 - protein, 9 aa, Homo Sapiens
PPCLCSYRV

SEQ ID NO: 467904 - protein, 9 aa, Homo Sapiens
TRNGFDLDL

SEQ ID NO: 467905 - protein, 9 aa, Homo Sapiens
RRYTRNGFD

SEQ ID NO: 467906 - protein, 9 aa, Homo Sapiens
ICVLFPFCG

SEQ ID NO: 467907 - protein, 9 aa, Homo Sapiens
ISASNVSIL

SEQ ID NO: 467908 - protein, 9 aa, Homo Sapiens
QGFSQICVL

SEQ ID NO: 467909 - protein, 9 aa, Homo Sapiens
STDNFLTLT

SEQ ID NO: 467910 - protein, 9 aa, Homo Sapiens
LCSYRVSSM

SEQ ID NO: 467911 - protein, 9 aa, Homo Sapiens
KMSKSTDNF

SEQ ID NO: 467912 - protein, 9 aa, Homo Sapiens
SNVSILSTI

SEQ ID NO: 467913 - protein, 9 aa, Homo Sapiens
CLCSYRVSS

SEQ ID NO: 467914 - protein, 9 aa, Homo Sapiens
ATAGFSQIC

SEQ ID NO: 467915 - protein, 9 aa, Homo Sapiens
TISASNVSI

SEQ ID NO: 467916 - protein, 9 aa, Homo Sapiens
MSKSTDNFL

SEQ ID NO: 467917 - protein, 9 aa, Homo Sapiens
CVLFPFCGG

SEQ ID NO: 467918 - protein, 9 aa, Homo Sapiens
NVSILSTIL

SEQ ID NO: 467919 - protein, 9 aa, Homo Sapiens
ENKRRYTRN

SEQ ID NO: 467920 - protein, 9 aa, Homo Sapiens
DNFLTLTQA

SEQ ID NO: 467921 - protein, 9 aa, Homo Sapiens
RNGFDLDLT

SEQ ID NO: 467922 - protein, 9 aa, Homo Sapiens
HRHTGIHTD

SEQ ID NO: 467923 - protein, 9 aa, Homo Sapiens
TPSVVIHVC

SEQ ID NO: 467924 - protein, 9 aa, Homo Sapiens
LVSSGELFD

SEQ ID NO: 467925 - protein, 9 aa, Homo Sapiens
GFEAAEGST

SEQ ID NO: 467926 - protein, 9 aa, Homo Sapiens
DTHRNTQAH

SEQ ID NO: 467927 - protein, 9 aa, Homo Sapiens
DNGYLLEKK

SEQ ID NO: 467928 - protein, 9 aa, Homo Sapiens
PRDFTWQWQ

SEQ ID NO: 467929 - protein, 9 aa, Homo Sapiens
TGIHTDTHR

SEQ ID NO: 467930 - protein, 9 aa, Homo Sapiens
RHTHTQAYT

SEQ ID NO: 467931 - protein, 9 aa, Homo Sapiens
AEGSTKCRA

SEQ ID NO: 467932 - protein, 9 aa, Homo Sapiens
THRHTGIHT

SEQ ID NO: 467933 - protein, 9 aa, Homo Sapiens
VVMFNCSDQ

SEQ ID NO: 467934 - protein, 9 aa, Homo Sapiens
NEDDSYEAR

SEQ ID NO: 467935 - protein, 9 aa, Homo Sapiens
LCWFPFNCY

SEQ ID NO: 467936 - protein, 9 aa, Homo Sapiens
GKSLRKMIS

SEQ ID NO: 467937 - protein, 9 aa, Homo Sapiens
ADVVARSSH

SEQ ID NO: 467938 - protein, 9 aa, Homo Sapiens
RQQQEEEQP

SEQ ID NO: 467939 - protein, 9 aa, Homo Sapiens
MFNCSDQMD

SEQ ID NO: 467940 - protein, 9 aa, Homo Sapiens
SAAATAAAG

SEQ ID NO: 467941 - protein, 9 aa, Homo Sapiens
AYAAMGLNS

SEQ ID NO: 467942 - protein, 9 aa, Homo Sapiens
NSCILNQIS

SEQ ID NO: 467943 - protein, 9 aa, Homo Sapiens
EGSNFGGDK

SEQ ID NO: 467944 - protein, 9 aa, Homo Sapiens
GTHTVVVMG

SEQ ID NO: 467945 - protein, 9 aa, Homo Sapiens
WFADKFSFR

SEQ ID NO: 467946 - protein, 9 aa, Homo Sapiens
LGKYVVMFN

SEQ ID NO: 467947 - protein, 9 aa, Homo Sapiens
HTQAYTLTY

SEQ ID NO: 467948 - protein, 9 aa, Homo Sapiens
YAAMGLNSI

SEQ ID NO: 467949 - protein, 9 aa, Homo Sapiens
EQDHSLSSS

SEQ ID NO: 467950 - protein, 9 aa, Homo Sapiens
SPAWAYAAM

SEQ ID NO: 467951 - protein, 9 aa, Homo Sapiens
KKYGKSLRK

SEQ ID NO: 467952 - protein, 9 aa, Homo Sapiens
WAYAAMGLN

SEQ ID NO: 467953 - protein, 9 aa, Homo Sapiens
AYTLTYTGT

SEQ ID NO: 467954 - protein, 9 aa, Homo Sapiens
CILNQISNK

SEQ ID NO: 467955 - protein, 9 aa, Homo Sapiens
IRALRYYYD

SEQ ID NO: 467956 - protein, 9 aa, Homo Sapiens
DIDSLEVEV

SEQ ID NO: 467957 - protein, 9 aa, Homo Sapiens
RQQDGSVQG

SEQ ID NO: 467958 - protein, 9 aa, Homo Sapiens
RECLGTHTV

SEQ ID NO: 467959 - protein, 9 aa, Homo Sapiens
RHTGIHTDT

SEQ ID NO: 467960 - protein, 9 aa, Homo Sapiens
VNVADIDSL

SEQ ID NO: 467961 - protein, 9 aa, Homo Sapiens
YVICAASPG

SEQ ID NO: 467962 - protein, 9 aa, Homo Sapiens
VRAGAGSGS

SEQ ID NO: 467963 - protein, 9 aa, Homo Sapiens
HRYTHRHTQ

SEQ ID NO: 467964 - protein, 9 aa, Homo Sapiens
SSGELFDRI

SEQ ID NO: 467965 - protein, 9 aa, Homo Sapiens
NVADIDSLE

SEQ ID NO: 467966 - protein, 9 aa, Homo Sapiens
THRHTHTHR

SEQ ID NO: 467967 - protein, 9 aa, Homo Sapiens
VAVLKRPIQ

SEQ ID NO: 467968 - protein, 9 aa, Homo Sapiens
KVKQTQCIL

SEQ ID NO: 467969 - protein, 9 aa, Homo Sapiens
GFQDTVNLT

SEQ ID NO: 467970 - protein, 9 aa, Homo Sapiens
FEAAEGSTK

SEQ ID NO: 467971 - protein, 9 aa, Homo Sapiens
VADIDSLEV

SEQ ID NO: 467972 - protein, 9 aa, Homo Sapiens
KLIRALRYY

SEQ ID NO: 467973 - protein, 9 aa, Homo Sapiens
MLIFFIIWI

SEQ ID NO: 467974 - protein, 9 aa, Homo Sapiens
GTHRHTHTH

SEQ ID NO: 467975 - protein, 9 aa, Homo Sapiens
RYTHRHTQA

SEQ ID NO: 467976 - protein, 9 aa, Homo Sapiens
DFANMMGLV

SEQ ID NO: 467977 - protein, 9 aa, Homo Sapiens
HRNTQAHTG

SEQ ID NO: 467978 - protein, 9 aa, Homo Sapiens
DPKGNEDDS

SEQ ID NO: 467979 - protein, 9 aa, Homo Sapiens
QAQTGTHRH

SEQ ID NO: 467980 - protein, 9 aa, Homo Sapiens
SELRQNSST

SEQ ID NO: 467981 - protein, 9 aa, Homo Sapiens
QCILYMAAE

SEQ ID NO: 467982 - protein, 9 aa, Homo Sapiens
ALCWFPFNC

SEQ ID NO: 467983 - protein, 9 aa, Homo Sapiens
HTDTDTHSH

SEQ ID NO: 467984 - protein, 9 aa, Homo Sapiens
TQAYTQTHI

SEQ ID NO: 467985 - protein, 9 aa, Homo Sapiens
PIQLSRKNN

SEQ ID NO: 467986 - protein, 9 aa, Homo Sapiens
LQTLSYEKK

SEQ ID NO: 467987 - protein, 9 aa, Homo Sapiens
FADKFSFRL

SEQ ID NO: 467988 - protein, 9 aa, Homo Sapiens
GLTKCTTSA

SEQ ID NO: 467989 - protein, 9 aa, Homo Sapiens
PPMASEKYT

SEQ ID NO: 467990 - protein, 9 aa, Homo Sapiens
RQDFANMMG

SEQ ID NO: 467991 - protein, 9 aa, Homo Sapiens
CVARKLECN

SEQ ID NO: 467992 - protein, 9 aa, Homo Sapiens
EQPRDFTWQ

SEQ ID NO: 467993 - protein, 9 aa, Homo Sapiens
FQDTVNLTN

SEQ ID NO: 467994 - protein, 9 aa, Homo Sapiens
MGLNSIQGL

SEQ ID NO: 467995 - protein, 9 aa, Homo Sapiens
HTDTHRNTQ

SEQ ID NO: 467996 - protein, 9 aa, Homo Sapiens
HTHTHRYTH

SEQ ID NO: 467997 - protein, 9 aa, Homo Sapiens
ALDPKGNED

SEQ ID NO: 467998 - protein, 9 aa, Homo Sapiens
SLRKMISLC

SEQ ID NO: 467999 - protein, 9 aa, Homo Sapiens
YTGTHRHTH

SEQ ID NO: 468000 - protein, 9 aa, Homo Sapiens
PIIGYHLER

SEQ ID NO: 468001 - protein, 9 aa, Homo Sapiens
HTVVVMGGK

SEQ ID NO: 468002 - protein, 9 aa, Homo Sapiens
RLKGRKLEQ

SEQ ID NO: 468003 - protein, 9 aa, Homo Sapiens
EAAEGSTKC

SEQ ID NO: 468004 - protein, 9 aa, Homo Sapiens
RTHAYTREC

SEQ ID NO: 468005 - protein, 9 aa, Homo Sapiens
GYVICAASP

SEQ ID NO: 468006 - protein, 9 aa, Homo Sapiens
QTGTHRHIH

SEQ ID NO: 468007 - protein, 9 aa, Homo Sapiens
EEEQPRDFT

SEQ ID NO: 468008 - protein, 9 aa, Homo Sapiens
VARKLECNG

SEQ ID NO: 468009 - protein, 9 aa, Homo Sapiens
TRTLQTLSY

SEQ ID NO: 468010 - protein, 9 aa, Homo Sapiens
STKCRACAQ

SEQ ID NO: 468011 - protein, 9 aa, Homo Sapiens
SSVRAGAGS

SEQ ID NO: 468012 - protein, 9 aa, Homo Sapiens
QGPPMASEK

SEQ ID NO: 468013 - protein, 9 aa, Homo Sapiens
KEDNGYLLE

SEQ ID NO: 468014 - protein, 9 aa, Homo Sapiens
LPSSVRAGA

SEQ ID NO: 468015 - protein, 9 aa, Homo Sapiens
NMMGLVDLT

SEQ ID NO: 468016 - protein, 9 aa, Homo Sapiens
RPIQLSRKN

SEQ ID NO: 468017 - protein, 9 aa, Homo Sapiens
KENISHPRG

SEQ ID NO: 468018 - protein, 9 aa, Homo Sapiens
LPDPPEDAD

SEQ ID NO: 468019 - protein, 9 aa, Homo Sapiens
QGDPANVEI

SEQ ID NO: 468020 - protein, 9 aa, Homo Sapiens
GNEDDSYEA

SEQ ID NO: 468021 - protein, 9 aa, Homo Sapiens
DGRLPSSVR

SEQ ID NO: 468022 - protein, 9 aa, Homo Sapiens
NIVVYHVIV

SEQ ID NO: 468023 - protein, 9 aa, Homo Sapiens
PFNCYVLLL

SEQ ID NO: 468024 - protein, 9 aa, Homo Sapiens
YTRECLGTH

SEQ ID NO: 468025 - protein, 9 aa, Homo Sapiens
FPFNCYVLL

SEQ ID NO: 468026 - protein, 9 aa, Homo Sapiens
SEKYTGEED

SEQ ID NO: 468027 - protein, 9 aa, Homo Sapiens
DSQGEGSNF

SEQ ID NO: 468028 - protein, 9 aa, Homo Sapiens
SHPRGIAVH

SEQ ID NO: 468029 - protein, 9 aa, Homo Sapiens
LKCGNIVVY

SEQ ID NO: 468030 - protein, 9 aa, Homo Sapiens
YRQQDGSVQ

SEQ ID NO: 468031 - protein, 9 aa, Homo Sapiens
SVVIHVCES

SEQ ID NO: 468032 - protein, 9 aa, Homo Sapiens
DKFSFRLKG

SEQ ID NO: 468033 - protein, 9 aa, Homo Sapiens
TVVVMGGKE

SEQ ID NO: 468034 - protein, 9 aa, Homo Sapiens
PGKRRTPGD

SEQ ID NO: 468035 - protein, 9 aa, Homo Sapiens
TGMHRHTHT

SEQ ID NO: 468036 - protein, 9 aa, Homo Sapiens
SQGEGSNFG

SEQ ID NO: 468037 - protein, 9 aa, Homo Sapiens
DTVNLTNST

SEQ ID NO: 468038 - protein, 9 aa, Homo Sapiens
RQNSSTTQG

SEQ ID NO: 468039 - protein, 9 aa, Homo Sapiens
GSVQGDPAN

SEQ ID NO: 468040 - protein, 9 aa, Homo Sapiens
IQAQTGTHR

SEQ ID NO: 468041 - protein, 9 aa, Homo Sapiens
HSRTHAYTR

SEQ ID NO: 468042 - protein, 9 aa, Homo Sapiens
ADIDSLEVE

SEQ ID NO: 468043 - protein, 9 aa, Homo Sapiens
MNYDKLIRA

SEQ ID NO: 468044 - protein, 9 aa, Homo Sapiens
LRKMISLCL

SEQ ID NO: 468045 - protein, 9 aa, Homo Sapiens
HKREQDHSL

SEQ ID NO: 468046 - protein, 9 aa, Homo Sapiens
KREQDHSLS

SEQ ID NO: 468047 - protein, 9 aa, Homo Sapiens
CAASPGFWL

SEQ ID NO: 468048 - protein, 9 aa, Homo Sapiens
WFPFNCYVL

SEQ ID NO: 468049 - protein, 9 aa, Homo Sapiens
GKRRTPGDR

SEQ ID NO: 468050 - protein, 9 aa, Homo Sapiens
SMLIFFIIW

SEQ ID NO: 468051 - protein, 9 aa, Homo Sapiens
PSVVIHVCE

SEQ ID NO: 468052 - protein, 9 aa, Homo Sapiens
THRYTHRHT

SEQ ID NO: 468053 - protein, 9 aa, Homo Sapiens
KQTQCILYM

SEQ ID NO: 468054 - protein, 9 aa, Homo Sapiens
AQTGTHRHI

SEQ ID NO: 468055 - protein, 9 aa, Homo Sapiens
SLSITLAQT

SEQ ID NO: 468056 - protein, 9 aa, Homo Sapiens
ANMMGLVDL

SEQ ID NO: 468057 - protein, 9 aa, Homo Sapiens
GMHRHTHTQ

SEQ ID NO: 468058 - protein, 9 aa, Homo Sapiens
FALCWFPFN

SEQ ID NO: 468059 - protein, 9 aa, Homo Sapiens
KFSFRLKGR

SEQ ID NO: 468060 - protein, 9 aa, Homo Sapiens
VVIHVCESD

SEQ ID NO: 468061 - protein, 9 aa, Homo Sapiens
TGTHRHTHT

SEQ ID NO: 468062 - protein, 9 aa, Homo Sapiens
FVMTVYSIF

SEQ ID NO: 468063 - protein, 9 aa, Homo Sapiens
YVVMFNCSD

SEQ ID NO: 468064 - protein, 9 aa, Homo Sapiens
GNIVVYHVI

SEQ ID NO: 468065 - protein, 9 aa, Homo Sapiens
FKVKQTQCI

SEQ ID NO: 468066 - protein, 9 aa, Homo Sapiens
PAWAYAAMG

SEQ ID NO: 468067 - protein, 9 aa, Homo Sapiens
ENISHPRGI

SEQ ID NO: 468068 - protein, 9 aa, Homo Sapiens
FSFRLKGRK

SEQ ID NO: 468069 - protein, 9 aa, Homo Sapiens
TDTHRNTQA

SEQ ID NO: 468070 - protein, 9 aa, Homo Sapiens
YTHRHTQAY

SEQ ID NO: 468071 - protein, 9 aa, Homo Sapiens
VICAASPGF

SEQ ID NO: 468072 - protein, 9 aa, Homo Sapiens
QNSSTTQGQ

SEQ ID NO: 468073 - protein, 9 aa, Homo Sapiens
DVVARSSHT

SEQ ID NO: 468074 - protein, 9 aa, Homo Sapiens
VLKRPIQLS

SEQ ID NO: 468075 - protein, 9 aa, Homo Sapiens
RCVARKLEC

SEQ ID NO: 468076 - protein, 9 aa, Homo Sapiens
GSNFGGDKI

SEQ ID NO: 468077 - protein, 9 aa, Homo Sapiens
VCGLTKCTT

SEQ ID NO: 468078 - protein, 9 aa, Homo Sapiens
CLKCGNIVV

SEQ ID NO: 468079 - protein, 9 aa, Homo Sapiens
VLALDPKGN

SEQ ID NO: 468080 - protein, 9 aa, Homo Sapiens
AMGLNSIQG

SEQ ID NO: 468081 - protein, 9 aa, Homo Sapiens
GGKEDNGYL

SEQ ID NO: 468082 - protein, 9 aa, Homo Sapiens
NGYLLEKKI

SEQ ID NO: 468083 - protein, 9 aa, Homo Sapiens
LDPKGNEDD

SEQ ID NO: 468084 - protein, 9 aa, Homo Sapiens
ISHPRGIAV

SEQ ID NO: 468085 - protein, 9 aa, Homo Sapiens
CGNIVVYHV

SEQ ID NO: 468086 - protein, 9 aa, Homo Sapiens
MMGLVDLTL

SEQ ID NO: 468087 - protein, 9 aa, Homo Sapiens
LFALCWFPF

SEQ ID NO: 468088 - protein, 9 aa, Homo Sapiens
DTHSHRHTH

SEQ ID NO: 468089 - protein, 9 aa, Homo Sapiens
EDADVVARS

SEQ ID NO: 468090 - protein, 9 aa, Homo Sapiens
QTHIQAQTG

SEQ ID NO: 468091 - protein, 9 aa, Homo Sapiens
TQAHTGIHT

SEQ ID NO: 468092 - protein, 9 aa, Homo Sapiens
KRPIQLSRK

SEQ ID NO: 468093 - protein, 9 aa, Homo Sapiens
ADWGFQDTV

SEQ ID NO: 468094 - protein, 9 aa, Homo Sapiens
HMLSLSITL

SEQ ID NO: 468095 - protein, 9 aa, Homo Sapiens
HTHTQAYTL

SEQ ID NO: 468096 - protein, 9 aa, Homo Sapiens
PNMNYDKLI

SEQ ID NO: 468097 - protein, 9 aa, Homo Sapiens
PGFEAAEGS

SEQ ID NO: 468098 - protein, 9 aa, Homo Sapiens
YLVMQLVSS

SEQ ID NO: 468099 - protein, 9 aa, Homo Sapiens
PVAVLKRPI

SEQ ID NO: 468100 - protein, 9 aa, Homo Sapiens
STDSELRQN

SEQ ID NO: 468101 - protein, 9 aa, Homo Sapiens
PEDADVVAR

SEQ ID NO: 468102 - protein, 9 aa, Homo Sapiens
NYDKLIRAL

SEQ ID NO: 468103 - protein, 9 aa, Homo Sapiens
IFFIIWISF

SEQ ID NO: 468104 - protein, 9 aa, Homo Sapiens
LIRALRYYY

SEQ ID NO: 468105 - protein, 9 aa, Homo Sapiens
SLSSSSSAS

SEQ ID NO: 468106 - protein, 9 aa, Homo Sapiens
YDKLIRALR

SEQ ID NO: 468107 - protein, 9 aa, Homo Sapiens
QQQEEEQPR

SEQ ID NO: 468108 - protein, 9 aa, Homo Sapiens
RHIHSRTHA

SEQ ID NO: 468109 - protein, 9 aa, Homo Sapiens
LVCGLTKCT

SEQ ID NO: 468110 - protein, 9 aa, Homo Sapiens
SVQGDPANV

SEQ ID NO: 468111 - protein, 9 aa, Homo Sapiens
SYEKKAKKV

SEQ ID NO: 468112 - protein, 9 aa, Homo Sapiens
SCVYFVMTV

SEQ ID NO: 468113 - protein, 9 aa, Homo Sapiens
RHTHTHRYT

SEQ ID NO: 468114 - protein, 9 aa, Homo Sapiens
THRNTQAHT

SEQ ID NO: 468115 - protein, 9 aa, Homo Sapiens
TFIPADSDF

SEQ ID NO: 468116 - protein, 9 aa, Homo Sapiens
TQAYTLTYT

SEQ ID NO: 468117 - protein, 9 aa, Homo Sapiens
HSHRHTHTH

SEQ ID NO: 468118 - protein, 9 aa, Homo Sapiens
VMTVYSIFG

SEQ ID NO: 468119 - protein, 9 aa, Homo Sapiens
GSTKCRACA

SEQ ID NO: 468120 - protein, 9 aa, Homo Sapiens
MAICNPLRH

SEQ ID NO: 468121 - protein, 9 aa, Homo Sapiens
THTQAYTLT

SEQ ID NO: 468122 - protein, 9 aa, Homo Sapiens
CDSGRCVAR

SEQ ID NO: 468123 - protein, 9 aa, Homo Sapiens
YVNVADIDS

SEQ ID NO: 468124 - protein, 9 aa, Homo Sapiens
LAQTAAWRK

SEQ ID NO: 468125 - protein, 9 aa, Homo Sapiens
CLGKYVVMF

SEQ ID NO: 468126 - protein, 9 aa, Homo Sapiens
CLGTHTVVV

SEQ ID NO: 468127 - protein, 9 aa, Homo Sapiens
KGNEDDSYE

SEQ ID NO: 468128 - protein, 9 aa, Homo Sapiens
GTHRHIHSR

SEQ ID NO: 468129 - protein, 9 aa, Homo Sapiens
KRRTPGDRG

SEQ ID NO: 468130 - protein, 9 aa, Homo Sapiens
ENSCILNQI

SEQ ID NO: 468131 - protein, 9 aa, Homo Sapiens
FYVNVADID

SEQ ID NO: 468132 - protein, 9 aa, Homo Sapiens
GSPIIGYHL

SEQ ID NO: 468133 - protein, 9 aa, Homo Sapiens
HTQAYTQTH

SEQ ID NO: 468134 - protein, 9 aa, Homo Sapiens
SNFGGDKIQ

SEQ ID NO: 468135 - protein, 9 aa, Homo Sapiens
PVNNGGSPI

SEQ ID NO: 468136 - protein, 9 aa, Homo Sapiens
VKQTQCILY

SEQ ID NO: 468137 - protein, 9 aa, Homo Sapiens
LLLENSCIL

SEQ ID NO: 468138 - protein, 9 aa, Homo Sapiens
KITFIPADS

SEQ ID NO: 468139 - protein, 9 aa, Homo Sapiens
CGLTKCTTS

SEQ ID NO: 468140 - protein, 9 aa, Homo Sapiens
VYHVIVPCS

SEQ ID NO: 468141 - protein, 9 aa, Homo Sapiens
SFKVKQTQC

SEQ ID NO: 468142 - protein, 9 aa, Homo Sapiens
CTTSADVIQ

SEQ ID NO: 468143 - protein, 9 aa, Homo Sapiens
CILYMAAET

SEQ ID NO: 468144 - protein, 9 aa, Homo Sapiens
AAATAAAGG

SEQ ID NO: 468145 - protein, 9 aa, Homo Sapiens
QAYTLTYTG

SEQ ID NO: 468146 - protein, 9 aa, Homo Sapiens
GSPGKRRTP

SEQ ID NO: 468147 - protein, 9 aa, Homo Sapiens
TLAQTAAWR

SEQ ID NO: 468148 - protein, 9 aa, Homo Sapiens
GKYVVMFNC

SEQ ID NO: 468149 - protein, 9 aa, Homo Sapiens
TDSELRQNS

SEQ ID NO: 468150 - protein, 9 aa, Homo Sapiens
YEKKAKKVR

SEQ ID NO: 468151 - protein, 9 aa, Homo Sapiens
IIWISFIPA

SEQ ID NO: 468152 - protein, 9 aa, Homo Sapiens
ITLAQTAAW

SEQ ID NO: 468153 - protein, 9 aa, Homo Sapiens
DIQMQDNRD

SEQ ID NO: 468154 - protein, 9 aa, Homo Sapiens
SRQDFANMM

SEQ ID NO: 468155 - protein, 9 aa, Homo Sapiens
YGKSLRKMI

SEQ ID NO: 468156 - protein, 9 aa, Homo Sapiens
ASPGFWLLF

SEQ ID NO: 468157 - protein, 9 aa, Homo Sapiens
QLVSSGELF

SEQ ID NO: 468158 - protein, 9 aa, Homo Sapiens
FRCDSGRCV

SEQ ID NO: 468159 - protein, 9 aa, Homo Sapiens
KCTTSADVI

SEQ ID NO: 468160 - protein, 9 aa, Homo Sapiens
RTLQTLSYE

SEQ ID NO: 468161 - protein, 9 aa, Homo Sapiens
PSSVRAGAG

SEQ ID NO: 468162 - protein, 9 aa, Homo Sapiens
CVYFVMTVY

SEQ ID NO: 468163 - protein, 9 aa, Homo Sapiens
TTPSVVIHV

SEQ ID NO: 468164 - protein, 9 aa, Homo Sapiens
AQRIDIQMQ

SEQ ID NO: 468165 - protein, 9 aa, Homo Sapiens
IDSLEVEVS

SEQ ID NO: 468166 - protein, 9 aa, Homo Sapiens
WSCVYFVMT

SEQ ID NO: 468167 - protein, 9 aa, Homo Sapiens
PKGNEDDSY

SEQ ID NO: 468168 - protein, 9 aa, Homo Sapiens
KLVCGLTKC

SEQ ID NO: 468169 - protein, 9 aa, Homo Sapiens
PKITFIPAD

SEQ ID NO: 468170 - protein, 9 aa, Homo Sapiens
IVVYHVIVP

SEQ ID NO: 468171 - protein, 9 aa, Homo Sapiens
NTQAHTGIH

SEQ ID NO: 468172 - protein, 9 aa, Homo Sapiens
HPRGIAVHP

SEQ ID NO: 468173 - protein, 9 aa, Homo Sapiens
YPKITFIPA

SEQ ID NO: 468174 - protein, 9 aa, Homo Sapiens
THRHIHSRT

SEQ ID NO: 468175 - protein, 9 aa, Homo Sapiens
SVRAGAGSG

SEQ ID NO: 468176 - protein, 9 aa, Homo Sapiens
LKRPIQLSR

SEQ ID NO: 468177 - protein, 9 aa, Homo Sapiens
IWISFIPAY

SEQ ID NO: 468178 - protein, 9 aa, Homo Sapiens
QAHTGIHTD

SEQ ID NO: 468179 - protein, 9 aa, Homo Sapiens
THTVVVMGG

SEQ ID NO: 468180 - protein, 9 aa, Homo Sapiens
LGTHTVVVM

SEQ ID NO: 468181 - protein, 9 aa, Homo Sapiens
THRHTQAYT

SEQ ID NO: 468182 - protein, 9 aa, Homo Sapiens
RTPGDRGAK

SEQ ID NO: 468183 - protein, 9 aa, Homo Sapiens
AVLKRPIQL

SEQ ID NO: 468184 - protein, 9 aa, Homo Sapiens
AAEGSTKCR

SEQ ID NO: 468185 - protein, 9 aa, Homo Sapiens
SGELFDRIV

SEQ ID NO: 468186 - protein, 9 aa, Homo Sapiens
QEEEQPRDF

SEQ ID NO: 468187 - protein, 9 aa, Homo Sapiens
VYFVMTVYS

SEQ ID NO: 468188 - protein, 9 aa, Homo Sapiens
HRHTQAYTQ

SEQ ID NO: 468189 - protein, 9 aa, Homo Sapiens
HSLSSSSSA

SEQ ID NO: 468190 - protein, 9 aa, Homo Sapiens
REQDHSLSS

SEQ ID NO: 468191 - protein, 9 aa, Homo Sapiens
LALDPKGNE

SEQ ID NO: 468192 - protein, 9 aa, Homo Sapiens
NFGGDKIQL

SEQ ID NO: 468193 - protein, 9 aa, Homo Sapiens
QQEEEQPRD

SEQ ID NO: 468194 - protein, 9 aa, Homo Sapiens
RCLGKYVVM

SEQ ID NO: 468195 - protein, 9 aa, Homo Sapiens
MTVYSIFGR

SEQ ID NO: 468196 - protein, 9 aa, Homo Sapiens
HAYTRECLG

SEQ ID NO: 468197 - protein, 9 aa, Homo Sapiens
LRQNSSTTQ

SEQ ID NO: 468198 - protein, 9 aa, Homo Sapiens
YTQTHIQAQ

SEQ ID NO: 468199 - protein, 9 aa, Homo Sapiens
ITFIPADSD

SEQ ID NO: 468200 - protein, 9 aa, Homo Sapiens
VSSGELFDR

SEQ ID NO: 468201 - protein, 9 aa, Homo Sapiens
LTYTGTHRH

SEQ ID NO: 468202 - protein, 9 aa, Homo Sapiens
THTHRHTGI

SEQ ID NO: 468203 - protein, 9 aa, Homo Sapiens
GPPMASEKY

SEQ ID NO: 468204 - protein, 9 aa, Homo Sapiens
LTKCTTSAD

SEQ ID NO: 468205 - protein, 9 aa, Homo Sapiens
TQCILYMAA

SEQ ID NO: 468206 - protein, 9 aa, Homo Sapiens
GIHTDTHRN

SEQ ID NO: 468207 - protein, 9 aa, Homo Sapiens
PMASEKYTG

SEQ ID NO: 468208 - protein, 9 aa, Homo Sapiens
RIDIQMQDN

SEQ ID NO: 468209 - protein, 9 aa, Homo Sapiens
IHSRTHAYT

SEQ ID NO: 468210 - protein, 9 aa, Homo Sapiens
YFVMTVYSI

SEQ ID NO: 468211 - protein, 9 aa, Homo Sapiens
SQGSPGKRR

SEQ ID NO: 468212 - protein, 9 aa, Homo Sapiens
THTHRYTHR

SEQ ID NO: 468213 - protein, 9 aa, Homo Sapiens
FSMLIFFII

SEQ ID NO: 468214 - protein, 9 aa, Homo Sapiens
TDSQGEGSN

SEQ ID NO: 468215 - protein, 9 aa, Homo Sapiens
HTHRHTGIH

SEQ ID NO: 468216 - protein, 9 aa, Homo Sapiens
DSGRCVARK

SEQ ID NO: 468217 - protein, 9 aa, Homo Sapiens
VIHVCESDQ

SEQ ID NO: 468218 - protein, 9 aa, Homo Sapiens
RHTHTHRHT

SEQ ID NO: 468219 - protein, 9 aa, Homo Sapiens
RCDSGRCVA

SEQ ID NO: 468220 - protein, 9 aa, Homo Sapiens
VMFNCSDQM

SEQ ID NO: 468221 - protein, 9 aa, Homo Sapiens
GRLPSSVRA

SEQ ID NO: 468222 - protein, 9 aa, Homo Sapiens
IHTDTHRNT

SEQ ID NO: 468223 - protein, 9 aa, Homo Sapiens
LSYEKKAKK

SEQ ID NO: 468224 - protein, 9 aa, Homo Sapiens
FFIIWISFI

SEQ ID NO: 468225 - protein, 9 aa, Homo Sapiens
IDIQMQDNR

SEQ ID NO: 468226 - protein, 9 aa, Homo Sapiens
DTDTHSHRH

SEQ ID NO: 468227 - protein, 9 aa, Homo Sapiens
SPIIGYHLE

SEQ ID NO: 468228 - protein, 9 aa, Homo Sapiens
HTHRYTHRH

SEQ ID NO: 468229 - protein, 9 aa, Homo Sapiens
SRTHAYTRE

SEQ ID NO: 468230 - protein, 9 aa, Homo Sapiens
FIIWISFIP

SEQ ID NO: 468231 - protein, 9 aa, Homo Sapiens
LENSCILNQ

SEQ ID NO: 468232 - protein, 9 aa, Homo Sapiens
TGIHTDTDT

SEQ ID NO: 468233 - protein, 9 aa, Homo Sapiens
HTGIHTDTD

SEQ ID NO: 468234 - protein, 9 aa, Homo Sapiens
RNTQAHTGI

SEQ ID NO: 468235 - protein, 9 aa, Homo Sapiens
QCYPKITFI

SEQ ID NO: 468236 - protein, 9 aa, Homo Sapiens
HTGIHTDTH

SEQ ID NO: 468237 - protein, 9 aa, Homo Sapiens
NISHPRGIA

SEQ ID NO: 468238 - protein, 9 aa, Homo Sapiens
GEGSNFGGD

SEQ ID NO: 468239 - protein, 9 aa, Homo Sapiens
WGFQDTVNL

SEQ ID NO: 468240 - protein, 9 aa, Homo Sapiens
GRCVARKLE

SEQ ID NO: 468241 - protein, 9 aa, Homo Sapiens
TLQTLSYEK

SEQ ID NO: 468242 - protein, 9 aa, Homo Sapiens
YTLTYTGTH

SEQ ID NO: 468243 - protein, 9 aa, Homo Sapiens
CYPKITFIP

SEQ ID NO: 468244 - protein, 9 aa, Homo Sapiens
AATAAAGGG

SEQ ID NO: 468245 - protein, 9 aa, Homo Sapiens
TDTDTHSHR

SEQ ID NO: 468246 - protein, 9 aa, Homo Sapiens
TRECLGTHT

SEQ ID NO: 468247 - protein, 9 aa, Homo Sapiens
HTGMHRHTH

SEQ ID NO: 468248 - protein, 9 aa, Homo Sapiens
IHVCESDQE

SEQ ID NO: 468249 - protein, 9 aa, Homo Sapiens
EGSTKCRAC

SEQ ID NO: 468250 - protein, 9 aa, Homo Sapiens
SPGKRRTPG

SEQ ID NO: 468251 - protein, 9 aa, Homo Sapiens
IHTDTDTHS

SEQ ID NO: 468252 - protein, 9 aa, Homo Sapiens
HRHTHTHRY

SEQ ID NO: 468253 - protein, 9 aa, Homo Sapiens
LSLSITLAQ

SEQ ID NO: 468254 - protein, 9 aa, Homo Sapiens
GVQGPPMAS

SEQ ID NO: 468255 - protein, 9 aa, Homo Sapiens
MLKKYGKSL

SEQ ID NO: 468256 - protein, 9 aa, Homo Sapiens
QGSPGKRRT

SEQ ID NO: 468257 - protein, 9 aa, Homo Sapiens
ADGRLPSSV

SEQ ID NO: 468258 - protein, 9 aa, Homo Sapiens
LVMQLVSSG

SEQ ID NO: 468259 - protein, 9 aa, Homo Sapiens
EEQPRDFTW

SEQ ID NO: 468260 - protein, 9 aa, Homo Sapiens
VQGDPANVE

SEQ ID NO: 468261 - protein, 9 aa, Homo Sapiens
ADKFSFRLK

SEQ ID NO: 468262 - protein, 9 aa, Homo Sapiens
GYLLEKKIY

SEQ ID NO: 468263 - protein, 9 aa, Homo Sapiens
HTHTHRHTG

SEQ ID NO: 468264 - protein, 9 aa, Homo Sapiens
FNCYVLLLS

SEQ ID NO: 468265 - protein, 9 aa, Homo Sapiens
SFRLKGRKL

SEQ ID NO: 468266 - protein, 9 aa, Homo Sapiens
QGEGSNFGG

SEQ ID NO: 468267 - protein, 9 aa, Homo Sapiens
TKCTTSADV

SEQ ID NO: 468268 - protein, 9 aa, Homo Sapiens
LLENSCILN

SEQ ID NO: 468269 - protein, 9 aa, Homo Sapiens
DHSLSSSSS

SEQ ID NO: 468270 - protein, 9 aa, Homo Sapiens
AWAYAAMGL

SEQ ID NO: 468271 - protein, 9 aa, Homo Sapiens
VVMGGKEDN

SEQ ID NO: 468272 - protein, 9 aa, Homo Sapiens
AHTGIHTDT

SEQ ID NO: 468273 - protein, 9 aa, Homo Sapiens
QDHSLSSSS

SEQ ID NO: 468274 - protein, 9 aa, Homo Sapiens
ICAASPGFW

SEQ ID NO: 468275 - protein, 9 aa, Homo Sapiens
MASEKYTGE

SEQ ID NO: 468276 - protein, 9 aa, Homo Sapiens
QDFANMMGL

SEQ ID NO: 468277 - protein, 9 aa, Homo Sapiens
NMNYDKLIR

SEQ ID NO: 468278 - protein, 9 aa, Homo Sapiens
TDTTPSVVI

SEQ ID NO: 468279 - protein, 9 aa, Homo Sapiens
AYTRECLGT

SEQ ID NO: 468280 - protein, 9 aa, Homo Sapiens
SWSCVYFVM

SEQ ID NO: 468281 - protein, 9 aa, Homo Sapiens
SGRCVARKL

SEQ ID NO: 468282 - protein, 9 aa, Homo Sapiens
MQDNRDAQH

SEQ ID NO: 468283 - protein, 9 aa, Homo Sapiens
SHRHTHTHR

SEQ ID NO: 468284 - protein, 9 aa, Homo Sapiens
QDNRDAQHV

SEQ ID NO: 468285 - protein, 9 aa, Homo Sapiens
EDNGYLLEK

SEQ ID NO: 468286 - protein, 9 aa, Homo Sapiens
AAMGLNSIQ

SEQ ID NO: 468287 - protein, 9 aa, Homo Sapiens
QDTVNLTNS

SEQ ID NO: 468288 - protein, 9 aa, Homo Sapiens
ASEKYTGEE

SEQ ID NO: 468289 - protein, 9 aa, Homo Sapiens
CWFPFNCYV

SEQ ID NO: 468290 - protein, 9 aa, Homo Sapiens
HRHIHSRTH

SEQ ID NO: 468291 - protein, 9 aa, Homo Sapiens
PPEDADVVA

SEQ ID NO: 468292 - protein, 9 aa, Homo Sapiens
CRGYVICAA

SEQ ID NO: 468293 - protein, 9 aa, Homo Sapiens
DTTPSVVIH

SEQ ID NO: 468294 - protein, 9 aa, Homo Sapiens
LAMAFDRYM

SEQ ID NO: 468295 - protein, 9 aa, Homo Sapiens
AYTQTHIQA

SEQ ID NO: 468296 - protein, 9 aa, Homo Sapiens
ECLGTHTVV

SEQ ID NO: 468297 - protein, 9 aa, Homo Sapiens
VNNGGSPII

SEQ ID NO: 468298 - protein, 9 aa, Homo Sapiens
MGLVDLTLS

SEQ ID NO: 468299 - protein, 9 aa, Homo Sapiens
ITKENISHP

SEQ ID NO: 468300 - protein, 9 aa, Homo Sapiens
QQDGSVQGD

SEQ ID NO: 468301 - protein, 9 aa, Homo Sapiens
MHRHTHTQA

SEQ ID NO: 468302 - protein, 9 aa, Homo Sapiens
FRLKGRKLE

SEQ ID NO: 468303 - protein, 9 aa, Homo Sapiens
RLPSSVRAG

SEQ ID NO: 468304 - protein, 9 aa, Homo Sapiens
RRTPGDRGA

SEQ ID NO: 468305 - protein, 9 aa, Homo Sapiens
PDPPEDADV

SEQ ID NO: 468306 - protein, 9 aa, Homo Sapiens
DGSVQGDPA

SEQ ID NO: 468307 - protein, 9 aa, Homo Sapiens
VMGGKEDNG

SEQ ID NO: 468308 - protein, 9 aa, Homo Sapiens
GKEDNGYLL

SEQ ID NO: 468309 - protein, 9 aa, Homo Sapiens
AASPGFWLL

SEQ ID NO: 468310 - protein, 9 aa, Homo Sapiens
RHTQAYTQT

SEQ ID NO: 468311 - protein, 9 aa, Homo Sapiens
KYVVMFNCS

SEQ ID NO: 468312 - protein, 9 aa, Homo Sapiens
FANMMGLVD

SEQ ID NO: 468313 - protein, 9 aa, Homo Sapiens
NNGGSPIIG

SEQ ID NO: 468314 - protein, 9 aa, Homo Sapiens
IPADSDFQG

SEQ ID NO: 468315 - protein, 9 aa, Homo Sapiens
HIQAQTGTH

SEQ ID NO: 468316 - protein, 9 aa, Homo Sapiens
DPPEDADVV

SEQ ID NO: 468317 - protein, 9 aa, Homo Sapiens
TLSYEKKAK

SEQ ID NO: 468318 - protein, 9 aa, Homo Sapiens
LSITLAQTA

SEQ ID NO: 468319 - protein, 9 aa, Homo Sapiens
QPRDFTWQW

SEQ ID NO: 468320 - protein, 9 aa, Homo Sapiens
QDGSVQGDP

SEQ ID NO: 468321 - protein, 9 aa, Homo Sapiens
FIPADSDFQ

SEQ ID NO: 468322 - protein, 9 aa, Homo Sapiens
VQGPPMASE

SEQ ID NO: 468323 - protein, 9 aa, Homo Sapiens
LIFFIIWIS

SEQ ID NO: 468324 - protein, 9 aa, Homo Sapiens
HRHTHTQAY

SEQ ID NO: 468325 - protein, 9 aa, Homo Sapiens
RHTGMHRHT

SEQ ID NO: 468326 - protein, 9 aa, Homo Sapiens
SCILNQISN

SEQ ID NO: 468327 - protein, 9 aa, Homo Sapiens
QTQCILYMA

SEQ ID NO: 468328 - protein, 9 aa, Homo Sapiens
QAYTQTHIQ

SEQ ID NO: 468329 - protein, 9 aa, Homo Sapiens
TAAAGGGGS

SEQ ID NO: 468330 - protein, 9 aa, Homo Sapiens
KCGNIVVYH

SEQ ID NO: 468331 - protein, 9 aa, Homo Sapiens
SITLAQTAA

SEQ ID NO: 468332 - protein, 9 aa, Homo Sapiens
GIHTDTDTH

SEQ ID NO: 468333 - protein, 9 aa, Homo Sapiens
THAYTRECL

SEQ ID NO: 468334 - protein, 9 aa, Homo Sapiens
TKENISHPR

SEQ ID NO: 468335 - protein, 9 aa, Homo Sapiens
IIGYHLERK

SEQ ID NO: 468336 - protein, 9 aa, Homo Sapiens
TVNLTNSTE

SEQ ID NO: 468337 - protein, 9 aa, Homo Sapiens
DWGFQDTVN

SEQ ID NO: 468338 - protein, 9 aa, Homo Sapiens
TYTGTHRHT

SEQ ID NO: 468339 - protein, 9 aa, Homo Sapiens
DSELRQNSS

SEQ ID NO: 468340 - protein, 9 aa, Homo Sapiens
RGYVICAAS

SEQ ID NO: 468341 - protein, 9 aa, Homo Sapiens
QMQDNRDAQ

SEQ ID NO: 468342 - protein, 9 aa, Homo Sapiens
IQMQDNRDA

SEQ ID NO: 468343 - protein, 9 aa, Homo Sapiens
TLTYTGTHR

SEQ ID NO: 468344 - protein, 9 aa, Homo Sapiens
VNLTNSTEE

SEQ ID NO: 468345 - protein, 9 aa, Homo Sapiens
MLSLSITLA

SEQ ID NO: 468346 - protein, 9 aa, Homo Sapiens
QRIDIQMQD

SEQ ID NO: 468347 - protein, 9 aa, Homo Sapiens
DSLEVEVSY

SEQ ID NO: 468348 - protein, 9 aa, Homo Sapiens
IQLSRKNNI

SEQ ID NO: 468349 - protein, 9 aa, Homo Sapiens
VMQLVSSGE

SEQ ID NO: 468350 - protein, 9 aa, Homo Sapiens
ELRQNSSTT

SEQ ID NO: 468351 - protein, 9 aa, Homo Sapiens
NLLLENSCI

SEQ ID NO: 468352 - protein, 9 aa, Homo Sapiens
HRHTHTHRH

SEQ ID NO: 468353 - protein, 9 aa, Homo Sapiens
DADVVARSS

SEQ ID NO: 468354 - protein, 9 aa, Homo Sapiens
LKKYGKSLR

SEQ ID NO: 468355 - protein, 9 aa, Homo Sapiens
QTLSYEKKA

SEQ ID NO: 468356 - protein, 9 aa, Homo Sapiens
DKLIRALRY

SEQ ID NO: 468357 - protein, 9 aa, Homo Sapiens
THIQAQTGT

SEQ ID NO: 468358 - protein, 9 aa, Homo Sapiens
HIHSRTHAY

SEQ ID NO: 468359 - protein, 9 aa, Homo Sapiens
THSHRHTHT

SEQ ID NO: 468360 - protein, 9 aa, Homo Sapiens
MGGKEDNGY

SEQ ID NO: 468361 - protein, 9 aa, Homo Sapiens
IITKENISH

SEQ ID NO: 468362 - protein, 9 aa, Homo Sapiens
TGTHRHIHS

SEQ ID NO: 468363 - protein, 9 aa, Homo Sapiens
TQTHIQAQT

SEQ ID NO: 468364 - protein, 9 aa, Homo Sapiens
LSTDSELRQ

SEQ ID NO: 468365 - protein, 9 aa, Homo Sapiens
VVYHVIVPC

SEQ ID NO: 468366 - protein, 9 aa, Homo Sapiens
ATAAAGGGG

SEQ ID NO: 468367 - protein, 9 aa, Homo Sapiens
KYGKSLRKM

SEQ ID NO: 468368 - protein, 9 aa, Homo Sapiens
LSSSSSASP

SEQ ID NO: 468369 - protein, 9 aa, Homo Sapiens
MQLVSSGEL

SEQ ID NO: 468370 - protein, 9 aa, Homo Sapiens
KSLRKMISL

SEQ ID NO: 468371 - protein, 9 aa, Homo Sapiens
TDTHSHRHT

SEQ ID NO: 468372 - protein, 9 aa, Homo Sapiens
HRHTGMHRH

SEQ ID NO: 468373 - protein, 9 aa, Homo Sapiens
FNLLLENSC

SEQ ID NO: 468374 - protein, 9 aa, Homo Sapiens
VVVMGGKED

SEQ ID NO: 468375 - protein, 9 aa, Homo Sapiens
TLFENDHHF

SEQ ID NO: 468376 - protein, 9 aa, Homo Sapiens
GPALAEPHL

SEQ ID NO: 468377 - protein, 9 aa, Homo Sapiens
HWMHQEVSF

SEQ ID NO: 468378 - protein, 9 aa, Homo Sapiens
HGQTGHHQQ

SEQ ID NO: 468379 - protein, 9 aa, Homo Sapiens
ETKWSSDTH

SEQ ID NO: 468380 - protein, 9 aa, Homo Sapiens
TVTPNPTPT

SEQ ID NO: 468381 - protein, 9 aa, Homo Sapiens
HHFSHLSSL

SEQ ID NO: 468382 - protein, 9 aa, Homo Sapiens
QKEMKARKI

SEQ ID NO: 468383 - protein, 9 aa, Homo Sapiens
QSVSGHGQT

SEQ ID NO: 468384 - protein, 9 aa, Homo Sapiens
ERKVLEKNV

SEQ ID NO: 468385 - protein, 9 aa, Homo Sapiens
GWHPISQII

SEQ ID NO: 468386 - protein, 9 aa, Homo Sapiens
VTPNPTPTG

SEQ ID NO: 468387 - protein, 9 aa, Homo Sapiens
TKRKFCYQQ

SEQ ID NO: 468388 - protein, 9 aa, Homo Sapiens
TKWSSDTHL

SEQ ID NO: 468389 - protein, 9 aa, Homo Sapiens
LNTTDILTA

SEQ ID NO: 468390 - protein, 9 aa, Homo Sapiens
KVLEKNVAL

SEQ ID NO: 468391 - protein, 9 aa, Homo Sapiens
NPTPTGTQT

SEQ ID NO: 468392 - protein, 9 aa, Homo Sapiens
LLNDWQKEM

SEQ ID NO: 468393 - protein, 9 aa, Homo Sapiens
YIHCHVIGY

SEQ ID NO: 468394 - protein, 9 aa, Homo Sapiens
SGPALAEPH

SEQ ID NO: 468395 - protein, 9 aa, Homo Sapiens
LNDWQKEMK

SEQ ID NO: 468396 - protein, 9 aa, Homo Sapiens
VKNDTKRKF

SEQ ID NO: 468397 - protein, 9 aa, Homo Sapiens
GQPLGWHPI

SEQ ID NO: 468398 - protein, 9 aa, Homo Sapiens
TGHHQQSHQ

SEQ ID NO: 468399 - protein, 9 aa, Homo Sapiens
NDTKRKFCY

SEQ ID NO: 468400 - protein, 9 aa, Homo Sapiens
TTTTTVTPN

SEQ ID NO: 468401 - protein, 9 aa, Homo Sapiens
KNVALSKKR

SEQ ID NO: 468402 - protein, 9 aa, Homo Sapiens
SVSGHGQTG

SEQ ID NO: 468403 - protein, 9 aa, Homo Sapiens
RDPGQPLGW

SEQ ID NO: 468404 - protein, 9 aa, Homo Sapiens
GHGQTGHHQ

SEQ ID NO: 468405 - protein, 9 aa, Homo Sapiens
RDTYIHCHV

SEQ ID NO: 468406 - protein, 9 aa, Homo Sapiens
HVIGYPYYS

SEQ ID NO: 468407 - protein, 9 aa, Homo Sapiens
GQTGHHQQS

SEQ ID NO: 468408 - protein, 9 aa, Homo Sapiens
SGHGQTGHH

SEQ ID NO: 468409 - protein, 9 aa, Homo Sapiens
THLQQAQAL

SEQ ID NO: 468410 - protein, 9 aa, Homo Sapiens
TPNPTPTGT

SEQ ID NO: 468411 - protein, 9 aa, Homo Sapiens
DTHLQQAQA

SEQ ID NO: 468412 - protein, 9 aa, Homo Sapiens
VGASGPALA

SEQ ID NO: 468413 - protein, 9 aa, Homo Sapiens
IHCHVIGYP

SEQ ID NO: 468414 - protein, 9 aa, Homo Sapiens
LLLNDWQKE

SEQ ID NO: 468415 - protein, 9 aa, Homo Sapiens
HCHVIGYPY

SEQ ID NO: 468416 - protein, 9 aa, Homo Sapiens
HQEVSFGKL

SEQ ID NO: 468417 - protein, 9 aa, Homo Sapiens
DPLGGLNTT

SEQ ID NO: 468418 - protein, 9 aa, Homo Sapiens
KERKVLEKN

SEQ ID NO: 468419 - protein, 9 aa, Homo Sapiens
EVGASGPAL

SEQ ID NO: 468420 - protein, 9 aa, Homo Sapiens
VSGHGQTGH

SEQ ID NO: 468421 - protein, 9 aa, Homo Sapiens
PNPTPTGTQ

SEQ ID NO: 468422 - protein, 9 aa, Homo Sapiens
DPGQPLGWH

SEQ ID NO: 468423 - protein, 9 aa, Homo Sapiens
AVKNDTKRK

SEQ ID NO: 468424 - protein, 9 aa, Homo Sapiens
KNDTKRKFC

SEQ ID NO: 468425 - protein, 9 aa, Homo Sapiens
TTTVTPNPT

SEQ ID NO: 468426 - protein, 9 aa, Homo Sapiens
VTLFENDHH

SEQ ID NO: 468427 - protein, 9 aa, Homo Sapiens
TYIHCHVIG

SEQ ID NO: 468428 - protein, 9 aa, Homo Sapiens
CHVIGYPYY

SEQ ID NO: 468429 - protein, 9 aa, Homo Sapiens
NDWQKEMKA

SEQ ID NO: 468430 - protein, 9 aa, Homo Sapiens
PNTGAHWMH

SEQ ID NO: 468431 - protein, 9 aa, Homo Sapiens
RDLLLNDWQ

SEQ ID NO: 468432 - protein, 9 aa, Homo Sapiens
QTGHHQQSH

SEQ ID NO: 468433 - protein, 9 aa, Homo Sapiens
WMHQEVSFG

SEQ ID NO: 468434 - protein, 9 aa, Homo Sapiens
FENDHHFSH

SEQ ID NO: 468435 - protein, 9 aa, Homo Sapiens
TDILTAIRN

SEQ ID NO: 468436 - protein, 9 aa, Homo Sapiens
LEKNVALSK

SEQ ID NO: 468437 - protein, 9 aa, Homo Sapiens
TTVTPNPTP

SEQ ID NO: 468438 - protein, 9 aa, Homo Sapiens
PLGGLNTTD

SEQ ID NO: 468439 - protein, 9 aa, Homo Sapiens
NTTDILTAI

SEQ ID NO: 468440 - protein, 9 aa, Homo Sapiens
RKVLEKNVA

SEQ ID NO: 468441 - protein, 9 aa, Homo Sapiens
GGLNTTDIL

SEQ ID NO: 468442 - protein, 9 aa, Homo Sapiens
TTTTVTPNP

SEQ ID NO: 468443 - protein, 9 aa, Homo Sapiens
NTGAHWMHQ

SEQ ID NO: 468444 - protein, 9 aa, Homo Sapiens
TGAHWMHQE

SEQ ID NO: 468445 - protein, 9 aa, Homo Sapiens
LGGLNTTDI

SEQ ID NO: 468446 - protein, 9 aa, Homo Sapiens
DHHFSHLSS

SEQ ID NO: 468447 - protein, 9 aa, Homo Sapiens
ENDHHFSHL

SEQ ID NO: 468448 - protein, 9 aa, Homo Sapiens
KWSSDTHLQ

SEQ ID NO: 468449 - protein, 9 aa, Homo Sapiens
LFENDHHFS

SEQ ID NO: 468450 - protein, 9 aa, Homo Sapiens
NVALSKKRK

SEQ ID NO: 468451 - protein, 9 aa, Homo Sapiens
TTDILTAIR

SEQ ID NO: 468452 - protein, 9 aa, Homo Sapiens
WHPISQIIP

SEQ ID NO: 468453 - protein, 9 aa, Homo Sapiens
EKNVALSKK

SEQ ID NO: 468454 - protein, 9 aa, Homo Sapiens
QPLGWHPIS

SEQ ID NO: 468455 - protein, 9 aa, Homo Sapiens
LVTLFENDH

SEQ ID NO: 468456 - protein, 9 aa, Homo Sapiens
WQKEMKARK

SEQ ID NO: 468457 - protein, 9 aa, Homo Sapiens
SSDTHLQQA

SEQ ID NO: 468458 - protein, 9 aa, Homo Sapiens
PGQPLGWHP

SEQ ID NO: 468459 - protein, 9 aa, Homo Sapiens
ASGPALAEP

SEQ ID NO: 468460 - protein, 9 aa, Homo Sapiens
DTYIHCHVI

SEQ ID NO: 468461 - protein, 9 aa, Homo Sapiens
DTKRKFCYQ

SEQ ID NO: 468462 - protein, 9 aa, Homo Sapiens
GLNTTDILT

SEQ ID NO: 468463 - protein, 9 aa, Homo Sapiens
KRKFCYQQL

SEQ ID NO: 468464 - protein, 9 aa, Homo Sapiens
HLQQAQALR

SEQ ID NO: 468465 - protein, 9 aa, Homo Sapiens
LGWHPISQI

SEQ ID NO: 468466 - protein, 9 aa, Homo Sapiens
HAAVKNDTK

SEQ ID NO: 468467 - protein, 9 aa, Homo Sapiens
GRDTYIHCH

SEQ ID NO: 468468 - protein, 9 aa, Homo Sapiens
PLGWHPISQ

SEQ ID NO: 468469 - protein, 9 aa, Homo Sapiens
MHQEVSFGK

SEQ ID NO: 468470 - protein, 9 aa, Homo Sapiens
SDTHLQQAQ

SEQ ID NO: 468471 - protein, 9 aa, Homo Sapiens
AAVKNDTKR

SEQ ID NO: 468472 - protein, 9 aa, Homo Sapiens
GASGPALAE

SEQ ID NO: 468473 - protein, 9 aa, Homo Sapiens
WSSDTHLQQ

SEQ ID NO: 468474 - protein, 9 aa, Homo Sapiens
GAHWMHQEV

SEQ ID NO: 468475 - protein, 9 aa, Homo Sapiens
NDHHFSHLS

SEQ ID NO: 468476 - protein, 9 aa, Homo Sapiens
VLEKNVALS

SEQ ID NO: 468477 - protein, 9 aa, Homo Sapiens
DWQKEMKAR

SEQ ID NO: 468478 - protein, 9 aa, Homo Sapiens
DLLLNDWQK

SEQ ID NO: 468479 - protein, 9 aa, Homo Sapiens
AHWMHQEVS

SEQ ID NO: 468480 - protein, 9 aa, Homo Sapiens
LSRAVRTML

SEQ ID NO: 468481 - protein, 9 aa, Homo Sapiens
SPYMVASMR

SEQ ID NO: 468482 - protein, 9 aa, Homo Sapiens
VSLTSGYAI

SEQ ID NO: 468483 - protein, 9 aa, Homo Sapiens
QMMIYVKFD

SEQ ID NO: 468484 - protein, 9 aa, Homo Sapiens
QTQKVKRKA

SEQ ID NO: 468485 - protein, 9 aa, Homo Sapiens
HSPTSSEDE

SEQ ID NO: 468486 - protein, 9 aa, Homo Sapiens
YTYQGSGML

SEQ ID NO: 468487 - protein, 9 aa, Homo Sapiens
YLQRKCVNE

SEQ ID NO: 468488 - protein, 9 aa, Homo Sapiens
PWWEAHFFF

SEQ ID NO: 468489 - protein, 9 aa, Homo Sapiens
NLVEIHLDA

SEQ ID NO: 468490 - protein, 9 aa, Homo Sapiens
MLNLFPEEY

SEQ ID NO: 468491 - protein, 9 aa, Homo Sapiens
LYGQMMIYV

SEQ ID NO: 468492 - protein, 9 aa, Homo Sapiens
SGYAIIRTP

SEQ ID NO: 468493 - protein, 9 aa, Homo Sapiens
PPDNQSSAP

SEQ ID NO: 468494 - protein, 9 aa, Homo Sapiens
ITTATTVTP

SEQ ID NO: 468495 - protein, 9 aa, Homo Sapiens
KVKRKAQFA

SEQ ID NO: 468496 - protein, 9 aa, Homo Sapiens
TMLNLFPEE

SEQ ID NO: 468497 - protein, 9 aa, Homo Sapiens
PIRVSRKGW

SEQ ID NO: 468498 - protein, 9 aa, Homo Sapiens
RTMLNLFPE

SEQ ID NO: 468499 - protein, 9 aa, Homo Sapiens
NFQRILNLK

SEQ ID NO: 468500 - protein, 9 aa, Homo Sapiens
TTPITTATT

SEQ ID NO: 468501 - protein, 9 aa, Homo Sapiens
PKETPLHLV

SEQ ID NO: 468502 - protein, 9 aa, Homo Sapiens
EAAEKEIPM

SEQ ID NO: 468503 - protein, 9 aa, Homo Sapiens
RSTPCHSVK

SEQ ID NO: 468504 - protein, 9 aa, Homo Sapiens
TNLQTQKVK

SEQ ID NO: 468505 - protein, 9 aa, Homo Sapiens
QLSSLCVCN

SEQ ID NO: 468506 - protein, 9 aa, Homo Sapiens
FSNLVEIHL

SEQ ID NO: 468507 - protein, 9 aa, Homo Sapiens
KETPLHLVV

SEQ ID NO: 468508 - protein, 9 aa, Homo Sapiens
LLPEPPDNQ

SEQ ID NO: 468509 - protein, 9 aa, Homo Sapiens
AEKEIPMAP

SEQ ID NO: 468510 - protein, 9 aa, Homo Sapiens
VRTMLNLFP

SEQ ID NO: 468511 - protein, 9 aa, Homo Sapiens
KELDPILEP

SEQ ID NO: 468512 - protein, 9 aa, Homo Sapiens
FAEICLNTE

SEQ ID NO: 468513 - protein, 9 aa, Homo Sapiens
HADNYRCRY

SEQ ID NO: 468514 - protein, 9 aa, Homo Sapiens
LVEIHLDAI

SEQ ID NO: 468515 - protein, 9 aa, Homo Sapiens
YGQMMIYVK

SEQ ID NO: 468516 - protein, 9 aa, Homo Sapiens
PHSPTSSED

SEQ ID NO: 468517 - protein, 9 aa, Homo Sapiens
TYTYQGSGM

SEQ ID NO: 468518 - protein, 9 aa, Homo Sapiens
PVLLENVGK

SEQ ID NO: 468519 - protein, 9 aa, Homo Sapiens
NTYTYQGSG

SEQ ID NO: 468520 - protein, 9 aa, Homo Sapiens
IHLDAIKMV

SEQ ID NO: 468521 - protein, 9 aa, Homo Sapiens
LPEPPDNQS

SEQ ID NO: 468522 - protein, 9 aa, Homo Sapiens
YTHSFTPGY

SEQ ID NO: 468523 - protein, 9 aa, Homo Sapiens
ALSEVENDR

SEQ ID NO: 468524 - protein, 9 aa, Homo Sapiens
AAGAFLYDN

SEQ ID NO: 468525 - protein, 9 aa, Homo Sapiens
SMCVQLAGA

SEQ ID NO: 468526 - protein, 9 aa, Homo Sapiens
WWEAHFFFF

SEQ ID NO: 468527 - protein, 9 aa, Homo Sapiens
EIPMAPPKK

SEQ ID NO: 468528 - protein, 9 aa, Homo Sapiens
SGLTKYSTL

SEQ ID NO: 468529 - protein, 9 aa, Homo Sapiens
LRAAAEAAL

SEQ ID NO: 468530 - protein, 9 aa, Homo Sapiens
TPSGLTKYS

SEQ ID NO: 468531 - protein, 9 aa, Homo Sapiens
LENVGKELD

SEQ ID NO: 468532 - protein, 9 aa, Homo Sapiens
EEAQNFQRI

SEQ ID NO: 468533 - protein, 9 aa, Homo Sapiens
AGAFLYDNW

SEQ ID NO: 468534 - protein, 9 aa, Homo Sapiens
TDSPYMVAS

SEQ ID NO: 468535 - protein, 9 aa, Homo Sapiens
GAVPLPLPS

SEQ ID NO: 468536 - protein, 9 aa, Homo Sapiens
PYMVASMRI

SEQ ID NO: 468537 - protein, 9 aa, Homo Sapiens
PFVYTHSFT

SEQ ID NO: 468538 - protein, 9 aa, Homo Sapiens
QYRSTPCHS

SEQ ID NO: 468539 - protein, 9 aa, Homo Sapiens
LLENVGKEL

SEQ ID NO: 468540 - protein, 9 aa, Homo Sapiens
LNHSPIRVS

SEQ ID NO: 468541 - protein, 9 aa, Homo Sapiens
PDNQSSAPP

SEQ ID NO: 468542 - protein, 9 aa, Homo Sapiens
TTAAGAFLY

SEQ ID NO: 468543 - protein, 9 aa, Homo Sapiens
PKFRTFAEI

SEQ ID NO: 468544 - protein, 9 aa, Homo Sapiens
AYLQRKCVN

SEQ ID NO: 468545 - protein, 9 aa, Homo Sapiens
RYGTLMSRS

SEQ ID NO: 468546 - protein, 9 aa, Homo Sapiens
EGADTPVYL

SEQ ID NO: 468547 - protein, 9 aa, Homo Sapiens
PCHSVKHGD

SEQ ID NO: 468548 - protein, 9 aa, Homo Sapiens
TPLHLVVIN

SEQ ID NO: 468549 - protein, 9 aa, Homo Sapiens
DNYRCRYRS

SEQ ID NO: 468550 - protein, 9 aa, Homo Sapiens
LPGAVPLPL

SEQ ID NO: 468551 - protein, 9 aa, Homo Sapiens
EAQNFQRIL

SEQ ID NO: 468552 - protein, 9 aa, Homo Sapiens
YGTLMSRSM

SEQ ID NO: 468553 - protein, 9 aa, Homo Sapiens
LRMQLSSLC

SEQ ID NO: 468554 - protein, 9 aa, Homo Sapiens
HPWWEAHFF

SEQ ID NO: 468555 - protein, 9 aa, Homo Sapiens
PEPPDNQSS

SEQ ID NO: 468556 - protein, 9 aa, Homo Sapiens
DPKFRTFAE

SEQ ID NO: 468557 - protein, 9 aa, Homo Sapiens
AAAEAALSQ

SEQ ID NO: 468558 - protein, 9 aa, Homo Sapiens
WEAHFFFFF

SEQ ID NO: 468559 - protein, 9 aa, Homo Sapiens
TKYSTLTLC

SEQ ID NO: 468560 - protein, 9 aa, Homo Sapiens
SLCVCNSHC

SEQ ID NO: 468561 - protein, 9 aa, Homo Sapiens
IELTDSPYM

SEQ ID NO: 468562 - protein, 9 aa, Homo Sapiens
LSEVENDRK

SEQ ID NO: 468563 - protein, 9 aa, Homo Sapiens
PTTTPITTA

SEQ ID NO: 468564 - protein, 9 aa, Homo Sapiens
KEIPMAPPK

SEQ ID NO: 468565 - protein, 9 aa, Homo Sapiens
YRSTPCHSV

SEQ ID NO: 468566 - protein, 9 aa, Homo Sapiens
MIYVKFDKN

SEQ ID NO: 468567 - protein, 9 aa, Homo Sapiens
NLQTQKVKR

SEQ ID NO: 468568 - protein, 9 aa, Homo Sapiens
ETPLHLVVI

SEQ ID NO: 468569 - protein, 9 aa, Homo Sapiens
IFVGPQHAD

SEQ ID NO: 468570 - protein, 9 aa, Homo Sapiens
VENDRKMFL

SEQ ID NO: 468571 - protein, 9 aa, Homo Sapiens
IPMAPPKKP

SEQ ID NO: 468572 - protein, 9 aa, Homo Sapiens
SRSMCVQLA

SEQ ID NO: 468573 - protein, 9 aa, Homo Sapiens
HQKVEPKET

SEQ ID NO: 468574 - protein, 9 aa, Homo Sapiens
NIPFVYTHS

SEQ ID NO: 468575 - protein, 9 aa, Homo Sapiens
YMVASMRIM

SEQ ID NO: 468576 - protein, 9 aa, Homo Sapiens
LCVCNSHCV

SEQ ID NO: 468577 - protein, 9 aa, Homo Sapiens
PMAPPKKPE

SEQ ID NO: 468578 - protein, 9 aa, Homo Sapiens
KVEPKETPL

SEQ ID NO: 468579 - protein, 9 aa, Homo Sapiens
KSPEEGADT

SEQ ID NO: 468580 - protein, 9 aa, Homo Sapiens
EPPDNQSSA

SEQ ID NO: 468581 - protein, 9 aa, Homo Sapiens
GQMMIYVKF

SEQ ID NO: 468582 - protein, 9 aa, Homo Sapiens
FVGPQHADN

SEQ ID NO: 468583 - protein, 9 aa, Homo Sapiens
GAFLYDNWV

SEQ ID NO: 468584 - protein, 9 aa, Homo Sapiens
ENVGKELDP

SEQ ID NO: 468585 - protein, 9 aa, Homo Sapiens
KYSTLTLCQ

SEQ ID NO: 468586 - protein, 9 aa, Homo Sapiens
IYVKFDKNV

SEQ ID NO: 468587 - protein, 9 aa, Homo Sapiens
EAALSQTGF

SEQ ID NO: 468588 - protein, 9 aa, Homo Sapiens
ADNYRCRYR

SEQ ID NO: 468589 - protein, 9 aa, Homo Sapiens
LQTQKVKRK

SEQ ID NO: 468590 - protein, 9 aa, Homo Sapiens
GTLMSRSMC

SEQ ID NO: 468591 - protein, 9 aa, Homo Sapiens
ILNHSPIRV

SEQ ID NO: 468592 - protein, 9 aa, Homo Sapiens
SLTSGYAII

SEQ ID NO: 468593 - protein, 9 aa, Homo Sapiens
NHSPIRVSR

SEQ ID NO: 468594 - protein, 9 aa, Homo Sapiens
PTPSGLTKY

SEQ ID NO: 468595 - protein, 9 aa, Homo Sapiens
QHADNYRCR

SEQ ID NO: 468596 - protein, 9 aa, Homo Sapiens
AQNFQRILN

SEQ ID NO: 468597 - protein, 9 aa, Homo Sapiens
CHSVKHGDE

SEQ ID NO: 468598 - protein, 9 aa, Homo Sapiens
QKVEPKETP

SEQ ID NO: 468599 - protein, 9 aa, Homo Sapiens
NQSSAPPRK

SEQ ID NO: 468600 - protein, 9 aa, Homo Sapiens
LALSEVEND

SEQ ID NO: 468601 - protein, 9 aa, Homo Sapiens
TPITTATTV

SEQ ID NO: 468602 - protein, 9 aa, Homo Sapiens
RKCVNELNQ

SEQ ID NO: 468603 - protein, 9 aa, Homo Sapiens
VEIHLDAIK

SEQ ID NO: 468604 - protein, 9 aa, Homo Sapiens
GYAIIRTPM

SEQ ID NO: 468605 - protein, 9 aa, Homo Sapiens
PSGLTKYST

SEQ ID NO: 468606 - protein, 9 aa, Homo Sapiens
EALALSEVE

SEQ ID NO: 468607 - protein, 9 aa, Homo Sapiens
EEGADTPVY

SEQ ID NO: 468608 - protein, 9 aa, Homo Sapiens
ADTPVYLAL

SEQ ID NO: 468609 - protein, 9 aa, Homo Sapiens
LNTYTYQGS

SEQ ID NO: 468610 - protein, 9 aa, Homo Sapiens
PQTAYLQRK

SEQ ID NO: 468611 - protein, 9 aa, Homo Sapiens
FRTFAEICL

SEQ ID NO: 468612 - protein, 9 aa, Homo Sapiens
ENDRKMFLF

SEQ ID NO: 468613 - protein, 9 aa, Homo Sapiens
ATTVTPTPT

SEQ ID NO: 468614 - protein, 9 aa, Homo Sapiens
VLLENVGKE

SEQ ID NO: 468615 - protein, 9 aa, Homo Sapiens
ITYILNHSP

SEQ ID NO: 468616 - protein, 9 aa, Homo Sapiens
ALALSEVEN

SEQ ID NO: 468617 - protein, 9 aa, Homo Sapiens
AVRTMLNLF

SEQ ID NO: 468618 - protein, 9 aa, Homo Sapiens
SRAVRTMLN

SEQ ID NO: 468619 - protein, 9 aa, Homo Sapiens
THSFTPGYS

SEQ ID NO: 468620 - protein, 9 aa, Homo Sapiens
LSQTGFSYD

SEQ ID NO: 468621 - protein, 9 aa, Homo Sapiens
VLNTYTYQG

SEQ ID NO: 468622 - protein, 9 aa, Homo Sapiens
FTNLQTQKV

SEQ ID NO: 468623 - protein, 9 aa, Homo Sapiens
NGPVLNTYT

SEQ ID NO: 468624 - protein, 9 aa, Homo Sapiens
EAHFFFFFF

SEQ ID NO: 468625 - protein, 9 aa, Homo Sapiens
SPIRVSRKG

SEQ ID NO: 468626 - protein, 9 aa, Homo Sapiens
TKSPEEGAD

SEQ ID NO: 468627 - protein, 9 aa, Homo Sapiens
MPHSPTSSE

SEQ ID NO: 468628 - protein, 9 aa, Homo Sapiens
TPCHSVKHG

SEQ ID NO: 468629 - protein, 9 aa, Homo Sapiens
RMQLSSLCV

SEQ ID NO: 468630 - protein, 9 aa, Homo Sapiens
PLPLPSALP

SEQ ID NO: 468631 - protein, 9 aa, Homo Sapiens
KFRTFAEIC

SEQ ID NO: 468632 - protein, 9 aa, Homo Sapiens
LPLPSALPA

SEQ ID NO: 468633 - protein, 9 aa, Homo Sapiens
YVKFDKNVY

SEQ ID NO: 468634 - protein, 9 aa, Homo Sapiens
FQYRSTPCH

SEQ ID NO: 468635 - protein, 9 aa, Homo Sapiens
LNLFPEEYN

SEQ ID NO: 468636 - protein, 9 aa, Homo Sapiens
GADTPVYLA

SEQ ID NO: 468637 - protein, 9 aa, Homo Sapiens
SPEEGADTP

SEQ ID NO: 468638 - protein, 9 aa, Homo Sapiens
EKEIPMAPP

SEQ ID NO: 468639 - protein, 9 aa, Homo Sapiens
PLPGAVPLP

SEQ ID NO: 468640 - protein, 9 aa, Homo Sapiens
FNIPFVYTH

SEQ ID NO: 468641 - protein, 9 aa, Homo Sapiens
RESEEAQNF

SEQ ID NO: 468642 - protein, 9 aa, Homo Sapiens
GEVSLTSGY

SEQ ID NO: 468643 - protein, 9 aa, Homo Sapiens
YAIIRTPMG

SEQ ID NO: 468644 - protein, 9 aa, Homo Sapiens
ARESEEAQN

SEQ ID NO: 468645 - protein, 9 aa, Homo Sapiens
GPQHADNYR

SEQ ID NO: 468646 - protein, 9 aa, Homo Sapiens
QSSAPPRKD

SEQ ID NO: 468647 - protein, 9 aa, Homo Sapiens
VKRKAQFAA

SEQ ID NO: 468648 - protein, 9 aa, Homo Sapiens
ESEEAQNFQ

SEQ ID NO: 468649 - protein, 9 aa, Homo Sapiens
RAVRTMLNL

SEQ ID NO: 468650 - protein, 9 aa, Homo Sapiens
SEEAQNFQR

SEQ ID NO: 468651 - protein, 9 aa, Homo Sapiens
PVLNTYTYQ

SEQ ID NO: 468652 - protein, 9 aa, Homo Sapiens
VKFDKNVYL

SEQ ID NO: 468653 - protein, 9 aa, Homo Sapiens
IPFVYTHSF

SEQ ID NO: 468654 - protein, 9 aa, Homo Sapiens
TFAEICLNT

SEQ ID NO: 468655 - protein, 9 aa, Homo Sapiens
DSPYMVASM

SEQ ID NO: 468656 - protein, 9 aa, Homo Sapiens
EVENDRKMF

SEQ ID NO: 468657 - protein, 9 aa, Homo Sapiens
STPCHSVKH

SEQ ID NO: 468658 - protein, 9 aa, Homo Sapiens
AFLYDNWVL

SEQ ID NO: 468659 - protein, 9 aa, Homo Sapiens
ALSQTGFSY

SEQ ID NO: 468660 - protein, 9 aa, Homo Sapiens
TLMSRSMCV

SEQ ID NO: 468661 - protein, 9 aa, Homo Sapiens
MSRSMCVQL

SEQ ID NO: 468662 - protein, 9 aa, Homo Sapiens
AALSQTGFS

SEQ ID NO: 468663 - protein, 9 aa, Homo Sapiens
NVGKELDPI

SEQ ID NO: 468664 - protein, 9 aa, Homo Sapiens
YILNHSPIR

SEQ ID NO: 468665 - protein, 9 aa, Homo Sapiens
PQHADNYRC

SEQ ID NO: 468666 - protein, 9 aa, Homo Sapiens
PGAVPLPLP

SEQ ID NO: 468667 - protein, 9 aa, Homo Sapiens
GTTAAGAFL

SEQ ID NO: 468668 - protein, 9 aa, Homo Sapiens
TSGYAIIRT

SEQ ID NO: 468669 - protein, 9 aa, Homo Sapiens
VPLPLPSAL

SEQ ID NO: 468670 - protein, 9 aa, Homo Sapiens
EIHLDAIKM

SEQ ID NO: 468671 - protein, 9 aa, Homo Sapiens
PEEGADTPV

SEQ ID NO: 468672 - protein, 9 aa, Homo Sapiens
PITTATTVT

SEQ ID NO: 468673 - protein, 9 aa, Homo Sapiens
TAYLQRKCV

SEQ ID NO: 468674 - protein, 9 aa, Homo Sapiens
RPLPGAVPL

SEQ ID NO: 468675 - protein, 9 aa, Homo Sapiens
AAEKEIPMA

SEQ ID NO: 468676 - protein, 9 aa, Homo Sapiens
EPKETPLHL

SEQ ID NO: 468677 - protein, 9 aa, Homo Sapiens
ELTDSPYMV

SEQ ID NO: 468678 - protein, 9 aa, Homo Sapiens
TTTPITTAT

SEQ ID NO: 468679 - protein, 9 aa, Homo Sapiens
GLTKYSTLT

SEQ ID NO: 468680 - protein, 9 aa, Homo Sapiens
RTFAEICLN

SEQ ID NO: 468681 - protein, 9 aa, Homo Sapiens
MMIYVKFDK

SEQ ID NO: 468682 - protein, 9 aa, Homo Sapiens
HSPIRVSRK

SEQ ID NO: 468683 - protein, 9 aa, Homo Sapiens
TQKVKRKAQ

SEQ ID NO: 468684 - protein, 9 aa, Homo Sapiens
VGKELDPIL

SEQ ID NO: 468685 - protein, 9 aa, Homo Sapiens
LDPKFRTFA

SEQ ID NO: 468686 - protein, 9 aa, Homo Sapiens
SNGPVLNTY

SEQ ID NO: 468687 - protein, 9 aa, Homo Sapiens
LTSGYAIIR

SEQ ID NO: 468688 - protein, 9 aa, Homo Sapiens
LTDSPYMVA

SEQ ID NO: 468689 - protein, 9 aa, Homo Sapiens
LFNIPFVYT

SEQ ID NO: 468690 - protein, 9 aa, Homo Sapiens
TTATTVTPT

SEQ ID NO: 468691 - protein, 9 aa, Homo Sapiens
RPQTAYLQR

SEQ ID NO: 468692 - protein, 9 aa, Homo Sapiens
VGPQHADNY

SEQ ID NO: 468693 - protein, 9 aa, Homo Sapiens
VEPKETPLH

SEQ ID NO: 468694 - protein, 9 aa, Homo Sapiens
AVPLPLPSA

SEQ ID NO: 468695 - protein, 9 aa, Homo Sapiens
FLYDNWVLT

SEQ ID NO: 468696 - protein, 9 aa, Homo Sapiens
LQRKCVNEL

SEQ ID NO: 468697 - protein, 9 aa, Homo Sapiens
TATTVTPTP

SEQ ID NO: 468698 - protein, 9 aa, Homo Sapiens
RSMCVQLAG

SEQ ID NO: 468699 - protein, 9 aa, Homo Sapiens
LSSLCVCNS

SEQ ID NO: 468700 - protein, 9 aa, Homo Sapiens
TAAGAFLYD

SEQ ID NO: 468701 - protein, 9 aa, Homo Sapiens
ALRMQLSSL

SEQ ID NO: 468702 - protein, 9 aa, Homo Sapiens
QKVKRKAQF

SEQ ID NO: 468703 - protein, 9 aa, Homo Sapiens
LTKYSTLTL

SEQ ID NO: 468704 - protein, 9 aa, Homo Sapiens
MVASMRIMT

SEQ ID NO: 468705 - protein, 9 aa, Homo Sapiens
QTAYLQRKC

SEQ ID NO: 468706 - protein, 9 aa, Homo Sapiens
MAPPKKPEA

SEQ ID NO: 468707 - protein, 9 aa, Homo Sapiens
TLDPKFRTF

SEQ ID NO: 468708 - protein, 9 aa, Homo Sapiens
RAAAEAALS

SEQ ID NO: 468709 - protein, 9 aa, Homo Sapiens
QRKCVNELN

SEQ ID NO: 468710 - protein, 9 aa, Homo Sapiens
LFSNLVEIH

SEQ ID NO: 468711 - protein, 9 aa, Homo Sapiens
GPVLNTYTY

SEQ ID NO: 468712 - protein, 9 aa, Homo Sapiens
AAEAALSQT

SEQ ID NO: 468713 - protein, 9 aa, Homo Sapiens
HLDAIKMVW

SEQ ID NO: 468714 - protein, 9 aa, Homo Sapiens
TYILNHSPI

SEQ ID NO: 468715 - protein, 9 aa, Homo Sapiens
EVSLTSGYA

SEQ ID NO: 468716 - protein, 9 aa, Homo Sapiens
LMSRSMCVQ

SEQ ID NO: 468717 - protein, 9 aa, Homo Sapiens
SEVENDRKM

SEQ ID NO: 468718 - protein, 9 aa, Homo Sapiens
DNQSSAPPR

SEQ ID NO: 468719 - protein, 9 aa, Homo Sapiens
QNFQRILNL

SEQ ID NO: 468720 - protein, 9 aa, Homo Sapiens
SSLCVCNSH

SEQ ID NO: 468721 - protein, 9 aa, Homo Sapiens
SNLVEIHLD

SEQ ID NO: 468722 - protein, 9 aa, Homo Sapiens
GKELDPILE

SEQ ID NO: 468723 - protein, 9 aa, Homo Sapiens
HSVKHGDEW

SEQ ID NO: 468724 - protein, 9 aa, Homo Sapiens
GGTTAAGAF

SEQ ID NO: 468725 - protein, 9 aa, Homo Sapiens
FVYTHSFTP

SEQ ID NO: 468726 - protein, 9 aa, Homo Sapiens
DTPVYLALL

SEQ ID NO: 468727 - protein, 9 aa, Homo Sapiens
MQLSSLCVC

SEQ ID NO: 468728 - protein, 9 aa, Homo Sapiens
VYTHSFTPG

SEQ ID NO: 468729 - protein, 9 aa, Homo Sapiens
AEAALSQTG

SEQ ID NO: 468730 - protein, 9 aa, Homo Sapiens
WPTPSGLTK

SEQ ID NO: 468731 - protein, 9 aa, Homo Sapiens
TTLQMVSED

SEQ ID NO: 468732 - protein, 9 aa, Homo Sapiens
HSGPFGQVL

SEQ ID NO: 468733 - protein, 9 aa, Homo Sapiens
ARFHLAMSL

SEQ ID NO: 468734 - protein, 9 aa, Homo Sapiens
SKLSDHSEI

SEQ ID NO: 468735 - protein, 9 aa, Homo Sapiens
ESCWFFRDF

SEQ ID NO: 468736 - protein, 9 aa, Homo Sapiens
HAVSEGAKA

SEQ ID NO: 468737 - protein, 9 aa, Homo Sapiens
PQAAALAPW

SEQ ID NO: 468738 - protein, 9 aa, Homo Sapiens
TYQRSYGFR

SEQ ID NO: 468739 - protein, 9 aa, Homo Sapiens
EKNSLIAEP

SEQ ID NO: 468740 - protein, 9 aa, Homo Sapiens
GEEGVRLTQ

SEQ ID NO: 468741 - protein, 9 aa, Homo Sapiens
VSEGAKAVT

SEQ ID NO: 468742 - protein, 9 aa, Homo Sapiens
QRSYGFRLG

SEQ ID NO: 468743 - protein, 9 aa, Homo Sapiens
AEEEEEEDD

SEQ ID NO: 468744 - protein, 9 aa, Homo Sapiens
LAAPDQEQK

SEQ ID NO: 468745 - protein, 9 aa, Homo Sapiens
EAYPCLCDI

SEQ ID NO: 468746 - protein, 9 aa, Homo Sapiens
ASQIWNLNP

SEQ ID NO: 468747 - protein, 9 aa, Homo Sapiens
KAVNRCLDL

SEQ ID NO: 468748 - protein, 9 aa, Homo Sapiens
SSQTKMVRK

SEQ ID NO: 468749 - protein, 9 aa, Homo Sapiens
SRMWIEFCS

SEQ ID NO: 468750 - protein, 9 aa, Homo Sapiens
NLASRLYHL

SEQ ID NO: 468751 - protein, 9 aa, Homo Sapiens
QWHSLSFSA

SEQ ID NO: 468752 - protein, 9 aa, Homo Sapiens
AQPLRLCEL

SEQ ID NO: 468753 - protein, 9 aa, Homo Sapiens
NRCLDLNNC

SEQ ID NO: 468754 - protein, 9 aa, Homo Sapiens
LETWHHHTQ

SEQ ID NO: 468755 - protein, 9 aa, Homo Sapiens
GSLSPKVLF

SEQ ID NO: 468756 - protein, 9 aa, Homo Sapiens
IEFCSSSNW

SEQ ID NO: 468757 - protein, 9 aa, Homo Sapiens
SCKENRRPP

SEQ ID NO: 468758 - protein, 9 aa, Homo Sapiens
NRDNYIHSC

SEQ ID NO: 468759 - protein, 9 aa, Homo Sapiens
MAKYYNAAC

SEQ ID NO: 468760 - protein, 9 aa, Homo Sapiens
AFSIHYYEE

SEQ ID NO: 468761 - protein, 9 aa, Homo Sapiens
CIGKGARRT

SEQ ID NO: 468762 - protein, 9 aa, Homo Sapiens
CKAFRHIKV

SEQ ID NO: 468763 - protein, 9 aa, Homo Sapiens
YTFAVTDGL

SEQ ID NO: 468764 - protein, 9 aa, Homo Sapiens
FPGALLRVP

SEQ ID NO: 468765 - protein, 9 aa, Homo Sapiens
NKFGAACAS

SEQ ID NO: 468766 - protein, 9 aa, Homo Sapiens
CSSSNWVGK

SEQ ID NO: 468767 - protein, 9 aa, Homo Sapiens
NYIHSCKLL

SEQ ID NO: 468768 - protein, 9 aa, Homo Sapiens
NPILLQKFQ

SEQ ID NO: 468769 - protein, 9 aa, Homo Sapiens
FRVEYVIGC

SEQ ID NO: 468770 - protein, 9 aa, Homo Sapiens
KAFTLLTNL

SEQ ID NO: 468771 - protein, 9 aa, Homo Sapiens
PGTMDSVHS

SEQ ID NO: 468772 - protein, 9 aa, Homo Sapiens
TGKESCIGK

SEQ ID NO: 468773 - protein, 9 aa, Homo Sapiens
AVSEGAKAV

SEQ ID NO: 468774 - protein, 9 aa, Homo Sapiens
WKPYKFRRL

SEQ ID NO: 468775 - protein, 9 aa, Homo Sapiens
IKVDTLSQP

SEQ ID NO: 468776 - protein, 9 aa, Homo Sapiens
GGCEFFDRH

SEQ ID NO: 468777 - protein, 9 aa, Homo Sapiens
IGKKNPILL

SEQ ID NO: 468778 - protein, 9 aa, Homo Sapiens
HLKCLLIVV

SEQ ID NO: 468779 - protein, 9 aa, Homo Sapiens
QKTYQRSYG

SEQ ID NO: 468780 - protein, 9 aa, Homo Sapiens
LDRIGKKNP

SEQ ID NO: 468781 - protein, 9 aa, Homo Sapiens
ASTCQMLAT

SEQ ID NO: 468782 - protein, 9 aa, Homo Sapiens
HYSDWTCAR

SEQ ID NO: 468783 - protein, 9 aa, Homo Sapiens
VTTSPNVVQ

SEQ ID NO: 468784 - protein, 9 aa, Homo Sapiens
SQKTYQRSY

SEQ ID NO: 468785 - protein, 9 aa, Homo Sapiens
GCRGPPGEI

SEQ ID NO: 468786 - protein, 9 aa, Homo Sapiens
EQVLAAPDQ

SEQ ID NO: 468787 - protein, 9 aa, Homo Sapiens
VLKESASNL

SEQ ID NO: 468788 - protein, 9 aa, Homo Sapiens
SLSKSVMLT

SEQ ID NO: 468789 - protein, 9 aa, Homo Sapiens
ITEPLLPGA

SEQ ID NO: 468790 - protein, 9 aa, Homo Sapiens
EEHQAHAWQ

SEQ ID NO: 468791 - protein, 9 aa, Homo Sapiens
PQDMLTYSL

SEQ ID NO: 468792 - protein, 9 aa, Homo Sapiens
LRNLEITYV

SEQ ID NO: 468793 - protein, 9 aa, Homo Sapiens
NIDQLGEEG

SEQ ID NO: 468794 - protein, 9 aa, Homo Sapiens
LYQKMRLRY

SEQ ID NO: 468795 - protein, 9 aa, Homo Sapiens
LSFSAKWSH

SEQ ID NO: 468796 - protein, 9 aa, Homo Sapiens
RLEEHQAHA

SEQ ID NO: 468797 - protein, 9 aa, Homo Sapiens
MAMENHSLA

SEQ ID NO: 468798 - protein, 9 aa, Homo Sapiens
QNSDMKNQG

SEQ ID NO: 468799 - protein, 9 aa, Homo Sapiens
MSARFHLAM

SEQ ID NO: 468800 - protein, 9 aa, Homo Sapiens
ASMSHLLKE

SEQ ID NO: 468801 - protein, 9 aa, Homo Sapiens
MKETEKGSL

SEQ ID NO: 468802 - protein, 9 aa, Homo Sapiens
TMDSVHSGP

SEQ ID NO: 468803 - protein, 9 aa, Homo Sapiens
RFSTLSVIK

SEQ ID NO: 468804 - protein, 9 aa, Homo Sapiens
SCWFFRDFL

SEQ ID NO: 468805 - protein, 9 aa, Homo Sapiens
PILAQIQED

SEQ ID NO: 468806 - protein, 9 aa, Homo Sapiens
LNRDNYIHS

SEQ ID NO: 468807 - protein, 9 aa, Homo Sapiens
GRPGCRGPP

SEQ ID NO: 468808 - protein, 9 aa, Homo Sapiens
ANAVSMAKY

SEQ ID NO: 468809 - protein, 9 aa, Homo Sapiens
HSTLEEVDQ

SEQ ID NO: 468810 - protein, 9 aa, Homo Sapiens
AKHAVSEGA

SEQ ID NO: 468811 - protein, 9 aa, Homo Sapiens
VTAALETWH

SEQ ID NO: 468812 - protein, 9 aa, Homo Sapiens
KETEKGSLS

SEQ ID NO: 468813 - protein, 9 aa, Homo Sapiens
NSLIAEPSR

SEQ ID NO: 468814 - protein, 9 aa, Homo Sapiens
ERCTYLTIL

SEQ ID NO: 468815 - protein, 9 aa, Homo Sapiens
DSRMWIEFC

SEQ ID NO: 468816 - protein, 9 aa, Homo Sapiens
VLRNLEITY

SEQ ID NO: 468817 - protein, 9 aa, Homo Sapiens
SPVMRAQKS

SEQ ID NO: 468818 - protein, 9 aa, Homo Sapiens
LPEGPMPEG

SEQ ID NO: 468819 - protein, 9 aa, Homo Sapiens
SSCKENRRP

SEQ ID NO: 468820 - protein, 9 aa, Homo Sapiens
DAQPLRLCE

SEQ ID NO: 468821 - protein, 9 aa, Homo Sapiens
HLLKENSEE

SEQ ID NO: 468822 - protein, 9 aa, Homo Sapiens
CDSPYSEHS

SEQ ID NO: 468823 - protein, 9 aa, Homo Sapiens
VTDGLLLPG

SEQ ID NO: 468824 - protein, 9 aa, Homo Sapiens
EHQAHAWQG

SEQ ID NO: 468825 - protein, 9 aa, Homo Sapiens
EHSTLEEVD

SEQ ID NO: 468826 - protein, 9 aa, Homo Sapiens
LTILNWARQ

SEQ ID NO: 468827 - protein, 9 aa, Homo Sapiens
LAQIQEDRT

SEQ ID NO: 468828 - protein, 9 aa, Homo Sapiens
ALLIQKTLV

SEQ ID NO: 468829 - protein, 9 aa, Homo Sapiens
HNAGPHRDE

SEQ ID NO: 468830 - protein, 9 aa, Homo Sapiens
ILNWARQDL

SEQ ID NO: 468831 - protein, 9 aa, Homo Sapiens
TLMNIHSLS

SEQ ID NO: 468832 - protein, 9 aa, Homo Sapiens
MSHLLKENS

SEQ ID NO: 468833 - protein, 9 aa, Homo Sapiens
MPQAAALAP

SEQ ID NO: 468834 - protein, 9 aa, Homo Sapiens
VDAQPLRLC

SEQ ID NO: 468835 - protein, 9 aa, Homo Sapiens
PEKEAEFVP

SEQ ID NO: 468836 - protein, 9 aa, Homo Sapiens
VPSQKTYQR

SEQ ID NO: 468837 - protein, 9 aa, Homo Sapiens
DGQWHSLSF

SEQ ID NO: 468838 - protein, 9 aa, Homo Sapiens
RCTYLTILN

SEQ ID NO: 468839 - protein, 9 aa, Homo Sapiens
ALIHSIRGE

SEQ ID NO: 468840 - protein, 9 aa, Homo Sapiens
EDLNQWLSE

SEQ ID NO: 468841 - protein, 9 aa, Homo Sapiens
GLISMEEFR

SEQ ID NO: 468842 - protein, 9 aa, Homo Sapiens
QDMLTYSLA

SEQ ID NO: 468843 - protein, 9 aa, Homo Sapiens
ENRRPPDNS

SEQ ID NO: 468844 - protein, 9 aa, Homo Sapiens
CLLIVVVVV

SEQ ID NO: 468845 - protein, 9 aa, Homo Sapiens
LIQKTLVRG

SEQ ID NO: 468846 - protein, 9 aa, Homo Sapiens
VKPSEEMPL

SEQ ID NO: 468847 - protein, 9 aa, Homo Sapiens
HSIRGEAGL

SEQ ID NO: 468848 - protein, 9 aa, Homo Sapiens
GAACASTCQ

SEQ ID NO: 468849 - protein, 9 aa, Homo Sapiens
KPGERKKMV

SEQ ID NO: 468850 - protein, 9 aa, Homo Sapiens
SRLYHLEGF

SEQ ID NO: 468851 - protein, 9 aa, Homo Sapiens
IGLVTPLLI

SEQ ID NO: 468852 - protein, 9 aa, Homo Sapiens
CYPQENKGT

SEQ ID NO: 468853 - protein, 9 aa, Homo Sapiens
YYEEGTDPE

SEQ ID NO: 468854 - protein, 9 aa, Homo Sapiens
PFCEDLNQW

SEQ ID NO: 468855 - protein, 9 aa, Homo Sapiens
GDPGRPGCR

SEQ ID NO: 468856 - protein, 9 aa, Homo Sapiens
EPILAQIQE

SEQ ID NO: 468857 - protein, 9 aa, Homo Sapiens
LLKENSEEK

SEQ ID NO: 468858 - protein, 9 aa, Homo Sapiens
DNEKNSLIA

SEQ ID NO: 468859 - protein, 9 aa, Homo Sapiens
DEKLKYYIP

SEQ ID NO: 468860 - protein, 9 aa, Homo Sapiens
HSLYQKMRL

SEQ ID NO: 468861 - protein, 9 aa, Homo Sapiens
TLVRGGLGT

SEQ ID NO: 468862 - protein, 9 aa, Homo Sapiens
SWLALIHSI

SEQ ID NO: 468863 - protein, 9 aa, Homo Sapiens
TWHHHTQIA

SEQ ID NO: 468864 - protein, 9 aa, Homo Sapiens
LVTPLLIVL

SEQ ID NO: 468865 - protein, 9 aa, Homo Sapiens
SPEKEAEFV

SEQ ID NO: 468866 - protein, 9 aa, Homo Sapiens
DRIGKKNPI

SEQ ID NO: 468867 - protein, 9 aa, Homo Sapiens
PVSTLMNIH

SEQ ID NO: 468868 - protein, 9 aa, Homo Sapiens
SEHSTLEEV

SEQ ID NO: 468869 - protein, 9 aa, Homo Sapiens
LMNIHSLSH

SEQ ID NO: 468870 - protein, 9 aa, Homo Sapiens
TITLNCPQN

SEQ ID NO: 468871 - protein, 9 aa, Homo Sapiens
EGPMPEGAS

SEQ ID NO: 468872 - protein, 9 aa, Homo Sapiens
MENHSLAAE

SEQ ID NO: 468873 - protein, 9 aa, Homo Sapiens
SQTKMVRKN

SEQ ID NO: 468874 - protein, 9 aa, Homo Sapiens
AITEPLLPG

SEQ ID NO: 468875 - protein, 9 aa, Homo Sapiens
SLREGLYIN

SEQ ID NO: 468876 - protein, 9 aa, Homo Sapiens
GLYINPYFP

SEQ ID NO: 468877 - protein, 9 aa, Homo Sapiens
HIKVDTLSQ

SEQ ID NO: 468878 - protein, 9 aa, Homo Sapiens
TEPLLPGAR

SEQ ID NO: 468879 - protein, 9 aa, Homo Sapiens
FPTQDLTSL

SEQ ID NO: 468880 - protein, 9 aa, Homo Sapiens
KVKPSEEMP

SEQ ID NO: 468881 - protein, 9 aa, Homo Sapiens
EFVPYPRMD

SEQ ID NO: 468882 - protein, 9 aa, Homo Sapiens
LPFPGALLR

SEQ ID NO: 468883 - protein, 9 aa, Homo Sapiens
LIGLVTPLL

SEQ ID NO: 468884 - protein, 9 aa, Homo Sapiens
QETGKESCI

SEQ ID NO: 468885 - protein, 9 aa, Homo Sapiens
QIQEDRTVI

SEQ ID NO: 468886 - protein, 9 aa, Homo Sapiens
VSLREGLYI

SEQ ID NO: 468887 - protein, 9 aa, Homo Sapiens
MVSEDKLRE

SEQ ID NO: 468888 - protein, 9 aa, Homo Sapiens
WSPVMRAQK

SEQ ID NO: 468889 - protein, 9 aa, Homo Sapiens
RDFLCRLHT

SEQ ID NO: 468890 - protein, 9 aa, Homo Sapiens
KAQETGKES

SEQ ID NO: 468891 - protein, 9 aa, Homo Sapiens
TDHSGLISM

SEQ ID NO: 468892 - protein, 9 aa, Homo Sapiens
SFPTQDLTS

SEQ ID NO: 468893 - protein, 9 aa, Homo Sapiens
ANEAYPCLC

SEQ ID NO: 468894 - protein, 9 aa, Homo Sapiens
ILAQIQEDR

SEQ ID NO: 468895 - protein, 9 aa, Homo Sapiens
QIWNLNPVF

SEQ ID NO: 468896 - protein, 9 aa, Homo Sapiens
PPRISKAQE

SEQ ID NO: 468897 - protein, 9 aa, Homo Sapiens
RAQKSSFNV

SEQ ID NO: 468898 - protein, 9 aa, Homo Sapiens
GCEFFDRHP

SEQ ID NO: 468899 - protein, 9 aa, Homo Sapiens
LQKVKPSEE

SEQ ID NO: 468900 - protein, 9 aa, Homo Sapiens
TAALETWHH

SEQ ID NO: 468901 - protein, 9 aa, Homo Sapiens
PYSEHSTLE

SEQ ID NO: 468902 - protein, 9 aa, Homo Sapiens
DNYIHSCKL

SEQ ID NO: 468903 - protein, 9 aa, Homo Sapiens
SARFHLAMS

SEQ ID NO: 468904 - protein, 9 aa, Homo Sapiens
KLPEGPMPE

SEQ ID NO: 468905 - protein, 9 aa, Homo Sapiens
IWNLNPVFG

SEQ ID NO: 468906 - protein, 9 aa, Homo Sapiens
TALLIQKTL

SEQ ID NO: 468907 - protein, 9 aa, Homo Sapiens
GNVMVTTSP

SEQ ID NO: 468908 - protein, 9 aa, Homo Sapiens
RLNAPWPPW

SEQ ID NO: 468909 - protein, 9 aa, Homo Sapiens
YSEHSTLEE

SEQ ID NO: 468910 - protein, 9 aa, Homo Sapiens
ETEKGSLSP

SEQ ID NO: 468911 - protein, 9 aa, Homo Sapiens
KKKCKFKSL

SEQ ID NO: 468912 - protein, 9 aa, Homo Sapiens
GALLRVPAE

SEQ ID NO: 468913 - protein, 9 aa, Homo Sapiens
WIEFCSSSN

SEQ ID NO: 468914 - protein, 9 aa, Homo Sapiens
LAEEVLKES

SEQ ID NO: 468915 - protein, 9 aa, Homo Sapiens
MANEAYPCL

SEQ ID NO: 468916 - protein, 9 aa, Homo Sapiens
VKLPEGPMP

SEQ ID NO: 468917 - protein, 9 aa, Homo Sapiens
VLAAPDQEQ

SEQ ID NO: 468918 - protein, 9 aa, Homo Sapiens
YIHSCKLLP

SEQ ID NO: 468919 - protein, 9 aa, Homo Sapiens
LLTNLVRHQ

SEQ ID NO: 468920 - protein, 9 aa, Homo Sapiens
NRRPPDNSF

SEQ ID NO: 468921 - protein, 9 aa, Homo Sapiens
NVRFSVAKS

SEQ ID NO: 468922 - protein, 9 aa, Homo Sapiens
SIHYYEEGT

SEQ ID NO: 468923 - protein, 9 aa, Homo Sapiens
LALIHSIRG

SEQ ID NO: 468924 - protein, 9 aa, Homo Sapiens
KESASNLGL

SEQ ID NO: 468925 - protein, 9 aa, Homo Sapiens
SCIGKGARR

SEQ ID NO: 468926 - protein, 9 aa, Homo Sapiens
VMVTTSPNV

SEQ ID NO: 468927 - protein, 9 aa, Homo Sapiens
SMAKYYNAA

SEQ ID NO: 468928 - protein, 9 aa, Homo Sapiens
SLQNVCFWT

SEQ ID NO: 468929 - protein, 9 aa, Homo Sapiens
ALPFPGALL

SEQ ID NO: 468930 - protein, 9 aa, Homo Sapiens
SKAQETGKE

SEQ ID NO: 468931 - protein, 9 aa, Homo Sapiens
SLKSFFVKK

SEQ ID NO: 468932 - protein, 9 aa, Homo Sapiens
TNLVRHQKI

SEQ ID NO: 468933 - protein, 9 aa, Homo Sapiens
QVLAAPDQE

SEQ ID NO: 468934 - protein, 9 aa, Homo Sapiens
EVLKESASN

SEQ ID NO: 468935 - protein, 9 aa, Homo Sapiens
KFKSLKSFF

SEQ ID NO: 468936 - protein, 9 aa, Homo Sapiens
QKTLVRGGL

SEQ ID NO: 468937 - protein, 9 aa, Homo Sapiens
KSVMLTFQH

SEQ ID NO: 468938 - protein, 9 aa, Homo Sapiens
KFRRLYFIW

SEQ ID NO: 468939 - protein, 9 aa, Homo Sapiens
DDWKPYKFR

SEQ ID NO: 468940 - protein, 9 aa, Homo Sapiens
GKDQQQQQE

SEQ ID NO: 468941 - protein, 9 aa, Homo Sapiens
HRDEKLKYY

SEQ ID NO: 468942 - protein, 9 aa, Homo Sapiens
LNWARQDLR

SEQ ID NO: 468943 - protein, 9 aa, Homo Sapiens
ELEQVLAAP

SEQ ID NO: 468944 - protein, 9 aa, Homo Sapiens
NAGPHRDEK

SEQ ID NO: 468945 - protein, 9 aa, Homo Sapiens
PECPEIPQL

SEQ ID NO: 468946 - protein, 9 aa, Homo Sapiens
FGAACASTC

SEQ ID NO: 468947 - protein, 9 aa, Homo Sapiens
PGALLRVPA

SEQ ID NO: 468948 - protein, 9 aa, Homo Sapiens
EGAKAVTKY

SEQ ID NO: 468949 - protein, 9 aa, Homo Sapiens
QMVSEDKLR

SEQ ID NO: 468950 - protein, 9 aa, Homo Sapiens
FSIHYYEEG

SEQ ID NO: 468951 - protein, 9 aa, Homo Sapiens
EKHSLYQKM

SEQ ID NO: 468952 - protein, 9 aa, Homo Sapiens
STLMNIHSL

SEQ ID NO: 468953 - protein, 9 aa, Homo Sapiens
PCLCDIGHR

SEQ ID NO: 468954 - protein, 9 aa, Homo Sapiens
PWPPWAHSM

SEQ ID NO: 468955 - protein, 9 aa, Homo Sapiens
CPQNSDMKN

SEQ ID NO: 468956 - protein, 9 aa, Homo Sapiens
QTTLQMVSE

SEQ ID NO: 468957 - protein, 9 aa, Homo Sapiens
GKGARRTDS

SEQ ID NO: 468958 - protein, 9 aa, Homo Sapiens
TYLTILNWA

SEQ ID NO: 468959 - protein, 9 aa, Homo Sapiens
DHSGLISME

SEQ ID NO: 468960 - protein, 9 aa, Homo Sapiens
HSGLISMEE

SEQ ID NO: 468961 - protein, 9 aa, Homo Sapiens
CCPVHLKCL

SEQ ID NO: 468962 - protein, 9 aa, Homo Sapiens
NLAEEVLKE

SEQ ID NO: 468963 - protein, 9 aa, Homo Sapiens
RCLDLNNCG

SEQ ID NO: 468964 - protein, 9 aa, Homo Sapiens
LEEHQAHAW

SEQ ID NO: 468965 - protein, 9 aa, Homo Sapiens
REGLYINPY

SEQ ID NO: 468966 - protein, 9 aa, Homo Sapiens
LERIDCTPD

SEQ ID NO: 468967 - protein, 9 aa, Homo Sapiens
SVESCWFFR

SEQ ID NO: 468968 - protein, 9 aa, Homo Sapiens
AVTDGLLLP

SEQ ID NO: 468969 - protein, 9 aa, Homo Sapiens
ACASTCQML

SEQ ID NO: 468970 - protein, 9 aa, Homo Sapiens
QKSSFNVSD

SEQ ID NO: 468971 - protein, 9 aa, Homo Sapiens
PLRLCELQR

SEQ ID NO: 468972 - protein, 9 aa, Homo Sapiens
VRFSVAKSL

SEQ ID NO: 468973 - protein, 9 aa, Homo Sapiens
CASTCQMLA

SEQ ID NO: 468974 - protein, 9 aa, Homo Sapiens
MWIEFCSSS

SEQ ID NO: 468975 - protein, 9 aa, Homo Sapiens
AQKSSFNVS

SEQ ID NO: 468976 - protein, 9 aa, Homo Sapiens
LKENSEEKS

SEQ ID NO: 468977 - protein, 9 aa, Homo Sapiens
LSSCKENRR

SEQ ID NO: 468978 - protein, 9 aa, Homo Sapiens
AEPILAQIQ

SEQ ID NO: 468979 - protein, 9 aa, Homo Sapiens
EVVLRNLEI

SEQ ID NO: 468980 - protein, 9 aa, Homo Sapiens
DWKPYKFRR

SEQ ID NO: 468981 - protein, 9 aa, Homo Sapiens
YLTILNWAR

SEQ ID NO: 468982 - protein, 9 aa, Homo Sapiens
EYVIGCYPQ

SEQ ID NO: 468983 - protein, 9 aa, Homo Sapiens
SASQIWNLN

SEQ ID NO: 468984 - protein, 9 aa, Homo Sapiens
TPNIDQLGE

SEQ ID NO: 468985 - protein, 9 aa, Homo Sapiens
TLLTNLVRH

SEQ ID NO: 468986 - protein, 9 aa, Homo Sapiens
PILLQKFQK

SEQ ID NO: 468987 - protein, 9 aa, Homo Sapiens
GKSANAVSM

SEQ ID NO: 468988 - protein, 9 aa, Homo Sapiens
VHSGPFGQV

SEQ ID NO: 468989 - protein, 9 aa, Homo Sapiens
PEIPQLERI

SEQ ID NO: 468990 - protein, 9 aa, Homo Sapiens
LPPVSTLMN

SEQ ID NO: 468991 - protein, 9 aa, Homo Sapiens
DSVHSGPFG

SEQ ID NO: 468992 - protein, 9 aa, Homo Sapiens
RDEKLKYYI

SEQ ID NO: 468993 - protein, 9 aa, Homo Sapiens
PSQKTYQRS

SEQ ID NO: 468994 - protein, 9 aa, Homo Sapiens
AQIQEDRTV

SEQ ID NO: 468995 - protein, 9 aa, Homo Sapiens
KGDPGRPGC

SEQ ID NO: 468996 - protein, 9 aa, Homo Sapiens
SLYQKMRLR

SEQ ID NO: 468997 - protein, 9 aa, Homo Sapiens
LCKAFRHIK

SEQ ID NO: 468998 - protein, 9 aa, Homo Sapiens
SANAVSMAK

SEQ ID NO: 468999 - protein, 9 aa, Homo Sapiens
QKVKPSEEM

SEQ ID NO: 469000 - protein, 9 aa, Homo Sapiens
KHAVSEGAK

SEQ ID NO: 469001 - protein, 9 aa, Homo Sapiens
YSDWTCARC

SEQ ID NO: 469002 - protein, 9 aa, Homo Sapiens
NNCEVVLRN

SEQ ID NO: 469003 - protein, 9 aa, Homo Sapiens
AMSARFHLA

SEQ ID NO: 469004 - protein, 9 aa, Homo Sapiens
CEDLNQWLS

SEQ ID NO: 469005 - protein, 9 aa, Homo Sapiens
NQWLSEDDN

SEQ ID NO: 469006 - protein, 9 aa, Homo Sapiens
MVSSQTKMV

SEQ ID NO: 469007 - protein, 9 aa, Homo Sapiens
AVNRCLDLN

SEQ ID NO: 469008 - protein, 9 aa, Homo Sapiens
HAWQGAMDA

SEQ ID NO: 469009 - protein, 9 aa, Homo Sapiens
AMENHSLAA

SEQ ID NO: 469010 - protein, 9 aa, Homo Sapiens
CKPGERKKM

SEQ ID NO: 469011 - protein, 9 aa, Homo Sapiens
SHLLKENSE

SEQ ID NO: 469012 - protein, 9 aa, Homo Sapiens
MEEFRAMWK

SEQ ID NO: 469013 - protein, 9 aa, Homo Sapiens
NMVSSQTKM

SEQ ID NO: 469014 - protein, 9 aa, Homo Sapiens
FCSSSNWVG

SEQ ID NO: 469015 - protein, 9 aa, Homo Sapiens
TIGELIGLV

SEQ ID NO: 469016 - protein, 9 aa, Homo Sapiens
RLCELQRET

SEQ ID NO: 469017 - protein, 9 aa, Homo Sapiens
SLSFSAKWS

SEQ ID NO: 469018 - protein, 9 aa, Homo Sapiens
CAYTFAVTD

SEQ ID NO: 469019 - protein, 9 aa, Homo Sapiens
LTSLQNVCF

SEQ ID NO: 469020 - protein, 9 aa, Homo Sapiens
LSASQIWNL

SEQ ID NO: 469021 - protein, 9 aa, Homo Sapiens
CLCNCEEKD

SEQ ID NO: 469022 - protein, 9 aa, Homo Sapiens
AALAPWTSV

SEQ ID NO: 469023 - protein, 9 aa, Homo Sapiens
GLVTPLLIV

SEQ ID NO: 469024 - protein, 9 aa, Homo Sapiens
RHIKVDTLS

SEQ ID NO: 469025 - protein, 9 aa, Homo Sapiens
ELIGLVTPL

SEQ ID NO: 469026 - protein, 9 aa, Homo Sapiens
EGLYINPYF

SEQ ID NO: 469027 - protein, 9 aa, Homo Sapiens
QQTTLQMVS

SEQ ID NO: 469028 - protein, 9 aa, Homo Sapiens
PSTYLCETR

SEQ ID NO: 469029 - protein, 9 aa, Homo Sapiens
ITLNCPQNS

SEQ ID NO: 469030 - protein, 9 aa, Homo Sapiens
MAFSIHYYE

SEQ ID NO: 469031 - protein, 9 aa, Homo Sapiens
HSLSFSAKW

SEQ ID NO: 469032 - protein, 9 aa, Homo Sapiens
RDNYIHSCK

SEQ ID NO: 469033 - protein, 9 aa, Homo Sapiens
PEGPMPEGA

SEQ ID NO: 469034 - protein, 9 aa, Homo Sapiens
QRLEEHQAH

SEQ ID NO: 469035 - protein, 9 aa, Homo Sapiens
VPYPRMDSY

SEQ ID NO: 469036 - protein, 9 aa, Homo Sapiens
QLERIDCTP

SEQ ID NO: 469037 - protein, 9 aa, Homo Sapiens
SQIWNLNPV

SEQ ID NO: 469038 - protein, 9 aa, Homo Sapiens
AKAVTKYTS

SEQ ID NO: 469039 - protein, 9 aa, Homo Sapiens
PGRPGCRGP

SEQ ID NO: 469040 - protein, 9 aa, Homo Sapiens
WNLNPVFGG

SEQ ID NO: 469041 - protein, 9 aa, Homo Sapiens
SVAKSLQKI

SEQ ID NO: 469042 - protein, 9 aa, Homo Sapiens
ETGKESCIG

SEQ ID NO: 469043 - protein, 9 aa, Homo Sapiens
DQVANVRFS

SEQ ID NO: 469044 - protein, 9 aa, Homo Sapiens
WHHHTQIAS

SEQ ID NO: 469045 - protein, 9 aa, Homo Sapiens
GFCAYTFAV

SEQ ID NO: 469046 - protein, 9 aa, Homo Sapiens
ALETWHHHT

SEQ ID NO: 469047 - protein, 9 aa, Homo Sapiens
AQETGKESC

SEQ ID NO: 469048 - protein, 9 aa, Homo Sapiens
DQQQQQEAP

SEQ ID NO: 469049 - protein, 9 aa, Homo Sapiens
LNDGQWHSL

SEQ ID NO: 469050 - protein, 9 aa, Homo Sapiens
EPGTMDSVH

SEQ ID NO: 469051 - protein, 9 aa, Homo Sapiens
VSSQTKMVR

SEQ ID NO: 469052 - protein, 9 aa, Homo Sapiens
CWFFRDFLC

SEQ ID NO: 469053 - protein, 9 aa, Homo Sapiens
RFSVAKSLQ

SEQ ID NO: 469054 - protein, 9 aa, Homo Sapiens
WPPWAHSML

SEQ ID NO: 469055 - protein, 9 aa, Homo Sapiens
QVANVRFSV

SEQ ID NO: 469056 - protein, 9 aa, Homo Sapiens
GMAFSIHYY

SEQ ID NO: 469057 - protein, 9 aa, Homo Sapiens
MPEGASLKG

SEQ ID NO: 469058 - protein, 9 aa, Homo Sapiens
QDLTSLQNV

SEQ ID NO: 469059 - protein, 9 aa, Homo Sapiens
EKEAEFVPY

SEQ ID NO: 469060 - protein, 9 aa, Homo Sapiens
KENRRPPDN

SEQ ID NO: 469061 - protein, 9 aa, Homo Sapiens
PQNSDMKNQ

SEQ ID NO: 469062 - protein, 9 aa, Homo Sapiens
GAKAVTKYT

SEQ ID NO: 469063 - protein, 9 aa, Homo Sapiens
CLNRDNYIH

SEQ ID NO: 469064 - protein, 9 aa, Homo Sapiens
SRLSASQIW

SEQ ID NO: 469065 - protein, 9 aa, Homo Sapiens
IHSIRGEAG

SEQ ID NO: 469066 - protein, 9 aa, Homo Sapiens
PQQQQQLTA

SEQ ID NO: 469067 - protein, 9 aa, Homo Sapiens
IVQQTTLQM

SEQ ID NO: 469068 - protein, 9 aa, Homo Sapiens
CKENRRPPD

SEQ ID NO: 469069 - protein, 9 aa, Homo Sapiens
DSPYSEHST

SEQ ID NO: 469070 - protein, 9 aa, Homo Sapiens
YQRSYGFRL

SEQ ID NO: 469071 - protein, 9 aa, Homo Sapiens
NEKNSLIAE

SEQ ID NO: 469072 - protein, 9 aa, Homo Sapiens
KPYKFRRLY

SEQ ID NO: 469073 - protein, 9 aa, Homo Sapiens
GPHRDEKLK

SEQ ID NO: 469074 - protein, 9 aa, Homo Sapiens
PLAMSARFH

SEQ ID NO: 469075 - protein, 9 aa, Homo Sapiens
MLTFQHVKM

SEQ ID NO: 469076 - protein, 9 aa, Homo Sapiens
LAMSARFHL

SEQ ID NO: 469077 - protein, 9 aa, Homo Sapiens
CLCDIGHRL

SEQ ID NO: 469078 - protein, 9 aa, Homo Sapiens
ESCIGKGAR

SEQ ID NO: 469079 - protein, 9 aa, Homo Sapiens
EIPQLERID

SEQ ID NO: 469080 - protein, 9 aa, Homo Sapiens
FRDFLCRLH

SEQ ID NO: 469081 - protein, 9 aa, Homo Sapiens
KKCKFKSLK

SEQ ID NO: 469082 - protein, 9 aa, Homo Sapiens
RMWIEFCSS

SEQ ID NO: 469083 - protein, 9 aa, Homo Sapiens
LRLCELQRE

SEQ ID NO: 469084 - protein, 9 aa, Homo Sapiens
NAPWPPWAH

SEQ ID NO: 469085 - protein, 9 aa, Homo Sapiens
KSANAVSMA

SEQ ID NO: 469086 - protein, 9 aa, Homo Sapiens
EFCSSSNWV

SEQ ID NO: 469087 - protein, 9 aa, Homo Sapiens
LYHLEGFRK

SEQ ID NO: 469088 - protein, 9 aa, Homo Sapiens
WTCARCQES

SEQ ID NO: 469089 - protein, 9 aa, Homo Sapiens
RPGCRGPPG

SEQ ID NO: 469090 - protein, 9 aa, Homo Sapiens
CKFKSLKSF

SEQ ID NO: 469091 - protein, 9 aa, Homo Sapiens
QAHAWQGAM

SEQ ID NO: 469092 - protein, 9 aa, Homo Sapiens
RTPNIDQLG

SEQ ID NO: 469093 - protein, 9 aa, Homo Sapiens
LEDALPFPG

SEQ ID NO: 469094 - protein, 9 aa, Homo Sapiens
SDWTCARCQ

SEQ ID NO: 469095 - protein, 9 aa, Homo Sapiens
PRISKAQET

SEQ ID NO: 469096 - protein, 9 aa, Homo Sapiens
LCELQRETA

SEQ ID NO: 469097 - protein, 9 aa, Homo Sapiens
GWAEPILAQ

SEQ ID NO: 469098 - protein, 9 aa, Homo Sapiens
ISMEEFRAM

SEQ ID NO: 469099 - protein, 9 aa, Homo Sapiens
PQLERIDCT

SEQ ID NO: 469100 - protein, 9 aa, Homo Sapiens
PNVVQTGKA

SEQ ID NO: 469101 - protein, 9 aa, Homo Sapiens
KGSLSPKVL

SEQ ID NO: 469102 - protein, 9 aa, Homo Sapiens
GKKAVNRCL

SEQ ID NO: 469103 - protein, 9 aa, Homo Sapiens
TYLCETRFS

SEQ ID NO: 469104 - protein, 9 aa, Homo Sapiens
FCAYTFAVT

SEQ ID NO: 469105 - protein, 9 aa, Homo Sapiens
VANVRFSVA

SEQ ID NO: 469106 - protein, 9 aa, Homo Sapiens
KESCIGKGA

SEQ ID NO: 469107 - protein, 9 aa, Homo Sapiens
SVMLTFQHV

SEQ ID NO: 469108 - protein, 9 aa, Homo Sapiens
KAFRHIKVD

SEQ ID NO: 469109 - protein, 9 aa, Homo Sapiens
PVHLKCLLI

SEQ ID NO: 469110 - protein, 9 aa, Homo Sapiens
CRGPPGEIG

SEQ ID NO: 469111 - protein, 9 aa, Homo Sapiens
IKPFCEDLN

SEQ ID NO: 469112 - protein, 9 aa, Homo Sapiens
YEKHSLYQK

SEQ ID NO: 469113 - protein, 9 aa, Homo Sapiens
MNIHSLSHH

SEQ ID NO: 469114 - protein, 9 aa, Homo Sapiens
PFPGALLRV

SEQ ID NO: 469115 - protein, 9 aa, Homo Sapiens
VNRCLDLNN

SEQ ID NO: 469116 - protein, 9 aa, Homo Sapiens
LREGLYINP

SEQ ID NO: 469117 - protein, 9 aa, Homo Sapiens
LDDWKPYKF

SEQ ID NO: 469118 - protein, 9 aa, Homo Sapiens
TQDLTSLQN

SEQ ID NO: 469119 - protein, 9 aa, Homo Sapiens
WLALIHSIR

SEQ ID NO: 469120 - protein, 9 aa, Homo Sapiens
LIHSIRGEA

SEQ ID NO: 469121 - protein, 9 aa, Homo Sapiens
DLTSLQNVC

SEQ ID NO: 469122 - protein, 9 aa, Homo Sapiens
CTYLTILNW

SEQ ID NO: 469123 - protein, 9 aa, Homo Sapiens
KCKFKSLKS

SEQ ID NO: 469124 - protein, 9 aa, Homo Sapiens
SGLISMEEF

SEQ ID NO: 469125 - protein, 9 aa, Homo Sapiens
STLEEVDQD

SEQ ID NO: 469126 - protein, 9 aa, Homo Sapiens
FRHIKVDTL

SEQ ID NO: 469127 - protein, 9 aa, Homo Sapiens
EKLKYYIPE

SEQ ID NO: 469128 - protein, 9 aa, Homo Sapiens
AWSPVMRAQ

SEQ ID NO: 469129 - protein, 9 aa, Homo Sapiens
RIGKKNPIL

SEQ ID NO: 469130 - protein, 9 aa, Homo Sapiens
GSCDCLCNC

SEQ ID NO: 469131 - protein, 9 aa, Homo Sapiens
KDQQQQQEA

SEQ ID NO: 469132 - protein, 9 aa, Homo Sapiens
TSPNVVQTG

SEQ ID NO: 469133 - protein, 9 aa, Homo Sapiens
MLTYSLAEE

SEQ ID NO: 469134 - protein, 9 aa, Homo Sapiens
AAALAPWTS

SEQ ID NO: 469135 - protein, 9 aa, Homo Sapiens
LQMVSEDKL

SEQ ID NO: 469136 - protein, 9 aa, Homo Sapiens
NSRRLNAPW

SEQ ID NO: 469137 - protein, 9 aa, Homo Sapiens
PTQDLTSLQ

SEQ ID NO: 469138 - protein, 9 aa, Homo Sapiens
PLCKAFRHI

SEQ ID NO: 469139 - protein, 9 aa, Homo Sapiens
IDIWIGAIT

SEQ ID NO: 469140 - protein, 9 aa, Homo Sapiens
KENSEEKSL

SEQ ID NO: 469141 - protein, 9 aa, Homo Sapiens
KCLLIVVVV

SEQ ID NO: 469142 - protein, 9 aa, Homo Sapiens
LISMEEFRA

SEQ ID NO: 469143 - protein, 9 aa, Homo Sapiens
HQAHAWQGA

SEQ ID NO: 469144 - protein, 9 aa, Homo Sapiens
KLRLQKVKP

SEQ ID NO: 469145 - protein, 9 aa, Homo Sapiens
HSCKLLPDG

SEQ ID NO: 469146 - protein, 9 aa, Homo Sapiens
MDSVHSGPF

SEQ ID NO: 469147 - protein, 9 aa, Homo Sapiens
FHLAMSLAQ

SEQ ID NO: 469148 - protein, 9 aa, Homo Sapiens
CEFFDRHPG

SEQ ID NO: 469149 - protein, 9 aa, Homo Sapiens
LTNLVRHQK

SEQ ID NO: 469150 - protein, 9 aa, Homo Sapiens
AGPHRDEKL

SEQ ID NO: 469151 - protein, 9 aa, Homo Sapiens
SMLSSCKEN

SEQ ID NO: 469152 - protein, 9 aa, Homo Sapiens
TLNCPQNSD

SEQ ID NO: 469153 - protein, 9 aa, Homo Sapiens
LCDIGHRLE

SEQ ID NO: 469154 - protein, 9 aa, Homo Sapiens
GGGCEFFDR

SEQ ID NO: 469155 - protein, 9 aa, Homo Sapiens
APWPPWAHS

SEQ ID NO: 469156 - protein, 9 aa, Homo Sapiens
RSYGFRLGF

SEQ ID NO: 469157 - protein, 9 aa, Homo Sapiens
VQQTTLQMV

SEQ ID NO: 469158 - protein, 9 aa, Homo Sapiens
PPQQQQQLT

SEQ ID NO: 469159 - protein, 9 aa, Homo Sapiens
EDALPFPGA

SEQ ID NO: 469160 - protein, 9 aa, Homo Sapiens
LEQVLAAPD

SEQ ID NO: 469161 - protein, 9 aa, Homo Sapiens
DIWIGAITE

SEQ ID NO: 469162 - protein, 9 aa, Homo Sapiens
QPLRLCELQ

SEQ ID NO: 469163 - protein, 9 aa, Homo Sapiens
IWIGAITEP

SEQ ID NO: 469164 - protein, 9 aa, Homo Sapiens
ALAPWTSVS

SEQ ID NO: 469165 - protein, 9 aa, Homo Sapiens
QAAALAPWT

SEQ ID NO: 469166 - protein, 9 aa, Homo Sapiens
AACASTCQM

SEQ ID NO: 469167 - protein, 9 aa, Homo Sapiens
IQKTLVRGG

SEQ ID NO: 469168 - protein, 9 aa, Homo Sapiens
ATDRDPQDM

SEQ ID NO: 469169 - protein, 9 aa, Homo Sapiens
STYLCETRF

SEQ ID NO: 469170 - protein, 9 aa, Homo Sapiens
RVEYVIGCY

SEQ ID NO: 469171 - protein, 9 aa, Homo Sapiens
ASRLYHLEG

SEQ ID NO: 469172 - protein, 9 aa, Homo Sapiens
DMLTYSLAE

SEQ ID NO: 469173 - protein, 9 aa, Homo Sapiens
YINPYFPGQ

SEQ ID NO: 469174 - protein, 9 aa, Homo Sapiens
VIGCYPQEN

SEQ ID NO: 469175 - protein, 9 aa, Homo Sapiens
LLIQKTLVR

SEQ ID NO: 469176 - protein, 9 aa, Homo Sapiens
VESCWFFRD

SEQ ID NO: 469177 - protein, 9 aa, Homo Sapiens
NVSLSKSVM

SEQ ID NO: 469178 - protein, 9 aa, Homo Sapiens
RISKAQETG

SEQ ID NO: 469179 - protein, 9 aa, Homo Sapiens
LKCLLIVVV

SEQ ID NO: 469180 - protein, 9 aa, Homo Sapiens
SMKETEKGS

SEQ ID NO: 469181 - protein, 9 aa, Homo Sapiens
AVSMAKYYN

SEQ ID NO: 469182 - protein, 9 aa, Homo Sapiens
RLQKVKPSE

SEQ ID NO: 469183 - protein, 9 aa, Homo Sapiens
IHYYEEGTD

SEQ ID NO: 469184 - protein, 9 aa, Homo Sapiens
IHSCKLLPD

SEQ ID NO: 469185 - protein, 9 aa, Homo Sapiens
IFHKCSNSN

SEQ ID NO: 469186 - protein, 9 aa, Homo Sapiens
AEFVPYPRM

SEQ ID NO: 469187 - protein, 9 aa, Homo Sapiens
LYINPYFPG

SEQ ID NO: 469188 - protein, 9 aa, Homo Sapiens
AFRHIKVDT

SEQ ID NO: 469189 - protein, 9 aa, Homo Sapiens
HLAMSLAQA

SEQ ID NO: 469190 - protein, 9 aa, Homo Sapiens
FTLLTNLVR

SEQ ID NO: 469191 - protein, 9 aa, Homo Sapiens
TDRDPQDML

SEQ ID NO: 469192 - protein, 9 aa, Homo Sapiens
KKNPILLQK

SEQ ID NO: 469193 - protein, 9 aa, Homo Sapiens
LSKSVMLTF

SEQ ID NO: 469194 - protein, 9 aa, Homo Sapiens
QLGEEGVRL

SEQ ID NO: 469195 - protein, 9 aa, Homo Sapiens
VEYVIGCYP

SEQ ID NO: 469196 - protein, 9 aa, Homo Sapiens
MTIGELIGL

SEQ ID NO: 469197 - protein, 9 aa, Homo Sapiens
SRGSCDCLC

SEQ ID NO: 469198 - protein, 9 aa, Homo Sapiens
SIRGEAGLL

SEQ ID NO: 469199 - protein, 9 aa, Homo Sapiens
WNLASRLYH

SEQ ID NO: 469200 - protein, 9 aa, Homo Sapiens
KKAVNRCLD

SEQ ID NO: 469201 - protein, 9 aa, Homo Sapiens
FKSLKSFFV

SEQ ID NO: 469202 - protein, 9 aa, Homo Sapiens
PPPQQQQQL

SEQ ID NO: 469203 - protein, 9 aa, Homo Sapiens
LGKKAVNRC

SEQ ID NO: 469204 - protein, 9 aa, Homo Sapiens
VSLSKSVML

SEQ ID NO: 469205 - protein, 9 aa, Homo Sapiens
YLCETRFST

SEQ ID NO: 469206 - protein, 9 aa, Homo Sapiens
CETRFSTLS

SEQ ID NO: 469207 - protein, 9 aa, Homo Sapiens
ISKAQETGK

SEQ ID NO: 469208 - protein, 9 aa, Homo Sapiens
FNNCEVVLR

SEQ ID NO: 469209 - protein, 9 aa, Homo Sapiens
EKGSLSPKV

SEQ ID NO: 469210 - protein, 9 aa, Homo Sapiens
IGAITEPLL

SEQ ID NO: 469211 - protein, 9 aa, Homo Sapiens
FAVTDGLLL

SEQ ID NO: 469212 - protein, 9 aa, Homo Sapiens
FFRDFLCRL

SEQ ID NO: 469213 - protein, 9 aa, Homo Sapiens
LRLQKVKPS

SEQ ID NO: 469214 - protein, 9 aa, Homo Sapiens
LNCPQNSDM

SEQ ID NO: 469215 - protein, 9 aa, Homo Sapiens
DRDPQDMLT

SEQ ID NO: 469216 - protein, 9 aa, Homo Sapiens
SKSVMLTFQ

SEQ ID NO: 469217 - protein, 9 aa, Homo Sapiens
LNAPWPPWA

SEQ ID NO: 469218 - protein, 9 aa, Homo Sapiens
QKMRLRYPV

SEQ ID NO: 469219 - protein, 9 aa, Homo Sapiens
DGMAFSIHY

SEQ ID NO: 469220 - protein, 9 aa, Homo Sapiens
RLSASQIWN

SEQ ID NO: 469221 - protein, 9 aa, Homo Sapiens
GELIGLVTP

SEQ ID NO: 469222 - protein, 9 aa, Homo Sapiens
LNQWLSEDD

SEQ ID NO: 469223 - protein, 9 aa, Homo Sapiens
TTSPNVVQT

SEQ ID NO: 469224 - protein, 9 aa, Homo Sapiens
DALPFPGAL

SEQ ID NO: 469225 - protein, 9 aa, Homo Sapiens
AHAWQGAMD

SEQ ID NO: 469226 - protein, 9 aa, Homo Sapiens
VVLRNLEIT

SEQ ID NO: 469227 - protein, 9 aa, Homo Sapiens
SMSHLLKEN

SEQ ID NO: 469228 - protein, 9 aa, Homo Sapiens
WFFRDFLCR

SEQ ID NO: 469229 - protein, 9 aa, Homo Sapiens
TLQMVSEDK

SEQ ID NO: 469230 - protein, 9 aa, Homo Sapiens
YVIGCYPQE

SEQ ID NO: 469231 - protein, 9 aa, Homo Sapiens
ENSEEKSLM

SEQ ID NO: 469232 - protein, 9 aa, Homo Sapiens
NAVSMAKYY

SEQ ID NO: 469233 - protein, 9 aa, Homo Sapiens
PPVSTLMNI

SEQ ID NO: 469234 - protein, 9 aa, Homo Sapiens
YKFRRLYFI

SEQ ID NO: 469235 - protein, 9 aa, Homo Sapiens
GSDNEKNSL

SEQ ID NO: 469236 - protein, 9 aa, Homo Sapiens
PHRDEKLKY

SEQ ID NO: 469237 - protein, 9 aa, Homo Sapiens
AVTAALETW

SEQ ID NO: 469238 - protein, 9 aa, Homo Sapiens
ETRFSTLSV

SEQ ID NO: 469239 - protein, 9 aa, Homo Sapiens
VMLTFQHVK

SEQ ID NO: 469240 - protein, 9 aa, Homo Sapiens
YHLEGFRKS

SEQ ID NO: 469241 - protein, 9 aa, Homo Sapiens
EEVLKESAS

SEQ ID NO: 469242 - protein, 9 aa, Homo Sapiens
HLEGFRKSE

SEQ ID NO: 469243 - protein, 9 aa, Homo Sapiens
ATALLIQKT

SEQ ID NO: 469244 - protein, 9 aa, Homo Sapiens
PCCPVHLKC

SEQ ID NO: 469245 - protein, 9 aa, Homo Sapiens
TRFSTLSVI

SEQ ID NO: 469246 - protein, 9 aa, Homo Sapiens
CDCLCNCEE

SEQ ID NO: 469247 - protein, 9 aa, Homo Sapiens
SSRGSCDCL

SEQ ID NO: 469248 - protein, 9 aa, Homo Sapiens
TFAVTDGLL

SEQ ID NO: 469249 - protein, 9 aa, Homo Sapiens
RDPQDMLTY

SEQ ID NO: 469250 - protein, 9 aa, Homo Sapiens
LASRLYHLE

SEQ ID NO: 469251 - protein, 9 aa, Homo Sapiens
RRLNAPWPP

SEQ ID NO: 469252 - protein, 9 aa, Homo Sapiens
SCDCLCNCE

SEQ ID NO: 469253 - protein, 9 aa, Homo Sapiens
CEVVLRNLE

SEQ ID NO: 469254 - protein, 9 aa, Homo Sapiens
AYPCLCDIG

SEQ ID NO: 469255 - protein, 9 aa, Homo Sapiens
DPGRPGCRG

SEQ ID NO: 469256 - protein, 9 aa, Homo Sapiens
VMRAQKSSF

SEQ ID NO: 469257 - protein, 9 aa, Homo Sapiens
IGCYPQENK

SEQ ID NO: 469258 - protein, 9 aa, Homo Sapiens
RGSCDCLCN

SEQ ID NO: 469259 - protein, 9 aa, Homo Sapiens
SDNEKNSLI

SEQ ID NO: 469260 - protein, 9 aa, Homo Sapiens
TILNWARQD

SEQ ID NO: 469261 - protein, 9 aa, Homo Sapiens
CPEIPQLER

SEQ ID NO: 469262 - protein, 9 aa, Homo Sapiens
NVMVTTSPN

SEQ ID NO: 469263 - protein, 9 aa, Homo Sapiens
DTITLNCPQ

SEQ ID NO: 469264 - protein, 9 aa, Homo Sapiens
NLVRHQKIH

SEQ ID NO: 469265 - protein, 9 aa, Homo Sapiens
INPYFPGQA

SEQ ID NO: 469266 - protein, 9 aa, Homo Sapiens
TKLRLQKVK

SEQ ID NO: 469267 - protein, 9 aa, Homo Sapiens
DVKLPEGPM

SEQ ID NO: 469268 - protein, 9 aa, Homo Sapiens
TEKGSLSPK

SEQ ID NO: 469269 - protein, 9 aa, Homo Sapiens
YQKMRLRYP

SEQ ID NO: 469270 - protein, 9 aa, Homo Sapiens
LCETRFSTL

SEQ ID NO: 469271 - protein, 9 aa, Homo Sapiens
SVHSGPFGQ

SEQ ID NO: 469272 - protein, 9 aa, Homo Sapiens
SLSPKVLFN

SEQ ID NO: 469273 - protein, 9 aa, Homo Sapiens
RGSQHYSDW

SEQ ID NO: 469274 - protein, 9 aa, Homo Sapiens
GKKKCKFKS

SEQ ID NO: 469275 - protein, 9 aa, Homo Sapiens
MRAQKSSFN

SEQ ID NO: 469276 - protein, 9 aa, Homo Sapiens
KFGAACAST

SEQ ID NO: 469277 - protein, 9 aa, Homo Sapiens
FSVAKSLQK

SEQ ID NO: 469278 - protein, 9 aa, Homo Sapiens
DCLCNCEEK

SEQ ID NO: 469279 - protein, 9 aa, Homo Sapiens
GTMDSVHSG

SEQ ID NO: 469280 - protein, 9 aa, Homo Sapiens
GPMPEGASL

SEQ ID NO: 469281 - protein, 9 aa, Homo Sapiens
YYEKHSLYQ

SEQ ID NO: 469282 - protein, 9 aa, Homo Sapiens
SPNVVQTGK

SEQ ID NO: 469283 - protein, 9 aa, Homo Sapiens
PMPEGASLK

SEQ ID NO: 469284 - protein, 9 aa, Homo Sapiens
EGSDNEKNS

SEQ ID NO: 469285 - protein, 9 aa, Homo Sapiens
GGGGCEFFD

SEQ ID NO: 469286 - protein, 9 aa, Homo Sapiens
DTKLRLQKV

SEQ ID NO: 469287 - protein, 9 aa, Homo Sapiens
AALETWHHH

SEQ ID NO: 469288 - protein, 9 aa, Homo Sapiens
QHYSDWTCA

SEQ ID NO: 469289 - protein, 9 aa, Homo Sapiens
WAEPILAQI

SEQ ID NO: 469290 - protein, 9 aa, Homo Sapiens
KEAEFVPYP

SEQ ID NO: 469291 - protein, 9 aa, Homo Sapiens
PVMRAQKSS

SEQ ID NO: 469292 - protein, 9 aa, Homo Sapiens
QVDAQPLRL

SEQ ID NO: 469293 - protein, 9 aa, Homo Sapiens
EAEFVPYPR

SEQ ID NO: 469294 - protein, 9 aa, Homo Sapiens
QEGSDNEKN

SEQ ID NO: 469295 - protein, 9 aa, Homo Sapiens
KNPILLQKF

SEQ ID NO: 469296 - protein, 9 aa, Homo Sapiens
VHLKCLLIV

SEQ ID NO: 469297 - protein, 9 aa, Homo Sapiens
AYTFAVTDG

SEQ ID NO: 469298 - protein, 9 aa, Homo Sapiens
DWTCARCQE

SEQ ID NO: 469299 - protein, 9 aa, Homo Sapiens
EFFDRHPGV

SEQ ID NO: 469300 - protein, 9 aa, Homo Sapiens
FVPYPRMDS

SEQ ID NO: 469301 - protein, 9 aa, Homo Sapiens
GKKNPILLQ

SEQ ID NO: 469302 - protein, 9 aa, Homo Sapiens
WHSLSFSAK

SEQ ID NO: 469303 - protein, 9 aa, Homo Sapiens
PYKFRRLYF

SEQ ID NO: 469304 - protein, 9 aa, Homo Sapiens
LSSRGSCDC

SEQ ID NO: 469305 - protein, 9 aa, Homo Sapiens
GAITEPLLP

SEQ ID NO: 469306 - protein, 9 aa, Homo Sapiens
MVTTSPNVV

SEQ ID NO: 469307 - protein, 9 aa, Homo Sapiens
CPVHLKCLL

SEQ ID NO: 469308 - protein, 9 aa, Homo Sapiens
KSLKSFFVK

SEQ ID NO: 469309 - protein, 9 aa, Homo Sapiens
LGEEGVRLT

SEQ ID NO: 469310 - protein, 9 aa, Homo Sapiens
SRRLNAPWP

SEQ ID NO: 469311 - protein, 9 aa, Homo Sapiens
TSLQNVCFW

SEQ ID NO: 469312 - protein, 9 aa, Homo Sapiens
RKAFTLLTN

SEQ ID NO: 469313 - protein, 9 aa, Homo Sapiens
ETWHHHTQI

SEQ ID NO: 469314 - protein, 9 aa, Homo Sapiens
AEEVLKESA

SEQ ID NO: 469315 - protein, 9 aa, Homo Sapiens
PGCRGPPGE

SEQ ID NO: 469316 - protein, 9 aa, Homo Sapiens
VSMAKYYNA

SEQ ID NO: 469317 - protein, 9 aa, Homo Sapiens
KPFCEDLNQ

SEQ ID NO: 469318 - protein, 9 aa, Homo Sapiens
DLNQWLSED

SEQ ID NO: 469319 - protein, 9 aa, Homo Sapiens
RNLEITYVQ

SEQ ID NO: 469320 - protein, 9 aa, Homo Sapiens
PNIDQLGEE

SEQ ID NO: 469321 - protein, 9 aa, Homo Sapiens
VSTLMNIHS

SEQ ID NO: 469322 - protein, 9 aa, Homo Sapiens
AAPDQEQKK

SEQ ID NO: 469323 - protein, 9 aa, Homo Sapiens
LKESASNLG

SEQ ID NO: 469324 - protein, 9 aa, Homo Sapiens
SPYSEHSTL

SEQ ID NO: 469325 - protein, 9 aa, Homo Sapiens
IRGEAGLLV

SEQ ID NO: 469326 - protein, 9 aa, Homo Sapiens
STCQMLATG

SEQ ID NO: 469327 - protein, 9 aa, Homo Sapiens
SMEEFRAMW

SEQ ID NO: 469328 - protein, 9 aa, Homo Sapiens
YPCLCDIGH

SEQ ID NO: 469329 - protein, 9 aa, Homo Sapiens
FCEDLNQWL

SEQ ID NO: 469330 - protein, 9 aa, Homo Sapiens
NEAYPCLCD

SEQ ID NO: 469331 - protein, 9 aa, Homo Sapiens
GSQHYSDWT

SEQ ID NO: 469332 - protein, 9 aa, Homo Sapiens
ANVRFSVAK

SEQ ID NO: 469333 - protein, 9 aa, Homo Sapiens
SQHYSDWTC

SEQ ID NO: 469334 - protein, 9 aa, Homo Sapiens
IGELIGLVT

SEQ ID NO: 469335 - protein, 9 aa, Homo Sapiens
KHSLYQKMR

SEQ ID NO: 469336 - protein, 9 aa, Homo Sapiens
GKESCIGKG

SEQ ID NO: 469337 - protein, 9 aa, Homo Sapiens
KNSLIAEPS

SEQ ID NO: 469338 - protein, 9 aa, Homo Sapiens
HYYEEGTDP

SEQ ID NO: 469339 - protein, 9 aa, Homo Sapiens
RFHLAMSLA

SEQ ID NO: 469340 - protein, 9 aa, Homo Sapiens
NDGQWHSLS

SEQ ID NO: 469341 - protein, 9 aa, Homo Sapiens
AFTLLTNLV

SEQ ID NO: 469342 - protein, 9 aa, Homo Sapiens
KLGKKAVNR

SEQ ID NO: 469343 - protein, 9 aa, Homo Sapiens
FRRLYFIWV

SEQ ID NO: 469344 - protein, 9 aa, Homo Sapiens
GLPPVSTLM

SEQ ID NO: 469345 - protein, 9 aa, Homo Sapiens
KTYQRSYGF

SEQ ID NO: 469346 - protein, 9 aa, Homo Sapiens
DQLGEEGVR

SEQ ID NO: 469347 - protein, 9 aa, Homo Sapiens
KTLVRGGLG

SEQ ID NO: 469348 - protein, 9 aa, Homo Sapiens
IGKGARRTD

SEQ ID NO: 469349 - protein, 9 aa, Homo Sapiens
RLYHLEGFR

SEQ ID NO: 469350 - protein, 9 aa, Homo Sapiens
NCPQNSDMK

SEQ ID NO: 469351 - protein, 9 aa, Homo Sapiens
ECPEIPQLE

SEQ ID NO: 469352 - protein, 9 aa, Homo Sapiens
IPQLERIDC

SEQ ID NO: 469353 - protein, 9 aa, Homo Sapiens
GQWHSLSFS

SEQ ID NO: 469354 - protein, 9 aa, Homo Sapiens
IDQLGEEGV

SEQ ID NO: 469355 - protein, 9 aa, Homo Sapiens
GCYPQENKG

SEQ ID NO: 469356 - protein, 9 aa, Homo Sapiens
WIGAITEPL

SEQ ID NO: 469357 - protein, 9 aa, Homo Sapiens
LAPWTSVSC

SEQ ID NO: 469358 - protein, 9 aa, Homo Sapiens
NCEVVLRNL

SEQ ID NO: 469359 - protein, 9 aa, Homo Sapiens
DPQDMLTYS

SEQ ID NO: 469360 - protein, 9 aa, Homo Sapiens
RNLAEEVLK

SEQ ID NO: 469361 - protein, 9 aa, Homo Sapiens
SEGAKAVTK

SEQ ID NO: 469362 - protein, 9 aa, Homo Sapiens
MLSSCKENR

SEQ ID NO: 469363 - protein, 9 aa, Homo Sapiens
KKKLQVLRM

SEQ ID NO: 469364 - protein, 9 aa, Homo Sapiens
WKKKLQVLR

SEQ ID NO: 469365 - protein, 9 aa, Homo Sapiens
TPEQVTVHL

SEQ ID NO: 469366 - protein, 9 aa, Homo Sapiens
LRMAISKSK

SEQ ID NO: 469367 - protein, 9 aa, Homo Sapiens
AMGEQLFPG

SEQ ID NO: 469368 - protein, 9 aa, Homo Sapiens
HTTVYFFLS

SEQ ID NO: 469369 - protein, 9 aa, Homo Sapiens
IGSVVVYAT

SEQ ID NO: 469370 - protein, 9 aa, Homo Sapiens
PAEILLDLG

SEQ ID NO: 469371 - protein, 9 aa, Homo Sapiens
QVSSRLHTT

SEQ ID NO: 469372 - protein, 9 aa, Homo Sapiens
SVVVYATQD

SEQ ID NO: 469373 - protein, 9 aa, Homo Sapiens
EAGFNWVYY

SEQ ID NO: 469374 - protein, 9 aa, Homo Sapiens
SKKRFILKT

SEQ ID NO: 469375 - protein, 9 aa, Homo Sapiens
MMGKLTLWQ

SEQ ID NO: 469376 - protein, 9 aa, Homo Sapiens
RRKRCVVWR

SEQ ID NO: 469377 - protein, 9 aa, Homo Sapiens
GKTAIAMSM

SEQ ID NO: 469378 - protein, 9 aa, Homo Sapiens
IGISGKNMT

SEQ ID NO: 469379 - protein, 9 aa, Homo Sapiens
VLRMAISKS

SEQ ID NO: 469380 - protein, 9 aa, Homo Sapiens
AGFNWVYYE

SEQ ID NO: 469381 - protein, 9 aa, Homo Sapiens
CRRKRCVVW

SEQ ID NO: 469382 - protein, 9 aa, Homo Sapiens
FVSKKRFIL

SEQ ID NO: 469383 - protein, 9 aa, Homo Sapiens
SGCRRKRCV

SEQ ID NO: 469384 - protein, 9 aa, Homo Sapiens
EELVRQTWQ

SEQ ID NO: 469385 - protein, 9 aa, Homo Sapiens
SKMQSRQIG

SEQ ID NO: 469386 - protein, 9 aa, Homo Sapiens
TICLTCTLR

SEQ ID NO: 469387 - protein, 9 aa, Homo Sapiens
RTPEQVTVH

SEQ ID NO: 469388 - protein, 9 aa, Homo Sapiens
SSALGTTIC

SEQ ID NO: 469389 - protein, 9 aa, Homo Sapiens
LRNHYGEEV

SEQ ID NO: 469390 - protein, 9 aa, Homo Sapiens
GYGMMGKLT

SEQ ID NO: 469391 - protein, 9 aa, Homo Sapiens
GCRRKRCVV

SEQ ID NO: 469392 - protein, 9 aa, Homo Sapiens
LVRQTWQVV

SEQ ID NO: 469393 - protein, 9 aa, Homo Sapiens
WSGCRRKRC

SEQ ID NO: 469394 - protein, 9 aa, Homo Sapiens
SMAQALGPD

SEQ ID NO: 469395 - protein, 9 aa, Homo Sapiens
VHLPQGTCL

SEQ ID NO: 469396 - protein, 9 aa, Homo Sapiens
SSMFVSKKR

SEQ ID NO: 469397 - protein, 9 aa, Homo Sapiens
AVEAGFNWV

SEQ ID NO: 469398 - protein, 9 aa, Homo Sapiens
RMAISKSKW

SEQ ID NO: 469399 - protein, 9 aa, Homo Sapiens
SKWSGCRRK

SEQ ID NO: 469400 - protein, 9 aa, Homo Sapiens
TWQVVQGLE

SEQ ID NO: 469401 - protein, 9 aa, Homo Sapiens
NHYGEEVRD

SEQ ID NO: 469402 - protein, 9 aa, Homo Sapiens
TSKMQSRQI

SEQ ID NO: 469403 - protein, 9 aa, Homo Sapiens
KLQVLRMAI

SEQ ID NO: 469404 - protein, 9 aa, Homo Sapiens
MGKLTLWQQ

SEQ ID NO: 469405 - protein, 9 aa, Homo Sapiens
SRLHTTVYF

SEQ ID NO: 469406 - protein, 9 aa, Homo Sapiens
CLRNHYGEE

SEQ ID NO: 469407 - protein, 9 aa, Homo Sapiens
LGTTICLTC

SEQ ID NO: 469408 - protein, 9 aa, Homo Sapiens
TVYFFLSHL

SEQ ID NO: 469409 - protein, 9 aa, Homo Sapiens
GFNWVYYES

SEQ ID NO: 469410 - protein, 9 aa, Homo Sapiens
VVYATQDDL

SEQ ID NO: 469411 - protein, 9 aa, Homo Sapiens
LEFWEIDPA

SEQ ID NO: 469412 - protein, 9 aa, Homo Sapiens
FWEIDPAEI

SEQ ID NO: 469413 - protein, 9 aa, Homo Sapiens
MAISKSKWS

SEQ ID NO: 469414 - protein, 9 aa, Homo Sapiens
VSSRLHTTV

SEQ ID NO: 469415 - protein, 9 aa, Homo Sapiens
RIGSVVVYA

SEQ ID NO: 469416 - protein, 9 aa, Homo Sapiens
CLTCTLRND

SEQ ID NO: 469417 - protein, 9 aa, Homo Sapiens
RQTWQVVQG

SEQ ID NO: 469418 - protein, 9 aa, Homo Sapiens
VSKKRFILK

SEQ ID NO: 469419 - protein, 9 aa, Homo Sapiens
AISKSKWSG

SEQ ID NO: 469420 - protein, 9 aa, Homo Sapiens
TGKTAIAMS

SEQ ID NO: 469421 - protein, 9 aa, Homo Sapiens
LFPGKKFWE

SEQ ID NO: 469422 - protein, 9 aa, Homo Sapiens
RKRCVVWRK

SEQ ID NO: 469423 - protein, 9 aa, Homo Sapiens
QLFPGKKFW

SEQ ID NO: 469424 - protein, 9 aa, Homo Sapiens
TTVYFFLSH

SEQ ID NO: 469425 - protein, 9 aa, Homo Sapiens
MQSRQIGIS

SEQ ID NO: 469426 - protein, 9 aa, Homo Sapiens
VYATQDDLK

SEQ ID NO: 469427 - protein, 9 aa, Homo Sapiens
FNWVYYESK

SEQ ID NO: 469428 - protein, 9 aa, Homo Sapiens
ISKSKWSGC

SEQ ID NO: 469429 - protein, 9 aa, Homo Sapiens
GPCLRNHYG

SEQ ID NO: 469430 - protein, 9 aa, Homo Sapiens
RLHTTVYFF

SEQ ID NO: 469431 - protein, 9 aa, Homo Sapiens
LHTTVYFFL

SEQ ID NO: 469432 - protein, 9 aa, Homo Sapiens
ETQGYGMMG

SEQ ID NO: 469433 - protein, 9 aa, Homo Sapiens
VVVYATQDD

SEQ ID NO: 469434 - protein, 9 aa, Homo Sapiens
MFVSKKRFI

SEQ ID NO: 469435 - protein, 9 aa, Homo Sapiens
ELVRQTWQV

SEQ ID NO: 469436 - protein, 9 aa, Homo Sapiens
RNHYGEEVR

SEQ ID NO: 469437 - protein, 9 aa, Homo Sapiens
SMFVSKKRF

SEQ ID NO: 469438 - protein, 9 aa, Homo Sapiens
KWSGCRRKR

SEQ ID NO: 469439 - protein, 9 aa, Homo Sapiens
SKSKWSGCR

SEQ ID NO: 469440 - protein, 9 aa, Homo Sapiens
GRAMGEQLF

SEQ ID NO: 469441 - protein, 9 aa, Homo Sapiens
SSRLHTTVY

SEQ ID NO: 469442 - protein, 9 aa, Homo Sapiens
FPGKKFWET

SEQ ID NO: 469443 - protein, 9 aa, Homo Sapiens
TQGYGMMGK

SEQ ID NO: 469444 - protein, 9 aa, Homo Sapiens
FCGPCLRNH

SEQ ID NO: 469445 - protein, 9 aa, Homo Sapiens
KRCVVWRKC

SEQ ID NO: 469446 - protein, 9 aa, Homo Sapiens
TVHLPQGTC

SEQ ID NO: 469447 - protein, 9 aa, Homo Sapiens
VRQTWQVVQ

SEQ ID NO: 469448 - protein, 9 aa, Homo Sapiens
KKLQVLRMA

SEQ ID NO: 469449 - protein, 9 aa, Homo Sapiens
AIAMSMAQA

SEQ ID NO: 469450 - protein, 9 aa, Homo Sapiens
KKRFILKTC

SEQ ID NO: 469451 - protein, 9 aa, Homo Sapiens
AEILLDLGF

SEQ ID NO: 469452 - protein, 9 aa, Homo Sapiens
DPAEILLDL

SEQ ID NO: 469453 - protein, 9 aa, Homo Sapiens
QVTVHLPQG

SEQ ID NO: 469454 - protein, 9 aa, Homo Sapiens
YGMMGKLTL

SEQ ID NO: 469455 - protein, 9 aa, Homo Sapiens
WQVVQGLEA

SEQ ID NO: 469456 - protein, 9 aa, Homo Sapiens
LQVLRMAIS

SEQ ID NO: 469457 - protein, 9 aa, Homo Sapiens
VTVHLPQGT

SEQ ID NO: 469458 - protein, 9 aa, Homo Sapiens
KRFILKTCG

SEQ ID NO: 469459 - protein, 9 aa, Homo Sapiens
AMSMAQALG

SEQ ID NO: 469460 - protein, 9 aa, Homo Sapiens
VEAGFNWVY

SEQ ID NO: 469461 - protein, 9 aa, Homo Sapiens
KSKWSGCRR

SEQ ID NO: 469462 - protein, 9 aa, Homo Sapiens
ESSMFVSKK

SEQ ID NO: 469463 - protein, 9 aa, Homo Sapiens
HYGEEVRDA

SEQ ID NO: 469464 - protein, 9 aa, Homo Sapiens
NWVYYESKA

SEQ ID NO: 469465 - protein, 9 aa, Homo Sapiens
RAMGEQLFP

SEQ ID NO: 469466 - protein, 9 aa, Homo Sapiens
RLAVEAGFN

SEQ ID NO: 469467 - protein, 9 aa, Homo Sapiens
ICLTCTLRN

SEQ ID NO: 469468 - protein, 9 aa, Homo Sapiens
IAMSMAQAL

SEQ ID NO: 469469 - protein, 9 aa, Homo Sapiens
PEELVRQTW

SEQ ID NO: 469470 - protein, 9 aa, Homo Sapiens
PEQVTVHLP

SEQ ID NO: 469471 - protein, 9 aa, Homo Sapiens
SALGTTICL

SEQ ID NO: 469472 - protein, 9 aa, Homo Sapiens
EQLFPGKKF

SEQ ID NO: 469473 - protein, 9 aa, Homo Sapiens
GMMGKLTLW

SEQ ID NO: 469474 - protein, 9 aa, Homo Sapiens
MSMAQALGP

SEQ ID NO: 469475 - protein, 9 aa, Homo Sapiens
EIDPAEILL

SEQ ID NO: 469476 - protein, 9 aa, Homo Sapiens
KTAIAMSMA

SEQ ID NO: 469477 - protein, 9 aa, Homo Sapiens
GEQLFPGKK

SEQ ID NO: 469478 - protein, 9 aa, Homo Sapiens
LAVEAGFNW

SEQ ID NO: 469479 - protein, 9 aa, Homo Sapiens
DKIQCLGKA

SEQ ID NO: 469480 - protein, 9 aa, Homo Sapiens
QSRQIGISG

SEQ ID NO: 469481 - protein, 9 aa, Homo Sapiens
TSDKIQCLG

SEQ ID NO: 469482 - protein, 9 aa, Homo Sapiens
QVLRMAISK

SEQ ID NO: 469483 - protein, 9 aa, Homo Sapiens
CGPCLRNHY

SEQ ID NO: 469484 - protein, 9 aa, Homo Sapiens
TETQGYGMM

SEQ ID NO: 469485 - protein, 9 aa, Homo Sapiens
WEIDPAEIL

SEQ ID NO: 469486 - protein, 9 aa, Homo Sapiens
RQIGISGKN

SEQ ID NO: 469487 - protein, 9 aa, Homo Sapiens
KMQSRQIGI

SEQ ID NO: 469488 - protein, 9 aa, Homo Sapiens
SDKIQCLGK

SEQ ID NO: 469489 - protein, 9 aa, Homo Sapiens
ATQDDLKWS

SEQ ID NO: 469490 - protein, 9 aa, Homo Sapiens
YATQDDLKW

SEQ ID NO: 469491 - protein, 9 aa, Homo Sapiens
EQVTVHLPQ

SEQ ID NO: 469492 - protein, 9 aa, Homo Sapiens
MGEQLFPGK

SEQ ID NO: 469493 - protein, 9 aa, Homo Sapiens
QTWQVVQGL

SEQ ID NO: 469494 - protein, 9 aa, Homo Sapiens
GSVVVYATQ

SEQ ID NO: 469495 - protein, 9 aa, Homo Sapiens
QIGISGKNM

SEQ ID NO: 469496 - protein, 9 aa, Homo Sapiens
TAIAMSMAQ

SEQ ID NO: 469497 - protein, 9 aa, Homo Sapiens
HLPQGTCLT

SEQ ID NO: 469498 - protein, 9 aa, Homo Sapiens
GTTICLTCT

SEQ ID NO: 469499 - protein, 9 aa, Homo Sapiens
ALGTTICLT

SEQ ID NO: 469500 - protein, 9 aa, Homo Sapiens
QGYGMMGKL

SEQ ID NO: 469501 - protein, 9 aa, Homo Sapiens
IDPAEILLD

SEQ ID NO: 469502 - protein, 9 aa, Homo Sapiens
TTICLTCTL

SEQ ID NO: 469503 - protein, 9 aa, Homo Sapiens
SRQIGISGK

SEQ ID NO: 469504 - protein, 9 aa, Homo Sapiens
PCLRNHYGE

SEQ ID NO: 469505 - protein, 9 aa, Homo Sapiens
EFWEIDPAE

SEQ ID NO: 469506 - protein, 9 aa, Homo Sapiens
HRHTGIHTD

SEQ ID NO: 469507 - protein, 9 aa, Homo Sapiens
DTHRNTQAH

SEQ ID NO: 469508 - protein, 9 aa, Homo Sapiens
DNGYLLEKK

SEQ ID NO: 469509 - protein, 9 aa, Homo Sapiens
TGIHTDTHR

SEQ ID NO: 469510 - protein, 9 aa, Homo Sapiens
RHTHTQAYT

SEQ ID NO: 469511 - protein, 9 aa, Homo Sapiens
RIEDGKLYC

SEQ ID NO: 469512 - protein, 9 aa, Homo Sapiens
SMPSASLGR

SEQ ID NO: 469513 - protein, 9 aa, Homo Sapiens
SPSRNTLPP

SEQ ID NO: 469514 - protein, 9 aa, Homo Sapiens
WLDAGTQVF

SEQ ID NO: 469515 - protein, 9 aa, Homo Sapiens
KLYCDKRWY

SEQ ID NO: 469516 - protein, 9 aa, Homo Sapiens
SMLPPNAAA

SEQ ID NO: 469517 - protein, 9 aa, Homo Sapiens
TIILKMATS

SEQ ID NO: 469518 - protein, 9 aa, Homo Sapiens
PYQSVSMDT

SEQ ID NO: 469519 - protein, 9 aa, Homo Sapiens
RIEDTNLIP

SEQ ID NO: 469520 - protein, 9 aa, Homo Sapiens
LKGIVVIEK

SEQ ID NO: 469521 - protein, 9 aa, Homo Sapiens
CLIGIPEKE

SEQ ID NO: 469522 - protein, 9 aa, Homo Sapiens
CVIGFIVFV

SEQ ID NO: 469523 - protein, 9 aa, Homo Sapiens
HTQAYTLTY

SEQ ID NO: 469524 - protein, 9 aa, Homo Sapiens
VPPVLDVQT

SEQ ID NO: 469525 - protein, 9 aa, Homo Sapiens
CKRGCWVCT

SEQ ID NO: 469526 - protein, 9 aa, Homo Sapiens
AGTQVFFSF

SEQ ID NO: 469527 - protein, 9 aa, Homo Sapiens
DAGTQVFFS

SEQ ID NO: 469528 - protein, 9 aa, Homo Sapiens
QSPRSPPGK

SEQ ID NO: 469529 - protein, 9 aa, Homo Sapiens
EMEKEKSER

SEQ ID NO: 469530 - protein, 9 aa, Homo Sapiens
CTCKRGCWV

SEQ ID NO: 469531 - protein, 9 aa, Homo Sapiens
AYTLTYTGT

SEQ ID NO: 469532 - protein, 9 aa, Homo Sapiens
QTHIQAQTG

SEQ ID NO: 469533 - protein, 9 aa, Homo Sapiens
AVMAYDRSV

SEQ ID NO: 469534 - protein, 9 aa, Homo Sapiens
RECLGTHTV

SEQ ID NO: 469535 - protein, 9 aa, Homo Sapiens
YVLQAMEHM

SEQ ID NO: 469536 - protein, 9 aa, Homo Sapiens
AIYFIQKYF

SEQ ID NO: 469537 - protein, 9 aa, Homo Sapiens
AGAFSMLPP

SEQ ID NO: 469538 - protein, 9 aa, Homo Sapiens
PLSFAGAFS

SEQ ID NO: 469539 - protein, 9 aa, Homo Sapiens
VQTLLQRGL

SEQ ID NO: 469540 - protein, 9 aa, Homo Sapiens
DEVGTVVLV

SEQ ID NO: 469541 - protein, 9 aa, Homo Sapiens
DVQTLLQRG

SEQ ID NO: 469542 - protein, 9 aa, Homo Sapiens
HRYTHRHTQ

SEQ ID NO: 469543 - protein, 9 aa, Homo Sapiens
PLGVAIYFI

SEQ ID NO: 469544 - protein, 9 aa, Homo Sapiens
VISSSCGSM

SEQ ID NO: 469545 - protein, 9 aa, Homo Sapiens
THRHTHTHR

SEQ ID NO: 469546 - protein, 9 aa, Homo Sapiens
ITVFEVIIR

SEQ ID NO: 469547 - protein, 9 aa, Homo Sapiens
IYFIQKYFR

SEQ ID NO: 469548 - protein, 9 aa, Homo Sapiens
PQMPSDFLS

SEQ ID NO: 469549 - protein, 9 aa, Homo Sapiens
LSFAGAFSM

SEQ ID NO: 469550 - protein, 9 aa, Homo Sapiens
HGHIRARQR

SEQ ID NO: 469551 - protein, 9 aa, Homo Sapiens
RYLTWRRRI

SEQ ID NO: 469552 - protein, 9 aa, Homo Sapiens
VRIRNRKDA

SEQ ID NO: 469553 - protein, 9 aa, Homo Sapiens
GHIRARQRD

SEQ ID NO: 469554 - protein, 9 aa, Homo Sapiens
GTHRHTHTH

SEQ ID NO: 469555 - protein, 9 aa, Homo Sapiens
SMDTFNSKN

SEQ ID NO: 469556 - protein, 9 aa, Homo Sapiens
RYTHRHTQA

SEQ ID NO: 469557 - protein, 9 aa, Homo Sapiens
QFSMKLEKL

SEQ ID NO: 469558 - protein, 9 aa, Homo Sapiens
SPAFRIEDT

SEQ ID NO: 469559 - protein, 9 aa, Homo Sapiens
KVRIRNRKD

SEQ ID NO: 469560 - protein, 9 aa, Homo Sapiens
RSVAICNPL

SEQ ID NO: 469561 - protein, 9 aa, Homo Sapiens
VIVRDWVRQ

SEQ ID NO: 469562 - protein, 9 aa, Homo Sapiens
EEFSCSIRT

SEQ ID NO: 469563 - protein, 9 aa, Homo Sapiens
QLDFQQFSM

SEQ ID NO: 469564 - protein, 9 aa, Homo Sapiens
HTDTDTHSH

SEQ ID NO: 469565 - protein, 9 aa, Homo Sapiens
AGPPQMPSD

SEQ ID NO: 469566 - protein, 9 aa, Homo Sapiens
FAGAFSMLP

SEQ ID NO: 469567 - protein, 9 aa, Homo Sapiens
KGIVVIEKT

SEQ ID NO: 469568 - protein, 9 aa, Homo Sapiens
KEKKTKHKD

SEQ ID NO: 469569 - protein, 9 aa, Homo Sapiens
DKSQSPRSP

SEQ ID NO: 469570 - protein, 9 aa, Homo Sapiens
SVSMDTFNS

SEQ ID NO: 469571 - protein, 9 aa, Homo Sapiens
HTDTHRNTQ

SEQ ID NO: 469572 - protein, 9 aa, Homo Sapiens
GKLYCDKRW

SEQ ID NO: 469573 - protein, 9 aa, Homo Sapiens
HTHTHRYTH

SEQ ID NO: 469574 - protein, 9 aa, Homo Sapiens
LKTQLEMEK

SEQ ID NO: 469575 - protein, 9 aa, Homo Sapiens
VRDWVRQKP

SEQ ID NO: 469576 - protein, 9 aa, Homo Sapiens
VCSLKMEKK

SEQ ID NO: 469577 - protein, 9 aa, Homo Sapiens
YTGTHRHTH

SEQ ID NO: 469578 - protein, 9 aa, Homo Sapiens
HTVVVMGGK

SEQ ID NO: 469579 - protein, 9 aa, Homo Sapiens
RTHAYTREC

SEQ ID NO: 469580 - protein, 9 aa, Homo Sapiens
HRNTQAHTG

SEQ ID NO: 469581 - protein, 9 aa, Homo Sapiens
MEKKHDKYR

SEQ ID NO: 469582 - protein, 9 aa, Homo Sapiens
DKVRIRNRK

SEQ ID NO: 469583 - protein, 9 aa, Homo Sapiens
HFNRYLTWR

SEQ ID NO: 469584 - protein, 9 aa, Homo Sapiens
QTGTHRHIH

SEQ ID NO: 469585 - protein, 9 aa, Homo Sapiens
FSCSIRTGL

SEQ ID NO: 469586 - protein, 9 aa, Homo Sapiens
TQLEMEKEK

SEQ ID NO: 469587 - protein, 9 aa, Homo Sapiens
KSQSPRSPP

SEQ ID NO: 469588 - protein, 9 aa, Homo Sapiens
NTLPPPGTY

SEQ ID NO: 469589 - protein, 9 aa, Homo Sapiens
VLAPFMAQC

SEQ ID NO: 469590 - protein, 9 aa, Homo Sapiens
YLTWRRRIE

SEQ ID NO: 469591 - protein, 9 aa, Homo Sapiens
CGSMPSASL

SEQ ID NO: 469592 - protein, 9 aa, Homo Sapiens
QMPSDFLSF

SEQ ID NO: 469593 - protein, 9 aa, Homo Sapiens
SCGSMPSAS

SEQ ID NO: 469594 - protein, 9 aa, Homo Sapiens
KEDNGYLLE

SEQ ID NO: 469595 - protein, 9 aa, Homo Sapiens
QQFSMKLEK

SEQ ID NO: 469596 - protein, 9 aa, Homo Sapiens
IILKMATSY

SEQ ID NO: 469597 - protein, 9 aa, Homo Sapiens
IGFIVFVAS

SEQ ID NO: 469598 - protein, 9 aa, Homo Sapiens
MATSYLSGK

SEQ ID NO: 469599 - protein, 9 aa, Homo Sapiens
PSDFLSFQD

SEQ ID NO: 469600 - protein, 9 aa, Homo Sapiens
GIHTDTDTH

SEQ ID NO: 469601 - protein, 9 aa, Homo Sapiens
SRSCNICLI

SEQ ID NO: 469602 - protein, 9 aa, Homo Sapiens
LIQIHGHIR

SEQ ID NO: 469603 - protein, 9 aa, Homo Sapiens
VDKVRIRNR

SEQ ID NO: 469604 - protein, 9 aa, Homo Sapiens
QGDKSQSPR

SEQ ID NO: 469605 - protein, 9 aa, Homo Sapiens
GTHTVVVMG

SEQ ID NO: 469606 - protein, 9 aa, Homo Sapiens
NNLKGIVVI

SEQ ID NO: 469607 - protein, 9 aa, Homo Sapiens
PDTWLDAGT

SEQ ID NO: 469608 - protein, 9 aa, Homo Sapiens
TVVVMGGKE

SEQ ID NO: 469609 - protein, 9 aa, Homo Sapiens
DGNPDVLAP

SEQ ID NO: 469610 - protein, 9 aa, Homo Sapiens
NTCAAFTPT

SEQ ID NO: 469611 - protein, 9 aa, Homo Sapiens
FSITVFEVI

SEQ ID NO: 469612 - protein, 9 aa, Homo Sapiens
DTNLIPPVP

SEQ ID NO: 469613 - protein, 9 aa, Homo Sapiens
IQAQTGTHR

SEQ ID NO: 469614 - protein, 9 aa, Homo Sapiens
HSRTHAYTR

SEQ ID NO: 469615 - protein, 9 aa, Homo Sapiens
IHTDTHRNT

SEQ ID NO: 469616 - protein, 9 aa, Homo Sapiens
IHSALHKCQ

SEQ ID NO: 469617 - protein, 9 aa, Homo Sapiens
RIRNRKDAV

SEQ ID NO: 469618 - protein, 9 aa, Homo Sapiens
YCDKRWYHK

SEQ ID NO: 469619 - protein, 9 aa, Homo Sapiens
ICLIGIPEK

SEQ ID NO: 469620 - protein, 9 aa, Homo Sapiens
HTGMHRHTH

SEQ ID NO: 469621 - protein, 9 aa, Homo Sapiens
IHTDTDTHS

SEQ ID NO: 469622 - protein, 9 aa, Homo Sapiens
GSMPSASLG

SEQ ID NO: 469623 - protein, 9 aa, Homo Sapiens
VIEKTRMSE

SEQ ID NO: 469624 - protein, 9 aa, Homo Sapiens
ERSRSCNIC

SEQ ID NO: 469625 - protein, 9 aa, Homo Sapiens
GIVVIEKTR

SEQ ID NO: 469626 - protein, 9 aa, Homo Sapiens
THRYTHRHT

SEQ ID NO: 469627 - protein, 9 aa, Homo Sapiens
YDRSVAICN

SEQ ID NO: 469628 - protein, 9 aa, Homo Sapiens
AQTGTHRHI

SEQ ID NO: 469629 - protein, 9 aa, Homo Sapiens
SIRTGLLSD

SEQ ID NO: 469630 - protein, 9 aa, Homo Sapiens
GMHRHTHTQ

SEQ ID NO: 469631 - protein, 9 aa, Homo Sapiens
SVAICNPLL

SEQ ID NO: 469632 - protein, 9 aa, Homo Sapiens
ITWGKFMNS

SEQ ID NO: 469633 - protein, 9 aa, Homo Sapiens
LHKCQLQVQ

SEQ ID NO: 469634 - protein, 9 aa, Homo Sapiens
TCTCKRGCW

SEQ ID NO: 469635 - protein, 9 aa, Homo Sapiens
TGTHRHTHT

SEQ ID NO: 469636 - protein, 9 aa, Homo Sapiens
KRGCWVCTQ

SEQ ID NO: 469637 - protein, 9 aa, Homo Sapiens
FSMKLEKLT

SEQ ID NO: 469638 - protein, 9 aa, Homo Sapiens
FNRYLTWRR

SEQ ID NO: 469639 - protein, 9 aa, Homo Sapiens
AAFTPTFLV

SEQ ID NO: 469640 - protein, 9 aa, Homo Sapiens
TDTHRNTQA

SEQ ID NO: 469641 - protein, 9 aa, Homo Sapiens
YTHRHTQAY

SEQ ID NO: 469642 - protein, 9 aa, Homo Sapiens
LPNSHWFWL

SEQ ID NO: 469643 - protein, 9 aa, Homo Sapiens
LRVIVRDWV

SEQ ID NO: 469644 - protein, 9 aa, Homo Sapiens
LIHSALHKC

SEQ ID NO: 469645 - protein, 9 aa, Homo Sapiens
HRHTGMHRH

SEQ ID NO: 469646 - protein, 9 aa, Homo Sapiens
TWRRRIEIA

SEQ ID NO: 469647 - protein, 9 aa, Homo Sapiens
TQVFFSFSL

SEQ ID NO: 469648 - protein, 9 aa, Homo Sapiens
THRHTGIHT

SEQ ID NO: 469649 - protein, 9 aa, Homo Sapiens
GGKEDNGYL

SEQ ID NO: 469650 - protein, 9 aa, Homo Sapiens
CSIRTGLLS

SEQ ID NO: 469651 - protein, 9 aa, Homo Sapiens
EFSCSIRTG

SEQ ID NO: 469652 - protein, 9 aa, Homo Sapiens
VSMDTFNSK

SEQ ID NO: 469653 - protein, 9 aa, Homo Sapiens
KPFCVIGFI

SEQ ID NO: 469654 - protein, 9 aa, Homo Sapiens
NGYLLEKKI

SEQ ID NO: 469655 - protein, 9 aa, Homo Sapiens
FHFNRYLTW

SEQ ID NO: 469656 - protein, 9 aa, Homo Sapiens
YTRECLGTH

SEQ ID NO: 469657 - protein, 9 aa, Homo Sapiens
LGHTSPSRN

SEQ ID NO: 469658 - protein, 9 aa, Homo Sapiens
DRSVAICNP

SEQ ID NO: 469659 - protein, 9 aa, Homo Sapiens
IRARQRDKL

SEQ ID NO: 469660 - protein, 9 aa, Homo Sapiens
CNICLIGIP

SEQ ID NO: 469661 - protein, 9 aa, Homo Sapiens
DVACRRITW

SEQ ID NO: 469662 - protein, 9 aa, Homo Sapiens
DTHSHRHTH

SEQ ID NO: 469663 - protein, 9 aa, Homo Sapiens
TQAHTGIHT

SEQ ID NO: 469664 - protein, 9 aa, Homo Sapiens
AFSMLPPNA

SEQ ID NO: 469665 - protein, 9 aa, Homo Sapiens
HTSPSRNTL

SEQ ID NO: 469666 - protein, 9 aa, Homo Sapiens
SCNICLIGI

SEQ ID NO: 469667 - protein, 9 aa, Homo Sapiens
VDKQKLSKR

SEQ ID NO: 469668 - protein, 9 aa, Homo Sapiens
LKMEKKHDK

SEQ ID NO: 469669 - protein, 9 aa, Homo Sapiens
HTHTQAYTL

SEQ ID NO: 469670 - protein, 9 aa, Homo Sapiens
IVVIEKTRM

SEQ ID NO: 469671 - protein, 9 aa, Homo Sapiens
LPLGVAIYF

SEQ ID NO: 469672 - protein, 9 aa, Homo Sapiens
CRRITWGKF

SEQ ID NO: 469673 - protein, 9 aa, Homo Sapiens
QEEFSCSIR

SEQ ID NO: 469674 - protein, 9 aa, Homo Sapiens
NWLDFSITV

SEQ ID NO: 469675 - protein, 9 aa, Homo Sapiens
HKEKKTKHK

SEQ ID NO: 469676 - protein, 9 aa, Homo Sapiens
NLKGIVVIE

SEQ ID NO: 469677 - protein, 9 aa, Homo Sapiens
FRIEDTNLI

SEQ ID NO: 469678 - protein, 9 aa, Homo Sapiens
RHIHSRTHA

SEQ ID NO: 469679 - protein, 9 aa, Homo Sapiens
SDFLSFQDI

SEQ ID NO: 469680 - protein, 9 aa, Homo Sapiens
LDVQTLLQR

SEQ ID NO: 469681 - protein, 9 aa, Homo Sapiens
RHTHTHRYT

SEQ ID NO: 469682 - protein, 9 aa, Homo Sapiens
THRNTQAHT

SEQ ID NO: 469683 - protein, 9 aa, Homo Sapiens
LAVMAYDRS

SEQ ID NO: 469684 - protein, 9 aa, Homo Sapiens
RHTGIHTDT

SEQ ID NO: 469685 - protein, 9 aa, Homo Sapiens
TQAYTLTYT

SEQ ID NO: 469686 - protein, 9 aa, Homo Sapiens
HSHRHTHTH

SEQ ID NO: 469687 - protein, 9 aa, Homo Sapiens
IIHKVVRQI

SEQ ID NO: 469688 - protein, 9 aa, Homo Sapiens
DVLAPFMAQ

SEQ ID NO: 469689 - protein, 9 aa, Homo Sapiens
TKKIIHKVV

SEQ ID NO: 469690 - protein, 9 aa, Homo Sapiens
VAIYFIQKY

SEQ ID NO: 469691 - protein, 9 aa, Homo Sapiens
THTQAYTLT

SEQ ID NO: 469692 - protein, 9 aa, Homo Sapiens
NTQAHTGIH

SEQ ID NO: 469693 - protein, 9 aa, Homo Sapiens
SSVREDDEV

SEQ ID NO: 469694 - protein, 9 aa, Homo Sapiens
ISSSCGSMP

SEQ ID NO: 469695 - protein, 9 aa, Homo Sapiens
KKTKHKDGS

SEQ ID NO: 469696 - protein, 9 aa, Homo Sapiens
CLGTHTVVV

SEQ ID NO: 469697 - protein, 9 aa, Homo Sapiens
PPVLDVQTL

SEQ ID NO: 469698 - protein, 9 aa, Homo Sapiens
GTHRHIHSR

SEQ ID NO: 469699 - protein, 9 aa, Homo Sapiens
EDTNLIPPV

SEQ ID NO: 469700 - protein, 9 aa, Homo Sapiens
LEMEKEKSE

SEQ ID NO: 469701 - protein, 9 aa, Homo Sapiens
RSRSCNICL

SEQ ID NO: 469702 - protein, 9 aa, Homo Sapiens
KKIIHKVVR

SEQ ID NO: 469703 - protein, 9 aa, Homo Sapiens
LSPGRRLPN

SEQ ID NO: 469704 - protein, 9 aa, Homo Sapiens
GAFSMLPPN

SEQ ID NO: 469705 - protein, 9 aa, Homo Sapiens
HTQAYTQTH

SEQ ID NO: 469706 - protein, 9 aa, Homo Sapiens
ACRRITWGK

SEQ ID NO: 469707 - protein, 9 aa, Homo Sapiens
FDGNPDVLA

SEQ ID NO: 469708 - protein, 9 aa, Homo Sapiens
DDEVGTVVL

SEQ ID NO: 469709 - protein, 9 aa, Homo Sapiens
DFQQFSMKL

SEQ ID NO: 469710 - protein, 9 aa, Homo Sapiens
YQSVSMDTF

SEQ ID NO: 469711 - protein, 9 aa, Homo Sapiens
VIGFIVFVA

SEQ ID NO: 469712 - protein, 9 aa, Homo Sapiens
VACRRITWG

SEQ ID NO: 469713 - protein, 9 aa, Homo Sapiens
MLSPGRRLP

SEQ ID NO: 469714 - protein, 9 aa, Homo Sapiens
TWGKFMNSG

SEQ ID NO: 469715 - protein, 9 aa, Homo Sapiens
RHTQAYTQT

SEQ ID NO: 469716 - protein, 9 aa, Homo Sapiens
SFAGAFSML

SEQ ID NO: 469717 - protein, 9 aa, Homo Sapiens
IFVDKQKLS

SEQ ID NO: 469718 - protein, 9 aa, Homo Sapiens
WRRRIEIAN

SEQ ID NO: 469719 - protein, 9 aa, Homo Sapiens
MEKEKSERR

SEQ ID NO: 469720 - protein, 9 aa, Homo Sapiens
KLKTQLEME

SEQ ID NO: 469721 - protein, 9 aa, Homo Sapiens
QLEMEKEKS

SEQ ID NO: 469722 - protein, 9 aa, Homo Sapiens
EDDEVGTVV

SEQ ID NO: 469723 - protein, 9 aa, Homo Sapiens
LYCDKRWYH

SEQ ID NO: 469724 - protein, 9 aa, Homo Sapiens
EHMEPQVKQ

SEQ ID NO: 469725 - protein, 9 aa, Homo Sapiens
DLRVIVRDW

SEQ ID NO: 469726 - protein, 9 aa, Homo Sapiens
EDGKLYCDK

SEQ ID NO: 469727 - protein, 9 aa, Homo Sapiens
IHKVVRQID

SEQ ID NO: 469728 - protein, 9 aa, Homo Sapiens
GDKSQSPRS

SEQ ID NO: 469729 - protein, 9 aa, Homo Sapiens
VLDVQTLLQ

SEQ ID NO: 469730 - protein, 9 aa, Homo Sapiens
RTGLLSDET

SEQ ID NO: 469731 - protein, 9 aa, Homo Sapiens
DKQKLSKRA

SEQ ID NO: 469732 - protein, 9 aa, Homo Sapiens
NRKDAVEAY

SEQ ID NO: 469733 - protein, 9 aa, Homo Sapiens
RITWGKFMN

SEQ ID NO: 469734 - protein, 9 aa, Homo Sapiens
VMAYDRSVA

SEQ ID NO: 469735 - protein, 9 aa, Homo Sapiens
VLQAMEHME

SEQ ID NO: 469736 - protein, 9 aa, Homo Sapiens
CSLKMEKKH

SEQ ID NO: 469737 - protein, 9 aa, Homo Sapiens
CWVCTQAVC

SEQ ID NO: 469738 - protein, 9 aa, Homo Sapiens
THRHIHSRT

SEQ ID NO: 469739 - protein, 9 aa, Homo Sapiens
HKVVRQIDL

SEQ ID NO: 469740 - protein, 9 aa, Homo Sapiens
QAHTGIHTD

SEQ ID NO: 469741 - protein, 9 aa, Homo Sapiens
THTVVVMGG

SEQ ID NO: 469742 - protein, 9 aa, Homo Sapiens
SSCGSMPSA

SEQ ID NO: 469743 - protein, 9 aa, Homo Sapiens
PFCVIGFIV

SEQ ID NO: 469744 - protein, 9 aa, Homo Sapiens
LGTHTVVVM

SEQ ID NO: 469745 - protein, 9 aa, Homo Sapiens
THRHTQAYT

SEQ ID NO: 469746 - protein, 9 aa, Homo Sapiens
LTWRRRIEI

SEQ ID NO: 469747 - protein, 9 aa, Homo Sapiens
EKKHKEKKT

SEQ ID NO: 469748 - protein, 9 aa, Homo Sapiens
RSCNICLIG

SEQ ID NO: 469749 - protein, 9 aa, Homo Sapiens
KMEKKHDKY

SEQ ID NO: 469750 - protein, 9 aa, Homo Sapiens
QEVCSLKME

SEQ ID NO: 469751 - protein, 9 aa, Homo Sapiens
SPGRRLPNS

SEQ ID NO: 469752 - protein, 9 aa, Homo Sapiens
HRHTQAYTQ

SEQ ID NO: 469753 - protein, 9 aa, Homo Sapiens
SSSCGSMPS

SEQ ID NO: 469754 - protein, 9 aa, Homo Sapiens
KKLKTQLEM

SEQ ID NO: 469755 - protein, 9 aa, Homo Sapiens
SALHKCQLQ

SEQ ID NO: 469756 - protein, 9 aa, Homo Sapiens
MGGKEDNGY

SEQ ID NO: 469757 - protein, 9 aa, Homo Sapiens
QTLLQRGLQ

SEQ ID NO: 469758 - protein, 9 aa, Homo Sapiens
HKCQLQVQD

SEQ ID NO: 469759 - protein, 9 aa, Homo Sapiens
HAYTRECLG

SEQ ID NO: 469760 - protein, 9 aa, Homo Sapiens
PSRNTLPPP

SEQ ID NO: 469761 - protein, 9 aa, Homo Sapiens
SMKLEKLTD

SEQ ID NO: 469762 - protein, 9 aa, Homo Sapiens
YTQTHIQAQ

SEQ ID NO: 469763 - protein, 9 aa, Homo Sapiens
SEKKHKEKK

SEQ ID NO: 469764 - protein, 9 aa, Homo Sapiens
QAMEHMEPQ

SEQ ID NO: 469765 - protein, 9 aa, Homo Sapiens
LTYTGTHRH

SEQ ID NO: 469766 - protein, 9 aa, Homo Sapiens
MPSDFLSFQ

SEQ ID NO: 469767 - protein, 9 aa, Homo Sapiens
THTHRHTGI

SEQ ID NO: 469768 - protein, 9 aa, Homo Sapiens
PDVLAPFMA

SEQ ID NO: 469769 - protein, 9 aa, Homo Sapiens
SLKMEKKHD

SEQ ID NO: 469770 - protein, 9 aa, Homo Sapiens
PQGDKSQSP

SEQ ID NO: 469771 - protein, 9 aa, Homo Sapiens
ISNTCAAFT

SEQ ID NO: 469772 - protein, 9 aa, Homo Sapiens
DTWLDAGTQ

SEQ ID NO: 469773 - protein, 9 aa, Homo Sapiens
GIHTDTHRN

SEQ ID NO: 469774 - protein, 9 aa, Homo Sapiens
HSALHKCQL

SEQ ID NO: 469775 - protein, 9 aa, Homo Sapiens
GRRLPNSHW

SEQ ID NO: 469776 - protein, 9 aa, Homo Sapiens
KCQLQVQDM

SEQ ID NO: 469777 - protein, 9 aa, Homo Sapiens
IHSRTHAYT

SEQ ID NO: 469778 - protein, 9 aa, Homo Sapiens
HTHTHRHTG

SEQ ID NO: 469779 - protein, 9 aa, Homo Sapiens
THTHRYTHR

SEQ ID NO: 469780 - protein, 9 aa, Homo Sapiens
TSPSRNTLP

SEQ ID NO: 469781 - protein, 9 aa, Homo Sapiens
HTHRHTGIH

SEQ ID NO: 469782 - protein, 9 aa, Homo Sapiens
QSSVREDDE

SEQ ID NO: 469783 - protein, 9 aa, Homo Sapiens
RHTHTHRHT

SEQ ID NO: 469784 - protein, 9 aa, Homo Sapiens
VVIEKTRMS

SEQ ID NO: 469785 - protein, 9 aa, Homo Sapiens
PNSHWFWLK

SEQ ID NO: 469786 - protein, 9 aa, Homo Sapiens
TNLIPPVPD

SEQ ID NO: 469787 - protein, 9 aa, Homo Sapiens
LGVAIYFIQ

SEQ ID NO: 469788 - protein, 9 aa, Homo Sapiens
QVPPVLDVQ

SEQ ID NO: 469789 - protein, 9 aa, Homo Sapiens
DFSITVFEV

SEQ ID NO: 469790 - protein, 9 aa, Homo Sapiens
EVCSLKMEK

SEQ ID NO: 469791 - protein, 9 aa, Homo Sapiens
WNWLDFSIT

SEQ ID NO: 469792 - protein, 9 aa, Homo Sapiens
PGRRLPNSH

SEQ ID NO: 469793 - protein, 9 aa, Homo Sapiens
EKFDGNPDV

SEQ ID NO: 469794 - protein, 9 aa, Homo Sapiens
AYDRSVAIC

SEQ ID NO: 469795 - protein, 9 aa, Homo Sapiens
DTDTHSHRH

SEQ ID NO: 469796 - protein, 9 aa, Homo Sapiens
IQIHGHIRA

SEQ ID NO: 469797 - protein, 9 aa, Homo Sapiens
HIRARQRDK

SEQ ID NO: 469798 - protein, 9 aa, Homo Sapiens
GVAIYFIQK

SEQ ID NO: 469799 - protein, 9 aa, Homo Sapiens
SRTHAYTRE

SEQ ID NO: 469800 - protein, 9 aa, Homo Sapiens
IEDTNLIPP

SEQ ID NO: 469801 - protein, 9 aa, Homo Sapiens
TGIHTDTDT

SEQ ID NO: 469802 - protein, 9 aa, Homo Sapiens
HTGIHTDTD

SEQ ID NO: 469803 - protein, 9 aa, Homo Sapiens
RNTQAHTGI

SEQ ID NO: 469804 - protein, 9 aa, Homo Sapiens
KTQLEMEKE

SEQ ID NO: 469805 - protein, 9 aa, Homo Sapiens
NICLIGIPE

SEQ ID NO: 469806 - protein, 9 aa, Homo Sapiens
HTGIHTDTH

SEQ ID NO: 469807 - protein, 9 aa, Homo Sapiens
LKMATSYLS

SEQ ID NO: 469808 - protein, 9 aa, Homo Sapiens
RNTLPPPGT

SEQ ID NO: 469809 - protein, 9 aa, Homo Sapiens
YTLTYTGTH

SEQ ID NO: 469810 - protein, 9 aa, Homo Sapiens
KKHKEKKTK

SEQ ID NO: 469811 - protein, 9 aa, Homo Sapiens
GPPQMPSDF

SEQ ID NO: 469812 - protein, 9 aa, Homo Sapiens
AFTPTFLVY

SEQ ID NO: 469813 - protein, 9 aa, Homo Sapiens
GHTSPSRNT

SEQ ID NO: 469814 - protein, 9 aa, Homo Sapiens
TDTDTHSHR

SEQ ID NO: 469815 - protein, 9 aa, Homo Sapiens
TRECLGTHT

SEQ ID NO: 469816 - protein, 9 aa, Homo Sapiens
YQSSVREDD

SEQ ID NO: 469817 - protein, 9 aa, Homo Sapiens
KHKEKKTKH

SEQ ID NO: 469818 - protein, 9 aa, Homo Sapiens
TGMHRHTHT

SEQ ID NO: 469819 - protein, 9 aa, Homo Sapiens
KQKLSKRAE

SEQ ID NO: 469820 - protein, 9 aa, Homo Sapiens
LQAMEHMEP

SEQ ID NO: 469821 - protein, 9 aa, Homo Sapiens
ARKPFCVIG

SEQ ID NO: 469822 - protein, 9 aa, Homo Sapiens
GNPDVLAPF

SEQ ID NO: 469823 - protein, 9 aa, Homo Sapiens
QAQTGTHRH

SEQ ID NO: 469824 - protein, 9 aa, Homo Sapiens
LLPLGVAIY

SEQ ID NO: 469825 - protein, 9 aa, Homo Sapiens
LDFQQFSMK

SEQ ID NO: 469826 - protein, 9 aa, Homo Sapiens
ALHKCQLQV

SEQ ID NO: 469827 - protein, 9 aa, Homo Sapiens
GTQVFFSFS

SEQ ID NO: 469828 - protein, 9 aa, Homo Sapiens
MDTFNSKND

SEQ ID NO: 469829 - protein, 9 aa, Homo Sapiens
MAGPPQMPS

SEQ ID NO: 469830 - protein, 9 aa, Homo Sapiens
GYLLEKKIY

SEQ ID NO: 469831 - protein, 9 aa, Homo Sapiens
AFRIEDTNL

SEQ ID NO: 469832 - protein, 9 aa, Homo Sapiens
PAFRIEDTN

SEQ ID NO: 469833 - protein, 9 aa, Homo Sapiens
QKLSKRAEG

SEQ ID NO: 469834 - protein, 9 aa, Homo Sapiens
RVIVRDWVR

SEQ ID NO: 469835 - protein, 9 aa, Homo Sapiens
QSVSMDTFN

SEQ ID NO: 469836 - protein, 9 aa, Homo Sapiens
VVMGGKEDN

SEQ ID NO: 469837 - protein, 9 aa, Homo Sapiens
AHTGIHTDT

SEQ ID NO: 469838 - protein, 9 aa, Homo Sapiens
NIVTKKIIH

SEQ ID NO: 469839 - protein, 9 aa, Homo Sapiens
AMEHMEPQV

SEQ ID NO: 469840 - protein, 9 aa, Homo Sapiens
GCWVCTQAV

SEQ ID NO: 469841 - protein, 9 aa, Homo Sapiens
FTPTFLVYC

SEQ ID NO: 469842 - protein, 9 aa, Homo Sapiens
RRLPNSHWF

SEQ ID NO: 469843 - protein, 9 aa, Homo Sapiens
AYTRECLGT

SEQ ID NO: 469844 - protein, 9 aa, Homo Sapiens
SVREDDEVG

SEQ ID NO: 469845 - protein, 9 aa, Homo Sapiens
SHRHTHTHR

SEQ ID NO: 469846 - protein, 9 aa, Homo Sapiens
TPTFLVYCI

SEQ ID NO: 469847 - protein, 9 aa, Homo Sapiens
EDNGYLLEK

SEQ ID NO: 469848 - protein, 9 aa, Homo Sapiens
CDKRWYHKS

SEQ ID NO: 469849 - protein, 9 aa, Homo Sapiens
HRHIHSRTH

SEQ ID NO: 469850 - protein, 9 aa, Homo Sapiens
KIIHKVVRQ

SEQ ID NO: 469851 - protein, 9 aa, Homo Sapiens
IEKTRMSEQ

SEQ ID NO: 469852 - protein, 9 aa, Homo Sapiens
AYTQTHIQA

SEQ ID NO: 469853 - protein, 9 aa, Homo Sapiens
ECLGTHTVV

SEQ ID NO: 469854 - protein, 9 aa, Homo Sapiens
SQEVCSLKM

SEQ ID NO: 469855 - protein, 9 aa, Homo Sapiens
IEDGKLYCD

SEQ ID NO: 469856 - protein, 9 aa, Homo Sapiens
PVLDVQTLL

SEQ ID NO: 469857 - protein, 9 aa, Homo Sapiens
MAYDRSVAI

SEQ ID NO: 469858 - protein, 9 aa, Homo Sapiens
KMATSYLSG

SEQ ID NO: 469859 - protein, 9 aa, Homo Sapiens
REDDEVGTV

SEQ ID NO: 469860 - protein, 9 aa, Homo Sapiens
LDVACRRIT

SEQ ID NO: 469861 - protein, 9 aa, Homo Sapiens
NPDVLAPFM

SEQ ID NO: 469862 - protein, 9 aa, Homo Sapiens
TQAYTQTHI

SEQ ID NO: 469863 - protein, 9 aa, Homo Sapiens
PPQMPSDFL

SEQ ID NO: 469864 - protein, 9 aa, Homo Sapiens
SCSIRTGLL

SEQ ID NO: 469865 - protein, 9 aa, Homo Sapiens
EKKTKHKDG

SEQ ID NO: 469866 - protein, 9 aa, Homo Sapiens
CAAFTPTFL

SEQ ID NO: 469867 - protein, 9 aa, Homo Sapiens
LDAGTQVFF

SEQ ID NO: 469868 - protein, 9 aa, Homo Sapiens
TSYLSGKKS

SEQ ID NO: 469869 - protein, 9 aa, Homo Sapiens
IVRDWVRQK

SEQ ID NO: 469870 - protein, 9 aa, Homo Sapiens
FVDKQKLSK

SEQ ID NO: 469871 - protein, 9 aa, Homo Sapiens
PPQGDKSQS

SEQ ID NO: 469872 - protein, 9 aa, Homo Sapiens
GKEDNGYLL

SEQ ID NO: 469873 - protein, 9 aa, Homo Sapiens
FSMLPPNAA

SEQ ID NO: 469874 - protein, 9 aa, Homo Sapiens
RNRKDAVEA

SEQ ID NO: 469875 - protein, 9 aa, Homo Sapiens
GRYVLQAME

SEQ ID NO: 469876 - protein, 9 aa, Homo Sapiens
SRNTLPPPG

SEQ ID NO: 469877 - protein, 9 aa, Homo Sapiens
HIQAQTGTH

SEQ ID NO: 469878 - protein, 9 aa, Homo Sapiens
VREDDEVGT

SEQ ID NO: 469879 - protein, 9 aa, Homo Sapiens
IRNRKDAVE

SEQ ID NO: 469880 - protein, 9 aa, Homo Sapiens
TCAAFTPTF

SEQ ID NO: 469881 - protein, 9 aa, Homo Sapiens
PPPQGDKSQ

SEQ ID NO: 469882 - protein, 9 aa, Homo Sapiens
MHRHTHTQA

SEQ ID NO: 469883 - protein, 9 aa, Homo Sapiens
GDDLRVIVR

SEQ ID NO: 469884 - protein, 9 aa, Homo Sapiens
SQSPRSPPG

SEQ ID NO: 469885 - protein, 9 aa, Homo Sapiens
WLDFSITVF

SEQ ID NO: 469886 - protein, 9 aa, Homo Sapiens
FCVIGFIVF

SEQ ID NO: 469887 - protein, 9 aa, Homo Sapiens
RDWVRQKPV

SEQ ID NO: 469888 - protein, 9 aa, Homo Sapiens
HRHTHTQAY

SEQ ID NO: 469889 - protein, 9 aa, Homo Sapiens
RHTGMHRHT

SEQ ID NO: 469890 - protein, 9 aa, Homo Sapiens
TWLDAGTQV

SEQ ID NO: 469891 - protein, 9 aa, Homo Sapiens
QAYTQTHIQ

SEQ ID NO: 469892 - protein, 9 aa, Homo Sapiens
ALLPLGVAI

SEQ ID NO: 469893 - protein, 9 aa, Homo Sapiens
QIHGHIRAR

SEQ ID NO: 469894 - protein, 9 aa, Homo Sapiens
LDFSITVFE

SEQ ID NO: 469895 - protein, 9 aa, Homo Sapiens
FQQFSMKLE

SEQ ID NO: 469896 - protein, 9 aa, Homo Sapiens
CQLQVQDMR

SEQ ID NO: 469897 - protein, 9 aa, Homo Sapiens
DDLRVIVRD

SEQ ID NO: 469898 - protein, 9 aa, Homo Sapiens
TCKRGCWVC

SEQ ID NO: 469899 - protein, 9 aa, Homo Sapiens
RGCWVCTQA

SEQ ID NO: 469900 - protein, 9 aa, Homo Sapiens
DGKLYCDKR

SEQ ID NO: 469901 - protein, 9 aa, Homo Sapiens
SNTCAAFTP

SEQ ID NO: 469902 - protein, 9 aa, Homo Sapiens
KFDGNPDVL

SEQ ID NO: 469903 - protein, 9 aa, Homo Sapiens
THAYTRECL

SEQ ID NO: 469904 - protein, 9 aa, Homo Sapiens
TVDKVRIRN

SEQ ID NO: 469905 - protein, 9 aa, Homo Sapiens
MPSASLGRG

SEQ ID NO: 469906 - protein, 9 aa, Homo Sapiens
RRITWGKFM

SEQ ID NO: 469907 - protein, 9 aa, Homo Sapiens
IHGHIRARQ

SEQ ID NO: 469908 - protein, 9 aa, Homo Sapiens
ILKMATSYL

SEQ ID NO: 469909 - protein, 9 aa, Homo Sapiens
IVTKKIIHK

SEQ ID NO: 469910 - protein, 9 aa, Homo Sapiens
TYTGTHRHT

SEQ ID NO: 469911 - protein, 9 aa, Homo Sapiens
MQLDFQQFS

SEQ ID NO: 469912 - protein, 9 aa, Homo Sapiens
RKPFCVIGF

SEQ ID NO: 469913 - protein, 9 aa, Homo Sapiens
QAYTLTYTG

SEQ ID NO: 469914 - protein, 9 aa, Homo Sapiens
RLPNSHWFW

SEQ ID NO: 469915 - protein, 9 aa, Homo Sapiens
TLTYTGTHR

SEQ ID NO: 469916 - protein, 9 aa, Homo Sapiens
SITVFEVII

SEQ ID NO: 469917 - protein, 9 aa, Homo Sapiens
HRHTHTHRY

SEQ ID NO: 469918 - protein, 9 aa, Homo Sapiens
HRHTHTHRH

SEQ ID NO: 469919 - protein, 9 aa, Homo Sapiens
THIQAQTGT

SEQ ID NO: 469920 - protein, 9 aa, Homo Sapiens
LPYQSVSMD

SEQ ID NO: 469921 - protein, 9 aa, Homo Sapiens
IRTGLLSDE

SEQ ID NO: 469922 - protein, 9 aa, Homo Sapiens
HIHSRTHAY

SEQ ID NO: 469923 - protein, 9 aa, Homo Sapiens
THSHRHTHT

SEQ ID NO: 469924 - protein, 9 aa, Homo Sapiens
NTCTCKRGC

SEQ ID NO: 469925 - protein, 9 aa, Homo Sapiens
RYVLQAMEH

SEQ ID NO: 469926 - protein, 9 aa, Homo Sapiens
NRYLTWRRR

SEQ ID NO: 469927 - protein, 9 aa, Homo Sapiens
TGTHRHIHS

SEQ ID NO: 469928 - protein, 9 aa, Homo Sapiens
MEHMEPQVK

SEQ ID NO: 469929 - protein, 9 aa, Homo Sapiens
TQTHIQAQT

SEQ ID NO: 469930 - protein, 9 aa, Homo Sapiens
VMGGKEDNG

SEQ ID NO: 469931 - protein, 9 aa, Homo Sapiens
VTKKIIHKV

SEQ ID NO: 469932 - protein, 9 aa, Homo Sapiens
SLIQIHGHI

SEQ ID NO: 469933 - protein, 9 aa, Homo Sapiens
TDTHSHRHT

SEQ ID NO: 469934 - protein, 9 aa, Homo Sapiens
TLPYQSVSM

SEQ ID NO: 469935 - protein, 9 aa, Homo Sapiens
PWNWLDFSI

SEQ ID NO: 469936 - protein, 9 aa, Homo Sapiens
HTHRYTHRH

SEQ ID NO: 469937 - protein, 9 aa, Homo Sapiens
ATSYLSGKK

SEQ ID NO: 469938 - protein, 9 aa, Homo Sapiens
VVVMGGKED

SEQ ID NO: 469939 - protein, 9 aa, Homo Sapiens
GFIVFVASV

SEQ ID NO: 469940 - protein, 9 aa, Homo Sapiens
GMVELGTQS

SEQ ID NO: 469941 - protein, 9 aa, Homo Sapiens
QGEMAHTCH

SEQ ID NO: 469942 - protein, 9 aa, Homo Sapiens
QACMAKGCA

SEQ ID NO: 469943 - protein, 9 aa, Homo Sapiens
FSGSPCSHP

SEQ ID NO: 469944 - protein, 9 aa, Homo Sapiens
TQSIVYELA

SEQ ID NO: 469945 - protein, 9 aa, Homo Sapiens
VLPPNQEVQ

SEQ ID NO: 469946 - protein, 9 aa, Homo Sapiens
MLGKIVYTH

SEQ ID NO: 469947 - protein, 9 aa, Homo Sapiens
TCHGTINLS

SEQ ID NO: 469948 - protein, 9 aa, Homo Sapiens
SQIGFKCSW

SEQ ID NO: 469949 - protein, 9 aa, Homo Sapiens
IGFKCSWCS

SEQ ID NO: 469950 - protein, 9 aa, Homo Sapiens
QKDLNFLSP

SEQ ID NO: 469951 - protein, 9 aa, Homo Sapiens
LGTVEQNQD

SEQ ID NO: 469952 - protein, 9 aa, Homo Sapiens
DALVLRTQT

SEQ ID NO: 469953 - protein, 9 aa, Homo Sapiens
LPPNQEVQR

SEQ ID NO: 469954 - protein, 9 aa, Homo Sapiens
LVLPPNQEV

SEQ ID NO: 469955 - protein, 9 aa, Homo Sapiens
SFRVQACMA

SEQ ID NO: 469956 - protein, 9 aa, Homo Sapiens
NQDSEGSFK

SEQ ID NO: 469957 - protein, 9 aa, Homo Sapiens
RSCFFFLVT

SEQ ID NO: 469958 - protein, 9 aa, Homo Sapiens
YHTYHSLQK

SEQ ID NO: 469959 - protein, 9 aa, Homo Sapiens
EFSGSPCSH

SEQ ID NO: 469960 - protein, 9 aa, Homo Sapiens
SFQELFQFT

SEQ ID NO: 469961 - protein, 9 aa, Homo Sapiens
ALVLRTQTT

SEQ ID NO: 469962 - protein, 9 aa, Homo Sapiens
TVEQNQDSE

SEQ ID NO: 469963 - protein, 9 aa, Homo Sapiens
FFFDNLLVY

SEQ ID NO: 469964 - protein, 9 aa, Homo Sapiens
GTQSIVYEL

SEQ ID NO: 469965 - protein, 9 aa, Homo Sapiens
VEQNQDSEG

SEQ ID NO: 469966 - protein, 9 aa, Homo Sapiens
KKSMLGKIV

SEQ ID NO: 469967 - protein, 9 aa, Homo Sapiens
DEPTDIIPQ

SEQ ID NO: 469968 - protein, 9 aa, Homo Sapiens
ERVFFFFDN

SEQ ID NO: 469969 - protein, 9 aa, Homo Sapiens
EPTDIIPQS

SEQ ID NO: 469970 - protein, 9 aa, Homo Sapiens
RTQTTQLPI

SEQ ID NO: 469971 - protein, 9 aa, Homo Sapiens
QSCQLMTDV

SEQ ID NO: 469972 - protein, 9 aa, Homo Sapiens
QFTSEEHSC

SEQ ID NO: 469973 - protein, 9 aa, Homo Sapiens
MVELGTQSI

SEQ ID NO: 469974 - protein, 9 aa, Homo Sapiens
IQERVFFFF

SEQ ID NO: 469975 - protein, 9 aa, Homo Sapiens
SGSPCSHPQ

SEQ ID NO: 469976 - protein, 9 aa, Homo Sapiens
FLVTCVCLW

SEQ ID NO: 469977 - protein, 9 aa, Homo Sapiens
TYHSLQKDL

SEQ ID NO: 469978 - protein, 9 aa, Homo Sapiens
CSHPQYSSY

SEQ ID NO: 469979 - protein, 9 aa, Homo Sapiens
DSLGTVEQN

SEQ ID NO: 469980 - protein, 9 aa, Homo Sapiens
ILGMVELGT

SEQ ID NO: 469981 - protein, 9 aa, Homo Sapiens
KCSWCSKLQ

SEQ ID NO: 469982 - protein, 9 aa, Homo Sapiens
VSSQIGFKC

SEQ ID NO: 469983 - protein, 9 aa, Homo Sapiens
FFFFDNLLV

SEQ ID NO: 469984 - protein, 9 aa, Homo Sapiens
QNQDSEGSF

SEQ ID NO: 469985 - protein, 9 aa, Homo Sapiens
LRTQTTQLP

SEQ ID NO: 469986 - protein, 9 aa, Homo Sapiens
LLIFFPLNK

SEQ ID NO: 469987 - protein, 9 aa, Homo Sapiens
TEFIFLVLP

SEQ ID NO: 469988 - protein, 9 aa, Homo Sapiens
AHTCHGTIN

SEQ ID NO: 469989 - protein, 9 aa, Homo Sapiens
SSQIGFKCS

SEQ ID NO: 469990 - protein, 9 aa, Homo Sapiens
EFIFLVLPP

SEQ ID NO: 469991 - protein, 9 aa, Homo Sapiens
CFFFLVTCV

SEQ ID NO: 469992 - protein, 9 aa, Homo Sapiens
PQSCQLMTD

SEQ ID NO: 469993 - protein, 9 aa, Homo Sapiens
LVLRTQTTQ

SEQ ID NO: 469994 - protein, 9 aa, Homo Sapiens
AATRCRLLK

SEQ ID NO: 469995 - protein, 9 aa, Homo Sapiens
SCFFFLVTC

SEQ ID NO: 469996 - protein, 9 aa, Homo Sapiens
LGMVELGTQ

SEQ ID NO: 469997 - protein, 9 aa, Homo Sapiens
TRCRLLKES

SEQ ID NO: 469998 - protein, 9 aa, Homo Sapiens
TSEEHSCVE

SEQ ID NO: 469999 - protein, 9 aa, Homo Sapiens
LREKAATRC

SEQ ID NO: 470000 - protein, 9 aa, Homo Sapiens
GSEFSGSPC

SEQ ID NO: 470001 - protein, 9 aa, Homo Sapiens
QIGFKCSWC

SEQ ID NO: 470002 - protein, 9 aa, Homo Sapiens
IPQSCQLMT

SEQ ID NO: 470003 - protein, 9 aa, Homo Sapiens
PTDIIPQSC

SEQ ID NO: 470004 - protein, 9 aa, Homo Sapiens
FQFTSEEHS

SEQ ID NO: 470005 - protein, 9 aa, Homo Sapiens
ELFQFTSEE

SEQ ID NO: 470006 - protein, 9 aa, Homo Sapiens
QELFQFTSE

SEQ ID NO: 470007 - protein, 9 aa, Homo Sapiens
KSMLGKIVY

SEQ ID NO: 470008 - protein, 9 aa, Homo Sapiens
FIFLVLPPN

SEQ ID NO: 470009 - protein, 9 aa, Homo Sapiens
PLLLIFFPL

SEQ ID NO: 470010 - protein, 9 aa, Homo Sapiens
SPCSHPQYS

SEQ ID NO: 470011 - protein, 9 aa, Homo Sapiens
CVSSQIGFK

SEQ ID NO: 470012 - protein, 9 aa, Homo Sapiens
LFQFTSEEH

SEQ ID NO: 470013 - protein, 9 aa, Homo Sapiens
KIVYTHSGC

SEQ ID NO: 470014 - protein, 9 aa, Homo Sapiens
VLRTQTTQL

SEQ ID NO: 470015 - protein, 9 aa, Homo Sapiens
FFLVTCVCL

SEQ ID NO: 470016 - protein, 9 aa, Homo Sapiens
PPNQEVQRV

SEQ ID NO: 470017 - protein, 9 aa, Homo Sapiens
VQACMAKGC

SEQ ID NO: 470018 - protein, 9 aa, Homo Sapiens
ELGTQSIVY

SEQ ID NO: 470019 - protein, 9 aa, Homo Sapiens
FLVLPPNQE

SEQ ID NO: 470020 - protein, 9 aa, Homo Sapiens
EQNQDSEGS

SEQ ID NO: 470021 - protein, 9 aa, Homo Sapiens
LMYRSCFFF

SEQ ID NO: 470022 - protein, 9 aa, Homo Sapiens
HSFRVQACM

SEQ ID NO: 470023 - protein, 9 aa, Homo Sapiens
FRVQACMAK

SEQ ID NO: 470024 - protein, 9 aa, Homo Sapiens
HGTINLSTA

SEQ ID NO: 470025 - protein, 9 aa, Homo Sapiens
GFKCSWCSK

SEQ ID NO: 470026 - protein, 9 aa, Homo Sapiens
MYRSCFFFL

SEQ ID NO: 470027 - protein, 9 aa, Homo Sapiens
TPLLLIFFP

SEQ ID NO: 470028 - protein, 9 aa, Homo Sapiens
IVYTHSGCW

SEQ ID NO: 470029 - protein, 9 aa, Homo Sapiens
RVFFFFDNL

SEQ ID NO: 470030 - protein, 9 aa, Homo Sapiens
VFFFFDNLL

SEQ ID NO: 470031 - protein, 9 aa, Homo Sapiens
KKKSMLGKI

SEQ ID NO: 470032 - protein, 9 aa, Homo Sapiens
QTTQLPIIP

SEQ ID NO: 470033 - protein, 9 aa, Homo Sapiens
CRLLKESLL

SEQ ID NO: 470034 - protein, 9 aa, Homo Sapiens
TTQLPIIPT

SEQ ID NO: 470035 - protein, 9 aa, Homo Sapiens
YHSLQKDLN

SEQ ID NO: 470036 - protein, 9 aa, Homo Sapiens
MAKGCALGP

SEQ ID NO: 470037 - protein, 9 aa, Homo Sapiens
LQKDLNFLS

SEQ ID NO: 470038 - protein, 9 aa, Homo Sapiens
IFFPLNKSW

SEQ ID NO: 470039 - protein, 9 aa, Homo Sapiens
RVQACMAKG

SEQ ID NO: 470040 - protein, 9 aa, Homo Sapiens
CHGTINLST

SEQ ID NO: 470041 - protein, 9 aa, Homo Sapiens
YRSCFFFLV

SEQ ID NO: 470042 - protein, 9 aa, Homo Sapiens
IIPQSCQLM

SEQ ID NO: 470043 - protein, 9 aa, Homo Sapiens
REKAATRCR

SEQ ID NO: 470044 - protein, 9 aa, Homo Sapiens
EKAATRCRL

SEQ ID NO: 470045 - protein, 9 aa, Homo Sapiens
QERVFFFFD

SEQ ID NO: 470046 - protein, 9 aa, Homo Sapiens
IFLVLPPNQ

SEQ ID NO: 470047 - protein, 9 aa, Homo Sapiens
HTCHGTINL

SEQ ID NO: 470048 - protein, 9 aa, Homo Sapiens
KAATRCRLL

SEQ ID NO: 470049 - protein, 9 aa, Homo Sapiens
HTYHSLQKD

SEQ ID NO: 470050 - protein, 9 aa, Homo Sapiens
SMLGKIVYT

SEQ ID NO: 470051 - protein, 9 aa, Homo Sapiens
EMAHTCHGT

SEQ ID NO: 470052 - protein, 9 aa, Homo Sapiens
FKCSWCSKL

SEQ ID NO: 470053 - protein, 9 aa, Homo Sapiens
ATRCRLLKE

SEQ ID NO: 470054 - protein, 9 aa, Homo Sapiens
FQELFQFTS

SEQ ID NO: 470055 - protein, 9 aa, Homo Sapiens
LLLIFFPLN

SEQ ID NO: 470056 - protein, 9 aa, Homo Sapiens
ITPLLLIFF

SEQ ID NO: 470057 - protein, 9 aa, Homo Sapiens
GKIVYTHSG

SEQ ID NO: 470058 - protein, 9 aa, Homo Sapiens
NIQERVFFF

SEQ ID NO: 470059 - protein, 9 aa, Homo Sapiens
FFPLNKSWI

SEQ ID NO: 470060 - protein, 9 aa, Homo Sapiens
LIFFPLNKS

SEQ ID NO: 470061 - protein, 9 aa, Homo Sapiens
DIIPQSCQL

SEQ ID NO: 470062 - protein, 9 aa, Homo Sapiens
RCRLLKESL

SEQ ID NO: 470063 - protein, 9 aa, Homo Sapiens
ACMAKGCAL

SEQ ID NO: 470064 - protein, 9 aa, Homo Sapiens
FFFLVTCVC

SEQ ID NO: 470065 - protein, 9 aa, Homo Sapiens
SLQKDLNFL

SEQ ID NO: 470066 - protein, 9 aa, Homo Sapiens
FTSEEHSCV

SEQ ID NO: 470067 - protein, 9 aa, Homo Sapiens
FFDNLLVYC

SEQ ID NO: 470068 - protein, 9 aa, Homo Sapiens
GSPCSHPQY

SEQ ID NO: 470069 - protein, 9 aa, Homo Sapiens
SLGTVEQNQ

SEQ ID NO: 470070 - protein, 9 aa, Homo Sapiens
LITPLLLIF

SEQ ID NO: 470071 - protein, 9 aa, Homo Sapiens
LYHTYHSLQ

SEQ ID NO: 470072 - protein, 9 aa, Homo Sapiens
GTVEQNQDS

SEQ ID NO: 470073 - protein, 9 aa, Homo Sapiens
TDIIPQSCQ

SEQ ID NO: 470074 - protein, 9 aa, Homo Sapiens
LGKIVYTHS

SEQ ID NO: 470075 - protein, 9 aa, Homo Sapiens
PCSHPQYSS

SEQ ID NO: 470076 - protein, 9 aa, Homo Sapiens
SEFSGSPCS

SEQ ID NO: 470077 - protein, 9 aa, Homo Sapiens
LGTQSIVYE

SEQ ID NO: 470078 - protein, 9 aa, Homo Sapiens
GEMAHTCHG

SEQ ID NO: 470079 - protein, 9 aa, Homo Sapiens
VELGTQSIV

SEQ ID NO: 470080 - protein, 9 aa, Homo Sapiens
TQTTQLPII

SEQ ID NO: 470081 - protein, 9 aa, Homo Sapiens
HSLQKDLNF

SEQ ID NO: 470082 - protein, 9 aa, Homo Sapiens
CMAKGCALG

SEQ ID NO: 470083 - protein, 9 aa, Homo Sapiens
MAHTCHGTI

SEQ ID NO: 470084 - protein, 9 aa, Homo Sapiens
NLFVLGPAT

SEQ ID NO: 470085 - protein, 9 aa, Homo Sapiens
MFGKPRKLL

SEQ ID NO: 470086 - protein, 9 aa, Homo Sapiens
LVESTMERN

SEQ ID NO: 470087 - protein, 9 aa, Homo Sapiens
ARKKFWKIL

SEQ ID NO: 470088 - protein, 9 aa, Homo Sapiens
DRGLDEGPW

SEQ ID NO: 470089 - protein, 9 aa, Homo Sapiens
RTALTKKCK

SEQ ID NO: 470090 - protein, 9 aa, Homo Sapiens
LLKLVSCIL

SEQ ID NO: 470091 - protein, 9 aa, Homo Sapiens
GNMEVGRDV

SEQ ID NO: 470092 - protein, 9 aa, Homo Sapiens
PYQNDATCL

SEQ ID NO: 470093 - protein, 9 aa, Homo Sapiens
LFVRKNNSP

SEQ ID NO: 470094 - protein, 9 aa, Homo Sapiens
TALTKKCKL

SEQ ID NO: 470095 - protein, 9 aa, Homo Sapiens
SAVDTMLTT

SEQ ID NO: 470096 - protein, 9 aa, Homo Sapiens
KPSAGPGSW

SEQ ID NO: 470097 - protein, 9 aa, Homo Sapiens
WTAPLQCVS

SEQ ID NO: 470098 - protein, 9 aa, Homo Sapiens
DHAGAWALV

SEQ ID NO: 470099 - protein, 9 aa, Homo Sapiens
EHDQHQLLK

SEQ ID NO: 470100 - protein, 9 aa, Homo Sapiens
GKDQQQQQE

SEQ ID NO: 470101 - protein, 9 aa, Homo Sapiens
ECWIHSKYE

SEQ ID NO: 470102 - protein, 9 aa, Homo Sapiens
DFVIIVFAY

SEQ ID NO: 470103 - protein, 9 aa, Homo Sapiens
RINLFVLGP

SEQ ID NO: 470104 - protein, 9 aa, Homo Sapiens
WRQEERIRE

SEQ ID NO: 470105 - protein, 9 aa, Homo Sapiens
GIANGNVAL

SEQ ID NO: 470106 - protein, 9 aa, Homo Sapiens
QLLKDNRAE

SEQ ID NO: 470107 - protein, 9 aa, Homo Sapiens
SRTALTKKC

SEQ ID NO: 470108 - protein, 9 aa, Homo Sapiens
AVLGFKTNV

SEQ ID NO: 470109 - protein, 9 aa, Homo Sapiens
TMERNFLLD

SEQ ID NO: 470110 - protein, 9 aa, Homo Sapiens
SAFLSPMPY

SEQ ID NO: 470111 - protein, 9 aa, Homo Sapiens
KETMSVSNL

SEQ ID NO: 470112 - protein, 9 aa, Homo Sapiens
DQHQLLKDN

SEQ ID NO: 470113 - protein, 9 aa, Homo Sapiens
WLDFVIIVF

SEQ ID NO: 470114 - protein, 9 aa, Homo Sapiens
FKFSVAYII

SEQ ID NO: 470115 - protein, 9 aa, Homo Sapiens
PNRHEISPR

SEQ ID NO: 470116 - protein, 9 aa, Homo Sapiens
PRYRINLFV

SEQ ID NO: 470117 - protein, 9 aa, Homo Sapiens
ISLLNWRQE

SEQ ID NO: 470118 - protein, 9 aa, Homo Sapiens
TSTTHEYRE

SEQ ID NO: 470119 - protein, 9 aa, Homo Sapiens
NWRQEERIR

SEQ ID NO: 470120 - protein, 9 aa, Homo Sapiens
PVGGAKGAW

SEQ ID NO: 470121 - protein, 9 aa, Homo Sapiens
SNLWNTLSS

SEQ ID NO: 470122 - protein, 9 aa, Homo Sapiens
LDFVIIVFA

SEQ ID NO: 470123 - protein, 9 aa, Homo Sapiens
GGLFVDSPE

SEQ ID NO: 470124 - protein, 9 aa, Homo Sapiens
NMEVGRDVT

SEQ ID NO: 470125 - protein, 9 aa, Homo Sapiens
VVDGKRDTR

SEQ ID NO: 470126 - protein, 9 aa, Homo Sapiens
NHSRETVIL

SEQ ID NO: 470127 - protein, 9 aa, Homo Sapiens
PYLNWITSK

SEQ ID NO: 470128 - protein, 9 aa, Homo Sapiens
SSKMDTLNS

SEQ ID NO: 470129 - protein, 9 aa, Homo Sapiens
RNFLLDKEG

SEQ ID NO: 470130 - protein, 9 aa, Homo Sapiens
GKRDTRLRP

SEQ ID NO: 470131 - protein, 9 aa, Homo Sapiens
KDNRAERGH

SEQ ID NO: 470132 - protein, 9 aa, Homo Sapiens
FVLGPATRG

SEQ ID NO: 470133 - protein, 9 aa, Homo Sapiens
QDLHVSPYD

SEQ ID NO: 470134 - protein, 9 aa, Homo Sapiens
ITIANNNVD

SEQ ID NO: 470135 - protein, 9 aa, Homo Sapiens
LYVPPAWTY

SEQ ID NO: 470136 - protein, 9 aa, Homo Sapiens
WSIPKCSES

SEQ ID NO: 470137 - protein, 9 aa, Homo Sapiens
PACDPRPQE

SEQ ID NO: 470138 - protein, 9 aa, Homo Sapiens
FLGKPSAGP

SEQ ID NO: 470139 - protein, 9 aa, Homo Sapiens
FLFTLLLQH

SEQ ID NO: 470140 - protein, 9 aa, Homo Sapiens
RDTRLRPSR

SEQ ID NO: 470141 - protein, 9 aa, Homo Sapiens
RYRINLFVL

SEQ ID NO: 470142 - protein, 9 aa, Homo Sapiens
EWVDNHSRE

SEQ ID NO: 470143 - protein, 9 aa, Homo Sapiens
PPAWTYECD

SEQ ID NO: 470144 - protein, 9 aa, Homo Sapiens
EQIKAGTPG

SEQ ID NO: 470145 - protein, 9 aa, Homo Sapiens
PDIRGRACF

SEQ ID NO: 470146 - protein, 9 aa, Homo Sapiens
FAVLGFKTN

SEQ ID NO: 470147 - protein, 9 aa, Homo Sapiens
ALTKKCKLE

SEQ ID NO: 470148 - protein, 9 aa, Homo Sapiens
ALSSAFLGK

SEQ ID NO: 470149 - protein, 9 aa, Homo Sapiens
PWSIPKCSE

SEQ ID NO: 470150 - protein, 9 aa, Homo Sapiens
ANNNVDLII

SEQ ID NO: 470151 - protein, 9 aa, Homo Sapiens
PHNEPIPIE

SEQ ID NO: 470152 - protein, 9 aa, Homo Sapiens
CEAGGLFVD

SEQ ID NO: 470153 - protein, 9 aa, Homo Sapiens
PAWTYECDE

SEQ ID NO: 470154 - protein, 9 aa, Homo Sapiens
KILSAVEYC

SEQ ID NO: 470155 - protein, 9 aa, Homo Sapiens
WITSKIGSN

SEQ ID NO: 470156 - protein, 9 aa, Homo Sapiens
ALLQDLHVS

SEQ ID NO: 470157 - protein, 9 aa, Homo Sapiens
LKLVSCILG

SEQ ID NO: 470158 - protein, 9 aa, Homo Sapiens
KRDTRLRPS

SEQ ID NO: 470159 - protein, 9 aa, Homo Sapiens
IKAGTPGRL

SEQ ID NO: 470160 - protein, 9 aa, Homo Sapiens
KKCKLEEDF

SEQ ID NO: 470161 - protein, 9 aa, Homo Sapiens
RACFCALLN

SEQ ID NO: 470162 - protein, 9 aa, Homo Sapiens
TKKCKLEED

SEQ ID NO: 470163 - protein, 9 aa, Homo Sapiens
VIQGPLFFL

SEQ ID NO: 470164 - protein, 9 aa, Homo Sapiens
IKVEQIKAG

SEQ ID NO: 470165 - protein, 9 aa, Homo Sapiens
STMERNFLL

SEQ ID NO: 470166 - protein, 9 aa, Homo Sapiens
SYTLFVRKN

SEQ ID NO: 470167 - protein, 9 aa, Homo Sapiens
FENVAVKFT

SEQ ID NO: 470168 - protein, 9 aa, Homo Sapiens
FGKPRKLLT

SEQ ID NO: 470169 - protein, 9 aa, Homo Sapiens
LVSCILGQK

SEQ ID NO: 470170 - protein, 9 aa, Homo Sapiens
EKECWIHSK

SEQ ID NO: 470171 - protein, 9 aa, Homo Sapiens
EWIENGIAN

SEQ ID NO: 470172 - protein, 9 aa, Homo Sapiens
ANGNVALKI

SEQ ID NO: 470173 - protein, 9 aa, Homo Sapiens
LHVSPYDPI

SEQ ID NO: 470174 - protein, 9 aa, Homo Sapiens
CDPRPQEYL

SEQ ID NO: 470175 - protein, 9 aa, Homo Sapiens
YTLFVRKNN

SEQ ID NO: 470176 - protein, 9 aa, Homo Sapiens
REEKECWIH

SEQ ID NO: 470177 - protein, 9 aa, Homo Sapiens
HLEAEILAL

SEQ ID NO: 470178 - protein, 9 aa, Homo Sapiens
PWDTNKCRP

SEQ ID NO: 470179 - protein, 9 aa, Homo Sapiens
FKTNVINEK

SEQ ID NO: 470180 - protein, 9 aa, Homo Sapiens
AYHFVRFDY

SEQ ID NO: 470181 - protein, 9 aa, Homo Sapiens
TIANNNVDL

SEQ ID NO: 470182 - protein, 9 aa, Homo Sapiens
MTLFPYGTR

SEQ ID NO: 470183 - protein, 9 aa, Homo Sapiens
TLFVRKNNS

SEQ ID NO: 470184 - protein, 9 aa, Homo Sapiens
TIAETEKKE

SEQ ID NO: 470185 - protein, 9 aa, Homo Sapiens
KDQQQQQEA

SEQ ID NO: 470186 - protein, 9 aa, Homo Sapiens
VLGFKTNVI

SEQ ID NO: 470187 - protein, 9 aa, Homo Sapiens
CILGQKMLT

SEQ ID NO: 470188 - protein, 9 aa, Homo Sapiens
SNPYQNDAT

SEQ ID NO: 470189 - protein, 9 aa, Homo Sapiens
RPQEYLIKL

SEQ ID NO: 470190 - protein, 9 aa, Homo Sapiens
WVDNHSRET

SEQ ID NO: 470191 - protein, 9 aa, Homo Sapiens
NGNVALKIH

SEQ ID NO: 470192 - protein, 9 aa, Homo Sapiens
ACDPRPQEY

SEQ ID NO: 470193 - protein, 9 aa, Homo Sapiens
SPPKLGHTS

SEQ ID NO: 470194 - protein, 9 aa, Homo Sapiens
NEPIPIEND

SEQ ID NO: 470195 - protein, 9 aa, Homo Sapiens
VTFENVAVK

SEQ ID NO: 470196 - protein, 9 aa, Homo Sapiens
QHQLLKDNR

SEQ ID NO: 470197 - protein, 9 aa, Homo Sapiens
GVPAYHFVR

SEQ ID NO: 470198 - protein, 9 aa, Homo Sapiens
SSPPKLGHT

SEQ ID NO: 470199 - protein, 8 aa, Homo Sapiens
WPLTALLL

SEQ ID NO: 470200 - protein, 9 aa, Homo Sapiens
VEQIKAGTP

SEQ ID NO: 470201 - protein, 9 aa, Homo Sapiens
PPKLGHTSD

SEQ ID NO: 470202 - protein, 9 aa, Homo Sapiens
SVSNLWNTL

SEQ ID NO: 470203 - protein, 9 aa, Homo Sapiens
FVDSPEEPS

SEQ ID NO: 470204 - protein, 9 aa, Homo Sapiens
PRPQEYLIK

SEQ ID NO: 470205 - protein, 9 aa, Homo Sapiens
YLNWITSKI

SEQ ID NO: 470206 - protein, 9 aa, Homo Sapiens
RKNNSPALH

SEQ ID NO: 470207 - protein, 9 aa, Homo Sapiens
LNWRQEERI

SEQ ID NO: 470208 - protein, 9 aa, Homo Sapiens
DPRYRINLF

SEQ ID NO: 470209 - protein, 9 aa, Homo Sapiens
TNKCRPTEF

SEQ ID NO: 470210 - protein, 9 aa, Homo Sapiens
DEMTDSSKM

SEQ ID NO: 470211 - protein, 9 aa, Homo Sapiens
EEWVDNHSR

SEQ ID NO: 470212 - protein, 9 aa, Homo Sapiens
INLFVLGPA

SEQ ID NO: 470213 - protein, 9 aa, Homo Sapiens
GGAKGAWTA

SEQ ID NO: 470214 - protein, 9 aa, Homo Sapiens
NNVDLIIRI

SEQ ID NO: 470215 - protein, 9 aa, Homo Sapiens
HDQHQLLKD

SEQ ID NO: 470216 - protein, 9 aa, Homo Sapiens
MVIQGPLFF

SEQ ID NO: 470217 - protein, 9 aa, Homo Sapiens
KECWIHSKY

SEQ ID NO: 470218 - protein, 9 aa, Homo Sapiens
PCSAFLSPM

SEQ ID NO: 470219 - protein, 9 aa, Homo Sapiens
AGAWALVHA

SEQ ID NO: 470220 - protein, 9 aa, Homo Sapiens
QGPLFFLFT

SEQ ID NO: 470221 - protein, 9 aa, Homo Sapiens
HAGAWALVH

SEQ ID NO: 470222 - protein, 9 aa, Homo Sapiens
NECVSNPYQ

SEQ ID NO: 470223 - protein, 9 aa, Homo Sapiens
NGIANGNVA

SEQ ID NO: 470224 - protein, 9 aa, Homo Sapiens
VGGAKGAWT

SEQ ID NO: 470225 - protein, 9 aa, Homo Sapiens
VDNHSRETV

SEQ ID NO: 470226 - protein, 9 aa, Homo Sapiens
EAENRHLEA

SEQ ID NO: 470227 - protein, 9 aa, Homo Sapiens
YHFVRFDYI

SEQ ID NO: 470228 - protein, 9 aa, Homo Sapiens
QRLLYVPPA

SEQ ID NO: 470229 - protein, 9 aa, Homo Sapiens
AYIIQEYME

SEQ ID NO: 470230 - protein, 9 aa, Homo Sapiens
VDTMLTTRS

SEQ ID NO: 470231 - protein, 9 aa, Homo Sapiens
GTVTFENVA

SEQ ID NO: 470232 - protein, 9 aa, Homo Sapiens
TLWEQSSQS

SEQ ID NO: 470233 - protein, 9 aa, Homo Sapiens
YVPPAWTYE

SEQ ID NO: 470234 - protein, 9 aa, Homo Sapiens
AGSPTQYPP

SEQ ID NO: 470235 - protein, 9 aa, Homo Sapiens
VFAVLGFKT

SEQ ID NO: 470236 - protein, 9 aa, Homo Sapiens
AQGTVTFEN

SEQ ID NO: 470237 - protein, 9 aa, Homo Sapiens
LSPMPYFEQ

SEQ ID NO: 470238 - protein, 9 aa, Homo Sapiens
CAFWGNMEV

SEQ ID NO: 470239 - protein, 9 aa, Homo Sapiens
KFWKILSAV

SEQ ID NO: 470240 - protein, 9 aa, Homo Sapiens
ETMSVSNLW

SEQ ID NO: 470241 - protein, 9 aa, Homo Sapiens
LEALLQDLH

SEQ ID NO: 470242 - protein, 9 aa, Homo Sapiens
SVAYIIQEY

SEQ ID NO: 470243 - protein, 9 aa, Homo Sapiens
VTSSPPKLG

SEQ ID NO: 470244 - protein, 9 aa, Homo Sapiens
VDSPEEPSL

SEQ ID NO: 470245 - protein, 9 aa, Homo Sapiens
AATASIAGS

SEQ ID NO: 470246 - protein, 9 aa, Homo Sapiens
VPIKVEQIK

SEQ ID NO: 470247 - protein, 9 aa, Homo Sapiens
IPIENDGEA

SEQ ID NO: 470248 - protein, 9 aa, Homo Sapiens
IIVFAYLTE

SEQ ID NO: 470249 - protein, 9 aa, Homo Sapiens
LDEGPWSIP

SEQ ID NO: 470250 - protein, 9 aa, Homo Sapiens
VRDHAGAWA

SEQ ID NO: 470251 - protein, 9 aa, Homo Sapiens
CVSNPYQND

SEQ ID NO: 470252 - protein, 9 aa, Homo Sapiens
ENGIANGNV

SEQ ID NO: 470253 - protein, 9 aa, Homo Sapiens
EEKECWIHS

SEQ ID NO: 470254 - protein, 9 aa, Homo Sapiens
GKPRKLLTK

SEQ ID NO: 470255 - protein, 9 aa, Homo Sapiens
STTHEYRET

SEQ ID NO: 470256 - protein, 9 aa, Homo Sapiens
LLYVPPAWT

SEQ ID NO: 470257 - protein, 9 aa, Homo Sapiens
FVIIVFAYL

SEQ ID NO: 470258 - protein, 9 aa, Homo Sapiens
GSPTQYPPG

SEQ ID NO: 470259 - protein, 9 aa, Homo Sapiens
TSYTLFVRK

SEQ ID NO: 470260 - protein, 9 aa, Homo Sapiens
IENGIANGN

SEQ ID NO: 470261 - protein, 9 aa, Homo Sapiens
GLLLLLLVT

SEQ ID NO: 470262 - protein, 9 aa, Homo Sapiens
KVEQIKAGT

SEQ ID NO: 470263 - protein, 9 aa, Homo Sapiens
MEVGRDVTV

SEQ ID NO: 470264 - protein, 9 aa, Homo Sapiens
YRINLFVLG

SEQ ID NO: 470265 - protein, 9 aa, Homo Sapiens
HQLLKDNRA

SEQ ID NO: 470266 - protein, 9 aa, Homo Sapiens
TTHEYRETP

SEQ ID NO: 470267 - protein, 9 aa, Homo Sapiens
LGFKTNVIN

SEQ ID NO: 470268 - protein, 9 aa, Homo Sapiens
TFENVAVKF

SEQ ID NO: 470269 - protein, 9 aa, Homo Sapiens
PQEYLIKLP

SEQ ID NO: 470270 - protein, 9 aa, Homo Sapiens
FSRTALTKK

SEQ ID NO: 470271 - protein, 9 aa, Homo Sapiens
HISLLNWRQ

SEQ ID NO: 470272 - protein, 9 aa, Homo Sapiens
FWGNMEVGR

SEQ ID NO: 470273 - protein, 9 aa, Homo Sapiens
VITIANNNV

SEQ ID NO: 470274 - protein, 9 aa, Homo Sapiens
LLQDLHVSP

SEQ ID NO: 470275 - protein, 9 aa, Homo Sapiens
NLWNTLSSL

SEQ ID NO: 470276 - protein, 9 aa, Homo Sapiens
AWALVHALD

SEQ ID NO: 470277 - protein, 9 aa, Homo Sapiens
QGTVTFENV

SEQ ID NO: 470278 - protein, 9 aa, Homo Sapiens
DGKRDTRLR

SEQ ID NO: 470279 - protein, 9 aa, Homo Sapiens
WALVHALDR

SEQ ID NO: 470280 - protein, 9 aa, Homo Sapiens
SKMDTLNSS

SEQ ID NO: 470281 - protein, 9 aa, Homo Sapiens
GGLLLLLLV

SEQ ID NO: 470282 - protein, 9 aa, Homo Sapiens
PDMTLFPYG

SEQ ID NO: 470283 - protein, 9 aa, Homo Sapiens
LTKKCKLEE

SEQ ID NO: 470284 - protein, 9 aa, Homo Sapiens
EALLQDLHV

SEQ ID NO: 470285 - protein, 9 aa, Homo Sapiens
VEAENRHLE

SEQ ID NO: 470286 - protein, 9 aa, Homo Sapiens
TMSVSNLWN

SEQ ID NO: 470287 - protein, 9 aa, Homo Sapiens
NRHLEAEIL

SEQ ID NO: 470288 - protein, 9 aa, Homo Sapiens
VVEAENRHL

SEQ ID NO: 470289 - protein, 9 aa, Homo Sapiens
PIPIENDGE

SEQ ID NO: 470290 - protein, 9 aa, Homo Sapiens
NWITSKIGS

SEQ ID NO: 470291 - protein, 9 aa, Homo Sapiens
STLWEQSSQ

SEQ ID NO: 470292 - protein, 9 aa, Homo Sapiens
DQQQQQEAP

SEQ ID NO: 470293 - protein, 9 aa, Homo Sapiens
IAETEKKEK

SEQ ID NO: 470294 - protein, 9 aa, Homo Sapiens
KNNSPALHI

SEQ ID NO: 470295 - protein, 9 aa, Homo Sapiens
TSSPPKLGH

SEQ ID NO: 470296 - protein, 9 aa, Homo Sapiens
LSTLWEQSS

SEQ ID NO: 470297 - protein, 9 aa, Homo Sapiens
PWNWLDFVI

SEQ ID NO: 470298 - protein, 9 aa, Homo Sapiens
ERNFLLDKE

SEQ ID NO: 470299 - protein, 9 aa, Homo Sapiens
VAYIIQEYM

SEQ ID NO: 470300 - protein, 9 aa, Homo Sapiens
AETEKKEKR

SEQ ID NO: 470301 - protein, 9 aa, Homo Sapiens
GIEHFMFGK

SEQ ID NO: 470302 - protein, 9 aa, Homo Sapiens
KVPPPDMTL

SEQ ID NO: 470303 - protein, 9 aa, Homo Sapiens
KTNVINEKC

SEQ ID NO: 470304 - protein, 9 aa, Homo Sapiens
EARKKFWKI

SEQ ID NO: 470305 - protein, 9 aa, Homo Sapiens
SLLNWRQEE

SEQ ID NO: 470306 - protein, 9 aa, Homo Sapiens
TRSVDGDQG

SEQ ID NO: 470307 - protein, 9 aa, Homo Sapiens
AENRHLEAE

SEQ ID NO: 470308 - protein, 9 aa, Homo Sapiens
SSAFLGKPS

SEQ ID NO: 470309 - protein, 9 aa, Homo Sapiens
PLFFLFTLL

SEQ ID NO: 470310 - protein, 9 aa, Homo Sapiens
GAKGAWTAP

SEQ ID NO: 470311 - protein, 9 aa, Homo Sapiens
VSNLWNTLS

SEQ ID NO: 470312 - protein, 9 aa, Homo Sapiens
ISPRHDGTW

SEQ ID NO: 470313 - protein, 9 aa, Homo Sapiens
NPEETTTST

SEQ ID NO: 470314 - protein, 9 aa, Homo Sapiens
ATIAETEKK

SEQ ID NO: 470315 - protein, 9 aa, Homo Sapiens
TVTFENVAV

SEQ ID NO: 470316 - protein, 9 aa, Homo Sapiens
RSRRLSTLW

SEQ ID NO: 470317 - protein, 9 aa, Homo Sapiens
VPAYHFVRF

SEQ ID NO: 470318 - protein, 9 aa, Homo Sapiens
TLFPYGTRR

SEQ ID NO: 470319 - protein, 9 aa, Homo Sapiens
WKILSAVEY

SEQ ID NO: 470320 - protein, 9 aa, Homo Sapiens
IIQEYMETD

SEQ ID NO: 470321 - protein, 9 aa, Homo Sapiens
KSTREEKEC

SEQ ID NO: 470322 - protein, 9 aa, Homo Sapiens
SPTQYPPGR

SEQ ID NO: 470323 - protein, 9 aa, Homo Sapiens
KGAWTAPLQ

SEQ ID NO: 470324 - protein, 9 aa, Homo Sapiens
GPWSIPKCS

SEQ ID NO: 470325 - protein, 9 aa, Homo Sapiens
GRACFCALL

SEQ ID NO: 470326 - protein, 9 aa, Homo Sapiens
QPACDPRPQ

SEQ ID NO: 470327 - protein, 9 aa, Homo Sapiens
FFLFTLLLQ

SEQ ID NO: 470328 - protein, 9 aa, Homo Sapiens
QHISLLNWR

SEQ ID NO: 470329 - protein, 9 aa, Homo Sapiens
DIRGRACFC

SEQ ID NO: 470330 - protein, 9 aa, Homo Sapiens
ETEKKEKRF

SEQ ID NO: 470331 - protein, 9 aa, Homo Sapiens
LNWITSKIG

SEQ ID NO: 470332 - protein, 9 aa, Homo Sapiens
MLTTRSVDG

SEQ ID NO: 470333 - protein, 9 aa, Homo Sapiens
PVVEAENRH

SEQ ID NO: 470334 - protein, 9 aa, Homo Sapiens
NEARKKFWK

SEQ ID NO: 470335 - protein, 9 aa, Homo Sapiens
IQGPLFFLF

SEQ ID NO: 470336 - protein, 9 aa, Homo Sapiens
LGKPSAGPG

SEQ ID NO: 470337 - protein, 9 aa, Homo Sapiens
RDHAGAWAL

SEQ ID NO: 470338 - protein, 9 aa, Homo Sapiens
ESTMERNFL

SEQ ID NO: 470339 - protein, 9 aa, Homo Sapiens
NPYQNDATC

SEQ ID NO: 470340 - protein, 9 aa, Homo Sapiens
GRCAFWGNM

SEQ ID NO: 470341 - protein, 9 aa, Homo Sapiens
NNNVDLIIR

SEQ ID NO: 470342 - protein, 9 aa, Homo Sapiens
TEKKEKRFQ

SEQ ID NO: 470343 - protein, 9 aa, Homo Sapiens
EAGGLFVDS

SEQ ID NO: 470344 - protein, 9 aa, Homo Sapiens
EETTTSTTH

SEQ ID NO: 470345 - protein, 9 aa, Homo Sapiens
AKGAWTAPL

SEQ ID NO: 470346 - protein, 9 aa, Homo Sapiens
KKEKRFQEA

SEQ ID NO: 470347 - protein, 9 aa, Homo Sapiens
FWKILSAVE

SEQ ID NO: 470348 - protein, 9 aa, Homo Sapiens
TDSSKMDTL

SEQ ID NO: 470349 - protein, 9 aa, Homo Sapiens
VSNPYQNDA

SEQ ID NO: 470350 - protein, 9 aa, Homo Sapiens
VPPAWTYEC

SEQ ID NO: 470351 - protein, 9 aa, Homo Sapiens
NVAVKFTQE

SEQ ID NO: 470352 - protein, 9 aa, Homo Sapiens
VPPPDMTLF

SEQ ID NO: 470353 - protein, 9 aa, Homo Sapiens
VDGKRDTRL

SEQ ID NO: 470354 - protein, 9 aa, Homo Sapiens
VVITIANNN

SEQ ID NO: 470355 - protein, 9 aa, Homo Sapiens
YIIQEYMET

SEQ ID NO: 470356 - protein, 9 aa, Homo Sapiens
SAFLGKPSA

SEQ ID NO: 470357 - protein, 9 aa, Homo Sapiens
TASIAGSPT

SEQ ID NO: 470358 - protein, 9 aa, Homo Sapiens
KLVESTMER

SEQ ID NO: 470359 - protein, 9 aa, Homo Sapiens
AFLSPMPYF

SEQ ID NO: 470360 - protein, 9 aa, Homo Sapiens
TNVINEKCI

SEQ ID NO: 470361 - protein, 9 aa, Homo Sapiens
SVRDHAGAW

SEQ ID NO: 470362 - protein, 9 aa, Homo Sapiens
LKDNRAERG

SEQ ID NO: 470363 - protein, 9 aa, Homo Sapiens
AWTYECDED

SEQ ID NO: 470364 - protein, 9 aa, Homo Sapiens
PEETTTSTT

SEQ ID NO: 470365 - protein, 9 aa, Homo Sapiens
DTMLTTRSV

SEQ ID NO: 470366 - protein, 9 aa, Homo Sapiens
FVRKNNSPA

SEQ ID NO: 470367 - protein, 9 aa, Homo Sapiens
HVSPYDPIG

SEQ ID NO: 470368 - protein, 9 aa, Homo Sapiens
MERNFLLDK

SEQ ID NO: 470369 - protein, 9 aa, Homo Sapiens
EMTDSSKMD

SEQ ID NO: 470370 - protein, 9 aa, Homo Sapiens
FMFGKPRKL

SEQ ID NO: 470371 - protein, 9 aa, Homo Sapiens
RKETMSVSN

SEQ ID NO: 470372 - protein, 9 aa, Homo Sapiens
IRGRACFCA

SEQ ID NO: 470373 - protein, 9 aa, Homo Sapiens
EHFMFGKPR

SEQ ID NO: 470374 - protein, 9 aa, Homo Sapiens
TDPWDTNKC

SEQ ID NO: 470375 - protein, 9 aa, Homo Sapiens
PKLGHTSDE

SEQ ID NO: 470376 - protein, 9 aa, Homo Sapiens
LFVDSPEEP

SEQ ID NO: 470377 - protein, 9 aa, Homo Sapiens
WIENGIANG

SEQ ID NO: 470378 - protein, 9 aa, Homo Sapiens
LWEQSSQSE

SEQ ID NO: 470379 - protein, 9 aa, Homo Sapiens
MDTLNSSSS

SEQ ID NO: 470380 - protein, 9 aa, Homo Sapiens
IEHFMFGKP

SEQ ID NO: 470381 - protein, 9 aa, Homo Sapiens
KCRPTEFAV

SEQ ID NO: 470382 - protein, 9 aa, Homo Sapiens
GKPSAGPGS

SEQ ID NO: 470383 - protein, 9 aa, Homo Sapiens
NWLDFVIIV

SEQ ID NO: 470384 - protein, 9 aa, Homo Sapiens
QEYLIKLPE

SEQ ID NO: 470385 - protein, 9 aa, Homo Sapiens
NQHISLLNW

SEQ ID NO: 470386 - protein, 9 aa, Homo Sapiens
ILGQKMLTC

SEQ ID NO: 470387 - protein, 9 aa, Homo Sapiens
TTRSVDGDQ

SEQ ID NO: 470388 - protein, 9 aa, Homo Sapiens
DSPEEPSLS

SEQ ID NO: 470389 - protein, 9 aa, Homo Sapiens
AFWGNMEVG

SEQ ID NO: 470390 - protein, 9 aa, Homo Sapiens
LFSRTALTK

SEQ ID NO: 470391 - protein, 9 aa, Homo Sapiens
CWIHSKYEE

SEQ ID NO: 470392 - protein, 9 aa, Homo Sapiens
LSSAFLGKP

SEQ ID NO: 470393 - protein, 9 aa, Homo Sapiens
VESTMERNF

SEQ ID NO: 470394 - protein, 9 aa, Homo Sapiens
IANGNVALK

SEQ ID NO: 470395 - protein, 9 aa, Homo Sapiens
DPRPQEYLI

SEQ ID NO: 470396 - protein, 9 aa, Homo Sapiens
RHLEAEILA

SEQ ID NO: 470397 - protein, 9 aa, Homo Sapiens
TRLRPSRWR

SEQ ID NO: 470398 - protein, 9 aa, Homo Sapiens
FSVAYIIQE

SEQ ID NO: 470399 - protein, 9 aa, Homo Sapiens
MSVSNLWNT

SEQ ID NO: 470400 - protein, 9 aa, Homo Sapiens
KMDTLNSSS

SEQ ID NO: 470401 - protein, 9 aa, Homo Sapiens
AWTAPLQCV

SEQ ID NO: 470402 - protein, 9 aa, Homo Sapiens
RRLSTLWEQ

SEQ ID NO: 470403 - protein, 9 aa, Homo Sapiens
QIKAGTPGR

SEQ ID NO: 470404 - protein, 9 aa, Homo Sapiens
PIENDGEAC

SEQ ID NO: 470405 - protein, 9 aa, Homo Sapiens
EKKEKRFQE

SEQ ID NO: 470406 - protein, 9 aa, Homo Sapiens
SPMPYFEQC

SEQ ID NO: 470407 - protein, 9 aa, Homo Sapiens
GPLFFLFTL

SEQ ID NO: 470408 - protein, 9 aa, Homo Sapiens
CSAFLSPMP

SEQ ID NO: 470409 - protein, 9 aa, Homo Sapiens
DNHSRETVI

SEQ ID NO: 470410 - protein, 9 aa, Homo Sapiens
RLLYVPPAW

SEQ ID NO: 470411 - protein, 9 aa, Homo Sapiens
DTNKCRPTE

SEQ ID NO: 470412 - protein, 9 aa, Homo Sapiens
RHEISPRHD

SEQ ID NO: 470413 - protein, 9 aa, Homo Sapiens
DMTLFPYGT

SEQ ID NO: 470414 - protein, 9 aa, Homo Sapiens
IQEYMETDL

SEQ ID NO: 470415 - protein, 9 aa, Homo Sapiens
VSCILGQKM

SEQ ID NO: 470416 - protein, 9 aa, Homo Sapiens
NKCRPTEFA

SEQ ID NO: 470417 - protein, 9 aa, Homo Sapiens
RHDGTWNDN

SEQ ID NO: 470418 - protein, 9 aa, Homo Sapiens
KLVSCILGQ

SEQ ID NO: 470419 - protein, 9 aa, Homo Sapiens
DTRLRPSRW

SEQ ID NO: 470420 - protein, 9 aa, Homo Sapiens
LFPYGTRRS

SEQ ID NO: 470421 - protein, 9 aa, Homo Sapiens
RGRACFCAL

SEQ ID NO: 470422 - protein, 9 aa, Homo Sapiens
ENVAVKFTQ

SEQ ID NO: 470423 - protein, 9 aa, Homo Sapiens
HEISPRHDG

SEQ ID NO: 470424 - protein, 9 aa, Homo Sapiens
GFKTNVINE

SEQ ID NO: 470425 - protein, 9 aa, Homo Sapiens
EPIPIENDG

SEQ ID NO: 470426 - protein, 9 aa, Homo Sapiens
WNWLDFVII

SEQ ID NO: 470427 - protein, 9 aa, Homo Sapiens
PRHDGTWND

SEQ ID NO: 470428 - protein, 9 aa, Homo Sapiens
QATIAETEK

SEQ ID NO: 470429 - protein, 9 aa, Homo Sapiens
VGEEWVDNH

SEQ ID NO: 470430 - protein, 9 aa, Homo Sapiens
VRKNNSPAL

SEQ ID NO: 470431 - protein, 9 aa, Homo Sapiens
TTTSTTHEY

SEQ ID NO: 470432 - protein, 9 aa, Homo Sapiens
LLNWRQEER

SEQ ID NO: 470433 - protein, 9 aa, Homo Sapiens
TTSTTHEYR

SEQ ID NO: 470434 - protein, 9 aa, Homo Sapiens
WDTNKCRPT

SEQ ID NO: 470435 - protein, 9 aa, Homo Sapiens
AVDTMLTTR

SEQ ID NO: 470436 - protein, 9 aa, Homo Sapiens
GLDEGPWSI

SEQ ID NO: 470437 - protein, 9 aa, Homo Sapiens
MPYFEQCRR

SEQ ID NO: 470438 - protein, 9 aa, Homo Sapiens
LFVLGPATR

SEQ ID NO: 470439 - protein, 9 aa, Homo Sapiens
FLSPMPYFE

SEQ ID NO: 470440 - protein, 9 aa, Homo Sapiens
HNEPIPIEN

SEQ ID NO: 470441 - protein, 9 aa, Homo Sapiens
LQDLHVSPY

SEQ ID NO: 470442 - protein, 9 aa, Homo Sapiens
SRRLSTLWE

SEQ ID NO: 470443 - protein, 9 aa, Homo Sapiens
LLKDNRAER

SEQ ID NO: 470444 - protein, 9 aa, Homo Sapiens
YQNDATCLD

SEQ ID NO: 470445 - protein, 9 aa, Homo Sapiens
LGHTSDERL

SEQ ID NO: 470446 - protein, 9 aa, Homo Sapiens
EISPRHDGT

SEQ ID NO: 470447 - protein, 9 aa, Homo Sapiens
GEEWVDNHS

SEQ ID NO: 470448 - protein, 9 aa, Homo Sapiens
PPDIRGRAC

SEQ ID NO: 470449 - protein, 9 aa, Homo Sapiens
TWPYLNWIT

SEQ ID NO: 470450 - protein, 9 aa, Homo Sapiens
HFMFGKPRK

SEQ ID NO: 470451 - protein, 9 aa, Homo Sapiens
MTDSSKMDT

SEQ ID NO: 470452 - protein, 9 aa, Homo Sapiens
HFVRFDYIP

SEQ ID NO: 470453 - protein, 9 aa, Homo Sapiens
RGLDEGPWS

SEQ ID NO: 470454 - protein, 9 aa, Homo Sapiens
SCILGQKML

SEQ ID NO: 470455 - protein, 9 aa, Homo Sapiens
NVDLIIRIS

SEQ ID NO: 470456 - protein, 9 aa, Homo Sapiens
SIAGSPTQY

SEQ ID NO: 470457 - protein, 9 aa, Homo Sapiens
PMPYFEQCR

SEQ ID NO: 470458 - protein, 9 aa, Homo Sapiens
PAYHFVRFD

SEQ ID NO: 470459 - protein, 9 aa, Homo Sapiens
ENRHLEAEI

SEQ ID NO: 470460 - protein, 9 aa, Homo Sapiens
VVGEEWVDN

SEQ ID NO: 470461 - protein, 9 aa, Homo Sapiens
SVVDGKRDT

SEQ ID NO: 470462 - protein, 9 aa, Homo Sapiens
DLHVSPYDP

SEQ ID NO: 470463 - protein, 9 aa, Homo Sapiens
GAWALVHAL

SEQ ID NO: 470464 - protein, 9 aa, Homo Sapiens
GLFVDSPEE

SEQ ID NO: 470465 - protein, 9 aa, Homo Sapiens
VIIVFAYLT

SEQ ID NO: 470466 - protein, 9 aa, Homo Sapiens
TMLTTRSVD

SEQ ID NO: 470467 - protein, 9 aa, Homo Sapiens
GAWTAPLQC

SEQ ID NO: 470468 - protein, 9 aa, Homo Sapiens
LFFLFTLLL

SEQ ID NO: 470469 - protein, 9 aa, Homo Sapiens
RCAFWGNME

SEQ ID NO: 470470 - protein, 9 aa, Homo Sapiens
WEQSSQSET

SEQ ID NO: 470471 - protein, 9 aa, Homo Sapiens
PGVPAYHFV

SEQ ID NO: 470472 - protein, 9 aa, Homo Sapiens
DPGVPAYHF

SEQ ID NO: 470473 - protein, 9 aa, Homo Sapiens
KFSVAYIIQ

SEQ ID NO: 470474 - protein, 9 aa, Homo Sapiens
ITSKIGSNA

SEQ ID NO: 470475 - protein, 9 aa, Homo Sapiens
IAGSPTQYP

SEQ ID NO: 470476 - protein, 9 aa, Homo Sapiens
WGNMEVGRD

SEQ ID NO: 470477 - protein, 9 aa, Homo Sapiens
IANNNVDLI

SEQ ID NO: 470478 - protein, 9 aa, Homo Sapiens
GTDPWDTNK

SEQ ID NO: 470479 - protein, 9 aa, Homo Sapiens
PIKVEQIKA

SEQ ID NO: 470480 - protein, 9 aa, Homo Sapiens
DSSKMDTLN

SEQ ID NO: 470481 - protein, 9 aa, Homo Sapiens
NRHEISPRH

SEQ ID NO: 470482 - protein, 9 aa, Homo Sapiens
KAGTPGRLR

SEQ ID NO: 470483 - protein, 9 aa, Homo Sapiens
TSKIGSNAL

SEQ ID NO: 470484 - protein, 9 aa, Homo Sapiens
TREEKECWI

SEQ ID NO: 470485 - protein, 9 aa, Homo Sapiens
EGPWSIPKC

SEQ ID NO: 470486 - protein, 9 aa, Homo Sapiens
PPPDMTLFP

SEQ ID NO: 470487 - protein, 9 aa, Homo Sapiens
ETTTSTTHE

SEQ ID NO: 470488 - protein, 9 aa, Homo Sapiens
LTTRSVDGD

SEQ ID NO: 470489 - protein, 9 aa, Homo Sapiens
ATASIAGSP

SEQ ID NO: 470490 - protein, 9 aa, Homo Sapiens
GHTSDERLT

SEQ ID NO: 470491 - protein, 9 aa, Homo Sapiens
KKFWKILSA

SEQ ID NO: 470492 - protein, 9 aa, Homo Sapiens
IENDGEACG

SEQ ID NO: 470493 - protein, 9 aa, Homo Sapiens
RLSTLWEQS

SEQ ID NO: 470494 - protein, 9 aa, Homo Sapiens
LLLKLVSCI

SEQ ID NO: 470495 - protein, 9 aa, Homo Sapiens
AGGLFVDSP

SEQ ID NO: 470496 - protein, 9 aa, Homo Sapiens
PDPGVPAYH

SEQ ID NO: 470497 - protein, 9 aa, Homo Sapiens
VNECVSNPY

SEQ ID NO: 470498 - protein, 9 aa, Homo Sapiens
AFLGKPSAG

SEQ ID NO: 470499 - protein, 9 aa, Homo Sapiens
KPRKLLTKD

SEQ ID NO: 470500 - protein, 9 aa, Homo Sapiens
WPYLNWITS

SEQ ID NO: 470501 - protein, 9 aa, Homo Sapiens
DPWDTNKCR

SEQ ID NO: 470502 - protein, 9 aa, Homo Sapiens
PPDMTLFPY

SEQ ID NO: 470503 - protein, 9 aa, Homo Sapiens
PPHNEPIPI

SEQ ID NO: 470504 - protein, 9 aa, Homo Sapiens
RKKFWKILS

SEQ ID NO: 470505 - protein, 9 aa, Homo Sapiens
STREEKECW

SEQ ID NO: 470506 - protein, 9 aa, Homo Sapiens
KLGHTSDER

SEQ ID NO: 470507 - protein, 9 aa, Homo Sapiens
ASIAGSPTQ

SEQ ID NO: 470508 - protein, 9 aa, Homo Sapiens
DEGPWSIPK

SEQ ID NO: 470509 - protein, 9 aa, Homo Sapiens
SPRHDGTWN

SEQ ID NO: 470510 - protein, 9 aa, Homo Sapiens
ECVSNPYQN

SEQ ID NO: 470511 - protein, 9 aa, Homo Sapiens
VASVERRSV

SEQ ID NO: 470512 - protein, 9 aa, Homo Sapiens
EGEATWEEL

SEQ ID NO: 470513 - protein, 9 aa, Homo Sapiens
VASNLTEPI

SEQ ID NO: 470514 - protein, 9 aa, Homo Sapiens
LGGAKASSS

SEQ ID NO: 470515 - protein, 9 aa, Homo Sapiens
YDEGPYSCS

SEQ ID NO: 470516 - protein, 9 aa, Homo Sapiens
GIPDVPGNE

SEQ ID NO: 470517 - protein, 9 aa, Homo Sapiens
LKMLPQLEQ

SEQ ID NO: 470518 - protein, 9 aa, Homo Sapiens
ENRGEHPQR

SEQ ID NO: 470519 - protein, 9 aa, Homo Sapiens
CVPVGCRPI

SEQ ID NO: 470520 - protein, 9 aa, Homo Sapiens
IEGDQPIFV

SEQ ID NO: 470521 - protein, 9 aa, Homo Sapiens
AIRLLKILP

SEQ ID NO: 470522 - protein, 9 aa, Homo Sapiens
EECAKAFSK

SEQ ID NO: 470523 - protein, 9 aa, Homo Sapiens
RCASRFTGE

SEQ ID NO: 470524 - protein, 9 aa, Homo Sapiens
ALWQVGRKD

SEQ ID NO: 470525 - protein, 9 aa, Homo Sapiens
APISQWSSR

SEQ ID NO: 470526 - protein, 9 aa, Homo Sapiens
RGRVWALII

SEQ ID NO: 470527 - protein, 9 aa, Homo Sapiens
IPCSVLGHV

SEQ ID NO: 470528 - protein, 9 aa, Homo Sapiens
FQASEASTH

SEQ ID NO: 470529 - protein, 9 aa, Homo Sapiens
EKMMAAKGA

SEQ ID NO: 470530 - protein, 9 aa, Homo Sapiens
LVSIIKELQ

SEQ ID NO: 470531 - protein, 9 aa, Homo Sapiens
MKNECSMLK

SEQ ID NO: 470532 - protein, 9 aa, Homo Sapiens
ARILQMRAI

SEQ ID NO: 470533 - protein, 9 aa, Homo Sapiens
SWKNIKPEC

SEQ ID NO: 470534 - protein, 9 aa, Homo Sapiens
GEVLLHVEH

SEQ ID NO: 470535 - protein, 9 aa, Homo Sapiens
SSPVDLENH

SEQ ID NO: 470536 - protein, 9 aa, Homo Sapiens
HPPHPGTPM

SEQ ID NO: 470537 - protein, 9 aa, Homo Sapiens
SACATLVES

SEQ ID NO: 470538 - protein, 9 aa, Homo Sapiens
LNNTRAYTL

SEQ ID NO: 470539 - protein, 9 aa, Homo Sapiens
RIRSLQCSV

SEQ ID NO: 470540 - protein, 9 aa, Homo Sapiens
QTPGEGRMA

SEQ ID NO: 470541 - protein, 9 aa, Homo Sapiens
KVAQPDGAS

SEQ ID NO: 470542 - protein, 9 aa, Homo Sapiens
VILMVEERK

SEQ ID NO: 470543 - protein, 9 aa, Homo Sapiens
EIAHFCCEF

SEQ ID NO: 470544 - protein, 9 aa, Homo Sapiens
LGHVSLKLG

SEQ ID NO: 470545 - protein, 9 aa, Homo Sapiens
MPSASTTTP

SEQ ID NO: 470546 - protein, 9 aa, Homo Sapiens
CLRSSDFIE

SEQ ID NO: 470547 - protein, 9 aa, Homo Sapiens
KKFNHDGED

SEQ ID NO: 470548 - protein, 9 aa, Homo Sapiens
DLRGYIAWS

SEQ ID NO: 470549 - protein, 9 aa, Homo Sapiens
ELPDSVPHG

SEQ ID NO: 470550 - protein, 9 aa, Homo Sapiens
VWALIIMLC

SEQ ID NO: 470551 - protein, 9 aa, Homo Sapiens
EELRMEAEE

SEQ ID NO: 470552 - protein, 9 aa, Homo Sapiens
FVIFIIFVS

SEQ ID NO: 470553 - protein, 9 aa, Homo Sapiens
NHDGEDEEE

SEQ ID NO: 470554 - protein, 9 aa, Homo Sapiens
PDVTQSTLE

SEQ ID NO: 470555 - protein, 9 aa, Homo Sapiens
GFFGPSVRV

SEQ ID NO: 470556 - protein, 9 aa, Homo Sapiens
NSTYIWVLL

SEQ ID NO: 470557 - protein, 9 aa, Homo Sapiens
VTKKLHFFP

SEQ ID NO: 470558 - protein, 9 aa, Homo Sapiens
ATNSAQSAG

SEQ ID NO: 470559 - protein, 9 aa, Homo Sapiens
SSQRYTFSN

SEQ ID NO: 470560 - protein, 9 aa, Homo Sapiens
TFCRHCTDF

SEQ ID NO: 470561 - protein, 9 aa, Homo Sapiens
RPSSEVLYS

SEQ ID NO: 470562 - protein, 9 aa, Homo Sapiens
NAPEPDSIT

SEQ ID NO: 470563 - protein, 9 aa, Homo Sapiens
QIIFFHFAG

SEQ ID NO: 470564 - protein, 9 aa, Homo Sapiens
ALIIMLCLI

SEQ ID NO: 470565 - protein, 9 aa, Homo Sapiens
MLVIDSTDR

SEQ ID NO: 470566 - protein, 9 aa, Homo Sapiens
IEQVKTCGY

SEQ ID NO: 470567 - protein, 9 aa, Homo Sapiens
QHEVFVENE

SEQ ID NO: 470568 - protein, 9 aa, Homo Sapiens
HQLCGNYPT

SEQ ID NO: 470569 - protein, 9 aa, Homo Sapiens
TGEKFYKYE

SEQ ID NO: 470570 - protein, 9 aa, Homo Sapiens
SAGDTEAKI

SEQ ID NO: 470571 - protein, 9 aa, Homo Sapiens
LCRNIVQKS

SEQ ID NO: 470572 - protein, 9 aa, Homo Sapiens
FALRDHIPE

SEQ ID NO: 470573 - protein, 9 aa, Homo Sapiens
VFSYIVLPL

SEQ ID NO: 470574 - protein, 9 aa, Homo Sapiens
CLWRDCACA

SEQ ID NO: 470575 - protein, 9 aa, Homo Sapiens
SYAAVCHPL

SEQ ID NO: 470576 - protein, 9 aa, Homo Sapiens
ESFLDPIKA

SEQ ID NO: 470577 - protein, 9 aa, Homo Sapiens
IALFKVCRQ

SEQ ID NO: 470578 - protein, 9 aa, Homo Sapiens
SWALVFRSG

SEQ ID NO: 470579 - protein, 9 aa, Homo Sapiens
SKEDLHPAE

SEQ ID NO: 470580 - protein, 9 aa, Homo Sapiens
GVFLGQGNL

SEQ ID NO: 470581 - protein, 9 aa, Homo Sapiens
NIEAIVSVI

SEQ ID NO: 470582 - protein, 9 aa, Homo Sapiens
PSARLNSTT

SEQ ID NO: 470583 - protein, 9 aa, Homo Sapiens
LLTERRTLM

SEQ ID NO: 470584 - protein, 9 aa, Homo Sapiens
QVAYLNGLH

SEQ ID NO: 470585 - protein, 9 aa, Homo Sapiens
LRAQMVRYK

SEQ ID NO: 470586 - protein, 9 aa, Homo Sapiens
IRGLDGPPG

SEQ ID NO: 470587 - protein, 9 aa, Homo Sapiens
LDRRGSVIQ

SEQ ID NO: 470588 - protein, 9 aa, Homo Sapiens
EDDTDFFSP

SEQ ID NO: 470589 - protein, 9 aa, Homo Sapiens
TPSSLSPES

SEQ ID NO: 470590 - protein, 9 aa, Homo Sapiens
HSMMGDDKD

SEQ ID NO: 470591 - protein, 9 aa, Homo Sapiens
RDHNVLGTP

SEQ ID NO: 470592 - protein, 9 aa, Homo Sapiens
QLISNLAMK

SEQ ID NO: 470593 - protein, 9 aa, Homo Sapiens
REALAAKEA

SEQ ID NO: 470594 - protein, 9 aa, Homo Sapiens
EGRMARAGD

SEQ ID NO: 470595 - protein, 9 aa, Homo Sapiens
QTSPMEIVT

SEQ ID NO: 470596 - protein, 9 aa, Homo Sapiens
GSLETCRSE

SEQ ID NO: 470597 - protein, 9 aa, Homo Sapiens
SQSTYTVAT

SEQ ID NO: 470598 - protein, 9 aa, Homo Sapiens
AKGADGAAP

SEQ ID NO: 470599 - protein, 9 aa, Homo Sapiens
IIPSQSTYT

SEQ ID NO: 470600 - protein, 9 aa, Homo Sapiens
LNGLHEVLL

SEQ ID NO: 470601 - protein, 9 aa, Homo Sapiens
FSKFGHLTT

SEQ ID NO: 470602 - protein, 9 aa, Homo Sapiens
EDLAQGSSK

SEQ ID NO: 470603 - protein, 9 aa, Homo Sapiens
PTKGEVLLH

SEQ ID NO: 470604 - protein, 9 aa, Homo Sapiens
SPSSSSTLQ

SEQ ID NO: 470605 - protein, 9 aa, Homo Sapiens
RLDPNDYLT

SEQ ID NO: 470606 - protein, 9 aa, Homo Sapiens
CGFWLRQFP

SEQ ID NO: 470607 - protein, 9 aa, Homo Sapiens
NPLLYPVHV

SEQ ID NO: 470608 - protein, 9 aa, Homo Sapiens
LSVRDISGR

SEQ ID NO: 470609 - protein, 9 aa, Homo Sapiens
TGHPGPGGV

SEQ ID NO: 470610 - protein, 9 aa, Homo Sapiens
YLYCCRESI

SEQ ID NO: 470611 - protein, 9 aa, Homo Sapiens
VVVGAGATA

SEQ ID NO: 470612 - protein, 9 aa, Homo Sapiens
NALIGRLVC

SEQ ID NO: 470613 - protein, 9 aa, Homo Sapiens
SLLGRLWLF

SEQ ID NO: 470614 - protein, 9 aa, Homo Sapiens
LLIPSLRRH

SEQ ID NO: 470615 - protein, 9 aa, Homo Sapiens
SLQCSVQVL

SEQ ID NO: 470616 - protein, 9 aa, Homo Sapiens
MFCPLAKTC

SEQ ID NO: 470617 - protein, 9 aa, Homo Sapiens
FGALHVYRN

SEQ ID NO: 470618 - protein, 9 aa, Homo Sapiens
RMSEKKCSL

SEQ ID NO: 470619 - protein, 9 aa, Homo Sapiens
IVLPLTLIV

SEQ ID NO: 470620 - protein, 9 aa, Homo Sapiens
KISSEMPSP

SEQ ID NO: 470621 - protein, 9 aa, Homo Sapiens
PKTHPTDTI

SEQ ID NO: 470622 - protein, 9 aa, Homo Sapiens
EWTTLPTCI

SEQ ID NO: 470623 - protein, 9 aa, Homo Sapiens
LFVFQGAGE

SEQ ID NO: 470624 - protein, 9 aa, Homo Sapiens
QSPRDKLPG

SEQ ID NO: 470625 - protein, 9 aa, Homo Sapiens
IGFMSYARK

SEQ ID NO: 470626 - protein, 9 aa, Homo Sapiens
PGEGRMARA

SEQ ID NO: 470627 - protein, 9 aa, Homo Sapiens
SKIQGSQTG

SEQ ID NO: 470628 - protein, 9 aa, Homo Sapiens
GKIVGYILA

SEQ ID NO: 470629 - protein, 9 aa, Homo Sapiens
DQCETQCQM

SEQ ID NO: 470630 - protein, 9 aa, Homo Sapiens
LLPKTKYAA

SEQ ID NO: 470631 - protein, 9 aa, Homo Sapiens
GRGFQRLSL

SEQ ID NO: 470632 - protein, 9 aa, Homo Sapiens
VCRLRHVSP

SEQ ID NO: 470633 - protein, 9 aa, Homo Sapiens
YSSTCGEGW

SEQ ID NO: 470634 - protein, 9 aa, Homo Sapiens
RGYIAWSLM

SEQ ID NO: 470635 - protein, 9 aa, Homo Sapiens
LPYFIRGFA

SEQ ID NO: 470636 - protein, 9 aa, Homo Sapiens
IHGKISSEM

SEQ ID NO: 470637 - protein, 9 aa, Homo Sapiens
SNPTPICQK

SEQ ID NO: 470638 - protein, 9 aa, Homo Sapiens
PFAGKDERL

SEQ ID NO: 470639 - protein, 9 aa, Homo Sapiens
KAHKENPNQ

SEQ ID NO: 470640 - protein, 9 aa, Homo Sapiens
EIFPVELEK

SEQ ID NO: 470641 - protein, 9 aa, Homo Sapiens
LLRRQYNRV

SEQ ID NO: 470642 - protein, 9 aa, Homo Sapiens
PSVRVPWFI

SEQ ID NO: 470643 - protein, 9 aa, Homo Sapiens
NIENETPFE

SEQ ID NO: 470644 - protein, 9 aa, Homo Sapiens
HTGEKPSEC

SEQ ID NO: 470645 - protein, 9 aa, Homo Sapiens
GIWSNPTPI

SEQ ID NO: 470646 - protein, 9 aa, Homo Sapiens
SALWQVGRK

SEQ ID NO: 470647 - protein, 9 aa, Homo Sapiens
MTLEEMEEM

SEQ ID NO: 470648 - protein, 9 aa, Homo Sapiens
ELVLKKSGE

SEQ ID NO: 470649 - protein, 9 aa, Homo Sapiens
AKMKMPKFS

SEQ ID NO: 470650 - protein, 9 aa, Homo Sapiens
PRTQGVKCE

SEQ ID NO: 470651 - protein, 9 aa, Homo Sapiens
VYAMADALH

SEQ ID NO: 470652 - protein, 9 aa, Homo Sapiens
GQFPLTQNL

SEQ ID NO: 470653 - protein, 9 aa, Homo Sapiens
SRLLIIASI

SEQ ID NO: 470654 - protein, 9 aa, Homo Sapiens
CFHLGIWPE

SEQ ID NO: 470655 - protein, 9 aa, Homo Sapiens
YMQVAYLNG

SEQ ID NO: 470656 - protein, 9 aa, Homo Sapiens
RLCDVEIKE

SEQ ID NO: 470657 - protein, 9 aa, Homo Sapiens
LSQTSPPCA

SEQ ID NO: 470658 - protein, 9 aa, Homo Sapiens
QEQLISNLA

SEQ ID NO: 470659 - protein, 9 aa, Homo Sapiens
TKPEDGIPD

SEQ ID NO: 470660 - protein, 9 aa, Homo Sapiens
KCCKSDDKE

SEQ ID NO: 470661 - protein, 9 aa, Homo Sapiens
KGGAHPGDG

SEQ ID NO: 470662 - protein, 9 aa, Homo Sapiens
SKFGHLTTH

SEQ ID NO: 470663 - protein, 9 aa, Homo Sapiens
IRLLKILPE

SEQ ID NO: 470664 - protein, 9 aa, Homo Sapiens
LIVDPQGRR

SEQ ID NO: 470665 - protein, 9 aa, Homo Sapiens
FWLRQFPRS

SEQ ID NO: 470666 - protein, 9 aa, Homo Sapiens
YPQKFAMEL

SEQ ID NO: 470667 - protein, 9 aa, Homo Sapiens
YEFFKNPMC

SEQ ID NO: 470668 - protein, 9 aa, Homo Sapiens
RLLDPTEPI

SEQ ID NO: 470669 - protein, 9 aa, Homo Sapiens
GQKGTKKAV

SEQ ID NO: 470670 - protein, 9 aa, Homo Sapiens
NPNKHISKT

SEQ ID NO: 470671 - protein, 9 aa, Homo Sapiens
VDLENHEPV

SEQ ID NO: 470672 - protein, 9 aa, Homo Sapiens
PYRMLRIWN

SEQ ID NO: 470673 - protein, 9 aa, Homo Sapiens
SQTSPPCAL

SEQ ID NO: 470674 - protein, 9 aa, Homo Sapiens
QGFFGPSVR

SEQ ID NO: 470675 - protein, 9 aa, Homo Sapiens
AHKENPNQP

SEQ ID NO: 470676 - protein, 9 aa, Homo Sapiens
RSPLPTSLA

SEQ ID NO: 470677 - protein, 9 aa, Homo Sapiens
GHERRTDYY

SEQ ID NO: 470678 - protein, 9 aa, Homo Sapiens
TLSLQGVFL

SEQ ID NO: 470679 - protein, 9 aa, Homo Sapiens
RRHASLVTV

SEQ ID NO: 470680 - protein, 9 aa, Homo Sapiens
GKTGHPGPG

SEQ ID NO: 470681 - protein, 9 aa, Homo Sapiens
RNIVQKSVT

SEQ ID NO: 470682 - protein, 9 aa, Homo Sapiens
QLVCFQKLK

SEQ ID NO: 470683 - protein, 9 aa, Homo Sapiens
GDQPIFVQW

SEQ ID NO: 470684 - protein, 9 aa, Homo Sapiens
PCLRSSDFI

SEQ ID NO: 470685 - protein, 9 aa, Homo Sapiens
LQCSVQVLR

SEQ ID NO: 470686 - protein, 9 aa, Homo Sapiens
LLGRLWLFP

SEQ ID NO: 470687 - protein, 9 aa, Homo Sapiens
QKARLLDPT

SEQ ID NO: 470688 - protein, 9 aa, Homo Sapiens
IAWSLMDNF

SEQ ID NO: 470689 - protein, 9 aa, Homo Sapiens
SFYDLEVDQ

SEQ ID NO: 470690 - protein, 9 aa, Homo Sapiens
GGGGNGSHR

SEQ ID NO: 470691 - protein, 9 aa, Homo Sapiens
CEETMPVEA

SEQ ID NO: 470692 - protein, 9 aa, Homo Sapiens
GLGACELLL

SEQ ID NO: 470693 - protein, 9 aa, Homo Sapiens
GLHYGYGVL

SEQ ID NO: 470694 - protein, 9 aa, Homo Sapiens
VMFSARVLG

SEQ ID NO: 470695 - protein, 9 aa, Homo Sapiens
SNADKSLHE

SEQ ID NO: 470696 - protein, 9 aa, Homo Sapiens
RHCTDFIWG

SEQ ID NO: 470697 - protein, 9 aa, Homo Sapiens
LRRQYNRVS

SEQ ID NO: 470698 - protein, 9 aa, Homo Sapiens
AHFCCEFPS

SEQ ID NO: 470699 - protein, 9 aa, Homo Sapiens
MIPMVQNEG

SEQ ID NO: 470700 - protein, 9 aa, Homo Sapiens
LQGEAGRIA

SEQ ID NO: 470701 - protein, 9 aa, Homo Sapiens
RGSVIQSVP

SEQ ID NO: 470702 - protein, 9 aa, Homo Sapiens
NADKSLHES

SEQ ID NO: 470703 - protein, 9 aa, Homo Sapiens
PSAKERESL

SEQ ID NO: 470704 - protein, 9 aa, Homo Sapiens
EKSAGDTEA

SEQ ID NO: 470705 - protein, 9 aa, Homo Sapiens
FLGLLIIRF

SEQ ID NO: 470706 - protein, 9 aa, Homo Sapiens
TTPTSRCPT

SEQ ID NO: 470707 - protein, 9 aa, Homo Sapiens
VYDELCGLI

SEQ ID NO: 470708 - protein, 9 aa, Homo Sapiens
LHVEHQQQK

SEQ ID NO: 470709 - protein, 9 aa, Homo Sapiens
ITHGYGTPA

SEQ ID NO: 470710 - protein, 9 aa, Homo Sapiens
HVSPTPSEE

SEQ ID NO: 470711 - protein, 9 aa, Homo Sapiens
GFLQPVGAI

SEQ ID NO: 470712 - protein, 9 aa, Homo Sapiens
DVYDEGPYS

SEQ ID NO: 470713 - protein, 9 aa, Homo Sapiens
HLLTERRTL

SEQ ID NO: 470714 - protein, 9 aa, Homo Sapiens
PRDKLPGGR

SEQ ID NO: 470715 - protein, 9 aa, Homo Sapiens
SVTDYPQKF

SEQ ID NO: 470716 - protein, 9 aa, Homo Sapiens
PSEENNKDA

SEQ ID NO: 470717 - protein, 9 aa, Homo Sapiens
LLHVEHQQQ

SEQ ID NO: 470718 - protein, 9 aa, Homo Sapiens
QPGIRGLDG

SEQ ID NO: 470719 - protein, 9 aa, Homo Sapiens
GECVCPPRT

SEQ ID NO: 470720 - protein, 9 aa, Homo Sapiens
RGAGAIRLL

SEQ ID NO: 470721 - protein, 9 aa, Homo Sapiens
WQSGCAVSL

SEQ ID NO: 470722 - protein, 9 aa, Homo Sapiens
ATCRCASRF

SEQ ID NO: 470723 - protein, 9 aa, Homo Sapiens
RPKTHPTDT

SEQ ID NO: 470724 - protein, 9 aa, Homo Sapiens
STASEESEK

SEQ ID NO: 470725 - protein, 9 aa, Homo Sapiens
WVLLLPESQ

SEQ ID NO: 470726 - protein, 9 aa, Homo Sapiens
KMAKMKMPK

SEQ ID NO: 470727 - protein, 9 aa, Homo Sapiens
IEDLAQGSS

SEQ ID NO: 470728 - protein, 9 aa, Homo Sapiens
ISGPRDPPT

SEQ ID NO: 470729 - protein, 9 aa, Homo Sapiens
PGKRKFNCR

SEQ ID NO: 470730 - protein, 9 aa, Homo Sapiens
FSIDTQTTI

SEQ ID NO: 470731 - protein, 9 aa, Homo Sapiens
AAVFPSNSV

SEQ ID NO: 470732 - protein, 9 aa, Homo Sapiens
NHLFVFQGA

SEQ ID NO: 470733 - protein, 9 aa, Homo Sapiens
GGSLIANSC

SEQ ID NO: 470734 - protein, 9 aa, Homo Sapiens
QKSVTDEAA

SEQ ID NO: 470735 - protein, 9 aa, Homo Sapiens
TVFSSKIQG

SEQ ID NO: 470736 - protein, 9 aa, Homo Sapiens
SDIWLFGAL

SEQ ID NO: 470737 - protein, 9 aa, Homo Sapiens
LICAKSRMP

SEQ ID NO: 470738 - protein, 9 aa, Homo Sapiens
VLLDQHAAH

SEQ ID NO: 470739 - protein, 9 aa, Homo Sapiens
GTGFKSFGL

SEQ ID NO: 470740 - protein, 9 aa, Homo Sapiens
HPGTPMAHP

SEQ ID NO: 470741 - protein, 9 aa, Homo Sapiens
MPRINSAAA

SEQ ID NO: 470742 - protein, 9 aa, Homo Sapiens
HWITTPYRM

SEQ ID NO: 470743 - protein, 9 aa, Homo Sapiens
KKHGFKFGP

SEQ ID NO: 470744 - protein, 9 aa, Homo Sapiens
AYDSYAAVC

SEQ ID NO: 470745 - protein, 9 aa, Homo Sapiens
PSECGFWLR

SEQ ID NO: 470746 - protein, 9 aa, Homo Sapiens
YDLEVDQCC

SEQ ID NO: 470747 - protein, 9 aa, Homo Sapiens
GSVIQSVPG

SEQ ID NO: 470748 - protein, 9 aa, Homo Sapiens
YKLPNFFSV

SEQ ID NO: 470749 - protein, 9 aa, Homo Sapiens
ENLLMQDEI

SEQ ID NO: 470750 - protein, 9 aa, Homo Sapiens
RDHIPELEN

SEQ ID NO: 470751 - protein, 9 aa, Homo Sapiens
RASSANRTT

SEQ ID NO: 470752 - protein, 9 aa, Homo Sapiens
TIKTDGRKE

SEQ ID NO: 470753 - protein, 9 aa, Homo Sapiens
RCASCSPLS

SEQ ID NO: 470754 - protein, 9 aa, Homo Sapiens
LIESSMEHG

SEQ ID NO: 470755 - protein, 9 aa, Homo Sapiens
PGRVSWKNI

SEQ ID NO: 470756 - protein, 9 aa, Homo Sapiens
CCEFPSLLI

SEQ ID NO: 470757 - protein, 9 aa, Homo Sapiens
SLHESLQKT

SEQ ID NO: 470758 - protein, 9 aa, Homo Sapiens
DINHTSPRR

SEQ ID NO: 470759 - protein, 9 aa, Homo Sapiens
CEQEEKMCE

SEQ ID NO: 470760 - protein, 9 aa, Homo Sapiens
THTGEKPSE

SEQ ID NO: 470761 - protein, 9 aa, Homo Sapiens
PAIPYLQGH

SEQ ID NO: 470762 - protein, 9 aa, Homo Sapiens
INHTSPRRR

SEQ ID NO: 470763 - protein, 9 aa, Homo Sapiens
WTTMDVATP

SEQ ID NO: 470764 - protein, 9 aa, Homo Sapiens
AGRIAGDLG

SEQ ID NO: 470765 - protein, 9 aa, Homo Sapiens
SSVCVPVGC

SEQ ID NO: 470766 - protein, 9 aa, Homo Sapiens
SCGRGFQRL

SEQ ID NO: 470767 - protein, 9 aa, Homo Sapiens
WLRQFPRSL

SEQ ID NO: 470768 - protein, 9 aa, Homo Sapiens
ACLICAKSR

SEQ ID NO: 470769 - protein, 9 aa, Homo Sapiens
RRTDYYMGY

SEQ ID NO: 470770 - protein, 9 aa, Homo Sapiens
LTVTASDQS

SEQ ID NO: 470771 - protein, 9 aa, Homo Sapiens
WKNIKPECP

SEQ ID NO: 470772 - protein, 9 aa, Homo Sapiens
ELCYFSDIV

SEQ ID NO: 470773 - protein, 9 aa, Homo Sapiens
CCKSDDKET

SEQ ID NO: 470774 - protein, 9 aa, Homo Sapiens
KWLVARINK

SEQ ID NO: 470775 - protein, 9 aa, Homo Sapiens
ESVTDYPQK

SEQ ID NO: 470776 - protein, 9 aa, Homo Sapiens
LEEMEEMGK

SEQ ID NO: 470777 - protein, 9 aa, Homo Sapiens
CGWFNDPSN

SEQ ID NO: 470778 - protein, 9 aa, Homo Sapiens
LKLQELPDS

SEQ ID NO: 470779 - protein, 9 aa, Homo Sapiens
SLHPVIREP

SEQ ID NO: 470780 - protein, 9 aa, Homo Sapiens
PGIIPSQST

SEQ ID NO: 470781 - protein, 9 aa, Homo Sapiens
RSSDFIEGF

SEQ ID NO: 470782 - protein, 9 aa, Homo Sapiens
IITSNSLAP

SEQ ID NO: 470783 - protein, 9 aa, Homo Sapiens
EDQKVRPSE

SEQ ID NO: 470784 - protein, 9 aa, Homo Sapiens
RSFFALRDH

SEQ ID NO: 470785 - protein, 9 aa, Homo Sapiens
SMEHGKEMT

SEQ ID NO: 470786 - protein, 9 aa, Homo Sapiens
QAEAGNYSA

SEQ ID NO: 470787 - protein, 9 aa, Homo Sapiens
TVEMAVAAG

SEQ ID NO: 470788 - protein, 9 aa, Homo Sapiens
LTERRTLMQ

SEQ ID NO: 470789 - protein, 9 aa, Homo Sapiens
YHLLTERRT

SEQ ID NO: 470790 - protein, 9 aa, Homo Sapiens
ARQSPPPDW

SEQ ID NO: 470791 - protein, 9 aa, Homo Sapiens
PGCGWFNDP

SEQ ID NO: 470792 - protein, 9 aa, Homo Sapiens
LKKKLKRII

SEQ ID NO: 470793 - protein, 9 aa, Homo Sapiens
ERESLNKGI

SEQ ID NO: 470794 - protein, 9 aa, Homo Sapiens
GCGKSFSYS

SEQ ID NO: 470795 - protein, 9 aa, Homo Sapiens
KSLQVVDHA

SEQ ID NO: 470796 - protein, 9 aa, Homo Sapiens
TSPPCALEE

SEQ ID NO: 470797 - protein, 9 aa, Homo Sapiens
PSQSTYTVA

SEQ ID NO: 470798 - protein, 9 aa, Homo Sapiens
WALIIMLCL

SEQ ID NO: 470799 - protein, 9 aa, Homo Sapiens
THGYGTPAI

SEQ ID NO: 470800 - protein, 9 aa, Homo Sapiens
YAACVCVQG

SEQ ID NO: 470801 - protein, 9 aa, Homo Sapiens
TLANLIPVT

SEQ ID NO: 470802 - protein, 9 aa, Homo Sapiens
KDAFVIVVE

SEQ ID NO: 470803 - protein, 9 aa, Homo Sapiens
LQMRAIQWQ

SEQ ID NO: 470804 - protein, 9 aa, Homo Sapiens
VIALFKVCR

SEQ ID NO: 470805 - protein, 9 aa, Homo Sapiens
SCEETMPVE

SEQ ID NO: 470806 - protein, 9 aa, Homo Sapiens
APEPDSITC

SEQ ID NO: 470807 - protein, 9 aa, Homo Sapiens
ELAPSWAQR

SEQ ID NO: 470808 - protein, 9 aa, Homo Sapiens
RAGFIIYTV

SEQ ID NO: 470809 - protein, 9 aa, Homo Sapiens
STSTPNVSQ

SEQ ID NO: 470810 - protein, 9 aa, Homo Sapiens
PVGCRPIVC

SEQ ID NO: 470811 - protein, 9 aa, Homo Sapiens
KEGGVIALF

SEQ ID NO: 470812 - protein, 9 aa, Homo Sapiens
KFYKYEECG

SEQ ID NO: 470813 - protein, 9 aa, Homo Sapiens
SITSATTLY

SEQ ID NO: 470814 - protein, 9 aa, Homo Sapiens
LHPVIREPP

SEQ ID NO: 470815 - protein, 9 aa, Homo Sapiens
LIANSCVLT

SEQ ID NO: 470816 - protein, 9 aa, Homo Sapiens
WQVGRKDCP

SEQ ID NO: 470817 - protein, 9 aa, Homo Sapiens
RGIVVGPVN

SEQ ID NO: 470818 - protein, 9 aa, Homo Sapiens
VTKQKFDYL

SEQ ID NO: 470819 - protein, 9 aa, Homo Sapiens
YYFGGCPEN

SEQ ID NO: 470820 - protein, 9 aa, Homo Sapiens
CFKGEAGSP

SEQ ID NO: 470821 - protein, 9 aa, Homo Sapiens
GWINLLNMA

SEQ ID NO: 470822 - protein, 9 aa, Homo Sapiens
ADMDHPCKH

SEQ ID NO: 470823 - protein, 9 aa, Homo Sapiens
GSGGDEEAT

SEQ ID NO: 470824 - protein, 9 aa, Homo Sapiens
EEEKVAQPD

SEQ ID NO: 470825 - protein, 9 aa, Homo Sapiens
LDAKFNAYK

SEQ ID NO: 470826 - protein, 9 aa, Homo Sapiens
YNYLNRIVC

SEQ ID NO: 470827 - protein, 9 aa, Homo Sapiens
ELQAEAGNY

SEQ ID NO: 470828 - protein, 9 aa, Homo Sapiens
LPTSLASLR

SEQ ID NO: 470829 - protein, 9 aa, Homo Sapiens
GHAVRPHAG

SEQ ID NO: 470830 - protein, 9 aa, Homo Sapiens
AGKNYIILT

SEQ ID NO: 470831 - protein, 9 aa, Homo Sapiens
SLVSVGSLL

SEQ ID NO: 470832 - protein, 9 aa, Homo Sapiens
EDEEEDDDY

SEQ ID NO: 470833 - protein, 9 aa, Homo Sapiens
KLSNHLFVF

SEQ ID NO: 470834 - protein, 9 aa, Homo Sapiens
LAQGSSKVP

SEQ ID NO: 470835 - protein, 9 aa, Homo Sapiens
HPATVPSKE

SEQ ID NO: 470836 - protein, 9 aa, Homo Sapiens
VLGHVFRTK

SEQ ID NO: 470837 - protein, 9 aa, Homo Sapiens
PRGKIGLVH

SEQ ID NO: 470838 - protein, 9 aa, Homo Sapiens
PLPSCMDSN

SEQ ID NO: 470839 - protein, 9 aa, Homo Sapiens
WLIVIIKIN

SEQ ID NO: 470840 - protein, 9 aa, Homo Sapiens
NLTVVEGGT

SEQ ID NO: 470841 - protein, 9 aa, Homo Sapiens
LVFRSGYLQ

SEQ ID NO: 470842 - protein, 9 aa, Homo Sapiens
KRRGKNHVS

SEQ ID NO: 470843 - protein, 9 aa, Homo Sapiens
CAKSRMPFK

SEQ ID NO: 470844 - protein, 9 aa, Homo Sapiens
DYLYCCRES

SEQ ID NO: 470845 - protein, 9 aa, Homo Sapiens
QHQLCGNYP

SEQ ID NO: 470846 - protein, 9 aa, Homo Sapiens
CRPLHYAII

SEQ ID NO: 470847 - protein, 9 aa, Homo Sapiens
RGKNHVSNV

SEQ ID NO: 470848 - protein, 9 aa, Homo Sapiens
ETILTETPQ

SEQ ID NO: 470849 - protein, 9 aa, Homo Sapiens
STLQSLFQS

SEQ ID NO: 470850 - protein, 9 aa, Homo Sapiens
SAQSAGMDL

SEQ ID NO: 470851 - protein, 9 aa, Homo Sapiens
FFRIIYSLL

SEQ ID NO: 470852 - protein, 9 aa, Homo Sapiens
KNALIGRLV

SEQ ID NO: 470853 - protein, 9 aa, Homo Sapiens
REAAPAIPY

SEQ ID NO: 470854 - protein, 9 aa, Homo Sapiens
LLIQKFSHS

SEQ ID NO: 470855 - protein, 9 aa, Homo Sapiens
TASDQSVNV

SEQ ID NO: 470856 - protein, 9 aa, Homo Sapiens
PLPTSLASL

SEQ ID NO: 470857 - protein, 9 aa, Homo Sapiens
KLGPGEKHE

SEQ ID NO: 470858 - protein, 9 aa, Homo Sapiens
GESVDPFNQ

SEQ ID NO: 470859 - protein, 9 aa, Homo Sapiens
PENLTDSQC

SEQ ID NO: 470860 - protein, 9 aa, Homo Sapiens
SAKERESLN

SEQ ID NO: 470861 - protein, 9 aa, Homo Sapiens
HFCCEFPSL

SEQ ID NO: 470862 - protein, 9 aa, Homo Sapiens
WSVYSSTCG

SEQ ID NO: 470863 - protein, 9 aa, Homo Sapiens
ILNVKRATL

SEQ ID NO: 470864 - protein, 9 aa, Homo Sapiens
KYIIHEHSV

SEQ ID NO: 470865 - protein, 9 aa, Homo Sapiens
DHIPELENN

SEQ ID NO: 470866 - protein, 9 aa, Homo Sapiens
ITSNSLAPR

SEQ ID NO: 470867 - protein, 9 aa, Homo Sapiens
LENHEPVKK

SEQ ID NO: 470868 - protein, 9 aa, Homo Sapiens
VIHMEEKTC

SEQ ID NO: 470869 - protein, 9 aa, Homo Sapiens
VGLELQAEA

SEQ ID NO: 470870 - protein, 9 aa, Homo Sapiens
VSHGTGFKS

SEQ ID NO: 470871 - protein, 9 aa, Homo Sapiens
YYGGLHYGY

SEQ ID NO: 470872 - protein, 9 aa, Homo Sapiens
KEWYVGVPR

SEQ ID NO: 470873 - protein, 9 aa, Homo Sapiens
MVQNEGQVA

SEQ ID NO: 470874 - protein, 9 aa, Homo Sapiens
HYAIIMNQR

SEQ ID NO: 470875 - protein, 9 aa, Homo Sapiens
EGNIGFMSY

SEQ ID NO: 470876 - protein, 9 aa, Homo Sapiens
ASIEGDQPI

SEQ ID NO: 470877 - protein, 9 aa, Homo Sapiens
PDSITCCVS

SEQ ID NO: 470878 - protein, 9 aa, Homo Sapiens
LRGAGAIRL

SEQ ID NO: 470879 - protein, 9 aa, Homo Sapiens
DVELAPSWA

SEQ ID NO: 470880 - protein, 9 aa, Homo Sapiens
MSEKKCSLA

SEQ ID NO: 470881 - protein, 9 aa, Homo Sapiens
YLETLSLES

SEQ ID NO: 470882 - protein, 9 aa, Homo Sapiens
HMEEKTCKC

SEQ ID NO: 470883 - protein, 9 aa, Homo Sapiens
LVRHKTIHT

SEQ ID NO: 470884 - protein, 9 aa, Homo Sapiens
TTWHGQGQG

SEQ ID NO: 470885 - protein, 9 aa, Homo Sapiens
SRFTGEDCQ

SEQ ID NO: 470886 - protein, 9 aa, Homo Sapiens
ISNLAMKEV

SEQ ID NO: 470887 - protein, 9 aa, Homo Sapiens
ANWYFLLAC

SEQ ID NO: 470888 - protein, 9 aa, Homo Sapiens
LEECGITST

SEQ ID NO: 470889 - protein, 9 aa, Homo Sapiens
VLVAVYDEL

SEQ ID NO: 470890 - protein, 9 aa, Homo Sapiens
RVLGNLIAL

SEQ ID NO: 470891 - protein, 9 aa, Homo Sapiens
SGRVEISHG

SEQ ID NO: 470892 - protein, 9 aa, Homo Sapiens
QRTTEGLTL

SEQ ID NO: 470893 - protein, 9 aa, Homo Sapiens
IVVGPVNGW

SEQ ID NO: 470894 - protein, 9 aa, Homo Sapiens
AMARFRKNI

SEQ ID NO: 470895 - protein, 9 aa, Homo Sapiens
CAKAFSKFG

SEQ ID NO: 470896 - protein, 9 aa, Homo Sapiens
WAHNGEVRN

SEQ ID NO: 470897 - protein, 9 aa, Homo Sapiens
FYDLEVDQC

SEQ ID NO: 470898 - protein, 9 aa, Homo Sapiens
KSQVLMLTG

SEQ ID NO: 470899 - protein, 9 aa, Homo Sapiens
SYLVRHKTI

SEQ ID NO: 470900 - protein, 9 aa, Homo Sapiens
QPVGAICLC

SEQ ID NO: 470901 - protein, 9 aa, Homo Sapiens
EILSVRDIS

SEQ ID NO: 470902 - protein, 9 aa, Homo Sapiens
DAHWITTPY

SEQ ID NO: 470903 - protein, 9 aa, Homo Sapiens
GFAHVFPSN

SEQ ID NO: 470904 - protein, 9 aa, Homo Sapiens
ISSVMFSAR

SEQ ID NO: 470905 - protein, 9 aa, Homo Sapiens
PPRTQGVKC

SEQ ID NO: 470906 - protein, 9 aa, Homo Sapiens
TKTGASNLK

SEQ ID NO: 470907 - protein, 9 aa, Homo Sapiens
ILTGPSITS

SEQ ID NO: 470908 - protein, 9 aa, Homo Sapiens
PYLQGHAVR

SEQ ID NO: 470909 - protein, 9 aa, Homo Sapiens
SGPRDPPTS

SEQ ID NO: 470910 - protein, 9 aa, Homo Sapiens
SDPYVTVKV

SEQ ID NO: 470911 - protein, 9 aa, Homo Sapiens
LIEESYKDS

SEQ ID NO: 470912 - protein, 9 aa, Homo Sapiens
ARLNSTTFP

SEQ ID NO: 470913 - protein, 9 aa, Homo Sapiens
IWLFGALHV

SEQ ID NO: 470914 - protein, 9 aa, Homo Sapiens
LGPGEKHEL

SEQ ID NO: 470915 - protein, 9 aa, Homo Sapiens
ANSCVLTAA

SEQ ID NO: 470916 - protein, 9 aa, Homo Sapiens
EVFVENEIV

SEQ ID NO: 470917 - protein, 9 aa, Homo Sapiens
GDLLQPPLA

SEQ ID NO: 470918 - protein, 9 aa, Homo Sapiens
LVTVFPSPS

SEQ ID NO: 470919 - protein, 9 aa, Homo Sapiens
HKENPNQPA

SEQ ID NO: 470920 - protein, 9 aa, Homo Sapiens
TSCASLVSV

SEQ ID NO: 470921 - protein, 9 aa, Homo Sapiens
EDLHPAEPQ

SEQ ID NO: 470922 - protein, 9 aa, Homo Sapiens
SVTKQKFDY

SEQ ID NO: 470923 - protein, 9 aa, Homo Sapiens
FHQGDSELL

SEQ ID NO: 470924 - protein, 9 aa, Homo Sapiens
NTEFIMLVI

SEQ ID NO: 470925 - protein, 9 aa, Homo Sapiens
WFVFKETTW

SEQ ID NO: 470926 - protein, 9 aa, Homo Sapiens
CELLLVLIS

SEQ ID NO: 470927 - protein, 9 aa, Homo Sapiens
EFYEQADEE

SEQ ID NO: 470928 - protein, 9 aa, Homo Sapiens
EALGGAKAS

SEQ ID NO: 470929 - protein, 9 aa, Homo Sapiens
QRCASCSPL

SEQ ID NO: 470930 - protein, 9 aa, Homo Sapiens
RVWALIIML

SEQ ID NO: 470931 - protein, 9 aa, Homo Sapiens
PGEKHELHA

SEQ ID NO: 470932 - protein, 9 aa, Homo Sapiens
FLGSGGDEE

SEQ ID NO: 470933 - protein, 9 aa, Homo Sapiens
VYDEGPYSC

SEQ ID NO: 470934 - protein, 9 aa, Homo Sapiens
ASNLTEPIY

SEQ ID NO: 470935 - protein, 9 aa, Homo Sapiens
GHTPLKNFI

SEQ ID NO: 470936 - protein, 9 aa, Homo Sapiens
LVAVYDELC

SEQ ID NO: 470937 - protein, 9 aa, Homo Sapiens
IIENLKNEL

SEQ ID NO: 470938 - protein, 9 aa, Homo Sapiens
AEGGGGNGS

SEQ ID NO: 470939 - protein, 9 aa, Homo Sapiens
EEVCIETYI

SEQ ID NO: 470940 - protein, 9 aa, Homo Sapiens
KRATLSWEN

SEQ ID NO: 470941 - protein, 9 aa, Homo Sapiens
HIFARGKRR

SEQ ID NO: 470942 - protein, 9 aa, Homo Sapiens
KFGHLTTHR

SEQ ID NO: 470943 - protein, 9 aa, Homo Sapiens
SIIKELQPK

SEQ ID NO: 470944 - protein, 9 aa, Homo Sapiens
GCCRSLASV

SEQ ID NO: 470945 - protein, 9 aa, Homo Sapiens
IPMLNSLIY

SEQ ID NO: 470946 - protein, 9 aa, Homo Sapiens
KARLLDPTE

SEQ ID NO: 470947 - protein, 9 aa, Homo Sapiens
VPSKERPGK

SEQ ID NO: 470948 - protein, 9 aa, Homo Sapiens
RASFQASKR

SEQ ID NO: 470949 - protein, 9 aa, Homo Sapiens
IAKEGGVIA

SEQ ID NO: 470950 - protein, 9 aa, Homo Sapiens
ATLSWENSL

SEQ ID NO: 470951 - protein, 9 aa, Homo Sapiens
KTTAGKKSS

SEQ ID NO: 470952 - protein, 9 aa, Homo Sapiens
GGVIALFKV

SEQ ID NO: 470953 - protein, 9 aa, Homo Sapiens
EGDRVGVEH

SEQ ID NO: 470954 - protein, 9 aa, Homo Sapiens
SRRLREALA

SEQ ID NO: 470955 - protein, 9 aa, Homo Sapiens
LTLDAQNSL

SEQ ID NO: 470956 - protein, 9 aa, Homo Sapiens
KTCEQFEAE

SEQ ID NO: 470957 - protein, 9 aa, Homo Sapiens
GEKAHKENP

SEQ ID NO: 470958 - protein, 9 aa, Homo Sapiens
TDYYMGYRQ

SEQ ID NO: 470959 - protein, 9 aa, Homo Sapiens
PPHPGTPMA

SEQ ID NO: 470960 - protein, 9 aa, Homo Sapiens
QGKSQVLML

SEQ ID NO: 470961 - protein, 9 aa, Homo Sapiens
TQGVVVGAG

SEQ ID NO: 470962 - protein, 9 aa, Homo Sapiens
ANLIPVTLS

SEQ ID NO: 470963 - protein, 9 aa, Homo Sapiens
NKMFCPLAK

SEQ ID NO: 470964 - protein, 9 aa, Homo Sapiens
WSSRRRSRS

SEQ ID NO: 470965 - protein, 9 aa, Homo Sapiens
AEPEKVESS

SEQ ID NO: 470966 - protein, 9 aa, Homo Sapiens
ISSPVDLEN

SEQ ID NO: 470967 - protein, 9 aa, Homo Sapiens
LLQGEAGRI

SEQ ID NO: 470968 - protein, 9 aa, Homo Sapiens
TLRASFQAS

SEQ ID NO: 470969 - protein, 9 aa, Homo Sapiens
PYFIRGFAS

SEQ ID NO: 470970 - protein, 9 aa, Homo Sapiens
VSTSTPNVS

SEQ ID NO: 470971 - protein, 9 aa, Homo Sapiens
FGSDGTDSI

SEQ ID NO: 470972 - protein, 9 aa, Homo Sapiens
KDTSGNQAV

SEQ ID NO: 470973 - protein, 9 aa, Homo Sapiens
LQGVFLGQG

SEQ ID NO: 470974 - protein, 9 aa, Homo Sapiens
VSIIKELQP

SEQ ID NO: 470975 - protein, 9 aa, Homo Sapiens
LRSSDFIEG

SEQ ID NO: 470976 - protein, 9 aa, Homo Sapiens
TDVPELQMA

SEQ ID NO: 470977 - protein, 9 aa, Homo Sapiens
VAGRFQASE

SEQ ID NO: 470978 - protein, 9 aa, Homo Sapiens
RLREALAAK

SEQ ID NO: 470979 - protein, 9 aa, Homo Sapiens
CMLTSGCCR

SEQ ID NO: 470980 - protein, 9 aa, Homo Sapiens
KGHKRFCLW

SEQ ID NO: 470981 - protein, 9 aa, Homo Sapiens
PPLAYQMNT

SEQ ID NO: 470982 - protein, 9 aa, Homo Sapiens
VKVGKNKRR

SEQ ID NO: 470983 - protein, 9 aa, Homo Sapiens
QWADMDHPC

SEQ ID NO: 470984 - protein, 9 aa, Homo Sapiens
QGVFLGQGN

SEQ ID NO: 470985 - protein, 9 aa, Homo Sapiens
QRPKTHPTD

SEQ ID NO: 470986 - protein, 9 aa, Homo Sapiens
PVIVLKLGG

SEQ ID NO: 470987 - protein, 9 aa, Homo Sapiens
LATGPIILP

SEQ ID NO: 470988 - protein, 9 aa, Homo Sapiens
FRKNIEAIV

SEQ ID NO: 470989 - protein, 9 aa, Homo Sapiens
GKRKFNCRQ

SEQ ID NO: 470990 - protein, 9 aa, Homo Sapiens
PPSPLPSCM

SEQ ID NO: 470991 - protein, 9 aa, Homo Sapiens
PFKCVGCGK

SEQ ID NO: 470992 - protein, 9 aa, Homo Sapiens
SSEMPSPNF

SEQ ID NO: 470993 - protein, 9 aa, Homo Sapiens
EQTFPLGLG

SEQ ID NO: 470994 - protein, 9 aa, Homo Sapiens
QLASHPGMA

SEQ ID NO: 470995 - protein, 9 aa, Homo Sapiens
THLEEIVSY

SEQ ID NO: 470996 - protein, 9 aa, Homo Sapiens
LVARINKAL

SEQ ID NO: 470997 - protein, 9 aa, Homo Sapiens
PELQMAVFT

SEQ ID NO: 470998 - protein, 9 aa, Homo Sapiens
STHLVKSYP

SEQ ID NO: 470999 - protein, 9 aa, Homo Sapiens
FVAMVAVAL

SEQ ID NO: 471000 - protein, 9 aa, Homo Sapiens
RRIRSLQCS

SEQ ID NO: 471001 - protein, 9 aa, Homo Sapiens
LSLFQGWIN

SEQ ID NO: 471002 - protein, 9 aa, Homo Sapiens
EPIYSSSTC

SEQ ID NO: 471003 - protein, 9 aa, Homo Sapiens
IKELQPKLK

SEQ ID NO: 471004 - protein, 9 aa, Homo Sapiens
GSRPSSEVL

SEQ ID NO: 471005 - protein, 9 aa, Homo Sapiens
HPRGIVVGP

SEQ ID NO: 471006 - protein, 9 aa, Homo Sapiens
VELAPSWAQ

SEQ ID NO: 471007 - protein, 9 aa, Homo Sapiens
LIIRFFKIL

SEQ ID NO: 471008 - protein, 9 aa, Homo Sapiens
IVNEFYEQA

SEQ ID NO: 471009 - protein, 9 aa, Homo Sapiens
LLIIRFFKI

SEQ ID NO: 471010 - protein, 9 aa, Homo Sapiens
VIFIIFVSF

SEQ ID NO: 471011 - protein, 9 aa, Homo Sapiens
LGGGHKWQN

SEQ ID NO: 471012 - protein, 9 aa, Homo Sapiens
VSPTPSEEH

SEQ ID NO: 471013 - protein, 9 aa, Homo Sapiens
VRRIRSLQC

SEQ ID NO: 471014 - protein, 9 aa, Homo Sapiens
GVPSTQGKW

SEQ ID NO: 471015 - protein, 9 aa, Homo Sapiens
NISNTAGGE

SEQ ID NO: 471016 - protein, 9 aa, Homo Sapiens
PERRHASLV

SEQ ID NO: 471017 - protein, 9 aa, Homo Sapiens
VTAFKPHDL

SEQ ID NO: 471018 - protein, 9 aa, Homo Sapiens
LKDAAEKSA

SEQ ID NO: 471019 - protein, 9 aa, Homo Sapiens
SHSVAWTTM

SEQ ID NO: 471020 - protein, 9 aa, Homo Sapiens
KPEDGIPDV

SEQ ID NO: 471021 - protein, 9 aa, Homo Sapiens
AVYDELCGL

SEQ ID NO: 471022 - protein, 9 aa, Homo Sapiens
DSTHLVKSY

SEQ ID NO: 471023 - protein, 9 aa, Homo Sapiens
VIKSLQVVD

SEQ ID NO: 471024 - protein, 9 aa, Homo Sapiens
YHSMMGDDK

SEQ ID NO: 471025 - protein, 9 aa, Homo Sapiens
TPGEGRMAR

SEQ ID NO: 471026 - protein, 9 aa, Homo Sapiens
HNGEVRNAR

SEQ ID NO: 471027 - protein, 9 aa, Homo Sapiens
SHPRGIVVG

SEQ ID NO: 471028 - protein, 9 aa, Homo Sapiens
MPCYEGVHC

SEQ ID NO: 471029 - protein, 9 aa, Homo Sapiens
LLSQTSPPC

SEQ ID NO: 471030 - protein, 9 aa, Homo Sapiens
DSPYEWSDP

SEQ ID NO: 471031 - protein, 9 aa, Homo Sapiens
KNFIMSCAF

SEQ ID NO: 471032 - protein, 9 aa, Homo Sapiens
MQVAYLNGL

SEQ ID NO: 471033 - protein, 9 aa, Homo Sapiens
TPNVSQTNQ

SEQ ID NO: 471034 - protein, 9 aa, Homo Sapiens
IILTGPSIT

SEQ ID NO: 471035 - protein, 9 aa, Homo Sapiens
IVGYILAKM

SEQ ID NO: 471036 - protein, 9 aa, Homo Sapiens
QARLCFHLG

SEQ ID NO: 471037 - protein, 9 aa, Homo Sapiens
HWMRQLVCF

SEQ ID NO: 471038 - protein, 9 aa, Homo Sapiens
KEAETSRLL

SEQ ID NO: 471039 - protein, 9 aa, Homo Sapiens
RYKLPNFFS

SEQ ID NO: 471040 - protein, 9 aa, Homo Sapiens
SSVPLLLKN

SEQ ID NO: 471041 - protein, 9 aa, Homo Sapiens
KSLHESLQK

SEQ ID NO: 471042 - protein, 9 aa, Homo Sapiens
NESFLDPIK

SEQ ID NO: 471043 - protein, 9 aa, Homo Sapiens
IIKELQPKL

SEQ ID NO: 471044 - protein, 9 aa, Homo Sapiens
NLLMQDEIA

SEQ ID NO: 471045 - protein, 9 aa, Homo Sapiens
ATVFSSKIQ

SEQ ID NO: 471046 - protein, 9 aa, Homo Sapiens
DGKIVGYIL

SEQ ID NO: 471047 - protein, 9 aa, Homo Sapiens
LLIESSMEH

SEQ ID NO: 471048 - protein, 9 aa, Homo Sapiens
GLQEEPVKG

SEQ ID NO: 471049 - protein, 9 aa, Homo Sapiens
TTEGLTLLF

SEQ ID NO: 471050 - protein, 9 aa, Homo Sapiens
QMRAIQWQS

SEQ ID NO: 471051 - protein, 9 aa, Homo Sapiens
KRLKNISLK

SEQ ID NO: 471052 - protein, 9 aa, Homo Sapiens
SQRPKTHPT

SEQ ID NO: 471053 - protein, 9 aa, Homo Sapiens
PGSTASEES

SEQ ID NO: 471054 - protein, 9 aa, Homo Sapiens
GPSVRVPWF

SEQ ID NO: 471055 - protein, 9 aa, Homo Sapiens
DVVGESVDP

SEQ ID NO: 471056 - protein, 9 aa, Homo Sapiens
LGVFSYIVL

SEQ ID NO: 471057 - protein, 9 aa, Homo Sapiens
LPTCIEQVK

SEQ ID NO: 471058 - protein, 9 aa, Homo Sapiens
LRMEAEEEA

SEQ ID NO: 471059 - protein, 9 aa, Homo Sapiens
SSKIQGSQT

SEQ ID NO: 471060 - protein, 9 aa, Homo Sapiens
TDFFSPSGG

SEQ ID NO: 471061 - protein, 9 aa, Homo Sapiens
NTCIIENLK

SEQ ID NO: 471062 - protein, 9 aa, Homo Sapiens
LNRIVCFFL

SEQ ID NO: 471063 - protein, 9 aa, Homo Sapiens
DSDHDATNS

SEQ ID NO: 471064 - protein, 9 aa, Homo Sapiens
TCRSESNPR

SEQ ID NO: 471065 - protein, 9 aa, Homo Sapiens
FQGWINLLN

SEQ ID NO: 471066 - protein, 9 aa, Homo Sapiens
LPESQWADM

SEQ ID NO: 471067 - protein, 9 aa, Homo Sapiens
LMSFFLLIP

SEQ ID NO: 471068 - protein, 9 aa, Homo Sapiens
AQSLHPVIR

SEQ ID NO: 471069 - protein, 9 aa, Homo Sapiens
DGEDEEEDD

SEQ ID NO: 471070 - protein, 9 aa, Homo Sapiens
SQLASHPGM

SEQ ID NO: 471071 - protein, 9 aa, Homo Sapiens
LSRNISNTA

SEQ ID NO: 471072 - protein, 9 aa, Homo Sapiens
LQGHAVRPH

SEQ ID NO: 471073 - protein, 9 aa, Homo Sapiens
NPTPICQKL

SEQ ID NO: 471074 - protein, 9 aa, Homo Sapiens
VLPLTLIVI

SEQ ID NO: 471075 - protein, 9 aa, Homo Sapiens
KYAACVCVQ

SEQ ID NO: 471076 - protein, 9 aa, Homo Sapiens
QGHAVRPHA

SEQ ID NO: 471077 - protein, 9 aa, Homo Sapiens
TAGGETLVI

SEQ ID NO: 471078 - protein, 9 aa, Homo Sapiens
QAEAPSARL

SEQ ID NO: 471079 - protein, 9 aa, Homo Sapiens
EKAHKENPN

SEQ ID NO: 471080 - protein, 9 aa, Homo Sapiens
PSTGGHGPL

SEQ ID NO: 471081 - protein, 9 aa, Homo Sapiens
NLTEPIYSS

SEQ ID NO: 471082 - protein, 9 aa, Homo Sapiens
IILPIPPLS

SEQ ID NO: 471083 - protein, 9 aa, Homo Sapiens
HLKMAKMKM

SEQ ID NO: 471084 - protein, 9 aa, Homo Sapiens
TTMDVATPS

SEQ ID NO: 471085 - protein, 9 aa, Homo Sapiens
SFNNIENET

SEQ ID NO: 471086 - protein, 9 aa, Homo Sapiens
AHWITTPYR

SEQ ID NO: 471087 - protein, 9 aa, Homo Sapiens
DLHPAEPQS

SEQ ID NO: 471088 - protein, 9 aa, Homo Sapiens
DRRGSVIQS

SEQ ID NO: 471089 - protein, 9 aa, Homo Sapiens
VNTKKDTSG

SEQ ID NO: 471090 - protein, 9 aa, Homo Sapiens
LDTLIEESY

SEQ ID NO: 471091 - protein, 9 aa, Homo Sapiens
SVRDISGRK

SEQ ID NO: 471092 - protein, 9 aa, Homo Sapiens
VEKLEIFPV

SEQ ID NO: 471093 - protein, 9 aa, Homo Sapiens
SLQVVDHAF

SEQ ID NO: 471094 - protein, 9 aa, Homo Sapiens
LGVPSTQGK

SEQ ID NO: 471095 - protein, 9 aa, Homo Sapiens
GEKPSECSE

SEQ ID NO: 471096 - protein, 9 aa, Homo Sapiens
ETMPVEAIH

SEQ ID NO: 471097 - protein, 9 aa, Homo Sapiens
GLGRSITSA

SEQ ID NO: 471098 - protein, 9 aa, Homo Sapiens
SSRRRSRSS

SEQ ID NO: 471099 - protein, 9 aa, Homo Sapiens
QPPSPLPSC

SEQ ID NO: 471100 - protein, 9 aa, Homo Sapiens
VRFKLQDVS

SEQ ID NO: 471101 - protein, 9 aa, Homo Sapiens
LIGRLVCEA

SEQ ID NO: 471102 - protein, 9 aa, Homo Sapiens
RGPGRVSWK

SEQ ID NO: 471103 - protein, 9 aa, Homo Sapiens
KLQDVSDSF

SEQ ID NO: 471104 - protein, 9 aa, Homo Sapiens
ECVCPPRTQ

SEQ ID NO: 471105 - protein, 9 aa, Homo Sapiens
TGASNLKEL

SEQ ID NO: 471106 - protein, 9 aa, Homo Sapiens
PYSIQYSLD

SEQ ID NO: 471107 - protein, 9 aa, Homo Sapiens
KLGGGHKWQ

SEQ ID NO: 471108 - protein, 9 aa, Homo Sapiens
FFGPSVRVP

SEQ ID NO: 471109 - protein, 9 aa, Homo Sapiens
ITLSLQGVF

SEQ ID NO: 471110 - protein, 9 aa, Homo Sapiens
SGIWSNPTP

SEQ ID NO: 471111 - protein, 9 aa, Homo Sapiens
YPVHVSGRI

SEQ ID NO: 471112 - protein, 9 aa, Homo Sapiens
RGFFRIIYS

SEQ ID NO: 471113 - protein, 9 aa, Homo Sapiens
GAHPGDGRV

SEQ ID NO: 471114 - protein, 9 aa, Homo Sapiens
VEVRMIGFA

SEQ ID NO: 471115 - protein, 9 aa, Homo Sapiens
RAQMVRYKL

SEQ ID NO: 471116 - protein, 9 aa, Homo Sapiens
PESQWADMD

SEQ ID NO: 471117 - protein, 9 aa, Homo Sapiens
ILGLEECGI

SEQ ID NO: 471118 - protein, 9 aa, Homo Sapiens
EKTCKCEEC

SEQ ID NO: 471119 - protein, 9 aa, Homo Sapiens
GFIIYTVAL

SEQ ID NO: 471120 - protein, 9 aa, Homo Sapiens
SPLPTSLAS

SEQ ID NO: 471121 - protein, 9 aa, Homo Sapiens
TDPLTVFVS

SEQ ID NO: 471122 - protein, 9 aa, Homo Sapiens
IVTAFKPHD

SEQ ID NO: 471123 - protein, 9 aa, Homo Sapiens
QSSVCVPVG

SEQ ID NO: 471124 - protein, 9 aa, Homo Sapiens
VCRSMSCGL

SEQ ID NO: 471125 - protein, 9 aa, Homo Sapiens
CQVKSAKSA

SEQ ID NO: 471126 - protein, 9 aa, Homo Sapiens
VEERKIPAH

SEQ ID NO: 471127 - protein, 9 aa, Homo Sapiens
FIIYTVALG

SEQ ID NO: 471128 - protein, 9 aa, Homo Sapiens
IDAVYAMAD

SEQ ID NO: 471129 - protein, 9 aa, Homo Sapiens
AIERYPIPL

SEQ ID NO: 471130 - protein, 9 aa, Homo Sapiens
GFTIWKCWD

SEQ ID NO: 471131 - protein, 9 aa, Homo Sapiens
TTLPTCIEQ

SEQ ID NO: 471132 - protein, 9 aa, Homo Sapiens
ERRTDYYMG

SEQ ID NO: 471133 - protein, 9 aa, Homo Sapiens
PSWALVFRS

SEQ ID NO: 471134 - protein, 9 aa, Homo Sapiens
PVPGQKGTK

SEQ ID NO: 471135 - protein, 9 aa, Homo Sapiens
RFTGEDCQY

SEQ ID NO: 471136 - protein, 9 aa, Homo Sapiens
AGGNLLVLL

SEQ ID NO: 471137 - protein, 9 aa, Homo Sapiens
WITTPYRML

SEQ ID NO: 471138 - protein, 9 aa, Homo Sapiens
QFEPKQRQS

SEQ ID NO: 471139 - protein, 9 aa, Homo Sapiens
KVIHMEEKT

SEQ ID NO: 471140 - protein, 9 aa, Homo Sapiens
SRNDILLNI

SEQ ID NO: 471141 - protein, 9 aa, Homo Sapiens
KVGKNKRRT

SEQ ID NO: 471142 - protein, 9 aa, Homo Sapiens
KPSAKERES

SEQ ID NO: 471143 - protein, 9 aa, Homo Sapiens
KIQGSQTGC

SEQ ID NO: 471144 - protein, 9 aa, Homo Sapiens
MAAFLFSID

SEQ ID NO: 471145 - protein, 9 aa, Homo Sapiens
VKPSAKERE

SEQ ID NO: 471146 - protein, 9 aa, Homo Sapiens
SPRDKLPGG

SEQ ID NO: 471147 - protein, 9 aa, Homo Sapiens
AVLVAVYDE

SEQ ID NO: 471148 - protein, 9 aa, Homo Sapiens
MRAIQWQSG

SEQ ID NO: 471149 - protein, 9 aa, Homo Sapiens
DLLHENLLM

SEQ ID NO: 471150 - protein, 9 aa, Homo Sapiens
ISCEHPGVP

SEQ ID NO: 471151 - protein, 9 aa, Homo Sapiens
YDELCGLIA

SEQ ID NO: 471152 - protein, 9 aa, Homo Sapiens
LGVNTKKDT

SEQ ID NO: 471153 - protein, 9 aa, Homo Sapiens
ATSHDQKRS

SEQ ID NO: 471154 - protein, 9 aa, Homo Sapiens
IHEHSVPTI

SEQ ID NO: 471155 - protein, 9 aa, Homo Sapiens
LKGHKRFCL

SEQ ID NO: 471156 - protein, 9 aa, Homo Sapiens
ALRDHIPEL

SEQ ID NO: 471157 - protein, 9 aa, Homo Sapiens
VAVALGGHP

SEQ ID NO: 471158 - protein, 9 aa, Homo Sapiens
SSGLGACEL

SEQ ID NO: 471159 - protein, 9 aa, Homo Sapiens
VGHERRTDY

SEQ ID NO: 471160 - protein, 9 aa, Homo Sapiens
RLCFHLGIW

SEQ ID NO: 471161 - protein, 9 aa, Homo Sapiens
QPTFCRHCT

SEQ ID NO: 471162 - protein, 9 aa, Homo Sapiens
CVGHERRTD

SEQ ID NO: 471163 - protein, 9 aa, Homo Sapiens
LVLTCRQEL

SEQ ID NO: 471164 - protein, 9 aa, Homo Sapiens
STYEDRLCD

SEQ ID NO: 471165 - protein, 9 aa, Homo Sapiens
GGHKWQNHC

SEQ ID NO: 471166 - protein, 9 aa, Homo Sapiens
CTCFGMPRR

SEQ ID NO: 471167 - protein, 9 aa, Homo Sapiens
AKDAFVIVV

SEQ ID NO: 471168 - protein, 9 aa, Homo Sapiens
QKVRPSEEN

SEQ ID NO: 471169 - protein, 9 aa, Homo Sapiens
SCASLVSVG

SEQ ID NO: 471170 - protein, 9 aa, Homo Sapiens
KFDYLYCCR

SEQ ID NO: 471171 - protein, 9 aa, Homo Sapiens
KHILVWAAR

SEQ ID NO: 471172 - protein, 9 aa, Homo Sapiens
EKKCSLASY

SEQ ID NO: 471173 - protein, 9 aa, Homo Sapiens
RDSPYEWSD

SEQ ID NO: 471174 - protein, 9 aa, Homo Sapiens
ENFPRDKEF

SEQ ID NO: 471175 - protein, 9 aa, Homo Sapiens
GNGSHRLGD

SEQ ID NO: 471176 - protein, 9 aa, Homo Sapiens
FVDSSQSAF

SEQ ID NO: 471177 - protein, 9 aa, Homo Sapiens
ISKTEVIIR

SEQ ID NO: 471178 - protein, 9 aa, Homo Sapiens
DPCLRSSDF

SEQ ID NO: 471179 - protein, 9 aa, Homo Sapiens
AVALSYQCA

SEQ ID NO: 471180 - protein, 9 aa, Homo Sapiens
FSLITHGYG

SEQ ID NO: 471181 - protein, 9 aa, Homo Sapiens
FCPLAKTCP

SEQ ID NO: 471182 - protein, 9 aa, Homo Sapiens
AKSIITSNS

SEQ ID NO: 471183 - protein, 9 aa, Homo Sapiens
DAVYAMADA

SEQ ID NO: 471184 - protein, 9 aa, Homo Sapiens
MCKTCEQFE

SEQ ID NO: 471185 - protein, 9 aa, Homo Sapiens
VGFGSDGTD

SEQ ID NO: 471186 - protein, 9 aa, Homo Sapiens
PTCIEQVKT

SEQ ID NO: 471187 - protein, 9 aa, Homo Sapiens
RNISNTAGG

SEQ ID NO: 471188 - protein, 9 aa, Homo Sapiens
MARFRKNIE

SEQ ID NO: 471189 - protein, 9 aa, Homo Sapiens
SKVPVIVLK

SEQ ID NO: 471190 - protein, 9 aa, Homo Sapiens
QKGTKKAVE

SEQ ID NO: 471191 - protein, 9 aa, Homo Sapiens
QYNRVSLMR

SEQ ID NO: 471192 - protein, 9 aa, Homo Sapiens
SAKDAFVIV

SEQ ID NO: 471193 - protein, 9 aa, Homo Sapiens
CATLVESPL

SEQ ID NO: 471194 - protein, 9 aa, Homo Sapiens
LPDAKELEA

SEQ ID NO: 471195 - protein, 9 aa, Homo Sapiens
FREVAGRFQ

SEQ ID NO: 471196 - protein, 9 aa, Homo Sapiens
VKVPQSIAN

SEQ ID NO: 471197 - protein, 9 aa, Homo Sapiens
MSCGLSNKE

SEQ ID NO: 471198 - protein, 9 aa, Homo Sapiens
HILVWAARQ

SEQ ID NO: 471199 - protein, 9 aa, Homo Sapiens
HTSPRRRSR

SEQ ID NO: 471200 - protein, 9 aa, Homo Sapiens
ASEESEKFR

SEQ ID NO: 471201 - protein, 9 aa, Homo Sapiens
ELDTLIEES

SEQ ID NO: 471202 - protein, 9 aa, Homo Sapiens
SIQYSLDTD

SEQ ID NO: 471203 - protein, 9 aa, Homo Sapiens
RNDILLNIN

SEQ ID NO: 471204 - protein, 9 aa, Homo Sapiens
PTASRDKRF

SEQ ID NO: 471205 - protein, 9 aa, Homo Sapiens
LMGFLQPVG

SEQ ID NO: 471206 - protein, 9 aa, Homo Sapiens
VIREPPDHG

SEQ ID NO: 471207 - protein, 9 aa, Homo Sapiens
LMRDHNVLG

SEQ ID NO: 471208 - protein, 9 aa, Homo Sapiens
ACFWPAVTV

SEQ ID NO: 471209 - protein, 9 aa, Homo Sapiens
AEILSVRDI

SEQ ID NO: 471210 - protein, 9 aa, Homo Sapiens
QGVVVGAGA

SEQ ID NO: 471211 - protein, 9 aa, Homo Sapiens
SFFLLIPSL

SEQ ID NO: 471212 - protein, 9 aa, Homo Sapiens
KGFRVTLVD

SEQ ID NO: 471213 - protein, 9 aa, Homo Sapiens
NIEISFENE

SEQ ID NO: 471214 - protein, 9 aa, Homo Sapiens
TAVLVAVYD

SEQ ID NO: 471215 - protein, 9 aa, Homo Sapiens
DEGPYSCSV

SEQ ID NO: 471216 - protein, 9 aa, Homo Sapiens
PCYEGVHCE

SEQ ID NO: 471217 - protein, 9 aa, Homo Sapiens
PQRQSAIED

SEQ ID NO: 471218 - protein, 9 aa, Homo Sapiens
RILQMRAIQ

SEQ ID NO: 471219 - protein, 9 aa, Homo Sapiens
TPLKNFIMS

SEQ ID NO: 471220 - protein, 9 aa, Homo Sapiens
LSHRQPETI

SEQ ID NO: 471221 - protein, 9 aa, Homo Sapiens
DCMAQIIFF

SEQ ID NO: 471222 - protein, 9 aa, Homo Sapiens
KELQPKLKS

SEQ ID NO: 471223 - protein, 9 aa, Homo Sapiens
FLFSIDTQT

SEQ ID NO: 471224 - protein, 9 aa, Homo Sapiens
IVCFFLHPR

SEQ ID NO: 471225 - protein, 9 aa, Homo Sapiens
SSNYVAEDR

SEQ ID NO: 471226 - protein, 9 aa, Homo Sapiens
LETPSPSPG

SEQ ID NO: 471227 - protein, 9 aa, Homo Sapiens
EKLEIFPVE

SEQ ID NO: 471228 - protein, 9 aa, Homo Sapiens
VIPMLNSLI

SEQ ID NO: 471229 - protein, 9 aa, Homo Sapiens
GSSKVPVIV

SEQ ID NO: 471230 - protein, 9 aa, Homo Sapiens
GEHPQRQSA

SEQ ID NO: 471231 - protein, 9 aa, Homo Sapiens
SSVMFSARV

SEQ ID NO: 471232 - protein, 9 aa, Homo Sapiens
AAMAYDSYA

SEQ ID NO: 471233 - protein, 9 aa, Homo Sapiens
IVQKSVTDE

SEQ ID NO: 471234 - protein, 9 aa, Homo Sapiens
KHISKTEVI

SEQ ID NO: 471235 - protein, 9 aa, Homo Sapiens
AMAYDSYAA

SEQ ID NO: 471236 - protein, 9 aa, Homo Sapiens
MGKRYRERQ

SEQ ID NO: 471237 - protein, 9 aa, Homo Sapiens
FVSFFTLNL

SEQ ID NO: 471238 - protein, 9 aa, Homo Sapiens
EDIFVVGTA

SEQ ID NO: 471239 - protein, 9 aa, Homo Sapiens
TDGRKEENR

SEQ ID NO: 471240 - protein, 9 aa, Homo Sapiens
MSCEETMPV

SEQ ID NO: 471241 - protein, 9 aa, Homo Sapiens
SYAVALSYQ

SEQ ID NO: 471242 - protein, 9 aa, Homo Sapiens
VKSAKSATS

SEQ ID NO: 471243 - protein, 9 aa, Homo Sapiens
VPELQMAVF

SEQ ID NO: 471244 - protein, 9 aa, Homo Sapiens
IFLCEILRI

SEQ ID NO: 471245 - protein, 9 aa, Homo Sapiens
DAFVIVVEN

SEQ ID NO: 471246 - protein, 9 aa, Homo Sapiens
SDGTDSIEG

SEQ ID NO: 471247 - protein, 9 aa, Homo Sapiens
KENPNQPAP

SEQ ID NO: 471248 - protein, 9 aa, Homo Sapiens
LLDPTEPIR

SEQ ID NO: 471249 - protein, 9 aa, Homo Sapiens
KDKKGLKKG

SEQ ID NO: 471250 - protein, 9 aa, Homo Sapiens
SSQSAFALL

SEQ ID NO: 471251 - protein, 9 aa, Homo Sapiens
CRLRHVSPT

SEQ ID NO: 471252 - protein, 9 aa, Homo Sapiens
QEQEEKMCE

SEQ ID NO: 471253 - protein, 9 aa, Homo Sapiens
DKEFRPERW

SEQ ID NO: 471254 - protein, 9 aa, Homo Sapiens
QVSHGTGFK

SEQ ID NO: 471255 - protein, 9 aa, Homo Sapiens
EATWEELVL

SEQ ID NO: 471256 - protein, 9 aa, Homo Sapiens
LAPSWAQRY

SEQ ID NO: 471257 - protein, 9 aa, Homo Sapiens
NLIPVTLSL

SEQ ID NO: 471258 - protein, 9 aa, Homo Sapiens
TTVIVTAFK

SEQ ID NO: 471259 - protein, 9 aa, Homo Sapiens
HGKISSEMP

SEQ ID NO: 471260 - protein, 9 aa, Homo Sapiens
FKSFGLLKL

SEQ ID NO: 471261 - protein, 9 aa, Homo Sapiens
DVSDSFKKI

SEQ ID NO: 471262 - protein, 9 aa, Homo Sapiens
HESLQKTIY

SEQ ID NO: 471263 - protein, 9 aa, Homo Sapiens
GLELQAEAG

SEQ ID NO: 471264 - protein, 9 aa, Homo Sapiens
HSSVPLLLK

SEQ ID NO: 471265 - protein, 9 aa, Homo Sapiens
RGFQRLSLK

SEQ ID NO: 471266 - protein, 9 aa, Homo Sapiens
LIIMLCLIA

SEQ ID NO: 471267 - protein, 9 aa, Homo Sapiens
KAFSKFGHL

SEQ ID NO: 471268 - protein, 9 aa, Homo Sapiens
ADALHHMNK

SEQ ID NO: 471269 - protein, 9 aa, Homo Sapiens
PGDGRVEVL

SEQ ID NO: 471270 - protein, 9 aa, Homo Sapiens
SDQSVNVTD

SEQ ID NO: 471271 - protein, 9 aa, Homo Sapiens
SLKLGDVAL

SEQ ID NO: 471272 - protein, 9 aa, Homo Sapiens
QSGCAVSLY

SEQ ID NO: 471273 - protein, 9 aa, Homo Sapiens
YLTLDAQNS

SEQ ID NO: 471274 - protein, 9 aa, Homo Sapiens
KYHLLTERR

SEQ ID NO: 471275 - protein, 9 aa, Homo Sapiens
PLKNFIMSC

SEQ ID NO: 471276 - protein, 9 aa, Homo Sapiens
NSVDRFTLS

SEQ ID NO: 471277 - protein, 9 aa, Homo Sapiens
AKFNAYKFK

SEQ ID NO: 471278 - protein, 9 aa, Homo Sapiens
ASSANRTTQ

SEQ ID NO: 471279 - protein, 9 aa, Homo Sapiens
VTIGLLLIQ

SEQ ID NO: 471280 - protein, 9 aa, Homo Sapiens
FPLTQNLTV

SEQ ID NO: 471281 - protein, 9 aa, Homo Sapiens
FFKQPTFCR

SEQ ID NO: 471282 - protein, 9 aa, Homo Sapiens
TVIVTAFKP

SEQ ID NO: 471283 - protein, 9 aa, Homo Sapiens
KEDLLHENL

SEQ ID NO: 471284 - protein, 9 aa, Homo Sapiens
GDVALGCLA

SEQ ID NO: 471285 - protein, 9 aa, Homo Sapiens
VENEIVDPL

SEQ ID NO: 471286 - protein, 9 aa, Homo Sapiens
VAVLIVDPQ

SEQ ID NO: 471287 - protein, 9 aa, Homo Sapiens
LDQHAAHER

SEQ ID NO: 471288 - protein, 9 aa, Homo Sapiens
HPIITRYVR

SEQ ID NO: 471289 - protein, 9 aa, Homo Sapiens
PDGASADLN

SEQ ID NO: 471290 - protein, 9 aa, Homo Sapiens
SSGIWSNPT

SEQ ID NO: 471291 - protein, 9 aa, Homo Sapiens
VFVAMVAVA

SEQ ID NO: 471292 - protein, 9 aa, Homo Sapiens
TKKDTSGNQ

SEQ ID NO: 471293 - protein, 9 aa, Homo Sapiens
AEPGEEQTF

SEQ ID NO: 471294 - protein, 9 aa, Homo Sapiens
AIAELDTLI

SEQ ID NO: 471295 - protein, 9 aa, Homo Sapiens
GPYSCSVQT

SEQ ID NO: 471296 - protein, 9 aa, Homo Sapiens
PRGIVVGPV

SEQ ID NO: 471297 - protein, 9 aa, Homo Sapiens
HFLNITDPL

SEQ ID NO: 471298 - protein, 9 aa, Homo Sapiens
EKVAQPDGA

SEQ ID NO: 471299 - protein, 9 aa, Homo Sapiens
SHPATVPSK

SEQ ID NO: 471300 - protein, 9 aa, Homo Sapiens
SAEPGEEQT

SEQ ID NO: 471301 - protein, 9 aa, Homo Sapiens
SSDPYVTVK

SEQ ID NO: 471302 - protein, 9 aa, Homo Sapiens
YGTPAICAA

SEQ ID NO: 471303 - protein, 9 aa, Homo Sapiens
VAYLNGLHE

SEQ ID NO: 471304 - protein, 9 aa, Homo Sapiens
TKKAVEQRD

SEQ ID NO: 471305 - protein, 9 aa, Homo Sapiens
QKMQVQQQH

SEQ ID NO: 471306 - protein, 9 aa, Homo Sapiens
IIFTELQLM

SEQ ID NO: 471307 - protein, 9 aa, Homo Sapiens
QMVRYKLPN

SEQ ID NO: 471308 - protein, 9 aa, Homo Sapiens
GTPMAHPPH

SEQ ID NO: 471309 - protein, 9 aa, Homo Sapiens
NRGEHPQRQ

SEQ ID NO: 471310 - protein, 9 aa, Homo Sapiens
GRSITSATT

SEQ ID NO: 471311 - protein, 9 aa, Homo Sapiens
EMEEMGKRY

SEQ ID NO: 471312 - protein, 9 aa, Homo Sapiens
TSRLLIIAS

SEQ ID NO: 471313 - protein, 9 aa, Homo Sapiens
KCVGCGKSF

SEQ ID NO: 471314 - protein, 9 aa, Homo Sapiens
DIFVVGTAE

SEQ ID NO: 471315 - protein, 9 aa, Homo Sapiens
NFCENSTYI

SEQ ID NO: 471316 - protein, 9 aa, Homo Sapiens
SFENESFLD

SEQ ID NO: 471317 - protein, 9 aa, Homo Sapiens
IAVADQEDI

SEQ ID NO: 471318 - protein, 9 aa, Homo Sapiens
VTQGVVVGA

SEQ ID NO: 471319 - protein, 9 aa, Homo Sapiens
RKNIEAIVS

SEQ ID NO: 471320 - protein, 9 aa, Homo Sapiens
LIQKFSHSS

SEQ ID NO: 471321 - protein, 9 aa, Homo Sapiens
AKSATSHDQ

SEQ ID NO: 471322 - protein, 9 aa, Homo Sapiens
ATVPSKERP

SEQ ID NO: 471323 - protein, 9 aa, Homo Sapiens
VVGSVQGKS

SEQ ID NO: 471324 - protein, 9 aa, Homo Sapiens
CSVQVLRAI

SEQ ID NO: 471325 - protein, 9 aa, Homo Sapiens
LSPEQKARL

SEQ ID NO: 471326 - protein, 9 aa, Homo Sapiens
HIDDMQFEP

SEQ ID NO: 471327 - protein, 9 aa, Homo Sapiens
FSEDVLSVL

SEQ ID NO: 471328 - protein, 9 aa, Homo Sapiens
DATNSAQSA

SEQ ID NO: 471329 - protein, 9 aa, Homo Sapiens
CVLTAAHCI

SEQ ID NO: 471330 - protein, 9 aa, Homo Sapiens
CEILRIMCI

SEQ ID NO: 471331 - protein, 9 aa, Homo Sapiens
ESQWADMDH

SEQ ID NO: 471332 - protein, 9 aa, Homo Sapiens
KGDVELAPS

SEQ ID NO: 471333 - protein, 9 aa, Homo Sapiens
LSYQCALCR

SEQ ID NO: 471334 - protein, 9 aa, Homo Sapiens
GCPENLTDS

SEQ ID NO: 471335 - protein, 9 aa, Homo Sapiens
TKYAACVCV

SEQ ID NO: 471336 - protein, 9 aa, Homo Sapiens
KNTCIIENL

SEQ ID NO: 471337 - protein, 9 aa, Homo Sapiens
EKNTCIIEN

SEQ ID NO: 471338 - protein, 9 aa, Homo Sapiens
RYTFSNLSS

SEQ ID NO: 471339 - protein, 9 aa, Homo Sapiens
VEHTVAGEL

SEQ ID NO: 471340 - protein, 9 aa, Homo Sapiens
GKISSEMPS

SEQ ID NO: 471341 - protein, 9 aa, Homo Sapiens
NRIVCFFLH

SEQ ID NO: 471342 - protein, 9 aa, Homo Sapiens
QAVASVERR

SEQ ID NO: 471343 - protein, 9 aa, Homo Sapiens
SHRQPETIL

SEQ ID NO: 471344 - protein, 9 aa, Homo Sapiens
RTDYYMGYR

SEQ ID NO: 471345 - protein, 9 aa, Homo Sapiens
EKPFAGKDE

SEQ ID NO: 471346 - protein, 9 aa, Homo Sapiens
RFQASEAST

SEQ ID NO: 471347 - protein, 9 aa, Homo Sapiens
WALLRRQYN

SEQ ID NO: 471348 - protein, 9 aa, Homo Sapiens
QVQRTTEGL

SEQ ID NO: 471349 - protein, 9 aa, Homo Sapiens
RQLVCFQKL

SEQ ID NO: 471350 - protein, 9 aa, Homo Sapiens
ACSDPDPKA

SEQ ID NO: 471351 - protein, 9 aa, Homo Sapiens
LRDHIPELE

SEQ ID NO: 471352 - protein, 9 aa, Homo Sapiens
VYSSTCGEG

SEQ ID NO: 471353 - protein, 9 aa, Homo Sapiens
KGADGAAPA

SEQ ID NO: 471354 - protein, 9 aa, Homo Sapiens
SRGRVWALI

SEQ ID NO: 471355 - protein, 9 aa, Homo Sapiens
QQHQLCGNY

SEQ ID NO: 471356 - protein, 9 aa, Homo Sapiens
NGLHEVLLP

SEQ ID NO: 471357 - protein, 9 aa, Homo Sapiens
ERYPIPLPD

SEQ ID NO: 471358 - protein, 9 aa, Homo Sapiens
SHGGSWGTV

SEQ ID NO: 471359 - protein, 9 aa, Homo Sapiens
PKTKYAACV

SEQ ID NO: 471360 - protein, 9 aa, Homo Sapiens
RHVSPTPSE

SEQ ID NO: 471361 - protein, 9 aa, Homo Sapiens
LLACSDPDP

SEQ ID NO: 471362 - protein, 9 aa, Homo Sapiens
QKKPRRSRI

SEQ ID NO: 471363 - protein, 9 aa, Homo Sapiens
LHFHQGDSE

SEQ ID NO: 471364 - protein, 9 aa, Homo Sapiens
VGVPRGKIG

SEQ ID NO: 471365 - protein, 9 aa, Homo Sapiens
SMMGDDKDA

SEQ ID NO: 471366 - protein, 9 aa, Homo Sapiens
QCSYLVRHK

SEQ ID NO: 471367 - protein, 9 aa, Homo Sapiens
RRLREALAA

SEQ ID NO: 471368 - protein, 9 aa, Homo Sapiens
VLTCRQELQ

SEQ ID NO: 471369 - protein, 9 aa, Homo Sapiens
TLIEESYKD

SEQ ID NO: 471370 - protein, 9 aa, Homo Sapiens
SAKSATSHD

SEQ ID NO: 471371 - protein, 9 aa, Homo Sapiens
DEDQKVRPS

SEQ ID NO: 471372 - protein, 9 aa, Homo Sapiens
TTLANLIPV

SEQ ID NO: 471373 - protein, 9 aa, Homo Sapiens
AEPQSGEGV

SEQ ID NO: 471374 - protein, 9 aa, Homo Sapiens
LLLIQKFSH

SEQ ID NO: 471375 - protein, 9 aa, Homo Sapiens
SVTDEAAQS

SEQ ID NO: 471376 - protein, 9 aa, Homo Sapiens
AHNGEVRNA

SEQ ID NO: 471377 - protein, 9 aa, Homo Sapiens
PYSCSVQTD

SEQ ID NO: 471378 - protein, 9 aa, Homo Sapiens
ITDPLTVFV

SEQ ID NO: 471379 - protein, 9 aa, Homo Sapiens
DVPELQMAV

SEQ ID NO: 471380 - protein, 9 aa, Homo Sapiens
PEDGIPDVP

SEQ ID NO: 471381 - protein, 9 aa, Homo Sapiens
KSVTDEAAQ

SEQ ID NO: 471382 - protein, 9 aa, Homo Sapiens
EDGIPDVPG

SEQ ID NO: 471383 - protein, 9 aa, Homo Sapiens
VSWKNIKPE

SEQ ID NO: 471384 - protein, 9 aa, Homo Sapiens
VTDYPQKFA

SEQ ID NO: 471385 - protein, 9 aa, Homo Sapiens
EATVFSSKI

SEQ ID NO: 471386 - protein, 9 aa, Homo Sapiens
LQARLCFHL

SEQ ID NO: 471387 - protein, 9 aa, Homo Sapiens
GLKKGDGLQ

SEQ ID NO: 471388 - protein, 9 aa, Homo Sapiens
SQHEVFVEN

SEQ ID NO: 471389 - protein, 9 aa, Homo Sapiens
EQADEEASL

SEQ ID NO: 471390 - protein, 9 aa, Homo Sapiens
DVILMVEER

SEQ ID NO: 471391 - protein, 9 aa, Homo Sapiens
DLFQTSPME

SEQ ID NO: 471392 - protein, 9 aa, Homo Sapiens
AGTGDVAVL

SEQ ID NO: 471393 - protein, 9 aa, Homo Sapiens
KSRMPFKPR

SEQ ID NO: 471394 - protein, 9 aa, Homo Sapiens
PFVCRLRHV

SEQ ID NO: 471395 - protein, 9 aa, Homo Sapiens
TGDVAVLIV

SEQ ID NO: 471396 - protein, 9 aa, Homo Sapiens
MRQLVCFQK

SEQ ID NO: 471397 - protein, 9 aa, Homo Sapiens
RHREIVVDK

SEQ ID NO: 471398 - protein, 9 aa, Homo Sapiens
SISSQRYTF

SEQ ID NO: 471399 - protein, 9 aa, Homo Sapiens
EVLLHVEHQ

SEQ ID NO: 471400 - protein, 9 aa, Homo Sapiens
SNHLFVFQG

SEQ ID NO: 471401 - protein, 9 aa, Homo Sapiens
AVGLELQAE

SEQ ID NO: 471402 - protein, 9 aa, Homo Sapiens
IESSMEHGK

SEQ ID NO: 471403 - protein, 9 aa, Homo Sapiens
DHDATNSAQ

SEQ ID NO: 471404 - protein, 9 aa, Homo Sapiens
ASHPGMANL

SEQ ID NO: 471405 - protein, 9 aa, Homo Sapiens
PLPDAKELE

SEQ ID NO: 471406 - protein, 9 aa, Homo Sapiens
ISTYEDRLC

SEQ ID NO: 471407 - protein, 9 aa, Homo Sapiens
KHGFKFGPA

SEQ ID NO: 471408 - protein, 9 aa, Homo Sapiens
GALHVYRNF

SEQ ID NO: 471409 - protein, 9 aa, Homo Sapiens
GEEQTFPLG

SEQ ID NO: 471410 - protein, 9 aa, Homo Sapiens
GHVSLKLGD

SEQ ID NO: 471411 - protein, 9 aa, Homo Sapiens
PCFKGEAGS

SEQ ID NO: 471412 - protein, 9 aa, Homo Sapiens
GEVRNARLL

SEQ ID NO: 471413 - protein, 9 aa, Homo Sapiens
ENEIVDPLY

SEQ ID NO: 471414 - protein, 9 aa, Homo Sapiens
QYKGHELYE

SEQ ID NO: 471415 - protein, 9 aa, Homo Sapiens
GRVWALIIM

SEQ ID NO: 471416 - protein, 9 aa, Homo Sapiens
MVRYKLPNF

SEQ ID NO: 471417 - protein, 9 aa, Homo Sapiens
QMAVFTFLF

SEQ ID NO: 471418 - protein, 9 aa, Homo Sapiens
KDACRDTET

SEQ ID NO: 471419 - protein, 9 aa, Homo Sapiens
RQAPGKRKF

SEQ ID NO: 471420 - protein, 9 aa, Homo Sapiens
QHPIITRYV

SEQ ID NO: 471421 - protein, 9 aa, Homo Sapiens
ALSYQCALC

SEQ ID NO: 471422 - protein, 9 aa, Homo Sapiens
RAVLGVPST

SEQ ID NO: 471423 - protein, 9 aa, Homo Sapiens
YSNTEFIML

SEQ ID NO: 471424 - protein, 9 aa, Homo Sapiens
KPFAGKDER

SEQ ID NO: 471425 - protein, 9 aa, Homo Sapiens
SFQASKRNG

SEQ ID NO: 471426 - protein, 9 aa, Homo Sapiens
GSPCFKGEA

SEQ ID NO: 471427 - protein, 9 aa, Homo Sapiens
GLRSALWQV

SEQ ID NO: 471428 - protein, 9 aa, Homo Sapiens
CCTGPQRLL

SEQ ID NO: 471429 - protein, 9 aa, Homo Sapiens
HERRTDYYM

SEQ ID NO: 471430 - protein, 9 aa, Homo Sapiens
PTFCRHCTD

SEQ ID NO: 471431 - protein, 9 aa, Homo Sapiens
QELPDSVPH

SEQ ID NO: 471432 - protein, 9 aa, Homo Sapiens
DSITCCVSE

SEQ ID NO: 471433 - protein, 9 aa, Homo Sapiens
CFFPEHMVS

SEQ ID NO: 471434 - protein, 9 aa, Homo Sapiens
YFGGCPENL

SEQ ID NO: 471435 - protein, 9 aa, Homo Sapiens
FFSPSGGAR

SEQ ID NO: 471436 - protein, 9 aa, Homo Sapiens
CGITSTCCK

SEQ ID NO: 471437 - protein, 9 aa, Homo Sapiens
FNDPSNTGR

SEQ ID NO: 471438 - protein, 9 aa, Homo Sapiens
HVEHQQQKQ

SEQ ID NO: 471439 - protein, 9 aa, Homo Sapiens
CFQKLKLTN

SEQ ID NO: 471440 - protein, 9 aa, Homo Sapiens
QGWINLLNM

SEQ ID NO: 471441 - protein, 9 aa, Homo Sapiens
KHVARILQM

SEQ ID NO: 471442 - protein, 9 aa, Homo Sapiens
VALSYQCAL

SEQ ID NO: 471443 - protein, 9 aa, Homo Sapiens
EQHSVMCKT

SEQ ID NO: 471444 - protein, 9 aa, Homo Sapiens
GWFNDPSNT

SEQ ID NO: 471445 - protein, 9 aa, Homo Sapiens
TPYRMLRIW

SEQ ID NO: 471446 - protein, 9 aa, Homo Sapiens
DGRKEENRG

SEQ ID NO: 471447 - protein, 9 aa, Homo Sapiens
PQNMLNKHP

SEQ ID NO: 471448 - protein, 9 aa, Homo Sapiens
EDINHTSPR

SEQ ID NO: 471449 - protein, 9 aa, Homo Sapiens
LSWENSLED

SEQ ID NO: 471450 - protein, 9 aa, Homo Sapiens
ENLTDSQCL

SEQ ID NO: 471451 - protein, 9 aa, Homo Sapiens
SLIYSLRSK

SEQ ID NO: 471452 - protein, 9 aa, Homo Sapiens
SMSCGLSNK

SEQ ID NO: 471453 - protein, 9 aa, Homo Sapiens
YRMLRIWND

SEQ ID NO: 471454 - protein, 9 aa, Homo Sapiens
DDTDFFSPS

SEQ ID NO: 471455 - protein, 9 aa, Homo Sapiens
YIVLPLTLI

SEQ ID NO: 471456 - protein, 9 aa, Homo Sapiens
YQCALCRRS

SEQ ID NO: 471457 - protein, 9 aa, Homo Sapiens
ACELLLVLI

SEQ ID NO: 471458 - protein, 9 aa, Homo Sapiens
RLQSPRDKL

SEQ ID NO: 471459 - protein, 9 aa, Homo Sapiens
GPVNGWMYW

SEQ ID NO: 471460 - protein, 9 aa, Homo Sapiens
RINKALDAK

SEQ ID NO: 471461 - protein, 9 aa, Homo Sapiens
APSARLNST

SEQ ID NO: 471462 - protein, 9 aa, Homo Sapiens
PGQASPAQA

SEQ ID NO: 471463 - protein, 9 aa, Homo Sapiens
RIMCIGCDH

SEQ ID NO: 471464 - protein, 9 aa, Homo Sapiens
IRAVLGVPS

SEQ ID NO: 471465 - protein, 9 aa, Homo Sapiens
ASVERRSVS

SEQ ID NO: 471466 - protein, 9 aa, Homo Sapiens
TVIRSPLPT

SEQ ID NO: 471467 - protein, 9 aa, Homo Sapiens
ILSRRLREA

SEQ ID NO: 471468 - protein, 9 aa, Homo Sapiens
TRYVRIVPL

SEQ ID NO: 471469 - protein, 9 aa, Homo Sapiens
TYEDRLCDV

SEQ ID NO: 471470 - protein, 9 aa, Homo Sapiens
SNYYGGLHY

SEQ ID NO: 471471 - protein, 9 aa, Homo Sapiens
IIFFHFAGG

SEQ ID NO: 471472 - protein, 9 aa, Homo Sapiens
LLQPPLAYQ

SEQ ID NO: 471473 - protein, 9 aa, Homo Sapiens
DPFNQTLTG

SEQ ID NO: 471474 - protein, 9 aa, Homo Sapiens
KFNAYKFKW

SEQ ID NO: 471475 - protein, 9 aa, Homo Sapiens
FIMLVIDST

SEQ ID NO: 471476 - protein, 9 aa, Homo Sapiens
KFNCRQEMR

SEQ ID NO: 471477 - protein, 9 aa, Homo Sapiens
WLFGALHVY

SEQ ID NO: 471478 - protein, 9 aa, Homo Sapiens
GGLHYGYGV

SEQ ID NO: 471479 - protein, 9 aa, Homo Sapiens
AQTPGEGRM

SEQ ID NO: 471480 - protein, 9 aa, Homo Sapiens
ILAKMEEEP

SEQ ID NO: 471481 - protein, 9 aa, Homo Sapiens
VGEKAHKEN

SEQ ID NO: 471482 - protein, 9 aa, Homo Sapiens
ISVKVPQSI

SEQ ID NO: 471483 - protein, 9 aa, Homo Sapiens
NVSQTNQIQ

SEQ ID NO: 471484 - protein, 9 aa, Homo Sapiens
IDDMQFEPK

SEQ ID NO: 471485 - protein, 9 aa, Homo Sapiens
DILLNINVE

SEQ ID NO: 471486 - protein, 9 aa, Homo Sapiens
CPLAKTCPV

SEQ ID NO: 471487 - protein, 9 aa, Homo Sapiens
QPDGASADL

SEQ ID NO: 471488 - protein, 9 aa, Homo Sapiens
PVHVSGRIC

SEQ ID NO: 471489 - protein, 9 aa, Homo Sapiens
NTTVIVTAF

SEQ ID NO: 471490 - protein, 9 aa, Homo Sapiens
EDRLCDVEI

SEQ ID NO: 471491 - protein, 9 aa, Homo Sapiens
EEATVFSSK

SEQ ID NO: 471492 - protein, 9 aa, Homo Sapiens
GFQRLSLKC

SEQ ID NO: 471493 - protein, 9 aa, Homo Sapiens
ASRFTGEDC

SEQ ID NO: 471494 - protein, 9 aa, Homo Sapiens
NEIVDPLYG

SEQ ID NO: 471495 - protein, 9 aa, Homo Sapiens
GFMSYARKV

SEQ ID NO: 471496 - protein, 9 aa, Homo Sapiens
KCWDYGIYF

SEQ ID NO: 471497 - protein, 9 aa, Homo Sapiens
VDSSQSAFA

SEQ ID NO: 471498 - protein, 9 aa, Homo Sapiens
STPNVSQTN

SEQ ID NO: 471499 - protein, 9 aa, Homo Sapiens
SVMFSARVL

SEQ ID NO: 471500 - protein, 9 aa, Homo Sapiens
VRMIGFAHV

SEQ ID NO: 471501 - protein, 9 aa, Homo Sapiens
RTAVLVAVY

SEQ ID NO: 471502 - protein, 9 aa, Homo Sapiens
EMGKRYRER

SEQ ID NO: 471503 - protein, 9 aa, Homo Sapiens
IRSPLPTSL

SEQ ID NO: 471504 - protein, 9 aa, Homo Sapiens
PSECSECGK

SEQ ID NO: 471505 - protein, 9 aa, Homo Sapiens
WPAVTVEMA

SEQ ID NO: 471506 - protein, 9 aa, Homo Sapiens
ASNLKELFQ

SEQ ID NO: 471507 - protein, 9 aa, Homo Sapiens
LNITDPLTV

SEQ ID NO: 471508 - protein, 9 aa, Homo Sapiens
FLLIPSLRR

SEQ ID NO: 471509 - protein, 9 aa, Homo Sapiens
EVRNARLLS

SEQ ID NO: 471510 - protein, 9 aa, Homo Sapiens
DLATGPIIL

SEQ ID NO: 471511 - protein, 9 aa, Homo Sapiens
NDYLTLDAQ

SEQ ID NO: 471512 - protein, 9 aa, Homo Sapiens
DRVGVEHTV

SEQ ID NO: 471513 - protein, 9 aa, Homo Sapiens
EKVTIKTDG

SEQ ID NO: 471514 - protein, 9 aa, Homo Sapiens
DLAQGSSKV

SEQ ID NO: 471515 - protein, 9 aa, Homo Sapiens
GHELYERPP

SEQ ID NO: 471516 - protein, 9 aa, Homo Sapiens
YSIQYSLDT

SEQ ID NO: 471517 - protein, 9 aa, Homo Sapiens
SVIQSVPGF

SEQ ID NO: 471518 - protein, 9 aa, Homo Sapiens
GLLIIRFFK

SEQ ID NO: 471519 - protein, 9 aa, Homo Sapiens
WKCWDYGIY

SEQ ID NO: 471520 - protein, 9 aa, Homo Sapiens
LVCFQKLKL

SEQ ID NO: 471521 - protein, 9 aa, Homo Sapiens
ITSATTLYD

SEQ ID NO: 471522 - protein, 9 aa, Homo Sapiens
NTKKDTSGN

SEQ ID NO: 471523 - protein, 9 aa, Homo Sapiens
IGLLLIQKF

SEQ ID NO: 471524 - protein, 9 aa, Homo Sapiens
KNPMCFFPE

SEQ ID NO: 471525 - protein, 9 aa, Homo Sapiens
RAGQFTVLM

SEQ ID NO: 471526 - protein, 9 aa, Homo Sapiens
FQRLSLKCV

SEQ ID NO: 471527 - protein, 9 aa, Homo Sapiens
DALHHMNKD

SEQ ID NO: 471528 - protein, 9 aa, Homo Sapiens
FENESFLDP

SEQ ID NO: 471529 - protein, 9 aa, Homo Sapiens
KRKFNCRQE

SEQ ID NO: 471530 - protein, 9 aa, Homo Sapiens
PHLDRRGSV

SEQ ID NO: 471531 - protein, 9 aa, Homo Sapiens
GKDERLLCT

SEQ ID NO: 471532 - protein, 9 aa, Homo Sapiens
ARLCFHLGI

SEQ ID NO: 471533 - protein, 9 aa, Homo Sapiens
RIIYSLLLG

SEQ ID NO: 471534 - protein, 9 aa, Homo Sapiens
NYYGGLHYG

SEQ ID NO: 471535 - protein, 9 aa, Homo Sapiens
MQEQEEKMC

SEQ ID NO: 471536 - protein, 9 aa, Homo Sapiens
CYEGVHCEV

SEQ ID NO: 471537 - protein, 9 aa, Homo Sapiens
PSKERPGKE

SEQ ID NO: 471538 - protein, 9 aa, Homo Sapiens
IPYLQGHAV

SEQ ID NO: 471539 - protein, 9 aa, Homo Sapiens
LELQAEAGN

SEQ ID NO: 471540 - protein, 9 aa, Homo Sapiens
EWYVGVPRG

SEQ ID NO: 471541 - protein, 9 aa, Homo Sapiens
SNSVDRFTL

SEQ ID NO: 471542 - protein, 9 aa, Homo Sapiens
DTIEQYKGH

SEQ ID NO: 471543 - protein, 9 aa, Homo Sapiens
GVPRGKIGL

SEQ ID NO: 471544 - protein, 9 aa, Homo Sapiens
SQQLQGYIS

SEQ ID NO: 471545 - protein, 9 aa, Homo Sapiens
AVLGVPSTQ

SEQ ID NO: 471546 - protein, 9 aa, Homo Sapiens
LCDVILMVE

SEQ ID NO: 471547 - protein, 9 aa, Homo Sapiens
RSFYDLEVD

SEQ ID NO: 471548 - protein, 9 aa, Homo Sapiens
ASPGRASPG

SEQ ID NO: 471549 - protein, 9 aa, Homo Sapiens
HDATNSAQS

SEQ ID NO: 471550 - protein, 9 aa, Homo Sapiens
IMIPMVQNE

SEQ ID NO: 471551 - protein, 9 aa, Homo Sapiens
GESFLGSGG

SEQ ID NO: 471552 - protein, 9 aa, Homo Sapiens
SYQCALCRR

SEQ ID NO: 471553 - protein, 9 aa, Homo Sapiens
NDPNTTVIV

SEQ ID NO: 471554 - protein, 9 aa, Homo Sapiens
VFPSNSVDR

SEQ ID NO: 471555 - protein, 9 aa, Homo Sapiens
SLITHGYGT

SEQ ID NO: 471556 - protein, 9 aa, Homo Sapiens
FIEGFCCAR

SEQ ID NO: 471557 - protein, 9 aa, Homo Sapiens
WHLKMAKMK

SEQ ID NO: 471558 - protein, 9 aa, Homo Sapiens
YKDYMKLLG

SEQ ID NO: 471559 - protein, 9 aa, Homo Sapiens
TAVGLELQA

SEQ ID NO: 471560 - protein, 9 aa, Homo Sapiens
SRMPFKPRE

SEQ ID NO: 471561 - protein, 9 aa, Homo Sapiens
GNIWLIVII

SEQ ID NO: 471562 - protein, 9 aa, Homo Sapiens
KTGHPGPGG

SEQ ID NO: 471563 - protein, 9 aa, Homo Sapiens
AACVCVQGL

SEQ ID NO: 471564 - protein, 9 aa, Homo Sapiens
NSCVLTAAH

SEQ ID NO: 471565 - protein, 9 aa, Homo Sapiens
SSTASALVP

SEQ ID NO: 471566 - protein, 9 aa, Homo Sapiens
GTTTPSSLS

SEQ ID NO: 471567 - protein, 9 aa, Homo Sapiens
LWRDCACAK

SEQ ID NO: 471568 - protein, 9 aa, Homo Sapiens
RGEHPQRQS

SEQ ID NO: 471569 - protein, 9 aa, Homo Sapiens
KPRRSRIIF

SEQ ID NO: 471570 - protein, 9 aa, Homo Sapiens
FLGVNTKKD

SEQ ID NO: 471571 - protein, 9 aa, Homo Sapiens
ENLKNELQR

SEQ ID NO: 471572 - protein, 9 aa, Homo Sapiens
LHENLLMQD

SEQ ID NO: 471573 - protein, 8 aa, Homo Sapiens
LMSWSPEE

SEQ ID NO: 471574 - protein, 9 aa, Homo Sapiens
LQGYISSNY

SEQ ID NO: 471575 - protein, 9 aa, Homo Sapiens
VALGGHPLL

SEQ ID NO: 471576 - protein, 9 aa, Homo Sapiens
QSLHPVIRE

SEQ ID NO: 471577 - protein, 9 aa, Homo Sapiens
SRPSSEVLY

SEQ ID NO: 471578 - protein, 9 aa, Homo Sapiens
VRYKLPNFF

SEQ ID NO: 471579 - protein, 9 aa, Homo Sapiens
LVEKPFAGK

SEQ ID NO: 471580 - protein, 9 aa, Homo Sapiens
SECGFWLRQ

SEQ ID NO: 471581 - protein, 9 aa, Homo Sapiens
PEDINHTSP

SEQ ID NO: 471582 - protein, 9 aa, Homo Sapiens
RLMRDHNVL

SEQ ID NO: 471583 - protein, 9 aa, Homo Sapiens
YDSTHLVKS

SEQ ID NO: 471584 - protein, 9 aa, Homo Sapiens
LAYQMNTSS

SEQ ID NO: 471585 - protein, 9 aa, Homo Sapiens
LKLGDVALG

SEQ ID NO: 471586 - protein, 9 aa, Homo Sapiens
SLVEKPFAG

SEQ ID NO: 471587 - protein, 9 aa, Homo Sapiens
PLAYQMNTS

SEQ ID NO: 471588 - protein, 9 aa, Homo Sapiens
TCEQFEAET

SEQ ID NO: 471589 - protein, 9 aa, Homo Sapiens
LHYGYGVLG

SEQ ID NO: 471590 - protein, 9 aa, Homo Sapiens
MLSQLASHP

SEQ ID NO: 471591 - protein, 9 aa, Homo Sapiens
TWEELVLKK

SEQ ID NO: 471592 - protein, 9 aa, Homo Sapiens
PKTTAGKKS

SEQ ID NO: 471593 - protein, 9 aa, Homo Sapiens
TYKYIIHEH

SEQ ID NO: 471594 - protein, 9 aa, Homo Sapiens
AFVEKCCKS

SEQ ID NO: 471595 - protein, 9 aa, Homo Sapiens
FLGQGNLPS

SEQ ID NO: 471596 - protein, 9 aa, Homo Sapiens
SARVIKSLQ

SEQ ID NO: 471597 - protein, 9 aa, Homo Sapiens
MLNKHPKLR

SEQ ID NO: 471598 - protein, 9 aa, Homo Sapiens
NFPRDKEFR

SEQ ID NO: 471599 - protein, 9 aa, Homo Sapiens
QDENFPRDK

SEQ ID NO: 471600 - protein, 9 aa, Homo Sapiens
GEDEEEDDD

SEQ ID NO: 471601 - protein, 9 aa, Homo Sapiens
KIEEVCIET

SEQ ID NO: 471602 - protein, 9 aa, Homo Sapiens
LRIMCIGCD

SEQ ID NO: 471603 - protein, 9 aa, Homo Sapiens
GRKEENRGE

SEQ ID NO: 471604 - protein, 9 aa, Homo Sapiens
LLLQARLCF

SEQ ID NO: 471605 - protein, 9 aa, Homo Sapiens
VQKSVTDEA

SEQ ID NO: 471606 - protein, 9 aa, Homo Sapiens
ENPNQPAPR

SEQ ID NO: 471607 - protein, 9 aa, Homo Sapiens
IVVENALRV

SEQ ID NO: 471608 - protein, 9 aa, Homo Sapiens
EQYKGHELY

SEQ ID NO: 471609 - protein, 9 aa, Homo Sapiens
QTSPPCALE

SEQ ID NO: 471610 - protein, 9 aa, Homo Sapiens
REIAHFCCE

SEQ ID NO: 471611 - protein, 9 aa, Homo Sapiens
NSAQSAGMD

SEQ ID NO: 471612 - protein, 9 aa, Homo Sapiens
IEAIVSVIA

SEQ ID NO: 471613 - protein, 9 aa, Homo Sapiens
PGQPGIRGL

SEQ ID NO: 471614 - protein, 9 aa, Homo Sapiens
SDSFKKIFD

SEQ ID NO: 471615 - protein, 9 aa, Homo Sapiens
MAKMKMPKF

SEQ ID NO: 471616 - protein, 9 aa, Homo Sapiens
DQPIFVQWL

SEQ ID NO: 471617 - protein, 9 aa, Homo Sapiens
CRCASRFTG

SEQ ID NO: 471618 - protein, 9 aa, Homo Sapiens
PYVTVKVGK

SEQ ID NO: 471619 - protein, 9 aa, Homo Sapiens
VFSSKIQGS

SEQ ID NO: 471620 - protein, 9 aa, Homo Sapiens
EISHGGSWG

SEQ ID NO: 471621 - protein, 9 aa, Homo Sapiens
TTAGKKSSA

SEQ ID NO: 471622 - protein, 9 aa, Homo Sapiens
YPYSIQYSL

SEQ ID NO: 471623 - protein, 9 aa, Homo Sapiens
KPFKCVGCG

SEQ ID NO: 471624 - protein, 9 aa, Homo Sapiens
TLVESPLCP

SEQ ID NO: 471625 - protein, 9 aa, Homo Sapiens
SPGRASPGQ

SEQ ID NO: 471626 - protein, 9 aa, Homo Sapiens
SARVLGNLI

SEQ ID NO: 471627 - protein, 9 aa, Homo Sapiens
TILTETPQD

SEQ ID NO: 471628 - protein, 9 aa, Homo Sapiens
LNKHPKLRG

SEQ ID NO: 471629 - protein, 9 aa, Homo Sapiens
SKWKAYDST

SEQ ID NO: 471630 - protein, 9 aa, Homo Sapiens
LLPESQWAD

SEQ ID NO: 471631 - protein, 9 aa, Homo Sapiens
ALLSQTSPP

SEQ ID NO: 471632 - protein, 9 aa, Homo Sapiens
LLLEGQWHH

SEQ ID NO: 471633 - protein, 9 aa, Homo Sapiens
FGPAPKTLG

SEQ ID NO: 471634 - protein, 9 aa, Homo Sapiens
LSRRLREAL

SEQ ID NO: 471635 - protein, 9 aa, Homo Sapiens
DPYVTVKVG

SEQ ID NO: 471636 - protein, 9 aa, Homo Sapiens
RRSVSTSPS

SEQ ID NO: 471637 - protein, 9 aa, Homo Sapiens
LKKHGFKFG

SEQ ID NO: 471638 - protein, 9 aa, Homo Sapiens
SYYFGGCPE

SEQ ID NO: 471639 - protein, 9 aa, Homo Sapiens
PGRASPGQA

SEQ ID NO: 471640 - protein, 9 aa, Homo Sapiens
EAAPAIPYL

SEQ ID NO: 471641 - protein, 9 aa, Homo Sapiens
MVTKKLHFF

SEQ ID NO: 471642 - protein, 9 aa, Homo Sapiens
DAAEKSAGD

SEQ ID NO: 471643 - protein, 9 aa, Homo Sapiens
PLHYAIIMN

SEQ ID NO: 471644 - protein, 9 aa, Homo Sapiens
SANRTTQRE

SEQ ID NO: 471645 - protein, 9 aa, Homo Sapiens
SLGVFSYIV

SEQ ID NO: 471646 - protein, 9 aa, Homo Sapiens
EIVVDKYYQ

SEQ ID NO: 471647 - protein, 9 aa, Homo Sapiens
YRLDPNDYL

SEQ ID NO: 471648 - protein, 9 aa, Homo Sapiens
ASSFVDSSQ

SEQ ID NO: 471649 - protein, 9 aa, Homo Sapiens
HGFKFGPAP

SEQ ID NO: 471650 - protein, 9 aa, Homo Sapiens
DGLMGSPCF

SEQ ID NO: 471651 - protein, 9 aa, Homo Sapiens
KHPKLRGTD

SEQ ID NO: 471652 - protein, 9 aa, Homo Sapiens
SECSECGKV

SEQ ID NO: 471653 - protein, 9 aa, Homo Sapiens
TIEQYKGHE

SEQ ID NO: 471654 - protein, 9 aa, Homo Sapiens
ETTWHGQGQ

SEQ ID NO: 471655 - protein, 9 aa, Homo Sapiens
YGGLHYGYG

SEQ ID NO: 471656 - protein, 9 aa, Homo Sapiens
MSFFLLIPS

SEQ ID NO: 471657 - protein, 9 aa, Homo Sapiens
IYSLLLGGS

SEQ ID NO: 471658 - protein, 9 aa, Homo Sapiens
IREPPDHGE

SEQ ID NO: 471659 - protein, 9 aa, Homo Sapiens
PIILPIPPL

SEQ ID NO: 471660 - protein, 9 aa, Homo Sapiens
LLLVLISLL

SEQ ID NO: 471661 - protein, 9 aa, Homo Sapiens
KTKYAACVC

SEQ ID NO: 471662 - protein, 9 aa, Homo Sapiens
YIIHEHSVP

SEQ ID NO: 471663 - protein, 9 aa, Homo Sapiens
LLYPVHVSG

SEQ ID NO: 471664 - protein, 9 aa, Homo Sapiens
LHESLQKTI

SEQ ID NO: 471665 - protein, 9 aa, Homo Sapiens
SYSRNDILL

SEQ ID NO: 471666 - protein, 9 aa, Homo Sapiens
KTEVIIRFA

SEQ ID NO: 471667 - protein, 9 aa, Homo Sapiens
GACELLLVL

SEQ ID NO: 471668 - protein, 9 aa, Homo Sapiens
QQQHQLCGN

SEQ ID NO: 471669 - protein, 9 aa, Homo Sapiens
WAARQSPPP

SEQ ID NO: 471670 - protein, 9 aa, Homo Sapiens
RPSEENNKD

SEQ ID NO: 471671 - protein, 9 aa, Homo Sapiens
SGCAVSLYM

SEQ ID NO: 471672 - protein, 9 aa, Homo Sapiens
KSIITSNSL

SEQ ID NO: 471673 - protein, 9 aa, Homo Sapiens
PLAEILSVR

SEQ ID NO: 471674 - protein, 9 aa, Homo Sapiens
PVDLENHEP

SEQ ID NO: 471675 - protein, 9 aa, Homo Sapiens
VFITKGDVE

SEQ ID NO: 471676 - protein, 9 aa, Homo Sapiens
YFLLACSDP

SEQ ID NO: 471677 - protein, 9 aa, Homo Sapiens
GGCPENLTD

SEQ ID NO: 471678 - protein, 9 aa, Homo Sapiens
WAGGPPSTG

SEQ ID NO: 471679 - protein, 9 aa, Homo Sapiens
SGGDEEATR

SEQ ID NO: 471680 - protein, 9 aa, Homo Sapiens
TKGEVLLHV

SEQ ID NO: 471681 - protein, 9 aa, Homo Sapiens
VELCYFSDI

SEQ ID NO: 471682 - protein, 9 aa, Homo Sapiens
SNLTEPIYS

SEQ ID NO: 471683 - protein, 9 aa, Homo Sapiens
HVSGRICFL

SEQ ID NO: 471684 - protein, 9 aa, Homo Sapiens
YVTVKVGKN

SEQ ID NO: 471685 - protein, 9 aa, Homo Sapiens
VADQEDIFV

SEQ ID NO: 471686 - protein, 9 aa, Homo Sapiens
NGEVRNARL

SEQ ID NO: 471687 - protein, 9 aa, Homo Sapiens
IGFAHVFPS

SEQ ID NO: 471688 - protein, 9 aa, Homo Sapiens
GKRRGKNHV

SEQ ID NO: 471689 - protein, 9 aa, Homo Sapiens
CAVSLYMER

SEQ ID NO: 471690 - protein, 9 aa, Homo Sapiens
SLKMLPQLE

SEQ ID NO: 471691 - protein, 9 aa, Homo Sapiens
STYIWVLLL

SEQ ID NO: 471692 - protein, 9 aa, Homo Sapiens
FVKRLSEIQ

SEQ ID NO: 471693 - protein, 9 aa, Homo Sapiens
EGEGCEEAL

SEQ ID NO: 471694 - protein, 9 aa, Homo Sapiens
QYPYSIQYS

SEQ ID NO: 471695 - protein, 9 aa, Homo Sapiens
AQRYSTSCA

SEQ ID NO: 471696 - protein, 9 aa, Homo Sapiens
EEMGKRYRE

SEQ ID NO: 471697 - protein, 9 aa, Homo Sapiens
PNVSQTNQI

SEQ ID NO: 471698 - protein, 9 aa, Homo Sapiens
LLVLTCRQE

SEQ ID NO: 471699 - protein, 9 aa, Homo Sapiens
YDSYAAVCH

SEQ ID NO: 471700 - protein, 9 aa, Homo Sapiens
VGILSRRLR

SEQ ID NO: 471701 - protein, 9 aa, Homo Sapiens
HISKTEVII

SEQ ID NO: 471702 - protein, 9 aa, Homo Sapiens
SNLKELFQE

SEQ ID NO: 471703 - protein, 9 aa, Homo Sapiens
MPRRYIIAI

SEQ ID NO: 471704 - protein, 9 aa, Homo Sapiens
YNRVSLMRP

SEQ ID NO: 471705 - protein, 9 aa, Homo Sapiens
LRHVSPTPS

SEQ ID NO: 471706 - protein, 9 aa, Homo Sapiens
TSATTLYDR

SEQ ID NO: 471707 - protein, 9 aa, Homo Sapiens
ATWEELVLK

SEQ ID NO: 471708 - protein, 9 aa, Homo Sapiens
TGPIILPIP

SEQ ID NO: 471709 - protein, 9 aa, Homo Sapiens
TSNSLAPRV

SEQ ID NO: 471710 - protein, 9 aa, Homo Sapiens
INLLNMAKK

SEQ ID NO: 471711 - protein, 9 aa, Homo Sapiens
TVKVGKNKR

SEQ ID NO: 471712 - protein, 9 aa, Homo Sapiens
NNTHLEEIV

SEQ ID NO: 471713 - protein, 9 aa, Homo Sapiens
EKKDKKGLK

SEQ ID NO: 471714 - protein, 9 aa, Homo Sapiens
GVIALFKVC

SEQ ID NO: 471715 - protein, 9 aa, Homo Sapiens
MLTSGCCRS

SEQ ID NO: 471716 - protein, 9 aa, Homo Sapiens
QHSVMCKTC

SEQ ID NO: 471717 - protein, 9 aa, Homo Sapiens
LKGGAHPGD

SEQ ID NO: 471718 - protein, 9 aa, Homo Sapiens
AEKSAGDTE

SEQ ID NO: 471719 - protein, 9 aa, Homo Sapiens
MKYHLLTER

SEQ ID NO: 471720 - protein, 9 aa, Homo Sapiens
TCRCASRFT

SEQ ID NO: 471721 - protein, 9 aa, Homo Sapiens
PGLPGQPGI

SEQ ID NO: 471722 - protein, 9 aa, Homo Sapiens
VVGPVNGWM

SEQ ID NO: 471723 - protein, 9 aa, Homo Sapiens
SAQSLHPVI

SEQ ID NO: 471724 - protein, 9 aa, Homo Sapiens
LNVKRATLS

SEQ ID NO: 471725 - protein, 9 aa, Homo Sapiens
CDVILMVEE

SEQ ID NO: 471726 - protein, 9 aa, Homo Sapiens
PTSRCPTGC

SEQ ID NO: 471727 - protein, 9 aa, Homo Sapiens
HPGPGGVVG

SEQ ID NO: 471728 - protein, 9 aa, Homo Sapiens
VIVLKLGGG

SEQ ID NO: 471729 - protein, 9 aa, Homo Sapiens
QFLPYFIRG

SEQ ID NO: 471730 - protein, 9 aa, Homo Sapiens
ITRYVRIVP

SEQ ID NO: 471731 - protein, 9 aa, Homo Sapiens
HPCKHVARI

SEQ ID NO: 471732 - protein, 9 aa, Homo Sapiens
QTHTGEKPS

SEQ ID NO: 471733 - protein, 9 aa, Homo Sapiens
DGASADLNT

SEQ ID NO: 471734 - protein, 9 aa, Homo Sapiens
ENIIMQFVK

SEQ ID NO: 471735 - protein, 9 aa, Homo Sapiens
GHPGPGGVV

SEQ ID NO: 471736 - protein, 9 aa, Homo Sapiens
VLKLGGGHK

SEQ ID NO: 471737 - protein, 9 aa, Homo Sapiens
KILNNTRAY

SEQ ID NO: 471738 - protein, 9 aa, Homo Sapiens
EPGEEQTFP

SEQ ID NO: 471739 - protein, 9 aa, Homo Sapiens
SDFIEGFCC

SEQ ID NO: 471740 - protein, 9 aa, Homo Sapiens
HTGEKFYKY

SEQ ID NO: 471741 - protein, 9 aa, Homo Sapiens
GFGSDGTDS

SEQ ID NO: 471742 - protein, 9 aa, Homo Sapiens
EPVKGFRVT

SEQ ID NO: 471743 - protein, 9 aa, Homo Sapiens
SATTLYDRY

SEQ ID NO: 471744 - protein, 9 aa, Homo Sapiens
DDMQFEPKQ

SEQ ID NO: 471745 - protein, 9 aa, Homo Sapiens
CRSESNPRQ

SEQ ID NO: 471746 - protein, 9 aa, Homo Sapiens
PCSVLGHVF

SEQ ID NO: 471747 - protein, 9 aa, Homo Sapiens
IRSLQCSVQ

SEQ ID NO: 471748 - protein, 9 aa, Homo Sapiens
NIGFMSYAR

SEQ ID NO: 471749 - protein, 9 aa, Homo Sapiens
IFARGKRRG

SEQ ID NO: 471750 - protein, 9 aa, Homo Sapiens
KDYMKLLGE

SEQ ID NO: 471751 - protein, 9 aa, Homo Sapiens
VPVGCRPIV

SEQ ID NO: 471752 - protein, 9 aa, Homo Sapiens
TGPQRLLPR

SEQ ID NO: 471753 - protein, 9 aa, Homo Sapiens
AVFPSNSVD

SEQ ID NO: 471754 - protein, 9 aa, Homo Sapiens
IPMVQNEGQ

SEQ ID NO: 471755 - protein, 9 aa, Homo Sapiens
LSRGRVWAL

SEQ ID NO: 471756 - protein, 9 aa, Homo Sapiens
FLNITDPLT

SEQ ID NO: 471757 - protein, 9 aa, Homo Sapiens
FPSNSVDRF

SEQ ID NO: 471758 - protein, 9 aa, Homo Sapiens
KKPRRSRII

SEQ ID NO: 471759 - protein, 9 aa, Homo Sapiens
LQHPIITRY

SEQ ID NO: 471760 - protein, 9 aa, Homo Sapiens
VPVIVLKLG

SEQ ID NO: 471761 - protein, 9 aa, Homo Sapiens
GLEECGITS

SEQ ID NO: 471762 - protein, 9 aa, Homo Sapiens
AIIMNQRLC

SEQ ID NO: 471763 - protein, 9 aa, Homo Sapiens
KNYIILTGP

SEQ ID NO: 471764 - protein, 9 aa, Homo Sapiens
VCFFLHPRC

SEQ ID NO: 471765 - protein, 9 aa, Homo Sapiens
LVESPLCPS

SEQ ID NO: 471766 - protein, 9 aa, Homo Sapiens
FFALRDHIP

SEQ ID NO: 471767 - protein, 9 aa, Homo Sapiens
VIVVENALR

SEQ ID NO: 471768 - protein, 9 aa, Homo Sapiens
SLKPGIIPS

SEQ ID NO: 471769 - protein, 9 aa, Homo Sapiens
FQGKTGHPG

SEQ ID NO: 471770 - protein, 9 aa, Homo Sapiens
TGFKSFGLL

SEQ ID NO: 471771 - protein, 9 aa, Homo Sapiens
QPPLAYQMN

SEQ ID NO: 471772 - protein, 9 aa, Homo Sapiens
LTQNLTVVE

SEQ ID NO: 471773 - protein, 9 aa, Homo Sapiens
PLAKTCPVQ

SEQ ID NO: 471774 - protein, 9 aa, Homo Sapiens
YTFLMGFLQ

SEQ ID NO: 471775 - protein, 9 aa, Homo Sapiens
IEQYKGHEL

SEQ ID NO: 471776 - protein, 9 aa, Homo Sapiens
IIYSLLLGG

SEQ ID NO: 471777 - protein, 9 aa, Homo Sapiens
WADMDHPCK

SEQ ID NO: 471778 - protein, 9 aa, Homo Sapiens
PSTQGKWKA

SEQ ID NO: 471779 - protein, 9 aa, Homo Sapiens
TLLVLTCRQ

SEQ ID NO: 471780 - protein, 9 aa, Homo Sapiens
QCSVQVLRA

SEQ ID NO: 471781 - protein, 9 aa, Homo Sapiens
EEEALMGPT

SEQ ID NO: 471782 - protein, 9 aa, Homo Sapiens
DMDHPCKHV

SEQ ID NO: 471783 - protein, 9 aa, Homo Sapiens
SVPHGEMPR

SEQ ID NO: 471784 - protein, 9 aa, Homo Sapiens
IAGDLGAGS

SEQ ID NO: 471785 - protein, 9 aa, Homo Sapiens
CSYLVRHKT

SEQ ID NO: 471786 - protein, 9 aa, Homo Sapiens
AKLHIDDMQ

SEQ ID NO: 471787 - protein, 9 aa, Homo Sapiens
VLSVLGANL

SEQ ID NO: 471788 - protein, 9 aa, Homo Sapiens
CSLASYMTN

SEQ ID NO: 471789 - protein, 9 aa, Homo Sapiens
PPPPAMPSA

SEQ ID NO: 471790 - protein, 9 aa, Homo Sapiens
LPWKTLRAS

SEQ ID NO: 471791 - protein, 9 aa, Homo Sapiens
RFFKILLDP

SEQ ID NO: 471792 - protein, 9 aa, Homo Sapiens
VTASDQSVN

SEQ ID NO: 471793 - protein, 9 aa, Homo Sapiens
NTAGGETLV

SEQ ID NO: 471794 - protein, 9 aa, Homo Sapiens
MAAKGADGA

SEQ ID NO: 471795 - protein, 9 aa, Homo Sapiens
RPLHYAIIM

SEQ ID NO: 471796 - protein, 9 aa, Homo Sapiens
DPRASSANR

SEQ ID NO: 471797 - protein, 9 aa, Homo Sapiens
PLTQNLTVV

SEQ ID NO: 471798 - protein, 9 aa, Homo Sapiens
KMMAAKGAD

SEQ ID NO: 471799 - protein, 9 aa, Homo Sapiens
VFLGQGNLP

SEQ ID NO: 471800 - protein, 9 aa, Homo Sapiens
KLQELPDSV

SEQ ID NO: 471801 - protein, 9 aa, Homo Sapiens
FSSKIQGSQ

SEQ ID NO: 471802 - protein, 9 aa, Homo Sapiens
FRGFFRIIY

SEQ ID NO: 471803 - protein, 9 aa, Homo Sapiens
VVIPMLNSL

SEQ ID NO: 471804 - protein, 9 aa, Homo Sapiens
NLSFVELCY

SEQ ID NO: 471805 - protein, 9 aa, Homo Sapiens
RNARLLSER

SEQ ID NO: 471806 - protein, 9 aa, Homo Sapiens
VQNEGQVAS

SEQ ID NO: 471807 - protein, 9 aa, Homo Sapiens
LPKTKYAAC

SEQ ID NO: 471808 - protein, 9 aa, Homo Sapiens
CSDPDPKAP

SEQ ID NO: 471809 - protein, 9 aa, Homo Sapiens
SEHAQRDQC

SEQ ID NO: 471810 - protein, 9 aa, Homo Sapiens
LCDCTCFGM

SEQ ID NO: 471811 - protein, 9 aa, Homo Sapiens
HRQPETILT

SEQ ID NO: 471812 - protein, 9 aa, Homo Sapiens
LLAAMAYDS

SEQ ID NO: 471813 - protein, 9 aa, Homo Sapiens
ILLNINVES

SEQ ID NO: 471814 - protein, 9 aa, Homo Sapiens
VKSAEPGEE

SEQ ID NO: 471815 - protein, 9 aa, Homo Sapiens
QFVKRLSEI

SEQ ID NO: 471816 - protein, 9 aa, Homo Sapiens
FLQPVGAIC

SEQ ID NO: 471817 - protein, 9 aa, Homo Sapiens
ASPGQASPA

SEQ ID NO: 471818 - protein, 9 aa, Homo Sapiens
KALDAKLSR

SEQ ID NO: 471819 - protein, 9 aa, Homo Sapiens
GTDSIEGEN

SEQ ID NO: 471820 - protein, 9 aa, Homo Sapiens
TSGCCRSLA

SEQ ID NO: 471821 - protein, 9 aa, Homo Sapiens
SYIVLPLTL

SEQ ID NO: 471822 - protein, 9 aa, Homo Sapiens
LAAMAYDSY

SEQ ID NO: 471823 - protein, 9 aa, Homo Sapiens
RFRKNIEAI

SEQ ID NO: 471824 - protein, 9 aa, Homo Sapiens
LKMAKMKMP

SEQ ID NO: 471825 - protein, 9 aa, Homo Sapiens
PTSLASLRS

SEQ ID NO: 471826 - protein, 9 aa, Homo Sapiens
QNEGQVASD

SEQ ID NO: 471827 - protein, 9 aa, Homo Sapiens
FSYIVLPLT

SEQ ID NO: 471828 - protein, 9 aa, Homo Sapiens
GVFSYIVLP

SEQ ID NO: 471829 - protein, 9 aa, Homo Sapiens
IIAKEGGVI

SEQ ID NO: 471830 - protein, 9 aa, Homo Sapiens
PISQWSSRR

SEQ ID NO: 471831 - protein, 9 aa, Homo Sapiens
LRAGQFTVL

SEQ ID NO: 471832 - protein, 9 aa, Homo Sapiens
GITSTCCKD

SEQ ID NO: 471833 - protein, 9 aa, Homo Sapiens
CASCSPLSY

SEQ ID NO: 471834 - protein, 9 aa, Homo Sapiens
GILSRRLRE

SEQ ID NO: 471835 - protein, 9 aa, Homo Sapiens
IDLRGYIAW

SEQ ID NO: 471836 - protein, 9 aa, Homo Sapiens
RSLQCSVQV

SEQ ID NO: 471837 - protein, 9 aa, Homo Sapiens
NDCMAQIIF

SEQ ID NO: 471838 - protein, 9 aa, Homo Sapiens
LKNISLKML

SEQ ID NO: 471839 - protein, 9 aa, Homo Sapiens
DLLIESSME

SEQ ID NO: 471840 - protein, 9 aa, Homo Sapiens
GFKFGPAPK

SEQ ID NO: 471841 - protein, 9 aa, Homo Sapiens
QDVVGESVD

SEQ ID NO: 471842 - protein, 9 aa, Homo Sapiens
EAMKYHLLT

SEQ ID NO: 471843 - protein, 9 aa, Homo Sapiens
FGGCPENLT

SEQ ID NO: 471844 - protein, 9 aa, Homo Sapiens
HLKKKLKRI

SEQ ID NO: 471845 - protein, 9 aa, Homo Sapiens
HKRFCLWRD

SEQ ID NO: 471846 - protein, 9 aa, Homo Sapiens
PSCMDSNSS

SEQ ID NO: 471847 - protein, 9 aa, Homo Sapiens
VRPSEENNK

SEQ ID NO: 471848 - protein, 9 aa, Homo Sapiens
SELLIESLE

SEQ ID NO: 471849 - protein, 9 aa, Homo Sapiens
AKERESLNK

SEQ ID NO: 471850 - protein, 9 aa, Homo Sapiens
AEAPSARLN

SEQ ID NO: 471851 - protein, 9 aa, Homo Sapiens
AEVEVRMIG

SEQ ID NO: 471852 - protein, 9 aa, Homo Sapiens
ELDAKFNAY

SEQ ID NO: 471853 - protein, 9 aa, Homo Sapiens
QGYISSNYV

SEQ ID NO: 471854 - protein, 9 aa, Homo Sapiens
GEKFYKYEE

SEQ ID NO: 471855 - protein, 9 aa, Homo Sapiens
QCETQCQMK

SEQ ID NO: 471856 - protein, 9 aa, Homo Sapiens
RESLNKGIA

SEQ ID NO: 471857 - protein, 9 aa, Homo Sapiens
VPSTQGKWK

SEQ ID NO: 471858 - protein, 9 aa, Homo Sapiens
MVAVALGGH

SEQ ID NO: 471859 - protein, 9 aa, Homo Sapiens
NVKRATLSW

SEQ ID NO: 471860 - protein, 9 aa, Homo Sapiens
WSPWSVYSS

SEQ ID NO: 471861 - protein, 9 aa, Homo Sapiens
RTTEGLTLL

SEQ ID NO: 471862 - protein, 9 aa, Homo Sapiens
AFLFSIDTQ

SEQ ID NO: 471863 - protein, 9 aa, Homo Sapiens
SHSSVPLLL

SEQ ID NO: 471864 - protein, 9 aa, Homo Sapiens
FKQPTFCRH

SEQ ID NO: 471865 - protein, 9 aa, Homo Sapiens
DYMKLLGEC

SEQ ID NO: 471866 - protein, 9 aa, Homo Sapiens
LGANLSLSA

SEQ ID NO: 471867 - protein, 9 aa, Homo Sapiens
HVARILQMR

SEQ ID NO: 471868 - protein, 9 aa, Homo Sapiens
AGHTPLKNF

SEQ ID NO: 471869 - protein, 9 aa, Homo Sapiens
VVGESVDPF

SEQ ID NO: 471870 - protein, 9 aa, Homo Sapiens
IPLPDAKEL

SEQ ID NO: 471871 - protein, 9 aa, Homo Sapiens
KKGLKKGDG

SEQ ID NO: 471872 - protein, 9 aa, Homo Sapiens
CDCTCFGMP

SEQ ID NO: 471873 - protein, 9 aa, Homo Sapiens
ATLVESPLC

SEQ ID NO: 471874 - protein, 9 aa, Homo Sapiens
AFSKFGHLT

SEQ ID NO: 471875 - protein, 9 aa, Homo Sapiens
LGNIWLIVI

SEQ ID NO: 471876 - protein, 9 aa, Homo Sapiens
RFCLWRDCA

SEQ ID NO: 471877 - protein, 9 aa, Homo Sapiens
FSARVLGNL

SEQ ID NO: 471878 - protein, 9 aa, Homo Sapiens
FKDIMKNEC

SEQ ID NO: 471879 - protein, 9 aa, Homo Sapiens
QNLTVVEGG

SEQ ID NO: 471880 - protein, 9 aa, Homo Sapiens
CASRFTGED

SEQ ID NO: 471881 - protein, 9 aa, Homo Sapiens
LDLLIESSM

SEQ ID NO: 471882 - protein, 9 aa, Homo Sapiens
KKDKKGLKK

SEQ ID NO: 471883 - protein, 9 aa, Homo Sapiens
NPNQPAPRP

SEQ ID NO: 471884 - protein, 9 aa, Homo Sapiens
ADLATGPII

SEQ ID NO: 471885 - protein, 9 aa, Homo Sapiens
IRVVSHSSV

SEQ ID NO: 471886 - protein, 9 aa, Homo Sapiens
AVASVERRS

SEQ ID NO: 471887 - protein, 9 aa, Homo Sapiens
TNSAQSAGM

SEQ ID NO: 471888 - protein, 9 aa, Homo Sapiens
GKKSSALVS

SEQ ID NO: 471889 - protein, 9 aa, Homo Sapiens
VSDSFKKIF

SEQ ID NO: 471890 - protein, 9 aa, Homo Sapiens
WALVFRSGY

SEQ ID NO: 471891 - protein, 9 aa, Homo Sapiens
RTRESVTDY

SEQ ID NO: 471892 - protein, 9 aa, Homo Sapiens
EGGVIALFK

SEQ ID NO: 471893 - protein, 9 aa, Homo Sapiens
SRHREIVVD

SEQ ID NO: 471894 - protein, 9 aa, Homo Sapiens
FISVKVPQS

SEQ ID NO: 471895 - protein, 9 aa, Homo Sapiens
KSEKVTIKT

SEQ ID NO: 471896 - protein, 9 aa, Homo Sapiens
HNVLGTPGE

SEQ ID NO: 471897 - protein, 9 aa, Homo Sapiens
SNLSFVELC

SEQ ID NO: 471898 - protein, 9 aa, Homo Sapiens
PCFASMVTK

SEQ ID NO: 471899 - protein, 9 aa, Homo Sapiens
CASLVSVGS

SEQ ID NO: 471900 - protein, 9 aa, Homo Sapiens
ELPLQLLLE

SEQ ID NO: 471901 - protein, 9 aa, Homo Sapiens
TERRTLMQS

SEQ ID NO: 471902 - protein, 9 aa, Homo Sapiens
AWTTMDVAT

SEQ ID NO: 471903 - protein, 9 aa, Homo Sapiens
FVELCYFSD

SEQ ID NO: 471904 - protein, 9 aa, Homo Sapiens
NECSMLKLQ

SEQ ID NO: 471905 - protein, 9 aa, Homo Sapiens
LSLKCVGHG

SEQ ID NO: 471906 - protein, 9 aa, Homo Sapiens
LFSIDTQTT

SEQ ID NO: 471907 - protein, 9 aa, Homo Sapiens
TWHGQGQGQ

SEQ ID NO: 471908 - protein, 9 aa, Homo Sapiens
PSASTTTPT

SEQ ID NO: 471909 - protein, 9 aa, Homo Sapiens
LTDVPELQM

SEQ ID NO: 471910 - protein, 9 aa, Homo Sapiens
HPGDGRVEV

SEQ ID NO: 471911 - protein, 9 aa, Homo Sapiens
SPESTTFHS

SEQ ID NO: 471912 - protein, 9 aa, Homo Sapiens
TVALGFFGP

SEQ ID NO: 471913 - protein, 9 aa, Homo Sapiens
TLSWENSLE

SEQ ID NO: 471914 - protein, 9 aa, Homo Sapiens
SGSACATLV

SEQ ID NO: 471915 - protein, 9 aa, Homo Sapiens
DCTCFGMPR

SEQ ID NO: 471916 - protein, 9 aa, Homo Sapiens
QSRHREIVV

SEQ ID NO: 471917 - protein, 9 aa, Homo Sapiens
SEKKCSLAS

SEQ ID NO: 471918 - protein, 9 aa, Homo Sapiens
NWYFLLACS

SEQ ID NO: 471919 - protein, 9 aa, Homo Sapiens
GRVSWKNIK

SEQ ID NO: 471920 - protein, 9 aa, Homo Sapiens
KPDVTQSTL

SEQ ID NO: 471921 - protein, 9 aa, Homo Sapiens
QLLLEGQWH

SEQ ID NO: 471922 - protein, 9 aa, Homo Sapiens
RLKNISLKM

SEQ ID NO: 471923 - protein, 9 aa, Homo Sapiens
EGCEEALGG

SEQ ID NO: 471924 - protein, 9 aa, Homo Sapiens
LHPAEPQSG

SEQ ID NO: 471925 - protein, 9 aa, Homo Sapiens
RKHILVWAA

SEQ ID NO: 471926 - protein, 9 aa, Homo Sapiens
AMVAVALGG

SEQ ID NO: 471927 - protein, 9 aa, Homo Sapiens
SAAAGNPFP

SEQ ID NO: 471928 - protein, 9 aa, Homo Sapiens
HELHAGTES

SEQ ID NO: 471929 - protein, 9 aa, Homo Sapiens
LDPNDYLTL

SEQ ID NO: 471930 - protein, 9 aa, Homo Sapiens
EEDLFQTSP

SEQ ID NO: 471931 - protein, 9 aa, Homo Sapiens
NGSAVLKIE

SEQ ID NO: 471932 - protein, 9 aa, Homo Sapiens
ARGKRRGKN

SEQ ID NO: 471933 - protein, 9 aa, Homo Sapiens
ANNTHLEEI

SEQ ID NO: 471934 - protein, 9 aa, Homo Sapiens
EVLYSVQSL

SEQ ID NO: 471935 - protein, 9 aa, Homo Sapiens
GKNYIILTG

SEQ ID NO: 471936 - protein, 9 aa, Homo Sapiens
SVCRSMSCG

SEQ ID NO: 471937 - protein, 9 aa, Homo Sapiens
RYSTSCASL

SEQ ID NO: 471938 - protein, 9 aa, Homo Sapiens
VDRFTLSKL

SEQ ID NO: 471939 - protein, 9 aa, Homo Sapiens
GTKKAVEQR

SEQ ID NO: 471940 - protein, 9 aa, Homo Sapiens
QYSLDTDLL

SEQ ID NO: 471941 - protein, 9 aa, Homo Sapiens
SSMEHGKEM

SEQ ID NO: 471942 - protein, 9 aa, Homo Sapiens
AHWMRQLVC

SEQ ID NO: 471943 - protein, 9 aa, Homo Sapiens
SVLGHVFRT

SEQ ID NO: 471944 - protein, 9 aa, Homo Sapiens
KLHIDDMQF

SEQ ID NO: 471945 - protein, 9 aa, Homo Sapiens
LMVEERKIP

SEQ ID NO: 471946 - protein, 9 aa, Homo Sapiens
LYSVQSLSD

SEQ ID NO: 471947 - protein, 9 aa, Homo Sapiens
MMAAKGADG

SEQ ID NO: 471948 - protein, 9 aa, Homo Sapiens
SIITSNSLA

SEQ ID NO: 471949 - protein, 9 aa, Homo Sapiens
ILSVRDISG

SEQ ID NO: 471950 - protein, 9 aa, Homo Sapiens
ERRHASLVT

SEQ ID NO: 471951 - protein, 9 aa, Homo Sapiens
NARLLSERD

SEQ ID NO: 471952 - protein, 9 aa, Homo Sapiens
NTRAYTLPI

SEQ ID NO: 471953 - protein, 9 aa, Homo Sapiens
ENHEPVKKF

SEQ ID NO: 471954 - protein, 9 aa, Homo Sapiens
EGEPSWALV

SEQ ID NO: 471955 - protein, 9 aa, Homo Sapiens
PPAMPSAST

SEQ ID NO: 471956 - protein, 9 aa, Homo Sapiens
KVTIKTDGR

SEQ ID NO: 471957 - protein, 9 aa, Homo Sapiens
EPVPGQKGT

SEQ ID NO: 471958 - protein, 9 aa, Homo Sapiens
SVYSSTCGE

SEQ ID NO: 471959 - protein, 9 aa, Homo Sapiens
SLETCRSES

SEQ ID NO: 471960 - protein, 9 aa, Homo Sapiens
LPDSVPHGE

SEQ ID NO: 471961 - protein, 9 aa, Homo Sapiens
IPSQSTYTV

SEQ ID NO: 471962 - protein, 9 aa, Homo Sapiens
DLCFISVKV

SEQ ID NO: 471963 - protein, 9 aa, Homo Sapiens
RASPGQASP

SEQ ID NO: 471964 - protein, 9 aa, Homo Sapiens
GANNTHLEE

SEQ ID NO: 471965 - protein, 9 aa, Homo Sapiens
EEMEEMGKR

SEQ ID NO: 471966 - protein, 9 aa, Homo Sapiens
NLKNELQRN

SEQ ID NO: 471967 - protein, 9 aa, Homo Sapiens
EEWSPWSVY

SEQ ID NO: 471968 - protein, 9 aa, Homo Sapiens
SVMCKTCEQ

SEQ ID NO: 471969 - protein, 9 aa, Homo Sapiens
SQWADMDHP

SEQ ID NO: 471970 - protein, 9 aa, Homo Sapiens
FIQKSSLTC

SEQ ID NO: 471971 - protein, 9 aa, Homo Sapiens
AVLIVDPQG

SEQ ID NO: 471972 - protein, 9 aa, Homo Sapiens
IQWQSGCAV

SEQ ID NO: 471973 - protein, 9 aa, Homo Sapiens
ARINKALDA

SEQ ID NO: 471974 - protein, 9 aa, Homo Sapiens
WKTLRASFQ

SEQ ID NO: 471975 - protein, 9 aa, Homo Sapiens
GCRPIVCAA

SEQ ID NO: 471976 - protein, 9 aa, Homo Sapiens
YSITVNYRK

SEQ ID NO: 471977 - protein, 9 aa, Homo Sapiens
EPQNMLNKH

SEQ ID NO: 471978 - protein, 9 aa, Homo Sapiens
HSVAWTTMD

SEQ ID NO: 471979 - protein, 9 aa, Homo Sapiens
SGCCRSLAS

SEQ ID NO: 471980 - protein, 9 aa, Homo Sapiens
IAELDTLIE

SEQ ID NO: 471981 - protein, 9 aa, Homo Sapiens
CEHPGVPAN

SEQ ID NO: 471982 - protein, 9 aa, Homo Sapiens
TLPTCIEQV

SEQ ID NO: 471983 - protein, 9 aa, Homo Sapiens
GSVQGKSQV

SEQ ID NO: 471984 - protein, 9 aa, Homo Sapiens
RRQYNRVSL

SEQ ID NO: 471985 - protein, 9 aa, Homo Sapiens
QFTVLMQLT

SEQ ID NO: 471986 - protein, 9 aa, Homo Sapiens
YRLMRDHNV

SEQ ID NO: 471987 - protein, 9 aa, Homo Sapiens
RVEISHGGS

SEQ ID NO: 471988 - protein, 9 aa, Homo Sapiens
LRSALWQVG

SEQ ID NO: 471989 - protein, 9 aa, Homo Sapiens
SKTEVIIRF

SEQ ID NO: 471990 - protein, 9 aa, Homo Sapiens
NEFYEQADE

SEQ ID NO: 471991 - protein, 9 aa, Homo Sapiens
LSFVELCYF

SEQ ID NO: 471992 - protein, 9 aa, Homo Sapiens
TEFIMLVID

SEQ ID NO: 471993 - protein, 9 aa, Homo Sapiens
FCENSTYIW

SEQ ID NO: 471994 - protein, 9 aa, Homo Sapiens
NIVQKSVTD

SEQ ID NO: 471995 - protein, 9 aa, Homo Sapiens
EETMPVEAI

SEQ ID NO: 471996 - protein, 9 aa, Homo Sapiens
HLEEIVSYP

SEQ ID NO: 471997 - protein, 9 aa, Homo Sapiens
GSDGTDSIE

SEQ ID NO: 471998 - protein, 9 aa, Homo Sapiens
SSNADKSLH

SEQ ID NO: 471999 - protein, 9 aa, Homo Sapiens
ESVDPFNQT

SEQ ID NO: 472000 - protein, 9 aa, Homo Sapiens
VARILQMRA

SEQ ID NO: 472001 - protein, 9 aa, Homo Sapiens
ISQWSSRRR

SEQ ID NO: 472002 - protein, 9 aa, Homo Sapiens
VTQSTLETP

SEQ ID NO: 472003 - protein, 9 aa, Homo Sapiens
LSVLGANLS

SEQ ID NO: 472004 - protein, 9 aa, Homo Sapiens
FLLACSDPD

SEQ ID NO: 472005 - protein, 9 aa, Homo Sapiens
KTGASNLKE

SEQ ID NO: 472006 - protein, 9 aa, Homo Sapiens
VMCKTCEQF

SEQ ID NO: 472007 - protein, 9 aa, Homo Sapiens
PSPLPSCMD

SEQ ID NO: 472008 - protein, 9 aa, Homo Sapiens
GFWLRQFPR

SEQ ID NO: 472009 - protein, 9 aa, Homo Sapiens
EPTKTGASN

SEQ ID NO: 472010 - protein, 9 aa, Homo Sapiens
DLLQPPLAY

SEQ ID NO: 472011 - protein, 9 aa, Homo Sapiens
SPWSVYSST

SEQ ID NO: 472012 - protein, 9 aa, Homo Sapiens
ALIGRLVCE

SEQ ID NO: 472013 - protein, 9 aa, Homo Sapiens
LCFISVKVP

SEQ ID NO: 472014 - protein, 9 aa, Homo Sapiens
PRRSRIIFT

SEQ ID NO: 472015 - protein, 9 aa, Homo Sapiens
VSVGSLLGR

SEQ ID NO: 472016 - protein, 9 aa, Homo Sapiens
PALNKMFCP

SEQ ID NO: 472017 - protein, 9 aa, Homo Sapiens
AYKFKWDKM

SEQ ID NO: 472018 - protein, 9 aa, Homo Sapiens
LHIDDMQFE

SEQ ID NO: 472019 - protein, 9 aa, Homo Sapiens
AETSRLLII

SEQ ID NO: 472020 - protein, 9 aa, Homo Sapiens
AVYAMADAL

SEQ ID NO: 472021 - protein, 9 aa, Homo Sapiens
NDILLNINV

SEQ ID NO: 472022 - protein, 9 aa, Homo Sapiens
FCLWRDCAC

SEQ ID NO: 472023 - protein, 9 aa, Homo Sapiens
RDPPTSASQ

SEQ ID NO: 472024 - protein, 9 aa, Homo Sapiens
KGHELYERP

SEQ ID NO: 472025 - protein, 9 aa, Homo Sapiens
PIYSSSTCG

SEQ ID NO: 472026 - protein, 9 aa, Homo Sapiens
TRESVTDYP

SEQ ID NO: 472027 - protein, 9 aa, Homo Sapiens
AGESFLGSG

SEQ ID NO: 472028 - protein, 9 aa, Homo Sapiens
GEKPFKCVG

SEQ ID NO: 472029 - protein, 9 aa, Homo Sapiens
DGIPDVPGN

SEQ ID NO: 472030 - protein, 9 aa, Homo Sapiens
LADLATGPI

SEQ ID NO: 472031 - protein, 9 aa, Homo Sapiens
TVNYRKNEL

SEQ ID NO: 472032 - protein, 9 aa, Homo Sapiens
DEDDTDFFS

SEQ ID NO: 472033 - protein, 9 aa, Homo Sapiens
EDDPEDINH

SEQ ID NO: 472034 - protein, 9 aa, Homo Sapiens
PVKGFRVTL

SEQ ID NO: 472035 - protein, 9 aa, Homo Sapiens
YKFKWDKMC

SEQ ID NO: 472036 - protein, 9 aa, Homo Sapiens
AGKDERLLC

SEQ ID NO: 472037 - protein, 9 aa, Homo Sapiens
EFTLLVLTC

SEQ ID NO: 472038 - protein, 9 aa, Homo Sapiens
ELPSECGFW

SEQ ID NO: 472039 - protein, 9 aa, Homo Sapiens
DTQTTIGYG

SEQ ID NO: 472040 - protein, 9 aa, Homo Sapiens
AKLGPGEKH

SEQ ID NO: 472041 - protein, 9 aa, Homo Sapiens
SVDRFTLSK

SEQ ID NO: 472042 - protein, 9 aa, Homo Sapiens
TGEKPSECS

SEQ ID NO: 472043 - protein, 9 aa, Homo Sapiens
EFFKNPMCF

SEQ ID NO: 472044 - protein, 9 aa, Homo Sapiens
ALVFRSGYL

SEQ ID NO: 472045 - protein, 9 aa, Homo Sapiens
NISLKMLPQ

SEQ ID NO: 472046 - protein, 9 aa, Homo Sapiens
GQASPAQAS

SEQ ID NO: 472047 - protein, 9 aa, Homo Sapiens
AHPGDGRVE

SEQ ID NO: 472048 - protein, 9 aa, Homo Sapiens
ASRDKRFRS

SEQ ID NO: 472049 - protein, 9 aa, Homo Sapiens
LGLEECGIT

SEQ ID NO: 472050 - protein, 9 aa, Homo Sapiens
GVTQGVVVG

SEQ ID NO: 472051 - protein, 9 aa, Homo Sapiens
VLIVDPQGR

SEQ ID NO: 472052 - protein, 9 aa, Homo Sapiens
ISHGGSWGT

SEQ ID NO: 472053 - protein, 9 aa, Homo Sapiens
GYIAWSLMD

SEQ ID NO: 472054 - protein, 9 aa, Homo Sapiens
TSVCRSMSC

SEQ ID NO: 472055 - protein, 9 aa, Homo Sapiens
GPPSTGGHG

SEQ ID NO: 472056 - protein, 9 aa, Homo Sapiens
SFLGSGGDE

SEQ ID NO: 472057 - protein, 9 aa, Homo Sapiens
IPSLRRHIR

SEQ ID NO: 472058 - protein, 9 aa, Homo Sapiens
LPSCMDSNS

SEQ ID NO: 472059 - protein, 9 aa, Homo Sapiens
ICAKSRMPF

SEQ ID NO: 472060 - protein, 9 aa, Homo Sapiens
ARLLDPTEP

SEQ ID NO: 472061 - protein, 9 aa, Homo Sapiens
LSQLASHPG

SEQ ID NO: 472062 - protein, 9 aa, Homo Sapiens
SCSGRVEIS

SEQ ID NO: 472063 - protein, 9 aa, Homo Sapiens
FCCEFPSLL

SEQ ID NO: 472064 - protein, 9 aa, Homo Sapiens
MQFEPKQRQ

SEQ ID NO: 472065 - protein, 9 aa, Homo Sapiens
SVQGKSQVL

SEQ ID NO: 472066 - protein, 9 aa, Homo Sapiens
SRNISNTAG

SEQ ID NO: 472067 - protein, 9 aa, Homo Sapiens
IFVSFFTLN

SEQ ID NO: 472068 - protein, 9 aa, Homo Sapiens
PSSSSTLQS

SEQ ID NO: 472069 - protein, 9 aa, Homo Sapiens
IHMEEKTCK

SEQ ID NO: 472070 - protein, 9 aa, Homo Sapiens
LKLGGGHKW

SEQ ID NO: 472071 - protein, 9 aa, Homo Sapiens
RLRHVSPTP

SEQ ID NO: 472072 - protein, 9 aa, Homo Sapiens
IMLVIDSTD

SEQ ID NO: 472073 - protein, 9 aa, Homo Sapiens
YLQGHAVRP

SEQ ID NO: 472074 - protein, 9 aa, Homo Sapiens
RKFNCRQEM

SEQ ID NO: 472075 - protein, 9 aa, Homo Sapiens
LVLKKSGES

SEQ ID NO: 472076 - protein, 9 aa, Homo Sapiens
AGRFQASEA

SEQ ID NO: 472077 - protein, 9 aa, Homo Sapiens
QLLQVQRTT

SEQ ID NO: 472078 - protein, 9 aa, Homo Sapiens
IKTDGRKEE

SEQ ID NO: 472079 - protein, 9 aa, Homo Sapiens
EKRVEKLEI

SEQ ID NO: 472080 - protein, 9 aa, Homo Sapiens
LGDVALGCL

SEQ ID NO: 472081 - protein, 9 aa, Homo Sapiens
QWSSRRRSR

SEQ ID NO: 472082 - protein, 9 aa, Homo Sapiens
VFKETTWHG

SEQ ID NO: 472083 - protein, 9 aa, Homo Sapiens
ETSRLLIIA

SEQ ID NO: 472084 - protein, 9 aa, Homo Sapiens
WNPLLYPVH

SEQ ID NO: 472085 - protein, 9 aa, Homo Sapiens
RPTASRDKR

SEQ ID NO: 472086 - protein, 9 aa, Homo Sapiens
PVTLSLICF

SEQ ID NO: 472087 - protein, 9 aa, Homo Sapiens
TEFTLLVLT

SEQ ID NO: 472088 - protein, 9 aa, Homo Sapiens
GQPGIRGLD

SEQ ID NO: 472089 - protein, 9 aa, Homo Sapiens
LFQGWINLL

SEQ ID NO: 472090 - protein, 9 aa, Homo Sapiens
RSMSCGLSN

SEQ ID NO: 472091 - protein, 9 aa, Homo Sapiens
AAGKNYIIL

SEQ ID NO: 472092 - protein, 9 aa, Homo Sapiens
EDLFQTSPM

SEQ ID NO: 472093 - protein, 9 aa, Homo Sapiens
GEGRMARAG

SEQ ID NO: 472094 - protein, 9 aa, Homo Sapiens
PRCCTGPQR

SEQ ID NO: 472095 - protein, 9 aa, Homo Sapiens
LIPSLRRHI

SEQ ID NO: 472096 - protein, 9 aa, Homo Sapiens
LIQGFTIWK

SEQ ID NO: 472097 - protein, 9 aa, Homo Sapiens
EEKTCKCEE

SEQ ID NO: 472098 - protein, 9 aa, Homo Sapiens
FVIVVENAL

SEQ ID NO: 472099 - protein, 9 aa, Homo Sapiens
HLSLFQGWI

SEQ ID NO: 472100 - protein, 9 aa, Homo Sapiens
VGSVQGKSQ

SEQ ID NO: 472101 - protein, 9 aa, Homo Sapiens
SSGSACATL

SEQ ID NO: 472102 - protein, 9 aa, Homo Sapiens
KSAEPGEEQ

SEQ ID NO: 472103 - protein, 9 aa, Homo Sapiens
FGMPRRYII

SEQ ID NO: 472104 - protein, 9 aa, Homo Sapiens
LWLFPPGAC

SEQ ID NO: 472105 - protein, 9 aa, Homo Sapiens
TVLMQLTWL

SEQ ID NO: 472106 - protein, 9 aa, Homo Sapiens
RATLSWENS

SEQ ID NO: 472107 - protein, 9 aa, Homo Sapiens
VNYRKNELE

SEQ ID NO: 472108 - protein, 9 aa, Homo Sapiens
LGHVFRTKS

SEQ ID NO: 472109 - protein, 9 aa, Homo Sapiens
LGRLWLFPP

SEQ ID NO: 472110 - protein, 9 aa, Homo Sapiens
GDRVGVEHT

SEQ ID NO: 472111 - protein, 9 aa, Homo Sapiens
CDVEIKENP

SEQ ID NO: 472112 - protein, 9 aa, Homo Sapiens
QSLFQSFSE

SEQ ID NO: 472113 - protein, 9 aa, Homo Sapiens
NLLVLLDQH

SEQ ID NO: 472114 - protein, 9 aa, Homo Sapiens
HGYGTPAIC

SEQ ID NO: 472115 - protein, 9 aa, Homo Sapiens
LQEEPVKGF

SEQ ID NO: 472116 - protein, 9 aa, Homo Sapiens
WINLLNMAK

SEQ ID NO: 472117 - protein, 9 aa, Homo Sapiens
LASHPGMAN

SEQ ID NO: 472118 - protein, 9 aa, Homo Sapiens
DVLSVLGAN

SEQ ID NO: 472119 - protein, 9 aa, Homo Sapiens
IKILNNTRA

SEQ ID NO: 472120 - protein, 9 aa, Homo Sapiens
WAQRYSTSC

SEQ ID NO: 472121 - protein, 9 aa, Homo Sapiens
HQGDSELLI

SEQ ID NO: 472122 - protein, 9 aa, Homo Sapiens
MEHGKEMTM

SEQ ID NO: 472123 - protein, 9 aa, Homo Sapiens
FIIFVSFFT

SEQ ID NO: 472124 - protein, 9 aa, Homo Sapiens
SVSTSTPNV

SEQ ID NO: 472125 - protein, 9 aa, Homo Sapiens
AELDTLIEE

SEQ ID NO: 472126 - protein, 9 aa, Homo Sapiens
DTDFFSPSG

SEQ ID NO: 472127 - protein, 9 aa, Homo Sapiens
AEELRMEAE

SEQ ID NO: 472128 - protein, 9 aa, Homo Sapiens
RRGSVIQSV

SEQ ID NO: 472129 - protein, 9 aa, Homo Sapiens
IYSSSTCGS

SEQ ID NO: 472130 - protein, 9 aa, Homo Sapiens
KGEVLLHVE

SEQ ID NO: 472131 - protein, 9 aa, Homo Sapiens
RPSQRPKTH

SEQ ID NO: 472132 - protein, 9 aa, Homo Sapiens
LHYAIIMNQ

SEQ ID NO: 472133 - protein, 9 aa, Homo Sapiens
DIMKNECSM

SEQ ID NO: 472134 - protein, 9 aa, Homo Sapiens
EPSWALVFR

SEQ ID NO: 472135 - protein, 9 aa, Homo Sapiens
LANLIPVTL

SEQ ID NO: 472136 - protein, 9 aa, Homo Sapiens
VTVKVGKNK

SEQ ID NO: 472137 - protein, 9 aa, Homo Sapiens
QLQGYISSN

SEQ ID NO: 472138 - protein, 9 aa, Homo Sapiens
LEEDLFQTS

SEQ ID NO: 472139 - protein, 9 aa, Homo Sapiens
CICMPCYEG

SEQ ID NO: 472140 - protein, 9 aa, Homo Sapiens
GDSELLIES

SEQ ID NO: 472141 - protein, 9 aa, Homo Sapiens
SQWSSRRRS

SEQ ID NO: 472142 - protein, 9 aa, Homo Sapiens
LAEILSVRD

SEQ ID NO: 472143 - protein, 9 aa, Homo Sapiens
SITVNYRKN

SEQ ID NO: 472144 - protein, 9 aa, Homo Sapiens
KTLRASFQA

SEQ ID NO: 472145 - protein, 9 aa, Homo Sapiens
RLLPRYSES

SEQ ID NO: 472146 - protein, 9 aa, Homo Sapiens
VVSHSSVPL

SEQ ID NO: 472147 - protein, 9 aa, Homo Sapiens
THPTDTILY

SEQ ID NO: 472148 - protein, 9 aa, Homo Sapiens
ALLRRQYNR

SEQ ID NO: 472149 - protein, 9 aa, Homo Sapiens
LFGALHVYR

SEQ ID NO: 472150 - protein, 9 aa, Homo Sapiens
VCFQKLKLT

SEQ ID NO: 472151 - protein, 9 aa, Homo Sapiens
CSGRVEISH

SEQ ID NO: 472152 - protein, 9 aa, Homo Sapiens
ATGPIILPI

SEQ ID NO: 472153 - protein, 9 aa, Homo Sapiens
MSYARKVGA

SEQ ID NO: 472154 - protein, 9 aa, Homo Sapiens
KGLQEEPVK

SEQ ID NO: 472155 - protein, 9 aa, Homo Sapiens
RESVTDYPQ

SEQ ID NO: 472156 - protein, 9 aa, Homo Sapiens
LTSGCCRSL

SEQ ID NO: 472157 - protein, 9 aa, Homo Sapiens
SHGTGFKSF

SEQ ID NO: 472158 - protein, 9 aa, Homo Sapiens
VCVPVGCRP

SEQ ID NO: 472159 - protein, 9 aa, Homo Sapiens
GPDWHLKMA

SEQ ID NO: 472160 - protein, 9 aa, Homo Sapiens
QRYSTSCAS

SEQ ID NO: 472161 - protein, 9 aa, Homo Sapiens
PPSTGGHGP

SEQ ID NO: 472162 - protein, 9 aa, Homo Sapiens
ASLEEDLFQ

SEQ ID NO: 472163 - protein, 9 aa, Homo Sapiens
ALHVYRNFF

SEQ ID NO: 472164 - protein, 9 aa, Homo Sapiens
SQVLMLTGK

SEQ ID NO: 472165 - protein, 9 aa, Homo Sapiens
MGDDKDACR

SEQ ID NO: 472166 - protein, 9 aa, Homo Sapiens
IITRYVRIV

SEQ ID NO: 472167 - protein, 9 aa, Homo Sapiens
AQRDQCETQ

SEQ ID NO: 472168 - protein, 9 aa, Homo Sapiens
VPCFASMVT

SEQ ID NO: 472169 - protein, 9 aa, Homo Sapiens
DGIDLRGYI

SEQ ID NO: 472170 - protein, 9 aa, Homo Sapiens
FTIWKCWDY

SEQ ID NO: 472171 - protein, 9 aa, Homo Sapiens
TTPYRMLRI

SEQ ID NO: 472172 - protein, 9 aa, Homo Sapiens
VTVLGNIWL

SEQ ID NO: 472173 - protein, 9 aa, Homo Sapiens
EECMLTSGC

SEQ ID NO: 472174 - protein, 9 aa, Homo Sapiens
IQCSYLVRH

SEQ ID NO: 472175 - protein, 9 aa, Homo Sapiens
LQLLLEGQW

SEQ ID NO: 472176 - protein, 9 aa, Homo Sapiens
IFVVGTAEG

SEQ ID NO: 472177 - protein, 9 aa, Homo Sapiens
LAISCEHPG

SEQ ID NO: 472178 - protein, 9 aa, Homo Sapiens
LVWAARQSP

SEQ ID NO: 472179 - protein, 9 aa, Homo Sapiens
KMQVQQQHQ

SEQ ID NO: 472180 - protein, 9 aa, Homo Sapiens
ITSTCCKDL

SEQ ID NO: 472181 - protein, 9 aa, Homo Sapiens
LETCRSESN

SEQ ID NO: 472182 - protein, 9 aa, Homo Sapiens
EAETSRLLI

SEQ ID NO: 472183 - protein, 9 aa, Homo Sapiens
VARINKALD

SEQ ID NO: 472184 - protein, 9 aa, Homo Sapiens
LLQVQRTTE

SEQ ID NO: 472185 - protein, 9 aa, Homo Sapiens
EISFENESF

SEQ ID NO: 472186 - protein, 9 aa, Homo Sapiens
EESEKFRTT

SEQ ID NO: 472187 - protein, 9 aa, Homo Sapiens
IIMNQRLCC

SEQ ID NO: 472188 - protein, 9 aa, Homo Sapiens
FQTSPMEIV

SEQ ID NO: 472189 - protein, 9 aa, Homo Sapiens
FVFKETTWH

SEQ ID NO: 472190 - protein, 9 aa, Homo Sapiens
AKSRMPFKP

SEQ ID NO: 472191 - protein, 9 aa, Homo Sapiens
EKPFKCVGC

SEQ ID NO: 472192 - protein, 9 aa, Homo Sapiens
ELRGAGAIR

SEQ ID NO: 472193 - protein, 9 aa, Homo Sapiens
TKNKLSNHL

SEQ ID NO: 472194 - protein, 9 aa, Homo Sapiens
MEAEEEALM

SEQ ID NO: 472195 - protein, 9 aa, Homo Sapiens
TEGLTLLFK

SEQ ID NO: 472196 - protein, 9 aa, Homo Sapiens
YAMADALHH

SEQ ID NO: 472197 - protein, 9 aa, Homo Sapiens
KSATSHDQK

SEQ ID NO: 472198 - protein, 9 aa, Homo Sapiens
DWHLKMAKM

SEQ ID NO: 472199 - protein, 9 aa, Homo Sapiens
QLKKHGFKF

SEQ ID NO: 472200 - protein, 9 aa, Homo Sapiens
SSEVLYSVQ

SEQ ID NO: 472201 - protein, 9 aa, Homo Sapiens
LVCEAPTRL

SEQ ID NO: 472202 - protein, 9 aa, Homo Sapiens
FKETTWHGQ

SEQ ID NO: 472203 - protein, 9 aa, Homo Sapiens
IQKFSHSSN

SEQ ID NO: 472204 - protein, 9 aa, Homo Sapiens
CENSTYIWV

SEQ ID NO: 472205 - protein, 9 aa, Homo Sapiens
TPTSRCPTG

SEQ ID NO: 472206 - protein, 9 aa, Homo Sapiens
GIRGLDGPP

SEQ ID NO: 472207 - protein, 9 aa, Homo Sapiens
VGSLLGRLW

SEQ ID NO: 472208 - protein, 9 aa, Homo Sapiens
SGTQSRHRE

SEQ ID NO: 472209 - protein, 9 aa, Homo Sapiens
NKHISKTEV

SEQ ID NO: 472210 - protein, 9 aa, Homo Sapiens
EAGRIAGDL

SEQ ID NO: 472211 - protein, 9 aa, Homo Sapiens
KNISLKMLP

SEQ ID NO: 472212 - protein, 9 aa, Homo Sapiens
EVAGRFQAS

SEQ ID NO: 472213 - protein, 9 aa, Homo Sapiens
SRIIFTELQ

SEQ ID NO: 472214 - protein, 9 aa, Homo Sapiens
TQSRHREIV

SEQ ID NO: 472215 - protein, 9 aa, Homo Sapiens
GYISSNYVA

SEQ ID NO: 472216 - protein, 9 aa, Homo Sapiens
LWQVGRKDC

SEQ ID NO: 472217 - protein, 9 aa, Homo Sapiens
GSTASEESE

SEQ ID NO: 472218 - protein, 9 aa, Homo Sapiens
ELQMAVFTF

SEQ ID NO: 472219 - protein, 9 aa, Homo Sapiens
PSQRPKTHP

SEQ ID NO: 472220 - protein, 9 aa, Homo Sapiens
HTSVCRSMS

SEQ ID NO: 472221 - protein, 9 aa, Homo Sapiens
AKEGGVIAL

SEQ ID NO: 472222 - protein, 9 aa, Homo Sapiens
LMGSPCFKG

SEQ ID NO: 472223 - protein, 9 aa, Homo Sapiens
TLQSLFQSF

SEQ ID NO: 472224 - protein, 9 aa, Homo Sapiens
SLFQGWINL

SEQ ID NO: 472225 - protein, 9 aa, Homo Sapiens
FYEQADEEA

SEQ ID NO: 472226 - protein, 9 aa, Homo Sapiens
SITCCVSES

SEQ ID NO: 472227 - protein, 9 aa, Homo Sapiens
FTVLMQLTW

SEQ ID NO: 472228 - protein, 9 aa, Homo Sapiens
SNSLAPRVD

SEQ ID NO: 472229 - protein, 9 aa, Homo Sapiens
LLVLLDQHA

SEQ ID NO: 472230 - protein, 9 aa, Homo Sapiens
DPNDYLTLD

SEQ ID NO: 472231 - protein, 9 aa, Homo Sapiens
CVVAEPEKV

SEQ ID NO: 472232 - protein, 9 aa, Homo Sapiens
YFIRGFASY

SEQ ID NO: 472233 - protein, 9 aa, Homo Sapiens
SFVELCYFS

SEQ ID NO: 472234 - protein, 9 aa, Homo Sapiens
VWAARQSPP

SEQ ID NO: 472235 - protein, 9 aa, Homo Sapiens
AVADQEDIF

SEQ ID NO: 472236 - protein, 9 aa, Homo Sapiens
FIMSCAFYW

SEQ ID NO: 472237 - protein, 9 aa, Homo Sapiens
IMKNECSML

SEQ ID NO: 472238 - protein, 9 aa, Homo Sapiens
SDHDATNSA

SEQ ID NO: 472239 - protein, 9 aa, Homo Sapiens
VVENALRVA

SEQ ID NO: 472240 - protein, 9 aa, Homo Sapiens
SHTSVCRSM

SEQ ID NO: 472241 - protein, 9 aa, Homo Sapiens
SSDFIEGFC

SEQ ID NO: 472242 - protein, 9 aa, Homo Sapiens
QRLSLKCVG

SEQ ID NO: 472243 - protein, 9 aa, Homo Sapiens
ADKSLHESL

SEQ ID NO: 472244 - protein, 9 aa, Homo Sapiens
SAIEDLAQG

SEQ ID NO: 472245 - protein, 9 aa, Homo Sapiens
IFIIFVSFF

SEQ ID NO: 472246 - protein, 9 aa, Homo Sapiens
IVLKLGGGH

SEQ ID NO: 472247 - protein, 9 aa, Homo Sapiens
ISSNYVAED

SEQ ID NO: 472248 - protein, 9 aa, Homo Sapiens
GEATWEELV

SEQ ID NO: 472249 - protein, 9 aa, Homo Sapiens
DHPCKHVAR

SEQ ID NO: 472250 - protein, 9 aa, Homo Sapiens
GGNGSHRLG

SEQ ID NO: 472251 - protein, 9 aa, Homo Sapiens
TCIEQVKTC

SEQ ID NO: 472252 - protein, 9 aa, Homo Sapiens
KFNHDGEDE

SEQ ID NO: 472253 - protein, 9 aa, Homo Sapiens
YKGHELYER

SEQ ID NO: 472254 - protein, 9 aa, Homo Sapiens
GPGRVSWKN

SEQ ID NO: 472255 - protein, 9 aa, Homo Sapiens
SLVTVFPSP

SEQ ID NO: 472256 - protein, 9 aa, Homo Sapiens
LEGQWHHIC

SEQ ID NO: 472257 - protein, 9 aa, Homo Sapiens
HYGYGVLGG

SEQ ID NO: 472258 - protein, 9 aa, Homo Sapiens
ARFRKNIEA

SEQ ID NO: 472259 - protein, 9 aa, Homo Sapiens
DSIEGENNE

SEQ ID NO: 472260 - protein, 9 aa, Homo Sapiens
GFKSFGLLK

SEQ ID NO: 472261 - protein, 9 aa, Homo Sapiens
TKGDVELAP

SEQ ID NO: 472262 - protein, 9 aa, Homo Sapiens
MCEQEEKMC

SEQ ID NO: 472263 - protein, 9 aa, Homo Sapiens
RMARAGDAR

SEQ ID NO: 472264 - protein, 9 aa, Homo Sapiens
FPRDKEFRP

SEQ ID NO: 472265 - protein, 9 aa, Homo Sapiens
TLEEMEEMG

SEQ ID NO: 472266 - protein, 9 aa, Homo Sapiens
NKHPKLRGT

SEQ ID NO: 472267 - protein, 9 aa, Homo Sapiens
LLHENLLMQ

SEQ ID NO: 472268 - protein, 9 aa, Homo Sapiens
MGFLQPVGA

SEQ ID NO: 472269 - protein, 9 aa, Homo Sapiens
KNKLSNHLF

SEQ ID NO: 472270 - protein, 9 aa, Homo Sapiens
YYSNTEFIM

SEQ ID NO: 472271 - protein, 9 aa, Homo Sapiens
TTPSSLSPE

SEQ ID NO: 472272 - protein, 9 aa, Homo Sapiens
EELVLKKSG

SEQ ID NO: 472273 - protein, 9 aa, Homo Sapiens
IPVTLSLIC

SEQ ID NO: 472274 - protein, 9 aa, Homo Sapiens
GRASPGQAS

SEQ ID NO: 472275 - protein, 9 aa, Homo Sapiens
GMPRRYIIA

SEQ ID NO: 472276 - protein, 9 aa, Homo Sapiens
IQGANNTHL

SEQ ID NO: 472277 - protein, 9 aa, Homo Sapiens
PVIREPPDH

SEQ ID NO: 472278 - protein, 9 aa, Homo Sapiens
FFKNPMCFF

SEQ ID NO: 472279 - protein, 9 aa, Homo Sapiens
CVGCGKSFS

SEQ ID NO: 472280 - protein, 9 aa, Homo Sapiens
PMVQNEGQV

SEQ ID NO: 472281 - protein, 9 aa, Homo Sapiens
LQASIEGDQ

SEQ ID NO: 472282 - protein, 9 aa, Homo Sapiens
ELLIESLEK

SEQ ID NO: 472283 - protein, 9 aa, Homo Sapiens
PLQLLLEGQ

SEQ ID NO: 472284 - protein, 9 aa, Homo Sapiens
SVERRSVST

SEQ ID NO: 472285 - protein, 9 aa, Homo Sapiens
HLDRRGSVI

SEQ ID NO: 472286 - protein, 9 aa, Homo Sapiens
KCSYSRNDI

SEQ ID NO: 472287 - protein, 9 aa, Homo Sapiens
NKRLKNISL

SEQ ID NO: 472288 - protein, 9 aa, Homo Sapiens
RSESNPRQN

SEQ ID NO: 472289 - protein, 9 aa, Homo Sapiens
TAGKKSSAL

SEQ ID NO: 472290 - protein, 9 aa, Homo Sapiens
KKDTSGNQA

SEQ ID NO: 472291 - protein, 9 aa, Homo Sapiens
ETMPRINSA

SEQ ID NO: 472292 - protein, 9 aa, Homo Sapiens
WMRQLVCFQ

SEQ ID NO: 472293 - protein, 9 aa, Homo Sapiens
EGDQPIFVQ

SEQ ID NO: 472294 - protein, 9 aa, Homo Sapiens
LSPESTTFH

SEQ ID NO: 472295 - protein, 9 aa, Homo Sapiens
GFFRIIYSL

SEQ ID NO: 472296 - protein, 9 aa, Homo Sapiens
SPCFKGEAG

SEQ ID NO: 472297 - protein, 9 aa, Homo Sapiens
AISCEHPGV

SEQ ID NO: 472298 - protein, 9 aa, Homo Sapiens
KTHPTDTIL

SEQ ID NO: 472299 - protein, 9 aa, Homo Sapiens
YIILTGPSI

SEQ ID NO: 472300 - protein, 9 aa, Homo Sapiens
GRLVCEAPT

SEQ ID NO: 472301 - protein, 9 aa, Homo Sapiens
GDVELAPSW

SEQ ID NO: 472302 - protein, 9 aa, Homo Sapiens
SQSAFALLP

SEQ ID NO: 472303 - protein, 9 aa, Homo Sapiens
GAIRLLKIL

SEQ ID NO: 472304 - protein, 9 aa, Homo Sapiens
RVIKSLQVV

SEQ ID NO: 472305 - protein, 9 aa, Homo Sapiens
ICRPLHYAI

SEQ ID NO: 472306 - protein, 9 aa, Homo Sapiens
RMPFKPREA

SEQ ID NO: 472307 - protein, 9 aa, Homo Sapiens
VGCRPIVCA

SEQ ID NO: 472308 - protein, 9 aa, Homo Sapiens
RINSAAAGN

SEQ ID NO: 472309 - protein, 9 aa, Homo Sapiens
TIWKCWDYG

SEQ ID NO: 472310 - protein, 9 aa, Homo Sapiens
GVNTKKDTS

SEQ ID NO: 472311 - protein, 9 aa, Homo Sapiens
LRASFQASK

SEQ ID NO: 472312 - protein, 9 aa, Homo Sapiens
TRGPGRVSW

SEQ ID NO: 472313 - protein, 9 aa, Homo Sapiens
AAPAIPYLQ

SEQ ID NO: 472314 - protein, 9 aa, Homo Sapiens
LCFHLGIWP

SEQ ID NO: 472315 - protein, 9 aa, Homo Sapiens
PAEPQSGEG

SEQ ID NO: 472316 - protein, 9 aa, Homo Sapiens
AYDSTHLVK

SEQ ID NO: 472317 - protein, 9 aa, Homo Sapiens
FASMVTKKL

SEQ ID NO: 472318 - protein, 9 aa, Homo Sapiens
AVALGGHPL

SEQ ID NO: 472319 - protein, 9 aa, Homo Sapiens
RDQCETQCQ

SEQ ID NO: 472320 - protein, 9 aa, Homo Sapiens
AFVIVVENA

SEQ ID NO: 472321 - protein, 9 aa, Homo Sapiens
LCDVEIKEN

SEQ ID NO: 472322 - protein, 9 aa, Homo Sapiens
SSANRTTQR

SEQ ID NO: 472323 - protein, 9 aa, Homo Sapiens
NRHYYSITV

SEQ ID NO: 472324 - protein, 9 aa, Homo Sapiens
EQPGCGWFN

SEQ ID NO: 472325 - protein, 9 aa, Homo Sapiens
LLDQHAAHE

SEQ ID NO: 472326 - protein, 9 aa, Homo Sapiens
FSPSGGARL

SEQ ID NO: 472327 - protein, 9 aa, Homo Sapiens
IWVLLLPES

SEQ ID NO: 472328 - protein, 9 aa, Homo Sapiens
QSKWKAYDS

SEQ ID NO: 472329 - protein, 9 aa, Homo Sapiens
DPNTTVIVT

SEQ ID NO: 472330 - protein, 9 aa, Homo Sapiens
ISPGSTASE

SEQ ID NO: 472331 - protein, 9 aa, Homo Sapiens
ERRSVSTSP

SEQ ID NO: 472332 - protein, 9 aa, Homo Sapiens
PCALEELAS

SEQ ID NO: 472333 - protein, 9 aa, Homo Sapiens
KVRPSEENN

SEQ ID NO: 472334 - protein, 9 aa, Homo Sapiens
VESSISSSS

SEQ ID NO: 472335 - protein, 9 aa, Homo Sapiens
TRAYTLPIS

SEQ ID NO: 472336 - protein, 9 aa, Homo Sapiens
TACLICAKS

SEQ ID NO: 472337 - protein, 9 aa, Homo Sapiens
EAEEEALMG

SEQ ID NO: 472338 - protein, 9 aa, Homo Sapiens
LQSLFQSFS

SEQ ID NO: 472339 - protein, 9 aa, Homo Sapiens
PHPGTPMAH

SEQ ID NO: 472340 - protein, 9 aa, Homo Sapiens
PKNALIGRL

SEQ ID NO: 472341 - protein, 9 aa, Homo Sapiens
DLEVDQCCC

SEQ ID NO: 472342 - protein, 9 aa, Homo Sapiens
ENETPFEFV

SEQ ID NO: 472343 - protein, 9 aa, Homo Sapiens
FMSYARKVG

SEQ ID NO: 472344 - protein, 9 aa, Homo Sapiens
LDTSYKDYM

SEQ ID NO: 472345 - protein, 9 aa, Homo Sapiens
IQKSSLTCH

SEQ ID NO: 472346 - protein, 9 aa, Homo Sapiens
DSSQSAFAL

SEQ ID NO: 472347 - protein, 9 aa, Homo Sapiens
FYKYEECGK

SEQ ID NO: 472348 - protein, 9 aa, Homo Sapiens
HPKCYLETL

SEQ ID NO: 472349 - protein, 9 aa, Homo Sapiens
ISFENESFL

SEQ ID NO: 472350 - protein, 9 aa, Homo Sapiens
VVGAGATAL

SEQ ID NO: 472351 - protein, 9 aa, Homo Sapiens
QGKTGHPGP

SEQ ID NO: 472352 - protein, 9 aa, Homo Sapiens
HEVFVENEI

SEQ ID NO: 472353 - protein, 9 aa, Homo Sapiens
ITTPYRMLR

SEQ ID NO: 472354 - protein, 9 aa, Homo Sapiens
SMVTKKLHF

SEQ ID NO: 472355 - protein, 9 aa, Homo Sapiens
DVTQSTLET

SEQ ID NO: 472356 - protein, 9 aa, Homo Sapiens
PSLRRHIRR

SEQ ID NO: 472357 - protein, 9 aa, Homo Sapiens
CMDSNSSPE

SEQ ID NO: 472358 - protein, 9 aa, Homo Sapiens
PNTTVIVTA

SEQ ID NO: 472359 - protein, 9 aa, Homo Sapiens
DAKFNAYKF

SEQ ID NO: 472360 - protein, 9 aa, Homo Sapiens
KRVEKLEIF

SEQ ID NO: 472361 - protein, 9 aa, Homo Sapiens
WFLGVNTKK

SEQ ID NO: 472362 - protein, 9 aa, Homo Sapiens
VIVTAFKPH

SEQ ID NO: 472363 - protein, 9 aa, Homo Sapiens
EEKKDKKGL

SEQ ID NO: 472364 - protein, 9 aa, Homo Sapiens
LQPVGAICL

SEQ ID NO: 472365 - protein, 9 aa, Homo Sapiens
IKSLQVVDH

SEQ ID NO: 472366 - protein, 9 aa, Homo Sapiens
IIHEHSVPT

SEQ ID NO: 472367 - protein, 9 aa, Homo Sapiens
SEVLYSVQS

SEQ ID NO: 472368 - protein, 9 aa, Homo Sapiens
KHELHAGTE

SEQ ID NO: 472369 - protein, 9 aa, Homo Sapiens
VQAVASVER

SEQ ID NO: 472370 - protein, 9 aa, Homo Sapiens
LQELPDSVP

SEQ ID NO: 472371 - protein, 9 aa, Homo Sapiens
FENIIMQFV

SEQ ID NO: 472372 - protein, 9 aa, Homo Sapiens
HGTGFKSFG

SEQ ID NO: 472373 - protein, 9 aa, Homo Sapiens
TKQKFDYLY

SEQ ID NO: 472374 - protein, 9 aa, Homo Sapiens
NHEPVKKFK

SEQ ID NO: 472375 - protein, 9 aa, Homo Sapiens
VKRATLSWE

SEQ ID NO: 472376 - protein, 9 aa, Homo Sapiens
LSNHLFVFQ

SEQ ID NO: 472377 - protein, 9 aa, Homo Sapiens
PAMPSASTT

SEQ ID NO: 472378 - protein, 9 aa, Homo Sapiens
RLNSTTFPS

SEQ ID NO: 472379 - protein, 9 aa, Homo Sapiens
DTLIEESYK

SEQ ID NO: 472380 - protein, 9 aa, Homo Sapiens
PNKHISKTE

SEQ ID NO: 472381 - protein, 9 aa, Homo Sapiens
TQNLTVVEG

SEQ ID NO: 472382 - protein, 9 aa, Homo Sapiens
HDGEDEEED

SEQ ID NO: 472383 - protein, 9 aa, Homo Sapiens
VLGANLSLS

SEQ ID NO: 472384 - protein, 9 aa, Homo Sapiens
GDEDDTDFF

SEQ ID NO: 472385 - protein, 9 aa, Homo Sapiens
SRDKRFRSD

SEQ ID NO: 472386 - protein, 9 aa, Homo Sapiens
GSLLGRLWL

SEQ ID NO: 472387 - protein, 9 aa, Homo Sapiens
LETMPRINS

SEQ ID NO: 472388 - protein, 9 aa, Homo Sapiens
NSLIYSLRS

SEQ ID NO: 472389 - protein, 9 aa, Homo Sapiens
GLLLIQKFS

SEQ ID NO: 472390 - protein, 9 aa, Homo Sapiens
KKCSLASYM

SEQ ID NO: 472391 - protein, 9 aa, Homo Sapiens
SPVDLENHE

SEQ ID NO: 472392 - protein, 9 aa, Homo Sapiens
VTLSLICFL

SEQ ID NO: 472393 - protein, 9 aa, Homo Sapiens
RRGKNHVSN

SEQ ID NO: 472394 - protein, 9 aa, Homo Sapiens
PNPNKHISK

SEQ ID NO: 472395 - protein, 9 aa, Homo Sapiens
KCSLASYMT

SEQ ID NO: 472396 - protein, 9 aa, Homo Sapiens
NNTRAYTLP

SEQ ID NO: 472397 - protein, 9 aa, Homo Sapiens
DQSVNVTDR

SEQ ID NO: 472398 - protein, 9 aa, Homo Sapiens
GHKRFCLWR

SEQ ID NO: 472399 - protein, 9 aa, Homo Sapiens
ISSQRYTFS

SEQ ID NO: 472400 - protein, 9 aa, Homo Sapiens
YVGVPRGKI

SEQ ID NO: 472401 - protein, 9 aa, Homo Sapiens
VLGTPGEIT

SEQ ID NO: 472402 - protein, 9 aa, Homo Sapiens
DPEDINHTS

SEQ ID NO: 472403 - protein, 9 aa, Homo Sapiens
RIVCFFLHP

SEQ ID NO: 472404 - protein, 9 aa, Homo Sapiens
VQQQHQLCG

SEQ ID NO: 472405 - protein, 9 aa, Homo Sapiens
PRDPPTSAS

SEQ ID NO: 472406 - protein, 9 aa, Homo Sapiens
VEKCCKSDD

SEQ ID NO: 472407 - protein, 9 aa, Homo Sapiens
SPGQASPAQ

SEQ ID NO: 472408 - protein, 9 aa, Homo Sapiens
MQFVKRLSE

SEQ ID NO: 472409 - protein, 9 aa, Homo Sapiens
GSAVLKIEE

SEQ ID NO: 472410 - protein, 9 aa, Homo Sapiens
EPAEGGGGN

SEQ ID NO: 472411 - protein, 9 aa, Homo Sapiens
CWFVFKETT

SEQ ID NO: 472412 - protein, 9 aa, Homo Sapiens
AMSCEETMP

SEQ ID NO: 472413 - protein, 9 aa, Homo Sapiens
NNIENETPF

SEQ ID NO: 472414 - protein, 9 aa, Homo Sapiens
EERKIPAHR

SEQ ID NO: 472415 - protein, 9 aa, Homo Sapiens
CYLETLSLE

SEQ ID NO: 472416 - protein, 9 aa, Homo Sapiens
DKRFRSDVH

SEQ ID NO: 472417 - protein, 9 aa, Homo Sapiens
APGKRKFNC

SEQ ID NO: 472418 - protein, 9 aa, Homo Sapiens
FKPREAAPA

SEQ ID NO: 472419 - protein, 9 aa, Homo Sapiens
TCFGMPRRY

SEQ ID NO: 472420 - protein, 9 aa, Homo Sapiens
EEQTFPLGL

SEQ ID NO: 472421 - protein, 9 aa, Homo Sapiens
INKALDAKL

SEQ ID NO: 472422 - protein, 9 aa, Homo Sapiens
VSQTNQIQT

SEQ ID NO: 472423 - protein, 9 aa, Homo Sapiens
HVSLKLGDV

SEQ ID NO: 472424 - protein, 9 aa, Homo Sapiens
GRVEISHGG

SEQ ID NO: 472425 - protein, 9 aa, Homo Sapiens
EKFYKYEEC

SEQ ID NO: 472426 - protein, 9 aa, Homo Sapiens
GDDKDACRD

SEQ ID NO: 472427 - protein, 9 aa, Homo Sapiens
LYPVHVSGR

SEQ ID NO: 472428 - protein, 9 aa, Homo Sapiens
EDLLHENLL

SEQ ID NO: 472429 - protein, 9 aa, Homo Sapiens
IYNYLNRIV

SEQ ID NO: 472430 - protein, 9 aa, Homo Sapiens
NMLNKHPKL

SEQ ID NO: 472431 - protein, 9 aa, Homo Sapiens
HFHQGDSEL

SEQ ID NO: 472432 - protein, 9 aa, Homo Sapiens
VGAGATALV

SEQ ID NO: 472433 - protein, 9 aa, Homo Sapiens
ADEEASLGL

SEQ ID NO: 472434 - protein, 9 aa, Homo Sapiens
AAEKSAGDT

SEQ ID NO: 472435 - protein, 9 aa, Homo Sapiens
GSACATLVE

SEQ ID NO: 472436 - protein, 9 aa, Homo Sapiens
NLKELFQED

SEQ ID NO: 472437 - protein, 9 aa, Homo Sapiens
HPKLRGTDL

SEQ ID NO: 472438 - protein, 9 aa, Homo Sapiens
YSLLLGGSL

SEQ ID NO: 472439 - protein, 9 aa, Homo Sapiens
HPVIREPPD

SEQ ID NO: 472440 - protein, 9 aa, Homo Sapiens
LLQARLCFH

SEQ ID NO: 472441 - protein, 9 aa, Homo Sapiens
PTPICQKLD

SEQ ID NO: 472442 - protein, 9 aa, Homo Sapiens
KGTKKAVEQ

SEQ ID NO: 472443 - protein, 9 aa, Homo Sapiens
PWSVYSSTC

SEQ ID NO: 472444 - protein, 9 aa, Homo Sapiens
GTQSRHREI

SEQ ID NO: 472445 - protein, 9 aa, Homo Sapiens
QSTLETPSP

SEQ ID NO: 472446 - protein, 9 aa, Homo Sapiens
LQPPLAYQM

SEQ ID NO: 472447 - protein, 9 aa, Homo Sapiens
QSAFALLPL

SEQ ID NO: 472448 - protein, 9 aa, Homo Sapiens
YLVRHKTIH

SEQ ID NO: 472449 - protein, 9 aa, Homo Sapiens
LNKMFCPLA

SEQ ID NO: 472450 - protein, 9 aa, Homo Sapiens
SSFVDSSQS

SEQ ID NO: 472451 - protein, 9 aa, Homo Sapiens
HEHSVPTIN

SEQ ID NO: 472452 - protein, 9 aa, Homo Sapiens
YYSITVNYR

SEQ ID NO: 472453 - protein, 9 aa, Homo Sapiens
IIFVSFFTL

SEQ ID NO: 472454 - protein, 9 aa, Homo Sapiens
LVSVGSLLG

SEQ ID NO: 472455 - protein, 9 aa, Homo Sapiens
ELLLVLISL

SEQ ID NO: 472456 - protein, 9 aa, Homo Sapiens
NYIILTGPS

SEQ ID NO: 472457 - protein, 9 aa, Homo Sapiens
EHTVAGELR

SEQ ID NO: 472458 - protein, 9 aa, Homo Sapiens
SVCVPVGCR

SEQ ID NO: 472459 - protein, 9 aa, Homo Sapiens
VGYILAKME

SEQ ID NO: 472460 - protein, 9 aa, Homo Sapiens
LVLLDQHAA

SEQ ID NO: 472461 - protein, 9 aa, Homo Sapiens
YQDENFPRD

SEQ ID NO: 472462 - protein, 9 aa, Homo Sapiens
GKSQVLMLT

SEQ ID NO: 472463 - protein, 9 aa, Homo Sapiens
RVEKLEIFP

SEQ ID NO: 472464 - protein, 9 aa, Homo Sapiens
MAYDSYAAV

SEQ ID NO: 472465 - protein, 9 aa, Homo Sapiens
EQLISNLAM

SEQ ID NO: 472466 - protein, 9 aa, Homo Sapiens
SPPCALEEL

SEQ ID NO: 472467 - protein, 9 aa, Homo Sapiens
DIWLFGALH

SEQ ID NO: 472468 - protein, 9 aa, Homo Sapiens
SCMDSNSSP

SEQ ID NO: 472469 - protein, 9 aa, Homo Sapiens
PETILTETP

SEQ ID NO: 472470 - protein, 9 aa, Homo Sapiens
SVNVTDRRL

SEQ ID NO: 472471 - protein, 9 aa, Homo Sapiens
RTQGVKCEE

SEQ ID NO: 472472 - protein, 9 aa, Homo Sapiens
SRRRSRSSY

SEQ ID NO: 472473 - protein, 9 aa, Homo Sapiens
ITVNYRKNE

SEQ ID NO: 472474 - protein, 9 aa, Homo Sapiens
QASIEGDQP

SEQ ID NO: 472475 - protein, 9 aa, Homo Sapiens
WRLQSPRDK

SEQ ID NO: 472476 - protein, 9 aa, Homo Sapiens
MIRVVSHSS

SEQ ID NO: 472477 - protein, 9 aa, Homo Sapiens
FARGKRRGK

SEQ ID NO: 472478 - protein, 9 aa, Homo Sapiens
VGESVDPFN

SEQ ID NO: 472479 - protein, 9 aa, Homo Sapiens
QSAIEDLAQ

SEQ ID NO: 472480 - protein, 9 aa, Homo Sapiens
VLGVPSTQG

SEQ ID NO: 472481 - protein, 9 aa, Homo Sapiens
VTEFTLLVL

SEQ ID NO: 472482 - protein, 9 aa, Homo Sapiens
IRGFASYFT

SEQ ID NO: 472483 - protein, 9 aa, Homo Sapiens
EFENIIMQF

SEQ ID NO: 472484 - protein, 9 aa, Homo Sapiens
AQIIFFHFA

SEQ ID NO: 472485 - protein, 9 aa, Homo Sapiens
MCFFPEHMV

SEQ ID NO: 472486 - protein, 9 aa, Homo Sapiens
CFISVKVPQ

SEQ ID NO: 472487 - protein, 9 aa, Homo Sapiens
CFGMPRRYI

SEQ ID NO: 472488 - protein, 9 aa, Homo Sapiens
YSRNDILLN

SEQ ID NO: 472489 - protein, 9 aa, Homo Sapiens
CKHVARILQ

SEQ ID NO: 472490 - protein, 9 aa, Homo Sapiens
ELQHPIITR

SEQ ID NO: 472491 - protein, 9 aa, Homo Sapiens
IRFFKILLD

SEQ ID NO: 472492 - protein, 9 aa, Homo Sapiens
YTVALGFFG

SEQ ID NO: 472493 - protein, 9 aa, Homo Sapiens
TSLIHGKIS

SEQ ID NO: 472494 - protein, 9 aa, Homo Sapiens
TFLMGFLQP

SEQ ID NO: 472495 - protein, 9 aa, Homo Sapiens
DKDACRDTE

SEQ ID NO: 472496 - protein, 9 aa, Homo Sapiens
DVTEFTLLV

SEQ ID NO: 472497 - protein, 9 aa, Homo Sapiens
FDYLYCCRE

SEQ ID NO: 472498 - protein, 9 aa, Homo Sapiens
PSWAQRYST

SEQ ID NO: 472499 - protein, 9 aa, Homo Sapiens
MEEMGKRYR

SEQ ID NO: 472500 - protein, 9 aa, Homo Sapiens
SHPGMANLH

SEQ ID NO: 472501 - protein, 9 aa, Homo Sapiens
WEELVLKKS

SEQ ID NO: 472502 - protein, 9 aa, Homo Sapiens
RGLRSALWQ

SEQ ID NO: 472503 - protein, 9 aa, Homo Sapiens
SYKDYMKLL

SEQ ID NO: 472504 - protein, 9 aa, Homo Sapiens
MDHPCKHVA

SEQ ID NO: 472505 - protein, 9 aa, Homo Sapiens
PPPAMPSAS

SEQ ID NO: 472506 - protein, 9 aa, Homo Sapiens
VIRSPLPTS

SEQ ID NO: 472507 - protein, 9 aa, Homo Sapiens
QPGCGWFND

SEQ ID NO: 472508 - protein, 9 aa, Homo Sapiens
SSTLQSLFQ

SEQ ID NO: 472509 - protein, 9 aa, Homo Sapiens
VGVEHTVAG

SEQ ID NO: 472510 - protein, 9 aa, Homo Sapiens
VEMAVAAGC

SEQ ID NO: 472511 - protein, 9 aa, Homo Sapiens
PREAAPAIP

SEQ ID NO: 472512 - protein, 9 aa, Homo Sapiens
GIDLRGYIA

SEQ ID NO: 472513 - protein, 9 aa, Homo Sapiens
PIITRYVRI

SEQ ID NO: 472514 - protein, 9 aa, Homo Sapiens
DDPEDINHT

SEQ ID NO: 472515 - protein, 9 aa, Homo Sapiens
CRHCTDFIW

SEQ ID NO: 472516 - protein, 9 aa, Homo Sapiens
TASRDKRFR

SEQ ID NO: 472517 - protein, 9 aa, Homo Sapiens
VALGFFGPL

SEQ ID NO: 472518 - protein, 9 aa, Homo Sapiens
VKSEKVTIK

SEQ ID NO: 472519 - protein, 9 aa, Homo Sapiens
FFLLIPSLR

SEQ ID NO: 472520 - protein, 9 aa, Homo Sapiens
LQPKLKSVL

SEQ ID NO: 472521 - protein, 9 aa, Homo Sapiens
FKLQDVSDS

SEQ ID NO: 472522 - protein, 9 aa, Homo Sapiens
DQKVRPSEE

SEQ ID NO: 472523 - protein, 9 aa, Homo Sapiens
TLETPSPSP

SEQ ID NO: 472524 - protein, 9 aa, Homo Sapiens
CFASMVTKK

SEQ ID NO: 472525 - protein, 9 aa, Homo Sapiens
ARVLGNLIA

SEQ ID NO: 472526 - protein, 9 aa, Homo Sapiens
NETPFEFVS

SEQ ID NO: 472527 - protein, 9 aa, Homo Sapiens
EKVESSISS

SEQ ID NO: 472528 - protein, 9 aa, Homo Sapiens
SPLPSCMDS

SEQ ID NO: 472529 - protein, 9 aa, Homo Sapiens
AFIQKSSLT

SEQ ID NO: 472530 - protein, 9 aa, Homo Sapiens
RYPIPLPDA

SEQ ID NO: 472531 - protein, 9 aa, Homo Sapiens
DHNVLGTPG

SEQ ID NO: 472532 - protein, 9 aa, Homo Sapiens
EGGGGNGSH

SEQ ID NO: 472533 - protein, 9 aa, Homo Sapiens
RLVCEAPTR

SEQ ID NO: 472534 - protein, 9 aa, Homo Sapiens
LACSDPDPK

SEQ ID NO: 472535 - protein, 9 aa, Homo Sapiens
STLETPSPS

SEQ ID NO: 472536 - protein, 9 aa, Homo Sapiens
AGQFTVLMQ

SEQ ID NO: 472537 - protein, 9 aa, Homo Sapiens
GGGHKWQNH

SEQ ID NO: 472538 - protein, 9 aa, Homo Sapiens
VSHSSVPLL

SEQ ID NO: 472539 - protein, 9 aa, Homo Sapiens
GEGCEEALG

SEQ ID NO: 472540 - protein, 9 aa, Homo Sapiens
RIAGDLGAG

SEQ ID NO: 472541 - protein, 9 aa, Homo Sapiens
CPENLTDSQ

SEQ ID NO: 472542 - protein, 9 aa, Homo Sapiens
CKSDDKETC

SEQ ID NO: 472543 - protein, 9 aa, Homo Sapiens
VLGNIWLIV

SEQ ID NO: 472544 - protein, 9 aa, Homo Sapiens
FNAYKFKWD

SEQ ID NO: 472545 - protein, 9 aa, Homo Sapiens
FWPAVTVEM

SEQ ID NO: 472546 - protein, 9 aa, Homo Sapiens
ISWRLQSPR

SEQ ID NO: 472547 - protein, 9 aa, Homo Sapiens
KETTWHGQG

SEQ ID NO: 472548 - protein, 9 aa, Homo Sapiens
NYLNRIVCF

SEQ ID NO: 472549 - protein, 9 aa, Homo Sapiens
LDLCFISVK

SEQ ID NO: 472550 - protein, 9 aa, Homo Sapiens
CVCPPRTQG

SEQ ID NO: 472551 - protein, 9 aa, Homo Sapiens
AVTVEMAVA

SEQ ID NO: 472552 - protein, 9 aa, Homo Sapiens
HELYERPPH

SEQ ID NO: 472553 - protein, 9 aa, Homo Sapiens
PGQKGTKKA

SEQ ID NO: 472554 - protein, 9 aa, Homo Sapiens
AEEEALMGP

SEQ ID NO: 472555 - protein, 9 aa, Homo Sapiens
VGPVNGWMY

SEQ ID NO: 472556 - protein, 9 aa, Homo Sapiens
LPLQLLLEG

SEQ ID NO: 472557 - protein, 9 aa, Homo Sapiens
RVFVAMVAV

SEQ ID NO: 472558 - protein, 9 aa, Homo Sapiens
LEECMLTSG

SEQ ID NO: 472559 - protein, 9 aa, Homo Sapiens
DETKPEDGI

SEQ ID NO: 472560 - protein, 9 aa, Homo Sapiens
SNTEFIMLV

SEQ ID NO: 472561 - protein, 9 aa, Homo Sapiens
TPICQKLDK

SEQ ID NO: 472562 - protein, 9 aa, Homo Sapiens
KSAGDTEAK

SEQ ID NO: 472563 - protein, 9 aa, Homo Sapiens
FGPSVRVPW

SEQ ID NO: 472564 - protein, 9 aa, Homo Sapiens
INSAAAGNP

SEQ ID NO: 472565 - protein, 9 aa, Homo Sapiens
SEDVLSVLG

SEQ ID NO: 472566 - protein, 9 aa, Homo Sapiens
REIVVDKYY

SEQ ID NO: 472567 - protein, 9 aa, Homo Sapiens
NIIMQFVKR

SEQ ID NO: 472568 - protein, 9 aa, Homo Sapiens
GVEHTVAGE

SEQ ID NO: 472569 - protein, 9 aa, Homo Sapiens
NPMCFFPEH

SEQ ID NO: 472570 - protein, 9 aa, Homo Sapiens
ENESFLDPI

SEQ ID NO: 472571 - protein, 9 aa, Homo Sapiens
GPQRLLPRY

SEQ ID NO: 472572 - protein, 9 aa, Homo Sapiens
RCCTGPQRL

SEQ ID NO: 472573 - protein, 9 aa, Homo Sapiens
ASDQSVNVT

SEQ ID NO: 472574 - protein, 9 aa, Homo Sapiens
AEGEPSWAL

SEQ ID NO: 472575 - protein, 9 aa, Homo Sapiens
NKALDAKLS

SEQ ID NO: 472576 - protein, 9 aa, Homo Sapiens
SPGSTASEE

SEQ ID NO: 472577 - protein, 9 aa, Homo Sapiens
YEDRLCDVE

SEQ ID NO: 472578 - protein, 9 aa, Homo Sapiens
DRLCDVEIK

SEQ ID NO: 472579 - protein, 9 aa, Homo Sapiens
QSVNVTDRR

SEQ ID NO: 472580 - protein, 9 aa, Homo Sapiens
LEIIPCSVL

SEQ ID NO: 472581 - protein, 9 aa, Homo Sapiens
SVGSLLGRL

SEQ ID NO: 472582 - protein, 9 aa, Homo Sapiens
QCICMPCYE

SEQ ID NO: 472583 - protein, 9 aa, Homo Sapiens
CIEQVKTCG

SEQ ID NO: 472584 - protein, 9 aa, Homo Sapiens
SASTTTPTS

SEQ ID NO: 472585 - protein, 9 aa, Homo Sapiens
TVTASDQSV

SEQ ID NO: 472586 - protein, 9 aa, Homo Sapiens
ILRIMCIGC

SEQ ID NO: 472587 - protein, 9 aa, Homo Sapiens
VHVSGRICF

SEQ ID NO: 472588 - protein, 9 aa, Homo Sapiens
GFQGKTGHP

SEQ ID NO: 472589 - protein, 9 aa, Homo Sapiens
LTVFVSERE

SEQ ID NO: 472590 - protein, 9 aa, Homo Sapiens
DEEEDDDYG

SEQ ID NO: 472591 - protein, 9 aa, Homo Sapiens
QFPLTQNLT

SEQ ID NO: 472592 - protein, 9 aa, Homo Sapiens
SGVTQGVVV

SEQ ID NO: 472593 - protein, 9 aa, Homo Sapiens
VVAEPEKVE

SEQ ID NO: 472594 - protein, 9 aa, Homo Sapiens
GPGEKHELH

SEQ ID NO: 472595 - protein, 9 aa, Homo Sapiens
SNLAMKEVI

SEQ ID NO: 472596 - protein, 9 aa, Homo Sapiens
HPAEPQSGE

SEQ ID NO: 472597 - protein, 9 aa, Homo Sapiens
AIPYLQGHA

SEQ ID NO: 472598 - protein, 9 aa, Homo Sapiens
SIDTQTTIG

SEQ ID NO: 472599 - protein, 9 aa, Homo Sapiens
PLTVFVSER

SEQ ID NO: 472600 - protein, 9 aa, Homo Sapiens
KNIEAIVSV

SEQ ID NO: 472601 - protein, 9 aa, Homo Sapiens
AGGPPSTGG

SEQ ID NO: 472602 - protein, 9 aa, Homo Sapiens
KNECSMLKL

SEQ ID NO: 472603 - protein, 9 aa, Homo Sapiens
TEPIYSSST

SEQ ID NO: 472604 - protein, 9 aa, Homo Sapiens
ETCRSESNP

SEQ ID NO: 472605 - protein, 9 aa, Homo Sapiens
KPSECSECG

SEQ ID NO: 472606 - protein, 9 aa, Homo Sapiens
EILRIMCIG

SEQ ID NO: 472607 - protein, 9 aa, Homo Sapiens
ETLSLESCG

SEQ ID NO: 472608 - protein, 9 aa, Homo Sapiens
HENLLMQDE

SEQ ID NO: 472609 - protein, 9 aa, Homo Sapiens
KCYLETLSL

SEQ ID NO: 472610 - protein, 9 aa, Homo Sapiens
ECGFWLRQF

SEQ ID NO: 472611 - protein, 9 aa, Homo Sapiens
EFIMLVIDS

SEQ ID NO: 472612 - protein, 9 aa, Homo Sapiens
YEQADEEAS

SEQ ID NO: 472613 - protein, 9 aa, Homo Sapiens
KDGLMGSPC

SEQ ID NO: 472614 - protein, 9 aa, Homo Sapiens
QVQQQHQLC

SEQ ID NO: 472615 - protein, 9 aa, Homo Sapiens
EWSPWSVYS

SEQ ID NO: 472616 - protein, 9 aa, Homo Sapiens
TDSIEGENN

SEQ ID NO: 472617 - protein, 9 aa, Homo Sapiens
NIWLIVIIK

SEQ ID NO: 472618 - protein, 9 aa, Homo Sapiens
IYTVALGFF

SEQ ID NO: 472619 - protein, 9 aa, Homo Sapiens
KTDGRKEEN

SEQ ID NO: 472620 - protein, 9 aa, Homo Sapiens
IQYSLDTDL

SEQ ID NO: 472621 - protein, 9 aa, Homo Sapiens
GKWAGGPPS

SEQ ID NO: 472622 - protein, 9 aa, Homo Sapiens
GCEEALGGA

SEQ ID NO: 472623 - protein, 9 aa, Homo Sapiens
RRRSRSSYT

SEQ ID NO: 472624 - protein, 9 aa, Homo Sapiens
LFQTSPMEI

SEQ ID NO: 472625 - protein, 9 aa, Homo Sapiens
PEQKARLLD

SEQ ID NO: 472626 - protein, 9 aa, Homo Sapiens
CSVLGHVFR

SEQ ID NO: 472627 - protein, 9 aa, Homo Sapiens
GEPSWALVF

SEQ ID NO: 472628 - protein, 9 aa, Homo Sapiens
IANSCVLTA

SEQ ID NO: 472629 - protein, 9 aa, Homo Sapiens
AQMVRYKLP

SEQ ID NO: 472630 - protein, 9 aa, Homo Sapiens
EDETKPEDG

SEQ ID NO: 472631 - protein, 9 aa, Homo Sapiens
LEQPGCGWF

SEQ ID NO: 472632 - protein, 9 aa, Homo Sapiens
LKKGDGLQL

SEQ ID NO: 472633 - protein, 9 aa, Homo Sapiens
YIWVLLLPE

SEQ ID NO: 472634 - protein, 9 aa, Homo Sapiens
SVLGANLSL

SEQ ID NO: 472635 - protein, 9 aa, Homo Sapiens
QTAVGLELQ

SEQ ID NO: 472636 - protein, 9 aa, Homo Sapiens
IEESYKDST

SEQ ID NO: 472637 - protein, 9 aa, Homo Sapiens
MAHPPHPGT

SEQ ID NO: 472638 - protein, 9 aa, Homo Sapiens
PAVTVEMAV

SEQ ID NO: 472639 - protein, 9 aa, Homo Sapiens
PVSARVIKS

SEQ ID NO: 472640 - protein, 9 aa, Homo Sapiens
MPFKPREAA

SEQ ID NO: 472641 - protein, 9 aa, Homo Sapiens
KKSSALVSH

SEQ ID NO: 472642 - protein, 9 aa, Homo Sapiens
VSYAVALSY

SEQ ID NO: 472643 - protein, 9 aa, Homo Sapiens
LHVYRNFFN

SEQ ID NO: 472644 - protein, 9 aa, Homo Sapiens
KWAGGPPST

SEQ ID NO: 472645 - protein, 9 aa, Homo Sapiens
LREALAAKE

SEQ ID NO: 472646 - protein, 9 aa, Homo Sapiens
AIEDLAQGS

SEQ ID NO: 472647 - protein, 9 aa, Homo Sapiens
FVCRLRHVS

SEQ ID NO: 472648 - protein, 9 aa, Homo Sapiens
VLKIEEVCI

SEQ ID NO: 472649 - protein, 9 aa, Homo Sapiens
TDYPQKFAM

SEQ ID NO: 472650 - protein, 9 aa, Homo Sapiens
SLDTDLLPY

SEQ ID NO: 472651 - protein, 9 aa, Homo Sapiens
QKFSHSSNN

SEQ ID NO: 472652 - protein, 9 aa, Homo Sapiens
ILVWAARQS

SEQ ID NO: 472653 - protein, 9 aa, Homo Sapiens
QWQSGCAVS

SEQ ID NO: 472654 - protein, 9 aa, Homo Sapiens
ITCCVSEST

SEQ ID NO: 472655 - protein, 9 aa, Homo Sapiens
KQKFDYLYC

SEQ ID NO: 472656 - protein, 9 aa, Homo Sapiens
QVPCFASMV

SEQ ID NO: 472657 - protein, 9 aa, Homo Sapiens
GCAVSLYME

SEQ ID NO: 472658 - protein, 9 aa, Homo Sapiens
SLASYMTNS

SEQ ID NO: 472659 - protein, 9 aa, Homo Sapiens
GLMGSPCFK

SEQ ID NO: 472660 - protein, 9 aa, Homo Sapiens
TSTPNVSQT

SEQ ID NO: 472661 - protein, 9 aa, Homo Sapiens
QLKDAAEKS

SEQ ID NO: 472662 - protein, 9 aa, Homo Sapiens
GAGAIRLLK

SEQ ID NO: 472663 - protein, 9 aa, Homo Sapiens
LQSPRDKLP

SEQ ID NO: 472664 - protein, 9 aa, Homo Sapiens
RLWLFPPGA

SEQ ID NO: 472665 - protein, 9 aa, Homo Sapiens
GNIGFMSYA

SEQ ID NO: 472666 - protein, 9 aa, Homo Sapiens
RFKLQDVSD

SEQ ID NO: 472667 - protein, 9 aa, Homo Sapiens
AAFLFSIDT

SEQ ID NO: 472668 - protein, 9 aa, Homo Sapiens
ASLVSVGSL

SEQ ID NO: 472669 - protein, 9 aa, Homo Sapiens
SKERPGKEQ

SEQ ID NO: 472670 - protein, 9 aa, Homo Sapiens
YSTSCASLV

SEQ ID NO: 472671 - protein, 9 aa, Homo Sapiens
CSYSRNDIL

SEQ ID NO: 472672 - protein, 9 aa, Homo Sapiens
TMDVATPSV

SEQ ID NO: 472673 - protein, 9 aa, Homo Sapiens
WTTLPTCIE

SEQ ID NO: 472674 - protein, 9 aa, Homo Sapiens
VQGKSQVLM

SEQ ID NO: 472675 - protein, 9 aa, Homo Sapiens
DFFSPSGGA

SEQ ID NO: 472676 - protein, 9 aa, Homo Sapiens
MIGFAHVFP

SEQ ID NO: 472677 - protein, 9 aa, Homo Sapiens
LLLPESQWA

SEQ ID NO: 472678 - protein, 9 aa, Homo Sapiens
YLNGLHEVL

SEQ ID NO: 472679 - protein, 9 aa, Homo Sapiens
FKFGPAPKT

SEQ ID NO: 472680 - protein, 9 aa, Homo Sapiens
KRFCLWRDC

SEQ ID NO: 472681 - protein, 9 aa, Homo Sapiens
VNEFYEQAD

SEQ ID NO: 472682 - protein, 9 aa, Homo Sapiens
VAWTTMDVA

SEQ ID NO: 472683 - protein, 9 aa, Homo Sapiens
PNDYLTLDA

SEQ ID NO: 472684 - protein, 9 aa, Homo Sapiens
NRVSLMRPQ

SEQ ID NO: 472685 - protein, 9 aa, Homo Sapiens
PTKTGASNL

SEQ ID NO: 472686 - protein, 9 aa, Homo Sapiens
NVLGTPGEI

SEQ ID NO: 472687 - protein, 9 aa, Homo Sapiens
FVEKCCKSD

SEQ ID NO: 472688 - protein, 9 aa, Homo Sapiens
DDKDACRDT

SEQ ID NO: 472689 - protein, 9 aa, Homo Sapiens
QGANNTHLE

SEQ ID NO: 472690 - protein, 9 aa, Homo Sapiens
QGDSELLIE

SEQ ID NO: 472691 - protein, 9 aa, Homo Sapiens
MMGDDKDAC

SEQ ID NO: 472692 - protein, 9 aa, Homo Sapiens
LTEPIYSSS

SEQ ID NO: 472693 - protein, 9 aa, Homo Sapiens
GCGWFNDPS

SEQ ID NO: 472694 - protein, 9 aa, Homo Sapiens
AIQWQSGCA

SEQ ID NO: 472695 - protein, 9 aa, Homo Sapiens
EHSVPTINS

SEQ ID NO: 472696 - protein, 9 aa, Homo Sapiens
LGSGGDEEA

SEQ ID NO: 472697 - protein, 9 aa, Homo Sapiens
LRGYIAWSL

SEQ ID NO: 472698 - protein, 9 aa, Homo Sapiens
HTPLKNFIM

SEQ ID NO: 472699 - protein, 9 aa, Homo Sapiens
IIMQFVKRL

SEQ ID NO: 472700 - protein, 9 aa, Homo Sapiens
LKNFIMSCA

SEQ ID NO: 472701 - protein, 9 aa, Homo Sapiens
KVPQSIANS

SEQ ID NO: 472702 - protein, 9 aa, Homo Sapiens
RVSWKNIKP

SEQ ID NO: 472703 - protein, 9 aa, Homo Sapiens
QEEPVKGFR

SEQ ID NO: 472704 - protein, 9 aa, Homo Sapiens
SGLGACELL

SEQ ID NO: 472705 - protein, 9 aa, Homo Sapiens
FKNPMCFFP

SEQ ID NO: 472706 - protein, 9 aa, Homo Sapiens
RGKRRGKNH

SEQ ID NO: 472707 - protein, 9 aa, Homo Sapiens
FLPYFIRGF

SEQ ID NO: 472708 - protein, 9 aa, Homo Sapiens
CFWPAVTVE

SEQ ID NO: 472709 - protein, 9 aa, Homo Sapiens
GPIILPIPP

SEQ ID NO: 472710 - protein, 9 aa, Homo Sapiens
FLSNLSFVE

SEQ ID NO: 472711 - protein, 9 aa, Homo Sapiens
QRYTFSNLS

SEQ ID NO: 472712 - protein, 9 aa, Homo Sapiens
PGEEQTFPL

SEQ ID NO: 472713 - protein, 9 aa, Homo Sapiens
ETKPEDGIP

SEQ ID NO: 472714 - protein, 9 aa, Homo Sapiens
VRNARLLSE

SEQ ID NO: 472715 - protein, 9 aa, Homo Sapiens
LASYMTNSP

SEQ ID NO: 472716 - protein, 9 aa, Homo Sapiens
VLLHVEHQQ

SEQ ID NO: 472717 - protein, 9 aa, Homo Sapiens
AFIQCSYLV

SEQ ID NO: 472718 - protein, 9 aa, Homo Sapiens
NTHLEEIVS

SEQ ID NO: 472719 - protein, 9 aa, Homo Sapiens
RSALWQVGR

SEQ ID NO: 472720 - protein, 9 aa, Homo Sapiens
GRLWLFPPG

SEQ ID NO: 472721 - protein, 9 aa, Homo Sapiens
LGLLIIRFF

SEQ ID NO: 472722 - protein, 9 aa, Homo Sapiens
RHYYSITVN

SEQ ID NO: 472723 - protein, 9 aa, Homo Sapiens
LLLLQARLC

SEQ ID NO: 472724 - protein, 9 aa, Homo Sapiens
LCEILRIMC

SEQ ID NO: 472725 - protein, 9 aa, Homo Sapiens
VKEWYVGVP

SEQ ID NO: 472726 - protein, 9 aa, Homo Sapiens
ESLNKGIAL

SEQ ID NO: 472727 - protein, 9 aa, Homo Sapiens
IMCIGCDHQ

SEQ ID NO: 472728 - protein, 9 aa, Homo Sapiens
GASNLKELF

SEQ ID NO: 472729 - protein, 9 aa, Homo Sapiens
IENLKNELQ

SEQ ID NO: 472730 - protein, 9 aa, Homo Sapiens
RAIQWQSGC

SEQ ID NO: 472731 - protein, 9 aa, Homo Sapiens
PSSEVLYSV

SEQ ID NO: 472732 - protein, 9 aa, Homo Sapiens
PLLYPVHVS

SEQ ID NO: 472733 - protein, 9 aa, Homo Sapiens
VFVENEIVD

SEQ ID NO: 472734 - protein, 9 aa, Homo Sapiens
QGEAGRIAG

SEQ ID NO: 472735 - protein, 9 aa, Homo Sapiens
EVRMIGFAH

SEQ ID NO: 472736 - protein, 9 aa, Homo Sapiens
MPVEAIHLC

SEQ ID NO: 472737 - protein, 9 aa, Homo Sapiens
LQAEAGNYS

SEQ ID NO: 472738 - protein, 9 aa, Homo Sapiens
FLMGFLQPV

SEQ ID NO: 472739 - protein, 9 aa, Homo Sapiens
ADQEDIFVV

SEQ ID NO: 472740 - protein, 9 aa, Homo Sapiens
CPPRTQGVK

SEQ ID NO: 472741 - protein, 9 aa, Homo Sapiens
GADGAAPAG

SEQ ID NO: 472742 - protein, 9 aa, Homo Sapiens
ITKGDVELA

SEQ ID NO: 472743 - protein, 9 aa, Homo Sapiens
ANRTTQREN

SEQ ID NO: 472744 - protein, 9 aa, Homo Sapiens
KPGIIPSQS

SEQ ID NO: 472745 - protein, 9 aa, Homo Sapiens
ILNNTRAYT

SEQ ID NO: 472746 - protein, 9 aa, Homo Sapiens
WYVGVPRGK

SEQ ID NO: 472747 - protein, 9 aa, Homo Sapiens
KWKAYDSTH

SEQ ID NO: 472748 - protein, 9 aa, Homo Sapiens
TMPRINSAA

SEQ ID NO: 472749 - protein, 9 aa, Homo Sapiens
VAEPEKVES

SEQ ID NO: 472750 - protein, 9 aa, Homo Sapiens
KIVGYILAK

SEQ ID NO: 472751 - protein, 9 aa, Homo Sapiens
SFVDSSQSA

SEQ ID NO: 472752 - protein, 9 aa, Homo Sapiens
IDTQTTIGY

SEQ ID NO: 472753 - protein, 9 aa, Homo Sapiens
SEESEKFRT

SEQ ID NO: 472754 - protein, 9 aa, Homo Sapiens
PEKVESSIS

SEQ ID NO: 472755 - protein, 9 aa, Homo Sapiens
IFFHFAGGA

SEQ ID NO: 472756 - protein, 9 aa, Homo Sapiens
STGGHGPLS

SEQ ID NO: 472757 - protein, 9 aa, Homo Sapiens
PKCYLETLS

SEQ ID NO: 472758 - protein, 9 aa, Homo Sapiens
AGAIRLLKI

SEQ ID NO: 472759 - protein, 9 aa, Homo Sapiens
PQRLLPRYS

SEQ ID NO: 472760 - protein, 9 aa, Homo Sapiens
RSITSATTL

SEQ ID NO: 472761 - protein, 9 aa, Homo Sapiens
GNLLVLLDQ

SEQ ID NO: 472762 - protein, 9 aa, Homo Sapiens
SMLSQLASH

SEQ ID NO: 472763 - protein, 9 aa, Homo Sapiens
GDVAVLIVD

SEQ ID NO: 472764 - protein, 9 aa, Homo Sapiens
LGACELLLV

SEQ ID NO: 472765 - protein, 9 aa, Homo Sapiens
KPREAAPAI

SEQ ID NO: 472766 - protein, 9 aa, Homo Sapiens
SCEHPGVPA

SEQ ID NO: 472767 - protein, 9 aa, Homo Sapiens
PRDKEFRPE

SEQ ID NO: 472768 - protein, 9 aa, Homo Sapiens
SSALVSHCL

SEQ ID NO: 472769 - protein, 9 aa, Homo Sapiens
LETLSLESC

SEQ ID NO: 472770 - protein, 9 aa, Homo Sapiens
TLSLESCGL

SEQ ID NO: 472771 - protein, 9 aa, Homo Sapiens
KSAKSATSH

SEQ ID NO: 472772 - protein, 9 aa, Homo Sapiens
DIMIPMVQN

SEQ ID NO: 472773 - protein, 9 aa, Homo Sapiens
ELDTSYKDY

SEQ ID NO: 472774 - protein, 9 aa, Homo Sapiens
DFIEGFCCA

SEQ ID NO: 472775 - protein, 9 aa, Homo Sapiens
CMAQIIFFH

SEQ ID NO: 472776 - protein, 9 aa, Homo Sapiens
EQKARLLDP

SEQ ID NO: 472777 - protein, 9 aa, Homo Sapiens
EVEVRMIGF

SEQ ID NO: 472778 - protein, 9 aa, Homo Sapiens
RQSAIEDLA

SEQ ID NO: 472779 - protein, 9 aa, Homo Sapiens
FKCVGCGKS

SEQ ID NO: 472780 - protein, 9 aa, Homo Sapiens
SPEQKARLL

SEQ ID NO: 472781 - protein, 9 aa, Homo Sapiens
QDVSDSFKK

SEQ ID NO: 472782 - protein, 9 aa, Homo Sapiens
HLFVFQGAG

SEQ ID NO: 472783 - protein, 9 aa, Homo Sapiens
KEENRGEHP

SEQ ID NO: 472784 - protein, 9 aa, Homo Sapiens
YAIIMNQRL

SEQ ID NO: 472785 - protein, 9 aa, Homo Sapiens
HELQHPIIT

SEQ ID NO: 472786 - protein, 9 aa, Homo Sapiens
CKTCEQFEA

SEQ ID NO: 472787 - protein, 9 aa, Homo Sapiens
GYILAKMEE

SEQ ID NO: 472788 - protein, 9 aa, Homo Sapiens
SVAWTTMDV

SEQ ID NO: 472789 - protein, 9 aa, Homo Sapiens
LKIEEVCIE

SEQ ID NO: 472790 - protein, 9 aa, Homo Sapiens
VTIKTDGRK

SEQ ID NO: 472791 - protein, 9 aa, Homo Sapiens
KERPGKEQL

SEQ ID NO: 472792 - protein, 9 aa, Homo Sapiens
QRQSAIEDL

SEQ ID NO: 472793 - protein, 9 aa, Homo Sapiens
PDWHLKMAK

SEQ ID NO: 472794 - protein, 9 aa, Homo Sapiens
WSNPTPICQ

SEQ ID NO: 472795 - protein, 9 aa, Homo Sapiens
VTVEMAVAA

SEQ ID NO: 472796 - protein, 9 aa, Homo Sapiens
RQYNRVSLM

SEQ ID NO: 472797 - protein, 9 aa, Homo Sapiens
PAEGGGGNG

SEQ ID NO: 472798 - protein, 9 aa, Homo Sapiens
EECGITSTC

SEQ ID NO: 472799 - protein, 9 aa, Homo Sapiens
APAIPYLQG

SEQ ID NO: 472800 - protein, 9 aa, Homo Sapiens
AQPDGASAD

SEQ ID NO: 472801 - protein, 9 aa, Homo Sapiens
EDGKIVGYI

SEQ ID NO: 472802 - protein, 9 aa, Homo Sapiens
SCSVQTDNH

SEQ ID NO: 472803 - protein, 9 aa, Homo Sapiens
KDIMKNECS

SEQ ID NO: 472804 - protein, 9 aa, Homo Sapiens
GTGDVAVLI

SEQ ID NO: 472805 - protein, 9 aa, Homo Sapiens
GIIPSQSTY

SEQ ID NO: 472806 - protein, 9 aa, Homo Sapiens
SVRVPWFIS

SEQ ID NO: 472807 - protein, 9 aa, Homo Sapiens
RRSRIIFTE

SEQ ID NO: 472808 - protein, 9 aa, Homo Sapiens
LSNLSFVEL

SEQ ID NO: 472809 - protein, 9 aa, Homo Sapiens
YILAKMEEE

SEQ ID NO: 472810 - protein, 9 aa, Homo Sapiens
HREIVVDKY

SEQ ID NO: 472811 - protein, 9 aa, Homo Sapiens
ARVIKSLQV

SEQ ID NO: 472812 - protein, 9 aa, Homo Sapiens
ATTLYDRYS

SEQ ID NO: 472813 - protein, 9 aa, Homo Sapiens
RHASLVTVF

SEQ ID NO: 472814 - protein, 9 aa, Homo Sapiens
HSVMCKTCE

SEQ ID NO: 472815 - protein, 9 aa, Homo Sapiens
GPRDPPTSA

SEQ ID NO: 472816 - protein, 9 aa, Homo Sapiens
TGECVCPPR

SEQ ID NO: 472817 - protein, 9 aa, Homo Sapiens
NIIKILNNT

SEQ ID NO: 472818 - protein, 9 aa, Homo Sapiens
AYQMNTSSW

SEQ ID NO: 472819 - protein, 9 aa, Homo Sapiens
VGCGKSFSY

SEQ ID NO: 472820 - protein, 9 aa, Homo Sapiens
LLMQDEIAR

SEQ ID NO: 472821 - protein, 9 aa, Homo Sapiens
TVLGNIWLI

SEQ ID NO: 472822 - protein, 9 aa, Homo Sapiens
EENRGEHPQ

SEQ ID NO: 472823 - protein, 9 aa, Homo Sapiens
PFKPREAAP

SEQ ID NO: 472824 - protein, 9 aa, Homo Sapiens
APSWAQRYS

SEQ ID NO: 472825 - protein, 9 aa, Homo Sapiens
TYIWVLLLP

SEQ ID NO: 472826 - protein, 9 aa, Homo Sapiens
IQGFTIWKC

SEQ ID NO: 472827 - protein, 9 aa, Homo Sapiens
ECGITSTCC

SEQ ID NO: 472828 - protein, 9 aa, Homo Sapiens
WLVARINKA

SEQ ID NO: 472829 - protein, 9 aa, Homo Sapiens
AGFIIYTVA

SEQ ID NO: 472830 - protein, 9 aa, Homo Sapiens
PKCLAISCE

SEQ ID NO: 472831 - protein, 9 aa, Homo Sapiens
EDVLSVLGA

SEQ ID NO: 472832 - protein, 9 aa, Homo Sapiens
ELRMEAEEE

SEQ ID NO: 472833 - protein, 9 aa, Homo Sapiens
LLEGQWHHI

SEQ ID NO: 472834 - protein, 9 aa, Homo Sapiens
YSLDTDLLP

SEQ ID NO: 472835 - protein, 9 aa, Homo Sapiens
ELQPKLKSV

SEQ ID NO: 472836 - protein, 9 aa, Homo Sapiens
HIPELENNE

SEQ ID NO: 472837 - protein, 9 aa, Homo Sapiens
NVTVLGNIW

SEQ ID NO: 472838 - protein, 9 aa, Homo Sapiens
EPQSGEGVP

SEQ ID NO: 472839 - protein, 9 aa, Homo Sapiens
LTVVEGGTA

SEQ ID NO: 472840 - protein, 9 aa, Homo Sapiens
IWSNPTPIC

SEQ ID NO: 472841 - protein, 9 aa, Homo Sapiens
AHPPHPGTP

SEQ ID NO: 472842 - protein, 9 aa, Homo Sapiens
YSCSVQTDN

SEQ ID NO: 472843 - protein, 9 aa, Homo Sapiens
DKKGLKKGD

SEQ ID NO: 472844 - protein, 9 aa, Homo Sapiens
QRLLPRYSE

SEQ ID NO: 472845 - protein, 9 aa, Homo Sapiens
GGAHPGDGR

SEQ ID NO: 472846 - protein, 9 aa, Homo Sapiens
MDVATPSVH

SEQ ID NO: 472847 - protein, 9 aa, Homo Sapiens
SYARKVGAV

SEQ ID NO: 472848 - protein, 9 aa, Homo Sapiens
RSRIIFTEL

SEQ ID NO: 472849 - protein, 9 aa, Homo Sapiens
KSDDKETCF

SEQ ID NO: 472850 - protein, 9 aa, Homo Sapiens
FNNIENETP

SEQ ID NO: 472851 - protein, 9 aa, Homo Sapiens
VCPPRTQGV

SEQ ID NO: 472852 - protein, 9 aa, Homo Sapiens
SRPTASRDK

SEQ ID NO: 472853 - protein, 9 aa, Homo Sapiens
IGRLVCEAP

SEQ ID NO: 472854 - protein, 9 aa, Homo Sapiens
KQPTFCRHC

SEQ ID NO: 472855 - protein, 9 aa, Homo Sapiens
ASFQASKRN

SEQ ID NO: 472856 - protein, 9 aa, Homo Sapiens
VDPFNQTLT

SEQ ID NO: 472857 - protein, 9 aa, Homo Sapiens
YISSNYVAE

SEQ ID NO: 472858 - protein, 9 aa, Homo Sapiens
IWKCWDYGI

SEQ ID NO: 472859 - protein, 9 aa, Homo Sapiens
SESNPRQNQ

SEQ ID NO: 472860 - protein, 9 aa, Homo Sapiens
ECMLTSGCC

SEQ ID NO: 472861 - protein, 9 aa, Homo Sapiens
LISNLAMKE

SEQ ID NO: 472862 - protein, 9 aa, Homo Sapiens
CIIENLKNE

SEQ ID NO: 472863 - protein, 9 aa, Homo Sapiens
DSYAAVCHP

SEQ ID NO: 472864 - protein, 9 aa, Homo Sapiens
KDAAEKSAG

SEQ ID NO: 472865 - protein, 9 aa, Homo Sapiens
QKFDYLYCC

SEQ ID NO: 472866 - protein, 9 aa, Homo Sapiens
VQRTTEGLT

SEQ ID NO: 472867 - protein, 9 aa, Homo Sapiens
ISNTAGGET

SEQ ID NO: 472868 - protein, 9 aa, Homo Sapiens
LQDVSDSFK

SEQ ID NO: 472869 - protein, 9 aa, Homo Sapiens
AMPSASTTT

SEQ ID NO: 472870 - protein, 9 aa, Homo Sapiens
ELQASIEGD

SEQ ID NO: 472871 - protein, 9 aa, Homo Sapiens
NEGQVASDM

SEQ ID NO: 472872 - protein, 9 aa, Homo Sapiens
DLENHEPVK

SEQ ID NO: 472873 - protein, 9 aa, Homo Sapiens
TTTPSSLSP

SEQ ID NO: 472874 - protein, 9 aa, Homo Sapiens
KGLKKGDGL

SEQ ID NO: 472875 - protein, 9 aa, Homo Sapiens
SSKVPVIVL

SEQ ID NO: 472876 - protein, 9 aa, Homo Sapiens
VAQPDGASA

SEQ ID NO: 472877 - protein, 9 aa, Homo Sapiens
KRFRSDVHT

SEQ ID NO: 472878 - protein, 9 aa, Homo Sapiens
ALGGAKASS

SEQ ID NO: 472879 - protein, 9 aa, Homo Sapiens
FQCICMPCY

SEQ ID NO: 472880 - protein, 9 aa, Homo Sapiens
REKMMAAKG

SEQ ID NO: 472881 - protein, 9 aa, Homo Sapiens
ECAKAFSKF

SEQ ID NO: 472882 - protein, 9 aa, Homo Sapiens
RQPETILTE

SEQ ID NO: 472883 - protein, 9 aa, Homo Sapiens
IIKILNNTR

SEQ ID NO: 472884 - protein, 9 aa, Homo Sapiens
EPEKVESSI

SEQ ID NO: 472885 - protein, 9 aa, Homo Sapiens
KEDLHPAEP

SEQ ID NO: 472886 - protein, 9 aa, Homo Sapiens
IIYTVALGF

SEQ ID NO: 472887 - protein, 9 aa, Homo Sapiens
KATCRCASR

SEQ ID NO: 472888 - protein, 9 aa, Homo Sapiens
YPIPLPDAK

SEQ ID NO: 472889 - protein, 9 aa, Homo Sapiens
DPLTVFVSE

SEQ ID NO: 472890 - protein, 9 aa, Homo Sapiens
HSVPTINSN

SEQ ID NO: 472891 - protein, 9 aa, Homo Sapiens
QRDQCETQC

SEQ ID NO: 472892 - protein, 9 aa, Homo Sapiens
QDDPRASSA

SEQ ID NO: 472893 - protein, 9 aa, Homo Sapiens
LQGFFGPSV

SEQ ID NO: 472894 - protein, 9 aa, Homo Sapiens
YAVALSYQC

SEQ ID NO: 472895 - protein, 9 aa, Homo Sapiens
LITHGYGTP

SEQ ID NO: 472896 - protein, 9 aa, Homo Sapiens
NITDPLTVF

SEQ ID NO: 472897 - protein, 9 aa, Homo Sapiens
VLLLPESQW

SEQ ID NO: 472898 - protein, 9 aa, Homo Sapiens
KVPVIVLKL

SEQ ID NO: 472899 - protein, 9 aa, Homo Sapiens
KVESSISSS

SEQ ID NO: 472900 - protein, 9 aa, Homo Sapiens
TCIIENLKN

SEQ ID NO: 472901 - protein, 9 aa, Homo Sapiens
FAGKDERLL

SEQ ID NO: 472902 - protein, 9 aa, Homo Sapiens
IERYPIPLP

SEQ ID NO: 472903 - protein, 9 aa, Homo Sapiens
CRSMSCGLS

SEQ ID NO: 472904 - protein, 9 aa, Homo Sapiens
SSSTLQSLF

SEQ ID NO: 472905 - protein, 9 aa, Homo Sapiens
SRCPTGCSS

SEQ ID NO: 472906 - protein, 9 aa, Homo Sapiens
FIQCSYLVR

SEQ ID NO: 472907 - protein, 9 aa, Homo Sapiens
VSFFTLNLF

SEQ ID NO: 472908 - protein, 9 aa, Homo Sapiens
IEISFENES

SEQ ID NO: 472909 - protein, 9 aa, Homo Sapiens
EHPGVPANA

SEQ ID NO: 472910 - protein, 9 aa, Homo Sapiens
KTCKCEECG

SEQ ID NO: 472911 - protein, 9 aa, Homo Sapiens
GQFLPYFIR

SEQ ID NO: 472912 - protein, 9 aa, Homo Sapiens
EGQWHHICV

SEQ ID NO: 472913 - protein, 9 aa, Homo Sapiens
PMCFFPEHM

SEQ ID NO: 472914 - protein, 9 aa, Homo Sapiens
ATVIRSPLP

SEQ ID NO: 472915 - protein, 9 aa, Homo Sapiens
LTGPSITSL

SEQ ID NO: 472916 - protein, 9 aa, Homo Sapiens
HPTDTILYT

SEQ ID NO: 472917 - protein, 9 aa, Homo Sapiens
GGPPSTGGH

SEQ ID NO: 472918 - protein, 9 aa, Homo Sapiens
LEIFPVELE

SEQ ID NO: 472919 - protein, 9 aa, Homo Sapiens
SIQGANNTH

SEQ ID NO: 472920 - protein, 9 aa, Homo Sapiens
KLGDVALGC

SEQ ID NO: 472921 - protein, 9 aa, Homo Sapiens
YFVIFIIFV

SEQ ID NO: 472922 - protein, 9 aa, Homo Sapiens
AKAFSKFGH

SEQ ID NO: 472923 - protein, 9 aa, Homo Sapiens
ASMVTKKLH

SEQ ID NO: 472924 - protein, 9 aa, Homo Sapiens
MARAGDARS

SEQ ID NO: 472925 - protein, 9 aa, Homo Sapiens
ESSMEHGKE

SEQ ID NO: 472926 - protein, 9 aa, Homo Sapiens
LPSECGFWL

SEQ ID NO: 472927 - protein, 9 aa, Homo Sapiens
MAVFTFLFL

SEQ ID NO: 472928 - protein, 9 aa, Homo Sapiens
DKSLHESLQ

SEQ ID NO: 472929 - protein, 9 aa, Homo Sapiens
FFKILLDPY

SEQ ID NO: 472930 - protein, 9 aa, Homo Sapiens
EEALGGAKA

SEQ ID NO: 472931 - protein, 9 aa, Homo Sapiens
VEISHGGSW

SEQ ID NO: 472932 - protein, 9 aa, Homo Sapiens
TQSTLETPS

SEQ ID NO: 472933 - protein, 9 aa, Homo Sapiens
SEENNKDAD

SEQ ID NO: 472934 - protein, 9 aa, Homo Sapiens
AYLNGLHEV

SEQ ID NO: 472935 - protein, 9 aa, Homo Sapiens
AARQSPPPD

SEQ ID NO: 472936 - protein, 9 aa, Homo Sapiens
RDKEFRPER

SEQ ID NO: 472937 - protein, 9 aa, Homo Sapiens
MEEKTCKCE

SEQ ID NO: 472938 - protein, 9 aa, Homo Sapiens
QASEASTHL

SEQ ID NO: 472939 - protein, 9 aa, Homo Sapiens
LPGQPGIRG

SEQ ID NO: 472940 - protein, 9 aa, Homo Sapiens
CRNIVQKSV

SEQ ID NO: 472941 - protein, 9 aa, Homo Sapiens
IENETPFEF

SEQ ID NO: 472942 - protein, 9 aa, Homo Sapiens
CMPCYEGVH

SEQ ID NO: 472943 - protein, 9 aa, Homo Sapiens
PDSVPHGEM

SEQ ID NO: 472944 - protein, 9 aa, Homo Sapiens
TQEQLISNL

SEQ ID NO: 472945 - protein, 9 aa, Homo Sapiens
KFGPAPKTL

SEQ ID NO: 472946 - protein, 9 aa, Homo Sapiens
YKYIIHEHS

SEQ ID NO: 472947 - protein, 9 aa, Homo Sapiens
PGIRGLDGP

SEQ ID NO: 472948 - protein, 9 aa, Homo Sapiens
MFSARVLGN

SEQ ID NO: 472949 - protein, 9 aa, Homo Sapiens
EGPYSCSVQ

SEQ ID NO: 472950 - protein, 9 aa, Homo Sapiens
VERRSVSTS

SEQ ID NO: 472951 - protein, 9 aa, Homo Sapiens
HPGMANLHG

SEQ ID NO: 472952 - protein, 9 aa, Homo Sapiens
TPMAHPPHP

SEQ ID NO: 472953 - protein, 9 aa, Homo Sapiens
LIPVTLSLI

SEQ ID NO: 472954 - protein, 9 aa, Homo Sapiens
GEAGRIAGD

SEQ ID NO: 472955 - protein, 9 aa, Homo Sapiens
LSLQGVFLG

SEQ ID NO: 472956 - protein, 9 aa, Homo Sapiens
NHTSPRRRS

SEQ ID NO: 472957 - protein, 9 aa, Homo Sapiens
TASEESEKF

SEQ ID NO: 472958 - protein, 9 aa, Homo Sapiens
FVENEIVDP

SEQ ID NO: 472959 - protein, 9 aa, Homo Sapiens
RVVSHSSVP

SEQ ID NO: 472960 - protein, 9 aa, Homo Sapiens
TVPSKERPG

SEQ ID NO: 472961 - protein, 9 aa, Homo Sapiens
PGSLETCRS

SEQ ID NO: 472962 - protein, 9 aa, Homo Sapiens
MADALHHMN

SEQ ID NO: 472963 - protein, 9 aa, Homo Sapiens
RIIFTELQL

SEQ ID NO: 472964 - protein, 9 aa, Homo Sapiens
YIAWSLMDN

SEQ ID NO: 472965 - protein, 9 aa, Homo Sapiens
HAQRDQCET

SEQ ID NO: 472966 - protein, 9 aa, Homo Sapiens
NFIMSCAFY

SEQ ID NO: 472967 - protein, 9 aa, Homo Sapiens
VSLKLGDVA

SEQ ID NO: 472968 - protein, 9 aa, Homo Sapiens
AMADALHHM

SEQ ID NO: 472969 - protein, 9 aa, Homo Sapiens
SCVLTAAHC

SEQ ID NO: 472970 - protein, 9 aa, Homo Sapiens
TMIRVVSHS

SEQ ID NO: 472971 - protein, 9 aa, Homo Sapiens
PPCALEELA

SEQ ID NO: 472972 - protein, 9 aa, Homo Sapiens
IIRFFKILL

SEQ ID NO: 472973 - protein, 9 aa, Homo Sapiens
SIEGDQPIF

SEQ ID NO: 472974 - protein, 9 aa, Homo Sapiens
DQEDIFVVG

SEQ ID NO: 472975 - protein, 9 aa, Homo Sapiens
SARLNSTTF

SEQ ID NO: 472976 - protein, 9 aa, Homo Sapiens
SLSPESTTF

SEQ ID NO: 472977 - protein, 9 aa, Homo Sapiens
TSYKDYMKL

SEQ ID NO: 472978 - protein, 9 aa, Homo Sapiens
VRHKTIHTR

SEQ ID NO: 472979 - protein, 9 aa, Homo Sapiens
IMQFVKRLS

SEQ ID NO: 472980 - protein, 9 aa, Homo Sapiens
DYPQKFAME

SEQ ID NO: 472981 - protein, 9 aa, Homo Sapiens
ILQMRAIQW

SEQ ID NO: 472982 - protein, 9 aa, Homo Sapiens
GIVVGPVNG

SEQ ID NO: 472983 - protein, 9 aa, Homo Sapiens
QGFTIWKCW

SEQ ID NO: 472984 - protein, 9 aa, Homo Sapiens
KEDKEAETS

SEQ ID NO: 472985 - protein, 9 aa, Homo Sapiens
DDPRASSAN

SEQ ID NO: 472986 - protein, 9 aa, Homo Sapiens
KMFCPLAKT

SEQ ID NO: 472987 - protein, 9 aa, Homo Sapiens
HFSLITHGY

SEQ ID NO: 472988 - protein, 9 aa, Homo Sapiens
FLCEILRIM

SEQ ID NO: 472989 - protein, 9 aa, Homo Sapiens
ALNKMFCPL

SEQ ID NO: 472990 - protein, 9 aa, Homo Sapiens
SEKVTIKTD

SEQ ID NO: 472991 - protein, 9 aa, Homo Sapiens
VPRGKIGLV

SEQ ID NO: 472992 - protein, 9 aa, Homo Sapiens
EDKEAETSR

SEQ ID NO: 472993 - protein, 9 aa, Homo Sapiens
PMAHPPHPG

SEQ ID NO: 472994 - protein, 9 aa, Homo Sapiens
FNCRQEMRT

SEQ ID NO: 472995 - protein, 9 aa, Homo Sapiens
AAKGADGAA

SEQ ID NO: 472996 - protein, 9 aa, Homo Sapiens
IWLIVIIKI

SEQ ID NO: 472997 - protein, 9 aa, Homo Sapiens
LQVQRTTEG

SEQ ID NO: 472998 - protein, 9 aa, Homo Sapiens
GGGNGSHRL

SEQ ID NO: 472999 - protein, 9 aa, Homo Sapiens
ISSEMPSPN

SEQ ID NO: 473000 - protein, 9 aa, Homo Sapiens
VAMVAVALG

SEQ ID NO: 473001 - protein, 9 aa, Homo Sapiens
SFFALRDHI

SEQ ID NO: 473002 - protein, 9 aa, Homo Sapiens
GGNLLVLLD

SEQ ID NO: 473003 - protein, 9 aa, Homo Sapiens
KPHLDRRGS

SEQ ID NO: 473004 - protein, 9 aa, Homo Sapiens
RKEENRGEH

SEQ ID NO: 473005 - protein, 9 aa, Homo Sapiens
STSCASLVS

SEQ ID NO: 473006 - protein, 9 aa, Homo Sapiens
NSAAAGNPF

SEQ ID NO: 473007 - protein, 9 aa, Homo Sapiens
IIRAVLGVP

SEQ ID NO: 473008 - protein, 9 aa, Homo Sapiens
IEEVCIETY

SEQ ID NO: 473009 - protein, 9 aa, Homo Sapiens
SDDKETCFA

SEQ ID NO: 473010 - protein, 9 aa, Homo Sapiens
FNHDGEDEE

SEQ ID NO: 473011 - protein, 9 aa, Homo Sapiens
CTGPQRLLP

SEQ ID NO: 473012 - protein, 9 aa, Homo Sapiens
GYGTPAICA

SEQ ID NO: 473013 - protein, 9 aa, Homo Sapiens
HYYSITVNY

SEQ ID NO: 473014 - protein, 9 aa, Homo Sapiens
GSLIANSCV

SEQ ID NO: 473015 - protein, 9 aa, Homo Sapiens
PRINSAAAG

SEQ ID NO: 473016 - protein, 9 aa, Homo Sapiens
SLIHGKISS

SEQ ID NO: 473017 - protein, 9 aa, Homo Sapiens
DGRVEVLKA

SEQ ID NO: 473018 - protein, 9 aa, Homo Sapiens
LTQEQLISN

SEQ ID NO: 473019 - protein, 9 aa, Homo Sapiens
ICMPCYEGV

SEQ ID NO: 473020 - protein, 9 aa, Homo Sapiens
RDKRFRSDV

SEQ ID NO: 473021 - protein, 9 aa, Homo Sapiens
WVKSEKVTI

SEQ ID NO: 473022 - protein, 9 aa, Homo Sapiens
DSELLIESL

SEQ ID NO: 473023 - protein, 9 aa, Homo Sapiens
DMQFEPKQR

SEQ ID NO: 473024 - protein, 9 aa, Homo Sapiens
KSSALVSHC

SEQ ID NO: 473025 - protein, 9 aa, Homo Sapiens
YSNYYGGLH

SEQ ID NO: 473026 - protein, 9 aa, Homo Sapiens
ASLVTVFPS

SEQ ID NO: 473027 - protein, 9 aa, Homo Sapiens
RLSLKCVGH

SEQ ID NO: 473028 - protein, 9 aa, Homo Sapiens
MGSPCFKGE

SEQ ID NO: 473029 - protein, 9 aa, Homo Sapiens
SATSHDQKR

SEQ ID NO: 473030 - protein, 9 aa, Homo Sapiens
RLLKILPEI

SEQ ID NO: 473031 - protein, 9 aa, Homo Sapiens
QNMLNKHPK

SEQ ID NO: 473032 - protein, 9 aa, Homo Sapiens
NRSFYDLEV

SEQ ID NO: 473033 - protein, 9 aa, Homo Sapiens
ILTETPQDT

SEQ ID NO: 473034 - protein, 9 aa, Homo Sapiens
HASLVTVFP

SEQ ID NO: 473035 - protein, 9 aa, Homo Sapiens
SLQGVFLGQ

SEQ ID NO: 473036 - protein, 9 aa, Homo Sapiens
DYLTLDAQN

SEQ ID NO: 473037 - protein, 9 aa, Homo Sapiens
TTTPTSRCP

SEQ ID NO: 473038 - protein, 9 aa, Homo Sapiens
PATVPSKER

SEQ ID NO: 473039 - protein, 9 aa, Homo Sapiens
YLNRIVCFF

SEQ ID NO: 473040 - protein, 9 aa, Homo Sapiens
TIGLLLIQK

SEQ ID NO: 473041 - protein, 9 aa, Homo Sapiens
KCLAISCEH

SEQ ID NO: 473042 - protein, 9 aa, Homo Sapiens
QQLQGYISS

SEQ ID NO: 473043 - protein, 9 aa, Homo Sapiens
RHPKCYLET

SEQ ID NO: 473044 - protein, 9 aa, Homo Sapiens
GQFTVLMQL

SEQ ID NO: 473045 - protein, 9 aa, Homo Sapiens
VPFKDIMKN

SEQ ID NO: 473046 - protein, 9 aa, Homo Sapiens
VLMQLTWLY

SEQ ID NO: 473047 - protein, 9 aa, Homo Sapiens
PSSLSPEST

SEQ ID NO: 473048 - protein, 9 aa, Homo Sapiens
PCKHVARIL

SEQ ID NO: 473049 - protein, 9 aa, Homo Sapiens
PVEAIHLCP

SEQ ID NO: 473050 - protein, 9 aa, Homo Sapiens
PRASSANRT

SEQ ID NO: 473051 - protein, 9 aa, Homo Sapiens
SQRYTFSNL

SEQ ID NO: 473052 - protein, 9 aa, Homo Sapiens
RAKSIITSN

SEQ ID NO: 473053 - protein, 9 aa, Homo Sapiens
MVEERKIPA

SEQ ID NO: 473054 - protein, 9 aa, Homo Sapiens
REVAGRFQA

SEQ ID NO: 473055 - protein, 9 aa, Homo Sapiens
SLEEDLFQT

SEQ ID NO: 473056 - protein, 9 aa, Homo Sapiens
PIPLPDAKE

SEQ ID NO: 473057 - protein, 9 aa, Homo Sapiens
PFKDIMKNE

SEQ ID NO: 473058 - protein, 9 aa, Homo Sapiens
PWKTLRASF

SEQ ID NO: 473059 - protein, 9 aa, Homo Sapiens
NSLAPRVDA

SEQ ID NO: 473060 - protein, 9 aa, Homo Sapiens
RGFASYFTP

SEQ ID NO: 473061 - protein, 9 aa, Homo Sapiens
VPGQKGTKK

SEQ ID NO: 473062 - protein, 9 aa, Homo Sapiens
PEPDSITCC

SEQ ID NO: 473063 - protein, 9 aa, Homo Sapiens
EKCCKSDDK

SEQ ID NO: 473064 - protein, 9 aa, Homo Sapiens
VRDISGRKL

SEQ ID NO: 473065 - protein, 9 aa, Homo Sapiens
GVVVGAGAT

SEQ ID NO: 473066 - protein, 9 aa, Homo Sapiens
VEKPFAGKD

SEQ ID NO: 473067 - protein, 9 aa, Homo Sapiens
LQMAVFTFL

SEQ ID NO: 473068 - protein, 9 aa, Homo Sapiens
EAPSARLNS

SEQ ID NO: 473069 - protein, 9 aa, Homo Sapiens
GRIAGDLGA

SEQ ID NO: 473070 - protein, 9 aa, Homo Sapiens
PLTQEQLIS

SEQ ID NO: 473071 - protein, 9 aa, Homo Sapiens
SVDPFNQTL

SEQ ID NO: 473072 - protein, 9 aa, Homo Sapiens
GLHEVLLPQ

SEQ ID NO: 473073 - protein, 9 aa, Homo Sapiens
VSARVIKSL

SEQ ID NO: 473074 - protein, 9 aa, Homo Sapiens
SWAQRYSTS

SEQ ID NO: 473075 - protein, 9 aa, Homo Sapiens
EEPVKGFRV

SEQ ID NO: 473076 - protein, 9 aa, Homo Sapiens
QAPGKRKFN

SEQ ID NO: 473077 - protein, 9 aa, Homo Sapiens
SAVLKIEEV

SEQ ID NO: 473078 - protein, 9 aa, Homo Sapiens
FRIIYSLLL

SEQ ID NO: 473079 - protein, 9 aa, Homo Sapiens
FCRHCTDFI

SEQ ID NO: 473080 - protein, 9 aa, Homo Sapiens
DENFPRDKE

SEQ ID NO: 473081 - protein, 9 aa, Homo Sapiens
PSNSVDRFT

SEQ ID NO: 473082 - protein, 9 aa, Homo Sapiens
VAVYDELCG

SEQ ID NO: 473083 - protein, 9 aa, Homo Sapiens
AVLKIEEVC

SEQ ID NO: 473084 - protein, 9 aa, Homo Sapiens
NKLSNHLFV

SEQ ID NO: 473085 - protein, 9 aa, Homo Sapiens
ENSTYIWVL

SEQ ID NO: 473086 - protein, 9 aa, Homo Sapiens
DYYMGYRQV

SEQ ID NO: 473087 - protein, 9 aa, Homo Sapiens
LGRSITSAT

SEQ ID NO: 473088 - protein, 9 aa, Homo Sapiens
EHPQRQSAI

SEQ ID NO: 473089 - protein, 9 aa, Homo Sapiens
EFQCICMPC

SEQ ID NO: 473090 - protein, 9 aa, Homo Sapiens
DSVPHGEMP

SEQ ID NO: 473091 - protein, 9 aa, Homo Sapiens
TLSRNISNT

SEQ ID NO: 473092 - protein, 9 aa, Homo Sapiens
YNDCMAQII

SEQ ID NO: 473093 - protein, 9 aa, Homo Sapiens
RDKLPGGRK

SEQ ID NO: 473094 - protein, 9 aa, Homo Sapiens
SSSSTLQSL

SEQ ID NO: 473095 - protein, 9 aa, Homo Sapiens
RVGVEHTVA

SEQ ID NO: 473096 - protein, 9 aa, Homo Sapiens
QPETILTET

SEQ ID NO: 473097 - protein, 9 aa, Homo Sapiens
SVKVPQSIA

SEQ ID NO: 473098 - protein, 9 aa, Homo Sapiens
KAYDSTHLV

SEQ ID NO: 473099 - protein, 9 aa, Homo Sapiens
GEKHELHAG

SEQ ID NO: 473100 - protein, 9 aa, Homo Sapiens
VLYSVQSLS

SEQ ID NO: 473101 - protein, 9 aa, Homo Sapiens
QVGRKDCPR

SEQ ID NO: 473102 - protein, 9 aa, Homo Sapiens
LIHGKISSE

SEQ ID NO: 473103 - protein, 9 aa, Homo Sapiens
DGTDSIEGE

SEQ ID NO: 473104 - protein, 9 aa, Homo Sapiens
CLICAKSRM

SEQ ID NO: 473105 - protein, 9 aa, Homo Sapiens
IFPVELEKD

SEQ ID NO: 473106 - protein, 9 aa, Homo Sapiens
QVKSAKSAT

SEQ ID NO: 473107 - protein, 9 aa, Homo Sapiens
AGKKSSALV

SEQ ID NO: 473108 - protein, 9 aa, Homo Sapiens
IIPCSVLGH

SEQ ID NO: 473109 - protein, 9 aa, Homo Sapiens
ILMVEERKI

SEQ ID NO: 473110 - protein, 9 aa, Homo Sapiens
CSISSQRYT

SEQ ID NO: 473111 - protein, 9 aa, Homo Sapiens
GDGRVEVLK

SEQ ID NO: 473112 - protein, 9 aa, Homo Sapiens
ACATLVESP

SEQ ID NO: 473113 - protein, 9 aa, Homo Sapiens
LKPGIIPSQ

SEQ ID NO: 473114 - protein, 9 aa, Homo Sapiens
PELDTSYKD

SEQ ID NO: 473115 - protein, 9 aa, Homo Sapiens
CEEALGGAK

SEQ ID NO: 473116 - protein, 9 aa, Homo Sapiens
HTVAGELRL

SEQ ID NO: 473117 - protein, 9 aa, Homo Sapiens
ENAPEPDSI

SEQ ID NO: 473118 - protein, 9 aa, Homo Sapiens
DVAVLIVDP

SEQ ID NO: 473119 - protein, 9 aa, Homo Sapiens
STTTPTSRC

SEQ ID NO: 473120 - protein, 9 aa, Homo Sapiens
EHAQRDQCE

SEQ ID NO: 473121 - protein, 9 aa, Homo Sapiens
ELRAGQFTV

SEQ ID NO: 473122 - protein, 9 aa, Homo Sapiens
FIRGFASYF

SEQ ID NO: 473123 - protein, 9 aa, Homo Sapiens
ASTTTPTSR

SEQ ID NO: 473124 - protein, 9 aa, Homo Sapiens
MRDHNVLGT

SEQ ID NO: 473125 - protein, 9 aa, Homo Sapiens
GLPGQPGIR

SEQ ID NO: 473126 - protein, 9 aa, Homo Sapiens
SSLSPESTT

SEQ ID NO: 473127 - protein, 9 aa, Homo Sapiens
HPQRQSAIE

SEQ ID NO: 473128 - protein, 9 aa, Homo Sapiens
QPKLKSVLT

SEQ ID NO: 473129 - protein, 9 aa, Homo Sapiens
RMEAEEEAL

SEQ ID NO: 473130 - protein, 9 aa, Homo Sapiens
KLEIFPVEL

SEQ ID NO: 473131 - protein, 9 aa, Homo Sapiens
GRMARAGDA

SEQ ID NO: 473132 - protein, 9 aa, Homo Sapiens
EKHELHAGT

SEQ ID NO: 473133 - protein, 9 aa, Homo Sapiens
CGRGFQRLS

SEQ ID NO: 473134 - protein, 9 aa, Homo Sapiens
VCSISSQRY

SEQ ID NO: 473135 - protein, 9 aa, Homo Sapiens
EEKVAQPDG

SEQ ID NO: 473136 - protein, 9 aa, Homo Sapiens
EIIPCSVLG

SEQ ID NO: 473137 - protein, 9 aa, Homo Sapiens
FITKGDVEL

SEQ ID NO: 473138 - protein, 9 aa, Homo Sapiens
NAYKFKWDK

SEQ ID NO: 473139 - protein, 9 aa, Homo Sapiens
GGDEEATRE

SEQ ID NO: 473140 - protein, 9 aa, Homo Sapiens
NGSHRLGDA

SEQ ID NO: 473141 - protein, 9 aa, Homo Sapiens
TGFQGKTGH

SEQ ID NO: 473142 - protein, 9 aa, Homo Sapiens
WYFLLACSD

SEQ ID NO: 473143 - protein, 9 aa, Homo Sapiens
SWRLQSPRD

SEQ ID NO: 473144 - protein, 9 aa, Homo Sapiens
QGSSKVPVI

SEQ ID NO: 473145 - protein, 9 aa, Homo Sapiens
MQVQQQHQL

SEQ ID NO: 473146 - protein, 9 aa, Homo Sapiens
DKEAETSRL

SEQ ID NO: 473147 - protein, 9 aa, Homo Sapiens
IAHFCCEFP

SEQ ID NO: 473148 - protein, 9 aa, Homo Sapiens
VTVFPSPSS

SEQ ID NO: 473149 - protein, 9 aa, Homo Sapiens
AQGSSKVPV

SEQ ID NO: 473150 - protein, 9 aa, Homo Sapiens
CLAISCEHP

SEQ ID NO: 473151 - protein, 9 aa, Homo Sapiens
MAQIIFFHF

SEQ ID NO: 473152 - protein, 9 aa, Homo Sapiens
FTLLVLTCR

SEQ ID NO: 473153 - protein, 9 aa, Homo Sapiens
GLLPKTKYA

SEQ ID NO: 473154 - protein, 9 aa, Homo Sapiens
VKGFRVTLV

SEQ ID NO: 473155 - protein, 9 aa, Homo Sapiens
RMIGFAHVF

SEQ ID NO: 473156 - protein, 9 aa, Homo Sapiens
TSRCPTGCS

SEQ ID NO: 473157 - protein, 9 aa, Homo Sapiens
GRFQASEAS

SEQ ID NO: 473158 - protein, 9 aa, Homo Sapiens
KERESLNKG

SEQ ID NO: 473159 - protein, 9 aa, Homo Sapiens
WKAYDSTHL

SEQ ID NO: 473160 - protein, 9 aa, Homo Sapiens
QEDIFVVGT

SEQ ID NO: 473161 - protein, 9 aa, Homo Sapiens
QADEEASLG

SEQ ID NO: 473162 - protein, 9 aa, Homo Sapiens
DTSYKDYMK

SEQ ID NO: 473163 - protein, 9 aa, Homo Sapiens
ISLKMLPQL

SEQ ID NO: 473164 - protein, 9 aa, Homo Sapiens
EKPSECSEC

SEQ ID NO: 473165 - protein, 9 aa, Homo Sapiens
LNSTTFPSR

SEQ ID NO: 473166 - protein, 9 aa, Homo Sapiens
ESFLGSGGD

SEQ ID NO: 473167 - protein, 9 aa, Homo Sapiens
SLIANSCVL

SEQ ID NO: 473168 - protein, 9 aa, Homo Sapiens
EPDSITCCV

SEQ ID NO: 473169 - protein, 9 aa, Homo Sapiens
WFNDPSNTG

SEQ ID NO: 473170 - protein, 9 aa, Homo Sapiens
AMKYHLLTE

SEQ ID NO: 473171 - protein, 9 aa, Homo Sapiens
SNTAGGETL

SEQ ID NO: 473172 - protein, 9 aa, Homo Sapiens
RDISGRKLF

SEQ ID NO: 473173 - protein, 9 aa, Homo Sapiens
TEGNIGFMS

SEQ ID NO: 473174 - protein, 9 aa, Homo Sapiens
TMPVEAIHL

SEQ ID NO: 473175 - protein, 9 aa, Homo Sapiens
TVGGVNQGL

SEQ ID NO: 473176 - protein, 9 aa, Homo Sapiens
QQDEYSQNY

SEQ ID NO: 473177 - protein, 9 aa, Homo Sapiens
NLFGKMMDR

SEQ ID NO: 473178 - protein, 9 aa, Homo Sapiens
YLGHLGKGL

SEQ ID NO: 473179 - protein, 9 aa, Homo Sapiens
PRMELRLVG

SEQ ID NO: 473180 - protein, 9 aa, Homo Sapiens
GEKPFVCMQ

SEQ ID NO: 473181 - protein, 9 aa, Homo Sapiens
QVARISTCL

SEQ ID NO: 473182 - protein, 9 aa, Homo Sapiens
LEYKRELTM

SEQ ID NO: 473183 - protein, 9 aa, Homo Sapiens
LLDDPLSTV

SEQ ID NO: 473184 - protein, 9 aa, Homo Sapiens
ELRKAHGGR

SEQ ID NO: 473185 - protein, 9 aa, Homo Sapiens
MSLQQKRHR

SEQ ID NO: 473186 - protein, 9 aa, Homo Sapiens
PFVCMQCGR

SEQ ID NO: 473187 - protein, 9 aa, Homo Sapiens
TMSIMSYNH

SEQ ID NO: 473188 - protein, 9 aa, Homo Sapiens
LPHPLYDMS

SEQ ID NO: 473189 - protein, 9 aa, Homo Sapiens
ATVAFFKVK

SEQ ID NO: 473190 - protein, 9 aa, Homo Sapiens
NTNIGSRFP

SEQ ID NO: 473191 - protein, 9 aa, Homo Sapiens
NLHRYNWIE

SEQ ID NO: 473192 - protein, 9 aa, Homo Sapiens
KLDGTTPVW

SEQ ID NO: 473193 - protein, 9 aa, Homo Sapiens
TSHELEAAE

SEQ ID NO: 473194 - protein, 9 aa, Homo Sapiens
RRKYEETLK

SEQ ID NO: 473195 - protein, 9 aa, Homo Sapiens
EAEIHAHLV

SEQ ID NO: 473196 - protein, 9 aa, Homo Sapiens
HASMDFARS

SEQ ID NO: 473197 - protein, 9 aa, Homo Sapiens
LMWAEEGQR

SEQ ID NO: 473198 - protein, 9 aa, Homo Sapiens
ANLFGKMMD

SEQ ID NO: 473199 - protein, 9 aa, Homo Sapiens
PGIGNKVDA

SEQ ID NO: 473200 - protein, 9 aa, Homo Sapiens
VAEYGKKAK

SEQ ID NO: 473201 - protein, 9 aa, Homo Sapiens
RMELRLVGD

SEQ ID NO: 473202 - protein, 9 aa, Homo Sapiens
CRDIFPQSL

SEQ ID NO: 473203 - protein, 9 aa, Homo Sapiens
LSRRHMKAA

SEQ ID NO: 473204 - protein, 9 aa, Homo Sapiens
GNQLIVIMS

SEQ ID NO: 473205 - protein, 9 aa, Homo Sapiens
NMSPLQALE

SEQ ID NO: 473206 - protein, 9 aa, Homo Sapiens
PWPSAFKPL

SEQ ID NO: 473207 - protein, 9 aa, Homo Sapiens
EDVDVNITQ

SEQ ID NO: 473208 - protein, 9 aa, Homo Sapiens
KAVTGKNNF

SEQ ID NO: 473209 - protein, 9 aa, Homo Sapiens
NSMSQTSIQ

SEQ ID NO: 473210 - protein, 9 aa, Homo Sapiens
RALIKQLKD

SEQ ID NO: 473211 - protein, 9 aa, Homo Sapiens
VWYGLRLNM

SEQ ID NO: 473212 - protein, 9 aa, Homo Sapiens
MEQQDEYSQ

SEQ ID NO: 473213 - protein, 9 aa, Homo Sapiens
IICLKFFNF

SEQ ID NO: 473214 - protein, 9 aa, Homo Sapiens
NKKAVTGKN

SEQ ID NO: 473215 - protein, 9 aa, Homo Sapiens
ILTEAEIHA

SEQ ID NO: 473216 - protein, 9 aa, Homo Sapiens
SRFPIPLAS

SEQ ID NO: 473217 - protein, 9 aa, Homo Sapiens
KEQYGPGVQ

SEQ ID NO: 473218 - protein, 9 aa, Homo Sapiens
LLGASLGGI

SEQ ID NO: 473219 - protein, 9 aa, Homo Sapiens
SRRHMKAAF

SEQ ID NO: 473220 - protein, 9 aa, Homo Sapiens
GCSSPVTVN

SEQ ID NO: 473221 - protein, 9 aa, Homo Sapiens
PKARQSFLE

SEQ ID NO: 473222 - protein, 9 aa, Homo Sapiens
LHPPVPASY

SEQ ID NO: 473223 - protein, 9 aa, Homo Sapiens
GTAAVRGTD

SEQ ID NO: 473224 - protein, 9 aa, Homo Sapiens
TDLFRSVVT

SEQ ID NO: 473225 - protein, 9 aa, Homo Sapiens
YPCVVDESS

SEQ ID NO: 473226 - protein, 9 aa, Homo Sapiens
ELTMPLCIA

SEQ ID NO: 473227 - protein, 9 aa, Homo Sapiens
DLIHLYSEL

SEQ ID NO: 473228 - protein, 9 aa, Homo Sapiens
TGEKPFVCM

SEQ ID NO: 473229 - protein, 9 aa, Homo Sapiens
SCWMETPKS

SEQ ID NO: 473230 - protein, 9 aa, Homo Sapiens
WQSKEELIP

SEQ ID NO: 473231 - protein, 9 aa, Homo Sapiens
IGNKVDAVY

SEQ ID NO: 473232 - protein, 9 aa, Homo Sapiens
MEHCIVGPG

SEQ ID NO: 473233 - protein, 9 aa, Homo Sapiens
TYEAHAKQK

SEQ ID NO: 473234 - protein, 9 aa, Homo Sapiens
GAELRKAHG

SEQ ID NO: 473235 - protein, 9 aa, Homo Sapiens
QPPPPTQHS

SEQ ID NO: 473236 - protein, 9 aa, Homo Sapiens
PPVPASYAP

SEQ ID NO: 473237 - protein, 9 aa, Homo Sapiens
LPRMSDDNW

SEQ ID NO: 473238 - protein, 9 aa, Homo Sapiens
EYKRELTMP

SEQ ID NO: 473239 - protein, 9 aa, Homo Sapiens
DVTSKEVIE

SEQ ID NO: 473240 - protein, 9 aa, Homo Sapiens
SDRSQRLPR

SEQ ID NO: 473241 - protein, 9 aa, Homo Sapiens
EAAEKTMME

SEQ ID NO: 473242 - protein, 9 aa, Homo Sapiens
VVSLYYGAI

SEQ ID NO: 473243 - protein, 9 aa, Homo Sapiens
ASMDFARSK

SEQ ID NO: 473244 - protein, 9 aa, Homo Sapiens
PRHAGPGRL

SEQ ID NO: 473245 - protein, 9 aa, Homo Sapiens
LYYGAIIGL

SEQ ID NO: 473246 - protein, 9 aa, Homo Sapiens
ALIKQLKDK

SEQ ID NO: 473247 - protein, 9 aa, Homo Sapiens
IVVKNCLLT

SEQ ID NO: 473248 - protein, 9 aa, Homo Sapiens
KGEEKVFLI

SEQ ID NO: 473249 - protein, 9 aa, Homo Sapiens
IHASMDFAR

SEQ ID NO: 473250 - protein, 9 aa, Homo Sapiens
PEVKSKYLI

SEQ ID NO: 473251 - protein, 9 aa, Homo Sapiens
KQKLYPLIS

SEQ ID NO: 473252 - protein, 9 aa, Homo Sapiens
YTDTPVSAR

SEQ ID NO: 473253 - protein, 9 aa, Homo Sapiens
KGSEEKRSA

SEQ ID NO: 473254 - protein, 9 aa, Homo Sapiens
CIHEEVINL

SEQ ID NO: 473255 - protein, 9 aa, Homo Sapiens
LRHQASSDY

SEQ ID NO: 473256 - protein, 9 aa, Homo Sapiens
VQLRHQASS

SEQ ID NO: 473257 - protein, 9 aa, Homo Sapiens
HEAFLLTKG

SEQ ID NO: 473258 - protein, 9 aa, Homo Sapiens
HHFHNAIYM

SEQ ID NO: 473259 - protein, 9 aa, Homo Sapiens
AEGVRRALL

SEQ ID NO: 473260 - protein, 9 aa, Homo Sapiens
WEARASQIC

SEQ ID NO: 473261 - protein, 9 aa, Homo Sapiens
RRHMKAAFF

SEQ ID NO: 473262 - protein, 9 aa, Homo Sapiens
LCAVTRLLI

SEQ ID NO: 473263 - protein, 9 aa, Homo Sapiens
PANVSDLRA

SEQ ID NO: 473264 - protein, 9 aa, Homo Sapiens
DSYYLNRTH

SEQ ID NO: 473265 - protein, 9 aa, Homo Sapiens
CCLLSPLLK

SEQ ID NO: 473266 - protein, 9 aa, Homo Sapiens
LEAAEKTMM

SEQ ID NO: 473267 - protein, 9 aa, Homo Sapiens
VRRALLGSM

SEQ ID NO: 473268 - protein, 9 aa, Homo Sapiens
SRKKGDSYY

SEQ ID NO: 473269 - protein, 9 aa, Homo Sapiens
SAGSHIEDG

SEQ ID NO: 473270 - protein, 9 aa, Homo Sapiens
HQASSDYDW

SEQ ID NO: 473271 - protein, 9 aa, Homo Sapiens
DCMICFLVI

SEQ ID NO: 473272 - protein, 9 aa, Homo Sapiens
VEDCMICFL

SEQ ID NO: 473273 - protein, 9 aa, Homo Sapiens
VDVNITQEE

SEQ ID NO: 473274 - protein, 9 aa, Homo Sapiens
CYAVIDPFI

SEQ ID NO: 473275 - protein, 9 aa, Homo Sapiens
GKMMDRNRI

SEQ ID NO: 473276 - protein, 9 aa, Homo Sapiens
RQSFLEKRP

SEQ ID NO: 473277 - protein, 9 aa, Homo Sapiens
LLVNPDDAK

SEQ ID NO: 473278 - protein, 9 aa, Homo Sapiens
DCRDIFPQS

SEQ ID NO: 473279 - protein, 9 aa, Homo Sapiens
SPLQALEPV

SEQ ID NO: 473280 - protein, 9 aa, Homo Sapiens
RHAFDVWQN

SEQ ID NO: 473281 - protein, 9 aa, Homo Sapiens
ALKTAYFLL

SEQ ID NO: 473282 - protein, 9 aa, Homo Sapiens
NIDEHFFSV

SEQ ID NO: 473283 - protein, 9 aa, Homo Sapiens
IMSCLTKED

SEQ ID NO: 473284 - protein, 9 aa, Homo Sapiens
VDMRKVHHC

SEQ ID NO: 473285 - protein, 9 aa, Homo Sapiens
RKVAEYGKK

SEQ ID NO: 473286 - protein, 9 aa, Homo Sapiens
LTVGGVNQG

SEQ ID NO: 473287 - protein, 9 aa, Homo Sapiens
KHYEEKTQK

SEQ ID NO: 473288 - protein, 9 aa, Homo Sapiens
RASNPANVS

SEQ ID NO: 473289 - protein, 9 aa, Homo Sapiens
LFVKSAGSH

SEQ ID NO: 473290 - protein, 9 aa, Homo Sapiens
VNPDDAKEL

SEQ ID NO: 473291 - protein, 9 aa, Homo Sapiens
FLFLCCLLS

SEQ ID NO: 473292 - protein, 9 aa, Homo Sapiens
LSWAHPDGV

SEQ ID NO: 473293 - protein, 9 aa, Homo Sapiens
ETLKEVHNL

SEQ ID NO: 473294 - protein, 9 aa, Homo Sapiens
YTKTYEAHA

SEQ ID NO: 473295 - protein, 9 aa, Homo Sapiens
AGQRIRLAP

SEQ ID NO: 473296 - protein, 9 aa, Homo Sapiens
STVDSHVAK

SEQ ID NO: 473297 - protein, 9 aa, Homo Sapiens
DGTEDDDLF

SEQ ID NO: 473298 - protein, 9 aa, Homo Sapiens
PLLGASLGG

SEQ ID NO: 473299 - protein, 9 aa, Homo Sapiens
FRLSSEEAA

SEQ ID NO: 473300 - protein, 9 aa, Homo Sapiens
LYGAMVQHS

SEQ ID NO: 473301 - protein, 9 aa, Homo Sapiens
CQAYLGHLG

SEQ ID NO: 473302 - protein, 9 aa, Homo Sapiens
NLEDGTEDD

SEQ ID NO: 473303 - protein, 9 aa, Homo Sapiens
RTTEEGMIQ

SEQ ID NO: 473304 - protein, 9 aa, Homo Sapiens
TGYNLCVLA

SEQ ID NO: 473305 - protein, 9 aa, Homo Sapiens
VIEKKEQRA

SEQ ID NO: 473306 - protein, 9 aa, Homo Sapiens
TRKAIRHAF

SEQ ID NO: 473307 - protein, 9 aa, Homo Sapiens
KEEEEEEDV

SEQ ID NO: 473308 - protein, 9 aa, Homo Sapiens
HDVGSQVNY

SEQ ID NO: 473309 - protein, 9 aa, Homo Sapiens
CFLVIHGFN

SEQ ID NO: 473310 - protein, 9 aa, Homo Sapiens
KMSLQQKRH

SEQ ID NO: 473311 - protein, 9 aa, Homo Sapiens
CSTCWNRLV

SEQ ID NO: 473312 - protein, 9 aa, Homo Sapiens
PTDIWEIIE

SEQ ID NO: 473313 - protein, 9 aa, Homo Sapiens
NCLLTVGGV

SEQ ID NO: 473314 - protein, 9 aa, Homo Sapiens
ALLCAVTRL

SEQ ID NO: 473315 - protein, 9 aa, Homo Sapiens
KKAVTGKNN

SEQ ID NO: 473316 - protein, 9 aa, Homo Sapiens
ASIHASMDF

SEQ ID NO: 473317 - protein, 9 aa, Homo Sapiens
YNLCVLAMW

SEQ ID NO: 473318 - protein, 9 aa, Homo Sapiens
IRHAFDVWQ

SEQ ID NO: 473319 - protein, 9 aa, Homo Sapiens
SYLNLRPHN

SEQ ID NO: 473320 - protein, 9 aa, Homo Sapiens
GKRIRSDFS

SEQ ID NO: 473321 - protein, 9 aa, Homo Sapiens
QPWPSAFKP

SEQ ID NO: 473322 - protein, 9 aa, Homo Sapiens
IVIMSCLTK

SEQ ID NO: 473323 - protein, 9 aa, Homo Sapiens
LFRSVVTVI

SEQ ID NO: 473324 - protein, 9 aa, Homo Sapiens
EQGEEEDKE

SEQ ID NO: 473325 - protein, 9 aa, Homo Sapiens
PTQHSITDN

SEQ ID NO: 473326 - protein, 9 aa, Homo Sapiens
SEAYIDALT

SEQ ID NO: 473327 - protein, 9 aa, Homo Sapiens
LAERFPRHA

SEQ ID NO: 473328 - protein, 9 aa, Homo Sapiens
YIDALTLRK

SEQ ID NO: 473329 - protein, 9 aa, Homo Sapiens
AHSSYQEGT

SEQ ID NO: 473330 - protein, 9 aa, Homo Sapiens
YRFASFVFI

SEQ ID NO: 473331 - protein, 9 aa, Homo Sapiens
KNNFTDTMR

SEQ ID NO: 473332 - protein, 9 aa, Homo Sapiens
LRKAHGGRL

SEQ ID NO: 473333 - protein, 9 aa, Homo Sapiens
GMIQVRKSK

SEQ ID NO: 473334 - protein, 9 aa, Homo Sapiens
YPLISGPIV

SEQ ID NO: 473335 - protein, 9 aa, Homo Sapiens
CMICFLVIH

SEQ ID NO: 473336 - protein, 9 aa, Homo Sapiens
SARRTLSAV

SEQ ID NO: 473337 - protein, 9 aa, Homo Sapiens
ASQICYSVP

SEQ ID NO: 473338 - protein, 9 aa, Homo Sapiens
SVKGEEKVF

SEQ ID NO: 473339 - protein, 9 aa, Homo Sapiens
LAKHYEEKT

SEQ ID NO: 473340 - protein, 9 aa, Homo Sapiens
LEDGTEDDD

SEQ ID NO: 473341 - protein, 9 aa, Homo Sapiens
CSVKGEEKV

SEQ ID NO: 473342 - protein, 9 aa, Homo Sapiens
LDDPLSTVD

SEQ ID NO: 473343 - protein, 9 aa, Homo Sapiens
LLAKHYEEK

SEQ ID NO: 473344 - protein, 9 aa, Homo Sapiens
NGMLIMCYA

SEQ ID NO: 473345 - protein, 9 aa, Homo Sapiens
FAVVQLRHQ

SEQ ID NO: 473346 - protein, 9 aa, Homo Sapiens
KKEQYGPGV

SEQ ID NO: 473347 - protein, 9 aa, Homo Sapiens
RALLCAVTR

SEQ ID NO: 473348 - protein, 9 aa, Homo Sapiens
AIYMLLSGA

SEQ ID NO: 473349 - protein, 9 aa, Homo Sapiens
IHAHLVALA

SEQ ID NO: 473350 - protein, 9 aa, Homo Sapiens
GDCGKTFNS

SEQ ID NO: 473351 - protein, 9 aa, Homo Sapiens
PLLYTIAIS

SEQ ID NO: 473352 - protein, 9 aa, Homo Sapiens
TTPVWYGLR

SEQ ID NO: 473353 - protein, 9 aa, Homo Sapiens
TGLHHCTQP

SEQ ID NO: 473354 - protein, 9 aa, Homo Sapiens
LYTIAISQK

SEQ ID NO: 473355 - protein, 9 aa, Homo Sapiens
PENTNIGSR

SEQ ID NO: 473356 - protein, 9 aa, Homo Sapiens
SQICYSVPE

SEQ ID NO: 473357 - protein, 9 aa, Homo Sapiens
PETRKAIRH

SEQ ID NO: 473358 - protein, 9 aa, Homo Sapiens
FFNFCHFHI

SEQ ID NO: 473359 - protein, 9 aa, Homo Sapiens
WNRKVAEYG

SEQ ID NO: 473360 - protein, 9 aa, Homo Sapiens
QLFREALMW

SEQ ID NO: 473361 - protein, 9 aa, Homo Sapiens
TFLLPWAFP

SEQ ID NO: 473362 - protein, 9 aa, Homo Sapiens
SKAAAHAVA

SEQ ID NO: 473363 - protein, 9 aa, Homo Sapiens
RSGQGEVYN

SEQ ID NO: 473364 - protein, 9 aa, Homo Sapiens
TVDSHVAKH

SEQ ID NO: 473365 - protein, 9 aa, Homo Sapiens
AGSHIEDGV

SEQ ID NO: 473366 - protein, 9 aa, Homo Sapiens
GHRKISGAD

SEQ ID NO: 473367 - protein, 9 aa, Homo Sapiens
WQVSLPELE

SEQ ID NO: 473368 - protein, 9 aa, Homo Sapiens
HKCGDCGKT

SEQ ID NO: 473369 - protein, 9 aa, Homo Sapiens
VPVRPPPPT

SEQ ID NO: 473370 - protein, 9 aa, Homo Sapiens
IQQVQQQVV

SEQ ID NO: 473371 - protein, 9 aa, Homo Sapiens
APLLGASLG

SEQ ID NO: 473372 - protein, 9 aa, Homo Sapiens
SHSLPHPLY

SEQ ID NO: 473373 - protein, 9 aa, Homo Sapiens
EPENGKRIR

SEQ ID NO: 473374 - protein, 9 aa, Homo Sapiens
YYSEGPTFA

SEQ ID NO: 473375 - protein, 9 aa, Homo Sapiens
PPPTQHSIT

SEQ ID NO: 473376 - protein, 9 aa, Homo Sapiens
NAIYMLLSG

SEQ ID NO: 473377 - protein, 9 aa, Homo Sapiens
KNCLLTVGG

SEQ ID NO: 473378 - protein, 9 aa, Homo Sapiens
RQDCRDIFP

SEQ ID NO: 473379 - protein, 9 aa, Homo Sapiens
CWNRLVPGD

SEQ ID NO: 473380 - protein, 9 aa, Homo Sapiens
DIFPQSLPK

SEQ ID NO: 473381 - protein, 9 aa, Homo Sapiens
SHELEAAEK

SEQ ID NO: 473382 - protein, 9 aa, Homo Sapiens
TNNKKEQYG

SEQ ID NO: 473383 - protein, 9 aa, Homo Sapiens
NLRPHNIAY

SEQ ID NO: 473384 - protein, 9 aa, Homo Sapiens
MCYAVIDPF

SEQ ID NO: 473385 - protein, 9 aa, Homo Sapiens
CAHSSYQEG

SEQ ID NO: 473386 - protein, 9 aa, Homo Sapiens
AIIGLYFLP

SEQ ID NO: 473387 - protein, 9 aa, Homo Sapiens
QVVQNRNHN

SEQ ID NO: 473388 - protein, 9 aa, Homo Sapiens
EALMWAEEG

SEQ ID NO: 473389 - protein, 9 aa, Homo Sapiens
TDTPVSARR

SEQ ID NO: 473390 - protein, 9 aa, Homo Sapiens
KFFNFCHFH

SEQ ID NO: 473391 - protein, 9 aa, Homo Sapiens
TIAISQKLC

SEQ ID NO: 473392 - protein, 9 aa, Homo Sapiens
EQRTVTLEI

SEQ ID NO: 473393 - protein, 9 aa, Homo Sapiens
CIVGPGPYR

SEQ ID NO: 473394 - protein, 9 aa, Homo Sapiens
SYAPHHPLP

SEQ ID NO: 473395 - protein, 9 aa, Homo Sapiens
VQHSIPLPE

SEQ ID NO: 473396 - protein, 9 aa, Homo Sapiens
SRGSPNSMS

SEQ ID NO: 473397 - protein, 9 aa, Homo Sapiens
QDCRDIFPQ

SEQ ID NO: 473398 - protein, 9 aa, Homo Sapiens
PHNIAYLLI

SEQ ID NO: 473399 - protein, 9 aa, Homo Sapiens
DKNEGQRME

SEQ ID NO: 473400 - protein, 9 aa, Homo Sapiens
IMCYAVIDP

SEQ ID NO: 473401 - protein, 9 aa, Homo Sapiens
PFGQKAGFS

SEQ ID NO: 473402 - protein, 9 aa, Homo Sapiens
RFASFVFIL

SEQ ID NO: 473403 - protein, 9 aa, Homo Sapiens
EITKQEKDF

SEQ ID NO: 473404 - protein, 9 aa, Homo Sapiens
AELRKAHGG

SEQ ID NO: 473405 - protein, 9 aa, Homo Sapiens
TDIWEIIET

SEQ ID NO: 473406 - protein, 9 aa, Homo Sapiens
GIDVTSKEV

SEQ ID NO: 473407 - protein, 9 aa, Homo Sapiens
PVPVRPPPP

SEQ ID NO: 473408 - protein, 9 aa, Homo Sapiens
VRGTDNGEA

SEQ ID NO: 473409 - protein, 9 aa, Homo Sapiens
PTFLLPWAF

SEQ ID NO: 473410 - protein, 9 aa, Homo Sapiens
RKAHGGRLR

SEQ ID NO: 473411 - protein, 9 aa, Homo Sapiens
EKALAKDLS

SEQ ID NO: 473412 - protein, 9 aa, Homo Sapiens
NLCVLAMWD

SEQ ID NO: 473413 - protein, 9 aa, Homo Sapiens
DDAKELGRV

SEQ ID NO: 473414 - protein, 9 aa, Homo Sapiens
VCGSVQATD

SEQ ID NO: 473415 - protein, 9 aa, Homo Sapiens
GSRFPIPLA

SEQ ID NO: 473416 - protein, 9 aa, Homo Sapiens
LIVIMSCLT

SEQ ID NO: 473417 - protein, 9 aa, Homo Sapiens
NPLLYTIAI

SEQ ID NO: 473418 - protein, 9 aa, Homo Sapiens
RRTLSAVGT

SEQ ID NO: 473419 - protein, 9 aa, Homo Sapiens
YGLYGAMVQ

SEQ ID NO: 473420 - protein, 9 aa, Homo Sapiens
HPPVPASYA

SEQ ID NO: 473421 - protein, 9 aa, Homo Sapiens
TEAEIHAHL

SEQ ID NO: 473422 - protein, 9 aa, Homo Sapiens
GGRRNLQPW

SEQ ID NO: 473423 - protein, 9 aa, Homo Sapiens
QHSIPLPES

SEQ ID NO: 473424 - protein, 9 aa, Homo Sapiens
LLTKGSEEK

SEQ ID NO: 473425 - protein, 9 aa, Homo Sapiens
VLLKPALVA

SEQ ID NO: 473426 - protein, 9 aa, Homo Sapiens
AVCGSVQAT

SEQ ID NO: 473427 - protein, 9 aa, Homo Sapiens
DENMSPLQA

SEQ ID NO: 473428 - protein, 9 aa, Homo Sapiens
PDPTDIWEI

SEQ ID NO: 473429 - protein, 9 aa, Homo Sapiens
KDLIHLYSE

SEQ ID NO: 473430 - protein, 9 aa, Homo Sapiens
SNLHRYNWI

SEQ ID NO: 473431 - protein, 9 aa, Homo Sapiens
STCLEQSLS

SEQ ID NO: 473432 - protein, 9 aa, Homo Sapiens
CMQCGRAFR

SEQ ID NO: 473433 - protein, 9 aa, Homo Sapiens
STNNKKEQY

SEQ ID NO: 473434 - protein, 9 aa, Homo Sapiens
VDLRKDAHS

SEQ ID NO: 473435 - protein, 9 aa, Homo Sapiens
PEHYSNLHR

SEQ ID NO: 473436 - protein, 9 aa, Homo Sapiens
LRQDCRDIF

SEQ ID NO: 473437 - protein, 9 aa, Homo Sapiens
PELEDRLQC

SEQ ID NO: 473438 - protein, 9 aa, Homo Sapiens
TKQEKDFLW

SEQ ID NO: 473439 - protein, 9 aa, Homo Sapiens
NGAVCGSVQ

SEQ ID NO: 473440 - protein, 9 aa, Homo Sapiens
LDRSGQGEV

SEQ ID NO: 473441 - protein, 9 aa, Homo Sapiens
VAPLLGASL

SEQ ID NO: 473442 - protein, 9 aa, Homo Sapiens
IKQLKDKNE

SEQ ID NO: 473443 - protein, 9 aa, Homo Sapiens
LLAERFPRH

SEQ ID NO: 473444 - protein, 9 aa, Homo Sapiens
YGAIIGLYF

SEQ ID NO: 473445 - protein, 9 aa, Homo Sapiens
LQPWPSAFK

SEQ ID NO: 473446 - protein, 9 aa, Homo Sapiens
FVHKVDLRK

SEQ ID NO: 473447 - protein, 9 aa, Homo Sapiens
VRAARALLC

SEQ ID NO: 473448 - protein, 9 aa, Homo Sapiens
LKPALVASR

SEQ ID NO: 473449 - protein, 9 aa, Homo Sapiens
MSIMSYNHL

SEQ ID NO: 473450 - protein, 9 aa, Homo Sapiens
YSISSCIHE

SEQ ID NO: 473451 - protein, 9 aa, Homo Sapiens
WAHPDGVGV

SEQ ID NO: 473452 - protein, 9 aa, Homo Sapiens
YYGAIIGLY

SEQ ID NO: 473453 - protein, 9 aa, Homo Sapiens
DFLLKDKHA

SEQ ID NO: 473454 - protein, 9 aa, Homo Sapiens
EFLSLLAKH

SEQ ID NO: 473455 - protein, 9 aa, Homo Sapiens
CLLTVGGVN

SEQ ID NO: 473456 - protein, 9 aa, Homo Sapiens
RSRGSPNSM

SEQ ID NO: 473457 - protein, 9 aa, Homo Sapiens
PASYAPHHP

SEQ ID NO: 473458 - protein, 9 aa, Homo Sapiens
AFLLTKGSE

SEQ ID NO: 473459 - protein, 9 aa, Homo Sapiens
ISSCIHEEV

SEQ ID NO: 473460 - protein, 9 aa, Homo Sapiens
RSQRLPRMS

SEQ ID NO: 473461 - protein, 9 aa, Homo Sapiens
PSRKKGDSY

SEQ ID NO: 473462 - protein, 9 aa, Homo Sapiens
PCQAYLGHL

SEQ ID NO: 473463 - protein, 9 aa, Homo Sapiens
IAISQKLCA

SEQ ID NO: 473464 - protein, 9 aa, Homo Sapiens
NGKRIRSDF

SEQ ID NO: 473465 - protein, 9 aa, Homo Sapiens
VKSAGSHIE

SEQ ID NO: 473466 - protein, 9 aa, Homo Sapiens
LKDKNEGQR

SEQ ID NO: 473467 - protein, 9 aa, Homo Sapiens
GQGEVYNLI

SEQ ID NO: 473468 - protein, 9 aa, Homo Sapiens
DTGNQLIVI

SEQ ID NO: 473469 - protein, 9 aa, Homo Sapiens
GAVCGSVQA

SEQ ID NO: 473470 - protein, 9 aa, Homo Sapiens
CFTCSTCWN

SEQ ID NO: 473471 - protein, 9 aa, Homo Sapiens
EKPFVCMQC

SEQ ID NO: 473472 - protein, 9 aa, Homo Sapiens
GMTVWQSKE

SEQ ID NO: 473473 - protein, 9 aa, Homo Sapiens
ALNSKAAAH

SEQ ID NO: 473474 - protein, 9 aa, Homo Sapiens
QVSHSLPHP

SEQ ID NO: 473475 - protein, 9 aa, Homo Sapiens
LDGTTPVWY

SEQ ID NO: 473476 - protein, 9 aa, Homo Sapiens
TGHRKISGA

SEQ ID NO: 473477 - protein, 9 aa, Homo Sapiens
QKLYPLISG

SEQ ID NO: 473478 - protein, 9 aa, Homo Sapiens
TDENMSPLQ

SEQ ID NO: 473479 - protein, 9 aa, Homo Sapiens
ARRTLSAVG

SEQ ID NO: 473480 - protein, 9 aa, Homo Sapiens
DPLSTVDSH

SEQ ID NO: 473481 - protein, 9 aa, Homo Sapiens
GRMKMSLQQ

SEQ ID NO: 473482 - protein, 9 aa, Homo Sapiens
NPDDAKELG

SEQ ID NO: 473483 - protein, 9 aa, Homo Sapiens
PPRMELRLV

SEQ ID NO: 473484 - protein, 9 aa, Homo Sapiens
TCSTCWNRL

SEQ ID NO: 473485 - protein, 9 aa, Homo Sapiens
SISSCIHEE

SEQ ID NO: 473486 - protein, 9 aa, Homo Sapiens
VVQNRNHNA

SEQ ID NO: 473487 - protein, 9 aa, Homo Sapiens
LTLRKHMTK

SEQ ID NO: 473488 - protein, 9 aa, Homo Sapiens
LHRYNWIEE

SEQ ID NO: 473489 - protein, 9 aa, Homo Sapiens
ARISTCLEQ

SEQ ID NO: 473490 - protein, 9 aa, Homo Sapiens
QQVVQNRNH

SEQ ID NO: 473491 - protein, 9 aa, Homo Sapiens
LVNPDDAKE

SEQ ID NO: 473492 - protein, 9 aa, Homo Sapiens
DVNITQEEW

SEQ ID NO: 473493 - protein, 9 aa, Homo Sapiens
LNLRPHNIA

SEQ ID NO: 473494 - protein, 9 aa, Homo Sapiens
FLSLLAKHY

SEQ ID NO: 473495 - protein, 9 aa, Homo Sapiens
FCHFHILSH

SEQ ID NO: 473496 - protein, 9 aa, Homo Sapiens
MPTFLLPWA

SEQ ID NO: 473497 - protein, 9 aa, Homo Sapiens
SSWNRKVAE

SEQ ID NO: 473498 - protein, 9 aa, Homo Sapiens
LSTVDSHVA

SEQ ID NO: 473499 - protein, 9 aa, Homo Sapiens
PVWYGLRLN

SEQ ID NO: 473500 - protein, 9 aa, Homo Sapiens
WTSGDALKT

SEQ ID NO: 473501 - protein, 9 aa, Homo Sapiens
KANGRMKMS

SEQ ID NO: 473502 - protein, 9 aa, Homo Sapiens
GHEAFLLTK

SEQ ID NO: 473503 - protein, 9 aa, Homo Sapiens
LISGPIVPI

SEQ ID NO: 473504 - protein, 9 aa, Homo Sapiens
FGKMMDRNR

SEQ ID NO: 473505 - protein, 9 aa, Homo Sapiens
GFRLSSEEA

SEQ ID NO: 473506 - protein, 9 aa, Homo Sapiens
LFFTGHRKI

SEQ ID NO: 473507 - protein, 9 aa, Homo Sapiens
GASLGGIIY

SEQ ID NO: 473508 - protein, 9 aa, Homo Sapiens
TTEEGMIQV

SEQ ID NO: 473509 - protein, 9 aa, Homo Sapiens
RLAPLNATA

SEQ ID NO: 473510 - protein, 9 aa, Homo Sapiens
NPANVSDLR

SEQ ID NO: 473511 - protein, 9 aa, Homo Sapiens
PPTQHSITD

SEQ ID NO: 473512 - protein, 9 aa, Homo Sapiens
EHYSNLHRY

SEQ ID NO: 473513 - protein, 9 aa, Homo Sapiens
MDFARSKQL

SEQ ID NO: 473514 - protein, 9 aa, Homo Sapiens
VVSSWNRKV

SEQ ID NO: 473515 - protein, 9 aa, Homo Sapiens
QRIRLAPLN

SEQ ID NO: 473516 - protein, 9 aa, Homo Sapiens
TCLEQSLST

SEQ ID NO: 473517 - protein, 9 aa, Homo Sapiens
DDPLSTVDS

SEQ ID NO: 473518 - protein, 9 aa, Homo Sapiens
LLDRSGQGE

SEQ ID NO: 473519 - protein, 9 aa, Homo Sapiens
HRYNWIEES

SEQ ID NO: 473520 - protein, 9 aa, Homo Sapiens
TKGSEEKRS

SEQ ID NO: 473521 - protein, 9 aa, Homo Sapiens
GYSISSCIH

SEQ ID NO: 473522 - protein, 9 aa, Homo Sapiens
TPVWYGLRL

SEQ ID NO: 473523 - protein, 9 aa, Homo Sapiens
KPFVCMQCG

SEQ ID NO: 473524 - protein, 9 aa, Homo Sapiens
FSVALENNR

SEQ ID NO: 473525 - protein, 9 aa, Homo Sapiens
VTGKNNFTD

SEQ ID NO: 473526 - protein, 9 aa, Homo Sapiens
CNPLLYTIA

SEQ ID NO: 473527 - protein, 9 aa, Homo Sapiens
ALVYRLIRN

SEQ ID NO: 473528 - protein, 9 aa, Homo Sapiens
GFQPCQAYL

SEQ ID NO: 473529 - protein, 9 aa, Homo Sapiens
DCGKTFNSP

SEQ ID NO: 473530 - protein, 9 aa, Homo Sapiens
ALMWAEEGQ

SEQ ID NO: 473531 - protein, 9 aa, Homo Sapiens
TKTYEAHAK

SEQ ID NO: 473532 - protein, 9 aa, Homo Sapiens
GLYRFASFV

SEQ ID NO: 473533 - protein, 9 aa, Homo Sapiens
SWNRKVAEY

SEQ ID NO: 473534 - protein, 9 aa, Homo Sapiens
FARSKQLLT

SEQ ID NO: 473535 - protein, 9 aa, Homo Sapiens
FTGHRKISG

SEQ ID NO: 473536 - protein, 9 aa, Homo Sapiens
FRRKYEETL

SEQ ID NO: 473537 - protein, 9 aa, Homo Sapiens
AGTAAVRGT

SEQ ID NO: 473538 - protein, 9 aa, Homo Sapiens
DIVCAHSSY

SEQ ID NO: 473539 - protein, 9 aa, Homo Sapiens
NGRMKMSLQ

SEQ ID NO: 473540 - protein, 9 aa, Homo Sapiens
LEQSLSTRS

SEQ ID NO: 473541 - protein, 9 aa, Homo Sapiens
LSSEEAASS

SEQ ID NO: 473542 - protein, 9 aa, Homo Sapiens
IGSRFPIPL

SEQ ID NO: 473543 - protein, 9 aa, Homo Sapiens
LCCLLSPLL

SEQ ID NO: 473544 - protein, 9 aa, Homo Sapiens
KTYEAHAKQ

SEQ ID NO: 473545 - protein, 9 aa, Homo Sapiens
RMKMSLQQK

SEQ ID NO: 473546 - protein, 9 aa, Homo Sapiens
PGAELRKAH

SEQ ID NO: 473547 - protein, 9 aa, Homo Sapiens
CSEAYIDAL

SEQ ID NO: 473548 - protein, 9 aa, Homo Sapiens
LLYTIAISQ

SEQ ID NO: 473549 - protein, 9 aa, Homo Sapiens
HFHNAIYML

SEQ ID NO: 473550 - protein, 9 aa, Homo Sapiens
SCPFGQKAG

SEQ ID NO: 473551 - protein, 9 aa, Homo Sapiens
AMLASQMEA

SEQ ID NO: 473552 - protein, 9 aa, Homo Sapiens
GQLHDVGSQ

SEQ ID NO: 473553 - protein, 9 aa, Homo Sapiens
HAHLVALAE

SEQ ID NO: 473554 - protein, 9 aa, Homo Sapiens
HSLPHPLYD

SEQ ID NO: 473555 - protein, 9 aa, Homo Sapiens
CLLSPLLKA

SEQ ID NO: 473556 - protein, 9 aa, Homo Sapiens
AWQVSLPEL

SEQ ID NO: 473557 - protein, 9 aa, Homo Sapiens
NIGSRFPIP

SEQ ID NO: 473558 - protein, 9 aa, Homo Sapiens
LGVTYEKAL

SEQ ID NO: 473559 - protein, 9 aa, Homo Sapiens
FREALMWAE

SEQ ID NO: 473560 - protein, 9 aa, Homo Sapiens
NHKFLHRMS

SEQ ID NO: 473561 - protein, 9 aa, Homo Sapiens
LTEAEIHAH

SEQ ID NO: 473562 - protein, 9 aa, Homo Sapiens
EGMIQVRKS

SEQ ID NO: 473563 - protein, 9 aa, Homo Sapiens
QNYILRATT

SEQ ID NO: 473564 - protein, 9 aa, Homo Sapiens
KLYPLISGP

SEQ ID NO: 473565 - protein, 9 aa, Homo Sapiens
VSLPELEDR

SEQ ID NO: 473566 - protein, 9 aa, Homo Sapiens
EAFLLTKGS

SEQ ID NO: 473567 - protein, 9 aa, Homo Sapiens
VKNCLLTVG

SEQ ID NO: 473568 - protein, 9 aa, Homo Sapiens
PTKIGSGCS

SEQ ID NO: 473569 - protein, 9 aa, Homo Sapiens
LCSCWMETP

SEQ ID NO: 473570 - protein, 9 aa, Homo Sapiens
EEDFPGIGN

SEQ ID NO: 473571 - protein, 9 aa, Homo Sapiens
HYEEKTQKQ

SEQ ID NO: 473572 - protein, 9 aa, Homo Sapiens
PDDAKELGR

SEQ ID NO: 473573 - protein, 9 aa, Homo Sapiens
SCIHEEVIN

SEQ ID NO: 473574 - protein, 9 aa, Homo Sapiens
LRPHNIAYL

SEQ ID NO: 473575 - protein, 9 aa, Homo Sapiens
AAGTAAVRG

SEQ ID NO: 473576 - protein, 9 aa, Homo Sapiens
DIWEIIETI

SEQ ID NO: 473577 - protein, 9 aa, Homo Sapiens
EEAVAEGVR

SEQ ID NO: 473578 - protein, 9 aa, Homo Sapiens
PMPTFLLPW

SEQ ID NO: 473579 - protein, 9 aa, Homo Sapiens
NKVDAVYEK

SEQ ID NO: 473580 - protein, 9 aa, Homo Sapiens
GMLIMCYAV

SEQ ID NO: 473581 - protein, 9 aa, Homo Sapiens
QPIQVHIPR

SEQ ID NO: 473582 - protein, 9 aa, Homo Sapiens
KSKYLISTE

SEQ ID NO: 473583 - protein, 9 aa, Homo Sapiens
DFARSKQLL

SEQ ID NO: 473584 - protein, 9 aa, Homo Sapiens
SATVAFFKV

SEQ ID NO: 473585 - protein, 9 aa, Homo Sapiens
AAANQQGSA

SEQ ID NO: 473586 - protein, 9 aa, Homo Sapiens
NLVSGTGYN

SEQ ID NO: 473587 - protein, 9 aa, Homo Sapiens
EMAPLGPKD

SEQ ID NO: 473588 - protein, 9 aa, Homo Sapiens
SSEEAASSF

SEQ ID NO: 473589 - protein, 9 aa, Homo Sapiens
LVIHGFNYS

SEQ ID NO: 473590 - protein, 9 aa, Homo Sapiens
RQPPPPTQH

SEQ ID NO: 473591 - protein, 9 aa, Homo Sapiens
LLKDKHADP

SEQ ID NO: 473592 - protein, 9 aa, Homo Sapiens
NITQEEWAL

SEQ ID NO: 473593 - protein, 9 aa, Homo Sapiens
IDVTSKEVI

SEQ ID NO: 473594 - protein, 9 aa, Homo Sapiens
RLPRMSDDN

SEQ ID NO: 473595 - protein, 9 aa, Homo Sapiens
SIHASMDFA

SEQ ID NO: 473596 - protein, 9 aa, Homo Sapiens
ANVSDLRAD

SEQ ID NO: 473597 - protein, 9 aa, Homo Sapiens
QLRHQASSD

SEQ ID NO: 473598 - protein, 9 aa, Homo Sapiens
RLVGQLHDV

SEQ ID NO: 473599 - protein, 9 aa, Homo Sapiens
MIQVRKSKG

SEQ ID NO: 473600 - protein, 9 aa, Homo Sapiens
ARALLCAVT

SEQ ID NO: 473601 - protein, 9 aa, Homo Sapiens
LDIVCAHSS

SEQ ID NO: 473602 - protein, 9 aa, Homo Sapiens
HKVDLRKDA

SEQ ID NO: 473603 - protein, 9 aa, Homo Sapiens
RHAGPGRLG

SEQ ID NO: 473604 - protein, 9 aa, Homo Sapiens
QLKDKNEGQ

SEQ ID NO: 473605 - protein, 9 aa, Homo Sapiens
DESSEDSIT

SEQ ID NO: 473606 - protein, 9 aa, Homo Sapiens
QDFLLKDKH

SEQ ID NO: 473607 - protein, 9 aa, Homo Sapiens
SAGQRIRLA

SEQ ID NO: 473608 - protein, 9 aa, Homo Sapiens
VAFFKVKWI

SEQ ID NO: 473609 - protein, 9 aa, Homo Sapiens
EPTKIGSGC

SEQ ID NO: 473610 - protein, 9 aa, Homo Sapiens
EAYIDALTL

SEQ ID NO: 473611 - protein, 9 aa, Homo Sapiens
EPITEPEVK

SEQ ID NO: 473612 - protein, 9 aa, Homo Sapiens
RSDFSLGST

SEQ ID NO: 473613 - protein, 9 aa, Homo Sapiens
ISTCLEQSL

SEQ ID NO: 473614 - protein, 9 aa, Homo Sapiens
KGDSYYLNR

SEQ ID NO: 473615 - protein, 9 aa, Homo Sapiens
RKANGRMKM

SEQ ID NO: 473616 - protein, 9 aa, Homo Sapiens
YKRELTMPL

SEQ ID NO: 473617 - protein, 9 aa, Homo Sapiens
MICFLVIHG

SEQ ID NO: 473618 - protein, 9 aa, Homo Sapiens
QGLYRFASF

SEQ ID NO: 473619 - protein, 9 aa, Homo Sapiens
YTIAISQKL

SEQ ID NO: 473620 - protein, 9 aa, Homo Sapiens
TSKEVIEKK

SEQ ID NO: 473621 - protein, 9 aa, Homo Sapiens
FLVIHGFNY

SEQ ID NO: 473622 - protein, 9 aa, Homo Sapiens
QPCQAYLGH

SEQ ID NO: 473623 - protein, 9 aa, Homo Sapiens
IRLAPLNAT

SEQ ID NO: 473624 - protein, 9 aa, Homo Sapiens
PKDLIHLYS

SEQ ID NO: 473625 - protein, 9 aa, Homo Sapiens
GAIIGLYFL

SEQ ID NO: 473626 - protein, 9 aa, Homo Sapiens
GDSYYLNRT

SEQ ID NO: 473627 - protein, 9 aa, Homo Sapiens
PNSMSQTSI

SEQ ID NO: 473628 - protein, 9 aa, Homo Sapiens
RDIFPQSLP

SEQ ID NO: 473629 - protein, 9 aa, Homo Sapiens
TMPLCIAAA

SEQ ID NO: 473630 - protein, 9 aa, Homo Sapiens
ITKQEKDFL

SEQ ID NO: 473631 - protein, 9 aa, Homo Sapiens
VWQSKEELI

SEQ ID NO: 473632 - protein, 9 aa, Homo Sapiens
ASNPANVSD

SEQ ID NO: 473633 - protein, 9 aa, Homo Sapiens
DVGSQVNYS

SEQ ID NO: 473634 - protein, 9 aa, Homo Sapiens
KQEKDFLWS

SEQ ID NO: 473635 - protein, 9 aa, Homo Sapiens
ASSASCPFG

SEQ ID NO: 473636 - protein, 9 aa, Homo Sapiens
HKFLHRMSP

SEQ ID NO: 473637 - protein, 9 aa, Homo Sapiens
DSRLEVGVD

SEQ ID NO: 473638 - protein, 9 aa, Homo Sapiens
LHHCTQPIQ

SEQ ID NO: 473639 - protein, 9 aa, Homo Sapiens
LKDKHADPD

SEQ ID NO: 473640 - protein, 9 aa, Homo Sapiens
RGSPNSMSQ

SEQ ID NO: 473641 - protein, 9 aa, Homo Sapiens
LNGAVCGSV

SEQ ID NO: 473642 - protein, 9 aa, Homo Sapiens
GSGCSSPVT

SEQ ID NO: 473643 - protein, 9 aa, Homo Sapiens
SQRLPRMSD

SEQ ID NO: 473644 - protein, 9 aa, Homo Sapiens
KGMTVWQSK

SEQ ID NO: 473645 - protein, 9 aa, Homo Sapiens
YLNLRPHNI

SEQ ID NO: 473646 - protein, 9 aa, Homo Sapiens
TCWNRLVPG

SEQ ID NO: 473647 - protein, 9 aa, Homo Sapiens
KEVIEKKEQ

SEQ ID NO: 473648 - protein, 9 aa, Homo Sapiens
MEQRTVTLE

SEQ ID NO: 473649 - protein, 9 aa, Homo Sapiens
YEETLKEVH

SEQ ID NO: 473650 - protein, 9 aa, Homo Sapiens
QLIVIMSCL

SEQ ID NO: 473651 - protein, 9 aa, Homo Sapiens
QLHDVGSQV

SEQ ID NO: 473652 - protein, 9 aa, Homo Sapiens
QVQQQVVQN

SEQ ID NO: 473653 - protein, 9 aa, Homo Sapiens
NTLDIVCAH

SEQ ID NO: 473654 - protein, 9 aa, Homo Sapiens
GEQGEEEDK

SEQ ID NO: 473655 - protein, 9 aa, Homo Sapiens
KMMDRNRIK

SEQ ID NO: 473656 - protein, 9 aa, Homo Sapiens
FTCSTCWNR

SEQ ID NO: 473657 - protein, 9 aa, Homo Sapiens
TMALNSKAA

SEQ ID NO: 473658 - protein, 9 aa, Homo Sapiens
AYLGHLGKG

SEQ ID NO: 473659 - protein, 9 aa, Homo Sapiens
LIKQLKDKN

SEQ ID NO: 473660 - protein, 9 aa, Homo Sapiens
SGDALKTAY

SEQ ID NO: 473661 - protein, 9 aa, Homo Sapiens
VKQKLYPLI

SEQ ID NO: 473662 - protein, 9 aa, Homo Sapiens
SLPDPTDIW

SEQ ID NO: 473663 - protein, 9 aa, Homo Sapiens
RKKGDSYYL

SEQ ID NO: 473664 - protein, 9 aa, Homo Sapiens
VCYSATVAF

SEQ ID NO: 473665 - protein, 9 aa, Homo Sapiens
QGPGLSWAH

SEQ ID NO: 473666 - protein, 9 aa, Homo Sapiens
ICLKFFNFC

SEQ ID NO: 473667 - protein, 9 aa, Homo Sapiens
AAAANQQGS

SEQ ID NO: 473668 - protein, 9 aa, Homo Sapiens
NSKAAAHAV

SEQ ID NO: 473669 - protein, 9 aa, Homo Sapiens
EKTMMEKNE

SEQ ID NO: 473670 - protein, 9 aa, Homo Sapiens
AHPDGVGVQ

SEQ ID NO: 473671 - protein, 9 aa, Homo Sapiens
FPGIGNKVD

SEQ ID NO: 473672 - protein, 9 aa, Homo Sapiens
SCSVKGEEK

SEQ ID NO: 473673 - protein, 9 aa, Homo Sapiens
TKKPVPVRP

SEQ ID NO: 473674 - protein, 9 aa, Homo Sapiens
SPNSMSQTS

SEQ ID NO: 473675 - protein, 9 aa, Homo Sapiens
SNPANVSDL

SEQ ID NO: 473676 - protein, 9 aa, Homo Sapiens
TLRQDCRDI

SEQ ID NO: 473677 - protein, 9 aa, Homo Sapiens
VAEGVRRAL

SEQ ID NO: 473678 - protein, 9 aa, Homo Sapiens
DRSGQGEVY

SEQ ID NO: 473679 - protein, 9 aa, Homo Sapiens
SGLKTMSIM

SEQ ID NO: 473680 - protein, 9 aa, Homo Sapiens
SDSRLEVGV

SEQ ID NO: 473681 - protein, 9 aa, Homo Sapiens
ASLGGIIYL

SEQ ID NO: 473682 - protein, 9 aa, Homo Sapiens
FGLGVTYEK

SEQ ID NO: 473683 - protein, 9 aa, Homo Sapiens
AERFPRHAG

SEQ ID NO: 473684 - protein, 9 aa, Homo Sapiens
QVFQVSHSL

SEQ ID NO: 473685 - protein, 9 aa, Homo Sapiens
RKISGADTV

SEQ ID NO: 473686 - protein, 9 aa, Homo Sapiens
GVRRALLGS

SEQ ID NO: 473687 - protein, 9 aa, Homo Sapiens
KFLHRMSPF

SEQ ID NO: 473688 - protein, 9 aa, Homo Sapiens
SVVSLYYGA

SEQ ID NO: 473689 - protein, 9 aa, Homo Sapiens
QSFLEKRPD

SEQ ID NO: 473690 - protein, 9 aa, Homo Sapiens
VQQQVVQNR

SEQ ID NO: 473691 - protein, 9 aa, Homo Sapiens
GYNLCVLAM

SEQ ID NO: 473692 - protein, 9 aa, Homo Sapiens
SGILRIYIQ

SEQ ID NO: 473693 - protein, 9 aa, Homo Sapiens
VCMQCGRAF

SEQ ID NO: 473694 - protein, 9 aa, Homo Sapiens
YSNLHRYNW

SEQ ID NO: 473695 - protein, 9 aa, Homo Sapiens
SVCYSATVA

SEQ ID NO: 473696 - protein, 9 aa, Homo Sapiens
IWEIIETIG

SEQ ID NO: 473697 - protein, 9 aa, Homo Sapiens
VNGMLIMCY

SEQ ID NO: 473698 - protein, 9 aa, Homo Sapiens
SYPCVVDES

SEQ ID NO: 473699 - protein, 9 aa, Homo Sapiens
KPVPVRPPP

SEQ ID NO: 473700 - protein, 9 aa, Homo Sapiens
SVLLKPALV

SEQ ID NO: 473701 - protein, 9 aa, Homo Sapiens
KTFNSPSHL

SEQ ID NO: 473702 - protein, 9 aa, Homo Sapiens
QRLPRMSDD

SEQ ID NO: 473703 - protein, 9 aa, Homo Sapiens
PLQALEPVL

SEQ ID NO: 473704 - protein, 9 aa, Homo Sapiens
IGSGCSSPV

SEQ ID NO: 473705 - protein, 9 aa, Homo Sapiens
IMSYNHLGN

SEQ ID NO: 473706 - protein, 9 aa, Homo Sapiens
STCWNRLVP

SEQ ID NO: 473707 - protein, 9 aa, Homo Sapiens
IHEEVINLI

SEQ ID NO: 473708 - protein, 9 aa, Homo Sapiens
AAVRGTDNG

SEQ ID NO: 473709 - protein, 9 aa, Homo Sapiens
VTSKEVIEK

SEQ ID NO: 473710 - protein, 9 aa, Homo Sapiens
SLLAKHYEE

SEQ ID NO: 473711 - protein, 9 aa, Homo Sapiens
SGQGEVYNL

SEQ ID NO: 473712 - protein, 9 aa, Homo Sapiens
CGDCGKTFN

SEQ ID NO: 473713 - protein, 9 aa, Homo Sapiens
NIAYLLIYM

SEQ ID NO: 473714 - protein, 9 aa, Homo Sapiens
RDGFRLSSE

SEQ ID NO: 473715 - protein, 9 aa, Homo Sapiens
EDFPGIGNK

SEQ ID NO: 473716 - protein, 9 aa, Homo Sapiens
SHIEDGVPQ

SEQ ID NO: 473717 - protein, 9 aa, Homo Sapiens
ITSVLLKPA

SEQ ID NO: 473718 - protein, 9 aa, Homo Sapiens
REALMWAEE

SEQ ID NO: 473719 - protein, 9 aa, Homo Sapiens
LRLVGDIEQ

SEQ ID NO: 473720 - protein, 9 aa, Homo Sapiens
RFPIPLASD

SEQ ID NO: 473721 - protein, 9 aa, Homo Sapiens
GEEKVFLIG

SEQ ID NO: 473722 - protein, 9 aa, Homo Sapiens
SASCPFGQK

SEQ ID NO: 473723 - protein, 9 aa, Homo Sapiens
GKTFNSPSH

SEQ ID NO: 473724 - protein, 9 aa, Homo Sapiens
SSQYYSEGP

SEQ ID NO: 473725 - protein, 9 aa, Homo Sapiens
RASQICYSV

SEQ ID NO: 473726 - protein, 9 aa, Homo Sapiens
RRNLQPWPS

SEQ ID NO: 473727 - protein, 9 aa, Homo Sapiens
SMSQTSIQA

SEQ ID NO: 473728 - protein, 9 aa, Homo Sapiens
GLYGAMVQH

SEQ ID NO: 473729 - protein, 9 aa, Homo Sapiens
DGTTPVWYG

SEQ ID NO: 473730 - protein, 9 aa, Homo Sapiens
KAAFFGRTS

SEQ ID NO: 473731 - protein, 9 aa, Homo Sapiens
EQQDEYSQN

SEQ ID NO: 473732 - protein, 9 aa, Homo Sapiens
SQYYSEGPT

SEQ ID NO: 473733 - protein, 9 aa, Homo Sapiens
FEDVDVNIT

SEQ ID NO: 473734 - protein, 9 aa, Homo Sapiens
DEHFFSVAL

SEQ ID NO: 473735 - protein, 9 aa, Homo Sapiens
AFFKVKWIF

SEQ ID NO: 473736 - protein, 9 aa, Homo Sapiens
ESLPDPTDI

SEQ ID NO: 473737 - protein, 9 aa, Homo Sapiens
IQVRKSKGK

SEQ ID NO: 473738 - protein, 9 aa, Homo Sapiens
ARQSFLEKR

SEQ ID NO: 473739 - protein, 9 aa, Homo Sapiens
PLCSCWMET

SEQ ID NO: 473740 - protein, 9 aa, Homo Sapiens
EKVFLIGKN

SEQ ID NO: 473741 - protein, 9 aa, Homo Sapiens
ITEPEVKSK

SEQ ID NO: 473742 - protein, 9 aa, Homo Sapiens
LMWTSGDAL

SEQ ID NO: 473743 - protein, 9 aa, Homo Sapiens
ASCPFGQKA

SEQ ID NO: 473744 - protein, 9 aa, Homo Sapiens
RLSSEEAAS

SEQ ID NO: 473745 - protein, 9 aa, Homo Sapiens
TYEKALAKD

SEQ ID NO: 473746 - protein, 9 aa, Homo Sapiens
AVTGKNNFT

SEQ ID NO: 473747 - protein, 9 aa, Homo Sapiens
NQLIVIMSC

SEQ ID NO: 473748 - protein, 9 aa, Homo Sapiens
YSATVAFFK

SEQ ID NO: 473749 - protein, 9 aa, Homo Sapiens
EEKVFLIGK

SEQ ID NO: 473750 - protein, 9 aa, Homo Sapiens
AVRGTDNGE

SEQ ID NO: 473751 - protein, 9 aa, Homo Sapiens
QALEPVLSS

SEQ ID NO: 473752 - protein, 9 aa, Homo Sapiens
EAVAEGVRR

SEQ ID NO: 473753 - protein, 9 aa, Homo Sapiens
PPLHPPVPA

SEQ ID NO: 473754 - protein, 9 aa, Homo Sapiens
PVRPPPPTN

SEQ ID NO: 473755 - protein, 9 aa, Homo Sapiens
AMVQHSIPL

SEQ ID NO: 473756 - protein, 9 aa, Homo Sapiens
WAAGTAAVR

SEQ ID NO: 473757 - protein, 9 aa, Homo Sapiens
LGPKDLIHL

SEQ ID NO: 473758 - protein, 9 aa, Homo Sapiens
GAMVQHSIP

SEQ ID NO: 473759 - protein, 9 aa, Homo Sapiens
MMDRNRIKR

SEQ ID NO: 473760 - protein, 9 aa, Homo Sapiens
AAAAANQQG

SEQ ID NO: 473761 - protein, 9 aa, Homo Sapiens
GEVYNLINR

SEQ ID NO: 473762 - protein, 9 aa, Homo Sapiens
MQCGRAFRE

SEQ ID NO: 473763 - protein, 9 aa, Homo Sapiens
GPGLSWAHP

SEQ ID NO: 473764 - protein, 9 aa, Homo Sapiens
QGEVYNLIN

SEQ ID NO: 473765 - protein, 9 aa, Homo Sapiens
TVTMALNSK

SEQ ID NO: 473766 - protein, 9 aa, Homo Sapiens
HPMPTFLLP

SEQ ID NO: 473767 - protein, 9 aa, Homo Sapiens
KCFTCSTCW

SEQ ID NO: 473768 - protein, 9 aa, Homo Sapiens
LLPWAFPLA

SEQ ID NO: 473769 - protein, 9 aa, Homo Sapiens
VNITQEEWA

SEQ ID NO: 473770 - protein, 9 aa, Homo Sapiens
HRKISGADT

SEQ ID NO: 473771 - protein, 9 aa, Homo Sapiens
GLHHCTQPI

SEQ ID NO: 473772 - protein, 9 aa, Homo Sapiens
LKFFNFCHF

SEQ ID NO: 473773 - protein, 9 aa, Homo Sapiens
LYPLISGPI

SEQ ID NO: 473774 - protein, 9 aa, Homo Sapiens
LHDVGSQVN

SEQ ID NO: 473775 - protein, 9 aa, Homo Sapiens
KALAKDLSI

SEQ ID NO: 473776 - protein, 9 aa, Homo Sapiens
VVDESSEDS

SEQ ID NO: 473777 - protein, 9 aa, Homo Sapiens
KDKNEGQRM

SEQ ID NO: 473778 - protein, 9 aa, Homo Sapiens
SPPLHPPVP

SEQ ID NO: 473779 - protein, 9 aa, Homo Sapiens
FAKGMTVWQ

SEQ ID NO: 473780 - protein, 9 aa, Homo Sapiens
NRKVAEYGK

SEQ ID NO: 473781 - protein, 9 aa, Homo Sapiens
QGEEEDKEE

SEQ ID NO: 473782 - protein, 9 aa, Homo Sapiens
LFVHKVDLR

SEQ ID NO: 473783 - protein, 9 aa, Homo Sapiens
EDGTEDDDL

SEQ ID NO: 473784 - protein, 9 aa, Homo Sapiens
LHRMSPFGS

SEQ ID NO: 473785 - protein, 9 aa, Homo Sapiens
AAFFGRTSS

SEQ ID NO: 473786 - protein, 9 aa, Homo Sapiens
RNLQPWPSA

SEQ ID NO: 473787 - protein, 9 aa, Homo Sapiens
WPSAFKPLS

SEQ ID NO: 473788 - protein, 9 aa, Homo Sapiens
LTKGSEEKR

SEQ ID NO: 473789 - protein, 9 aa, Homo Sapiens
QYGPGVQGK

SEQ ID NO: 473790 - protein, 9 aa, Homo Sapiens
AKELGRVKA

SEQ ID NO: 473791 - protein, 9 aa, Homo Sapiens
LPLGPHLHT

SEQ ID NO: 473792 - protein, 9 aa, Homo Sapiens
RHQASSDYD

SEQ ID NO: 473793 - protein, 9 aa, Homo Sapiens
CLKFFNFCH

SEQ ID NO: 473794 - protein, 9 aa, Homo Sapiens
FLLDDPLST

SEQ ID NO: 473795 - protein, 9 aa, Homo Sapiens
ASTKKPVPV

SEQ ID NO: 473796 - protein, 9 aa, Homo Sapiens
WTLRQDCRD

SEQ ID NO: 473797 - protein, 9 aa, Homo Sapiens
LKTMSIMSY

SEQ ID NO: 473798 - protein, 9 aa, Homo Sapiens
PLISGPIVP

SEQ ID NO: 473799 - protein, 9 aa, Homo Sapiens
SRLEVGVDM

SEQ ID NO: 473800 - protein, 9 aa, Homo Sapiens
DAKELGRVK

SEQ ID NO: 473801 - protein, 9 aa, Homo Sapiens
RKYEETLKE

SEQ ID NO: 473802 - protein, 9 aa, Homo Sapiens
NFCHFHILS

SEQ ID NO: 473803 - protein, 9 aa, Homo Sapiens
TEPEVKSKY

SEQ ID NO: 473804 - protein, 9 aa, Homo Sapiens
KAIRHAFDV

SEQ ID NO: 473805 - protein, 9 aa, Homo Sapiens
PCVVDESSE

SEQ ID NO: 473806 - protein, 9 aa, Homo Sapiens
VAAMLASQM

SEQ ID NO: 473807 - protein, 9 aa, Homo Sapiens
RDPLSEITK

SEQ ID NO: 473808 - protein, 9 aa, Homo Sapiens
SGTGYNLCV

SEQ ID NO: 473809 - protein, 9 aa, Homo Sapiens
RYNWIEESN

SEQ ID NO: 473810 - protein, 9 aa, Homo Sapiens
LFLCCLLSP

SEQ ID NO: 473811 - protein, 9 aa, Homo Sapiens
TFAVVQLRH

SEQ ID NO: 473812 - protein, 9 aa, Homo Sapiens
WMETPKSRE

SEQ ID NO: 473813 - protein, 9 aa, Homo Sapiens
DEYSQNYIL

SEQ ID NO: 473814 - protein, 9 aa, Homo Sapiens
HCTQPIQVH

SEQ ID NO: 473815 - protein, 9 aa, Homo Sapiens
FVKSAGSHI

SEQ ID NO: 473816 - protein, 9 aa, Homo Sapiens
EASNHKFLH

SEQ ID NO: 473817 - protein, 9 aa, Homo Sapiens
YEKALAKDL

SEQ ID NO: 473818 - protein, 9 aa, Homo Sapiens
EPVRSGILR

SEQ ID NO: 473819 - protein, 9 aa, Homo Sapiens
CWMETPKSR

SEQ ID NO: 473820 - protein, 9 aa, Homo Sapiens
PGPSSPPLH

SEQ ID NO: 473821 - protein, 9 aa, Homo Sapiens
FNFCHFHIL

SEQ ID NO: 473822 - protein, 9 aa, Homo Sapiens
RIRLAPLNA

SEQ ID NO: 473823 - protein, 9 aa, Homo Sapiens
TTITSVLLK

SEQ ID NO: 473824 - protein, 9 aa, Homo Sapiens
VQGPGLSWA

SEQ ID NO: 473825 - protein, 9 aa, Homo Sapiens
FPGAELRKA

SEQ ID NO: 473826 - protein, 9 aa, Homo Sapiens
TSVLLKPAL

SEQ ID NO: 473827 - protein, 9 aa, Homo Sapiens
VIMSCLTKE

SEQ ID NO: 473828 - protein, 9 aa, Homo Sapiens
DALKTAYFL

SEQ ID NO: 473829 - protein, 9 aa, Homo Sapiens
SKDNLEDGT

SEQ ID NO: 473830 - protein, 9 aa, Homo Sapiens
ANQQGSAKN

SEQ ID NO: 473831 - protein, 9 aa, Homo Sapiens
VGSQVNYSM

SEQ ID NO: 473832 - protein, 9 aa, Homo Sapiens
VARISTCLE

SEQ ID NO: 473833 - protein, 9 aa, Homo Sapiens
PPPPTQHSI

SEQ ID NO: 473834 - protein, 9 aa, Homo Sapiens
LKTAYFLLK

SEQ ID NO: 473835 - protein, 9 aa, Homo Sapiens
CTQPIQVHI

SEQ ID NO: 473836 - protein, 9 aa, Homo Sapiens
SKEVIEKKE

SEQ ID NO: 473837 - protein, 9 aa, Homo Sapiens
TEEGMIQVR

SEQ ID NO: 473838 - protein, 9 aa, Homo Sapiens
QVSLPELED

SEQ ID NO: 473839 - protein, 9 aa, Homo Sapiens
AARALLCAV

SEQ ID NO: 473840 - protein, 9 aa, Homo Sapiens
YAPHHPLPG

SEQ ID NO: 473841 - protein, 9 aa, Homo Sapiens
DPTDIWEII

SEQ ID NO: 473842 - protein, 9 aa, Homo Sapiens
SEITKQEKD

SEQ ID NO: 473843 - protein, 9 aa, Homo Sapiens
EYSQNYILR

SEQ ID NO: 473844 - protein, 9 aa, Homo Sapiens
GYTKTYEAH

SEQ ID NO: 473845 - protein, 9 aa, Homo Sapiens
RHMKAAFFG

SEQ ID NO: 473846 - protein, 9 aa, Homo Sapiens
VKGEEKVFL

SEQ ID NO: 473847 - protein, 9 aa, Homo Sapiens
FQPCQAYLG

SEQ ID NO: 473848 - protein, 9 aa, Homo Sapiens
VQSAGQRIR

SEQ ID NO: 473849 - protein, 9 aa, Homo Sapiens
HNAIYMLLS

SEQ ID NO: 473850 - protein, 9 aa, Homo Sapiens
CYSVPEETE

SEQ ID NO: 473851 - protein, 9 aa, Homo Sapiens
RKAIRHAFD

SEQ ID NO: 473852 - protein, 9 aa, Homo Sapiens
CVVDESSED

SEQ ID NO: 473853 - protein, 9 aa, Homo Sapiens
DGFRLSSEE

SEQ ID NO: 473854 - protein, 9 aa, Homo Sapiens
THHPMPTFL

SEQ ID NO: 473855 - protein, 9 aa, Homo Sapiens
QDYLNGAVC

SEQ ID NO: 473856 - protein, 9 aa, Homo Sapiens
EVKSKYLIS

SEQ ID NO: 473857 - protein, 9 aa, Homo Sapiens
DALTLRKHM

SEQ ID NO: 473858 - protein, 9 aa, Homo Sapiens
RLEVGVDMR

SEQ ID NO: 473859 - protein, 9 aa, Homo Sapiens
EVANLFGKM

SEQ ID NO: 473860 - protein, 9 aa, Homo Sapiens
TQHSITDNS

SEQ ID NO: 473861 - protein, 9 aa, Homo Sapiens
QEVPLCSCW

SEQ ID NO: 473862 - protein, 9 aa, Homo Sapiens
KISGADTVG

SEQ ID NO: 473863 - protein, 9 aa, Homo Sapiens
LIMCYAVID

SEQ ID NO: 473864 - protein, 9 aa, Homo Sapiens
PVSARRTLS

SEQ ID NO: 473865 - protein, 9 aa, Homo Sapiens
EEAASSFGD

SEQ ID NO: 473866 - protein, 9 aa, Homo Sapiens
TITSVLLKP

SEQ ID NO: 473867 - protein, 9 aa, Homo Sapiens
EDCMICFLV

SEQ ID NO: 473868 - protein, 9 aa, Homo Sapiens
STKKPVPVR

SEQ ID NO: 473869 - protein, 9 aa, Homo Sapiens
KRIRSDFSL

SEQ ID NO: 473870 - protein, 9 aa, Homo Sapiens
SVALENNRR

SEQ ID NO: 473871 - protein, 9 aa, Homo Sapiens
ICNPLLYTI

SEQ ID NO: 473872 - protein, 9 aa, Homo Sapiens
VFAKGMTVW

SEQ ID NO: 473873 - protein, 9 aa, Homo Sapiens
MAWQVSLPE

SEQ ID NO: 473874 - protein, 9 aa, Homo Sapiens
DLFRSVVTV

SEQ ID NO: 473875 - protein, 9 aa, Homo Sapiens
DFFLFLCCL

SEQ ID NO: 473876 - protein, 9 aa, Homo Sapiens
IYMLLSGAG

SEQ ID NO: 473877 - protein, 9 aa, Homo Sapiens
CLPLGPHLH

SEQ ID NO: 473878 - protein, 9 aa, Homo Sapiens
ASFVFILMG

SEQ ID NO: 473879 - protein, 9 aa, Homo Sapiens
ILRIYIQVV

SEQ ID NO: 473880 - protein, 9 aa, Homo Sapiens
MTVWQSKEE

SEQ ID NO: 473881 - protein, 9 aa, Homo Sapiens
RSGILRIYI

SEQ ID NO: 473882 - protein, 9 aa, Homo Sapiens
KYEETLKEV

SEQ ID NO: 473883 - protein, 9 aa, Homo Sapiens
CPFGQKAGF

SEQ ID NO: 473884 - protein, 9 aa, Homo Sapiens
SEGPTFAAN

SEQ ID NO: 473885 - protein, 9 aa, Homo Sapiens
LSLLAKHYE

SEQ ID NO: 473886 - protein, 9 aa, Homo Sapiens
HPSRKKGDS

SEQ ID NO: 473887 - protein, 9 aa, Homo Sapiens
TNIDEHFFS

SEQ ID NO: 473888 - protein, 9 aa, Homo Sapiens
MEAFVPIFT

SEQ ID NO: 473889 - protein, 9 aa, Homo Sapiens
DLQDFLLKD

SEQ ID NO: 473890 - protein, 9 aa, Homo Sapiens
MSYNHLGNN

SEQ ID NO: 473891 - protein, 9 aa, Homo Sapiens
LKEVHNLNQ

SEQ ID NO: 473892 - protein, 9 aa, Homo Sapiens
GILRIYIQV

SEQ ID NO: 473893 - protein, 9 aa, Homo Sapiens
EFPGAELRK

SEQ ID NO: 473894 - protein, 9 aa, Homo Sapiens
PLHPPVPAS

SEQ ID NO: 473895 - protein, 9 aa, Homo Sapiens
AKGMTVWQS

SEQ ID NO: 473896 - protein, 9 aa, Homo Sapiens
PLSTVDSHV

SEQ ID NO: 473897 - protein, 9 aa, Homo Sapiens
DKEEEEEED

SEQ ID NO: 473898 - protein, 9 aa, Homo Sapiens
EVGVDMRKV

SEQ ID NO: 473899 - protein, 9 aa, Homo Sapiens
DRSQRLPRM

SEQ ID NO: 473900 - protein, 9 aa, Homo Sapiens
SSDRSQRLP

SEQ ID NO: 473901 - protein, 9 aa, Homo Sapiens
HHPMPTFLL

SEQ ID NO: 473902 - protein, 9 aa, Homo Sapiens
EPPRMELRL

SEQ ID NO: 473903 - protein, 9 aa, Homo Sapiens
ASNHKFLHR

SEQ ID NO: 473904 - protein, 9 aa, Homo Sapiens
EHCIVGPGP

SEQ ID NO: 473905 - protein, 9 aa, Homo Sapiens
LVYRLIRNA

SEQ ID NO: 473906 - protein, 9 aa, Homo Sapiens
ISGADTVGD

SEQ ID NO: 473907 - protein, 9 aa, Homo Sapiens
VSSWNRKVA

SEQ ID NO: 473908 - protein, 9 aa, Homo Sapiens
ESMIPKARQ

SEQ ID NO: 473909 - protein, 9 aa, Homo Sapiens
VCAHSSYQE

SEQ ID NO: 473910 - protein, 9 aa, Homo Sapiens
ANGRMKMSL

SEQ ID NO: 473911 - protein, 9 aa, Homo Sapiens
AAEKTMMEK

SEQ ID NO: 473912 - protein, 9 aa, Homo Sapiens
TLDIVCAHS

SEQ ID NO: 473913 - protein, 9 aa, Homo Sapiens
VSGTGYNLC

SEQ ID NO: 473914 - protein, 9 aa, Homo Sapiens
FLLPWAFPL

SEQ ID NO: 473915 - protein, 9 aa, Homo Sapiens
RFCPACLPL

SEQ ID NO: 473916 - protein, 9 aa, Homo Sapiens
RGFQPCQAY

SEQ ID NO: 473917 - protein, 9 aa, Homo Sapiens
KVFLIGKNF

SEQ ID NO: 473918 - protein, 9 aa, Homo Sapiens
PSSPPLHPP

SEQ ID NO: 473919 - protein, 9 aa, Homo Sapiens
AYIDALTLR

SEQ ID NO: 473920 - protein, 9 aa, Homo Sapiens
LTMPLCIAA

SEQ ID NO: 473921 - protein, 9 aa, Homo Sapiens
FHNAIYMLL

SEQ ID NO: 473922 - protein, 9 aa, Homo Sapiens
GSPNSMSQT

SEQ ID NO: 473923 - protein, 9 aa, Homo Sapiens
HHCTQPIQV

SEQ ID NO: 473924 - protein, 9 aa, Homo Sapiens
DLRKDAHST

SEQ ID NO: 473925 - protein, 9 aa, Homo Sapiens
LASQMEAFV

SEQ ID NO: 473926 - protein, 9 aa, Homo Sapiens
LLTVGGVNQ

SEQ ID NO: 473927 - protein, 9 aa, Homo Sapiens
HMKAAFFGR

SEQ ID NO: 473928 - protein, 9 aa, Homo Sapiens
FFLFLCCLL

SEQ ID NO: 473929 - protein, 9 aa, Homo Sapiens
VSARRTLSA

SEQ ID NO: 473930 - protein, 9 aa, Homo Sapiens
EHFFSVALE

SEQ ID NO: 473931 - protein, 9 aa, Homo Sapiens
VFEDVDVNI

SEQ ID NO: 473932 - protein, 9 aa, Homo Sapiens
PITEPEVKS

SEQ ID NO: 473933 - protein, 9 aa, Homo Sapiens
GSYPCVVDE

SEQ ID NO: 473934 - protein, 9 aa, Homo Sapiens
ESSDRSQRL

SEQ ID NO: 473935 - protein, 9 aa, Homo Sapiens
SYYLNRTHM

SEQ ID NO: 473936 - protein, 9 aa, Homo Sapiens
KARQSFLEK

SEQ ID NO: 473937 - protein, 9 aa, Homo Sapiens
IPKARQSFL

SEQ ID NO: 473938 - protein, 9 aa, Homo Sapiens
MKMSLQQKR

SEQ ID NO: 473939 - protein, 9 aa, Homo Sapiens
ACLPLGPHL

SEQ ID NO: 473940 - protein, 9 aa, Homo Sapiens
VGVDMRKVH

SEQ ID NO: 473941 - protein, 9 aa, Homo Sapiens
KQLKDKNEG

SEQ ID NO: 473942 - protein, 9 aa, Homo Sapiens
SFVFILMGV

SEQ ID NO: 473943 - protein, 9 aa, Homo Sapiens
SSCIHEEVI

SEQ ID NO: 473944 - protein, 9 aa, Homo Sapiens
TPVSARRTL

SEQ ID NO: 473945 - protein, 9 aa, Homo Sapiens
SSASCPFGQ

SEQ ID NO: 473946 - protein, 9 aa, Homo Sapiens
FVCMQCGRA

SEQ ID NO: 473947 - protein, 9 aa, Homo Sapiens
HIEDGVPQH

SEQ ID NO: 473948 - protein, 9 aa, Homo Sapiens
SNHKFLHRM

SEQ ID NO: 473949 - protein, 9 aa, Homo Sapiens
VPLCSCWME

SEQ ID NO: 473950 - protein, 9 aa, Homo Sapiens
AANQQGSAK

SEQ ID NO: 473951 - protein, 9 aa, Homo Sapiens
FQVSHSLPH

SEQ ID NO: 473952 - protein, 9 aa, Homo Sapiens
SQGLYRFAS

SEQ ID NO: 473953 - protein, 9 aa, Homo Sapiens
TNKKAVTGK

SEQ ID NO: 473954 - protein, 9 aa, Homo Sapiens
KRELTMPLC

SEQ ID NO: 473955 - protein, 9 aa, Homo Sapiens
VHKVDLRKD

SEQ ID NO: 473956 - protein, 9 aa, Homo Sapiens
MLASQMEAF

SEQ ID NO: 473957 - protein, 9 aa, Homo Sapiens
YRSSQYYSE

SEQ ID NO: 473958 - protein, 9 aa, Homo Sapiens
MWTSGDALK

SEQ ID NO: 473959 - protein, 9 aa, Homo Sapiens
IGSYPCVVD

SEQ ID NO: 473960 - protein, 9 aa, Homo Sapiens
GVDMRKVHH

SEQ ID NO: 473961 - protein, 9 aa, Homo Sapiens
HFFSVALEN

SEQ ID NO: 473962 - protein, 9 aa, Homo Sapiens
QYYSEGPTF

SEQ ID NO: 473963 - protein, 9 aa, Homo Sapiens
CAVTRLLIL

SEQ ID NO: 473964 - protein, 9 aa, Homo Sapiens
EARASQICY

SEQ ID NO: 473965 - protein, 9 aa, Homo Sapiens
TFNSPSHLI

SEQ ID NO: 473966 - protein, 9 aa, Homo Sapiens
GTTPVWYGL

SEQ ID NO: 473967 - protein, 9 aa, Homo Sapiens
ELEAAEKTM

SEQ ID NO: 473968 - protein, 9 aa, Homo Sapiens
KVDLRKDAH

SEQ ID NO: 473969 - protein, 9 aa, Homo Sapiens
RISTCLEQS

SEQ ID NO: 473970 - protein, 9 aa, Homo Sapiens
AAMLASQME

SEQ ID NO: 473971 - protein, 9 aa, Homo Sapiens
YMLLSGAGG

SEQ ID NO: 473972 - protein, 9 aa, Homo Sapiens
GKNNFTDTM

SEQ ID NO: 473973 - protein, 9 aa, Homo Sapiens
SASSASCPF

SEQ ID NO: 473974 - protein, 9 aa, Homo Sapiens
LLCAVTRLL

SEQ ID NO: 473975 - protein, 9 aa, Homo Sapiens
TQPIQVHIP

SEQ ID NO: 473976 - protein, 9 aa, Homo Sapiens
VRSGILRIY

SEQ ID NO: 473977 - protein, 9 aa, Homo Sapiens
FWAAGTAAV

SEQ ID NO: 473978 - protein, 9 aa, Homo Sapiens
MLIMCYAVI

SEQ ID NO: 473979 - protein, 9 aa, Homo Sapiens
KSAGSHIED

SEQ ID NO: 473980 - protein, 9 aa, Homo Sapiens
DDLQDFLLK

SEQ ID NO: 473981 - protein, 9 aa, Homo Sapiens
KVAEYGKKA

SEQ ID NO: 473982 - protein, 9 aa, Homo Sapiens
EAHAKQKFS

SEQ ID NO: 473983 - protein, 9 aa, Homo Sapiens
RELTMPLCI

SEQ ID NO: 473984 - protein, 9 aa, Homo Sapiens
HAGPGRLGL

SEQ ID NO: 473985 - protein, 9 aa, Homo Sapiens
DNLEDGTED

SEQ ID NO: 473986 - protein, 9 aa, Homo Sapiens
NGYSISSCI

SEQ ID NO: 473987 - protein, 9 aa, Homo Sapiens
TGKNNFTDT

SEQ ID NO: 473988 - protein, 9 aa, Homo Sapiens
QSAGQRIRL

SEQ ID NO: 473989 - protein, 9 aa, Homo Sapiens
DVDVNITQE

SEQ ID NO: 473990 - protein, 9 aa, Homo Sapiens
MIPKARQSF

SEQ ID NO: 473991 - protein, 9 aa, Homo Sapiens
MALNSKAAA

SEQ ID NO: 473992 - protein, 9 aa, Homo Sapiens
ASQMEAFVP

SEQ ID NO: 473993 - protein, 9 aa, Homo Sapiens
VSHSLPHPL

SEQ ID NO: 473994 - protein, 9 aa, Homo Sapiens
HRMSPFGSL

SEQ ID NO: 473995 - protein, 9 aa, Homo Sapiens
TAAVRGTDN

SEQ ID NO: 473996 - protein, 9 aa, Homo Sapiens
KAAAHAVAT

SEQ ID NO: 473997 - protein, 9 aa, Homo Sapiens
EEGMIQVRK

SEQ ID NO: 473998 - protein, 9 aa, Homo Sapiens
KKGDSYYLN

SEQ ID NO: 473999 - protein, 9 aa, Homo Sapiens
GDALKTAYF

SEQ ID NO: 474000 - protein, 9 aa, Homo Sapiens
FASFVFILM

SEQ ID NO: 474001 - protein, 9 aa, Homo Sapiens
HNIAYLLIY

SEQ ID NO: 474002 - protein, 9 aa, Homo Sapiens
NNKKEQYGP

SEQ ID NO: 474003 - protein, 9 aa, Homo Sapiens
PPGPSSPPL

SEQ ID NO: 474004 - protein, 9 aa, Homo Sapiens
RRASNPANV

SEQ ID NO: 474005 - protein, 9 aa, Homo Sapiens
AEIHAHLVA

SEQ ID NO: 474006 - protein, 9 aa, Homo Sapiens
IVCAHSSYQ

SEQ ID NO: 474007 - protein, 9 aa, Homo Sapiens
KKPVPVRPP

SEQ ID NO: 474008 - protein, 9 aa, Homo Sapiens
YEAHAKQKF

SEQ ID NO: 474009 - protein, 9 aa, Homo Sapiens
TVAFFKVKW

SEQ ID NO: 474010 - protein, 9 aa, Homo Sapiens
MELRLVGDI

SEQ ID NO: 474011 - protein, 9 aa, Homo Sapiens
TKIGSGCSS

SEQ ID NO: 474012 - protein, 9 aa, Homo Sapiens
EPEVKSKYL

SEQ ID NO: 474013 - protein, 9 aa, Homo Sapiens
ELRLVGDIE

SEQ ID NO: 474014 - protein, 9 aa, Homo Sapiens
YSEGPTFAA

SEQ ID NO: 474015 - protein, 9 aa, Homo Sapiens
YAVIDPFIY

SEQ ID NO: 474016 - protein, 9 aa, Homo Sapiens
VPASYAPHH

SEQ ID NO: 474017 - protein, 9 aa, Homo Sapiens
RFPRHAGPG

SEQ ID NO: 474018 - protein, 9 aa, Homo Sapiens
SIMSYNHLG

SEQ ID NO: 474019 - protein, 9 aa, Homo Sapiens
TLKEVHNLN

SEQ ID NO: 474020 - protein, 9 aa, Homo Sapiens
QDEYSQNYI

SEQ ID NO: 474021 - protein, 9 aa, Homo Sapiens
CYSATVAFF

SEQ ID NO: 474022 - protein, 9 aa, Homo Sapiens
EIHAHLVAL

SEQ ID NO: 474023 - protein, 9 aa, Homo Sapiens
SMIPKARQS

SEQ ID NO: 474024 - protein, 9 aa, Homo Sapiens
CSSPVTVNQ

SEQ ID NO: 474025 - protein, 9 aa, Homo Sapiens
SQNYILRAT

SEQ ID NO: 474026 - protein, 9 aa, Homo Sapiens
WYGLRLNMD

SEQ ID NO: 474027 - protein, 9 aa, Homo Sapiens
PGLSWAHPD

SEQ ID NO: 474028 - protein, 9 aa, Homo Sapiens
SSPPLHPPV

SEQ ID NO: 474029 - protein, 9 aa, Homo Sapiens
MSPLQALEP

SEQ ID NO: 474030 - protein, 9 aa, Homo Sapiens
RAARALLCA

SEQ ID NO: 474031 - protein, 9 aa, Homo Sapiens
QAYLGHLGK

SEQ ID NO: 474032 - protein, 9 aa, Homo Sapiens
VLSRRHMKA

SEQ ID NO: 474033 - protein, 9 aa, Homo Sapiens
TTGLHHCTQ

SEQ ID NO: 474034 - protein, 9 aa, Homo Sapiens
KTMSIMSYN

SEQ ID NO: 474035 - protein, 9 aa, Homo Sapiens
GPKDLIHLY

SEQ ID NO: 474036 - protein, 9 aa, Homo Sapiens
GTGYNLCVL

SEQ ID NO: 474037 - protein, 9 aa, Homo Sapiens
ATTITSVLL

SEQ ID NO: 474038 - protein, 9 aa, Homo Sapiens
TSGDALKTA

SEQ ID NO: 474039 - protein, 9 aa, Homo Sapiens
SLPHPLYDM

SEQ ID NO: 474040 - protein, 9 aa, Homo Sapiens
ARASQICYS

SEQ ID NO: 474041 - protein, 9 aa, Homo Sapiens
GSHIEDGVP

SEQ ID NO: 474042 - protein, 9 aa, Homo Sapiens
REEAVAEGV

SEQ ID NO: 474043 - protein, 9 aa, Homo Sapiens
FLCCLLSPL

SEQ ID NO: 474044 - protein, 9 aa, Homo Sapiens
FLLKDKHAD

SEQ ID NO: 474045 - protein, 9 aa, Homo Sapiens
ERFPRHAGP

SEQ ID NO: 474046 - protein, 9 aa, Homo Sapiens
GNKVDAVYE

SEQ ID NO: 474047 - protein, 9 aa, Homo Sapiens
ASYAPHHPL

SEQ ID NO: 474048 - protein, 9 aa, Homo Sapiens
FLHRMSPFG

SEQ ID NO: 474049 - protein, 9 aa, Homo Sapiens
RPHNIAYLL

SEQ ID NO: 474050 - protein, 9 aa, Homo Sapiens
LVSGTGYNL

SEQ ID NO: 474051 - protein, 9 aa, Homo Sapiens
CSCWMETPK

SEQ ID NO: 474052 - protein, 9 aa, Homo Sapiens
TNIGSRFPI

SEQ ID NO: 474053 - protein, 9 aa, Homo Sapiens
SWAHPDGVG

SEQ ID NO: 474054 - protein, 9 aa, Homo Sapiens
LRKDAHSTL

SEQ ID NO: 474055 - protein, 9 aa, Homo Sapiens
LSEITKQEK

SEQ ID NO: 474056 - protein, 9 aa, Homo Sapiens
CPACLPLGP

SEQ ID NO: 474057 - protein, 9 aa, Homo Sapiens
VRPPPPTNF

SEQ ID NO: 474058 - protein, 9 aa, Homo Sapiens
GRRNLQPWP

SEQ ID NO: 474059 - protein, 9 aa, Homo Sapiens
HELEAAEKT

SEQ ID NO: 474060 - protein, 9 aa, Homo Sapiens
MKAAFFGRT

SEQ ID NO: 474061 - protein, 9 aa, Homo Sapiens
KIGSGCSSP

SEQ ID NO: 474062 - protein, 9 aa, Homo Sapiens
LGASLGGII

SEQ ID NO: 474063 - protein, 9 aa, Homo Sapiens
GGEPVRSGI

SEQ ID NO: 474064 - protein, 9 aa, Homo Sapiens
PENGKRIRS

SEQ ID NO: 474065 - protein, 9 aa, Homo Sapiens
AKHYEEKTQ

SEQ ID NO: 474066 - protein, 9 aa, Homo Sapiens
VFQVSHSLP

SEQ ID NO: 474067 - protein, 9 aa, Homo Sapiens
YLNGAVCGS

SEQ ID NO: 474068 - protein, 9 aa, Homo Sapiens
GLSWAHPDG

SEQ ID NO: 474069 - protein, 9 aa, Homo Sapiens
ETRKAIRHA

SEQ ID NO: 474070 - protein, 9 aa, Homo Sapiens
GPSSPPLHP

SEQ ID NO: 474071 - protein, 9 aa, Homo Sapiens
EVYNLINRR

SEQ ID NO: 474072 - protein, 9 aa, Homo Sapiens
EETLKEVHN

SEQ ID NO: 474073 - protein, 9 aa, Homo Sapiens
KDNLEDGTE

SEQ ID NO: 474074 - protein, 9 aa, Homo Sapiens
ALTLRKHMT

SEQ ID NO: 474075 - protein, 9 aa, Homo Sapiens
CLEQSLSTR

SEQ ID NO: 474076 - protein, 9 aa, Homo Sapiens
IRSDFSLGS

SEQ ID NO: 474077 - protein, 9 aa, Homo Sapiens
FQLFREALM

SEQ ID NO: 474078 - protein, 9 aa, Homo Sapiens
RLVGDIEQE

SEQ ID NO: 474079 - protein, 9 aa, Homo Sapiens
GVTYEKALA

SEQ ID NO: 474080 - protein, 9 aa, Homo Sapiens
YSQNYILRA

SEQ ID NO: 474081 - protein, 9 aa, Homo Sapiens
ENMSPLQAL

SEQ ID NO: 474082 - protein, 9 aa, Homo Sapiens
VVAPLLGAS

SEQ ID NO: 474083 - protein, 9 aa, Homo Sapiens
VTMALNSKA

SEQ ID NO: 474084 - protein, 9 aa, Homo Sapiens
IDEHFFSVA

SEQ ID NO: 474085 - protein, 9 aa, Homo Sapiens
MTDLFRSVV

SEQ ID NO: 474086 - protein, 9 aa, Homo Sapiens
QMEAFVPIF

SEQ ID NO: 474087 - protein, 9 aa, Homo Sapiens
FLLTKGSEE

SEQ ID NO: 474088 - protein, 9 aa, Homo Sapiens
TGYTKTYEA

SEQ ID NO: 474089 - protein, 9 aa, Homo Sapiens
PLGPKDLIH

SEQ ID NO: 474090 - protein, 9 aa, Homo Sapiens
QICYSVPEE

SEQ ID NO: 474091 - protein, 9 aa, Homo Sapiens
SLFVHKVDL

SEQ ID NO: 474092 - protein, 9 aa, Homo Sapiens
PACLPLGPH

SEQ ID NO: 474093 - protein, 9 aa, Homo Sapiens
DFPGIGNKV

SEQ ID NO: 474094 - protein, 9 aa, Homo Sapiens
KCGDCGKTF

SEQ ID NO: 474095 - protein, 9 aa, Homo Sapiens
SEEAASSFG

SEQ ID NO: 474096 - protein, 9 aa, Homo Sapiens
EVPLCSCWM

SEQ ID NO: 474097 - protein, 9 aa, Homo Sapiens
VSLYYGAII

SEQ ID NO: 474098 - protein, 9 aa, Homo Sapiens
FCPACLPLG

SEQ ID NO: 474099 - protein, 9 aa, Homo Sapiens
DSTNNKKEQ

SEQ ID NO: 474100 - protein, 9 aa, Homo Sapiens
EVIEKKEQR

SEQ ID NO: 474101 - protein, 9 aa, Homo Sapiens
APLGPKDLI

SEQ ID NO: 474102 - protein, 9 aa, Homo Sapiens
LFGKMMDRN

SEQ ID NO: 474103 - protein, 9 aa, Homo Sapiens
KAHGGRLRF

SEQ ID NO: 474104 - protein, 9 aa, Homo Sapiens
NKKEQYGPG

SEQ ID NO: 474105 - protein, 9 aa, Homo Sapiens
EQYGPGVQG

SEQ ID NO: 474106 - protein, 9 aa, Homo Sapiens
MWAEEGQRV

SEQ ID NO: 474107 - protein, 9 aa, Homo Sapiens
DTPVSARRT

SEQ ID NO: 474108 - protein, 9 aa, Homo Sapiens
DYLNGAVCG

SEQ ID NO: 474109 - protein, 9 aa, Homo Sapiens
MDDLQDFLL

SEQ ID NO: 474110 - protein, 9 aa, Homo Sapiens
FPRHAGPGR

SEQ ID NO: 474111 - protein, 9 aa, Homo Sapiens
LVGDIEQEL

SEQ ID NO: 474112 - protein, 9 aa, Homo Sapiens
RIRSDFSLG

SEQ ID NO: 474113 - protein, 9 aa, Homo Sapiens
EGVRRALLG

SEQ ID NO: 474114 - protein, 9 aa, Homo Sapiens
GLGVTYEKA

SEQ ID NO: 474115 - protein, 9 aa, Homo Sapiens
QQVQQQVVQ

SEQ ID NO: 474116 - protein, 9 aa, Homo Sapiens
NQQGSAKNG

SEQ ID NO: 474117 - protein, 9 aa, Homo Sapiens
QIQQVQQQV

SEQ ID NO: 474118 - protein, 9 aa, Homo Sapiens
PLSEITKQE

SEQ ID NO: 474119 - protein, 9 aa, Homo Sapiens
NVSDLRADD

SEQ ID NO: 474120 - protein, 9 aa, Homo Sapiens
TVWQSKEEL

SEQ ID NO: 474121 - protein, 9 aa, Homo Sapiens
SLPELEDRL

SEQ ID NO: 474122 - protein, 9 aa, Homo Sapiens
MSQTSIQAG

SEQ ID NO: 474123 - protein, 9 aa, Homo Sapiens
SMDFARSKQ

SEQ ID NO: 474124 - protein, 9 aa, Homo Sapiens
SQMEAFVPI

SEQ ID NO: 474125 - protein, 9 aa, Homo Sapiens
CGKTFNSPS

SEQ ID NO: 474126 - protein, 9 aa, Homo Sapiens
LPELEDRLQ

SEQ ID NO: 474127 - protein, 9 aa, Homo Sapiens
AIRHAFDVW

SEQ ID NO: 474128 - protein, 9 aa, Homo Sapiens
LEVGVDMRK

SEQ ID NO: 474129 - protein, 9 aa, Homo Sapiens
YGAMVQHSI

SEQ ID NO: 474130 - protein, 9 aa, Homo Sapiens
DPLSEITKQ

SEQ ID NO: 474131 - protein, 9 aa, Homo Sapiens
LLKPALVAS

SEQ ID NO: 474132 - protein, 9 aa, Homo Sapiens
HAFDVWQNV

SEQ ID NO: 474133 - protein, 9 aa, Homo Sapiens
IDALTLRKH

SEQ ID NO: 474134 - protein, 9 aa, Homo Sapiens
LGPHLHTQP

SEQ ID NO: 474135 - protein, 9 aa, Homo Sapiens
AVVQLRHQA

SEQ ID NO: 474136 - protein, 9 aa, Homo Sapiens
SLGGIIYLV

SEQ ID NO: 474137 - protein, 9 aa, Homo Sapiens
TSKDNLEDG

SEQ ID NO: 474138 - protein, 9 aa, Homo Sapiens
GRRASNPAN

SEQ ID NO: 474139 - protein, 9 aa, Homo Sapiens
WNRLVPGDR

SEQ ID NO: 474140 - protein, 9 aa, Homo Sapiens
VVQLRHQAS

SEQ ID NO: 474141 - protein, 9 aa, Homo Sapiens
MPLCIAAAH

SEQ ID NO: 474142 - protein, 9 aa, Homo Sapiens
VTYEKALAK

SEQ ID NO: 474143 - protein, 9 aa, Homo Sapiens
GQRIRLAPL

SEQ ID NO: 474144 - protein, 9 aa, Homo Sapiens
QVRKSKGKY

SEQ ID NO: 474145 - protein, 9 aa, Homo Sapiens
ICFLVIHGF

SEQ ID NO: 474146 - protein, 9 aa, Homo Sapiens
ITQEEWALL

SEQ ID NO: 474147 - protein, 9 aa, Homo Sapiens
NNTLDIVCA

SEQ ID NO: 474148 - protein, 9 aa, Homo Sapiens
AVAEGVRRA

SEQ ID NO: 474149 - protein, 9 aa, Homo Sapiens
MLLSGAGGA

SEQ ID NO: 474150 - protein, 9 aa, Homo Sapiens
FGQKAGFSH

SEQ ID NO: 474151 - protein, 9 aa, Homo Sapiens
GTEDDDLFE

SEQ ID NO: 474152 - protein, 9 aa, Homo Sapiens
QQQVVQNRN

SEQ ID NO: 474153 - protein, 9 aa, Homo Sapiens
RTGYTKTYE

SEQ ID NO: 474154 - protein, 9 aa, Homo Sapiens
VGQLHDVGS

SEQ ID NO: 474155 - protein, 9 aa, Homo Sapiens
LFREALMWA

SEQ ID NO: 474156 - protein, 9 aa, Homo Sapiens
MAPLGPKDL

SEQ ID NO: 474157 - protein, 9 aa, Homo Sapiens
VKSKYLIST

SEQ ID NO: 474158 - protein, 9 aa, Homo Sapiens
SGCSSPVTV

SEQ ID NO: 474159 - protein, 9 aa, Homo Sapiens
LYRFASFVF

SEQ ID NO: 474160 - protein, 9 aa, Homo Sapiens
RILTEAEIH

SEQ ID NO: 474161 - protein, 9 aa, Homo Sapiens
ENTNIGSRF

SEQ ID NO: 474162 - protein, 9 aa, Homo Sapiens
LQDFLLKDK

SEQ ID NO: 474163 - protein, 9 aa, Homo Sapiens
LNSKAAAHA

SEQ ID NO: 474164 - protein, 9 aa, Homo Sapiens
VVKNCLLTV

SEQ ID NO: 474165 - protein, 9 aa, Homo Sapiens
GIGNKVDAV

SEQ ID NO: 474166 - protein, 9 aa, Homo Sapiens
LVGQLHDVG

SEQ ID NO: 474167 - protein, 9 aa, Homo Sapiens
ENGKRIRSD

SEQ ID NO: 474168 - protein, 9 aa, Homo Sapiens
LQALEPVLS

SEQ ID NO: 474169 - protein, 9 aa, Homo Sapiens
FFSVALENN

SEQ ID NO: 474170 - protein, 9 aa, Homo Sapiens
FFTGHRKIS

SEQ ID NO: 474171 - protein, 9 aa, Homo Sapiens
QRTVTLEIP

SEQ ID NO: 474172 - protein, 9 aa, Homo Sapiens
SLYYGAIIG

SEQ ID NO: 474173 - protein, 9 aa, Homo Sapiens
GLKTMSIMS

SEQ ID NO: 474174 - protein, 9 aa, Homo Sapiens
ICYSVPEET

SEQ ID NO: 474175 - protein, 9 aa, Homo Sapiens
FRSVVTVID

SEQ ID NO: 474176 - protein, 9 aa, Homo Sapiens
VANLFGKMM

SEQ ID NO: 474177 - protein, 9 aa, Homo Sapiens
AEKTMMEKN

SEQ ID NO: 474178 - protein, 9 aa, Homo Sapiens
HCIVGPGPY

SEQ ID NO: 474179 - protein, 9 aa, Homo Sapiens
VDESSEDSI

SEQ ID NO: 474180 - protein, 9 aa, Homo Sapiens
PDFFLFLCC

SEQ ID NO: 474181 - protein, 9 aa, Homo Sapiens
AAAAAANQQ

SEQ ID NO: 474182 - protein, 9 aa, Homo Sapiens
PVRSGILRI

SEQ ID NO: 474183 - protein, 9 aa, Homo Sapiens
RSSQYYSEG

SEQ ID NO: 474184 - protein, 9 aa, Homo Sapiens
HYSNLHRYN

SEQ ID NO: 474185 - protein, 9 aa, Homo Sapiens
PVPASYAPH

SEQ ID NO: 474186 - protein, 9 aa, Homo Sapiens
CGSVQATDR

SEQ ID NO: 474187 - protein, 9 aa, Homo Sapiens
MVQHSIPLP

SEQ ID NO: 474188 - protein, 9 aa, Homo Sapiens
PLGPHLHTQ

SEQ ID NO: 474189 - protein, 9 aa, Homo Sapiens
TGNQLIVIM

SEQ ID NO: 474190 - protein, 9 aa, Homo Sapiens
LPDPTDIWE

SEQ ID NO: 474191 - protein, 9 aa, Homo Sapiens
KELGRVKAF

SEQ ID NO: 474192 - protein, 9 aa, Homo Sapiens
NLQPWPSAF

SEQ ID NO: 474193 - protein, 9 aa, Homo Sapiens
EGPTFAANA

SEQ ID NO: 474194 - protein, 9 aa, Homo Sapiens
GEPVRSGIL

SEQ ID NO: 474195 - protein, 9 aa, Homo Sapiens
ILMSLVGYF

SEQ ID NO: 474196 - protein, 9 aa, Homo Sapiens
NAGTDQGTA

SEQ ID NO: 474197 - protein, 9 aa, Homo Sapiens
PTPFDISST

SEQ ID NO: 474198 - protein, 9 aa, Homo Sapiens
LGKEVSRLL

SEQ ID NO: 474199 - protein, 9 aa, Homo Sapiens
ALVLDKVME

SEQ ID NO: 474200 - protein, 9 aa, Homo Sapiens
DRISMQERH

SEQ ID NO: 474201 - protein, 9 aa, Homo Sapiens
SCGPSYVLQ

SEQ ID NO: 474202 - protein, 9 aa, Homo Sapiens
VCECCTKPV

SEQ ID NO: 474203 - protein, 9 aa, Homo Sapiens
VTLLVSRKC

SEQ ID NO: 474204 - protein, 9 aa, Homo Sapiens
CVSSPCCPV

SEQ ID NO: 474205 - protein, 9 aa, Homo Sapiens
DSLGGNSDT

SEQ ID NO: 474206 - protein, 9 aa, Homo Sapiens
HSNPQHRHG

SEQ ID NO: 474207 - protein, 9 aa, Homo Sapiens
GGNSDTLMI

SEQ ID NO: 474208 - protein, 9 aa, Homo Sapiens
DQGTAGNNA

SEQ ID NO: 474209 - protein, 9 aa, Homo Sapiens
SSCGPSYVL

SEQ ID NO: 474210 - protein, 9 aa, Homo Sapiens
SGEKNAGTD

SEQ ID NO: 474211 - protein, 9 aa, Homo Sapiens
TLLVSRKCQ

SEQ ID NO: 474212 - protein, 9 aa, Homo Sapiens
LPRPVLQNL

SEQ ID NO: 474213 - protein, 9 aa, Homo Sapiens
LQNLPQPQM

SEQ ID NO: 474214 - protein, 9 aa, Homo Sapiens
VVIVSEKGE

SEQ ID NO: 474215 - protein, 9 aa, Homo Sapiens
VYYACGECP

SEQ ID NO: 474216 - protein, 9 aa, Homo Sapiens
RYRWQIVPN

SEQ ID NO: 474217 - protein, 9 aa, Homo Sapiens
VGRDITELL

SEQ ID NO: 474218 - protein, 9 aa, Homo Sapiens
STWVQHADY

SEQ ID NO: 474219 - protein, 9 aa, Homo Sapiens
QDSLGGNSD

SEQ ID NO: 474220 - protein, 9 aa, Homo Sapiens
FLPMLMFFL

SEQ ID NO: 474221 - protein, 9 aa, Homo Sapiens
RQLLSPWQA

SEQ ID NO: 474222 - protein, 9 aa, Homo Sapiens
QPISCVKVE

SEQ ID NO: 474223 - protein, 9 aa, Homo Sapiens
GPQKHHLPE

SEQ ID NO: 474224 - protein, 9 aa, Homo Sapiens
LSPVMTFPH

SEQ ID NO: 474225 - protein, 9 aa, Homo Sapiens
TTSTIPSTA

SEQ ID NO: 474226 - protein, 9 aa, Homo Sapiens
LDYEIESKY

SEQ ID NO: 474227 - protein, 9 aa, Homo Sapiens
EYLSQRLHI

SEQ ID NO: 474228 - protein, 9 aa, Homo Sapiens
LGHEHPSSR

SEQ ID NO: 474229 - protein, 9 aa, Homo Sapiens
PFCVCECCT

SEQ ID NO: 474230 - protein, 9 aa, Homo Sapiens
TEKTIEQKL

SEQ ID NO: 474231 - protein, 9 aa, Homo Sapiens
SRPSTNCSP

SEQ ID NO: 474232 - protein, 9 aa, Homo Sapiens
LVLDKVMEN

SEQ ID NO: 474233 - protein, 9 aa, Homo Sapiens
QEEREQQLR

SEQ ID NO: 474234 - protein, 9 aa, Homo Sapiens
LPCHQDTPA

SEQ ID NO: 474235 - protein, 9 aa, Homo Sapiens
RKTNITHEE

SEQ ID NO: 474236 - protein, 9 aa, Homo Sapiens
RLPSTPVSG

SEQ ID NO: 474237 - protein, 9 aa, Homo Sapiens
PQKHHLPEE

SEQ ID NO: 474238 - protein, 9 aa, Homo Sapiens
KNAGTDQGT

SEQ ID NO: 474239 - protein, 9 aa, Homo Sapiens
PVLQNLPQP

SEQ ID NO: 474240 - protein, 9 aa, Homo Sapiens
KSLSKDTAF

SEQ ID NO: 474241 - protein, 9 aa, Homo Sapiens
LVSRKCQID

SEQ ID NO: 474242 - protein, 9 aa, Homo Sapiens
GHEHPSSRP

SEQ ID NO: 474243 - protein, 9 aa, Homo Sapiens
SFLVIVNGS

SEQ ID NO: 474244 - protein, 9 aa, Homo Sapiens
KSSKAGEKA

SEQ ID NO: 474245 - protein, 9 aa, Homo Sapiens
GRQSHRGPQ

SEQ ID NO: 474246 - protein, 9 aa, Homo Sapiens
GKEVSRLLD

SEQ ID NO: 474247 - protein, 9 aa, Homo Sapiens
SELKPRPLR

SEQ ID NO: 474248 - protein, 9 aa, Homo Sapiens
GGIPSSCGP

SEQ ID NO: 474249 - protein, 9 aa, Homo Sapiens
SMAFSSRLG

SEQ ID NO: 474250 - protein, 9 aa, Homo Sapiens
MTFPHFIGL

SEQ ID NO: 474251 - protein, 9 aa, Homo Sapiens
WSWCDCSCG

SEQ ID NO: 474252 - protein, 9 aa, Homo Sapiens
VLDKVMENV

SEQ ID NO: 474253 - protein, 9 aa, Homo Sapiens
SAKVYSKLI

SEQ ID NO: 474254 - protein, 9 aa, Homo Sapiens
GPASPDSQP

SEQ ID NO: 474255 - protein, 9 aa, Homo Sapiens
PTLPSTTTP

SEQ ID NO: 474256 - protein, 9 aa, Homo Sapiens
GTWQPQCSL

SEQ ID NO: 474257 - protein, 9 aa, Homo Sapiens
LMFFLVDDY

SEQ ID NO: 474258 - protein, 9 aa, Homo Sapiens
ADEKALVLD

SEQ ID NO: 474259 - protein, 9 aa, Homo Sapiens
LELTEATPR

SEQ ID NO: 474260 - protein, 9 aa, Homo Sapiens
WCDCSCGGG

SEQ ID NO: 474261 - protein, 9 aa, Homo Sapiens
KICGAVRLP

SEQ ID NO: 474262 - protein, 9 aa, Homo Sapiens
ILLESAKVY

SEQ ID NO: 474263 - protein, 9 aa, Homo Sapiens
RRESEAFRQ

SEQ ID NO: 474264 - protein, 9 aa, Homo Sapiens
ALPRPVLQN

SEQ ID NO: 474265 - protein, 9 aa, Homo Sapiens
GECPLLPCH

SEQ ID NO: 474266 - protein, 9 aa, Homo Sapiens
LPSTTTPSV

SEQ ID NO: 474267 - protein, 9 aa, Homo Sapiens
ESEAFRQAS

SEQ ID NO: 474268 - protein, 9 aa, Homo Sapiens
LEILKSLSK

SEQ ID NO: 474269 - protein, 9 aa, Homo Sapiens
LVAERKKIC

SEQ ID NO: 474270 - protein, 9 aa, Homo Sapiens
PPTPFDISS

SEQ ID NO: 474271 - protein, 9 aa, Homo Sapiens
DEKALVLDK

SEQ ID NO: 474272 - protein, 9 aa, Homo Sapiens
CHSYLAKHS

SEQ ID NO: 474273 - protein, 9 aa, Homo Sapiens
GLLFIILMS

SEQ ID NO: 474274 - protein, 9 aa, Homo Sapiens
GHLSSHSNP

SEQ ID NO: 474275 - protein, 9 aa, Homo Sapiens
IPSTASCPR

SEQ ID NO: 474276 - protein, 9 aa, Homo Sapiens
QERHKEIML

SEQ ID NO: 474277 - protein, 9 aa, Homo Sapiens
SSKAGEKAD

SEQ ID NO: 474278 - protein, 9 aa, Homo Sapiens
PFRQLLSPW

SEQ ID NO: 474279 - protein, 9 aa, Homo Sapiens
AVTKLHVVG

SEQ ID NO: 474280 - protein, 9 aa, Homo Sapiens
TLPSTTTPS

SEQ ID NO: 474281 - protein, 9 aa, Homo Sapiens
RFLPMLMFF

SEQ ID NO: 474282 - protein, 9 aa, Homo Sapiens
KPRPNRTCL

SEQ ID NO: 474283 - protein, 9 aa, Homo Sapiens
SYLAKHSGE

SEQ ID NO: 474284 - protein, 9 aa, Homo Sapiens
CPVMIMLLM

SEQ ID NO: 474285 - protein, 9 aa, Homo Sapiens
SPDSQPAGG

SEQ ID NO: 474286 - protein, 9 aa, Homo Sapiens
LSLAISPVT

SEQ ID NO: 474287 - protein, 9 aa, Homo Sapiens
AGTDQGTAG

SEQ ID NO: 474288 - protein, 9 aa, Homo Sapiens
PQHRHGRPS

SEQ ID NO: 474289 - protein, 9 aa, Homo Sapiens
VAERKKICG

SEQ ID NO: 474290 - protein, 9 aa, Homo Sapiens
SFLWSWWSI

SEQ ID NO: 474291 - protein, 9 aa, Homo Sapiens
CVCECCTKP

SEQ ID NO: 474292 - protein, 9 aa, Homo Sapiens
IYKQSQLMT

SEQ ID NO: 474293 - protein, 9 aa, Homo Sapiens
RLLDYEIES

SEQ ID NO: 474294 - protein, 9 aa, Homo Sapiens
TEATPRYRW

SEQ ID NO: 474295 - protein, 9 aa, Homo Sapiens
HCPVMIMLL

SEQ ID NO: 474296 - protein, 9 aa, Homo Sapiens
TLEPPPERV

SEQ ID NO: 474297 - protein, 9 aa, Homo Sapiens
TFRDMHEER

SEQ ID NO: 474298 - protein, 9 aa, Homo Sapiens
CGECPLLPC

SEQ ID NO: 474299 - protein, 9 aa, Homo Sapiens
CPRGAGGIP

SEQ ID NO: 474300 - protein, 9 aa, Homo Sapiens
QEEGPASPD

SEQ ID NO: 474301 - protein, 9 aa, Homo Sapiens
GGGGGGTPP

SEQ ID NO: 474302 - protein, 9 aa, Homo Sapiens
AFRQASASS

SEQ ID NO: 474303 - protein, 9 aa, Homo Sapiens
TEYKKKLAG

SEQ ID NO: 474304 - protein, 9 aa, Homo Sapiens
VPTTSTIPS

SEQ ID NO: 474305 - protein, 9 aa, Homo Sapiens
WSPWSWCDC

SEQ ID NO: 474306 - protein, 9 aa, Homo Sapiens
AVRLPSTPV

SEQ ID NO: 474307 - protein, 9 aa, Homo Sapiens
RQSHRGPQK

SEQ ID NO: 474308 - protein, 9 aa, Homo Sapiens
LPSTPVSGH

SEQ ID NO: 474309 - protein, 9 aa, Homo Sapiens
VMIMLLMRA

SEQ ID NO: 474310 - protein, 9 aa, Homo Sapiens
RPSGRQSHR

SEQ ID NO: 474311 - protein, 9 aa, Homo Sapiens
TPRYRWQIV

SEQ ID NO: 474312 - protein, 9 aa, Homo Sapiens
STPVSGHHC

SEQ ID NO: 474313 - protein, 9 aa, Homo Sapiens
ISMQERHKE

SEQ ID NO: 474314 - protein, 9 aa, Homo Sapiens
PRPNRTCLV

SEQ ID NO: 474315 - protein, 9 aa, Homo Sapiens
AKDIQQTEK

SEQ ID NO: 474316 - protein, 9 aa, Homo Sapiens
SPPPPPPTP

SEQ ID NO: 474317 - protein, 9 aa, Homo Sapiens
QRLHIKEED

SEQ ID NO: 474318 - protein, 9 aa, Homo Sapiens
PVMIMLLMR

SEQ ID NO: 474319 - protein, 9 aa, Homo Sapiens
WSWWSILPI

SEQ ID NO: 474320 - protein, 9 aa, Homo Sapiens
KQPISCVKV

SEQ ID NO: 474321 - protein, 9 aa, Homo Sapiens
AVYYACGEC

SEQ ID NO: 474322 - protein, 9 aa, Homo Sapiens
VIVSEKGEV

SEQ ID NO: 474323 - protein, 9 aa, Homo Sapiens
EAFRQASAS

SEQ ID NO: 474324 - protein, 9 aa, Homo Sapiens
ECCTKPVPL

SEQ ID NO: 474325 - protein, 9 aa, Homo Sapiens
EEREQQLRR

SEQ ID NO: 474326 - protein, 9 aa, Homo Sapiens
HSLMKLTRG

SEQ ID NO: 474327 - protein, 9 aa, Homo Sapiens
ESAKVYSKL

SEQ ID NO: 474328 - protein, 9 aa, Homo Sapiens
ECPLLPCHQ

SEQ ID NO: 474329 - protein, 9 aa, Homo Sapiens
MAFSSRLGG

SEQ ID NO: 474330 - protein, 9 aa, Homo Sapiens
YKQSQLMTE

SEQ ID NO: 474331 - protein, 9 aa, Homo Sapiens
KTNITHEEH

SEQ ID NO: 474332 - protein, 9 aa, Homo Sapiens
QKHHLPEEY

SEQ ID NO: 474333 - protein, 9 aa, Homo Sapiens
PPPPPPTPF

SEQ ID NO: 474334 - protein, 9 aa, Homo Sapiens
QCSLSLAIS

SEQ ID NO: 474335 - protein, 9 aa, Homo Sapiens
NQSSNFTDH

SEQ ID NO: 474336 - protein, 9 aa, Homo Sapiens
KKKLAGRLK

SEQ ID NO: 474337 - protein, 9 aa, Homo Sapiens
QPFRQLLSP

SEQ ID NO: 474338 - protein, 9 aa, Homo Sapiens
SQRLHIKEE

SEQ ID NO: 474339 - protein, 9 aa, Homo Sapiens
LGELEQRLS

SEQ ID NO: 474340 - protein, 9 aa, Homo Sapiens
PLGELEQRL

SEQ ID NO: 474341 - protein, 9 aa, Homo Sapiens
SLVGYFFCM

SEQ ID NO: 474342 - protein, 9 aa, Homo Sapiens
PWSWCDCSC

SEQ ID NO: 474343 - protein, 9 aa, Homo Sapiens
DYKYKPRPN

SEQ ID NO: 474344 - protein, 9 aa, Homo Sapiens
GRLKAKLPD

SEQ ID NO: 474345 - protein, 9 aa, Homo Sapiens
PQCSLSLAI

SEQ ID NO: 474346 - protein, 9 aa, Homo Sapiens
QLMTEVVRR

SEQ ID NO: 474347 - protein, 9 aa, Homo Sapiens
PVGTWQPQC

SEQ ID NO: 474348 - protein, 9 aa, Homo Sapiens
DMHEERDLL

SEQ ID NO: 474349 - protein, 9 aa, Homo Sapiens
EVMHSLMKL

SEQ ID NO: 474350 - protein, 9 aa, Homo Sapiens
RPVLQNLPQ

SEQ ID NO: 474351 - protein, 9 aa, Homo Sapiens
KALVLDKVM

SEQ ID NO: 474352 - protein, 9 aa, Homo Sapiens
AGSCSGRAR

SEQ ID NO: 474353 - protein, 9 aa, Homo Sapiens
GHHCPVMIM

SEQ ID NO: 474354 - protein, 9 aa, Homo Sapiens
SNPQHRHGR

SEQ ID NO: 474355 - protein, 9 aa, Homo Sapiens
FRQASASSS

SEQ ID NO: 474356 - protein, 9 aa, Homo Sapiens
EPRKTNITH

SEQ ID NO: 474357 - protein, 9 aa, Homo Sapiens
SLSLAISPV

SEQ ID NO: 474358 - protein, 9 aa, Homo Sapiens
STFRDMHEE

SEQ ID NO: 474359 - protein, 9 aa, Homo Sapiens
PNRTCLVDG

SEQ ID NO: 474360 - protein, 9 aa, Homo Sapiens
PCHQDTPAI

SEQ ID NO: 474361 - protein, 9 aa, Homo Sapiens
GGGGGTPPD

SEQ ID NO: 474362 - protein, 9 aa, Homo Sapiens
FPHFIGLSM

SEQ ID NO: 474363 - protein, 9 aa, Homo Sapiens
RHGRPSGRQ

SEQ ID NO: 474364 - protein, 9 aa, Homo Sapiens
AISPVTLCG

SEQ ID NO: 474365 - protein, 9 aa, Homo Sapiens
EHPSSRPST

SEQ ID NO: 474366 - protein, 9 aa, Homo Sapiens
NSLLVAERK

SEQ ID NO: 474367 - protein, 9 aa, Homo Sapiens
PFDISSTPT

SEQ ID NO: 474368 - protein, 9 aa, Homo Sapiens
PHFIGLSML

SEQ ID NO: 474369 - protein, 9 aa, Homo Sapiens
TPFDISSTP

SEQ ID NO: 474370 - protein, 9 aa, Homo Sapiens
MHEERDLLL

SEQ ID NO: 474371 - protein, 9 aa, Homo Sapiens
MLMFFLVDD

SEQ ID NO: 474372 - protein, 9 aa, Homo Sapiens
RGAGGIPSS

SEQ ID NO: 474373 - protein, 9 aa, Homo Sapiens
STASCPRGA

SEQ ID NO: 474374 - protein, 9 aa, Homo Sapiens
SPWSWCDCS

SEQ ID NO: 474375 - protein, 9 aa, Homo Sapiens
GGAGSCSGR

SEQ ID NO: 474376 - protein, 9 aa, Homo Sapiens
GPTLEPPPE

SEQ ID NO: 474377 - protein, 9 aa, Homo Sapiens
ATASPFFQA

SEQ ID NO: 474378 - protein, 9 aa, Homo Sapiens
LSQRLHIKE

SEQ ID NO: 474379 - protein, 9 aa, Homo Sapiens
SKAGEKADG

SEQ ID NO: 474380 - protein, 9 aa, Homo Sapiens
KAFNQSSNF

SEQ ID NO: 474381 - protein, 9 aa, Homo Sapiens
GVYHCAPST

SEQ ID NO: 474382 - protein, 9 aa, Homo Sapiens
YKPRPNRTC

SEQ ID NO: 474383 - protein, 9 aa, Homo Sapiens
AYSGEKNAG

SEQ ID NO: 474384 - protein, 9 aa, Homo Sapiens
NSDTLMIAC

SEQ ID NO: 474385 - protein, 9 aa, Homo Sapiens
SLMKLTRGA

SEQ ID NO: 474386 - protein, 9 aa, Homo Sapiens
MLLMRAVRP

SEQ ID NO: 474387 - protein, 9 aa, Homo Sapiens
PAVYYACGE

SEQ ID NO: 474388 - protein, 9 aa, Homo Sapiens
PSTASCPRG

SEQ ID NO: 474389 - protein, 9 aa, Homo Sapiens
ENDIPSMAF

SEQ ID NO: 474390 - protein, 9 aa, Homo Sapiens
RGPQKHHLP

SEQ ID NO: 474391 - protein, 9 aa, Homo Sapiens
TASCPRGAG

SEQ ID NO: 474392 - protein, 9 aa, Homo Sapiens
CGPSYVLQE

SEQ ID NO: 474393 - protein, 9 aa, Homo Sapiens
QKSSKAGEK

SEQ ID NO: 474394 - protein, 9 aa, Homo Sapiens
FRQLLSPWQ

SEQ ID NO: 474395 - protein, 9 aa, Homo Sapiens
FRDMHEERD

SEQ ID NO: 474396 - protein, 9 aa, Homo Sapiens
TGPPGPSGP

SEQ ID NO: 474397 - protein, 9 aa, Homo Sapiens
FDISSTPTL

SEQ ID NO: 474398 - protein, 9 aa, Homo Sapiens
EKTIEQKLV

SEQ ID NO: 474399 - protein, 9 aa, Homo Sapiens
MQERHKEIM

SEQ ID NO: 474400 - protein, 9 aa, Homo Sapiens
VLQEEGPAS

SEQ ID NO: 474401 - protein, 9 aa, Homo Sapiens
KDIQQTEKT

SEQ ID NO: 474402 - protein, 9 aa, Homo Sapiens
PSTWVQHAD

SEQ ID NO: 474403 - protein, 9 aa, Homo Sapiens
KSSSTVSFH

SEQ ID NO: 474404 - protein, 9 aa, Homo Sapiens
HAVTKLHVV

SEQ ID NO: 474405 - protein, 9 aa, Homo Sapiens
ISCVKVEIQ

SEQ ID NO: 474406 - protein, 9 aa, Homo Sapiens
PRGAGGIPS

SEQ ID NO: 474407 - protein, 9 aa, Homo Sapiens
GGGGGGGTP

SEQ ID NO: 474408 - protein, 9 aa, Homo Sapiens
ITHEEHTAV

SEQ ID NO: 474409 - protein, 9 aa, Homo Sapiens
RARGHLSSH

SEQ ID NO: 474410 - protein, 9 aa, Homo Sapiens
MIMLLMRAV

SEQ ID NO: 474411 - protein, 9 aa, Homo Sapiens
GTPPDDLLQ

SEQ ID NO: 474412 - protein, 9 aa, Homo Sapiens
QGKGLSYLS

SEQ ID NO: 474413 - protein, 9 aa, Homo Sapiens
SLGGNSDTL

SEQ ID NO: 474414 - protein, 9 aa, Homo Sapiens
NPQHRHGRP

SEQ ID NO: 474415 - protein, 9 aa, Homo Sapiens
MAIYKQSQL

SEQ ID NO: 474416 - protein, 9 aa, Homo Sapiens
LLDYEIESK

SEQ ID NO: 474417 - protein, 9 aa, Homo Sapiens
HLSSHSNPQ

SEQ ID NO: 474418 - protein, 9 aa, Homo Sapiens
AGGAGSCSG

SEQ ID NO: 474419 - protein, 9 aa, Homo Sapiens
PSSCGPSYV

SEQ ID NO: 474420 - protein, 9 aa, Homo Sapiens
FLVIVNGSP

SEQ ID NO: 474421 - protein, 9 aa, Homo Sapiens
PLLPCHQDT

SEQ ID NO: 474422 - protein, 9 aa, Homo Sapiens
MKLTRGALL

SEQ ID NO: 474423 - protein, 9 aa, Homo Sapiens
SCPRGAGGI

SEQ ID NO: 474424 - protein, 9 aa, Homo Sapiens
KVVTLLVSR

SEQ ID NO: 474425 - protein, 9 aa, Homo Sapiens
CDCSCGGGQ

SEQ ID NO: 474426 - protein, 9 aa, Homo Sapiens
RQASASSSQ

SEQ ID NO: 474427 - protein, 9 aa, Homo Sapiens
LLFIILMSL

SEQ ID NO: 474428 - protein, 9 aa, Homo Sapiens
GPSYVLQEE

SEQ ID NO: 474429 - protein, 9 aa, Homo Sapiens
QASASSSQQ

SEQ ID NO: 474430 - protein, 9 aa, Homo Sapiens
TWVQHADYS

SEQ ID NO: 474431 - protein, 9 aa, Homo Sapiens
ASPFFQALL

SEQ ID NO: 474432 - protein, 9 aa, Homo Sapiens
SKDTAFALG

SEQ ID NO: 474433 - protein, 9 aa, Homo Sapiens
VTKLHVVGR

SEQ ID NO: 474434 - protein, 9 aa, Homo Sapiens
GAVRLPSTP

SEQ ID NO: 474435 - protein, 9 aa, Homo Sapiens
RPLGELEQR

SEQ ID NO: 474436 - protein, 9 aa, Homo Sapiens
GTDQGTAGN

SEQ ID NO: 474437 - protein, 9 aa, Homo Sapiens
LFEVQWQLA

SEQ ID NO: 474438 - protein, 9 aa, Homo Sapiens
EALPRPVLQ

SEQ ID NO: 474439 - protein, 9 aa, Homo Sapiens
PTLEPPPER

SEQ ID NO: 474440 - protein, 9 aa, Homo Sapiens
CECCTKPVP

SEQ ID NO: 474441 - protein, 9 aa, Homo Sapiens
VDDGTLSEL

SEQ ID NO: 474442 - protein, 9 aa, Homo Sapiens
KQSQLMTEV

SEQ ID NO: 474443 - protein, 9 aa, Homo Sapiens
AFNQSSNFT

SEQ ID NO: 474444 - protein, 9 aa, Homo Sapiens
WQPQCSLSL

SEQ ID NO: 474445 - protein, 9 aa, Homo Sapiens
CSLSLAISP

SEQ ID NO: 474446 - protein, 9 aa, Homo Sapiens
LKSLSKDTA

SEQ ID NO: 474447 - protein, 9 aa, Homo Sapiens
QPQCSLSLA

SEQ ID NO: 474448 - protein, 9 aa, Homo Sapiens
LTEATPRYR

SEQ ID NO: 474449 - protein, 9 aa, Homo Sapiens
QTEKTIEQK

SEQ ID NO: 474450 - protein, 9 aa, Homo Sapiens
LSPWQAPRQ

SEQ ID NO: 474451 - protein, 9 aa, Homo Sapiens
LWSWWSILP

SEQ ID NO: 474452 - protein, 9 aa, Homo Sapiens
IVNGSPKND

SEQ ID NO: 474453 - protein, 9 aa, Homo Sapiens
YPAVYYACG

SEQ ID NO: 474454 - protein, 9 aa, Homo Sapiens
SQPAGGAGS

SEQ ID NO: 474455 - protein, 9 aa, Homo Sapiens
HCAPSTWVQ

SEQ ID NO: 474456 - protein, 9 aa, Homo Sapiens
PLIHRVVIV

SEQ ID NO: 474457 - protein, 9 aa, Homo Sapiens
LLSPWQAPR

SEQ ID NO: 474458 - protein, 9 aa, Homo Sapiens
SPFFQALLS

SEQ ID NO: 474459 - protein, 9 aa, Homo Sapiens
VLQNLPQPQ

SEQ ID NO: 474460 - protein, 9 aa, Homo Sapiens
KSFLVIVNG

SEQ ID NO: 474461 - protein, 9 aa, Homo Sapiens
YVLQEEGPA

SEQ ID NO: 474462 - protein, 9 aa, Homo Sapiens
HPSSRPSTN

SEQ ID NO: 474463 - protein, 9 aa, Homo Sapiens
IQEVMHSLM

SEQ ID NO: 474464 - protein, 9 aa, Homo Sapiens
SGRARGHLS

SEQ ID NO: 474465 - protein, 9 aa, Homo Sapiens
CCTKPVPLC

SEQ ID NO: 474466 - protein, 9 aa, Homo Sapiens
RPNRTCLVD

SEQ ID NO: 474467 - protein, 9 aa, Homo Sapiens
MRAVRPVGT

SEQ ID NO: 474468 - protein, 9 aa, Homo Sapiens
DISSTPTLP

SEQ ID NO: 474469 - protein, 9 aa, Homo Sapiens
PSMAFSSRL

SEQ ID NO: 474470 - protein, 9 aa, Homo Sapiens
PSPPPPPPT

SEQ ID NO: 474471 - protein, 9 aa, Homo Sapiens
QSHRGPQKH

SEQ ID NO: 474472 - protein, 9 aa, Homo Sapiens
EIYRRPLGE

SEQ ID NO: 474473 - protein, 9 aa, Homo Sapiens
SGHHCPVMI

SEQ ID NO: 474474 - protein, 9 aa, Homo Sapiens
EATPRYRWQ

SEQ ID NO: 474475 - protein, 9 aa, Homo Sapiens
VVTLLVSRK

SEQ ID NO: 474476 - protein, 9 aa, Homo Sapiens
EYPAVYYAC

SEQ ID NO: 474477 - protein, 9 aa, Homo Sapiens
IILMSLVGY

SEQ ID NO: 474478 - protein, 9 aa, Homo Sapiens
APSTWVQHA

SEQ ID NO: 474479 - protein, 9 aa, Homo Sapiens
LEPPPERVS

SEQ ID NO: 474480 - protein, 9 aa, Homo Sapiens
EERDLLLRS

SEQ ID NO: 474481 - protein, 9 aa, Homo Sapiens
TIPSTASCP

SEQ ID NO: 474482 - protein, 9 aa, Homo Sapiens
VMTFPHFIG

SEQ ID NO: 474483 - protein, 9 aa, Homo Sapiens
SPVTLCGEL

SEQ ID NO: 474484 - protein, 9 aa, Homo Sapiens
KHHLPEEYP

SEQ ID NO: 474485 - protein, 9 aa, Homo Sapiens
REIYRRPLG

SEQ ID NO: 474486 - protein, 9 aa, Homo Sapiens
SSTFRDMHE

SEQ ID NO: 474487 - protein, 9 aa, Homo Sapiens
ELTEATPRY

SEQ ID NO: 474488 - protein, 9 aa, Homo Sapiens
ACGECPLLP

SEQ ID NO: 474489 - protein, 9 aa, Homo Sapiens
FEVQWQLAQ

SEQ ID NO: 474490 - protein, 9 aa, Homo Sapiens
CSGRARGHL

SEQ ID NO: 474491 - protein, 9 aa, Homo Sapiens
WSILPIQIL

SEQ ID NO: 474492 - protein, 9 aa, Homo Sapiens
LLVAERKKI

SEQ ID NO: 474493 - protein, 9 aa, Homo Sapiens
FLWSWWSIL

SEQ ID NO: 474494 - protein, 9 aa, Homo Sapiens
NEPRKTNIT

SEQ ID NO: 474495 - protein, 9 aa, Homo Sapiens
IYRRPLGEL

SEQ ID NO: 474496 - protein, 9 aa, Homo Sapiens
RHKEIMLGL

SEQ ID NO: 474497 - protein, 9 aa, Homo Sapiens
NDIPSMAFS

SEQ ID NO: 474498 - protein, 9 aa, Homo Sapiens
GSLFEVQWQ

SEQ ID NO: 474499 - protein, 9 aa, Homo Sapiens
VSRLLDYEI

SEQ ID NO: 474500 - protein, 9 aa, Homo Sapiens
MSLVGYFFC

SEQ ID NO: 474501 - protein, 9 aa, Homo Sapiens
SREIYRRPL

SEQ ID NO: 474502 - protein, 9 aa, Homo Sapiens
HLPEEYPAV

SEQ ID NO: 474503 - protein, 9 aa, Homo Sapiens
EKNAGTDQG

SEQ ID NO: 474504 - protein, 9 aa, Homo Sapiens
QPAGGAGSC

SEQ ID NO: 474505 - protein, 9 aa, Homo Sapiens
PAYSGEKNA

SEQ ID NO: 474506 - protein, 9 aa, Homo Sapiens
EYKKKLAGR

SEQ ID NO: 474507 - protein, 9 aa, Homo Sapiens
LAGRLKAKL

SEQ ID NO: 474508 - protein, 9 aa, Homo Sapiens
GIPSSCGPS

SEQ ID NO: 474509 - protein, 9 aa, Homo Sapiens
LSELKPRPL

SEQ ID NO: 474510 - protein, 9 aa, Homo Sapiens
NGSPKNDDG

SEQ ID NO: 474511 - protein, 9 aa, Homo Sapiens
LMRAVRPVG

SEQ ID NO: 474512 - protein, 9 aa, Homo Sapiens
SPVMTFPHF

SEQ ID NO: 474513 - protein, 9 aa, Homo Sapiens
MHSLMKLTR

SEQ ID NO: 474514 - protein, 9 aa, Homo Sapiens
VSGHHCPVM

SEQ ID NO: 474515 - protein, 9 aa, Homo Sapiens
ITGPPGPSG

SEQ ID NO: 474516 - protein, 9 aa, Homo Sapiens
SCVKVEIQE

SEQ ID NO: 474517 - protein, 9 aa, Homo Sapiens
HEHPSSRPS

SEQ ID NO: 474518 - protein, 9 aa, Homo Sapiens
MFFLVDDYT

SEQ ID NO: 474519 - protein, 9 aa, Homo Sapiens
ILNLQGKGL

SEQ ID NO: 474520 - protein, 9 aa, Homo Sapiens
VVGRDITEL

SEQ ID NO: 474521 - protein, 9 aa, Homo Sapiens
TAGNNAKME

SEQ ID NO: 474522 - protein, 9 aa, Homo Sapiens
IQQTEKTIE

SEQ ID NO: 474523 - protein, 9 aa, Homo Sapiens
GQPFRQLLS

SEQ ID NO: 474524 - protein, 9 aa, Homo Sapiens
HRVVIVSEK

SEQ ID NO: 474525 - protein, 9 aa, Homo Sapiens
DKVMENVGL

SEQ ID NO: 474526 - protein, 9 aa, Homo Sapiens
SEAFRQASA

SEQ ID NO: 474527 - protein, 9 aa, Homo Sapiens
LMKLTRGAL

SEQ ID NO: 474528 - protein, 9 aa, Homo Sapiens
YRRPLGELE

SEQ ID NO: 474529 - protein, 9 aa, Homo Sapiens
AKHSGEKPY

SEQ ID NO: 474530 - protein, 9 aa, Homo Sapiens
HHCPVMIML

SEQ ID NO: 474531 - protein, 9 aa, Homo Sapiens
PSSRPSTNC

SEQ ID NO: 474532 - protein, 9 aa, Homo Sapiens
KVYSKLICM

SEQ ID NO: 474533 - protein, 9 aa, Homo Sapiens
GGTPPDDLL

SEQ ID NO: 474534 - protein, 9 aa, Homo Sapiens
AIYKQSQLM

SEQ ID NO: 474535 - protein, 9 aa, Homo Sapiens
PVMTFPHFI

SEQ ID NO: 474536 - protein, 9 aa, Homo Sapiens
EEGPASPDS

SEQ ID NO: 474537 - protein, 9 aa, Homo Sapiens
HFIGLSMLS

SEQ ID NO: 474538 - protein, 9 aa, Homo Sapiens
SVPTTSTIP

SEQ ID NO: 474539 - protein, 9 aa, Homo Sapiens
GTAGNNAKM

SEQ ID NO: 474540 - protein, 9 aa, Homo Sapiens
TASPFFQAL

SEQ ID NO: 474541 - protein, 9 aa, Homo Sapiens
PASPDSQPA

SEQ ID NO: 474542 - protein, 9 aa, Homo Sapiens
LESAKVYSK

SEQ ID NO: 474543 - protein, 9 aa, Homo Sapiens
VNGSPKNDD

SEQ ID NO: 474544 - protein, 9 aa, Homo Sapiens
TWQPQCSLS

SEQ ID NO: 474545 - protein, 9 aa, Homo Sapiens
ERHKEIMLG

SEQ ID NO: 474546 - protein, 9 aa, Homo Sapiens
SLAISPVTL

SEQ ID NO: 474547 - protein, 9 aa, Homo Sapiens
PPPTPFDIS

SEQ ID NO: 474548 - protein, 9 aa, Homo Sapiens
LNLQGKGLS

SEQ ID NO: 474549 - protein, 9 aa, Homo Sapiens
AGGIPSSCG

SEQ ID NO: 474550 - protein, 9 aa, Homo Sapiens
SGRQSHRGP

SEQ ID NO: 474551 - protein, 9 aa, Homo Sapiens
HKEIMLGLK

SEQ ID NO: 474552 - protein, 9 aa, Homo Sapiens
PRKTNITHE

SEQ ID NO: 474553 - protein, 9 aa, Homo Sapiens
KKICGAVRL

SEQ ID NO: 474554 - protein, 9 aa, Homo Sapiens
DCSCGGGQS

SEQ ID NO: 474555 - protein, 9 aa, Homo Sapiens
DGTLSELKP

SEQ ID NO: 474556 - protein, 9 aa, Homo Sapiens
WKSFLVIVN

SEQ ID NO: 474557 - protein, 9 aa, Homo Sapiens
IPAYSGEKN

SEQ ID NO: 474558 - protein, 9 aa, Homo Sapiens
NNILNLQGK

SEQ ID NO: 474559 - protein, 9 aa, Homo Sapiens
AKVYSKLIC

SEQ ID NO: 474560 - protein, 9 aa, Homo Sapiens
VSFHKKIHT

SEQ ID NO: 474561 - protein, 9 aa, Homo Sapiens
PPPPTPFDI

SEQ ID NO: 474562 - protein, 9 aa, Homo Sapiens
QHRHGRPSG

SEQ ID NO: 474563 - protein, 9 aa, Homo Sapiens
TPPDDLLQD

SEQ ID NO: 474564 - protein, 9 aa, Homo Sapiens
RDMHEERDL

SEQ ID NO: 474565 - protein, 9 aa, Homo Sapiens
QALLSGSFA

SEQ ID NO: 474566 - protein, 9 aa, Homo Sapiens
TPTLPSTTT

SEQ ID NO: 474567 - protein, 9 aa, Homo Sapiens
VQWQLAQLE

SEQ ID NO: 474568 - protein, 9 aa, Homo Sapiens
SQLMTEVVR

SEQ ID NO: 474569 - protein, 9 aa, Homo Sapiens
TTTPSVPTT

SEQ ID NO: 474570 - protein, 9 aa, Homo Sapiens
DIPSMAFSS

SEQ ID NO: 474571 - protein, 9 aa, Homo Sapiens
GSCSGRARG

SEQ ID NO: 474572 - protein, 9 aa, Homo Sapiens
ELSHQKSSK

SEQ ID NO: 474573 - protein, 9 aa, Homo Sapiens
FIILMSLVG

SEQ ID NO: 474574 - protein, 9 aa, Homo Sapiens
GAGSCSGRA

SEQ ID NO: 474575 - protein, 9 aa, Homo Sapiens
QGTAGNNAK

SEQ ID NO: 474576 - protein, 9 aa, Homo Sapiens
SRKCQIDIY

SEQ ID NO: 474577 - protein, 9 aa, Homo Sapiens
ISSTPTLPS

SEQ ID NO: 474578 - protein, 9 aa, Homo Sapiens
FNQSSNFTD

SEQ ID NO: 474579 - protein, 9 aa, Homo Sapiens
PPERVSPAA

SEQ ID NO: 474580 - protein, 9 aa, Homo Sapiens
FFQALLSGS

SEQ ID NO: 474581 - protein, 9 aa, Homo Sapiens
EVSRLLDYE

SEQ ID NO: 474582 - protein, 9 aa, Homo Sapiens
RESEAFRQA

SEQ ID NO: 474583 - protein, 9 aa, Homo Sapiens
PFFQALLSG

SEQ ID NO: 474584 - protein, 9 aa, Homo Sapiens
KYKPRPNRT

SEQ ID NO: 474585 - protein, 9 aa, Homo Sapiens
MVDDGTLSE

SEQ ID NO: 474586 - protein, 9 aa, Homo Sapiens
SHQKSSKAG

SEQ ID NO: 474587 - protein, 9 aa, Homo Sapiens
SRLLDYEIE

SEQ ID NO: 474588 - protein, 9 aa, Homo Sapiens
KKLAGRLKA

SEQ ID NO: 474589 - protein, 9 aa, Homo Sapiens
VYSKLICMF

SEQ ID NO: 474590 - protein, 9 aa, Homo Sapiens
ISPVTLCGE

SEQ ID NO: 474591 - protein, 9 aa, Homo Sapiens
HGRPSGRQS

SEQ ID NO: 474592 - protein, 9 aa, Homo Sapiens
HHLPEEYPA

SEQ ID NO: 474593 - protein, 9 aa, Homo Sapiens
LVIVNGSPK

SEQ ID NO: 474594 - protein, 9 aa, Homo Sapiens
GTLSELKPR

SEQ ID NO: 474595 - protein, 9 aa, Homo Sapiens
SCSGRARGH

SEQ ID NO: 474596 - protein, 9 aa, Homo Sapiens
YKKKLAGRL

SEQ ID NO: 474597 - protein, 9 aa, Homo Sapiens
FSPFCVCEC

SEQ ID NO: 474598 - protein, 9 aa, Homo Sapiens
CVKVEIQET

SEQ ID NO: 474599 - protein, 9 aa, Homo Sapiens
HVVGRDITE

SEQ ID NO: 474600 - protein, 9 aa, Homo Sapiens
SSTVSFHKK

SEQ ID NO: 474601 - protein, 9 aa, Homo Sapiens
PEEYPAVYY

SEQ ID NO: 474602 - protein, 9 aa, Homo Sapiens
ASENDIPSM

SEQ ID NO: 474603 - protein, 9 aa, Homo Sapiens
SHRGPQKHH

SEQ ID NO: 474604 - protein, 9 aa, Homo Sapiens
ERVSPAAAQ

SEQ ID NO: 474605 - protein, 9 aa, Homo Sapiens
LHVVGRDIT

SEQ ID NO: 474606 - protein, 9 aa, Homo Sapiens
PPPERVSPA

SEQ ID NO: 474607 - protein, 9 aa, Homo Sapiens
SYVLQEEGP

SEQ ID NO: 474608 - protein, 9 aa, Homo Sapiens
QLLSPWQAP

SEQ ID NO: 474609 - protein, 9 aa, Homo Sapiens
QQTEKTIEQ

SEQ ID NO: 474610 - protein, 9 aa, Homo Sapiens
GGGTPPDDL

SEQ ID NO: 474611 - protein, 9 aa, Homo Sapiens
KNNILNLQG

SEQ ID NO: 474612 - protein, 9 aa, Homo Sapiens
AGNNAKMEK

SEQ ID NO: 474613 - protein, 9 aa, Homo Sapiens
QWQLAQLEA

SEQ ID NO: 474614 - protein, 9 aa, Homo Sapiens
GEKNAGTDQ

SEQ ID NO: 474615 - protein, 9 aa, Homo Sapiens
RRPLGELEQ

SEQ ID NO: 474616 - protein, 9 aa, Homo Sapiens
ATPRYRWQI

SEQ ID NO: 474617 - protein, 9 aa, Homo Sapiens
LLESAKVYS

SEQ ID NO: 474618 - protein, 9 aa, Homo Sapiens
LSHQKSSKA

SEQ ID NO: 474619 - protein, 9 aa, Homo Sapiens
WQLAQLEAR

SEQ ID NO: 474620 - protein, 9 aa, Homo Sapiens
KEVSRLLDY

SEQ ID NO: 474621 - protein, 9 aa, Homo Sapiens
TRFLPMLMF

SEQ ID NO: 474622 - protein, 9 aa, Homo Sapiens
RREQEEREQ

SEQ ID NO: 474623 - protein, 9 aa, Homo Sapiens
AERKKICGA

SEQ ID NO: 474624 - protein, 9 aa, Homo Sapiens
HRGPQKHHL

SEQ ID NO: 474625 - protein, 9 aa, Homo Sapiens
TKLHVVGRD

SEQ ID NO: 474626 - protein, 9 aa, Homo Sapiens
YLAKHSGEK

SEQ ID NO: 474627 - protein, 9 aa, Homo Sapiens
TTPSVPTTS

SEQ ID NO: 474628 - protein, 9 aa, Homo Sapiens
GRPSGRQSH

SEQ ID NO: 474629 - protein, 9 aa, Homo Sapiens
VEALPRPVL

SEQ ID NO: 474630 - protein, 9 aa, Homo Sapiens
SDTLMIACV

SEQ ID NO: 474631 - protein, 9 aa, Homo Sapiens
LQGKGLSYL

SEQ ID NO: 474632 - protein, 9 aa, Homo Sapiens
YSKLICMFQ

SEQ ID NO: 474633 - protein, 9 aa, Homo Sapiens
TPVSGHHCP

SEQ ID NO: 474634 - protein, 9 aa, Homo Sapiens
HEERDLLLR

SEQ ID NO: 474635 - protein, 9 aa, Homo Sapiens
CAPSTWVQH

SEQ ID NO: 474636 - protein, 9 aa, Homo Sapiens
VYHCAPSTW

SEQ ID NO: 474637 - protein, 9 aa, Homo Sapiens
VEIQETQTP

SEQ ID NO: 474638 - protein, 9 aa, Homo Sapiens
PSTTTPSVP

SEQ ID NO: 474639 - protein, 9 aa, Homo Sapiens
FTDHKRIHT

SEQ ID NO: 474640 - protein, 9 aa, Homo Sapiens
GRARGHLSS

SEQ ID NO: 474641 - protein, 9 aa, Homo Sapiens
SSRPSTNCS

SEQ ID NO: 474642 - protein, 9 aa, Homo Sapiens
SATASPFFQ

SEQ ID NO: 474643 - protein, 9 aa, Homo Sapiens
TLSELKPRP

SEQ ID NO: 474644 - protein, 9 aa, Homo Sapiens
TNITHEEHT

SEQ ID NO: 474645 - protein, 9 aa, Homo Sapiens
AGRLKAKLP

SEQ ID NO: 474646 - protein, 9 aa, Homo Sapiens
FCVCECCTK

SEQ ID NO: 474647 - protein, 9 aa, Homo Sapiens
RPSTNCSPR

SEQ ID NO: 474648 - protein, 9 aa, Homo Sapiens
RPVGTWQPQ

SEQ ID NO: 474649 - protein, 9 aa, Homo Sapiens
IPSMAFSSR

SEQ ID NO: 474650 - protein, 9 aa, Homo Sapiens
LPMLMFFLV

SEQ ID NO: 474651 - protein, 9 aa, Homo Sapiens
EPPPERVSP

SEQ ID NO: 474652 - protein, 9 aa, Homo Sapiens
NITHEEHTA

SEQ ID NO: 474653 - protein, 9 aa, Homo Sapiens
GNNAKMEKQ

SEQ ID NO: 474654 - protein, 9 aa, Homo Sapiens
REQEEREQQ

SEQ ID NO: 474655 - protein, 9 aa, Homo Sapiens
NRTCLVDGK

SEQ ID NO: 474656 - protein, 9 aa, Homo Sapiens
KNEPRKTNI

SEQ ID NO: 474657 - protein, 9 aa, Homo Sapiens
SNFTDHKRI

SEQ ID NO: 474658 - protein, 9 aa, Homo Sapiens
DDGTLSELK

SEQ ID NO: 474659 - protein, 9 aa, Homo Sapiens
PRPVLQNLP

SEQ ID NO: 474660 - protein, 9 aa, Homo Sapiens
EQEEREQQL

SEQ ID NO: 474661 - protein, 9 aa, Homo Sapiens
LAKHSGEKP

SEQ ID NO: 474662 - protein, 9 aa, Homo Sapiens
CGAVRLPST

SEQ ID NO: 474663 - protein, 9 aa, Homo Sapiens
CHQDTPAIY

SEQ ID NO: 474664 - protein, 9 aa, Homo Sapiens
PSVPTTSTI

SEQ ID NO: 474665 - protein, 9 aa, Homo Sapiens
SLSKDTAFA

SEQ ID NO: 474666 - protein, 9 aa, Homo Sapiens
KLHVVGRDI

SEQ ID NO: 474667 - protein, 9 aa, Homo Sapiens
KTIEQKLVQ

SEQ ID NO: 474668 - protein, 9 aa, Homo Sapiens
PVPLIHRVV

SEQ ID NO: 474669 - protein, 9 aa, Homo Sapiens
SENDIPSMA

SEQ ID NO: 474670 - protein, 9 aa, Homo Sapiens
VPLIHRVVI

SEQ ID NO: 474671 - protein, 9 aa, Homo Sapiens
IPSSCGPSY

SEQ ID NO: 474672 - protein, 9 aa, Homo Sapiens
VSRKCQIDI

SEQ ID NO: 474673 - protein, 9 aa, Homo Sapiens
FHKKIHTGE

SEQ ID NO: 474674 - protein, 9 aa, Homo Sapiens
PTTSTIPST

SEQ ID NO: 474675 - protein, 9 aa, Homo Sapiens
HQKSSKAGE

SEQ ID NO: 474676 - protein, 9 aa, Homo Sapiens
ICGAVRLPS

SEQ ID NO: 474677 - protein, 9 aa, Homo Sapiens
STIPSTASC

SEQ ID NO: 474678 - protein, 9 aa, Homo Sapiens
CPLLPCHQD

SEQ ID NO: 474679 - protein, 9 aa, Homo Sapiens
IHRVVIVSE

SEQ ID NO: 474680 - protein, 9 aa, Homo Sapiens
VKVVTLLVS

SEQ ID NO: 474681 - protein, 9 aa, Homo Sapiens
WWSILPIQI

SEQ ID NO: 474682 - protein, 9 aa, Homo Sapiens
SMQERHKEI

SEQ ID NO: 474683 - protein, 9 aa, Homo Sapiens
FQALLSGSF

SEQ ID NO: 474684 - protein, 9 aa, Homo Sapiens
PRYRWQIVP

SEQ ID NO: 474685 - protein, 9 aa, Homo Sapiens
RKKICGAVR

SEQ ID NO: 474686 - protein, 9 aa, Homo Sapiens
PMLMFFLVD

SEQ ID NO: 474687 - protein, 9 aa, Homo Sapiens
YHCAPSTWV

SEQ ID NO: 474688 - protein, 9 aa, Homo Sapiens
PSYVLQEEG

SEQ ID NO: 474689 - protein, 9 aa, Homo Sapiens
GGGGTPPDD

SEQ ID NO: 474690 - protein, 9 aa, Homo Sapiens
VGTWQPQCS

SEQ ID NO: 474691 - protein, 9 aa, Homo Sapiens
DTLMIACVS

SEQ ID NO: 474692 - protein, 9 aa, Homo Sapiens
EGSLFEVQW

SEQ ID NO: 474693 - protein, 9 aa, Homo Sapiens
PAPSPPPPP

SEQ ID NO: 474694 - protein, 9 aa, Homo Sapiens
PSGRQSHRG

SEQ ID NO: 474695 - protein, 9 aa, Homo Sapiens
TDQGTAGNN

SEQ ID NO: 474696 - protein, 9 aa, Homo Sapiens
GAGGIPSSC

SEQ ID NO: 474697 - protein, 9 aa, Homo Sapiens
PSTPVSGHH

SEQ ID NO: 474698 - protein, 9 aa, Homo Sapiens
PAGGAGSCS

SEQ ID NO: 474699 - protein, 9 aa, Homo Sapiens
PPPPPTPFD

SEQ ID NO: 474700 - protein, 9 aa, Homo Sapiens
VRLPSTPVS

SEQ ID NO: 474701 - protein, 9 aa, Homo Sapiens
YYACGECPL

SEQ ID NO: 474702 - protein, 9 aa, Homo Sapiens
DIQQTEKTI

SEQ ID NO: 474703 - protein, 9 aa, Homo Sapiens
STPTLPSTT

SEQ ID NO: 474704 - protein, 9 aa, Homo Sapiens
ASCPRGAGG

SEQ ID NO: 474705 - protein, 9 aa, Homo Sapiens
EILKSLSKD

SEQ ID NO: 474706 - protein, 9 aa, Homo Sapiens
VMHSLMKLT

SEQ ID NO: 474707 - protein, 9 aa, Homo Sapiens
GKGLSYLSQ

SEQ ID NO: 474708 - protein, 9 aa, Homo Sapiens
KHSGEKPYK

SEQ ID NO: 474709 - protein, 9 aa, Homo Sapiens
YLSQRLHIK

SEQ ID NO: 474710 - protein, 9 aa, Homo Sapiens
LAISPVTLC

SEQ ID NO: 474711 - protein, 9 aa, Homo Sapiens
EREQQLRRE

SEQ ID NO: 474712 - protein, 9 aa, Homo Sapiens
HEYLSQRLH

SEQ ID NO: 474713 - protein, 9 aa, Homo Sapiens
TFPHFIGLS

SEQ ID NO: 474714 - protein, 9 aa, Homo Sapiens
QEVMHSLMK

SEQ ID NO: 474715 - protein, 9 aa, Homo Sapiens
LLVSRKCQI

SEQ ID NO: 474716 - protein, 9 aa, Homo Sapiens
SILPIQILS

SEQ ID NO: 474717 - protein, 9 aa, Homo Sapiens
IMLLMRAVR

SEQ ID NO: 474718 - protein, 9 aa, Homo Sapiens
FFLVDDYTF

SEQ ID NO: 474719 - protein, 9 aa, Homo Sapiens
PISCVKVEI

SEQ ID NO: 474720 - protein, 9 aa, Homo Sapiens
RVVIVSEKG

SEQ ID NO: 474721 - protein, 9 aa, Homo Sapiens
SPFCVCECC

SEQ ID NO: 474722 - protein, 9 aa, Homo Sapiens
QSQLMTEVV

SEQ ID NO: 474723 - protein, 9 aa, Homo Sapiens
EKALVLDKV

SEQ ID NO: 474724 - protein, 9 aa, Homo Sapiens
LMSLVGYFF

SEQ ID NO: 474725 - protein, 9 aa, Homo Sapiens
KDTAFALGF

SEQ ID NO: 474726 - protein, 9 aa, Homo Sapiens
NLQGKGLSY

SEQ ID NO: 474727 - protein, 9 aa, Homo Sapiens
SLFEVQWQL

SEQ ID NO: 474728 - protein, 9 aa, Homo Sapiens
SSTPTLPST

SEQ ID NO: 474729 - protein, 9 aa, Homo Sapiens
SFHKKIHTG

SEQ ID NO: 474730 - protein, 9 aa, Homo Sapiens
LLPCHQDTP

SEQ ID NO: 474731 - protein, 9 aa, Homo Sapiens
YSGEKNAGT

SEQ ID NO: 474732 - protein, 9 aa, Homo Sapiens
KLAGRLKAK

SEQ ID NO: 474733 - protein, 9 aa, Homo Sapiens
GITGPPGPS

SEQ ID NO: 474734 - protein, 9 aa, Homo Sapiens
LSSHSNPQH

SEQ ID NO: 474735 - protein, 9 aa, Homo Sapiens
YACGECPLL

SEQ ID NO: 474736 - protein, 9 aa, Homo Sapiens
ARGHLSSHS

SEQ ID NO: 474737 - protein, 9 aa, Homo Sapiens
LIHRVVIVS

SEQ ID NO: 474738 - protein, 9 aa, Homo Sapiens
QSSNFTDHK

SEQ ID NO: 474739 - protein, 9 aa, Homo Sapiens
ERKKICGAV

SEQ ID NO: 474740 - protein, 9 aa, Homo Sapiens
SSSTVSFHK

SEQ ID NO: 474741 - protein, 9 aa, Homo Sapiens
SSHSNPQHR

SEQ ID NO: 474742 - protein, 9 aa, Homo Sapiens
LPEEYPAVY

SEQ ID NO: 474743 - protein, 9 aa, Homo Sapiens
LLMRAVRPV

SEQ ID NO: 474744 - protein, 9 aa, Homo Sapiens
GNSDTLMIA

SEQ ID NO: 474745 - protein, 9 aa, Homo Sapiens
STVSFHKKI

SEQ ID NO: 474746 - protein, 9 aa, Homo Sapiens
EEYPAVYYA

SEQ ID NO: 474747 - protein, 9 aa, Homo Sapiens
EGPASPDSQ

SEQ ID NO: 474748 - protein, 9 aa, Homo Sapiens
PERVSPAAA

SEQ ID NO: 474749 - protein, 9 aa, Homo Sapiens
TVSFHKKIH

SEQ ID NO: 474750 - protein, 9 aa, Homo Sapiens
TSTIPSTAS

SEQ ID NO: 474751 - protein, 9 aa, Homo Sapiens
PVSGHHCPV

SEQ ID NO: 474752 - protein, 9 aa, Homo Sapiens
HSYLAKHSG

SEQ ID NO: 474753 - protein, 9 aa, Homo Sapiens
CNSLLVAER

SEQ ID NO: 474754 - protein, 9 aa, Homo Sapiens
ILKSLSKDT

SEQ ID NO: 474755 - protein, 9 aa, Homo Sapiens
TPSVPTTST

SEQ ID NO: 474756 - protein, 9 aa, Homo Sapiens
FKSSSTVSF

SEQ ID NO: 474757 - protein, 9 aa, Homo Sapiens
CSCGGGQSL

SEQ ID NO: 474758 - protein, 9 aa, Homo Sapiens
NILNLQGKG

SEQ ID NO: 474759 - protein, 9 aa, Homo Sapiens
RLHIKEEDM

SEQ ID NO: 474760 - protein, 9 aa, Homo Sapiens
SWWSILPIQ

SEQ ID NO: 474761 - protein, 9 aa, Homo Sapiens
YKYKPRPNR

SEQ ID NO: 474762 - protein, 9 aa, Homo Sapiens
VMVDDGTLS

SEQ ID NO: 474763 - protein, 9 aa, Homo Sapiens
KVEIQETQT

SEQ ID NO: 474764 - protein, 9 aa, Homo Sapiens
SHSNPQHRH

SEQ ID NO: 474765 - protein, 9 aa, Homo Sapiens
HQDTPAIYG

SEQ ID NO: 474766 - protein, 9 aa, Homo Sapiens
LMTEVVRRC

SEQ ID NO: 474767 - protein, 9 aa, Homo Sapiens
VKVEIQETQ

SEQ ID NO: 474768 - protein, 9 aa, Homo Sapiens
LFIILMSLV

SEQ ID NO: 474769 - protein, 9 aa, Homo Sapiens
APSPPPPPP

SEQ ID NO: 474770 - protein, 9 aa, Homo Sapiens
LGGNSDTLM

SEQ ID NO: 474771 - protein, 9 aa, Homo Sapiens
STTTPSVPT

SEQ ID NO: 474772 - protein, 9 aa, Homo Sapiens
ASPDSQPAG

SEQ ID NO: 474773 - protein, 9 aa, Homo Sapiens
RAVRPVGTW

SEQ ID NO: 474774 - protein, 9 aa, Homo Sapiens
RISMQERHK

SEQ ID NO: 474775 - protein, 9 aa, Homo Sapiens
ILPIQILSA

SEQ ID NO: 474776 - protein, 9 aa, Homo Sapiens
RGHLSSHSN

SEQ ID NO: 474777 - protein, 9 aa, Homo Sapiens
NFTDHKRIH

SEQ ID NO: 474778 - protein, 9 aa, Homo Sapiens
EVQWQLAQL

SEQ ID NO: 474779 - protein, 9 aa, Homo Sapiens
SLLVAERKK

SEQ ID NO: 474780 - protein, 9 aa, Homo Sapiens
HGQPFRQLL

SEQ ID NO: 474781 - protein, 9 aa, Homo Sapiens
KAGEKADGV

SEQ ID NO: 474782 - protein, 9 aa, Homo Sapiens
VIVNGSPKN

SEQ ID NO: 474783 - protein, 9 aa, Homo Sapiens
SSNFTDHKR

SEQ ID NO: 474784 - protein, 9 aa, Homo Sapiens
AVRPVGTWQ

SEQ ID NO: 474785 - protein, 9 aa, Homo Sapiens
HIKEEDMRL

SEQ ID NO: 474786 - protein, 9 aa, Homo Sapiens
PDSQPAGGA

SEQ ID NO: 474787 - protein, 9 aa, Homo Sapiens
LDKVMENVG

SEQ ID NO: 474788 - protein, 9 aa, Homo Sapiens
DSQPAGGAG

SEQ ID NO: 474789 - protein, 9 aa, Homo Sapiens
SWCDCSCGG

SEQ ID NO: 474790 - protein, 9 aa, Homo Sapiens
HRHGRPSGR

SEQ ID NO: 474791 - protein, 9 aa, Homo Sapiens
LSKDTAFAL

SEQ ID NO: 474792 - protein, 9 aa, Homo Sapiens
LQEEGPASP

SEQ ID NO: 474793 - protein, 9 aa, Homo Sapiens
VRPVGTWQP

SEQ ID NO: 474794 - protein, 9 aa, Homo Sapiens
LRREQEERE

SEQ ID NO: 474795 - protein, 9 aa, Homo Sapiens
LHIKEEDMR

SEQ ID NO: 474796 - protein, 9 aa, Homo Sapiens
SCVSSPCCP

SEQ ID NO: 474797 - protein, 9 aa, Homo Sapiens
KGPFFASDF

SEQ ID NO: 474798 - protein, 9 aa, Homo Sapiens
EKSARSPLS

SEQ ID NO: 474799 - protein, 9 aa, Homo Sapiens
RDLPLQSPK

SEQ ID NO: 474800 - protein, 9 aa, Homo Sapiens
KFKICKLRS

SEQ ID NO: 474801 - protein, 9 aa, Homo Sapiens
YNATLSVRQ

SEQ ID NO: 474802 - protein, 9 aa, Homo Sapiens
AGAGVGELQ

SEQ ID NO: 474803 - protein, 9 aa, Homo Sapiens
PHEASFVMA

SEQ ID NO: 474804 - protein, 9 aa, Homo Sapiens
QPTHSLTPS

SEQ ID NO: 474805 - protein, 9 aa, Homo Sapiens
CTVAANIVL

SEQ ID NO: 474806 - protein, 9 aa, Homo Sapiens
SVRQLIENA

SEQ ID NO: 474807 - protein, 9 aa, Homo Sapiens
GLSTERDLP

SEQ ID NO: 474808 - protein, 9 aa, Homo Sapiens
DTQMEMRPM

SEQ ID NO: 474809 - protein, 9 aa, Homo Sapiens
LQSPKERPP

SEQ ID NO: 474810 - protein, 9 aa, Homo Sapiens
VSSCTVAAN

SEQ ID NO: 474811 - protein, 9 aa, Homo Sapiens
QLSSLCVCN

SEQ ID NO: 474812 - protein, 9 aa, Homo Sapiens
MAAESEGEV

SEQ ID NO: 474813 - protein, 9 aa, Homo Sapiens
MADNLKRIR

SEQ ID NO: 474814 - protein, 9 aa, Homo Sapiens
YGMADNLKR

SEQ ID NO: 474815 - protein, 9 aa, Homo Sapiens
TGLMLCNLH

SEQ ID NO: 474816 - protein, 9 aa, Homo Sapiens
RRVYISYLN

SEQ ID NO: 474817 - protein, 9 aa, Homo Sapiens
LHIVLPHEA

SEQ ID NO: 474818 - protein, 9 aa, Homo Sapiens
SRLGLSTER

SEQ ID NO: 474819 - protein, 9 aa, Homo Sapiens
SCTVAANIV

SEQ ID NO: 474820 - protein, 9 aa, Homo Sapiens
MNYMAAESE

SEQ ID NO: 474821 - protein, 9 aa, Homo Sapiens
MAGAGVGEL

SEQ ID NO: 474822 - protein, 9 aa, Homo Sapiens
PLTASPFLL

SEQ ID NO: 474823 - protein, 9 aa, Homo Sapiens
FIITGLMLC

SEQ ID NO: 474824 - protein, 9 aa, Homo Sapiens
NLKRIRKIK

SEQ ID NO: 474825 - protein, 9 aa, Homo Sapiens
NATLSVRQL

SEQ ID NO: 474826 - protein, 9 aa, Homo Sapiens
LSLSDNLDF

SEQ ID NO: 474827 - protein, 9 aa, Homo Sapiens
AGVGELQCL

SEQ ID NO: 474828 - protein, 9 aa, Homo Sapiens
VLPHEASFV

SEQ ID NO: 474829 - protein, 9 aa, Homo Sapiens
DQTSQTSWT

SEQ ID NO: 474830 - protein, 9 aa, Homo Sapiens
LSVRQLIEN

SEQ ID NO: 474831 - protein, 9 aa, Homo Sapiens
QKFIITGLM

SEQ ID NO: 474832 - protein, 9 aa, Homo Sapiens
ALRMQLSSL

SEQ ID NO: 474833 - protein, 9 aa, Homo Sapiens
YDQTSQTSW

SEQ ID NO: 474834 - protein, 9 aa, Homo Sapiens
RQLIENADE

SEQ ID NO: 474835 - protein, 9 aa, Homo Sapiens
YIEQRARQK

SEQ ID NO: 474836 - protein, 9 aa, Homo Sapiens
VMIIVSSCT

SEQ ID NO: 474837 - protein, 9 aa, Homo Sapiens
PTHSLTPSR

SEQ ID NO: 474838 - protein, 9 aa, Homo Sapiens
NLHIVLPHE

SEQ ID NO: 474839 - protein, 9 aa, Homo Sapiens
LRMQLSSLC

SEQ ID NO: 474840 - protein, 9 aa, Homo Sapiens
ASFVMAGAG

SEQ ID NO: 474841 - protein, 9 aa, Homo Sapiens
EQRARQKFI

SEQ ID NO: 474842 - protein, 9 aa, Homo Sapiens
NSVHFFRPK

SEQ ID NO: 474843 - protein, 9 aa, Homo Sapiens
FKICKLRSF

SEQ ID NO: 474844 - protein, 9 aa, Homo Sapiens
YISYLNSVH

SEQ ID NO: 474845 - protein, 9 aa, Homo Sapiens
SLCVCNSHC

SEQ ID NO: 474846 - protein, 9 aa, Homo Sapiens
RSPLSLSDN

SEQ ID NO: 474847 - protein, 9 aa, Homo Sapiens
SRGRRKKKF

SEQ ID NO: 474848 - protein, 9 aa, Homo Sapiens
LCNLHIVLP

SEQ ID NO: 474849 - protein, 9 aa, Homo Sapiens
IITGLMLCN

SEQ ID NO: 474850 - protein, 9 aa, Homo Sapiens
ATLSVRQLI

SEQ ID NO: 474851 - protein, 9 aa, Homo Sapiens
RSGFILSVH

SEQ ID NO: 474852 - protein, 9 aa, Homo Sapiens
LCVCNSHCV

SEQ ID NO: 474853 - protein, 9 aa, Homo Sapiens
YLNSVHFFR

SEQ ID NO: 474854 - protein, 9 aa, Homo Sapiens
RPPLTASPF

SEQ ID NO: 474855 - protein, 9 aa, Homo Sapiens
GFILSVHGN

SEQ ID NO: 474856 - protein, 9 aa, Homo Sapiens
ARSPLSLSD

SEQ ID NO: 474857 - protein, 9 aa, Homo Sapiens
RARQKFIIT

SEQ ID NO: 474858 - protein, 9 aa, Homo Sapiens
KKKFKICKL

SEQ ID NO: 474859 - protein, 9 aa, Homo Sapiens
SYLNSVHFF

SEQ ID NO: 474860 - protein, 9 aa, Homo Sapiens
DVSYGMADN

SEQ ID NO: 474861 - protein, 9 aa, Homo Sapiens
SEGEVCVKG

SEQ ID NO: 474862 - protein, 9 aa, Homo Sapiens
RMQLSSLCV

SEQ ID NO: 474863 - protein, 9 aa, Homo Sapiens
KRKGPFFAS

SEQ ID NO: 474864 - protein, 9 aa, Homo Sapiens
LTPSRLGLS

SEQ ID NO: 474865 - protein, 9 aa, Homo Sapiens
IKRKGPFFA

SEQ ID NO: 474866 - protein, 9 aa, Homo Sapiens
LSTERDLPL

SEQ ID NO: 474867 - protein, 9 aa, Homo Sapiens
IVSSCTVAA

SEQ ID NO: 474868 - protein, 9 aa, Homo Sapiens
DIKRKGPFF

SEQ ID NO: 474869 - protein, 9 aa, Homo Sapiens
ERPPLTASP

SEQ ID NO: 474870 - protein, 9 aa, Homo Sapiens
QRARQKFII

SEQ ID NO: 474871 - protein, 9 aa, Homo Sapiens
CNLHIVLPH

SEQ ID NO: 474872 - protein, 9 aa, Homo Sapiens
RRKKKFKIC

SEQ ID NO: 474873 - protein, 9 aa, Homo Sapiens
GPFFASDFY

SEQ ID NO: 474874 - protein, 9 aa, Homo Sapiens
ESEGEVCVK

SEQ ID NO: 474875 - protein, 9 aa, Homo Sapiens
PKERPPLTA

SEQ ID NO: 474876 - protein, 9 aa, Homo Sapiens
SLTPSRLGL

SEQ ID NO: 474877 - protein, 9 aa, Homo Sapiens
EMNYMAAES

SEQ ID NO: 474878 - protein, 9 aa, Homo Sapiens
QQYIEQRAR

SEQ ID NO: 474879 - protein, 9 aa, Homo Sapiens
SGFILSVHG

SEQ ID NO: 474880 - protein, 9 aa, Homo Sapiens
GMADNLKRI

SEQ ID NO: 474881 - protein, 9 aa, Homo Sapiens
TPSRLGLST

SEQ ID NO: 474882 - protein, 9 aa, Homo Sapiens
IEQRARQKF

SEQ ID NO: 474883 - protein, 9 aa, Homo Sapiens
IRYDQTSQT

SEQ ID NO: 474884 - protein, 9 aa, Homo Sapiens
VYISYLNSV

SEQ ID NO: 474885 - protein, 9 aa, Homo Sapiens
GLMLCNLHI

SEQ ID NO: 474886 - protein, 9 aa, Homo Sapiens
HIVLPHEAS

SEQ ID NO: 474887 - protein, 9 aa, Homo Sapiens
ERDLPLQSP

SEQ ID NO: 474888 - protein, 9 aa, Homo Sapiens
RKKKFKICK

SEQ ID NO: 474889 - protein, 9 aa, Homo Sapiens
RKGPFFASD

SEQ ID NO: 474890 - protein, 9 aa, Homo Sapiens
RGRRKKKFK

SEQ ID NO: 474891 - protein, 9 aa, Homo Sapiens
LMLCNLHIV

SEQ ID NO: 474892 - protein, 9 aa, Homo Sapiens
KKFKICKLR

SEQ ID NO: 474893 - protein, 9 aa, Homo Sapiens
RVYISYLNS

SEQ ID NO: 474894 - protein, 9 aa, Homo Sapiens
EASFVMAGA

SEQ ID NO: 474895 - protein, 9 aa, Homo Sapiens
SPLSLSDNL

SEQ ID NO: 474896 - protein, 9 aa, Homo Sapiens
KSARSPLSL

SEQ ID NO: 474897 - protein, 9 aa, Homo Sapiens
QMEMRPMTL

SEQ ID NO: 474898 - protein, 9 aa, Homo Sapiens
STERDLPLQ

SEQ ID NO: 474899 - protein, 9 aa, Homo Sapiens
RSEIRYDQT

SEQ ID NO: 474900 - protein, 9 aa, Homo Sapiens
RLGLSTERD

SEQ ID NO: 474901 - protein, 9 aa, Homo Sapiens
PLSLSDNLD

SEQ ID NO: 474902 - protein, 9 aa, Homo Sapiens
TQMEMRPMT

SEQ ID NO: 474903 - protein, 9 aa, Homo Sapiens
SYGMADNLK

SEQ ID NO: 474904 - protein, 9 aa, Homo Sapiens
VMAGAGVGE

SEQ ID NO: 474905 - protein, 9 aa, Homo Sapiens
IKDIKRKGP

SEQ ID NO: 474906 - protein, 9 aa, Homo Sapiens
MEMRPMTLE

SEQ ID NO: 474907 - protein, 9 aa, Homo Sapiens
HEASFVMAG

SEQ ID NO: 474908 - protein, 9 aa, Homo Sapiens
RYDQTSQTS

SEQ ID NO: 474909 - protein, 9 aa, Homo Sapiens
KFIITGLML

SEQ ID NO: 474910 - protein, 9 aa, Homo Sapiens
AVDTQMEMR

SEQ ID NO: 474911 - protein, 9 aa, Homo Sapiens
AESEGEVCV

SEQ ID NO: 474912 - protein, 9 aa, Homo Sapiens
QSPKERPPL

SEQ ID NO: 474913 - protein, 9 aa, Homo Sapiens
RQKFIITGL

SEQ ID NO: 474914 - protein, 9 aa, Homo Sapiens
KERPPLTAS

SEQ ID NO: 474915 - protein, 9 aa, Homo Sapiens
TLSVRQLIE

SEQ ID NO: 474916 - protein, 9 aa, Homo Sapiens
DNLKRIRKI

SEQ ID NO: 474917 - protein, 9 aa, Homo Sapiens
TERDLPLQS

SEQ ID NO: 474918 - protein, 9 aa, Homo Sapiens
TVAANIVLT

SEQ ID NO: 474919 - protein, 9 aa, Homo Sapiens
ITGLMLCNL

SEQ ID NO: 474920 - protein, 9 aa, Homo Sapiens
SARSPLSLS

SEQ ID NO: 474921 - protein, 9 aa, Homo Sapiens
VRQLIENAD

SEQ ID NO: 474922 - protein, 9 aa, Homo Sapiens
LPHEASFVM

SEQ ID NO: 474923 - protein, 9 aa, Homo Sapiens
EMRPMTLEE

SEQ ID NO: 474924 - protein, 9 aa, Homo Sapiens
IVLPHEASF

SEQ ID NO: 474925 - protein, 9 aa, Homo Sapiens
SPKERPPLT

SEQ ID NO: 474926 - protein, 9 aa, Homo Sapiens
YMAAESEGE

SEQ ID NO: 474927 - protein, 9 aa, Homo Sapiens
AKQQYIEQR

SEQ ID NO: 474928 - protein, 9 aa, Homo Sapiens
PSRLGLSTE

SEQ ID NO: 474929 - protein, 9 aa, Homo Sapiens
AAESEGEVC

SEQ ID NO: 474930 - protein, 9 aa, Homo Sapiens
HSLTPSRLG

SEQ ID NO: 474931 - protein, 9 aa, Homo Sapiens
SFVMAGAGV

SEQ ID NO: 474932 - protein, 9 aa, Homo Sapiens
LGLSTERDL

SEQ ID NO: 474933 - protein, 9 aa, Homo Sapiens
PLQSPKERP

SEQ ID NO: 474934 - protein, 9 aa, Homo Sapiens
KDIKRKGPF

SEQ ID NO: 474935 - protein, 9 aa, Homo Sapiens
KQQYIEQRA

SEQ ID NO: 474936 - protein, 9 aa, Homo Sapiens
THSLTPSRL

SEQ ID NO: 474937 - protein, 9 aa, Homo Sapiens
LIKDIKRKG

SEQ ID NO: 474938 - protein, 9 aa, Homo Sapiens
DLPLQSPKE

SEQ ID NO: 474939 - protein, 9 aa, Homo Sapiens
LSSLCVCNS

SEQ ID NO: 474940 - protein, 9 aa, Homo Sapiens
MLCNLHIVL

SEQ ID NO: 474941 - protein, 9 aa, Homo Sapiens
EIRYDQTSQ

SEQ ID NO: 474942 - protein, 9 aa, Homo Sapiens
GRRKKKFKI

SEQ ID NO: 474943 - protein, 9 aa, Homo Sapiens
PYNATLSVR

SEQ ID NO: 474944 - protein, 9 aa, Homo Sapiens
MRPMTLEEM

SEQ ID NO: 474945 - protein, 9 aa, Homo Sapiens
ADNLKRIRK

SEQ ID NO: 474946 - protein, 9 aa, Homo Sapiens
VSYGMADNL

SEQ ID NO: 474947 - protein, 9 aa, Homo Sapiens
GEKSARSPL

SEQ ID NO: 474948 - protein, 9 aa, Homo Sapiens
PAVDTQMEM

SEQ ID NO: 474949 - protein, 9 aa, Homo Sapiens
IIVSSCTVA

SEQ ID NO: 474950 - protein, 9 aa, Homo Sapiens
MIIVSSCTV

SEQ ID NO: 474951 - protein, 9 aa, Homo Sapiens
GAGVGELQC

SEQ ID NO: 474952 - protein, 9 aa, Homo Sapiens
SSLCVCNSH

SEQ ID NO: 474953 - protein, 9 aa, Homo Sapiens
QYIEQRARQ

SEQ ID NO: 474954 - protein, 9 aa, Homo Sapiens
PPLTASPFL

SEQ ID NO: 474955 - protein, 9 aa, Homo Sapiens
LNSVHFFRP

SEQ ID NO: 474956 - protein, 9 aa, Homo Sapiens
VDTQMEMRP

SEQ ID NO: 474957 - protein, 9 aa, Homo Sapiens
NYMAAESEG

SEQ ID NO: 474958 - protein, 9 aa, Homo Sapiens
SEIRYDQTS

SEQ ID NO: 474959 - protein, 9 aa, Homo Sapiens
ISYLNSVHF

SEQ ID NO: 474960 - protein, 9 aa, Homo Sapiens
FVMAGAGVG

SEQ ID NO: 474961 - protein, 9 aa, Homo Sapiens
SSCTVAANI

SEQ ID NO: 474962 - protein, 9 aa, Homo Sapiens
LPLQSPKER

SEQ ID NO: 474963 - protein, 9 aa, Homo Sapiens
MQLSSLCVC

SEQ ID NO: 474964 - protein, 9 aa, Homo Sapiens
ARQKFIITG

SEQ ID NO: 474965 - protein, 9 aa, Homo Sapiens
QHQLSADAA

SEQ ID NO: 474966 - protein, 9 aa, Homo Sapiens
KRGKYIKTW

SEQ ID NO: 474967 - protein, 9 aa, Homo Sapiens
DKRGVTLDP

SEQ ID NO: 474968 - protein, 9 aa, Homo Sapiens
RMEPKAEPV

SEQ ID NO: 474969 - protein, 9 aa, Homo Sapiens
QVTGLWMDP

SEQ ID NO: 474970 - protein, 9 aa, Homo Sapiens
LALHLNLGY

SEQ ID NO: 474971 - protein, 9 aa, Homo Sapiens
FVSEDKRGV

SEQ ID NO: 474972 - protein, 9 aa, Homo Sapiens
DRQDRHPEE

SEQ ID NO: 474973 - protein, 9 aa, Homo Sapiens
VTFVYQTIV

SEQ ID NO: 474974 - protein, 9 aa, Homo Sapiens
RLPRELRGR

SEQ ID NO: 474975 - protein, 9 aa, Homo Sapiens
AGFLKIDMA

SEQ ID NO: 474976 - protein, 9 aa, Homo Sapiens
EGRMEPKAE

SEQ ID NO: 474977 - protein, 9 aa, Homo Sapiens
FTGSLGFSL

SEQ ID NO: 474978 - protein, 9 aa, Homo Sapiens
HLNLGYSKA

SEQ ID NO: 474979 - protein, 9 aa, Homo Sapiens
WLHKRGKYI

SEQ ID NO: 474980 - protein, 9 aa, Homo Sapiens
DVQQQIAQV

SEQ ID NO: 474981 - protein, 9 aa, Homo Sapiens
SSHHPLQHQ

SEQ ID NO: 474982 - protein, 9 aa, Homo Sapiens
LHDCADGKC

SEQ ID NO: 474983 - protein, 9 aa, Homo Sapiens
SEGRMEPKA

SEQ ID NO: 474984 - protein, 9 aa, Homo Sapiens
PGYQGHSCR

SEQ ID NO: 474985 - protein, 9 aa, Homo Sapiens
HKLCERIDG

SEQ ID NO: 474986 - protein, 9 aa, Homo Sapiens
NQLIYGTVL

SEQ ID NO: 474987 - protein, 9 aa, Homo Sapiens
QVVTFVYQT

SEQ ID NO: 474988 - protein, 9 aa, Homo Sapiens
MDPSWAAPA

SEQ ID NO: 474989 - protein, 9 aa, Homo Sapiens
DVYGVDPEL

SEQ ID NO: 474990 - protein, 9 aa, Homo Sapiens
AQVQQGEGG

SEQ ID NO: 474991 - protein, 9 aa, Homo Sapiens
KYIKTWRPR

SEQ ID NO: 474992 - protein, 9 aa, Homo Sapiens
MPHFGTQYV

SEQ ID NO: 474993 - protein, 9 aa, Homo Sapiens
LKIDMASLG

SEQ ID NO: 474994 - protein, 9 aa, Homo Sapiens
QSMPHFGTQ

SEQ ID NO: 474995 - protein, 9 aa, Homo Sapiens
SLVAFLLFC

SEQ ID NO: 474996 - protein, 9 aa, Homo Sapiens
GSEGRMEPK

SEQ ID NO: 474997 - protein, 9 aa, Homo Sapiens
ILARVLHDC

SEQ ID NO: 474998 - protein, 9 aa, Homo Sapiens
LFVSEDKRG

SEQ ID NO: 474999 - protein, 9 aa, Homo Sapiens
LPRPAPGLE

SEQ ID NO: 475000 - protein, 9 aa, Homo Sapiens
FVDVYGVDP

SEQ ID NO: 475001 - protein, 9 aa, Homo Sapiens
RVLHDCADG

SEQ ID NO: 475002 - protein, 9 aa, Homo Sapiens
CAGFLKIDM

SEQ ID NO: 475003 - protein, 9 aa, Homo Sapiens
YGVDPELLS

SEQ ID NO: 475004 - protein, 9 aa, Homo Sapiens
GTQYVCQFP

SEQ ID NO: 475005 - protein, 9 aa, Homo Sapiens
LIYLDTQIH

SEQ ID NO: 475006 - protein, 9 aa, Homo Sapiens
KLQILKELF

SEQ ID NO: 475007 - protein, 9 aa, Homo Sapiens
PGTRRYWMK

SEQ ID NO: 475008 - protein, 9 aa, Homo Sapiens
MAQKTGDNL

SEQ ID NO: 475009 - protein, 9 aa, Homo Sapiens
HQLSADAAV

SEQ ID NO: 475010 - protein, 9 aa, Homo Sapiens
RIDGMNSSK

SEQ ID NO: 475011 - protein, 9 aa, Homo Sapiens
GYQGHSCRS

SEQ ID NO: 475012 - protein, 9 aa, Homo Sapiens
IMNQLIYGT

SEQ ID NO: 475013 - protein, 9 aa, Homo Sapiens
QRTVRDSDS

SEQ ID NO: 475014 - protein, 9 aa, Homo Sapiens
TRLEQEITT

SEQ ID NO: 475015 - protein, 9 aa, Homo Sapiens
LAVDWVSHN

SEQ ID NO: 475016 - protein, 9 aa, Homo Sapiens
RHISLDTPD

SEQ ID NO: 475017 - protein, 9 aa, Homo Sapiens
KNQTSVTLL

SEQ ID NO: 475018 - protein, 9 aa, Homo Sapiens
TNLAAAAAY

SEQ ID NO: 475019 - protein, 9 aa, Homo Sapiens
PPGYQGHSC

SEQ ID NO: 475020 - protein, 9 aa, Homo Sapiens
PGGIRETQR

SEQ ID NO: 475021 - protein, 9 aa, Homo Sapiens
GLAVDWVSH

SEQ ID NO: 475022 - protein, 9 aa, Homo Sapiens
LRHISLDTP

SEQ ID NO: 475023 - protein, 9 aa, Homo Sapiens
GHSCRSDVD

SEQ ID NO: 475024 - protein, 9 aa, Homo Sapiens
VVTFVYQTI

SEQ ID NO: 475025 - protein, 9 aa, Homo Sapiens
VYGVDPELL

SEQ ID NO: 475026 - protein, 9 aa, Homo Sapiens
NLAAAAAYI

SEQ ID NO: 475027 - protein, 9 aa, Homo Sapiens
EERLVTKKA

SEQ ID NO: 475028 - protein, 9 aa, Homo Sapiens
RRTDLRHIS

SEQ ID NO: 475029 - protein, 9 aa, Homo Sapiens
ARVLHDCAD

SEQ ID NO: 475030 - protein, 9 aa, Homo Sapiens
GFLKIDMAS

SEQ ID NO: 475031 - protein, 9 aa, Homo Sapiens
VQQQIAQVQ

SEQ ID NO: 475032 - protein, 9 aa, Homo Sapiens
WSKQVVTFV

SEQ ID NO: 475033 - protein, 9 aa, Homo Sapiens
RDRQDRHPE

SEQ ID NO: 475034 - protein, 9 aa, Homo Sapiens
GVHLFFTPA

SEQ ID NO: 475035 - protein, 9 aa, Homo Sapiens
EEDEEEESF

SEQ ID NO: 475036 - protein, 9 aa, Homo Sapiens
MEPKAEPVS

SEQ ID NO: 475037 - protein, 9 aa, Homo Sapiens
WMKETDSEY

SEQ ID NO: 475038 - protein, 9 aa, Homo Sapiens
RTDLRHISL

SEQ ID NO: 475039 - protein, 9 aa, Homo Sapiens
ARRTDLRHI

SEQ ID NO: 475040 - protein, 9 aa, Homo Sapiens
QIAQVQQGE

SEQ ID NO: 475041 - protein, 9 aa, Homo Sapiens
TDLRHISLD

SEQ ID NO: 475042 - protein, 9 aa, Homo Sapiens
LARRTDLRH

SEQ ID NO: 475043 - protein, 9 aa, Homo Sapiens
WQFVDVYGV

SEQ ID NO: 475044 - protein, 9 aa, Homo Sapiens
TFVYQTIVK

SEQ ID NO: 475045 - protein, 9 aa, Homo Sapiens
MASLGDSTD

SEQ ID NO: 475046 - protein, 9 aa, Homo Sapiens
HSCRSDVDE

SEQ ID NO: 475047 - protein, 9 aa, Homo Sapiens
LKDAKLQIL

SEQ ID NO: 475048 - protein, 9 aa, Homo Sapiens
EDKRGVTLD

SEQ ID NO: 475049 - protein, 9 aa, Homo Sapiens
CERIDGMNS

SEQ ID NO: 475050 - protein, 9 aa, Homo Sapiens
IRYAIGVHL

SEQ ID NO: 475051 - protein, 9 aa, Homo Sapiens
MLSARDRQD

SEQ ID NO: 475052 - protein, 9 aa, Homo Sapiens
NNLMAMAQK

SEQ ID NO: 475053 - protein, 9 aa, Homo Sapiens
NLGYSKARL

SEQ ID NO: 475054 - protein, 9 aa, Homo Sapiens
SFASALPRP

SEQ ID NO: 475055 - protein, 9 aa, Homo Sapiens
KQWSKQVVT

SEQ ID NO: 475056 - protein, 9 aa, Homo Sapiens
LLSLVAFLL

SEQ ID NO: 475057 - protein, 9 aa, Homo Sapiens
SKQVVTFVY

SEQ ID NO: 475058 - protein, 9 aa, Homo Sapiens
VNKNQTSVT

SEQ ID NO: 475059 - protein, 9 aa, Homo Sapiens
AIGVHLFFT

SEQ ID NO: 475060 - protein, 9 aa, Homo Sapiens
TGSLGFSLN

SEQ ID NO: 475061 - protein, 9 aa, Homo Sapiens
IYLDTQIHT

SEQ ID NO: 475062 - protein, 9 aa, Homo Sapiens
RNQVITPLT

SEQ ID NO: 475063 - protein, 9 aa, Homo Sapiens
ASALPRPAP

SEQ ID NO: 475064 - protein, 9 aa, Homo Sapiens
KTRLEQEIT

SEQ ID NO: 475065 - protein, 9 aa, Homo Sapiens
LPRELRGRG

SEQ ID NO: 475066 - protein, 9 aa, Homo Sapiens
QFVDVYGVD

SEQ ID NO: 475067 - protein, 9 aa, Homo Sapiens
HHPLQHQLS

SEQ ID NO: 475068 - protein, 9 aa, Homo Sapiens
EGWLHKRGK

SEQ ID NO: 475069 - protein, 9 aa, Homo Sapiens
LRNQVITPL

SEQ ID NO: 475070 - protein, 9 aa, Homo Sapiens
LQILKELFP

SEQ ID NO: 475071 - protein, 9 aa, Homo Sapiens
PQLHKDEPA

SEQ ID NO: 475072 - protein, 9 aa, Homo Sapiens
DGMNSSKTK

SEQ ID NO: 475073 - protein, 9 aa, Homo Sapiens
VDVYGVDPE

SEQ ID NO: 475074 - protein, 9 aa, Homo Sapiens
AMAQKTGDN

SEQ ID NO: 475075 - protein, 9 aa, Homo Sapiens
GYSKARLSS

SEQ ID NO: 475076 - protein, 9 aa, Homo Sapiens
TQYVCQFPD

SEQ ID NO: 475077 - protein, 9 aa, Homo Sapiens
DCADGKCSH

SEQ ID NO: 475078 - protein, 9 aa, Homo Sapiens
LNLGYSKAR

SEQ ID NO: 475079 - protein, 9 aa, Homo Sapiens
HNLYWISSE

SEQ ID NO: 475080 - protein, 9 aa, Homo Sapiens
WVSHNLYWI

SEQ ID NO: 475081 - protein, 9 aa, Homo Sapiens
SLLCLLSLV

SEQ ID NO: 475082 - protein, 9 aa, Homo Sapiens
KIDMASLGD

SEQ ID NO: 475083 - protein, 9 aa, Homo Sapiens
MNQLIYGTV

SEQ ID NO: 475084 - protein, 9 aa, Homo Sapiens
GSLGFSLNS

SEQ ID NO: 475085 - protein, 9 aa, Homo Sapiens
VLHDCADGK

SEQ ID NO: 475086 - protein, 9 aa, Homo Sapiens
GHIMNQLIY

SEQ ID NO: 475087 - protein, 9 aa, Homo Sapiens
TQIHTPMYL

SEQ ID NO: 475088 - protein, 9 aa, Homo Sapiens
NQTSVTLLW

SEQ ID NO: 475089 - protein, 9 aa, Homo Sapiens
ARDRQDRHP

SEQ ID NO: 475090 - protein, 9 aa, Homo Sapiens
HIMNQLIYG

SEQ ID NO: 475091 - protein, 9 aa, Homo Sapiens
WMDPSWAAP

SEQ ID NO: 475092 - protein, 9 aa, Homo Sapiens
QLIYGTVLV

SEQ ID NO: 475093 - protein, 9 aa, Homo Sapiens
LSLLCLLSL

SEQ ID NO: 475094 - protein, 9 aa, Homo Sapiens
AYIPQDQLV

SEQ ID NO: 475095 - protein, 9 aa, Homo Sapiens
RETQRTVRD

SEQ ID NO: 475096 - protein, 9 aa, Homo Sapiens
LRGRGDLLF

SEQ ID NO: 475097 - protein, 9 aa, Homo Sapiens
HFGTQYVCQ

SEQ ID NO: 475098 - protein, 9 aa, Homo Sapiens
WFTGSLGFS

SEQ ID NO: 475099 - protein, 9 aa, Homo Sapiens
SALPRPAPG

SEQ ID NO: 475100 - protein, 9 aa, Homo Sapiens
VDWVSHNLY

SEQ ID NO: 475101 - protein, 9 aa, Homo Sapiens
LIYGTVLVE

SEQ ID NO: 475102 - protein, 9 aa, Homo Sapiens
AAYIPQDQL

SEQ ID NO: 475103 - protein, 9 aa, Homo Sapiens
GARGSEGRM

SEQ ID NO: 475104 - protein, 9 aa, Homo Sapiens
LWMDPSWAA

SEQ ID NO: 475105 - protein, 9 aa, Homo Sapiens
VITPLTEEL

SEQ ID NO: 475106 - protein, 9 aa, Homo Sapiens
LCERIDGMN

SEQ ID NO: 475107 - protein, 9 aa, Homo Sapiens
AAAAYIPQD

SEQ ID NO: 475108 - protein, 9 aa, Homo Sapiens
ERLVTKKAS

SEQ ID NO: 475109 - protein, 9 aa, Homo Sapiens
PHFGTQYVC

SEQ ID NO: 475110 - protein, 9 aa, Homo Sapiens
AVDWVSHNL

SEQ ID NO: 475111 - protein, 9 aa, Homo Sapiens
RGKYIKTWR

SEQ ID NO: 475112 - protein, 9 aa, Homo Sapiens
GLWMDPSWA

SEQ ID NO: 475113 - protein, 9 aa, Homo Sapiens
CLLSLVAFL

SEQ ID NO: 475114 - protein, 9 aa, Homo Sapiens
LAEERLVTK

SEQ ID NO: 475115 - protein, 9 aa, Homo Sapiens
LHKDEPAWK

SEQ ID NO: 475116 - protein, 9 aa, Homo Sapiens
TQRTVRDSD

SEQ ID NO: 475117 - protein, 9 aa, Homo Sapiens
QYVCQFPDQ

SEQ ID NO: 475118 - protein, 9 aa, Homo Sapiens
LCLLSLVAF

SEQ ID NO: 475119 - protein, 9 aa, Homo Sapiens
MAMAQKTGD

SEQ ID NO: 475120 - protein, 9 aa, Homo Sapiens
LHKRGKYIK

SEQ ID NO: 475121 - protein, 9 aa, Homo Sapiens
IIRYAIGVH

SEQ ID NO: 475122 - protein, 9 aa, Homo Sapiens
QDRHPEEGV

SEQ ID NO: 475123 - protein, 9 aa, Homo Sapiens
ELRGRGDLL

SEQ ID NO: 475124 - protein, 9 aa, Homo Sapiens
TSFASALPR

SEQ ID NO: 475125 - protein, 9 aa, Homo Sapiens
TPLTEELVF

SEQ ID NO: 475126 - protein, 9 aa, Homo Sapiens
NQVITPLTE

SEQ ID NO: 475127 - protein, 9 aa, Homo Sapiens
PRELRGRGD

SEQ ID NO: 475128 - protein, 9 aa, Homo Sapiens
NLMAMAQKT

SEQ ID NO: 475129 - protein, 9 aa, Homo Sapiens
IAQVQQGEG

SEQ ID NO: 475130 - protein, 9 aa, Homo Sapiens
LVTKKASVY

SEQ ID NO: 475131 - protein, 9 aa, Homo Sapiens
LHLNLGYSK

SEQ ID NO: 475132 - protein, 9 aa, Homo Sapiens
IYGTVLVES

SEQ ID NO: 475133 - protein, 9 aa, Homo Sapiens
HDCADGKCS

SEQ ID NO: 475134 - protein, 9 aa, Homo Sapiens
VTKKASVYC

SEQ ID NO: 475135 - protein, 9 aa, Homo Sapiens
LQHQLSADA

SEQ ID NO: 475136 - protein, 9 aa, Homo Sapiens
IDMASLGDS

SEQ ID NO: 475137 - protein, 9 aa, Homo Sapiens
LGFSLNSVN

SEQ ID NO: 475138 - protein, 9 aa, Homo Sapiens
IDGMNSSKT

SEQ ID NO: 475139 - protein, 9 aa, Homo Sapiens
LLCLLSLVA

SEQ ID NO: 475140 - protein, 9 aa, Homo Sapiens
VTGLWMDPS

SEQ ID NO: 475141 - protein, 9 aa, Homo Sapiens
SEDKRGVTL

SEQ ID NO: 475142 - protein, 9 aa, Homo Sapiens
HISLDTPDF

SEQ ID NO: 475143 - protein, 9 aa, Homo Sapiens
SLFAVNKNQ

SEQ ID NO: 475144 - protein, 9 aa, Homo Sapiens
LEQEITTYR

SEQ ID NO: 475145 - protein, 9 aa, Homo Sapiens
TRRYWMKET

SEQ ID NO: 475146 - protein, 9 aa, Homo Sapiens
RGSEGRMEP

SEQ ID NO: 475147 - protein, 9 aa, Homo Sapiens
AAAYIPQDQ

SEQ ID NO: 475148 - protein, 9 aa, Homo Sapiens
APGGIRETQ

SEQ ID NO: 475149 - protein, 9 aa, Homo Sapiens
KDAKLQILK

SEQ ID NO: 475150 - protein, 9 aa, Homo Sapiens
NKNQTSVTL

SEQ ID NO: 475151 - protein, 9 aa, Homo Sapiens
LAAAAAYIP

SEQ ID NO: 475152 - protein, 9 aa, Homo Sapiens
KLCERIDGM

SEQ ID NO: 475153 - protein, 9 aa, Homo Sapiens
YQGHSCRSD

SEQ ID NO: 475154 - protein, 9 aa, Homo Sapiens
YLDTQIHTP

SEQ ID NO: 475155 - protein, 9 aa, Homo Sapiens
RYWMKETDS

SEQ ID NO: 475156 - protein, 9 aa, Homo Sapiens
QVITPLTEE

SEQ ID NO: 475157 - protein, 9 aa, Homo Sapiens
WRLPRELRG

SEQ ID NO: 475158 - protein, 9 aa, Homo Sapiens
PLQHQLSAD

SEQ ID NO: 475159 - protein, 9 aa, Homo Sapiens
DMASLGDST

SEQ ID NO: 475160 - protein, 9 aa, Homo Sapiens
QQQIAQVQQ

SEQ ID NO: 475161 - protein, 9 aa, Homo Sapiens
HWRLPRELR

SEQ ID NO: 475162 - protein, 9 aa, Homo Sapiens
ARGSEGRME

SEQ ID NO: 475163 - protein, 9 aa, Homo Sapiens
MKETDSEYV

SEQ ID NO: 475164 - protein, 9 aa, Homo Sapiens
ALHLNLGYS

SEQ ID NO: 475165 - protein, 9 aa, Homo Sapiens
QLHKDEPAW

SEQ ID NO: 475166 - protein, 9 aa, Homo Sapiens
AAAAAYIPQ

SEQ ID NO: 475167 - protein, 9 aa, Homo Sapiens
RWLRNQVIT

SEQ ID NO: 475168 - protein, 9 aa, Homo Sapiens
VDPELLSMV

SEQ ID NO: 475169 - protein, 9 aa, Homo Sapiens
YLSLLCLLS

SEQ ID NO: 475170 - protein, 9 aa, Homo Sapiens
HKDEPAWKP

SEQ ID NO: 475171 - protein, 9 aa, Homo Sapiens
YIPQDQLVV

SEQ ID NO: 475172 - protein, 9 aa, Homo Sapiens
KRGVTLDPS

SEQ ID NO: 475173 - protein, 9 aa, Homo Sapiens
KDEPAWKPV

SEQ ID NO: 475174 - protein, 9 aa, Homo Sapiens
RGRGDLLFN

SEQ ID NO: 475175 - protein, 9 aa, Homo Sapiens
CADGKCSHL

SEQ ID NO: 475176 - protein, 9 aa, Homo Sapiens
QQIAQVQQG

SEQ ID NO: 475177 - protein, 9 aa, Homo Sapiens
GVDPELLSM

SEQ ID NO: 475178 - protein, 9 aa, Homo Sapiens
LGYSKARLS

SEQ ID NO: 475179 - protein, 9 aa, Homo Sapiens
GVTLDPSRE

SEQ ID NO: 475180 - protein, 9 aa, Homo Sapiens
GTRRYWMKE

SEQ ID NO: 475181 - protein, 9 aa, Homo Sapiens
SMPHFGTQY

SEQ ID NO: 475182 - protein, 9 aa, Homo Sapiens
YSKARLSSS

SEQ ID NO: 475183 - protein, 9 aa, Homo Sapiens
AQKTGDNLY

SEQ ID NO: 475184 - protein, 9 aa, Homo Sapiens
AVNKNQTSV

SEQ ID NO: 475185 - protein, 9 aa, Homo Sapiens
SCQVTGLWM

SEQ ID NO: 475186 - protein, 9 aa, Homo Sapiens
KSLFAVNKN

SEQ ID NO: 475187 - protein, 9 aa, Homo Sapiens
SCPPGYQGH

SEQ ID NO: 475188 - protein, 9 aa, Homo Sapiens
DTQIHTPMY

SEQ ID NO: 475189 - protein, 9 aa, Homo Sapiens
FLKIDMASL

SEQ ID NO: 475190 - protein, 9 aa, Homo Sapiens
ILKELFPQR

SEQ ID NO: 475191 - protein, 9 aa, Homo Sapiens
SHHPLQHQL

SEQ ID NO: 475192 - protein, 9 aa, Homo Sapiens
RYAIGVHLF

SEQ ID NO: 475193 - protein, 9 aa, Homo Sapiens
KQVVTFVYQ

SEQ ID NO: 475194 - protein, 9 aa, Homo Sapiens
RELRGRGDL

SEQ ID NO: 475195 - protein, 9 aa, Homo Sapiens
LMAMAQKTG

SEQ ID NO: 475196 - protein, 9 aa, Homo Sapiens
GGIRETQRT

SEQ ID NO: 475197 - protein, 9 aa, Homo Sapiens
QEEDEEEES

SEQ ID NO: 475198 - protein, 9 aa, Homo Sapiens
QVQQGEGGL

SEQ ID NO: 475199 - protein, 9 aa, Homo Sapiens
GKYIKTWRP

SEQ ID NO: 475200 - protein, 9 aa, Homo Sapiens
YWMKETDSE

SEQ ID NO: 475201 - protein, 9 aa, Homo Sapiens
VSHNLYWIS

SEQ ID NO: 475202 - protein, 9 aa, Homo Sapiens
DLRHISLDT

SEQ ID NO: 475203 - protein, 9 aa, Homo Sapiens
IGVHLFFTP

SEQ ID NO: 475204 - protein, 9 aa, Homo Sapiens
GWLHKRGKY

SEQ ID NO: 475205 - protein, 9 aa, Homo Sapiens
RRYWMKETD

SEQ ID NO: 475206 - protein, 9 aa, Homo Sapiens
FGTQYVCQF

SEQ ID NO: 475207 - protein, 9 aa, Homo Sapiens
RLEQEITTY

SEQ ID NO: 475208 - protein, 9 aa, Homo Sapiens
GFSLNSVNL

SEQ ID NO: 475209 - protein, 9 aa, Homo Sapiens
KNPQLHKDE

SEQ ID NO: 475210 - protein, 9 aa, Homo Sapiens
SKNPQLHKD

SEQ ID NO: 475211 - protein, 9 aa, Homo Sapiens
ALPRPAPGL

SEQ ID NO: 475212 - protein, 9 aa, Homo Sapiens
LHKLCERID

SEQ ID NO: 475213 - protein, 9 aa, Homo Sapiens
LSLVAFLLF

SEQ ID NO: 475214 - protein, 9 aa, Homo Sapiens
YGTVLVESF

SEQ ID NO: 475215 - protein, 9 aa, Homo Sapiens
KTGDNLYWG

SEQ ID NO: 475216 - protein, 9 aa, Homo Sapiens
TTSFASALP

SEQ ID NO: 475217 - protein, 9 aa, Homo Sapiens
WLRNQVITP

SEQ ID NO: 475218 - protein, 9 aa, Homo Sapiens
DEEEESFGT

SEQ ID NO: 475219 - protein, 9 aa, Homo Sapiens
LPGTRRYWM

SEQ ID NO: 475220 - protein, 9 aa, Homo Sapiens
IHTPMYLLL

SEQ ID NO: 475221 - protein, 9 aa, Homo Sapiens
YAIGVHLFF

SEQ ID NO: 475222 - protein, 9 aa, Homo Sapiens
ITPLTEELV

SEQ ID NO: 475223 - protein, 9 aa, Homo Sapiens
LARVLHDCA

SEQ ID NO: 475224 - protein, 9 aa, Homo Sapiens
VQQGEGGLP

SEQ ID NO: 475225 - protein, 9 aa, Homo Sapiens
RLVTKKASV

SEQ ID NO: 475226 - protein, 9 aa, Homo Sapiens
QILKELFPQ

SEQ ID NO: 475227 - protein, 9 aa, Homo Sapiens
DLKDAKLQI

SEQ ID NO: 475228 - protein, 9 aa, Homo Sapiens
GRMEPKAEP

SEQ ID NO: 475229 - protein, 9 aa, Homo Sapiens
LDTQIHTPM

SEQ ID NO: 475230 - protein, 9 aa, Homo Sapiens
FAVNKNQTS

SEQ ID NO: 475231 - protein, 9 aa, Homo Sapiens
IRETQRTVR

SEQ ID NO: 475232 - protein, 9 aa, Homo Sapiens
HPLQHQLSA

SEQ ID NO: 475233 - protein, 9 aa, Homo Sapiens
QKTGDNLYW

SEQ ID NO: 475234 - protein, 9 aa, Homo Sapiens
HKRGKYIKT

SEQ ID NO: 475235 - protein, 9 aa, Homo Sapiens
CQVTGLWMD

SEQ ID NO: 475236 - protein, 9 aa, Homo Sapiens
VSEDKRGVT

SEQ ID NO: 475237 - protein, 9 aa, Homo Sapiens
ESSHHPLQH

SEQ ID NO: 475238 - protein, 9 aa, Homo Sapiens
FASALPRPA

SEQ ID NO: 475239 - protein, 9 aa, Homo Sapiens
LLIYLDTQI

SEQ ID NO: 475240 - protein, 9 aa, Homo Sapiens
TKKASVYCV

SEQ ID NO: 475241 - protein, 9 aa, Homo Sapiens
DAKLQILKE

SEQ ID NO: 475242 - protein, 9 aa, Homo Sapiens
QIHTPMYLL

SEQ ID NO: 475243 - protein, 9 aa, Homo Sapiens
KKASVYCVA

SEQ ID NO: 475244 - protein, 9 aa, Homo Sapiens
AKLQILKEL

SEQ ID NO: 475245 - protein, 9 aa, Homo Sapiens
ERIDGMNSS

SEQ ID NO: 475246 - protein, 9 aa, Homo Sapiens
TGLWMDPSW

SEQ ID NO: 475247 - protein, 9 aa, Homo Sapiens
TTYRSLLEG

SEQ ID NO: 475248 - protein, 9 aa, Homo Sapiens
CPPGYQGHS

SEQ ID NO: 475249 - protein, 9 aa, Homo Sapiens
RQDRHPEEG

SEQ ID NO: 475250 - protein, 9 aa, Homo Sapiens
ETQRTVRDS

SEQ ID NO: 475251 - protein, 9 aa, Homo Sapiens
LFAVNKNQT

SEQ ID NO: 475252 - protein, 9 aa, Homo Sapiens
RGVTLDPSR

SEQ ID NO: 475253 - protein, 9 aa, Homo Sapiens
QGHSCRSDV

SEQ ID NO: 475254 - protein, 9 aa, Homo Sapiens
LSARDRQDR

SEQ ID NO: 475255 - protein, 9 aa, Homo Sapiens
SARDRQDRH

SEQ ID NO: 475256 - protein, 9 aa, Homo Sapiens
VHLFFTPAP

SEQ ID NO: 475257 - protein, 9 aa, Homo Sapiens
EDEEEESFG

SEQ ID NO: 475258 - protein, 9 aa, Homo Sapiens
SHNLYWISS

SEQ ID NO: 475259 - protein, 9 aa, Homo Sapiens
QEITTYRSL

SEQ ID NO: 475260 - protein, 9 aa, Homo Sapiens
STTSFASAL

SEQ ID NO: 475261 - protein, 9 aa, Homo Sapiens
AEERLVTKK

SEQ ID NO: 475262 - protein, 9 aa, Homo Sapiens
QWSKQVVTF

SEQ ID NO: 475263 - protein, 9 aa, Homo Sapiens
DWVSHNLYW

SEQ ID NO: 475264 - protein, 9 aa, Homo Sapiens
SLGFSLNSV

SEQ ID NO: 475265 - protein, 9 aa, Homo Sapiens
NPQLHKDEP

SEQ ID NO: 475266 - protein, 9 aa, Homo Sapiens
HLFFTPAPG

SEQ ID NO: 475267 - protein, 9 aa, Homo Sapiens
GIRETQRTV

SEQ ID NO: 475268 - protein, 9 aa, Homo Sapiens
EQEITTYRS

SEQ ID NO: 475269 - protein, 9 aa, Homo Sapiens
EKRCQRRLQ

SEQ ID NO: 475270 - protein, 9 aa, Homo Sapiens
LYLAFAVTQ

SEQ ID NO: 475271 - protein, 9 aa, Homo Sapiens
IFSQYLEKE

SEQ ID NO: 475272 - protein, 9 aa, Homo Sapiens
LQGLGRGPP

SEQ ID NO: 475273 - protein, 9 aa, Homo Sapiens
YPLCQFQYM

SEQ ID NO: 475274 - protein, 9 aa, Homo Sapiens
PGVGHVARP

SEQ ID NO: 475275 - protein, 9 aa, Homo Sapiens
TKDNKDSPY

SEQ ID NO: 475276 - protein, 9 aa, Homo Sapiens
HLLEKTTVR

SEQ ID NO: 475277 - protein, 9 aa, Homo Sapiens
KYNCTVVEY

SEQ ID NO: 475278 - protein, 9 aa, Homo Sapiens
QLAQTQQHL

SEQ ID NO: 475279 - protein, 9 aa, Homo Sapiens
GHVARPGPT

SEQ ID NO: 475280 - protein, 9 aa, Homo Sapiens
FAVKLMDFQ

SEQ ID NO: 475281 - protein, 9 aa, Homo Sapiens
QPLQKGVRT

SEQ ID NO: 475282 - protein, 9 aa, Homo Sapiens
PLKLVRNAM

SEQ ID NO: 475283 - protein, 9 aa, Homo Sapiens
AQFQKRLEK

SEQ ID NO: 475284 - protein, 9 aa, Homo Sapiens
FPSPLSVGK

SEQ ID NO: 475285 - protein, 9 aa, Homo Sapiens
YSLIKDTIQ

SEQ ID NO: 475286 - protein, 9 aa, Homo Sapiens
TLVNSGVPE

SEQ ID NO: 475287 - protein, 9 aa, Homo Sapiens
QNNIMRTII

SEQ ID NO: 475288 - protein, 9 aa, Homo Sapiens
CSHRMCRED

SEQ ID NO: 475289 - protein, 9 aa, Homo Sapiens
AFRRDFHMV

SEQ ID NO: 475290 - protein, 9 aa, Homo Sapiens
QETPVVLQL

SEQ ID NO: 475291 - protein, 9 aa, Homo Sapiens
GALLSSGHK

SEQ ID NO: 475292 - protein, 9 aa, Homo Sapiens
GARQAKLTV

SEQ ID NO: 475293 - protein, 9 aa, Homo Sapiens
EVVFIKMCR

SEQ ID NO: 475294 - protein, 9 aa, Homo Sapiens
DPVHPGGSF

SEQ ID NO: 475295 - protein, 9 aa, Homo Sapiens
LLPPFASGV

SEQ ID NO: 475296 - protein, 9 aa, Homo Sapiens
TEEVTNLLL

SEQ ID NO: 475297 - protein, 9 aa, Homo Sapiens
PVYHCVHYF

SEQ ID NO: 475298 - protein, 9 aa, Homo Sapiens
RTGYYDLLI

SEQ ID NO: 475299 - protein, 9 aa, Homo Sapiens
HPLLSMPAM

SEQ ID NO: 475300 - protein, 9 aa, Homo Sapiens
NSAHQLGFE

SEQ ID NO: 475301 - protein, 9 aa, Homo Sapiens
ATAPGAEPG

SEQ ID NO: 475302 - protein, 9 aa, Homo Sapiens
AWAGQKGYH

SEQ ID NO: 475303 - protein, 9 aa, Homo Sapiens
QFEGLITQA

SEQ ID NO: 475304 - protein, 9 aa, Homo Sapiens
YTHEAGTGQ

SEQ ID NO: 475305 - protein, 9 aa, Homo Sapiens
IQGLLVTSS

SEQ ID NO: 475306 - protein, 9 aa, Homo Sapiens
DLSYNQLQN

SEQ ID NO: 475307 - protein, 9 aa, Homo Sapiens
GRGTYVRRN

SEQ ID NO: 475308 - protein, 9 aa, Homo Sapiens
PLKDKGLGT

SEQ ID NO: 475309 - protein, 9 aa, Homo Sapiens
VLLDRLPPG

SEQ ID NO: 475310 - protein, 9 aa, Homo Sapiens
VGFAGGYTL

SEQ ID NO: 475311 - protein, 9 aa, Homo Sapiens
VCISLSICH

SEQ ID NO: 475312 - protein, 9 aa, Homo Sapiens
GYFHPHFVR

SEQ ID NO: 475313 - protein, 9 aa, Homo Sapiens
IKDGGLFPS

SEQ ID NO: 475314 - protein, 9 aa, Homo Sapiens
IRGGTGRTG

SEQ ID NO: 475315 - protein, 9 aa, Homo Sapiens
VFIKMCRAF

SEQ ID NO: 475316 - protein, 9 aa, Homo Sapiens
CHTLWCSLG

SEQ ID NO: 475317 - protein, 9 aa, Homo Sapiens
GVLQKESGA

SEQ ID NO: 475318 - protein, 9 aa, Homo Sapiens
SLLQDSPLV

SEQ ID NO: 475319 - protein, 9 aa, Homo Sapiens
ILQPKGYQL

SEQ ID NO: 475320 - protein, 9 aa, Homo Sapiens
DIIKGKSIH

SEQ ID NO: 475321 - protein, 9 aa, Homo Sapiens
CQEADRKEL

SEQ ID NO: 475322 - protein, 9 aa, Homo Sapiens
PEHVFTCSE

SEQ ID NO: 475323 - protein, 9 aa, Homo Sapiens
LQKMKAGGN

SEQ ID NO: 475324 - protein, 9 aa, Homo Sapiens
AMPDIMVKI

SEQ ID NO: 475325 - protein, 9 aa, Homo Sapiens
RDWPGFYPH

SEQ ID NO: 475326 - protein, 9 aa, Homo Sapiens
ACEEQILRY

SEQ ID NO: 475327 - protein, 9 aa, Homo Sapiens
IACRSFPRS

SEQ ID NO: 475328 - protein, 9 aa, Homo Sapiens
NSDVPPSNT

SEQ ID NO: 475329 - protein, 9 aa, Homo Sapiens
DHPKSTGKP

SEQ ID NO: 475330 - protein, 9 aa, Homo Sapiens
AGYFHPHFV

SEQ ID NO: 475331 - protein, 9 aa, Homo Sapiens
LSAAHTKQI

SEQ ID NO: 475332 - protein, 9 aa, Homo Sapiens
RDFHMVTNE

SEQ ID NO: 475333 - protein, 9 aa, Homo Sapiens
LGARQAKLT

SEQ ID NO: 475334 - protein, 9 aa, Homo Sapiens
EKGQLLGLK

SEQ ID NO: 475335 - protein, 9 aa, Homo Sapiens
VNVTDVNNN

SEQ ID NO: 475336 - protein, 9 aa, Homo Sapiens
LGKVTIAHG

SEQ ID NO: 475337 - protein, 9 aa, Homo Sapiens
ICCLVDGEI

SEQ ID NO: 475338 - protein, 9 aa, Homo Sapiens
RGEGNPSGI

SEQ ID NO: 475339 - protein, 9 aa, Homo Sapiens
KSLERLFRN

SEQ ID NO: 475340 - protein, 9 aa, Homo Sapiens
KDSPYPKHS

SEQ ID NO: 475341 - protein, 9 aa, Homo Sapiens
LRAARGAAA

SEQ ID NO: 475342 - protein, 9 aa, Homo Sapiens
GKEQYYAAT

SEQ ID NO: 475343 - protein, 9 aa, Homo Sapiens
GKVTIAHGG

SEQ ID NO: 475344 - protein, 9 aa, Homo Sapiens
LLQATRNAG

SEQ ID NO: 475345 - protein, 9 aa, Homo Sapiens
GKHPKKLGG

SEQ ID NO: 475346 - protein, 9 aa, Homo Sapiens
GLFPSPLSV

SEQ ID NO: 475347 - protein, 9 aa, Homo Sapiens
LMNTSKAQG

SEQ ID NO: 475348 - protein, 9 aa, Homo Sapiens
VRQPDQIQE

SEQ ID NO: 475349 - protein, 9 aa, Homo Sapiens
VGMGYPVKK

SEQ ID NO: 475350 - protein, 9 aa, Homo Sapiens
PPPESHHNG

SEQ ID NO: 475351 - protein, 9 aa, Homo Sapiens
PETSLLWTD

SEQ ID NO: 475352 - protein, 9 aa, Homo Sapiens
TGNLTYSVC

SEQ ID NO: 475353 - protein, 9 aa, Homo Sapiens
PWNLKTHHM

SEQ ID NO: 475354 - protein, 9 aa, Homo Sapiens
RIKLESKRS

SEQ ID NO: 475355 - protein, 9 aa, Homo Sapiens
DLGYVPAIE

SEQ ID NO: 475356 - protein, 9 aa, Homo Sapiens
RSSLSPTIR

SEQ ID NO: 475357 - protein, 9 aa, Homo Sapiens
SPPLLSLVA

SEQ ID NO: 475358 - protein, 9 aa, Homo Sapiens
LKILLHEMG

SEQ ID NO: 475359 - protein, 9 aa, Homo Sapiens
MLRVRSLEK

SEQ ID NO: 475360 - protein, 9 aa, Homo Sapiens
DNKDSPYPK

SEQ ID NO: 475361 - protein, 9 aa, Homo Sapiens
HIRSKNSLQ

SEQ ID NO: 475362 - protein, 9 aa, Homo Sapiens
RIIQVNGRD

SEQ ID NO: 475363 - protein, 9 aa, Homo Sapiens
MYGLRNLEQ

SEQ ID NO: 475364 - protein, 9 aa, Homo Sapiens
TLWCSLGTT

SEQ ID NO: 475365 - protein, 9 aa, Homo Sapiens
RAPQPSQLG

SEQ ID NO: 475366 - protein, 9 aa, Homo Sapiens
LLCRDWPGF

SEQ ID NO: 475367 - protein, 9 aa, Homo Sapiens
HIIIAGLFA

SEQ ID NO: 475368 - protein, 9 aa, Homo Sapiens
GRDNLALFC

SEQ ID NO: 475369 - protein, 9 aa, Homo Sapiens
QASQTQQEL

SEQ ID NO: 475370 - protein, 9 aa, Homo Sapiens
SQETPVVLQ

SEQ ID NO: 475371 - protein, 9 aa, Homo Sapiens
RPEANSVES

SEQ ID NO: 475372 - protein, 9 aa, Homo Sapiens
DAFKDDDSG

SEQ ID NO: 475373 - protein, 9 aa, Homo Sapiens
SQLGAESPS

SEQ ID NO: 475374 - protein, 9 aa, Homo Sapiens
KCEATGNPQ

SEQ ID NO: 475375 - protein, 9 aa, Homo Sapiens
VVFALMADK

SEQ ID NO: 475376 - protein, 9 aa, Homo Sapiens
SEYCCCVSS

SEQ ID NO: 475377 - protein, 9 aa, Homo Sapiens
GGENEVIPK

SEQ ID NO: 475378 - protein, 9 aa, Homo Sapiens
ITLIKMDSQ

SEQ ID NO: 475379 - protein, 9 aa, Homo Sapiens
PFQCKLCHQ

SEQ ID NO: 475380 - protein, 9 aa, Homo Sapiens
KVSSIRVDT

SEQ ID NO: 475381 - protein, 9 aa, Homo Sapiens
SKAGEGPFS

SEQ ID NO: 475382 - protein, 9 aa, Homo Sapiens
AKGPVNYCQ

SEQ ID NO: 475383 - protein, 9 aa, Homo Sapiens
KPFQCKLCH

SEQ ID NO: 475384 - protein, 9 aa, Homo Sapiens
LENFQLVQG

SEQ ID NO: 475385 - protein, 9 aa, Homo Sapiens
IQQLKQLGH

SEQ ID NO: 475386 - protein, 9 aa, Homo Sapiens
SPLPLRARW

SEQ ID NO: 475387 - protein, 9 aa, Homo Sapiens
VREALRQAF

SEQ ID NO: 475388 - protein, 9 aa, Homo Sapiens
RDNLALFCL

SEQ ID NO: 475389 - protein, 9 aa, Homo Sapiens
KDIEMAQKK

SEQ ID NO: 475390 - protein, 9 aa, Homo Sapiens
EGQQGSEEA

SEQ ID NO: 475391 - protein, 9 aa, Homo Sapiens
VNNNVPSID

SEQ ID NO: 475392 - protein, 9 aa, Homo Sapiens
TQEEEEMET

SEQ ID NO: 475393 - protein, 9 aa, Homo Sapiens
PQAAPILGP

SEQ ID NO: 475394 - protein, 9 aa, Homo Sapiens
EKQKLDAQF

SEQ ID NO: 475395 - protein, 9 aa, Homo Sapiens
FCGFCFVTP

SEQ ID NO: 475396 - protein, 9 aa, Homo Sapiens
AERHNEGQG

SEQ ID NO: 475397 - protein, 9 aa, Homo Sapiens
YISCSSSAS

SEQ ID NO: 475398 - protein, 9 aa, Homo Sapiens
PVCRPGWSH

SEQ ID NO: 475399 - protein, 9 aa, Homo Sapiens
PHPHHHSHH

SEQ ID NO: 475400 - protein, 9 aa, Homo Sapiens
KGLSTLVNS

SEQ ID NO: 475401 - protein, 9 aa, Homo Sapiens
NALGARQAK

SEQ ID NO: 475402 - protein, 9 aa, Homo Sapiens
ALQGLGRGP

SEQ ID NO: 475403 - protein, 9 aa, Homo Sapiens
QEFSKEEQD

SEQ ID NO: 475404 - protein, 9 aa, Homo Sapiens
HQQIHTEQK

SEQ ID NO: 475405 - protein, 9 aa, Homo Sapiens
TDLYNASGA

SEQ ID NO: 475406 - protein, 9 aa, Homo Sapiens
PNMICNFVH

SEQ ID NO: 475407 - protein, 9 aa, Homo Sapiens
QLQDDAVYE

SEQ ID NO: 475408 - protein, 9 aa, Homo Sapiens
RECPFSSWR

SEQ ID NO: 475409 - protein, 9 aa, Homo Sapiens
LGSVILIFY

SEQ ID NO: 475410 - protein, 9 aa, Homo Sapiens
QLAQASQTQ

SEQ ID NO: 475411 - protein, 9 aa, Homo Sapiens
TWRKNHDKD

SEQ ID NO: 475412 - protein, 9 aa, Homo Sapiens
SQGTPVCRP

SEQ ID NO: 475413 - protein, 9 aa, Homo Sapiens
SGDSNSYFG

SEQ ID NO: 475414 - protein, 9 aa, Homo Sapiens
RPNTTQEEE

SEQ ID NO: 475415 - protein, 9 aa, Homo Sapiens
KTTVRTEWT

SEQ ID NO: 475416 - protein, 9 aa, Homo Sapiens
LGELCYQVI

SEQ ID NO: 475417 - protein, 9 aa, Homo Sapiens
PGSPGDKGE

SEQ ID NO: 475418 - protein, 9 aa, Homo Sapiens
ENTDQKSLE

SEQ ID NO: 475419 - protein, 9 aa, Homo Sapiens
DKPTVDRFI

SEQ ID NO: 475420 - protein, 9 aa, Homo Sapiens
LEVVFIKMC

SEQ ID NO: 475421 - protein, 9 aa, Homo Sapiens
IQLTIDDID

SEQ ID NO: 475422 - protein, 9 aa, Homo Sapiens
QGESFWSIT

SEQ ID NO: 475423 - protein, 9 aa, Homo Sapiens
PLTVLLDRL

SEQ ID NO: 475424 - protein, 9 aa, Homo Sapiens
TNGLCIWLL

SEQ ID NO: 475425 - protein, 9 aa, Homo Sapiens
FCAQGQLYK

SEQ ID NO: 475426 - protein, 9 aa, Homo Sapiens
KALQVKGNT

SEQ ID NO: 475427 - protein, 9 aa, Homo Sapiens
HHTVLFSAT

SEQ ID NO: 475428 - protein, 9 aa, Homo Sapiens
HVNNGWAMC

SEQ ID NO: 475429 - protein, 9 aa, Homo Sapiens
ILSNKKQSA

SEQ ID NO: 475430 - protein, 9 aa, Homo Sapiens
DPLKLVRNA

SEQ ID NO: 475431 - protein, 9 aa, Homo Sapiens
SVQPSLLQD

SEQ ID NO: 475432 - protein, 9 aa, Homo Sapiens
HIVGIQSPN

SEQ ID NO: 475433 - protein, 9 aa, Homo Sapiens
LGPALEQSE

SEQ ID NO: 475434 - protein, 9 aa, Homo Sapiens
GHIQLICCL

SEQ ID NO: 475435 - protein, 9 aa, Homo Sapiens
QYMCSCLHS

SEQ ID NO: 475436 - protein, 9 aa, Homo Sapiens
TVFAPLQVF

SEQ ID NO: 475437 - protein, 9 aa, Homo Sapiens
LCIWLLILS

SEQ ID NO: 475438 - protein, 9 aa, Homo Sapiens
SIHSLFSQE

SEQ ID NO: 475439 - protein, 9 aa, Homo Sapiens
VTQCLILVV

SEQ ID NO: 475440 - protein, 9 aa, Homo Sapiens
PVHPGGSFT

SEQ ID NO: 475441 - protein, 9 aa, Homo Sapiens
RYPAAQYVD

SEQ ID NO: 475442 - protein, 9 aa, Homo Sapiens
TDVNNNVPS

SEQ ID NO: 475443 - protein, 9 aa, Homo Sapiens
APQKQCREH

SEQ ID NO: 475444 - protein, 9 aa, Homo Sapiens
EKKEEAKRL

SEQ ID NO: 475445 - protein, 9 aa, Homo Sapiens
TVMQGFNRC

SEQ ID NO: 475446 - protein, 9 aa, Homo Sapiens
LMADKRLLF

SEQ ID NO: 475447 - protein, 9 aa, Homo Sapiens
RGKKRSKAP

SEQ ID NO: 475448 - protein, 9 aa, Homo Sapiens
FEGFKSKES

SEQ ID NO: 475449 - protein, 9 aa, Homo Sapiens
EYCCCVSSS

SEQ ID NO: 475450 - protein, 9 aa, Homo Sapiens
TSTQLKELE

SEQ ID NO: 475451 - protein, 9 aa, Homo Sapiens
KHQKEAEEK

SEQ ID NO: 475452 - protein, 9 aa, Homo Sapiens
ISLHSGHEK

SEQ ID NO: 475453 - protein, 9 aa, Homo Sapiens
KTLLRQHEA

SEQ ID NO: 475454 - protein, 9 aa, Homo Sapiens
GRGPPGLAP

SEQ ID NO: 475455 - protein, 9 aa, Homo Sapiens
GETADVWAV

SEQ ID NO: 475456 - protein, 9 aa, Homo Sapiens
LGFSFVRIR

SEQ ID NO: 475457 - protein, 9 aa, Homo Sapiens
HDRIIQVNG

SEQ ID NO: 475458 - protein, 9 aa, Homo Sapiens
QPDQIQENS

SEQ ID NO: 475459 - protein, 9 aa, Homo Sapiens
QDIVSKLPR

SEQ ID NO: 475460 - protein, 9 aa, Homo Sapiens
VRYTPQVLE

SEQ ID NO: 475461 - protein, 9 aa, Homo Sapiens
RTNQGVIEF

SEQ ID NO: 475462 - protein, 9 aa, Homo Sapiens
GARSTTELR

SEQ ID NO: 475463 - protein, 9 aa, Homo Sapiens
ANINAFHKK

SEQ ID NO: 475464 - protein, 9 aa, Homo Sapiens
PDINSSDKG

SEQ ID NO: 475465 - protein, 9 aa, Homo Sapiens
EDDEEYAGS

SEQ ID NO: 475466 - protein, 9 aa, Homo Sapiens
ASNSAHQLG

SEQ ID NO: 475467 - protein, 9 aa, Homo Sapiens
DLTMASFLH

SEQ ID NO: 475468 - protein, 9 aa, Homo Sapiens
GENEVIPKV

SEQ ID NO: 475469 - protein, 9 aa, Homo Sapiens
CLVHLYNFH

SEQ ID NO: 475470 - protein, 9 aa, Homo Sapiens
AFPVGSNLT

SEQ ID NO: 475471 - protein, 9 aa, Homo Sapiens
LPLRARWCL

SEQ ID NO: 475472 - protein, 9 aa, Homo Sapiens
RAKEVTLMN

SEQ ID NO: 475473 - protein, 9 aa, Homo Sapiens
IETILSNKK

SEQ ID NO: 475474 - protein, 9 aa, Homo Sapiens
GSSYCSRKD

SEQ ID NO: 475475 - protein, 9 aa, Homo Sapiens
GAKYIQNLQ

SEQ ID NO: 475476 - protein, 9 aa, Homo Sapiens
SLEKLDQGR

SEQ ID NO: 475477 - protein, 9 aa, Homo Sapiens
SPSLFCGFC

SEQ ID NO: 475478 - protein, 9 aa, Homo Sapiens
LLDRLPPGT

SEQ ID NO: 475479 - protein, 9 aa, Homo Sapiens
RHGKRVDQI

SEQ ID NO: 475480 - protein, 9 aa, Homo Sapiens
PQVLEEMEA

SEQ ID NO: 475481 - protein, 9 aa, Homo Sapiens
RFQTTSGKV

SEQ ID NO: 475482 - protein, 9 aa, Homo Sapiens
LYLWKALAN

SEQ ID NO: 475483 - protein, 9 aa, Homo Sapiens
VAFYNLSDS

SEQ ID NO: 475484 - protein, 9 aa, Homo Sapiens
NTSQVSVEL

SEQ ID NO: 475485 - protein, 9 aa, Homo Sapiens
DPQQDYGDE

SEQ ID NO: 475486 - protein, 9 aa, Homo Sapiens
PLCQFQYMC

SEQ ID NO: 475487 - protein, 9 aa, Homo Sapiens
EIVALGGNP

SEQ ID NO: 475488 - protein, 9 aa, Homo Sapiens
CTSPMQRSP

SEQ ID NO: 475489 - protein, 9 aa, Homo Sapiens
STTLLCRDW

SEQ ID NO: 475490 - protein, 9 aa, Homo Sapiens
NEATTLGIL

SEQ ID NO: 475491 - protein, 9 aa, Homo Sapiens
LEKRCQRRL

SEQ ID NO: 475492 - protein, 9 aa, Homo Sapiens
MVTVVLGAK

SEQ ID NO: 475493 - protein, 9 aa, Homo Sapiens
HDPVHPGGS

SEQ ID NO: 475494 - protein, 9 aa, Homo Sapiens
NAGRRLARM

SEQ ID NO: 475495 - protein, 9 aa, Homo Sapiens
TIRPGTGAE

SEQ ID NO: 475496 - protein, 9 aa, Homo Sapiens
QPLFVSGAD

SEQ ID NO: 475497 - protein, 9 aa, Homo Sapiens
KALGSFLIH

SEQ ID NO: 475498 - protein, 9 aa, Homo Sapiens
CSPGTALTP

SEQ ID NO: 475499 - protein, 9 aa, Homo Sapiens
LSTKNADEY

SEQ ID NO: 475500 - protein, 9 aa, Homo Sapiens
TKQEKDFLW

SEQ ID NO: 475501 - protein, 9 aa, Homo Sapiens
HKKDRRAIH

SEQ ID NO: 475502 - protein, 9 aa, Homo Sapiens
ANSDVPPSN

SEQ ID NO: 475503 - protein, 9 aa, Homo Sapiens
PVLIGSTSA

SEQ ID NO: 475504 - protein, 9 aa, Homo Sapiens
VQPSLLQDS

SEQ ID NO: 475505 - protein, 9 aa, Homo Sapiens
IVKVSSIRV

SEQ ID NO: 475506 - protein, 9 aa, Homo Sapiens
VPLPVGMGY

SEQ ID NO: 475507 - protein, 9 aa, Homo Sapiens
CVSDESEGT

SEQ ID NO: 475508 - protein, 9 aa, Homo Sapiens
NVCISLSIC

SEQ ID NO: 475509 - protein, 9 aa, Homo Sapiens
QCAIKSLSC

SEQ ID NO: 475510 - protein, 9 aa, Homo Sapiens
VRHGKRVDQ

SEQ ID NO: 475511 - protein, 9 aa, Homo Sapiens
AKISSLQRA

SEQ ID NO: 475512 - protein, 9 aa, Homo Sapiens
GALATHIRQ

SEQ ID NO: 475513 - protein, 9 aa, Homo Sapiens
AERPAPRTC

SEQ ID NO: 475514 - protein, 9 aa, Homo Sapiens
EKCGKQFSE

SEQ ID NO: 475515 - protein, 9 aa, Homo Sapiens
SLMELSLAH

SEQ ID NO: 475516 - protein, 9 aa, Homo Sapiens
SPSPGRQPN

SEQ ID NO: 475517 - protein, 9 aa, Homo Sapiens
VTVVLGAKQ

SEQ ID NO: 475518 - protein, 9 aa, Homo Sapiens
SIPTYCKYC

SEQ ID NO: 475519 - protein, 9 aa, Homo Sapiens
VEEIRTQLE

SEQ ID NO: 475520 - protein, 9 aa, Homo Sapiens
RLSEGKAKE

SEQ ID NO: 475521 - protein, 9 aa, Homo Sapiens
SSGDLLPPF

SEQ ID NO: 475522 - protein, 9 aa, Homo Sapiens
HGTLVLDPT

SEQ ID NO: 475523 - protein, 9 aa, Homo Sapiens
KQKDIEMAQ

SEQ ID NO: 475524 - protein, 9 aa, Homo Sapiens
LPASHPLFG

SEQ ID NO: 475525 - protein, 9 aa, Homo Sapiens
EEPQAAPIL

SEQ ID NO: 475526 - protein, 9 aa, Homo Sapiens
YIHGLYLNG

SEQ ID NO: 475527 - protein, 9 aa, Homo Sapiens
TFEELRDKL

SEQ ID NO: 475528 - protein, 9 aa, Homo Sapiens
QGARSTTEL

SEQ ID NO: 475529 - protein, 9 aa, Homo Sapiens
VPEESALSE

SEQ ID NO: 475530 - protein, 9 aa, Homo Sapiens
NSEFYNKGM

SEQ ID NO: 475531 - protein, 9 aa, Homo Sapiens
TATNRRHRR

SEQ ID NO: 475532 - protein, 9 aa, Homo Sapiens
QVEEIRTQL

SEQ ID NO: 475533 - protein, 9 aa, Homo Sapiens
EKTTVRTEW

SEQ ID NO: 475534 - protein, 9 aa, Homo Sapiens
LWTHLEKGQ

SEQ ID NO: 475535 - protein, 9 aa, Homo Sapiens
DLGTKGCWD

SEQ ID NO: 475536 - protein, 9 aa, Homo Sapiens
QTGRFKPES

SEQ ID NO: 475537 - protein, 9 aa, Homo Sapiens
LARFRHPLR

SEQ ID NO: 475538 - protein, 9 aa, Homo Sapiens
GVACALDSH

SEQ ID NO: 475539 - protein, 9 aa, Homo Sapiens
EKELEIPPQ

SEQ ID NO: 475540 - protein, 9 aa, Homo Sapiens
ELAPRSTEP

SEQ ID NO: 475541 - protein, 9 aa, Homo Sapiens
KPTREIELK

SEQ ID NO: 475542 - protein, 9 aa, Homo Sapiens
KQIAVQAQE

SEQ ID NO: 475543 - protein, 9 aa, Homo Sapiens
NVKDKPTVD

SEQ ID NO: 475544 - protein, 9 aa, Homo Sapiens
SLGTTCHSK

SEQ ID NO: 475545 - protein, 9 aa, Homo Sapiens
DSDSDKDFE

SEQ ID NO: 475546 - protein, 9 aa, Homo Sapiens
KIENRIIEL

SEQ ID NO: 475547 - protein, 9 aa, Homo Sapiens
GSLEVVFIK

SEQ ID NO: 475548 - protein, 9 aa, Homo Sapiens
TNRRHRRRR

SEQ ID NO: 475549 - protein, 9 aa, Homo Sapiens
FSGPVADLP

SEQ ID NO: 475550 - protein, 9 aa, Homo Sapiens
ASQTQQELQ

SEQ ID NO: 475551 - protein, 9 aa, Homo Sapiens
LLHEMGADV

SEQ ID NO: 475552 - protein, 9 aa, Homo Sapiens
HRMCREDPG

SEQ ID NO: 475553 - protein, 9 aa, Homo Sapiens
NPQERINYC

SEQ ID NO: 475554 - protein, 9 aa, Homo Sapiens
PVKIENRII

SEQ ID NO: 475555 - protein, 9 aa, Homo Sapiens
LATHIRQAL

SEQ ID NO: 475556 - protein, 9 aa, Homo Sapiens
LSMPAMAHF

SEQ ID NO: 475557 - protein, 9 aa, Homo Sapiens
EEMHVNNGW

SEQ ID NO: 475558 - protein, 9 aa, Homo Sapiens
MLLTSYYAF

SEQ ID NO: 475559 - protein, 9 aa, Homo Sapiens
RDRLRVTFE

SEQ ID NO: 475560 - protein, 9 aa, Homo Sapiens
VGEKKEEAK

SEQ ID NO: 475561 - protein, 9 aa, Homo Sapiens
HSEGQQGSE

SEQ ID NO: 475562 - protein, 9 aa, Homo Sapiens
RKDPRFCRK

SEQ ID NO: 475563 - protein, 9 aa, Homo Sapiens
SFRIQAASK

SEQ ID NO: 475564 - protein, 9 aa, Homo Sapiens
DTGPKGNRG

SEQ ID NO: 475565 - protein, 9 aa, Homo Sapiens
LGVIVKVSS

SEQ ID NO: 475566 - protein, 9 aa, Homo Sapiens
SPRSPHSPL

SEQ ID NO: 475567 - protein, 9 aa, Homo Sapiens
SPQGPGKEK

SEQ ID NO: 475568 - protein, 9 aa, Homo Sapiens
NETDIFSQY

SEQ ID NO: 475569 - protein, 9 aa, Homo Sapiens
LLMNDRDPE

SEQ ID NO: 475570 - protein, 9 aa, Homo Sapiens
ANGVINFER

SEQ ID NO: 475571 - protein, 9 aa, Homo Sapiens
PAWTTTAKI

SEQ ID NO: 475572 - protein, 9 aa, Homo Sapiens
ELRDKLQRF

SEQ ID NO: 475573 - protein, 9 aa, Homo Sapiens
PDIMVKIIG

SEQ ID NO: 475574 - protein, 9 aa, Homo Sapiens
QLSLPAEAE

SEQ ID NO: 475575 - protein, 9 aa, Homo Sapiens
SCITEMQQV

SEQ ID NO: 475576 - protein, 9 aa, Homo Sapiens
TRYGGRLHI

SEQ ID NO: 475577 - protein, 9 aa, Homo Sapiens
QAGRLVYSL

SEQ ID NO: 475578 - protein, 9 aa, Homo Sapiens
SVLTNVGAV

SEQ ID NO: 475579 - protein, 9 aa, Homo Sapiens
QAAPILGPG

SEQ ID NO: 475580 - protein, 9 aa, Homo Sapiens
ISPAGSMAR

SEQ ID NO: 475581 - protein, 9 aa, Homo Sapiens
TENLVALKQ

SEQ ID NO: 475582 - protein, 9 aa, Homo Sapiens
LLTSPRTCT

SEQ ID NO: 475583 - protein, 9 aa, Homo Sapiens
AKRSVVNNP

SEQ ID NO: 475584 - protein, 9 aa, Homo Sapiens
KRPEANSVE

SEQ ID NO: 475585 - protein, 9 aa, Homo Sapiens
HLMWSQRDA

SEQ ID NO: 475586 - protein, 9 aa, Homo Sapiens
GSTCPSRHF

SEQ ID NO: 475587 - protein, 9 aa, Homo Sapiens
PELLLGAFP

SEQ ID NO: 475588 - protein, 9 aa, Homo Sapiens
SDEYKALRD

SEQ ID NO: 475589 - protein, 9 aa, Homo Sapiens
DFEEMKRNK

SEQ ID NO: 475590 - protein, 9 aa, Homo Sapiens
IAAPGLAPG

SEQ ID NO: 475591 - protein, 9 aa, Homo Sapiens
KLVRNAMEE

SEQ ID NO: 475592 - protein, 9 aa, Homo Sapiens
CWNFGFEVA

SEQ ID NO: 475593 - protein, 9 aa, Homo Sapiens
VKVSSIRVD

SEQ ID NO: 475594 - protein, 9 aa, Homo Sapiens
VQAQEILRT

SEQ ID NO: 475595 - protein, 9 aa, Homo Sapiens
QITYSLIKD

SEQ ID NO: 475596 - protein, 9 aa, Homo Sapiens
LPGALADLR

SEQ ID NO: 475597 - protein, 9 aa, Homo Sapiens
QFQKRLEKN

SEQ ID NO: 475598 - protein, 9 aa, Homo Sapiens
LNETDIFSQ

SEQ ID NO: 475599 - protein, 9 aa, Homo Sapiens
PPDADPVKI

SEQ ID NO: 475600 - protein, 9 aa, Homo Sapiens
RRCQEADRK

SEQ ID NO: 475601 - protein, 9 aa, Homo Sapiens
PPCMTILKL

SEQ ID NO: 475602 - protein, 9 aa, Homo Sapiens
LSYNQLQNI

SEQ ID NO: 475603 - protein, 9 aa, Homo Sapiens
PEAPGPLKD

SEQ ID NO: 475604 - protein, 9 aa, Homo Sapiens
CTGGVTEIA

SEQ ID NO: 475605 - protein, 9 aa, Homo Sapiens
PVFMEEPDT

SEQ ID NO: 475606 - protein, 9 aa, Homo Sapiens
EERTRLAKQ

SEQ ID NO: 475607 - protein, 9 aa, Homo Sapiens
LLLDIYTHE

SEQ ID NO: 475608 - protein, 9 aa, Homo Sapiens
LGNKSELIM

SEQ ID NO: 475609 - protein, 9 aa, Homo Sapiens
KNKQTGRFK

SEQ ID NO: 475610 - protein, 9 aa, Homo Sapiens
MTKQHLTKF

SEQ ID NO: 475611 - protein, 9 aa, Homo Sapiens
GHRGEGNPS

SEQ ID NO: 475612 - protein, 9 aa, Homo Sapiens
PGLAPGSQY

SEQ ID NO: 475613 - protein, 9 aa, Homo Sapiens
ANCGADQFR

SEQ ID NO: 475614 - protein, 9 aa, Homo Sapiens
STEPGYLVT

SEQ ID NO: 475615 - protein, 9 aa, Homo Sapiens
CCSHRMCRE

SEQ ID NO: 475616 - protein, 9 aa, Homo Sapiens
IQSPNQQAA

SEQ ID NO: 475617 - protein, 9 aa, Homo Sapiens
CVVFALMAD

SEQ ID NO: 475618 - protein, 9 aa, Homo Sapiens
FLLEENVPA

SEQ ID NO: 475619 - protein, 9 aa, Homo Sapiens
PNTTQEEEE

SEQ ID NO: 475620 - protein, 9 aa, Homo Sapiens
AQPAAEAPV

SEQ ID NO: 475621 - protein, 9 aa, Homo Sapiens
RYLANSGRS

SEQ ID NO: 475622 - protein, 9 aa, Homo Sapiens
PKGYQLNYC

SEQ ID NO: 475623 - protein, 9 aa, Homo Sapiens
NTDLLEYKF

SEQ ID NO: 475624 - protein, 9 aa, Homo Sapiens
KRLQKQREL

SEQ ID NO: 475625 - protein, 9 aa, Homo Sapiens
RRYCTSSKV

SEQ ID NO: 475626 - protein, 9 aa, Homo Sapiens
RNTAGGGPG

SEQ ID NO: 475627 - protein, 9 aa, Homo Sapiens
DSNEQDPQE

SEQ ID NO: 475628 - protein, 9 aa, Homo Sapiens
QHLTKFINQ

SEQ ID NO: 475629 - protein, 9 aa, Homo Sapiens
PEESALSEK

SEQ ID NO: 475630 - protein, 9 aa, Homo Sapiens
ECLHMLQCL

SEQ ID NO: 475631 - protein, 9 aa, Homo Sapiens
EEEQEFHIR

SEQ ID NO: 475632 - protein, 9 aa, Homo Sapiens
LEEEQEFHI

SEQ ID NO: 475633 - protein, 9 aa, Homo Sapiens
RTRLAKQLS

SEQ ID NO: 475634 - protein, 9 aa, Homo Sapiens
MNKLQPGCV

SEQ ID NO: 475635 - protein, 9 aa, Homo Sapiens
VEELAQDIV

SEQ ID NO: 475636 - protein, 9 aa, Homo Sapiens
ALMADKRLL

SEQ ID NO: 475637 - protein, 9 aa, Homo Sapiens
TGGVTEIAC

SEQ ID NO: 475638 - protein, 9 aa, Homo Sapiens
ILAMLCNEN

SEQ ID NO: 475639 - protein, 9 aa, Homo Sapiens
LSPPLLSLV

SEQ ID NO: 475640 - protein, 9 aa, Homo Sapiens
YRGKKRSKA

SEQ ID NO: 475641 - protein, 9 aa, Homo Sapiens
GYQYATEHG

SEQ ID NO: 475642 - protein, 9 aa, Homo Sapiens
PTRQDAPLE

SEQ ID NO: 475643 - protein, 9 aa, Homo Sapiens
KQHLTKFIN

SEQ ID NO: 475644 - protein, 9 aa, Homo Sapiens
QLQQKEVQI

SEQ ID NO: 475645 - protein, 9 aa, Homo Sapiens
KPRRGSFQV

SEQ ID NO: 475646 - protein, 9 aa, Homo Sapiens
VALKQIRLE

SEQ ID NO: 475647 - protein, 9 aa, Homo Sapiens
QEDGPVLIG

SEQ ID NO: 475648 - protein, 9 aa, Homo Sapiens
VELEAAVPF

SEQ ID NO: 475649 - protein, 9 aa, Homo Sapiens
SFGSAASSE

SEQ ID NO: 475650 - protein, 9 aa, Homo Sapiens
EKRETLQTN

SEQ ID NO: 475651 - protein, 9 aa, Homo Sapiens
GFNRCERCP

SEQ ID NO: 475652 - protein, 9 aa, Homo Sapiens
FDGFANGLG

SEQ ID NO: 475653 - protein, 9 aa, Homo Sapiens
MLQCLGIPW

SEQ ID NO: 475654 - protein, 9 aa, Homo Sapiens
TPVCRPGWS

SEQ ID NO: 475655 - protein, 9 aa, Homo Sapiens
FDSDLAAHQ

SEQ ID NO: 475656 - protein, 9 aa, Homo Sapiens
DKNEDMHGS

SEQ ID NO: 475657 - protein, 9 aa, Homo Sapiens
FERTILSAQ

SEQ ID NO: 475658 - protein, 9 aa, Homo Sapiens
VADLPEGIT

SEQ ID NO: 475659 - protein, 9 aa, Homo Sapiens
GKSIHLMWS

SEQ ID NO: 475660 - protein, 9 aa, Homo Sapiens
AVTQCLILV

SEQ ID NO: 475661 - protein, 9 aa, Homo Sapiens
VVNKKIEEF

SEQ ID NO: 475662 - protein, 9 aa, Homo Sapiens
HNEGQGVGE

SEQ ID NO: 475663 - protein, 9 aa, Homo Sapiens
EPQGVTGAL

SEQ ID NO: 475664 - protein, 9 aa, Homo Sapiens
IETDTSSSH

SEQ ID NO: 475665 - protein, 9 aa, Homo Sapiens
SSFATLPPP

SEQ ID NO: 475666 - protein, 9 aa, Homo Sapiens
LTSFGSAAS

SEQ ID NO: 475667 - protein, 9 aa, Homo Sapiens
AQKDLYRHV

SEQ ID NO: 475668 - protein, 9 aa, Homo Sapiens
CILESLDKW

SEQ ID NO: 475669 - protein, 9 aa, Homo Sapiens
SNLQMHKRT

SEQ ID NO: 475670 - protein, 9 aa, Homo Sapiens
KVLRAGRPV

SEQ ID NO: 475671 - protein, 9 aa, Homo Sapiens
RRLSGASSA

SEQ ID NO: 475672 - protein, 9 aa, Homo Sapiens
ANCSFPNLQ

SEQ ID NO: 475673 - protein, 9 aa, Homo Sapiens
HPHFVRIFE

SEQ ID NO: 475674 - protein, 9 aa, Homo Sapiens
VICQEDVLR

SEQ ID NO: 475675 - protein, 9 aa, Homo Sapiens
MATWRKNHD

SEQ ID NO: 475676 - protein, 9 aa, Homo Sapiens
HNVHTQLAG

SEQ ID NO: 475677 - protein, 9 aa, Homo Sapiens
LEYKFVNSR

SEQ ID NO: 475678 - protein, 9 aa, Homo Sapiens
TNLLLEEIR

SEQ ID NO: 475679 - protein, 9 aa, Homo Sapiens
LKKPTKTSQ

SEQ ID NO: 475680 - protein, 9 aa, Homo Sapiens
QGELSGDFE

SEQ ID NO: 475681 - protein, 9 aa, Homo Sapiens
QPKGYQLNY

SEQ ID NO: 475682 - protein, 9 aa, Homo Sapiens
VKIENRIIE

SEQ ID NO: 475683 - protein, 9 aa, Homo Sapiens
LIRKLEGHE

SEQ ID NO: 475684 - protein, 9 aa, Homo Sapiens
VLLWEIVAL

SEQ ID NO: 475685 - protein, 9 aa, Homo Sapiens
SGADDYKIK

SEQ ID NO: 475686 - protein, 9 aa, Homo Sapiens
NNCIDAVKL

SEQ ID NO: 475687 - protein, 9 aa, Homo Sapiens
SHHNGILKG

SEQ ID NO: 475688 - protein, 9 aa, Homo Sapiens
FIPLCVDAL

SEQ ID NO: 475689 - protein, 9 aa, Homo Sapiens
APGPLKDKG

SEQ ID NO: 475690 - protein, 9 aa, Homo Sapiens
VRQLIENAD

SEQ ID NO: 475691 - protein, 9 aa, Homo Sapiens
GYDPSHVTR

SEQ ID NO: 475692 - protein, 9 aa, Homo Sapiens
ALGGNPYPG

SEQ ID NO: 475693 - protein, 9 aa, Homo Sapiens
PKAKGRIKH

SEQ ID NO: 475694 - protein, 9 aa, Homo Sapiens
KDNKDSPYP

SEQ ID NO: 475695 - protein, 9 aa, Homo Sapiens
PRGQARRPR

SEQ ID NO: 475696 - protein, 9 aa, Homo Sapiens
FPLTVLLDR

SEQ ID NO: 475697 - protein, 9 aa, Homo Sapiens
DKDFEVKED

SEQ ID NO: 475698 - protein, 9 aa, Homo Sapiens
KNHDKDGFS

SEQ ID NO: 475699 - protein, 9 aa, Homo Sapiens
IMSPTLLAE

SEQ ID NO: 475700 - protein, 9 aa, Homo Sapiens
TNQGVIEFR

SEQ ID NO: 475701 - protein, 9 aa, Homo Sapiens
ESPTGKLPF

SEQ ID NO: 475702 - protein, 9 aa, Homo Sapiens
TLLVTASPL

SEQ ID NO: 475703 - protein, 9 aa, Homo Sapiens
PFGPSCSGD

SEQ ID NO: 475704 - protein, 9 aa, Homo Sapiens
AVTKMLQLC

SEQ ID NO: 475705 - protein, 9 aa, Homo Sapiens
SAHLLVNLS

SEQ ID NO: 475706 - protein, 9 aa, Homo Sapiens
GQLLGLKPT

SEQ ID NO: 475707 - protein, 9 aa, Homo Sapiens
ISLSICHTF

SEQ ID NO: 475708 - protein, 9 aa, Homo Sapiens
TNLPCCVTL

SEQ ID NO: 475709 - protein, 9 aa, Homo Sapiens
HHHSHHHHH

SEQ ID NO: 475710 - protein, 9 aa, Homo Sapiens
LINIYRDKL

SEQ ID NO: 475711 - protein, 9 aa, Homo Sapiens
ERTNQGVIE

SEQ ID NO: 475712 - protein, 9 aa, Homo Sapiens
HEAFDSDLA

SEQ ID NO: 475713 - protein, 9 aa, Homo Sapiens
GPLPASHPL

SEQ ID NO: 475714 - protein, 9 aa, Homo Sapiens
EAVEEPQAA

SEQ ID NO: 475715 - protein, 9 aa, Homo Sapiens
EVHITEKSF

SEQ ID NO: 475716 - protein, 9 aa, Homo Sapiens
KAGEGPFSE

SEQ ID NO: 475717 - protein, 9 aa, Homo Sapiens
DHISPAGSM

SEQ ID NO: 475718 - protein, 9 aa, Homo Sapiens
DVLRDSMEE

SEQ ID NO: 475719 - protein, 9 aa, Homo Sapiens
DSRAQSVTN

SEQ ID NO: 475720 - protein, 9 aa, Homo Sapiens
ADPVKIENR

SEQ ID NO: 475721 - protein, 9 aa, Homo Sapiens
KDKGLGTPE

SEQ ID NO: 475722 - protein, 9 aa, Homo Sapiens
NRGFDGLPG

SEQ ID NO: 475723 - protein, 9 aa, Homo Sapiens
ADLPEGITV

SEQ ID NO: 475724 - protein, 9 aa, Homo Sapiens
LGSLPANPV

SEQ ID NO: 475725 - protein, 9 aa, Homo Sapiens
KEYVDMMEW

SEQ ID NO: 475726 - protein, 9 aa, Homo Sapiens
NGNVFTTGF

SEQ ID NO: 475727 - protein, 9 aa, Homo Sapiens
VLRDSMEEK

SEQ ID NO: 475728 - protein, 9 aa, Homo Sapiens
VKEGVQVTD

SEQ ID NO: 475729 - protein, 9 aa, Homo Sapiens
NYCHLIEKL

SEQ ID NO: 475730 - protein, 9 aa, Homo Sapiens
VTGERKNET

SEQ ID NO: 475731 - protein, 9 aa, Homo Sapiens
AKIHLKTII

SEQ ID NO: 475732 - protein, 9 aa, Homo Sapiens
SGCWNFGFE

SEQ ID NO: 475733 - protein, 9 aa, Homo Sapiens
RELSPQGPG

SEQ ID NO: 475734 - protein, 9 aa, Homo Sapiens
ATLSVRQLI

SEQ ID NO: 475735 - protein, 9 aa, Homo Sapiens
TEPGHPLLS

SEQ ID NO: 475736 - protein, 9 aa, Homo Sapiens
TGALLSSGH

SEQ ID NO: 475737 - protein, 9 aa, Homo Sapiens
SGNPGPESD

SEQ ID NO: 475738 - protein, 9 aa, Homo Sapiens
EETHSGARA

SEQ ID NO: 475739 - protein, 9 aa, Homo Sapiens
ERYPAAQYV

SEQ ID NO: 475740 - protein, 9 aa, Homo Sapiens
CIWLLILSY

SEQ ID NO: 475741 - protein, 9 aa, Homo Sapiens
HHRRLHTAE

SEQ ID NO: 475742 - protein, 9 aa, Homo Sapiens
SFQVTLLRP

SEQ ID NO: 475743 - protein, 9 aa, Homo Sapiens
LIKMDSQLH

SEQ ID NO: 475744 - protein, 9 aa, Homo Sapiens
LGRTVTFKC

SEQ ID NO: 475745 - protein, 9 aa, Homo Sapiens
TLKQEVHIT

SEQ ID NO: 475746 - protein, 9 aa, Homo Sapiens
EFSKEEQDP

SEQ ID NO: 475747 - protein, 9 aa, Homo Sapiens
PMRAIFLAN

SEQ ID NO: 475748 - protein, 9 aa, Homo Sapiens
TVVLGAKQL

SEQ ID NO: 475749 - protein, 9 aa, Homo Sapiens
PYPKHSLTT

SEQ ID NO: 475750 - protein, 9 aa, Homo Sapiens
VKEYVDMME

SEQ ID NO: 475751 - protein, 9 aa, Homo Sapiens
EFHIRSKNS

SEQ ID NO: 475752 - protein, 9 aa, Homo Sapiens
SSHSDESES

SEQ ID NO: 475753 - protein, 9 aa, Homo Sapiens
DAHKERTNQ

SEQ ID NO: 475754 - protein, 9 aa, Homo Sapiens
PLPIATPPS

SEQ ID NO: 475755 - protein, 9 aa, Homo Sapiens
NHLSKQKDI

SEQ ID NO: 475756 - protein, 9 aa, Homo Sapiens
APYNTTQLL

SEQ ID NO: 475757 - protein, 9 aa, Homo Sapiens
SSGDSNSYF

SEQ ID NO: 475758 - protein, 9 aa, Homo Sapiens
GQAGRLVYS

SEQ ID NO: 475759 - protein, 9 aa, Homo Sapiens
QLSSLRDQR

SEQ ID NO: 475760 - protein, 9 aa, Homo Sapiens
ALGLQGARS

SEQ ID NO: 475761 - protein, 9 aa, Homo Sapiens
ELLQATRNA

SEQ ID NO: 475762 - protein, 9 aa, Homo Sapiens
RGSTCFLDT

SEQ ID NO: 475763 - protein, 9 aa, Homo Sapiens
PSSSGSAFT

SEQ ID NO: 475764 - protein, 9 aa, Homo Sapiens
HTLWCSLGT

SEQ ID NO: 475765 - protein, 9 aa, Homo Sapiens
KCQGADIVL

SEQ ID NO: 475766 - protein, 9 aa, Homo Sapiens
ATWRKNHDK

SEQ ID NO: 475767 - protein, 9 aa, Homo Sapiens
HLESEFEIK

SEQ ID NO: 475768 - protein, 9 aa, Homo Sapiens
LDWAAAQAD

SEQ ID NO: 475769 - protein, 9 aa, Homo Sapiens
WRRRQRRLS

SEQ ID NO: 475770 - protein, 9 aa, Homo Sapiens
SMEFAAICI

SEQ ID NO: 475771 - protein, 9 aa, Homo Sapiens
GHHTVLFSA

SEQ ID NO: 475772 - protein, 9 aa, Homo Sapiens
QLGAESPSR

SEQ ID NO: 475773 - protein, 9 aa, Homo Sapiens
INSSDKGKN

SEQ ID NO: 475774 - protein, 9 aa, Homo Sapiens
CRDWPGFYP

SEQ ID NO: 475775 - protein, 9 aa, Homo Sapiens
LGEELCSVS

SEQ ID NO: 475776 - protein, 9 aa, Homo Sapiens
SAVPLPVGM

SEQ ID NO: 475777 - protein, 9 aa, Homo Sapiens
HSHHHHHHH

SEQ ID NO: 475778 - protein, 9 aa, Homo Sapiens
YKSRKRGML

SEQ ID NO: 475779 - protein, 9 aa, Homo Sapiens
QFKAFRRDF

SEQ ID NO: 475780 - protein, 9 aa, Homo Sapiens
LVTRNIKPR

SEQ ID NO: 475781 - protein, 9 aa, Homo Sapiens
QQPSTESTP

SEQ ID NO: 475782 - protein, 9 aa, Homo Sapiens
PFSLKKPTK

SEQ ID NO: 475783 - protein, 9 aa, Homo Sapiens
MPCCSHRMC

SEQ ID NO: 475784 - protein, 9 aa, Homo Sapiens
RAAAGAPGG

SEQ ID NO: 475785 - protein, 9 aa, Homo Sapiens
TRHRIQQLK

SEQ ID NO: 475786 - protein, 9 aa, Homo Sapiens
GSSIQLTID

SEQ ID NO: 475787 - protein, 9 aa, Homo Sapiens
PLQKGVRTA

SEQ ID NO: 475788 - protein, 9 aa, Homo Sapiens
KYFQYVTSN

SEQ ID NO: 475789 - protein, 9 aa, Homo Sapiens
AGQAGRLVY

SEQ ID NO: 475790 - protein, 9 aa, Homo Sapiens
TATATAPGA

SEQ ID NO: 475791 - protein, 9 aa, Homo Sapiens
ELCSVSPSE

SEQ ID NO: 475792 - protein, 9 aa, Homo Sapiens
NYCQGKNYN

SEQ ID NO: 475793 - protein, 9 aa, Homo Sapiens
GYMGSTCPS

SEQ ID NO: 475794 - protein, 9 aa, Homo Sapiens
HPSNPEHVF

SEQ ID NO: 475795 - protein, 9 aa, Homo Sapiens
NRSWPFNLK

SEQ ID NO: 475796 - protein, 9 aa, Homo Sapiens
AASKAGEGP

SEQ ID NO: 475797 - protein, 9 aa, Homo Sapiens
QAASKAGEG

SEQ ID NO: 475798 - protein, 9 aa, Homo Sapiens
YTKRPEANS

SEQ ID NO: 475799 - protein, 9 aa, Homo Sapiens
SLSPTIRPG

SEQ ID NO: 475800 - protein, 9 aa, Homo Sapiens
WLILIPQKA

SEQ ID NO: 475801 - protein, 9 aa, Homo Sapiens
GCCFIPLCV

SEQ ID NO: 475802 - protein, 9 aa, Homo Sapiens
RKNHDKDGF

SEQ ID NO: 475803 - protein, 9 aa, Homo Sapiens
AQSVTNTLV

SEQ ID NO: 475804 - protein, 9 aa, Homo Sapiens
ESCDDLDES

SEQ ID NO: 475805 - protein, 9 aa, Homo Sapiens
FMKNSLKDV

SEQ ID NO: 475806 - protein, 9 aa, Homo Sapiens
DILTGSSTC

SEQ ID NO: 475807 - protein, 9 aa, Homo Sapiens
AEGGRPWHL

SEQ ID NO: 475808 - protein, 9 aa, Homo Sapiens
PKVLRKSHS

SEQ ID NO: 475809 - protein, 9 aa, Homo Sapiens
IRTQLEELE

SEQ ID NO: 475810 - protein, 9 aa, Homo Sapiens
VTSTSEYCC

SEQ ID NO: 475811 - protein, 9 aa, Homo Sapiens
GVINFERTI

SEQ ID NO: 475812 - protein, 9 aa, Homo Sapiens
KVWQQAEFQ

SEQ ID NO: 475813 - protein, 9 aa, Homo Sapiens
ADDYKIKVW

SEQ ID NO: 475814 - protein, 9 aa, Homo Sapiens
ILARLSTKN

SEQ ID NO: 475815 - protein, 9 aa, Homo Sapiens
LLQVILSTS

SEQ ID NO: 475816 - protein, 9 aa, Homo Sapiens
GGRLHIEKR

SEQ ID NO: 475817 - protein, 9 aa, Homo Sapiens
THLEKGQLL

SEQ ID NO: 475818 - protein, 9 aa, Homo Sapiens
KILLHEMGA

SEQ ID NO: 475819 - protein, 9 aa, Homo Sapiens
TKYNSEVVN

SEQ ID NO: 475820 - protein, 9 aa, Homo Sapiens
AVRESPQLG

SEQ ID NO: 475821 - protein, 9 aa, Homo Sapiens
CVTLQPGPE

SEQ ID NO: 475822 - protein, 9 aa, Homo Sapiens
ESPSPGRQP

SEQ ID NO: 475823 - protein, 9 aa, Homo Sapiens
YSIPTYCKY

SEQ ID NO: 475824 - protein, 9 aa, Homo Sapiens
FHIRSKNSL

SEQ ID NO: 475825 - protein, 9 aa, Homo Sapiens
FQCKLCHQR

SEQ ID NO: 475826 - protein, 9 aa, Homo Sapiens
LSERHVTIW

SEQ ID NO: 475827 - protein, 9 aa, Homo Sapiens
WQQAEFQNM

SEQ ID NO: 475828 - protein, 9 aa, Homo Sapiens
GKAEAVGAV

SEQ ID NO: 475829 - protein, 9 aa, Homo Sapiens
LLVTSSPPM

SEQ ID NO: 475830 - protein, 9 aa, Homo Sapiens
FAVTQCLIL

SEQ ID NO: 475831 - protein, 9 aa, Homo Sapiens
VGHVARPGP

SEQ ID NO: 475832 - protein, 9 aa, Homo Sapiens
LVVRYTPQV

SEQ ID NO: 475833 - protein, 9 aa, Homo Sapiens
EQKSCICSE

SEQ ID NO: 475834 - protein, 9 aa, Homo Sapiens
ADRKELNHW

SEQ ID NO: 475835 - protein, 9 aa, Homo Sapiens
IDAVKLDSA

SEQ ID NO: 475836 - protein, 9 aa, Homo Sapiens
DLLQVILST

SEQ ID NO: 475837 - protein, 9 aa, Homo Sapiens
NYLRMVEYH

SEQ ID NO: 475838 - protein, 9 aa, Homo Sapiens
QRDAPRGQA

SEQ ID NO: 475839 - protein, 9 aa, Homo Sapiens
TEVKDACVS

SEQ ID NO: 475840 - protein, 9 aa, Homo Sapiens
NLTPKLAYP

SEQ ID NO: 475841 - protein, 9 aa, Homo Sapiens
ESEFEIKVY

SEQ ID NO: 475842 - protein, 9 aa, Homo Sapiens
SKSPLIPSD

SEQ ID NO: 475843 - protein, 9 aa, Homo Sapiens
ERINYCHLI

SEQ ID NO: 475844 - protein, 9 aa, Homo Sapiens
QIRLEHEEG

SEQ ID NO: 475845 - protein, 9 aa, Homo Sapiens
EPGVAKAEL

SEQ ID NO: 475846 - protein, 9 aa, Homo Sapiens
CALDSHGTL

SEQ ID NO: 475847 - protein, 9 aa, Homo Sapiens
ETADVWAVG

SEQ ID NO: 475848 - protein, 9 aa, Homo Sapiens
KEMAPASEA

SEQ ID NO: 475849 - protein, 9 aa, Homo Sapiens
SEITKQEKD

SEQ ID NO: 475850 - protein, 9 aa, Homo Sapiens
ESWAERPAP

SEQ ID NO: 475851 - protein, 9 aa, Homo Sapiens
PDQIQENSV

SEQ ID NO: 475852 - protein, 9 aa, Homo Sapiens
QKNHTHEKP

SEQ ID NO: 475853 - protein, 9 aa, Homo Sapiens
CSIAWAGQK

SEQ ID NO: 475854 - protein, 9 aa, Homo Sapiens
CALTTGNLT

SEQ ID NO: 475855 - protein, 9 aa, Homo Sapiens
PEEMHVNNG

SEQ ID NO: 475856 - protein, 9 aa, Homo Sapiens
SWAERPAPR

SEQ ID NO: 475857 - protein, 9 aa, Homo Sapiens
STIPQIPQI

SEQ ID NO: 475858 - protein, 9 aa, Homo Sapiens
RIQQLKQLG

SEQ ID NO: 475859 - protein, 9 aa, Homo Sapiens
MRAIFLANG

SEQ ID NO: 475860 - protein, 9 aa, Homo Sapiens
RGYLLPGAL

SEQ ID NO: 475861 - protein, 9 aa, Homo Sapiens
EGKAKEDSL

SEQ ID NO: 475862 - protein, 9 aa, Homo Sapiens
ASSEGAKNG

SEQ ID NO: 475863 - protein, 9 aa, Homo Sapiens
GTKGCWDQL

SEQ ID NO: 475864 - protein, 9 aa, Homo Sapiens
KTCNKVDLE

SEQ ID NO: 475865 - protein, 9 aa, Homo Sapiens
TGKLPFWTW

SEQ ID NO: 475866 - protein, 9 aa, Homo Sapiens
LSLVASLSA

SEQ ID NO: 475867 - protein, 9 aa, Homo Sapiens
SHDAERHNE

SEQ ID NO: 475868 - protein, 9 aa, Homo Sapiens
NGVINFERT

SEQ ID NO: 475869 - protein, 9 aa, Homo Sapiens
PAPAGRPAP

SEQ ID NO: 475870 - protein, 9 aa, Homo Sapiens
HLYNFHALG

SEQ ID NO: 475871 - protein, 9 aa, Homo Sapiens
SSSTEPGHP

SEQ ID NO: 475872 - protein, 9 aa, Homo Sapiens
MKNSLKDVD

SEQ ID NO: 475873 - protein, 9 aa, Homo Sapiens
VANGVINFE

SEQ ID NO: 475874 - protein, 9 aa, Homo Sapiens
DSDLAAHQD

SEQ ID NO: 475875 - protein, 9 aa, Homo Sapiens
WMFPCRMAW

SEQ ID NO: 475876 - protein, 9 aa, Homo Sapiens
HGGVLPNIQ

SEQ ID NO: 475877 - protein, 9 aa, Homo Sapiens
VEVLKILLH

SEQ ID NO: 475878 - protein, 9 aa, Homo Sapiens
HDAERHNEG

SEQ ID NO: 475879 - protein, 9 aa, Homo Sapiens
FLGTEGAAT

SEQ ID NO: 475880 - protein, 9 aa, Homo Sapiens
RRRQRRLSG

SEQ ID NO: 475881 - protein, 9 aa, Homo Sapiens
NVTDVNNNV

SEQ ID NO: 475882 - protein, 9 aa, Homo Sapiens
ISERNEDAT

SEQ ID NO: 475883 - protein, 9 aa, Homo Sapiens
ASFISKTYL

SEQ ID NO: 475884 - protein, 9 aa, Homo Sapiens
RQQVAEGGP

SEQ ID NO: 475885 - protein, 9 aa, Homo Sapiens
ALGARQAKL

SEQ ID NO: 475886 - protein, 9 aa, Homo Sapiens
SCDDLDESH

SEQ ID NO: 475887 - protein, 9 aa, Homo Sapiens
INYCHLIEK

SEQ ID NO: 475888 - protein, 9 aa, Homo Sapiens
DIVSKLPRD

SEQ ID NO: 475889 - protein, 9 aa, Homo Sapiens
VLVKEAECA

SEQ ID NO: 475890 - protein, 9 aa, Homo Sapiens
QATRNAGRR

SEQ ID NO: 475891 - protein, 9 aa, Homo Sapiens
LKDYDPLIH

SEQ ID NO: 475892 - protein, 9 aa, Homo Sapiens
SLKDVDQMF

SEQ ID NO: 475893 - protein, 9 aa, Homo Sapiens
QGPGKEKEL

SEQ ID NO: 475894 - protein, 9 aa, Homo Sapiens
AIFLANGNV

SEQ ID NO: 475895 - protein, 9 aa, Homo Sapiens
STTFVLGCR

SEQ ID NO: 475896 - protein, 9 aa, Homo Sapiens
ALGRTVTFK

SEQ ID NO: 475897 - protein, 9 aa, Homo Sapiens
ATQRIAFKN

SEQ ID NO: 475898 - protein, 9 aa, Homo Sapiens
STSEYCCCV

SEQ ID NO: 475899 - protein, 9 aa, Homo Sapiens
GSRVRQVSV

SEQ ID NO: 475900 - protein, 9 aa, Homo Sapiens
LHMLQCLGI

SEQ ID NO: 475901 - protein, 9 aa, Homo Sapiens
QYATEHGLI

SEQ ID NO: 475902 - protein, 9 aa, Homo Sapiens
TPQQPSTES

SEQ ID NO: 475903 - protein, 9 aa, Homo Sapiens
LPHVRQPDQ

SEQ ID NO: 475904 - protein, 9 aa, Homo Sapiens
RVVPMLLVP

SEQ ID NO: 475905 - protein, 9 aa, Homo Sapiens
YYAFSLVII

SEQ ID NO: 475906 - protein, 9 aa, Homo Sapiens
SNKKQSAMP

SEQ ID NO: 475907 - protein, 9 aa, Homo Sapiens
HLPGPLRTG

SEQ ID NO: 475908 - protein, 9 aa, Homo Sapiens
LICCLVDGE

SEQ ID NO: 475909 - protein, 9 aa, Homo Sapiens
GPVNYCQGK

SEQ ID NO: 475910 - protein, 9 aa, Homo Sapiens
PRFCRKLRA

SEQ ID NO: 475911 - protein, 9 aa, Homo Sapiens
SIDRELSPQ

SEQ ID NO: 475912 - protein, 9 aa, Homo Sapiens
LDIYTHEAG

SEQ ID NO: 475913 - protein, 9 aa, Homo Sapiens
SEGDNCKLK

SEQ ID NO: 475914 - protein, 9 aa, Homo Sapiens
RDWILQPKG

SEQ ID NO: 475915 - protein, 9 aa, Homo Sapiens
KPEEMHVNN

SEQ ID NO: 475916 - protein, 9 aa, Homo Sapiens
NKDSPYPKH

SEQ ID NO: 475917 - protein, 9 aa, Homo Sapiens
FDTFPAGIM

SEQ ID NO: 475918 - protein, 9 aa, Homo Sapiens
SSFSNGPCE

SEQ ID NO: 475919 - protein, 9 aa, Homo Sapiens
NLKDYDPLI

SEQ ID NO: 475920 - protein, 9 aa, Homo Sapiens
GGFDCLCPF

SEQ ID NO: 475921 - protein, 9 aa, Homo Sapiens
SKQVEGIEV

SEQ ID NO: 475922 - protein, 9 aa, Homo Sapiens
GDLLPPFAS

SEQ ID NO: 475923 - protein, 9 aa, Homo Sapiens
LSIVPGNVS

SEQ ID NO: 475924 - protein, 9 aa, Homo Sapiens
GELCYQVIY

SEQ ID NO: 475925 - protein, 9 aa, Homo Sapiens
KTYLVICGA

SEQ ID NO: 475926 - protein, 9 aa, Homo Sapiens
AAGAPVAAQ

SEQ ID NO: 475927 - protein, 9 aa, Homo Sapiens
TGERKNETD

SEQ ID NO: 475928 - protein, 9 aa, Homo Sapiens
EDSNEQDPQ

SEQ ID NO: 475929 - protein, 9 aa, Homo Sapiens
DLLEYKFVN

SEQ ID NO: 475930 - protein, 9 aa, Homo Sapiens
ARLPGGHHT

SEQ ID NO: 475931 - protein, 9 aa, Homo Sapiens
VTSSPPMKK

SEQ ID NO: 475932 - protein, 9 aa, Homo Sapiens
GPLKDKGLG

SEQ ID NO: 475933 - protein, 9 aa, Homo Sapiens
QPGCVPKIN

SEQ ID NO: 475934 - protein, 9 aa, Homo Sapiens
LCNENRDHI

SEQ ID NO: 475935 - protein, 9 aa, Homo Sapiens
PSTQADSSF

SEQ ID NO: 475936 - protein, 9 aa, Homo Sapiens
PLSSIVFSA

SEQ ID NO: 475937 - protein, 9 aa, Homo Sapiens
TKNADEYNF

SEQ ID NO: 475938 - protein, 9 aa, Homo Sapiens
HNLYRNVML

SEQ ID NO: 475939 - protein, 9 aa, Homo Sapiens
HTVLFSATL

SEQ ID NO: 475940 - protein, 9 aa, Homo Sapiens
PVSLPRTQS

SEQ ID NO: 475941 - protein, 9 aa, Homo Sapiens
NLQMHKRTH

SEQ ID NO: 475942 - protein, 9 aa, Homo Sapiens
QKQRELERQ

SEQ ID NO: 475943 - protein, 9 aa, Homo Sapiens
FEKSEEDPV

SEQ ID NO: 475944 - protein, 9 aa, Homo Sapiens
SLSKSPLIP

SEQ ID NO: 475945 - protein, 9 aa, Homo Sapiens
EELAQDIVS

SEQ ID NO: 475946 - protein, 9 aa, Homo Sapiens
SPMQRSPFS

SEQ ID NO: 475947 - protein, 9 aa, Homo Sapiens
PSLFCGFCF

SEQ ID NO: 475948 - protein, 9 aa, Homo Sapiens
RRQSSTFTL

SEQ ID NO: 475949 - protein, 9 aa, Homo Sapiens
KGAIFEGFK

SEQ ID NO: 475950 - protein, 9 aa, Homo Sapiens
RGGSLHIQG

SEQ ID NO: 475951 - protein, 9 aa, Homo Sapiens
ADKKFSYSS

SEQ ID NO: 475952 - protein, 9 aa, Homo Sapiens
QLQNIPPVN

SEQ ID NO: 475953 - protein, 9 aa, Homo Sapiens
VVPMLLVPV

SEQ ID NO: 475954 - protein, 9 aa, Homo Sapiens
TISSSPFPV

SEQ ID NO: 475955 - protein, 9 aa, Homo Sapiens
QLGFEKYYQ

SEQ ID NO: 475956 - protein, 9 aa, Homo Sapiens
NTTQLLMND

SEQ ID NO: 475957 - protein, 9 aa, Homo Sapiens
EVFMKNSLK

SEQ ID NO: 475958 - protein, 9 aa, Homo Sapiens
AAPGLAPGS

SEQ ID NO: 475959 - protein, 9 aa, Homo Sapiens
LSEGKAKED

SEQ ID NO: 475960 - protein, 9 aa, Homo Sapiens
APGGGAAVG

SEQ ID NO: 475961 - protein, 9 aa, Homo Sapiens
DRELSPQGP

SEQ ID NO: 475962 - protein, 9 aa, Homo Sapiens
ILIPQKALV

SEQ ID NO: 475963 - protein, 9 aa, Homo Sapiens
LSLPAEAES

SEQ ID NO: 475964 - protein, 9 aa, Homo Sapiens
KDTIQGAPL

SEQ ID NO: 475965 - protein, 9 aa, Homo Sapiens
QIAVQAQEI

SEQ ID NO: 475966 - protein, 9 aa, Homo Sapiens
TVLESWAER

SEQ ID NO: 475967 - protein, 9 aa, Homo Sapiens
SSAAVQHEQ

SEQ ID NO: 475968 - protein, 9 aa, Homo Sapiens
LANGNVFTT

SEQ ID NO: 475969 - protein, 9 aa, Homo Sapiens
KHDPVHPGG

SEQ ID NO: 475970 - protein, 9 aa, Homo Sapiens
DGKVWQQAE

SEQ ID NO: 475971 - protein, 9 aa, Homo Sapiens
GGTGRTGLA

SEQ ID NO: 475972 - protein, 9 aa, Homo Sapiens
MKFMYTSQY

SEQ ID NO: 475973 - protein, 9 aa, Homo Sapiens
GFAGGYTLN

SEQ ID NO: 475974 - protein, 9 aa, Homo Sapiens
TSSKVAAHY

SEQ ID NO: 475975 - protein, 9 aa, Homo Sapiens
IEVFMKNSL

SEQ ID NO: 475976 - protein, 9 aa, Homo Sapiens
CAQGQLYKV

SEQ ID NO: 475977 - protein, 9 aa, Homo Sapiens
LVELEAAVP

SEQ ID NO: 475978 - protein, 9 aa, Homo Sapiens
DIVLEVPPY

SEQ ID NO: 475979 - protein, 9 aa, Homo Sapiens
RIMSPTLLA

SEQ ID NO: 475980 - protein, 9 aa, Homo Sapiens
RAVTKMLQL

SEQ ID NO: 475981 - protein, 9 aa, Homo Sapiens
DSLSKSPLI

SEQ ID NO: 475982 - protein, 9 aa, Homo Sapiens
LGPRSPLDM

SEQ ID NO: 475983 - protein, 9 aa, Homo Sapiens
HLWENLGKK

SEQ ID NO: 475984 - protein, 9 aa, Homo Sapiens
QEDVLRDSM

SEQ ID NO: 475985 - protein, 9 aa, Homo Sapiens
EFTEEVTNL

SEQ ID NO: 475986 - protein, 9 aa, Homo Sapiens
CTVVEYIGE

SEQ ID NO: 475987 - protein, 9 aa, Homo Sapiens
QLELEKRLQ

SEQ ID NO: 475988 - protein, 9 aa, Homo Sapiens
DWILQPKGY

SEQ ID NO: 475989 - protein, 9 aa, Homo Sapiens
GLPGIRGGT

SEQ ID NO: 475990 - protein, 9 aa, Homo Sapiens
SSIQLTIDD

SEQ ID NO: 475991 - protein, 9 aa, Homo Sapiens
ERPAPRTCR

SEQ ID NO: 475992 - protein, 9 aa, Homo Sapiens
FENTDQKSL

SEQ ID NO: 475993 - protein, 9 aa, Homo Sapiens
NSEVVNKKI

SEQ ID NO: 475994 - protein, 9 aa, Homo Sapiens
QGARQGRLE

SEQ ID NO: 475995 - protein, 9 aa, Homo Sapiens
EFAAICIRN

SEQ ID NO: 475996 - protein, 9 aa, Homo Sapiens
NSTQALVAF

SEQ ID NO: 475997 - protein, 9 aa, Homo Sapiens
IPQIPASVP

SEQ ID NO: 475998 - protein, 9 aa, Homo Sapiens
TSRRSMNLH

SEQ ID NO: 475999 - protein, 9 aa, Homo Sapiens
FSLKKPTKT

SEQ ID NO: 476000 - protein, 9 aa, Homo Sapiens
CGRGYDPSH

SEQ ID NO: 476001 - protein, 9 aa, Homo Sapiens
FHILISLLD

SEQ ID NO: 476002 - protein, 9 aa, Homo Sapiens
KGQGEYSGC

SEQ ID NO: 476003 - protein, 9 aa, Homo Sapiens
NFQLVQGVQ

SEQ ID NO: 476004 - protein, 9 aa, Homo Sapiens
LLEKTTVRT

SEQ ID NO: 476005 - protein, 9 aa, Homo Sapiens
LEKRLQKQR

SEQ ID NO: 476006 - protein, 9 aa, Homo Sapiens
VLESWAERP

SEQ ID NO: 476007 - protein, 9 aa, Homo Sapiens
SPFKVPGFL

SEQ ID NO: 476008 - protein, 9 aa, Homo Sapiens
IFRDKNEDM

SEQ ID NO: 476009 - protein, 9 aa, Homo Sapiens
KWRIMSPTL

SEQ ID NO: 476010 - protein, 9 aa, Homo Sapiens
KGYQLNYCS

SEQ ID NO: 476011 - protein, 9 aa, Homo Sapiens
PQPSQLGAE

SEQ ID NO: 476012 - protein, 9 aa, Homo Sapiens
DWPGFYPHQ

SEQ ID NO: 476013 - protein, 9 aa, Homo Sapiens
NGVLQKESG

SEQ ID NO: 476014 - protein, 9 aa, Homo Sapiens
AFTPQEEQT

SEQ ID NO: 476015 - protein, 9 aa, Homo Sapiens
LGLQGARST

SEQ ID NO: 476016 - protein, 9 aa, Homo Sapiens
TSPWMFPCR

SEQ ID NO: 476017 - protein, 9 aa, Homo Sapiens
VAPYNTTQL

SEQ ID NO: 476018 - protein, 9 aa, Homo Sapiens
DLQAGYFHP

SEQ ID NO: 476019 - protein, 9 aa, Homo Sapiens
DSVLDHLFP

SEQ ID NO: 476020 - protein, 9 aa, Homo Sapiens
LSRMIEGPI

SEQ ID NO: 476021 - protein, 9 aa, Homo Sapiens
CLHMLQCLG

SEQ ID NO: 476022 - protein, 9 aa, Homo Sapiens
TQAMSRFAS

SEQ ID NO: 476023 - protein, 9 aa, Homo Sapiens
RIGREARFQ

SEQ ID NO: 476024 - protein, 9 aa, Homo Sapiens
TWKGAIFEG

SEQ ID NO: 476025 - protein, 9 aa, Homo Sapiens
RRFKEPWFF

SEQ ID NO: 476026 - protein, 9 aa, Homo Sapiens
DFRIKLESK

SEQ ID NO: 476027 - protein, 9 aa, Homo Sapiens
GLRCYPPQG

SEQ ID NO: 476028 - protein, 9 aa, Homo Sapiens
QRKTISVKG

SEQ ID NO: 476029 - protein, 9 aa, Homo Sapiens
PQERINYCH

SEQ ID NO: 476030 - protein, 9 aa, Homo Sapiens
GKPIEASIQ

SEQ ID NO: 476031 - protein, 9 aa, Homo Sapiens
GVICQEDVL

SEQ ID NO: 476032 - protein, 9 aa, Homo Sapiens
KGSQEGAKY

SEQ ID NO: 476033 - protein, 9 aa, Homo Sapiens
YFHPHFVRI

SEQ ID NO: 476034 - protein, 9 aa, Homo Sapiens
MPAMAHFQW

SEQ ID NO: 476035 - protein, 9 aa, Homo Sapiens
LNPQERINY

SEQ ID NO: 476036 - protein, 9 aa, Homo Sapiens
PTIRPGTGA

SEQ ID NO: 476037 - protein, 9 aa, Homo Sapiens
GGVIAYISC

SEQ ID NO: 476038 - protein, 9 aa, Homo Sapiens
GPTGCPGTS

SEQ ID NO: 476039 - protein, 9 aa, Homo Sapiens
LEAADKNKQ

SEQ ID NO: 476040 - protein, 9 aa, Homo Sapiens
LPCCVTLQP

SEQ ID NO: 476041 - protein, 9 aa, Homo Sapiens
HRGEGNPSG

SEQ ID NO: 476042 - protein, 9 aa, Homo Sapiens
TGFTATPSC

SEQ ID NO: 476043 - protein, 9 aa, Homo Sapiens
ITEKSFQCN

SEQ ID NO: 476044 - protein, 9 aa, Homo Sapiens
SYCSRKDCQ

SEQ ID NO: 476045 - protein, 9 aa, Homo Sapiens
EESALSEKA

SEQ ID NO: 476046 - protein, 9 aa, Homo Sapiens
VYDPQQDYG

SEQ ID NO: 476047 - protein, 9 aa, Homo Sapiens
VPAIEGAEE

SEQ ID NO: 476048 - protein, 9 aa, Homo Sapiens
GRTVTFKCE

SEQ ID NO: 476049 - protein, 9 aa, Homo Sapiens
FRDKNEDMH

SEQ ID NO: 476050 - protein, 9 aa, Homo Sapiens
MGSTCPSRH

SEQ ID NO: 476051 - protein, 9 aa, Homo Sapiens
RGAGTATAT

SEQ ID NO: 476052 - protein, 9 aa, Homo Sapiens
QHVAKETAG

SEQ ID NO: 476053 - protein, 9 aa, Homo Sapiens
QQELQRELD

SEQ ID NO: 476054 - protein, 9 aa, Homo Sapiens
SCSIDVTVF

SEQ ID NO: 476055 - protein, 9 aa, Homo Sapiens
NGPCEIRKL

SEQ ID NO: 476056 - protein, 9 aa, Homo Sapiens
SSLSPTIRP

SEQ ID NO: 476057 - protein, 9 aa, Homo Sapiens
CICGFTHDL

SEQ ID NO: 476058 - protein, 9 aa, Homo Sapiens
AHERLDWAA

SEQ ID NO: 476059 - protein, 9 aa, Homo Sapiens
KTSQGTPVC

SEQ ID NO: 476060 - protein, 9 aa, Homo Sapiens
TTLLVTASP

SEQ ID NO: 476061 - protein, 9 aa, Homo Sapiens
QNIPPVNTN

SEQ ID NO: 476062 - protein, 9 aa, Homo Sapiens
GNYLCIANN

SEQ ID NO: 476063 - protein, 9 aa, Homo Sapiens
NILAMLCNE

SEQ ID NO: 476064 - protein, 9 aa, Homo Sapiens
LIFYTQGIS

SEQ ID NO: 476065 - protein, 9 aa, Homo Sapiens
ARRPRRGPG

SEQ ID NO: 476066 - protein, 9 aa, Homo Sapiens
MKRQDQIED

SEQ ID NO: 476067 - protein, 9 aa, Homo Sapiens
RCERCPRDT

SEQ ID NO: 476068 - protein, 9 aa, Homo Sapiens
MAAKIEGSD

SEQ ID NO: 476069 - protein, 9 aa, Homo Sapiens
SVLVVRHGK

SEQ ID NO: 476070 - protein, 9 aa, Homo Sapiens
PAGIMTVFQ

SEQ ID NO: 476071 - protein, 9 aa, Homo Sapiens
SGDLLPPFA

SEQ ID NO: 476072 - protein, 9 aa, Homo Sapiens
LRCYPPQGV

SEQ ID NO: 476073 - protein, 9 aa, Homo Sapiens
FTKRESPTG

SEQ ID NO: 476074 - protein, 9 aa, Homo Sapiens
KEEQDPVKA

SEQ ID NO: 476075 - protein, 9 aa, Homo Sapiens
CGHAGGPVS

SEQ ID NO: 476076 - protein, 9 aa, Homo Sapiens
DFHMVTNES

SEQ ID NO: 476077 - protein, 9 aa, Homo Sapiens
EENVPAEDI

SEQ ID NO: 476078 - protein, 9 aa, Homo Sapiens
CHIKHDPVH

SEQ ID NO: 476079 - protein, 9 aa, Homo Sapiens
HESSVVSCD

SEQ ID NO: 476080 - protein, 9 aa, Homo Sapiens
SAQFEGLIT

SEQ ID NO: 476081 - protein, 9 aa, Homo Sapiens
QSPNQQAAL

SEQ ID NO: 476082 - protein, 9 aa, Homo Sapiens
PLSEITKQE

SEQ ID NO: 476083 - protein, 9 aa, Homo Sapiens
NVPAEDIEK

SEQ ID NO: 476084 - protein, 9 aa, Homo Sapiens
SMARNSAAA

SEQ ID NO: 476085 - protein, 9 aa, Homo Sapiens
RHVMMENYS

SEQ ID NO: 476086 - protein, 9 aa, Homo Sapiens
VSGADDYKI

SEQ ID NO: 476087 - protein, 9 aa, Homo Sapiens
LSTLVNSGV

SEQ ID NO: 476088 - protein, 9 aa, Homo Sapiens
YRKFSSASH

SEQ ID NO: 476089 - protein, 9 aa, Homo Sapiens
GGRPWHLPT

SEQ ID NO: 476090 - protein, 9 aa, Homo Sapiens
PHSPLPIAT

SEQ ID NO: 476091 - protein, 9 aa, Homo Sapiens
HGSEQDEDV

SEQ ID NO: 476092 - protein, 9 aa, Homo Sapiens
SHGTLVLDP

SEQ ID NO: 476093 - protein, 9 aa, Homo Sapiens
VAEGGPGCT

SEQ ID NO: 476094 - protein, 9 aa, Homo Sapiens
AFVVAFYNL

SEQ ID NO: 476095 - protein, 9 aa, Homo Sapiens
ANGNVFTTG

SEQ ID NO: 476096 - protein, 9 aa, Homo Sapiens
VTAKGPVNY

SEQ ID NO: 476097 - protein, 9 aa, Homo Sapiens
WWLILIPQK

SEQ ID NO: 476098 - protein, 9 aa, Homo Sapiens
LCIICIVTY

SEQ ID NO: 476099 - protein, 9 aa, Homo Sapiens
VRNAMEETT

SEQ ID NO: 476100 - protein, 9 aa, Homo Sapiens
YDPSHVTRM

SEQ ID NO: 476101 - protein, 9 aa, Homo Sapiens
DYVFHGERS

SEQ ID NO: 476102 - protein, 9 aa, Homo Sapiens
QDAPLEGST

SEQ ID NO: 476103 - protein, 9 aa, Homo Sapiens
GTYVRRNTA

SEQ ID NO: 476104 - protein, 9 aa, Homo Sapiens
HSRTDPMQM

SEQ ID NO: 476105 - protein, 9 aa, Homo Sapiens
YNSEVVNKK

SEQ ID NO: 476106 - protein, 9 aa, Homo Sapiens
PGHPLLSMP

SEQ ID NO: 476107 - protein, 9 aa, Homo Sapiens
KELEIPPQY

SEQ ID NO: 476108 - protein, 9 aa, Homo Sapiens
NFERTILSA

SEQ ID NO: 476109 - protein, 9 aa, Homo Sapiens
VEGIEVVEL

SEQ ID NO: 476110 - protein, 9 aa, Homo Sapiens
EARFQTTSG

SEQ ID NO: 476111 - protein, 9 aa, Homo Sapiens
RSTEPGYLV

SEQ ID NO: 476112 - protein, 9 aa, Homo Sapiens
YCQGKNYNL

SEQ ID NO: 476113 - protein, 9 aa, Homo Sapiens
RKLEGHESS

SEQ ID NO: 476114 - protein, 9 aa, Homo Sapiens
VKLDSASFL

SEQ ID NO: 476115 - protein, 9 aa, Homo Sapiens
QREGKAEAV

SEQ ID NO: 476116 - protein, 9 aa, Homo Sapiens
LYKWEFEKS

SEQ ID NO: 476117 - protein, 9 aa, Homo Sapiens
GLGPALEQS

SEQ ID NO: 476118 - protein, 9 aa, Homo Sapiens
ATPSCSPGT

SEQ ID NO: 476119 - protein, 9 aa, Homo Sapiens
GVREALRQA

SEQ ID NO: 476120 - protein, 9 aa, Homo Sapiens
QGYQYATEH

SEQ ID NO: 476121 - protein, 9 aa, Homo Sapiens
SEEALGPRS

SEQ ID NO: 476122 - protein, 9 aa, Homo Sapiens
TSYYAFSLV

SEQ ID NO: 476123 - protein, 9 aa, Homo Sapiens
STQLKELER

SEQ ID NO: 476124 - protein, 9 aa, Homo Sapiens
KFDAFKDDD

SEQ ID NO: 476125 - protein, 9 aa, Homo Sapiens
PCRMAWPED

SEQ ID NO: 476126 - protein, 9 aa, Homo Sapiens
IKGKSIHLM

SEQ ID NO: 476127 - protein, 9 aa, Homo Sapiens
VTEIACRSF

SEQ ID NO: 476128 - protein, 9 aa, Homo Sapiens
LVVRHGKRV

SEQ ID NO: 476129 - protein, 9 aa, Homo Sapiens
AALDYGRDN

SEQ ID NO: 476130 - protein, 9 aa, Homo Sapiens
HPHHHSHHH

SEQ ID NO: 476131 - protein, 9 aa, Homo Sapiens
GCWNFGFEV

SEQ ID NO: 476132 - protein, 9 aa, Homo Sapiens
GIQSPNQQA

SEQ ID NO: 476133 - protein, 9 aa, Homo Sapiens
TAERPYECS

SEQ ID NO: 476134 - protein, 9 aa, Homo Sapiens
AVARKEEVP

SEQ ID NO: 476135 - protein, 9 aa, Homo Sapiens
ENVPAEDIE

SEQ ID NO: 476136 - protein, 9 aa, Homo Sapiens
IMTNGLCIW

SEQ ID NO: 476137 - protein, 9 aa, Homo Sapiens
APRGQARRP

SEQ ID NO: 476138 - protein, 9 aa, Homo Sapiens
KNKLYAHEV

SEQ ID NO: 476139 - protein, 9 aa, Homo Sapiens
DGGLFPSPL

SEQ ID NO: 476140 - protein, 9 aa, Homo Sapiens
SQEGAKYIQ

SEQ ID NO: 476141 - protein, 9 aa, Homo Sapiens
RQPDQIQEN

SEQ ID NO: 476142 - protein, 9 aa, Homo Sapiens
VLKELCIIC

SEQ ID NO: 476143 - protein, 9 aa, Homo Sapiens
VIVKVSSIR

SEQ ID NO: 476144 - protein, 9 aa, Homo Sapiens
PGAEGGRPW

SEQ ID NO: 476145 - protein, 9 aa, Homo Sapiens
VGAVLHGFH

SEQ ID NO: 476146 - protein, 9 aa, Homo Sapiens
LAQDIVSKL

SEQ ID NO: 476147 - protein, 9 aa, Homo Sapiens
PDGKVWQQA

SEQ ID NO: 476148 - protein, 9 aa, Homo Sapiens
QAMSRFASK

SEQ ID NO: 476149 - protein, 9 aa, Homo Sapiens
AEPSAHLLV

SEQ ID NO: 476150 - protein, 9 aa, Homo Sapiens
MKRNKNDIY

SEQ ID NO: 476151 - protein, 9 aa, Homo Sapiens
GSGNPGPES

SEQ ID NO: 476152 - protein, 9 aa, Homo Sapiens
RSRRETANL

SEQ ID NO: 476153 - protein, 9 aa, Homo Sapiens
VHITEKSFQ

SEQ ID NO: 476154 - protein, 9 aa, Homo Sapiens
DDEEYAGSD

SEQ ID NO: 476155 - protein, 9 aa, Homo Sapiens
GPGARGAGT

SEQ ID NO: 476156 - protein, 9 aa, Homo Sapiens
ERTILSAQV

SEQ ID NO: 476157 - protein, 9 aa, Homo Sapiens
HQLGFEKYY

SEQ ID NO: 476158 - protein, 9 aa, Homo Sapiens
INTPCGRTP

SEQ ID NO: 476159 - protein, 9 aa, Homo Sapiens
AAVPFTNYI

SEQ ID NO: 476160 - protein, 9 aa, Homo Sapiens
AQDIVSKLP

SEQ ID NO: 476161 - protein, 9 aa, Homo Sapiens
IDSDSDKDF

SEQ ID NO: 476162 - protein, 9 aa, Homo Sapiens
WRIMSPTLL

SEQ ID NO: 476163 - protein, 9 aa, Homo Sapiens
EIETILSNK

SEQ ID NO: 476164 - protein, 9 aa, Homo Sapiens
FPCRMAWPE

SEQ ID NO: 476165 - protein, 9 aa, Homo Sapiens
FQTTSGKVL

SEQ ID NO: 476166 - protein, 9 aa, Homo Sapiens
KNFSGPVAD

SEQ ID NO: 476167 - protein, 9 aa, Homo Sapiens
DAVKLDSAS

SEQ ID NO: 476168 - protein, 9 aa, Homo Sapiens
EEVTNLLLE

SEQ ID NO: 476169 - protein, 9 aa, Homo Sapiens
IRSKNSLQY

SEQ ID NO: 476170 - protein, 9 aa, Homo Sapiens
YPDIQMNPY

SEQ ID NO: 476171 - protein, 9 aa, Homo Sapiens
LNHANSDVP

SEQ ID NO: 476172 - protein, 9 aa, Homo Sapiens
EKSSCNSTQ

SEQ ID NO: 476173 - protein, 9 aa, Homo Sapiens
PVEPLSPPL

SEQ ID NO: 476174 - protein, 9 aa, Homo Sapiens
IKSYADKKF

SEQ ID NO: 476175 - protein, 9 aa, Homo Sapiens
ILSLTENSY

SEQ ID NO: 476176 - protein, 9 aa, Homo Sapiens
HHYLINIYR

SEQ ID NO: 476177 - protein, 9 aa, Homo Sapiens
LPGPLPASH

SEQ ID NO: 476178 - protein, 9 aa, Homo Sapiens
NGLGVAEAI

SEQ ID NO: 476179 - protein, 9 aa, Homo Sapiens
RRECPFSSW

SEQ ID NO: 476180 - protein, 9 aa, Homo Sapiens
LSLTENSYN

SEQ ID NO: 476181 - protein, 9 aa, Homo Sapiens
AGNYLCIAN

SEQ ID NO: 476182 - protein, 9 aa, Homo Sapiens
YQYATEHGL

SEQ ID NO: 476183 - protein, 9 aa, Homo Sapiens
DLEISLHSG

SEQ ID NO: 476184 - protein, 9 aa, Homo Sapiens
PGALQGLGR

SEQ ID NO: 476185 - protein, 9 aa, Homo Sapiens
RSLEKLDQG

SEQ ID NO: 476186 - protein, 9 aa, Homo Sapiens
SGARAAAGA

SEQ ID NO: 476187 - protein, 9 aa, Homo Sapiens
LIMESNSDA

SEQ ID NO: 476188 - protein, 9 aa, Homo Sapiens
FSQETPVVL

SEQ ID NO: 476189 - protein, 9 aa, Homo Sapiens
LCQFQYMCS

SEQ ID NO: 476190 - protein, 9 aa, Homo Sapiens
THSGARAAA

SEQ ID NO: 476191 - protein, 9 aa, Homo Sapiens
LKQEVHITE

SEQ ID NO: 476192 - protein, 9 aa, Homo Sapiens
KNLKDYDPL

SEQ ID NO: 476193 - protein, 9 aa, Homo Sapiens
LGNSFRRQS

SEQ ID NO: 476194 - protein, 9 aa, Homo Sapiens
NEKCGKQFS

SEQ ID NO: 476195 - protein, 9 aa, Homo Sapiens
FQYVTSNRW

SEQ ID NO: 476196 - protein, 9 aa, Homo Sapiens
CCCVSSSRK

SEQ ID NO: 476197 - protein, 9 aa, Homo Sapiens
PQNNIMRTI

SEQ ID NO: 476198 - protein, 9 aa, Homo Sapiens
RHNEGQGVG

SEQ ID NO: 476199 - protein, 9 aa, Homo Sapiens
VVRYTPQVL

SEQ ID NO: 476200 - protein, 9 aa, Homo Sapiens
PLCVDALQD

SEQ ID NO: 476201 - protein, 9 aa, Homo Sapiens
RQRRLSGAS

SEQ ID NO: 476202 - protein, 9 aa, Homo Sapiens
VNREDSNEQ

SEQ ID NO: 476203 - protein, 9 aa, Homo Sapiens
INILAMLCN

SEQ ID NO: 476204 - protein, 9 aa, Homo Sapiens
QQKEVQISH

SEQ ID NO: 476205 - protein, 9 aa, Homo Sapiens
HVAKETAGF

SEQ ID NO: 476206 - protein, 9 aa, Homo Sapiens
AFYNLSDST

SEQ ID NO: 476207 - protein, 9 aa, Homo Sapiens
RKLRAARGA

SEQ ID NO: 476208 - protein, 9 aa, Homo Sapiens
PAEAESKKE

SEQ ID NO: 476209 - protein, 9 aa, Homo Sapiens
KRNKNDIYG

SEQ ID NO: 476210 - protein, 9 aa, Homo Sapiens
GSLHIQGLS

SEQ ID NO: 476211 - protein, 9 aa, Homo Sapiens
QLEAHERLD

SEQ ID NO: 476212 - protein, 9 aa, Homo Sapiens
VRRRYLANS

SEQ ID NO: 476213 - protein, 9 aa, Homo Sapiens
ALADLREEL

SEQ ID NO: 476214 - protein, 9 aa, Homo Sapiens
QIEDEPEQF

SEQ ID NO: 476215 - protein, 9 aa, Homo Sapiens
ASIQGELSG

SEQ ID NO: 476216 - protein, 9 aa, Homo Sapiens
GAIAKNKLA

SEQ ID NO: 476217 - protein, 9 aa, Homo Sapiens
ATTNLSERH

SEQ ID NO: 476218 - protein, 9 aa, Homo Sapiens
EVTLMNTSK

SEQ ID NO: 476219 - protein, 9 aa, Homo Sapiens
QERINYCHL

SEQ ID NO: 476220 - protein, 9 aa, Homo Sapiens
SLNPQERIN

SEQ ID NO: 476221 - protein, 9 aa, Homo Sapiens
DSGQHPDIN

SEQ ID NO: 476222 - protein, 9 aa, Homo Sapiens
CAESLNHAN

SEQ ID NO: 476223 - protein, 9 aa, Homo Sapiens
SAFTPQEEQ

SEQ ID NO: 476224 - protein, 9 aa, Homo Sapiens
LFVSGADDY

SEQ ID NO: 476225 - protein, 9 aa, Homo Sapiens
KCGKQFSEF

SEQ ID NO: 476226 - protein, 9 aa, Homo Sapiens
PHEGSSYCS

SEQ ID NO: 476227 - protein, 9 aa, Homo Sapiens
HPWRLLPET

SEQ ID NO: 476228 - protein, 9 aa, Homo Sapiens
RANSLLQET

SEQ ID NO: 476229 - protein, 9 aa, Homo Sapiens
FPVGSNLTS

SEQ ID NO: 476230 - protein, 9 aa, Homo Sapiens
QGEYSGCWN

SEQ ID NO: 476231 - protein, 9 aa, Homo Sapiens
HIQLICCLV

SEQ ID NO: 476232 - protein, 9 aa, Homo Sapiens
QVTLLRPDG

SEQ ID NO: 476233 - protein, 9 aa, Homo Sapiens
VLYLWKALA

SEQ ID NO: 476234 - protein, 9 aa, Homo Sapiens
VFALMADKR

SEQ ID NO: 476235 - protein, 9 aa, Homo Sapiens
TDIFSQYLE

SEQ ID NO: 476236 - protein, 9 aa, Homo Sapiens
PPLLSLVAS

SEQ ID NO: 476237 - protein, 9 aa, Homo Sapiens
DTDLYNASG

SEQ ID NO: 476238 - protein, 9 aa, Homo Sapiens
QEADRKELN

SEQ ID NO: 476239 - protein, 9 aa, Homo Sapiens
PAPAPSLMD

SEQ ID NO: 476240 - protein, 9 aa, Homo Sapiens
TAGFVARDF

SEQ ID NO: 476241 - protein, 9 aa, Homo Sapiens
QQASNSAHQ

SEQ ID NO: 476242 - protein, 9 aa, Homo Sapiens
HEKPFCCEA

SEQ ID NO: 476243 - protein, 9 aa, Homo Sapiens
GNKSELIME

SEQ ID NO: 476244 - protein, 9 aa, Homo Sapiens
ERLDWAAAQ

SEQ ID NO: 476245 - protein, 9 aa, Homo Sapiens
YSEEALGPR

SEQ ID NO: 476246 - protein, 9 aa, Homo Sapiens
KLQRFPGVM

SEQ ID NO: 476247 - protein, 9 aa, Homo Sapiens
VFMEEPDTK

SEQ ID NO: 476248 - protein, 9 aa, Homo Sapiens
KDLYRHVMM

SEQ ID NO: 476249 - protein, 9 aa, Homo Sapiens
FHALGSTEC

SEQ ID NO: 476250 - protein, 9 aa, Homo Sapiens
STCFLDTRF

SEQ ID NO: 476251 - protein, 9 aa, Homo Sapiens
DIQMNPYPV

SEQ ID NO: 476252 - protein, 9 aa, Homo Sapiens
PKKLGGSAE

SEQ ID NO: 476253 - protein, 9 aa, Homo Sapiens
ANVCISLSI

SEQ ID NO: 476254 - protein, 9 aa, Homo Sapiens
QPHEGSSYC

SEQ ID NO: 476255 - protein, 9 aa, Homo Sapiens
GHESSVVSC

SEQ ID NO: 476256 - protein, 9 aa, Homo Sapiens
ARQAKLTVQ

SEQ ID NO: 476257 - protein, 9 aa, Homo Sapiens
DDETEFKAS

SEQ ID NO: 476258 - protein, 9 aa, Homo Sapiens
YTPQVLEEM

SEQ ID NO: 476259 - protein, 9 aa, Homo Sapiens
QKKLEKKRM

SEQ ID NO: 476260 - protein, 9 aa, Homo Sapiens
HNGILKGYI

SEQ ID NO: 476261 - protein, 9 aa, Homo Sapiens
ADQFRVNTE

SEQ ID NO: 476262 - protein, 9 aa, Homo Sapiens
LLQETKQGN

SEQ ID NO: 476263 - protein, 9 aa, Homo Sapiens
LLGKVTIAH

SEQ ID NO: 476264 - protein, 9 aa, Homo Sapiens
GPESDVLSP

SEQ ID NO: 476265 - protein, 9 aa, Homo Sapiens
QDEDVSDGH

SEQ ID NO: 476266 - protein, 9 aa, Homo Sapiens
QGFNRCERC

SEQ ID NO: 476267 - protein, 9 aa, Homo Sapiens
CQFQYMCSC

SEQ ID NO: 476268 - protein, 9 aa, Homo Sapiens
DQKSLERLF

SEQ ID NO: 476269 - protein, 9 aa, Homo Sapiens
LAALGAPAP

SEQ ID NO: 476270 - protein, 9 aa, Homo Sapiens
KLVVRYTPQ

SEQ ID NO: 476271 - protein, 9 aa, Homo Sapiens
YPKHSLTTR

SEQ ID NO: 476272 - protein, 9 aa, Homo Sapiens
PAIEGAEEI

SEQ ID NO: 476273 - protein, 9 aa, Homo Sapiens
TNHLSKQKD

SEQ ID NO: 476274 - protein, 9 aa, Homo Sapiens
QNLTPKLAY

SEQ ID NO: 476275 - protein, 9 aa, Homo Sapiens
SSGSAFTPQ

SEQ ID NO: 476276 - protein, 9 aa, Homo Sapiens
RIAFKNKLY

SEQ ID NO: 476277 - protein, 9 aa, Homo Sapiens
SPLIPSDYQ

SEQ ID NO: 476278 - protein, 9 aa, Homo Sapiens
TTSPWMFPC

SEQ ID NO: 476279 - protein, 9 aa, Homo Sapiens
LSEKAKEPE

SEQ ID NO: 476280 - protein, 9 aa, Homo Sapiens
QPSTESTPQ

SEQ ID NO: 476281 - protein, 9 aa, Homo Sapiens
KSRKRGMLE

SEQ ID NO: 476282 - protein, 9 aa, Homo Sapiens
KDACVSDES

SEQ ID NO: 476283 - protein, 9 aa, Homo Sapiens
NNSAGSAMG

SEQ ID NO: 476284 - protein, 9 aa, Homo Sapiens
AEDIEKVAN

SEQ ID NO: 476285 - protein, 9 aa, Homo Sapiens
ALEGSRVRQ

SEQ ID NO: 476286 - protein, 9 aa, Homo Sapiens
PEANSVESE

SEQ ID NO: 476287 - protein, 9 aa, Homo Sapiens
ERLYPLIHN

SEQ ID NO: 476288 - protein, 9 aa, Homo Sapiens
AASSEGAKN

SEQ ID NO: 476289 - protein, 9 aa, Homo Sapiens
GSLPANPVK

SEQ ID NO: 476290 - protein, 9 aa, Homo Sapiens
AIAKNKLAE

SEQ ID NO: 476291 - protein, 9 aa, Homo Sapiens
ENLMASDRL

SEQ ID NO: 476292 - protein, 9 aa, Homo Sapiens
KYPDIQMNP

SEQ ID NO: 476293 - protein, 9 aa, Homo Sapiens
LYLNGARWD

SEQ ID NO: 476294 - protein, 9 aa, Homo Sapiens
ATATAPGAE

SEQ ID NO: 476295 - protein, 9 aa, Homo Sapiens
VDDLLQVIL

SEQ ID NO: 476296 - protein, 9 aa, Homo Sapiens
WKGAIFEGF

SEQ ID NO: 476297 - protein, 9 aa, Homo Sapiens
SKTYLVICG

SEQ ID NO: 476298 - protein, 9 aa, Homo Sapiens
AHKERTNQG

SEQ ID NO: 476299 - protein, 9 aa, Homo Sapiens
SEGKAKEDS

SEQ ID NO: 476300 - protein, 9 aa, Homo Sapiens
WPFNLKEIK

SEQ ID NO: 476301 - protein, 9 aa, Homo Sapiens
GAPGGGAAV

SEQ ID NO: 476302 - protein, 9 aa, Homo Sapiens
LFVTQDAEG

SEQ ID NO: 476303 - protein, 9 aa, Homo Sapiens
EEAPLQPGV

SEQ ID NO: 476304 - protein, 9 aa, Homo Sapiens
SFRRQSSTF

SEQ ID NO: 476305 - protein, 9 aa, Homo Sapiens
APAPAGRPA

SEQ ID NO: 476306 - protein, 9 aa, Homo Sapiens
KEEAKRLTT

SEQ ID NO: 476307 - protein, 9 aa, Homo Sapiens
STLPGVGHV

SEQ ID NO: 476308 - protein, 9 aa, Homo Sapiens
IQGELSGDF

SEQ ID NO: 476309 - protein, 9 aa, Homo Sapiens
LMASDRLDT

SEQ ID NO: 476310 - protein, 9 aa, Homo Sapiens
VYHCVHYFE

SEQ ID NO: 476311 - protein, 9 aa, Homo Sapiens
LQEFSKEEQ

SEQ ID NO: 476312 - protein, 9 aa, Homo Sapiens
AKPYMTKQH

SEQ ID NO: 476313 - protein, 9 aa, Homo Sapiens
AVKLMDFQA

SEQ ID NO: 476314 - protein, 9 aa, Homo Sapiens
SYNQLQNIP

SEQ ID NO: 476315 - protein, 9 aa, Homo Sapiens
AKNKLAEAK

SEQ ID NO: 476316 - protein, 9 aa, Homo Sapiens
QTQQHLNNL

SEQ ID NO: 476317 - protein, 9 aa, Homo Sapiens
SKRSLRQLV

SEQ ID NO: 476318 - protein, 9 aa, Homo Sapiens
FQYMCSCLH

SEQ ID NO: 476319 - protein, 9 aa, Homo Sapiens
SPLSVGKSK

SEQ ID NO: 476320 - protein, 9 aa, Homo Sapiens
PASEALAEK

SEQ ID NO: 476321 - protein, 9 aa, Homo Sapiens
SSSAAVQHE

SEQ ID NO: 476322 - protein, 9 aa, Homo Sapiens
ERTRLAKQL

SEQ ID NO: 476323 - protein, 9 aa, Homo Sapiens
LANSGRSHL

SEQ ID NO: 476324 - protein, 9 aa, Homo Sapiens
HPKKLGGSA

SEQ ID NO: 476325 - protein, 9 aa, Homo Sapiens
GARAAAGAP

SEQ ID NO: 476326 - protein, 9 aa, Homo Sapiens
IRLSEGKAK

SEQ ID NO: 476327 - protein, 9 aa, Homo Sapiens
GNSFRRQSS

SEQ ID NO: 476328 - protein, 9 aa, Homo Sapiens
SSPFPVTSL

SEQ ID NO: 476329 - protein, 9 aa, Homo Sapiens
YLANSGRSH

SEQ ID NO: 476330 - protein, 9 aa, Homo Sapiens
QVAEGGPGC

SEQ ID NO: 476331 - protein, 9 aa, Homo Sapiens
ANHSEGQQG

SEQ ID NO: 476332 - protein, 9 aa, Homo Sapiens
QLAALGAPA

SEQ ID NO: 476333 - protein, 9 aa, Homo Sapiens
RSWPFNLKE

SEQ ID NO: 476334 - protein, 9 aa, Homo Sapiens
FHPSNPEHV

SEQ ID NO: 476335 - protein, 9 aa, Homo Sapiens
LASTIPQIP

SEQ ID NO: 476336 - protein, 9 aa, Homo Sapiens
LKELCIICI

SEQ ID NO: 476337 - protein, 9 aa, Homo Sapiens
QFQYMCSCL

SEQ ID NO: 476338 - protein, 9 aa, Homo Sapiens
LADLREELG

SEQ ID NO: 476339 - protein, 9 aa, Homo Sapiens
NTASKDVNI

SEQ ID NO: 476340 - protein, 9 aa, Homo Sapiens
NCGADQFRV

SEQ ID NO: 476341 - protein, 9 aa, Homo Sapiens
NIFENTDQK

SEQ ID NO: 476342 - protein, 9 aa, Homo Sapiens
QVLEEMEAR

SEQ ID NO: 476343 - protein, 9 aa, Homo Sapiens
FLIHLSDRA

SEQ ID NO: 476344 - protein, 9 aa, Homo Sapiens
PYNATLSVR

SEQ ID NO: 476345 - protein, 9 aa, Homo Sapiens
LPAEAESKK

SEQ ID NO: 476346 - protein, 9 aa, Homo Sapiens
VIFPLTVLL

SEQ ID NO: 476347 - protein, 9 aa, Homo Sapiens
RKQEDKVWR

SEQ ID NO: 476348 - protein, 9 aa, Homo Sapiens
SQTQQELQR

SEQ ID NO: 476349 - protein, 9 aa, Homo Sapiens
HCKEMAPAS

SEQ ID NO: 476350 - protein, 9 aa, Homo Sapiens
RRGPGARGA

SEQ ID NO: 476351 - protein, 9 aa, Homo Sapiens
HHSHHHHHH

SEQ ID NO: 476352 - protein, 9 aa, Homo Sapiens
TQQSSQANE

SEQ ID NO: 476353 - protein, 9 aa, Homo Sapiens
EGKHPKKLG

SEQ ID NO: 476354 - protein, 9 aa, Homo Sapiens
VGIQSPNQQ

SEQ ID NO: 476355 - protein, 9 aa, Homo Sapiens
IAVQAQEIL

SEQ ID NO: 476356 - protein, 9 aa, Homo Sapiens
SLFSQETPV

SEQ ID NO: 476357 - protein, 9 aa, Homo Sapiens
MTNGLCIWL

SEQ ID NO: 476358 - protein, 9 aa, Homo Sapiens
AAAGAPGGG

SEQ ID NO: 476359 - protein, 9 aa, Homo Sapiens
ESFAVKLMD

SEQ ID NO: 476360 - protein, 9 aa, Homo Sapiens
GSAQFEGLI

SEQ ID NO: 476361 - protein, 9 aa, Homo Sapiens
PDTKDVAQE

SEQ ID NO: 476362 - protein, 9 aa, Homo Sapiens
VKKESFAVK

SEQ ID NO: 476363 - protein, 9 aa, Homo Sapiens
VVELQLSHV

SEQ ID NO: 476364 - protein, 9 aa, Homo Sapiens
KLTVQVKEG

SEQ ID NO: 476365 - protein, 9 aa, Homo Sapiens
PCCSHRMCR

SEQ ID NO: 476366 - protein, 9 aa, Homo Sapiens
LLSLVASLS

SEQ ID NO: 476367 - protein, 9 aa, Homo Sapiens
TEIACRSFP

SEQ ID NO: 476368 - protein, 9 aa, Homo Sapiens
KQEKDFLWS

SEQ ID NO: 476369 - protein, 9 aa, Homo Sapiens
AIKHYLSIV

SEQ ID NO: 476370 - protein, 9 aa, Homo Sapiens
DIYTHEAGT

SEQ ID NO: 476371 - protein, 9 aa, Homo Sapiens
EVKDACVSD

SEQ ID NO: 476372 - protein, 9 aa, Homo Sapiens
TKRARLLYK

SEQ ID NO: 476373 - protein, 9 aa, Homo Sapiens
KRLTTEEQE

SEQ ID NO: 476374 - protein, 9 aa, Homo Sapiens
ITFEELRDK

SEQ ID NO: 476375 - protein, 9 aa, Homo Sapiens
SGPQLAALG

SEQ ID NO: 476376 - protein, 9 aa, Homo Sapiens
RRSSLSPTI

SEQ ID NO: 476377 - protein, 9 aa, Homo Sapiens
LFPSPLSVG

SEQ ID NO: 476378 - protein, 9 aa, Homo Sapiens
AGTATATAP

SEQ ID NO: 476379 - protein, 9 aa, Homo Sapiens
CCVSSSRKL

SEQ ID NO: 476380 - protein, 9 aa, Homo Sapiens
RRNTAGGGP

SEQ ID NO: 476381 - protein, 9 aa, Homo Sapiens
GPVADLPEG

SEQ ID NO: 476382 - protein, 9 aa, Homo Sapiens
GGSLHIQGL

SEQ ID NO: 476383 - protein, 9 aa, Homo Sapiens
SFDRSIPQN

SEQ ID NO: 476384 - protein, 9 aa, Homo Sapiens
NFDTFPAGI

SEQ ID NO: 476385 - protein, 9 aa, Homo Sapiens
AMLCNENRD

SEQ ID NO: 476386 - protein, 9 aa, Homo Sapiens
FSQYLEKED

SEQ ID NO: 476387 - protein, 9 aa, Homo Sapiens
VIPKVLRKS

SEQ ID NO: 476388 - protein, 9 aa, Homo Sapiens
KERTNQGVI

SEQ ID NO: 476389 - protein, 9 aa, Homo Sapiens
TGYYDLLIS

SEQ ID NO: 476390 - protein, 9 aa, Homo Sapiens
KEGVQVTDH

SEQ ID NO: 476391 - protein, 9 aa, Homo Sapiens
DKWKDIELQ

SEQ ID NO: 476392 - protein, 9 aa, Homo Sapiens
VVEYIGEIC

SEQ ID NO: 476393 - protein, 9 aa, Homo Sapiens
GIRGGTGRT

SEQ ID NO: 476394 - protein, 9 aa, Homo Sapiens
RFRHPLRHH

SEQ ID NO: 476395 - protein, 9 aa, Homo Sapiens
TLMNTSKAQ

SEQ ID NO: 476396 - protein, 9 aa, Homo Sapiens
DRFIAMNRG

SEQ ID NO: 476397 - protein, 9 aa, Homo Sapiens
LAFAVTQCL

SEQ ID NO: 476398 - protein, 9 aa, Homo Sapiens
GAIFEGFKS

SEQ ID NO: 476399 - protein, 9 aa, Homo Sapiens
QRIAFKNKL

SEQ ID NO: 476400 - protein, 9 aa, Homo Sapiens
FMEEPDTKD

SEQ ID NO: 476401 - protein, 9 aa, Homo Sapiens
CPSRHFSSL

SEQ ID NO: 476402 - protein, 9 aa, Homo Sapiens
LPPFASGVY

SEQ ID NO: 476403 - protein, 9 aa, Homo Sapiens
LTTGNLTYS

SEQ ID NO: 476404 - protein, 9 aa, Homo Sapiens
PFLPPCMTI

SEQ ID NO: 476405 - protein, 9 aa, Homo Sapiens
RSFPRSLLT

SEQ ID NO: 476406 - protein, 9 aa, Homo Sapiens
RVRSLEKLD

SEQ ID NO: 476407 - protein, 9 aa, Homo Sapiens
KRSLRQLVE

SEQ ID NO: 476408 - protein, 9 aa, Homo Sapiens
KLGNKSELI

SEQ ID NO: 476409 - protein, 9 aa, Homo Sapiens
QLVQGVQEQ

SEQ ID NO: 476410 - protein, 9 aa, Homo Sapiens
HRGHGSEQD

SEQ ID NO: 476411 - protein, 9 aa, Homo Sapiens
WDLEISLHS

SEQ ID NO: 476412 - protein, 9 aa, Homo Sapiens
VEEPQAAPI

SEQ ID NO: 476413 - protein, 9 aa, Homo Sapiens
FEEPDSCGH

SEQ ID NO: 476414 - protein, 9 aa, Homo Sapiens
NATLSVRQL

SEQ ID NO: 476415 - protein, 9 aa, Homo Sapiens
TVILPESLQ

SEQ ID NO: 476416 - protein, 9 aa, Homo Sapiens
DVTVFPFDQ

SEQ ID NO: 476417 - protein, 9 aa, Homo Sapiens
RPWHLPTRS

SEQ ID NO: 476418 - protein, 9 aa, Homo Sapiens
APAGRPAPA

SEQ ID NO: 476419 - protein, 9 aa, Homo Sapiens
AFKDDDSGD

SEQ ID NO: 476420 - protein, 9 aa, Homo Sapiens
LEQSENEKD

SEQ ID NO: 476421 - protein, 9 aa, Homo Sapiens
AHGGVLPNI

SEQ ID NO: 476422 - protein, 9 aa, Homo Sapiens
WCLSPPALP

SEQ ID NO: 476423 - protein, 9 aa, Homo Sapiens
QGVTGALAT

SEQ ID NO: 476424 - protein, 9 aa, Homo Sapiens
GPQLAALGA

SEQ ID NO: 476425 - protein, 9 aa, Homo Sapiens
RTCTSPMQR

SEQ ID NO: 476426 - protein, 9 aa, Homo Sapiens
CRFGPLVVD

SEQ ID NO: 476427 - protein, 9 aa, Homo Sapiens
IHSLNPKLE

SEQ ID NO: 476428 - protein, 9 aa, Homo Sapiens
RQLIENADE

SEQ ID NO: 476429 - protein, 9 aa, Homo Sapiens
KSELIMESN

SEQ ID NO: 476430 - protein, 9 aa, Homo Sapiens
KKEEAKRLT

SEQ ID NO: 476431 - protein, 9 aa, Homo Sapiens
AVSYTKRPE

SEQ ID NO: 476432 - protein, 9 aa, Homo Sapiens
PMQRSPFSL

SEQ ID NO: 476433 - protein, 9 aa, Homo Sapiens
QAQGESFWS

SEQ ID NO: 476434 - protein, 9 aa, Homo Sapiens
EVVNKKIEE

SEQ ID NO: 476435 - protein, 9 aa, Homo Sapiens
PSSGDSNSY

SEQ ID NO: 476436 - protein, 9 aa, Homo Sapiens
SFAVKLMDF

SEQ ID NO: 476437 - protein, 9 aa, Homo Sapiens
RLDTPMLRS

SEQ ID NO: 476438 - protein, 9 aa, Homo Sapiens
IGREARFQT

SEQ ID NO: 476439 - protein, 9 aa, Homo Sapiens
LQPGVSVGV

SEQ ID NO: 476440 - protein, 9 aa, Homo Sapiens
KMCRAFDSQ

SEQ ID NO: 476441 - protein, 9 aa, Homo Sapiens
GQGEYSGCW

SEQ ID NO: 476442 - protein, 9 aa, Homo Sapiens
HHNGILKGY

SEQ ID NO: 476443 - protein, 9 aa, Homo Sapiens
PRTCTSPMQ

SEQ ID NO: 476444 - protein, 9 aa, Homo Sapiens
SEQDEDVSD

SEQ ID NO: 476445 - protein, 9 aa, Homo Sapiens
PGALADLRE

SEQ ID NO: 476446 - protein, 9 aa, Homo Sapiens
EGEDDEEYA

SEQ ID NO: 476447 - protein, 9 aa, Homo Sapiens
SNGPCEIRK

SEQ ID NO: 476448 - protein, 9 aa, Homo Sapiens
ARGAGTATA

SEQ ID NO: 476449 - protein, 9 aa, Homo Sapiens
GQRDNGVLQ

SEQ ID NO: 476450 - protein, 9 aa, Homo Sapiens
SEFEIKVYY

SEQ ID NO: 476451 - protein, 9 aa, Homo Sapiens
TSQGTPVCR

SEQ ID NO: 476452 - protein, 9 aa, Homo Sapiens
LSSGHKDYV

SEQ ID NO: 476453 - protein, 9 aa, Homo Sapiens
SKGLGPALE

SEQ ID NO: 476454 - protein, 9 aa, Homo Sapiens
LEKSSCNST

SEQ ID NO: 476455 - protein, 9 aa, Homo Sapiens
SSSFSNGPC

SEQ ID NO: 476456 - protein, 9 aa, Homo Sapiens
EEQDPVKAH

SEQ ID NO: 476457 - protein, 9 aa, Homo Sapiens
QEPVVIRNM

SEQ ID NO: 476458 - protein, 9 aa, Homo Sapiens
LNEFKNIPQ

SEQ ID NO: 476459 - protein, 9 aa, Homo Sapiens
HIQGLSPTP

SEQ ID NO: 476460 - protein, 9 aa, Homo Sapiens
ARFRHPLRH

SEQ ID NO: 476461 - protein, 9 aa, Homo Sapiens
PESDVLSPQ

SEQ ID NO: 476462 - protein, 9 aa, Homo Sapiens
VCHSNIYSR

SEQ ID NO: 476463 - protein, 9 aa, Homo Sapiens
DNLALFCLQ

SEQ ID NO: 476464 - protein, 9 aa, Homo Sapiens
KGQLLGLKP

SEQ ID NO: 476465 - protein, 9 aa, Homo Sapiens
LQTRHRIQQ

SEQ ID NO: 476466 - protein, 9 aa, Homo Sapiens
IEGAEEIDS

SEQ ID NO: 476467 - protein, 9 aa, Homo Sapiens
HFLGTEGAA

SEQ ID NO: 476468 - protein, 9 aa, Homo Sapiens
PGPESDVLS

SEQ ID NO: 476469 - protein, 9 aa, Homo Sapiens
SIPQNNIMR

SEQ ID NO: 476470 - protein, 9 aa, Homo Sapiens
DELLQATRN

SEQ ID NO: 476471 - protein, 9 aa, Homo Sapiens
DKNKQTGRF

SEQ ID NO: 476472 - protein, 9 aa, Homo Sapiens
YNQLQNIPP

SEQ ID NO: 476473 - protein, 9 aa, Homo Sapiens
ALGPRSPLD

SEQ ID NO: 476474 - protein, 9 aa, Homo Sapiens
LKNFSGPVA

SEQ ID NO: 476475 - protein, 9 aa, Homo Sapiens
IELQKMKAG

SEQ ID NO: 476476 - protein, 9 aa, Homo Sapiens
AFDSDLAAH

SEQ ID NO: 476477 - protein, 9 aa, Homo Sapiens
PKGLSTLVN

SEQ ID NO: 476478 - protein, 9 aa, Homo Sapiens
DLLPPFASG

SEQ ID NO: 476479 - protein, 9 aa, Homo Sapiens
RRTQAMSRF

SEQ ID NO: 476480 - protein, 9 aa, Homo Sapiens
LIPQKALVG

SEQ ID NO: 476481 - protein, 9 aa, Homo Sapiens
AFHKKDRRA

SEQ ID NO: 476482 - protein, 9 aa, Homo Sapiens
AEGFRGRWF

SEQ ID NO: 476483 - protein, 9 aa, Homo Sapiens
KSYADKKFS

SEQ ID NO: 476484 - protein, 9 aa, Homo Sapiens
LPPCMTILK

SEQ ID NO: 476485 - protein, 9 aa, Homo Sapiens
CNSTQALVA

SEQ ID NO: 476486 - protein, 9 aa, Homo Sapiens
EFEKSEEDP

SEQ ID NO: 476487 - protein, 9 aa, Homo Sapiens
RPRRGPGAR

SEQ ID NO: 476488 - protein, 9 aa, Homo Sapiens
LLLLTTLLV

SEQ ID NO: 476489 - protein, 9 aa, Homo Sapiens
NAMEETTDW

SEQ ID NO: 476490 - protein, 9 aa, Homo Sapiens
EAADKNKQT

SEQ ID NO: 476491 - protein, 9 aa, Homo Sapiens
TPDGKVWQQ

SEQ ID NO: 476492 - protein, 9 aa, Homo Sapiens
EEKMQQEER

SEQ ID NO: 476493 - protein, 9 aa, Homo Sapiens
MIEGPILPS

SEQ ID NO: 476494 - protein, 9 aa, Homo Sapiens
QGRLELQQL

SEQ ID NO: 476495 - protein, 9 aa, Homo Sapiens
INEKCGKQF

SEQ ID NO: 476496 - protein, 9 aa, Homo Sapiens
GFANGLGVA

SEQ ID NO: 476497 - protein, 9 aa, Homo Sapiens
EAPGPLKDK

SEQ ID NO: 476498 - protein, 9 aa, Homo Sapiens
VYSDEYKAL

SEQ ID NO: 476499 - protein, 9 aa, Homo Sapiens
MMEWLVGTH

SEQ ID NO: 476500 - protein, 9 aa, Homo Sapiens
QKMKAGGNA

SEQ ID NO: 476501 - protein, 9 aa, Homo Sapiens
KNADEYNFV

SEQ ID NO: 476502 - protein, 9 aa, Homo Sapiens
LSNKKQSAM

SEQ ID NO: 476503 - protein, 9 aa, Homo Sapiens
NFSGPVADL

SEQ ID NO: 476504 - protein, 9 aa, Homo Sapiens
HHPHPHHHS

SEQ ID NO: 476505 - protein, 9 aa, Homo Sapiens
LWEIVALGG

SEQ ID NO: 476506 - protein, 9 aa, Homo Sapiens
CLVDGEIRG

SEQ ID NO: 476507 - protein, 9 aa, Homo Sapiens
GMRMHLLEK

SEQ ID NO: 476508 - protein, 9 aa, Homo Sapiens
WQPPPESHH

SEQ ID NO: 476509 - protein, 9 aa, Homo Sapiens
PVSFPWIRG

SEQ ID NO: 476510 - protein, 9 aa, Homo Sapiens
EQDPVKAHE

SEQ ID NO: 476511 - protein, 9 aa, Homo Sapiens
TSTSEYCCC

SEQ ID NO: 476512 - protein, 9 aa, Homo Sapiens
GVELAPRST

SEQ ID NO: 476513 - protein, 9 aa, Homo Sapiens
QKSLERLFR

SEQ ID NO: 476514 - protein, 9 aa, Homo Sapiens
ATQQSSQAN

SEQ ID NO: 476515 - protein, 9 aa, Homo Sapiens
LLGAFPVGS

SEQ ID NO: 476516 - protein, 9 aa, Homo Sapiens
LVDGEIRGY

SEQ ID NO: 476517 - protein, 9 aa, Homo Sapiens
IHLMWSQRD

SEQ ID NO: 476518 - protein, 9 aa, Homo Sapiens
SFATLPPPY

SEQ ID NO: 476519 - protein, 9 aa, Homo Sapiens
SLNHANSDV

SEQ ID NO: 476520 - protein, 9 aa, Homo Sapiens
INFERTILS

SEQ ID NO: 476521 - protein, 9 aa, Homo Sapiens
DRLRVTFED

SEQ ID NO: 476522 - protein, 9 aa, Homo Sapiens
KMDSQLHTP

SEQ ID NO: 476523 - protein, 9 aa, Homo Sapiens
GQEIETILS

SEQ ID NO: 476524 - protein, 9 aa, Homo Sapiens
LKSEPYGET

SEQ ID NO: 476525 - protein, 9 aa, Homo Sapiens
ASVDDETEF

SEQ ID NO: 476526 - protein, 9 aa, Homo Sapiens
DADPVKIEN

SEQ ID NO: 476527 - protein, 9 aa, Homo Sapiens
TPKLAYPMA

SEQ ID NO: 476528 - protein, 9 aa, Homo Sapiens
QDSPLVQAL

SEQ ID NO: 476529 - protein, 9 aa, Homo Sapiens
TYSLIKDTI

SEQ ID NO: 476530 - protein, 9 aa, Homo Sapiens
VALVELEAA

SEQ ID NO: 476531 - protein, 9 aa, Homo Sapiens
GIEVVELQL

SEQ ID NO: 476532 - protein, 9 aa, Homo Sapiens
FLANGNVFT

SEQ ID NO: 476533 - protein, 9 aa, Homo Sapiens
CMEQPLQKG

SEQ ID NO: 476534 - protein, 9 aa, Homo Sapiens
NTTQEEEEM

SEQ ID NO: 476535 - protein, 9 aa, Homo Sapiens
SLPRTQSKG

SEQ ID NO: 476536 - protein, 9 aa, Homo Sapiens
EPGHPLLSM

SEQ ID NO: 476537 - protein, 9 aa, Homo Sapiens
VNSGVPEAL

SEQ ID NO: 476538 - protein, 9 aa, Homo Sapiens
GESFWSITS

SEQ ID NO: 476539 - protein, 9 aa, Homo Sapiens
QLCCKRYRE

SEQ ID NO: 476540 - protein, 9 aa, Homo Sapiens
QQKTILQLK

SEQ ID NO: 476541 - protein, 9 aa, Homo Sapiens
PGHIIIAGL

SEQ ID NO: 476542 - protein, 9 aa, Homo Sapiens
QDAEGFRGR

SEQ ID NO: 476543 - protein, 9 aa, Homo Sapiens
PAGRPAPAP

SEQ ID NO: 476544 - protein, 9 aa, Homo Sapiens
GLSRMIEGP

SEQ ID NO: 476545 - protein, 9 aa, Homo Sapiens
TEADLVSQE

SEQ ID NO: 476546 - protein, 9 aa, Homo Sapiens
KEVQISHLK

SEQ ID NO: 476547 - protein, 9 aa, Homo Sapiens
SEPYGETAD

SEQ ID NO: 476548 - protein, 9 aa, Homo Sapiens
LLLSVTGER

SEQ ID NO: 476549 - protein, 9 aa, Homo Sapiens
VFTCSEDGS

SEQ ID NO: 476550 - protein, 9 aa, Homo Sapiens
SIGSSIQLV

SEQ ID NO: 476551 - protein, 9 aa, Homo Sapiens
VTIAHGGVL

SEQ ID NO: 476552 - protein, 9 aa, Homo Sapiens
VIAAPGLAP

SEQ ID NO: 476553 - protein, 9 aa, Homo Sapiens
KSIHLMWSQ

SEQ ID NO: 476554 - protein, 9 aa, Homo Sapiens
PYMTKQHLT

SEQ ID NO: 476555 - protein, 9 aa, Homo Sapiens
KEFTEEVTN

SEQ ID NO: 476556 - protein, 9 aa, Homo Sapiens
SLVASLSAF

SEQ ID NO: 476557 - protein, 9 aa, Homo Sapiens
LLKKHEAFD

SEQ ID NO: 476558 - protein, 9 aa, Homo Sapiens
LYFVLKELC

SEQ ID NO: 476559 - protein, 9 aa, Homo Sapiens
KVTIAHGGV

SEQ ID NO: 476560 - protein, 9 aa, Homo Sapiens
FKAFRRDFH

SEQ ID NO: 476561 - protein, 9 aa, Homo Sapiens
NKQTGRFKP

SEQ ID NO: 476562 - protein, 9 aa, Homo Sapiens
SIAWAGQKG

SEQ ID NO: 476563 - protein, 9 aa, Homo Sapiens
FPRSLLTSP

SEQ ID NO: 476564 - protein, 9 aa, Homo Sapiens
YVFHGERSR

SEQ ID NO: 476565 - protein, 9 aa, Homo Sapiens
LNPKLESST

SEQ ID NO: 476566 - protein, 9 aa, Homo Sapiens
MTPFGSSIQ

SEQ ID NO: 476567 - protein, 9 aa, Homo Sapiens
EVQISHLKA

SEQ ID NO: 476568 - protein, 9 aa, Homo Sapiens
LMNKLQPGC

SEQ ID NO: 476569 - protein, 9 aa, Homo Sapiens
RAEPSAHLL

SEQ ID NO: 476570 - protein, 9 aa, Homo Sapiens
LSKVCILES

SEQ ID NO: 476571 - protein, 9 aa, Homo Sapiens
AKYIQNLQG

SEQ ID NO: 476572 - protein, 9 aa, Homo Sapiens
YVRRNTAGG

SEQ ID NO: 476573 - protein, 9 aa, Homo Sapiens
RGPPGLAPA

SEQ ID NO: 476574 - protein, 9 aa, Homo Sapiens
PLPVGMGYP

SEQ ID NO: 476575 - protein, 9 aa, Homo Sapiens
ESKRSLRQL

SEQ ID NO: 476576 - protein, 9 aa, Homo Sapiens
LGSFLIHLS

SEQ ID NO: 476577 - protein, 9 aa, Homo Sapiens
SDAMPDIMV

SEQ ID NO: 476578 - protein, 9 aa, Homo Sapiens
RRGSFQVTL

SEQ ID NO: 476579 - protein, 9 aa, Homo Sapiens
QPSQLGAES

SEQ ID NO: 476580 - protein, 9 aa, Homo Sapiens
KPTVDRFIA

SEQ ID NO: 476581 - protein, 9 aa, Homo Sapiens
RRANSLLQE

SEQ ID NO: 476582 - protein, 9 aa, Homo Sapiens
RARLLYKSR

SEQ ID NO: 476583 - protein, 9 aa, Homo Sapiens
VVNNPSKHI

SEQ ID NO: 476584 - protein, 9 aa, Homo Sapiens
PGPLKDKGL

SEQ ID NO: 476585 - protein, 9 aa, Homo Sapiens
RMHLLEKTT

SEQ ID NO: 476586 - protein, 9 aa, Homo Sapiens
QVFRRFVWN

SEQ ID NO: 476587 - protein, 9 aa, Homo Sapiens
LKTHHMVAK

SEQ ID NO: 476588 - protein, 9 aa, Homo Sapiens
ELEKRLQKQ

SEQ ID NO: 476589 - protein, 9 aa, Homo Sapiens
IEDEPEQFC

SEQ ID NO: 476590 - protein, 9 aa, Homo Sapiens
RETLQTNWK

SEQ ID NO: 476591 - protein, 9 aa, Homo Sapiens
AEYDPKAKG

SEQ ID NO: 476592 - protein, 9 aa, Homo Sapiens
CSVSPSENS

SEQ ID NO: 476593 - protein, 9 aa, Homo Sapiens
TLSVRQLIE

SEQ ID NO: 476594 - protein, 9 aa, Homo Sapiens
QSLGEELCS

SEQ ID NO: 476595 - protein, 9 aa, Homo Sapiens
DRSIPQNNI

SEQ ID NO: 476596 - protein, 9 aa, Homo Sapiens
FRRQSSTFT

SEQ ID NO: 476597 - protein, 9 aa, Homo Sapiens
AAMPFLPPC

SEQ ID NO: 476598 - protein, 9 aa, Homo Sapiens
QCQLSCLGK

SEQ ID NO: 476599 - protein, 9 aa, Homo Sapiens
SNIYSRKET

SEQ ID NO: 476600 - protein, 9 aa, Homo Sapiens
GHPGSPGDK

SEQ ID NO: 476601 - protein, 9 aa, Homo Sapiens
VGPGEPEPA

SEQ ID NO: 476602 - protein, 9 aa, Homo Sapiens
KDPRFCRKL

SEQ ID NO: 476603 - protein, 9 aa, Homo Sapiens
EHVFTCSED

SEQ ID NO: 476604 - protein, 9 aa, Homo Sapiens
PRSTEPGYL

SEQ ID NO: 476605 - protein, 9 aa, Homo Sapiens
MALGLQGAR

SEQ ID NO: 476606 - protein, 9 aa, Homo Sapiens
LTMASFLHS

SEQ ID NO: 476607 - protein, 9 aa, Homo Sapiens
MSPTLLAEY

SEQ ID NO: 476608 - protein, 9 aa, Homo Sapiens
GCRANKALG

SEQ ID NO: 476609 - protein, 9 aa, Homo Sapiens
WENLGKKIA

SEQ ID NO: 476610 - protein, 9 aa, Homo Sapiens
LGCRANKAL

SEQ ID NO: 476611 - protein, 9 aa, Homo Sapiens
VHENEDEEV

SEQ ID NO: 476612 - protein, 9 aa, Homo Sapiens
GHGSEQDED

SEQ ID NO: 476613 - protein, 9 aa, Homo Sapiens
GSAFTPQEE

SEQ ID NO: 476614 - protein, 9 aa, Homo Sapiens
PFASGVYSD

SEQ ID NO: 476615 - protein, 9 aa, Homo Sapiens
FKVPGFLSK

SEQ ID NO: 476616 - protein, 9 aa, Homo Sapiens
CRMAWPEDH

SEQ ID NO: 476617 - protein, 9 aa, Homo Sapiens
NLKEIKDLL

SEQ ID NO: 476618 - protein, 9 aa, Homo Sapiens
PLLSLVASL

SEQ ID NO: 476619 - protein, 9 aa, Homo Sapiens
PQKQCREHL

SEQ ID NO: 476620 - protein, 9 aa, Homo Sapiens
RNAMEETTD

SEQ ID NO: 476621 - protein, 9 aa, Homo Sapiens
GPVLIGSTS

SEQ ID NO: 476622 - protein, 9 aa, Homo Sapiens
VTDVNNNVP

SEQ ID NO: 476623 - protein, 9 aa, Homo Sapiens
RRQRRLSGA

SEQ ID NO: 476624 - protein, 9 aa, Homo Sapiens
VFMKNSLKD

SEQ ID NO: 476625 - protein, 9 aa, Homo Sapiens
IPQNNIMRT

SEQ ID NO: 476626 - protein, 9 aa, Homo Sapiens
TFEDKEPKE

SEQ ID NO: 476627 - protein, 9 aa, Homo Sapiens
KTRKIPYLT

SEQ ID NO: 476628 - protein, 9 aa, Homo Sapiens
GALADLREE

SEQ ID NO: 476629 - protein, 9 aa, Homo Sapiens
RRYLANSGR

SEQ ID NO: 476630 - protein, 9 aa, Homo Sapiens
IHTEQKSCI

SEQ ID NO: 476631 - protein, 9 aa, Homo Sapiens
EAKRLTTEE

SEQ ID NO: 476632 - protein, 9 aa, Homo Sapiens
VNKKIEEFL

SEQ ID NO: 476633 - protein, 9 aa, Homo Sapiens
GRPWHLPTR

SEQ ID NO: 476634 - protein, 9 aa, Homo Sapiens
YNCTVVEYI

SEQ ID NO: 476635 - protein, 9 aa, Homo Sapiens
EKMQQEERI

SEQ ID NO: 476636 - protein, 9 aa, Homo Sapiens
STEPGHPLL

SEQ ID NO: 476637 - protein, 9 aa, Homo Sapiens
HLEKGQLLG

SEQ ID NO: 476638 - protein, 9 aa, Homo Sapiens
QEGAKYIQN

SEQ ID NO: 476639 - protein, 9 aa, Homo Sapiens
QGTPVCRPG

SEQ ID NO: 476640 - protein, 9 aa, Homo Sapiens
RLPGGHHTV

SEQ ID NO: 476641 - protein, 9 aa, Homo Sapiens
TFKCEATGN

SEQ ID NO: 476642 - protein, 9 aa, Homo Sapiens
KHKVWGSNQ

SEQ ID NO: 476643 - protein, 9 aa, Homo Sapiens
YFVLKELCI

SEQ ID NO: 476644 - protein, 9 aa, Homo Sapiens
EFKNIPQIV

SEQ ID NO: 476645 - protein, 9 aa, Homo Sapiens
TSSSHSDES

SEQ ID NO: 476646 - protein, 9 aa, Homo Sapiens
RQLCCKRYR

SEQ ID NO: 476647 - protein, 9 aa, Homo Sapiens
ASEALAEKY

SEQ ID NO: 476648 - protein, 9 aa, Homo Sapiens
WTTTAKIHL

SEQ ID NO: 476649 - protein, 9 aa, Homo Sapiens
KQFKAFRRD

SEQ ID NO: 476650 - protein, 9 aa, Homo Sapiens
QELILMKFM

SEQ ID NO: 476651 - protein, 9 aa, Homo Sapiens
PDSVLDHLF

SEQ ID NO: 476652 - protein, 9 aa, Homo Sapiens
PLLACPFPT

SEQ ID NO: 476653 - protein, 9 aa, Homo Sapiens
ILKYFQYVT

SEQ ID NO: 476654 - protein, 9 aa, Homo Sapiens
PIYSEEALG

SEQ ID NO: 476655 - protein, 9 aa, Homo Sapiens
AALGAPAPE

SEQ ID NO: 476656 - protein, 9 aa, Homo Sapiens
ILQLKKNLQ

SEQ ID NO: 476657 - protein, 9 aa, Homo Sapiens
IAGLFAIHE

SEQ ID NO: 476658 - protein, 9 aa, Homo Sapiens
KEQYYAATQ

SEQ ID NO: 476659 - protein, 9 aa, Homo Sapiens
YVPAIEGAE

SEQ ID NO: 476660 - protein, 9 aa, Homo Sapiens
FVTQDAEGF

SEQ ID NO: 476661 - protein, 9 aa, Homo Sapiens
YGGRLHIEK

SEQ ID NO: 476662 - protein, 9 aa, Homo Sapiens
QVKGNTASK

SEQ ID NO: 476663 - protein, 9 aa, Homo Sapiens
SHSDESESL

SEQ ID NO: 476664 - protein, 9 aa, Homo Sapiens
CGADQFRVN

SEQ ID NO: 476665 - protein, 9 aa, Homo Sapiens
LRVTFEDKE

SEQ ID NO: 476666 - protein, 9 aa, Homo Sapiens
CIDAVKLDS

SEQ ID NO: 476667 - protein, 9 aa, Homo Sapiens
AAQPAAEAP

SEQ ID NO: 476668 - protein, 9 aa, Homo Sapiens
KAKGRIKHL

SEQ ID NO: 476669 - protein, 9 aa, Homo Sapiens
PVTISSSPF

SEQ ID NO: 476670 - protein, 9 aa, Homo Sapiens
GFTATPSCS

SEQ ID NO: 476671 - protein, 9 aa, Homo Sapiens
STLVNSGVP

SEQ ID NO: 476672 - protein, 9 aa, Homo Sapiens
TLPGVGHVA

SEQ ID NO: 476673 - protein, 9 aa, Homo Sapiens
RIAACEEQI

SEQ ID NO: 476674 - protein, 9 aa, Homo Sapiens
VTVFPFDQQ

SEQ ID NO: 476675 - protein, 9 aa, Homo Sapiens
CLCPFGPSC

SEQ ID NO: 476676 - protein, 9 aa, Homo Sapiens
EENILPPKK

SEQ ID NO: 476677 - protein, 9 aa, Homo Sapiens
ELSPQGPGK

SEQ ID NO: 476678 - protein, 9 aa, Homo Sapiens
DPLSEITKQ

SEQ ID NO: 476679 - protein, 9 aa, Homo Sapiens
YKWEFEKSE

SEQ ID NO: 476680 - protein, 9 aa, Homo Sapiens
MAPASEALA

SEQ ID NO: 476681 - protein, 9 aa, Homo Sapiens
AGFVARDFT

SEQ ID NO: 476682 - protein, 9 aa, Homo Sapiens
VLHGFHDVM

SEQ ID NO: 476683 - protein, 9 aa, Homo Sapiens
HGERSRRET

SEQ ID NO: 476684 - protein, 9 aa, Homo Sapiens
ELIMESNSD

SEQ ID NO: 476685 - protein, 9 aa, Homo Sapiens
VDMMEWLVG

SEQ ID NO: 476686 - protein, 9 aa, Homo Sapiens
LQPKGYQLN

SEQ ID NO: 476687 - protein, 9 aa, Homo Sapiens
AKAELEQNL

SEQ ID NO: 476688 - protein, 9 aa, Homo Sapiens
TKQHLTKFI

SEQ ID NO: 476689 - protein, 9 aa, Homo Sapiens
PSLLQDSPL

SEQ ID NO: 476690 - protein, 9 aa, Homo Sapiens
TQQHLNNLM

SEQ ID NO: 476691 - protein, 9 aa, Homo Sapiens
TQADSSFAT

SEQ ID NO: 476692 - protein, 9 aa, Homo Sapiens
TILSNKKQS

SEQ ID NO: 476693 - protein, 9 aa, Homo Sapiens
FYNTDLLEY

SEQ ID NO: 476694 - protein, 9 aa, Homo Sapiens
KRCQRRLQD

SEQ ID NO: 476695 - protein, 9 aa, Homo Sapiens
NQQAALARH

SEQ ID NO: 476696 - protein, 9 aa, Homo Sapiens
EGIEVVELQ

SEQ ID NO: 476697 - protein, 9 aa, Homo Sapiens
FSSWRFPGL

SEQ ID NO: 476698 - protein, 9 aa, Homo Sapiens
QALLCGQDG

SEQ ID NO: 476699 - protein, 9 aa, Homo Sapiens
KELNHWARR

SEQ ID NO: 476700 - protein, 9 aa, Homo Sapiens
YLNGARWDR

SEQ ID NO: 476701 - protein, 9 aa, Homo Sapiens
PVAAQPAAE

SEQ ID NO: 476702 - protein, 9 aa, Homo Sapiens
QRHQKNHTH

SEQ ID NO: 476703 - protein, 9 aa, Homo Sapiens
QRDNGVLQK

SEQ ID NO: 476704 - protein, 9 aa, Homo Sapiens
KSPLIPSDY

SEQ ID NO: 476705 - protein, 9 aa, Homo Sapiens
HDKDGFSNP

SEQ ID NO: 476706 - protein, 9 aa, Homo Sapiens
NLALFCLQE

SEQ ID NO: 476707 - protein, 9 aa, Homo Sapiens
KHPKKLGGS

SEQ ID NO: 476708 - protein, 9 aa, Homo Sapiens
GSHDMVDGN

SEQ ID NO: 476709 - protein, 9 aa, Homo Sapiens
GSMARNSAA

SEQ ID NO: 476710 - protein, 9 aa, Homo Sapiens
QADSSFATL

SEQ ID NO: 476711 - protein, 9 aa, Homo Sapiens
LCRDWPGFY

SEQ ID NO: 476712 - protein, 9 aa, Homo Sapiens
KRSVVNNPS

SEQ ID NO: 476713 - protein, 9 aa, Homo Sapiens
LESWAERPA

SEQ ID NO: 476714 - protein, 9 aa, Homo Sapiens
DYGRDNLAL

SEQ ID NO: 476715 - protein, 9 aa, Homo Sapiens
EGAATTMGN

SEQ ID NO: 476716 - protein, 9 aa, Homo Sapiens
LARLSTKNA

SEQ ID NO: 476717 - protein, 9 aa, Homo Sapiens
RDPLSEITK

SEQ ID NO: 476718 - protein, 9 aa, Homo Sapiens
HSPLPIATP

SEQ ID NO: 476719 - protein, 9 aa, Homo Sapiens
NTPCGRTPW

SEQ ID NO: 476720 - protein, 9 aa, Homo Sapiens
FLSKVCILE

SEQ ID NO: 476721 - protein, 9 aa, Homo Sapiens
FEVKEDTEC

SEQ ID NO: 476722 - protein, 9 aa, Homo Sapiens
ELLLGAFPV

SEQ ID NO: 476723 - protein, 9 aa, Homo Sapiens
GHKDYVTVQ

SEQ ID NO: 476724 - protein, 9 aa, Homo Sapiens
GRQLCCKRY

SEQ ID NO: 476725 - protein, 9 aa, Homo Sapiens
SEALAEKYQ

SEQ ID NO: 476726 - protein, 9 aa, Homo Sapiens
VLTNVGAVL

SEQ ID NO: 476727 - protein, 9 aa, Homo Sapiens
RKELNHWAR

SEQ ID NO: 476728 - protein, 9 aa, Homo Sapiens
LCVDALQDV

SEQ ID NO: 476729 - protein, 9 aa, Homo Sapiens
KFVDDLLQV

SEQ ID NO: 476730 - protein, 9 aa, Homo Sapiens
EIQKLRAKI

SEQ ID NO: 476731 - protein, 9 aa, Homo Sapiens
RECLHMLQC

SEQ ID NO: 476732 - protein, 9 aa, Homo Sapiens
NNPPVNSLS

SEQ ID NO: 476733 - protein, 9 aa, Homo Sapiens
RVNTEGSYE

SEQ ID NO: 476734 - protein, 9 aa, Homo Sapiens
VRQQVAEGG

SEQ ID NO: 476735 - protein, 9 aa, Homo Sapiens
VEYIGEICR

SEQ ID NO: 476736 - protein, 9 aa, Homo Sapiens
GNTASKDVN

SEQ ID NO: 476737 - protein, 9 aa, Homo Sapiens
LQSLGEELC

SEQ ID NO: 476738 - protein, 9 aa, Homo Sapiens
KEIKDLLPE

SEQ ID NO: 476739 - protein, 9 aa, Homo Sapiens
PDLLLSVTG

SEQ ID NO: 476740 - protein, 9 aa, Homo Sapiens
RTWKGAIFE

SEQ ID NO: 476741 - protein, 9 aa, Homo Sapiens
SPLSSIVFS

SEQ ID NO: 476742 - protein, 9 aa, Homo Sapiens
FTEEVTNLL

SEQ ID NO: 476743 - protein, 9 aa, Homo Sapiens
LQVILSTSR

SEQ ID NO: 476744 - protein, 9 aa, Homo Sapiens
QAFLSADER

SEQ ID NO: 476745 - protein, 9 aa, Homo Sapiens
LPRAEPSAH

SEQ ID NO: 476746 - protein, 9 aa, Homo Sapiens
KRARLLYKS

SEQ ID NO: 476747 - protein, 9 aa, Homo Sapiens
CGRTPWSQG

SEQ ID NO: 476748 - protein, 9 aa, Homo Sapiens
TKHKWRIMS

SEQ ID NO: 476749 - protein, 9 aa, Homo Sapiens
KGLGPALEQ

SEQ ID NO: 476750 - protein, 9 aa, Homo Sapiens
NKSELIMES

SEQ ID NO: 476751 - protein, 9 aa, Homo Sapiens
QAKLTVQVK

SEQ ID NO: 476752 - protein, 9 aa, Homo Sapiens
EANHSEGQQ

SEQ ID NO: 476753 - protein, 9 aa, Homo Sapiens
LPGIRGGTG

SEQ ID NO: 476754 - protein, 9 aa, Homo Sapiens
TESTPQHSS

SEQ ID NO: 476755 - protein, 9 aa, Homo Sapiens
FAVTSRRSM

SEQ ID NO: 476756 - protein, 9 aa, Homo Sapiens
KLEGHESSV

SEQ ID NO: 476757 - protein, 9 aa, Homo Sapiens
IVRRRYLAN

SEQ ID NO: 476758 - protein, 9 aa, Homo Sapiens
FPWIRGPAP

SEQ ID NO: 476759 - protein, 9 aa, Homo Sapiens
NKLAEAKYK

SEQ ID NO: 476760 - protein, 9 aa, Homo Sapiens
CPFSSWRFP

SEQ ID NO: 476761 - protein, 9 aa, Homo Sapiens
VQVTDHRFF

SEQ ID NO: 476762 - protein, 9 aa, Homo Sapiens
NIYSRKETI

SEQ ID NO: 476763 - protein, 9 aa, Homo Sapiens
SESPSPGRQ

SEQ ID NO: 476764 - protein, 9 aa, Homo Sapiens
VHQQIHTEQ

SEQ ID NO: 476765 - protein, 9 aa, Homo Sapiens
AGLFAIHEK

SEQ ID NO: 476766 - protein, 9 aa, Homo Sapiens
LHTAERPYE

SEQ ID NO: 476767 - protein, 9 aa, Homo Sapiens
VVFIKMCRA

SEQ ID NO: 476768 - protein, 9 aa, Homo Sapiens
TILQLKKNL

SEQ ID NO: 476769 - protein, 9 aa, Homo Sapiens
ADSSFATLP

SEQ ID NO: 476770 - protein, 9 aa, Homo Sapiens
ESHHNGILK

SEQ ID NO: 476771 - protein, 9 aa, Homo Sapiens
YLTKNPFTW

SEQ ID NO: 476772 - protein, 9 aa, Homo Sapiens
GKVWQQAEF

SEQ ID NO: 476773 - protein, 9 aa, Homo Sapiens
QEVHITEKS

SEQ ID NO: 476774 - protein, 9 aa, Homo Sapiens
TSPMQRSPF

SEQ ID NO: 476775 - protein, 9 aa, Homo Sapiens
TCTSPMQRS

SEQ ID NO: 476776 - protein, 9 aa, Homo Sapiens
KHLWENLGK

SEQ ID NO: 476777 - protein, 9 aa, Homo Sapiens
NSLKDVDQM

SEQ ID NO: 476778 - protein, 9 aa, Homo Sapiens
TTFTSTQLK

SEQ ID NO: 476779 - protein, 9 aa, Homo Sapiens
GADIVLEVP

SEQ ID NO: 476780 - protein, 9 aa, Homo Sapiens
SSSGSAFTP

SEQ ID NO: 476781 - protein, 9 aa, Homo Sapiens
SHPLFGRLV

SEQ ID NO: 476782 - protein, 9 aa, Homo Sapiens
RSLLTSPRT

SEQ ID NO: 476783 - protein, 9 aa, Homo Sapiens
LLVGDSRAQ

SEQ ID NO: 476784 - protein, 9 aa, Homo Sapiens
HVTIWFQNR

SEQ ID NO: 476785 - protein, 9 aa, Homo Sapiens
DERYPAAQY

SEQ ID NO: 476786 - protein, 9 aa, Homo Sapiens
NLGKKIAHR

SEQ ID NO: 476787 - protein, 9 aa, Homo Sapiens
SFVRIRALM

SEQ ID NO: 476788 - protein, 9 aa, Homo Sapiens
QQPLFVSGA

SEQ ID NO: 476789 - protein, 9 aa, Homo Sapiens
IAACEEQIL

SEQ ID NO: 476790 - protein, 9 aa, Homo Sapiens
QLKKNLQLA

SEQ ID NO: 476791 - protein, 9 aa, Homo Sapiens
HILISLLDK

SEQ ID NO: 476792 - protein, 9 aa, Homo Sapiens
ELSLAHVEG

SEQ ID NO: 476793 - protein, 9 aa, Homo Sapiens
SFSNGPCEI

SEQ ID NO: 476794 - protein, 9 aa, Homo Sapiens
ILFVTQDAE

SEQ ID NO: 476795 - protein, 9 aa, Homo Sapiens
HVMMENYSS

SEQ ID NO: 476796 - protein, 9 aa, Homo Sapiens
ESIGSSIQL

SEQ ID NO: 476797 - protein, 9 aa, Homo Sapiens
SLLQETKQG

SEQ ID NO: 476798 - protein, 9 aa, Homo Sapiens
EGVQVTDHR

SEQ ID NO: 476799 - protein, 9 aa, Homo Sapiens
SASHAWSYG

SEQ ID NO: 476800 - protein, 9 aa, Homo Sapiens
YNLSDSTNQ

SEQ ID NO: 476801 - protein, 9 aa, Homo Sapiens
PGIRGGTGR

SEQ ID NO: 476802 - protein, 9 aa, Homo Sapiens
QFRVNTEGS

SEQ ID NO: 476803 - protein, 9 aa, Homo Sapiens
FNNPPVNSL

SEQ ID NO: 476804 - protein, 9 aa, Homo Sapiens
NIESIGSSI

SEQ ID NO: 476805 - protein, 9 aa, Homo Sapiens
LPVGMGYPV

SEQ ID NO: 476806 - protein, 9 aa, Homo Sapiens
CDINILAML

SEQ ID NO: 476807 - protein, 9 aa, Homo Sapiens
ASKAGEGPF

SEQ ID NO: 476808 - protein, 9 aa, Homo Sapiens
FPVTSLLTS

SEQ ID NO: 476809 - protein, 9 aa, Homo Sapiens
IRNALLLLP

SEQ ID NO: 476810 - protein, 9 aa, Homo Sapiens
LSKQKDIEM

SEQ ID NO: 476811 - protein, 9 aa, Homo Sapiens
VFAPLQVFR

SEQ ID NO: 476812 - protein, 9 aa, Homo Sapiens
ELEKSSCNS

SEQ ID NO: 476813 - protein, 9 aa, Homo Sapiens
SDLQAGYFH

SEQ ID NO: 476814 - protein, 9 aa, Homo Sapiens
SKVAAHYCK

SEQ ID NO: 476815 - protein, 9 aa, Homo Sapiens
LGTTCHSKL

SEQ ID NO: 476816 - protein, 9 aa, Homo Sapiens
SGLRCYPPQ

SEQ ID NO: 476817 - protein, 9 aa, Homo Sapiens
HQKNHTHEK

SEQ ID NO: 476818 - protein, 9 aa, Homo Sapiens
AADKNKQTG

SEQ ID NO: 476819 - protein, 9 aa, Homo Sapiens
RLHTAERPY

SEQ ID NO: 476820 - protein, 9 aa, Homo Sapiens
RMATWRKNH

SEQ ID NO: 476821 - protein, 9 aa, Homo Sapiens
IHSLFSQET

SEQ ID NO: 476822 - protein, 9 aa, Homo Sapiens
TGSHDAERH

SEQ ID NO: 476823 - protein, 9 aa, Homo Sapiens
AAMGRVVPM

SEQ ID NO: 476824 - protein, 9 aa, Homo Sapiens
SVKGCLAQV

SEQ ID NO: 476825 - protein, 9 aa, Homo Sapiens
GSFDRSIPQ

SEQ ID NO: 476826 - protein, 9 aa, Homo Sapiens
YPPQGVEKP

SEQ ID NO: 476827 - protein, 9 aa, Homo Sapiens
GVIAYISCS

SEQ ID NO: 476828 - protein, 9 aa, Homo Sapiens
AEKQKLDAQ

SEQ ID NO: 476829 - protein, 9 aa, Homo Sapiens
VFAVTSRRS

SEQ ID NO: 476830 - protein, 9 aa, Homo Sapiens
PYPTDFLGS

SEQ ID NO: 476831 - protein, 9 aa, Homo Sapiens
SDSDKDFEV

SEQ ID NO: 476832 - protein, 9 aa, Homo Sapiens
WQCQLSCLG

SEQ ID NO: 476833 - protein, 9 aa, Homo Sapiens
QKDLYRHVM

SEQ ID NO: 476834 - protein, 9 aa, Homo Sapiens
RKTLLRQHE

SEQ ID NO: 476835 - protein, 9 aa, Homo Sapiens
KKESFAVKL

SEQ ID NO: 476836 - protein, 9 aa, Homo Sapiens
ILRAQLQDD

SEQ ID NO: 476837 - protein, 9 aa, Homo Sapiens
VGAVVFAVT

SEQ ID NO: 476838 - protein, 9 aa, Homo Sapiens
CELDDERYP

SEQ ID NO: 476839 - protein, 9 aa, Homo Sapiens
LKLVRNAME

SEQ ID NO: 476840 - protein, 9 aa, Homo Sapiens
SEGEDDEEY

SEQ ID NO: 476841 - protein, 9 aa, Homo Sapiens
AQEDGPVLI

SEQ ID NO: 476842 - protein, 9 aa, Homo Sapiens
LGTEGAATT

SEQ ID NO: 476843 - protein, 9 aa, Homo Sapiens
TSPGHIIIA

SEQ ID NO: 476844 - protein, 9 aa, Homo Sapiens
CQLSCLGKV

SEQ ID NO: 476845 - protein, 9 aa, Homo Sapiens
PDHEYVLVK

SEQ ID NO: 476846 - protein, 9 aa, Homo Sapiens
DTESCDDLD

SEQ ID NO: 476847 - protein, 9 aa, Homo Sapiens
PLLSMPAMA

SEQ ID NO: 476848 - protein, 9 aa, Homo Sapiens
LESEFEIKV

SEQ ID NO: 476849 - protein, 9 aa, Homo Sapiens
TVNYFTNRG

SEQ ID NO: 476850 - protein, 9 aa, Homo Sapiens
VTNLPCCVT

SEQ ID NO: 476851 - protein, 9 aa, Homo Sapiens
SSYCSRKDC

SEQ ID NO: 476852 - protein, 9 aa, Homo Sapiens
EPQAAPILG

SEQ ID NO: 476853 - protein, 9 aa, Homo Sapiens
SFPRSLLTS

SEQ ID NO: 476854 - protein, 9 aa, Homo Sapiens
QETKQGNLE

SEQ ID NO: 476855 - protein, 9 aa, Homo Sapiens
CSRKDCQMA

SEQ ID NO: 476856 - protein, 9 aa, Homo Sapiens
LAPVYHCVH

SEQ ID NO: 476857 - protein, 9 aa, Homo Sapiens
KVLRKSHSH

SEQ ID NO: 476858 - protein, 9 aa, Homo Sapiens
PFPVTSLLT

SEQ ID NO: 476859 - protein, 9 aa, Homo Sapiens
NGARWDRES

SEQ ID NO: 476860 - protein, 9 aa, Homo Sapiens
CGVPEESAL

SEQ ID NO: 476861 - protein, 9 aa, Homo Sapiens
GSAASSEGA

SEQ ID NO: 476862 - protein, 9 aa, Homo Sapiens
LMDVKTCNK

SEQ ID NO: 476863 - protein, 9 aa, Homo Sapiens
QVEGIEVVE

SEQ ID NO: 476864 - protein, 9 aa, Homo Sapiens
FLGSLPANP

SEQ ID NO: 476865 - protein, 9 aa, Homo Sapiens
NFHALGSTE

SEQ ID NO: 476866 - protein, 9 aa, Homo Sapiens
GLAPGSQYG

SEQ ID NO: 476867 - protein, 9 aa, Homo Sapiens
ALEQQVEEI

SEQ ID NO: 476868 - protein, 9 aa, Homo Sapiens
NLVALKQIR

SEQ ID NO: 476869 - protein, 9 aa, Homo Sapiens
ACALDSHGT

SEQ ID NO: 476870 - protein, 9 aa, Homo Sapiens
NMICNFVHE

SEQ ID NO: 476871 - protein, 9 aa, Homo Sapiens
VRESPQLGE

SEQ ID NO: 476872 - protein, 9 aa, Homo Sapiens
RKALQVKGN

SEQ ID NO: 476873 - protein, 9 aa, Homo Sapiens
KWDLEISLH

SEQ ID NO: 476874 - protein, 9 aa, Homo Sapiens
RVGCSIAWA

SEQ ID NO: 476875 - protein, 9 aa, Homo Sapiens
QGVIEFRSY

SEQ ID NO: 476876 - protein, 9 aa, Homo Sapiens
SHSSSTEPG

SEQ ID NO: 476877 - protein, 9 aa, Homo Sapiens
HPDINSSDK

SEQ ID NO: 476878 - protein, 9 aa, Homo Sapiens
LAKRSVVNN

SEQ ID NO: 476879 - protein, 9 aa, Homo Sapiens
PTDFLGSLP

SEQ ID NO: 476880 - protein, 9 aa, Homo Sapiens
QLYLVGSLS

SEQ ID NO: 476881 - protein, 9 aa, Homo Sapiens
LQRDAPRGQ

SEQ ID NO: 476882 - protein, 9 aa, Homo Sapiens
VGAGAIAKN

SEQ ID NO: 476883 - protein, 9 aa, Homo Sapiens
GVSESPSPG

SEQ ID NO: 476884 - protein, 9 aa, Homo Sapiens
LKDKGLGTP

SEQ ID NO: 476885 - protein, 9 aa, Homo Sapiens
PLQPGVSVG

SEQ ID NO: 476886 - protein, 9 aa, Homo Sapiens
ATVNYFTNR

SEQ ID NO: 476887 - protein, 9 aa, Homo Sapiens
VINFERTIL

SEQ ID NO: 476888 - protein, 9 aa, Homo Sapiens
VRAPQPSQL

SEQ ID NO: 476889 - protein, 9 aa, Homo Sapiens
NVGAVLHGF

SEQ ID NO: 476890 - protein, 9 aa, Homo Sapiens
RTVTFKCEA

SEQ ID NO: 476891 - protein, 9 aa, Homo Sapiens
FHGERSRRE

SEQ ID NO: 476892 - protein, 9 aa, Homo Sapiens
KNKLAEAKY

SEQ ID NO: 476893 - protein, 9 aa, Homo Sapiens
MLCNENRDH

SEQ ID NO: 476894 - protein, 9 aa, Homo Sapiens
TDTSSSHSD

SEQ ID NO: 476895 - protein, 9 aa, Homo Sapiens
RCQEADRKE

SEQ ID NO: 476896 - protein, 9 aa, Homo Sapiens
AKETAGFVA

SEQ ID NO: 476897 - protein, 9 aa, Homo Sapiens
EDSGQHPDI

SEQ ID NO: 476898 - protein, 9 aa, Homo Sapiens
PSCSPGTAL

SEQ ID NO: 476899 - protein, 9 aa, Homo Sapiens
RGTYVRRNT

SEQ ID NO: 476900 - protein, 9 aa, Homo Sapiens
PIFRDKNED

SEQ ID NO: 476901 - protein, 9 aa, Homo Sapiens
AFSLVIIWG

SEQ ID NO: 476902 - protein, 9 aa, Homo Sapiens
STQADSSFA

SEQ ID NO: 476903 - protein, 9 aa, Homo Sapiens
IATVFAPLQ

SEQ ID NO: 476904 - protein, 9 aa, Homo Sapiens
WTHLEKGQL

SEQ ID NO: 476905 - protein, 9 aa, Homo Sapiens
TVFPFDQQN

SEQ ID NO: 476906 - protein, 9 aa, Homo Sapiens
IPLCVDALQ

SEQ ID NO: 476907 - protein, 9 aa, Homo Sapiens
FSNGPCEIR

SEQ ID NO: 476908 - protein, 9 aa, Homo Sapiens
LYNFHALGS

SEQ ID NO: 476909 - protein, 9 aa, Homo Sapiens
MEFAAICIR

SEQ ID NO: 476910 - protein, 9 aa, Homo Sapiens
STAIIWRRG

SEQ ID NO: 476911 - protein, 9 aa, Homo Sapiens
SSTCYSFFP

SEQ ID NO: 476912 - protein, 9 aa, Homo Sapiens
QQVEEIRTQ

SEQ ID NO: 476913 - protein, 9 aa, Homo Sapiens
RNLEQLYLV

SEQ ID NO: 476914 - protein, 9 aa, Homo Sapiens
IFENTDQKS

SEQ ID NO: 476915 - protein, 9 aa, Homo Sapiens
VPVSLPRTQ

SEQ ID NO: 476916 - protein, 9 aa, Homo Sapiens
DTFPAGIMT

SEQ ID NO: 476917 - protein, 9 aa, Homo Sapiens
KRSKAPPHI

SEQ ID NO: 476918 - protein, 9 aa, Homo Sapiens
SLLTSPRTC

SEQ ID NO: 476919 - protein, 9 aa, Homo Sapiens
LVNVTDVNN

SEQ ID NO: 476920 - protein, 9 aa, Homo Sapiens
SMPAMAHFQ

SEQ ID NO: 476921 - protein, 9 aa, Homo Sapiens
SIEKRETLQ

SEQ ID NO: 476922 - protein, 9 aa, Homo Sapiens
PGPLPASHP

SEQ ID NO: 476923 - protein, 9 aa, Homo Sapiens
IPKVLRKSH

SEQ ID NO: 476924 - protein, 9 aa, Homo Sapiens
DSCGHAGGP

SEQ ID NO: 476925 - protein, 9 aa, Homo Sapiens
LPGVGHVAR

SEQ ID NO: 476926 - protein, 9 aa, Homo Sapiens
KNHTHEKPF

SEQ ID NO: 476927 - protein, 9 aa, Homo Sapiens
VQGARQGRL

SEQ ID NO: 476928 - protein, 9 aa, Homo Sapiens
EEQILRYSW

SEQ ID NO: 476929 - protein, 9 aa, Homo Sapiens
QLLGLKPTP

SEQ ID NO: 476930 - protein, 9 aa, Homo Sapiens
LSPTIRPGT

SEQ ID NO: 476931 - protein, 9 aa, Homo Sapiens
QAEFQNMSR

SEQ ID NO: 476932 - protein, 9 aa, Homo Sapiens
PECMVTVVL

SEQ ID NO: 476933 - protein, 9 aa, Homo Sapiens
KYCSSLIWI

SEQ ID NO: 476934 - protein, 9 aa, Homo Sapiens
AVMKFNNPP

SEQ ID NO: 476935 - protein, 9 aa, Homo Sapiens
IPQIPQIPA

SEQ ID NO: 476936 - protein, 9 aa, Homo Sapiens
CFVTPPDYS

SEQ ID NO: 476937 - protein, 9 aa, Homo Sapiens
HLLKSFTDQ

SEQ ID NO: 476938 - protein, 9 aa, Homo Sapiens
DAGQAGRLV

SEQ ID NO: 476939 - protein, 9 aa, Homo Sapiens
ERHVTIWFQ

SEQ ID NO: 476940 - protein, 9 aa, Homo Sapiens
DPGVSESPS

SEQ ID NO: 476941 - protein, 9 aa, Homo Sapiens
VTLMNTSKA

SEQ ID NO: 476942 - protein, 9 aa, Homo Sapiens
KAEAVGAVE

SEQ ID NO: 476943 - protein, 9 aa, Homo Sapiens
HGCALTTGN

SEQ ID NO: 476944 - protein, 9 aa, Homo Sapiens
DMMEWLVGT

SEQ ID NO: 476945 - protein, 9 aa, Homo Sapiens
AVVFAVTSR

SEQ ID NO: 476946 - protein, 9 aa, Homo Sapiens
LVRNAMEET

SEQ ID NO: 476947 - protein, 9 aa, Homo Sapiens
IDRELSPQG

SEQ ID NO: 476948 - protein, 9 aa, Homo Sapiens
SKRAVTKML

SEQ ID NO: 476949 - protein, 9 aa, Homo Sapiens
ICQEDVLRD

SEQ ID NO: 476950 - protein, 9 aa, Homo Sapiens
VRIRALMVS

SEQ ID NO: 476951 - protein, 9 aa, Homo Sapiens
MELSLAHVE

SEQ ID NO: 476952 - protein, 9 aa, Homo Sapiens
HSSSTEPGH

SEQ ID NO: 476953 - protein, 9 aa, Homo Sapiens
EGSSYCSRK

SEQ ID NO: 476954 - protein, 9 aa, Homo Sapiens
RALMVSCNR

SEQ ID NO: 476955 - protein, 9 aa, Homo Sapiens
EKIRKQEDK

SEQ ID NO: 476956 - protein, 9 aa, Homo Sapiens
ILLHEMGAD

SEQ ID NO: 476957 - protein, 9 aa, Homo Sapiens
PCGRTPWSQ

SEQ ID NO: 476958 - protein, 9 aa, Homo Sapiens
FFKNHMRTH

SEQ ID NO: 476959 - protein, 9 aa, Homo Sapiens
PLFVSGADD

SEQ ID NO: 476960 - protein, 9 aa, Homo Sapiens
SSSPFPVTS

SEQ ID NO: 476961 - protein, 9 aa, Homo Sapiens
TNVGAVLHG

SEQ ID NO: 476962 - protein, 9 aa, Homo Sapiens
FAAICIRNA

SEQ ID NO: 476963 - protein, 9 aa, Homo Sapiens
IRGPAPWPG

SEQ ID NO: 476964 - protein, 9 aa, Homo Sapiens
PHVRQPDQI

SEQ ID NO: 476965 - protein, 9 aa, Homo Sapiens
PPPVSFPWI

SEQ ID NO: 476966 - protein, 9 aa, Homo Sapiens
ERSRRETAN

SEQ ID NO: 476967 - protein, 9 aa, Homo Sapiens
RMLRVRSLE

SEQ ID NO: 476968 - protein, 9 aa, Homo Sapiens
VDRFIAMNR

SEQ ID NO: 476969 - protein, 9 aa, Homo Sapiens
VARKEEVPV

SEQ ID NO: 476970 - protein, 9 aa, Homo Sapiens
CRPGWSHSS

SEQ ID NO: 476971 - protein, 9 aa, Homo Sapiens
PLIHNVHTQ

SEQ ID NO: 476972 - protein, 9 aa, Homo Sapiens
IIKGKSIHL

SEQ ID NO: 476973 - protein, 9 aa, Homo Sapiens
GQARRPRRG

SEQ ID NO: 476974 - protein, 9 aa, Homo Sapiens
QTRHRIQQL

SEQ ID NO: 476975 - protein, 9 aa, Homo Sapiens
EMHVNNGWA

SEQ ID NO: 476976 - protein, 9 aa, Homo Sapiens
QKTILQLKK

SEQ ID NO: 476977 - protein, 9 aa, Homo Sapiens
FYTQGISRS

SEQ ID NO: 476978 - protein, 9 aa, Homo Sapiens
APAPSLMDE

SEQ ID NO: 476979 - protein, 9 aa, Homo Sapiens
LRQAFLSAD

SEQ ID NO: 476980 - protein, 9 aa, Homo Sapiens
RDPTRQDAP

SEQ ID NO: 476981 - protein, 9 aa, Homo Sapiens
DIMVKIIGS

SEQ ID NO: 476982 - protein, 9 aa, Homo Sapiens
KPRHLCRQT

SEQ ID NO: 476983 - protein, 9 aa, Homo Sapiens
KEAECAMSE

SEQ ID NO: 476984 - protein, 9 aa, Homo Sapiens
VLVVRHGKR

SEQ ID NO: 476985 - protein, 9 aa, Homo Sapiens
QASNSAHQL

SEQ ID NO: 476986 - protein, 9 aa, Homo Sapiens
QKHKVWGSN

SEQ ID NO: 476987 - protein, 9 aa, Homo Sapiens
SPFSLKKPT

SEQ ID NO: 476988 - protein, 9 aa, Homo Sapiens
KNIESIGSS

SEQ ID NO: 476989 - protein, 9 aa, Homo Sapiens
KDYDPLIHC

SEQ ID NO: 476990 - protein, 9 aa, Homo Sapiens
LYPLIHNVH

SEQ ID NO: 476991 - protein, 9 aa, Homo Sapiens
PHHHSHHHH

SEQ ID NO: 476992 - protein, 9 aa, Homo Sapiens
AGAIAKNKL

SEQ ID NO: 476993 - protein, 9 aa, Homo Sapiens
AAGAPGGGA

SEQ ID NO: 476994 - protein, 9 aa, Homo Sapiens
QIHDRIIQV

SEQ ID NO: 476995 - protein, 9 aa, Homo Sapiens
SIHLMWSQR

SEQ ID NO: 476996 - protein, 9 aa, Homo Sapiens
DIRRVGPGE

SEQ ID NO: 476997 - protein, 9 aa, Homo Sapiens
DPMQMPYGD

SEQ ID NO: 476998 - protein, 9 aa, Homo Sapiens
ENVGSHDMV

SEQ ID NO: 476999 - protein, 9 aa, Homo Sapiens
KLEKKRMEQ

SEQ ID NO: 477000 - protein, 9 aa, Homo Sapiens
HSLNPKLES

SEQ ID NO: 477001 - protein, 9 aa, Homo Sapiens
MNGKEQYYA

SEQ ID NO: 477002 - protein, 9 aa, Homo Sapiens
KHKWRIMSP

SEQ ID NO: 477003 - protein, 9 aa, Homo Sapiens
YDPKAKGRI

SEQ ID NO: 477004 - protein, 9 aa, Homo Sapiens
AERPYECSK

SEQ ID NO: 477005 - protein, 9 aa, Homo Sapiens
LEKKRMEQQ

SEQ ID NO: 477006 - protein, 9 aa, Homo Sapiens
EQQVEEIRT

SEQ ID NO: 477007 - protein, 9 aa, Homo Sapiens
QKQCREHLL

SEQ ID NO: 477008 - protein, 9 aa, Homo Sapiens
QLGELCYQV

SEQ ID NO: 477009 - protein, 9 aa, Homo Sapiens
EDTEVKDAC

SEQ ID NO: 477010 - protein, 9 aa, Homo Sapiens
SGSGNPGPE

SEQ ID NO: 477011 - protein, 9 aa, Homo Sapiens
IKHYLSIVP

SEQ ID NO: 477012 - protein, 9 aa, Homo Sapiens
RGSFQVTLL

SEQ ID NO: 477013 - protein, 9 aa, Homo Sapiens
SSIQLVEVP

SEQ ID NO: 477014 - protein, 9 aa, Homo Sapiens
LGKKIAHRQ

SEQ ID NO: 477015 - protein, 9 aa, Homo Sapiens
VQGVQEQVN

SEQ ID NO: 477016 - protein, 9 aa, Homo Sapiens
CMVTVVLGA

SEQ ID NO: 477017 - protein, 9 aa, Homo Sapiens
PDADPVKIE

SEQ ID NO: 477018 - protein, 9 aa, Homo Sapiens
VTGALATHI

SEQ ID NO: 477019 - protein, 9 aa, Homo Sapiens
GVYDPQQDY

SEQ ID NO: 477020 - protein, 9 aa, Homo Sapiens
GEKPFQCKL

SEQ ID NO: 477021 - protein, 9 aa, Homo Sapiens
GLQGARSTT

SEQ ID NO: 477022 - protein, 9 aa, Homo Sapiens
CKYCSSLIW

SEQ ID NO: 477023 - protein, 9 aa, Homo Sapiens
QIVAVYSRI

SEQ ID NO: 477024 - protein, 9 aa, Homo Sapiens
ENLVALKQI

SEQ ID NO: 477025 - protein, 9 aa, Homo Sapiens
IVFSALDSD

SEQ ID NO: 477026 - protein, 9 aa, Homo Sapiens
FKDDDSGDH

SEQ ID NO: 477027 - protein, 9 aa, Homo Sapiens
VSNGGLQQN

SEQ ID NO: 477028 - protein, 9 aa, Homo Sapiens
QPPPESHHN

SEQ ID NO: 477029 - protein, 9 aa, Homo Sapiens
METEADLVS

SEQ ID NO: 477030 - protein, 9 aa, Homo Sapiens
RARWCLSPP

SEQ ID NO: 477031 - protein, 9 aa, Homo Sapiens
TQCLILVVM

SEQ ID NO: 477032 - protein, 9 aa, Homo Sapiens
FRHPLRHHW

SEQ ID NO: 477033 - protein, 9 aa, Homo Sapiens
RFWQCQLSC

SEQ ID NO: 477034 - protein, 9 aa, Homo Sapiens
IFEGFKSKE

SEQ ID NO: 477035 - protein, 9 aa, Homo Sapiens
SVSSSAAVQ

SEQ ID NO: 477036 - protein, 9 aa, Homo Sapiens
KWEFEKSEE

SEQ ID NO: 477037 - protein, 9 aa, Homo Sapiens
LSKSPLIPS

SEQ ID NO: 477038 - protein, 9 aa, Homo Sapiens
MYFEEPDSC

SEQ ID NO: 477039 - protein, 9 aa, Homo Sapiens
LITLIKMDS

SEQ ID NO: 477040 - protein, 9 aa, Homo Sapiens
CAIKSLSCI

SEQ ID NO: 477041 - protein, 9 aa, Homo Sapiens
AGAPGGGAA

SEQ ID NO: 477042 - protein, 9 aa, Homo Sapiens
LQHVAKETA

SEQ ID NO: 477043 - protein, 9 aa, Homo Sapiens
YHCVHYFEL

SEQ ID NO: 477044 - protein, 9 aa, Homo Sapiens
IQAASKAGE

SEQ ID NO: 477045 - protein, 9 aa, Homo Sapiens
FATVNYFTN

SEQ ID NO: 477046 - protein, 9 aa, Homo Sapiens
NKPMAAKIE

SEQ ID NO: 477047 - protein, 9 aa, Homo Sapiens
LQAGYFHPH

SEQ ID NO: 477048 - protein, 9 aa, Homo Sapiens
RAQSVTNTL

SEQ ID NO: 477049 - protein, 9 aa, Homo Sapiens
DFTKRESPT

SEQ ID NO: 477050 - protein, 9 aa, Homo Sapiens
QQSSQANEA

SEQ ID NO: 477051 - protein, 9 aa, Homo Sapiens
PIEASIQGE

SEQ ID NO: 477052 - protein, 9 aa, Homo Sapiens
IAGCCFIPL

SEQ ID NO: 477053 - protein, 9 aa, Homo Sapiens
EEYAGSDEE

SEQ ID NO: 477054 - protein, 9 aa, Homo Sapiens
SERHVTIWF

SEQ ID NO: 477055 - protein, 9 aa, Homo Sapiens
EAESKKEKA

SEQ ID NO: 477056 - protein, 9 aa, Homo Sapiens
QRPNTTQEE

SEQ ID NO: 477057 - protein, 9 aa, Homo Sapiens
SEILKYFQY

SEQ ID NO: 477058 - protein, 9 aa, Homo Sapiens
RLARFRHPL

SEQ ID NO: 477059 - protein, 9 aa, Homo Sapiens
EIRTQLEEL

SEQ ID NO: 477060 - protein, 9 aa, Homo Sapiens
DKLQRFPGV

SEQ ID NO: 477061 - protein, 9 aa, Homo Sapiens
YFQYVTSNR

SEQ ID NO: 477062 - protein, 9 aa, Homo Sapiens
KVCILESLD

SEQ ID NO: 477063 - protein, 9 aa, Homo Sapiens
ETHSGARAA

SEQ ID NO: 477064 - protein, 9 aa, Homo Sapiens
LCIANNSAG

SEQ ID NO: 477065 - protein, 9 aa, Homo Sapiens
DPASAPDSV

SEQ ID NO: 477066 - protein, 9 aa, Homo Sapiens
QVTDHRFFI

SEQ ID NO: 477067 - protein, 9 aa, Homo Sapiens
DGFANGLGV

SEQ ID NO: 477068 - protein, 9 aa, Homo Sapiens
YAGSDEEGD

SEQ ID NO: 477069 - protein, 9 aa, Homo Sapiens
SVVNNPSKH

SEQ ID NO: 477070 - protein, 9 aa, Homo Sapiens
CCLVDGEIR

SEQ ID NO: 477071 - protein, 9 aa, Homo Sapiens
RYGGRLHIE

SEQ ID NO: 477072 - protein, 9 aa, Homo Sapiens
SLTENSYNY

SEQ ID NO: 477073 - protein, 9 aa, Homo Sapiens
RDQEEKMQQ

SEQ ID NO: 477074 - protein, 9 aa, Homo Sapiens
DKVWRQEEK

SEQ ID NO: 477075 - protein, 9 aa, Homo Sapiens
EYVDMMEWL

SEQ ID NO: 477076 - protein, 9 aa, Homo Sapiens
TCPSRHFSS

SEQ ID NO: 477077 - protein, 9 aa, Homo Sapiens
DMVDGNHRL

SEQ ID NO: 477078 - protein, 9 aa, Homo Sapiens
KLRAARGAA

SEQ ID NO: 477079 - protein, 9 aa, Homo Sapiens
DINSSDKGK

SEQ ID NO: 477080 - protein, 9 aa, Homo Sapiens
SIVFSALDS

SEQ ID NO: 477081 - protein, 9 aa, Homo Sapiens
RNEDATVYV

SEQ ID NO: 477082 - protein, 9 aa, Homo Sapiens
VVAFYNLSD

SEQ ID NO: 477083 - protein, 9 aa, Homo Sapiens
KSEPYGETA

SEQ ID NO: 477084 - protein, 9 aa, Homo Sapiens
EKKRMEQQR

SEQ ID NO: 477085 - protein, 9 aa, Homo Sapiens
TISVKGCLA

SEQ ID NO: 477086 - protein, 9 aa, Homo Sapiens
LLVTASPLV

SEQ ID NO: 477087 - protein, 9 aa, Homo Sapiens
LLSSGHKDY

SEQ ID NO: 477088 - protein, 9 aa, Homo Sapiens
ISIKSYADK

SEQ ID NO: 477089 - protein, 9 aa, Homo Sapiens
NMYHNSEFY

SEQ ID NO: 477090 - protein, 9 aa, Homo Sapiens
SNSAHQLGF

SEQ ID NO: 477091 - protein, 9 aa, Homo Sapiens
RKTISVKGC

SEQ ID NO: 477092 - protein, 9 aa, Homo Sapiens
TVIAAPGLA

SEQ ID NO: 477093 - protein, 9 aa, Homo Sapiens
IIAGLFAIH

SEQ ID NO: 477094 - protein, 9 aa, Homo Sapiens
QRRLSGASS

SEQ ID NO: 477095 - protein, 9 aa, Homo Sapiens
RGHGSEQDE

SEQ ID NO: 477096 - protein, 9 aa, Homo Sapiens
YLSIVPGNV

SEQ ID NO: 477097 - protein, 9 aa, Homo Sapiens
KQKLDAQFQ

SEQ ID NO: 477098 - protein, 9 aa, Homo Sapiens
LCPFGPSCS

SEQ ID NO: 477099 - protein, 9 aa, Homo Sapiens
DAPRGQARR

SEQ ID NO: 477100 - protein, 9 aa, Homo Sapiens
KGCLAQVFF

SEQ ID NO: 477101 - protein, 9 aa, Homo Sapiens
AGRPAPAPS

SEQ ID NO: 477102 - protein, 9 aa, Homo Sapiens
PWRQREGKA

SEQ ID NO: 477103 - protein, 9 aa, Homo Sapiens
SSCSIDVTV

SEQ ID NO: 477104 - protein, 9 aa, Homo Sapiens
RKETIPEEA

SEQ ID NO: 477105 - protein, 9 aa, Homo Sapiens
RHRFWQCQL

SEQ ID NO: 477106 - protein, 9 aa, Homo Sapiens
WCSLGTTCH

SEQ ID NO: 477107 - protein, 9 aa, Homo Sapiens
PQLAALGAP

SEQ ID NO: 477108 - protein, 9 aa, Homo Sapiens
NRRHRRRRR

SEQ ID NO: 477109 - protein, 9 aa, Homo Sapiens
REIQKLRAK

SEQ ID NO: 477110 - protein, 9 aa, Homo Sapiens
RQREGKAEA

SEQ ID NO: 477111 - protein, 9 aa, Homo Sapiens
SHPDLGTKG

SEQ ID NO: 477112 - protein, 9 aa, Homo Sapiens
TADVWAVGC

SEQ ID NO: 477113 - protein, 9 aa, Homo Sapiens
LEGSRVRQV

SEQ ID NO: 477114 - protein, 9 aa, Homo Sapiens
KAFRRDFHM

SEQ ID NO: 477115 - protein, 9 aa, Homo Sapiens
DGPVLIGST

SEQ ID NO: 477116 - protein, 9 aa, Homo Sapiens
TDFLGSLPA

SEQ ID NO: 477117 - protein, 9 aa, Homo Sapiens
EKCQGADIV

SEQ ID NO: 477118 - protein, 9 aa, Homo Sapiens
AQEPVVIRN

SEQ ID NO: 477119 - protein, 9 aa, Homo Sapiens
LIHNVHTQL

SEQ ID NO: 477120 - protein, 9 aa, Homo Sapiens
PNQQAALAR

SEQ ID NO: 477121 - protein, 9 aa, Homo Sapiens
KKLGGSAES

SEQ ID NO: 477122 - protein, 9 aa, Homo Sapiens
NHTHEKPFC

SEQ ID NO: 477123 - protein, 9 aa, Homo Sapiens
KIRKQEDKV

SEQ ID NO: 477124 - protein, 9 aa, Homo Sapiens
RSPHSPLPI

SEQ ID NO: 477125 - protein, 9 aa, Homo Sapiens
EGFFEENIL

SEQ ID NO: 477126 - protein, 9 aa, Homo Sapiens
SAAVQHEQR

SEQ ID NO: 477127 - protein, 9 aa, Homo Sapiens
LPGPLRTGY

SEQ ID NO: 477128 - protein, 9 aa, Homo Sapiens
IRTTFTSTQ

SEQ ID NO: 477129 - protein, 9 aa, Homo Sapiens
LQVFRRFVW

SEQ ID NO: 477130 - protein, 9 aa, Homo Sapiens
QNTSQVSVE

SEQ ID NO: 477131 - protein, 9 aa, Homo Sapiens
VCVVFALMA

SEQ ID NO: 477132 - protein, 9 aa, Homo Sapiens
ATRNAGRRL

SEQ ID NO: 477133 - protein, 9 aa, Homo Sapiens
LSLAHVEGL

SEQ ID NO: 477134 - protein, 9 aa, Homo Sapiens
SIKSYADKK

SEQ ID NO: 477135 - protein, 9 aa, Homo Sapiens
PVNYCQGKN

SEQ ID NO: 477136 - protein, 9 aa, Homo Sapiens
GQLEAHERL

SEQ ID NO: 477137 - protein, 9 aa, Homo Sapiens
PQGPGKEKE

SEQ ID NO: 477138 - protein, 9 aa, Homo Sapiens
KVAAHYCKK

SEQ ID NO: 477139 - protein, 9 aa, Homo Sapiens
LPIATPPSQ

SEQ ID NO: 477140 - protein, 9 aa, Homo Sapiens
MEQPLQKGV

SEQ ID NO: 477141 - protein, 9 aa, Homo Sapiens
VGLSRMIEG

SEQ ID NO: 477142 - protein, 9 aa, Homo Sapiens
CVHYFELLK

SEQ ID NO: 477143 - protein, 9 aa, Homo Sapiens
LFSQETPVV

SEQ ID NO: 477144 - protein, 9 aa, Homo Sapiens
SSWRFPGLL

SEQ ID NO: 477145 - protein, 9 aa, Homo Sapiens
LGAFPVGSN

SEQ ID NO: 477146 - protein, 9 aa, Homo Sapiens
CQGADIVLE

SEQ ID NO: 477147 - protein, 9 aa, Homo Sapiens
KLDAQFQKR

SEQ ID NO: 477148 - protein, 9 aa, Homo Sapiens
LLEENVPAE

SEQ ID NO: 477149 - protein, 9 aa, Homo Sapiens
CNFVHENED

SEQ ID NO: 477150 - protein, 9 aa, Homo Sapiens
GGYTLNPTY

SEQ ID NO: 477151 - protein, 9 aa, Homo Sapiens
LNPTYKEVC

SEQ ID NO: 477152 - protein, 9 aa, Homo Sapiens
ARWCLSPPA

SEQ ID NO: 477153 - protein, 9 aa, Homo Sapiens
MQGFNRCER

SEQ ID NO: 477154 - protein, 9 aa, Homo Sapiens
HGLYLNGAR

SEQ ID NO: 477155 - protein, 9 aa, Homo Sapiens
TGRTGLAGA

SEQ ID NO: 477156 - protein, 9 aa, Homo Sapiens
PESHHNGIL

SEQ ID NO: 477157 - protein, 9 aa, Homo Sapiens
LKEIKDLLP

SEQ ID NO: 477158 - protein, 9 aa, Homo Sapiens
ETSLLWTDL

SEQ ID NO: 477159 - protein, 9 aa, Homo Sapiens
PGVSESPSP

SEQ ID NO: 477160 - protein, 9 aa, Homo Sapiens
PTGCPGTSG

SEQ ID NO: 477161 - protein, 9 aa, Homo Sapiens
EKYPDIQMN

SEQ ID NO: 477162 - protein, 9 aa, Homo Sapiens
TDQKSLERL

SEQ ID NO: 477163 - protein, 9 aa, Homo Sapiens
ANEATTLGI

SEQ ID NO: 477164 - protein, 9 aa, Homo Sapiens
VVSLSTAII

SEQ ID NO: 477165 - protein, 9 aa, Homo Sapiens
GKKRSKAPP

SEQ ID NO: 477166 - protein, 9 aa, Homo Sapiens
SLSTAIIWR

SEQ ID NO: 477167 - protein, 9 aa, Homo Sapiens
STKNADEYN

SEQ ID NO: 477168 - protein, 9 aa, Homo Sapiens
NEFKNIPQI

SEQ ID NO: 477169 - protein, 9 aa, Homo Sapiens
AHFLGTEGA

SEQ ID NO: 477170 - protein, 9 aa, Homo Sapiens
AKRLTTEEQ

SEQ ID NO: 477171 - protein, 9 aa, Homo Sapiens
NRCERCPRD

SEQ ID NO: 477172 - protein, 9 aa, Homo Sapiens
IQVNGRDLS

SEQ ID NO: 477173 - protein, 9 aa, Homo Sapiens
VQISHLKAR

SEQ ID NO: 477174 - protein, 9 aa, Homo Sapiens
CFIPLCVDA

SEQ ID NO: 477175 - protein, 9 aa, Homo Sapiens
YPLIHNVHT

SEQ ID NO: 477176 - protein, 9 aa, Homo Sapiens
SINKPMAAK

SEQ ID NO: 477177 - protein, 9 aa, Homo Sapiens
KESFAVKLM

SEQ ID NO: 477178 - protein, 9 aa, Homo Sapiens
NPGPESDVL

SEQ ID NO: 477179 - protein, 9 aa, Homo Sapiens
NHGCALTTG

SEQ ID NO: 477180 - protein, 9 aa, Homo Sapiens
FSKEEQDPV

SEQ ID NO: 477181 - protein, 9 aa, Homo Sapiens
HYLSIVPGN

SEQ ID NO: 477182 - protein, 9 aa, Homo Sapiens
KETAGFVAR

SEQ ID NO: 477183 - protein, 9 aa, Homo Sapiens
FDFEEMKRN

SEQ ID NO: 477184 - protein, 9 aa, Homo Sapiens
IYHFQAQGE

SEQ ID NO: 477185 - protein, 9 aa, Homo Sapiens
ITCCDTDLY

SEQ ID NO: 477186 - protein, 9 aa, Homo Sapiens
QTTSGKVLD

SEQ ID NO: 477187 - protein, 9 aa, Homo Sapiens
SIDVTVFPF

SEQ ID NO: 477188 - protein, 9 aa, Homo Sapiens
RHRIQQLKQ

SEQ ID NO: 477189 - protein, 9 aa, Homo Sapiens
RLQKQRELE

SEQ ID NO: 477190 - protein, 9 aa, Homo Sapiens
PAGSMARNS

SEQ ID NO: 477191 - protein, 9 aa, Homo Sapiens
MPLVTRNIK

SEQ ID NO: 477192 - protein, 9 aa, Homo Sapiens
DMAQHNLYR

SEQ ID NO: 477193 - protein, 9 aa, Homo Sapiens
TFVLGCRAN

SEQ ID NO: 477194 - protein, 9 aa, Homo Sapiens
RVVSLSTAI

SEQ ID NO: 477195 - protein, 9 aa, Homo Sapiens
GQHPDINSS

SEQ ID NO: 477196 - protein, 9 aa, Homo Sapiens
KDIELQKMK

SEQ ID NO: 477197 - protein, 9 aa, Homo Sapiens
GRAVQGARQ

SEQ ID NO: 477198 - protein, 9 aa, Homo Sapiens
LILIPQKAL

SEQ ID NO: 477199 - protein, 9 aa, Homo Sapiens
GFFEENILP

SEQ ID NO: 477200 - protein, 9 aa, Homo Sapiens
QKLDAQFQK

SEQ ID NO: 477201 - protein, 9 aa, Homo Sapiens
NFVHENEDE

SEQ ID NO: 477202 - protein, 9 aa, Homo Sapiens
STCYSFFPD

SEQ ID NO: 477203 - protein, 9 aa, Homo Sapiens
LVALKQIRL

SEQ ID NO: 477204 - protein, 9 aa, Homo Sapiens
FCFVTPPDY

SEQ ID NO: 477205 - protein, 9 aa, Homo Sapiens
ESKKEKARD

SEQ ID NO: 477206 - protein, 9 aa, Homo Sapiens
QPLSGLPGQ

SEQ ID NO: 477207 - protein, 9 aa, Homo Sapiens
GCALTTGNL

SEQ ID NO: 477208 - protein, 9 aa, Homo Sapiens
QDLKPFHIL

SEQ ID NO: 477209 - protein, 9 aa, Homo Sapiens
FRIQAASKA

SEQ ID NO: 477210 - protein, 9 aa, Homo Sapiens
LTNVGAVLH

SEQ ID NO: 477211 - protein, 9 aa, Homo Sapiens
FAPLQVFRR

SEQ ID NO: 477212 - protein, 9 aa, Homo Sapiens
LTENSYNYS

SEQ ID NO: 477213 - protein, 9 aa, Homo Sapiens
WSLFDGFAN

SEQ ID NO: 477214 - protein, 9 aa, Homo Sapiens
KRQDQIEDE

SEQ ID NO: 477215 - protein, 9 aa, Homo Sapiens
IEKRETLQT

SEQ ID NO: 477216 - protein, 9 aa, Homo Sapiens
AVLHGFHDV

SEQ ID NO: 477217 - protein, 9 aa, Homo Sapiens
ATNRRHRRR

SEQ ID NO: 477218 - protein, 9 aa, Homo Sapiens
LAKQLSSLR

SEQ ID NO: 477219 - protein, 9 aa, Homo Sapiens
PYGETADVW

SEQ ID NO: 477220 - protein, 9 aa, Homo Sapiens
GFCFVTPPD

SEQ ID NO: 477221 - protein, 9 aa, Homo Sapiens
RSIPQNNIM

SEQ ID NO: 477222 - protein, 9 aa, Homo Sapiens
FQAQGESFW

SEQ ID NO: 477223 - protein, 9 aa, Homo Sapiens
WKALANCSF

SEQ ID NO: 477224 - protein, 9 aa, Homo Sapiens
IAIKHYLSI

SEQ ID NO: 477225 - protein, 9 aa, Homo Sapiens
YCKYCSSLI

SEQ ID NO: 477226 - protein, 9 aa, Homo Sapiens
GVQVTDHRF

SEQ ID NO: 477227 - protein, 9 aa, Homo Sapiens
GEGKHPKKL

SEQ ID NO: 477228 - protein, 9 aa, Homo Sapiens
PSAHLLVNL

SEQ ID NO: 477229 - protein, 9 aa, Homo Sapiens
CRSFPRSLL

SEQ ID NO: 477230 - protein, 9 aa, Homo Sapiens
TLQTNWKMV

SEQ ID NO: 477231 - protein, 9 aa, Homo Sapiens
QRKDPRFCR

SEQ ID NO: 477232 - protein, 9 aa, Homo Sapiens
PPQGVEKPL

SEQ ID NO: 477233 - protein, 9 aa, Homo Sapiens
HTHEKPFCC

SEQ ID NO: 477234 - protein, 9 aa, Homo Sapiens
SDKDFEVKE

SEQ ID NO: 477235 - protein, 9 aa, Homo Sapiens
TRNIKPRHL

SEQ ID NO: 477236 - protein, 9 aa, Homo Sapiens
EESGPQLAA

SEQ ID NO: 477237 - protein, 9 aa, Homo Sapiens
VRRNTAGGG

SEQ ID NO: 477238 - protein, 9 aa, Homo Sapiens
VNNGWAMCG

SEQ ID NO: 477239 - protein, 9 aa, Homo Sapiens
INNCIDAVK

SEQ ID NO: 477240 - protein, 9 aa, Homo Sapiens
EPWNLKTHH

SEQ ID NO: 477241 - protein, 9 aa, Homo Sapiens
RAKISSLQR

SEQ ID NO: 477242 - protein, 9 aa, Homo Sapiens
LLWEIVALG

SEQ ID NO: 477243 - protein, 9 aa, Homo Sapiens
PQRGSTCFL

SEQ ID NO: 477244 - protein, 9 aa, Homo Sapiens
KLESSTSLD

SEQ ID NO: 477245 - protein, 9 aa, Homo Sapiens
IQLICCLVD

SEQ ID NO: 477246 - protein, 9 aa, Homo Sapiens
NPEHVFTCS

SEQ ID NO: 477247 - protein, 9 aa, Homo Sapiens
GLRNLEQLY

SEQ ID NO: 477248 - protein, 9 aa, Homo Sapiens
SPEAPGPLK

SEQ ID NO: 477249 - protein, 9 aa, Homo Sapiens
ILIFYTQGI

SEQ ID NO: 477250 - protein, 9 aa, Homo Sapiens
NVGSHDMVD

SEQ ID NO: 477251 - protein, 9 aa, Homo Sapiens
HMLQCLGIP

SEQ ID NO: 477252 - protein, 9 aa, Homo Sapiens
LSVTGERKN

SEQ ID NO: 477253 - protein, 9 aa, Homo Sapiens
TTVLESWAE

SEQ ID NO: 477254 - protein, 9 aa, Homo Sapiens
PSTESTPQH

SEQ ID NO: 477255 - protein, 9 aa, Homo Sapiens
LWENLGKKI

SEQ ID NO: 477256 - protein, 9 aa, Homo Sapiens
MNTSKAQGE

SEQ ID NO: 477257 - protein, 9 aa, Homo Sapiens
EYDPKAKGR

SEQ ID NO: 477258 - protein, 9 aa, Homo Sapiens
GGLQQNTSQ

SEQ ID NO: 477259 - protein, 9 aa, Homo Sapiens
GRGYDPSHV

SEQ ID NO: 477260 - protein, 9 aa, Homo Sapiens
CKPEEMHVN

SEQ ID NO: 477261 - protein, 9 aa, Homo Sapiens
LMQDLKPFH

SEQ ID NO: 477262 - protein, 9 aa, Homo Sapiens
FTPQEEQTK

SEQ ID NO: 477263 - protein, 9 aa, Homo Sapiens
TPQVLEEME

SEQ ID NO: 477264 - protein, 9 aa, Homo Sapiens
DLEKRCQRR

SEQ ID NO: 477265 - protein, 9 aa, Homo Sapiens
TTFVLGCRA

SEQ ID NO: 477266 - protein, 9 aa, Homo Sapiens
LTKNPFTWL

SEQ ID NO: 477267 - protein, 9 aa, Homo Sapiens
TTVILPESL

SEQ ID NO: 477268 - protein, 9 aa, Homo Sapiens
DSNSYFGPY

SEQ ID NO: 477269 - protein, 9 aa, Homo Sapiens
SRAQSVTNT

SEQ ID NO: 477270 - protein, 9 aa, Homo Sapiens
FKCEATGNP

SEQ ID NO: 477271 - protein, 9 aa, Homo Sapiens
VIAYISCSS

SEQ ID NO: 477272 - protein, 9 aa, Homo Sapiens
YHFQAQGES

SEQ ID NO: 477273 - protein, 9 aa, Homo Sapiens
AQGQLYKVL

SEQ ID NO: 477274 - protein, 9 aa, Homo Sapiens
PMQMPYGDV

SEQ ID NO: 477275 - protein, 9 aa, Homo Sapiens
VKDKPTVDR

SEQ ID NO: 477276 - protein, 9 aa, Homo Sapiens
PTGKLPFWT

SEQ ID NO: 477277 - protein, 9 aa, Homo Sapiens
YKVLRAGRP

SEQ ID NO: 477278 - protein, 9 aa, Homo Sapiens
RIQAASKAG

SEQ ID NO: 477279 - protein, 9 aa, Homo Sapiens
LSKNLKDYD

SEQ ID NO: 477280 - protein, 9 aa, Homo Sapiens
SLSICHTFR

SEQ ID NO: 477281 - protein, 9 aa, Homo Sapiens
ALSEKAKEP

SEQ ID NO: 477282 - protein, 9 aa, Homo Sapiens
AFAVTQCLI

SEQ ID NO: 477283 - protein, 9 aa, Homo Sapiens
IVAFVVAFY

SEQ ID NO: 477284 - protein, 9 aa, Homo Sapiens
YVLVKEAEC

SEQ ID NO: 477285 - protein, 9 aa, Homo Sapiens
TAIIWRRGH

SEQ ID NO: 477286 - protein, 9 aa, Homo Sapiens
HSNIYSRKE

SEQ ID NO: 477287 - protein, 9 aa, Homo Sapiens
VNYCQGKNY

SEQ ID NO: 477288 - protein, 9 aa, Homo Sapiens
GPALEQSEN

SEQ ID NO: 477289 - protein, 9 aa, Homo Sapiens
RLHIEKRLR

SEQ ID NO: 477290 - protein, 9 aa, Homo Sapiens
TQRIAFKNK

SEQ ID NO: 477291 - protein, 9 aa, Homo Sapiens
HYLINIYRD

SEQ ID NO: 477292 - protein, 9 aa, Homo Sapiens
LQLKKNLQL

SEQ ID NO: 477293 - protein, 9 aa, Homo Sapiens
CCVTLQPGP

SEQ ID NO: 477294 - protein, 9 aa, Homo Sapiens
TVVEYIGEI

SEQ ID NO: 477295 - protein, 9 aa, Homo Sapiens
EANSVESEQ

SEQ ID NO: 477296 - protein, 9 aa, Homo Sapiens
APRSTEPGY

SEQ ID NO: 477297 - protein, 9 aa, Homo Sapiens
FVLGCRANK

SEQ ID NO: 477298 - protein, 9 aa, Homo Sapiens
GARQGRLEL

SEQ ID NO: 477299 - protein, 9 aa, Homo Sapiens
REHLLKSFT

SEQ ID NO: 477300 - protein, 9 aa, Homo Sapiens
IGSSIQLVE

SEQ ID NO: 477301 - protein, 9 aa, Homo Sapiens
KKRMEQQRS

SEQ ID NO: 477302 - protein, 9 aa, Homo Sapiens
GRLHIEKRL

SEQ ID NO: 477303 - protein, 9 aa, Homo Sapiens
ALTTGNLTY

SEQ ID NO: 477304 - protein, 9 aa, Homo Sapiens
VTRNIKPRH

SEQ ID NO: 477305 - protein, 9 aa, Homo Sapiens
LFDGFANGL

SEQ ID NO: 477306 - protein, 9 aa, Homo Sapiens
SQRKTISVK

SEQ ID NO: 477307 - protein, 9 aa, Homo Sapiens
VRSLEKLDQ

SEQ ID NO: 477308 - protein, 9 aa, Homo Sapiens
PPFASGVYS

SEQ ID NO: 477309 - protein, 9 aa, Homo Sapiens
TYVRRNTAG

SEQ ID NO: 477310 - protein, 9 aa, Homo Sapiens
LLFTRAILQ

SEQ ID NO: 477311 - protein, 9 aa, Homo Sapiens
AHVEGLSVL

SEQ ID NO: 477312 - protein, 9 aa, Homo Sapiens
PTYCKYCSS

SEQ ID NO: 477313 - protein, 9 aa, Homo Sapiens
VPGFLSKRL

SEQ ID NO: 477314 - protein, 9 aa, Homo Sapiens
LLLTTLLVT

SEQ ID NO: 477315 - protein, 9 aa, Homo Sapiens
PAMAHFQWR

SEQ ID NO: 477316 - protein, 9 aa, Homo Sapiens
NIKPRHLCR

SEQ ID NO: 477317 - protein, 9 aa, Homo Sapiens
IAWAGQKGY

SEQ ID NO: 477318 - protein, 9 aa, Homo Sapiens
DKGEKGETG

SEQ ID NO: 477319 - protein, 9 aa, Homo Sapiens
RSKAPPHIF

SEQ ID NO: 477320 - protein, 9 aa, Homo Sapiens
EPECMVTVV

SEQ ID NO: 477321 - protein, 9 aa, Homo Sapiens
GAGAIAKNK

SEQ ID NO: 477322 - protein, 9 aa, Homo Sapiens
KGPVNYCQG

SEQ ID NO: 477323 - protein, 9 aa, Homo Sapiens
MARNSAAAK

SEQ ID NO: 477324 - protein, 9 aa, Homo Sapiens
DRKELNHWA

SEQ ID NO: 477325 - protein, 9 aa, Homo Sapiens
YCTSSKVAA

SEQ ID NO: 477326 - protein, 9 aa, Homo Sapiens
YAFSLVIIW

SEQ ID NO: 477327 - protein, 9 aa, Homo Sapiens
QCKLCHQRS

SEQ ID NO: 477328 - protein, 9 aa, Homo Sapiens
TVNREDSNE

SEQ ID NO: 477329 - protein, 9 aa, Homo Sapiens
QVSVAHFGS

SEQ ID NO: 477330 - protein, 9 aa, Homo Sapiens
PWHLPTRSL

SEQ ID NO: 477331 - protein, 9 aa, Homo Sapiens
HSGARAAAG

SEQ ID NO: 477332 - protein, 9 aa, Homo Sapiens
LEISLHSGH

SEQ ID NO: 477333 - protein, 9 aa, Homo Sapiens
HKERTNQGV

SEQ ID NO: 477334 - protein, 9 aa, Homo Sapiens
FEELRDKLQ

SEQ ID NO: 477335 - protein, 9 aa, Homo Sapiens
IHLSDRATG

SEQ ID NO: 477336 - protein, 9 aa, Homo Sapiens
SSKVAAHYC

SEQ ID NO: 477337 - protein, 9 aa, Homo Sapiens
QRHKEKYPD

SEQ ID NO: 477338 - protein, 9 aa, Homo Sapiens
PWMFPCRMA

SEQ ID NO: 477339 - protein, 9 aa, Homo Sapiens
VCILESLDK

SEQ ID NO: 477340 - protein, 9 aa, Homo Sapiens
LEQLYLVGS

SEQ ID NO: 477341 - protein, 9 aa, Homo Sapiens
NNGWAMCGK

SEQ ID NO: 477342 - protein, 9 aa, Homo Sapiens
LSCITEMQQ

SEQ ID NO: 477343 - protein, 9 aa, Homo Sapiens
ERHNEGQGV

SEQ ID NO: 477344 - protein, 9 aa, Homo Sapiens
TCCDTDLYN

SEQ ID NO: 477345 - protein, 9 aa, Homo Sapiens
AEEKELEIP

SEQ ID NO: 477346 - protein, 9 aa, Homo Sapiens
DHEYVLVKE

SEQ ID NO: 477347 - protein, 9 aa, Homo Sapiens
TANVCISLS

SEQ ID NO: 477348 - protein, 9 aa, Homo Sapiens
EQEFHIRSK

SEQ ID NO: 477349 - protein, 9 aa, Homo Sapiens
VCRPGWSHS

SEQ ID NO: 477350 - protein, 9 aa, Homo Sapiens
DSDKDFEVK

SEQ ID NO: 477351 - protein, 9 aa, Homo Sapiens
KTILQLKKN

SEQ ID NO: 477352 - protein, 9 aa, Homo Sapiens
TEHGLIHTN

SEQ ID NO: 477353 - protein, 9 aa, Homo Sapiens
TEGAATTMG

SEQ ID NO: 477354 - protein, 9 aa, Homo Sapiens
MPFLPPCMT

SEQ ID NO: 477355 - protein, 9 aa, Homo Sapiens
GTIAIKHYL

SEQ ID NO: 477356 - protein, 9 aa, Homo Sapiens
LLPETSLLW

SEQ ID NO: 477357 - protein, 9 aa, Homo Sapiens
DEEAPLQPG

SEQ ID NO: 477358 - protein, 9 aa, Homo Sapiens
CYPPQGVEK

SEQ ID NO: 477359 - protein, 9 aa, Homo Sapiens
TDLLEYKFV

SEQ ID NO: 477360 - protein, 9 aa, Homo Sapiens
EKSEEDPVT

SEQ ID NO: 477361 - protein, 9 aa, Homo Sapiens
YNFHALGST

SEQ ID NO: 477362 - protein, 9 aa, Homo Sapiens
LRMVEYHGL

SEQ ID NO: 477363 - protein, 9 aa, Homo Sapiens
VDDETEFKA

SEQ ID NO: 477364 - protein, 9 aa, Homo Sapiens
EKIRLSEGK

SEQ ID NO: 477365 - protein, 9 aa, Homo Sapiens
GGGAAVGAA

SEQ ID NO: 477366 - protein, 9 aa, Homo Sapiens
QDPVKAHEG

SEQ ID NO: 477367 - protein, 9 aa, Homo Sapiens
PGDTGPKGN

SEQ ID NO: 477368 - protein, 9 aa, Homo Sapiens
LEKGQLLGL

SEQ ID NO: 477369 - protein, 9 aa, Homo Sapiens
DPTRQDAPL

SEQ ID NO: 477370 - protein, 9 aa, Homo Sapiens
FTSTQLKEL

SEQ ID NO: 477371 - protein, 9 aa, Homo Sapiens
TKRESPTGK

SEQ ID NO: 477372 - protein, 9 aa, Homo Sapiens
ALRQAFLSA

SEQ ID NO: 477373 - protein, 9 aa, Homo Sapiens
GPISERNED

SEQ ID NO: 477374 - protein, 9 aa, Homo Sapiens
VAKAELEQN

SEQ ID NO: 477375 - protein, 9 aa, Homo Sapiens
YLRMVEYHG

SEQ ID NO: 477376 - protein, 9 aa, Homo Sapiens
EALGPRSPL

SEQ ID NO: 477377 - protein, 9 aa, Homo Sapiens
ITASFISKT

SEQ ID NO: 477378 - protein, 9 aa, Homo Sapiens
STPHHYLIN

SEQ ID NO: 477379 - protein, 9 aa, Homo Sapiens
QCREHLLKS

SEQ ID NO: 477380 - protein, 9 aa, Homo Sapiens
PSQLGAESP

SEQ ID NO: 477381 - protein, 9 aa, Homo Sapiens
PAEDIEKVA

SEQ ID NO: 477382 - protein, 9 aa, Homo Sapiens
KRETLQTNW

SEQ ID NO: 477383 - protein, 9 aa, Homo Sapiens
NCTVVEYIG

SEQ ID NO: 477384 - protein, 9 aa, Homo Sapiens
HERLDWAAA

SEQ ID NO: 477385 - protein, 9 aa, Homo Sapiens
NKFDAFKDD

SEQ ID NO: 477386 - protein, 9 aa, Homo Sapiens
KVPGFLSKR

SEQ ID NO: 477387 - protein, 9 aa, Homo Sapiens
AGCCFIPLC

SEQ ID NO: 477388 - protein, 9 aa, Homo Sapiens
PRPQRGSTC

SEQ ID NO: 477389 - protein, 9 aa, Homo Sapiens
YLCIANNSA

SEQ ID NO: 477390 - protein, 9 aa, Homo Sapiens
GVIVKVSSI

SEQ ID NO: 477391 - protein, 9 aa, Homo Sapiens
SWPFNLKEI

SEQ ID NO: 477392 - protein, 9 aa, Homo Sapiens
LGTKGCWDQ

SEQ ID NO: 477393 - protein, 9 aa, Homo Sapiens
MSRFASKRR

SEQ ID NO: 477394 - protein, 9 aa, Homo Sapiens
NRGWAWDGK

SEQ ID NO: 477395 - protein, 9 aa, Homo Sapiens
KFNNPPVNS

SEQ ID NO: 477396 - protein, 9 aa, Homo Sapiens
PTVDRFIAM

SEQ ID NO: 477397 - protein, 9 aa, Homo Sapiens
DIEMAQKKM

SEQ ID NO: 477398 - protein, 9 aa, Homo Sapiens
QDYGDESAD

SEQ ID NO: 477399 - protein, 9 aa, Homo Sapiens
YFTNRGWAW

SEQ ID NO: 477400 - protein, 9 aa, Homo Sapiens
SINEKCGKQ

SEQ ID NO: 477401 - protein, 9 aa, Homo Sapiens
KEEVPVSLP

SEQ ID NO: 477402 - protein, 9 aa, Homo Sapiens
GEYSGCWNF

SEQ ID NO: 477403 - protein, 9 aa, Homo Sapiens
ETDTSSSHS

SEQ ID NO: 477404 - protein, 9 aa, Homo Sapiens
IVSKLPRDF

SEQ ID NO: 477405 - protein, 9 aa, Homo Sapiens
IRRVGPGEP

SEQ ID NO: 477406 - protein, 9 aa, Homo Sapiens
ILPESLQRD

SEQ ID NO: 477407 - protein, 9 aa, Homo Sapiens
RVRQVSVAH

SEQ ID NO: 477408 - protein, 9 aa, Homo Sapiens
SPHSPLPIA

SEQ ID NO: 477409 - protein, 9 aa, Homo Sapiens
YADKKFSYS

SEQ ID NO: 477410 - protein, 9 aa, Homo Sapiens
QFENNMYHN

SEQ ID NO: 477411 - protein, 9 aa, Homo Sapiens
VKEAECAMS

SEQ ID NO: 477412 - protein, 9 aa, Homo Sapiens
DRLDTPMLR

SEQ ID NO: 477413 - protein, 9 aa, Homo Sapiens
HPGSPGDKG

SEQ ID NO: 477414 - protein, 9 aa, Homo Sapiens
VACALDSHG

SEQ ID NO: 477415 - protein, 9 aa, Homo Sapiens
VILPESLQR

SEQ ID NO: 477416 - protein, 9 aa, Homo Sapiens
SCNSTQALV

SEQ ID NO: 477417 - protein, 9 aa, Homo Sapiens
LQPGCVPKI

SEQ ID NO: 477418 - protein, 9 aa, Homo Sapiens
ELCIICIVT

SEQ ID NO: 477419 - protein, 9 aa, Homo Sapiens
TRKIPYLTK

SEQ ID NO: 477420 - protein, 9 aa, Homo Sapiens
RRDFHMVTN

SEQ ID NO: 477421 - protein, 9 aa, Homo Sapiens
EEMKRNKND

SEQ ID NO: 477422 - protein, 9 aa, Homo Sapiens
RIRTTFTST

SEQ ID NO: 477423 - protein, 9 aa, Homo Sapiens
RNKNDIYGE

SEQ ID NO: 477424 - protein, 9 aa, Homo Sapiens
FCELDDERY

SEQ ID NO: 477425 - protein, 9 aa, Homo Sapiens
VAQDPDAGQ

SEQ ID NO: 477426 - protein, 9 aa, Homo Sapiens
SGASSAEAP

SEQ ID NO: 477427 - protein, 9 aa, Homo Sapiens
FLSKRLKGS

SEQ ID NO: 477428 - protein, 9 aa, Homo Sapiens
MEEPDTKDV

SEQ ID NO: 477429 - protein, 9 aa, Homo Sapiens
SAHQLGFEK

SEQ ID NO: 477430 - protein, 9 aa, Homo Sapiens
AYISCSSSA

SEQ ID NO: 477431 - protein, 9 aa, Homo Sapiens
LGLITLIKM

SEQ ID NO: 477432 - protein, 9 aa, Homo Sapiens
EAFDSDLAA

SEQ ID NO: 477433 - protein, 9 aa, Homo Sapiens
RPWRQREGK

SEQ ID NO: 477434 - protein, 9 aa, Homo Sapiens
KGNTASKDV

SEQ ID NO: 477435 - protein, 9 aa, Homo Sapiens
ENNMYHNSE

SEQ ID NO: 477436 - protein, 9 aa, Homo Sapiens
IHDRIIQVN

SEQ ID NO: 477437 - protein, 9 aa, Homo Sapiens
NNVPSIDIR

SEQ ID NO: 477438 - protein, 9 aa, Homo Sapiens
YMTKQHLTK

SEQ ID NO: 477439 - protein, 9 aa, Homo Sapiens
FMYTSQYDN

SEQ ID NO: 477440 - protein, 9 aa, Homo Sapiens
AVKEYVDMM

SEQ ID NO: 477441 - protein, 9 aa, Homo Sapiens
AEGGPGCTR

SEQ ID NO: 477442 - protein, 9 aa, Homo Sapiens
SRRETANLE

SEQ ID NO: 477443 - protein, 9 aa, Homo Sapiens
LIKDTIQGA

SEQ ID NO: 477444 - protein, 9 aa, Homo Sapiens
DYDPLIHCV

SEQ ID NO: 477445 - protein, 9 aa, Homo Sapiens
PFGSSIQLT

SEQ ID NO: 477446 - protein, 8 aa, Homo Sapiens
IRCGLACE

SEQ ID NO: 477447 - protein, 9 aa, Homo Sapiens
WHLPTRSLE

SEQ ID NO: 477448 - protein, 9 aa, Homo Sapiens
EVIPKVLRK

SEQ ID NO: 477449 - protein, 9 aa, Homo Sapiens
VHPGGSFTL

SEQ ID NO: 477450 - protein, 9 aa, Homo Sapiens
TSEYCCCVS

SEQ ID NO: 477451 - protein, 9 aa, Homo Sapiens
AAVQHEQRE

SEQ ID NO: 477452 - protein, 9 aa, Homo Sapiens
EVLKILLHE

SEQ ID NO: 477453 - protein, 9 aa, Homo Sapiens
SRFASKRRS

SEQ ID NO: 477454 - protein, 9 aa, Homo Sapiens
HPKSTGKPT

SEQ ID NO: 477455 - protein, 9 aa, Homo Sapiens
EIKVYYDGT

SEQ ID NO: 477456 - protein, 9 aa, Homo Sapiens
LEKTTVRTE

SEQ ID NO: 477457 - protein, 9 aa, Homo Sapiens
EELRDKLQR

SEQ ID NO: 477458 - protein, 9 aa, Homo Sapiens
FFEENILPP

SEQ ID NO: 477459 - protein, 9 aa, Homo Sapiens
KLKRRKLSF

SEQ ID NO: 477460 - protein, 9 aa, Homo Sapiens
GTGRTGLAG

SEQ ID NO: 477461 - protein, 9 aa, Homo Sapiens
ICIRNALLL

SEQ ID NO: 477462 - protein, 9 aa, Homo Sapiens
QQNTSQVSV

SEQ ID NO: 477463 - protein, 9 aa, Homo Sapiens
PWRLLPETS

SEQ ID NO: 477464 - protein, 9 aa, Homo Sapiens
SNGGLQQNT

SEQ ID NO: 477465 - protein, 9 aa, Homo Sapiens
PFSSWRFPG

SEQ ID NO: 477466 - protein, 9 aa, Homo Sapiens
NEQDPQEVT

SEQ ID NO: 477467 - protein, 9 aa, Homo Sapiens
CMTILKLSQ

SEQ ID NO: 477468 - protein, 9 aa, Homo Sapiens
VLKILLHEM

SEQ ID NO: 477469 - protein, 9 aa, Homo Sapiens
PRAEPSAHL

SEQ ID NO: 477470 - protein, 9 aa, Homo Sapiens
NSIHSLFSQ

SEQ ID NO: 477471 - protein, 9 aa, Homo Sapiens
NCKLKRRKL

SEQ ID NO: 477472 - protein, 9 aa, Homo Sapiens
IHNVHTQLA

SEQ ID NO: 477473 - protein, 9 aa, Homo Sapiens
RGSDAMPDI

SEQ ID NO: 477474 - protein, 9 aa, Homo Sapiens
THEKPFCCE

SEQ ID NO: 477475 - protein, 9 aa, Homo Sapiens
GRVVSLSTA

SEQ ID NO: 477476 - protein, 9 aa, Homo Sapiens
TASFISKTY

SEQ ID NO: 477477 - protein, 9 aa, Homo Sapiens
RPNMICNFV

SEQ ID NO: 477478 - protein, 9 aa, Homo Sapiens
RSVVNNPSK

SEQ ID NO: 477479 - protein, 9 aa, Homo Sapiens
EGHESSVVS

SEQ ID NO: 477480 - protein, 9 aa, Homo Sapiens
SFISKTYLV

SEQ ID NO: 477481 - protein, 9 aa, Homo Sapiens
QANEATTLG

SEQ ID NO: 477482 - protein, 9 aa, Homo Sapiens
RGPGARGAG

SEQ ID NO: 477483 - protein, 9 aa, Homo Sapiens
SHLESEFEI

SEQ ID NO: 477484 - protein, 9 aa, Homo Sapiens
NHDKDGFSN

SEQ ID NO: 477485 - protein, 9 aa, Homo Sapiens
PGPLRTGYY

SEQ ID NO: 477486 - protein, 9 aa, Homo Sapiens
CGFCFVTPP

SEQ ID NO: 477487 - protein, 9 aa, Homo Sapiens
GRPAPAPSL

SEQ ID NO: 477488 - protein, 9 aa, Homo Sapiens
KLGEGKHPK

SEQ ID NO: 477489 - protein, 9 aa, Homo Sapiens
WAEYDPKAK

SEQ ID NO: 477490 - protein, 9 aa, Homo Sapiens
CISLSICHT

SEQ ID NO: 477491 - protein, 9 aa, Homo Sapiens
VTKMLQLCG

SEQ ID NO: 477492 - protein, 9 aa, Homo Sapiens
VGCSIAWAG

SEQ ID NO: 477493 - protein, 9 aa, Homo Sapiens
AKEVTLMNT

SEQ ID NO: 477494 - protein, 9 aa, Homo Sapiens
AMPFLPPCM

SEQ ID NO: 477495 - protein, 9 aa, Homo Sapiens
LAPGSQYGT

SEQ ID NO: 477496 - protein, 9 aa, Homo Sapiens
KQIRLEHEE

SEQ ID NO: 477497 - protein, 9 aa, Homo Sapiens
ARAAAGAPG

SEQ ID NO: 477498 - protein, 9 aa, Homo Sapiens
FNLKEIKDL

SEQ ID NO: 477499 - protein, 9 aa, Homo Sapiens
LQQKEVQIS

SEQ ID NO: 477500 - protein, 9 aa, Homo Sapiens
GHPWRLLPE

SEQ ID NO: 477501 - protein, 9 aa, Homo Sapiens
EFEIKVYYD

SEQ ID NO: 477502 - protein, 9 aa, Homo Sapiens
EGLITQARL

SEQ ID NO: 477503 - protein, 9 aa, Homo Sapiens
EDEITASFC

SEQ ID NO: 477504 - protein, 9 aa, Homo Sapiens
QKEAEEKEL

SEQ ID NO: 477505 - protein, 9 aa, Homo Sapiens
HFQAQGESF

SEQ ID NO: 477506 - protein, 9 aa, Homo Sapiens
QLYKVLRAG

SEQ ID NO: 477507 - protein, 9 aa, Homo Sapiens
GAEGGRPWH

SEQ ID NO: 477508 - protein, 9 aa, Homo Sapiens
PRRGSFQVT

SEQ ID NO: 477509 - protein, 9 aa, Homo Sapiens
QMHKRTHTG

SEQ ID NO: 477510 - protein, 9 aa, Homo Sapiens
QMVTNLPCC

SEQ ID NO: 477511 - protein, 9 aa, Homo Sapiens
DAQFQKRLE

SEQ ID NO: 477512 - protein, 9 aa, Homo Sapiens
KQEVHITEK

SEQ ID NO: 477513 - protein, 9 aa, Homo Sapiens
PSHVTRMTK

SEQ ID NO: 477514 - protein, 9 aa, Homo Sapiens
AGGYTLNPT

SEQ ID NO: 477515 - protein, 9 aa, Homo Sapiens
QILDTALKE

SEQ ID NO: 477516 - protein, 9 aa, Homo Sapiens
RRLHTAERP

SEQ ID NO: 477517 - protein, 9 aa, Homo Sapiens
ETAGFVARD

SEQ ID NO: 477518 - protein, 9 aa, Homo Sapiens
GSTCFLDTR

SEQ ID NO: 477519 - protein, 9 aa, Homo Sapiens
FCRFGPLVV

SEQ ID NO: 477520 - protein, 9 aa, Homo Sapiens
PGGGAAVGA

SEQ ID NO: 477521 - protein, 9 aa, Homo Sapiens
LTSYYAFSL

SEQ ID NO: 477522 - protein, 9 aa, Homo Sapiens
IESIGSSIQ

SEQ ID NO: 477523 - protein, 9 aa, Homo Sapiens
KLRAKISSL

SEQ ID NO: 477524 - protein, 9 aa, Homo Sapiens
LGEGKHPKK

SEQ ID NO: 477525 - protein, 9 aa, Homo Sapiens
SAPDSVLDH

SEQ ID NO: 477526 - protein, 9 aa, Homo Sapiens
QISHLKARQ

SEQ ID NO: 477527 - protein, 9 aa, Homo Sapiens
HRRRRRRQP

SEQ ID NO: 477528 - protein, 9 aa, Homo Sapiens
GLGRGPPGL

SEQ ID NO: 477529 - protein, 9 aa, Homo Sapiens
PASHPLFGR

SEQ ID NO: 477530 - protein, 9 aa, Homo Sapiens
MKRIAACEE

SEQ ID NO: 477531 - protein, 9 aa, Homo Sapiens
FLQTRHRIQ

SEQ ID NO: 477532 - protein, 9 aa, Homo Sapiens
KNEDMHGSG

SEQ ID NO: 477533 - protein, 9 aa, Homo Sapiens
LHIQGLSPT

SEQ ID NO: 477534 - protein, 9 aa, Homo Sapiens
AHLLVNLSR

SEQ ID NO: 477535 - protein, 9 aa, Homo Sapiens
QQDYGDESA

SEQ ID NO: 477536 - protein, 9 aa, Homo Sapiens
IFYTQGISR

SEQ ID NO: 477537 - protein, 9 aa, Homo Sapiens
QKDIEMAQK

SEQ ID NO: 477538 - protein, 9 aa, Homo Sapiens
FSFVRIRAL

SEQ ID NO: 477539 - protein, 9 aa, Homo Sapiens
SFPWIRGPA

SEQ ID NO: 477540 - protein, 9 aa, Homo Sapiens
PLPASHPLF

SEQ ID NO: 477541 - protein, 9 aa, Homo Sapiens
ADLEKRCQR

SEQ ID NO: 477542 - protein, 9 aa, Homo Sapiens
EQKHKVWGS

SEQ ID NO: 477543 - protein, 9 aa, Homo Sapiens
LHEMGADVN

SEQ ID NO: 477544 - protein, 9 aa, Homo Sapiens
EVTNLLLEE

SEQ ID NO: 477545 - protein, 9 aa, Homo Sapiens
GAGTATATA

SEQ ID NO: 477546 - protein, 9 aa, Homo Sapiens
KRAVTKMLQ

SEQ ID NO: 477547 - protein, 9 aa, Homo Sapiens
GDSRAQSVT

SEQ ID NO: 477548 - protein, 9 aa, Homo Sapiens
PQKALVGKL

SEQ ID NO: 477549 - protein, 9 aa, Homo Sapiens
AYPMAHLCP

SEQ ID NO: 477550 - protein, 9 aa, Homo Sapiens
RHQKNHTHE

SEQ ID NO: 477551 - protein, 9 aa, Homo Sapiens
DPKAKGRIK

SEQ ID NO: 477552 - protein, 9 aa, Homo Sapiens
VHYFELLKQ

SEQ ID NO: 477553 - protein, 9 aa, Homo Sapiens
QRKKQIAVQ

SEQ ID NO: 477554 - protein, 9 aa, Homo Sapiens
ISVKGCLAQ

SEQ ID NO: 477555 - protein, 9 aa, Homo Sapiens
RINYCHLIE

SEQ ID NO: 477556 - protein, 9 aa, Homo Sapiens
NSGVPEALR

SEQ ID NO: 477557 - protein, 9 aa, Homo Sapiens
RHRGHGSEQ

SEQ ID NO: 477558 - protein, 9 aa, Homo Sapiens
PHHYLINIY

SEQ ID NO: 477559 - protein, 9 aa, Homo Sapiens
GGLFPSPLS

SEQ ID NO: 477560 - protein, 9 aa, Homo Sapiens
LVKEAECAM

SEQ ID NO: 477561 - protein, 9 aa, Homo Sapiens
VTQDAEGFR

SEQ ID NO: 477562 - protein, 9 aa, Homo Sapiens
AIEGAEEID

SEQ ID NO: 477563 - protein, 9 aa, Homo Sapiens
TQQELQREL

SEQ ID NO: 477564 - protein, 9 aa, Homo Sapiens
AMAHFQWRR

SEQ ID NO: 477565 - protein, 9 aa, Homo Sapiens
RTTFTSTQL

SEQ ID NO: 477566 - protein, 9 aa, Homo Sapiens
KMQQEERIR

SEQ ID NO: 477567 - protein, 9 aa, Homo Sapiens
CHSNIYSRK

SEQ ID NO: 477568 - protein, 9 aa, Homo Sapiens
HQKEAEEKE

SEQ ID NO: 477569 - protein, 9 aa, Homo Sapiens
IRPGTGAER

SEQ ID NO: 477570 - protein, 9 aa, Homo Sapiens
WRQREGKAE

SEQ ID NO: 477571 - protein, 9 aa, Homo Sapiens
IHGLYLNGA

SEQ ID NO: 477572 - protein, 9 aa, Homo Sapiens
IAHGGVLPN

SEQ ID NO: 477573 - protein, 9 aa, Homo Sapiens
DIFSQYLEK

SEQ ID NO: 477574 - protein, 9 aa, Homo Sapiens
RPGWSHSSS

SEQ ID NO: 477575 - protein, 9 aa, Homo Sapiens
KQVEGIEVV

SEQ ID NO: 477576 - protein, 9 aa, Homo Sapiens
SLSKNLKDY

SEQ ID NO: 477577 - protein, 9 aa, Homo Sapiens
GFDCLCPFG

SEQ ID NO: 477578 - protein, 9 aa, Homo Sapiens
IKMDSQLHT

SEQ ID NO: 477579 - protein, 9 aa, Homo Sapiens
IAKNKLAEA

SEQ ID NO: 477580 - protein, 9 aa, Homo Sapiens
EAHERLDWA

SEQ ID NO: 477581 - protein, 9 aa, Homo Sapiens
LNGARWDRE

SEQ ID NO: 477582 - protein, 9 aa, Homo Sapiens
EDATVYVGG

SEQ ID NO: 477583 - protein, 9 aa, Homo Sapiens
IKMCRAFDS

SEQ ID NO: 477584 - protein, 9 aa, Homo Sapiens
SCSSSASSP

SEQ ID NO: 477585 - protein, 9 aa, Homo Sapiens
HKWRIMSPT

SEQ ID NO: 477586 - protein, 9 aa, Homo Sapiens
SVDDETEFK

SEQ ID NO: 477587 - protein, 9 aa, Homo Sapiens
EDEETHSGA

SEQ ID NO: 477588 - protein, 9 aa, Homo Sapiens
ESSVVSCDF

SEQ ID NO: 477589 - protein, 9 aa, Homo Sapiens
VKGNTASKD

SEQ ID NO: 477590 - protein, 9 aa, Homo Sapiens
EITASFCRF

SEQ ID NO: 477591 - protein, 9 aa, Homo Sapiens
EVPVSLPRT

SEQ ID NO: 477592 - protein, 9 aa, Homo Sapiens
PPESHHNGI

SEQ ID NO: 477593 - protein, 9 aa, Homo Sapiens
YCCCVSSSR

SEQ ID NO: 477594 - protein, 9 aa, Homo Sapiens
SGHKDYVTV

SEQ ID NO: 477595 - protein, 9 aa, Homo Sapiens
IPYLTKNPF

SEQ ID NO: 477596 - protein, 9 aa, Homo Sapiens
HLSDRATGY

SEQ ID NO: 477597 - protein, 9 aa, Homo Sapiens
PSPLSVGKS

SEQ ID NO: 477598 - protein, 9 aa, Homo Sapiens
ATISIKSYA

SEQ ID NO: 477599 - protein, 9 aa, Homo Sapiens
SQANEATTL

SEQ ID NO: 477600 - protein, 9 aa, Homo Sapiens
GLCIWLLIL

SEQ ID NO: 477601 - protein, 9 aa, Homo Sapiens
AGSMARNSA

SEQ ID NO: 477602 - protein, 9 aa, Homo Sapiens
SLFCGFCFV

SEQ ID NO: 477603 - protein, 9 aa, Homo Sapiens
VSLSTAIIW

SEQ ID NO: 477604 - protein, 9 aa, Homo Sapiens
ENFQLVQGV

SEQ ID NO: 477605 - protein, 9 aa, Homo Sapiens
KMLQLCGRF

SEQ ID NO: 477606 - protein, 9 aa, Homo Sapiens
ASAPDSVLD

SEQ ID NO: 477607 - protein, 9 aa, Homo Sapiens
DAPLEGSTE

SEQ ID NO: 477608 - protein, 9 aa, Homo Sapiens
AARGAAACS

SEQ ID NO: 477609 - protein, 9 aa, Homo Sapiens
SDRLDTPML

SEQ ID NO: 477610 - protein, 9 aa, Homo Sapiens
IHHRRLHTA

SEQ ID NO: 477611 - protein, 9 aa, Homo Sapiens
GIMTVFQIL

SEQ ID NO: 477612 - protein, 9 aa, Homo Sapiens
FANGLGVAE

SEQ ID NO: 477613 - protein, 9 aa, Homo Sapiens
GHPLLSMPA

SEQ ID NO: 477614 - protein, 9 aa, Homo Sapiens
KIEGSDCEC

SEQ ID NO: 477615 - protein, 9 aa, Homo Sapiens
REALRQAFL

SEQ ID NO: 477616 - protein, 9 aa, Homo Sapiens
TATPSCSPG

SEQ ID NO: 477617 - protein, 9 aa, Homo Sapiens
RMCREDPGT

SEQ ID NO: 477618 - protein, 9 aa, Homo Sapiens
RQAKLTVQV

SEQ ID NO: 477619 - protein, 9 aa, Homo Sapiens
TEFKASGSV

SEQ ID NO: 477620 - protein, 9 aa, Homo Sapiens
EGFKSKESV

SEQ ID NO: 477621 - protein, 9 aa, Homo Sapiens
SILARLSTK

SEQ ID NO: 477622 - protein, 9 aa, Homo Sapiens
DINILAMLC

SEQ ID NO: 477623 - protein, 9 aa, Homo Sapiens
IAEDTESCD

SEQ ID NO: 477624 - protein, 9 aa, Homo Sapiens
ICGFTHDLL

SEQ ID NO: 477625 - protein, 9 aa, Homo Sapiens
YVTSNRWLM

SEQ ID NO: 477626 - protein, 9 aa, Homo Sapiens
KVEAVEEPQ

SEQ ID NO: 477627 - protein, 9 aa, Homo Sapiens
EEAKRLTTE

SEQ ID NO: 477628 - protein, 9 aa, Homo Sapiens
LGRGPPGLA

SEQ ID NO: 477629 - protein, 9 aa, Homo Sapiens
QGVQEQVNA

SEQ ID NO: 477630 - protein, 9 aa, Homo Sapiens
EQDEDVSDG

SEQ ID NO: 477631 - protein, 9 aa, Homo Sapiens
NHANSDVPP

SEQ ID NO: 477632 - protein, 9 aa, Homo Sapiens
SPGDKGEKG

SEQ ID NO: 477633 - protein, 9 aa, Homo Sapiens
GAKGPTGCP

SEQ ID NO: 477634 - protein, 9 aa, Homo Sapiens
PLSPPLLAC

SEQ ID NO: 477635 - protein, 9 aa, Homo Sapiens
TPCGRTPWS

SEQ ID NO: 477636 - protein, 9 aa, Homo Sapiens
ASFCRFGPL

SEQ ID NO: 477637 - protein, 9 aa, Homo Sapiens
ASHPLFGRL

SEQ ID NO: 477638 - protein, 9 aa, Homo Sapiens
LSKRLKGSI

SEQ ID NO: 477639 - protein, 9 aa, Homo Sapiens
DVKTCNKVD

SEQ ID NO: 477640 - protein, 9 aa, Homo Sapiens
MNNKFDAFK

SEQ ID NO: 477641 - protein, 9 aa, Homo Sapiens
VNYFTNRGW

SEQ ID NO: 477642 - protein, 9 aa, Homo Sapiens
SHDMVDGNH

SEQ ID NO: 477643 - protein, 9 aa, Homo Sapiens
LDAQFQKRL

SEQ ID NO: 477644 - protein, 9 aa, Homo Sapiens
QEIETILSN

SEQ ID NO: 477645 - protein, 9 aa, Homo Sapiens
PVCVVFALM

SEQ ID NO: 477646 - protein, 9 aa, Homo Sapiens
HPDLGTKGC

SEQ ID NO: 477647 - protein, 9 aa, Homo Sapiens
EIACRSFPR

SEQ ID NO: 477648 - protein, 9 aa, Homo Sapiens
PPLLACPFP

SEQ ID NO: 477649 - protein, 9 aa, Homo Sapiens
FDCLCPFGP

SEQ ID NO: 477650 - protein, 9 aa, Homo Sapiens
RGGTGRTGL

SEQ ID NO: 477651 - protein, 9 aa, Homo Sapiens
ANNSAGSAM

SEQ ID NO: 477652 - protein, 9 aa, Homo Sapiens
KLSPPLLSL

SEQ ID NO: 477653 - protein, 9 aa, Homo Sapiens
LKKHEAFDS

SEQ ID NO: 477654 - protein, 9 aa, Homo Sapiens
NLEQLYLVG

SEQ ID NO: 477655 - protein, 9 aa, Homo Sapiens
NPKLESSTS

SEQ ID NO: 477656 - protein, 9 aa, Homo Sapiens
IDIRRVGPG

SEQ ID NO: 477657 - protein, 9 aa, Homo Sapiens
AQTQQHLNN

SEQ ID NO: 477658 - protein, 9 aa, Homo Sapiens
AVPFTNYIL

SEQ ID NO: 477659 - protein, 9 aa, Homo Sapiens
SNSYFGPYY

SEQ ID NO: 477660 - protein, 9 aa, Homo Sapiens
RKIPYLTKN

SEQ ID NO: 477661 - protein, 9 aa, Homo Sapiens
HIAHFLGTE

SEQ ID NO: 477662 - protein, 9 aa, Homo Sapiens
LYNASGAHA

SEQ ID NO: 477663 - protein, 9 aa, Homo Sapiens
CKLKRRKLS

SEQ ID NO: 477664 - protein, 9 aa, Homo Sapiens
HDMVDGNHR

SEQ ID NO: 477665 - protein, 9 aa, Homo Sapiens
LSGLPGQAL

SEQ ID NO: 477666 - protein, 9 aa, Homo Sapiens
NPSGIPIFM

SEQ ID NO: 477667 - protein, 9 aa, Homo Sapiens
SEVVNKKIE

SEQ ID NO: 477668 - protein, 9 aa, Homo Sapiens
KSSCNSTQA

SEQ ID NO: 477669 - protein, 9 aa, Homo Sapiens
SLHSGHEKK

SEQ ID NO: 477670 - protein, 9 aa, Homo Sapiens
YMAGRQLCC

SEQ ID NO: 477671 - protein, 9 aa, Homo Sapiens
RRRRRRQPP

SEQ ID NO: 477672 - protein, 9 aa, Homo Sapiens
CSSSASSPA

SEQ ID NO: 477673 - protein, 9 aa, Homo Sapiens
ELILMKFMY

SEQ ID NO: 477674 - protein, 9 aa, Homo Sapiens
TTNLSERHV

SEQ ID NO: 477675 - protein, 9 aa, Homo Sapiens
YSDEYKALR

SEQ ID NO: 477676 - protein, 9 aa, Homo Sapiens
KGCWDQLSA

SEQ ID NO: 477677 - protein, 9 aa, Homo Sapiens
VGDSRAQSV

SEQ ID NO: 477678 - protein, 9 aa, Homo Sapiens
RQGRLELQQ

SEQ ID NO: 477679 - protein, 9 aa, Homo Sapiens
IEASIQGEL

SEQ ID NO: 477680 - protein, 9 aa, Homo Sapiens
TTQEEEEME

SEQ ID NO: 477681 - protein, 9 aa, Homo Sapiens
LHSGHEKKV

SEQ ID NO: 477682 - protein, 9 aa, Homo Sapiens
GRRECPFSS

SEQ ID NO: 477683 - protein, 9 aa, Homo Sapiens
ACVSDESEG

SEQ ID NO: 477684 - protein, 9 aa, Homo Sapiens
MICNFVHEN

SEQ ID NO: 477685 - protein, 9 aa, Homo Sapiens
NGLCIWLLI

SEQ ID NO: 477686 - protein, 9 aa, Homo Sapiens
LQKFVDDLL

SEQ ID NO: 477687 - protein, 9 aa, Homo Sapiens
FVRIRALMV

SEQ ID NO: 477688 - protein, 9 aa, Homo Sapiens
LVQGVQEQV

SEQ ID NO: 477689 - protein, 9 aa, Homo Sapiens
TEPGYLVTK

SEQ ID NO: 477690 - protein, 9 aa, Homo Sapiens
PASAPDSVL

SEQ ID NO: 477691 - protein, 9 aa, Homo Sapiens
PESLQRDAP

SEQ ID NO: 477692 - protein, 9 aa, Homo Sapiens
CYSFFPDKP

SEQ ID NO: 477693 - protein, 9 aa, Homo Sapiens
QCLDMAQHN

SEQ ID NO: 477694 - protein, 9 aa, Homo Sapiens
CIANNSAGS

SEQ ID NO: 477695 - protein, 9 aa, Homo Sapiens
YLVYSDEYK

SEQ ID NO: 477696 - protein, 9 aa, Homo Sapiens
GTATATAPG

SEQ ID NO: 477697 - protein, 9 aa, Homo Sapiens
ALYKWEFEK

SEQ ID NO: 477698 - protein, 9 aa, Homo Sapiens
QQIHTEQKS

SEQ ID NO: 477699 - protein, 9 aa, Homo Sapiens
NPKGSQEGA

SEQ ID NO: 477700 - protein, 9 aa, Homo Sapiens
ETEADLVSQ

SEQ ID NO: 477701 - protein, 9 aa, Homo Sapiens
LENVGSHDM

SEQ ID NO: 477702 - protein, 9 aa, Homo Sapiens
VLGNSFRRQ

SEQ ID NO: 477703 - protein, 9 aa, Homo Sapiens
TTTAKIHLK

SEQ ID NO: 477704 - protein, 9 aa, Homo Sapiens
VLGCRANKA

SEQ ID NO: 477705 - protein, 9 aa, Homo Sapiens
ILTGSSTCY

SEQ ID NO: 477706 - protein, 9 aa, Homo Sapiens
EEKELEIPP

SEQ ID NO: 477707 - protein, 9 aa, Homo Sapiens
VSTLPGVGH

SEQ ID NO: 477708 - protein, 9 aa, Homo Sapiens
RKEFTEEVT

SEQ ID NO: 477709 - protein, 9 aa, Homo Sapiens
HIKHDPVHP

SEQ ID NO: 477710 - protein, 9 aa, Homo Sapiens
IMESNSDAQ

SEQ ID NO: 477711 - protein, 9 aa, Homo Sapiens
PDAGQAGRL

SEQ ID NO: 477712 - protein, 9 aa, Homo Sapiens
AFKNKLYAH

SEQ ID NO: 477713 - protein, 9 aa, Homo Sapiens
TRVRQQVAE

SEQ ID NO: 477714 - protein, 9 aa, Homo Sapiens
ASNLQMHKR

SEQ ID NO: 477715 - protein, 9 aa, Homo Sapiens
YHGLTGRVE

SEQ ID NO: 477716 - protein, 9 aa, Homo Sapiens
AQGESFWSI

SEQ ID NO: 477717 - protein, 9 aa, Homo Sapiens
VKTCNKVDL

SEQ ID NO: 477718 - protein, 9 aa, Homo Sapiens
KPFHILISL

SEQ ID NO: 477719 - protein, 9 aa, Homo Sapiens
LLDIYTHEA

SEQ ID NO: 477720 - protein, 9 aa, Homo Sapiens
ALGSFLIHL

SEQ ID NO: 477721 - protein, 9 aa, Homo Sapiens
VSLPRTQSK

SEQ ID NO: 477722 - protein, 9 aa, Homo Sapiens
QKFVDDLLQ

SEQ ID NO: 477723 - protein, 9 aa, Homo Sapiens
LQKQRELER

SEQ ID NO: 477724 - protein, 9 aa, Homo Sapiens
RQAFLSADE

SEQ ID NO: 477725 - protein, 9 aa, Homo Sapiens
HITEKSFQC

SEQ ID NO: 477726 - protein, 9 aa, Homo Sapiens
LQMHKRTHT

SEQ ID NO: 477727 - protein, 9 aa, Homo Sapiens
DLYRHVMME

SEQ ID NO: 477728 - protein, 9 aa, Homo Sapiens
KQKKLEKKR

SEQ ID NO: 477729 - protein, 9 aa, Homo Sapiens
RHRRRRRRQ

SEQ ID NO: 477730 - protein, 9 aa, Homo Sapiens
YSIEKRETL

SEQ ID NO: 477731 - protein, 9 aa, Homo Sapiens
EPDSCGHAG

SEQ ID NO: 477732 - protein, 9 aa, Homo Sapiens
EEEEMETDM

SEQ ID NO: 477733 - protein, 9 aa, Homo Sapiens
EVVELQLSH

SEQ ID NO: 477734 - protein, 9 aa, Homo Sapiens
SHLLFTRAI

SEQ ID NO: 477735 - protein, 9 aa, Homo Sapiens
EALRQAFLS

SEQ ID NO: 477736 - protein, 9 aa, Homo Sapiens
YNATLSVRQ

SEQ ID NO: 477737 - protein, 9 aa, Homo Sapiens
RDAPRGQAR

SEQ ID NO: 477738 - protein, 9 aa, Homo Sapiens
DSHGTLVLD

SEQ ID NO: 477739 - protein, 9 aa, Homo Sapiens
TKPRRGSFQ

SEQ ID NO: 477740 - protein, 9 aa, Homo Sapiens
ERDRLRVTF

SEQ ID NO: 477741 - protein, 9 aa, Homo Sapiens
QKNIESIGS

SEQ ID NO: 477742 - protein, 9 aa, Homo Sapiens
LPETSLLWT

SEQ ID NO: 477743 - protein, 9 aa, Homo Sapiens
HCVHYFELL

SEQ ID NO: 477744 - protein, 9 aa, Homo Sapiens
RHKEKYPDI

SEQ ID NO: 477745 - protein, 9 aa, Homo Sapiens
QDQIEDEPE

SEQ ID NO: 477746 - protein, 9 aa, Homo Sapiens
YLINIYRDK

SEQ ID NO: 477747 - protein, 9 aa, Homo Sapiens
LVASLSAFP

SEQ ID NO: 477748 - protein, 9 aa, Homo Sapiens
AGPISERNE

SEQ ID NO: 477749 - protein, 9 aa, Homo Sapiens
SFCRFGPLV

SEQ ID NO: 477750 - protein, 9 aa, Homo Sapiens
TQLLMNDRD

SEQ ID NO: 477751 - protein, 9 aa, Homo Sapiens
ILMKFMYTS

SEQ ID NO: 477752 - protein, 9 aa, Homo Sapiens
CTSSKVAAH

SEQ ID NO: 477753 - protein, 9 aa, Homo Sapiens
EKQKKLEKK

SEQ ID NO: 477754 - protein, 9 aa, Homo Sapiens
APASEALAE

SEQ ID NO: 477755 - protein, 9 aa, Homo Sapiens
EEIRTQLEE

SEQ ID NO: 477756 - protein, 9 aa, Homo Sapiens
GSSTCYSFF

SEQ ID NO: 477757 - protein, 9 aa, Homo Sapiens
RYLVYSDEY

SEQ ID NO: 477758 - protein, 9 aa, Homo Sapiens
IQKLRAKIS

SEQ ID NO: 477759 - protein, 9 aa, Homo Sapiens
KEAEEKELE

SEQ ID NO: 477760 - protein, 9 aa, Homo Sapiens
FLPPCMTIL

SEQ ID NO: 477761 - protein, 9 aa, Homo Sapiens
SRKETIPEE

SEQ ID NO: 477762 - protein, 9 aa, Homo Sapiens
SPGHIIIAG

SEQ ID NO: 477763 - protein, 9 aa, Homo Sapiens
PSPGRQPNQ

SEQ ID NO: 477764 - protein, 9 aa, Homo Sapiens
VMKFNNPPV

SEQ ID NO: 477765 - protein, 9 aa, Homo Sapiens
PRGSDAMPD

SEQ ID NO: 477766 - protein, 9 aa, Homo Sapiens
YHNSEFYNK

SEQ ID NO: 477767 - protein, 9 aa, Homo Sapiens
NEGFFEENI

SEQ ID NO: 477768 - protein, 9 aa, Homo Sapiens
PKGNRGFDG

SEQ ID NO: 477769 - protein, 9 aa, Homo Sapiens
ELAQDIVSK

SEQ ID NO: 477770 - protein, 9 aa, Homo Sapiens
LMKFMYTSQ

SEQ ID NO: 477771 - protein, 9 aa, Homo Sapiens
GGVTEIACR

SEQ ID NO: 477772 - protein, 9 aa, Homo Sapiens
WAERPAPRT

SEQ ID NO: 477773 - protein, 9 aa, Homo Sapiens
NSGRSHLEP

SEQ ID NO: 477774 - protein, 9 aa, Homo Sapiens
RVTFEDKEP

SEQ ID NO: 477775 - protein, 9 aa, Homo Sapiens
EDKVWRQEE

SEQ ID NO: 477776 - protein, 9 aa, Homo Sapiens
RYCTSSKVA

SEQ ID NO: 477777 - protein, 9 aa, Homo Sapiens
KTISVKGCL

SEQ ID NO: 477778 - protein, 9 aa, Homo Sapiens
AVQGARQGR

SEQ ID NO: 477779 - protein, 9 aa, Homo Sapiens
AVQHEQREA

SEQ ID NO: 477780 - protein, 9 aa, Homo Sapiens
LSPQGPGKE

SEQ ID NO: 477781 - protein, 9 aa, Homo Sapiens
DGYMGSTCP

SEQ ID NO: 477782 - protein, 9 aa, Homo Sapiens
HVEGLSVLR

SEQ ID NO: 477783 - protein, 9 aa, Homo Sapiens
LLACPFPTG

SEQ ID NO: 477784 - protein, 9 aa, Homo Sapiens
LSVRQLIEN

SEQ ID NO: 477785 - protein, 9 aa, Homo Sapiens
PGQALLCGQ

SEQ ID NO: 477786 - protein, 9 aa, Homo Sapiens
YNASGAHAL

SEQ ID NO: 477787 - protein, 9 aa, Homo Sapiens
AAKVKEGVQ

SEQ ID NO: 477788 - protein, 9 aa, Homo Sapiens
PGSHLLFTR

SEQ ID NO: 477789 - protein, 9 aa, Homo Sapiens
GSVILIFYT

SEQ ID NO: 477790 - protein, 9 aa, Homo Sapiens
RGANINAFH

SEQ ID NO: 477791 - protein, 9 aa, Homo Sapiens
DTSSSHSDE

SEQ ID NO: 477792 - protein, 9 aa, Homo Sapiens
SRMIEGPIL

SEQ ID NO: 477793 - protein, 9 aa, Homo Sapiens
MFPCRMAWP

SEQ ID NO: 477794 - protein, 9 aa, Homo Sapiens
LFCGFCFVT

SEQ ID NO: 477795 - protein, 9 aa, Homo Sapiens
AVEEPQAAP

SEQ ID NO: 477796 - protein, 9 aa, Homo Sapiens
TGKPTREIE

SEQ ID NO: 477797 - protein, 9 aa, Homo Sapiens
EELCSVSPS

SEQ ID NO: 477798 - protein, 9 aa, Homo Sapiens
EEALGPRSP

SEQ ID NO: 477799 - protein, 9 aa, Homo Sapiens
GADDYKIKV

SEQ ID NO: 477800 - protein, 9 aa, Homo Sapiens
QKESGAGEE

SEQ ID NO: 477801 - protein, 9 aa, Homo Sapiens
EYVLVKEAE

SEQ ID NO: 477802 - protein, 9 aa, Homo Sapiens
LLLGAFPVG

SEQ ID NO: 477803 - protein, 9 aa, Homo Sapiens
QGVEKPLHT

SEQ ID NO: 477804 - protein, 9 aa, Homo Sapiens
RNAGRRLAR

SEQ ID NO: 477805 - protein, 9 aa, Homo Sapiens
PQGVTGALA

SEQ ID NO: 477806 - protein, 9 aa, Homo Sapiens
ADIVLEVPP

SEQ ID NO: 477807 - protein, 9 aa, Homo Sapiens
ENLGKKIAH

SEQ ID NO: 477808 - protein, 9 aa, Homo Sapiens
IPQKALVGK

SEQ ID NO: 477809 - protein, 9 aa, Homo Sapiens
SVILIFYTQ

SEQ ID NO: 477810 - protein, 9 aa, Homo Sapiens
YGDESADED

SEQ ID NO: 477811 - protein, 9 aa, Homo Sapiens
NIPPVNTNL

SEQ ID NO: 477812 - protein, 9 aa, Homo Sapiens
KKPTKTSQG

SEQ ID NO: 477813 - protein, 9 aa, Homo Sapiens
FPVCVVFAL

SEQ ID NO: 477814 - protein, 9 aa, Homo Sapiens
LTGSSTCYS

SEQ ID NO: 477815 - protein, 9 aa, Homo Sapiens
KQILDTALK

SEQ ID NO: 477816 - protein, 9 aa, Homo Sapiens
RQDAPLEGS

SEQ ID NO: 477817 - protein, 9 aa, Homo Sapiens
LQCLGIPWV

SEQ ID NO: 477818 - protein, 9 aa, Homo Sapiens
EHGLIHTND

SEQ ID NO: 477819 - protein, 9 aa, Homo Sapiens
QSKGLGPAL

SEQ ID NO: 477820 - protein, 9 aa, Homo Sapiens
FSSASHAWS

SEQ ID NO: 477821 - protein, 9 aa, Homo Sapiens
FKEPWFFKN

SEQ ID NO: 477822 - protein, 9 aa, Homo Sapiens
HLLFTRAIL

SEQ ID NO: 477823 - protein, 9 aa, Homo Sapiens
GELEKSSCN

SEQ ID NO: 477824 - protein, 9 aa, Homo Sapiens
SLPAEAESK

SEQ ID NO: 477825 - protein, 9 aa, Homo Sapiens
SYTKRPEAN

SEQ ID NO: 477826 - protein, 9 aa, Homo Sapiens
TTGNLTYSV

SEQ ID NO: 477827 - protein, 9 aa, Homo Sapiens
VDGYMGSTC

SEQ ID NO: 477828 - protein, 9 aa, Homo Sapiens
TAKIHLKTI

SEQ ID NO: 477829 - protein, 9 aa, Homo Sapiens
GSHDAERHN

SEQ ID NO: 477830 - protein, 9 aa, Homo Sapiens
QCLILVVMS

SEQ ID NO: 477831 - protein, 9 aa, Homo Sapiens
MQMPYGDVL

SEQ ID NO: 477832 - protein, 9 aa, Homo Sapiens
KVKEGVQVT

SEQ ID NO: 477833 - protein, 9 aa, Homo Sapiens
DTEVKDACV

SEQ ID NO: 477834 - protein, 9 aa, Homo Sapiens
NQGVIEFRS

SEQ ID NO: 477835 - protein, 9 aa, Homo Sapiens
SPGSHLLFT

SEQ ID NO: 477836 - protein, 9 aa, Homo Sapiens
YLLPGALAD

SEQ ID NO: 477837 - protein, 9 aa, Homo Sapiens
KKRSKAPPH

SEQ ID NO: 477838 - protein, 9 aa, Homo Sapiens
AGRQLCCKR

SEQ ID NO: 477839 - protein, 9 aa, Homo Sapiens
QEEKMQQEE

SEQ ID NO: 477840 - protein, 9 aa, Homo Sapiens
YATEHGLIH

SEQ ID NO: 477841 - protein, 9 aa, Homo Sapiens
GSFQVTLLR

SEQ ID NO: 477842 - protein, 9 aa, Homo Sapiens
ESALSEKAK

SEQ ID NO: 477843 - protein, 9 aa, Homo Sapiens
TKDVAQEDA

SEQ ID NO: 477844 - protein, 9 aa, Homo Sapiens
YNTTQLLMN

SEQ ID NO: 477845 - protein, 9 aa, Homo Sapiens
AHLPGPLRT

SEQ ID NO: 477846 - protein, 9 aa, Homo Sapiens
QARRPRRGP

SEQ ID NO: 477847 - protein, 9 aa, Homo Sapiens
PLIPSDYQQ

SEQ ID NO: 477848 - protein, 9 aa, Homo Sapiens
RESPQLGEL

SEQ ID NO: 477849 - protein, 9 aa, Homo Sapiens
PLPLRARWC

SEQ ID NO: 477850 - protein, 9 aa, Homo Sapiens
IPTYCKYCS

SEQ ID NO: 477851 - protein, 9 aa, Homo Sapiens
ISKTYLVIC

SEQ ID NO: 477852 - protein, 9 aa, Homo Sapiens
LQIHDRIIQ

SEQ ID NO: 477853 - protein, 9 aa, Homo Sapiens
HLLVNLSRC

SEQ ID NO: 477854 - protein, 9 aa, Homo Sapiens
IKLESKRSL

SEQ ID NO: 477855 - protein, 9 aa, Homo Sapiens
AVRKTLLRQ

SEQ ID NO: 477856 - protein, 9 aa, Homo Sapiens
VTRYGGRLH

SEQ ID NO: 477857 - protein, 9 aa, Homo Sapiens
LLSVTGERK

SEQ ID NO: 477858 - protein, 9 aa, Homo Sapiens
AVKLDSASF

SEQ ID NO: 477859 - protein, 9 aa, Homo Sapiens
GLSTLVNSG

SEQ ID NO: 477860 - protein, 9 aa, Homo Sapiens
TEQKSCICS

SEQ ID NO: 477861 - protein, 9 aa, Homo Sapiens
RLAKQLSSL

SEQ ID NO: 477862 - protein, 9 aa, Homo Sapiens
KRRANSLLQ

SEQ ID NO: 477863 - protein, 9 aa, Homo Sapiens
SALSEKAKE

SEQ ID NO: 477864 - protein, 9 aa, Homo Sapiens
IRKQEDKVW

SEQ ID NO: 477865 - protein, 9 aa, Homo Sapiens
TKMLQLCGR

SEQ ID NO: 477866 - protein, 9 aa, Homo Sapiens
PTATNRRHR

SEQ ID NO: 477867 - protein, 9 aa, Homo Sapiens
ESTPQQPST

SEQ ID NO: 477868 - protein, 9 aa, Homo Sapiens
QTQQELQRE

SEQ ID NO: 477869 - protein, 9 aa, Homo Sapiens
PWIRGPAPW

SEQ ID NO: 477870 - protein, 9 aa, Homo Sapiens
LKDVDQMFQ

SEQ ID NO: 477871 - protein, 9 aa, Homo Sapiens
GKRVDQIFG

SEQ ID NO: 477872 - protein, 9 aa, Homo Sapiens
NEVIPKVLR

SEQ ID NO: 477873 - protein, 9 aa, Homo Sapiens
TPDLLLSVT

SEQ ID NO: 477874 - protein, 9 aa, Homo Sapiens
TGALATHIR

SEQ ID NO: 477875 - protein, 9 aa, Homo Sapiens
FATLPPPYQ

SEQ ID NO: 477876 - protein, 9 aa, Homo Sapiens
SVLDHLFPF

SEQ ID NO: 477877 - protein, 9 aa, Homo Sapiens
FGTLKDVGM

SEQ ID NO: 477878 - protein, 9 aa, Homo Sapiens
CITEMQQVE

SEQ ID NO: 477879 - protein, 9 aa, Homo Sapiens
ANFDTFPAG

SEQ ID NO: 477880 - protein, 9 aa, Homo Sapiens
FALMADKRL

SEQ ID NO: 477881 - protein, 9 aa, Homo Sapiens
LRTGYYDLL

SEQ ID NO: 477882 - protein, 9 aa, Homo Sapiens
LVYSDEYKA

SEQ ID NO: 477883 - protein, 9 aa, Homo Sapiens
SGPVADLPE

SEQ ID NO: 477884 - protein, 9 aa, Homo Sapiens
ARLLYKSRK

SEQ ID NO: 477885 - protein, 9 aa, Homo Sapiens
LYKSRKRGM

SEQ ID NO: 477886 - protein, 9 aa, Homo Sapiens
SGQHPDINS

SEQ ID NO: 477887 - protein, 9 aa, Homo Sapiens
SLHIQGLSP

SEQ ID NO: 477888 - protein, 9 aa, Homo Sapiens
NKKIEEFLS

SEQ ID NO: 477889 - protein, 9 aa, Homo Sapiens
PCEIRKLVA

SEQ ID NO: 477890 - protein, 9 aa, Homo Sapiens
NYFTNRGWA

SEQ ID NO: 477891 - protein, 9 aa, Homo Sapiens
APQPSQLGA

SEQ ID NO: 477892 - protein, 9 aa, Homo Sapiens
WKDIELQKM

SEQ ID NO: 477893 - protein, 9 aa, Homo Sapiens
EQLYLVGSL

SEQ ID NO: 477894 - protein, 9 aa, Homo Sapiens
QDPDAGQAG

SEQ ID NO: 477895 - protein, 9 aa, Homo Sapiens
TDPMQMPYG

SEQ ID NO: 477896 - protein, 9 aa, Homo Sapiens
DTKDVAQED

SEQ ID NO: 477897 - protein, 9 aa, Homo Sapiens
LRECLHMLQ

SEQ ID NO: 477898 - protein, 9 aa, Homo Sapiens
FVLKELCII

SEQ ID NO: 477899 - protein, 9 aa, Homo Sapiens
DETEFKASG

SEQ ID NO: 477900 - protein, 9 aa, Homo Sapiens
APLQPGVSV

SEQ ID NO: 477901 - protein, 9 aa, Homo Sapiens
PQQPSTEST

SEQ ID NO: 477902 - protein, 9 aa, Homo Sapiens
NTAGGGPGQ

SEQ ID NO: 477903 - protein, 9 aa, Homo Sapiens
KRESPTGKL

SEQ ID NO: 477904 - protein, 9 aa, Homo Sapiens
ALANCSFPN

SEQ ID NO: 477905 - protein, 9 aa, Homo Sapiens
SGLPGQALL

SEQ ID NO: 477906 - protein, 9 aa, Homo Sapiens
VAVMKFNNP

SEQ ID NO: 477907 - protein, 9 aa, Homo Sapiens
RKEEVPVSL

SEQ ID NO: 477908 - protein, 9 aa, Homo Sapiens
EEQEFHIRS

SEQ ID NO: 477909 - protein, 9 aa, Homo Sapiens
HEGSSYCSR

SEQ ID NO: 477910 - protein, 9 aa, Homo Sapiens
KRIAACEEQ

SEQ ID NO: 477911 - protein, 9 aa, Homo Sapiens
LKRRKLSFE

SEQ ID NO: 477912 - protein, 9 aa, Homo Sapiens
RAIFLANGN

SEQ ID NO: 477913 - protein, 9 aa, Homo Sapiens
PYNTTQLLM

SEQ ID NO: 477914 - protein, 9 aa, Homo Sapiens
PWFFKNHMR

SEQ ID NO: 477915 - protein, 9 aa, Homo Sapiens
FPAGIMTVF

SEQ ID NO: 477916 - protein, 9 aa, Homo Sapiens
LLTTLLVTA

SEQ ID NO: 477917 - protein, 9 aa, Homo Sapiens
DVRAPQPSQ

SEQ ID NO: 477918 - protein, 9 aa, Homo Sapiens
DEITASFCR

SEQ ID NO: 477919 - protein, 9 aa, Homo Sapiens
HGLIHTNDQ

SEQ ID NO: 477920 - protein, 9 aa, Homo Sapiens
YCSRKDCQM

SEQ ID NO: 477921 - protein, 9 aa, Homo Sapiens
TRLAKQLSS

SEQ ID NO: 477922 - protein, 9 aa, Homo Sapiens
RQVSVAHFG

SEQ ID NO: 477923 - protein, 9 aa, Homo Sapiens
LDYGRDNLA

SEQ ID NO: 477924 - protein, 9 aa, Homo Sapiens
NLSERHVTI

SEQ ID NO: 477925 - protein, 9 aa, Homo Sapiens
PLQVFRRFV

SEQ ID NO: 477926 - protein, 9 aa, Homo Sapiens
YGETADVWA

SEQ ID NO: 477927 - protein, 9 aa, Homo Sapiens
NLMASDRLD

SEQ ID NO: 477928 - protein, 9 aa, Homo Sapiens
SAASSEGAK

SEQ ID NO: 477929 - protein, 9 aa, Homo Sapiens
IARLPGGHH

SEQ ID NO: 477930 - protein, 9 aa, Homo Sapiens
RSPFSLKKP

SEQ ID NO: 477931 - protein, 9 aa, Homo Sapiens
HAWSYGIVM

SEQ ID NO: 477932 - protein, 9 aa, Homo Sapiens
SIAEDTESC

SEQ ID NO: 477933 - protein, 9 aa, Homo Sapiens
WRLLPETSL

SEQ ID NO: 477934 - protein, 9 aa, Homo Sapiens
KIPYLTKNP

SEQ ID NO: 477935 - protein, 9 aa, Homo Sapiens
FRRDFHMVT

SEQ ID NO: 477936 - protein, 9 aa, Homo Sapiens
WRDWILQPK

SEQ ID NO: 477937 - protein, 9 aa, Homo Sapiens
LAQEDGPVL

SEQ ID NO: 477938 - protein, 9 aa, Homo Sapiens
PLTSFGSAA

SEQ ID NO: 477939 - protein, 9 aa, Homo Sapiens
REKCQGADI

SEQ ID NO: 477940 - protein, 9 aa, Homo Sapiens
SFLIHLSDR

SEQ ID NO: 477941 - protein, 9 aa, Homo Sapiens
FGSSIQLTI

SEQ ID NO: 477942 - protein, 9 aa, Homo Sapiens
TGCPGTSGP

SEQ ID NO: 477943 - protein, 9 aa, Homo Sapiens
TVTFKCEAT

SEQ ID NO: 477944 - protein, 9 aa, Homo Sapiens
ISCSSSASS

SEQ ID NO: 477945 - protein, 9 aa, Homo Sapiens
FENNMYHNS

SEQ ID NO: 477946 - protein, 9 aa, Homo Sapiens
TLIKMDSQL

SEQ ID NO: 477947 - protein, 9 aa, Homo Sapiens
RTVNREDSN

SEQ ID NO: 477948 - protein, 9 aa, Homo Sapiens
IKHDPVHPG

SEQ ID NO: 477949 - protein, 9 aa, Homo Sapiens
MVTNLPCCV

SEQ ID NO: 477950 - protein, 9 aa, Homo Sapiens
ALGAPAPEP

SEQ ID NO: 477951 - protein, 9 aa, Homo Sapiens
FVVAFYNLS

SEQ ID NO: 477952 - protein, 9 aa, Homo Sapiens
SKQKDIEMA

SEQ ID NO: 477953 - protein, 9 aa, Homo Sapiens
ESFWSITSF

SEQ ID NO: 477954 - protein, 9 aa, Homo Sapiens
LQDSPLVQA

SEQ ID NO: 477955 - protein, 9 aa, Homo Sapiens
NGHPGSPGD

SEQ ID NO: 477956 - protein, 9 aa, Homo Sapiens
KPIEASIQG

SEQ ID NO: 477957 - protein, 9 aa, Homo Sapiens
KLESKRSLR

SEQ ID NO: 477958 - protein, 9 aa, Homo Sapiens
FHKKDRRAI

SEQ ID NO: 477959 - protein, 9 aa, Homo Sapiens
PCMTILKLS

SEQ ID NO: 477960 - protein, 9 aa, Homo Sapiens
SSTEPGHPL

SEQ ID NO: 477961 - protein, 9 aa, Homo Sapiens
QAVRKTLLR

SEQ ID NO: 477962 - protein, 9 aa, Homo Sapiens
HMVAKPPVI

SEQ ID NO: 477963 - protein, 9 aa, Homo Sapiens
CPGTSGPPG

SEQ ID NO: 477964 - protein, 9 aa, Homo Sapiens
QEQQKTILQ

SEQ ID NO: 477965 - protein, 9 aa, Homo Sapiens
IKDTIQGAP

SEQ ID NO: 477966 - protein, 9 aa, Homo Sapiens
KRRKLSFES

SEQ ID NO: 477967 - protein, 9 aa, Homo Sapiens
LSTAIIWRR

SEQ ID NO: 477968 - protein, 9 aa, Homo Sapiens
NYLCIANNS

SEQ ID NO: 477969 - protein, 9 aa, Homo Sapiens
EYHGLTGRV

SEQ ID NO: 477970 - protein, 9 aa, Homo Sapiens
VSSIRVDTV

SEQ ID NO: 477971 - protein, 9 aa, Homo Sapiens
QSHPDLGTK

SEQ ID NO: 477972 - protein, 9 aa, Homo Sapiens
IWLLILSYV

SEQ ID NO: 477973 - protein, 9 aa, Homo Sapiens
ELDDERYPA

SEQ ID NO: 477974 - protein, 9 aa, Homo Sapiens
SDHPKSTGK

SEQ ID NO: 477975 - protein, 9 aa, Homo Sapiens
ALATHIRQA

SEQ ID NO: 477976 - protein, 9 aa, Homo Sapiens
EMKRNKNDI

SEQ ID NO: 477977 - protein, 9 aa, Homo Sapiens
HPHPHHHSH

SEQ ID NO: 477978 - protein, 9 aa, Homo Sapiens
HKEKYPDIQ

SEQ ID NO: 477979 - protein, 9 aa, Homo Sapiens
QAQEILRTD

SEQ ID NO: 477980 - protein, 9 aa, Homo Sapiens
LAPRSTEPG

SEQ ID NO: 477981 - protein, 9 aa, Homo Sapiens
LPIFRDKNE

SEQ ID NO: 477982 - protein, 9 aa, Homo Sapiens
EYAGSDEEG

SEQ ID NO: 477983 - protein, 9 aa, Homo Sapiens
IIQVNGRDL

SEQ ID NO: 477984 - protein, 9 aa, Homo Sapiens
GAFPVGSNL

SEQ ID NO: 477985 - protein, 9 aa, Homo Sapiens
MYHNSEFYN

SEQ ID NO: 477986 - protein, 9 aa, Homo Sapiens
ESLNHANSD

SEQ ID NO: 477987 - protein, 9 aa, Homo Sapiens
GQLYKVLRA

SEQ ID NO: 477988 - protein, 9 aa, Homo Sapiens
TATAPGAEP

SEQ ID NO: 477989 - protein, 9 aa, Homo Sapiens
FQVTLLRPD

SEQ ID NO: 477990 - protein, 9 aa, Homo Sapiens
SSASHAWSY

SEQ ID NO: 477991 - protein, 9 aa, Homo Sapiens
MADLEKRCQ

SEQ ID NO: 477992 - protein, 9 aa, Homo Sapiens
MGRVVPMLL

SEQ ID NO: 477993 - protein, 9 aa, Homo Sapiens
VNNPSKHII

SEQ ID NO: 477994 - protein, 9 aa, Homo Sapiens
IPQIVAVYS

SEQ ID NO: 477995 - protein, 9 aa, Homo Sapiens
FVHENEDEE

SEQ ID NO: 477996 - protein, 9 aa, Homo Sapiens
LQTNWKMVC

SEQ ID NO: 477997 - protein, 9 aa, Homo Sapiens
ILYFVLKEL

SEQ ID NO: 477998 - protein, 9 aa, Homo Sapiens
LLYKSRKRG

SEQ ID NO: 477999 - protein, 9 aa, Homo Sapiens
LSPGSHLLF

SEQ ID NO: 478000 - protein, 9 aa, Homo Sapiens
KAKEDSLDE

SEQ ID NO: 478001 - protein, 9 aa, Homo Sapiens
DCLCPFGPS

SEQ ID NO: 478002 - protein, 9 aa, Homo Sapiens
LEENVPAED

SEQ ID NO: 478003 - protein, 9 aa, Homo Sapiens
FWQCQLSCL

SEQ ID NO: 478004 - protein, 9 aa, Homo Sapiens
LDMAQHNLY

SEQ ID NO: 478005 - protein, 9 aa, Homo Sapiens
KFSSASHAW

SEQ ID NO: 478006 - protein, 9 aa, Homo Sapiens
TCYSFFPDK

SEQ ID NO: 478007 - protein, 9 aa, Homo Sapiens
SERNEDATV

SEQ ID NO: 478008 - protein, 9 aa, Homo Sapiens
QAVARKEEV

SEQ ID NO: 478009 - protein, 9 aa, Homo Sapiens
LAQASQTQQ

SEQ ID NO: 478010 - protein, 9 aa, Homo Sapiens
DQEEKMQQE

SEQ ID NO: 478011 - protein, 9 aa, Homo Sapiens
LELEKRLQK

SEQ ID NO: 478012 - protein, 9 aa, Homo Sapiens
SLPANPVKV

SEQ ID NO: 478013 - protein, 9 aa, Homo Sapiens
YTLNPTYKE

SEQ ID NO: 478014 - protein, 9 aa, Homo Sapiens
NLPCCVTLQ

SEQ ID NO: 478015 - protein, 9 aa, Homo Sapiens
AGIMTVFQI

SEQ ID NO: 478016 - protein, 9 aa, Homo Sapiens
IREKCQGAD

SEQ ID NO: 478017 - protein, 9 aa, Homo Sapiens
TASFCRFGP

SEQ ID NO: 478018 - protein, 9 aa, Homo Sapiens
KEVTLMNTS

SEQ ID NO: 478019 - protein, 9 aa, Homo Sapiens
EEVPVSLPR

SEQ ID NO: 478020 - protein, 9 aa, Homo Sapiens
LIGSTSAPG

SEQ ID NO: 478021 - protein, 9 aa, Homo Sapiens
WLLILSYVG

SEQ ID NO: 478022 - protein, 9 aa, Homo Sapiens
ARVGCSIAW

SEQ ID NO: 478023 - protein, 9 aa, Homo Sapiens
HLLSPGSHL

SEQ ID NO: 478024 - protein, 9 aa, Homo Sapiens
KVWGSNQNY

SEQ ID NO: 478025 - protein, 9 aa, Homo Sapiens
QIHTEQKSC

SEQ ID NO: 478026 - protein, 9 aa, Homo Sapiens
KRVDQIFGK

SEQ ID NO: 478027 - protein, 9 aa, Homo Sapiens
GGHHTVLFS

SEQ ID NO: 478028 - protein, 9 aa, Homo Sapiens
RPQRGSTCF

SEQ ID NO: 478029 - protein, 9 aa, Homo Sapiens
VSESPSPGR

SEQ ID NO: 478030 - protein, 9 aa, Homo Sapiens
IKYNCTVVE

SEQ ID NO: 478031 - protein, 9 aa, Homo Sapiens
YGLRNLEQL

SEQ ID NO: 478032 - protein, 9 aa, Homo Sapiens
NKLYAHEVV

SEQ ID NO: 478033 - protein, 9 aa, Homo Sapiens
ARFQTTSGK

SEQ ID NO: 478034 - protein, 9 aa, Homo Sapiens
QLLMNDRDP

SEQ ID NO: 478035 - protein, 9 aa, Homo Sapiens
EMLLLDIYT

SEQ ID NO: 478036 - protein, 9 aa, Homo Sapiens
LILMKFMYT

SEQ ID NO: 478037 - protein, 9 aa, Homo Sapiens
EGSRVRQVS

SEQ ID NO: 478038 - protein, 9 aa, Homo Sapiens
TTLLCRDWP

SEQ ID NO: 478039 - protein, 9 aa, Homo Sapiens
TRQDAPLEG

SEQ ID NO: 478040 - protein, 9 aa, Homo Sapiens
SASNLQMHK

SEQ ID NO: 478041 - protein, 9 aa, Homo Sapiens
GEDDEEYAG

SEQ ID NO: 478042 - protein, 9 aa, Homo Sapiens
PCCVTLQPG

SEQ ID NO: 478043 - protein, 9 aa, Homo Sapiens
GAVLHGFHD

SEQ ID NO: 478044 - protein, 9 aa, Homo Sapiens
RTKHKWRIM

SEQ ID NO: 478045 - protein, 9 aa, Homo Sapiens
QPAAEAPVG

SEQ ID NO: 478046 - protein, 9 aa, Homo Sapiens
AAKIEGSDC

SEQ ID NO: 478047 - protein, 9 aa, Homo Sapiens
HLSKQKDIE

SEQ ID NO: 478048 - protein, 9 aa, Homo Sapiens
HTKQILDTA

SEQ ID NO: 478049 - protein, 9 aa, Homo Sapiens
SLAKRSVVN

SEQ ID NO: 478050 - protein, 9 aa, Homo Sapiens
VSFPWIRGP

SEQ ID NO: 478051 - protein, 9 aa, Homo Sapiens
VGVICQEDV

SEQ ID NO: 478052 - protein, 9 aa, Homo Sapiens
FISKTYLVI

SEQ ID NO: 478053 - protein, 9 aa, Homo Sapiens
TLPIFRDKN

SEQ ID NO: 478054 - protein, 9 aa, Homo Sapiens
WRKNHDKDG

SEQ ID NO: 478055 - protein, 9 aa, Homo Sapiens
GEKKEEAKR

SEQ ID NO: 478056 - protein, 9 aa, Homo Sapiens
QCLGIPWVQ

SEQ ID NO: 478057 - protein, 9 aa, Homo Sapiens
KALANCSFP

SEQ ID NO: 478058 - protein, 9 aa, Homo Sapiens
SKAPPHIFS

SEQ ID NO: 478059 - protein, 9 aa, Homo Sapiens
SAAHTKQIL

SEQ ID NO: 478060 - protein, 9 aa, Homo Sapiens
SSIVFSALD

SEQ ID NO: 478061 - protein, 9 aa, Homo Sapiens
AESKKEKAR

SEQ ID NO: 478062 - protein, 9 aa, Homo Sapiens
LRAKISSLQ

SEQ ID NO: 478063 - protein, 9 aa, Homo Sapiens
TIPQIPQIP

SEQ ID NO: 478064 - protein, 9 aa, Homo Sapiens
LQQNTSQVS

SEQ ID NO: 478065 - protein, 9 aa, Homo Sapiens
TFTSTQLKE

SEQ ID NO: 478066 - protein, 9 aa, Homo Sapiens
EEFLSKVCI

SEQ ID NO: 478067 - protein, 9 aa, Homo Sapiens
EPWFFKNHM

SEQ ID NO: 478068 - protein, 9 aa, Homo Sapiens
LQATRNAGR

SEQ ID NO: 478069 - protein, 9 aa, Homo Sapiens
QGADIVLEV

SEQ ID NO: 478070 - protein, 9 aa, Homo Sapiens
KDGGLFPSP

SEQ ID NO: 478071 - protein, 9 aa, Homo Sapiens
KGPTGCPGT

SEQ ID NO: 478072 - protein, 9 aa, Homo Sapiens
QEPGVAKAE

SEQ ID NO: 478073 - protein, 9 aa, Homo Sapiens
LLNETDIFS

SEQ ID NO: 478074 - protein, 9 aa, Homo Sapiens
QGLGRGPPG

SEQ ID NO: 478075 - protein, 9 aa, Homo Sapiens
ARQGRLELQ

SEQ ID NO: 478076 - protein, 9 aa, Homo Sapiens
FKNHMRTHN

SEQ ID NO: 478077 - protein, 9 aa, Homo Sapiens
TPFGSSIQL

SEQ ID NO: 478078 - protein, 9 aa, Homo Sapiens
MYTSQYDNC

SEQ ID NO: 478079 - protein, 9 aa, Homo Sapiens
GCLVHLYNF

SEQ ID NO: 478080 - protein, 9 aa, Homo Sapiens
RDKNEDMHG

SEQ ID NO: 478081 - protein, 9 aa, Homo Sapiens
PISERNEDA

SEQ ID NO: 478082 - protein, 9 aa, Homo Sapiens
DAERHNEGQ

SEQ ID NO: 478083 - protein, 9 aa, Homo Sapiens
QSSTFTLKG

SEQ ID NO: 478084 - protein, 9 aa, Homo Sapiens
QRGSTCFLD

SEQ ID NO: 478085 - protein, 9 aa, Homo Sapiens
SPTGKLPFW

SEQ ID NO: 478086 - protein, 9 aa, Homo Sapiens
VSSSAAVQH

SEQ ID NO: 478087 - protein, 9 aa, Homo Sapiens
GDTGPKGNR

SEQ ID NO: 478088 - protein, 9 aa, Homo Sapiens
IEVVELQLS

SEQ ID NO: 478089 - protein, 9 aa, Homo Sapiens
EDGPVLIGS

SEQ ID NO: 478090 - protein, 9 aa, Homo Sapiens
PLVTRNIKP

SEQ ID NO: 478091 - protein, 9 aa, Homo Sapiens
SPWMFPCRM

SEQ ID NO: 478092 - protein, 9 aa, Homo Sapiens
LLPLRLARF

SEQ ID NO: 478093 - protein, 9 aa, Homo Sapiens
EKPFQCKLC

SEQ ID NO: 478094 - protein, 9 aa, Homo Sapiens
HVRQPDQIQ

SEQ ID NO: 478095 - protein, 9 aa, Homo Sapiens
TNLSERHVT

SEQ ID NO: 478096 - protein, 9 aa, Homo Sapiens
HPGGSFTLT

SEQ ID NO: 478097 - protein, 9 aa, Homo Sapiens
YMCSCLHSG

SEQ ID NO: 478098 - protein, 9 aa, Homo Sapiens
HRRLHTAER

SEQ ID NO: 478099 - protein, 9 aa, Homo Sapiens
CCGRGYDPS

SEQ ID NO: 478100 - protein, 9 aa, Homo Sapiens
RVLIINTPC

SEQ ID NO: 478101 - protein, 9 aa, Homo Sapiens
DQIQENSVQ

SEQ ID NO: 478102 - protein, 9 aa, Homo Sapiens
EHLLKSFTD

SEQ ID NO: 478103 - protein, 9 aa, Homo Sapiens
TESCDDLDE

SEQ ID NO: 478104 - protein, 9 aa, Homo Sapiens
MAGRQLCCK

SEQ ID NO: 478105 - protein, 9 aa, Homo Sapiens
PQLGELCYQ

SEQ ID NO: 478106 - protein, 9 aa, Homo Sapiens
TVDRFIAMN

SEQ ID NO: 478107 - protein, 9 aa, Homo Sapiens
TAKGPVNYC

SEQ ID NO: 478108 - protein, 9 aa, Homo Sapiens
RFCRKLRAA

SEQ ID NO: 478109 - protein, 9 aa, Homo Sapiens
KEKYPDIQM

SEQ ID NO: 478110 - protein, 9 aa, Homo Sapiens
TIAIKHYLS

SEQ ID NO: 478111 - protein, 9 aa, Homo Sapiens
NNKFDAFKD

SEQ ID NO: 478112 - protein, 9 aa, Homo Sapiens
KLQPGCVPK

SEQ ID NO: 478113 - protein, 9 aa, Homo Sapiens
PGVAKAELE

SEQ ID NO: 478114 - protein, 9 aa, Homo Sapiens
LSGASSAEA

SEQ ID NO: 478115 - protein, 9 aa, Homo Sapiens
SYYAFSLVI

SEQ ID NO: 478116 - protein, 9 aa, Homo Sapiens
LESKRSLRQ

SEQ ID NO: 478117 - protein, 9 aa, Homo Sapiens
LEKLDQGRL

SEQ ID NO: 478118 - protein, 9 aa, Homo Sapiens
IVALGGNPY

SEQ ID NO: 478119 - protein, 9 aa, Homo Sapiens
ISSSPFPVT

SEQ ID NO: 478120 - protein, 9 aa, Homo Sapiens
TEPECMVTV

SEQ ID NO: 478121 - protein, 9 aa, Homo Sapiens
KSTGKPTRE

SEQ ID NO: 478122 - protein, 9 aa, Homo Sapiens
LQKGVRTAR

SEQ ID NO: 478123 - protein, 9 aa, Homo Sapiens
RRPRRGPGA

SEQ ID NO: 478124 - protein, 9 aa, Homo Sapiens
ASHAWSYGI

SEQ ID NO: 478125 - protein, 9 aa, Homo Sapiens
VEPLSPPLL

SEQ ID NO: 478126 - protein, 9 aa, Homo Sapiens
QEERIRERE

SEQ ID NO: 478127 - protein, 9 aa, Homo Sapiens
IVGIQSPNQ

SEQ ID NO: 478128 - protein, 9 aa, Homo Sapiens
LDSHGTLVL

SEQ ID NO: 478129 - protein, 9 aa, Homo Sapiens
GARGAGTAT

SEQ ID NO: 478130 - protein, 9 aa, Homo Sapiens
KPYMTKQHL

SEQ ID NO: 478131 - protein, 9 aa, Homo Sapiens
TTAKIHLKT

SEQ ID NO: 478132 - protein, 9 aa, Homo Sapiens
WPGFYPHQS

SEQ ID NO: 478133 - protein, 9 aa, Homo Sapiens
PGDKGEKGE

SEQ ID NO: 478134 - protein, 9 aa, Homo Sapiens
TSSPPMKKP

SEQ ID NO: 478135 - protein, 9 aa, Homo Sapiens
LMELSLAHV

SEQ ID NO: 478136 - protein, 9 aa, Homo Sapiens
NINAFHKKD

SEQ ID NO: 478137 - protein, 9 aa, Homo Sapiens
CQEDVLRDS

SEQ ID NO: 478138 - protein, 9 aa, Homo Sapiens
AIKSLSCIT

SEQ ID NO: 478139 - protein, 9 aa, Homo Sapiens
DLVKKESFA

SEQ ID NO: 478140 - protein, 9 aa, Homo Sapiens
PYLTKNPFT

SEQ ID NO: 478141 - protein, 9 aa, Homo Sapiens
EAAVPFTNY

SEQ ID NO: 478142 - protein, 9 aa, Homo Sapiens
LQVKGNTAS

SEQ ID NO: 478143 - protein, 9 aa, Homo Sapiens
FRVNTEGSY

SEQ ID NO: 478144 - protein, 9 aa, Homo Sapiens
VKDACVSDE

SEQ ID NO: 478145 - protein, 9 aa, Homo Sapiens
ALDYGRDNL

SEQ ID NO: 478146 - protein, 9 aa, Homo Sapiens
HISPAGSMA

SEQ ID NO: 478147 - protein, 9 aa, Homo Sapiens
LPESLQRDA

SEQ ID NO: 478148 - protein, 9 aa, Homo Sapiens
KDKPTVDRF

SEQ ID NO: 478149 - protein, 9 aa, Homo Sapiens
VPMLLVPVP

SEQ ID NO: 478150 - protein, 9 aa, Homo Sapiens
CRKLRAARG

SEQ ID NO: 478151 - protein, 9 aa, Homo Sapiens
NTSKAQGEL

SEQ ID NO: 478152 - protein, 9 aa, Homo Sapiens
SLIKDTIQG

SEQ ID NO: 478153 - protein, 9 aa, Homo Sapiens
LGYVPAIEG

SEQ ID NO: 478154 - protein, 9 aa, Homo Sapiens
DSPYPKHSL

SEQ ID NO: 478155 - protein, 9 aa, Homo Sapiens
CLSAAHTKQ

SEQ ID NO: 478156 - protein, 9 aa, Homo Sapiens
EDTESCDDL

SEQ ID NO: 478157 - protein, 9 aa, Homo Sapiens
EDPASAPDS

SEQ ID NO: 478158 - protein, 9 aa, Homo Sapiens
LQAVRKTLL

SEQ ID NO: 478159 - protein, 9 aa, Homo Sapiens
KAELEQNLS

SEQ ID NO: 478160 - protein, 9 aa, Homo Sapiens
SKEEQDPVK

SEQ ID NO: 478161 - protein, 9 aa, Homo Sapiens
VTFEDKEPK

SEQ ID NO: 478162 - protein, 9 aa, Homo Sapiens
TIAHGGVLP

SEQ ID NO: 478163 - protein, 9 aa, Homo Sapiens
PRRGPGARG

SEQ ID NO: 478164 - protein, 9 aa, Homo Sapiens
MASDRLDTP

SEQ ID NO: 478165 - protein, 9 aa, Homo Sapiens
SYADKKFSY

SEQ ID NO: 478166 - protein, 9 aa, Homo Sapiens
FKNKLYAHE

SEQ ID NO: 478167 - protein, 9 aa, Homo Sapiens
AVGLSRMIE

SEQ ID NO: 478168 - protein, 9 aa, Homo Sapiens
LAQTQQHLN

SEQ ID NO: 478169 - protein, 9 aa, Homo Sapiens
AVTSRRSMN

SEQ ID NO: 478170 - protein, 9 aa, Homo Sapiens
MGSAQFEGL

SEQ ID NO: 478171 - protein, 9 aa, Homo Sapiens
TRRYCTSSK

SEQ ID NO: 478172 - protein, 9 aa, Homo Sapiens
LLSPGSHLL

SEQ ID NO: 478173 - protein, 9 aa, Homo Sapiens
ESDVLSPQD

SEQ ID NO: 478174 - protein, 9 aa, Homo Sapiens
GVLLWEIVA

SEQ ID NO: 478175 - protein, 9 aa, Homo Sapiens
PALEQSENE

SEQ ID NO: 478176 - protein, 9 aa, Homo Sapiens
VLQKESGAG

SEQ ID NO: 478177 - protein, 9 aa, Homo Sapiens
ENEVIPKVL

SEQ ID NO: 478178 - protein, 9 aa, Homo Sapiens
NVHTQLAGK

SEQ ID NO: 478179 - protein, 9 aa, Homo Sapiens
RKKQIAVQA

SEQ ID NO: 478180 - protein, 9 aa, Homo Sapiens
ICNFVHENE

SEQ ID NO: 478181 - protein, 9 aa, Homo Sapiens
LEAAVPFTN

SEQ ID NO: 478182 - protein, 9 aa, Homo Sapiens
GERSRRETA

SEQ ID NO: 478183 - protein, 9 aa, Homo Sapiens
TLLNETDIF

SEQ ID NO: 478184 - protein, 9 aa, Homo Sapiens
RTQAMSRFA

SEQ ID NO: 478185 - protein, 9 aa, Homo Sapiens
DYGDESADE

SEQ ID NO: 478186 - protein, 9 aa, Homo Sapiens
AICIRNALL

SEQ ID NO: 478187 - protein, 9 aa, Homo Sapiens
VCTGGVTEI

SEQ ID NO: 478188 - protein, 9 aa, Homo Sapiens
GSSIQLVEV

SEQ ID NO: 478189 - protein, 9 aa, Homo Sapiens
SSQANEATT

SEQ ID NO: 478190 - protein, 9 aa, Homo Sapiens
GTPVCRPGW

SEQ ID NO: 478191 - protein, 9 aa, Homo Sapiens
GPKGNRGFD

SEQ ID NO: 478192 - protein, 9 aa, Homo Sapiens
EEEMETDMD

SEQ ID NO: 478193 - protein, 9 aa, Homo Sapiens
GCPGTSGPP

SEQ ID NO: 478194 - protein, 9 aa, Homo Sapiens
NLENFQLVQ

SEQ ID NO: 478195 - protein, 9 aa, Homo Sapiens
HLKILRAQL

SEQ ID NO: 478196 - protein, 9 aa, Homo Sapiens
EGDNCKLKR

SEQ ID NO: 478197 - protein, 9 aa, Homo Sapiens
EAVKEYVDM

SEQ ID NO: 478198 - protein, 9 aa, Homo Sapiens
TMASFLHSS

SEQ ID NO: 478199 - protein, 9 aa, Homo Sapiens
LPERGGSLH

SEQ ID NO: 478200 - protein, 9 aa, Homo Sapiens
KSLSCITEM

SEQ ID NO: 478201 - protein, 9 aa, Homo Sapiens
PIGHRGEGN

SEQ ID NO: 478202 - protein, 9 aa, Homo Sapiens
MQDLKPFHI

SEQ ID NO: 478203 - protein, 9 aa, Homo Sapiens
PVGMGYPVK

SEQ ID NO: 478204 - protein, 9 aa, Homo Sapiens
SKNLKDYDP

SEQ ID NO: 478205 - protein, 9 aa, Homo Sapiens
FDAFKDDDS

SEQ ID NO: 478206 - protein, 9 aa, Homo Sapiens
SPAGSMARN

SEQ ID NO: 478207 - protein, 9 aa, Homo Sapiens
IKSLSCITE

SEQ ID NO: 478208 - protein, 9 aa, Homo Sapiens
GSQEGAKYI

SEQ ID NO: 478209 - protein, 9 aa, Homo Sapiens
LAHVEGLSV

SEQ ID NO: 478210 - protein, 9 aa, Homo Sapiens
VTFKCEATG

SEQ ID NO: 478211 - protein, 9 aa, Homo Sapiens
ESGPQLAAL

SEQ ID NO: 478212 - protein, 9 aa, Homo Sapiens
RQDQIEDEP

SEQ ID NO: 478213 - protein, 9 aa, Homo Sapiens
GQQGSEEAD

SEQ ID NO: 478214 - protein, 9 aa, Homo Sapiens
CCKRYREFA

SEQ ID NO: 478215 - protein, 9 aa, Homo Sapiens
STESTPQHS

SEQ ID NO: 478216 - protein, 9 aa, Homo Sapiens
AAICIRNAL

SEQ ID NO: 478217 - protein, 9 aa, Homo Sapiens
VVRHGKRVD

SEQ ID NO: 478218 - protein, 9 aa, Homo Sapiens
QEDKVWRQE

SEQ ID NO: 478219 - protein, 9 aa, Homo Sapiens
PLSGLPGQA

SEQ ID NO: 478220 - protein, 9 aa, Homo Sapiens
QHPDINSSD

SEQ ID NO: 478221 - protein, 9 aa, Homo Sapiens
KKSPLSSIV

SEQ ID NO: 478222 - protein, 9 aa, Homo Sapiens
EFGTLKDVG

SEQ ID NO: 478223 - protein, 9 aa, Homo Sapiens
AIFEGFKSK

SEQ ID NO: 478224 - protein, 9 aa, Homo Sapiens
PGWSHSSST

SEQ ID NO: 478225 - protein, 9 aa, Homo Sapiens
FVSGADDYK

SEQ ID NO: 478226 - protein, 9 aa, Homo Sapiens
ARLSTKNAD

SEQ ID NO: 478227 - protein, 9 aa, Homo Sapiens
NQLQNIPPV

SEQ ID NO: 478228 - protein, 9 aa, Homo Sapiens
RRRYLANSG

SEQ ID NO: 478229 - protein, 9 aa, Homo Sapiens
VTSRRSMNL

SEQ ID NO: 478230 - protein, 9 aa, Homo Sapiens
EPDTKDVAQ

SEQ ID NO: 478231 - protein, 9 aa, Homo Sapiens
LVGDSRAQS

SEQ ID NO: 478232 - protein, 9 aa, Homo Sapiens
SLSCITEMQ

SEQ ID NO: 478233 - protein, 9 aa, Homo Sapiens
RNIKPRHLC

SEQ ID NO: 478234 - protein, 9 aa, Homo Sapiens
QMDRYLVYS

SEQ ID NO: 478235 - protein, 9 aa, Homo Sapiens
RENLMASDR

SEQ ID NO: 478236 - protein, 9 aa, Homo Sapiens
FYNLSDSTN

SEQ ID NO: 478237 - protein, 9 aa, Homo Sapiens
RVGPGEPEP

SEQ ID NO: 478238 - protein, 9 aa, Homo Sapiens
VMQGFNRCE

SEQ ID NO: 478239 - protein, 9 aa, Homo Sapiens
KKIAHRQHK

SEQ ID NO: 478240 - protein, 9 aa, Homo Sapiens
AQITYSLIK

SEQ ID NO: 478241 - protein, 9 aa, Homo Sapiens
FHPHFVRIF

SEQ ID NO: 478242 - protein, 9 aa, Homo Sapiens
SCSPGTALT

SEQ ID NO: 478243 - protein, 9 aa, Homo Sapiens
QIPQIPASV

SEQ ID NO: 478244 - protein, 9 aa, Homo Sapiens
ALLSSGHKD

SEQ ID NO: 478245 - protein, 9 aa, Homo Sapiens
PLRLARFRH

SEQ ID NO: 478246 - protein, 9 aa, Homo Sapiens
LSICHTFRW

SEQ ID NO: 478247 - protein, 9 aa, Homo Sapiens
EILKYFQYV

SEQ ID NO: 478248 - protein, 9 aa, Homo Sapiens
LLTSYYAFS

SEQ ID NO: 478249 - protein, 9 aa, Homo Sapiens
QQVAEGGPG

SEQ ID NO: 478250 - protein, 9 aa, Homo Sapiens
FASGVYSDH

SEQ ID NO: 478251 - protein, 9 aa, Homo Sapiens
FASKRRSRF

SEQ ID NO: 478252 - protein, 9 aa, Homo Sapiens
FEGLITQAR

SEQ ID NO: 478253 - protein, 9 aa, Homo Sapiens
TRNAGRRLA

SEQ ID NO: 478254 - protein, 9 aa, Homo Sapiens
TNRGWAWDG

SEQ ID NO: 478255 - protein, 9 aa, Homo Sapiens
ERGGSLHIQ

SEQ ID NO: 478256 - protein, 9 aa, Homo Sapiens
SLPHVRQPD

SEQ ID NO: 478257 - protein, 9 aa, Homo Sapiens
AHQLGFEKY

SEQ ID NO: 478258 - protein, 9 aa, Homo Sapiens
QSSQANEAT

SEQ ID NO: 478259 - protein, 9 aa, Homo Sapiens
ESPQLGELC

SEQ ID NO: 478260 - protein, 9 aa, Homo Sapiens
DIELQKMKA

SEQ ID NO: 478261 - protein, 9 aa, Homo Sapiens
IAFKNKLYA

SEQ ID NO: 478262 - protein, 9 aa, Homo Sapiens
AEEFGTLKD

SEQ ID NO: 478263 - protein, 9 aa, Homo Sapiens
AQLQDDAVY

SEQ ID NO: 478264 - protein, 9 aa, Homo Sapiens
VSKLPRDFD

SEQ ID NO: 478265 - protein, 9 aa, Homo Sapiens
KIRLSEGKA

SEQ ID NO: 478266 - protein, 9 aa, Homo Sapiens
TLLCRDWPG

SEQ ID NO: 478267 - protein, 9 aa, Homo Sapiens
CCFIPLCVD

SEQ ID NO: 478268 - protein, 9 aa, Homo Sapiens
PFHILISLL

SEQ ID NO: 478269 - protein, 9 aa, Homo Sapiens
GVPEESALS

SEQ ID NO: 478270 - protein, 9 aa, Homo Sapiens
PQIVAVYSR

SEQ ID NO: 478271 - protein, 9 aa, Homo Sapiens
WEFEKSEED

SEQ ID NO: 478272 - protein, 9 aa, Homo Sapiens
ASDRLDTPM

SEQ ID NO: 478273 - protein, 9 aa, Homo Sapiens
PSNPEHVFT

SEQ ID NO: 478274 - protein, 9 aa, Homo Sapiens
PFNLKEIKD

SEQ ID NO: 478275 - protein, 9 aa, Homo Sapiens
VLIGSTSAP

SEQ ID NO: 478276 - protein, 9 aa, Homo Sapiens
ECMVTVVLG

SEQ ID NO: 478277 - protein, 9 aa, Homo Sapiens
TKQILDTAL

SEQ ID NO: 478278 - protein, 9 aa, Homo Sapiens
MCCGRGYDP

SEQ ID NO: 478279 - protein, 9 aa, Homo Sapiens
TKGCWDQLS

SEQ ID NO: 478280 - protein, 9 aa, Homo Sapiens
GRVVPMLLV

SEQ ID NO: 478281 - protein, 9 aa, Homo Sapiens
STCPSRHFS

SEQ ID NO: 478282 - protein, 9 aa, Homo Sapiens
YPAAQYVDL

SEQ ID NO: 478283 - protein, 9 aa, Homo Sapiens
QPGVSVGVS

SEQ ID NO: 478284 - protein, 9 aa, Homo Sapiens
MRMHLLEKT

SEQ ID NO: 478285 - protein, 9 aa, Homo Sapiens
LTSPRTCTS

SEQ ID NO: 478286 - protein, 9 aa, Homo Sapiens
VRQVSVAHF

SEQ ID NO: 478287 - protein, 9 aa, Homo Sapiens
QKEVQISHL

SEQ ID NO: 478288 - protein, 9 aa, Homo Sapiens
GLLVTSSPP

SEQ ID NO: 478289 - protein, 9 aa, Homo Sapiens
FIKMCRAFD

SEQ ID NO: 478290 - protein, 9 aa, Homo Sapiens
KNSLKDVDQ

SEQ ID NO: 478291 - protein, 9 aa, Homo Sapiens
HANSDVPPS

SEQ ID NO: 478292 - protein, 9 aa, Homo Sapiens
FTNRGWAWD

SEQ ID NO: 478293 - protein, 9 aa, Homo Sapiens
CRANKALGM

SEQ ID NO: 478294 - protein, 9 aa, Homo Sapiens
QHNLYRNVM

SEQ ID NO: 478295 - protein, 9 aa, Homo Sapiens
VALGGNPYP

SEQ ID NO: 478296 - protein, 9 aa, Homo Sapiens
DEEYAGSDE

SEQ ID NO: 478297 - protein, 9 aa, Homo Sapiens
VTISSSPFP

SEQ ID NO: 478298 - protein, 9 aa, Homo Sapiens
PRSLLTSPR

SEQ ID NO: 478299 - protein, 9 aa, Homo Sapiens
ETILSNKKQ

SEQ ID NO: 478300 - protein, 9 aa, Homo Sapiens
NAFHKKDRR

SEQ ID NO: 478301 - protein, 9 aa, Homo Sapiens
GNRGFDGLP

SEQ ID NO: 478302 - protein, 9 aa, Homo Sapiens
DACVSDESE

SEQ ID NO: 478303 - protein, 9 aa, Homo Sapiens
VQHEQREAA

SEQ ID NO: 478304 - protein, 9 aa, Homo Sapiens
GDSNSYFGP

SEQ ID NO: 478305 - protein, 9 aa, Homo Sapiens
KHYLSIVPG

SEQ ID NO: 478306 - protein, 9 aa, Homo Sapiens
VELAPRSTE

SEQ ID NO: 478307 - protein, 9 aa, Homo Sapiens
KAPPHIFSI

SEQ ID NO: 478308 - protein, 9 aa, Homo Sapiens
DTHSRTDPM

SEQ ID NO: 478309 - protein, 9 aa, Homo Sapiens
GLPGQALLC

SEQ ID NO: 478310 - protein, 9 aa, Homo Sapiens
PMAAKIEGS

SEQ ID NO: 478311 - protein, 9 aa, Homo Sapiens
LPGQALLCG

SEQ ID NO: 478312 - protein, 9 aa, Homo Sapiens
TQQLAQTQQ

SEQ ID NO: 478313 - protein, 9 aa, Homo Sapiens
PSAVPLPVG

SEQ ID NO: 478314 - protein, 9 aa, Homo Sapiens
SPGRQPNQK

SEQ ID NO: 478315 - protein, 9 aa, Homo Sapiens
KTHHMVAKP

SEQ ID NO: 478316 - protein, 9 aa, Homo Sapiens
EADLVSQEP

SEQ ID NO: 478317 - protein, 9 aa, Homo Sapiens
MDRYLVYSD

SEQ ID NO: 478318 - protein, 9 aa, Homo Sapiens
SEGQQGSEE

SEQ ID NO: 478319 - protein, 9 aa, Homo Sapiens
GTEGAATTM

SEQ ID NO: 478320 - protein, 9 aa, Homo Sapiens
VPAEDIEKV

SEQ ID NO: 478321 - protein, 9 aa, Homo Sapiens
TPSCSPGTA

SEQ ID NO: 478322 - protein, 9 aa, Homo Sapiens
LSSIVFSAL

SEQ ID NO: 478323 - protein, 9 aa, Homo Sapiens
LRLARFRHP

SEQ ID NO: 478324 - protein, 9 aa, Homo Sapiens
SELIMESNS

SEQ ID NO: 478325 - protein, 9 aa, Homo Sapiens
EITKQEKDF

SEQ ID NO: 478326 - protein, 9 aa, Homo Sapiens
HRIQQLKQL

SEQ ID NO: 478327 - protein, 9 aa, Homo Sapiens
ESTTFVLGC

SEQ ID NO: 478328 - protein, 9 aa, Homo Sapiens
RDKLQRFPG

SEQ ID NO: 478329 - protein, 9 aa, Homo Sapiens
SLQRDAPRG

SEQ ID NO: 478330 - protein, 9 aa, Homo Sapiens
APLQVFRRF

SEQ ID NO: 478331 - protein, 9 aa, Homo Sapiens
QQLKQLGHS

SEQ ID NO: 478332 - protein, 9 aa, Homo Sapiens
QQAEFQNMS

SEQ ID NO: 478333 - protein, 9 aa, Homo Sapiens
PTKTSQGTP

SEQ ID NO: 478334 - protein, 9 aa, Homo Sapiens
ITASFCRFG

SEQ ID NO: 478335 - protein, 9 aa, Homo Sapiens
LIHLSDRAT

SEQ ID NO: 478336 - protein, 9 aa, Homo Sapiens
SKTRKIPYL

SEQ ID NO: 478337 - protein, 9 aa, Homo Sapiens
PGCVPKINR

SEQ ID NO: 478338 - protein, 9 aa, Homo Sapiens
RAARGAAAC

SEQ ID NO: 478339 - protein, 9 aa, Homo Sapiens
GKKIAHRQH

SEQ ID NO: 478340 - protein, 9 aa, Homo Sapiens
GSPGDKGEK

SEQ ID NO: 478341 - protein, 9 aa, Homo Sapiens
LANCSFPNL

SEQ ID NO: 478342 - protein, 9 aa, Homo Sapiens
FMKRIAACE

SEQ ID NO: 478343 - protein, 9 aa, Homo Sapiens
CNKVDLENS

SEQ ID NO: 478344 - protein, 9 aa, Homo Sapiens
THHMVAKPP

SEQ ID NO: 478345 - protein, 9 aa, Homo Sapiens
VAFVVAFYN

SEQ ID NO: 478346 - protein, 9 aa, Homo Sapiens
ELEAAVPFT

SEQ ID NO: 478347 - protein, 9 aa, Homo Sapiens
DSSFATLPP

SEQ ID NO: 478348 - protein, 9 aa, Homo Sapiens
FEDKEPKEQ

SEQ ID NO: 478349 - protein, 9 aa, Homo Sapiens
RTDPMQMPY

SEQ ID NO: 478350 - protein, 9 aa, Homo Sapiens
HEMGADVNA

SEQ ID NO: 478351 - protein, 9 aa, Homo Sapiens
GVGHVARPG

SEQ ID NO: 478352 - protein, 9 aa, Homo Sapiens
VFPFDQQNC

SEQ ID NO: 478353 - protein, 9 aa, Homo Sapiens
SRTDPMQMP

SEQ ID NO: 478354 - protein, 9 aa, Homo Sapiens
DLYNASGAH

SEQ ID NO: 478355 - protein, 9 aa, Homo Sapiens
LTTLLVTAS

SEQ ID NO: 478356 - protein, 9 aa, Homo Sapiens
KAKPYMTKQ

SEQ ID NO: 478357 - protein, 9 aa, Homo Sapiens
TVPIEQKHK

SEQ ID NO: 478358 - protein, 9 aa, Homo Sapiens
MAEEFGTLK

SEQ ID NO: 478359 - protein, 9 aa, Homo Sapiens
GYVPAIEGA

SEQ ID NO: 478360 - protein, 9 aa, Homo Sapiens
RPAPAPSLM

SEQ ID NO: 478361 - protein, 9 aa, Homo Sapiens
IRALMVSCN

SEQ ID NO: 478362 - protein, 9 aa, Homo Sapiens
MHLLEKTTV

SEQ ID NO: 478363 - protein, 9 aa, Homo Sapiens
REARFQTTS

SEQ ID NO: 478364 - protein, 9 aa, Homo Sapiens
IKVYYDGTV

SEQ ID NO: 478365 - protein, 9 aa, Homo Sapiens
VYIHGLYLN

SEQ ID NO: 478366 - protein, 9 aa, Homo Sapiens
HSLFSQETP

SEQ ID NO: 478367 - protein, 9 aa, Homo Sapiens
RMIEGPILP

SEQ ID NO: 478368 - protein, 9 aa, Homo Sapiens
HGLTGRVEF

SEQ ID NO: 478369 - protein, 9 aa, Homo Sapiens
TKRPEANSV

SEQ ID NO: 478370 - protein, 9 aa, Homo Sapiens
ITKQEKDFL

SEQ ID NO: 478371 - protein, 9 aa, Homo Sapiens
RESPTGKLP

SEQ ID NO: 478372 - protein, 9 aa, Homo Sapiens
PGAKGPTGC

SEQ ID NO: 478373 - protein, 9 aa, Homo Sapiens
KRMEQQRSQ

SEQ ID NO: 478374 - protein, 9 aa, Homo Sapiens
KNIPQIVAV

SEQ ID NO: 478375 - protein, 9 aa, Homo Sapiens
PRSPHSPLP

SEQ ID NO: 478376 - protein, 9 aa, Homo Sapiens
ACMEQPLQK

SEQ ID NO: 478377 - protein, 9 aa, Homo Sapiens
SLNPKLESS

SEQ ID NO: 478378 - protein, 9 aa, Homo Sapiens
FPSSSGSAF

SEQ ID NO: 478379 - protein, 9 aa, Homo Sapiens
AKQLSSLRD

SEQ ID NO: 478380 - protein, 9 aa, Homo Sapiens
LYKVLRAGR

SEQ ID NO: 478381 - protein, 9 aa, Homo Sapiens
CREHLLKSF

SEQ ID NO: 478382 - protein, 9 aa, Homo Sapiens
RAVQGARQG

SEQ ID NO: 478383 - protein, 9 aa, Homo Sapiens
NKLQPGCVP

SEQ ID NO: 478384 - protein, 9 aa, Homo Sapiens
IAYISCSSS

SEQ ID NO: 478385 - protein, 9 aa, Homo Sapiens
SPLPIATPP

SEQ ID NO: 478386 - protein, 9 aa, Homo Sapiens
RLYPLIHNV

SEQ ID NO: 478387 - protein, 9 aa, Homo Sapiens
QGLLVTSSP

SEQ ID NO: 478388 - protein, 9 aa, Homo Sapiens
RGYDPSHVT

SEQ ID NO: 478389 - protein, 9 aa, Homo Sapiens
SNPEHVFTC

SEQ ID NO: 478390 - protein, 9 aa, Homo Sapiens
RFASKRRSR

SEQ ID NO: 478391 - protein, 9 aa, Homo Sapiens
LAMLCNENR

SEQ ID NO: 478392 - protein, 9 aa, Homo Sapiens
EKRLQKQRE

SEQ ID NO: 478393 - protein, 9 aa, Homo Sapiens
TFPAGIMTV

SEQ ID NO: 478394 - protein, 9 aa, Homo Sapiens
PKLAYPMAH

SEQ ID NO: 478395 - protein, 9 aa, Homo Sapiens
NLKTHHMVA

SEQ ID NO: 478396 - protein, 9 aa, Homo Sapiens
NCIDAVKLD

SEQ ID NO: 478397 - protein, 9 aa, Homo Sapiens
LLPGPLPAS

SEQ ID NO: 478398 - protein, 9 aa, Homo Sapiens
ANSLLQETK

SEQ ID NO: 478399 - protein, 9 aa, Homo Sapiens
YSRKETIPE

SEQ ID NO: 478400 - protein, 9 aa, Homo Sapiens
GREARFQTT

SEQ ID NO: 478401 - protein, 9 aa, Homo Sapiens
IFLANGNVF

SEQ ID NO: 478402 - protein, 9 aa, Homo Sapiens
CVPKINRSM

SEQ ID NO: 478403 - protein, 9 aa, Homo Sapiens
KFMYTSQYD

SEQ ID NO: 478404 - protein, 9 aa, Homo Sapiens
YPTDFLGSL

SEQ ID NO: 478405 - protein, 9 aa, Homo Sapiens
YFEEPDSCG

SEQ ID NO: 478406 - protein, 9 aa, Homo Sapiens
LVKKESFAV

SEQ ID NO: 478407 - protein, 9 aa, Homo Sapiens
SRRHRFWQC

SEQ ID NO: 478408 - protein, 9 aa, Homo Sapiens
KPMAAKIEG

SEQ ID NO: 478409 - protein, 9 aa, Homo Sapiens
GTANVCISL

SEQ ID NO: 478410 - protein, 9 aa, Homo Sapiens
LQETKQGNL

SEQ ID NO: 478411 - protein, 9 aa, Homo Sapiens
FQEPGVAKA

SEQ ID NO: 478412 - protein, 9 aa, Homo Sapiens
QKSCICSEC

SEQ ID NO: 478413 - protein, 9 aa, Homo Sapiens
KEPWFFKNH

SEQ ID NO: 478414 - protein, 9 aa, Homo Sapiens
RIRALMVSC

SEQ ID NO: 478415 - protein, 9 aa, Homo Sapiens
LRVRSLEKL

SEQ ID NO: 478416 - protein, 9 aa, Homo Sapiens
KQEDKVWRQ

SEQ ID NO: 478417 - protein, 9 aa, Homo Sapiens
GSFLIHLSD

SEQ ID NO: 478418 - protein, 9 aa, Homo Sapiens
ARKEEVPVS

SEQ ID NO: 478419 - protein, 9 aa, Homo Sapiens
KVDLENSAD

SEQ ID NO: 478420 - protein, 9 aa, Homo Sapiens
GTAAMGRVV

SEQ ID NO: 478421 - protein, 9 aa, Homo Sapiens
EGGRPWHLP

SEQ ID NO: 478422 - protein, 9 aa, Homo Sapiens
HVARPGPTA

SEQ ID NO: 478423 - protein, 9 aa, Homo Sapiens
RWCLSPPAL

SEQ ID NO: 478424 - protein, 9 aa, Homo Sapiens
ALDSHGTLV

SEQ ID NO: 478425 - protein, 9 aa, Homo Sapiens
RKFSSASHA

SEQ ID NO: 478426 - protein, 9 aa, Homo Sapiens
EMAPASEAL

SEQ ID NO: 478427 - protein, 9 aa, Homo Sapiens
LQKESGAGE

SEQ ID NO: 478428 - protein, 9 aa, Homo Sapiens
QAGYFHPHF

SEQ ID NO: 478429 - protein, 9 aa, Homo Sapiens
SVRQLIENA

SEQ ID NO: 478430 - protein, 9 aa, Homo Sapiens
RRHRRRRRR

SEQ ID NO: 478431 - protein, 9 aa, Homo Sapiens
YPMAHLCPV

SEQ ID NO: 478432 - protein, 9 aa, Homo Sapiens
AKLTVQVKE

SEQ ID NO: 478433 - protein, 9 aa, Homo Sapiens
DQIEDEPEQ

SEQ ID NO: 478434 - protein, 9 aa, Homo Sapiens
SRVRQVSVA

SEQ ID NO: 478435 - protein, 9 aa, Homo Sapiens
PKLESSTSL

SEQ ID NO: 478436 - protein, 9 aa, Homo Sapiens
CSIDVTVFP

SEQ ID NO: 478437 - protein, 9 aa, Homo Sapiens
PGFLSKRLK

SEQ ID NO: 478438 - protein, 9 aa, Homo Sapiens
EAEEKELEI

SEQ ID NO: 478439 - protein, 9 aa, Homo Sapiens
ALEQSENEK

SEQ ID NO: 478440 - protein, 9 aa, Homo Sapiens
VVFAVTSRR

SEQ ID NO: 478441 - protein, 9 aa, Homo Sapiens
SSCNSTQAL

SEQ ID NO: 478442 - protein, 9 aa, Homo Sapiens
QPPDADPVK

SEQ ID NO: 478443 - protein, 9 aa, Homo Sapiens
WSHSSSTEP

SEQ ID NO: 478444 - protein, 9 aa, Homo Sapiens
EFKASGSVS

SEQ ID NO: 478445 - protein, 9 aa, Homo Sapiens
MKELQAVRK

SEQ ID NO: 478446 - protein, 9 aa, Homo Sapiens
TSKRAVTKM

SEQ ID NO: 478447 - protein, 9 aa, Homo Sapiens
TTQLLMNDR

SEQ ID NO: 478448 - protein, 9 aa, Homo Sapiens
GKAKEDSLD

SEQ ID NO: 478449 - protein, 9 aa, Homo Sapiens
EPYGETADV

SEQ ID NO: 478450 - protein, 9 aa, Homo Sapiens
NHSEGQQGS

SEQ ID NO: 478451 - protein, 9 aa, Homo Sapiens
RDNGVLQKE

SEQ ID NO: 478452 - protein, 9 aa, Homo Sapiens
INAFHKKDR

SEQ ID NO: 478453 - protein, 9 aa, Homo Sapiens
MKFNNPPVN

SEQ ID NO: 478454 - protein, 9 aa, Homo Sapiens
HHLKILRAQ

SEQ ID NO: 478455 - protein, 9 aa, Homo Sapiens
VKGCLAQVF

SEQ ID NO: 478456 - protein, 9 aa, Homo Sapiens
REDSNEQDP

SEQ ID NO: 478457 - protein, 9 aa, Homo Sapiens
AIIWRRGHE

SEQ ID NO: 478458 - protein, 9 aa, Homo Sapiens
SLGEELCSV

SEQ ID NO: 478459 - protein, 9 aa, Homo Sapiens
SSSHSDESE

SEQ ID NO: 478460 - protein, 9 aa, Homo Sapiens
IYTHEAGTG

SEQ ID NO: 478461 - protein, 9 aa, Homo Sapiens
AQDPDAGQA

SEQ ID NO: 478462 - protein, 9 aa, Homo Sapiens
ANGLGVAEA

SEQ ID NO: 478463 - protein, 9 aa, Homo Sapiens
QEKIRKQED

SEQ ID NO: 478464 - protein, 9 aa, Homo Sapiens
LLEYKFVNS

SEQ ID NO: 478465 - protein, 9 aa, Homo Sapiens
GADQFRVNT

SEQ ID NO: 478466 - protein, 9 aa, Homo Sapiens
SPRTCTSPM

SEQ ID NO: 478467 - protein, 9 aa, Homo Sapiens
SLAHVEGLS

SEQ ID NO: 478468 - protein, 9 aa, Homo Sapiens
LWCSLGTTC

SEQ ID NO: 478469 - protein, 9 aa, Homo Sapiens
ATEPECMVT

SEQ ID NO: 478470 - protein, 9 aa, Homo Sapiens
NREDSNEQD

SEQ ID NO: 478471 - protein, 9 aa, Homo Sapiens
ITYSLIKDT

SEQ ID NO: 478472 - protein, 9 aa, Homo Sapiens
ALVELEAAV

SEQ ID NO: 478473 - protein, 9 aa, Homo Sapiens
DFLGSLPAN

SEQ ID NO: 478474 - protein, 9 aa, Homo Sapiens
SLFDGFANG

SEQ ID NO: 478475 - protein, 9 aa, Homo Sapiens
NTDQKSLER

SEQ ID NO: 478476 - protein, 9 aa, Homo Sapiens
TGSSTCYSF

SEQ ID NO: 478477 - protein, 9 aa, Homo Sapiens
IANNSAGSA

SEQ ID NO: 478478 - protein, 9 aa, Homo Sapiens
EGGPGCTRP

SEQ ID NO: 478479 - protein, 9 aa, Homo Sapiens
GFLSKRLKG

SEQ ID NO: 478480 - protein, 9 aa, Homo Sapiens
PDSCGHAGG

SEQ ID NO: 478481 - protein, 9 aa, Homo Sapiens
EYSGCWNFG

SEQ ID NO: 478482 - protein, 9 aa, Homo Sapiens
CLDMAQHNL

SEQ ID NO: 478483 - protein, 9 aa, Homo Sapiens
QYVTSNRWL

SEQ ID NO: 478484 - protein, 9 aa, Homo Sapiens
IYSEEALGP

SEQ ID NO: 478485 - protein, 9 aa, Homo Sapiens
FGPSCSGDC

SEQ ID NO: 478486 - protein, 9 aa, Homo Sapiens
QEFHIRSKN

SEQ ID NO: 478487 - protein, 9 aa, Homo Sapiens
PQGVEKPLH

SEQ ID NO: 478488 - protein, 9 aa, Homo Sapiens
LKYFQYVTS

SEQ ID NO: 478489 - protein, 9 aa, Homo Sapiens
QQLAQTQQH

SEQ ID NO: 478490 - protein, 9 aa, Homo Sapiens
YLWKALANC

SEQ ID NO: 478491 - protein, 9 aa, Homo Sapiens
YDPLIHCVL

SEQ ID NO: 478492 - protein, 9 aa, Homo Sapiens
LRAQLQDDA

SEQ ID NO: 478493 - protein, 9 aa, Homo Sapiens
MVEYHGLTG

SEQ ID NO: 478494 - protein, 9 aa, Homo Sapiens
PFKVPGFLS

SEQ ID NO: 478495 - protein, 9 aa, Homo Sapiens
PSVQPSLLQ

SEQ ID NO: 478496 - protein, 9 aa, Homo Sapiens
AQHNLYRNV

SEQ ID NO: 478497 - protein, 9 aa, Homo Sapiens
DPRFCRKLR

SEQ ID NO: 478498 - protein, 9 aa, Homo Sapiens
IINNCIDAV

SEQ ID NO: 478499 - protein, 9 aa, Homo Sapiens
VPIEQKHKV

SEQ ID NO: 478500 - protein, 9 aa, Homo Sapiens
AGAPVAAQP

SEQ ID NO: 478501 - protein, 9 aa, Homo Sapiens
QHEQREAAA

SEQ ID NO: 478502 - protein, 9 aa, Homo Sapiens
RLLPETSLL

SEQ ID NO: 478503 - protein, 9 aa, Homo Sapiens
IHLKTIISL

SEQ ID NO: 478504 - protein, 9 aa, Homo Sapiens
RLRVTFEDK

SEQ ID NO: 478505 - protein, 9 aa, Homo Sapiens
IFPLTVLLD

SEQ ID NO: 478506 - protein, 9 aa, Homo Sapiens
IEGPILPSE

SEQ ID NO: 478507 - protein, 9 aa, Homo Sapiens
WNLKTHHMV

SEQ ID NO: 478508 - protein, 9 aa, Homo Sapiens
KGNRGFDGL

SEQ ID NO: 478509 - protein, 9 aa, Homo Sapiens
FEIKVYYDG

SEQ ID NO: 478510 - protein, 9 aa, Homo Sapiens
QLICCLVDG

SEQ ID NO: 478511 - protein, 9 aa, Homo Sapiens
QKLRAKISS

SEQ ID NO: 478512 - protein, 9 aa, Homo Sapiens
KIHLKTIIS

SEQ ID NO: 478513 - protein, 9 aa, Homo Sapiens
LHIEKRLRE

SEQ ID NO: 478514 - protein, 9 aa, Homo Sapiens
CKEMAPASE

SEQ ID NO: 478515 - protein, 9 aa, Homo Sapiens
GNPGPESDV

SEQ ID NO: 478516 - protein, 9 aa, Homo Sapiens
VFSALDSDT

SEQ ID NO: 478517 - protein, 9 aa, Homo Sapiens
LLPGALADL

SEQ ID NO: 478518 - protein, 9 aa, Homo Sapiens
MHVNNGWAM

SEQ ID NO: 478519 - protein, 9 aa, Homo Sapiens
PVADLPEGI

SEQ ID NO: 478520 - protein, 9 aa, Homo Sapiens
APVAAQPAA

SEQ ID NO: 478521 - protein, 9 aa, Homo Sapiens
ECPFSSWRF

SEQ ID NO: 478522 - protein, 9 aa, Homo Sapiens
QPSLLQDSP

SEQ ID NO: 478523 - protein, 9 aa, Homo Sapiens
RRHRFWQCQ

SEQ ID NO: 478524 - protein, 9 aa, Homo Sapiens
TLNPTYKEV

SEQ ID NO: 478525 - protein, 9 aa, Homo Sapiens
KLAYPMAHL

SEQ ID NO: 478526 - protein, 9 aa, Homo Sapiens
LRDKLQRFP

SEQ ID NO: 478527 - protein, 9 aa, Homo Sapiens
DLLLSVTGE

SEQ ID NO: 478528 - protein, 9 aa, Homo Sapiens
EEPDTKDVA

SEQ ID NO: 478529 - protein, 9 aa, Homo Sapiens
TQLKELERV

SEQ ID NO: 478530 - protein, 9 aa, Homo Sapiens
RAQLQDDAV

SEQ ID NO: 478531 - protein, 9 aa, Homo Sapiens
VLIINTPCG

SEQ ID NO: 478532 - protein, 9 aa, Homo Sapiens
GSDAMPDIM

SEQ ID NO: 478533 - protein, 9 aa, Homo Sapiens
YTQGISRSC

SEQ ID NO: 478534 - protein, 9 aa, Homo Sapiens
FNRCERCPR

SEQ ID NO: 478535 - protein, 9 aa, Homo Sapiens
LDDERYPAA

SEQ ID NO: 478536 - protein, 9 aa, Homo Sapiens
GALQGLGRG

SEQ ID NO: 478537 - protein, 9 aa, Homo Sapiens
SLKKPTKTS

SEQ ID NO: 478538 - protein, 9 aa, Homo Sapiens
LEQQVEEIR

SEQ ID NO: 478539 - protein, 9 aa, Homo Sapiens
KPTKTSQGT

SEQ ID NO: 478540 - protein, 9 aa, Homo Sapiens
LLQDSPLVQ

SEQ ID NO: 478541 - protein, 9 aa, Homo Sapiens
KDFEVKEDT

SEQ ID NO: 478542 - protein, 9 aa, Homo Sapiens
AAHTKQILD

SEQ ID NO: 478543 - protein, 9 aa, Homo Sapiens
NGGLQQNTS

SEQ ID NO: 478544 - protein, 9 aa, Homo Sapiens
SPNQQAALA

SEQ ID NO: 478545 - protein, 9 aa, Homo Sapiens
INIYRDKLF

SEQ ID NO: 478546 - protein, 9 aa, Homo Sapiens
KHEAFDSDL

SEQ ID NO: 478547 - protein, 9 aa, Homo Sapiens
PQQDYGDES

SEQ ID NO: 478548 - protein, 9 aa, Homo Sapiens
RIWAEYDPK

SEQ ID NO: 478549 - protein, 9 aa, Homo Sapiens
AKVKEGVQV

SEQ ID NO: 478550 - protein, 9 aa, Homo Sapiens
LVHLYNFHA

SEQ ID NO: 478551 - protein, 9 aa, Homo Sapiens
NSLLQETKQ

SEQ ID NO: 478552 - protein, 9 aa, Homo Sapiens
ADKNKQTGR

SEQ ID NO: 478553 - protein, 9 aa, Homo Sapiens
NEDATVYVG

SEQ ID NO: 478554 - protein, 9 aa, Homo Sapiens
VWQQAEFQN

SEQ ID NO: 478555 - protein, 9 aa, Homo Sapiens
WAGQKGYHH

SEQ ID NO: 478556 - protein, 9 aa, Homo Sapiens
SPQLGELCY

SEQ ID NO: 478557 - protein, 9 aa, Homo Sapiens
LRNLEQLYL

SEQ ID NO: 478558 - protein, 9 aa, Homo Sapiens
CDDLDESHT

SEQ ID NO: 478559 - protein, 9 aa, Homo Sapiens
PPVSFPWIR

SEQ ID NO: 478560 - protein, 9 aa, Homo Sapiens
VHLYNFHAL

SEQ ID NO: 478561 - protein, 9 aa, Homo Sapiens
EADRKELNH

SEQ ID NO: 478562 - protein, 9 aa, Homo Sapiens
TEKSFQCNE

SEQ ID NO: 478563 - protein, 9 aa, Homo Sapiens
PERGGSLHI

SEQ ID NO: 478564 - protein, 9 aa, Homo Sapiens
LTPKLAYPM

SEQ ID NO: 478565 - protein, 9 aa, Homo Sapiens
EPIYSEEAL

SEQ ID NO: 478566 - protein, 9 aa, Homo Sapiens
EILFVTQDA

SEQ ID NO: 478567 - protein, 9 aa, Homo Sapiens
HHMVAKPPV

SEQ ID NO: 478568 - protein, 9 aa, Homo Sapiens
ALKQIRLEH

SEQ ID NO: 478569 - protein, 9 aa, Homo Sapiens
EDIHSLNPK

SEQ ID NO: 478570 - protein, 9 aa, Homo Sapiens
EEFGTLKDV

SEQ ID NO: 478571 - protein, 9 aa, Homo Sapiens
HTEQKSCIC

SEQ ID NO: 478572 - protein, 9 aa, Homo Sapiens
HSDESESLP

SEQ ID NO: 478573 - protein, 9 aa, Homo Sapiens
VSYTKRPEA

SEQ ID NO: 478574 - protein, 9 aa, Homo Sapiens
LLSMPAMAH

SEQ ID NO: 478575 - protein, 9 aa, Homo Sapiens
ELQAVRKTL

SEQ ID NO: 478576 - protein, 9 aa, Homo Sapiens
STGKPTREI

SEQ ID NO: 478577 - protein, 9 aa, Homo Sapiens
HVFTCSEDG

SEQ ID NO: 478578 - protein, 9 aa, Homo Sapiens
RQSSTFTLK

SEQ ID NO: 478579 - protein, 9 aa, Homo Sapiens
REGKAEAVG

SEQ ID NO: 478580 - protein, 9 aa, Homo Sapiens
WPIQGLLVT

SEQ ID NO: 478581 - protein, 9 aa, Homo Sapiens
GAVVFAVTS

SEQ ID NO: 478582 - protein, 9 aa, Homo Sapiens
DVNNNVPSI

SEQ ID NO: 478583 - protein, 9 aa, Homo Sapiens
LTVLLDRLP

SEQ ID NO: 478584 - protein, 9 aa, Homo Sapiens
LQNIPPVNT

SEQ ID NO: 478585 - protein, 9 aa, Homo Sapiens
EGVREALRQ

SEQ ID NO: 478586 - protein, 9 aa, Homo Sapiens
AEAESKKEK

SEQ ID NO: 478587 - protein, 9 aa, Homo Sapiens
AWTTTAKIH

SEQ ID NO: 478588 - protein, 9 aa, Homo Sapiens
FVDDLLQVI

SEQ ID NO: 478589 - protein, 9 aa, Homo Sapiens
LCCKRYREF

SEQ ID NO: 478590 - protein, 9 aa, Homo Sapiens
DPSHVTRMT

SEQ ID NO: 478591 - protein, 9 aa, Homo Sapiens
TKTSQGTPV

SEQ ID NO: 478592 - protein, 9 aa, Homo Sapiens
KELQAVRKT

SEQ ID NO: 478593 - protein, 9 aa, Homo Sapiens
PGGHHTVLF

SEQ ID NO: 478594 - protein, 9 aa, Homo Sapiens
VTNLLLEEI

SEQ ID NO: 478595 - protein, 9 aa, Homo Sapiens
DAEGFRGRW

SEQ ID NO: 478596 - protein, 9 aa, Homo Sapiens
QRSPFSLKK

SEQ ID NO: 478597 - protein, 9 aa, Homo Sapiens
GLQQNTSQV

SEQ ID NO: 478598 - protein, 9 aa, Homo Sapiens
GTLKDVGMD

SEQ ID NO: 478599 - protein, 9 aa, Homo Sapiens
CIRNALLLL

SEQ ID NO: 478600 - protein, 9 aa, Homo Sapiens
QSVTNTLVL

SEQ ID NO: 478601 - protein, 9 aa, Homo Sapiens
LPELLLGAF

SEQ ID NO: 478602 - protein, 9 aa, Homo Sapiens
IAHFLGTEG

SEQ ID NO: 478603 - protein, 9 aa, Homo Sapiens
HGKRVDQIF

SEQ ID NO: 478604 - protein, 9 aa, Homo Sapiens
DNGVLQKES

SEQ ID NO: 478605 - protein, 9 aa, Homo Sapiens
RFKEPWFFK

SEQ ID NO: 478606 - protein, 9 aa, Homo Sapiens
EQPLQKGVR

SEQ ID NO: 478607 - protein, 9 aa, Homo Sapiens
CTSKRAVTK

SEQ ID NO: 478608 - protein, 9 aa, Homo Sapiens
ASTIPQIPQ

SEQ ID NO: 478609 - protein, 9 aa, Homo Sapiens
QDSLSKSPL

SEQ ID NO: 478610 - protein, 9 aa, Homo Sapiens
IGHRGEGNP

SEQ ID NO: 478611 - protein, 9 aa, Homo Sapiens
VAKETAGFV

SEQ ID NO: 478612 - protein, 9 aa, Homo Sapiens
FEENILPPK

SEQ ID NO: 478613 - protein, 9 aa, Homo Sapiens
EKLDQGRLV

SEQ ID NO: 478614 - protein, 9 aa, Homo Sapiens
SHAWSYGIV

SEQ ID NO: 478615 - protein, 9 aa, Homo Sapiens
QLTIDDIDH

SEQ ID NO: 478616 - protein, 9 aa, Homo Sapiens
GFSFVRIRA

SEQ ID NO: 478617 - protein, 9 aa, Homo Sapiens
AVQAQEILR

SEQ ID NO: 478618 - protein, 9 aa, Homo Sapiens
LPLRLARFR

SEQ ID NO: 478619 - protein, 9 aa, Homo Sapiens
KWKDIELQK

SEQ ID NO: 478620 - protein, 9 aa, Homo Sapiens
GHIIIAGLF

SEQ ID NO: 478621 - protein, 9 aa, Homo Sapiens
DLKPFHILI

SEQ ID NO: 478622 - protein, 9 aa, Homo Sapiens
TAAMGRVVP

SEQ ID NO: 478623 - protein, 9 aa, Homo Sapiens
NIPQIVAVY

SEQ ID NO: 478624 - protein, 9 aa, Homo Sapiens
CDTDLYNAS

SEQ ID NO: 478625 - protein, 9 aa, Homo Sapiens
VCHTLWCSL

SEQ ID NO: 478626 - protein, 9 aa, Homo Sapiens
AKGPTGCPG

SEQ ID NO: 478627 - protein, 9 aa, Homo Sapiens
RMVEYHGLT

SEQ ID NO: 478628 - protein, 9 aa, Homo Sapiens
YLAFAVTQC

SEQ ID NO: 478629 - protein, 9 aa, Homo Sapiens
HNSEFYNKG

SEQ ID NO: 478630 - protein, 9 aa, Homo Sapiens
SSIRVDTVE

SEQ ID NO: 478631 - protein, 9 aa, Homo Sapiens
DIHSLNPKL

SEQ ID NO: 478632 - protein, 9 aa, Homo Sapiens
CERCPRDTR

SEQ ID NO: 478633 - protein, 9 aa, Homo Sapiens
APVYHCVHY

SEQ ID NO: 478634 - protein, 9 aa, Homo Sapiens
LSPPLLACP

SEQ ID NO: 478635 - protein, 9 aa, Homo Sapiens
QKGVRTART

SEQ ID NO: 478636 - protein, 9 aa, Homo Sapiens
NKNDIYGED

SEQ ID NO: 478637 - protein, 9 aa, Homo Sapiens
FAGGYTLNP

SEQ ID NO: 478638 - protein, 9 aa, Homo Sapiens
SNEQDPQEV

SEQ ID NO: 478639 - protein, 9 aa, Homo Sapiens
NEMLLLDIY

SEQ ID NO: 478640 - protein, 9 aa, Homo Sapiens
GKPTREIEL

SEQ ID NO: 478641 - protein, 9 aa, Homo Sapiens
LKPFHILIS

SEQ ID NO: 478642 - protein, 9 aa, Homo Sapiens
GPGEPEPAS

SEQ ID NO: 478643 - protein, 9 aa, Homo Sapiens
ELQKMKAGG

SEQ ID NO: 478644 - protein, 9 aa, Homo Sapiens
KELCIICIV

SEQ ID NO: 478645 - protein, 9 aa, Homo Sapiens
KGVRTARTS

SEQ ID NO: 478646 - protein, 9 aa, Homo Sapiens
GDKGEKGET

SEQ ID NO: 478647 - protein, 9 aa, Homo Sapiens
SIQGELSGD

SEQ ID NO: 478648 - protein, 9 aa, Homo Sapiens
AMSRFASKR

SEQ ID NO: 478649 - protein, 9 aa, Homo Sapiens
CCDTDLYNA

SEQ ID NO: 478650 - protein, 9 aa, Homo Sapiens
RCYPPQGVE

SEQ ID NO: 478651 - protein, 9 aa, Homo Sapiens
LIINTPCGR

SEQ ID NO: 478652 - protein, 9 aa, Homo Sapiens
WEIVALGGN

SEQ ID NO: 478653 - protein, 9 aa, Homo Sapiens
KQLSSLRDQ

SEQ ID NO: 478654 - protein, 9 aa, Homo Sapiens
STPQQPSTE

SEQ ID NO: 478655 - protein, 9 aa, Homo Sapiens
GEGNPSGIP

SEQ ID NO: 478656 - protein, 9 aa, Homo Sapiens
SGSAFTPQE

SEQ ID NO: 478657 - protein, 9 aa, Homo Sapiens
TPHHYLINI

SEQ ID NO: 478658 - protein, 9 aa, Homo Sapiens
EVIFPLTVL

SEQ ID NO: 478659 - protein, 9 aa, Homo Sapiens
AQASQTQQE

SEQ ID NO: 478660 - protein, 9 aa, Homo Sapiens
AAQKDLYRH

SEQ ID NO: 478661 - protein, 9 aa, Homo Sapiens
NIYRDKLFF

SEQ ID NO: 478662 - protein, 9 aa, Homo Sapiens
FKNIPQIVA

SEQ ID NO: 478663 - protein, 9 aa, Homo Sapiens
EGPILPSER

SEQ ID NO: 478664 - protein, 9 aa, Homo Sapiens
FDRSIPQNN

SEQ ID NO: 478665 - protein, 9 aa, Homo Sapiens
TCNKVDLEN

SEQ ID NO: 478666 - protein, 9 aa, Homo Sapiens
QQHLNNLMA

SEQ ID NO: 478667 - protein, 9 aa, Homo Sapiens
ERNEDATVY

SEQ ID NO: 478668 - protein, 9 aa, Homo Sapiens
SPYPKHSLT

SEQ ID NO: 478669 - protein, 9 aa, Homo Sapiens
ETLPIFRDK

SEQ ID NO: 478670 - protein, 9 aa, Homo Sapiens
MPDIMVKII

SEQ ID NO: 478671 - protein, 9 aa, Homo Sapiens
MQRSPFSLK

SEQ ID NO: 478672 - protein, 9 aa, Homo Sapiens
RRVGPGEPE

SEQ ID NO: 478673 - protein, 9 aa, Homo Sapiens
AKIEGSDCE

SEQ ID NO: 478674 - protein, 9 aa, Homo Sapiens
MCREDPGTS

SEQ ID NO: 478675 - protein, 9 aa, Homo Sapiens
HRFWQCQLS

SEQ ID NO: 478676 - protein, 9 aa, Homo Sapiens
MDVKTCNKV

SEQ ID NO: 478677 - protein, 9 aa, Homo Sapiens
HKDYVTVQL

SEQ ID NO: 478678 - protein, 9 aa, Homo Sapiens
ISLAKRSVV

SEQ ID NO: 478679 - protein, 9 aa, Homo Sapiens
PKGSQEGAK

SEQ ID NO: 478680 - protein, 9 aa, Homo Sapiens
APDSVLDHL

SEQ ID NO: 478681 - protein, 9 aa, Homo Sapiens
KKLEKKRME

SEQ ID NO: 478682 - protein, 9 aa, Homo Sapiens
AVPLPVGMG

SEQ ID NO: 478683 - protein, 9 aa, Homo Sapiens
VEAVEEPQA

SEQ ID NO: 478684 - protein, 9 aa, Homo Sapiens
IWAEYDPKA

SEQ ID NO: 478685 - protein, 9 aa, Homo Sapiens
GNPSGIPIF

SEQ ID NO: 478686 - protein, 9 aa, Homo Sapiens
RHVTIWFQN

SEQ ID NO: 478687 - protein, 9 aa, Homo Sapiens
STVIAAPGL

SEQ ID NO: 478688 - protein, 9 aa, Homo Sapiens
SKVCILESL

SEQ ID NO: 478689 - protein, 9 aa, Homo Sapiens
DQFRVNTEG

SEQ ID NO: 478690 - protein, 9 aa, Homo Sapiens
PLRARWCLS

SEQ ID NO: 478691 - protein, 9 aa, Homo Sapiens
DDLLQVILS

SEQ ID NO: 478692 - protein, 9 aa, Homo Sapiens
LEAHERLDW

SEQ ID NO: 478693 - protein, 9 aa, Homo Sapiens
AEDTESCDD

SEQ ID NO: 478694 - protein, 9 aa, Homo Sapiens
KGKSIHLMW

SEQ ID NO: 478695 - protein, 9 aa, Homo Sapiens
IRKLEGHES

SEQ ID NO: 478696 - protein, 9 aa, Homo Sapiens
GLITLIKMD

SEQ ID NO: 478697 - protein, 9 aa, Homo Sapiens
MAQHNLYRN

SEQ ID NO: 478698 - protein, 9 aa, Homo Sapiens
KKHEAFDSD

SEQ ID NO: 478699 - protein, 9 aa, Homo Sapiens
IKPRHLCRQ

SEQ ID NO: 478700 - protein, 9 aa, Homo Sapiens
WILQPKGYQ

SEQ ID NO: 478701 - protein, 9 aa, Homo Sapiens
GWSHSSSTE

SEQ ID NO: 478702 - protein, 9 aa, Homo Sapiens
QGQLYKVLR

SEQ ID NO: 478703 - protein, 9 aa, Homo Sapiens
ALQVKGNTA

SEQ ID NO: 478704 - protein, 9 aa, Homo Sapiens
GVAKAELEQ

SEQ ID NO: 478705 - protein, 9 aa, Homo Sapiens
EGKAEAVGA

SEQ ID NO: 478706 - protein, 9 aa, Homo Sapiens
KQTGRFKPE

SEQ ID NO: 478707 - protein, 9 aa, Homo Sapiens
LASVDDETE

SEQ ID NO: 478708 - protein, 9 aa, Homo Sapiens
ILGVIVKVS

SEQ ID NO: 478709 - protein, 9 aa, Homo Sapiens
TGPKGNRGF

SEQ ID NO: 478710 - protein, 9 aa, Homo Sapiens
DEETHSGAR

SEQ ID NO: 478711 - protein, 9 aa, Homo Sapiens
CEIRKLVAS

SEQ ID NO: 478712 - protein, 9 aa, Homo Sapiens
MCSCLHSGL

SEQ ID NO: 478713 - protein, 9 aa, Homo Sapiens
GCVPKINRS

SEQ ID NO: 478714 - protein, 9 aa, Homo Sapiens
GSEQDEDVS

SEQ ID NO: 478715 - protein, 9 aa, Homo Sapiens
PWWLILIPQ

SEQ ID NO: 478716 - protein, 9 aa, Homo Sapiens
LPWWLILIP

SEQ ID NO: 478717 - protein, 9 aa, Homo Sapiens
RGQARRPRR

SEQ ID NO: 478718 - protein, 9 aa, Homo Sapiens
WQCLDMAQH

SEQ ID NO: 478719 - protein, 9 aa, Homo Sapiens
QLASTIPQI

SEQ ID NO: 478720 - protein, 9 aa, Homo Sapiens
YEEFLSKVC

SEQ ID NO: 478721 - protein, 9 aa, Homo Sapiens
SCGHAGGPV

SEQ ID NO: 478722 - protein, 9 aa, Homo Sapiens
EDVLRDSME

SEQ ID NO: 478723 - protein, 9 aa, Homo Sapiens
AMGRVVPML

SEQ ID NO: 478724 - protein, 9 aa, Homo Sapiens
MLLLDIYTH

SEQ ID NO: 478725 - protein, 9 aa, Homo Sapiens
VFYNTDLLE

SEQ ID NO: 478726 - protein, 9 aa, Homo Sapiens
EPLSPPLLA

SEQ ID NO: 478727 - protein, 9 aa, Homo Sapiens
KILRAQLQD

SEQ ID NO: 478728 - protein, 9 aa, Homo Sapiens
SHRMCREDP

SEQ ID NO: 478729 - protein, 9 aa, Homo Sapiens
GCSIAWAGQ

SEQ ID NO: 478730 - protein, 9 aa, Homo Sapiens
LLAPVYHCV

SEQ ID NO: 478731 - protein, 9 aa, Homo Sapiens
LCSVSPSEN

SEQ ID NO: 478732 - protein, 9 aa, Homo Sapiens
ATEHGLIHT

SEQ ID NO: 478733 - protein, 9 aa, Homo Sapiens
TYLVICGAV

SEQ ID NO: 478734 - protein, 9 aa, Homo Sapiens
LWKALANCS

SEQ ID NO: 478735 - protein, 9 aa, Homo Sapiens
LYRHVMMEN

SEQ ID NO: 478736 - protein, 9 aa, Homo Sapiens
FRIKLESKR

SEQ ID NO: 478737 - protein, 9 aa, Homo Sapiens
EISLHSGHE

SEQ ID NO: 478738 - protein, 9 aa, Homo Sapiens
RLLYKSRKR

SEQ ID NO: 478739 - protein, 9 aa, Homo Sapiens
THSRTDPMQ

SEQ ID NO: 478740 - protein, 9 aa, Homo Sapiens
LKQIRLEHE

SEQ ID NO: 478741 - protein, 9 aa, Homo Sapiens
GEELCSVSP

SEQ ID NO: 478742 - protein, 9 aa, Homo Sapiens
HEYVLVKEA

SEQ ID NO: 478743 - protein, 9 aa, Homo Sapiens
KKQIAVQAQ

SEQ ID NO: 478744 - protein, 9 aa, Homo Sapiens
DFEVKEDTE

SEQ ID NO: 478745 - protein, 9 aa, Homo Sapiens
ETDIFSQYL

SEQ ID NO: 478746 - protein, 9 aa, Homo Sapiens
GQALLCGQD

SEQ ID NO: 478747 - protein, 9 aa, Homo Sapiens
PDLGTKGCW

SEQ ID NO: 478748 - protein, 9 aa, Homo Sapiens
AEDEEAPLQ

SEQ ID NO: 478749 - protein, 9 aa, Homo Sapiens
KSEEDPVTS

SEQ ID NO: 478750 - protein, 9 aa, Homo Sapiens
KSPLSSIVF

SEQ ID NO: 478751 - protein, 9 aa, Homo Sapiens
ACRSFPRSL

SEQ ID NO: 478752 - protein, 9 aa, Homo Sapiens
LSEITKQEK

SEQ ID NO: 478753 - protein, 9 aa, Homo Sapiens
ESLQRDAPR

SEQ ID NO: 478754 - protein, 9 aa, Homo Sapiens
LKILRAQLQ

SEQ ID NO: 478755 - protein, 9 aa, Homo Sapiens
FTATPSCSP

SEQ ID NO: 478756 - protein, 9 aa, Homo Sapiens
YNTDLLEYK

SEQ ID NO: 478757 - protein, 9 aa, Homo Sapiens
TYCKYCSSL

SEQ ID NO: 478758 - protein, 9 aa, Homo Sapiens
IDVTVFPFD

SEQ ID NO: 478759 - protein, 9 aa, Homo Sapiens
AGVAVMKFN

SEQ ID NO: 478760 - protein, 9 aa, Homo Sapiens
GPCEIRKLV

SEQ ID NO: 478761 - protein, 9 aa, Homo Sapiens
GAPVAAQPA

SEQ ID NO: 478762 - protein, 9 aa, Homo Sapiens
RLSTKNADE

SEQ ID NO: 478763 - protein, 9 aa, Homo Sapiens
CEEQILRYS

SEQ ID NO: 478764 - protein, 9 aa, Homo Sapiens
MQQEERIRE

SEQ ID NO: 478765 - protein, 9 aa, Homo Sapiens
EGNPSGIPI

SEQ ID NO: 478766 - protein, 9 aa, Homo Sapiens
FEEMKRNKN

SEQ ID NO: 478767 - protein, 9 aa, Homo Sapiens
EDEPEQFCK

SEQ ID NO: 478768 - protein, 9 aa, Homo Sapiens
EYIGEICRY

SEQ ID NO: 478769 - protein, 9 aa, Homo Sapiens
FSLVIIWGI

SEQ ID NO: 478770 - protein, 9 aa, Homo Sapiens
ANSGRSHLE

SEQ ID NO: 478771 - protein, 9 aa, Homo Sapiens
PKSTGKPTR

SEQ ID NO: 478772 - protein, 9 aa, Homo Sapiens
YRHVMMENY

SEQ ID NO: 478773 - protein, 9 aa, Homo Sapiens
SPPLLACPF

SEQ ID NO: 478774 - protein, 9 aa, Homo Sapiens
YDPQQDYGD

SEQ ID NO: 478775 - protein, 9 aa, Homo Sapiens
GYTLNPTYK

SEQ ID NO: 478776 - protein, 9 aa, Homo Sapiens
GSHLLFTRA

SEQ ID NO: 478777 - protein, 9 aa, Homo Sapiens
AACEEQILR

SEQ ID NO: 478778 - protein, 9 aa, Homo Sapiens
QQGSEEADM

SEQ ID NO: 478779 - protein, 9 aa, Homo Sapiens
EPSAHLLVN

SEQ ID NO: 478780 - protein, 9 aa, Homo Sapiens
KYNSEVVNK

SEQ ID NO: 478781 - protein, 9 aa, Homo Sapiens
HSGHEKKVI

SEQ ID NO: 478782 - protein, 9 aa, Homo Sapiens
NQLQQKEVQ

SEQ ID NO: 478783 - protein, 9 aa, Homo Sapiens
LAYPMAHLC

SEQ ID NO: 478784 - protein, 9 aa, Homo Sapiens
DRIIQVNGR

SEQ ID NO: 478785 - protein, 9 aa, Homo Sapiens
WIRGPAPWP

SEQ ID NO: 478786 - protein, 9 aa, Homo Sapiens
SDPLKLVRN

SEQ ID NO: 478787 - protein, 9 aa, Homo Sapiens
YSGCWNFGF

SEQ ID NO: 478788 - protein, 9 aa, Homo Sapiens
FQLVQGVQE

SEQ ID NO: 478789 - protein, 9 aa, Homo Sapiens
PGRRECPFS

SEQ ID NO: 478790 - protein, 9 aa, Homo Sapiens
LRARWCLSP

SEQ ID NO: 478791 - protein, 9 aa, Homo Sapiens
EASIQGELS

SEQ ID NO: 478792 - protein, 9 aa, Homo Sapiens
RVRQQVAEG

SEQ ID NO: 478793 - protein, 9 aa, Homo Sapiens
MVDGNHRLT

SEQ ID NO: 478794 - protein, 9 aa, Homo Sapiens
LPGGHHTVL

SEQ ID NO: 478795 - protein, 9 aa, Homo Sapiens
YGRDNLALF

SEQ ID NO: 478796 - protein, 9 aa, Homo Sapiens
NNNVPSIDI

SEQ ID NO: 478797 - protein, 9 aa, Homo Sapiens
GVTEIACRS

SEQ ID NO: 478798 - protein, 9 aa, Homo Sapiens
EAPLQPGVS

SEQ ID NO: 478799 - protein, 9 aa, Homo Sapiens
PQIPQIPAS

SEQ ID NO: 478800 - protein, 9 aa, Homo Sapiens
GANINAFHK

SEQ ID NO: 478801 - protein, 9 aa, Homo Sapiens
WFFKNHMRT

SEQ ID NO: 478802 - protein, 9 aa, Homo Sapiens
TSPRTCTSP

SEQ ID NO: 478803 - protein, 9 aa, Homo Sapiens
FGSAASSEG

SEQ ID NO: 478804 - protein, 9 aa, Homo Sapiens
QQEERIRER

SEQ ID NO: 478805 - protein, 9 aa, Homo Sapiens
TISIKSYAD

SEQ ID NO: 478806 - protein, 9 aa, Homo Sapiens
PIQGLLVTS

SEQ ID NO: 478807 - protein, 9 aa, Homo Sapiens
IINTPCGRT

SEQ ID NO: 478808 - protein, 9 aa, Homo Sapiens
LVTSSPPMK

SEQ ID NO: 478809 - protein, 9 aa, Homo Sapiens
LEGHESSVV

SEQ ID NO: 478810 - protein, 9 aa, Homo Sapiens
LQGARSTTE

SEQ ID NO: 478811 - protein, 9 aa, Homo Sapiens
SVTGERKNE

SEQ ID NO: 478812 - protein, 9 aa, Homo Sapiens
NNMYHNSEF

SEQ ID NO: 478813 - protein, 9 aa, Homo Sapiens
QGSEEADMR

SEQ ID NO: 478814 - protein, 9 aa, Homo Sapiens
EQQKTILQL

SEQ ID NO: 478815 - protein, 9 aa, Homo Sapiens
HIEKRLREL

SEQ ID NO: 478816 - protein, 9 aa, Homo Sapiens
GVAVMKFNN

SEQ ID NO: 478817 - protein, 9 aa, Homo Sapiens
EFLSKVCIL

SEQ ID NO: 478818 - protein, 9 aa, Homo Sapiens
INKPMAAKI

SEQ ID NO: 478819 - protein, 9 aa, Homo Sapiens
NSFRRQSST

SEQ ID NO: 478820 - protein, 9 aa, Homo Sapiens
DPVKIENRI

SEQ ID NO: 478821 - protein, 9 aa, Homo Sapiens
IEQKHKVWG

SEQ ID NO: 478822 - protein, 9 aa, Homo Sapiens
AQFEGLITQ

SEQ ID NO: 478823 - protein, 9 aa, Homo Sapiens
PGARGAGTA

SEQ ID NO: 478824 - protein, 9 aa, Homo Sapiens
VAAQPAAEA

SEQ ID NO: 478825 - protein, 9 aa, Homo Sapiens
AHTKQILDT

SEQ ID NO: 478826 - protein, 9 aa, Homo Sapiens
IIIAGLFAI

SEQ ID NO: 478827 - protein, 9 aa, Homo Sapiens
RYTPQVLEE

SEQ ID NO: 478828 - protein, 9 aa, Homo Sapiens
ETLQTNWKM

SEQ ID NO: 478829 - protein, 9 aa, Homo Sapiens
YMGSTCPSR

SEQ ID NO: 478830 - protein, 9 aa, Homo Sapiens
VILIFYTQG

SEQ ID NO: 478831 - protein, 9 aa, Homo Sapiens
LVNSGVPEA

SEQ ID NO: 478832 - protein, 9 aa, Homo Sapiens
RLDWAAAQA

SEQ ID NO: 478833 - protein, 9 aa, Homo Sapiens
SLEVVFIKM

SEQ ID NO: 478834 - protein, 9 aa, Homo Sapiens
CSLGTTCHS

SEQ ID NO: 478835 - protein, 9 aa, Homo Sapiens
SPTIRPGTG

SEQ ID NO: 478836 - protein, 9 aa, Homo Sapiens
GYLLPGALA

SEQ ID NO: 478837 - protein, 9 aa, Homo Sapiens
LVTASPLVF

SEQ ID NO: 478838 - protein, 9 aa, Homo Sapiens
LTQQLAQTQ

SEQ ID NO: 478839 - protein, 9 aa, Homo Sapiens
VEYHGLTGR

SEQ ID NO: 478840 - protein, 9 aa, Homo Sapiens
FCRKLRAAR

SEQ ID NO: 478841 - protein, 9 aa, Homo Sapiens
SSGHKDYVT

SEQ ID NO: 478842 - protein, 9 aa, Homo Sapiens
APGLAPGSQ

SEQ ID NO: 478843 - protein, 9 aa, Homo Sapiens
CKRYREFAI

SEQ ID NO: 478844 - protein, 9 aa, Homo Sapiens
VFHGERSRR

SEQ ID NO: 478845 - protein, 9 aa, Homo Sapiens
EGAKYIQNL

SEQ ID NO: 478846 - protein, 9 aa, Homo Sapiens
YFQEPGVAK

SEQ ID NO: 478847 - protein, 9 aa, Homo Sapiens
SPFPVTSLL

SEQ ID NO: 478848 - protein, 9 aa, Homo Sapiens
SIQLTIDDI

SEQ ID NO: 478849 - protein, 9 aa, Homo Sapiens
TSFGSAASS

SEQ ID NO: 478850 - protein, 9 aa, Homo Sapiens
TVFYNTDLL

SEQ ID NO: 478851 - protein, 9 aa, Homo Sapiens
DAMPDIMVK

SEQ ID NO: 478852 - protein, 9 aa, Homo Sapiens
NKVDLENSA

SEQ ID NO: 478853 - protein, 9 aa, Homo Sapiens
QYSIPTYCK

SEQ ID NO: 478854 - protein, 9 aa, Homo Sapiens
PIEQKHKVW

SEQ ID NO: 478855 - protein, 9 aa, Homo Sapiens
DDERYPAAQ

SEQ ID NO: 478856 - protein, 9 aa, Homo Sapiens
VGSHDMVDG

SEQ ID NO: 478857 - protein, 9 aa, Homo Sapiens
KISSLQRAQ

SEQ ID NO: 478858 - protein, 9 aa, Homo Sapiens
GDNCKLKRR

SEQ ID NO: 478859 - protein, 9 aa, Homo Sapiens
ETEFKASGS

SEQ ID NO: 478860 - protein, 9 aa, Homo Sapiens
AESLNHANS

SEQ ID NO: 478861 - protein, 9 aa, Homo Sapiens
EDEEAPLQP

SEQ ID NO: 478862 - protein, 9 aa, Homo Sapiens
GVTGALATH

SEQ ID NO: 478863 - protein, 9 aa, Homo Sapiens
GPLRTGYYD

SEQ ID NO: 478864 - protein, 9 aa, Homo Sapiens
CPFGPSCSG

SEQ ID NO: 478865 - protein, 9 aa, Homo Sapiens
SNHGCALTT

SEQ ID NO: 478866 - protein, 9 aa, Homo Sapiens
ATVFAPLQV

SEQ ID NO: 478867 - protein, 9 aa, Homo Sapiens
DRYLVYSDE

SEQ ID NO: 478868 - protein, 9 aa, Homo Sapiens
AYRGKKRSK

SEQ ID NO: 478869 - protein, 9 aa, Homo Sapiens
PDIQMNPYP

SEQ ID NO: 478870 - protein, 9 aa, Homo Sapiens
EGAEEIDSL

SEQ ID NO: 478871 - protein, 9 aa, Homo Sapiens
GMGYPVKKG

SEQ ID NO: 478872 - protein, 9 aa, Homo Sapiens
LIPSDYQQQ

SEQ ID NO: 478873 - protein, 9 aa, Homo Sapiens
IYSRKETIP

SEQ ID NO: 478874 - protein, 9 aa, Homo Sapiens
TQDAEGFRG

SEQ ID NO: 478875 - protein, 9 aa, Homo Sapiens
NGKEQYYAA

SEQ ID NO: 478876 - protein, 9 aa, Homo Sapiens
TVLLDRLPP

SEQ ID NO: 478877 - protein, 9 aa, Homo Sapiens
DNCKLKRRK

SEQ ID NO: 478878 - protein, 9 aa, Homo Sapiens
DPDAGQAGR

SEQ ID NO: 478879 - protein, 9 aa, Homo Sapiens
KQCREHLLK

SEQ ID NO: 478880 - protein, 9 aa, Homo Sapiens
YVDMMEWLV

SEQ ID NO: 478881 - protein, 9 aa, Homo Sapiens
PLRTGYYDL

SEQ ID NO: 478882 - protein, 9 aa, Homo Sapiens
RMKRQDQIE

SEQ ID NO: 478883 - protein, 9 aa, Homo Sapiens
RLSGASSAE

SEQ ID NO: 478884 - protein, 9 aa, Homo Sapiens
TENSYNYSY

SEQ ID NO: 478885 - protein, 9 aa, Homo Sapiens
VRKTLLRQH

SEQ ID NO: 478886 - protein, 9 aa, Homo Sapiens
GLYLNGARW

SEQ ID NO: 478887 - protein, 9 aa, Homo Sapiens
HKVWGSNQN

SEQ ID NO: 478888 - protein, 9 aa, Homo Sapiens
EEPDSCGHA

SEQ ID NO: 478889 - protein, 9 aa, Homo Sapiens
FSELLDPLV

SEQ ID NO: 478890 - protein, 9 aa, Homo Sapiens
FLLAYCMSF

SEQ ID NO: 478891 - protein, 9 aa, Homo Sapiens
QMTRHPNIT

SEQ ID NO: 478892 - protein, 9 aa, Homo Sapiens
SPGHAGASG

SEQ ID NO: 478893 - protein, 9 aa, Homo Sapiens
VTTDQDAHS

SEQ ID NO: 478894 - protein, 9 aa, Homo Sapiens
CAPFPDRSP

SEQ ID NO: 478895 - protein, 9 aa, Homo Sapiens
HLTLHKKVP

SEQ ID NO: 478896 - protein, 9 aa, Homo Sapiens
LSGGAAAAP

SEQ ID NO: 478897 - protein, 9 aa, Homo Sapiens
SASGQSSTC

SEQ ID NO: 478898 - protein, 9 aa, Homo Sapiens
KGDLIVEIN

SEQ ID NO: 478899 - protein, 9 aa, Homo Sapiens
LLDVHCSEE

SEQ ID NO: 478900 - protein, 9 aa, Homo Sapiens
DALFMEAIH

SEQ ID NO: 478901 - protein, 9 aa, Homo Sapiens
EIRQKVWPK

SEQ ID NO: 478902 - protein, 9 aa, Homo Sapiens
SQEMQMIDL

SEQ ID NO: 478903 - protein, 9 aa, Homo Sapiens
RYINQFQDA

SEQ ID NO: 478904 - protein, 9 aa, Homo Sapiens
ISKYAGHKN

SEQ ID NO: 478905 - protein, 9 aa, Homo Sapiens
DRSLRPLRF

SEQ ID NO: 478906 - protein, 9 aa, Homo Sapiens
RLGVTYEQA

SEQ ID NO: 478907 - protein, 9 aa, Homo Sapiens
SAKKLTEKT

SEQ ID NO: 478908 - protein, 9 aa, Homo Sapiens
HSLIGVVRK

SEQ ID NO: 478909 - protein, 9 aa, Homo Sapiens
ISSDIKLHF

SEQ ID NO: 478910 - protein, 9 aa, Homo Sapiens
HQLVRLSIK

SEQ ID NO: 478911 - protein, 9 aa, Homo Sapiens
EKLDDAITA

SEQ ID NO: 478912 - protein, 9 aa, Homo Sapiens
FYCGMVVVP

SEQ ID NO: 478913 - protein, 9 aa, Homo Sapiens
SNTTTIAEA

SEQ ID NO: 478914 - protein, 9 aa, Homo Sapiens
SVGSSSSSR

SEQ ID NO: 478915 - protein, 9 aa, Homo Sapiens
RSFFTCASH

SEQ ID NO: 478916 - protein, 9 aa, Homo Sapiens
SADEETISK

SEQ ID NO: 478917 - protein, 9 aa, Homo Sapiens
LIILATNMA

SEQ ID NO: 478918 - protein, 9 aa, Homo Sapiens
VLGCMLAGL

SEQ ID NO: 478919 - protein, 9 aa, Homo Sapiens
EYLDGGSAL

SEQ ID NO: 478920 - protein, 9 aa, Homo Sapiens
AWSAWLPPS

SEQ ID NO: 478921 - protein, 9 aa, Homo Sapiens
RQKVWPKLL

SEQ ID NO: 478922 - protein, 9 aa, Homo Sapiens
MVVVPIVIS

SEQ ID NO: 478923 - protein, 9 aa, Homo Sapiens
IWLPRPQFY

SEQ ID NO: 478924 - protein, 9 aa, Homo Sapiens
SPRLVAAAP

SEQ ID NO: 478925 - protein, 9 aa, Homo Sapiens
LRYINQFQD

SEQ ID NO: 478926 - protein, 9 aa, Homo Sapiens
RCHPVAVDV

SEQ ID NO: 478927 - protein, 9 aa, Homo Sapiens
ATLASPGNA

SEQ ID NO: 478928 - protein, 9 aa, Homo Sapiens
STENQAQSA

SEQ ID NO: 478929 - protein, 9 aa, Homo Sapiens
SKMEKLDDA

SEQ ID NO: 478930 - protein, 9 aa, Homo Sapiens
TIFIYYICI

SEQ ID NO: 478931 - protein, 9 aa, Homo Sapiens
PSKPVAMTV

SEQ ID NO: 478932 - protein, 9 aa, Homo Sapiens
DEETISKYA

SEQ ID NO: 478933 - protein, 9 aa, Homo Sapiens
GDEIETFRL

SEQ ID NO: 478934 - protein, 9 aa, Homo Sapiens
YGTYGGWGA

SEQ ID NO: 478935 - protein, 9 aa, Homo Sapiens
TTTAILATL

SEQ ID NO: 478936 - protein, 9 aa, Homo Sapiens
LQGPPFPPD

SEQ ID NO: 478937 - protein, 9 aa, Homo Sapiens
RAWSAWLPP

SEQ ID NO: 478938 - protein, 9 aa, Homo Sapiens
SSPGKEECE

SEQ ID NO: 478939 - protein, 9 aa, Homo Sapiens
ICLFGECEN

SEQ ID NO: 478940 - protein, 9 aa, Homo Sapiens
FPPDRSLRP

SEQ ID NO: 478941 - protein, 9 aa, Homo Sapiens
LQYRSLTRP

SEQ ID NO: 478942 - protein, 9 aa, Homo Sapiens
LAFPDDMDL

SEQ ID NO: 478943 - protein, 9 aa, Homo Sapiens
SSYQLIILA

SEQ ID NO: 478944 - protein, 9 aa, Homo Sapiens
GDALFMEAI

SEQ ID NO: 478945 - protein, 9 aa, Homo Sapiens
RHYWGKKLT

SEQ ID NO: 478946 - protein, 9 aa, Homo Sapiens
VFVGKLRCH

SEQ ID NO: 478947 - protein, 9 aa, Homo Sapiens
AMATVPTQP

SEQ ID NO: 478948 - protein, 9 aa, Homo Sapiens
PSFSAKKLT

SEQ ID NO: 478949 - protein, 9 aa, Homo Sapiens
HWKQAAIVL

SEQ ID NO: 478950 - protein, 9 aa, Homo Sapiens
PYFLRYINQ

SEQ ID NO: 478951 - protein, 9 aa, Homo Sapiens
LNRGLKKKK

SEQ ID NO: 478952 - protein, 9 aa, Homo Sapiens
FGNAGFSVP

SEQ ID NO: 478953 - protein, 9 aa, Homo Sapiens
GLCKGDLIV

SEQ ID NO: 478954 - protein, 9 aa, Homo Sapiens
ITDSMVYFV

SEQ ID NO: 478955 - protein, 9 aa, Homo Sapiens
GFSVPLPGA

SEQ ID NO: 478956 - protein, 9 aa, Homo Sapiens
WIRVERSQE

SEQ ID NO: 478957 - protein, 9 aa, Homo Sapiens
WRNKDQSDG

SEQ ID NO: 478958 - protein, 9 aa, Homo Sapiens
HAGASGNPG

SEQ ID NO: 478959 - protein, 9 aa, Homo Sapiens
ILATLASPG

SEQ ID NO: 478960 - protein, 9 aa, Homo Sapiens
GLAEAAAAG

SEQ ID NO: 478961 - protein, 9 aa, Homo Sapiens
FYGWIVLGP

SEQ ID NO: 478962 - protein, 9 aa, Homo Sapiens
CQRHVGTQL

SEQ ID NO: 478963 - protein, 9 aa, Homo Sapiens
ELMTVISTG

SEQ ID NO: 478964 - protein, 9 aa, Homo Sapiens
CDLNSNICL

SEQ ID NO: 478965 - protein, 9 aa, Homo Sapiens
GPPFPPDRS

SEQ ID NO: 478966 - protein, 9 aa, Homo Sapiens
RQIEYIDTE

SEQ ID NO: 478967 - protein, 9 aa, Homo Sapiens
LQKETFTTA

SEQ ID NO: 478968 - protein, 9 aa, Homo Sapiens
VERSQEMQM

SEQ ID NO: 478969 - protein, 9 aa, Homo Sapiens
QPSFSAKKL

SEQ ID NO: 478970 - protein, 9 aa, Homo Sapiens
KEIWLPRPQ

SEQ ID NO: 478971 - protein, 9 aa, Homo Sapiens
YSPYGTYGG

SEQ ID NO: 478972 - protein, 9 aa, Homo Sapiens
SSREGTQPS

SEQ ID NO: 478973 - protein, 9 aa, Homo Sapiens
IEYIDTERP

SEQ ID NO: 478974 - protein, 9 aa, Homo Sapiens
VVVPIVISL

SEQ ID NO: 478975 - protein, 9 aa, Homo Sapiens
TISKYAGHK

SEQ ID NO: 478976 - protein, 9 aa, Homo Sapiens
SEAESNSLK

SEQ ID NO: 478977 - protein, 9 aa, Homo Sapiens
LRCQSSRMD

SEQ ID NO: 478978 - protein, 9 aa, Homo Sapiens
DFGAEGAPS

SEQ ID NO: 478979 - protein, 9 aa, Homo Sapiens
FGSENSCER

SEQ ID NO: 478980 - protein, 9 aa, Homo Sapiens
GMVVVPIVI

SEQ ID NO: 478981 - protein, 9 aa, Homo Sapiens
SMVYFVGEN

SEQ ID NO: 478982 - protein, 9 aa, Homo Sapiens
NGDPQRFFN

SEQ ID NO: 478983 - protein, 9 aa, Homo Sapiens
GPGTGVLLL

SEQ ID NO: 478984 - protein, 9 aa, Homo Sapiens
SQQKQLIEV

SEQ ID NO: 478985 - protein, 9 aa, Homo Sapiens
FLSSFHKEE

SEQ ID NO: 478986 - protein, 9 aa, Homo Sapiens
GVRPASPQA

SEQ ID NO: 478987 - protein, 9 aa, Homo Sapiens
CKGDLIVEI

SEQ ID NO: 478988 - protein, 9 aa, Homo Sapiens
GQIQQMTRH

SEQ ID NO: 478989 - protein, 9 aa, Homo Sapiens
MPENQCRPY

SEQ ID NO: 478990 - protein, 9 aa, Homo Sapiens
LATNMAGMA

SEQ ID NO: 478991 - protein, 9 aa, Homo Sapiens
SFFTCASHL

SEQ ID NO: 478992 - protein, 9 aa, Homo Sapiens
DDGQRLSGG

SEQ ID NO: 478993 - protein, 9 aa, Homo Sapiens
ELMEAGSWH

SEQ ID NO: 478994 - protein, 9 aa, Homo Sapiens
YKTRARRGT

SEQ ID NO: 478995 - protein, 9 aa, Homo Sapiens
KTRARRGTL

SEQ ID NO: 478996 - protein, 9 aa, Homo Sapiens
LKNPSDSAM

SEQ ID NO: 478997 - protein, 9 aa, Homo Sapiens
PGLCKGDLI

SEQ ID NO: 478998 - protein, 9 aa, Homo Sapiens
RPTAVLLWT

SEQ ID NO: 478999 - protein, 9 aa, Homo Sapiens
RPQFYEVRR

SEQ ID NO: 479000 - protein, 9 aa, Homo Sapiens
GSENSCERT

SEQ ID NO: 479001 - protein, 9 aa, Homo Sapiens
LLVPSPRLV

SEQ ID NO: 479002 - protein, 9 aa, Homo Sapiens
TTEETEGLA

SEQ ID NO: 479003 - protein, 9 aa, Homo Sapiens
DSRQVSKKS

SEQ ID NO: 479004 - protein, 9 aa, Homo Sapiens
GYTFYGWIV

SEQ ID NO: 479005 - protein, 9 aa, Homo Sapiens
LMEAGSWHP

SEQ ID NO: 479006 - protein, 9 aa, Homo Sapiens
LTLHKKVPM

SEQ ID NO: 479007 - protein, 9 aa, Homo Sapiens
PGHDDGQRL

SEQ ID NO: 479008 - protein, 9 aa, Homo Sapiens
SENQRLGGD

SEQ ID NO: 479009 - protein, 9 aa, Homo Sapiens
RARRGTLST

SEQ ID NO: 479010 - protein, 9 aa, Homo Sapiens
QSAHTMPVR

SEQ ID NO: 479011 - protein, 9 aa, Homo Sapiens
RRSLESQKC

SEQ ID NO: 479012 - protein, 9 aa, Homo Sapiens
TFRLGVTYE

SEQ ID NO: 479013 - protein, 9 aa, Homo Sapiens
TPSAAASPA

SEQ ID NO: 479014 - protein, 9 aa, Homo Sapiens
AGDALFMEA

SEQ ID NO: 479015 - protein, 9 aa, Homo Sapiens
VIGGLLDVH

SEQ ID NO: 479016 - protein, 9 aa, Homo Sapiens
EGLTVQQLK

SEQ ID NO: 479017 - protein, 9 aa, Homo Sapiens
DNSGWTEIL

SEQ ID NO: 479018 - protein, 9 aa, Homo Sapiens
YIDTERPST

SEQ ID NO: 479019 - protein, 9 aa, Homo Sapiens
LVRMCQRHV

SEQ ID NO: 479020 - protein, 9 aa, Homo Sapiens
LEKMMRKKQ

SEQ ID NO: 479021 - protein, 9 aa, Homo Sapiens
SGWTEILRE

SEQ ID NO: 479022 - protein, 9 aa, Homo Sapiens
PELLARLKK

SEQ ID NO: 479023 - protein, 9 aa, Homo Sapiens
LSVAGQQIS

SEQ ID NO: 479024 - protein, 9 aa, Homo Sapiens
VYSKMEKLD

SEQ ID NO: 479025 - protein, 9 aa, Homo Sapiens
YPTKGEKVM

SEQ ID NO: 479026 - protein, 9 aa, Homo Sapiens
CMMGKTVVC

SEQ ID NO: 479027 - protein, 9 aa, Homo Sapiens
RCQSSRMDG

SEQ ID NO: 479028 - protein, 9 aa, Homo Sapiens
DVHCSEEVI

SEQ ID NO: 479029 - protein, 9 aa, Homo Sapiens
DEIRQKVWP

SEQ ID NO: 479030 - protein, 9 aa, Homo Sapiens
MMGKTVVCF

SEQ ID NO: 479031 - protein, 9 aa, Homo Sapiens
YCMSFKNLS

SEQ ID NO: 479032 - protein, 9 aa, Homo Sapiens
FIIRPTAVL

SEQ ID NO: 479033 - protein, 9 aa, Homo Sapiens
KAVFYCGMV

SEQ ID NO: 479034 - protein, 9 aa, Homo Sapiens
KQLIEVQLQ

SEQ ID NO: 479035 - protein, 9 aa, Homo Sapiens
AGDEIETFR

SEQ ID NO: 479036 - protein, 9 aa, Homo Sapiens
NSNICLFGE

SEQ ID NO: 479037 - protein, 9 aa, Homo Sapiens
AMTVEQEEE

SEQ ID NO: 479038 - protein, 9 aa, Homo Sapiens
FKDWRNKDQ

SEQ ID NO: 479039 - protein, 9 aa, Homo Sapiens
MKPHRYRPG

SEQ ID NO: 479040 - protein, 9 aa, Homo Sapiens
DSMVYFVGE

SEQ ID NO: 479041 - protein, 9 aa, Homo Sapiens
TKGEKVMLA

SEQ ID NO: 479042 - protein, 9 aa, Homo Sapiens
TSVLLEKMM

SEQ ID NO: 479043 - protein, 9 aa, Homo Sapiens
FPCSSDGPG

SEQ ID NO: 479044 - protein, 9 aa, Homo Sapiens
HLRCQSSRM

SEQ ID NO: 479045 - protein, 9 aa, Homo Sapiens
MDPDHQLLL

SEQ ID NO: 479046 - protein, 9 aa, Homo Sapiens
PIPMYGASQ

SEQ ID NO: 479047 - protein, 9 aa, Homo Sapiens
AERKHLSKL

SEQ ID NO: 479048 - protein, 9 aa, Homo Sapiens
FLRYINQFQ

SEQ ID NO: 479049 - protein, 9 aa, Homo Sapiens
TAILATLAS

SEQ ID NO: 479050 - protein, 9 aa, Homo Sapiens
VGSSSSSRE

SEQ ID NO: 479051 - protein, 9 aa, Homo Sapiens
KDWRNKDQS

SEQ ID NO: 479052 - protein, 9 aa, Homo Sapiens
HQVPPQSEA

SEQ ID NO: 479053 - protein, 9 aa, Homo Sapiens
SRQVSKKST

SEQ ID NO: 479054 - protein, 9 aa, Homo Sapiens
GKKLTLTPG

SEQ ID NO: 479055 - protein, 9 aa, Homo Sapiens
SDYSPYGTY

SEQ ID NO: 479056 - protein, 9 aa, Homo Sapiens
ENSCERTSF

SEQ ID NO: 479057 - protein, 9 aa, Homo Sapiens
AFSKASALT

SEQ ID NO: 479058 - protein, 9 aa, Homo Sapiens
GCWRSFFTC

SEQ ID NO: 479059 - protein, 9 aa, Homo Sapiens
FMPIPMYGA

SEQ ID NO: 479060 - protein, 9 aa, Homo Sapiens
MKSFFSELL

SEQ ID NO: 479061 - protein, 9 aa, Homo Sapiens
EEQLRAWSA

SEQ ID NO: 479062 - protein, 9 aa, Homo Sapiens
ARLKKDGVN

SEQ ID NO: 479063 - protein, 9 aa, Homo Sapiens
WKQAAIVLD

SEQ ID NO: 479064 - protein, 9 aa, Homo Sapiens
VFYCGMVVV

SEQ ID NO: 479065 - protein, 9 aa, Homo Sapiens
TEILREAWV

SEQ ID NO: 479066 - protein, 9 aa, Homo Sapiens
QLLLRNTKP

SEQ ID NO: 479067 - protein, 9 aa, Homo Sapiens
SAGPRGVRP

SEQ ID NO: 479068 - protein, 9 aa, Homo Sapiens
PGHAGASGN

SEQ ID NO: 479069 - protein, 9 aa, Homo Sapiens
SKPVAMTVE

SEQ ID NO: 479070 - protein, 9 aa, Homo Sapiens
AILATLASP

SEQ ID NO: 479071 - protein, 9 aa, Homo Sapiens
AKKLTEKTV

SEQ ID NO: 479072 - protein, 9 aa, Homo Sapiens
MHSPFTKRQ

SEQ ID NO: 479073 - protein, 9 aa, Homo Sapiens
HRHYWGKKL

SEQ ID NO: 479074 - protein, 9 aa, Homo Sapiens
TAERKHLSK

SEQ ID NO: 479075 - protein, 9 aa, Homo Sapiens
NQFQDAVLA

SEQ ID NO: 479076 - protein, 9 aa, Homo Sapiens
ARTPSAAAS

SEQ ID NO: 479077 - protein, 9 aa, Homo Sapiens
APFPDRSPE

SEQ ID NO: 479078 - protein, 9 aa, Homo Sapiens
RGVRPASPQ

SEQ ID NO: 479079 - protein, 9 aa, Homo Sapiens
SKEIWLPRP

SEQ ID NO: 479080 - protein, 9 aa, Homo Sapiens
IFIYYICIL

SEQ ID NO: 479081 - protein, 9 aa, Homo Sapiens
QLIEVQLQQ

SEQ ID NO: 479082 - protein, 9 aa, Homo Sapiens
TPGSPGHAG

SEQ ID NO: 479083 - protein, 9 aa, Homo Sapiens
WGKKLTLTP

SEQ ID NO: 479084 - protein, 9 aa, Homo Sapiens
IMINAFKIA

SEQ ID NO: 479085 - protein, 9 aa, Homo Sapiens
IPMYGASQA

SEQ ID NO: 479086 - protein, 9 aa, Homo Sapiens
SIFQINMII

SEQ ID NO: 479087 - protein, 9 aa, Homo Sapiens
IYLGYTFYG

SEQ ID NO: 479088 - protein, 9 aa, Homo Sapiens
SDSAMHSPF

SEQ ID NO: 479089 - protein, 9 aa, Homo Sapiens
SELMTVIST

SEQ ID NO: 479090 - protein, 9 aa, Homo Sapiens
AQSAHTMPV

SEQ ID NO: 479091 - protein, 9 aa, Homo Sapiens
QQKQLIEVQ

SEQ ID NO: 479092 - protein, 9 aa, Homo Sapiens
SPTPAMATV

SEQ ID NO: 479093 - protein, 9 aa, Homo Sapiens
QCRPYCQPW

SEQ ID NO: 479094 - protein, 9 aa, Homo Sapiens
VISTGVETT

SEQ ID NO: 479095 - protein, 9 aa, Homo Sapiens
MLSNTTTIA

SEQ ID NO: 479096 - protein, 9 aa, Homo Sapiens
FFKDWRNKD

SEQ ID NO: 479097 - protein, 9 aa, Homo Sapiens
MIIKDKYPN

SEQ ID NO: 479098 - protein, 9 aa, Homo Sapiens
PRPQFYEVR

SEQ ID NO: 479099 - protein, 9 aa, Homo Sapiens
DHPGSPIYG

SEQ ID NO: 479100 - protein, 9 aa, Homo Sapiens
LAYCMSFKN

SEQ ID NO: 479101 - protein, 9 aa, Homo Sapiens
LSPLLFKIV

SEQ ID NO: 479102 - protein, 9 aa, Homo Sapiens
GTPGSPGHA

SEQ ID NO: 479103 - protein, 9 aa, Homo Sapiens
MDLRVYGPA

SEQ ID NO: 479104 - protein, 9 aa, Homo Sapiens
EAGSWHPSS

SEQ ID NO: 479105 - protein, 9 aa, Homo Sapiens
AGFSVPLPG

SEQ ID NO: 479106 - protein, 9 aa, Homo Sapiens
PYCQPWGAG

SEQ ID NO: 479107 - protein, 9 aa, Homo Sapiens
GPSAFPCSS

SEQ ID NO: 479108 - protein, 9 aa, Homo Sapiens
YGGWGASPY

SEQ ID NO: 479109 - protein, 9 aa, Homo Sapiens
NAFKIASAS

SEQ ID NO: 479110 - protein, 9 aa, Homo Sapiens
ASHWKQAAI

SEQ ID NO: 479111 - protein, 9 aa, Homo Sapiens
GYRKDLGPP

SEQ ID NO: 479112 - protein, 9 aa, Homo Sapiens
SIVLKGKIS

SEQ ID NO: 479113 - protein, 9 aa, Homo Sapiens
GKAFSKASA

SEQ ID NO: 479114 - protein, 9 aa, Homo Sapiens
TIAEAWARL

SEQ ID NO: 479115 - protein, 9 aa, Homo Sapiens
TTDQDAHSL

SEQ ID NO: 479116 - protein, 9 aa, Homo Sapiens
CHPVAVDVL

SEQ ID NO: 479117 - protein, 9 aa, Homo Sapiens
IIRHDSRQV

SEQ ID NO: 479118 - protein, 9 aa, Homo Sapiens
NEESYSLLR

SEQ ID NO: 479119 - protein, 9 aa, Homo Sapiens
FTTAERKHL

SEQ ID NO: 479120 - protein, 9 aa, Homo Sapiens
NQRLGGDVQ

SEQ ID NO: 479121 - protein, 9 aa, Homo Sapiens
SSDIKLHFP

SEQ ID NO: 479122 - protein, 9 aa, Homo Sapiens
PDRSLRPLR

SEQ ID NO: 479123 - protein, 9 aa, Homo Sapiens
LLDFGSENS

SEQ ID NO: 479124 - protein, 9 aa, Homo Sapiens
LFMEAIHTD

SEQ ID NO: 479125 - protein, 9 aa, Homo Sapiens
EQLRAWSAW

SEQ ID NO: 479126 - protein, 9 aa, Homo Sapiens
TLEGTHVFV

SEQ ID NO: 479127 - protein, 9 aa, Homo Sapiens
IMEYLDGGS

SEQ ID NO: 479128 - protein, 9 aa, Homo Sapiens
EIITDSMVY

SEQ ID NO: 479129 - protein, 9 aa, Homo Sapiens
HCAPFPDRS

SEQ ID NO: 479130 - protein, 9 aa, Homo Sapiens
PGTGVLLLH

SEQ ID NO: 479131 - protein, 9 aa, Homo Sapiens
KEECEQSTR

SEQ ID NO: 479132 - protein, 9 aa, Homo Sapiens
LREAWVSSS

SEQ ID NO: 479133 - protein, 9 aa, Homo Sapiens
SSSREGTQP

SEQ ID NO: 479134 - protein, 9 aa, Homo Sapiens
AHTMPVRRN

SEQ ID NO: 479135 - protein, 9 aa, Homo Sapiens
FIYYICILF

SEQ ID NO: 479136 - protein, 9 aa, Homo Sapiens
PYGTYGGWG

SEQ ID NO: 479137 - protein, 9 aa, Homo Sapiens
RQVSKKSTT

SEQ ID NO: 479138 - protein, 9 aa, Homo Sapiens
ENGDPQRFF

SEQ ID NO: 479139 - protein, 9 aa, Homo Sapiens
QHQLVRLSI

SEQ ID NO: 479140 - protein, 9 aa, Homo Sapiens
EIWLPRPQF

SEQ ID NO: 479141 - protein, 9 aa, Homo Sapiens
IQQMTRHPN

SEQ ID NO: 479142 - protein, 9 aa, Homo Sapiens
LTEKTVKAK

SEQ ID NO: 479143 - protein, 9 aa, Homo Sapiens
DDAITALQQ

SEQ ID NO: 479144 - protein, 9 aa, Homo Sapiens
INMIIKDKY

SEQ ID NO: 479145 - protein, 9 aa, Homo Sapiens
MEAGSWHPS

SEQ ID NO: 479146 - protein, 9 aa, Homo Sapiens
SGQSSTCGQ

SEQ ID NO: 479147 - protein, 9 aa, Homo Sapiens
MINAFKIAS

SEQ ID NO: 479148 - protein, 9 aa, Homo Sapiens
SKASALTAH

SEQ ID NO: 479149 - protein, 9 aa, Homo Sapiens
LDFGSENSC

SEQ ID NO: 479150 - protein, 9 aa, Homo Sapiens
TTAERKHLS

SEQ ID NO: 479151 - protein, 9 aa, Homo Sapiens
CPGLCKGDL

SEQ ID NO: 479152 - protein, 9 aa, Homo Sapiens
YCGMVVVPI

SEQ ID NO: 479153 - protein, 9 aa, Homo Sapiens
VCAVNCLLY

SEQ ID NO: 479154 - protein, 9 aa, Homo Sapiens
AIDFLSSFH

SEQ ID NO: 479155 - protein, 9 aa, Homo Sapiens
KKLTLTPGN

SEQ ID NO: 479156 - protein, 9 aa, Homo Sapiens
FFSELLDPL

SEQ ID NO: 479157 - protein, 9 aa, Homo Sapiens
TFYGWIVLG

SEQ ID NO: 479158 - protein, 9 aa, Homo Sapiens
EAESNSLKR

SEQ ID NO: 479159 - protein, 9 aa, Homo Sapiens
LLTIFIYYI

SEQ ID NO: 479160 - protein, 9 aa, Homo Sapiens
KPELLARLK

SEQ ID NO: 479161 - protein, 9 aa, Homo Sapiens
YGASQALKT

SEQ ID NO: 479162 - protein, 9 aa, Homo Sapiens
LMQTLEGTH

SEQ ID NO: 479163 - protein, 9 aa, Homo Sapiens
RKCRRSLES

SEQ ID NO: 479164 - protein, 9 aa, Homo Sapiens
GWTEILREA

SEQ ID NO: 479165 - protein, 9 aa, Homo Sapiens
SPARTPSAA

SEQ ID NO: 479166 - protein, 9 aa, Homo Sapiens
PVLSVAGQQ

SEQ ID NO: 479167 - protein, 9 aa, Homo Sapiens
TSSYQLIIL

SEQ ID NO: 479168 - protein, 9 aa, Homo Sapiens
QKQLIEVQL

SEQ ID NO: 479169 - protein, 9 aa, Homo Sapiens
YRSLTRPSK

SEQ ID NO: 479170 - protein, 9 aa, Homo Sapiens
DWRNKDQSD

SEQ ID NO: 479171 - protein, 9 aa, Homo Sapiens
PPQSEAESN

SEQ ID NO: 479172 - protein, 9 aa, Homo Sapiens
EETEGLACQ

SEQ ID NO: 479173 - protein, 9 aa, Homo Sapiens
QFLLAYCMS

SEQ ID NO: 479174 - protein, 9 aa, Homo Sapiens
EGTHVFVHA

SEQ ID NO: 479175 - protein, 9 aa, Homo Sapiens
AVLAFPDDM

SEQ ID NO: 479176 - protein, 9 aa, Homo Sapiens
QRFFNLSET

SEQ ID NO: 479177 - protein, 9 aa, Homo Sapiens
NELTELKCN

SEQ ID NO: 479178 - protein, 9 aa, Homo Sapiens
IETFRLGVT

SEQ ID NO: 479179 - protein, 9 aa, Homo Sapiens
SAAASPAQA

SEQ ID NO: 479180 - protein, 9 aa, Homo Sapiens
LTVQQLKEI

SEQ ID NO: 479181 - protein, 9 aa, Homo Sapiens
PFPPDRSLR

SEQ ID NO: 479182 - protein, 9 aa, Homo Sapiens
RKRHCAPFP

SEQ ID NO: 479183 - protein, 9 aa, Homo Sapiens
LACQVCQML

SEQ ID NO: 479184 - protein, 9 aa, Homo Sapiens
LLIMINAFK

SEQ ID NO: 479185 - protein, 9 aa, Homo Sapiens
KQFFKDWRN

SEQ ID NO: 479186 - protein, 9 aa, Homo Sapiens
NQAQSAHTM

SEQ ID NO: 479187 - protein, 9 aa, Homo Sapiens
ETFTTAERK

SEQ ID NO: 479188 - protein, 9 aa, Homo Sapiens
PYPTKGEKV

SEQ ID NO: 479189 - protein, 9 aa, Homo Sapiens
YLGYTFYGW

SEQ ID NO: 479190 - protein, 9 aa, Homo Sapiens
QAQSAHTMP

SEQ ID NO: 479191 - protein, 9 aa, Homo Sapiens
SPFAPLLET

SEQ ID NO: 479192 - protein, 9 aa, Homo Sapiens
GSWHPSSSN

SEQ ID NO: 479193 - protein, 9 aa, Homo Sapiens
QFFKDWRNK

SEQ ID NO: 479194 - protein, 9 aa, Homo Sapiens
IEGLTVQQL

SEQ ID NO: 479195 - protein, 9 aa, Homo Sapiens
KLDDAITAL

SEQ ID NO: 479196 - protein, 9 aa, Homo Sapiens
IEVQLQQNK

SEQ ID NO: 479197 - protein, 9 aa, Homo Sapiens
PARTPSAAA

SEQ ID NO: 479198 - protein, 9 aa, Homo Sapiens
QSEAESNSL

SEQ ID NO: 479199 - protein, 9 aa, Homo Sapiens
QFQDAVLAN

SEQ ID NO: 479200 - protein, 9 aa, Homo Sapiens
FSVPLPGAR

SEQ ID NO: 479201 - protein, 9 aa, Homo Sapiens
TTAILATLA

SEQ ID NO: 479202 - protein, 9 aa, Homo Sapiens
PYVMDPDHQ

SEQ ID NO: 479203 - protein, 9 aa, Homo Sapiens
PAQACMDGR

SEQ ID NO: 479204 - protein, 9 aa, Homo Sapiens
NPSDSAMHS

SEQ ID NO: 479205 - protein, 9 aa, Homo Sapiens
NAGFSVPLP

SEQ ID NO: 479206 - protein, 9 aa, Homo Sapiens
EEAGTTSGG

SEQ ID NO: 479207 - protein, 9 aa, Homo Sapiens
INQFQDAVL

SEQ ID NO: 479208 - protein, 9 aa, Homo Sapiens
PVAMTVEQE

SEQ ID NO: 479209 - protein, 9 aa, Homo Sapiens
TVEQEEELE

SEQ ID NO: 479210 - protein, 9 aa, Homo Sapiens
EGSAYVKVS

SEQ ID NO: 479211 - protein, 9 aa, Homo Sapiens
ILATNMAGM

SEQ ID NO: 479212 - protein, 9 aa, Homo Sapiens
QGPPFPPDR

SEQ ID NO: 479213 - protein, 9 aa, Homo Sapiens
YVMDPDHQL

SEQ ID NO: 479214 - protein, 9 aa, Homo Sapiens
CQSSRMDGL

SEQ ID NO: 479215 - protein, 9 aa, Homo Sapiens
VMDPDHQLL

SEQ ID NO: 479216 - protein, 9 aa, Homo Sapiens
YLDGGSALD

SEQ ID NO: 479217 - protein, 9 aa, Homo Sapiens
ESENQRLGG

SEQ ID NO: 479218 - protein, 9 aa, Homo Sapiens
AGTTSGGDE

SEQ ID NO: 479219 - protein, 9 aa, Homo Sapiens
RPLVRMCQR

SEQ ID NO: 479220 - protein, 9 aa, Homo Sapiens
VCPVYKTRA

SEQ ID NO: 479221 - protein, 9 aa, Homo Sapiens
RNKDQSDGF

SEQ ID NO: 479222 - protein, 9 aa, Homo Sapiens
KMEKLDDAI

SEQ ID NO: 479223 - protein, 9 aa, Homo Sapiens
LSKEIWLPR

SEQ ID NO: 479224 - protein, 9 aa, Homo Sapiens
TVISTGVET

SEQ ID NO: 479225 - protein, 9 aa, Homo Sapiens
TERPSTGGL

SEQ ID NO: 479226 - protein, 9 aa, Homo Sapiens
KRHCAPFPD

SEQ ID NO: 479227 - protein, 9 aa, Homo Sapiens
LTDEIRQKV

SEQ ID NO: 479228 - protein, 9 aa, Homo Sapiens
SSFHKEELQ

SEQ ID NO: 479229 - protein, 9 aa, Homo Sapiens
YQLIILATN

SEQ ID NO: 479230 - protein, 9 aa, Homo Sapiens
KNPSDSAMH

SEQ ID NO: 479231 - protein, 9 aa, Homo Sapiens
LRCHPVAVD

SEQ ID NO: 479232 - protein, 9 aa, Homo Sapiens
MTARGQSPF

SEQ ID NO: 479233 - protein, 9 aa, Homo Sapiens
MTVEQEEEL

SEQ ID NO: 479234 - protein, 9 aa, Homo Sapiens
DPDHQLLLR

SEQ ID NO: 479235 - protein, 9 aa, Homo Sapiens
ILREAWVSS

SEQ ID NO: 479236 - protein, 9 aa, Homo Sapiens
LEESENQRL

SEQ ID NO: 479237 - protein, 9 aa, Homo Sapiens
MEYLDGGSA

SEQ ID NO: 479238 - protein, 9 aa, Homo Sapiens
YTFYGWIVL

SEQ ID NO: 479239 - protein, 9 aa, Homo Sapiens
IRPTAVLLW

SEQ ID NO: 479240 - protein, 9 aa, Homo Sapiens
NILYSSDTI

SEQ ID NO: 479241 - protein, 9 aa, Homo Sapiens
MYGASQALK

SEQ ID NO: 479242 - protein, 9 aa, Homo Sapiens
TGVLLLHFN

SEQ ID NO: 479243 - protein, 9 aa, Homo Sapiens
NAGVCAVNC

SEQ ID NO: 479244 - protein, 9 aa, Homo Sapiens
CRPYCQPWG

SEQ ID NO: 479245 - protein, 9 aa, Homo Sapiens
SCDHPGSPI

SEQ ID NO: 479246 - protein, 9 aa, Homo Sapiens
LHLTLHKKV

SEQ ID NO: 479247 - protein, 9 aa, Homo Sapiens
YWGKKLTLT

SEQ ID NO: 479248 - protein, 9 aa, Homo Sapiens
DQHQLVRLS

SEQ ID NO: 479249 - protein, 9 aa, Homo Sapiens
FHKEELQML

SEQ ID NO: 479250 - protein, 9 aa, Homo Sapiens
AFKIASASR

SEQ ID NO: 479251 - protein, 9 aa, Homo Sapiens
QYRSLTRPS

SEQ ID NO: 479252 - protein, 9 aa, Homo Sapiens
MEAIHTDTD

SEQ ID NO: 479253 - protein, 9 aa, Homo Sapiens
EILREAWVS

SEQ ID NO: 479254 - protein, 9 aa, Homo Sapiens
IITDSMVYF

SEQ ID NO: 479255 - protein, 9 aa, Homo Sapiens
RRSADFGAE

SEQ ID NO: 479256 - protein, 9 aa, Homo Sapiens
SPLLFKIVL

SEQ ID NO: 479257 - protein, 9 aa, Homo Sapiens
RSRKCRRSL

SEQ ID NO: 479258 - protein, 9 aa, Homo Sapiens
TDEIRQKVW

SEQ ID NO: 479259 - protein, 9 aa, Homo Sapiens
AGVCAVNCL

SEQ ID NO: 479260 - protein, 9 aa, Homo Sapiens
SSSSSREGT

SEQ ID NO: 479261 - protein, 9 aa, Homo Sapiens
FRLGVTYEQ

SEQ ID NO: 479262 - protein, 9 aa, Homo Sapiens
LNSNICLFG

SEQ ID NO: 479263 - protein, 9 aa, Homo Sapiens
FMEAIHTDT

SEQ ID NO: 479264 - protein, 9 aa, Homo Sapiens
NSGWTEILR

SEQ ID NO: 479265 - protein, 9 aa, Homo Sapiens
LVAAAPRRQ

SEQ ID NO: 479266 - protein, 9 aa, Homo Sapiens
TVTTDQDAH

SEQ ID NO: 479267 - protein, 9 aa, Homo Sapiens
SPYGTYGGW

SEQ ID NO: 479268 - protein, 9 aa, Homo Sapiens
GTYEVRFFN

SEQ ID NO: 479269 - protein, 9 aa, Homo Sapiens
FGAEGAPSH

SEQ ID NO: 479270 - protein, 9 aa, Homo Sapiens
RLSIKPQRI

SEQ ID NO: 479271 - protein, 9 aa, Homo Sapiens
QSSRMDGLM

SEQ ID NO: 479272 - protein, 9 aa, Homo Sapiens
LCKGDLIVE

SEQ ID NO: 479273 - protein, 9 aa, Homo Sapiens
EASAGPRGV

SEQ ID NO: 479274 - protein, 9 aa, Homo Sapiens
RVERSQEMQ

SEQ ID NO: 479275 - protein, 9 aa, Homo Sapiens
VPLPGARLE

SEQ ID NO: 479276 - protein, 9 aa, Homo Sapiens
QGPGTGVLL

SEQ ID NO: 479277 - protein, 9 aa, Homo Sapiens
QTLEGTHVF

SEQ ID NO: 479278 - protein, 9 aa, Homo Sapiens
PQRFFNLSE

SEQ ID NO: 479279 - protein, 9 aa, Homo Sapiens
SLTRPSKSS

SEQ ID NO: 479280 - protein, 9 aa, Homo Sapiens
LTELKCNLQ

SEQ ID NO: 479281 - protein, 9 aa, Homo Sapiens
CGPAQACMD

SEQ ID NO: 479282 - protein, 9 aa, Homo Sapiens
LGPPKGIGS

SEQ ID NO: 479283 - protein, 9 aa, Homo Sapiens
HDDGQRLSG

SEQ ID NO: 479284 - protein, 9 aa, Homo Sapiens
RGLKKKKQY

SEQ ID NO: 479285 - protein, 9 aa, Homo Sapiens
VYKTRARRG

SEQ ID NO: 479286 - protein, 9 aa, Homo Sapiens
DAHSLIGVV

SEQ ID NO: 479287 - protein, 9 aa, Homo Sapiens
RPYCQPWGA

SEQ ID NO: 479288 - protein, 9 aa, Homo Sapiens
LSADEETIS

SEQ ID NO: 479289 - protein, 9 aa, Homo Sapiens
AHSLIGVVR

SEQ ID NO: 479290 - protein, 9 aa, Homo Sapiens
RLSGGAAAA

SEQ ID NO: 479291 - protein, 9 aa, Homo Sapiens
GGLLDVHCS

SEQ ID NO: 479292 - protein, 9 aa, Homo Sapiens
KGEKVMLAI

SEQ ID NO: 479293 - protein, 9 aa, Homo Sapiens
TVPTQPQSK

SEQ ID NO: 479294 - protein, 9 aa, Homo Sapiens
KAFSKASAL

SEQ ID NO: 479295 - protein, 9 aa, Homo Sapiens
PSATGCWRS

SEQ ID NO: 479296 - protein, 9 aa, Homo Sapiens
QDAHSLIGV

SEQ ID NO: 479297 - protein, 9 aa, Homo Sapiens
QQLKEILAR

SEQ ID NO: 479298 - protein, 9 aa, Homo Sapiens
PPKGIGSGS

SEQ ID NO: 479299 - protein, 9 aa, Homo Sapiens
AMHSPFTKR

SEQ ID NO: 479300 - protein, 9 aa, Homo Sapiens
VQQLKEILA

SEQ ID NO: 479301 - protein, 9 aa, Homo Sapiens
GQRLSGGAA

SEQ ID NO: 479302 - protein, 9 aa, Homo Sapiens
QELMEAGSW

SEQ ID NO: 479303 - protein, 9 aa, Homo Sapiens
RLVAAAPRR

SEQ ID NO: 479304 - protein, 9 aa, Homo Sapiens
PQSEAESNS

SEQ ID NO: 479305 - protein, 9 aa, Homo Sapiens
FQINMIIKD

SEQ ID NO: 479306 - protein, 9 aa, Homo Sapiens
VRLSIKPQR

SEQ ID NO: 479307 - protein, 9 aa, Homo Sapiens
LVRLSIKPQ

SEQ ID NO: 479308 - protein, 9 aa, Homo Sapiens
LRTSVLLEK

SEQ ID NO: 479309 - protein, 9 aa, Homo Sapiens
YGWIVLGPY

SEQ ID NO: 479310 - protein, 9 aa, Homo Sapiens
FSAKKLTEK

SEQ ID NO: 479311 - protein, 9 aa, Homo Sapiens
LGLAEAAAA

SEQ ID NO: 479312 - protein, 9 aa, Homo Sapiens
TDSMVYFVG

SEQ ID NO: 479313 - protein, 9 aa, Homo Sapiens
GHDDGQRLS

SEQ ID NO: 479314 - protein, 9 aa, Homo Sapiens
LPRPQFYEV

SEQ ID NO: 479315 - protein, 9 aa, Homo Sapiens
RMDGLMLKP

SEQ ID NO: 479316 - protein, 9 aa, Homo Sapiens
GNAGFSVPL

SEQ ID NO: 479317 - protein, 9 aa, Homo Sapiens
KCNLQTLEI

SEQ ID NO: 479318 - protein, 9 aa, Homo Sapiens
MLAGLVPAG

SEQ ID NO: 479319 - protein, 9 aa, Homo Sapiens
DSDFQGPGT

SEQ ID NO: 479320 - protein, 9 aa, Homo Sapiens
RFFNEESYS

SEQ ID NO: 479321 - protein, 9 aa, Homo Sapiens
EGQIQQMTR

SEQ ID NO: 479322 - protein, 9 aa, Homo Sapiens
LIMINAFKI

SEQ ID NO: 479323 - protein, 9 aa, Homo Sapiens
LLFKIVLEV

SEQ ID NO: 479324 - protein, 9 aa, Homo Sapiens
LKCNLQTLE

SEQ ID NO: 479325 - protein, 9 aa, Homo Sapiens
NKDQSDGFG

SEQ ID NO: 479326 - protein, 9 aa, Homo Sapiens
TENQAQSAH

SEQ ID NO: 479327 - protein, 9 aa, Homo Sapiens
ELLIMINAF

SEQ ID NO: 479328 - protein, 9 aa, Homo Sapiens
SFSAKKLTE

SEQ ID NO: 479329 - protein, 9 aa, Homo Sapiens
CNLQTLEIE

SEQ ID NO: 479330 - protein, 9 aa, Homo Sapiens
EIETFRLGV

SEQ ID NO: 479331 - protein, 9 aa, Homo Sapiens
KQAAIVLDN

SEQ ID NO: 479332 - protein, 9 aa, Homo Sapiens
IDTERPSTG

SEQ ID NO: 479333 - protein, 9 aa, Homo Sapiens
YEVRFFNEE

SEQ ID NO: 479334 - protein, 9 aa, Homo Sapiens
PRKRHCAPF

SEQ ID NO: 479335 - protein, 9 aa, Homo Sapiens
VRFFNEESY

SEQ ID NO: 479336 - protein, 9 aa, Homo Sapiens
HDSRQVSKK

SEQ ID NO: 479337 - protein, 9 aa, Homo Sapiens
TDQDAHSLI

SEQ ID NO: 479338 - protein, 9 aa, Homo Sapiens
GSSSSSREG

SEQ ID NO: 479339 - protein, 9 aa, Homo Sapiens
TILGILPVF

SEQ ID NO: 479340 - protein, 9 aa, Homo Sapiens
PGTPGSPGH

SEQ ID NO: 479341 - protein, 9 aa, Homo Sapiens
RTPSAAASP

SEQ ID NO: 479342 - protein, 9 aa, Homo Sapiens
GPAQACMDG

SEQ ID NO: 479343 - protein, 9 aa, Homo Sapiens
LTIFIYYIC

SEQ ID NO: 479344 - protein, 9 aa, Homo Sapiens
AGQQISIIL

SEQ ID NO: 479345 - protein, 9 aa, Homo Sapiens
PDDMDLRVY

SEQ ID NO: 479346 - protein, 9 aa, Homo Sapiens
SREGTQPSR

SEQ ID NO: 479347 - protein, 9 aa, Homo Sapiens
LGCMLAGLV

SEQ ID NO: 479348 - protein, 9 aa, Homo Sapiens
FQGPGTGVL

SEQ ID NO: 479349 - protein, 9 aa, Homo Sapiens
PSAFPCSSD

SEQ ID NO: 479350 - protein, 9 aa, Homo Sapiens
KKDGVNQKD

SEQ ID NO: 479351 - protein, 9 aa, Homo Sapiens
LPVLSVAGQ

SEQ ID NO: 479352 - protein, 9 aa, Homo Sapiens
LDPLVPYNM

SEQ ID NO: 479353 - protein, 9 aa, Homo Sapiens
DTILGILPV

SEQ ID NO: 479354 - protein, 9 aa, Homo Sapiens
WSAWLPPSQ

SEQ ID NO: 479355 - protein, 9 aa, Homo Sapiens
HCFEIITDS

SEQ ID NO: 479356 - protein, 9 aa, Homo Sapiens
GQSSTCGQH

SEQ ID NO: 479357 - protein, 9 aa, Homo Sapiens
GTGVLLLHF

SEQ ID NO: 479358 - protein, 9 aa, Homo Sapiens
IRQKVWPKL

SEQ ID NO: 479359 - protein, 9 aa, Homo Sapiens
TLHKKVPML

SEQ ID NO: 479360 - protein, 9 aa, Homo Sapiens
SPGKEECEQ

SEQ ID NO: 479361 - protein, 9 aa, Homo Sapiens
GHAGASGNP

SEQ ID NO: 479362 - protein, 9 aa, Homo Sapiens
MGEEQLRAW

SEQ ID NO: 479363 - protein, 9 aa, Homo Sapiens
QIEYIDTER

SEQ ID NO: 479364 - protein, 9 aa, Homo Sapiens
VMLAIITKM

SEQ ID NO: 479365 - protein, 9 aa, Homo Sapiens
IIKDKYPNL

SEQ ID NO: 479366 - protein, 9 aa, Homo Sapiens
SWHPSSSNA

SEQ ID NO: 479367 - protein, 9 aa, Homo Sapiens
VCMLSNTTT

SEQ ID NO: 479368 - protein, 9 aa, Homo Sapiens
TSPTPAMAT

SEQ ID NO: 479369 - protein, 9 aa, Homo Sapiens
GGEEAGTTS

SEQ ID NO: 479370 - protein, 9 aa, Homo Sapiens
CLLYVVGGD

SEQ ID NO: 479371 - protein, 9 aa, Homo Sapiens
LWIIMEYLD

SEQ ID NO: 479372 - protein, 9 aa, Homo Sapiens
SSSSREGTQ

SEQ ID NO: 479373 - protein, 9 aa, Homo Sapiens
AAASPAQAS

SEQ ID NO: 479374 - protein, 9 aa, Homo Sapiens
ILGILPVFQ

SEQ ID NO: 479375 - protein, 9 aa, Homo Sapiens
VAMTVEQEE

SEQ ID NO: 479376 - protein, 9 aa, Homo Sapiens
APSTGGVMK

SEQ ID NO: 479377 - protein, 9 aa, Homo Sapiens
CMLAGLVPA

SEQ ID NO: 479378 - protein, 9 aa, Homo Sapiens
ADFGAEGAP

SEQ ID NO: 479379 - protein, 9 aa, Homo Sapiens
IYYICILFS

SEQ ID NO: 479380 - protein, 9 aa, Homo Sapiens
VMKPHRYRP

SEQ ID NO: 479381 - protein, 9 aa, Homo Sapiens
GTTSGGDEA

SEQ ID NO: 479382 - protein, 9 aa, Homo Sapiens
TRHPNITQL

SEQ ID NO: 479383 - protein, 9 aa, Homo Sapiens
FPLSELMTV

SEQ ID NO: 479384 - protein, 9 aa, Homo Sapiens
FKIVLEVLA

SEQ ID NO: 479385 - protein, 9 aa, Homo Sapiens
SAYVKVSIQ

SEQ ID NO: 479386 - protein, 9 aa, Homo Sapiens
RHDSRQVSK

SEQ ID NO: 479387 - protein, 9 aa, Homo Sapiens
SAPSTGGVM

SEQ ID NO: 479388 - protein, 9 aa, Homo Sapiens
LDRPLVRMC

SEQ ID NO: 479389 - protein, 9 aa, Homo Sapiens
QRLSGGAAA

SEQ ID NO: 479390 - protein, 9 aa, Homo Sapiens
KLRCHPVAV

SEQ ID NO: 479391 - protein, 9 aa, Homo Sapiens
RGQSPFAPL

SEQ ID NO: 479392 - protein, 9 aa, Homo Sapiens
KPVAMTVEQ

SEQ ID NO: 479393 - protein, 9 aa, Homo Sapiens
FKIASASRV

SEQ ID NO: 479394 - protein, 9 aa, Homo Sapiens
PDHQLLLRN

SEQ ID NO: 479395 - protein, 9 aa, Homo Sapiens
CRRSLESQK

SEQ ID NO: 479396 - protein, 9 aa, Homo Sapiens
LGYTFYGWI

SEQ ID NO: 479397 - protein, 9 aa, Homo Sapiens
DAGDALFME

SEQ ID NO: 479398 - protein, 9 aa, Homo Sapiens
YCQPWGAGK

SEQ ID NO: 479399 - protein, 9 aa, Homo Sapiens
LDGGSALDL

SEQ ID NO: 479400 - protein, 9 aa, Homo Sapiens
GRQIEYIDT

SEQ ID NO: 479401 - protein, 9 aa, Homo Sapiens
LDDAITALQ

SEQ ID NO: 479402 - protein, 9 aa, Homo Sapiens
AQACMDGRC

SEQ ID NO: 479403 - protein, 9 aa, Homo Sapiens
HYWGKKLTL

SEQ ID NO: 479404 - protein, 9 aa, Homo Sapiens
AVFYCGMVV

SEQ ID NO: 479405 - protein, 9 aa, Homo Sapiens
SVAGQQISI

SEQ ID NO: 479406 - protein, 9 aa, Homo Sapiens
EKMMRKKQA

SEQ ID NO: 479407 - protein, 9 aa, Homo Sapiens
VHCSEEVIK

SEQ ID NO: 479408 - protein, 9 aa, Homo Sapiens
SATGCWRSF

SEQ ID NO: 479409 - protein, 9 aa, Homo Sapiens
DHQLLLRNT

SEQ ID NO: 479410 - protein, 9 aa, Homo Sapiens
LLARLKKDG

SEQ ID NO: 479411 - protein, 9 aa, Homo Sapiens
STGGVMKPH

SEQ ID NO: 479412 - protein, 9 aa, Homo Sapiens
ALFMEAIHT

SEQ ID NO: 479413 - protein, 9 aa, Homo Sapiens
DYSPYGTYG

SEQ ID NO: 479414 - protein, 9 aa, Homo Sapiens
KDSQQKQLI

SEQ ID NO: 479415 - protein, 9 aa, Homo Sapiens
LSNTTTIAE

SEQ ID NO: 479416 - protein, 9 aa, Homo Sapiens
QLEESENQR

SEQ ID NO: 479417 - protein, 9 aa, Homo Sapiens
RSQEMQMID

SEQ ID NO: 479418 - protein, 9 aa, Homo Sapiens
SALTAHKTI

SEQ ID NO: 479419 - protein, 9 aa, Homo Sapiens
TSGGDEAWT

SEQ ID NO: 479420 - protein, 9 aa, Homo Sapiens
PSEVLGCML

SEQ ID NO: 479421 - protein, 9 aa, Homo Sapiens
KISSDIKLH

SEQ ID NO: 479422 - protein, 9 aa, Homo Sapiens
IIMEYLDGG

SEQ ID NO: 479423 - protein, 9 aa, Homo Sapiens
MQTLEGTHV

SEQ ID NO: 479424 - protein, 9 aa, Homo Sapiens
GTGPSAFPC

SEQ ID NO: 479425 - protein, 9 aa, Homo Sapiens
DTERPSTGG

SEQ ID NO: 479426 - protein, 9 aa, Homo Sapiens
LSSFHKEEL

SEQ ID NO: 479427 - protein, 9 aa, Homo Sapiens
KSFFSELLD

SEQ ID NO: 479428 - protein, 9 aa, Homo Sapiens
VSKKSTTKD

SEQ ID NO: 479429 - protein, 9 aa, Homo Sapiens
VPPQSEAES

SEQ ID NO: 479430 - protein, 9 aa, Homo Sapiens
FFNEESYSL

SEQ ID NO: 479431 - protein, 9 aa, Homo Sapiens
TGCWRSFFT

SEQ ID NO: 479432 - protein, 9 aa, Homo Sapiens
LMTVISTGV

SEQ ID NO: 479433 - protein, 9 aa, Homo Sapiens
PVYKTRARR

SEQ ID NO: 479434 - protein, 9 aa, Homo Sapiens
QLIILATNM

SEQ ID NO: 479435 - protein, 9 aa, Homo Sapiens
SRKCRRSLE

SEQ ID NO: 479436 - protein, 9 aa, Homo Sapiens
VRPASPQAQ

SEQ ID NO: 479437 - protein, 9 aa, Homo Sapiens
VKVSIQKQA

SEQ ID NO: 479438 - protein, 9 aa, Homo Sapiens
DDMDLRVYG

SEQ ID NO: 479439 - protein, 9 aa, Homo Sapiens
DLNSNICLF

SEQ ID NO: 479440 - protein, 9 aa, Homo Sapiens
RSADFGAEG

SEQ ID NO: 479441 - protein, 9 aa, Homo Sapiens
GGVMKPHRY

SEQ ID NO: 479442 - protein, 9 aa, Homo Sapiens
NRGLKKKKQ

SEQ ID NO: 479443 - protein, 9 aa, Homo Sapiens
LDAGDALFM

SEQ ID NO: 479444 - protein, 9 aa, Homo Sapiens
PFAPLLETL

SEQ ID NO: 479445 - protein, 9 aa, Homo Sapiens
LNGTGPSAF

SEQ ID NO: 479446 - protein, 9 aa, Homo Sapiens
DGGSALDLL

SEQ ID NO: 479447 - protein, 9 aa, Homo Sapiens
IFQINMIIK

SEQ ID NO: 479448 - protein, 9 aa, Homo Sapiens
YFLRYINQF

SEQ ID NO: 479449 - protein, 9 aa, Homo Sapiens
WIIMEYLDG

SEQ ID NO: 479450 - protein, 9 aa, Homo Sapiens
RKDLGPPKG

SEQ ID NO: 479451 - protein, 9 aa, Homo Sapiens
DLPVLSVAG

SEQ ID NO: 479452 - protein, 9 aa, Homo Sapiens
QLVRLSIKP

SEQ ID NO: 479453 - protein, 9 aa, Homo Sapiens
NQCRPYCQP

SEQ ID NO: 479454 - protein, 9 aa, Homo Sapiens
KRSRKCRRS

SEQ ID NO: 479455 - protein, 9 aa, Homo Sapiens
FVGKLRCHP

SEQ ID NO: 479456 - protein, 9 aa, Homo Sapiens
SRMDGLMLK

SEQ ID NO: 479457 - protein, 9 aa, Homo Sapiens
SAHTMPVRR

SEQ ID NO: 479458 - protein, 9 aa, Homo Sapiens
TGGVMKPHR

SEQ ID NO: 479459 - protein, 9 aa, Homo Sapiens
ATGCWRSFF

SEQ ID NO: 479460 - protein, 9 aa, Homo Sapiens
QKVWPKLLN

SEQ ID NO: 479461 - protein, 9 aa, Homo Sapiens
HCSEEVIKH

SEQ ID NO: 479462 - protein, 9 aa, Homo Sapiens
REGQIQQMT

SEQ ID NO: 479463 - protein, 9 aa, Homo Sapiens
TLQYRSLTR

SEQ ID NO: 479464 - protein, 9 aa, Homo Sapiens
SELLDPLVP

SEQ ID NO: 479465 - protein, 9 aa, Homo Sapiens
MIYLGYTFY

SEQ ID NO: 479466 - protein, 9 aa, Homo Sapiens
ADEETISKY

SEQ ID NO: 479467 - protein, 9 aa, Homo Sapiens
LRAWSAWLP

SEQ ID NO: 479468 - protein, 9 aa, Homo Sapiens
RMCQRHVGT

SEQ ID NO: 479469 - protein, 9 aa, Homo Sapiens
CPLSPLLFK

SEQ ID NO: 479470 - protein, 9 aa, Homo Sapiens
AARRSADFG

SEQ ID NO: 479471 - protein, 9 aa, Homo Sapiens
LAEAAAAGG

SEQ ID NO: 479472 - protein, 9 aa, Homo Sapiens
EDIEGLTVQ

SEQ ID NO: 479473 - protein, 9 aa, Homo Sapiens
EETISKYAG

SEQ ID NO: 479474 - protein, 9 aa, Homo Sapiens
KDLGPPKGI

SEQ ID NO: 479475 - protein, 9 aa, Homo Sapiens
KKRSRKCRR

SEQ ID NO: 479476 - protein, 9 aa, Homo Sapiens
KASALTAHK

SEQ ID NO: 479477 - protein, 9 aa, Homo Sapiens
ALTAHKTIH

SEQ ID NO: 479478 - protein, 9 aa, Homo Sapiens
QQMTRHPNI

SEQ ID NO: 479479 - protein, 9 aa, Homo Sapiens
ELLDPLVPY

SEQ ID NO: 479480 - protein, 9 aa, Homo Sapiens
SHWKQAAIV

SEQ ID NO: 479481 - protein, 9 aa, Homo Sapiens
EKVMLAIIT

SEQ ID NO: 479482 - protein, 9 aa, Homo Sapiens
MTRHPNITQ

SEQ ID NO: 479483 - protein, 9 aa, Homo Sapiens
IRHDSRQVS

SEQ ID NO: 479484 - protein, 9 aa, Homo Sapiens
FSKASALTA

SEQ ID NO: 479485 - protein, 9 aa, Homo Sapiens
DFLSSFHKE

SEQ ID NO: 479486 - protein, 9 aa, Homo Sapiens
VLAFPDDMD

SEQ ID NO: 479487 - protein, 9 aa, Homo Sapiens
MPIPMYGAS

SEQ ID NO: 479488 - protein, 9 aa, Homo Sapiens
SCVPVSCDH

SEQ ID NO: 479489 - protein, 9 aa, Homo Sapiens
SVLLEKMMR

SEQ ID NO: 479490 - protein, 9 aa, Homo Sapiens
IDFLSSFHK

SEQ ID NO: 479491 - protein, 9 aa, Homo Sapiens
ECEQSTRKE

SEQ ID NO: 479492 - protein, 9 aa, Homo Sapiens
VLLWTPLLF

SEQ ID NO: 479493 - protein, 9 aa, Homo Sapiens
GQSPFAPLL

SEQ ID NO: 479494 - protein, 9 aa, Homo Sapiens
AVNCLLYVV

SEQ ID NO: 479495 - protein, 9 aa, Homo Sapiens
GCPGLCKGD

SEQ ID NO: 479496 - protein, 9 aa, Homo Sapiens
QGCPGLCKG

SEQ ID NO: 479497 - protein, 9 aa, Homo Sapiens
DRPLVRMCQ

SEQ ID NO: 479498 - protein, 9 aa, Homo Sapiens
HVFVHAGPF

SEQ ID NO: 479499 - protein, 9 aa, Homo Sapiens
IQELMEAGS

SEQ ID NO: 479500 - protein, 9 aa, Homo Sapiens
DMDLRVYGP

SEQ ID NO: 479501 - protein, 9 aa, Homo Sapiens
VEQEEELEK

SEQ ID NO: 479502 - protein, 9 aa, Homo Sapiens
GLACQVCQM

SEQ ID NO: 479503 - protein, 9 aa, Homo Sapiens
KTVVCFIVM

SEQ ID NO: 479504 - protein, 9 aa, Homo Sapiens
LEGSAYVKV

SEQ ID NO: 479505 - protein, 9 aa, Homo Sapiens
TARGQSPFA

SEQ ID NO: 479506 - protein, 9 aa, Homo Sapiens
VNCLLYVVG

SEQ ID NO: 479507 - protein, 9 aa, Homo Sapiens
PLLFKIVLE

SEQ ID NO: 479508 - protein, 9 aa, Homo Sapiens
DLEGSAYVK

SEQ ID NO: 479509 - protein, 9 aa, Homo Sapiens
CDHPGSPIY

SEQ ID NO: 479510 - protein, 9 aa, Homo Sapiens
VRMCQRHVG

SEQ ID NO: 479511 - protein, 9 aa, Homo Sapiens
EAIDFLSSF

SEQ ID NO: 479512 - protein, 9 aa, Homo Sapiens
EAAAAGGEA

SEQ ID NO: 479513 - protein, 9 aa, Homo Sapiens
ETEGLACQV

SEQ ID NO: 479514 - protein, 9 aa, Homo Sapiens
GEEAGTTSG

SEQ ID NO: 479515 - protein, 9 aa, Homo Sapiens
QACMDGRCL

SEQ ID NO: 479516 - protein, 9 aa, Homo Sapiens
GEEQLRAWS

SEQ ID NO: 479517 - protein, 9 aa, Homo Sapiens
PENQCRPYC

SEQ ID NO: 479518 - protein, 9 aa, Homo Sapiens
WYHRHYWGK

SEQ ID NO: 479519 - protein, 9 aa, Homo Sapiens
ASGQSSTCG

SEQ ID NO: 479520 - protein, 9 aa, Homo Sapiens
ASALTAHKT

SEQ ID NO: 479521 - protein, 9 aa, Homo Sapiens
KETFTTAER

SEQ ID NO: 479522 - protein, 9 aa, Homo Sapiens
QINMIIKDK

SEQ ID NO: 479523 - protein, 9 aa, Homo Sapiens
IILATNMAG

SEQ ID NO: 479524 - protein, 9 aa, Homo Sapiens
HPVAVDVLL

SEQ ID NO: 479525 - protein, 9 aa, Homo Sapiens
GASQALKTN

SEQ ID NO: 479526 - protein, 9 aa, Homo Sapiens
PSPRLVAAA

SEQ ID NO: 479527 - protein, 9 aa, Homo Sapiens
ILYSSDTIL

SEQ ID NO: 479528 - protein, 9 aa, Homo Sapiens
QSSTCGQHG

SEQ ID NO: 479529 - protein, 9 aa, Homo Sapiens
DPQRFFNLS

SEQ ID NO: 479530 - protein, 9 aa, Homo Sapiens
LHKKVPMLT

SEQ ID NO: 479531 - protein, 9 aa, Homo Sapiens
GEKVMLAII

SEQ ID NO: 479532 - protein, 9 aa, Homo Sapiens
LATLASPGN

SEQ ID NO: 479533 - protein, 9 aa, Homo Sapiens
DFGSENSCE

SEQ ID NO: 479534 - protein, 9 aa, Homo Sapiens
WTEILREAW

SEQ ID NO: 479535 - protein, 9 aa, Homo Sapiens
TELKCNLQT

SEQ ID NO: 479536 - protein, 9 aa, Homo Sapiens
GPRGVRPAS

SEQ ID NO: 479537 - protein, 9 aa, Homo Sapiens
TTTIAEAWA

SEQ ID NO: 479538 - protein, 9 aa, Homo Sapiens
AAIVLDNPI

SEQ ID NO: 479539 - protein, 9 aa, Homo Sapiens
FEIITDSMV

SEQ ID NO: 479540 - protein, 9 aa, Homo Sapiens
GVMKPHRYR

SEQ ID NO: 479541 - protein, 9 aa, Homo Sapiens
SCERTSFAF

SEQ ID NO: 479542 - protein, 9 aa, Homo Sapiens
PFPDRSPEL

SEQ ID NO: 479543 - protein, 9 aa, Homo Sapiens
SDFQGPGTG

SEQ ID NO: 479544 - protein, 9 aa, Homo Sapiens
KIVLEVLAR

SEQ ID NO: 479545 - protein, 9 aa, Homo Sapiens
TRPSKSSTS

SEQ ID NO: 479546 - protein, 9 aa, Homo Sapiens
CMDGRCLHM

SEQ ID NO: 479547 - protein, 9 aa, Homo Sapiens
PGSPGHAGA

SEQ ID NO: 479548 - protein, 9 aa, Homo Sapiens
TTIAEAWAR

SEQ ID NO: 479549 - protein, 9 aa, Homo Sapiens
AIVLDNPIQ

SEQ ID NO: 479550 - protein, 9 aa, Homo Sapiens
YINQFQDAV

SEQ ID NO: 479551 - protein, 9 aa, Homo Sapiens
PSCVPVSCD

SEQ ID NO: 479552 - protein, 9 aa, Homo Sapiens
SVPLPGARL

SEQ ID NO: 479553 - protein, 9 aa, Homo Sapiens
IVLDNPIQV

SEQ ID NO: 479554 - protein, 9 aa, Homo Sapiens
YSKMEKLDD

SEQ ID NO: 479555 - protein, 9 aa, Homo Sapiens
LTRPSKSST

SEQ ID NO: 479556 - protein, 9 aa, Homo Sapiens
TRARRGTLS

SEQ ID NO: 479557 - protein, 9 aa, Homo Sapiens
CMSFKNLSM

SEQ ID NO: 479558 - protein, 9 aa, Homo Sapiens
CFEIITDSM

SEQ ID NO: 479559 - protein, 9 aa, Homo Sapiens
QEMQMIDLQ

SEQ ID NO: 479560 - protein, 9 aa, Homo Sapiens
LLTDEIRQK

SEQ ID NO: 479561 - protein, 9 aa, Homo Sapiens
NCLLYVVGG

SEQ ID NO: 479562 - protein, 9 aa, Homo Sapiens
LLHLTLHKK

SEQ ID NO: 479563 - protein, 9 aa, Homo Sapiens
GKEECEQST

SEQ ID NO: 479564 - protein, 9 aa, Homo Sapiens
SYQLIILAT

SEQ ID NO: 479565 - protein, 9 aa, Homo Sapiens
DSAMHSPFT

SEQ ID NO: 479566 - protein, 9 aa, Homo Sapiens
PGKEECEQS

SEQ ID NO: 479567 - protein, 9 aa, Homo Sapiens
VLKGKISSD

SEQ ID NO: 479568 - protein, 9 aa, Homo Sapiens
TVQQLKEIL

SEQ ID NO: 479569 - protein, 9 aa, Homo Sapiens
EVLGCMLAG

SEQ ID NO: 479570 - protein, 9 aa, Homo Sapiens
MEKLDDAIT

SEQ ID NO: 479571 - protein, 9 aa, Homo Sapiens
SENSCERTS

SEQ ID NO: 479572 - protein, 9 aa, Homo Sapiens
ACQVCQMLL

SEQ ID NO: 479573 - protein, 9 aa, Homo Sapiens
VLLEKMMRK

SEQ ID NO: 479574 - protein, 9 aa, Homo Sapiens
ATVPTQPQS

SEQ ID NO: 479575 - protein, 9 aa, Homo Sapiens
TGPSAFPCS

SEQ ID NO: 479576 - protein, 9 aa, Homo Sapiens
KCRRSLESQ

SEQ ID NO: 479577 - protein, 9 aa, Homo Sapiens
VAGQQISII

SEQ ID NO: 479578 - protein, 9 aa, Homo Sapiens
FLCMMGKTV

SEQ ID NO: 479579 - protein, 9 aa, Homo Sapiens
LKGKISSDI

SEQ ID NO: 479580 - protein, 9 aa, Homo Sapiens
ELTELKCNL

SEQ ID NO: 479581 - protein, 9 aa, Homo Sapiens
PPFPPDRSL

SEQ ID NO: 479582 - protein, 9 aa, Homo Sapiens
PSDSAMHSP

SEQ ID NO: 479583 - protein, 9 aa, Homo Sapiens
FAPLLETLE

SEQ ID NO: 479584 - protein, 9 aa, Homo Sapiens
GLLDVHCSE

SEQ ID NO: 479585 - protein, 9 aa, Homo Sapiens
WLPRPQFYE

SEQ ID NO: 479586 - protein, 9 aa, Homo Sapiens
PRGVRPASP

SEQ ID NO: 479587 - protein, 9 aa, Homo Sapiens
NGTGPSAFP

SEQ ID NO: 479588 - protein, 9 aa, Homo Sapiens
CPVYKTRAR

SEQ ID NO: 479589 - protein, 9 aa, Homo Sapiens
EAGTTSGGD

SEQ ID NO: 479590 - protein, 9 aa, Homo Sapiens
PQQLEESEN

SEQ ID NO: 479591 - protein, 9 aa, Homo Sapiens
EGLACQVCQ

SEQ ID NO: 479592 - protein, 9 aa, Homo Sapiens
PLVRMCQRH

SEQ ID NO: 479593 - protein, 9 aa, Homo Sapiens
GLLTDEIRQ

SEQ ID NO: 479594 - protein, 9 aa, Homo Sapiens
EYIDTERPS

SEQ ID NO: 479595 - protein, 9 aa, Homo Sapiens
GLTVQQLKE

SEQ ID NO: 479596 - protein, 9 aa, Homo Sapiens
LFKIVLEVL

SEQ ID NO: 479597 - protein, 9 aa, Homo Sapiens
VSCDHPGSP

SEQ ID NO: 479598 - protein, 9 aa, Homo Sapiens
AFPDDMDLR

SEQ ID NO: 479599 - protein, 9 aa, Homo Sapiens
GSAYVKVSI

SEQ ID NO: 479600 - protein, 9 aa, Homo Sapiens
LLDPLVPYN

SEQ ID NO: 479601 - protein, 9 aa, Homo Sapiens
TFTTAERKH

SEQ ID NO: 479602 - protein, 9 aa, Homo Sapiens
TYEVRFFNE

SEQ ID NO: 479603 - protein, 9 aa, Homo Sapiens
QVSKKSTTK

SEQ ID NO: 479604 - protein, 9 aa, Homo Sapiens
TCGQHGASS

SEQ ID NO: 479605 - protein, 9 aa, Homo Sapiens
PVSCDHPGS

SEQ ID NO: 479606 - protein, 9 aa, Homo Sapiens
SGGEEAGTT

SEQ ID NO: 479607 - protein, 9 aa, Homo Sapiens
VAAAPRRQL

SEQ ID NO: 479608 - protein, 9 aa, Homo Sapiens
QSPFAPLLE

SEQ ID NO: 479609 - protein, 9 aa, Homo Sapiens
ARGQSPFAP

SEQ ID NO: 479610 - protein, 9 aa, Homo Sapiens
KAARRSADF

SEQ ID NO: 479611 - protein, 9 aa, Homo Sapiens
IGGLLDVHC

SEQ ID NO: 479612 - protein, 9 aa, Homo Sapiens
SNICLFGEC

SEQ ID NO: 479613 - protein, 9 aa, Homo Sapiens
TPAMATVPT

SEQ ID NO: 479614 - protein, 9 aa, Homo Sapiens
RHCAPFPDR

SEQ ID NO: 479615 - protein, 9 aa, Homo Sapiens
KVMLAIITK

SEQ ID NO: 479616 - protein, 9 aa, Homo Sapiens
GDPQRFFNL

SEQ ID NO: 479617 - protein, 9 aa, Homo Sapiens
STCGQHGAS

SEQ ID NO: 479618 - protein, 9 aa, Homo Sapiens
SADFGAEGA

SEQ ID NO: 479619 - protein, 9 aa, Homo Sapiens
ILQFLLAYC

SEQ ID NO: 479620 - protein, 9 aa, Homo Sapiens
GSASGQSST

SEQ ID NO: 479621 - protein, 9 aa, Homo Sapiens
SLLTIFIYY

SEQ ID NO: 479622 - protein, 9 aa, Homo Sapiens
ENQCRPYCQ

SEQ ID NO: 479623 - protein, 9 aa, Homo Sapiens
RNELTELKC

SEQ ID NO: 479624 - protein, 9 aa, Homo Sapiens
LSELMTVIS

SEQ ID NO: 479625 - protein, 9 aa, Homo Sapiens
RLKKDGVNQ

SEQ ID NO: 479626 - protein, 9 aa, Homo Sapiens
TTLQYRSLT

SEQ ID NO: 479627 - protein, 9 aa, Homo Sapiens
SSRMDGLML

SEQ ID NO: 479628 - protein, 9 aa, Homo Sapiens
DGQRLSGGA

SEQ ID NO: 479629 - protein, 9 aa, Homo Sapiens
GSLLHLTLH

SEQ ID NO: 479630 - protein, 9 aa, Homo Sapiens
RFMPIPMYG

SEQ ID NO: 479631 - protein, 9 aa, Homo Sapiens
AASPAQASP

SEQ ID NO: 479632 - protein, 9 aa, Homo Sapiens
LLEKMMRKK

SEQ ID NO: 479633 - protein, 9 aa, Homo Sapiens
QIQQMTRHP

SEQ ID NO: 479634 - protein, 9 aa, Homo Sapiens
MCQRHVGTQ

SEQ ID NO: 479635 - protein, 9 aa, Homo Sapiens
LIEVQLQQN

SEQ ID NO: 479636 - protein, 9 aa, Homo Sapiens
TTSGGDEAW

SEQ ID NO: 479637 - protein, 9 aa, Homo Sapiens
ELLARLKKD

SEQ ID NO: 479638 - protein, 9 aa, Homo Sapiens
QVPPQSEAE

SEQ ID NO: 479639 - protein, 9 aa, Homo Sapiens
ASAGPRGVR

SEQ ID NO: 479640 - protein, 9 aa, Homo Sapiens
IQGCPGLCK

SEQ ID NO: 479641 - protein, 9 aa, Homo Sapiens
DEIETFRLG

SEQ ID NO: 479642 - protein, 9 aa, Homo Sapiens
PSAAASPAQ

SEQ ID NO: 479643 - protein, 9 aa, Homo Sapiens
IRVERSQEM

SEQ ID NO: 479644 - protein, 9 aa, Homo Sapiens
WRSFFTCAS

SEQ ID NO: 479645 - protein, 9 aa, Homo Sapiens
PSTGGVMKP

SEQ ID NO: 479646 - protein, 9 aa, Homo Sapiens
SSDTILGIL

SEQ ID NO: 479647 - protein, 9 aa, Homo Sapiens
LPSEVLGCM

SEQ ID NO: 479648 - protein, 9 aa, Homo Sapiens
LDVHCSEEV

SEQ ID NO: 479649 - protein, 9 aa, Homo Sapiens
YYICILFSI

SEQ ID NO: 479650 - protein, 9 aa, Homo Sapiens
AYVKVSIQK

SEQ ID NO: 479651 - protein, 9 aa, Homo Sapiens
KMMRKKQAM

SEQ ID NO: 479652 - protein, 9 aa, Homo Sapiens
DIEGLTVQQ

SEQ ID NO: 479653 - protein, 9 aa, Homo Sapiens
FPDDMDLRV

SEQ ID NO: 479654 - protein, 9 aa, Homo Sapiens
CGMVVVPIV

SEQ ID NO: 479655 - protein, 9 aa, Homo Sapiens
AESNSLKRR

SEQ ID NO: 479656 - protein, 9 aa, Homo Sapiens
EVRFFNEES

SEQ ID NO: 479657 - protein, 9 aa, Homo Sapiens
SAFPCSSDG

SEQ ID NO: 479658 - protein, 9 aa, Homo Sapiens
RTSVLLEKM

SEQ ID NO: 479659 - protein, 9 aa, Homo Sapiens
AGSWHPSSS

SEQ ID NO: 479660 - protein, 9 aa, Homo Sapiens
SDTILGILP

SEQ ID NO: 479661 - protein, 9 aa, Homo Sapiens
THVFVHAGP

SEQ ID NO: 479662 - protein, 9 aa, Homo Sapiens
PMYGASQAL

SEQ ID NO: 479663 - protein, 9 aa, Homo Sapiens
DFQGPGTGV

SEQ ID NO: 479664 - protein, 9 aa, Homo Sapiens
AYCMSFKNL

SEQ ID NO: 479665 - protein, 9 aa, Homo Sapiens
PAMATVPTQ

SEQ ID NO: 479666 - protein, 9 aa, Homo Sapiens
SFHKEELQM

SEQ ID NO: 479667 - protein, 9 aa, Homo Sapiens
GQQISIILT

SEQ ID NO: 479668 - protein, 9 aa, Homo Sapiens
TEGLACQVC

SEQ ID NO: 479669 - protein, 9 aa, Homo Sapiens
AGYRKDLGP

SEQ ID NO: 479670 - protein, 9 aa, Homo Sapiens
GTHVFVHAG

SEQ ID NO: 479671 - protein, 9 aa, Homo Sapiens
HKKVPMLTW

SEQ ID NO: 479672 - protein, 9 aa, Homo Sapiens
PTPAMATVP

SEQ ID NO: 479673 - protein, 9 aa, Homo Sapiens
LKKDGVNQK

SEQ ID NO: 479674 - protein, 9 aa, Homo Sapiens
INAFKIASA

SEQ ID NO: 479675 - protein, 9 aa, Homo Sapiens
SKYAGHKNQ

SEQ ID NO: 479676 - protein, 9 aa, Homo Sapiens
GTYGGWGAS

SEQ ID NO: 479677 - protein, 9 aa, Homo Sapiens
PRLVAAAPR

SEQ ID NO: 479678 - protein, 9 aa, Homo Sapiens
MGKTVVCFI

SEQ ID NO: 479679 - protein, 9 aa, Homo Sapiens
PTKGEKVML

SEQ ID NO: 479680 - protein, 9 aa, Homo Sapiens
GSLLTIFIY

SEQ ID NO: 479681 - protein, 9 aa, Homo Sapiens
ETFRLGVTY

SEQ ID NO: 479682 - protein, 9 aa, Homo Sapiens
YVKVSIQKQ

SEQ ID NO: 479683 - protein, 9 aa, Homo Sapiens
SAMHSPFTK

SEQ ID NO: 479684 - protein, 9 aa, Homo Sapiens
VPVSCDHPG

SEQ ID NO: 479685 - protein, 9 aa, Homo Sapiens
TEETEGLAC

SEQ ID NO: 479686 - protein, 9 aa, Homo Sapiens
IIRPTAVLL

SEQ ID NO: 479687 - protein, 9 aa, Homo Sapiens
KWIRVERSQ

SEQ ID NO: 479688 - protein, 9 aa, Homo Sapiens
ETISKYAGH

SEQ ID NO: 479689 - protein, 9 aa, Homo Sapiens
CMLSNTTTI

SEQ ID NO: 479690 - protein, 9 aa, Homo Sapiens
GDQHQLVRL

SEQ ID NO: 479691 - protein, 9 aa, Homo Sapiens
GSPGHAGAS

SEQ ID NO: 479692 - protein, 9 aa, Homo Sapiens
AGPRGVRPA

SEQ ID NO: 479693 - protein, 9 aa, Homo Sapiens
IVLKGKISS

SEQ ID NO: 479694 - protein, 9 aa, Homo Sapiens
LFGECENTK

SEQ ID NO: 479695 - protein, 9 aa, Homo Sapiens
FFLCMMGKT

SEQ ID NO: 479696 - protein, 9 aa, Homo Sapiens
FFNLSETTG

SEQ ID NO: 479697 - protein, 9 aa, Homo Sapiens
NTTTIAEAW

SEQ ID NO: 479698 - protein, 9 aa, Homo Sapiens
PLPGARLEG

SEQ ID NO: 479699 - protein, 9 aa, Homo Sapiens
HQLLLRNTK

SEQ ID NO: 479700 - protein, 9 aa, Homo Sapiens
TYGGWGASP

SEQ ID NO: 479701 - protein, 9 aa, Homo Sapiens
AFPCSSDGP

SEQ ID NO: 479702 - protein, 9 aa, Homo Sapiens
CEQSTRKEN

SEQ ID NO: 479703 - protein, 9 aa, Homo Sapiens
EECEQSTRK

SEQ ID NO: 479704 - protein, 9 aa, Homo Sapiens
SLLHLTLHK

SEQ ID NO: 479705 - protein, 9 aa, Homo Sapiens
NSCERTSFA

SEQ ID NO: 479706 - protein, 9 aa, Homo Sapiens
QAAIVLDNP

SEQ ID NO: 479707 - protein, 9 aa, Homo Sapiens
TLASPGNAL

SEQ ID NO: 479708 - protein, 9 aa, Homo Sapiens
TAVLLWTPL

SEQ ID NO: 479709 - protein, 9 aa, Homo Sapiens
YSSDTILGI

SEQ ID NO: 479710 - protein, 9 aa, Homo Sapiens
KGKISSDIK

SEQ ID NO: 479711 - protein, 9 aa, Homo Sapiens
SDLEGSAYV

SEQ ID NO: 479712 - protein, 9 aa, Homo Sapiens
MTVISTGVE

SEQ ID NO: 479713 - protein, 9 aa, Homo Sapiens
ELKCNLQTL

SEQ ID NO: 479714 - protein, 9 aa, Homo Sapiens
NMIIKDKYP

SEQ ID NO: 479715 - protein, 9 aa, Homo Sapiens
CAVNCLLYV

SEQ ID NO: 479716 - protein, 9 aa, Homo Sapiens
FNEESYSLL

SEQ ID NO: 479717 - protein, 9 aa, Homo Sapiens
ACMDGRCLH

SEQ ID NO: 479718 - protein, 9 aa, Homo Sapiens
GCMLAGLVP

SEQ ID NO: 479719 - protein, 9 aa, Homo Sapiens
GKTVVCFIV

SEQ ID NO: 479720 - protein, 9 aa, Homo Sapiens
GPPKGIGSG

SEQ ID NO: 479721 - protein, 9 aa, Homo Sapiens
LARLKKDGV

SEQ ID NO: 479722 - protein, 9 aa, Homo Sapiens
CLFGECENT

SEQ ID NO: 479723 - protein, 9 aa, Homo Sapiens
MDGRCLHMD

SEQ ID NO: 479724 - protein, 9 aa, Homo Sapiens
MATVPTQPQ

SEQ ID NO: 479725 - protein, 9 aa, Homo Sapiens
RFFNLSETT

SEQ ID NO: 479726 - protein, 9 aa, Homo Sapiens
AVLLWTPLL

SEQ ID NO: 479727 - protein, 9 aa, Homo Sapiens
RSLTRPSKS

SEQ ID NO: 479728 - protein, 9 aa, Homo Sapiens
LLAYCMSFK

SEQ ID NO: 479729 - protein, 9 aa, Homo Sapiens
LVPSPRLVA

SEQ ID NO: 479730 - protein, 9 aa, Homo Sapiens
SFFSELLDP

SEQ ID NO: 479731 - protein, 9 aa, Homo Sapiens
REGTQPSRT

SEQ ID NO: 479732 - protein, 9 aa, Homo Sapiens
GKISSDIKL

SEQ ID NO: 479733 - protein, 9 aa, Homo Sapiens
NICLFGECE

SEQ ID NO: 479734 - protein, 9 aa, Homo Sapiens
QKETFTTAE

SEQ ID NO: 479735 - protein, 9 aa, Homo Sapiens
EESENQRLG

SEQ ID NO: 479736 - protein, 9 aa, Homo Sapiens
KLTEKTVKA

SEQ ID NO: 479737 - protein, 9 aa, Homo Sapiens
LEGTHVFVH

SEQ ID NO: 479738 - protein, 9 aa, Homo Sapiens
SEVLGCMLA

SEQ ID NO: 479739 - protein, 9 aa, Homo Sapiens
VPSPRLVAA

SEQ ID NO: 479740 - protein, 9 aa, Homo Sapiens
FPDRSPELS

SEQ ID NO: 479741 - protein, 9 aa, Homo Sapiens
QQLEESENQ

SEQ ID NO: 479742 - protein, 9 aa, Homo Sapiens
LSIKPQRIE

SEQ ID NO: 479743 - protein, 9 aa, Homo Sapiens
YVCPVYKTR

SEQ ID NO: 479744 - protein, 9 aa, Homo Sapiens
SSTCGQHGA

SEQ ID NO: 479745 - protein, 9 aa, Homo Sapiens
LYSSDTILG

SEQ ID NO: 479746 - protein, 9 aa, Homo Sapiens
MDGLMLKPT

SEQ ID NO: 479747 - protein, 9 aa, Homo Sapiens
VLSVAGQQI

SEQ ID NO: 479748 - protein, 9 aa, Homo Sapiens
ARRSADFGA

SEQ ID NO: 479749 - protein, 9 aa, Homo Sapiens
GVCAVNCLL

SEQ ID NO: 479750 - protein, 9 aa, Homo Sapiens
LQFLLAYCM

SEQ ID NO: 479751 - protein, 9 aa, Homo Sapiens
ERSQEMQMI

SEQ ID NO: 479752 - protein, 9 aa, Homo Sapiens
TTTTAILAT

SEQ ID NO: 479753 - protein, 9 aa, Homo Sapiens
PPDRSLRPL

SEQ ID NO: 479754 - protein, 9 aa, Homo Sapiens
DGRCLHMDQ

SEQ ID NO: 479755 - protein, 9 aa, Homo Sapiens
LCMMGKTVV

SEQ ID NO: 479756 - protein, 9 aa, Homo Sapiens
PLSPLLFKI

SEQ ID NO: 479757 - protein, 9 aa, Homo Sapiens
PTAVLLWTP

SEQ ID NO: 479758 - protein, 9 aa, Homo Sapiens
VSSPGKEEC

SEQ ID NO: 479759 - protein, 9 aa, Homo Sapiens
CVPVSCDHP

SEQ ID NO: 479760 - protein, 9 aa, Homo Sapiens
RSLESQKCS

SEQ ID NO: 479761 - protein, 9 aa, Homo Sapiens
QLRAWSAWL

SEQ ID NO: 479762 - protein, 9 aa, Homo Sapiens
DLGPPKGIG

SEQ ID NO: 479763 - protein, 9 aa, Homo Sapiens
LLWTPLLFR

SEQ ID NO: 479764 - protein, 9 aa, Homo Sapiens
YRKDLGPPK

SEQ ID NO: 479765 - protein, 9 aa, Homo Sapiens
VGKLRCHPV

SEQ ID NO: 479766 - protein, 9 aa, Homo Sapiens
PLSELMTVI

SEQ ID NO: 479767 - protein, 9 aa, Homo Sapiens
KKLTEKTVK

SEQ ID NO: 479768 - protein, 9 aa, Homo Sapiens
CWRSFFTCA

SEQ ID NO: 479769 - protein, 9 aa, Homo Sapiens
ENQRLGGDV

SEQ ID NO: 479770 - protein, 9 aa, Homo Sapiens
DQDAHSLIG

SEQ ID NO: 479771 - protein, 9 aa, Homo Sapiens
YHRHYWGKK

SEQ ID NO: 479772 - protein, 9 aa, Homo Sapiens
DSQQKQLIE

SEQ ID NO: 479773 - protein, 9 aa, Homo Sapiens
GKLRCHPVA

SEQ ID NO: 479774 - protein, 9 aa, Homo Sapiens
ENQAQSAHT

SEQ ID NO: 479775 - protein, 9 aa, Homo Sapiens
IENGDPQRF

SEQ ID NO: 479776 - protein, 9 aa, Homo Sapiens
IFFLCMMGK

SEQ ID NO: 479777 - protein, 9 aa, Homo Sapiens
ILLVYSIPH

SEQ ID NO: 479778 - protein, 9 aa, Homo Sapiens
VYHEHADSR

SEQ ID NO: 479779 - protein, 9 aa, Homo Sapiens
MRNAFHENN

SEQ ID NO: 479780 - protein, 9 aa, Homo Sapiens
SQHISFMPT

SEQ ID NO: 479781 - protein, 9 aa, Homo Sapiens
YQISFKNNV

SEQ ID NO: 479782 - protein, 9 aa, Homo Sapiens
TDSRGHLLL

SEQ ID NO: 479783 - protein, 9 aa, Homo Sapiens
SGFIYEETR

SEQ ID NO: 479784 - protein, 9 aa, Homo Sapiens
QFCPSLAGF

SEQ ID NO: 479785 - protein, 9 aa, Homo Sapiens
RSDAYQDVS

SEQ ID NO: 479786 - protein, 9 aa, Homo Sapiens
NHFACTDSR

SEQ ID NO: 479787 - protein, 9 aa, Homo Sapiens
KVVVGALIK

SEQ ID NO: 479788 - protein, 9 aa, Homo Sapiens
PQSPFAHHV

SEQ ID NO: 479789 - protein, 9 aa, Homo Sapiens
HHVSNTRAW

SEQ ID NO: 479790 - protein, 9 aa, Homo Sapiens
LDRCGVFQA

SEQ ID NO: 479791 - protein, 9 aa, Homo Sapiens
YISYLNSVH

SEQ ID NO: 479792 - protein, 9 aa, Homo Sapiens
RMPSLTALR

SEQ ID NO: 479793 - protein, 9 aa, Homo Sapiens
TIHQQILET

SEQ ID NO: 479794 - protein, 9 aa, Homo Sapiens
GTILLVYSI

SEQ ID NO: 479795 - protein, 9 aa, Homo Sapiens
MAKGLNAKM

SEQ ID NO: 479796 - protein, 9 aa, Homo Sapiens
CGTILLVYS

SEQ ID NO: 479797 - protein, 9 aa, Homo Sapiens
INPYLVQSN

SEQ ID NO: 479798 - protein, 9 aa, Homo Sapiens
KKTAIASVS

SEQ ID NO: 479799 - protein, 9 aa, Homo Sapiens
SPLAEHRSD

SEQ ID NO: 479800 - protein, 9 aa, Homo Sapiens
PLPPPPTLP

SEQ ID NO: 479801 - protein, 9 aa, Homo Sapiens
SRGHLLLFG

SEQ ID NO: 479802 - protein, 9 aa, Homo Sapiens
YIMEALLGV

SEQ ID NO: 479803 - protein, 9 aa, Homo Sapiens
VGVEQAAQM

SEQ ID NO: 479804 - protein, 9 aa, Homo Sapiens
FERMKVVVG

SEQ ID NO: 479805 - protein, 9 aa, Homo Sapiens
SGIEQLGKN

SEQ ID NO: 479806 - protein, 9 aa, Homo Sapiens
SRMPSLTAL

SEQ ID NO: 479807 - protein, 9 aa, Homo Sapiens
KEALQPPGC

SEQ ID NO: 479808 - protein, 9 aa, Homo Sapiens
PKMSKPGSS

SEQ ID NO: 479809 - protein, 9 aa, Homo Sapiens
PPLPPPPTL

SEQ ID NO: 479810 - protein, 9 aa, Homo Sapiens
LAAVVGVEQ

SEQ ID NO: 479811 - protein, 9 aa, Homo Sapiens
LLRSRGIAS

SEQ ID NO: 479812 - protein, 9 aa, Homo Sapiens
GKNPSPRIV

SEQ ID NO: 479813 - protein, 9 aa, Homo Sapiens
SVLATVLLR

SEQ ID NO: 479814 - protein, 9 aa, Homo Sapiens
SYLNSVHFF

SEQ ID NO: 479815 - protein, 9 aa, Homo Sapiens
PYLVQSNKT

SEQ ID NO: 479816 - protein, 9 aa, Homo Sapiens
VEQAAQMLQ

SEQ ID NO: 479817 - protein, 9 aa, Homo Sapiens
AEAKAGDLE

SEQ ID NO: 479818 - protein, 9 aa, Homo Sapiens
LQGGNPHGW

SEQ ID NO: 479819 - protein, 9 aa, Homo Sapiens
NINPYLVQS

SEQ ID NO: 479820 - protein, 9 aa, Homo Sapiens
VYLFYNKVK

SEQ ID NO: 479821 - protein, 9 aa, Homo Sapiens
VVGALIKTT

SEQ ID NO: 479822 - protein, 9 aa, Homo Sapiens
VLATVLLRP

SEQ ID NO: 479823 - protein, 9 aa, Homo Sapiens
DVSAIEEAM

SEQ ID NO: 479824 - protein, 9 aa, Homo Sapiens
FAFSSVLAT

SEQ ID NO: 479825 - protein, 9 aa, Homo Sapiens
ISGFIYEET

SEQ ID NO: 479826 - protein, 9 aa, Homo Sapiens
RNAFHENNT

SEQ ID NO: 479827 - protein, 9 aa, Homo Sapiens
GSSGSVIPA

SEQ ID NO: 479828 - protein, 9 aa, Homo Sapiens
DPCHHGRCM

SEQ ID NO: 479829 - protein, 9 aa, Homo Sapiens
SQHPREVPF

SEQ ID NO: 479830 - protein, 9 aa, Homo Sapiens
ACTDSRGHL

SEQ ID NO: 479831 - protein, 9 aa, Homo Sapiens
TIGYIMEAL

SEQ ID NO: 479832 - protein, 9 aa, Homo Sapiens
VKMYQNSYT

SEQ ID NO: 479833 - protein, 9 aa, Homo Sapiens
DDGHQLQKA

SEQ ID NO: 479834 - protein, 9 aa, Homo Sapiens
FIKKCRLSS

SEQ ID NO: 479835 - protein, 9 aa, Homo Sapiens
IMEALLGVP

SEQ ID NO: 479836 - protein, 9 aa, Homo Sapiens
KAGDLEQLS

SEQ ID NO: 479837 - protein, 9 aa, Homo Sapiens
FPESLHVFA

SEQ ID NO: 479838 - protein, 9 aa, Homo Sapiens
IKRLKKNAS

SEQ ID NO: 479839 - protein, 9 aa, Homo Sapiens
FYNKVKKTA

SEQ ID NO: 479840 - protein, 9 aa, Homo Sapiens
RTGMDRGAG

SEQ ID NO: 479841 - protein, 9 aa, Homo Sapiens
TTTQVYHEH

SEQ ID NO: 479842 - protein, 9 aa, Homo Sapiens
VKTIHQQIL

SEQ ID NO: 479843 - protein, 9 aa, Homo Sapiens
PLAEHRSDA

SEQ ID NO: 479844 - protein, 9 aa, Homo Sapiens
KMMRGLSYS

SEQ ID NO: 479845 - protein, 9 aa, Homo Sapiens
LFYNKVKKT

SEQ ID NO: 479846 - protein, 9 aa, Homo Sapiens
QISFKNNVA

SEQ ID NO: 479847 - protein, 9 aa, Homo Sapiens
YNKVKKTAI

SEQ ID NO: 479848 - protein, 9 aa, Homo Sapiens
QAAQMLQSN

SEQ ID NO: 479849 - protein, 9 aa, Homo Sapiens
EEEPEPAGT

SEQ ID NO: 479850 - protein, 9 aa, Homo Sapiens
EHRSDAYQD

SEQ ID NO: 479851 - protein, 9 aa, Homo Sapiens
AVVGVEQAA

SEQ ID NO: 479852 - protein, 9 aa, Homo Sapiens
QVYHEHADS

SEQ ID NO: 479853 - protein, 9 aa, Homo Sapiens
NPYLVQSNK

SEQ ID NO: 479854 - protein, 9 aa, Homo Sapiens
GPQSPFAHH

SEQ ID NO: 479855 - protein, 9 aa, Homo Sapiens
EIKRLKKNA

SEQ ID NO: 479856 - protein, 9 aa, Homo Sapiens
IHQQILETR

SEQ ID NO: 479857 - protein, 9 aa, Homo Sapiens
IMFASIPNF

SEQ ID NO: 479858 - protein, 9 aa, Homo Sapiens
PPPLPPPPT

SEQ ID NO: 479859 - protein, 9 aa, Homo Sapiens
IEQLGKNPS

SEQ ID NO: 479860 - protein, 9 aa, Homo Sapiens
AFSSVLATV

SEQ ID NO: 479861 - protein, 9 aa, Homo Sapiens
HEHADSRTA

SEQ ID NO: 479862 - protein, 9 aa, Homo Sapiens
LVEYTMVKM

SEQ ID NO: 479863 - protein, 9 aa, Homo Sapiens
AKMMRGLSY

SEQ ID NO: 479864 - protein, 9 aa, Homo Sapiens
SLTALRAGS

SEQ ID NO: 479865 - protein, 9 aa, Homo Sapiens
QQCAEDRQF

SEQ ID NO: 479866 - protein, 9 aa, Homo Sapiens
NKVKKTAIA

SEQ ID NO: 479867 - protein, 9 aa, Homo Sapiens
MSKPGSSGS

SEQ ID NO: 479868 - protein, 9 aa, Homo Sapiens
ESLHVFAPR

SEQ ID NO: 479869 - protein, 9 aa, Homo Sapiens
KFIKKCRLS

SEQ ID NO: 479870 - protein, 9 aa, Homo Sapiens
CGPQSPFAH

SEQ ID NO: 479871 - protein, 9 aa, Homo Sapiens
GIMFASIPN

SEQ ID NO: 479872 - protein, 9 aa, Homo Sapiens
KPGSSGSVI

SEQ ID NO: 479873 - protein, 9 aa, Homo Sapiens
YHEHADSRT

SEQ ID NO: 479874 - protein, 9 aa, Homo Sapiens
EQAAQMLQS

SEQ ID NO: 479875 - protein, 9 aa, Homo Sapiens
NNTIYSLTS

SEQ ID NO: 479876 - protein, 9 aa, Homo Sapiens
KKCRLSSSR

SEQ ID NO: 479877 - protein, 9 aa, Homo Sapiens
KCRLSSSRR

SEQ ID NO: 479878 - protein, 9 aa, Homo Sapiens
TTQVYHEHA

SEQ ID NO: 479879 - protein, 9 aa, Homo Sapiens
QHPREVPFA

SEQ ID NO: 479880 - protein, 9 aa, Homo Sapiens
FQARLFRES

SEQ ID NO: 479881 - protein, 9 aa, Homo Sapiens
KRISGFIYE

SEQ ID NO: 479882 - protein, 9 aa, Homo Sapiens
TLPKTPRGG

SEQ ID NO: 479883 - protein, 9 aa, Homo Sapiens
GHQLQKAYA

SEQ ID NO: 479884 - protein, 9 aa, Homo Sapiens
FSSVLATVL

SEQ ID NO: 479885 - protein, 9 aa, Homo Sapiens
DDCTIGYIM

SEQ ID NO: 479886 - protein, 9 aa, Homo Sapiens
PLFPESLHV

SEQ ID NO: 479887 - protein, 9 aa, Homo Sapiens
LPPPPTLPK

SEQ ID NO: 479888 - protein, 9 aa, Homo Sapiens
AKFIKKCRL

SEQ ID NO: 479889 - protein, 9 aa, Homo Sapiens
KKYQISFKN

SEQ ID NO: 479890 - protein, 9 aa, Homo Sapiens
KKNASVNAR

SEQ ID NO: 479891 - protein, 9 aa, Homo Sapiens
IGYIMEALL

SEQ ID NO: 479892 - protein, 9 aa, Homo Sapiens
RISGFIYEE

SEQ ID NO: 479893 - protein, 9 aa, Homo Sapiens
NSVHFFRPK

SEQ ID NO: 479894 - protein, 9 aa, Homo Sapiens
EKLPLFPES

SEQ ID NO: 479895 - protein, 9 aa, Homo Sapiens
SQVGIMFAS

SEQ ID NO: 479896 - protein, 9 aa, Homo Sapiens
AGAAAGGEE

SEQ ID NO: 479897 - protein, 9 aa, Homo Sapiens
RQFCPSLAG

SEQ ID NO: 479898 - protein, 9 aa, Homo Sapiens
ASKKYQISF

SEQ ID NO: 479899 - protein, 9 aa, Homo Sapiens
SVNARICSD

SEQ ID NO: 479900 - protein, 9 aa, Homo Sapiens
GIASLYKGL

SEQ ID NO: 479901 - protein, 9 aa, Homo Sapiens
FAHHVSNTR

SEQ ID NO: 479902 - protein, 9 aa, Homo Sapiens
SRGIASLYK

SEQ ID NO: 479903 - protein, 9 aa, Homo Sapiens
AEDRQFCPS

SEQ ID NO: 479904 - protein, 9 aa, Homo Sapiens
FACTDSRGH

SEQ ID NO: 479905 - protein, 9 aa, Homo Sapiens
SPFAHHVSN

SEQ ID NO: 479906 - protein, 9 aa, Homo Sapiens
SDAYQDVSI

SEQ ID NO: 479907 - protein, 9 aa, Homo Sapiens
PFAHHVSNT

SEQ ID NO: 479908 - protein, 9 aa, Homo Sapiens
AGLTADQKL

SEQ ID NO: 479909 - protein, 9 aa, Homo Sapiens
QLQKAYAGD

SEQ ID NO: 479910 - protein, 9 aa, Homo Sapiens
KGLNAKMMR

SEQ ID NO: 479911 - protein, 9 aa, Homo Sapiens
YQSYSQVGI

SEQ ID NO: 479912 - protein, 9 aa, Homo Sapiens
LQPPGCPPQ

SEQ ID NO: 479913 - protein, 9 aa, Homo Sapiens
YAAKFIKKC

SEQ ID NO: 479914 - protein, 9 aa, Homo Sapiens
RLQGGNPHG

SEQ ID NO: 479915 - protein, 9 aa, Homo Sapiens
TGMDRGAGL

SEQ ID NO: 479916 - protein, 9 aa, Homo Sapiens
RVYISYLNS

SEQ ID NO: 479917 - protein, 9 aa, Homo Sapiens
QLGKNPSPR

SEQ ID NO: 479918 - protein, 9 aa, Homo Sapiens
MEALLGVPL

SEQ ID NO: 479919 - protein, 9 aa, Homo Sapiens
SSVLATVLL

SEQ ID NO: 479920 - protein, 9 aa, Homo Sapiens
GRCMDGIAS

SEQ ID NO: 479921 - protein, 9 aa, Homo Sapiens
PKSQHISFM

SEQ ID NO: 479922 - protein, 9 aa, Homo Sapiens
RGAGLTADQ

SEQ ID NO: 479923 - protein, 9 aa, Homo Sapiens
RELTPPASY

SEQ ID NO: 479924 - protein, 9 aa, Homo Sapiens
GFIYEETRG

SEQ ID NO: 479925 - protein, 9 aa, Homo Sapiens
PTLPKTPRG

SEQ ID NO: 479926 - protein, 9 aa, Homo Sapiens
GGEEEPEPA

SEQ ID NO: 479927 - protein, 9 aa, Homo Sapiens
EHADSRTAR

SEQ ID NO: 479928 - protein, 9 aa, Homo Sapiens
VKRISGFIY

SEQ ID NO: 479929 - protein, 9 aa, Homo Sapiens
LLVYSIPHG

SEQ ID NO: 479930 - protein, 9 aa, Homo Sapiens
HADSRTARG

SEQ ID NO: 479931 - protein, 9 aa, Homo Sapiens
QYNINPYLV

SEQ ID NO: 479932 - protein, 9 aa, Homo Sapiens
EVGRGAEAK

SEQ ID NO: 479933 - protein, 9 aa, Homo Sapiens
PESLHVFAP

SEQ ID NO: 479934 - protein, 9 aa, Homo Sapiens
ASLYKGLGA

SEQ ID NO: 479935 - protein, 9 aa, Homo Sapiens
SRTGMDRGA

SEQ ID NO: 479936 - protein, 9 aa, Homo Sapiens
QARLFRESC

SEQ ID NO: 479937 - protein, 9 aa, Homo Sapiens
QGGNPHGWR

SEQ ID NO: 479938 - protein, 9 aa, Homo Sapiens
DGHQLQKAY

SEQ ID NO: 479939 - protein, 9 aa, Homo Sapiens
TDGDRLRLQ

SEQ ID NO: 479940 - protein, 9 aa, Homo Sapiens
KRLKKNASV

SEQ ID NO: 479941 - protein, 9 aa, Homo Sapiens
PCHHGRCMD

SEQ ID NO: 479942 - protein, 9 aa, Homo Sapiens
GAAAGGEEE

SEQ ID NO: 479943 - protein, 9 aa, Homo Sapiens
GMDRGAGLT

SEQ ID NO: 479944 - protein, 9 aa, Homo Sapiens
AFHENNTIY

SEQ ID NO: 479945 - protein, 9 aa, Homo Sapiens
VSAIEEAMS

SEQ ID NO: 479946 - protein, 9 aa, Homo Sapiens
FCPSLAGFQ

SEQ ID NO: 479947 - protein, 9 aa, Homo Sapiens
AAVVGVEQA

SEQ ID NO: 479948 - protein, 9 aa, Homo Sapiens
ISYLNSVHF

SEQ ID NO: 479949 - protein, 9 aa, Homo Sapiens
KVKKTAIAS

SEQ ID NO: 479950 - protein, 9 aa, Homo Sapiens
LNSPKSQHI

SEQ ID NO: 479951 - protein, 9 aa, Homo Sapiens
VQDDGHQLQ

SEQ ID NO: 479952 - protein, 9 aa, Homo Sapiens
PPPTLPKTP

SEQ ID NO: 479953 - protein, 9 aa, Homo Sapiens
EALQPPGCP

SEQ ID NO: 479954 - protein, 9 aa, Homo Sapiens
YVKTIHQQI

SEQ ID NO: 479955 - protein, 9 aa, Homo Sapiens
GAEAKAGDL

SEQ ID NO: 479956 - protein, 9 aa, Homo Sapiens
DRCGVFQAR

SEQ ID NO: 479957 - protein, 9 aa, Homo Sapiens
ASVNARICS

SEQ ID NO: 479958 - protein, 9 aa, Homo Sapiens
DRGAGLTAD

SEQ ID NO: 479959 - protein, 9 aa, Homo Sapiens
HQLQKAYAG

SEQ ID NO: 479960 - protein, 9 aa, Homo Sapiens
DCTIGYIME

SEQ ID NO: 479961 - protein, 9 aa, Homo Sapiens
AKGLNAKMM

SEQ ID NO: 479962 - protein, 9 aa, Homo Sapiens
TSGIEQLGK

SEQ ID NO: 479963 - protein, 9 aa, Homo Sapiens
AHHVSNTRA

SEQ ID NO: 479964 - protein, 9 aa, Homo Sapiens
ILRELTPPA

SEQ ID NO: 479965 - protein, 9 aa, Homo Sapiens
VKLNKDVSA

SEQ ID NO: 479966 - protein, 9 aa, Homo Sapiens
TILLVYSIP

SEQ ID NO: 479967 - protein, 9 aa, Homo Sapiens
HEDCGTILL

SEQ ID NO: 479968 - protein, 9 aa, Homo Sapiens
VVGVEQAAQ

SEQ ID NO: 479969 - protein, 9 aa, Homo Sapiens
RRVYISYLN

SEQ ID NO: 479970 - protein, 9 aa, Homo Sapiens
RGAEAKAGD

SEQ ID NO: 479971 - protein, 9 aa, Homo Sapiens
MDRGAGLTA

SEQ ID NO: 479972 - protein, 9 aa, Homo Sapiens
CMDGIASFS

SEQ ID NO: 479973 - protein, 9 aa, Homo Sapiens
SLYKGLGAT

SEQ ID NO: 479974 - protein, 9 aa, Homo Sapiens
NSPKSQHIS

SEQ ID NO: 479975 - protein, 9 aa, Homo Sapiens
QSYSQVGIM

SEQ ID NO: 479976 - protein, 9 aa, Homo Sapiens
DSRGHLLLF

SEQ ID NO: 479977 - protein, 9 aa, Homo Sapiens
YLFYNKVKK

SEQ ID NO: 479978 - protein, 9 aa, Homo Sapiens
GGVKRISGF

SEQ ID NO: 479979 - protein, 9 aa, Homo Sapiens
HFACTDSRG

SEQ ID NO: 479980 - protein, 9 aa, Homo Sapiens
RCGVFQARL

SEQ ID NO: 479981 - protein, 9 aa, Homo Sapiens
DGDRLRLQG

SEQ ID NO: 479982 - protein, 9 aa, Homo Sapiens
HQQILETRV

SEQ ID NO: 479983 - protein, 9 aa, Homo Sapiens
GVKRISGFI

SEQ ID NO: 479984 - protein, 9 aa, Homo Sapiens
LFPESLHVF

SEQ ID NO: 479985 - protein, 9 aa, Homo Sapiens
EYVKTIHQQ

SEQ ID NO: 479986 - protein, 9 aa, Homo Sapiens
SSGSVIPAQ

SEQ ID NO: 479987 - protein, 9 aa, Homo Sapiens
NKDVSAIEE

SEQ ID NO: 479988 - protein, 9 aa, Homo Sapiens
GLNAKMMRG

SEQ ID NO: 479989 - protein, 9 aa, Homo Sapiens
EDCGTILLV

SEQ ID NO: 479990 - protein, 9 aa, Homo Sapiens
GRGAEAKAG

SEQ ID NO: 479991 - protein, 9 aa, Homo Sapiens
CTDSRGHLL

SEQ ID NO: 479992 - protein, 9 aa, Homo Sapiens
IKKCRLSSS

SEQ ID NO: 479993 - protein, 9 aa, Homo Sapiens
QPPGCPPQP

SEQ ID NO: 479994 - protein, 9 aa, Homo Sapiens
RSPLAEHRS

SEQ ID NO: 479995 - protein, 9 aa, Homo Sapiens
LFAFSSVLA

SEQ ID NO: 479996 - protein, 9 aa, Homo Sapiens
YLVQSNKTK

SEQ ID NO: 479997 - protein, 9 aa, Homo Sapiens
SPKSQHISF

SEQ ID NO: 479998 - protein, 9 aa, Homo Sapiens
GVFQARLFR

SEQ ID NO: 479999 - protein, 9 aa, Homo Sapiens
VYISYLNSV

SEQ ID NO: 480000 - protein, 9 aa, Homo Sapiens
YSQVGIMFA

SEQ ID NO: 480001 - protein, 9 aa, Homo Sapiens
DPLNSPKSQ

SEQ ID NO: 480002 - protein, 9 aa, Homo Sapiens
QDDGHQLQK

SEQ ID NO: 480003 - protein, 9 aa, Homo Sapiens
AGGEEEPEP

SEQ ID NO: 480004 - protein, 9 aa, Homo Sapiens
RMKVVVGAL

SEQ ID NO: 480005 - protein, 9 aa, Homo Sapiens
CAEDRQFCP

SEQ ID NO: 480006 - protein, 9 aa, Homo Sapiens
LTALRAGSR

SEQ ID NO: 480007 - protein, 9 aa, Homo Sapiens
RTSGIEQLG

SEQ ID NO: 480008 - protein, 9 aa, Homo Sapiens
QVGIMFASI

SEQ ID NO: 480009 - protein, 9 aa, Homo Sapiens
GALIKTTLP

SEQ ID NO: 480010 - protein, 9 aa, Homo Sapiens
VKKTAIASV

SEQ ID NO: 480011 - protein, 9 aa, Homo Sapiens
LPLFPESLH

SEQ ID NO: 480012 - protein, 9 aa, Homo Sapiens
HRSDAYQDV

SEQ ID NO: 480013 - protein, 9 aa, Homo Sapiens
RLKKNASVN

SEQ ID NO: 480014 - protein, 9 aa, Homo Sapiens
LATVLLRPK

SEQ ID NO: 480015 - protein, 9 aa, Homo Sapiens
AEHRSDAYQ

SEQ ID NO: 480016 - protein, 9 aa, Homo Sapiens
LRLQGGNPH

SEQ ID NO: 480017 - protein, 9 aa, Homo Sapiens
PPPPTLPKT

SEQ ID NO: 480018 - protein, 9 aa, Homo Sapiens
TALRAGSRA

SEQ ID NO: 480019 - protein, 9 aa, Homo Sapiens
ENNTIYSLT

SEQ ID NO: 480020 - protein, 9 aa, Homo Sapiens
DRDPLILRE

SEQ ID NO: 480021 - protein, 9 aa, Homo Sapiens
LRELTPPAS

SEQ ID NO: 480022 - protein, 9 aa, Homo Sapiens
KSQHISFMP

SEQ ID NO: 480023 - protein, 9 aa, Homo Sapiens
VVKLNKDVS

SEQ ID NO: 480024 - protein, 9 aa, Homo Sapiens
TMVKMYQNS

SEQ ID NO: 480025 - protein, 9 aa, Homo Sapiens
AAAGGEEEP

SEQ ID NO: 480026 - protein, 9 aa, Homo Sapiens
CRLSSSRRG

SEQ ID NO: 480027 - protein, 9 aa, Homo Sapiens
MPSLTALRA

SEQ ID NO: 480028 - protein, 9 aa, Homo Sapiens
DCGTILLVY

SEQ ID NO: 480029 - protein, 9 aa, Homo Sapiens
EEPEPAGTR

SEQ ID NO: 480030 - protein, 9 aa, Homo Sapiens
VASKKYQIS

SEQ ID NO: 480031 - protein, 9 aa, Homo Sapiens
LNAKMMRGL

SEQ ID NO: 480032 - protein, 9 aa, Homo Sapiens
CGVFQARLF

SEQ ID NO: 480033 - protein, 9 aa, Homo Sapiens
CHHGRCMDG

SEQ ID NO: 480034 - protein, 9 aa, Homo Sapiens
GYIMEALLG

SEQ ID NO: 480035 - protein, 9 aa, Homo Sapiens
SKKYQISFK

SEQ ID NO: 480036 - protein, 9 aa, Homo Sapiens
VGALIKTTL

SEQ ID NO: 480037 - protein, 9 aa, Homo Sapiens
GAGLTADQK

SEQ ID NO: 480038 - protein, 9 aa, Homo Sapiens
TQVYHEHAD

SEQ ID NO: 480039 - protein, 9 aa, Homo Sapiens
LLDRCGVFQ

SEQ ID NO: 480040 - protein, 9 aa, Homo Sapiens
DPLILRELT

SEQ ID NO: 480041 - protein, 9 aa, Homo Sapiens
NAFHENNTI

SEQ ID NO: 480042 - protein, 9 aa, Homo Sapiens
RGHLLLFGF

SEQ ID NO: 480043 - protein, 9 aa, Homo Sapiens
KTIHQQILE

SEQ ID NO: 480044 - protein, 9 aa, Homo Sapiens
LVVKLNKDV

SEQ ID NO: 480045 - protein, 9 aa, Homo Sapiens
VQSNKTKGD

SEQ ID NO: 480046 - protein, 9 aa, Homo Sapiens
KMYQNSYTW

SEQ ID NO: 480047 - protein, 9 aa, Homo Sapiens
KMSKPGSSG

SEQ ID NO: 480048 - protein, 9 aa, Homo Sapiens
GIEQLGKNP

SEQ ID NO: 480049 - protein, 9 aa, Homo Sapiens
LGKNPSPRI

SEQ ID NO: 480050 - protein, 9 aa, Homo Sapiens
AKAGDLEQL

SEQ ID NO: 480051 - protein, 9 aa, Homo Sapiens
YNINPYLVQ

SEQ ID NO: 480052 - protein, 9 aa, Homo Sapiens
LVASKKYQI

SEQ ID NO: 480053 - protein, 9 aa, Homo Sapiens
MKVVVGALI

SEQ ID NO: 480054 - protein, 9 aa, Homo Sapiens
LNKDVSAIE

SEQ ID NO: 480055 - protein, 9 aa, Homo Sapiens
RGIASLYKG

SEQ ID NO: 480056 - protein, 9 aa, Homo Sapiens
LRAGSRALS

SEQ ID NO: 480057 - protein, 9 aa, Homo Sapiens
KYQISFKNN

SEQ ID NO: 480058 - protein, 9 aa, Homo Sapiens
VEYTMVKMY

SEQ ID NO: 480059 - protein, 9 aa, Homo Sapiens
LVQSNKTKG

SEQ ID NO: 480060 - protein, 9 aa, Homo Sapiens
DRLRLQGGN

SEQ ID NO: 480061 - protein, 9 aa, Homo Sapiens
QVQDDGHQL

SEQ ID NO: 480062 - protein, 9 aa, Homo Sapiens
HHGRCMDGI

SEQ ID NO: 480063 - protein, 9 aa, Homo Sapiens
KEIKRLKKN

SEQ ID NO: 480064 - protein, 9 aa, Homo Sapiens
RSRGIASLY

SEQ ID NO: 480065 - protein, 9 aa, Homo Sapiens
EAKAGDLEQ

SEQ ID NO: 480066 - protein, 9 aa, Homo Sapiens
ALQPPGCPP

SEQ ID NO: 480067 - protein, 9 aa, Homo Sapiens
PPTLPKTPR

SEQ ID NO: 480068 - protein, 9 aa, Homo Sapiens
AAKFIKKCR

SEQ ID NO: 480069 - protein, 9 aa, Homo Sapiens
AAGGEEEPE

SEQ ID NO: 480070 - protein, 9 aa, Homo Sapiens
MYQNSYTWE

SEQ ID NO: 480071 - protein, 9 aa, Homo Sapiens
GDRLRLQGG

SEQ ID NO: 480072 - protein, 9 aa, Homo Sapiens
MVKMYQNSY

SEQ ID NO: 480073 - protein, 9 aa, Homo Sapiens
YLNSVHFFR

SEQ ID NO: 480074 - protein, 9 aa, Homo Sapiens
ERMKVVVGA

SEQ ID NO: 480075 - protein, 9 aa, Homo Sapiens
LVYSIPHGI

SEQ ID NO: 480076 - protein, 9 aa, Homo Sapiens
LAEHRSDAY

SEQ ID NO: 480077 - protein, 9 aa, Homo Sapiens
KLPLFPESL

SEQ ID NO: 480078 - protein, 9 aa, Homo Sapiens
QCAEDRQFC

SEQ ID NO: 480079 - protein, 9 aa, Homo Sapiens
HGRCMDGIA

SEQ ID NO: 480080 - protein, 9 aa, Homo Sapiens
GEEEPEPAG

SEQ ID NO: 480081 - protein, 9 aa, Homo Sapiens
PLNSPKSQH

SEQ ID NO: 480082 - protein, 9 aa, Homo Sapiens
RLRLQGGNP

SEQ ID NO: 480083 - protein, 9 aa, Homo Sapiens
VGRGAEAKA

SEQ ID NO: 480084 - protein, 9 aa, Homo Sapiens
ELTPPASYN

SEQ ID NO: 480085 - protein, 9 aa, Homo Sapiens
SMAKGLNAK

SEQ ID NO: 480086 - protein, 9 aa, Homo Sapiens
SKPGSSGSV

SEQ ID NO: 480087 - protein, 9 aa, Homo Sapiens
FEYVKTIHQ

SEQ ID NO: 480088 - protein, 9 aa, Homo Sapiens
RDPLILREL

SEQ ID NO: 480089 - protein, 9 aa, Homo Sapiens
SGSVIPAQA

SEQ ID NO: 480090 - protein, 9 aa, Homo Sapiens
KLNKDVSAI

SEQ ID NO: 480091 - protein, 9 aa, Homo Sapiens
CTIGYIMEA

SEQ ID NO: 480092 - protein, 9 aa, Homo Sapiens
QSPFAHHVS

SEQ ID NO: 480093 - protein, 9 aa, Homo Sapiens
FHENNTIYS

SEQ ID NO: 480094 - protein, 9 aa, Homo Sapiens
RCMDGIASF

SEQ ID NO: 480095 - protein, 9 aa, Homo Sapiens
EDPLNSPKS

SEQ ID NO: 480096 - protein, 9 aa, Homo Sapiens
NTIYSLTSA

SEQ ID NO: 480097 - protein, 9 aa, Homo Sapiens
ATVLLRPKE

SEQ ID NO: 480098 - protein, 9 aa, Homo Sapiens
HENNTIYSL

SEQ ID NO: 480099 - protein, 9 aa, Homo Sapiens
EQLGKNPSP

SEQ ID NO: 480100 - protein, 9 aa, Homo Sapiens
MDGIASFSC

SEQ ID NO: 480101 - protein, 9 aa, Homo Sapiens
PLILRELTP

SEQ ID NO: 480102 - protein, 9 aa, Homo Sapiens
EYTMVKMYQ

SEQ ID NO: 480103 - protein, 9 aa, Homo Sapiens
KNASVNARI

SEQ ID NO: 480104 - protein, 9 aa, Homo Sapiens
VVVGALIKT

SEQ ID NO: 480105 - protein, 9 aa, Homo Sapiens
LKKNASVNA

SEQ ID NO: 480106 - protein, 9 aa, Homo Sapiens
GVEQAAQML

SEQ ID NO: 480107 - protein, 9 aa, Homo Sapiens
QQVQDDGHQ

SEQ ID NO: 480108 - protein, 9 aa, Homo Sapiens
IASLYKGLG

SEQ ID NO: 480109 - protein, 9 aa, Homo Sapiens
SLHVFAPRA

SEQ ID NO: 480110 - protein, 9 aa, Homo Sapiens
PLVASKKYQ

SEQ ID NO: 480111 - protein, 9 aa, Homo Sapiens
PSLTALRAG

SEQ ID NO: 480112 - protein, 9 aa, Homo Sapiens
VGIMFASIP

SEQ ID NO: 480113 - protein, 9 aa, Homo Sapiens
KDVSAIEEA

SEQ ID NO: 480114 - protein, 9 aa, Homo Sapiens
FIYEETRGV

SEQ ID NO: 480115 - protein, 9 aa, Homo Sapiens
DRQFCPSLA

SEQ ID NO: 480116 - protein, 9 aa, Homo Sapiens
SFEYVKTIH

SEQ ID NO: 480117 - protein, 9 aa, Homo Sapiens
EDRQFCPSL

SEQ ID NO: 480118 - protein, 9 aa, Homo Sapiens
HPREVPFAL

SEQ ID NO: 480119 - protein, 9 aa, Homo Sapiens
PGSSGSVIP

SEQ ID NO: 480120 - protein, 9 aa, Homo Sapiens
LILRELTPP

SEQ ID NO: 480121 - protein, 9 aa, Homo Sapiens
NASVNARIC

SEQ ID NO: 480122 - protein, 9 aa, Homo Sapiens
VFQARLFRE

SEQ ID NO: 480123 - protein, 9 aa, Homo Sapiens
LNSVHFFRP

SEQ ID NO: 480124 - protein, 9 aa, Homo Sapiens
ALRAGSRAL

SEQ ID NO: 480125 - protein, 9 aa, Homo Sapiens
LRSRGIASL

SEQ ID NO: 480126 - protein, 9 aa, Homo Sapiens
YTMVKMYQN

SEQ ID NO: 480127 - protein, 9 aa, Homo Sapiens
SYSQVGIMF

SEQ ID NO: 480128 - protein, 9 aa, Homo Sapiens
NAKMMRGLS

SEQ ID NO: 480129 - protein, 9 aa, Homo Sapiens
LDPKTDPMR

SEQ ID NO: 480130 - protein, 9 aa, Homo Sapiens
PHMLQEGHS

SEQ ID NO: 480131 - protein, 9 aa, Homo Sapiens
RHSAAQEGQ

SEQ ID NO: 480132 - protein, 9 aa, Homo Sapiens
TGCPRPCAD

SEQ ID NO: 480133 - protein, 9 aa, Homo Sapiens
WDRNEKIFR

SEQ ID NO: 480134 - protein, 9 aa, Homo Sapiens
SLGDVDIRT

SEQ ID NO: 480135 - protein, 9 aa, Homo Sapiens
HMSMHMGNE

SEQ ID NO: 480136 - protein, 9 aa, Homo Sapiens
KGRPWIWNI

SEQ ID NO: 480137 - protein, 9 aa, Homo Sapiens
SKLMRHMKT

SEQ ID NO: 480138 - protein, 9 aa, Homo Sapiens
GLDEDTEDR

SEQ ID NO: 480139 - protein, 9 aa, Homo Sapiens
NCFPEEKCF

SEQ ID NO: 480140 - protein, 9 aa, Homo Sapiens
ALTTRLYLR

SEQ ID NO: 480141 - protein, 9 aa, Homo Sapiens
FILVRKAYM

SEQ ID NO: 480142 - protein, 9 aa, Homo Sapiens
PPRVAPQAI

SEQ ID NO: 480143 - protein, 9 aa, Homo Sapiens
GIGGILERS

SEQ ID NO: 480144 - protein, 9 aa, Homo Sapiens
VKETWKMLS

SEQ ID NO: 480145 - protein, 9 aa, Homo Sapiens
HEHSMQFAE

SEQ ID NO: 480146 - protein, 9 aa, Homo Sapiens
GFLHETILD

SEQ ID NO: 480147 - protein, 9 aa, Homo Sapiens
KQAPALCSV

SEQ ID NO: 480148 - protein, 9 aa, Homo Sapiens
CSLGAAATG

SEQ ID NO: 480149 - protein, 9 aa, Homo Sapiens
AYMADIPGH

SEQ ID NO: 480150 - protein, 9 aa, Homo Sapiens
ASGDCQDVI

SEQ ID NO: 480151 - protein, 9 aa, Homo Sapiens
KTFQMYRMW

SEQ ID NO: 480152 - protein, 9 aa, Homo Sapiens
KKDKSSIRE

SEQ ID NO: 480153 - protein, 9 aa, Homo Sapiens
QEEREQQLR

SEQ ID NO: 480154 - protein, 9 aa, Homo Sapiens
DPKTDPMRL

SEQ ID NO: 480155 - protein, 9 aa, Homo Sapiens
NGKEDSLNV

SEQ ID NO: 480156 - protein, 9 aa, Homo Sapiens
AASHGPGAF

SEQ ID NO: 480157 - protein, 9 aa, Homo Sapiens
YCNLTLCPV

SEQ ID NO: 480158 - protein, 9 aa, Homo Sapiens
KKRQVLKSL

SEQ ID NO: 480159 - protein, 9 aa, Homo Sapiens
ARMIHMSMH

SEQ ID NO: 480160 - protein, 9 aa, Homo Sapiens
WKGHEHSMQ

SEQ ID NO: 480161 - protein, 9 aa, Homo Sapiens
PFYSEHSKM

SEQ ID NO: 480162 - protein, 9 aa, Homo Sapiens
VYIATFAVS

SEQ ID NO: 480163 - protein, 9 aa, Homo Sapiens
CIQVIEINN

SEQ ID NO: 480164 - protein, 9 aa, Homo Sapiens
FQRQLTVLI

SEQ ID NO: 480165 - protein, 9 aa, Homo Sapiens
TSFLDVSTV

SEQ ID NO: 480166 - protein, 9 aa, Homo Sapiens
IIAHALTTR

SEQ ID NO: 480167 - protein, 9 aa, Homo Sapiens
LTVNLAASH

SEQ ID NO: 480168 - protein, 9 aa, Homo Sapiens
DGKANMVAQ

SEQ ID NO: 480169 - protein, 9 aa, Homo Sapiens
NCSLGAAAT

SEQ ID NO: 480170 - protein, 9 aa, Homo Sapiens
DIFEDNYSP

SEQ ID NO: 480171 - protein, 9 aa, Homo Sapiens
GDVDIRTMC

SEQ ID NO: 480172 - protein, 9 aa, Homo Sapiens
TCKNAGTCH

SEQ ID NO: 480173 - protein, 9 aa, Homo Sapiens
SGDTSSTGE

SEQ ID NO: 480174 - protein, 9 aa, Homo Sapiens
YCSPTGTGC

SEQ ID NO: 480175 - protein, 9 aa, Homo Sapiens
ETSFFSSST

SEQ ID NO: 480176 - protein, 9 aa, Homo Sapiens
EVVRHCPHH

SEQ ID NO: 480177 - protein, 9 aa, Homo Sapiens
YPGCGIAQF

SEQ ID NO: 480178 - protein, 9 aa, Homo Sapiens
RKEVKETWK

SEQ ID NO: 480179 - protein, 9 aa, Homo Sapiens
FEDNYSPIP

SEQ ID NO: 480180 - protein, 9 aa, Homo Sapiens
AFPPRVAPQ

SEQ ID NO: 480181 - protein, 9 aa, Homo Sapiens
HCPHHERCS

SEQ ID NO: 480182 - protein, 9 aa, Homo Sapiens
GTWKSATDT

SEQ ID NO: 480183 - protein, 9 aa, Homo Sapiens
TFWKRKSIA

SEQ ID NO: 480184 - protein, 9 aa, Homo Sapiens
GYATSLPVT

SEQ ID NO: 480185 - protein, 9 aa, Homo Sapiens
SIQDSLQSS

SEQ ID NO: 480186 - protein, 9 aa, Homo Sapiens
KTIHPEVSM

SEQ ID NO: 480187 - protein, 9 aa, Homo Sapiens
HYCSPTGTG

SEQ ID NO: 480188 - protein, 9 aa, Homo Sapiens
APLLHTRLS

SEQ ID NO: 480189 - protein, 9 aa, Homo Sapiens
TKYKIGGDI

SEQ ID NO: 480190 - protein, 9 aa, Homo Sapiens
DIETSFFSS

SEQ ID NO: 480191 - protein, 9 aa, Homo Sapiens
TRLSGDAAA

SEQ ID NO: 480192 - protein, 9 aa, Homo Sapiens
HMTEVVRHC

SEQ ID NO: 480193 - protein, 9 aa, Homo Sapiens
ETPPIRPPP

SEQ ID NO: 480194 - protein, 9 aa, Homo Sapiens
VTAALKSIT

SEQ ID NO: 480195 - protein, 9 aa, Homo Sapiens
EEDKVQRRA

SEQ ID NO: 480196 - protein, 9 aa, Homo Sapiens
ETKKPQVAS

SEQ ID NO: 480197 - protein, 9 aa, Homo Sapiens
VDIRTMCPL

SEQ ID NO: 480198 - protein, 9 aa, Homo Sapiens
VQGKLRKLR

SEQ ID NO: 480199 - protein, 9 aa, Homo Sapiens
SFLDVSTVY

SEQ ID NO: 480200 - protein, 9 aa, Homo Sapiens
CPFRCAHKD

SEQ ID NO: 480201 - protein, 9 aa, Homo Sapiens
TQQYFFDGD

SEQ ID NO: 480202 - protein, 9 aa, Homo Sapiens
TVTAALKSI

SEQ ID NO: 480203 - protein, 9 aa, Homo Sapiens
QSSKLMRHM

SEQ ID NO: 480204 - protein, 9 aa, Homo Sapiens
CWDRNEKIF

SEQ ID NO: 480205 - protein, 9 aa, Homo Sapiens
RTTNGKEDS

SEQ ID NO: 480206 - protein, 9 aa, Homo Sapiens
SPPPPPPPQ

SEQ ID NO: 480207 - protein, 9 aa, Homo Sapiens
YIATFAVSA

SEQ ID NO: 480208 - protein, 9 aa, Homo Sapiens
LDVSTVYGS

SEQ ID NO: 480209 - protein, 9 aa, Homo Sapiens
SSGISLQSK

SEQ ID NO: 480210 - protein, 9 aa, Homo Sapiens
DCGRALARR

SEQ ID NO: 480211 - protein, 9 aa, Homo Sapiens
LAGRQEASG

SEQ ID NO: 480212 - protein, 9 aa, Homo Sapiens
QQDDSDKYD

SEQ ID NO: 480213 - protein, 9 aa, Homo Sapiens
QPPHMLQEG

SEQ ID NO: 480214 - protein, 9 aa, Homo Sapiens
MWQSFQPVL

SEQ ID NO: 480215 - protein, 9 aa, Homo Sapiens
VQKRRGPNK

SEQ ID NO: 480216 - protein, 9 aa, Homo Sapiens
GATEVKGNF

SEQ ID NO: 480217 - protein, 9 aa, Homo Sapiens
LDIETSFFS

SEQ ID NO: 480218 - protein, 9 aa, Homo Sapiens
QNAPNPAGG

SEQ ID NO: 480219 - protein, 9 aa, Homo Sapiens
GLDIETSFF

SEQ ID NO: 480220 - protein, 9 aa, Homo Sapiens
DVSRKNSTV

SEQ ID NO: 480221 - protein, 9 aa, Homo Sapiens
KNADPCAVS

SEQ ID NO: 480222 - protein, 9 aa, Homo Sapiens
SLMKARWNH

SEQ ID NO: 480223 - protein, 9 aa, Homo Sapiens
RIFPPLEGP

SEQ ID NO: 480224 - protein, 9 aa, Homo Sapiens
KQQDDSDKY

SEQ ID NO: 480225 - protein, 9 aa, Homo Sapiens
ELYGSKGRP

SEQ ID NO: 480226 - protein, 9 aa, Homo Sapiens
ATFAVSAYS

SEQ ID NO: 480227 - protein, 9 aa, Homo Sapiens
NLSEGEGNG

SEQ ID NO: 480228 - protein, 9 aa, Homo Sapiens
AATGPPTRV

SEQ ID NO: 480229 - protein, 9 aa, Homo Sapiens
SGSSSSSGD

SEQ ID NO: 480230 - protein, 9 aa, Homo Sapiens
IQVIEINNW

SEQ ID NO: 480231 - protein, 9 aa, Homo Sapiens
TWKSATDTS

SEQ ID NO: 480232 - protein, 9 aa, Homo Sapiens
VITTKQAPA

SEQ ID NO: 480233 - protein, 9 aa, Homo Sapiens
AEKWLFDAS

SEQ ID NO: 480234 - protein, 9 aa, Homo Sapiens
GDCQDVISM

SEQ ID NO: 480235 - protein, 9 aa, Homo Sapiens
AQSSKLMRH

SEQ ID NO: 480236 - protein, 9 aa, Homo Sapiens
QFFLLPFCG

SEQ ID NO: 480237 - protein, 9 aa, Homo Sapiens
RQVLKSLCR

SEQ ID NO: 480238 - protein, 9 aa, Homo Sapiens
TKKPQVASW

SEQ ID NO: 480239 - protein, 9 aa, Homo Sapiens
MYRMWQSFQ

SEQ ID NO: 480240 - protein, 9 aa, Homo Sapiens
NSRFATPFY

SEQ ID NO: 480241 - protein, 9 aa, Homo Sapiens
TVVQLPTSN

SEQ ID NO: 480242 - protein, 9 aa, Homo Sapiens
ITTTVITTK

SEQ ID NO: 480243 - protein, 9 aa, Homo Sapiens
SGDAAASSS

SEQ ID NO: 480244 - protein, 9 aa, Homo Sapiens
AKKPNPGLK

SEQ ID NO: 480245 - protein, 9 aa, Homo Sapiens
TGYATSLPV

SEQ ID NO: 480246 - protein, 9 aa, Homo Sapiens
TAEGTRYTD

SEQ ID NO: 480247 - protein, 9 aa, Homo Sapiens
WIAFKYPGI

SEQ ID NO: 480248 - protein, 9 aa, Homo Sapiens
SSASTGYAT

SEQ ID NO: 480249 - protein, 9 aa, Homo Sapiens
LKKQLKTVV

SEQ ID NO: 480250 - protein, 9 aa, Homo Sapiens
AHENKKISA

SEQ ID NO: 480251 - protein, 9 aa, Homo Sapiens
RFATPFYQH

SEQ ID NO: 480252 - protein, 9 aa, Homo Sapiens
PGIGGILER

SEQ ID NO: 480253 - protein, 9 aa, Homo Sapiens
EKWLFDASS

SEQ ID NO: 480254 - protein, 9 aa, Homo Sapiens
GKEDSLNVS

SEQ ID NO: 480255 - protein, 9 aa, Homo Sapiens
QVIEINNWR

SEQ ID NO: 480256 - protein, 9 aa, Homo Sapiens
DIWPKQGKK

SEQ ID NO: 480257 - protein, 9 aa, Homo Sapiens
FLLPFCGFL

SEQ ID NO: 480258 - protein, 9 aa, Homo Sapiens
DPVNIFWVQ

SEQ ID NO: 480259 - protein, 9 aa, Homo Sapiens
LKSLCREEA

SEQ ID NO: 480260 - protein, 9 aa, Homo Sapiens
VKGNFTLFL

SEQ ID NO: 480261 - protein, 9 aa, Homo Sapiens
HLRDAGEFT

SEQ ID NO: 480262 - protein, 9 aa, Homo Sapiens
LDSWIAFKY

SEQ ID NO: 480263 - protein, 9 aa, Homo Sapiens
VSRKNSTVD

SEQ ID NO: 480264 - protein, 9 aa, Homo Sapiens
LRDAGEFTC

SEQ ID NO: 480265 - protein, 9 aa, Homo Sapiens
CAQSSKLMR

SEQ ID NO: 480266 - protein, 9 aa, Homo Sapiens
RQLTVLIGY

SEQ ID NO: 480267 - protein, 9 aa, Homo Sapiens
FLDVSTVYG

SEQ ID NO: 480268 - protein, 9 aa, Homo Sapiens
RAKKPNPGL

SEQ ID NO: 480269 - protein, 9 aa, Homo Sapiens
NAPNPAGGD

SEQ ID NO: 480270 - protein, 9 aa, Homo Sapiens
ELSRLQEET

SEQ ID NO: 480271 - protein, 9 aa, Homo Sapiens
RKAYMADIP

SEQ ID NO: 480272 - protein, 9 aa, Homo Sapiens
RMIHMSMHM

SEQ ID NO: 480273 - protein, 9 aa, Homo Sapiens
RKPMHTECG

SEQ ID NO: 480274 - protein, 9 aa, Homo Sapiens
TDVETKKPQ

SEQ ID NO: 480275 - protein, 9 aa, Homo Sapiens
MVYIATFAV

SEQ ID NO: 480276 - protein, 9 aa, Homo Sapiens
CNLTLCPVT

SEQ ID NO: 480277 - protein, 9 aa, Homo Sapiens
ASAFPPRVA

SEQ ID NO: 480278 - protein, 9 aa, Homo Sapiens
IGPCRGPDQ

SEQ ID NO: 480279 - protein, 9 aa, Homo Sapiens
EELSRLQEE

SEQ ID NO: 480280 - protein, 9 aa, Homo Sapiens
FPPLEGPPA

SEQ ID NO: 480281 - protein, 9 aa, Homo Sapiens
RQEASGDCQ

SEQ ID NO: 480282 - protein, 9 aa, Homo Sapiens
MNAFDKKDR

SEQ ID NO: 480283 - protein, 9 aa, Homo Sapiens
EGTRYTDPP

SEQ ID NO: 480284 - protein, 9 aa, Homo Sapiens
VRKAYMADI

SEQ ID NO: 480285 - protein, 9 aa, Homo Sapiens
MAAGSRKSL

SEQ ID NO: 480286 - protein, 9 aa, Homo Sapiens
VTKYKIGGD

SEQ ID NO: 480287 - protein, 9 aa, Homo Sapiens
LTVTAALKS

SEQ ID NO: 480288 - protein, 9 aa, Homo Sapiens
ENKKISAHI

SEQ ID NO: 480289 - protein, 9 aa, Homo Sapiens
YLAYVPRTL

SEQ ID NO: 480290 - protein, 9 aa, Homo Sapiens
GSNFCQLNN

SEQ ID NO: 480291 - protein, 9 aa, Homo Sapiens
YFAQDIWPK

SEQ ID NO: 480292 - protein, 9 aa, Homo Sapiens
LCPVTESSV

SEQ ID NO: 480293 - protein, 9 aa, Homo Sapiens
FCQLNNGGC

SEQ ID NO: 480294 - protein, 9 aa, Homo Sapiens
SANVIVIFV

SEQ ID NO: 480295 - protein, 9 aa, Homo Sapiens
GHHLGHRRA

SEQ ID NO: 480296 - protein, 9 aa, Homo Sapiens
ADTSANVIV

SEQ ID NO: 480297 - protein, 9 aa, Homo Sapiens
MTEVVRHCP

SEQ ID NO: 480298 - protein, 9 aa, Homo Sapiens
KQLKTVVQL

SEQ ID NO: 480299 - protein, 9 aa, Homo Sapiens
DEVIINLSE

SEQ ID NO: 480300 - protein, 9 aa, Homo Sapiens
ATEVKGNFT

SEQ ID NO: 480301 - protein, 9 aa, Homo Sapiens
KQKSIEIEL

SEQ ID NO: 480302 - protein, 9 aa, Homo Sapiens
TTTVITTKQ

SEQ ID NO: 480303 - protein, 9 aa, Homo Sapiens
ILSSNGISY

SEQ ID NO: 480304 - protein, 9 aa, Homo Sapiens
RRGPNKHYV

SEQ ID NO: 480305 - protein, 9 aa, Homo Sapiens
KELILSSNG

SEQ ID NO: 480306 - protein, 9 aa, Homo Sapiens
LDGKANMVA

SEQ ID NO: 480307 - protein, 9 aa, Homo Sapiens
SAITEIKLH

SEQ ID NO: 480308 - protein, 9 aa, Homo Sapiens
SIRKEVKET

SEQ ID NO: 480309 - protein, 9 aa, Homo Sapiens
DEEDKVQRR

SEQ ID NO: 480310 - protein, 9 aa, Homo Sapiens
KNFTGCIQV

SEQ ID NO: 480311 - protein, 9 aa, Homo Sapiens
TLSCWDRNE

SEQ ID NO: 480312 - protein, 9 aa, Homo Sapiens
VVRIFPPLE

SEQ ID NO: 480313 - protein, 9 aa, Homo Sapiens
CADTSANVI

SEQ ID NO: 480314 - protein, 9 aa, Homo Sapiens
LASLEARRF

SEQ ID NO: 480315 - protein, 9 aa, Homo Sapiens
QGSNFCQLN

SEQ ID NO: 480316 - protein, 9 aa, Homo Sapiens
IFPPLEGPP

SEQ ID NO: 480317 - protein, 9 aa, Homo Sapiens
VYSYFAQDI

SEQ ID NO: 480318 - protein, 9 aa, Homo Sapiens
SRHSAAQEG

SEQ ID NO: 480319 - protein, 9 aa, Homo Sapiens
DPCAVSYLL

SEQ ID NO: 480320 - protein, 9 aa, Homo Sapiens
AVGPPDPVN

SEQ ID NO: 480321 - protein, 9 aa, Homo Sapiens
IPEQQPPHM

SEQ ID NO: 480322 - protein, 9 aa, Homo Sapiens
SRFATPFYQ

SEQ ID NO: 480323 - protein, 9 aa, Homo Sapiens
DPMRLTQLY

SEQ ID NO: 480324 - protein, 9 aa, Homo Sapiens
GFRRQFQVL

SEQ ID NO: 480325 - protein, 9 aa, Homo Sapiens
THTGKKPYA

SEQ ID NO: 480326 - protein, 9 aa, Homo Sapiens
QLKTVVQLP

SEQ ID NO: 480327 - protein, 9 aa, Homo Sapiens
FQMYRMWQS

SEQ ID NO: 480328 - protein, 9 aa, Homo Sapiens
FRCAHKDNL

SEQ ID NO: 480329 - protein, 9 aa, Homo Sapiens
KDMQSIQDS

SEQ ID NO: 480330 - protein, 9 aa, Homo Sapiens
QDDSDKYDD

SEQ ID NO: 480331 - protein, 9 aa, Homo Sapiens
TFYTLSCWD

SEQ ID NO: 480332 - protein, 9 aa, Homo Sapiens
VKRSLAQTL

SEQ ID NO: 480333 - protein, 9 aa, Homo Sapiens
EEREQQLRR

SEQ ID NO: 480334 - protein, 9 aa, Homo Sapiens
AEGTRYTDP

SEQ ID NO: 480335 - protein, 9 aa, Homo Sapiens
DLDPKTDPM

SEQ ID NO: 480336 - protein, 9 aa, Homo Sapiens
FPPRVAPQA

SEQ ID NO: 480337 - protein, 9 aa, Homo Sapiens
PDPVNIFWV

SEQ ID NO: 480338 - protein, 9 aa, Homo Sapiens
VENRMKKDK

SEQ ID NO: 480339 - protein, 9 aa, Homo Sapiens
FLHETILDR

SEQ ID NO: 480340 - protein, 9 aa, Homo Sapiens
SSSGDTSST

SEQ ID NO: 480341 - protein, 9 aa, Homo Sapiens
GLTSFLDVS

SEQ ID NO: 480342 - protein, 9 aa, Homo Sapiens
PEERRNSIC

SEQ ID NO: 480343 - protein, 9 aa, Homo Sapiens
KGANMNAFD

SEQ ID NO: 480344 - protein, 9 aa, Homo Sapiens
EITKQEKDF

SEQ ID NO: 480345 - protein, 9 aa, Homo Sapiens
NFTGCIQVI

SEQ ID NO: 480346 - protein, 9 aa, Homo Sapiens
RDAGEFTCR

SEQ ID NO: 480347 - protein, 9 aa, Homo Sapiens
TLSSTFPSL

SEQ ID NO: 480348 - protein, 9 aa, Homo Sapiens
MRHMKTHGQ

SEQ ID NO: 480349 - protein, 9 aa, Homo Sapiens
GSFATLSST

SEQ ID NO: 480350 - protein, 9 aa, Homo Sapiens
KLMRHMKTH

SEQ ID NO: 480351 - protein, 9 aa, Homo Sapiens
LSSNGISYF

SEQ ID NO: 480352 - protein, 9 aa, Homo Sapiens
EVKGNFTLF

SEQ ID NO: 480353 - protein, 9 aa, Homo Sapiens
RLSGDAAAS

SEQ ID NO: 480354 - protein, 9 aa, Homo Sapiens
KQEKDFLWS

SEQ ID NO: 480355 - protein, 9 aa, Homo Sapiens
LLAKGANMN

SEQ ID NO: 480356 - protein, 9 aa, Homo Sapiens
IATFAVSAY

SEQ ID NO: 480357 - protein, 9 aa, Homo Sapiens
QQGSNFCQL

SEQ ID NO: 480358 - protein, 9 aa, Homo Sapiens
TRKPMHTEC

SEQ ID NO: 480359 - protein, 9 aa, Homo Sapiens
VGHHLGHRR

SEQ ID NO: 480360 - protein, 9 aa, Homo Sapiens
HENKKISAH

SEQ ID NO: 480361 - protein, 9 aa, Homo Sapiens
HALTTRLYL

SEQ ID NO: 480362 - protein, 9 aa, Homo Sapiens
ERMVYIATF

SEQ ID NO: 480363 - protein, 9 aa, Homo Sapiens
AKDEVIINL

SEQ ID NO: 480364 - protein, 9 aa, Homo Sapiens
QAVGPPDPV

SEQ ID NO: 480365 - protein, 9 aa, Homo Sapiens
YSLDSWIAF

SEQ ID NO: 480366 - protein, 9 aa, Homo Sapiens
RYTDPPAGK

SEQ ID NO: 480367 - protein, 9 aa, Homo Sapiens
SSSSGDTSS

SEQ ID NO: 480368 - protein, 9 aa, Homo Sapiens
VAISTDGDV

SEQ ID NO: 480369 - protein, 9 aa, Homo Sapiens
LTVLIGYDV

SEQ ID NO: 480370 - protein, 9 aa, Homo Sapiens
INSPDLLQA

SEQ ID NO: 480371 - protein, 9 aa, Homo Sapiens
KPVENRMKK

SEQ ID NO: 480372 - protein, 9 aa, Homo Sapiens
QQYFFDGDP

SEQ ID NO: 480373 - protein, 9 aa, Homo Sapiens
TKQAPALCS

SEQ ID NO: 480374 - protein, 9 aa, Homo Sapiens
IQNAPNPAG

SEQ ID NO: 480375 - protein, 9 aa, Homo Sapiens
LGDVDIRTM

SEQ ID NO: 480376 - protein, 9 aa, Homo Sapiens
AKKKAEKWL

SEQ ID NO: 480377 - protein, 9 aa, Homo Sapiens
TKQEKDFLW

SEQ ID NO: 480378 - protein, 9 aa, Homo Sapiens
KANSRFATP

SEQ ID NO: 480379 - protein, 9 aa, Homo Sapiens
VTQFFLLPF

SEQ ID NO: 480380 - protein, 9 aa, Homo Sapiens
WQSFQPVLN

SEQ ID NO: 480381 - protein, 9 aa, Homo Sapiens
PNPGLKKHQ

SEQ ID NO: 480382 - protein, 9 aa, Homo Sapiens
PQVLHSLMK

SEQ ID NO: 480383 - protein, 9 aa, Homo Sapiens
MLMRPPPKT

SEQ ID NO: 480384 - protein, 9 aa, Homo Sapiens
PYKSRSGHS

SEQ ID NO: 480385 - protein, 9 aa, Homo Sapiens
MHMGNEPPI

SEQ ID NO: 480386 - protein, 9 aa, Homo Sapiens
QTLVIIVSL

SEQ ID NO: 480387 - protein, 9 aa, Homo Sapiens
SSGDTSSTG

SEQ ID NO: 480388 - protein, 9 aa, Homo Sapiens
RLQEETAEL

SEQ ID NO: 480389 - protein, 9 aa, Homo Sapiens
AITEIKLHS

SEQ ID NO: 480390 - protein, 9 aa, Homo Sapiens
GSYYPGCGI

SEQ ID NO: 480391 - protein, 9 aa, Homo Sapiens
KIRDTGKKT

SEQ ID NO: 480392 - protein, 9 aa, Homo Sapiens
SAAQEGQDT

SEQ ID NO: 480393 - protein, 9 aa, Homo Sapiens
NVGHHLGHR

SEQ ID NO: 480394 - protein, 9 aa, Homo Sapiens
DPNPCLSTT

SEQ ID NO: 480395 - protein, 9 aa, Homo Sapiens
LGATEVKGN

SEQ ID NO: 480396 - protein, 9 aa, Homo Sapiens
GKPSNVGHH

SEQ ID NO: 480397 - protein, 9 aa, Homo Sapiens
RKNSTVDFS

SEQ ID NO: 480398 - protein, 9 aa, Homo Sapiens
AADNAPPEE

SEQ ID NO: 480399 - protein, 9 aa, Homo Sapiens
SSNGISYFL

SEQ ID NO: 480400 - protein, 9 aa, Homo Sapiens
PPDPVNIFW

SEQ ID NO: 480401 - protein, 9 aa, Homo Sapiens
IKTIHPEVS

SEQ ID NO: 480402 - protein, 9 aa, Homo Sapiens
AHKDNLKSH

SEQ ID NO: 480403 - protein, 9 aa, Homo Sapiens
AAQEGQDTI

SEQ ID NO: 480404 - protein, 9 aa, Homo Sapiens
PVENRMKKD

SEQ ID NO: 480405 - protein, 9 aa, Homo Sapiens
TCQAVGPPD

SEQ ID NO: 480406 - protein, 9 aa, Homo Sapiens
PGCGIAQFH

SEQ ID NO: 480407 - protein, 9 aa, Homo Sapiens
SCWDRNEKI

SEQ ID NO: 480408 - protein, 9 aa, Homo Sapiens
ASHGPGAFF

SEQ ID NO: 480409 - protein, 9 aa, Homo Sapiens
QGKLRKLRI

SEQ ID NO: 480410 - protein, 9 aa, Homo Sapiens
TEVVRHCPH

SEQ ID NO: 480411 - protein, 9 aa, Homo Sapiens
KKPNPGLKK

SEQ ID NO: 480412 - protein, 9 aa, Homo Sapiens
AGARLPYYL

SEQ ID NO: 480413 - protein, 9 aa, Homo Sapiens
GKYLDGKAN

SEQ ID NO: 480414 - protein, 9 aa, Homo Sapiens
RYRNWRLAS

SEQ ID NO: 480415 - protein, 9 aa, Homo Sapiens
KSIEIELLK

SEQ ID NO: 480416 - protein, 9 aa, Homo Sapiens
QKSIEIELL

SEQ ID NO: 480417 - protein, 9 aa, Homo Sapiens
ESIRKEVKE

SEQ ID NO: 480418 - protein, 9 aa, Homo Sapiens
NRMKKDKSS

SEQ ID NO: 480419 - protein, 9 aa, Homo Sapiens
LAQTLVIIV

SEQ ID NO: 480420 - protein, 9 aa, Homo Sapiens
KKPQVASWV

SEQ ID NO: 480421 - protein, 9 aa, Homo Sapiens
PTVAISTDG

SEQ ID NO: 480422 - protein, 9 aa, Homo Sapiens
YRNWRLASL

SEQ ID NO: 480423 - protein, 9 aa, Homo Sapiens
LSGDAAASS

SEQ ID NO: 480424 - protein, 9 aa, Homo Sapiens
SYFAQDIWP

SEQ ID NO: 480425 - protein, 9 aa, Homo Sapiens
FPEEKCFCE

SEQ ID NO: 480426 - protein, 9 aa, Homo Sapiens
GSSSSSGDT

SEQ ID NO: 480427 - protein, 9 aa, Homo Sapiens
IPEPVVRIF

SEQ ID NO: 480428 - protein, 9 aa, Homo Sapiens
TQFFLLPFC

SEQ ID NO: 480429 - protein, 9 aa, Homo Sapiens
QSFQPVLNP

SEQ ID NO: 480430 - protein, 9 aa, Homo Sapiens
HRYWSAWSP

SEQ ID NO: 480431 - protein, 9 aa, Homo Sapiens
SYYPGCGIA

SEQ ID NO: 480432 - protein, 9 aa, Homo Sapiens
PINSPDLLQ

SEQ ID NO: 480433 - protein, 9 aa, Homo Sapiens
WLFDASSFG

SEQ ID NO: 480434 - protein, 9 aa, Homo Sapiens
QAADNAPPE

SEQ ID NO: 480435 - protein, 9 aa, Homo Sapiens
KSRSGHSSV

SEQ ID NO: 480436 - protein, 9 aa, Homo Sapiens
CNCFPEEKC

SEQ ID NO: 480437 - protein, 9 aa, Homo Sapiens
GTGCPRPCA

SEQ ID NO: 480438 - protein, 9 aa, Homo Sapiens
LAASHGPGA

SEQ ID NO: 480439 - protein, 9 aa, Homo Sapiens
SWKKRQVLK

SEQ ID NO: 480440 - protein, 9 aa, Homo Sapiens
AGGDLQKAG

SEQ ID NO: 480441 - protein, 9 aa, Homo Sapiens
WVHLRDAGE

SEQ ID NO: 480442 - protein, 9 aa, Homo Sapiens
YSEHSKMLS

SEQ ID NO: 480443 - protein, 9 aa, Homo Sapiens
DMQSIQDSL

SEQ ID NO: 480444 - protein, 9 aa, Homo Sapiens
FQPVLNPCY

SEQ ID NO: 480445 - protein, 9 aa, Homo Sapiens
SKGRPWIWN

SEQ ID NO: 480446 - protein, 9 aa, Homo Sapiens
TRYTDPPAG

SEQ ID NO: 480447 - protein, 9 aa, Homo Sapiens
YTLSCWDRN

SEQ ID NO: 480448 - protein, 9 aa, Homo Sapiens
GPGIGGILE

SEQ ID NO: 480449 - protein, 9 aa, Homo Sapiens
TNGKEDSLN

SEQ ID NO: 480450 - protein, 9 aa, Homo Sapiens
RDKWVVQGK

SEQ ID NO: 480451 - protein, 9 aa, Homo Sapiens
ILVRKAYMA

SEQ ID NO: 480452 - protein, 9 aa, Homo Sapiens
FATPFYQHL

SEQ ID NO: 480453 - protein, 9 aa, Homo Sapiens
RDSSRHSAA

SEQ ID NO: 480454 - protein, 9 aa, Homo Sapiens
MISLGDVDI

SEQ ID NO: 480455 - protein, 9 aa, Homo Sapiens
KWVVQGKLR

SEQ ID NO: 480456 - protein, 9 aa, Homo Sapiens
VVQLPTSNM

SEQ ID NO: 480457 - protein, 9 aa, Homo Sapiens
AKPTVAIST

SEQ ID NO: 480458 - protein, 9 aa, Homo Sapiens
KRSLAQTLV

SEQ ID NO: 480459 - protein, 9 aa, Homo Sapiens
KEVKETWKM

SEQ ID NO: 480460 - protein, 9 aa, Homo Sapiens
VLDVQKRRG

SEQ ID NO: 480461 - protein, 9 aa, Homo Sapiens
ASAMPTAAG

SEQ ID NO: 480462 - protein, 9 aa, Homo Sapiens
GCQSSGISL

SEQ ID NO: 480463 - protein, 9 aa, Homo Sapiens
RMWQSFQPV

SEQ ID NO: 480464 - protein, 9 aa, Homo Sapiens
LSRLQEETA

SEQ ID NO: 480465 - protein, 9 aa, Homo Sapiens
STFPSLSAA

SEQ ID NO: 480466 - protein, 9 aa, Homo Sapiens
KRRGPNKHY

SEQ ID NO: 480467 - protein, 9 aa, Homo Sapiens
EMNNLHIAI

SEQ ID NO: 480468 - protein, 9 aa, Homo Sapiens
YVCKECRKA

SEQ ID NO: 480469 - protein, 9 aa, Homo Sapiens
KEDSLNVSR

SEQ ID NO: 480470 - protein, 9 aa, Homo Sapiens
LGAAATGPP

SEQ ID NO: 480471 - protein, 9 aa, Homo Sapiens
SNVGHHLGH

SEQ ID NO: 480472 - protein, 9 aa, Homo Sapiens
TILDRRAKL

SEQ ID NO: 480473 - protein, 9 aa, Homo Sapiens
LLLAKGANM

SEQ ID NO: 480474 - protein, 9 aa, Homo Sapiens
ECRKAFSNS

SEQ ID NO: 480475 - protein, 9 aa, Homo Sapiens
ACPDCGRAL

SEQ ID NO: 480476 - protein, 9 aa, Homo Sapiens
KVQRRAFLF

SEQ ID NO: 480477 - protein, 9 aa, Homo Sapiens
AAGSRKSLL

SEQ ID NO: 480478 - protein, 9 aa, Homo Sapiens
SFQPVLNPC

SEQ ID NO: 480479 - protein, 9 aa, Homo Sapiens
PMHTECGFI

SEQ ID NO: 480480 - protein, 9 aa, Homo Sapiens
VCKECRKAF

SEQ ID NO: 480481 - protein, 9 aa, Homo Sapiens
ENRMKKDKS

SEQ ID NO: 480482 - protein, 9 aa, Homo Sapiens
MKKDKSSIR

SEQ ID NO: 480483 - protein, 9 aa, Homo Sapiens
PEPVVRIFP

SEQ ID NO: 480484 - protein, 9 aa, Homo Sapiens
AALKSITAS

SEQ ID NO: 480485 - protein, 9 aa, Homo Sapiens
LILSSNGIS

SEQ ID NO: 480486 - protein, 9 aa, Homo Sapiens
GSRKSLLLA

SEQ ID NO: 480487 - protein, 9 aa, Homo Sapiens
DGDPDIFRH

SEQ ID NO: 480488 - protein, 9 aa, Homo Sapiens
IQQFSQGTW

SEQ ID NO: 480489 - protein, 9 aa, Homo Sapiens
CQSSGISLQ

SEQ ID NO: 480490 - protein, 9 aa, Homo Sapiens
SFATLSSTF

SEQ ID NO: 480491 - protein, 9 aa, Homo Sapiens
LRRDKWVVQ

SEQ ID NO: 480492 - protein, 9 aa, Homo Sapiens
LMRHMKTHG

SEQ ID NO: 480493 - protein, 9 aa, Homo Sapiens
IAHALTTRL

SEQ ID NO: 480494 - protein, 9 aa, Homo Sapiens
APPEERRNS

SEQ ID NO: 480495 - protein, 9 aa, Homo Sapiens
SNGISYFLN

SEQ ID NO: 480496 - protein, 9 aa, Homo Sapiens
QQFSQGTWK

SEQ ID NO: 480497 - protein, 9 aa, Homo Sapiens
TFQMYRMWQ

SEQ ID NO: 480498 - protein, 9 aa, Homo Sapiens
WEYCNLTLC

SEQ ID NO: 480499 - protein, 9 aa, Homo Sapiens
PPPPPQEEE

SEQ ID NO: 480500 - protein, 9 aa, Homo Sapiens
EQQPPHMLQ

SEQ ID NO: 480501 - protein, 9 aa, Homo Sapiens
CRKAFSNSS

SEQ ID NO: 480502 - protein, 9 aa, Homo Sapiens
TVAISTDGD

SEQ ID NO: 480503 - protein, 9 aa, Homo Sapiens
QEETAELEE

SEQ ID NO: 480504 - protein, 9 aa, Homo Sapiens
WHGKPYEWN

SEQ ID NO: 480505 - protein, 9 aa, Homo Sapiens
TVITTKQAP

SEQ ID NO: 480506 - protein, 9 aa, Homo Sapiens
QMYRMWQSF

SEQ ID NO: 480507 - protein, 9 aa, Homo Sapiens
EETAELEES

SEQ ID NO: 480508 - protein, 9 aa, Homo Sapiens
QDAEAHENK

SEQ ID NO: 480509 - protein, 9 aa, Homo Sapiens
YKIGGDIAN

SEQ ID NO: 480510 - protein, 9 aa, Homo Sapiens
GISYFLNNT

SEQ ID NO: 480511 - protein, 9 aa, Homo Sapiens
DEDEEDKVQ

SEQ ID NO: 480512 - protein, 9 aa, Homo Sapiens
ELILSSNGI

SEQ ID NO: 480513 - protein, 9 aa, Homo Sapiens
CPDCGRALA

SEQ ID NO: 480514 - protein, 9 aa, Homo Sapiens
ANSRFATPF

SEQ ID NO: 480515 - protein, 9 aa, Homo Sapiens
KAEKWLFDA

SEQ ID NO: 480516 - protein, 9 aa, Homo Sapiens
HSLPPSAIT

SEQ ID NO: 480517 - protein, 9 aa, Homo Sapiens
CGIAQFHID

SEQ ID NO: 480518 - protein, 9 aa, Homo Sapiens
PCLSTTCKN

SEQ ID NO: 480519 - protein, 9 aa, Homo Sapiens
KKKAEKWLF

SEQ ID NO: 480520 - protein, 9 aa, Homo Sapiens
STGYATSLP

SEQ ID NO: 480521 - protein, 9 aa, Homo Sapiens
NAPPEERRN

SEQ ID NO: 480522 - protein, 9 aa, Homo Sapiens
ILDRRAKLK

SEQ ID NO: 480523 - protein, 9 aa, Homo Sapiens
KRKSIARKS

SEQ ID NO: 480524 - protein, 9 aa, Homo Sapiens
PPEERRNSI

SEQ ID NO: 480525 - protein, 9 aa, Homo Sapiens
ISLGDVDIR

SEQ ID NO: 480526 - protein, 9 aa, Homo Sapiens
IHPEVSMST

SEQ ID NO: 480527 - protein, 9 aa, Homo Sapiens
GDEDEEDKV

SEQ ID NO: 480528 - protein, 9 aa, Homo Sapiens
EEMISLGDV

SEQ ID NO: 480529 - protein, 9 aa, Homo Sapiens
NLAASHGPG

SEQ ID NO: 480530 - protein, 9 aa, Homo Sapiens
RKSLLLAFA

SEQ ID NO: 480531 - protein, 9 aa, Homo Sapiens
KTDPMRLTQ

SEQ ID NO: 480532 - protein, 9 aa, Homo Sapiens
DRMGPGIGG

SEQ ID NO: 480533 - protein, 9 aa, Homo Sapiens
TGPPTRVTW

SEQ ID NO: 480534 - protein, 9 aa, Homo Sapiens
DRAKKPNPG

SEQ ID NO: 480535 - protein, 9 aa, Homo Sapiens
EDDKQKSIE

SEQ ID NO: 480536 - protein, 9 aa, Homo Sapiens
SGISLQSKY

SEQ ID NO: 480537 - protein, 9 aa, Homo Sapiens
SLQSKYLSF

SEQ ID NO: 480538 - protein, 9 aa, Homo Sapiens
PDHRYWSAW

SEQ ID NO: 480539 - protein, 9 aa, Homo Sapiens
GSKGRPWIW

SEQ ID NO: 480540 - protein, 9 aa, Homo Sapiens
GRPWIWNIP

SEQ ID NO: 480541 - protein, 9 aa, Homo Sapiens
HSLMKARWN

SEQ ID NO: 480542 - protein, 9 aa, Homo Sapiens
RKSIARKSL

SEQ ID NO: 480543 - protein, 9 aa, Homo Sapiens
VHLRDAGEF

SEQ ID NO: 480544 - protein, 9 aa, Homo Sapiens
MQFAEMKLR

SEQ ID NO: 480545 - protein, 9 aa, Homo Sapiens
PLLHTRLSG

SEQ ID NO: 480546 - protein, 9 aa, Homo Sapiens
IGGILERSI

SEQ ID NO: 480547 - protein, 9 aa, Homo Sapiens
YYLAYVPRT

SEQ ID NO: 480548 - protein, 9 aa, Homo Sapiens
GCGIAQFHI

SEQ ID NO: 480549 - protein, 9 aa, Homo Sapiens
FFSSSTLVA

SEQ ID NO: 480550 - protein, 9 aa, Homo Sapiens
KGSYYPGCG

SEQ ID NO: 480551 - protein, 9 aa, Homo Sapiens
TSANVIVIF

SEQ ID NO: 480552 - protein, 9 aa, Homo Sapiens
PVVRIFPPL

SEQ ID NO: 480553 - protein, 9 aa, Homo Sapiens
TECGFIRLK

SEQ ID NO: 480554 - protein, 9 aa, Homo Sapiens
KGLDEDTED

SEQ ID NO: 480555 - protein, 9 aa, Homo Sapiens
TPAKKHRAD

SEQ ID NO: 480556 - protein, 9 aa, Homo Sapiens
DKVQRRAFL

SEQ ID NO: 480557 - protein, 9 aa, Homo Sapiens
NPCLSTTCK

SEQ ID NO: 480558 - protein, 9 aa, Homo Sapiens
LIRHQRNHT

SEQ ID NO: 480559 - protein, 9 aa, Homo Sapiens
ITKQEKDFL

SEQ ID NO: 480560 - protein, 9 aa, Homo Sapiens
IETSFFSSS

SEQ ID NO: 480561 - protein, 9 aa, Homo Sapiens
DVETKKPQV

SEQ ID NO: 480562 - protein, 9 aa, Homo Sapiens
ANMVAQTIK

SEQ ID NO: 480563 - protein, 9 aa, Homo Sapiens
CAHKDNLKS

SEQ ID NO: 480564 - protein, 9 aa, Homo Sapiens
IKSHIKTIH

SEQ ID NO: 480565 - protein, 9 aa, Homo Sapiens
HPFYSEHSK

SEQ ID NO: 480566 - protein, 9 aa, Homo Sapiens
NQAPMLMRP

SEQ ID NO: 480567 - protein, 9 aa, Homo Sapiens
RLPYYLAYV

SEQ ID NO: 480568 - protein, 9 aa, Homo Sapiens
GPYKSRSGH

SEQ ID NO: 480569 - protein, 9 aa, Homo Sapiens
SSKLMRHMK

SEQ ID NO: 480570 - protein, 9 aa, Homo Sapiens
GISLQSKYL

SEQ ID NO: 480571 - protein, 9 aa, Homo Sapiens
PKWHGKPYE

SEQ ID NO: 480572 - protein, 9 aa, Homo Sapiens
PNPCLSTTC

SEQ ID NO: 480573 - protein, 9 aa, Homo Sapiens
VIINLSEGE

SEQ ID NO: 480574 - protein, 9 aa, Homo Sapiens
HSAAQEGQD

SEQ ID NO: 480575 - protein, 9 aa, Homo Sapiens
FKYPGIAIY

SEQ ID NO: 480576 - protein, 9 aa, Homo Sapiens
VRCKPDHRY

SEQ ID NO: 480577 - protein, 9 aa, Homo Sapiens
ALKSITASV

SEQ ID NO: 480578 - protein, 9 aa, Homo Sapiens
KKQLKTVVQ

SEQ ID NO: 480579 - protein, 9 aa, Homo Sapiens
LDEDTEDRW

SEQ ID NO: 480580 - protein, 9 aa, Homo Sapiens
CGRALARRS

SEQ ID NO: 480581 - protein, 9 aa, Homo Sapiens
KPMHTECGF

SEQ ID NO: 480582 - protein, 9 aa, Homo Sapiens
PAGGDLQKA

SEQ ID NO: 480583 - protein, 9 aa, Homo Sapiens
WKRKSIARK

SEQ ID NO: 480584 - protein, 9 aa, Homo Sapiens
WRLASLEAR

SEQ ID NO: 480585 - protein, 9 aa, Homo Sapiens
PEEKCFCEP

SEQ ID NO: 480586 - protein, 9 aa, Homo Sapiens
KPNPGLKKH

SEQ ID NO: 480587 - protein, 9 aa, Homo Sapiens
GASAMPTAA

SEQ ID NO: 480588 - protein, 9 aa, Homo Sapiens
ADNAPPEER

SEQ ID NO: 480589 - protein, 9 aa, Homo Sapiens
KSHIKTIHP

SEQ ID NO: 480590 - protein, 9 aa, Homo Sapiens
IRKEVKETW

SEQ ID NO: 480591 - protein, 9 aa, Homo Sapiens
IRYRNWRLA

SEQ ID NO: 480592 - protein, 9 aa, Homo Sapiens
RSLAQTLVI

SEQ ID NO: 480593 - protein, 9 aa, Homo Sapiens
QDSLQSSSL

SEQ ID NO: 480594 - protein, 9 aa, Homo Sapiens
TGTGCPRPC

SEQ ID NO: 480595 - protein, 9 aa, Homo Sapiens
REELSRLQE

SEQ ID NO: 480596 - protein, 9 aa, Homo Sapiens
IGGDIANRV

SEQ ID NO: 480597 - protein, 9 aa, Homo Sapiens
KMETPPIRP

SEQ ID NO: 480598 - protein, 9 aa, Homo Sapiens
EHSMQFAEM

SEQ ID NO: 480599 - protein, 9 aa, Homo Sapiens
IVIFVDIGI

SEQ ID NO: 480600 - protein, 9 aa, Homo Sapiens
ATPFYQHLA

SEQ ID NO: 480601 - protein, 9 aa, Homo Sapiens
LMRPPPKTG

SEQ ID NO: 480602 - protein, 9 aa, Homo Sapiens
FSSSTLVAL

SEQ ID NO: 480603 - protein, 9 aa, Homo Sapiens
AVTQFFLLP

SEQ ID NO: 480604 - protein, 9 aa, Homo Sapiens
AISTDGDVI

SEQ ID NO: 480605 - protein, 9 aa, Homo Sapiens
MRPPPKTGL

SEQ ID NO: 480606 - protein, 9 aa, Homo Sapiens
SEHSKMLSY

SEQ ID NO: 480607 - protein, 9 aa, Homo Sapiens
KPDHRYWSA

SEQ ID NO: 480608 - protein, 9 aa, Homo Sapiens
RRDKWVVQG

SEQ ID NO: 480609 - protein, 9 aa, Homo Sapiens
QHMTEVVRH

SEQ ID NO: 480610 - protein, 9 aa, Homo Sapiens
NGLTSFLDV

SEQ ID NO: 480611 - protein, 9 aa, Homo Sapiens
AKGANMNAF

SEQ ID NO: 480612 - protein, 9 aa, Homo Sapiens
DVQKRRGPN

SEQ ID NO: 480613 - protein, 9 aa, Homo Sapiens
RHQRNHTGE

SEQ ID NO: 480614 - protein, 9 aa, Homo Sapiens
AGEFTCRAQ

SEQ ID NO: 480615 - protein, 9 aa, Homo Sapiens
IEIELLKHE

SEQ ID NO: 480616 - protein, 9 aa, Homo Sapiens
SHIKTIHPE

SEQ ID NO: 480617 - protein, 9 aa, Homo Sapiens
KDEVIINLS

SEQ ID NO: 480618 - protein, 9 aa, Homo Sapiens
PKTDPMRLT

SEQ ID NO: 480619 - protein, 9 aa, Homo Sapiens
NADPCAVSY

SEQ ID NO: 480620 - protein, 9 aa, Homo Sapiens
DSSRHSAAQ

SEQ ID NO: 480621 - protein, 9 aa, Homo Sapiens
SLAQTLVII

SEQ ID NO: 480622 - protein, 9 aa, Homo Sapiens
PLCPFRCAH

SEQ ID NO: 480623 - protein, 9 aa, Homo Sapiens
SFFSSSTLV

SEQ ID NO: 480624 - protein, 9 aa, Homo Sapiens
ANMNAFDKK

SEQ ID NO: 480625 - protein, 9 aa, Homo Sapiens
NIIAHALTT

SEQ ID NO: 480626 - protein, 9 aa, Homo Sapiens
KAYMADIPG

SEQ ID NO: 480627 - protein, 9 aa, Homo Sapiens
KTVVQLPTS

SEQ ID NO: 480628 - protein, 9 aa, Homo Sapiens
PQVASWVHF

SEQ ID NO: 480629 - protein, 9 aa, Homo Sapiens
IQDSLQSSS

SEQ ID NO: 480630 - protein, 9 aa, Homo Sapiens
VRIFPPLEG

SEQ ID NO: 480631 - protein, 9 aa, Homo Sapiens
RDIFEDNYS

SEQ ID NO: 480632 - protein, 9 aa, Homo Sapiens
EDKVQRRAF

SEQ ID NO: 480633 - protein, 9 aa, Homo Sapiens
YFFDGDPDI

SEQ ID NO: 480634 - protein, 9 aa, Homo Sapiens
LIKSHIKTI

SEQ ID NO: 480635 - protein, 9 aa, Homo Sapiens
IWPKQGKKN

SEQ ID NO: 480636 - protein, 9 aa, Homo Sapiens
LKTVVQLPT

SEQ ID NO: 480637 - protein, 9 aa, Homo Sapiens
YSYFAQDIW

SEQ ID NO: 480638 - protein, 9 aa, Homo Sapiens
ETILDRRAK

SEQ ID NO: 480639 - protein, 9 aa, Homo Sapiens
APQAISPRG

SEQ ID NO: 480640 - protein, 9 aa, Homo Sapiens
TAALKSITA

SEQ ID NO: 480641 - protein, 9 aa, Homo Sapiens
QVLKSLCRE

SEQ ID NO: 480642 - protein, 9 aa, Homo Sapiens
NSWKKRQVL

SEQ ID NO: 480643 - protein, 9 aa, Homo Sapiens
TFAVSAYSS

SEQ ID NO: 480644 - protein, 9 aa, Homo Sapiens
AQQGSNFCQ

SEQ ID NO: 480645 - protein, 9 aa, Homo Sapiens
GTAEGTRYT

SEQ ID NO: 480646 - protein, 9 aa, Homo Sapiens
DLLQAKKDM

SEQ ID NO: 480647 - protein, 9 aa, Homo Sapiens
PPPQEEEEG

SEQ ID NO: 480648 - protein, 9 aa, Homo Sapiens
SWIAFKYPG

SEQ ID NO: 480649 - protein, 9 aa, Homo Sapiens
LMQDAEAHE

SEQ ID NO: 480650 - protein, 9 aa, Homo Sapiens
ETFYTLSCW

SEQ ID NO: 480651 - protein, 9 aa, Homo Sapiens
LHSLMKARW

SEQ ID NO: 480652 - protein, 9 aa, Homo Sapiens
CERMVYIAT

SEQ ID NO: 480653 - protein, 9 aa, Homo Sapiens
QPVLNPCYT

SEQ ID NO: 480654 - protein, 9 aa, Homo Sapiens
RDTGKKTFQ

SEQ ID NO: 480655 - protein, 9 aa, Homo Sapiens
DKQKSIEIE

SEQ ID NO: 480656 - protein, 9 aa, Homo Sapiens
CQAVGPPDP

SEQ ID NO: 480657 - protein, 9 aa, Homo Sapiens
EDGEMNNLH

SEQ ID NO: 480658 - protein, 9 aa, Homo Sapiens
GPNKHYVYI

SEQ ID NO: 480659 - protein, 9 aa, Homo Sapiens
LCPFRCAHK

SEQ ID NO: 480660 - protein, 9 aa, Homo Sapiens
QLTVLIGYD

SEQ ID NO: 480661 - protein, 9 aa, Homo Sapiens
SMHMGNEPP

SEQ ID NO: 480662 - protein, 9 aa, Homo Sapiens
DEDTEDRWG

SEQ ID NO: 480663 - protein, 9 aa, Homo Sapiens
DPLSEITKQ

SEQ ID NO: 480664 - protein, 9 aa, Homo Sapiens
PGASAMPTA

SEQ ID NO: 480665 - protein, 9 aa, Homo Sapiens
AAATGPPTR

SEQ ID NO: 480666 - protein, 9 aa, Homo Sapiens
GGILERSID

SEQ ID NO: 480667 - protein, 9 aa, Homo Sapiens
DGFLHETIL

SEQ ID NO: 480668 - protein, 9 aa, Homo Sapiens
TLCPVTESS

SEQ ID NO: 480669 - protein, 9 aa, Homo Sapiens
QVRCKPDHR

SEQ ID NO: 480670 - protein, 9 aa, Homo Sapiens
TGCIQVIEI

SEQ ID NO: 480671 - protein, 9 aa, Homo Sapiens
LTGFRRQFQ

SEQ ID NO: 480672 - protein, 9 aa, Homo Sapiens
NNLHIAIGR

SEQ ID NO: 480673 - protein, 9 aa, Homo Sapiens
HSMQFAEMK

SEQ ID NO: 480674 - protein, 9 aa, Homo Sapiens
NLTLCPVTE

SEQ ID NO: 480675 - protein, 9 aa, Homo Sapiens
RPPPKTGLF

SEQ ID NO: 480676 - protein, 9 aa, Homo Sapiens
SIARKSLFQ

SEQ ID NO: 480677 - protein, 9 aa, Homo Sapiens
PSNVGHHLG

SEQ ID NO: 480678 - protein, 9 aa, Homo Sapiens
FDGDPDIFR

SEQ ID NO: 480679 - protein, 9 aa, Homo Sapiens
GKPYEWNQV

SEQ ID NO: 480680 - protein, 9 aa, Homo Sapiens
YTDPPAGKP

SEQ ID NO: 480681 - protein, 9 aa, Homo Sapiens
QYFFDGDPD

SEQ ID NO: 480682 - protein, 9 aa, Homo Sapiens
QVASWVHFD

SEQ ID NO: 480683 - protein, 9 aa, Homo Sapiens
CLSTTCKNA

SEQ ID NO: 480684 - protein, 9 aa, Homo Sapiens
SSRHSAAQE

SEQ ID NO: 480685 - protein, 9 aa, Homo Sapiens
KPTVAISTD

SEQ ID NO: 480686 - protein, 9 aa, Homo Sapiens
TEVKGNFTL

SEQ ID NO: 480687 - protein, 9 aa, Homo Sapiens
FPGASAMPT

SEQ ID NO: 480688 - protein, 9 aa, Homo Sapiens
EHSKMLSYA

SEQ ID NO: 480689 - protein, 9 aa, Homo Sapiens
TVNLAASHG

SEQ ID NO: 480690 - protein, 9 aa, Homo Sapiens
SSTFPSLSA

SEQ ID NO: 480691 - protein, 9 aa, Homo Sapiens
LLPFCGFLL

SEQ ID NO: 480692 - protein, 9 aa, Homo Sapiens
GDPDIFRHI

SEQ ID NO: 480693 - protein, 9 aa, Homo Sapiens
GPDQQPLPA

SEQ ID NO: 480694 - protein, 9 aa, Homo Sapiens
CFPEEKCFC

SEQ ID NO: 480695 - protein, 9 aa, Homo Sapiens
CRGPDQQPL

SEQ ID NO: 480696 - protein, 9 aa, Homo Sapiens
VGPPDPVNI

SEQ ID NO: 480697 - protein, 9 aa, Homo Sapiens
NLHIAIGRI

SEQ ID NO: 480698 - protein, 9 aa, Homo Sapiens
GDTSSTGEE

SEQ ID NO: 480699 - protein, 9 aa, Homo Sapiens
DSDKYDDDD

SEQ ID NO: 480700 - protein, 9 aa, Homo Sapiens
DSLQSSSLC

SEQ ID NO: 480701 - protein, 9 aa, Homo Sapiens
AHALTTRLY

SEQ ID NO: 480702 - protein, 9 aa, Homo Sapiens
LTSFLDVST

SEQ ID NO: 480703 - protein, 9 aa, Homo Sapiens
ASVATPAKK

SEQ ID NO: 480704 - protein, 9 aa, Homo Sapiens
YADHMGLTG

SEQ ID NO: 480705 - protein, 9 aa, Homo Sapiens
LQEETAELE

SEQ ID NO: 480706 - protein, 9 aa, Homo Sapiens
AGRQEASGD

SEQ ID NO: 480707 - protein, 9 aa, Homo Sapiens
TTKQAPALC

SEQ ID NO: 480708 - protein, 9 aa, Homo Sapiens
QRQLTVLIG

SEQ ID NO: 480709 - protein, 9 aa, Homo Sapiens
RDPLSEITK

SEQ ID NO: 480710 - protein, 9 aa, Homo Sapiens
LGTAEGTRY

SEQ ID NO: 480711 - protein, 9 aa, Homo Sapiens
ITEIKLHSN

SEQ ID NO: 480712 - protein, 9 aa, Homo Sapiens
SHGPGAFFR

SEQ ID NO: 480713 - protein, 9 aa, Homo Sapiens
TSSASTGYA

SEQ ID NO: 480714 - protein, 9 aa, Homo Sapiens
HIKTIHPEV

SEQ ID NO: 480715 - protein, 9 aa, Homo Sapiens
RGDRAKKPN

SEQ ID NO: 480716 - protein, 9 aa, Homo Sapiens
PDQQPLPAD

SEQ ID NO: 480717 - protein, 9 aa, Homo Sapiens
KNDVSRKNS

SEQ ID NO: 480718 - protein, 9 aa, Homo Sapiens
METPPIRPP

SEQ ID NO: 480719 - protein, 9 aa, Homo Sapiens
RALARRSTL

SEQ ID NO: 480720 - protein, 9 aa, Homo Sapiens
LHTRLSGDA

SEQ ID NO: 480721 - protein, 9 aa, Homo Sapiens
LSCWDRNEK

SEQ ID NO: 480722 - protein, 9 aa, Homo Sapiens
TPPIRPPPH

SEQ ID NO: 480723 - protein, 9 aa, Homo Sapiens
PPIRPPPHG

SEQ ID NO: 480724 - protein, 9 aa, Homo Sapiens
TIHPEVSMS

SEQ ID NO: 480725 - protein, 9 aa, Homo Sapiens
PAKKKAEKW

SEQ ID NO: 480726 - protein, 9 aa, Homo Sapiens
HGKPYEWNQ

SEQ ID NO: 480727 - protein, 9 aa, Homo Sapiens
GKGLDEDTE

SEQ ID NO: 480728 - protein, 9 aa, Homo Sapiens
KARWNHELA

SEQ ID NO: 480729 - protein, 9 aa, Homo Sapiens
SSRGPYKSR

SEQ ID NO: 480730 - protein, 9 aa, Homo Sapiens
DTRKPMHTE

SEQ ID NO: 480731 - protein, 9 aa, Homo Sapiens
KKQQDDSDK

SEQ ID NO: 480732 - protein, 9 aa, Homo Sapiens
CKPDHRYWS

SEQ ID NO: 480733 - protein, 9 aa, Homo Sapiens
DNAPPEERR

SEQ ID NO: 480734 - protein, 9 aa, Homo Sapiens
RTALASVAT

SEQ ID NO: 480735 - protein, 9 aa, Homo Sapiens
GKANMVAQT

SEQ ID NO: 480736 - protein, 9 aa, Homo Sapiens
TPFYQHLAD

SEQ ID NO: 480737 - protein, 9 aa, Homo Sapiens
LAYVPRTLK

SEQ ID NO: 480738 - protein, 9 aa, Homo Sapiens
SEITKQEKD

SEQ ID NO: 480739 - protein, 9 aa, Homo Sapiens
RLAKPTVAI

SEQ ID NO: 480740 - protein, 9 aa, Homo Sapiens
DQQPLPADH

SEQ ID NO: 480741 - protein, 9 aa, Homo Sapiens
PKMETPPIR

SEQ ID NO: 480742 - protein, 9 aa, Homo Sapiens
LLHTRLSGD

SEQ ID NO: 480743 - protein, 9 aa, Homo Sapiens
QQPPHMLQE

SEQ ID NO: 480744 - protein, 9 aa, Homo Sapiens
FSQGTWKSA

SEQ ID NO: 480745 - protein, 9 aa, Homo Sapiens
VHERTHTGK

SEQ ID NO: 480746 - protein, 9 aa, Homo Sapiens
VLHSLMKAR

SEQ ID NO: 480747 - protein, 9 aa, Homo Sapiens
NFCQLNNGG

SEQ ID NO: 480748 - protein, 9 aa, Homo Sapiens
HKDNLKSHM

SEQ ID NO: 480749 - protein, 9 aa, Homo Sapiens
QAPMLMRPP

SEQ ID NO: 480750 - protein, 9 aa, Homo Sapiens
FTGCIQVIE

SEQ ID NO: 480751 - protein, 9 aa, Homo Sapiens
HWKGHEHSM

SEQ ID NO: 480752 - protein, 9 aa, Homo Sapiens
PDCGRALAR

SEQ ID NO: 480753 - protein, 9 aa, Homo Sapiens
HTECGFIRL

SEQ ID NO: 480754 - protein, 9 aa, Homo Sapiens
LDVQKRRGP

SEQ ID NO: 480755 - protein, 9 aa, Homo Sapiens
LSTTCKNAG

SEQ ID NO: 480756 - protein, 9 aa, Homo Sapiens
GTRYTDPPA

SEQ ID NO: 480757 - protein, 9 aa, Homo Sapiens
LYGSKGRPW

SEQ ID NO: 480758 - protein, 9 aa, Homo Sapiens
SRGPYKSRS

SEQ ID NO: 480759 - protein, 9 aa, Homo Sapiens
DKYDDDDSA

SEQ ID NO: 480760 - protein, 9 aa, Homo Sapiens
STTCKNAGT

SEQ ID NO: 480761 - protein, 9 aa, Homo Sapiens
TFPSLSAAN

SEQ ID NO: 480762 - protein, 9 aa, Homo Sapiens
DDKQKSIEI

SEQ ID NO: 480763 - protein, 9 aa, Homo Sapiens
TAAGMVGLS

SEQ ID NO: 480764 - protein, 9 aa, Homo Sapiens
KSIARKSLF

SEQ ID NO: 480765 - protein, 9 aa, Homo Sapiens
KGHEHSMQF

SEQ ID NO: 480766 - protein, 9 aa, Homo Sapiens
VPKWHGKPY

SEQ ID NO: 480767 - protein, 9 aa, Homo Sapiens
FYSEHSKML

SEQ ID NO: 480768 - protein, 9 aa, Homo Sapiens
AHYCSPTGT

SEQ ID NO: 480769 - protein, 9 aa, Homo Sapiens
PPPPPPPQE

SEQ ID NO: 480770 - protein, 9 aa, Homo Sapiens
AQTLVIIVS

SEQ ID NO: 480771 - protein, 9 aa, Homo Sapiens
DTSANVIVI

SEQ ID NO: 480772 - protein, 9 aa, Homo Sapiens
AQDIWPKQG

SEQ ID NO: 480773 - protein, 9 aa, Homo Sapiens
RCAHKDNLK

SEQ ID NO: 480774 - protein, 9 aa, Homo Sapiens
SAMPTAAGM

SEQ ID NO: 480775 - protein, 9 aa, Homo Sapiens
ARLPYYLAY

SEQ ID NO: 480776 - protein, 9 aa, Homo Sapiens
RMKKDKSSI

SEQ ID NO: 480777 - protein, 9 aa, Homo Sapiens
PPPINSPDL

SEQ ID NO: 480778 - protein, 9 aa, Homo Sapiens
DAGEFTCRA

SEQ ID NO: 480779 - protein, 9 aa, Homo Sapiens
EKGSYYPGC

SEQ ID NO: 480780 - protein, 9 aa, Homo Sapiens
ETQQYFFDG

SEQ ID NO: 480781 - protein, 9 aa, Homo Sapiens
EQEEREQQL

SEQ ID NO: 480782 - protein, 9 aa, Homo Sapiens
PIGPCRGPD

SEQ ID NO: 480783 - protein, 9 aa, Homo Sapiens
HMLQEGHSP

SEQ ID NO: 480784 - protein, 9 aa, Homo Sapiens
NPGLKKHQE

SEQ ID NO: 480785 - protein, 9 aa, Homo Sapiens
YYPGCGIAQ

SEQ ID NO: 480786 - protein, 9 aa, Homo Sapiens
CSPTGTGCP

SEQ ID NO: 480787 - protein, 9 aa, Homo Sapiens
DTSSASTGY

SEQ ID NO: 480788 - protein, 9 aa, Homo Sapiens
LSSTFPSLS

SEQ ID NO: 480789 - protein, 9 aa, Homo Sapiens
KWLFDASSF

SEQ ID NO: 480790 - protein, 9 aa, Homo Sapiens
VVTKYKIGG

SEQ ID NO: 480791 - protein, 9 aa, Homo Sapiens
KYKIGGDIA

SEQ ID NO: 480792 - protein, 9 aa, Homo Sapiens
LMKARWNHE

SEQ ID NO: 480793 - protein, 9 aa, Homo Sapiens
SIEIELLKH

SEQ ID NO: 480794 - protein, 9 aa, Homo Sapiens
MHTECGFIR

SEQ ID NO: 480795 - protein, 9 aa, Homo Sapiens
RWEYCNLTL

SEQ ID NO: 480796 - protein, 9 aa, Homo Sapiens
YLDGKANMV

SEQ ID NO: 480797 - protein, 9 aa, Homo Sapiens
SNFCQLNNG

SEQ ID NO: 480798 - protein, 9 aa, Homo Sapiens
PPQEEEEGA

SEQ ID NO: 480799 - protein, 9 aa, Homo Sapiens
YGSKGRPWI

SEQ ID NO: 480800 - protein, 9 aa, Homo Sapiens
EGDEDEEDK

SEQ ID NO: 480801 - protein, 9 aa, Homo Sapiens
GHSLPPSAI

SEQ ID NO: 480802 - protein, 9 aa, Homo Sapiens
MPTAAGMVG

SEQ ID NO: 480803 - protein, 9 aa, Homo Sapiens
PPPPPPQEE

SEQ ID NO: 480804 - protein, 9 aa, Homo Sapiens
PPHMLQEGH

SEQ ID NO: 480805 - protein, 9 aa, Homo Sapiens
RMVYIATFA

SEQ ID NO: 480806 - protein, 9 aa, Homo Sapiens
RREQEEREQ

SEQ ID NO: 480807 - protein, 9 aa, Homo Sapiens
VIPEQQPPH

SEQ ID NO: 480808 - protein, 9 aa, Homo Sapiens
GCIQVIEIN

SEQ ID NO: 480809 - protein, 9 aa, Homo Sapiens
TALASVATP

SEQ ID NO: 480810 - protein, 9 aa, Homo Sapiens
SRKSLLLAF

SEQ ID NO: 480811 - protein, 9 aa, Homo Sapiens
LKNADPCAV

SEQ ID NO: 480812 - protein, 9 aa, Homo Sapiens
GRLAKPTVA

SEQ ID NO: 480813 - protein, 9 aa, Homo Sapiens
KEAQQGSNF

SEQ ID NO: 480814 - protein, 9 aa, Homo Sapiens
PFYQHLADS

SEQ ID NO: 480815 - protein, 9 aa, Homo Sapiens
VSTVYGSSP

SEQ ID NO: 480816 - protein, 9 aa, Homo Sapiens
MQDAEAHEN

SEQ ID NO: 480817 - protein, 9 aa, Homo Sapiens
FRDIFEDNY

SEQ ID NO: 480818 - protein, 9 aa, Homo Sapiens
NKNDVSRKN

SEQ ID NO: 480819 - protein, 9 aa, Homo Sapiens
FFDGDPDIF

SEQ ID NO: 480820 - protein, 9 aa, Homo Sapiens
SMQFAEMKL

SEQ ID NO: 480821 - protein, 9 aa, Homo Sapiens
DLKNADPCA

SEQ ID NO: 480822 - protein, 9 aa, Homo Sapiens
RYWSAWSPA

SEQ ID NO: 480823 - protein, 9 aa, Homo Sapiens
FWKRKSIAR

SEQ ID NO: 480824 - protein, 9 aa, Homo Sapiens
HMGNEPPIS

SEQ ID NO: 480825 - protein, 9 aa, Homo Sapiens
SAVKRSLAQ

SEQ ID NO: 480826 - protein, 9 aa, Homo Sapiens
SSSSSGDTS

SEQ ID NO: 480827 - protein, 9 aa, Homo Sapiens
EASGDCQDV

SEQ ID NO: 480828 - protein, 9 aa, Homo Sapiens
ASTGYATSL

SEQ ID NO: 480829 - protein, 9 aa, Homo Sapiens
TCNCFPEEK

SEQ ID NO: 480830 - protein, 9 aa, Homo Sapiens
TGFRRQFQV

SEQ ID NO: 480831 - protein, 9 aa, Homo Sapiens
ATGPPTRVT

SEQ ID NO: 480832 - protein, 9 aa, Homo Sapiens
RGPNKHYVY

SEQ ID NO: 480833 - protein, 9 aa, Homo Sapiens
PPINSPDLL

SEQ ID NO: 480834 - protein, 9 aa, Homo Sapiens
NMVAQTIKP

SEQ ID NO: 480835 - protein, 9 aa, Homo Sapiens
LARRSTLAK

SEQ ID NO: 480836 - protein, 9 aa, Homo Sapiens
QSSGISLQS

SEQ ID NO: 480837 - protein, 9 aa, Homo Sapiens
NDVSRKNST

SEQ ID NO: 480838 - protein, 9 aa, Homo Sapiens
VFRDIFEDN

SEQ ID NO: 480839 - protein, 9 aa, Homo Sapiens
HLIRHQRNH

SEQ ID NO: 480840 - protein, 9 aa, Homo Sapiens
ADPCAVSYL

SEQ ID NO: 480841 - protein, 9 aa, Homo Sapiens
HLGHRRALF

SEQ ID NO: 480842 - protein, 9 aa, Homo Sapiens
PPPPQEEEE

SEQ ID NO: 480843 - protein, 9 aa, Homo Sapiens
QEEEEGAVP

SEQ ID NO: 480844 - protein, 9 aa, Homo Sapiens
MQSIQDSLQ

SEQ ID NO: 480845 - protein, 9 aa, Homo Sapiens
REQEEREQQ

SEQ ID NO: 480846 - protein, 9 aa, Homo Sapiens
KNSTVDFSK

SEQ ID NO: 480847 - protein, 9 aa, Homo Sapiens
KYDDDDSAA

SEQ ID NO: 480848 - protein, 9 aa, Homo Sapiens
EAQQGSNFC

SEQ ID NO: 480849 - protein, 9 aa, Homo Sapiens
HTRLSGDAA

SEQ ID NO: 480850 - protein, 9 aa, Homo Sapiens
KMLSYAASS

SEQ ID NO: 480851 - protein, 9 aa, Homo Sapiens
DVDIRTMCP

SEQ ID NO: 480852 - protein, 9 aa, Homo Sapiens
AQEGQDTIR

SEQ ID NO: 480853 - protein, 9 aa, Homo Sapiens
PQEEEEGAV

SEQ ID NO: 480854 - protein, 9 aa, Homo Sapiens
IHMSMHMGN

SEQ ID NO: 480855 - protein, 9 aa, Homo Sapiens
SRKNSTVDF

SEQ ID NO: 480856 - protein, 9 aa, Homo Sapiens
TGKGLDEDT

SEQ ID NO: 480857 - protein, 9 aa, Homo Sapiens
PTGTGCPRP

SEQ ID NO: 480858 - protein, 9 aa, Homo Sapiens
FAQDIWPKQ

SEQ ID NO: 480859 - protein, 9 aa, Homo Sapiens
ACAQSSKLM

SEQ ID NO: 480860 - protein, 9 aa, Homo Sapiens
GPPDPVNIF

SEQ ID NO: 480861 - protein, 9 aa, Homo Sapiens
ATLSSTFPS

SEQ ID NO: 480862 - protein, 9 aa, Homo Sapiens
IRDTGKKTF

SEQ ID NO: 480863 - protein, 9 aa, Homo Sapiens
HIRYRNWRL

SEQ ID NO: 480864 - protein, 9 aa, Homo Sapiens
IFEDNYSPI

SEQ ID NO: 480865 - protein, 9 aa, Homo Sapiens
HIAIGRIKL

SEQ ID NO: 480866 - protein, 9 aa, Homo Sapiens
NPAGGDLQK

SEQ ID NO: 480867 - protein, 9 aa, Homo Sapiens
GRALARRST

SEQ ID NO: 480868 - protein, 9 aa, Homo Sapiens
LAKGANMNA

SEQ ID NO: 480869 - protein, 9 aa, Homo Sapiens
SAFPPRVAP

SEQ ID NO: 480870 - protein, 9 aa, Homo Sapiens
QGTWKSATD

SEQ ID NO: 480871 - protein, 9 aa, Homo Sapiens
QFSQGTWKS

SEQ ID NO: 480872 - protein, 9 aa, Homo Sapiens
QKRRGPNKH

SEQ ID NO: 480873 - protein, 9 aa, Homo Sapiens
KKAEKWLFD

SEQ ID NO: 480874 - protein, 9 aa, Homo Sapiens
LQSKYLSFF

SEQ ID NO: 480875 - protein, 9 aa, Homo Sapiens
NGISYFLNN

SEQ ID NO: 480876 - protein, 9 aa, Homo Sapiens
KANMVAQTI

SEQ ID NO: 480877 - protein, 9 aa, Homo Sapiens
ENKNDVSRK

SEQ ID NO: 480878 - protein, 9 aa, Homo Sapiens
WKSATDTSA

SEQ ID NO: 480879 - protein, 9 aa, Homo Sapiens
RMGPGIGGI

SEQ ID NO: 480880 - protein, 9 aa, Homo Sapiens
SVATPAKKH

SEQ ID NO: 480881 - protein, 9 aa, Homo Sapiens
QEASGDCQD

SEQ ID NO: 480882 - protein, 9 aa, Homo Sapiens
KECRKAFSN

SEQ ID NO: 480883 - protein, 9 aa, Homo Sapiens
LTLCPVTES

SEQ ID NO: 480884 - protein, 9 aa, Homo Sapiens
EMISLGDVD

SEQ ID NO: 480885 - protein, 9 aa, Homo Sapiens
SGDCQDVIS

SEQ ID NO: 480886 - protein, 9 aa, Homo Sapiens
HSKMLSYAA

SEQ ID NO: 480887 - protein, 9 aa, Homo Sapiens
MRLTQLYEQ

SEQ ID NO: 480888 - protein, 9 aa, Homo Sapiens
TTVITTKQA

SEQ ID NO: 480889 - protein, 9 aa, Homo Sapiens
PWVHLRDAG

SEQ ID NO: 480890 - protein, 9 aa, Homo Sapiens
DHRYWSAWS

SEQ ID NO: 480891 - protein, 9 aa, Homo Sapiens
SPTGTGCPR

SEQ ID NO: 480892 - protein, 9 aa, Homo Sapiens
QPPPINSPD

SEQ ID NO: 480893 - protein, 9 aa, Homo Sapiens
RNWRLASLE

SEQ ID NO: 480894 - protein, 9 aa, Homo Sapiens
KWHGKPYEW

SEQ ID NO: 480895 - protein, 9 aa, Homo Sapiens
RGPDQQPLP

SEQ ID NO: 480896 - protein, 9 aa, Homo Sapiens
ILGATEVKG

SEQ ID NO: 480897 - protein, 9 aa, Homo Sapiens
GANMNAFDK

SEQ ID NO: 480898 - protein, 9 aa, Homo Sapiens
VETKKPQVA

SEQ ID NO: 480899 - protein, 9 aa, Homo Sapiens
RSSSRGPYK

SEQ ID NO: 480900 - protein, 9 aa, Homo Sapiens
EDSLNVSRN

SEQ ID NO: 480901 - protein, 9 aa, Homo Sapiens
PMRLTQLYE

SEQ ID NO: 480902 - protein, 9 aa, Homo Sapiens
RKAFSNSSH

SEQ ID NO: 480903 - protein, 9 aa, Homo Sapiens
VNLAASHGP

SEQ ID NO: 480904 - protein, 9 aa, Homo Sapiens
EERRNSICT

SEQ ID NO: 480905 - protein, 9 aa, Homo Sapiens
EVIINLSEG

SEQ ID NO: 480906 - protein, 9 aa, Homo Sapiens
ISLQSKYLS

SEQ ID NO: 480907 - protein, 9 aa, Homo Sapiens
HHLGHRRAL

SEQ ID NO: 480908 - protein, 9 aa, Homo Sapiens
FYTLSCWDR

SEQ ID NO: 480909 - protein, 9 aa, Homo Sapiens
LAKPTVAIS

SEQ ID NO: 480910 - protein, 9 aa, Homo Sapiens
KKTFQMYRM

SEQ ID NO: 480911 - protein, 9 aa, Homo Sapiens
DHMGLTGFR

SEQ ID NO: 480912 - protein, 9 aa, Homo Sapiens
KSLLLAFAL

SEQ ID NO: 480913 - protein, 9 aa, Homo Sapiens
QAFQRQLTV

SEQ ID NO: 480914 - protein, 9 aa, Homo Sapiens
SHLIRHQRN

SEQ ID NO: 480915 - protein, 9 aa, Homo Sapiens
QAKDEVIIN

SEQ ID NO: 480916 - protein, 9 aa, Homo Sapiens
MTGKGLDED

SEQ ID NO: 480917 - protein, 9 aa, Homo Sapiens
EKIVPKWHG

SEQ ID NO: 480918 - protein, 9 aa, Homo Sapiens
PRVAPQAIS

SEQ ID NO: 480919 - protein, 9 aa, Homo Sapiens
PNPAGGDLQ

SEQ ID NO: 480920 - protein, 9 aa, Homo Sapiens
PTAAGMVGL

SEQ ID NO: 480921 - protein, 9 aa, Homo Sapiens
KPQVASWVH

SEQ ID NO: 480922 - protein, 9 aa, Homo Sapiens
LVVTKYKIG

SEQ ID NO: 480923 - protein, 9 aa, Homo Sapiens
AVKRSLAQT

SEQ ID NO: 480924 - protein, 9 aa, Homo Sapiens
WVVQGKLRK

SEQ ID NO: 480925 - protein, 9 aa, Homo Sapiens
EYCNLTLCP

SEQ ID NO: 480926 - protein, 9 aa, Homo Sapiens
MSMHMGNEP

SEQ ID NO: 480927 - protein, 9 aa, Homo Sapiens
GAAATGPPT

SEQ ID NO: 480928 - protein, 9 aa, Homo Sapiens
GVFRDIFED

SEQ ID NO: 480929 - protein, 9 aa, Homo Sapiens
LSEITKQEK

SEQ ID NO: 480930 - protein, 9 aa, Homo Sapiens
WKKRQVLKS

SEQ ID NO: 480931 - protein, 9 aa, Homo Sapiens
YMADIPGHV

SEQ ID NO: 480932 - protein, 9 aa, Homo Sapiens
SPDLLQAKK

SEQ ID NO: 480933 - protein, 9 aa, Homo Sapiens
GDRAKKPNP

SEQ ID NO: 480934 - protein, 9 aa, Homo Sapiens
VFKRIAQET

SEQ ID NO: 480935 - protein, 9 aa, Homo Sapiens
DDSDKYDDD

SEQ ID NO: 480936 - protein, 9 aa, Homo Sapiens
KHYVCKECR

SEQ ID NO: 480937 - protein, 9 aa, Homo Sapiens
GEMNNLHIA

SEQ ID NO: 480938 - protein, 9 aa, Homo Sapiens
EAHENKKIS

SEQ ID NO: 480939 - protein, 9 aa, Homo Sapiens
NVIVIFVDI

SEQ ID NO: 480940 - protein, 9 aa, Homo Sapiens
YATSLPVTD

SEQ ID NO: 480941 - protein, 9 aa, Homo Sapiens
LKSITASVK

SEQ ID NO: 480942 - protein, 9 aa, Homo Sapiens
EREQQLRRE

SEQ ID NO: 480943 - protein, 9 aa, Homo Sapiens
PIRPPPHGT

SEQ ID NO: 480944 - protein, 9 aa, Homo Sapiens
YKSRSGHSS

SEQ ID NO: 480945 - protein, 9 aa, Homo Sapiens
LPYYLAYVP

SEQ ID NO: 480946 - protein, 9 aa, Homo Sapiens
AGSRKSLLL

SEQ ID NO: 480947 - protein, 9 aa, Homo Sapiens
GARLPYYLA

SEQ ID NO: 480948 - protein, 9 aa, Homo Sapiens
MKARWNHEL

SEQ ID NO: 480949 - protein, 9 aa, Homo Sapiens
YRMWQSFQP

SEQ ID NO: 480950 - protein, 9 aa, Homo Sapiens
MGPGIGGIL

SEQ ID NO: 480951 - protein, 9 aa, Homo Sapiens
GILERSIDM

SEQ ID NO: 480952 - protein, 9 aa, Homo Sapiens
SFILVRKAY

SEQ ID NO: 480953 - protein, 9 aa, Homo Sapiens
APNPAGGDL

SEQ ID NO: 480954 - protein, 9 aa, Homo Sapiens
ALRTTNGKE

SEQ ID NO: 480955 - protein, 9 aa, Homo Sapiens
SLGAAATGP

SEQ ID NO: 480956 - protein, 9 aa, Homo Sapiens
APMLMRPPP

SEQ ID NO: 480957 - protein, 9 aa, Homo Sapiens
GGNIIAHAL

SEQ ID NO: 480958 - protein, 9 aa, Homo Sapiens
MNNLHIAIG

SEQ ID NO: 480959 - protein, 9 aa, Homo Sapiens
RGPYKSRSG

SEQ ID NO: 480960 - protein, 9 aa, Homo Sapiens
GRQEASGDC

SEQ ID NO: 480961 - protein, 9 aa, Homo Sapiens
KRQVLKSLC

SEQ ID NO: 480962 - protein, 9 aa, Homo Sapiens
LHETILDRR

SEQ ID NO: 480963 - protein, 9 aa, Homo Sapiens
PTPKMETPP

SEQ ID NO: 480964 - protein, 9 aa, Homo Sapiens
SKMLSYAAS

SEQ ID NO: 480965 - protein, 9 aa, Homo Sapiens
NWRLASLEA

SEQ ID NO: 480966 - protein, 9 aa, Homo Sapiens
PLTVTAALK

SEQ ID NO: 480967 - protein, 9 aa, Homo Sapiens
DTGKKTFQM

SEQ ID NO: 480968 - protein, 9 aa, Homo Sapiens
GNIIAHALT

SEQ ID NO: 480969 - protein, 9 aa, Homo Sapiens
EDEEDKVQR

SEQ ID NO: 480970 - protein, 9 aa, Homo Sapiens
LASVATPAK

SEQ ID NO: 480971 - protein, 9 aa, Homo Sapiens
DAEAHENKK

SEQ ID NO: 480972 - protein, 9 aa, Homo Sapiens
NDLKNADPC

SEQ ID NO: 480973 - protein, 9 aa, Homo Sapiens
PCRGPDQQP

SEQ ID NO: 480974 - protein, 9 aa, Homo Sapiens
QVLHSLMKA

SEQ ID NO: 480975 - protein, 9 aa, Homo Sapiens
DKWVVQGKL

SEQ ID NO: 480976 - protein, 9 aa, Homo Sapiens
RCKPDHRYW

SEQ ID NO: 480977 - protein, 9 aa, Homo Sapiens
SASTGYATS

SEQ ID NO: 480978 - protein, 9 aa, Homo Sapiens
RLASLEARR

SEQ ID NO: 480979 - protein, 9 aa, Homo Sapiens
SSSRGPYKS

SEQ ID NO: 480980 - protein, 9 aa, Homo Sapiens
PMLMRPPPK

SEQ ID NO: 480981 - protein, 9 aa, Homo Sapiens
GHEHSMQFA

SEQ ID NO: 480982 - protein, 9 aa, Homo Sapiens
IINLSEGEG

SEQ ID NO: 480983 - protein, 9 aa, Homo Sapiens
EVKETWKML

SEQ ID NO: 480984 - protein, 9 aa, Homo Sapiens
TPKMETPPI

SEQ ID NO: 480985 - protein, 9 aa, Homo Sapiens
MIHMSMHMG

SEQ ID NO: 480986 - protein, 9 aa, Homo Sapiens
SDKYDDDDS

SEQ ID NO: 480987 - protein, 9 aa, Homo Sapiens
FATLSSTFP

SEQ ID NO: 480988 - protein, 9 aa, Homo Sapiens
GLTGFRRQF

SEQ ID NO: 480989 - protein, 9 aa, Homo Sapiens
TVLIGYDVT

SEQ ID NO: 480990 - protein, 9 aa, Homo Sapiens
TGKKTFQMY

SEQ ID NO: 480991 - protein, 9 aa, Homo Sapiens
ALASVATPA

SEQ ID NO: 480992 - protein, 9 aa, Homo Sapiens
VRHCPHHER

SEQ ID NO: 480993 - protein, 9 aa, Homo Sapiens
VVRHCPHHE

SEQ ID NO: 480994 - protein, 9 aa, Homo Sapiens
DSWIAFKYP

SEQ ID NO: 480995 - protein, 9 aa, Homo Sapiens
IAFKYPGIA

SEQ ID NO: 480996 - protein, 9 aa, Homo Sapiens
MGLTGFRRQ

SEQ ID NO: 480997 - protein, 9 aa, Homo Sapiens
ADHMGLTGF

SEQ ID NO: 480998 - protein, 9 aa, Homo Sapiens
KDKSSIREA

SEQ ID NO: 480999 - protein, 9 aa, Homo Sapiens
PLSEITKQE

SEQ ID NO: 481000 - protein, 9 aa, Homo Sapiens
GPCRGPDQQ

SEQ ID NO: 481001 - protein, 9 aa, Homo Sapiens
FFLLPFCGF

SEQ ID NO: 481002 - protein, 9 aa, Homo Sapiens
ETFWKRKSI

SEQ ID NO: 481003 - protein, 9 aa, Homo Sapiens
TDPMRLTQL

SEQ ID NO: 481004 - protein, 9 aa, Homo Sapiens
HMGLTGFRR

SEQ ID NO: 481005 - protein, 9 aa, Homo Sapiens
ANVIVIFVD

SEQ ID NO: 481006 - protein, 9 aa, Homo Sapiens
LNDLKNADP

SEQ ID NO: 481007 - protein, 9 aa, Homo Sapiens
LHIAIGRIK

SEQ ID NO: 481008 - protein, 9 aa, Homo Sapiens
DVSTVYGSS

SEQ ID NO: 481009 - protein, 9 aa, Homo Sapiens
LTTRLYLRK

SEQ ID NO: 481010 - protein, 9 aa, Homo Sapiens
TTNGKEDSL

SEQ ID NO: 481011 - protein, 9 aa, Homo Sapiens
PDLLQAKKD

SEQ ID NO: 481012 - protein, 9 aa, Homo Sapiens
IVPKWHGKP

SEQ ID NO: 481013 - protein, 9 aa, Homo Sapiens
DLVVTKYKI

SEQ ID NO: 481014 - protein, 9 aa, Homo Sapiens
KSITASVKA

SEQ ID NO: 481015 - protein, 9 aa, Homo Sapiens
VVQGKLRKL

SEQ ID NO: 481016 - protein, 9 aa, Homo Sapiens
IRHQRNHTG

SEQ ID NO: 481017 - protein, 9 aa, Homo Sapiens
EPVVRIFPP

SEQ ID NO: 481018 - protein, 9 aa, Homo Sapiens
ITTKQAPAL

SEQ ID NO: 481019 - protein, 9 aa, Homo Sapiens
PELYGSKGR

SEQ ID NO: 481020 - protein, 9 aa, Homo Sapiens
KNQAPMLMR

SEQ ID NO: 481021 - protein, 9 aa, Homo Sapiens
FKRIAQETF

SEQ ID NO: 481022 - protein, 9 aa, Homo Sapiens
SLDSWIAFK

SEQ ID NO: 481023 - protein, 9 aa, Homo Sapiens
RVAPQAISP

SEQ ID NO: 481024 - protein, 9 aa, Homo Sapiens
DGEMNNLHI

SEQ ID NO: 481025 - protein, 9 aa, Homo Sapiens
VAPQAISPR

SEQ ID NO: 481026 - protein, 9 aa, Homo Sapiens
AFQRQLTVL

SEQ ID NO: 481027 - protein, 9 aa, Homo Sapiens
EIELLKHEK

SEQ ID NO: 481028 - protein, 9 aa, Homo Sapiens
SQGTWKSAT

SEQ ID NO: 481029 - protein, 9 aa, Homo Sapiens
VKNFTGCIQ

SEQ ID NO: 481030 - protein, 9 aa, Homo Sapiens
GSGSSSSSG

SEQ ID NO: 481031 - protein, 9 aa, Homo Sapiens
INLSEGEGN

SEQ ID NO: 481032 - protein, 9 aa, Homo Sapiens
AMPTAAGMV

SEQ ID NO: 481033 - protein, 9 aa, Homo Sapiens
KPSNVGHHL

SEQ ID NO: 481034 - protein, 9 aa, Homo Sapiens
TTCKNAGTC

SEQ ID NO: 481035 - protein, 9 aa, Homo Sapiens
ALARRSTLA

SEQ ID NO: 481036 - protein, 9 aa, Homo Sapiens
HYVCKECRK

SEQ ID NO: 481037 - protein, 9 aa, Homo Sapiens
KIGGDIANR

SEQ ID NO: 481038 - protein, 9 aa, Homo Sapiens
LVRKAYMAD

SEQ ID NO: 481039 - protein, 9 aa, Homo Sapiens
LRTTNGKED

SEQ ID NO: 481040 - protein, 9 aa, Homo Sapiens
PDTRKPMHT

SEQ ID NO: 481041 - protein, 9 aa, Homo Sapiens
PFRCAHKDN

SEQ ID NO: 481042 - protein, 9 aa, Homo Sapiens
AFKYPGIAI

SEQ ID NO: 481043 - protein, 9 aa, Homo Sapiens
VLKSLCREE

SEQ ID NO: 481044 - protein, 9 aa, Homo Sapiens
QDIWPKQGK

SEQ ID NO: 481045 - protein, 9 aa, Homo Sapiens
NMNAFDKKD

SEQ ID NO: 481046 - protein, 9 aa, Homo Sapiens
TSFFSSSTL

SEQ ID NO: 481047 - protein, 9 aa, Homo Sapiens
LKDMQSIQD

SEQ ID NO: 481048 - protein, 9 aa, Homo Sapiens
KIVPKWHGK

SEQ ID NO: 481049 - protein, 9 aa, Homo Sapiens
AIQNAPNPA

SEQ ID NO: 481050 - protein, 9 aa, Homo Sapiens
NLTVNLAAS

SEQ ID NO: 481051 - protein, 9 aa, Homo Sapiens
ELKKQLKTV

SEQ ID NO: 481052 - protein, 9 aa, Homo Sapiens
HETILDRRA

SEQ ID NO: 481053 - protein, 9 aa, Homo Sapiens
VATPAKKHR

SEQ ID NO: 481054 - protein, 9 aa, Homo Sapiens
NSPDLLQAK

SEQ ID NO: 481055 - protein, 9 aa, Homo Sapiens
IARKSLFQK

SEQ ID NO: 481056 - protein, 9 aa, Homo Sapiens
PYYLAYVPR

SEQ ID NO: 481057 - protein, 9 aa, Homo Sapiens
RHCPHHERC

SEQ ID NO: 481058 - protein, 9 aa, Homo Sapiens
VLIGYDVTD

SEQ ID NO: 481059 - protein, 9 aa, Homo Sapiens
GKKTFQMYR

SEQ ID NO: 481060 - protein, 9 aa, Homo Sapiens
AEAHENKKI

SEQ ID NO: 481061 - protein, 9 aa, Homo Sapiens
SRLQEETAE

SEQ ID NO: 481062 - protein, 9 aa, Homo Sapiens
GAVTQFFLL

SEQ ID NO: 481063 - protein, 9 aa, Homo Sapiens
KDGFLHETI

SEQ ID NO: 481064 - protein, 9 aa, Homo Sapiens
VIVIFVDIG

SEQ ID NO: 481065 - protein, 9 aa, Homo Sapiens
LRREQEERE

SEQ ID NO: 481066 - protein, 9 aa, Homo Sapiens
MVFKRIAQE

SEQ ID NO: 481067 - protein, 9 aa, Homo Sapiens
LPFCGFLLS

SEQ ID NO: 481068 - protein, 9 aa, Homo Sapiens
KLNDLKNAD

SEQ ID NO: 481069 - protein, 9 aa, Homo Sapiens
QSIQDSLQS

SEQ ID NO: 481070 - protein, 9 aa, Homo Sapiens
PEQQPPHML

SEQ ID NO: 481071 - protein, 9 aa, Homo Sapiens
KYLDGKANM

SEQ ID NO: 481072 - protein, 9 aa, Homo Sapiens
ATPAKKHRA

SEQ ID NO: 481073 - protein, 9 aa, Homo Sapiens
ETLCALAVY

SEQ ID NO: 481074 - protein, 9 aa, Homo Sapiens
SPKPARTAP

SEQ ID NO: 481075 - protein, 9 aa, Homo Sapiens
IGITDQNEL

SEQ ID NO: 481076 - protein, 9 aa, Homo Sapiens
DHGPGQATQ

SEQ ID NO: 481077 - protein, 9 aa, Homo Sapiens
QDEQEKLLG

SEQ ID NO: 481078 - protein, 9 aa, Homo Sapiens
DYNIKLCEN

SEQ ID NO: 481079 - protein, 9 aa, Homo Sapiens
SYPPGKECD

SEQ ID NO: 481080 - protein, 9 aa, Homo Sapiens
HKFKTEWAS

SEQ ID NO: 481081 - protein, 9 aa, Homo Sapiens
ASPHETSET

SEQ ID NO: 481082 - protein, 9 aa, Homo Sapiens
PARTAPARP

SEQ ID NO: 481083 - protein, 9 aa, Homo Sapiens
NHWIRKLMS

SEQ ID NO: 481084 - protein, 9 aa, Homo Sapiens
VGTVLLEPL

SEQ ID NO: 481085 - protein, 9 aa, Homo Sapiens
EPLEEYVIR

SEQ ID NO: 481086 - protein, 9 aa, Homo Sapiens
RIQPQQCPA

SEQ ID NO: 481087 - protein, 9 aa, Homo Sapiens
GGPSRLTLP

SEQ ID NO: 481088 - protein, 9 aa, Homo Sapiens
NCESSTTSS

SEQ ID NO: 481089 - protein, 9 aa, Homo Sapiens
SSLTPQSFV

SEQ ID NO: 481090 - protein, 9 aa, Homo Sapiens
EISEIEYIG

SEQ ID NO: 481091 - protein, 9 aa, Homo Sapiens
REYGVPSLE

SEQ ID NO: 481092 - protein, 9 aa, Homo Sapiens
EDSYEEWTP

SEQ ID NO: 481093 - protein, 9 aa, Homo Sapiens
SGLFGQVFR

SEQ ID NO: 481094 - protein, 9 aa, Homo Sapiens
VLTMPCLTQ

SEQ ID NO: 481095 - protein, 9 aa, Homo Sapiens
EQLAKVYEQ

SEQ ID NO: 481096 - protein, 9 aa, Homo Sapiens
TRSLLLNHW

SEQ ID NO: 481097 - protein, 9 aa, Homo Sapiens
VMPREAGAR

SEQ ID NO: 481098 - protein, 9 aa, Homo Sapiens
PWRCEDELG

SEQ ID NO: 481099 - protein, 9 aa, Homo Sapiens
KPARTAPAR

SEQ ID NO: 481100 - protein, 9 aa, Homo Sapiens
CRNSEKFHI

SEQ ID NO: 481101 - protein, 9 aa, Homo Sapiens
PQQASPHET

SEQ ID NO: 481102 - protein, 9 aa, Homo Sapiens
GVCAGLLQE

SEQ ID NO: 481103 - protein, 9 aa, Homo Sapiens
TCKPLLKCT

SEQ ID NO: 481104 - protein, 9 aa, Homo Sapiens
YGAWYLKPM

SEQ ID NO: 481105 - protein, 9 aa, Homo Sapiens
YPESYPPGK

SEQ ID NO: 481106 - protein, 9 aa, Homo Sapiens
MPCLTQSTA

SEQ ID NO: 481107 - protein, 9 aa, Homo Sapiens
GAKQYKCNV

SEQ ID NO: 481108 - protein, 9 aa, Homo Sapiens
PLVLSCGHN

SEQ ID NO: 481109 - protein, 9 aa, Homo Sapiens
ILSPNYPES

SEQ ID NO: 481110 - protein, 9 aa, Homo Sapiens
PHETSETDH

SEQ ID NO: 481111 - protein, 9 aa, Homo Sapiens
QRGACMVQA

SEQ ID NO: 481112 - protein, 9 aa, Homo Sapiens
PSLETSAKT

SEQ ID NO: 481113 - protein, 9 aa, Homo Sapiens
DGVWAFLQT

SEQ ID NO: 481114 - protein, 9 aa, Homo Sapiens
PQQCPAGDG

SEQ ID NO: 481115 - protein, 9 aa, Homo Sapiens
SHSSTTHTV

SEQ ID NO: 481116 - protein, 9 aa, Homo Sapiens
GDGMLGEGL

SEQ ID NO: 481117 - protein, 9 aa, Homo Sapiens
ELHYSLSCR

SEQ ID NO: 481118 - protein, 9 aa, Homo Sapiens
PRRIATLHR

SEQ ID NO: 481119 - protein, 9 aa, Homo Sapiens
YRYLAVTNP

SEQ ID NO: 481120 - protein, 9 aa, Homo Sapiens
RPRGGLSLD

SEQ ID NO: 481121 - protein, 9 aa, Homo Sapiens
MLGKKLRSD

SEQ ID NO: 481122 - protein, 9 aa, Homo Sapiens
KSILFDAMN

SEQ ID NO: 481123 - protein, 9 aa, Homo Sapiens
WASVHLHSV

SEQ ID NO: 481124 - protein, 9 aa, Homo Sapiens
TFNISMHQS

SEQ ID NO: 481125 - protein, 9 aa, Homo Sapiens
DLLAGIELI

SEQ ID NO: 481126 - protein, 9 aa, Homo Sapiens
TVSSAPSTT

SEQ ID NO: 481127 - protein, 9 aa, Homo Sapiens
GVPSLETSA

SEQ ID NO: 481128 - protein, 9 aa, Homo Sapiens
AVQVPEETV

SEQ ID NO: 481129 - protein, 9 aa, Homo Sapiens
PGIRMFPIQ

SEQ ID NO: 481130 - protein, 9 aa, Homo Sapiens
AIVVRVQPA

SEQ ID NO: 481131 - protein, 9 aa, Homo Sapiens
PGSVDPWTR

SEQ ID NO: 481132 - protein, 9 aa, Homo Sapiens
PQDHGPGQA

SEQ ID NO: 481133 - protein, 9 aa, Homo Sapiens
VSSEITRIE

SEQ ID NO: 481134 - protein, 9 aa, Homo Sapiens
SVRSGLFGQ

SEQ ID NO: 481135 - protein, 9 aa, Homo Sapiens
PLEEYVIRT

SEQ ID NO: 481136 - protein, 9 aa, Homo Sapiens
TCGVTKVFL

SEQ ID NO: 481137 - protein, 9 aa, Homo Sapiens
LLTPQDHGP

SEQ ID NO: 481138 - protein, 9 aa, Homo Sapiens
TPLTVTSPS

SEQ ID NO: 481139 - protein, 9 aa, Homo Sapiens
YNIKLCENA

SEQ ID NO: 481140 - protein, 9 aa, Homo Sapiens
EPPRRIATL

SEQ ID NO: 481141 - protein, 9 aa, Homo Sapiens
CPRQADTVC

SEQ ID NO: 481142 - protein, 9 aa, Homo Sapiens
DPAGSWTCG

SEQ ID NO: 481143 - protein, 9 aa, Homo Sapiens
FIVVLEARE

SEQ ID NO: 481144 - protein, 9 aa, Homo Sapiens
LMSSSLTPQ

SEQ ID NO: 481145 - protein, 9 aa, Homo Sapiens
QEPPRRIAT

SEQ ID NO: 481146 - protein, 9 aa, Homo Sapiens
DTEDSYEEW

SEQ ID NO: 481147 - protein, 9 aa, Homo Sapiens
LFCTCGVTK

SEQ ID NO: 481148 - protein, 9 aa, Homo Sapiens
PRGGLSLDL

SEQ ID NO: 481149 - protein, 9 aa, Homo Sapiens
QCPAGDGML

SEQ ID NO: 481150 - protein, 9 aa, Homo Sapiens
RVQPALGGV

SEQ ID NO: 481151 - protein, 9 aa, Homo Sapiens
TMPCLTQST

SEQ ID NO: 481152 - protein, 9 aa, Homo Sapiens
ADLLAGIEL

SEQ ID NO: 481153 - protein, 9 aa, Homo Sapiens
RQKLKWAVA

SEQ ID NO: 481154 - protein, 9 aa, Homo Sapiens
EPLADVLLT

SEQ ID NO: 481155 - protein, 9 aa, Homo Sapiens
QFLKLACSD

SEQ ID NO: 481156 - protein, 9 aa, Homo Sapiens
SVRQLIENA

SEQ ID NO: 481157 - protein, 9 aa, Homo Sapiens
CESSTTSSG

SEQ ID NO: 481158 - protein, 9 aa, Homo Sapiens
TVCSRRVRQ

SEQ ID NO: 481159 - protein, 9 aa, Homo Sapiens
GMLGEGLHV

SEQ ID NO: 481160 - protein, 9 aa, Homo Sapiens
GIELITNFV

SEQ ID NO: 481161 - protein, 9 aa, Homo Sapiens
SKGDTTPLT

SEQ ID NO: 481162 - protein, 9 aa, Homo Sapiens
FGEFPWRCE

SEQ ID NO: 481163 - protein, 9 aa, Homo Sapiens
SDGLAPPQL

SEQ ID NO: 481164 - protein, 9 aa, Homo Sapiens
GNVFIIILS

SEQ ID NO: 481165 - protein, 9 aa, Homo Sapiens
LTMPCLTQS

SEQ ID NO: 481166 - protein, 9 aa, Homo Sapiens
DTVCSRRVR

SEQ ID NO: 481167 - protein, 9 aa, Homo Sapiens
LCALAVYRY

SEQ ID NO: 481168 - protein, 9 aa, Homo Sapiens
LDPAGSWTC

SEQ ID NO: 481169 - protein, 9 aa, Homo Sapiens
NVFIIILSY

SEQ ID NO: 481170 - protein, 9 aa, Homo Sapiens
YQLKTIIRM

SEQ ID NO: 481171 - protein, 9 aa, Homo Sapiens
LSPGSVDPW

SEQ ID NO: 481172 - protein, 9 aa, Homo Sapiens
LHSVFAVGT

SEQ ID NO: 481173 - protein, 9 aa, Homo Sapiens
SRRVRQKLK

SEQ ID NO: 481174 - protein, 9 aa, Homo Sapiens
KRAVQVPEE

SEQ ID NO: 481175 - protein, 9 aa, Homo Sapiens
SELHYSLSC

SEQ ID NO: 481176 - protein, 9 aa, Homo Sapiens
IELITNFVF

SEQ ID NO: 481177 - protein, 9 aa, Homo Sapiens
LRIQPQQCP

SEQ ID NO: 481178 - protein, 9 aa, Homo Sapiens
QELDWPAAG

SEQ ID NO: 481179 - protein, 9 aa, Homo Sapiens
SPNYPESYP

SEQ ID NO: 481180 - protein, 9 aa, Homo Sapiens
HLHSVFAVG

SEQ ID NO: 481181 - protein, 9 aa, Homo Sapiens
VTRSLLLNH

SEQ ID NO: 481182 - protein, 9 aa, Homo Sapiens
STATNCESS

SEQ ID NO: 481183 - protein, 9 aa, Homo Sapiens
TFVYIHMSG

SEQ ID NO: 481184 - protein, 9 aa, Homo Sapiens
LLLNHWIRK

SEQ ID NO: 481185 - protein, 9 aa, Homo Sapiens
SLSCRNSEK

SEQ ID NO: 481186 - protein, 9 aa, Homo Sapiens
NFVCDPSQF

SEQ ID NO: 481187 - protein, 9 aa, Homo Sapiens
TPQSFVLIS

SEQ ID NO: 481188 - protein, 9 aa, Homo Sapiens
KYLYNWLEV

SEQ ID NO: 481189 - protein, 9 aa, Homo Sapiens
ATNCESSTT

SEQ ID NO: 481190 - protein, 9 aa, Homo Sapiens
MHQSWWMEN

SEQ ID NO: 481191 - protein, 9 aa, Homo Sapiens
IPVSSEITR

SEQ ID NO: 481192 - protein, 9 aa, Homo Sapiens
ANMDALPLS

SEQ ID NO: 481193 - protein, 9 aa, Homo Sapiens
LGGVCAGLL

SEQ ID NO: 481194 - protein, 9 aa, Homo Sapiens
LTFNISMHQ

SEQ ID NO: 481195 - protein, 9 aa, Homo Sapiens
LSLDLSSVN

SEQ ID NO: 481196 - protein, 9 aa, Homo Sapiens
VYIHMSGYC

SEQ ID NO: 481197 - protein, 9 aa, Homo Sapiens
GDTTPLTVT

SEQ ID NO: 481198 - protein, 9 aa, Homo Sapiens
TRIKKRYRS

SEQ ID NO: 481199 - protein, 9 aa, Homo Sapiens
VLLEPLADV

SEQ ID NO: 481200 - protein, 9 aa, Homo Sapiens
GLAPPQLLI

SEQ ID NO: 481201 - protein, 9 aa, Homo Sapiens
IRKLMSSSL

SEQ ID NO: 481202 - protein, 9 aa, Homo Sapiens
TLCALAVYR

SEQ ID NO: 481203 - protein, 9 aa, Homo Sapiens
VDDTEDSYE

SEQ ID NO: 481204 - protein, 9 aa, Homo Sapiens
HFVGVDGVW

SEQ ID NO: 481205 - protein, 9 aa, Homo Sapiens
ENAVLNKKL

SEQ ID NO: 481206 - protein, 9 aa, Homo Sapiens
CDPSQFLKL

SEQ ID NO: 481207 - protein, 9 aa, Homo Sapiens
QEKLLGEAI

SEQ ID NO: 481208 - protein, 9 aa, Homo Sapiens
RKGGPSRLT

SEQ ID NO: 481209 - protein, 9 aa, Homo Sapiens
YLMTLTGNV

SEQ ID NO: 481210 - protein, 9 aa, Homo Sapiens
VTRIKKRYR

SEQ ID NO: 481211 - protein, 9 aa, Homo Sapiens
QDHGPGQAT

SEQ ID NO: 481212 - protein, 9 aa, Homo Sapiens
QRKGGPSRL

SEQ ID NO: 481213 - protein, 9 aa, Homo Sapiens
TEDSYEEWT

SEQ ID NO: 481214 - protein, 9 aa, Homo Sapiens
PYNATLSVR

SEQ ID NO: 481215 - protein, 9 aa, Homo Sapiens
AAGVMPREA

SEQ ID NO: 481216 - protein, 9 aa, Homo Sapiens
GSWTCGQPG

SEQ ID NO: 481217 - protein, 9 aa, Homo Sapiens
VLLTPQDHG

SEQ ID NO: 481218 - protein, 9 aa, Homo Sapiens
QNLIHKKFS

SEQ ID NO: 481219 - protein, 9 aa, Homo Sapiens
EITKQEKDF

SEQ ID NO: 481220 - protein, 9 aa, Homo Sapiens
QKLKWAVAS

SEQ ID NO: 481221 - protein, 9 aa, Homo Sapiens
YRSVFYRLT

SEQ ID NO: 481222 - protein, 9 aa, Homo Sapiens
PAGDGMLGE

SEQ ID NO: 481223 - protein, 9 aa, Homo Sapiens
TPQDHGPGQ

SEQ ID NO: 481224 - protein, 9 aa, Homo Sapiens
ADTVCSRRV

SEQ ID NO: 481225 - protein, 9 aa, Homo Sapiens
GACMVQAIV

SEQ ID NO: 481226 - protein, 9 aa, Homo Sapiens
YLYNWLEVE

SEQ ID NO: 481227 - protein, 9 aa, Homo Sapiens
QQASPHETS

SEQ ID NO: 481228 - protein, 9 aa, Homo Sapiens
GEFPWRCED

SEQ ID NO: 481229 - protein, 9 aa, Homo Sapiens
KQEKDFLWS

SEQ ID NO: 481230 - protein, 9 aa, Homo Sapiens
RGACMVQAI

SEQ ID NO: 481231 - protein, 9 aa, Homo Sapiens
EQPDSWQPY

SEQ ID NO: 481232 - protein, 9 aa, Homo Sapiens
IETEPLEEY

SEQ ID NO: 481233 - protein, 9 aa, Homo Sapiens
IATLHRKCK

SEQ ID NO: 481234 - protein, 9 aa, Homo Sapiens
STTIPVSSE

SEQ ID NO: 481235 - protein, 9 aa, Homo Sapiens
VSSLAWAKG

SEQ ID NO: 481236 - protein, 9 aa, Homo Sapiens
QAIVVRVQP

SEQ ID NO: 481237 - protein, 9 aa, Homo Sapiens
ATQRGACMV

SEQ ID NO: 481238 - protein, 9 aa, Homo Sapiens
TTECFPLAA

SEQ ID NO: 481239 - protein, 9 aa, Homo Sapiens
SVDPWTRLV

SEQ ID NO: 481240 - protein, 9 aa, Homo Sapiens
LIETEPLEE

SEQ ID NO: 481241 - protein, 9 aa, Homo Sapiens
ECFPLAAMA

SEQ ID NO: 481242 - protein, 9 aa, Homo Sapiens
RQMNEQLAK

SEQ ID NO: 481243 - protein, 9 aa, Homo Sapiens
GAWYLKPML

SEQ ID NO: 481244 - protein, 9 aa, Homo Sapiens
RSGLFGQVF

SEQ ID NO: 481245 - protein, 9 aa, Homo Sapiens
ELDWPAAGR

SEQ ID NO: 481246 - protein, 9 aa, Homo Sapiens
TVLLEPLAD

SEQ ID NO: 481247 - protein, 9 aa, Homo Sapiens
LGEPHKFKT

SEQ ID NO: 481248 - protein, 9 aa, Homo Sapiens
YGVPSLETS

SEQ ID NO: 481249 - protein, 9 aa, Homo Sapiens
SMHQSWWME

SEQ ID NO: 481250 - protein, 9 aa, Homo Sapiens
LLGEAIQAV

SEQ ID NO: 481251 - protein, 9 aa, Homo Sapiens
TKQEKDFLW

SEQ ID NO: 481252 - protein, 9 aa, Homo Sapiens
TSLVTLPGF

SEQ ID NO: 481253 - protein, 9 aa, Homo Sapiens
RMKILFIVV

SEQ ID NO: 481254 - protein, 9 aa, Homo Sapiens
ISMHQSWWM

SEQ ID NO: 481255 - protein, 9 aa, Homo Sapiens
PEVKYLYNW

SEQ ID NO: 481256 - protein, 9 aa, Homo Sapiens
SCRNSEKFH

SEQ ID NO: 481257 - protein, 9 aa, Homo Sapiens
RPLAAGVMP

SEQ ID NO: 481258 - protein, 9 aa, Homo Sapiens
MQITKSDSI

SEQ ID NO: 481259 - protein, 9 aa, Homo Sapiens
LTGNVFIII

SEQ ID NO: 481260 - protein, 9 aa, Homo Sapiens
RTAPARPRG

SEQ ID NO: 481261 - protein, 9 aa, Homo Sapiens
AREYGVPSL

SEQ ID NO: 481262 - protein, 9 aa, Homo Sapiens
SWIGLRNLY

SEQ ID NO: 481263 - protein, 9 aa, Homo Sapiens
GLSLDLSSV

SEQ ID NO: 481264 - protein, 9 aa, Homo Sapiens
TTIPVSSEI

SEQ ID NO: 481265 - protein, 9 aa, Homo Sapiens
VQVPEETVT

SEQ ID NO: 481266 - protein, 9 aa, Homo Sapiens
NGEKSILFD

SEQ ID NO: 481267 - protein, 9 aa, Homo Sapiens
IVSTTIPVS

SEQ ID NO: 481268 - protein, 9 aa, Homo Sapiens
THTVSSAPS

SEQ ID NO: 481269 - protein, 9 aa, Homo Sapiens
AGSWTCGQP

SEQ ID NO: 481270 - protein, 9 aa, Homo Sapiens
VQPQQASPH

SEQ ID NO: 481271 - protein, 9 aa, Homo Sapiens
CFPLAAMAY

SEQ ID NO: 481272 - protein, 9 aa, Homo Sapiens
PPRRIATLH

SEQ ID NO: 481273 - protein, 9 aa, Homo Sapiens
NATLSVRQL

SEQ ID NO: 481274 - protein, 9 aa, Homo Sapiens
PIQYNGTYD

SEQ ID NO: 481275 - protein, 9 aa, Homo Sapiens
CGQPGSQVP

SEQ ID NO: 481276 - protein, 9 aa, Homo Sapiens
DLSTFVYIH

SEQ ID NO: 481277 - protein, 9 aa, Homo Sapiens
SQANMDALP

SEQ ID NO: 481278 - protein, 9 aa, Homo Sapiens
MWLVSSLAW

SEQ ID NO: 481279 - protein, 9 aa, Homo Sapiens
EYIGITDQN

SEQ ID NO: 481280 - protein, 9 aa, Homo Sapiens
ELQRKGGPS

SEQ ID NO: 481281 - protein, 9 aa, Homo Sapiens
TSSNWGSSF

SEQ ID NO: 481282 - protein, 9 aa, Homo Sapiens
MTLTGNVFI

SEQ ID NO: 481283 - protein, 9 aa, Homo Sapiens
GLFGQVFRP

SEQ ID NO: 481284 - protein, 9 aa, Homo Sapiens
RQLIENADE

SEQ ID NO: 481285 - protein, 9 aa, Homo Sapiens
KTEWASVMR

SEQ ID NO: 481286 - protein, 9 aa, Homo Sapiens
YQEPPRRIA

SEQ ID NO: 481287 - protein, 9 aa, Homo Sapiens
FPWRCEDEL

SEQ ID NO: 481288 - protein, 9 aa, Homo Sapiens
ISEIEYIGI

SEQ ID NO: 481289 - protein, 9 aa, Homo Sapiens
CENAVLNKK

SEQ ID NO: 481290 - protein, 9 aa, Homo Sapiens
CLEQPDSWQ

SEQ ID NO: 481291 - protein, 9 aa, Homo Sapiens
TFGTTECFP

SEQ ID NO: 481292 - protein, 9 aa, Homo Sapiens
VDEVVVGTV

SEQ ID NO: 481293 - protein, 9 aa, Homo Sapiens
LPLSPYPFV

SEQ ID NO: 481294 - protein, 9 aa, Homo Sapiens
GITDQNELS

SEQ ID NO: 481295 - protein, 9 aa, Homo Sapiens
KTIIRMVKK

SEQ ID NO: 481296 - protein, 9 aa, Homo Sapiens
IKKYLTAEQ

SEQ ID NO: 481297 - protein, 9 aa, Homo Sapiens
NDWFRDPLV

SEQ ID NO: 481298 - protein, 9 aa, Homo Sapiens
WAFLQTYSH

SEQ ID NO: 481299 - protein, 9 aa, Homo Sapiens
FRDPLVLSC

SEQ ID NO: 481300 - protein, 9 aa, Homo Sapiens
SEGPRTSSN

SEQ ID NO: 481301 - protein, 9 aa, Homo Sapiens
LTPQDHGPG

SEQ ID NO: 481302 - protein, 9 aa, Homo Sapiens
MIPVPYIEK

SEQ ID NO: 481303 - protein, 9 aa, Homo Sapiens
VSSAPSTTS

SEQ ID NO: 481304 - protein, 9 aa, Homo Sapiens
QMNEQLAKV

SEQ ID NO: 481305 - protein, 9 aa, Homo Sapiens
CALAVYRYL

SEQ ID NO: 481306 - protein, 9 aa, Homo Sapiens
IPGIRMFPI

SEQ ID NO: 481307 - protein, 9 aa, Homo Sapiens
AWYLKPMLG

SEQ ID NO: 481308 - protein, 9 aa, Homo Sapiens
PVSSEITRI

SEQ ID NO: 481309 - protein, 9 aa, Homo Sapiens
SVTRIKKRY

SEQ ID NO: 481310 - protein, 9 aa, Homo Sapiens
PESYPPGKE

SEQ ID NO: 481311 - protein, 9 aa, Homo Sapiens
SYQEPPRRI

SEQ ID NO: 481312 - protein, 9 aa, Homo Sapiens
TAPARPRGG

SEQ ID NO: 481313 - protein, 9 aa, Homo Sapiens
RSLLLNHWI

SEQ ID NO: 481314 - protein, 9 aa, Homo Sapiens
QVDDTEDSY

SEQ ID NO: 481315 - protein, 9 aa, Homo Sapiens
QLKTIIRMV

SEQ ID NO: 481316 - protein, 9 aa, Homo Sapiens
SRLTLPSKS

SEQ ID NO: 481317 - protein, 9 aa, Homo Sapiens
QSWWMENGP

SEQ ID NO: 481318 - protein, 9 aa, Homo Sapiens
APARPRGGL

SEQ ID NO: 481319 - protein, 9 aa, Homo Sapiens
LEEYVIRTF

SEQ ID NO: 481320 - protein, 9 aa, Homo Sapiens
GVTKVFLLA

SEQ ID NO: 481321 - protein, 9 aa, Homo Sapiens
FATNGEKSI

SEQ ID NO: 481322 - protein, 9 aa, Homo Sapiens
QQCPAGDGM

SEQ ID NO: 481323 - protein, 9 aa, Homo Sapiens
YEEWTPRQQ

SEQ ID NO: 481324 - protein, 9 aa, Homo Sapiens
NIKLCENAV

SEQ ID NO: 481325 - protein, 9 aa, Homo Sapiens
SILFDAMNM

SEQ ID NO: 481326 - protein, 9 aa, Homo Sapiens
HIYQLKTII

SEQ ID NO: 481327 - protein, 9 aa, Homo Sapiens
GINTNTNNL

SEQ ID NO: 481328 - protein, 9 aa, Homo Sapiens
VSTTIPVSS

SEQ ID NO: 481329 - protein, 9 aa, Homo Sapiens
LKTIIRMVK

SEQ ID NO: 481330 - protein, 9 aa, Homo Sapiens
EEGSEMQIT

SEQ ID NO: 481331 - protein, 9 aa, Homo Sapiens
TEWASVMRC

SEQ ID NO: 481332 - protein, 9 aa, Homo Sapiens
ASVHLHSVF

SEQ ID NO: 481333 - protein, 9 aa, Homo Sapiens
AKQYKCNVC

SEQ ID NO: 481334 - protein, 9 aa, Homo Sapiens
KCTSLVTLP

SEQ ID NO: 481335 - protein, 9 aa, Homo Sapiens
RRSPKPART

SEQ ID NO: 481336 - protein, 9 aa, Homo Sapiens
SLLLNHWIR

SEQ ID NO: 481337 - protein, 9 aa, Homo Sapiens
ALAVYRYLA

SEQ ID NO: 481338 - protein, 9 aa, Homo Sapiens
PSQFLKLAC

SEQ ID NO: 481339 - protein, 9 aa, Homo Sapiens
PQLLIRVEG

SEQ ID NO: 481340 - protein, 9 aa, Homo Sapiens
VRVQPALGG

SEQ ID NO: 481341 - protein, 9 aa, Homo Sapiens
NNLFCSIIA

SEQ ID NO: 481342 - protein, 9 aa, Homo Sapiens
SDLSTFVYI

SEQ ID NO: 481343 - protein, 9 aa, Homo Sapiens
TAEQIMTCV

SEQ ID NO: 481344 - protein, 9 aa, Homo Sapiens
EQEKLLGEA

SEQ ID NO: 481345 - protein, 9 aa, Homo Sapiens
QPGSQVPDL

SEQ ID NO: 481346 - protein, 9 aa, Homo Sapiens
PALGGVCAG

SEQ ID NO: 481347 - protein, 9 aa, Homo Sapiens
NLIHKKFSP

SEQ ID NO: 481348 - protein, 9 aa, Homo Sapiens
GVWAFLQTY

SEQ ID NO: 481349 - protein, 9 aa, Homo Sapiens
TNTNNLFCS

SEQ ID NO: 481350 - protein, 9 aa, Homo Sapiens
GGRLDPAGS

SEQ ID NO: 481351 - protein, 9 aa, Homo Sapiens
WYLKPMLGK

SEQ ID NO: 481352 - protein, 9 aa, Homo Sapiens
VKYLYNWLE

SEQ ID NO: 481353 - protein, 9 aa, Homo Sapiens
MVQAIVVRV

SEQ ID NO: 481354 - protein, 9 aa, Homo Sapiens
LFIVVLEAR

SEQ ID NO: 481355 - protein, 9 aa, Homo Sapiens
VDGVWAFLQ

SEQ ID NO: 481356 - protein, 9 aa, Homo Sapiens
KLCENAVLN

SEQ ID NO: 481357 - protein, 9 aa, Homo Sapiens
DTTPLTVTS

SEQ ID NO: 481358 - protein, 9 aa, Homo Sapiens
GLLQELDWP

SEQ ID NO: 481359 - protein, 9 aa, Homo Sapiens
GLCCVLTMP

SEQ ID NO: 481360 - protein, 9 aa, Homo Sapiens
HYESFGEFP

SEQ ID NO: 481361 - protein, 9 aa, Homo Sapiens
PGSQVPDLQ

SEQ ID NO: 481362 - protein, 9 aa, Homo Sapiens
ALPLSPYPF

SEQ ID NO: 481363 - protein, 9 aa, Homo Sapiens
EIEYIGITD

SEQ ID NO: 481364 - protein, 9 aa, Homo Sapiens
SVFAVGTLL

SEQ ID NO: 481365 - protein, 9 aa, Homo Sapiens
IGLRNLYLK

SEQ ID NO: 481366 - protein, 9 aa, Homo Sapiens
PWTRLVLVN

SEQ ID NO: 481367 - protein, 9 aa, Homo Sapiens
DIVSTTIPV

SEQ ID NO: 481368 - protein, 9 aa, Homo Sapiens
KKYLTAEQI

SEQ ID NO: 481369 - protein, 9 aa, Homo Sapiens
ILFIVVLEA

SEQ ID NO: 481370 - protein, 9 aa, Homo Sapiens
FMWLVSSLA

SEQ ID NO: 481371 - protein, 9 aa, Homo Sapiens
VQAIVVRVQ

SEQ ID NO: 481372 - protein, 9 aa, Homo Sapiens
KRYRSVFYR

SEQ ID NO: 481373 - protein, 9 aa, Homo Sapiens
AVYRYLAVT

SEQ ID NO: 481374 - protein, 9 aa, Homo Sapiens
NISYSVTRS

SEQ ID NO: 481375 - protein, 9 aa, Homo Sapiens
CTCGVTKVF

SEQ ID NO: 481376 - protein, 9 aa, Homo Sapiens
DSWQPYGSS

SEQ ID NO: 481377 - protein, 9 aa, Homo Sapiens
TIPVSSEIT

SEQ ID NO: 481378 - protein, 9 aa, Homo Sapiens
QPQQCPAGD

SEQ ID NO: 481379 - protein, 9 aa, Homo Sapiens
CGVTKVFLL

SEQ ID NO: 481380 - protein, 9 aa, Homo Sapiens
LKWAVASTS

SEQ ID NO: 481381 - protein, 9 aa, Homo Sapiens
ELITNFVFA

SEQ ID NO: 481382 - protein, 9 aa, Homo Sapiens
ARCPRQADT

SEQ ID NO: 481383 - protein, 9 aa, Homo Sapiens
VHLHSVFAV

SEQ ID NO: 481384 - protein, 9 aa, Homo Sapiens
GPRTSSNWG

SEQ ID NO: 481385 - protein, 9 aa, Homo Sapiens
VGINTNTNN

SEQ ID NO: 481386 - protein, 9 aa, Homo Sapiens
AGDGMLGEG

SEQ ID NO: 481387 - protein, 9 aa, Homo Sapiens
KFKTEWASV

SEQ ID NO: 481388 - protein, 9 aa, Homo Sapiens
LVLSCGHNF

SEQ ID NO: 481389 - protein, 9 aa, Homo Sapiens
DGMLGEGLH

SEQ ID NO: 481390 - protein, 9 aa, Homo Sapiens
GARCPRQAD

SEQ ID NO: 481391 - protein, 9 aa, Homo Sapiens
WQPYGSSFY

SEQ ID NO: 481392 - protein, 9 aa, Homo Sapiens
LDWPAAGRP

SEQ ID NO: 481393 - protein, 9 aa, Homo Sapiens
QLLRIQPQQ

SEQ ID NO: 481394 - protein, 9 aa, Homo Sapiens
DPWTRLVLV

SEQ ID NO: 481395 - protein, 9 aa, Homo Sapiens
ITKQEKDFL

SEQ ID NO: 481396 - protein, 9 aa, Homo Sapiens
ALGGVCAGL

SEQ ID NO: 481397 - protein, 9 aa, Homo Sapiens
AEQIMTCVA

SEQ ID NO: 481398 - protein, 9 aa, Homo Sapiens
LSTFVYIHM

SEQ ID NO: 481399 - protein, 9 aa, Homo Sapiens
NMDALPLSP

SEQ ID NO: 481400 - protein, 9 aa, Homo Sapiens
GEPHKFKTE

SEQ ID NO: 481401 - protein, 9 aa, Homo Sapiens
RKLMSSSLT

SEQ ID NO: 481402 - protein, 9 aa, Homo Sapiens
PAAGRPLAA

SEQ ID NO: 481403 - protein, 9 aa, Homo Sapiens
LCCVLTMPC

SEQ ID NO: 481404 - protein, 9 aa, Homo Sapiens
HVDEVVVGT

SEQ ID NO: 481405 - protein, 9 aa, Homo Sapiens
FPLAAMAYD

SEQ ID NO: 481406 - protein, 9 aa, Homo Sapiens
WAVASTSRR

SEQ ID NO: 481407 - protein, 9 aa, Homo Sapiens
VQPALGGVC

SEQ ID NO: 481408 - protein, 9 aa, Homo Sapiens
AGARCPRQA

SEQ ID NO: 481409 - protein, 9 aa, Homo Sapiens
PPQLLIRVE

SEQ ID NO: 481410 - protein, 9 aa, Homo Sapiens
HKKFSPSPL

SEQ ID NO: 481411 - protein, 9 aa, Homo Sapiens
TLSVRQLIE

SEQ ID NO: 481412 - protein, 9 aa, Homo Sapiens
PLAAMAYDH

SEQ ID NO: 481413 - protein, 9 aa, Homo Sapiens
VDPWTRLVL

SEQ ID NO: 481414 - protein, 9 aa, Homo Sapiens
REAGARCPR

SEQ ID NO: 481415 - protein, 9 aa, Homo Sapiens
DSVRSGLFG

SEQ ID NO: 481416 - protein, 9 aa, Homo Sapiens
RSPKPARTA

SEQ ID NO: 481417 - protein, 9 aa, Homo Sapiens
LAPPQLLIR

SEQ ID NO: 481418 - protein, 9 aa, Homo Sapiens
EYGVPSLET

SEQ ID NO: 481419 - protein, 9 aa, Homo Sapiens
LLNHWIRKL

SEQ ID NO: 481420 - protein, 9 aa, Homo Sapiens
EGLHVDEVV

SEQ ID NO: 481421 - protein, 9 aa, Homo Sapiens
EAGARCPRQ

SEQ ID NO: 481422 - protein, 9 aa, Homo Sapiens
ICLQNLIHK

SEQ ID NO: 481423 - protein, 9 aa, Homo Sapiens
SYEEWTPRQ

SEQ ID NO: 481424 - protein, 9 aa, Homo Sapiens
LADLLAGIE

SEQ ID NO: 481425 - protein, 9 aa, Homo Sapiens
AGRPLAAGV

SEQ ID NO: 481426 - protein, 9 aa, Homo Sapiens
LAREYGVPS

SEQ ID NO: 481427 - protein, 9 aa, Homo Sapiens
AFMWLVSSL

SEQ ID NO: 481428 - protein, 9 aa, Homo Sapiens
RVRQKLKWA

SEQ ID NO: 481429 - protein, 9 aa, Homo Sapiens
TNCESSTTS

SEQ ID NO: 481430 - protein, 9 aa, Homo Sapiens
FSDLSTFVY

SEQ ID NO: 481431 - protein, 9 aa, Homo Sapiens
MLGEGLHVD

SEQ ID NO: 481432 - protein, 9 aa, Homo Sapiens
LHYSLSCRN

SEQ ID NO: 481433 - protein, 9 aa, Homo Sapiens
YSVTRSLLL

SEQ ID NO: 481434 - protein, 9 aa, Homo Sapiens
MPREAGARC

SEQ ID NO: 481435 - protein, 9 aa, Homo Sapiens
PHKFKTEWA

SEQ ID NO: 481436 - protein, 9 aa, Homo Sapiens
YESFGEFPW

SEQ ID NO: 481437 - protein, 9 aa, Homo Sapiens
INTNTNNLF

SEQ ID NO: 481438 - protein, 9 aa, Homo Sapiens
AVASTSRRS

SEQ ID NO: 481439 - protein, 9 aa, Homo Sapiens
APPQLLIRV

SEQ ID NO: 481440 - protein, 9 aa, Homo Sapiens
FKTEWASVM

SEQ ID NO: 481441 - protein, 9 aa, Homo Sapiens
HQSWWMENG

SEQ ID NO: 481442 - protein, 9 aa, Homo Sapiens
RYRSVFYRL

SEQ ID NO: 481443 - protein, 9 aa, Homo Sapiens
LRNLYLKGE

SEQ ID NO: 481444 - protein, 9 aa, Homo Sapiens
LAVYRYLAV

SEQ ID NO: 481445 - protein, 9 aa, Homo Sapiens
GSEMQITKS

SEQ ID NO: 481446 - protein, 9 aa, Homo Sapiens
DWFRDPLVL

SEQ ID NO: 481447 - protein, 9 aa, Homo Sapiens
LLRIQPQQC

SEQ ID NO: 481448 - protein, 9 aa, Homo Sapiens
SSLAWAKGL

SEQ ID NO: 481449 - protein, 9 aa, Homo Sapiens
IEKYRPASA

SEQ ID NO: 481450 - protein, 9 aa, Homo Sapiens
MNEQLAKVY

SEQ ID NO: 481451 - protein, 9 aa, Homo Sapiens
NVCGKVFNQ

SEQ ID NO: 481452 - protein, 9 aa, Homo Sapiens
LLEPLADVL

SEQ ID NO: 481453 - protein, 9 aa, Homo Sapiens
LEQPDSWQP

SEQ ID NO: 481454 - protein, 9 aa, Homo Sapiens
QYKCNVCGK

SEQ ID NO: 481455 - protein, 9 aa, Homo Sapiens
LEPLADVLL

SEQ ID NO: 481456 - protein, 9 aa, Homo Sapiens
DPSQFLKLA

SEQ ID NO: 481457 - protein, 9 aa, Homo Sapiens
TKSDSIHHM

SEQ ID NO: 481458 - protein, 9 aa, Homo Sapiens
CSRRVRQKL

SEQ ID NO: 481459 - protein, 9 aa, Homo Sapiens
FGTTECFPL

SEQ ID NO: 481460 - protein, 9 aa, Homo Sapiens
EIRNISYSV

SEQ ID NO: 481461 - protein, 9 aa, Homo Sapiens
PLLKCTSLV

SEQ ID NO: 481462 - protein, 9 aa, Homo Sapiens
DDTEDSYEE

SEQ ID NO: 481463 - protein, 9 aa, Homo Sapiens
IIRMVKKTY

SEQ ID NO: 481464 - protein, 9 aa, Homo Sapiens
VCDPSQFLK

SEQ ID NO: 481465 - protein, 9 aa, Homo Sapiens
PSRLTLPSK

SEQ ID NO: 481466 - protein, 9 aa, Homo Sapiens
ASTSRRSPK

SEQ ID NO: 481467 - protein, 9 aa, Homo Sapiens
LCENAVLNK

SEQ ID NO: 481468 - protein, 9 aa, Homo Sapiens
TNGEKSILF

SEQ ID NO: 481469 - protein, 9 aa, Homo Sapiens
CLQNLIHKK

SEQ ID NO: 481470 - protein, 9 aa, Homo Sapiens
DGLAPPQLL

SEQ ID NO: 481471 - protein, 9 aa, Homo Sapiens
LQLLRIQPQ

SEQ ID NO: 481472 - protein, 9 aa, Homo Sapiens
FVCDPSQFL

SEQ ID NO: 481473 - protein, 9 aa, Homo Sapiens
CTSLVTLPG

SEQ ID NO: 481474 - protein, 9 aa, Homo Sapiens
LTAEQIMTC

SEQ ID NO: 481475 - protein, 9 aa, Homo Sapiens
GMIPVPYIE

SEQ ID NO: 481476 - protein, 9 aa, Homo Sapiens
DPLSEITKQ

SEQ ID NO: 481477 - protein, 9 aa, Homo Sapiens
LAAGVMPRE

SEQ ID NO: 481478 - protein, 9 aa, Homo Sapiens
LYLKGEFIW

SEQ ID NO: 481479 - protein, 9 aa, Homo Sapiens
LSPNYPESY

SEQ ID NO: 481480 - protein, 9 aa, Homo Sapiens
RGGLSLDLS

SEQ ID NO: 481481 - protein, 9 aa, Homo Sapiens
RIKKYLTAE

SEQ ID NO: 481482 - protein, 9 aa, Homo Sapiens
SLTPQSFVL

SEQ ID NO: 481483 - protein, 9 aa, Homo Sapiens
HWIRKLMSS

SEQ ID NO: 481484 - protein, 9 aa, Homo Sapiens
CKPLLKCTS

SEQ ID NO: 481485 - protein, 9 aa, Homo Sapiens
IRMFPIQYN

SEQ ID NO: 481486 - protein, 9 aa, Homo Sapiens
GEAIQAVKV

SEQ ID NO: 481487 - protein, 9 aa, Homo Sapiens
VRQKLKWAV

SEQ ID NO: 481488 - protein, 9 aa, Homo Sapiens
LFGQVFRPD

SEQ ID NO: 481489 - protein, 9 aa, Homo Sapiens
SRNKRAVQV

SEQ ID NO: 481490 - protein, 9 aa, Homo Sapiens
STSRRSPKP

SEQ ID NO: 481491 - protein, 9 aa, Homo Sapiens
YLKPMLGKK

SEQ ID NO: 481492 - protein, 9 aa, Homo Sapiens
YSQANMDAL

SEQ ID NO: 481493 - protein, 9 aa, Homo Sapiens
NKRAVQVPE

SEQ ID NO: 481494 - protein, 9 aa, Homo Sapiens
ETEPLEEYV

SEQ ID NO: 481495 - protein, 9 aa, Homo Sapiens
GQPGSQVPD

SEQ ID NO: 481496 - protein, 9 aa, Homo Sapiens
EGSEMQITK

SEQ ID NO: 481497 - protein, 9 aa, Homo Sapiens
FPIQYNGTY

SEQ ID NO: 481498 - protein, 9 aa, Homo Sapiens
SPGSVDPWT

SEQ ID NO: 481499 - protein, 9 aa, Homo Sapiens
LQRKGGPSR

SEQ ID NO: 481500 - protein, 9 aa, Homo Sapiens
SRRSPKPAR

SEQ ID NO: 481501 - protein, 9 aa, Homo Sapiens
TATNCESST

SEQ ID NO: 481502 - protein, 9 aa, Homo Sapiens
YSLSCRNSE

SEQ ID NO: 481503 - protein, 9 aa, Homo Sapiens
GIRMFPIQY

SEQ ID NO: 481504 - protein, 9 aa, Homo Sapiens
IVVRVQPAL

SEQ ID NO: 481505 - protein, 9 aa, Homo Sapiens
RDPLSEITK

SEQ ID NO: 481506 - protein, 9 aa, Homo Sapiens
KPLLKCTSL

SEQ ID NO: 481507 - protein, 9 aa, Homo Sapiens
VVVGTVLLE

SEQ ID NO: 481508 - protein, 9 aa, Homo Sapiens
PVPYIEKYR

SEQ ID NO: 481509 - protein, 9 aa, Homo Sapiens
LLRQMNEQL

SEQ ID NO: 481510 - protein, 9 aa, Homo Sapiens
GQATQRGAC

SEQ ID NO: 481511 - protein, 9 aa, Homo Sapiens
VASTSRRSP

SEQ ID NO: 481512 - protein, 9 aa, Homo Sapiens
WTCGQPGSQ

SEQ ID NO: 481513 - protein, 9 aa, Homo Sapiens
EASTATNCE

SEQ ID NO: 481514 - protein, 9 aa, Homo Sapiens
DPLVLSCGH

SEQ ID NO: 481515 - protein, 9 aa, Homo Sapiens
KYLTAEQIM

SEQ ID NO: 481516 - protein, 9 aa, Homo Sapiens
STTHTVSSA

SEQ ID NO: 481517 - protein, 9 aa, Homo Sapiens
LTPQSFVLI

SEQ ID NO: 481518 - protein, 9 aa, Homo Sapiens
TSRRSPKPA

SEQ ID NO: 481519 - protein, 9 aa, Homo Sapiens
RRIATLHRK

SEQ ID NO: 481520 - protein, 9 aa, Homo Sapiens
MFPIQYNGT

SEQ ID NO: 481521 - protein, 9 aa, Homo Sapiens
GTVLLEPLA

SEQ ID NO: 481522 - protein, 9 aa, Homo Sapiens
DGLCCVLTM

SEQ ID NO: 481523 - protein, 9 aa, Homo Sapiens
SWQPYGSSF

SEQ ID NO: 481524 - protein, 9 aa, Homo Sapiens
RDPLVLSCG

SEQ ID NO: 481525 - protein, 9 aa, Homo Sapiens
LNHWIRKLM

SEQ ID NO: 481526 - protein, 9 aa, Homo Sapiens
IPVPYIEKY

SEQ ID NO: 481527 - protein, 9 aa, Homo Sapiens
KQRMKILFI

SEQ ID NO: 481528 - protein, 9 aa, Homo Sapiens
YIHMSGYCF

SEQ ID NO: 481529 - protein, 9 aa, Homo Sapiens
EKSILFDAM

SEQ ID NO: 481530 - protein, 9 aa, Homo Sapiens
ATLSVRQLI

SEQ ID NO: 481531 - protein, 9 aa, Homo Sapiens
PARPRGGLS

SEQ ID NO: 481532 - protein, 9 aa, Homo Sapiens
RNKRAVQVP

SEQ ID NO: 481533 - protein, 9 aa, Homo Sapiens
DEQEKLLGE

SEQ ID NO: 481534 - protein, 9 aa, Homo Sapiens
SEITKQEKD

SEQ ID NO: 481535 - protein, 9 aa, Homo Sapiens
EPHKFKTEW

SEQ ID NO: 481536 - protein, 9 aa, Homo Sapiens
AGVMPREAG

SEQ ID NO: 481537 - protein, 9 aa, Homo Sapiens
KPMLGKKLR

SEQ ID NO: 481538 - protein, 9 aa, Homo Sapiens
HETSETDHQ

SEQ ID NO: 481539 - protein, 9 aa, Homo Sapiens
EFPWRCEDE

SEQ ID NO: 481540 - protein, 9 aa, Homo Sapiens
KVFLLAVMA

SEQ ID NO: 481541 - protein, 9 aa, Homo Sapiens
TGNVFIIIL

SEQ ID NO: 481542 - protein, 9 aa, Homo Sapiens
KQYKCNVCG

SEQ ID NO: 481543 - protein, 9 aa, Homo Sapiens
GGLSLDLSS

SEQ ID NO: 481544 - protein, 9 aa, Homo Sapiens
LQELDWPAA

SEQ ID NO: 481545 - protein, 9 aa, Homo Sapiens
VRQLIENAD

SEQ ID NO: 481546 - protein, 9 aa, Homo Sapiens
LKPMLGKKL

SEQ ID NO: 481547 - protein, 9 aa, Homo Sapiens
DSYEEWTPR

SEQ ID NO: 481548 - protein, 9 aa, Homo Sapiens
PMLGKKLRS

SEQ ID NO: 481549 - protein, 9 aa, Homo Sapiens
NIPGIRMFP

SEQ ID NO: 481550 - protein, 9 aa, Homo Sapiens
YLKGEFIWV

SEQ ID NO: 481551 - protein, 9 aa, Homo Sapiens
MSSSLTPQS

SEQ ID NO: 481552 - protein, 9 aa, Homo Sapiens
IHKKFSPSP

SEQ ID NO: 481553 - protein, 9 aa, Homo Sapiens
LRQMNEQLA

SEQ ID NO: 481554 - protein, 9 aa, Homo Sapiens
LGAKQYKCN

SEQ ID NO: 481555 - protein, 9 aa, Homo Sapiens
SQFLKLACS

SEQ ID NO: 481556 - protein, 9 aa, Homo Sapiens
FVYIHMSGY

SEQ ID NO: 481557 - protein, 9 aa, Homo Sapiens
EMQITKSDS

SEQ ID NO: 481558 - protein, 9 aa, Homo Sapiens
IKLCENAVL

SEQ ID NO: 481559 - protein, 9 aa, Homo Sapiens
GEKSILFDA

SEQ ID NO: 481560 - protein, 9 aa, Homo Sapiens
LHIYQLKTI

SEQ ID NO: 481561 - protein, 9 aa, Homo Sapiens
EGPRTSSNW

SEQ ID NO: 481562 - protein, 9 aa, Homo Sapiens
RIKKRYRSV

SEQ ID NO: 481563 - protein, 9 aa, Homo Sapiens
TQRGACMVQ

SEQ ID NO: 481564 - protein, 9 aa, Homo Sapiens
SSTTHTVSS

SEQ ID NO: 481565 - protein, 9 aa, Homo Sapiens
GLHVDEVVV

SEQ ID NO: 481566 - protein, 9 aa, Homo Sapiens
KLMSSSLTP

SEQ ID NO: 481567 - protein, 9 aa, Homo Sapiens
HGPGQATQR

SEQ ID NO: 481568 - protein, 9 aa, Homo Sapiens
ADVLLTPQD

SEQ ID NO: 481569 - protein, 9 aa, Homo Sapiens
WFRDPLVLS

SEQ ID NO: 481570 - protein, 9 aa, Homo Sapiens
RMFPIQYNG

SEQ ID NO: 481571 - protein, 9 aa, Homo Sapiens
PDSWQPYGS

SEQ ID NO: 481572 - protein, 9 aa, Homo Sapiens
SVTRSLLLN

SEQ ID NO: 481573 - protein, 9 aa, Homo Sapiens
QRMKILFIV

SEQ ID NO: 481574 - protein, 9 aa, Homo Sapiens
HSSTTHTVS

SEQ ID NO: 481575 - protein, 9 aa, Homo Sapiens
VTKVFLLAV

SEQ ID NO: 481576 - protein, 9 aa, Homo Sapiens
GVMPREAGA

SEQ ID NO: 481577 - protein, 9 aa, Homo Sapiens
PYIEKYRPA

SEQ ID NO: 481578 - protein, 9 aa, Homo Sapiens
LHVDEVVVG

SEQ ID NO: 481579 - protein, 9 aa, Homo Sapiens
RRVRQKLKW

SEQ ID NO: 481580 - protein, 9 aa, Homo Sapiens
NLYLKGEFI

SEQ ID NO: 481581 - protein, 9 aa, Homo Sapiens
QLAKVYEQL

SEQ ID NO: 481582 - protein, 9 aa, Homo Sapiens
LGEAIQAVK

SEQ ID NO: 481583 - protein, 9 aa, Homo Sapiens
PNYPESYPP

SEQ ID NO: 481584 - protein, 9 aa, Homo Sapiens
WPAAGRPLA

SEQ ID NO: 481585 - protein, 9 aa, Homo Sapiens
LVSSLAWAK

SEQ ID NO: 481586 - protein, 9 aa, Homo Sapiens
VPEVKYLYN

SEQ ID NO: 481587 - protein, 9 aa, Homo Sapiens
QPALGGVCA

SEQ ID NO: 481588 - protein, 9 aa, Homo Sapiens
WTRLVLVNA

SEQ ID NO: 481589 - protein, 9 aa, Homo Sapiens
HPLQLLRIQ

SEQ ID NO: 481590 - protein, 9 aa, Homo Sapiens
TIIRMVKKT

SEQ ID NO: 481591 - protein, 9 aa, Homo Sapiens
PREAGARCP

SEQ ID NO: 481592 - protein, 9 aa, Homo Sapiens
YNATLSVRQ

SEQ ID NO: 481593 - protein, 9 aa, Homo Sapiens
IVVLEAREP

SEQ ID NO: 481594 - protein, 9 aa, Homo Sapiens
RGMIPVPYI

SEQ ID NO: 481595 - protein, 9 aa, Homo Sapiens
LAWAKGLSD

SEQ ID NO: 481596 - protein, 9 aa, Homo Sapiens
KGGPSRLTL

SEQ ID NO: 481597 - protein, 9 aa, Homo Sapiens
LIHKKFSPS

SEQ ID NO: 481598 - protein, 9 aa, Homo Sapiens
GGVCAGLLQ

SEQ ID NO: 481599 - protein, 9 aa, Homo Sapiens
VFIIILSYV

SEQ ID NO: 481600 - protein, 9 aa, Homo Sapiens
TKVFLLAVM

SEQ ID NO: 481601 - protein, 9 aa, Homo Sapiens
MDALPLSPY

SEQ ID NO: 481602 - protein, 9 aa, Homo Sapiens
TCGQPGSQV

SEQ ID NO: 481603 - protein, 9 aa, Homo Sapiens
TLIETEPLE

SEQ ID NO: 481604 - protein, 9 aa, Homo Sapiens
ESYPPGKEC

SEQ ID NO: 481605 - protein, 9 aa, Homo Sapiens
YIGITDQNE

SEQ ID NO: 481606 - protein, 9 aa, Homo Sapiens
VWAFLQTYS

SEQ ID NO: 481607 - protein, 9 aa, Homo Sapiens
EEYVIRTFT

SEQ ID NO: 481608 - protein, 9 aa, Homo Sapiens
TTHTVSSAP

SEQ ID NO: 481609 - protein, 9 aa, Homo Sapiens
HYSLSCRNS

SEQ ID NO: 481610 - protein, 9 aa, Homo Sapiens
QITKSDSIH

SEQ ID NO: 481611 - protein, 9 aa, Homo Sapiens
SLAWAKGLS

SEQ ID NO: 481612 - protein, 9 aa, Homo Sapiens
LQNLIHKKF

SEQ ID NO: 481613 - protein, 9 aa, Homo Sapiens
TMDSVRSGL

SEQ ID NO: 481614 - protein, 9 aa, Homo Sapiens
TTPLTVTSP

SEQ ID NO: 481615 - protein, 9 aa, Homo Sapiens
LTVTSPSSA

SEQ ID NO: 481616 - protein, 9 aa, Homo Sapiens
ESFGEFPWR

SEQ ID NO: 481617 - protein, 9 aa, Homo Sapiens
FVGVDGVWA

SEQ ID NO: 481618 - protein, 9 aa, Homo Sapiens
PLTVTSPSS

SEQ ID NO: 481619 - protein, 9 aa, Homo Sapiens
ISYSVTRSL

SEQ ID NO: 481620 - protein, 9 aa, Homo Sapiens
NAVLNKKLM

SEQ ID NO: 481621 - protein, 9 aa, Homo Sapiens
ILFDAMNMT

SEQ ID NO: 481622 - protein, 9 aa, Homo Sapiens
LKCTSLVTL

SEQ ID NO: 481623 - protein, 9 aa, Homo Sapiens
GPGQATQRG

SEQ ID NO: 481624 - protein, 9 aa, Homo Sapiens
LMTLTGNVF

SEQ ID NO: 481625 - protein, 9 aa, Homo Sapiens
IYQLKTIIR

SEQ ID NO: 481626 - protein, 9 aa, Homo Sapiens
NLFCSIIAG

SEQ ID NO: 481627 - protein, 9 aa, Homo Sapiens
GSVDPWTRL

SEQ ID NO: 481628 - protein, 9 aa, Homo Sapiens
AAGRPLAAG

SEQ ID NO: 481629 - protein, 9 aa, Homo Sapiens
NISMHQSWW

SEQ ID NO: 481630 - protein, 9 aa, Homo Sapiens
LSVRQLIEN

SEQ ID NO: 481631 - protein, 9 aa, Homo Sapiens
PGQATQRGA

SEQ ID NO: 481632 - protein, 9 aa, Homo Sapiens
NYPESYPPG

SEQ ID NO: 481633 - protein, 9 aa, Homo Sapiens
RCPRQADTV

SEQ ID NO: 481634 - protein, 9 aa, Homo Sapiens
SEIEYIGIT

SEQ ID NO: 481635 - protein, 9 aa, Homo Sapiens
EVVVGTVLL

SEQ ID NO: 481636 - protein, 9 aa, Homo Sapiens
TECFPLAAM

SEQ ID NO: 481637 - protein, 9 aa, Homo Sapiens
SSNWGSSFS

SEQ ID NO: 481638 - protein, 9 aa, Homo Sapiens
VVPEVKYLY

SEQ ID NO: 481639 - protein, 9 aa, Homo Sapiens
LLIRVEGNL

SEQ ID NO: 481640 - protein, 9 aa, Homo Sapiens
KLKWAVAST

SEQ ID NO: 481641 - protein, 9 aa, Homo Sapiens
HSVFAVGTL

SEQ ID NO: 481642 - protein, 9 aa, Homo Sapiens
PLADVLLTP

SEQ ID NO: 481643 - protein, 9 aa, Homo Sapiens
NTNTNNLFC

SEQ ID NO: 481644 - protein, 9 aa, Homo Sapiens
VPYIEKYRP

SEQ ID NO: 481645 - protein, 9 aa, Homo Sapiens
SLETSAKTG

SEQ ID NO: 481646 - protein, 9 aa, Homo Sapiens
QPDSWQPYG

SEQ ID NO: 481647 - protein, 9 aa, Homo Sapiens
SYSVTRSLL

SEQ ID NO: 481648 - protein, 9 aa, Homo Sapiens
VYRYLAVTN

SEQ ID NO: 481649 - protein, 9 aa, Homo Sapiens
QPQQASPHE

SEQ ID NO: 481650 - protein, 9 aa, Homo Sapiens
QVPEETVTQ

SEQ ID NO: 481651 - protein, 9 aa, Homo Sapiens
ARTAPARPR

SEQ ID NO: 481652 - protein, 9 aa, Homo Sapiens
RTSSNWGSS

SEQ ID NO: 481653 - protein, 9 aa, Homo Sapiens
IQPQQCPAG

SEQ ID NO: 481654 - protein, 9 aa, Homo Sapiens
DWPAAGRPL

SEQ ID NO: 481655 - protein, 9 aa, Homo Sapiens
QANMDALPL

SEQ ID NO: 481656 - protein, 9 aa, Homo Sapiens
WGGRLDPAG

SEQ ID NO: 481657 - protein, 9 aa, Homo Sapiens
VCAGLLQEL

SEQ ID NO: 481658 - protein, 9 aa, Homo Sapiens
EVKYLYNWL

SEQ ID NO: 481659 - protein, 9 aa, Homo Sapiens
SEMQITKSD

SEQ ID NO: 481660 - protein, 9 aa, Homo Sapiens
WIRKLMSSS

SEQ ID NO: 481661 - protein, 9 aa, Homo Sapiens
AGIELITNF

SEQ ID NO: 481662 - protein, 9 aa, Homo Sapiens
DEVVVGTVL

SEQ ID NO: 481663 - protein, 9 aa, Homo Sapiens
CMVQAIVVR

SEQ ID NO: 481664 - protein, 9 aa, Homo Sapiens
SCLEQPDSW

SEQ ID NO: 481665 - protein, 9 aa, Homo Sapiens
VCSRRVRQK

SEQ ID NO: 481666 - protein, 9 aa, Homo Sapiens
DQVLKFGRP

SEQ ID NO: 481667 - protein, 9 aa, Homo Sapiens
QASPHETSE

SEQ ID NO: 481668 - protein, 9 aa, Homo Sapiens
GEGLHVDEV

SEQ ID NO: 481669 - protein, 9 aa, Homo Sapiens
LSEITKQEK

SEQ ID NO: 481670 - protein, 9 aa, Homo Sapiens
GRPLAAGVM

SEQ ID NO: 481671 - protein, 9 aa, Homo Sapiens
RIATLHRKC

SEQ ID NO: 481672 - protein, 9 aa, Homo Sapiens
LLAGIELIT

SEQ ID NO: 481673 - protein, 9 aa, Homo Sapiens
VPSLETSAK

SEQ ID NO: 481674 - protein, 9 aa, Homo Sapiens
PRTSSNWGS

SEQ ID NO: 481675 - protein, 9 aa, Homo Sapiens
KILFIVVLE

SEQ ID NO: 481676 - protein, 9 aa, Homo Sapiens
RLDPAGSWT

SEQ ID NO: 481677 - protein, 9 aa, Homo Sapiens
PRQADTVCS

SEQ ID NO: 481678 - protein, 9 aa, Homo Sapiens
QATQRGACM

SEQ ID NO: 481679 - protein, 9 aa, Homo Sapiens
LLKCTSLVT

SEQ ID NO: 481680 - protein, 9 aa, Homo Sapiens
TVTSPSSAS

SEQ ID NO: 481681 - protein, 9 aa, Homo Sapiens
LRIKKYLTA

SEQ ID NO: 481682 - protein, 9 aa, Homo Sapiens
GVDGVWAFL

SEQ ID NO: 481683 - protein, 9 aa, Homo Sapiens
IEYIGITDQ

SEQ ID NO: 481684 - protein, 9 aa, Homo Sapiens
VLSCGHNFC

SEQ ID NO: 481685 - protein, 9 aa, Homo Sapiens
AGLLQELDW

SEQ ID NO: 481686 - protein, 9 aa, Homo Sapiens
WLVSSLAWA

SEQ ID NO: 481687 - protein, 9 aa, Homo Sapiens
QSEGPRTSS

SEQ ID NO: 481688 - protein, 9 aa, Homo Sapiens
TNNLFCSII

SEQ ID NO: 481689 - protein, 9 aa, Homo Sapiens
YVVPEVKYL

SEQ ID NO: 481690 - protein, 9 aa, Homo Sapiens
CAGLLQELD

SEQ ID NO: 481691 - protein, 9 aa, Homo Sapiens
ASTATNCES

SEQ ID NO: 481692 - protein, 9 aa, Homo Sapiens
FLKLACSDS

SEQ ID NO: 481693 - protein, 9 aa, Homo Sapiens
LGEGLHVDE

SEQ ID NO: 481694 - protein, 9 aa, Homo Sapiens
LADVLLTPQ

SEQ ID NO: 481695 - protein, 9 aa, Homo Sapiens
LLQELDWPA

SEQ ID NO: 481696 - protein, 9 aa, Homo Sapiens
YIEKYRPAS

SEQ ID NO: 481697 - protein, 9 aa, Homo Sapiens
GPSRLTLPS

SEQ ID NO: 481698 - protein, 9 aa, Homo Sapiens
ATNGEKSIL

SEQ ID NO: 481699 - protein, 9 aa, Homo Sapiens
FCTCGVTKV

SEQ ID NO: 481700 - protein, 9 aa, Homo Sapiens
MKILFIVVL

SEQ ID NO: 481701 - protein, 9 aa, Homo Sapiens
WIGLRNLYL

SEQ ID NO: 481702 - protein, 9 aa, Homo Sapiens
RQADTVCSR

SEQ ID NO: 481703 - protein, 9 aa, Homo Sapiens
YLTAEQIMT

SEQ ID NO: 481704 - protein, 9 aa, Homo Sapiens
LAKVYEQLD

SEQ ID NO: 481705 - protein, 9 aa, Homo Sapiens
VVGTVLLEP

SEQ ID NO: 481706 - protein, 9 aa, Homo Sapiens
TLTGNVFII

SEQ ID NO: 481707 - protein, 9 aa, Homo Sapiens
STFVYIHMS

SEQ ID NO: 481708 - protein, 9 aa, Homo Sapiens
GRLDPAGSW

SEQ ID NO: 481709 - protein, 9 aa, Homo Sapiens
RNLYLKGEF

SEQ ID NO: 481710 - protein, 9 aa, Homo Sapiens
GLRNLYLKG

SEQ ID NO: 481711 - protein, 9 aa, Homo Sapiens
VPEETVTQD

SEQ ID NO: 481712 - protein, 9 aa, Homo Sapiens
PLSEITKQE

SEQ ID NO: 481713 - protein, 9 aa, Homo Sapiens
PAGSWTCGQ

SEQ ID NO: 481714 - protein, 9 aa, Homo Sapiens
GTTECFPLA

SEQ ID NO: 481715 - protein, 9 aa, Homo Sapiens
CVLTMPCLT

SEQ ID NO: 481716 - protein, 9 aa, Homo Sapiens
YDQVLKFGR

SEQ ID NO: 481717 - protein, 9 aa, Homo Sapiens
SFGEFPWRC

SEQ ID NO: 481718 - protein, 9 aa, Homo Sapiens
VVRVQPALG

SEQ ID NO: 481719 - protein, 9 aa, Homo Sapiens
HTVSSAPST

SEQ ID NO: 481720 - protein, 9 aa, Homo Sapiens
RAVQVPEET

SEQ ID NO: 481721 - protein, 9 aa, Homo Sapiens
ACMVQAIVV

SEQ ID NO: 481722 - protein, 9 aa, Homo Sapiens
DVLLTPQDH

SEQ ID NO: 481723 - protein, 9 aa, Homo Sapiens
LAGIELITN

SEQ ID NO: 481724 - protein, 9 aa, Homo Sapiens
TEPLEEYVI

SEQ ID NO: 481725 - protein, 9 aa, Homo Sapiens
MDSVRSGLF

SEQ ID NO: 481726 - protein, 9 aa, Homo Sapiens
SWTCGQPGS

SEQ ID NO: 481727 - protein, 9 aa, Homo Sapiens
PLAAGVMPR

SEQ ID NO: 481728 - protein, 9 aa, Homo Sapiens
NTNNLFCSI

SEQ ID NO: 481729 - protein, 9 aa, Homo Sapiens
ARPRGGLSL

SEQ ID NO: 481730 - protein, 9 aa, Homo Sapiens
LSCRNSEKF

SEQ ID NO: 481731 - protein, 9 aa, Homo Sapiens
SPHETSETD

SEQ ID NO: 481732 - protein, 9 aa, Homo Sapiens
CPAGDGMLG

SEQ ID NO: 481733 - protein, 9 aa, Homo Sapiens
SNWGSSFSQ

SEQ ID NO: 481734 - protein, 9 aa, Homo Sapiens
IKKRYRSVF

SEQ ID NO: 481735 - protein, 9 aa, Homo Sapiens
VRSGLFGQV

SEQ ID NO: 481736 - protein, 9 aa, Homo Sapiens
KWAVASTSR

SEQ ID NO: 481737 - protein, 9 aa, Homo Sapiens
RNISYSVTR

SEQ ID NO: 481738 - protein, 9 aa, Homo Sapiens
NEQLAKVYE

SEQ ID NO: 481739 - protein, 9 aa, Homo Sapiens
IRNISYSVT

SEQ ID NO: 481740 - protein, 9 aa, Homo Sapiens
CCVLTMPCL

SEQ ID NO: 481741 - protein, 9 aa, Homo Sapiens
KGDTTPLTV

SEQ ID NO: 481742 - protein, 9 aa, Homo Sapiens
KKFSPSPLN

SEQ ID NO: 481743 - protein, 9 aa, Homo Sapiens
EKLLGEAIQ

SEQ ID NO: 481744 - protein, 9 aa, Homo Sapiens
FNISMHQSW

SEQ ID NO: 481745 - protein, 9 aa, Homo Sapiens
PLQLLRIQP

SEQ ID NO: 481746 - protein, 9 aa, Homo Sapiens
PKPARTAPA

SEQ ID NO: 481747 - protein, 9 aa, Homo Sapiens
QYVVPEVKY

SEQ ID NO: 481748 - protein, 9 aa, Homo Sapiens
SSSLTPQSF

SEQ ID NO: 481749 - protein, 9 aa, Homo Sapiens
QADTVCSRR

SEQ ID NO: 481750 - protein, 9 aa, Homo Sapiens
KKRYRSVFY

SEQ ID NO: 481751 - protein, 9 aa, Homo Sapiens
ITKSDSIHH

SEQ ID NO: 481752 - protein, 9 aa, Homo Sapiens
VGVDGVWAF

SEQ ID NO: 481753 - protein, 9 aa, Homo Sapiens
QLLIRVEGN

SEQ ID NO: 481754 - protein, 9 aa, Homo Sapiens
VFAVGTLLV

SEQ ID NO: 481755 - protein, 9 aa, Homo Sapiens
KLLGEAIQA

SEQ ID NO: 481756 - protein, 9 aa, Homo Sapiens
SVHLHSVFA

SEQ ID NO: 481757 - protein, 9 aa, Homo Sapiens
DALPLSPYP

SEQ ID NO: 481758 - protein, 9 aa, Homo Sapiens
SEASTATNC

SEQ ID NO: 481759 - protein, 9 aa, Homo Sapiens
RTLKHPTVL

SEQ ID NO: 481760 - protein, 9 aa, Homo Sapiens
VGNLFIILA

SEQ ID NO: 481761 - protein, 9 aa, Homo Sapiens
VVRRCPHRE

SEQ ID NO: 481762 - protein, 9 aa, Homo Sapiens
VGYPRQYPP

SEQ ID NO: 481763 - protein, 9 aa, Homo Sapiens
TENVELKNK

SEQ ID NO: 481764 - protein, 9 aa, Homo Sapiens
KKKKKGILD

SEQ ID NO: 481765 - protein, 9 aa, Homo Sapiens
IMDQLQNLI

SEQ ID NO: 481766 - protein, 9 aa, Homo Sapiens
RLRFVNGCV

SEQ ID NO: 481767 - protein, 9 aa, Homo Sapiens
HENQIQIIN

SEQ ID NO: 481768 - protein, 9 aa, Homo Sapiens
NHCVTDEPP

SEQ ID NO: 481769 - protein, 9 aa, Homo Sapiens
SPNPGRDGD

SEQ ID NO: 481770 - protein, 9 aa, Homo Sapiens
LMEVASEIH

SEQ ID NO: 481771 - protein, 9 aa, Homo Sapiens
HPCCNLQDL

SEQ ID NO: 481772 - protein, 9 aa, Homo Sapiens
KKGILDSDN

SEQ ID NO: 481773 - protein, 9 aa, Homo Sapiens
KGRAGLRVV

SEQ ID NO: 481774 - protein, 9 aa, Homo Sapiens
LLLAALELV

SEQ ID NO: 481775 - protein, 9 aa, Homo Sapiens
TLIQRDQEQ

SEQ ID NO: 481776 - protein, 9 aa, Homo Sapiens
VNGCVPLSH

SEQ ID NO: 481777 - protein, 9 aa, Homo Sapiens
NSVSSQKQP

SEQ ID NO: 481778 - protein, 9 aa, Homo Sapiens
KGPGAVEGP

SEQ ID NO: 481779 - protein, 9 aa, Homo Sapiens
EQEVLKSKE

SEQ ID NO: 481780 - protein, 9 aa, Homo Sapiens
CTYADKCTQ

SEQ ID NO: 481781 - protein, 9 aa, Homo Sapiens
LGHLEIPAE

SEQ ID NO: 481782 - protein, 9 aa, Homo Sapiens
EQIPQNIDR

SEQ ID NO: 481783 - protein, 9 aa, Homo Sapiens
IKTARQDLL

SEQ ID NO: 481784 - protein, 9 aa, Homo Sapiens
AGGRLRFVN

SEQ ID NO: 481785 - protein, 9 aa, Homo Sapiens
VLQGRDRGT

SEQ ID NO: 481786 - protein, 9 aa, Homo Sapiens
SRHQRVQNG

SEQ ID NO: 481787 - protein, 9 aa, Homo Sapiens
TKKSKKEEN

SEQ ID NO: 481788 - protein, 9 aa, Homo Sapiens
VNKEQMIKK

SEQ ID NO: 481789 - protein, 9 aa, Homo Sapiens
LEEQEVLKS

SEQ ID NO: 481790 - protein, 9 aa, Homo Sapiens
LPINSNSVS

SEQ ID NO: 481791 - protein, 9 aa, Homo Sapiens
TEDNKVLGT

SEQ ID NO: 481792 - protein, 9 aa, Homo Sapiens
TISPLVVAK

SEQ ID NO: 481793 - protein, 9 aa, Homo Sapiens
VAERRSRPL

SEQ ID NO: 481794 - protein, 9 aa, Homo Sapiens
RRHFVTSGG

SEQ ID NO: 481795 - protein, 9 aa, Homo Sapiens
PGAVEGPGG

SEQ ID NO: 481796 - protein, 9 aa, Homo Sapiens
LLPFPSRDS

SEQ ID NO: 481797 - protein, 9 aa, Homo Sapiens
RRSGMCSMG

SEQ ID NO: 481798 - protein, 9 aa, Homo Sapiens
HFVTSGGLK

SEQ ID NO: 481799 - protein, 9 aa, Homo Sapiens
TPSPLPYLY

SEQ ID NO: 481800 - protein, 9 aa, Homo Sapiens
QIQIINVNS

SEQ ID NO: 481801 - protein, 9 aa, Homo Sapiens
HWHLEATPE

SEQ ID NO: 481802 - protein, 9 aa, Homo Sapiens
QVLKRYGDA

SEQ ID NO: 481803 - protein, 9 aa, Homo Sapiens
DATSLPVTD

SEQ ID NO: 481804 - protein, 9 aa, Homo Sapiens
LCIYWTKCY

SEQ ID NO: 481805 - protein, 9 aa, Homo Sapiens
SGSCVNHCV

SEQ ID NO: 481806 - protein, 9 aa, Homo Sapiens
HRERCSDSD

SEQ ID NO: 481807 - protein, 9 aa, Homo Sapiens
LPFPSRDSG

SEQ ID NO: 481808 - protein, 9 aa, Homo Sapiens
ARYLSCSAF

SEQ ID NO: 481809 - protein, 9 aa, Homo Sapiens
AALELVARR

SEQ ID NO: 481810 - protein, 9 aa, Homo Sapiens
RLEEQEVLK

SEQ ID NO: 481811 - protein, 9 aa, Homo Sapiens
CLSRHQRVQ

SEQ ID NO: 481812 - protein, 9 aa, Homo Sapiens
WDEDSVAGE

SEQ ID NO: 481813 - protein, 9 aa, Homo Sapiens
LVARRSGMC

SEQ ID NO: 481814 - protein, 9 aa, Homo Sapiens
DLPINSNSV

SEQ ID NO: 481815 - protein, 9 aa, Homo Sapiens
VGATDSAMP

SEQ ID NO: 481816 - protein, 9 aa, Homo Sapiens
KNFKETLRP

SEQ ID NO: 481817 - protein, 9 aa, Homo Sapiens
APHLTSGSP

SEQ ID NO: 481818 - protein, 9 aa, Homo Sapiens
LPDPEDLKS

SEQ ID NO: 481819 - protein, 9 aa, Homo Sapiens
RCPHRERCS

SEQ ID NO: 481820 - protein, 9 aa, Homo Sapiens
HLCHRLNPG

SEQ ID NO: 481821 - protein, 9 aa, Homo Sapiens
SDARNTTMV

SEQ ID NO: 481822 - protein, 9 aa, Homo Sapiens
DQLQNLIWD

SEQ ID NO: 481823 - protein, 9 aa, Homo Sapiens
GESFLGPDG

SEQ ID NO: 481824 - protein, 9 aa, Homo Sapiens
PQKSRTLKH

SEQ ID NO: 481825 - protein, 9 aa, Homo Sapiens
QALKVNKEQ

SEQ ID NO: 481826 - protein, 9 aa, Homo Sapiens
ATREHLCHR

SEQ ID NO: 481827 - protein, 9 aa, Homo Sapiens
RVPSMELGH

SEQ ID NO: 481828 - protein, 9 aa, Homo Sapiens
PPHVLVNWT

SEQ ID NO: 481829 - protein, 9 aa, Homo Sapiens
VLKRYGDAG

SEQ ID NO: 481830 - protein, 9 aa, Homo Sapiens
AVEIKQVGD

SEQ ID NO: 481831 - protein, 9 aa, Homo Sapiens
SGRGNQGGK

SEQ ID NO: 481832 - protein, 9 aa, Homo Sapiens
AGESFLGPD

SEQ ID NO: 481833 - protein, 9 aa, Homo Sapiens
QEVLKSKEL

SEQ ID NO: 481834 - protein, 9 aa, Homo Sapiens
VYEYMEALC

SEQ ID NO: 481835 - protein, 9 aa, Homo Sapiens
LRLRRFPNP

SEQ ID NO: 481836 - protein, 9 aa, Homo Sapiens
INSNSVSSQ

SEQ ID NO: 481837 - protein, 9 aa, Homo Sapiens
KKEENEKEK

SEQ ID NO: 481838 - protein, 9 aa, Homo Sapiens
MFNTELDVY

SEQ ID NO: 481839 - protein, 9 aa, Homo Sapiens
KWNPFDDFV

SEQ ID NO: 481840 - protein, 9 aa, Homo Sapiens
TELDVYKQL

SEQ ID NO: 481841 - protein, 9 aa, Homo Sapiens
NIKTARQDL

SEQ ID NO: 481842 - protein, 9 aa, Homo Sapiens
AERRSRPLL

SEQ ID NO: 481843 - protein, 9 aa, Homo Sapiens
KPAVEIKQV

SEQ ID NO: 481844 - protein, 9 aa, Homo Sapiens
CCNLQDLEL

SEQ ID NO: 481845 - protein, 9 aa, Homo Sapiens
VATRRGIPL

SEQ ID NO: 481846 - protein, 9 aa, Homo Sapiens
FCMEKGSIK

SEQ ID NO: 481847 - protein, 9 aa, Homo Sapiens
KTGMKKVPK

SEQ ID NO: 481848 - protein, 9 aa, Homo Sapiens
VHGLEGLGE

SEQ ID NO: 481849 - protein, 9 aa, Homo Sapiens
DSRPHLLLA

SEQ ID NO: 481850 - protein, 9 aa, Homo Sapiens
RSRLKLKVF

SEQ ID NO: 481851 - protein, 9 aa, Homo Sapiens
MGWLDGCSK

SEQ ID NO: 481852 - protein, 9 aa, Homo Sapiens
ALKVNKEQM

SEQ ID NO: 481853 - protein, 9 aa, Homo Sapiens
NLPVGYPRQ

SEQ ID NO: 481854 - protein, 9 aa, Homo Sapiens
LGRVKGRAG

SEQ ID NO: 481855 - protein, 9 aa, Homo Sapiens
VLLDRICRR

SEQ ID NO: 481856 - protein, 9 aa, Homo Sapiens
LNEKNISLS

SEQ ID NO: 481857 - protein, 9 aa, Homo Sapiens
ICKVPKKFA

SEQ ID NO: 481858 - protein, 9 aa, Homo Sapiens
DLETENVEL

SEQ ID NO: 481859 - protein, 9 aa, Homo Sapiens
NSRKRNQRI

SEQ ID NO: 481860 - protein, 9 aa, Homo Sapiens
HPNIIWVLR

SEQ ID NO: 481861 - protein, 9 aa, Homo Sapiens
VQNGETTFK

SEQ ID NO: 481862 - protein, 9 aa, Homo Sapiens
NILSFAALY

SEQ ID NO: 481863 - protein, 9 aa, Homo Sapiens
EIVLQGRDR

SEQ ID NO: 481864 - protein, 9 aa, Homo Sapiens
LEGLGEIVL

SEQ ID NO: 481865 - protein, 9 aa, Homo Sapiens
DVFRHPCCN

SEQ ID NO: 481866 - protein, 9 aa, Homo Sapiens
LNILSFAAL

SEQ ID NO: 481867 - protein, 9 aa, Homo Sapiens
QFRLYKKNF

SEQ ID NO: 481868 - protein, 9 aa, Homo Sapiens
HFMPGSRTK

SEQ ID NO: 481869 - protein, 9 aa, Homo Sapiens
SQCFSNPRY

SEQ ID NO: 481870 - protein, 9 aa, Homo Sapiens
GDATSLPVT

SEQ ID NO: 481871 - protein, 9 aa, Homo Sapiens
FRIGPVPAF

SEQ ID NO: 481872 - protein, 9 aa, Homo Sapiens
LSPAPHLTS

SEQ ID NO: 481873 - protein, 9 aa, Homo Sapiens
VKVLLDRIC

SEQ ID NO: 481874 - protein, 9 aa, Homo Sapiens
IPLLIGVRS

SEQ ID NO: 481875 - protein, 9 aa, Homo Sapiens
TNLPVGYPR

SEQ ID NO: 481876 - protein, 9 aa, Homo Sapiens
YEYMEALCS

SEQ ID NO: 481877 - protein, 9 aa, Homo Sapiens
QAKKAYDLR

SEQ ID NO: 481878 - protein, 9 aa, Homo Sapiens
EDFTYSKTA

SEQ ID NO: 481879 - protein, 9 aa, Homo Sapiens
MDQLQNLIW

SEQ ID NO: 481880 - protein, 9 aa, Homo Sapiens
KVAERRSRP

SEQ ID NO: 481881 - protein, 9 aa, Homo Sapiens
PFPLTSGLS

SEQ ID NO: 481882 - protein, 9 aa, Homo Sapiens
FTTAWVSHS

SEQ ID NO: 481883 - protein, 9 aa, Homo Sapiens
WTIGEDHFQ

SEQ ID NO: 481884 - protein, 9 aa, Homo Sapiens
CGAVGEGTP

SEQ ID NO: 481885 - protein, 9 aa, Homo Sapiens
QKLRFLVDE

SEQ ID NO: 481886 - protein, 9 aa, Homo Sapiens
RYFFCMEKG

SEQ ID NO: 481887 - protein, 9 aa, Homo Sapiens
KKVLRLEEQ

SEQ ID NO: 481888 - protein, 9 aa, Homo Sapiens
TSGSPPPGL

SEQ ID NO: 481889 - protein, 9 aa, Homo Sapiens
KVLLDRICR

SEQ ID NO: 481890 - protein, 9 aa, Homo Sapiens
RRDWELALR

SEQ ID NO: 481891 - protein, 9 aa, Homo Sapiens
EKATRIVVH

SEQ ID NO: 481892 - protein, 9 aa, Homo Sapiens
LTTAERVAR

SEQ ID NO: 481893 - protein, 9 aa, Homo Sapiens
VFVRFVKAI

SEQ ID NO: 481894 - protein, 9 aa, Homo Sapiens
GCSKNTSFM

SEQ ID NO: 481895 - protein, 9 aa, Homo Sapiens
QGISSFRHG

SEQ ID NO: 481896 - protein, 9 aa, Homo Sapiens
FIKRGKCRH

SEQ ID NO: 481897 - protein, 9 aa, Homo Sapiens
GHFISTEDN

SEQ ID NO: 481898 - protein, 9 aa, Homo Sapiens
AQGPVLKEA

SEQ ID NO: 481899 - protein, 9 aa, Homo Sapiens
RVQNGETTF

SEQ ID NO: 481900 - protein, 9 aa, Homo Sapiens
LRWEAEKGK

SEQ ID NO: 481901 - protein, 9 aa, Homo Sapiens
RWEAEKGKP

SEQ ID NO: 481902 - protein, 9 aa, Homo Sapiens
WNPFDDFVI

SEQ ID NO: 481903 - protein, 9 aa, Homo Sapiens
DDFVIASCS

SEQ ID NO: 481904 - protein, 9 aa, Homo Sapiens
AHIFRIGPV

SEQ ID NO: 481905 - protein, 9 aa, Homo Sapiens
PFLACSLLS

SEQ ID NO: 481906 - protein, 9 aa, Homo Sapiens
EENEKEKDG

SEQ ID NO: 481907 - protein, 9 aa, Homo Sapiens
GYPRQYPPT

SEQ ID NO: 481908 - protein, 9 aa, Homo Sapiens
YSCFIKRGK

SEQ ID NO: 481909 - protein, 9 aa, Homo Sapiens
PGTRVALDK

SEQ ID NO: 481910 - protein, 9 aa, Homo Sapiens
IDGTYFKIR

SEQ ID NO: 481911 - protein, 9 aa, Homo Sapiens
RSSMLVLGD

SEQ ID NO: 481912 - protein, 9 aa, Homo Sapiens
MPGSRTKTV

SEQ ID NO: 481913 - protein, 9 aa, Homo Sapiens
ERRDWELAL

SEQ ID NO: 481914 - protein, 9 aa, Homo Sapiens
PPFPLTSGL

SEQ ID NO: 481915 - protein, 9 aa, Homo Sapiens
VASPCQWSG

SEQ ID NO: 481916 - protein, 9 aa, Homo Sapiens
QVGDTFYIK

SEQ ID NO: 481917 - protein, 9 aa, Homo Sapiens
AGLRVVVKA

SEQ ID NO: 481918 - protein, 9 aa, Homo Sapiens
YDLRSDNLY

SEQ ID NO: 481919 - protein, 9 aa, Homo Sapiens
KCTQTPWRR

SEQ ID NO: 481920 - protein, 9 aa, Homo Sapiens
LVTMVGNLF

SEQ ID NO: 481921 - protein, 9 aa, Homo Sapiens
GEDHFQLVR

SEQ ID NO: 481922 - protein, 9 aa, Homo Sapiens
LKLAGWQCP

SEQ ID NO: 481923 - protein, 9 aa, Homo Sapiens
LGCWCGAVG

SEQ ID NO: 481924 - protein, 9 aa, Homo Sapiens
TSGLSQILL

SEQ ID NO: 481925 - protein, 9 aa, Homo Sapiens
DLMEVASEI

SEQ ID NO: 481926 - protein, 9 aa, Homo Sapiens
LAPHPNIIW

SEQ ID NO: 481927 - protein, 9 aa, Homo Sapiens
SLPSSVLVK

SEQ ID NO: 481928 - protein, 9 aa, Homo Sapiens
GRAGLRVVV

SEQ ID NO: 481929 - protein, 9 aa, Homo Sapiens
GKAFTCPRC

SEQ ID NO: 481930 - protein, 9 aa, Homo Sapiens
HHFMPGSRT

SEQ ID NO: 481931 - protein, 9 aa, Homo Sapiens
VLVNWTVQV

SEQ ID NO: 481932 - protein, 9 aa, Homo Sapiens
EVGQAALDA

SEQ ID NO: 481933 - protein, 9 aa, Homo Sapiens
ATRRGIPLL

SEQ ID NO: 481934 - protein, 9 aa, Homo Sapiens
EPVQFLRSM

SEQ ID NO: 481935 - protein, 9 aa, Homo Sapiens
SSWTIGEDH

SEQ ID NO: 481936 - protein, 9 aa, Homo Sapiens
LLTTAERVA

SEQ ID NO: 481937 - protein, 9 aa, Homo Sapiens
LFIILAISS

SEQ ID NO: 481938 - protein, 9 aa, Homo Sapiens
WTKCYDFKN

SEQ ID NO: 481939 - protein, 9 aa, Homo Sapiens
ELLPLNSAL

SEQ ID NO: 481940 - protein, 9 aa, Homo Sapiens
RGAAEAVGD

SEQ ID NO: 481941 - protein, 9 aa, Homo Sapiens
HRWLRGRPK

SEQ ID NO: 481942 - protein, 9 aa, Homo Sapiens
LRKLQALNS

SEQ ID NO: 481943 - protein, 9 aa, Homo Sapiens
SQQEVTEVL

SEQ ID NO: 481944 - protein, 9 aa, Homo Sapiens
AATQRHRWL

SEQ ID NO: 481945 - protein, 9 aa, Homo Sapiens
SLLFLNILS

SEQ ID NO: 481946 - protein, 9 aa, Homo Sapiens
SFLGPDGDE

SEQ ID NO: 481947 - protein, 9 aa, Homo Sapiens
AFTEENDYV

SEQ ID NO: 481948 - protein, 9 aa, Homo Sapiens
AALDAGLQD

SEQ ID NO: 481949 - protein, 9 aa, Homo Sapiens
RVKGRAGLR

SEQ ID NO: 481950 - protein, 9 aa, Homo Sapiens
NIIWVLRAF

SEQ ID NO: 481951 - protein, 9 aa, Homo Sapiens
DIELLPLNS

SEQ ID NO: 481952 - protein, 9 aa, Homo Sapiens
RRGIPLLIG

SEQ ID NO: 481953 - protein, 9 aa, Homo Sapiens
LKRYGDAGL

SEQ ID NO: 481954 - protein, 9 aa, Homo Sapiens
SVSSQKQPA

SEQ ID NO: 481955 - protein, 9 aa, Homo Sapiens
WLDGCSKNT

SEQ ID NO: 481956 - protein, 9 aa, Homo Sapiens
DRLGGTLAH

SEQ ID NO: 481957 - protein, 9 aa, Homo Sapiens
FLGPDGDEE

SEQ ID NO: 481958 - protein, 9 aa, Homo Sapiens
DELMYMLHK

SEQ ID NO: 481959 - protein, 9 aa, Homo Sapiens
ISPLVVAKG

SEQ ID NO: 481960 - protein, 9 aa, Homo Sapiens
ADQNSVSRA

SEQ ID NO: 481961 - protein, 9 aa, Homo Sapiens
KEDSRPHLL

SEQ ID NO: 481962 - protein, 9 aa, Homo Sapiens
KCTYADKCT

SEQ ID NO: 481963 - protein, 9 aa, Homo Sapiens
PFDRLGGTL

SEQ ID NO: 481964 - protein, 9 aa, Homo Sapiens
PHRERCSDS

SEQ ID NO: 481965 - protein, 9 aa, Homo Sapiens
LHKLLLNIG

SEQ ID NO: 481966 - protein, 9 aa, Homo Sapiens
KSRTLKHPT

SEQ ID NO: 481967 - protein, 9 aa, Homo Sapiens
AQVLKRYGD

SEQ ID NO: 481968 - protein, 9 aa, Homo Sapiens
QAQGPVLKE

SEQ ID NO: 481969 - protein, 9 aa, Homo Sapiens
TDSAMPCAM

SEQ ID NO: 481970 - protein, 9 aa, Homo Sapiens
HVLVNWTVQ

SEQ ID NO: 481971 - protein, 9 aa, Homo Sapiens
EKCTYADKC

SEQ ID NO: 481972 - protein, 9 aa, Homo Sapiens
PDNGRRSRL

SEQ ID NO: 481973 - protein, 9 aa, Homo Sapiens
EFVYEYMEA

SEQ ID NO: 481974 - protein, 9 aa, Homo Sapiens
PGHFISTED

SEQ ID NO: 481975 - protein, 9 aa, Homo Sapiens
GCWCGAVGE

SEQ ID NO: 481976 - protein, 9 aa, Homo Sapiens
HFNLRTSRD

SEQ ID NO: 481977 - protein, 9 aa, Homo Sapiens
PHLTSGSPP

SEQ ID NO: 481978 - protein, 9 aa, Homo Sapiens
FVHGLEGLG

SEQ ID NO: 481979 - protein, 9 aa, Homo Sapiens
KGGTAWLEW

SEQ ID NO: 481980 - protein, 9 aa, Homo Sapiens
FSKPPFPLT

SEQ ID NO: 481981 - protein, 9 aa, Homo Sapiens
HGLEGLGEI

SEQ ID NO: 481982 - protein, 9 aa, Homo Sapiens
SRVQAQGPV

SEQ ID NO: 481983 - protein, 9 aa, Homo Sapiens
FVNGCVPLS

SEQ ID NO: 481984 - protein, 9 aa, Homo Sapiens
SMELGHLEI

SEQ ID NO: 481985 - protein, 9 aa, Homo Sapiens
KVLRLEEQE

SEQ ID NO: 481986 - protein, 9 aa, Homo Sapiens
VNVYIKEEN

SEQ ID NO: 481987 - protein, 9 aa, Homo Sapiens
TYSRRLLTT

SEQ ID NO: 481988 - protein, 9 aa, Homo Sapiens
NFKETLRPY

SEQ ID NO: 481989 - protein, 9 aa, Homo Sapiens
RRLLTTAER

SEQ ID NO: 481990 - protein, 9 aa, Homo Sapiens
DEVEVGQAA

SEQ ID NO: 481991 - protein, 9 aa, Homo Sapiens
AKKAYDLRS

SEQ ID NO: 481992 - protein, 9 aa, Homo Sapiens
GAIPNCSPN

SEQ ID NO: 481993 - protein, 9 aa, Homo Sapiens
KSQSRGKSQ

SEQ ID NO: 481994 - protein, 9 aa, Homo Sapiens
GDAGLHCLE

SEQ ID NO: 481995 - protein, 9 aa, Homo Sapiens
GIHLRLRRF

SEQ ID NO: 481996 - protein, 9 aa, Homo Sapiens
LRFLVDEPQ

SEQ ID NO: 481997 - protein, 9 aa, Homo Sapiens
TSYSHSSSR

SEQ ID NO: 481998 - protein, 9 aa, Homo Sapiens
KKKKKKKGI

SEQ ID NO: 481999 - protein, 9 aa, Homo Sapiens
TVQVARGMN

SEQ ID NO: 482000 - protein, 9 aa, Homo Sapiens
KKKKKKGIL

SEQ ID NO: 482001 - protein, 9 aa, Homo Sapiens
CYDFKNPII

SEQ ID NO: 482002 - protein, 9 aa, Homo Sapiens
LTLEVNVYI

SEQ ID NO: 482003 - protein, 9 aa, Homo Sapiens
PLVVAKGGT

SEQ ID NO: 482004 - protein, 9 aa, Homo Sapiens
LVNWTVQVA

SEQ ID NO: 482005 - protein, 9 aa, Homo Sapiens
QRVQNGETT

SEQ ID NO: 482006 - protein, 9 aa, Homo Sapiens
TVHSQVWFG

SEQ ID NO: 482007 - protein, 9 aa, Homo Sapiens
ARRSGMCSM

SEQ ID NO: 482008 - protein, 9 aa, Homo Sapiens
DWELALRIA

SEQ ID NO: 482009 - protein, 9 aa, Homo Sapiens
KLRFLVDEP

SEQ ID NO: 482010 - protein, 9 aa, Homo Sapiens
IYTILLSTP

SEQ ID NO: 482011 - protein, 9 aa, Homo Sapiens
YTLITCEML

SEQ ID NO: 482012 - protein, 9 aa, Homo Sapiens
EAEGHRDTW

SEQ ID NO: 482013 - protein, 9 aa, Homo Sapiens
HRGAAEAVG

SEQ ID NO: 482014 - protein, 9 aa, Homo Sapiens
YKKNFKETL

SEQ ID NO: 482015 - protein, 9 aa, Homo Sapiens
EPPAVSPVV

SEQ ID NO: 482016 - protein, 9 aa, Homo Sapiens
FRHGTFTDC

SEQ ID NO: 482017 - protein, 9 aa, Homo Sapiens
RHPCCNLQD

SEQ ID NO: 482018 - protein, 9 aa, Homo Sapiens
DDEEEEAGP

SEQ ID NO: 482019 - protein, 9 aa, Homo Sapiens
PRYLYKKMH

SEQ ID NO: 482020 - protein, 9 aa, Homo Sapiens
QIMDQLQNL

SEQ ID NO: 482021 - protein, 9 aa, Homo Sapiens
VYKQLYNEH

SEQ ID NO: 482022 - protein, 9 aa, Homo Sapiens
HIFRIGPVP

SEQ ID NO: 482023 - protein, 9 aa, Homo Sapiens
LQQVVQSQQ

SEQ ID NO: 482024 - protein, 9 aa, Homo Sapiens
NHRSSMLVL

SEQ ID NO: 482025 - protein, 9 aa, Homo Sapiens
LKVNKEQMI

SEQ ID NO: 482026 - protein, 9 aa, Homo Sapiens
QDELMYMLH

SEQ ID NO: 482027 - protein, 9 aa, Homo Sapiens
KKSKKEENE

SEQ ID NO: 482028 - protein, 9 aa, Homo Sapiens
RERCSDSDG

SEQ ID NO: 482029 - protein, 9 aa, Homo Sapiens
IELLPLNSA

SEQ ID NO: 482030 - protein, 9 aa, Homo Sapiens
PAGGRLRFV

SEQ ID NO: 482031 - protein, 9 aa, Homo Sapiens
MPCAMMLEL

SEQ ID NO: 482032 - protein, 9 aa, Homo Sapiens
IINVNSFKH

SEQ ID NO: 482033 - protein, 9 aa, Homo Sapiens
PGAPPFLAC

SEQ ID NO: 482034 - protein, 9 aa, Homo Sapiens
EKNISLSKQ

SEQ ID NO: 482035 - protein, 9 aa, Homo Sapiens
DAGLQDGVG

SEQ ID NO: 482036 - protein, 9 aa, Homo Sapiens
LKSLPSSVL

SEQ ID NO: 482037 - protein, 9 aa, Homo Sapiens
VRNLRWEAE

SEQ ID NO: 482038 - protein, 9 aa, Homo Sapiens
HSQVWFGMW

SEQ ID NO: 482039 - protein, 9 aa, Homo Sapiens
EVNVYIKEE

SEQ ID NO: 482040 - protein, 9 aa, Homo Sapiens
ITCEMLRKK

SEQ ID NO: 482041 - protein, 9 aa, Homo Sapiens
ENEKEKDGE

SEQ ID NO: 482042 - protein, 9 aa, Homo Sapiens
KEQMIKKSR

SEQ ID NO: 482043 - protein, 9 aa, Homo Sapiens
IQIINVNSF

SEQ ID NO: 482044 - protein, 9 aa, Homo Sapiens
DSSWTIGED

SEQ ID NO: 482045 - protein, 9 aa, Homo Sapiens
ESWLEPVQF

SEQ ID NO: 482046 - protein, 9 aa, Homo Sapiens
VVLNTSFST

SEQ ID NO: 482047 - protein, 9 aa, Homo Sapiens
NLFIILAIS

SEQ ID NO: 482048 - protein, 9 aa, Homo Sapiens
MYMLHKLLL

SEQ ID NO: 482049 - protein, 9 aa, Homo Sapiens
KNSIHHNLS

SEQ ID NO: 482050 - protein, 9 aa, Homo Sapiens
TMVGNLFII

SEQ ID NO: 482051 - protein, 9 aa, Homo Sapiens
SAMPCAMML

SEQ ID NO: 482052 - protein, 9 aa, Homo Sapiens
DGCSKNTSF

SEQ ID NO: 482053 - protein, 9 aa, Homo Sapiens
YKKMHWHLE

SEQ ID NO: 482054 - protein, 9 aa, Homo Sapiens
EAVATRRGI

SEQ ID NO: 482055 - protein, 9 aa, Homo Sapiens
HMVCHTGEM

SEQ ID NO: 482056 - protein, 9 aa, Homo Sapiens
FDRLGGTLA

SEQ ID NO: 482057 - protein, 9 aa, Homo Sapiens
LSARYLSCS

SEQ ID NO: 482058 - protein, 9 aa, Homo Sapiens
EDSRPHLLL

SEQ ID NO: 482059 - protein, 9 aa, Homo Sapiens
LACSLLSAA

SEQ ID NO: 482060 - protein, 9 aa, Homo Sapiens
ELDVYKQLY

SEQ ID NO: 482061 - protein, 9 aa, Homo Sapiens
LPVGYPRQY

SEQ ID NO: 482062 - protein, 9 aa, Homo Sapiens
GTRVALDKT

SEQ ID NO: 482063 - protein, 9 aa, Homo Sapiens
QAALDAGLQ

SEQ ID NO: 482064 - protein, 9 aa, Homo Sapiens
NSIHHNLSL

SEQ ID NO: 482065 - protein, 9 aa, Homo Sapiens
IFRIGPVPA

SEQ ID NO: 482066 - protein, 9 aa, Homo Sapiens
LRLLPFPSR

SEQ ID NO: 482067 - protein, 9 aa, Homo Sapiens
DTYSCFIKR

SEQ ID NO: 482068 - protein, 9 aa, Homo Sapiens
RDWELALRI

SEQ ID NO: 482069 - protein, 9 aa, Homo Sapiens
SCFIKRGKC

SEQ ID NO: 482070 - protein, 9 aa, Homo Sapiens
LEVNVYIKE

SEQ ID NO: 482071 - protein, 9 aa, Homo Sapiens
TTAERVARS

SEQ ID NO: 482072 - protein, 9 aa, Homo Sapiens
GTYFKIRAI

SEQ ID NO: 482073 - protein, 9 aa, Homo Sapiens
EGHRDTWDE

SEQ ID NO: 482074 - protein, 9 aa, Homo Sapiens
TFYQNGDSW

SEQ ID NO: 482075 - protein, 9 aa, Homo Sapiens
EIHIRLHPR

SEQ ID NO: 482076 - protein, 9 aa, Homo Sapiens
ELGHLEIPA

SEQ ID NO: 482077 - protein, 9 aa, Homo Sapiens
GATDSAMPC

SEQ ID NO: 482078 - protein, 9 aa, Homo Sapiens
SRRLLTTAE

SEQ ID NO: 482079 - protein, 9 aa, Homo Sapiens
SRPLLRRKD

SEQ ID NO: 482080 - protein, 9 aa, Homo Sapiens
AFFYTLITC

SEQ ID NO: 482081 - protein, 9 aa, Homo Sapiens
AKGGTAWLE

SEQ ID NO: 482082 - protein, 9 aa, Homo Sapiens
DLKSLPSSV

SEQ ID NO: 482083 - protein, 9 aa, Homo Sapiens
MEVASEIHI

SEQ ID NO: 482084 - protein, 9 aa, Homo Sapiens
CIYWTKCYD

SEQ ID NO: 482085 - protein, 9 aa, Homo Sapiens
IESWLEPVQ

SEQ ID NO: 482086 - protein, 9 aa, Homo Sapiens
DKTTLTIMR

SEQ ID NO: 482087 - protein, 9 aa, Homo Sapiens
NEKNISLSK

SEQ ID NO: 482088 - protein, 9 aa, Homo Sapiens
IGPVPAFTG

SEQ ID NO: 482089 - protein, 9 aa, Homo Sapiens
VYGSQCFSN

SEQ ID NO: 482090 - protein, 9 aa, Homo Sapiens
LSKQIDQLS

SEQ ID NO: 482091 - protein, 9 aa, Homo Sapiens
SNSVSSQKQ

SEQ ID NO: 482092 - protein, 9 aa, Homo Sapiens
NKDSTNSRK

SEQ ID NO: 482093 - protein, 9 aa, Homo Sapiens
RFVNGCVPL

SEQ ID NO: 482094 - protein, 9 aa, Homo Sapiens
KGILDSDND

SEQ ID NO: 482095 - protein, 9 aa, Homo Sapiens
GRGNQGGKA

SEQ ID NO: 482096 - protein, 9 aa, Homo Sapiens
VWFGMWIFE

SEQ ID NO: 482097 - protein, 9 aa, Homo Sapiens
GPPGLPGQC

SEQ ID NO: 482098 - protein, 9 aa, Homo Sapiens
PAVSPVVPP

SEQ ID NO: 482099 - protein, 9 aa, Homo Sapiens
VVQSQQEVT

SEQ ID NO: 482100 - protein, 9 aa, Homo Sapiens
LRTSRDLST

SEQ ID NO: 482101 - protein, 9 aa, Homo Sapiens
RDQEQIPQN

SEQ ID NO: 482102 - protein, 9 aa, Homo Sapiens
LDAGLQDGV

SEQ ID NO: 482103 - protein, 9 aa, Homo Sapiens
AGLQDGVGP

SEQ ID NO: 482104 - protein, 9 aa, Homo Sapiens
NSNSVSSQK

SEQ ID NO: 482105 - protein, 9 aa, Homo Sapiens
HAGESFLGP

SEQ ID NO: 482106 - protein, 9 aa, Homo Sapiens
LIQRDQEQI

SEQ ID NO: 482107 - protein, 9 aa, Homo Sapiens
SRHHHSECM

SEQ ID NO: 482108 - protein, 9 aa, Homo Sapiens
HQDSYPFDR

SEQ ID NO: 482109 - protein, 9 aa, Homo Sapiens
FPNPCEDKD

SEQ ID NO: 482110 - protein, 9 aa, Homo Sapiens
KKAYDLRSD

SEQ ID NO: 482111 - protein, 9 aa, Homo Sapiens
RPLLRRKDG

SEQ ID NO: 482112 - protein, 9 aa, Homo Sapiens
AEAVGDEVE

SEQ ID NO: 482113 - protein, 9 aa, Homo Sapiens
KQIMDQLQN

SEQ ID NO: 482114 - protein, 9 aa, Homo Sapiens
RTSRDLSTF

SEQ ID NO: 482115 - protein, 9 aa, Homo Sapiens
EFADQNSVS

SEQ ID NO: 482116 - protein, 9 aa, Homo Sapiens
SRTKTVYKK

SEQ ID NO: 482117 - protein, 9 aa, Homo Sapiens
SQSRGKSQL

SEQ ID NO: 482118 - protein, 9 aa, Homo Sapiens
NLSPAPHLT

SEQ ID NO: 482119 - protein, 9 aa, Homo Sapiens
ILDSDNDDE

SEQ ID NO: 482120 - protein, 9 aa, Homo Sapiens
ESRHHHSEC

SEQ ID NO: 482121 - protein, 9 aa, Homo Sapiens
EGLGEIVLQ

SEQ ID NO: 482122 - protein, 9 aa, Homo Sapiens
EIKQVGDTF

SEQ ID NO: 482123 - protein, 9 aa, Homo Sapiens
KATRIVVHT

SEQ ID NO: 482124 - protein, 9 aa, Homo Sapiens
KRGKCRHEC

SEQ ID NO: 482125 - protein, 9 aa, Homo Sapiens
GKTGMKKVP

SEQ ID NO: 482126 - protein, 9 aa, Homo Sapiens
STEDNKVLG

SEQ ID NO: 482127 - protein, 9 aa, Homo Sapiens
HFVHGLEGL

SEQ ID NO: 482128 - protein, 9 aa, Homo Sapiens
SSAYTGDAT

SEQ ID NO: 482129 - protein, 9 aa, Homo Sapiens
ISLSKQIDQ

SEQ ID NO: 482130 - protein, 9 aa, Homo Sapiens
LQFRLYKKN

SEQ ID NO: 482131 - protein, 9 aa, Homo Sapiens
GPLRLLPFP

SEQ ID NO: 482132 - protein, 9 aa, Homo Sapiens
FFYTLITCE

SEQ ID NO: 482133 - protein, 9 aa, Homo Sapiens
TPLKLAGWQ

SEQ ID NO: 482134 - protein, 9 aa, Homo Sapiens
VDEVICKVP

SEQ ID NO: 482135 - protein, 9 aa, Homo Sapiens
FRLYKKNFK

SEQ ID NO: 482136 - protein, 9 aa, Homo Sapiens
RGNQGGKAR

SEQ ID NO: 482137 - protein, 9 aa, Homo Sapiens
YVVLNTSFS

SEQ ID NO: 482138 - protein, 9 aa, Homo Sapiens
QRHVLAASV

SEQ ID NO: 482139 - protein, 9 aa, Homo Sapiens
YPFDRLGGT

SEQ ID NO: 482140 - protein, 9 aa, Homo Sapiens
QRDQEQIPQ

SEQ ID NO: 482141 - protein, 9 aa, Homo Sapiens
NSVSRALAF

SEQ ID NO: 482142 - protein, 9 aa, Homo Sapiens
CSPNPGRDG

SEQ ID NO: 482143 - protein, 9 aa, Homo Sapiens
RVHMVCHTG

SEQ ID NO: 482144 - protein, 9 aa, Homo Sapiens
IKQVGDTFY

SEQ ID NO: 482145 - protein, 9 aa, Homo Sapiens
DVLVRNLRW

SEQ ID NO: 482146 - protein, 9 aa, Homo Sapiens
FADQNSVSR

SEQ ID NO: 482147 - protein, 9 aa, Homo Sapiens
PRCVRIHER

SEQ ID NO: 482148 - protein, 9 aa, Homo Sapiens
FDDFVIASC

SEQ ID NO: 482149 - protein, 9 aa, Homo Sapiens
GEIVLQGRD

SEQ ID NO: 482150 - protein, 9 aa, Homo Sapiens
RLLTTAERV

SEQ ID NO: 482151 - protein, 9 aa, Homo Sapiens
PAVEIKQVG

SEQ ID NO: 482152 - protein, 9 aa, Homo Sapiens
GSRSPMGMR

SEQ ID NO: 482153 - protein, 9 aa, Homo Sapiens
YPRQYPPTA

SEQ ID NO: 482154 - protein, 9 aa, Homo Sapiens
FTFTTAWVS

SEQ ID NO: 482155 - protein, 9 aa, Homo Sapiens
MGDDEDDEE

SEQ ID NO: 482156 - protein, 9 aa, Homo Sapiens
PNPGRDGDL

SEQ ID NO: 482157 - protein, 9 aa, Homo Sapiens
FKIRAIYDK

SEQ ID NO: 482158 - protein, 9 aa, Homo Sapiens
AGWKNSIHH

SEQ ID NO: 482159 - protein, 9 aa, Homo Sapiens
LNTEKATRI

SEQ ID NO: 482160 - protein, 9 aa, Homo Sapiens
NVYIKEENF

SEQ ID NO: 482161 - protein, 9 aa, Homo Sapiens
VKGRAGLRV

SEQ ID NO: 482162 - protein, 9 aa, Homo Sapiens
QEVTEVLQE

SEQ ID NO: 482163 - protein, 9 aa, Homo Sapiens
TREHLCHRL

SEQ ID NO: 482164 - protein, 9 aa, Homo Sapiens
VASEIHIRL

SEQ ID NO: 482165 - protein, 9 aa, Homo Sapiens
GTHRGAAEA

SEQ ID NO: 482166 - protein, 9 aa, Homo Sapiens
RHFVTSGGL

SEQ ID NO: 482167 - protein, 9 aa, Homo Sapiens
LDVYKQLYN

SEQ ID NO: 482168 - protein, 9 aa, Homo Sapiens
RRCPHRERC

SEQ ID NO: 482169 - protein, 9 aa, Homo Sapiens
ASVASPCQW

SEQ ID NO: 482170 - protein, 9 aa, Homo Sapiens
VLGRVKGRA

SEQ ID NO: 482171 - protein, 9 aa, Homo Sapiens
SAYTGDATS

SEQ ID NO: 482172 - protein, 9 aa, Homo Sapiens
RIVVHTDGS

SEQ ID NO: 482173 - protein, 9 aa, Homo Sapiens
NWTVQVARG

SEQ ID NO: 482174 - protein, 9 aa, Homo Sapiens
SDAGRYFFC

SEQ ID NO: 482175 - protein, 9 aa, Homo Sapiens
VEVGQAALD

SEQ ID NO: 482176 - protein, 9 aa, Homo Sapiens
LCHRLNPGC

SEQ ID NO: 482177 - protein, 9 aa, Homo Sapiens
RSGMCSMGW

SEQ ID NO: 482178 - protein, 9 aa, Homo Sapiens
FTCPRCVRI

SEQ ID NO: 482179 - protein, 9 aa, Homo Sapiens
KKNFKETLR

SEQ ID NO: 482180 - protein, 9 aa, Homo Sapiens
VPAFTGDTI

SEQ ID NO: 482181 - protein, 9 aa, Homo Sapiens
SRKRNQRIL

SEQ ID NO: 482182 - protein, 9 aa, Homo Sapiens
GTFYQNGDS

SEQ ID NO: 482183 - protein, 9 aa, Homo Sapiens
SRLKLKVFV

SEQ ID NO: 482184 - protein, 9 aa, Homo Sapiens
SVGKTGMKK

SEQ ID NO: 482185 - protein, 9 aa, Homo Sapiens
GRRSRLKLK

SEQ ID NO: 482186 - protein, 9 aa, Homo Sapiens
HGTFTDCAL

SEQ ID NO: 482187 - protein, 9 aa, Homo Sapiens
DPEDLKSLP

SEQ ID NO: 482188 - protein, 9 aa, Homo Sapiens
VHFVHGLEG

SEQ ID NO: 482189 - protein, 9 aa, Homo Sapiens
RPHLLLAAL

SEQ ID NO: 482190 - protein, 9 aa, Homo Sapiens
CHRLNPGCF

SEQ ID NO: 482191 - protein, 9 aa, Homo Sapiens
VALDKTTLT

SEQ ID NO: 482192 - protein, 9 aa, Homo Sapiens
CVRIHERTH

SEQ ID NO: 482193 - protein, 9 aa, Homo Sapiens
RVALDKTTL

SEQ ID NO: 482194 - protein, 9 aa, Homo Sapiens
RCVRIHERT

SEQ ID NO: 482195 - protein, 9 aa, Homo Sapiens
RGTHRGAAE

SEQ ID NO: 482196 - protein, 9 aa, Homo Sapiens
RKLQALNSD

SEQ ID NO: 482197 - protein, 9 aa, Homo Sapiens
HHSECMQHV

SEQ ID NO: 482198 - protein, 9 aa, Homo Sapiens
NQIQIINVN

SEQ ID NO: 482199 - protein, 9 aa, Homo Sapiens
HHHSECMQH

SEQ ID NO: 482200 - protein, 9 aa, Homo Sapiens
LQKLRFLVD

SEQ ID NO: 482201 - protein, 9 aa, Homo Sapiens
SWTIGEDHF

SEQ ID NO: 482202 - protein, 9 aa, Homo Sapiens
CFIKRGKCR

SEQ ID NO: 482203 - protein, 9 aa, Homo Sapiens
ECMQHVVQL

SEQ ID NO: 482204 - protein, 9 aa, Homo Sapiens
ATRIVVHTD

SEQ ID NO: 482205 - protein, 9 aa, Homo Sapiens
SRPHLLLAA

SEQ ID NO: 482206 - protein, 9 aa, Homo Sapiens
EDLKSLPSS

SEQ ID NO: 482207 - protein, 9 aa, Homo Sapiens
ERRSRPLLR

SEQ ID NO: 482208 - protein, 9 aa, Homo Sapiens
NLRTSRDLS

SEQ ID NO: 482209 - protein, 9 aa, Homo Sapiens
PLTSGLSQI

SEQ ID NO: 482210 - protein, 9 aa, Homo Sapiens
FLNILSFAA

SEQ ID NO: 482211 - protein, 9 aa, Homo Sapiens
FRHPCCNLQ

SEQ ID NO: 482212 - protein, 9 aa, Homo Sapiens
WTVQVARGM

SEQ ID NO: 482213 - protein, 9 aa, Homo Sapiens
DSAMPCAMM

SEQ ID NO: 482214 - protein, 9 aa, Homo Sapiens
LQALNSDAR

SEQ ID NO: 482215 - protein, 9 aa, Homo Sapiens
VHMVCHTGE

SEQ ID NO: 482216 - protein, 9 aa, Homo Sapiens
DRICRRSHH

SEQ ID NO: 482217 - protein, 9 aa, Homo Sapiens
FVIASCSED

SEQ ID NO: 482218 - protein, 9 aa, Homo Sapiens
PVNIKTARQ

SEQ ID NO: 482219 - protein, 9 aa, Homo Sapiens
SRDGRRDRY

SEQ ID NO: 482220 - protein, 9 aa, Homo Sapiens
IQALKVNKE

SEQ ID NO: 482221 - protein, 9 aa, Homo Sapiens
KCYDFKNPI

SEQ ID NO: 482222 - protein, 9 aa, Homo Sapiens
SEIHIRLHP

SEQ ID NO: 482223 - protein, 9 aa, Homo Sapiens
YENKDSTNS

SEQ ID NO: 482224 - protein, 9 aa, Homo Sapiens
CWCGAVGEG

SEQ ID NO: 482225 - protein, 9 aa, Homo Sapiens
NQGGKARAK

SEQ ID NO: 482226 - protein, 9 aa, Homo Sapiens
HCVTDEPPK

SEQ ID NO: 482227 - protein, 9 aa, Homo Sapiens
LLAALELVA

SEQ ID NO: 482228 - protein, 9 aa, Homo Sapiens
TRIVVHTDG

SEQ ID NO: 482229 - protein, 9 aa, Homo Sapiens
ALKALTIEH

SEQ ID NO: 482230 - protein, 9 aa, Homo Sapiens
KPPFPLTSG

SEQ ID NO: 482231 - protein, 9 aa, Homo Sapiens
LQGISSFRH

SEQ ID NO: 482232 - protein, 9 aa, Homo Sapiens
DLRSDNLYK

SEQ ID NO: 482233 - protein, 9 aa, Homo Sapiens
GISSFRHGT

SEQ ID NO: 482234 - protein, 9 aa, Homo Sapiens
APHPNIIWV

SEQ ID NO: 482235 - protein, 9 aa, Homo Sapiens
ENDYVVLNT

SEQ ID NO: 482236 - protein, 9 aa, Homo Sapiens
VAEVHFVHG

SEQ ID NO: 482237 - protein, 9 aa, Homo Sapiens
SGKGPGAVE

SEQ ID NO: 482238 - protein, 9 aa, Homo Sapiens
FNNTVHSQV

SEQ ID NO: 482239 - protein, 9 aa, Homo Sapiens
INVNSFKHL

SEQ ID NO: 482240 - protein, 9 aa, Homo Sapiens
TYADKCTQT

SEQ ID NO: 482241 - protein, 9 aa, Homo Sapiens
KVPKKFAET

SEQ ID NO: 482242 - protein, 9 aa, Homo Sapiens
SAGWKNSIH

SEQ ID NO: 482243 - protein, 9 aa, Homo Sapiens
SHHFMPGSR

SEQ ID NO: 482244 - protein, 9 aa, Homo Sapiens
QGRDRGTHR

SEQ ID NO: 482245 - protein, 9 aa, Homo Sapiens
KTARQDLLA

SEQ ID NO: 482246 - protein, 9 aa, Homo Sapiens
KTALKALTI

SEQ ID NO: 482247 - protein, 9 aa, Homo Sapiens
ILSFAALYY

SEQ ID NO: 482248 - protein, 9 aa, Homo Sapiens
VFRHPCCNL

SEQ ID NO: 482249 - protein, 9 aa, Homo Sapiens
AYTGDATSL

SEQ ID NO: 482250 - protein, 9 aa, Homo Sapiens
YGSQCFSNP

SEQ ID NO: 482251 - protein, 9 aa, Homo Sapiens
QFLRSMFAN

SEQ ID NO: 482252 - protein, 9 aa, Homo Sapiens
LAQVLKRYG

SEQ ID NO: 482253 - protein, 9 aa, Homo Sapiens
HPTVLEPIP

SEQ ID NO: 482254 - protein, 9 aa, Homo Sapiens
TYSKTALKA

SEQ ID NO: 482255 - protein, 9 aa, Homo Sapiens
PGSRTKTVY

SEQ ID NO: 482256 - protein, 9 aa, Homo Sapiens
CKVPKKFAE

SEQ ID NO: 482257 - protein, 9 aa, Homo Sapiens
TPCGPLRLL

SEQ ID NO: 482258 - protein, 9 aa, Homo Sapiens
GLEGLGEIV

SEQ ID NO: 482259 - protein, 9 aa, Homo Sapiens
FNTELDVYK

SEQ ID NO: 482260 - protein, 9 aa, Homo Sapiens
PLKLAGWQC

SEQ ID NO: 482261 - protein, 9 aa, Homo Sapiens
QIINVNSFK

SEQ ID NO: 482262 - protein, 9 aa, Homo Sapiens
GATREHLCH

SEQ ID NO: 482263 - protein, 9 aa, Homo Sapiens
VVAEVHFVH

SEQ ID NO: 482264 - protein, 9 aa, Homo Sapiens
MLHKLLLNI

SEQ ID NO: 482265 - protein, 9 aa, Homo Sapiens
VELKNKVQD

SEQ ID NO: 482266 - protein, 9 aa, Homo Sapiens
NSDARNTTM

SEQ ID NO: 482267 - protein, 9 aa, Homo Sapiens
DFVIASCSE

SEQ ID NO: 482268 - protein, 9 aa, Homo Sapiens
GPVLKEAFT

SEQ ID NO: 482269 - protein, 9 aa, Homo Sapiens
LEQERRDWE

SEQ ID NO: 482270 - protein, 9 aa, Homo Sapiens
CVNHCVTDE

SEQ ID NO: 482271 - protein, 9 aa, Homo Sapiens
TLITCEMLR

SEQ ID NO: 482272 - protein, 9 aa, Homo Sapiens
QNLIWDINA

SEQ ID NO: 482273 - protein, 9 aa, Homo Sapiens
VNWTVQVAR

SEQ ID NO: 482274 - protein, 9 aa, Homo Sapiens
VEIKQVGDT

SEQ ID NO: 482275 - protein, 9 aa, Homo Sapiens
WVLRAFTSS

SEQ ID NO: 482276 - protein, 9 aa, Homo Sapiens
VLKEAFTNK

SEQ ID NO: 482277 - protein, 9 aa, Homo Sapiens
TIGEDHFQL

SEQ ID NO: 482278 - protein, 9 aa, Homo Sapiens
LNSALLQLV

SEQ ID NO: 482279 - protein, 9 aa, Homo Sapiens
KSKKEENEK

SEQ ID NO: 482280 - protein, 9 aa, Homo Sapiens
DQNSVSRAL

SEQ ID NO: 482281 - protein, 9 aa, Homo Sapiens
HDSKARRHF

SEQ ID NO: 482282 - protein, 9 aa, Homo Sapiens
QSQQEVTEV

SEQ ID NO: 482283 - protein, 9 aa, Homo Sapiens
GHLEIPAEL

SEQ ID NO: 482284 - protein, 9 aa, Homo Sapiens
CSAFEPYSR

SEQ ID NO: 482285 - protein, 9 aa, Homo Sapiens
CVTDEPPKM

SEQ ID NO: 482286 - protein, 9 aa, Homo Sapiens
GLPGQCDPS

SEQ ID NO: 482287 - protein, 9 aa, Homo Sapiens
TSRDLSTFS

SEQ ID NO: 482288 - protein, 9 aa, Homo Sapiens
VEPPAVSPV

SEQ ID NO: 482289 - protein, 9 aa, Homo Sapiens
TNSRKRNQR

SEQ ID NO: 482290 - protein, 9 aa, Homo Sapiens
RHQRVQNGE

SEQ ID NO: 482291 - protein, 9 aa, Homo Sapiens
LMYMLHKLL

SEQ ID NO: 482292 - protein, 9 aa, Homo Sapiens
ASEIHIRLH

SEQ ID NO: 482293 - protein, 9 aa, Homo Sapiens
IVLQGRDRG

SEQ ID NO: 482294 - protein, 9 aa, Homo Sapiens
MSGRGNQGG

SEQ ID NO: 482295 - protein, 9 aa, Homo Sapiens
DEDDEEEEA

SEQ ID NO: 482296 - protein, 9 aa, Homo Sapiens
AEVHFVHGL

SEQ ID NO: 482297 - protein, 9 aa, Homo Sapiens
RYGDAGLHC

SEQ ID NO: 482298 - protein, 9 aa, Homo Sapiens
VTPLKLAGW

SEQ ID NO: 482299 - protein, 9 aa, Homo Sapiens
FVYEYMEAL

SEQ ID NO: 482300 - protein, 9 aa, Homo Sapiens
SECMQHVVQ

SEQ ID NO: 482301 - protein, 9 aa, Homo Sapiens
PDGDEEATR

SEQ ID NO: 482302 - protein, 9 aa, Homo Sapiens
KAFTCPRCV

SEQ ID NO: 482303 - protein, 9 aa, Homo Sapiens
RLLPFPSRD

SEQ ID NO: 482304 - protein, 9 aa, Homo Sapiens
EVHFVHGLE

SEQ ID NO: 482305 - protein, 9 aa, Homo Sapiens
APPFLACSL

SEQ ID NO: 482306 - protein, 9 aa, Homo Sapiens
VGQAALDAG

SEQ ID NO: 482307 - protein, 9 aa, Homo Sapiens
LKHPTVLEP

SEQ ID NO: 482308 - protein, 9 aa, Homo Sapiens
GSRTKTVYK

SEQ ID NO: 482309 - protein, 9 aa, Homo Sapiens
MNHRSSMLV

SEQ ID NO: 482310 - protein, 9 aa, Homo Sapiens
VICKVPKKF

SEQ ID NO: 482311 - protein, 9 aa, Homo Sapiens
QEQIPQNID

SEQ ID NO: 482312 - protein, 9 aa, Homo Sapiens
ETGTFYQNG

SEQ ID NO: 482313 - protein, 9 aa, Homo Sapiens
RIGPVPAFT

SEQ ID NO: 482314 - protein, 9 aa, Homo Sapiens
VHSQVWFGM

SEQ ID NO: 482315 - protein, 9 aa, Homo Sapiens
VLRLEEQEV

SEQ ID NO: 482316 - protein, 9 aa, Homo Sapiens
SPAPHLTSG

SEQ ID NO: 482317 - protein, 9 aa, Homo Sapiens
AEGHRDTWD

SEQ ID NO: 482318 - protein, 9 aa, Homo Sapiens
LDRICRRSH

SEQ ID NO: 482319 - protein, 9 aa, Homo Sapiens
RYLSCSAFE

SEQ ID NO: 482320 - protein, 9 aa, Homo Sapiens
VIASCSEDA

SEQ ID NO: 482321 - protein, 9 aa, Homo Sapiens
FMPGSRTKT

SEQ ID NO: 482322 - protein, 9 aa, Homo Sapiens
CGPLRLLPF

SEQ ID NO: 482323 - protein, 9 aa, Homo Sapiens
HHNLSLHSK

SEQ ID NO: 482324 - protein, 9 aa, Homo Sapiens
LHGCVYGSQ

SEQ ID NO: 482325 - protein, 9 aa, Homo Sapiens
ALELVARRS

SEQ ID NO: 482326 - protein, 9 aa, Homo Sapiens
WVSHSTTSP

SEQ ID NO: 482327 - protein, 9 aa, Homo Sapiens
TAWVSHSTT

SEQ ID NO: 482328 - protein, 9 aa, Homo Sapiens
SARYLSCSA

SEQ ID NO: 482329 - protein, 9 aa, Homo Sapiens
AVATRRGIP

SEQ ID NO: 482330 - protein, 9 aa, Homo Sapiens
PSMELGHLE

SEQ ID NO: 482331 - protein, 9 aa, Homo Sapiens
IQDLETENV

SEQ ID NO: 482332 - protein, 9 aa, Homo Sapiens
CTSYSHSSS

SEQ ID NO: 482333 - protein, 9 aa, Homo Sapiens
LLFLNILSF

SEQ ID NO: 482334 - protein, 9 aa, Homo Sapiens
LPGQCDPSQ

SEQ ID NO: 482335 - protein, 9 aa, Homo Sapiens
DTWDEDSVA

SEQ ID NO: 482336 - protein, 9 aa, Homo Sapiens
FLVDEPQHS

SEQ ID NO: 482337 - protein, 9 aa, Homo Sapiens
VGDTFYIKT

SEQ ID NO: 482338 - protein, 9 aa, Homo Sapiens
GAVGEGTPS

SEQ ID NO: 482339 - protein, 9 aa, Homo Sapiens
VSPVVPPDL

SEQ ID NO: 482340 - protein, 9 aa, Homo Sapiens
GPGAVEGPG

SEQ ID NO: 482341 - protein, 9 aa, Homo Sapiens
PVQFLRSMF

SEQ ID NO: 482342 - protein, 9 aa, Homo Sapiens
TDIELLPLN

SEQ ID NO: 482343 - protein, 9 aa, Homo Sapiens
DGTYFKIRA

SEQ ID NO: 482344 - protein, 9 aa, Homo Sapiens
LVDEVICKV

SEQ ID NO: 482345 - protein, 9 aa, Homo Sapiens
RDRGTHRGA

SEQ ID NO: 482346 - protein, 9 aa, Homo Sapiens
IAVTPLKLA

SEQ ID NO: 482347 - protein, 9 aa, Homo Sapiens
AMPCAMMLE

SEQ ID NO: 482348 - protein, 9 aa, Homo Sapiens
WELALRIAQ

SEQ ID NO: 482349 - protein, 9 aa, Homo Sapiens
KLQALNSDA

SEQ ID NO: 482350 - protein, 9 aa, Homo Sapiens
SRGKSQLLL

SEQ ID NO: 482351 - protein, 9 aa, Homo Sapiens
QALNSDARN

SEQ ID NO: 482352 - protein, 9 aa, Homo Sapiens
GKGPGAVEG

SEQ ID NO: 482353 - protein, 9 aa, Homo Sapiens
QIQALKVNK

SEQ ID NO: 482354 - protein, 9 aa, Homo Sapiens
KTTLTIMRY

SEQ ID NO: 482355 - protein, 9 aa, Homo Sapiens
QQVVQSQQE

SEQ ID NO: 482356 - protein, 9 aa, Homo Sapiens
YTILLSTPS

SEQ ID NO: 482357 - protein, 9 aa, Homo Sapiens
LAGWQCPEC

SEQ ID NO: 482358 - protein, 9 aa, Homo Sapiens
HVLAASVAS

SEQ ID NO: 482359 - protein, 9 aa, Homo Sapiens
ETYSRRLLT

SEQ ID NO: 482360 - protein, 9 aa, Homo Sapiens
PPAVSPVVP

SEQ ID NO: 482361 - protein, 9 aa, Homo Sapiens
MVGNLFIIL

SEQ ID NO: 482362 - protein, 9 aa, Homo Sapiens
FHFNLRTSR

SEQ ID NO: 482363 - protein, 9 aa, Homo Sapiens
AVTPLKLAG

SEQ ID NO: 482364 - protein, 9 aa, Homo Sapiens
VPKKFAETD

SEQ ID NO: 482365 - protein, 9 aa, Homo Sapiens
LVDEPQHSI

SEQ ID NO: 482366 - protein, 9 aa, Homo Sapiens
PRPGHFIST

SEQ ID NO: 482367 - protein, 9 aa, Homo Sapiens
TARQDLLAV

SEQ ID NO: 482368 - protein, 9 aa, Homo Sapiens
HRSSMLVLG

SEQ ID NO: 482369 - protein, 9 aa, Homo Sapiens
PVVPPDLLA

SEQ ID NO: 482370 - protein, 9 aa, Homo Sapiens
ALNSDARNT

SEQ ID NO: 482371 - protein, 9 aa, Homo Sapiens
EVVRRCPHR

SEQ ID NO: 482372 - protein, 9 aa, Homo Sapiens
MELGHLEIP

SEQ ID NO: 482373 - protein, 9 aa, Homo Sapiens
KNTSFMSTQ

SEQ ID NO: 482374 - protein, 9 aa, Homo Sapiens
ESFLGPDGD

SEQ ID NO: 482375 - protein, 9 aa, Homo Sapiens
THRGAAEAV

SEQ ID NO: 482376 - protein, 9 aa, Homo Sapiens
ETENVELKN

SEQ ID NO: 482377 - protein, 9 aa, Homo Sapiens
SGMCSMGWL

SEQ ID NO: 482378 - protein, 9 aa, Homo Sapiens
DYVVLNTSF

SEQ ID NO: 482379 - protein, 9 aa, Homo Sapiens
GWLDGCSKN

SEQ ID NO: 482380 - protein, 9 aa, Homo Sapiens
RHHHSECMQ

SEQ ID NO: 482381 - protein, 9 aa, Homo Sapiens
PGLPGQCDP

SEQ ID NO: 482382 - protein, 9 aa, Homo Sapiens
VYIKEENFF

SEQ ID NO: 482383 - protein, 9 aa, Homo Sapiens
SKARRHFVT

SEQ ID NO: 482384 - protein, 9 aa, Homo Sapiens
DKCTQTPWR

SEQ ID NO: 482385 - protein, 9 aa, Homo Sapiens
RKKSQSRGK

SEQ ID NO: 482386 - protein, 9 aa, Homo Sapiens
KGDAGSRSP

SEQ ID NO: 482387 - protein, 9 aa, Homo Sapiens
SVASPCQWS

SEQ ID NO: 482388 - protein, 9 aa, Homo Sapiens
HRLNPGCFY

SEQ ID NO: 482389 - protein, 9 aa, Homo Sapiens
LPLTSVGKT

SEQ ID NO: 482390 - protein, 9 aa, Homo Sapiens
GDAGSRSPM

SEQ ID NO: 482391 - protein, 9 aa, Homo Sapiens
VLEQERRDW

SEQ ID NO: 482392 - protein, 9 aa, Homo Sapiens
DSTNSRKRN

SEQ ID NO: 482393 - protein, 9 aa, Homo Sapiens
TQRHRWLRG

SEQ ID NO: 482394 - protein, 9 aa, Homo Sapiens
AGSRSPMGM

SEQ ID NO: 482395 - protein, 9 aa, Homo Sapiens
SMGDDEDDE

SEQ ID NO: 482396 - protein, 9 aa, Homo Sapiens
LGPDGDEEA

SEQ ID NO: 482397 - protein, 9 aa, Homo Sapiens
LRSDNLYKS

SEQ ID NO: 482398 - protein, 9 aa, Homo Sapiens
AYDLRSDNL

SEQ ID NO: 482399 - protein, 9 aa, Homo Sapiens
DQEQIPQNI

SEQ ID NO: 482400 - protein, 9 aa, Homo Sapiens
STPSPLPYL

SEQ ID NO: 482401 - protein, 9 aa, Homo Sapiens
SKKEENEKE

SEQ ID NO: 482402 - protein, 9 aa, Homo Sapiens
RAATQRHRW

SEQ ID NO: 482403 - protein, 9 aa, Homo Sapiens
NGDSWEKYV

SEQ ID NO: 482404 - protein, 9 aa, Homo Sapiens
SMLVLGDVV

SEQ ID NO: 482405 - protein, 9 aa, Homo Sapiens
FVGATDSAM

SEQ ID NO: 482406 - protein, 9 aa, Homo Sapiens
EVASEIHIR

SEQ ID NO: 482407 - protein, 9 aa, Homo Sapiens
QDSYPFDRL

SEQ ID NO: 482408 - protein, 9 aa, Homo Sapiens
LVLGDVVRR

SEQ ID NO: 482409 - protein, 9 aa, Homo Sapiens
LRLEEQEVL

SEQ ID NO: 482410 - protein, 9 aa, Homo Sapiens
HGCVYGSQC

SEQ ID NO: 482411 - protein, 9 aa, Homo Sapiens
YSKTALKAL

SEQ ID NO: 482412 - protein, 9 aa, Homo Sapiens
SPVVPPDLL

SEQ ID NO: 482413 - protein, 9 aa, Homo Sapiens
ALDKTTLTI

SEQ ID NO: 482414 - protein, 9 aa, Homo Sapiens
LRRFPNPCE

SEQ ID NO: 482415 - protein, 9 aa, Homo Sapiens
IIWVLRAFT

SEQ ID NO: 482416 - protein, 9 aa, Homo Sapiens
DFTYSKTAL

SEQ ID NO: 482417 - protein, 9 aa, Homo Sapiens
DAGSRSPMG

SEQ ID NO: 482418 - protein, 9 aa, Homo Sapiens
GAVEGPGGA

SEQ ID NO: 482419 - protein, 9 aa, Homo Sapiens
EENDYVVLN

SEQ ID NO: 482420 - protein, 9 aa, Homo Sapiens
PAPHLTSGS

SEQ ID NO: 482421 - protein, 9 aa, Homo Sapiens
LTSGLSQIL

SEQ ID NO: 482422 - protein, 9 aa, Homo Sapiens
YSRRLLTTA

SEQ ID NO: 482423 - protein, 9 aa, Homo Sapiens
PCGPLRLLP

SEQ ID NO: 482424 - protein, 9 aa, Homo Sapiens
TGTFYQNGD

SEQ ID NO: 482425 - protein, 9 aa, Homo Sapiens
DSKARRHFV

SEQ ID NO: 482426 - protein, 9 aa, Homo Sapiens
AFTCPRCVR

SEQ ID NO: 482427 - protein, 9 aa, Homo Sapiens
FNLRTSRDL

SEQ ID NO: 482428 - protein, 9 aa, Homo Sapiens
FTYSKTALK

SEQ ID NO: 482429 - protein, 9 aa, Homo Sapiens
AVGDEVEVG

SEQ ID NO: 482430 - protein, 9 aa, Homo Sapiens
YKQLYNEHM

SEQ ID NO: 482431 - protein, 9 aa, Homo Sapiens
SSRDGRRDR

SEQ ID NO: 482432 - protein, 9 aa, Homo Sapiens
GLGEIVLQG

SEQ ID NO: 482433 - protein, 9 aa, Homo Sapiens
FYQNGDSWE

SEQ ID NO: 482434 - protein, 9 aa, Homo Sapiens
KDTYSCFIK

SEQ ID NO: 482435 - protein, 9 aa, Homo Sapiens
IKRGKCRHE

SEQ ID NO: 482436 - protein, 9 aa, Homo Sapiens
SKTALKALT

SEQ ID NO: 482437 - protein, 9 aa, Homo Sapiens
LNSDARNTT

SEQ ID NO: 482438 - protein, 9 aa, Homo Sapiens
ILLSTPSPL

SEQ ID NO: 482439 - protein, 9 aa, Homo Sapiens
AVSPVVPPD

SEQ ID NO: 482440 - protein, 9 aa, Homo Sapiens
AIPNCSPNP

SEQ ID NO: 482441 - protein, 9 aa, Homo Sapiens
HQRVQNGET

SEQ ID NO: 482442 - protein, 9 aa, Homo Sapiens
AAEAVGDEV

SEQ ID NO: 482443 - protein, 9 aa, Homo Sapiens
KRYGDAGLH

SEQ ID NO: 482444 - protein, 9 aa, Homo Sapiens
KARRHFVTS

SEQ ID NO: 482445 - protein, 9 aa, Homo Sapiens
YSHSSSRDG

SEQ ID NO: 482446 - protein, 9 aa, Homo Sapiens
PHDSKARRH

SEQ ID NO: 482447 - protein, 9 aa, Homo Sapiens
GDEVEVGQA

SEQ ID NO: 482448 - protein, 9 aa, Homo Sapiens
PEDLKSLPS

SEQ ID NO: 482449 - protein, 9 aa, Homo Sapiens
AVGEGTPSA

SEQ ID NO: 482450 - protein, 9 aa, Homo Sapiens
FQPVNIKTA

SEQ ID NO: 482451 - protein, 9 aa, Homo Sapiens
VPSMELGHL

SEQ ID NO: 482452 - protein, 9 aa, Homo Sapiens
GNQGGKARA

SEQ ID NO: 482453 - protein, 9 aa, Homo Sapiens
VNIKTARQD

SEQ ID NO: 482454 - protein, 9 aa, Homo Sapiens
TTAWVSHST

SEQ ID NO: 482455 - protein, 9 aa, Homo Sapiens
VAKGGTAWL

SEQ ID NO: 482456 - protein, 9 aa, Homo Sapiens
EEFVYEYME

SEQ ID NO: 482457 - protein, 9 aa, Homo Sapiens
TKCYDFKNP

SEQ ID NO: 482458 - protein, 9 aa, Homo Sapiens
DAGRYFFCM

SEQ ID NO: 482459 - protein, 9 aa, Homo Sapiens
VEGPGGAFA

SEQ ID NO: 482460 - protein, 9 aa, Homo Sapiens
QVVQSQQEV

SEQ ID NO: 482461 - protein, 9 aa, Homo Sapiens
ENKDSTNSR

SEQ ID NO: 482462 - protein, 9 aa, Homo Sapiens
VVPPDLLAF

SEQ ID NO: 482463 - protein, 9 aa, Homo Sapiens
NTEKATRIV

SEQ ID NO: 482464 - protein, 9 aa, Homo Sapiens
LSRHQRVQN

SEQ ID NO: 482465 - protein, 9 aa, Homo Sapiens
EVICKVPKK

SEQ ID NO: 482466 - protein, 9 aa, Homo Sapiens
ENVELKNKV

SEQ ID NO: 482467 - protein, 9 aa, Homo Sapiens
LFLNILSFA

SEQ ID NO: 482468 - protein, 9 aa, Homo Sapiens
KKKGILDSD

SEQ ID NO: 482469 - protein, 9 aa, Homo Sapiens
HKLLLNIGD

SEQ ID NO: 482470 - protein, 9 aa, Homo Sapiens
GQAALDAGL

SEQ ID NO: 482471 - protein, 9 aa, Homo Sapiens
GRYFFCMEK

SEQ ID NO: 482472 - protein, 9 aa, Homo Sapiens
FISTEDNKV

SEQ ID NO: 482473 - protein, 9 aa, Homo Sapiens
ATQRHRWLR

SEQ ID NO: 482474 - protein, 9 aa, Homo Sapiens
VQSQQEVTE

SEQ ID NO: 482475 - protein, 9 aa, Homo Sapiens
NVNSFKHLR

SEQ ID NO: 482476 - protein, 8 aa, Homo Sapiens
VWKKLGSR

SEQ ID NO: 482477 - protein, 9 aa, Homo Sapiens
FFCMEKGSI

SEQ ID NO: 482478 - protein, 9 aa, Homo Sapiens
NDYVVLNTS

SEQ ID NO: 482479 - protein, 9 aa, Homo Sapiens
SLSKQIDQL

SEQ ID NO: 482480 - protein, 9 aa, Homo Sapiens
GWKNSIHHN

SEQ ID NO: 482481 - protein, 9 aa, Homo Sapiens
PINSNSVSS

SEQ ID NO: 482482 - protein, 9 aa, Homo Sapiens
RSRPLLRRK

SEQ ID NO: 482483 - protein, 9 aa, Homo Sapiens
QRHRWLRGR

SEQ ID NO: 482484 - protein, 9 aa, Homo Sapiens
EDDEEEEAG

SEQ ID NO: 482485 - protein, 9 aa, Homo Sapiens
YLYKKMHWH

SEQ ID NO: 482486 - protein, 9 aa, Homo Sapiens
MVCHTGEMP

SEQ ID NO: 482487 - protein, 9 aa, Homo Sapiens
NTVHSQVWF

SEQ ID NO: 482488 - protein, 9 aa, Homo Sapiens
EQERRDWEL

SEQ ID NO: 482489 - protein, 9 aa, Homo Sapiens
LTSGSPPPG

SEQ ID NO: 482490 - protein, 9 aa, Homo Sapiens
VGEGTPSAE

SEQ ID NO: 482491 - protein, 9 aa, Homo Sapiens
TLKHPTVLE

SEQ ID NO: 482492 - protein, 9 aa, Homo Sapiens
QNSVSRALA

SEQ ID NO: 482493 - protein, 9 aa, Homo Sapiens
TRVALDKTT

SEQ ID NO: 482494 - protein, 9 aa, Homo Sapiens
DRGTHRGAA

SEQ ID NO: 482495 - protein, 9 aa, Homo Sapiens
ELRVHMVCH

SEQ ID NO: 482496 - protein, 9 aa, Homo Sapiens
YQNGDSWEK

SEQ ID NO: 482497 - protein, 9 aa, Homo Sapiens
LPLNSALLQ

SEQ ID NO: 482498 - protein, 9 aa, Homo Sapiens
RQYPPTAFQ

SEQ ID NO: 482499 - protein, 9 aa, Homo Sapiens
EEEEAGPPP

SEQ ID NO: 482500 - protein, 9 aa, Homo Sapiens
LGAIPNCSP

SEQ ID NO: 482501 - protein, 9 aa, Homo Sapiens
TRRGIPLLI

SEQ ID NO: 482502 - protein, 9 aa, Homo Sapiens
QNGDSWEKY

SEQ ID NO: 482503 - protein, 9 aa, Homo Sapiens
KKSQSRGKS

SEQ ID NO: 482504 - protein, 9 aa, Homo Sapiens
SKNTSFMST

SEQ ID NO: 482505 - protein, 9 aa, Homo Sapiens
QDLETENVE

SEQ ID NO: 482506 - protein, 9 aa, Homo Sapiens
ELSARYLSC

SEQ ID NO: 482507 - protein, 9 aa, Homo Sapiens
WCGAVGEGT

SEQ ID NO: 482508 - protein, 9 aa, Homo Sapiens
TYSCFIKRG

SEQ ID NO: 482509 - protein, 9 aa, Homo Sapiens
RSDNLYKSD

SEQ ID NO: 482510 - protein, 9 aa, Homo Sapiens
PLRLLPFPS

SEQ ID NO: 482511 - protein, 9 aa, Homo Sapiens
LKQIMDQLQ

SEQ ID NO: 482512 - protein, 9 aa, Homo Sapiens
ACSLLSAAA

SEQ ID NO: 482513 - protein, 9 aa, Homo Sapiens
TYFKIRAIY

SEQ ID NO: 482514 - protein, 9 aa, Homo Sapiens
REHLCHRLN

SEQ ID NO: 482515 - protein, 9 aa, Homo Sapiens
LYKKNFKET

SEQ ID NO: 482516 - protein, 9 aa, Homo Sapiens
IQRDQEQIP

SEQ ID NO: 482517 - protein, 9 aa, Homo Sapiens
CSKNTSFMS

SEQ ID NO: 482518 - protein, 9 aa, Homo Sapiens
RPGHFISTE

SEQ ID NO: 482519 - protein, 9 aa, Homo Sapiens
LAASVASPC

SEQ ID NO: 482520 - protein, 9 aa, Homo Sapiens
YMEALCSVL

SEQ ID NO: 482521 - protein, 9 aa, Homo Sapiens
NGRRSRLKL

SEQ ID NO: 482522 - protein, 9 aa, Homo Sapiens
GSCVNHCVT

SEQ ID NO: 482523 - protein, 9 aa, Homo Sapiens
TFTTAWVSH

SEQ ID NO: 482524 - protein, 9 aa, Homo Sapiens
LSFAALYYK

SEQ ID NO: 482525 - protein, 9 aa, Homo Sapiens
GCVYGSQCF

SEQ ID NO: 482526 - protein, 9 aa, Homo Sapiens
LRVHMVCHT

SEQ ID NO: 482527 - protein, 9 aa, Homo Sapiens
MHWHLEATP

SEQ ID NO: 482528 - protein, 9 aa, Homo Sapiens
IPDNGRRSR

SEQ ID NO: 482529 - protein, 9 aa, Homo Sapiens
AGRYFFCME

SEQ ID NO: 482530 - protein, 9 aa, Homo Sapiens
YADKCTQTP

SEQ ID NO: 482531 - protein, 9 aa, Homo Sapiens
SETGTFYQN

SEQ ID NO: 482532 - protein, 9 aa, Homo Sapiens
YFFCMEKGS

SEQ ID NO: 482533 - protein, 9 aa, Homo Sapiens
KDSTNSRKR

SEQ ID NO: 482534 - protein, 9 aa, Homo Sapiens
DEVICKVPK

SEQ ID NO: 482535 - protein, 9 aa, Homo Sapiens
CHTGEMPYK

SEQ ID NO: 482536 - protein, 9 aa, Homo Sapiens
SMGWLDGCS

SEQ ID NO: 482537 - protein, 9 aa, Homo Sapiens
SYPFDRLGG

SEQ ID NO: 482538 - protein, 9 aa, Homo Sapiens
ALDAGLQDG

SEQ ID NO: 482539 - protein, 9 aa, Homo Sapiens
CMQHVVQLP

SEQ ID NO: 482540 - protein, 9 aa, Homo Sapiens
NCSPNPGRD

SEQ ID NO: 482541 - protein, 9 aa, Homo Sapiens
FPLTSGLSQ

SEQ ID NO: 482542 - protein, 9 aa, Homo Sapiens
HFISTEDNK

SEQ ID NO: 482543 - protein, 9 aa, Homo Sapiens
RNLRWEAEK

SEQ ID NO: 482544 - protein, 9 aa, Homo Sapiens
VSRALAFNG

SEQ ID NO: 482545 - protein, 9 aa, Homo Sapiens
IPNCSPNPG

SEQ ID NO: 482546 - protein, 9 aa, Homo Sapiens
VLTLEVNVY

SEQ ID NO: 482547 - protein, 9 aa, Homo Sapiens
PVGYPRQYP

SEQ ID NO: 482548 - protein, 9 aa, Homo Sapiens
FYTLITCEM

SEQ ID NO: 482549 - protein, 9 aa, Homo Sapiens
EMNHRSSML

SEQ ID NO: 482550 - protein, 9 aa, Homo Sapiens
SRSPMGMRG

SEQ ID NO: 482551 - protein, 9 aa, Homo Sapiens
RLRRFPNPC

SEQ ID NO: 482552 - protein, 9 aa, Homo Sapiens
EDLPINSNS

SEQ ID NO: 482553 - protein, 9 aa, Homo Sapiens
SSSRDGRRD

SEQ ID NO: 482554 - protein, 9 aa, Homo Sapiens
GILDSDNDD

SEQ ID NO: 482555 - protein, 9 aa, Homo Sapiens
GAAEAVGDE

SEQ ID NO: 482556 - protein, 9 aa, Homo Sapiens
LTSVGKTGM

SEQ ID NO: 482557 - protein, 9 aa, Homo Sapiens
QIPQNIDRV

SEQ ID NO: 482558 - protein, 9 aa, Homo Sapiens
TWDEDSVAG

SEQ ID NO: 482559 - protein, 9 aa, Homo Sapiens
NISLSKQID

SEQ ID NO: 482560 - protein, 9 aa, Homo Sapiens
SIHHNLSLH

SEQ ID NO: 482561 - protein, 9 aa, Homo Sapiens
SLRAATQRH

SEQ ID NO: 482562 - protein, 9 aa, Homo Sapiens
RYLYKKMHW

SEQ ID NO: 482563 - protein, 9 aa, Homo Sapiens
VQAQGPVLK

SEQ ID NO: 482564 - protein, 9 aa, Homo Sapiens
RGIPLLIGV

SEQ ID NO: 482565 - protein, 9 aa, Homo Sapiens
GPVPAFTGD

SEQ ID NO: 482566 - protein, 9 aa, Homo Sapiens
TSVGKTGMK

SEQ ID NO: 482567 - protein, 9 aa, Homo Sapiens
DNGRRSRLK

SEQ ID NO: 482568 - protein, 9 aa, Homo Sapiens
AASVASPCQ

SEQ ID NO: 482569 - protein, 9 aa, Homo Sapiens
SRTLKHPTV

SEQ ID NO: 482570 - protein, 9 aa, Homo Sapiens
KKKKGILDS

SEQ ID NO: 482571 - protein, 9 aa, Homo Sapiens
KVNKEQMIK

SEQ ID NO: 482572 - protein, 9 aa, Homo Sapiens
NLRWEAEKG

SEQ ID NO: 482573 - protein, 9 aa, Homo Sapiens
IWVLRAFTS

SEQ ID NO: 482574 - protein, 9 aa, Homo Sapiens
SYSHSSSRD

SEQ ID NO: 482575 - protein, 9 aa, Homo Sapiens
PRQYPPTAF

SEQ ID NO: 482576 - protein, 9 aa, Homo Sapiens
SCSAFEPYS

SEQ ID NO: 482577 - protein, 9 aa, Homo Sapiens
HRDTWDEDS

SEQ ID NO: 482578 - protein, 9 aa, Homo Sapiens
PLTSVGKTG

SEQ ID NO: 482579 - protein, 9 aa, Homo Sapiens
SPLVVAKGG

SEQ ID NO: 482580 - protein, 9 aa, Homo Sapiens
WKNSIHHNL

SEQ ID NO: 482581 - protein, 9 aa, Homo Sapiens
RLYKKNFKE

SEQ ID NO: 482582 - protein, 9 aa, Homo Sapiens
GRVKGRAGL

SEQ ID NO: 482583 - protein, 9 aa, Homo Sapiens
TEKATRIVV

SEQ ID NO: 482584 - protein, 9 aa, Homo Sapiens
SKPPFPLTS

SEQ ID NO: 482585 - protein, 9 aa, Homo Sapiens
LETENVELK

SEQ ID NO: 482586 - protein, 9 aa, Homo Sapiens
ELVARRSGM

SEQ ID NO: 482587 - protein, 9 aa, Homo Sapiens
AWVSHSTTS

SEQ ID NO: 482588 - protein, 9 aa, Homo Sapiens
CMEKGSIKW

SEQ ID NO: 482589 - protein, 9 aa, Homo Sapiens
ARRHFVTSG

SEQ ID NO: 482590 - protein, 9 aa, Homo Sapiens
NNTVHSQVW

SEQ ID NO: 482591 - protein, 9 aa, Homo Sapiens
FIILAISSD

SEQ ID NO: 482592 - protein, 9 aa, Homo Sapiens
PKGDAGSRS

SEQ ID NO: 482593 - protein, 9 aa, Homo Sapiens
NPFDDFVIA

SEQ ID NO: 482594 - protein, 9 aa, Homo Sapiens
RRFPNPCED

SEQ ID NO: 482595 - protein, 9 aa, Homo Sapiens
DSYPFDRLG

SEQ ID NO: 482596 - protein, 9 aa, Homo Sapiens
ISTEDNKVL

SEQ ID NO: 482597 - protein, 9 aa, Homo Sapiens
KHPTVLEPI

SEQ ID NO: 482598 - protein, 9 aa, Homo Sapiens
RSPMGMRGP

SEQ ID NO: 482599 - protein, 9 aa, Homo Sapiens
MELRVHMVC

SEQ ID NO: 482600 - protein, 9 aa, Homo Sapiens
CPHRERCSD

SEQ ID NO: 482601 - protein, 9 aa, Homo Sapiens
RHVLAASVA

SEQ ID NO: 482602 - protein, 9 aa, Homo Sapiens
VARRSGMCS

SEQ ID NO: 482603 - protein, 9 aa, Homo Sapiens
SKQIDQLSK

SEQ ID NO: 482604 - protein, 9 aa, Homo Sapiens
NTELDVYKQ

SEQ ID NO: 482605 - protein, 9 aa, Homo Sapiens
VCHTGEMPY

SEQ ID NO: 482606 - protein, 9 aa, Homo Sapiens
GDDEDDEEE

SEQ ID NO: 482607 - protein, 9 aa, Homo Sapiens
SFAALYYKK

SEQ ID NO: 482608 - protein, 9 aa, Homo Sapiens
VQFLRSMFA

SEQ ID NO: 482609 - protein, 9 aa, Homo Sapiens
VNHCVTDEP

SEQ ID NO: 482610 - protein, 9 aa, Homo Sapiens
EEEFVYEYM

SEQ ID NO: 482611 - protein, 9 aa, Homo Sapiens
KKMHWHLEA

SEQ ID NO: 482612 - protein, 9 aa, Homo Sapiens
PDPEDLKSL

SEQ ID NO: 482613 - protein, 9 aa, Homo Sapiens
QNGETTFKC

SEQ ID NO: 482614 - protein, 9 aa, Homo Sapiens
LLSTPSPLP

SEQ ID NO: 482615 - protein, 9 aa, Homo Sapiens
LCDVFRHPC

SEQ ID NO: 482616 - protein, 9 aa, Homo Sapiens
ADKCTQTPW

SEQ ID NO: 482617 - protein, 9 aa, Homo Sapiens
RVQAQGPVL

SEQ ID NO: 482618 - protein, 9 aa, Homo Sapiens
PNCSPNPGR

SEQ ID NO: 482619 - protein, 9 aa, Homo Sapiens
SRDLSTFSQ

SEQ ID NO: 482620 - protein, 9 aa, Homo Sapiens
NEKEKDGET

SEQ ID NO: 482621 - protein, 9 aa, Homo Sapiens
LITCEMLRK

SEQ ID NO: 482622 - protein, 9 aa, Homo Sapiens
CSLLSAAAK

SEQ ID NO: 482623 - protein, 9 aa, Homo Sapiens
TEENDYVVL

SEQ ID NO: 482624 - protein, 9 aa, Homo Sapiens
LLDRICRRS

SEQ ID NO: 482625 - protein, 9 aa, Homo Sapiens
IHIRLHPRL

SEQ ID NO: 482626 - protein, 9 aa, Homo Sapiens
PFDDFVIAS

SEQ ID NO: 482627 - protein, 9 aa, Homo Sapiens
PLNSALLQL

SEQ ID NO: 482628 - protein, 9 aa, Homo Sapiens
SLNTEKATR

SEQ ID NO: 482629 - protein, 9 aa, Homo Sapiens
RDTWDEDSV

SEQ ID NO: 482630 - protein, 9 aa, Homo Sapiens
RFPNPCEDK

SEQ ID NO: 482631 - protein, 9 aa, Homo Sapiens
ENQIQIINV

SEQ ID NO: 482632 - protein, 9 aa, Homo Sapiens
GMCSMGWLD

SEQ ID NO: 482633 - protein, 9 aa, Homo Sapiens
SRALAFNGV

SEQ ID NO: 482634 - protein, 9 aa, Homo Sapiens
IHHNLSLHS

SEQ ID NO: 482635 - protein, 9 aa, Homo Sapiens
LVRNLRWEA

SEQ ID NO: 482636 - protein, 9 aa, Homo Sapiens
ATDSAMPCA

SEQ ID NO: 482637 - protein, 9 aa, Homo Sapiens
TILLSTPSP

SEQ ID NO: 482638 - protein, 9 aa, Homo Sapiens
HSSSRDGRR

SEQ ID NO: 482639 - protein, 9 aa, Homo Sapiens
KLAGWQCPE

SEQ ID NO: 482640 - protein, 9 aa, Homo Sapiens
LSTPSPLPY

SEQ ID NO: 482641 - protein, 9 aa, Homo Sapiens
TALKALTIE

SEQ ID NO: 482642 - protein, 9 aa, Homo Sapiens
LYKKMHWHL

SEQ ID NO: 482643 - protein, 9 aa, Homo Sapiens
KAYDLRSDN

SEQ ID NO: 482644 - protein, 9 aa, Homo Sapiens
PVLKEAFTN

SEQ ID NO: 482645 - protein, 9 aa, Homo Sapiens
TLEVNVYIK

SEQ ID NO: 482646 - protein, 9 aa, Homo Sapiens
TGDATSLPV

SEQ ID NO: 482647 - protein, 9 aa, Homo Sapiens
AVEGPGGAF

SEQ ID NO: 482648 - protein, 9 aa, Homo Sapiens
LAALELVAR

SEQ ID NO: 482649 - protein, 9 aa, Homo Sapiens
SCVNHCVTD

SEQ ID NO: 482650 - protein, 9 aa, Homo Sapiens
QKSRTLKHP

SEQ ID NO: 482651 - protein, 9 aa, Homo Sapiens
GSQCFSNPR

SEQ ID NO: 482652 - protein, 9 aa, Homo Sapiens
HLRLRRFPN

SEQ ID NO: 482653 - protein, 9 aa, Homo Sapiens
PNIIWVLRA

SEQ ID NO: 482654 - protein, 9 aa, Homo Sapiens
DVYKQLYNE

SEQ ID NO: 482655 - protein, 9 aa, Homo Sapiens
CSMGWLDGC

SEQ ID NO: 482656 - protein, 9 aa, Homo Sapiens
PPGLPGQCD

SEQ ID NO: 482657 - protein, 9 aa, Homo Sapiens
TAFFYTLIT

SEQ ID NO: 482658 - protein, 9 aa, Homo Sapiens
RGKSQLLLS

SEQ ID NO: 482659 - protein, 9 aa, Homo Sapiens
QSRGKSQLL

SEQ ID NO: 482660 - protein, 9 aa, Homo Sapiens
LDGCSKNTS

SEQ ID NO: 482661 - protein, 9 aa, Homo Sapiens
HLLLAALEL

SEQ ID NO: 482662 - protein, 9 aa, Homo Sapiens
KSLPSSVLV

SEQ ID NO: 482663 - protein, 9 aa, Homo Sapiens
VVLTLEVNV

SEQ ID NO: 482664 - protein, 9 aa, Homo Sapiens
ISSFRHGTF

SEQ ID NO: 482665 - protein, 9 aa, Homo Sapiens
CDVFRHPCC

SEQ ID NO: 482666 - protein, 9 aa, Homo Sapiens
DIAVTPLKL

SEQ ID NO: 482667 - protein, 9 aa, Homo Sapiens
QVWFGMWIF

SEQ ID NO: 482668 - protein, 9 aa, Homo Sapiens
PCCNLQDLE

SEQ ID NO: 482669 - protein, 9 aa, Homo Sapiens
RLGGTLAHA

SEQ ID NO: 482670 - protein, 9 aa, Homo Sapiens
VLVRNLRWE

SEQ ID NO: 482671 - protein, 9 aa, Homo Sapiens
EYMEALCSV

SEQ ID NO: 482672 - protein, 9 aa, Homo Sapiens
QKVAERRSR

SEQ ID NO: 482673 - protein, 9 aa, Homo Sapiens
SQVWFGMWI

SEQ ID NO: 482674 - protein, 9 aa, Homo Sapiens
LSCSAFEPY

SEQ ID NO: 482675 - protein, 9 aa, Homo Sapiens
KNISLSKQI

SEQ ID NO: 482676 - protein, 9 aa, Homo Sapiens
ISGKGPGAV

SEQ ID NO: 482677 - protein, 9 aa, Homo Sapiens
ITAFFYTLI

SEQ ID NO: 482678 - protein, 9 aa, Homo Sapiens
KVKVLLDRI

SEQ ID NO: 482679 - protein, 9 aa, Homo Sapiens
PHVLVNWTV

SEQ ID NO: 482680 - protein, 9 aa, Homo Sapiens
VDEPQHSIP

SEQ ID NO: 482681 - protein, 9 aa, Homo Sapiens
FLACSLLSA

SEQ ID NO: 482682 - protein, 9 aa, Homo Sapiens
RAGLRVVVK

SEQ ID NO: 482683 - protein, 9 aa, Homo Sapiens
STNSRKRNQ

SEQ ID NO: 482684 - protein, 9 aa, Homo Sapiens
PHPNIIWVL

SEQ ID NO: 482685 - protein, 9 aa, Homo Sapiens
VSHSTTSPA

SEQ ID NO: 482686 - protein, 9 aa, Homo Sapiens
EHLCHRLNP

SEQ ID NO: 482687 - protein, 9 aa, Homo Sapiens
RRSRPLLRR

SEQ ID NO: 482688 - protein, 9 aa, Homo Sapiens
CPRCVRIHE

SEQ ID NO: 482689 - protein, 9 aa, Homo Sapiens
HLEIPAELA

SEQ ID NO: 482690 - protein, 9 aa, Homo Sapiens
WDKVKVLLD

SEQ ID NO: 482691 - protein, 9 aa, Homo Sapiens
SLPLTSVGK

SEQ ID NO: 482692 - protein, 9 aa, Homo Sapiens
SHSSSRDGR

SEQ ID NO: 482693 - protein, 9 aa, Homo Sapiens
PPFLACSLL

SEQ ID NO: 482694 - protein, 9 aa, Homo Sapiens
GIPLLIGVR

SEQ ID NO: 482695 - protein, 9 aa, Homo Sapiens
TSSAYTGDA

SEQ ID NO: 482696 - protein, 9 aa, Homo Sapiens
YTGDATSLP

SEQ ID NO: 482697 - protein, 9 aa, Homo Sapiens
QLCIYWTKC

SEQ ID NO: 482698 - protein, 9 aa, Homo Sapiens
VVAKGGTAW

SEQ ID NO: 482699 - protein, 9 aa, Homo Sapiens
KQVGDTFYI

SEQ ID NO: 482700 - protein, 9 aa, Homo Sapiens
RLKLKVFVR

SEQ ID NO: 482701 - protein, 9 aa, Homo Sapiens
YLSCSAFEP

SEQ ID NO: 482702 - protein, 9 aa, Homo Sapiens
LRAATQRHR

SEQ ID NO: 482703 - protein, 9 aa, Homo Sapiens
MCSMGWLDG

SEQ ID NO: 482704 - protein, 9 aa, Homo Sapiens
IGEDHFQLV

SEQ ID NO: 482705 - protein, 9 aa, Homo Sapiens
SHSTTSPAL

SEQ ID NO: 482706 - protein, 9 aa, Homo Sapiens
TCPRCVRIH

SEQ ID NO: 482707 - protein, 9 aa, Homo Sapiens
LQGRDRGTH

SEQ ID NO: 482708 - protein, 9 aa, Homo Sapiens
SVSRALAFN

SEQ ID NO: 482709 - protein, 9 aa, Homo Sapiens
VLHGCVYGS

SEQ ID NO: 482710 - protein, 9 aa, Homo Sapiens
VRRCPHRER

SEQ ID NO: 482711 - protein, 9 aa, Homo Sapiens
PHLLLAALE

SEQ ID NO: 482712 - protein, 9 aa, Homo Sapiens
DEEEEAGPP

SEQ ID NO: 482713 - protein, 9 aa, Homo Sapiens
LEEEFVYEY

SEQ ID NO: 482714 - protein, 9 aa, Homo Sapiens
GHRDTWDED

SEQ ID NO: 482715 - protein, 9 aa, Homo Sapiens
LVVAKGGTA

SEQ ID NO: 482716 - protein, 9 aa, Homo Sapiens
VGKTGMKKV

SEQ ID NO: 482717 - protein, 9 aa, Homo Sapiens
NVELKNKVQ

SEQ ID NO: 482718 - protein, 9 aa, Homo Sapiens
GRDRGTHRG

SEQ ID NO: 482719 - protein, 9 aa, Homo Sapiens
EDHFQLVRE

SEQ ID NO: 482720 - protein, 9 aa, Homo Sapiens
GFQPVNIKT

SEQ ID NO: 482721 - protein, 9 aa, Homo Sapiens
QGPVLKEAF

SEQ ID NO: 482722 - protein, 9 aa, Homo Sapiens
CTQTPWRRI

SEQ ID NO: 482723 - protein, 9 aa, Homo Sapiens
QQEVTEVLQ

SEQ ID NO: 482724 - protein, 9 aa, Homo Sapiens
VSGSCVNHC

SEQ ID NO: 482725 - protein, 9 aa, Homo Sapiens
SIYTILLST

SEQ ID NO: 482726 - protein, 9 aa, Homo Sapiens
SPMGMRGPP

SEQ ID NO: 482727 - protein, 9 aa, Homo Sapiens
SFRHGTFTD

SEQ ID NO: 482728 - protein, 9 aa, Homo Sapiens
VTMVGNLFI

SEQ ID NO: 482729 - protein, 9 aa, Homo Sapiens
VGDEVEVGQ

SEQ ID NO: 482730 - protein, 9 aa, Homo Sapiens
LRFVNGCVP

SEQ ID NO: 482731 - protein, 9 aa, Homo Sapiens
IYWTKCYDF

SEQ ID NO: 482732 - protein, 9 aa, Homo Sapiens
GEGTPSAES

SEQ ID NO: 482733 - protein, 9 aa, Homo Sapiens
SSFRHGTFT

SEQ ID NO: 482734 - protein, 9 aa, Homo Sapiens
FLQKLRFLV

SEQ ID NO: 482735 - protein, 9 aa, Homo Sapiens
KEENEKEKD

SEQ ID NO: 482736 - protein, 9 aa, Homo Sapiens
GPDGDEEAT

SEQ ID NO: 482737 - protein, 9 aa, Homo Sapiens
NKEQMIKKS

SEQ ID NO: 482738 - protein, 9 aa, Homo Sapiens
EAVGDEVEV

SEQ ID NO: 482739 - protein, 9 aa, Homo Sapiens
YGDAGLHCL

SEQ ID NO: 482740 - protein, 9 aa, Homo Sapiens
LQNLIWDIN

SEQ ID NO: 482741 - protein, 9 aa, Homo Sapiens
YMLHKLLLN

SEQ ID NO: 482742 - protein, 9 aa, Homo Sapiens
SSMLVLGDV

SEQ ID NO: 482743 - protein, 9 aa, Homo Sapiens
RRSRLKLKV

SEQ ID NO: 482744 - protein, 9 aa, Homo Sapiens
VLAASVASP

SEQ ID NO: 482745 - protein, 9 aa, Homo Sapiens
QERRDWELA

SEQ ID NO: 482746 - protein, 9 aa, Homo Sapiens
DHFQLVREF

SEQ ID NO: 482747 - protein, 9 aa, Homo Sapiens
YWTKCYDFK

SEQ ID NO: 482748 - protein, 9 aa, Homo Sapiens
WEAEKGKPV

SEQ ID NO: 482749 - protein, 9 aa, Homo Sapiens
EEQEVLKSK

SEQ ID NO: 482750 - protein, 9 aa, Homo Sapiens
IHLRLRRFP

SEQ ID NO: 482751 - protein, 9 aa, Homo Sapiens
ELMYMLHKL

SEQ ID NO: 482752 - protein, 9 aa, Homo Sapiens
NTDIELLPL

SEQ ID NO: 482753 - protein, 9 aa, Homo Sapiens
FTEENDYVV

SEQ ID NO: 482754 - protein, 9 aa, Homo Sapiens
LELVARRSG

SEQ ID NO: 482755 - protein, 9 aa, Homo Sapiens
CVYGSQCFS

SEQ ID NO: 482756 - protein, 9 aa, Homo Sapiens
LLPLNSALL

SEQ ID NO: 482757 - protein, 9 aa, Homo Sapiens
EVEVGQAAL

SEQ ID NO: 482758 - protein, 9 aa, Homo Sapiens
GGRLRFVNG

SEQ ID NO: 482759 - protein, 9 aa, Homo Sapiens
RHGTFTDCA

SEQ ID NO: 482760 - protein, 9 aa, Homo Sapiens
DKVKVLLDR

SEQ ID NO: 482761 - protein, 9 aa, Homo Sapiens
RTKTVYKKP

SEQ ID NO: 482762 - protein, 9 aa, Homo Sapiens
HLTSGSPPP

SEQ ID NO: 482763 - protein, 9 aa, Homo Sapiens
KMHWHLEAT

SEQ ID NO: 482764 - protein, 9 aa, Homo Sapiens
QPVNIKTAR

SEQ ID NO: 482765 - protein, 9 aa, Homo Sapiens
KIRAIYDKP

SEQ ID NO: 482766 - protein, 9 aa, Homo Sapiens
YFKIRAIYD

SEQ ID NO: 482767 - protein, 9 aa, Homo Sapiens
QLQNLIWDI

SEQ ID NO: 482768 - protein, 9 aa, Homo Sapiens
PVPAFTGDT

SEQ ID NO: 482769 - protein, 9 aa, Homo Sapiens
LGEIVLQGR

SEQ ID NO: 482770 - protein, 9 aa, Homo Sapiens
RHRWLRGRP

SEQ ID NO: 482771 - protein, 9 aa, Homo Sapiens
LDKTTLTIM

SEQ ID NO: 482772 - protein, 9 aa, Homo Sapiens
HFHFNLRTS

SEQ ID NO: 482773 - protein, 9 aa, Homo Sapiens
MLVLGDVVR

SEQ ID NO: 482774 - protein, 9 aa, Homo Sapiens
GAPPFLACS

SEQ ID NO: 482775 - protein, 9 aa, Homo Sapiens
GRLRFVNGC

SEQ ID NO: 482776 - protein, 9 aa, Homo Sapiens
HSECMQHVV

SEQ ID NO: 482777 - protein, 9 aa, Homo Sapiens
GNLFIILAI

SEQ ID NO: 482778 - protein, 9 aa, Homo Sapiens
TLQSWYLCY

SEQ ID NO: 482779 - protein, 9 aa, Homo Sapiens
RQVLDLDDL

SEQ ID NO: 482780 - protein, 9 aa, Homo Sapiens
ETLNFGVLE

SEQ ID NO: 482781 - protein, 9 aa, Homo Sapiens
KKEEMNAVR

SEQ ID NO: 482782 - protein, 9 aa, Homo Sapiens
SIDRYLAFV

SEQ ID NO: 482783 - protein, 9 aa, Homo Sapiens
RPLSLTRFD

SEQ ID NO: 482784 - protein, 9 aa, Homo Sapiens
RTGEKPYTC

SEQ ID NO: 482785 - protein, 9 aa, Homo Sapiens
KGNILEQIL

SEQ ID NO: 482786 - protein, 9 aa, Homo Sapiens
SAADLVTKT

SEQ ID NO: 482787 - protein, 9 aa, Homo Sapiens
DHKVRLQLE

SEQ ID NO: 482788 - protein, 9 aa, Homo Sapiens
LYLHMQLAY

SEQ ID NO: 482789 - protein, 9 aa, Homo Sapiens
PTSPTCRAH

SEQ ID NO: 482790 - protein, 9 aa, Homo Sapiens
TSGHCRKQC

SEQ ID NO: 482791 - protein, 9 aa, Homo Sapiens
LANLWYSFQ

SEQ ID NO: 482792 - protein, 9 aa, Homo Sapiens
EIHVYCQWQ

SEQ ID NO: 482793 - protein, 9 aa, Homo Sapiens
LTPWLTPIV

SEQ ID NO: 482794 - protein, 9 aa, Homo Sapiens
TLVDAHRLR

SEQ ID NO: 482795 - protein, 9 aa, Homo Sapiens
KRQRTGDHA

SEQ ID NO: 482796 - protein, 9 aa, Homo Sapiens
VFMMALQYS

SEQ ID NO: 482797 - protein, 9 aa, Homo Sapiens
ETTREMIAG

SEQ ID NO: 482798 - protein, 9 aa, Homo Sapiens
RQRTGDHAL

SEQ ID NO: 482799 - protein, 9 aa, Homo Sapiens
EGWLPSIKT

SEQ ID NO: 482800 - protein, 9 aa, Homo Sapiens
YDLPLSSVP

SEQ ID NO: 482801 - protein, 9 aa, Homo Sapiens
YWESRKPPM

SEQ ID NO: 482802 - protein, 9 aa, Homo Sapiens
MKTCADVNE

SEQ ID NO: 482803 - protein, 9 aa, Homo Sapiens
TRETGSALL

SEQ ID NO: 482804 - protein, 9 aa, Homo Sapiens
PVTSAQVGT

SEQ ID NO: 482805 - protein, 9 aa, Homo Sapiens
PPTKKLMLW

SEQ ID NO: 482806 - protein, 9 aa, Homo Sapiens
KGLIHTDIT

SEQ ID NO: 482807 - protein, 9 aa, Homo Sapiens
GFKGSFRPM

SEQ ID NO: 482808 - protein, 9 aa, Homo Sapiens
THDPPDGDP

SEQ ID NO: 482809 - protein, 9 aa, Homo Sapiens
GRGYDNSHV

SEQ ID NO: 482810 - protein, 9 aa, Homo Sapiens
KPPGFKATS

SEQ ID NO: 482811 - protein, 9 aa, Homo Sapiens
SSPEPPTTG

SEQ ID NO: 482812 - protein, 9 aa, Homo Sapiens
PLSLTRFDV

SEQ ID NO: 482813 - protein, 9 aa, Homo Sapiens
ALSQSLYYG

SEQ ID NO: 482814 - protein, 9 aa, Homo Sapiens
FKQASSGLK

SEQ ID NO: 482815 - protein, 9 aa, Homo Sapiens
AADTHTLVD

SEQ ID NO: 482816 - protein, 9 aa, Homo Sapiens
NEDFERAWR

SEQ ID NO: 482817 - protein, 9 aa, Homo Sapiens
QGPDAPAAV

SEQ ID NO: 482818 - protein, 9 aa, Homo Sapiens
HELEGPISF

SEQ ID NO: 482819 - protein, 9 aa, Homo Sapiens
LAVTYFFYQ

SEQ ID NO: 482820 - protein, 9 aa, Homo Sapiens
DEKLIGLMN

SEQ ID NO: 482821 - protein, 9 aa, Homo Sapiens
YGFKEKDYV

SEQ ID NO: 482822 - protein, 9 aa, Homo Sapiens
ETGSALLAL

SEQ ID NO: 482823 - protein, 9 aa, Homo Sapiens
ALAEFQALA

SEQ ID NO: 482824 - protein, 9 aa, Homo Sapiens
GTSSNSNNE

SEQ ID NO: 482825 - protein, 9 aa, Homo Sapiens
IEDELTTAL

SEQ ID NO: 482826 - protein, 9 aa, Homo Sapiens
RHPALSQSL

SEQ ID NO: 482827 - protein, 9 aa, Homo Sapiens
NCTQNGWSE

SEQ ID NO: 482828 - protein, 9 aa, Homo Sapiens
LQNRDVIGV

SEQ ID NO: 482829 - protein, 9 aa, Homo Sapiens
HGCCSTDSQ

SEQ ID NO: 482830 - protein, 9 aa, Homo Sapiens
WSSYHNNLL

SEQ ID NO: 482831 - protein, 9 aa, Homo Sapiens
PQGASLEGW

SEQ ID NO: 482832 - protein, 9 aa, Homo Sapiens
FYQAVDDVK

SEQ ID NO: 482833 - protein, 9 aa, Homo Sapiens
SNVSPGQPG

SEQ ID NO: 482834 - protein, 9 aa, Homo Sapiens
PTEFKVVLY

SEQ ID NO: 482835 - protein, 9 aa, Homo Sapiens
FQMKLFVDI

SEQ ID NO: 482836 - protein, 9 aa, Homo Sapiens
RSDVDMDLS

SEQ ID NO: 482837 - protein, 9 aa, Homo Sapiens
TNTTDIALK

SEQ ID NO: 482838 - protein, 9 aa, Homo Sapiens
SVVVKQPAF

SEQ ID NO: 482839 - protein, 9 aa, Homo Sapiens
IQWDWSTYP

SEQ ID NO: 482840 - protein, 9 aa, Homo Sapiens
KESRNAFRM

SEQ ID NO: 482841 - protein, 9 aa, Homo Sapiens
AGAKNELHI

SEQ ID NO: 482842 - protein, 9 aa, Homo Sapiens
AVGCPLLQQ

SEQ ID NO: 482843 - protein, 9 aa, Homo Sapiens
QECWYRDGV

SEQ ID NO: 482844 - protein, 9 aa, Homo Sapiens
SIQGCKVNN

SEQ ID NO: 482845 - protein, 9 aa, Homo Sapiens
KHKAFSTCV

SEQ ID NO: 482846 - protein, 9 aa, Homo Sapiens
SSYHNNLLA

SEQ ID NO: 482847 - protein, 9 aa, Homo Sapiens
EDQRAVGVA

SEQ ID NO: 482848 - protein, 9 aa, Homo Sapiens
SFGKNGRGT

SEQ ID NO: 482849 - protein, 9 aa, Homo Sapiens
EEKHFMEQP

SEQ ID NO: 482850 - protein, 9 aa, Homo Sapiens
VCLLLASCT

SEQ ID NO: 482851 - protein, 9 aa, Homo Sapiens
LLSVWKSIV

SEQ ID NO: 482852 - protein, 9 aa, Homo Sapiens
GQPLILNCE

SEQ ID NO: 482853 - protein, 9 aa, Homo Sapiens
QKHETRRKS

SEQ ID NO: 482854 - protein, 9 aa, Homo Sapiens
MPLEERRSY

SEQ ID NO: 482855 - protein, 9 aa, Homo Sapiens
VEYIRSLQQ

SEQ ID NO: 482856 - protein, 9 aa, Homo Sapiens
FRMALYGTT

SEQ ID NO: 482857 - protein, 9 aa, Homo Sapiens
NDEKDNCQL

SEQ ID NO: 482858 - protein, 9 aa, Homo Sapiens
HNGNIHGEE

SEQ ID NO: 482859 - protein, 9 aa, Homo Sapiens
GIFAAVEGA

SEQ ID NO: 482860 - protein, 9 aa, Homo Sapiens
LDDLVFTQG

SEQ ID NO: 482861 - protein, 9 aa, Homo Sapiens
TPQFISKKD

SEQ ID NO: 482862 - protein, 9 aa, Homo Sapiens
LNCESKGKP

SEQ ID NO: 482863 - protein, 9 aa, Homo Sapiens
LASSLPQCL

SEQ ID NO: 482864 - protein, 9 aa, Homo Sapiens
GIARWIPWT

SEQ ID NO: 482865 - protein, 9 aa, Homo Sapiens
QLLAIYYLA

SEQ ID NO: 482866 - protein, 9 aa, Homo Sapiens
RQLEDPDGP

SEQ ID NO: 482867 - protein, 9 aa, Homo Sapiens
QEMKNDQDH

SEQ ID NO: 482868 - protein, 9 aa, Homo Sapiens
IDGTYFKIR

SEQ ID NO: 482869 - protein, 9 aa, Homo Sapiens
LQVQCTSRT

SEQ ID NO: 482870 - protein, 9 aa, Homo Sapiens
SSWEPDLFP

SEQ ID NO: 482871 - protein, 9 aa, Homo Sapiens
YYKEKIPSP

SEQ ID NO: 482872 - protein, 9 aa, Homo Sapiens
APDHCYESL

SEQ ID NO: 482873 - protein, 9 aa, Homo Sapiens
SQSLYYGQY

SEQ ID NO: 482874 - protein, 9 aa, Homo Sapiens
TPCANNRTC

SEQ ID NO: 482875 - protein, 9 aa, Homo Sapiens
DGHTEMEEA

SEQ ID NO: 482876 - protein, 9 aa, Homo Sapiens
KSGRRLGSP

SEQ ID NO: 482877 - protein, 9 aa, Homo Sapiens
SRSDVDMDL

SEQ ID NO: 482878 - protein, 9 aa, Homo Sapiens
RQSLLQQEL

SEQ ID NO: 482879 - protein, 9 aa, Homo Sapiens
PPGTRFRAM

SEQ ID NO: 482880 - protein, 9 aa, Homo Sapiens
PSPVFLMEA

SEQ ID NO: 482881 - protein, 9 aa, Homo Sapiens
QYDQAKLFR

SEQ ID NO: 482882 - protein, 9 aa, Homo Sapiens
YKGADPRES

SEQ ID NO: 482883 - protein, 9 aa, Homo Sapiens
ASRSASLSW

SEQ ID NO: 482884 - protein, 9 aa, Homo Sapiens
LLKLIKVKG

SEQ ID NO: 482885 - protein, 9 aa, Homo Sapiens
GTNHNGNIH

SEQ ID NO: 482886 - protein, 9 aa, Homo Sapiens
CRPKVSNVV

SEQ ID NO: 482887 - protein, 9 aa, Homo Sapiens
TTREMIAGS

SEQ ID NO: 482888 - protein, 9 aa, Homo Sapiens
PRRARARRP

SEQ ID NO: 482889 - protein, 9 aa, Homo Sapiens
SMYIFGGFY

SEQ ID NO: 482890 - protein, 9 aa, Homo Sapiens
LPLSWFQRG

SEQ ID NO: 482891 - protein, 9 aa, Homo Sapiens
NDFHMDLRT

SEQ ID NO: 482892 - protein, 9 aa, Homo Sapiens
VSLGAGAKN

SEQ ID NO: 482893 - protein, 9 aa, Homo Sapiens
TEIQKILKL

SEQ ID NO: 482894 - protein, 9 aa, Homo Sapiens
RTGSEEEAC

SEQ ID NO: 482895 - protein, 9 aa, Homo Sapiens
NCSMQTDQE

SEQ ID NO: 482896 - protein, 9 aa, Homo Sapiens
NMTADASFL

SEQ ID NO: 482897 - protein, 9 aa, Homo Sapiens
YGVMYGENF

SEQ ID NO: 482898 - protein, 9 aa, Homo Sapiens
RPKVSNVVE

SEQ ID NO: 482899 - protein, 9 aa, Homo Sapiens
FYLCSTTTA

SEQ ID NO: 482900 - protein, 9 aa, Homo Sapiens
ADALPALPV

SEQ ID NO: 482901 - protein, 9 aa, Homo Sapiens
QLMVTGPFA

SEQ ID NO: 482902 - protein, 9 aa, Homo Sapiens
VTSAQVGTY

SEQ ID NO: 482903 - protein, 9 aa, Homo Sapiens
RGELYKELE

SEQ ID NO: 482904 - protein, 9 aa, Homo Sapiens
TTEFDTNTT

SEQ ID NO: 482905 - protein, 9 aa, Homo Sapiens
VEPFQCHRR

SEQ ID NO: 482906 - protein, 9 aa, Homo Sapiens
SNCSMQTDQ

SEQ ID NO: 482907 - protein, 9 aa, Homo Sapiens
VQMELDREE

SEQ ID NO: 482908 - protein, 9 aa, Homo Sapiens
PPPGTRFRA

SEQ ID NO: 482909 - protein, 9 aa, Homo Sapiens
GPDHARLYY

SEQ ID NO: 482910 - protein, 9 aa, Homo Sapiens
RATTTCWAA

SEQ ID NO: 482911 - protein, 9 aa, Homo Sapiens
GGGCGGSGG

SEQ ID NO: 482912 - protein, 9 aa, Homo Sapiens
VNNVNVVYT

SEQ ID NO: 482913 - protein, 9 aa, Homo Sapiens
LQLEMAYGV

SEQ ID NO: 482914 - protein, 9 aa, Homo Sapiens
VVLLVATEW

SEQ ID NO: 482915 - protein, 9 aa, Homo Sapiens
KKHTRSHTA

SEQ ID NO: 482916 - protein, 9 aa, Homo Sapiens
LGFFIVSSL

SEQ ID NO: 482917 - protein, 9 aa, Homo Sapiens
ITNAGAGGA

SEQ ID NO: 482918 - protein, 9 aa, Homo Sapiens
KHGCCSTDS

SEQ ID NO: 482919 - protein, 9 aa, Homo Sapiens
FPDSNTITQ

SEQ ID NO: 482920 - protein, 9 aa, Homo Sapiens
DQPQFQNLR

SEQ ID NO: 482921 - protein, 9 aa, Homo Sapiens
TVVEATLAR

SEQ ID NO: 482922 - protein, 9 aa, Homo Sapiens
SPHALVLKK

SEQ ID NO: 482923 - protein, 9 aa, Homo Sapiens
TASAPQATA

SEQ ID NO: 482924 - protein, 9 aa, Homo Sapiens
RFYRRTGVT

SEQ ID NO: 482925 - protein, 9 aa, Homo Sapiens
WWQDFCSVF

SEQ ID NO: 482926 - protein, 9 aa, Homo Sapiens
EDYLLSVWK

SEQ ID NO: 482927 - protein, 9 aa, Homo Sapiens
MIAGSAATL

SEQ ID NO: 482928 - protein, 9 aa, Homo Sapiens
QLNMTADAS

SEQ ID NO: 482929 - protein, 9 aa, Homo Sapiens
DLAVTYFFY

SEQ ID NO: 482930 - protein, 9 aa, Homo Sapiens
QLEMAYGVM

SEQ ID NO: 482931 - protein, 9 aa, Homo Sapiens
AQQISVVVK

SEQ ID NO: 482932 - protein, 9 aa, Homo Sapiens
FVHPMKSRL

SEQ ID NO: 482933 - protein, 9 aa, Homo Sapiens
KKLLKDTEA

SEQ ID NO: 482934 - protein, 9 aa, Homo Sapiens
SCMTLVDKF

SEQ ID NO: 482935 - protein, 9 aa, Homo Sapiens
KDFFDAEIM

SEQ ID NO: 482936 - protein, 9 aa, Homo Sapiens
GACAGNGDD

SEQ ID NO: 482937 - protein, 9 aa, Homo Sapiens
HNSMIALKP

SEQ ID NO: 482938 - protein, 9 aa, Homo Sapiens
LESTASNDL

SEQ ID NO: 482939 - protein, 9 aa, Homo Sapiens
KVNNVNVVY

SEQ ID NO: 482940 - protein, 9 aa, Homo Sapiens
FQLNMTADA

SEQ ID NO: 482941 - protein, 9 aa, Homo Sapiens
QCVQLSLSD

SEQ ID NO: 482942 - protein, 9 aa, Homo Sapiens
LHVTDPSSV

SEQ ID NO: 482943 - protein, 9 aa, Homo Sapiens
GLHRWWQDF

SEQ ID NO: 482944 - protein, 9 aa, Homo Sapiens
DRQSLLQQE

SEQ ID NO: 482945 - protein, 9 aa, Homo Sapiens
ESTASNDLI

SEQ ID NO: 482946 - protein, 9 aa, Homo Sapiens
MSIDRSTVG

SEQ ID NO: 482947 - protein, 9 aa, Homo Sapiens
LFNESVPES

SEQ ID NO: 482948 - protein, 9 aa, Homo Sapiens
SSVKSLCSE

SEQ ID NO: 482949 - protein, 9 aa, Homo Sapiens
ALDVVVLKF

SEQ ID NO: 482950 - protein, 9 aa, Homo Sapiens
CGRAFSRSY

SEQ ID NO: 482951 - protein, 9 aa, Homo Sapiens
PELHLLKLI

SEQ ID NO: 482952 - protein, 9 aa, Homo Sapiens
QRPLSLTRF

SEQ ID NO: 482953 - protein, 9 aa, Homo Sapiens
RPNPFGLLR

SEQ ID NO: 482954 - protein, 9 aa, Homo Sapiens
MPSRIIMYR

SEQ ID NO: 482955 - protein, 9 aa, Homo Sapiens
VSSLVMLIG

SEQ ID NO: 482956 - protein, 9 aa, Homo Sapiens
IELVESGDL

SEQ ID NO: 482957 - protein, 9 aa, Homo Sapiens
LHTCEKPYE

SEQ ID NO: 482958 - protein, 9 aa, Homo Sapiens
SRKRSRLSL

SEQ ID NO: 482959 - protein, 9 aa, Homo Sapiens
EGQPLILNC

SEQ ID NO: 482960 - protein, 9 aa, Homo Sapiens
ALGEAPDHC

SEQ ID NO: 482961 - protein, 9 aa, Homo Sapiens
KKVTEASTG

SEQ ID NO: 482962 - protein, 9 aa, Homo Sapiens
GHSRGPRLS

SEQ ID NO: 482963 - protein, 9 aa, Homo Sapiens
KMLGVVVFA

SEQ ID NO: 482964 - protein, 9 aa, Homo Sapiens
MLKANQTLK

SEQ ID NO: 482965 - protein, 9 aa, Homo Sapiens
SNNEVTLGQ

SEQ ID NO: 482966 - protein, 9 aa, Homo Sapiens
LLIQKRKKV

SEQ ID NO: 482967 - protein, 9 aa, Homo Sapiens
PCQLGPNGL

SEQ ID NO: 482968 - protein, 9 aa, Homo Sapiens
EMQNAAGVN

SEQ ID NO: 482969 - protein, 9 aa, Homo Sapiens
WYLCYKGAD

SEQ ID NO: 482970 - protein, 9 aa, Homo Sapiens
RQQRVKRWG

SEQ ID NO: 482971 - protein, 9 aa, Homo Sapiens
ISPTEFKVV

SEQ ID NO: 482972 - protein, 9 aa, Homo Sapiens
ICMLLRYLL

SEQ ID NO: 482973 - protein, 9 aa, Homo Sapiens
GCCSTDSQS

SEQ ID NO: 482974 - protein, 9 aa, Homo Sapiens
WEPDLFPHQ

SEQ ID NO: 482975 - protein, 9 aa, Homo Sapiens
EYGSFQSFV

SEQ ID NO: 482976 - protein, 9 aa, Homo Sapiens
PAAVSLPGS

SEQ ID NO: 482977 - protein, 9 aa, Homo Sapiens
LEDRQSLLQ

SEQ ID NO: 482978 - protein, 9 aa, Homo Sapiens
SMQTDQEGG

SEQ ID NO: 482979 - protein, 9 aa, Homo Sapiens
ISFQETSAT

SEQ ID NO: 482980 - protein, 9 aa, Homo Sapiens
VAREERGVR

SEQ ID NO: 482981 - protein, 9 aa, Homo Sapiens
PSITRFNTA

SEQ ID NO: 482982 - protein, 9 aa, Homo Sapiens
LKKNVARVW

SEQ ID NO: 482983 - protein, 9 aa, Homo Sapiens
REDYLLSVW

SEQ ID NO: 482984 - protein, 9 aa, Homo Sapiens
TSQGDTILS

SEQ ID NO: 482985 - protein, 9 aa, Homo Sapiens
VYLSQKYKR

SEQ ID NO: 482986 - protein, 9 aa, Homo Sapiens
VLDQCPKRR

SEQ ID NO: 482987 - protein, 9 aa, Homo Sapiens
MDCSVRTWD

SEQ ID NO: 482988 - protein, 9 aa, Homo Sapiens
CDHGCSRWG

SEQ ID NO: 482989 - protein, 9 aa, Homo Sapiens
ARARRPSPG

SEQ ID NO: 482990 - protein, 9 aa, Homo Sapiens
ITQRHPALS

SEQ ID NO: 482991 - protein, 9 aa, Homo Sapiens
IYTCCIELV

SEQ ID NO: 482992 - protein, 9 aa, Homo Sapiens
LCSFQGFVV

SEQ ID NO: 482993 - protein, 9 aa, Homo Sapiens
QLEQRKELW

SEQ ID NO: 482994 - protein, 9 aa, Homo Sapiens
VISITNAGA

SEQ ID NO: 482995 - protein, 9 aa, Homo Sapiens
TEYTAEEEE

SEQ ID NO: 482996 - protein, 9 aa, Homo Sapiens
VERHCQTRL

SEQ ID NO: 482997 - protein, 9 aa, Homo Sapiens
RIPNTKDID

SEQ ID NO: 482998 - protein, 9 aa, Homo Sapiens
EWVFGCDLQ

SEQ ID NO: 482999 - protein, 9 aa, Homo Sapiens
LTQYHRDFG

SEQ ID NO: 483000 - protein, 9 aa, Homo Sapiens
AELYRLQQQ

SEQ ID NO: 483001 - protein, 9 aa, Homo Sapiens
PVQGSAAGT

SEQ ID NO: 483002 - protein, 9 aa, Homo Sapiens
KSLCSERLI

SEQ ID NO: 483003 - protein, 9 aa, Homo Sapiens
GDLSRSLSS

SEQ ID NO: 483004 - protein, 9 aa, Homo Sapiens
AVTYFFYQA

SEQ ID NO: 483005 - protein, 9 aa, Homo Sapiens
ASQSGQLLA

SEQ ID NO: 483006 - protein, 9 aa, Homo Sapiens
QAIKKKLGM

SEQ ID NO: 483007 - protein, 9 aa, Homo Sapiens
LLHSVKNSM

SEQ ID NO: 483008 - protein, 9 aa, Homo Sapiens
PYICKECSK

SEQ ID NO: 483009 - protein, 9 aa, Homo Sapiens
FVASMSIDR

SEQ ID NO: 483010 - protein, 9 aa, Homo Sapiens
SDVDMDLSS

SEQ ID NO: 483011 - protein, 9 aa, Homo Sapiens
YGVECVAFS

SEQ ID NO: 483012 - protein, 9 aa, Homo Sapiens
LDLFLFLCL

SEQ ID NO: 483013 - protein, 9 aa, Homo Sapiens
VNDEKDNCQ

SEQ ID NO: 483014 - protein, 9 aa, Homo Sapiens
LILMLPFCG

SEQ ID NO: 483015 - protein, 9 aa, Homo Sapiens
HKLFCHYNQ

SEQ ID NO: 483016 - protein, 9 aa, Homo Sapiens
LFWKPVQLD

SEQ ID NO: 483017 - protein, 9 aa, Homo Sapiens
AEDMWLMEG

SEQ ID NO: 483018 - protein, 9 aa, Homo Sapiens
SLQQLLDEH

SEQ ID NO: 483019 - protein, 9 aa, Homo Sapiens
VLLQELASS

SEQ ID NO: 483020 - protein, 9 aa, Homo Sapiens
RQAPLPSGM

SEQ ID NO: 483021 - protein, 9 aa, Homo Sapiens
HQPRLHHPV

SEQ ID NO: 483022 - protein, 9 aa, Homo Sapiens
TGYPGRQGP

SEQ ID NO: 483023 - protein, 9 aa, Homo Sapiens
CGRGYDNSH

SEQ ID NO: 483024 - protein, 9 aa, Homo Sapiens
VEQLEDYTL

SEQ ID NO: 483025 - protein, 9 aa, Homo Sapiens
GPNHAVFLL

SEQ ID NO: 483026 - protein, 9 aa, Homo Sapiens
KGADPRESF

SEQ ID NO: 483027 - protein, 9 aa, Homo Sapiens
CHVIALSLF

SEQ ID NO: 483028 - protein, 9 aa, Homo Sapiens
YFLKLRMDT

SEQ ID NO: 483029 - protein, 9 aa, Homo Sapiens
RATALGDGT

SEQ ID NO: 483030 - protein, 9 aa, Homo Sapiens
PVKPKFYLC

SEQ ID NO: 483031 - protein, 9 aa, Homo Sapiens
PWCHKHSVE

SEQ ID NO: 483032 - protein, 9 aa, Homo Sapiens
CISWSSYHN

SEQ ID NO: 483033 - protein, 9 aa, Homo Sapiens
TDITDRRQH

SEQ ID NO: 483034 - protein, 9 aa, Homo Sapiens
RGVDPYLAP

SEQ ID NO: 483035 - protein, 9 aa, Homo Sapiens
GQLMVTGPF

SEQ ID NO: 483036 - protein, 9 aa, Homo Sapiens
LCIPSGAAR

SEQ ID NO: 483037 - protein, 9 aa, Homo Sapiens
LQALNEMRA

SEQ ID NO: 483038 - protein, 9 aa, Homo Sapiens
IYMFNLALA

SEQ ID NO: 483039 - protein, 9 aa, Homo Sapiens
WDASCMTLV

SEQ ID NO: 483040 - protein, 9 aa, Homo Sapiens
KYNEDFERA

SEQ ID NO: 483041 - protein, 9 aa, Homo Sapiens
AMGDPEPAI

SEQ ID NO: 483042 - protein, 9 aa, Homo Sapiens
RSAGGGAGH

SEQ ID NO: 483043 - protein, 9 aa, Homo Sapiens
WVFGCDLQE

SEQ ID NO: 483044 - protein, 9 aa, Homo Sapiens
ASAPQATAT

SEQ ID NO: 483045 - protein, 9 aa, Homo Sapiens
KPQGASLEG

SEQ ID NO: 483046 - protein, 9 aa, Homo Sapiens
VGYSQGMLD

SEQ ID NO: 483047 - protein, 9 aa, Homo Sapiens
HTDCKRRPG

SEQ ID NO: 483048 - protein, 9 aa, Homo Sapiens
LTITDIIVY

SEQ ID NO: 483049 - protein, 9 aa, Homo Sapiens
FKVVLYLNQ

SEQ ID NO: 483050 - protein, 9 aa, Homo Sapiens
RMHTGEKLY

SEQ ID NO: 483051 - protein, 9 aa, Homo Sapiens
CHYNQFIRP

SEQ ID NO: 483052 - protein, 9 aa, Homo Sapiens
LMLWKETGG

SEQ ID NO: 483053 - protein, 9 aa, Homo Sapiens
YEKATEFYK

SEQ ID NO: 483054 - protein, 9 aa, Homo Sapiens
TFQALHGMQ

SEQ ID NO: 483055 - protein, 9 aa, Homo Sapiens
LFYEKKYTG

SEQ ID NO: 483056 - protein, 9 aa, Homo Sapiens
HSDPDKSLL

SEQ ID NO: 483057 - protein, 9 aa, Homo Sapiens
EQRKELWRE

SEQ ID NO: 483058 - protein, 9 aa, Homo Sapiens
DKTRMFCHL

SEQ ID NO: 483059 - protein, 9 aa, Homo Sapiens
RAGAPETQG

SEQ ID NO: 483060 - protein, 9 aa, Homo Sapiens
GTFQALHGM

SEQ ID NO: 483061 - protein, 9 aa, Homo Sapiens
APRPRAPRR

SEQ ID NO: 483062 - protein, 9 aa, Homo Sapiens
CPHFPKAFL

SEQ ID NO: 483063 - protein, 9 aa, Homo Sapiens
TNSTCLNEK

SEQ ID NO: 483064 - protein, 9 aa, Homo Sapiens
IILQLEQRK

SEQ ID NO: 483065 - protein, 9 aa, Homo Sapiens
HALVLKKVT

SEQ ID NO: 483066 - protein, 9 aa, Homo Sapiens
SYFLREHRR

SEQ ID NO: 483067 - protein, 9 aa, Homo Sapiens
PSPPATPTP

SEQ ID NO: 483068 - protein, 9 aa, Homo Sapiens
RVTTPYKYP

SEQ ID NO: 483069 - protein, 9 aa, Homo Sapiens
RVPAEVSKT

SEQ ID NO: 483070 - protein, 9 aa, Homo Sapiens
IYYKEKIPS

SEQ ID NO: 483071 - protein, 9 aa, Homo Sapiens
TKSNGRATA

SEQ ID NO: 483072 - protein, 9 aa, Homo Sapiens
SLGTFQALH

SEQ ID NO: 483073 - protein, 9 aa, Homo Sapiens
KNELHIVEA

SEQ ID NO: 483074 - protein, 9 aa, Homo Sapiens
KDHKVRLQL

SEQ ID NO: 483075 - protein, 9 aa, Homo Sapiens
PSSVKSLCS

SEQ ID NO: 483076 - protein, 9 aa, Homo Sapiens
VKPKFYLCS

SEQ ID NO: 483077 - protein, 9 aa, Homo Sapiens
DYEKATEFY

SEQ ID NO: 483078 - protein, 9 aa, Homo Sapiens
MAQGSEDQR

SEQ ID NO: 483079 - protein, 9 aa, Homo Sapiens
EASKEPRQQ

SEQ ID NO: 483080 - protein, 9 aa, Homo Sapiens
AGHSRGPRL

SEQ ID NO: 483081 - protein, 9 aa, Homo Sapiens
VKPQALSMS

SEQ ID NO: 483082 - protein, 9 aa, Homo Sapiens
TAEKLGGFF

SEQ ID NO: 483083 - protein, 9 aa, Homo Sapiens
SDPDKSLLD

SEQ ID NO: 483084 - protein, 9 aa, Homo Sapiens
SRTITQSEE

SEQ ID NO: 483085 - protein, 9 aa, Homo Sapiens
LHFSALQLS

SEQ ID NO: 483086 - protein, 9 aa, Homo Sapiens
EIMKLGVEN

SEQ ID NO: 483087 - protein, 9 aa, Homo Sapiens
PCLNGCTCH

SEQ ID NO: 483088 - protein, 9 aa, Homo Sapiens
EHNDRQCSR

SEQ ID NO: 483089 - protein, 9 aa, Homo Sapiens
QAPLGYKDP

SEQ ID NO: 483090 - protein, 9 aa, Homo Sapiens
FPKAFLSAS

SEQ ID NO: 483091 - protein, 9 aa, Homo Sapiens
ETCEHNDRQ

SEQ ID NO: 483092 - protein, 9 aa, Homo Sapiens
PQFQNLRQV

SEQ ID NO: 483093 - protein, 9 aa, Homo Sapiens
GPNGLPMPG

SEQ ID NO: 483094 - protein, 9 aa, Homo Sapiens
LSLGTFQAL

SEQ ID NO: 483095 - protein, 9 aa, Homo Sapiens
DNDGVNDEK

SEQ ID NO: 483096 - protein, 9 aa, Homo Sapiens
FQRGMREEM

SEQ ID NO: 483097 - protein, 9 aa, Homo Sapiens
TEWRVRVNS

SEQ ID NO: 483098 - protein, 9 aa, Homo Sapiens
WGGWIVFQR

SEQ ID NO: 483099 - protein, 9 aa, Homo Sapiens
KATEFYKEA

SEQ ID NO: 483100 - protein, 9 aa, Homo Sapiens
FVLLQELAS

SEQ ID NO: 483101 - protein, 9 aa, Homo Sapiens
KETCEHNDR

SEQ ID NO: 483102 - protein, 9 aa, Homo Sapiens
QSTLQSWYL

SEQ ID NO: 483103 - protein, 9 aa, Homo Sapiens
PTPGRSLAF

SEQ ID NO: 483104 - protein, 9 aa, Homo Sapiens
GRRLGSPKP

SEQ ID NO: 483105 - protein, 9 aa, Homo Sapiens
EKHFMEQPS

SEQ ID NO: 483106 - protein, 9 aa, Homo Sapiens
GFKMMNGKQ

SEQ ID NO: 483107 - protein, 9 aa, Homo Sapiens
SALVEYGNL

SEQ ID NO: 483108 - protein, 9 aa, Homo Sapiens
AEFQALAEE

SEQ ID NO: 483109 - protein, 9 aa, Homo Sapiens
FYSVLLNDI

SEQ ID NO: 483110 - protein, 9 aa, Homo Sapiens
DCSVRTWDL

SEQ ID NO: 483111 - protein, 9 aa, Homo Sapiens
DQVGVMFQQ

SEQ ID NO: 483112 - protein, 9 aa, Homo Sapiens
MKTATNIYM

SEQ ID NO: 483113 - protein, 9 aa, Homo Sapiens
LNFFGCWNL

SEQ ID NO: 483114 - protein, 9 aa, Homo Sapiens
KKLPLSWFQ

SEQ ID NO: 483115 - protein, 9 aa, Homo Sapiens
SRSRITKYS

SEQ ID NO: 483116 - protein, 9 aa, Homo Sapiens
GYDNSHVTR

SEQ ID NO: 483117 - protein, 9 aa, Homo Sapiens
KLFVDIDAD

SEQ ID NO: 483118 - protein, 9 aa, Homo Sapiens
PVQGKTQNR

SEQ ID NO: 483119 - protein, 9 aa, Homo Sapiens
DIHELTNVL

SEQ ID NO: 483120 - protein, 9 aa, Homo Sapiens
EFLDVDNSP

SEQ ID NO: 483121 - protein, 9 aa, Homo Sapiens
RQLRGDTPY

SEQ ID NO: 483122 - protein, 9 aa, Homo Sapiens
ESFSCSFSR

SEQ ID NO: 483123 - protein, 9 aa, Homo Sapiens
GATCQNSIY

SEQ ID NO: 483124 - protein, 9 aa, Homo Sapiens
ITRFNTAAS

SEQ ID NO: 483125 - protein, 9 aa, Homo Sapiens
KRSRLSLLR

SEQ ID NO: 483126 - protein, 9 aa, Homo Sapiens
DALDRWEMS

SEQ ID NO: 483127 - protein, 9 aa, Homo Sapiens
PTFLMATAS

SEQ ID NO: 483128 - protein, 9 aa, Homo Sapiens
RIAVMPGGG

SEQ ID NO: 483129 - protein, 9 aa, Homo Sapiens
PKRRRQGRD

SEQ ID NO: 483130 - protein, 9 aa, Homo Sapiens
CPLLQQKLA

SEQ ID NO: 483131 - protein, 9 aa, Homo Sapiens
DRVDGVKYW

SEQ ID NO: 483132 - protein, 9 aa, Homo Sapiens
TFLMATASA

SEQ ID NO: 483133 - protein, 9 aa, Homo Sapiens
SITRFNTAA

SEQ ID NO: 483134 - protein, 9 aa, Homo Sapiens
TEMEEAPTH

SEQ ID NO: 483135 - protein, 9 aa, Homo Sapiens
YFFYQAVDD

SEQ ID NO: 483136 - protein, 9 aa, Homo Sapiens
GSRDRKSGR

SEQ ID NO: 483137 - protein, 9 aa, Homo Sapiens
PGTTGARAT

SEQ ID NO: 483138 - protein, 9 aa, Homo Sapiens
LAEMLKANQ

SEQ ID NO: 483139 - protein, 9 aa, Homo Sapiens
TNNFNLETL

SEQ ID NO: 483140 - protein, 9 aa, Homo Sapiens
CEIHVYCQW

SEQ ID NO: 483141 - protein, 9 aa, Homo Sapiens
VPLTQYHRD

SEQ ID NO: 483142 - protein, 9 aa, Homo Sapiens
PPEPAVGCP

SEQ ID NO: 483143 - protein, 9 aa, Homo Sapiens
QPQFQNLRQ

SEQ ID NO: 483144 - protein, 9 aa, Homo Sapiens
FRAMAIYKQ

SEQ ID NO: 483145 - protein, 9 aa, Homo Sapiens
LLDEVSPRR

SEQ ID NO: 483146 - protein, 9 aa, Homo Sapiens
IQYWVERHC

SEQ ID NO: 483147 - protein, 9 aa, Homo Sapiens
LNEMRADAE

SEQ ID NO: 483148 - protein, 9 aa, Homo Sapiens
GVVVFAFIL

SEQ ID NO: 483149 - protein, 9 aa, Homo Sapiens
AEIMKLGVE

SEQ ID NO: 483150 - protein, 9 aa, Homo Sapiens
SRPCLNGCT

SEQ ID NO: 483151 - protein, 9 aa, Homo Sapiens
TERLKMEQL

SEQ ID NO: 483152 - protein, 9 aa, Homo Sapiens
RALIRFLET

SEQ ID NO: 483153 - protein, 9 aa, Homo Sapiens
TVKENVCII

SEQ ID NO: 483154 - protein, 9 aa, Homo Sapiens
DAEIMKLGV

SEQ ID NO: 483155 - protein, 9 aa, Homo Sapiens
ILPLTLRYI

SEQ ID NO: 483156 - protein, 9 aa, Homo Sapiens
LLRLVAKVE

SEQ ID NO: 483157 - protein, 9 aa, Homo Sapiens
AFSRSYFLR

SEQ ID NO: 483158 - protein, 9 aa, Homo Sapiens
LMGSNVSPG

SEQ ID NO: 483159 - protein, 9 aa, Homo Sapiens
KEPRQQRVK

SEQ ID NO: 483160 - protein, 9 aa, Homo Sapiens
SWAFSLASA

SEQ ID NO: 483161 - protein, 9 aa, Homo Sapiens
PDLFPHQQQ

SEQ ID NO: 483162 - protein, 9 aa, Homo Sapiens
FTLCALCLD

SEQ ID NO: 483163 - protein, 9 aa, Homo Sapiens
SNLNFFGCW

SEQ ID NO: 483164 - protein, 9 aa, Homo Sapiens
LGVVVFAFI

SEQ ID NO: 483165 - protein, 9 aa, Homo Sapiens
SRVFMMALQ

SEQ ID NO: 483166 - protein, 9 aa, Homo Sapiens
PLSWFQRGM

SEQ ID NO: 483167 - protein, 9 aa, Homo Sapiens
GPAREQIPS

SEQ ID NO: 483168 - protein, 9 aa, Homo Sapiens
FLLLLLRVI

SEQ ID NO: 483169 - protein, 9 aa, Homo Sapiens
DIEDELTTA

SEQ ID NO: 483170 - protein, 9 aa, Homo Sapiens
LASADFLFL

SEQ ID NO: 483171 - protein, 9 aa, Homo Sapiens
AEQHERLLH

SEQ ID NO: 483172 - protein, 9 aa, Homo Sapiens
FCHLSFREW

SEQ ID NO: 483173 - protein, 9 aa, Homo Sapiens
HTLVDAHRL

SEQ ID NO: 483174 - protein, 9 aa, Homo Sapiens
LWKETGGVE

SEQ ID NO: 483175 - protein, 9 aa, Homo Sapiens
RKKVKKSSM

SEQ ID NO: 483176 - protein, 9 aa, Homo Sapiens
LPLTLRYIY

SEQ ID NO: 483177 - protein, 9 aa, Homo Sapiens
ELTTALELV

SEQ ID NO: 483178 - protein, 9 aa, Homo Sapiens
DRQCSRHAF

SEQ ID NO: 483179 - protein, 9 aa, Homo Sapiens
CENLKIHKR

SEQ ID NO: 483180 - protein, 9 aa, Homo Sapiens
APRQVLDLD

SEQ ID NO: 483181 - protein, 9 aa, Homo Sapiens
TEALSQRLE

SEQ ID NO: 483182 - protein, 9 aa, Homo Sapiens
LGGLEAPGE

SEQ ID NO: 483183 - protein, 9 aa, Homo Sapiens
MASEILPLT

SEQ ID NO: 483184 - protein, 9 aa, Homo Sapiens
CHTDCKRRP

SEQ ID NO: 483185 - protein, 9 aa, Homo Sapiens
MGSNVSPGQ

SEQ ID NO: 483186 - protein, 9 aa, Homo Sapiens
QPGEPFEIV

SEQ ID NO: 483187 - protein, 9 aa, Homo Sapiens
NFFGCWNLN

SEQ ID NO: 483188 - protein, 9 aa, Homo Sapiens
SLSSSPLGS

SEQ ID NO: 483189 - protein, 9 aa, Homo Sapiens
TCRPKVSNV

SEQ ID NO: 483190 - protein, 9 aa, Homo Sapiens
LAEFQALAE

SEQ ID NO: 483191 - protein, 9 aa, Homo Sapiens
GDTILSTAH

SEQ ID NO: 483192 - protein, 9 aa, Homo Sapiens
PPSTRPSHS

SEQ ID NO: 483193 - protein, 9 aa, Homo Sapiens
ALQLSHRYP

SEQ ID NO: 483194 - protein, 9 aa, Homo Sapiens
AIIQQLSPK

SEQ ID NO: 483195 - protein, 9 aa, Homo Sapiens
ELEGPISFQ

SEQ ID NO: 483196 - protein, 9 aa, Homo Sapiens
VRVYLSQKY

SEQ ID NO: 483197 - protein, 9 aa, Homo Sapiens
NYEQELCGV

SEQ ID NO: 483198 - protein, 9 aa, Homo Sapiens
KYWLSKNKG

SEQ ID NO: 483199 - protein, 9 aa, Homo Sapiens
KRRPGKKFL

SEQ ID NO: 483200 - protein, 9 aa, Homo Sapiens
PADYGQPNC

SEQ ID NO: 483201 - protein, 9 aa, Homo Sapiens
VLVIPARSK

SEQ ID NO: 483202 - protein, 9 aa, Homo Sapiens
PERFSLAPC

SEQ ID NO: 483203 - protein, 9 aa, Homo Sapiens
EQSLNVREE

SEQ ID NO: 483204 - protein, 9 aa, Homo Sapiens
YLSQKYKRI

SEQ ID NO: 483205 - protein, 9 aa, Homo Sapiens
GLRQAPLPS

SEQ ID NO: 483206 - protein, 9 aa, Homo Sapiens
KNGRGTSSN

SEQ ID NO: 483207 - protein, 9 aa, Homo Sapiens
TGIDVEKKE

SEQ ID NO: 483208 - protein, 9 aa, Homo Sapiens
KLHTCEKPY

SEQ ID NO: 483209 - protein, 9 aa, Homo Sapiens
GCGKVFARC

SEQ ID NO: 483210 - protein, 9 aa, Homo Sapiens
APIQECWYR

SEQ ID NO: 483211 - protein, 9 aa, Homo Sapiens
HKLHTCEKP

SEQ ID NO: 483212 - protein, 9 aa, Homo Sapiens
WEMSTGQLP

SEQ ID NO: 483213 - protein, 9 aa, Homo Sapiens
ERHCQTRLE

SEQ ID NO: 483214 - protein, 9 aa, Homo Sapiens
KETGIDVEK

SEQ ID NO: 483215 - protein, 9 aa, Homo Sapiens
RRRQGRDQL

SEQ ID NO: 483216 - protein, 9 aa, Homo Sapiens
FLMEANTQD

SEQ ID NO: 483217 - protein, 9 aa, Homo Sapiens
LHGMQFLHN

SEQ ID NO: 483218 - protein, 9 aa, Homo Sapiens
RLQLEMAYG

SEQ ID NO: 483219 - protein, 9 aa, Homo Sapiens
TSRSRITKY

SEQ ID NO: 483220 - protein, 9 aa, Homo Sapiens
EMLKANQTL

SEQ ID NO: 483221 - protein, 9 aa, Homo Sapiens
PGLPERGDP

SEQ ID NO: 483222 - protein, 9 aa, Homo Sapiens
LEILRNVTD

SEQ ID NO: 483223 - protein, 9 aa, Homo Sapiens
QEIRWELYD

SEQ ID NO: 483224 - protein, 9 aa, Homo Sapiens
LCAKGHSAQ

SEQ ID NO: 483225 - protein, 9 aa, Homo Sapiens
DLRPSVSAA

SEQ ID NO: 483226 - protein, 9 aa, Homo Sapiens
MEQLVSNFP

SEQ ID NO: 483227 - protein, 9 aa, Homo Sapiens
NPFGLLRHL

SEQ ID NO: 483228 - protein, 9 aa, Homo Sapiens
VPGLTGYPG

SEQ ID NO: 483229 - protein, 9 aa, Homo Sapiens
KAPRPRAPR

SEQ ID NO: 483230 - protein, 9 aa, Homo Sapiens
TSRTITQSE

SEQ ID NO: 483231 - protein, 9 aa, Homo Sapiens
REMIAGSAA

SEQ ID NO: 483232 - protein, 9 aa, Homo Sapiens
SVKSLCSER

SEQ ID NO: 483233 - protein, 9 aa, Homo Sapiens
EKQLKLRLR

SEQ ID NO: 483234 - protein, 9 aa, Homo Sapiens
CQSFPTHPQ

SEQ ID NO: 483235 - protein, 9 aa, Homo Sapiens
ILNCESKGK

SEQ ID NO: 483236 - protein, 9 aa, Homo Sapiens
DAPCQLGPN

SEQ ID NO: 483237 - protein, 9 aa, Homo Sapiens
DVLDQCPKR

SEQ ID NO: 483238 - protein, 9 aa, Homo Sapiens
AASAPANVN

SEQ ID NO: 483239 - protein, 9 aa, Homo Sapiens
TGPFATAGI

SEQ ID NO: 483240 - protein, 9 aa, Homo Sapiens
SWFLFWKPV

SEQ ID NO: 483241 - protein, 9 aa, Homo Sapiens
HALFWAQRK

SEQ ID NO: 483242 - protein, 9 aa, Homo Sapiens
APETQGPAA

SEQ ID NO: 483243 - protein, 9 aa, Homo Sapiens
TILSTAHMS

SEQ ID NO: 483244 - protein, 9 aa, Homo Sapiens
SEILPLTLR

SEQ ID NO: 483245 - protein, 9 aa, Homo Sapiens
LGAGAKNEL

SEQ ID NO: 483246 - protein, 9 aa, Homo Sapiens
HQQQCVQLS

SEQ ID NO: 483247 - protein, 9 aa, Homo Sapiens
PSPGTTGAR

SEQ ID NO: 483248 - protein, 9 aa, Homo Sapiens
MDCEIHVYC

SEQ ID NO: 483249 - protein, 9 aa, Homo Sapiens
MDLSRRVAG

SEQ ID NO: 483250 - protein, 9 aa, Homo Sapiens
NSIQGCKVN

SEQ ID NO: 483251 - protein, 9 aa, Homo Sapiens
SQGMLDLVA

SEQ ID NO: 483252 - protein, 9 aa, Homo Sapiens
ILSNLNFFG

SEQ ID NO: 483253 - protein, 9 aa, Homo Sapiens
ARQLRYQVL

SEQ ID NO: 483254 - protein, 9 aa, Homo Sapiens
VNKGTTPLA

SEQ ID NO: 483255 - protein, 9 aa, Homo Sapiens
SIARQLRYQ

SEQ ID NO: 483256 - protein, 9 aa, Homo Sapiens
LFILKARNF

SEQ ID NO: 483257 - protein, 9 aa, Homo Sapiens
TTGLKFSFL

SEQ ID NO: 483258 - protein, 9 aa, Homo Sapiens
STYPADYGQ

SEQ ID NO: 483259 - protein, 9 aa, Homo Sapiens
TCEHNDRQC

SEQ ID NO: 483260 - protein, 9 aa, Homo Sapiens
LTEIQKILK

SEQ ID NO: 483261 - protein, 9 aa, Homo Sapiens
IPTPGRSLA

SEQ ID NO: 483262 - protein, 9 aa, Homo Sapiens
DERGVDPYL

SEQ ID NO: 483263 - protein, 9 aa, Homo Sapiens
VLKKVTEAS

SEQ ID NO: 483264 - protein, 9 aa, Homo Sapiens
LDRFRAATN

SEQ ID NO: 483265 - protein, 9 aa, Homo Sapiens
QSQDQSLDL

SEQ ID NO: 483266 - protein, 9 aa, Homo Sapiens
QMKLFVDID

SEQ ID NO: 483267 - protein, 9 aa, Homo Sapiens
STPCANNRT

SEQ ID NO: 483268 - protein, 9 aa, Homo Sapiens
TVKMLGVVV

SEQ ID NO: 483269 - protein, 9 aa, Homo Sapiens
MSLEILRNV

SEQ ID NO: 483270 - protein, 9 aa, Homo Sapiens
ATLRCKAMG

SEQ ID NO: 483271 - protein, 9 aa, Homo Sapiens
PRATNSTCL

SEQ ID NO: 483272 - protein, 9 aa, Homo Sapiens
LFQLNMTAD

SEQ ID NO: 483273 - protein, 9 aa, Homo Sapiens
DFFDAEIMK

SEQ ID NO: 483274 - protein, 9 aa, Homo Sapiens
PDGGKENGC

SEQ ID NO: 483275 - protein, 9 aa, Homo Sapiens
LVAKVEESP

SEQ ID NO: 483276 - protein, 9 aa, Homo Sapiens
GKNGRGTSS

SEQ ID NO: 483277 - protein, 9 aa, Homo Sapiens
QDQSLDLFL

SEQ ID NO: 483278 - protein, 9 aa, Homo Sapiens
EKLGGFFFF

SEQ ID NO: 483279 - protein, 9 aa, Homo Sapiens
LPSLHTSFF

SEQ ID NO: 483280 - protein, 9 aa, Homo Sapiens
GIDVEKKEP

SEQ ID NO: 483281 - protein, 9 aa, Homo Sapiens
TPGRSLAFT

SEQ ID NO: 483282 - protein, 9 aa, Homo Sapiens
GAGAKNELH

SEQ ID NO: 483283 - protein, 9 aa, Homo Sapiens
RCENLKIHK

SEQ ID NO: 483284 - protein, 9 aa, Homo Sapiens
GPKRQRTGD

SEQ ID NO: 483285 - protein, 9 aa, Homo Sapiens
YQAVDDVKK

SEQ ID NO: 483286 - protein, 9 aa, Homo Sapiens
AFSTCSCHV

SEQ ID NO: 483287 - protein, 9 aa, Homo Sapiens
LTEWLRKRY

SEQ ID NO: 483288 - protein, 9 aa, Homo Sapiens
ADLVTKTDH

SEQ ID NO: 483289 - protein, 9 aa, Homo Sapiens
GELYKELEK

SEQ ID NO: 483290 - protein, 9 aa, Homo Sapiens
RRQGRDQLT

SEQ ID NO: 483291 - protein, 9 aa, Homo Sapiens
TPAGVSCFT

SEQ ID NO: 483292 - protein, 9 aa, Homo Sapiens
PTHPQFAFY

SEQ ID NO: 483293 - protein, 9 aa, Homo Sapiens
TRPSHSLPE

SEQ ID NO: 483294 - protein, 9 aa, Homo Sapiens
VQGSAAGTP

SEQ ID NO: 483295 - protein, 9 aa, Homo Sapiens
STFYGFKEK

SEQ ID NO: 483296 - protein, 9 aa, Homo Sapiens
GLTGYPGRQ

SEQ ID NO: 483297 - protein, 9 aa, Homo Sapiens
KVGSALGIR

SEQ ID NO: 483298 - protein, 9 aa, Homo Sapiens
HGVLLQALN

SEQ ID NO: 483299 - protein, 9 aa, Homo Sapiens
KGKRVEGPE

SEQ ID NO: 483300 - protein, 9 aa, Homo Sapiens
RVYLSQKYK

SEQ ID NO: 483301 - protein, 9 aa, Homo Sapiens
CIPSGAART

SEQ ID NO: 483302 - protein, 9 aa, Homo Sapiens
VSVLMKPSK

SEQ ID NO: 483303 - protein, 9 aa, Homo Sapiens
RKPPMKASL

SEQ ID NO: 483304 - protein, 9 aa, Homo Sapiens
KGPAREQIP

SEQ ID NO: 483305 - protein, 9 aa, Homo Sapiens
ELGMMVWQC

SEQ ID NO: 483306 - protein, 9 aa, Homo Sapiens
GRAGAPETQ

SEQ ID NO: 483307 - protein, 9 aa, Homo Sapiens
VWKSIVDFV

SEQ ID NO: 483308 - protein, 9 aa, Homo Sapiens
ASSGLKQWN

SEQ ID NO: 483309 - protein, 9 aa, Homo Sapiens
TEWLRKRYP

SEQ ID NO: 483310 - protein, 9 aa, Homo Sapiens
TPYKYPRKV

SEQ ID NO: 483311 - protein, 9 aa, Homo Sapiens
DACDHGCSR

SEQ ID NO: 483312 - protein, 9 aa, Homo Sapiens
DITDRRQHT

SEQ ID NO: 483313 - protein, 9 aa, Homo Sapiens
AEVSKTHQN

SEQ ID NO: 483314 - protein, 9 aa, Homo Sapiens
SYHNNLLAS

SEQ ID NO: 483315 - protein, 9 aa, Homo Sapiens
TWEPPAYAK

SEQ ID NO: 483316 - protein, 9 aa, Homo Sapiens
PVRVYLSQK

SEQ ID NO: 483317 - protein, 9 aa, Homo Sapiens
GRRQVAGHS

SEQ ID NO: 483318 - protein, 9 aa, Homo Sapiens
QALNEMRAD

SEQ ID NO: 483319 - protein, 9 aa, Homo Sapiens
STLRISPCL

SEQ ID NO: 483320 - protein, 9 aa, Homo Sapiens
ISNCSMQTD

SEQ ID NO: 483321 - protein, 9 aa, Homo Sapiens
PRLHHPVQG

SEQ ID NO: 483322 - protein, 9 aa, Homo Sapiens
LLPHTACGL

SEQ ID NO: 483323 - protein, 9 aa, Homo Sapiens
TEYKVTPQF

SEQ ID NO: 483324 - protein, 9 aa, Homo Sapiens
DLSRRVAGL

SEQ ID NO: 483325 - protein, 9 aa, Homo Sapiens
DYYYCVSGL

SEQ ID NO: 483326 - protein, 9 aa, Homo Sapiens
YQVLQSEDE

SEQ ID NO: 483327 - protein, 9 aa, Homo Sapiens
FSVIVAREE

SEQ ID NO: 483328 - protein, 9 aa, Homo Sapiens
LGYKDPVSL

SEQ ID NO: 483329 - protein, 9 aa, Homo Sapiens
DQSLDLFLF

SEQ ID NO: 483330 - protein, 9 aa, Homo Sapiens
AGSAATLIT

SEQ ID NO: 483331 - protein, 9 aa, Homo Sapiens
TTALELVDS

SEQ ID NO: 483332 - protein, 9 aa, Homo Sapiens
VEYGNLHYF

SEQ ID NO: 483333 - protein, 9 aa, Homo Sapiens
LGLCSFQGF

SEQ ID NO: 483334 - protein, 9 aa, Homo Sapiens
LSTTFGEKL

SEQ ID NO: 483335 - protein, 9 aa, Homo Sapiens
EYIRSLQQL

SEQ ID NO: 483336 - protein, 9 aa, Homo Sapiens
YLCSTTTAS

SEQ ID NO: 483337 - protein, 9 aa, Homo Sapiens
SIDRSTVGV

SEQ ID NO: 483338 - protein, 9 aa, Homo Sapiens
PPMKASLSL

SEQ ID NO: 483339 - protein, 9 aa, Homo Sapiens
GLERIPRDS

SEQ ID NO: 483340 - protein, 9 aa, Homo Sapiens
LPGHGTLDN

SEQ ID NO: 483341 - protein, 9 aa, Homo Sapiens
MGKGKRVEG

SEQ ID NO: 483342 - protein, 9 aa, Homo Sapiens
QEHESKVDS

SEQ ID NO: 483343 - protein, 9 aa, Homo Sapiens
SSEKPPGFK

SEQ ID NO: 483344 - protein, 9 aa, Homo Sapiens
PMLNPFTYT

SEQ ID NO: 483345 - protein, 9 aa, Homo Sapiens
IGLQNRDVI

SEQ ID NO: 483346 - protein, 9 aa, Homo Sapiens
SSFGKNGRG

SEQ ID NO: 483347 - protein, 9 aa, Homo Sapiens
RLFHKLFCH

SEQ ID NO: 483348 - protein, 9 aa, Homo Sapiens
RPRAPRRAR

SEQ ID NO: 483349 - protein, 9 aa, Homo Sapiens
TEFDTNTTD

SEQ ID NO: 483350 - protein, 9 aa, Homo Sapiens
CRITENGLE

SEQ ID NO: 483351 - protein, 9 aa, Homo Sapiens
LQPRFYRRT

SEQ ID NO: 483352 - protein, 9 aa, Homo Sapiens
GLVSTRSAQ

SEQ ID NO: 483353 - protein, 9 aa, Homo Sapiens
HAVFLLEDG

SEQ ID NO: 483354 - protein, 9 aa, Homo Sapiens
KIQYWVERH

SEQ ID NO: 483355 - protein, 9 aa, Homo Sapiens
KLRLRDFLL

SEQ ID NO: 483356 - protein, 9 aa, Homo Sapiens
EHSRKRSRL

SEQ ID NO: 483357 - protein, 9 aa, Homo Sapiens
LGPNGLPMP

SEQ ID NO: 483358 - protein, 9 aa, Homo Sapiens
PNGLPMPGC

SEQ ID NO: 483359 - protein, 9 aa, Homo Sapiens
LETLKGQAV

SEQ ID NO: 483360 - protein, 9 aa, Homo Sapiens
PDKSLLDEV

SEQ ID NO: 483361 - protein, 9 aa, Homo Sapiens
IPDSIAIIQ

SEQ ID NO: 483362 - protein, 9 aa, Homo Sapiens
WKSIVDFVL

SEQ ID NO: 483363 - protein, 9 aa, Homo Sapiens
YVTEKGQKK

SEQ ID NO: 483364 - protein, 9 aa, Homo Sapiens
SHNSMIALK

SEQ ID NO: 483365 - protein, 9 aa, Homo Sapiens
TCRAHQAAL

SEQ ID NO: 483366 - protein, 9 aa, Homo Sapiens
GGGGCGGSG

SEQ ID NO: 483367 - protein, 9 aa, Homo Sapiens
RNFDERVFK

SEQ ID NO: 483368 - protein, 9 aa, Homo Sapiens
KLIKVKGPR

SEQ ID NO: 483369 - protein, 9 aa, Homo Sapiens
CSFQGFVVA

SEQ ID NO: 483370 - protein, 9 aa, Homo Sapiens
TYFFYQAVD

SEQ ID NO: 483371 - protein, 9 aa, Homo Sapiens
FQALHGMQF

SEQ ID NO: 483372 - protein, 9 aa, Homo Sapiens
KTATNIYMF

SEQ ID NO: 483373 - protein, 9 aa, Homo Sapiens
CATWKVQKD

SEQ ID NO: 483374 - protein, 9 aa, Homo Sapiens
YTCCIELVE

SEQ ID NO: 483375 - protein, 9 aa, Homo Sapiens
SLHTSFFAP

SEQ ID NO: 483376 - protein, 9 aa, Homo Sapiens
GEKKCWNTS

SEQ ID NO: 483377 - protein, 9 aa, Homo Sapiens
LCLDRFRAA

SEQ ID NO: 483378 - protein, 9 aa, Homo Sapiens
KALSAVSSV

SEQ ID NO: 483379 - protein, 9 aa, Homo Sapiens
KLGVPGLTG

SEQ ID NO: 483380 - protein, 9 aa, Homo Sapiens
VDPYLAPLE

SEQ ID NO: 483381 - protein, 9 aa, Homo Sapiens
EIQKILKLL

SEQ ID NO: 483382 - protein, 9 aa, Homo Sapiens
HSRGPRLSL

SEQ ID NO: 483383 - protein, 9 aa, Homo Sapiens
RKELWREGR

SEQ ID NO: 483384 - protein, 9 aa, Homo Sapiens
KGSAKEWVF

SEQ ID NO: 483385 - protein, 9 aa, Homo Sapiens
SAPQATATT

SEQ ID NO: 483386 - protein, 9 aa, Homo Sapiens
CTRDVVKSA

SEQ ID NO: 483387 - protein, 9 aa, Homo Sapiens
LVLKKVTEA

SEQ ID NO: 483388 - protein, 9 aa, Homo Sapiens
GVKYWLSKN

SEQ ID NO: 483389 - protein, 9 aa, Homo Sapiens
NLNFFGCWN

SEQ ID NO: 483390 - protein, 9 aa, Homo Sapiens
TQYHRDFGL

SEQ ID NO: 483391 - protein, 9 aa, Homo Sapiens
NISNCSMQT

SEQ ID NO: 483392 - protein, 9 aa, Homo Sapiens
DGSSFGKNG

SEQ ID NO: 483393 - protein, 9 aa, Homo Sapiens
MMNGKQHIV

SEQ ID NO: 483394 - protein, 9 aa, Homo Sapiens
LFPHQQQCV

SEQ ID NO: 483395 - protein, 9 aa, Homo Sapiens
QTVKMLGVV

SEQ ID NO: 483396 - protein, 9 aa, Homo Sapiens
AKLFRILDV

SEQ ID NO: 483397 - protein, 9 aa, Homo Sapiens
REQIPSSDS

SEQ ID NO: 483398 - protein, 9 aa, Homo Sapiens
QSCGGKAGT

SEQ ID NO: 483399 - protein, 9 aa, Homo Sapiens
VAILMLVSP

SEQ ID NO: 483400 - protein, 9 aa, Homo Sapiens
VTTPYKYPR

SEQ ID NO: 483401 - protein, 9 aa, Homo Sapiens
GLGGLEAPG

SEQ ID NO: 483402 - protein, 9 aa, Homo Sapiens
GQLLAIYYL

SEQ ID NO: 483403 - protein, 9 aa, Homo Sapiens
TCLNEKSLQ

SEQ ID NO: 483404 - protein, 9 aa, Homo Sapiens
PPAYAKGPV

SEQ ID NO: 483405 - protein, 9 aa, Homo Sapiens
DPSSVSTGH

SEQ ID NO: 483406 - protein, 9 aa, Homo Sapiens
LIVQMELDR

SEQ ID NO: 483407 - protein, 9 aa, Homo Sapiens
AADVLDQCP

SEQ ID NO: 483408 - protein, 9 aa, Homo Sapiens
PGTRFRAMA

SEQ ID NO: 483409 - protein, 9 aa, Homo Sapiens
PYTCPHFPK

SEQ ID NO: 483410 - protein, 9 aa, Homo Sapiens
VKAAEEQPG

SEQ ID NO: 483411 - protein, 9 aa, Homo Sapiens
TQNRVCREY

SEQ ID NO: 483412 - protein, 9 aa, Homo Sapiens
NLTNGACAG

SEQ ID NO: 483413 - protein, 9 aa, Homo Sapiens
LEASKEPRQ

SEQ ID NO: 483414 - protein, 9 aa, Homo Sapiens
QLSHRYPRI

SEQ ID NO: 483415 - protein, 9 aa, Homo Sapiens
STCSCHVIA

SEQ ID NO: 483416 - protein, 9 aa, Homo Sapiens
YLHMQLAYP

SEQ ID NO: 483417 - protein, 9 aa, Homo Sapiens
CGKVFARCE

SEQ ID NO: 483418 - protein, 9 aa, Homo Sapiens
ATNIYMFNL

SEQ ID NO: 483419 - protein, 9 aa, Homo Sapiens
TPPPGTRFR

SEQ ID NO: 483420 - protein, 9 aa, Homo Sapiens
LYKELEKSE

SEQ ID NO: 483421 - protein, 9 aa, Homo Sapiens
PSGMMTGTI

SEQ ID NO: 483422 - protein, 9 aa, Homo Sapiens
NVKLRGRLC

SEQ ID NO: 483423 - protein, 9 aa, Homo Sapiens
RWEMSTGQL

SEQ ID NO: 483424 - protein, 9 aa, Homo Sapiens
EPFQCHRRG

SEQ ID NO: 483425 - protein, 9 aa, Homo Sapiens
QPLILNCES

SEQ ID NO: 483426 - protein, 9 aa, Homo Sapiens
FYEKKYTGD

SEQ ID NO: 483427 - protein, 9 aa, Homo Sapiens
VGFLLLLLR

SEQ ID NO: 483428 - protein, 9 aa, Homo Sapiens
ARTNNFNLE

SEQ ID NO: 483429 - protein, 9 aa, Homo Sapiens
ELTNVLDGA

SEQ ID NO: 483430 - protein, 9 aa, Homo Sapiens
DGGKENGCL

SEQ ID NO: 483431 - protein, 9 aa, Homo Sapiens
NTIAKHGCC

SEQ ID NO: 483432 - protein, 9 aa, Homo Sapiens
EEGEQGPGR

SEQ ID NO: 483433 - protein, 9 aa, Homo Sapiens
IRWELYDIF

SEQ ID NO: 483434 - protein, 9 aa, Homo Sapiens
MKNDQDHYT

SEQ ID NO: 483435 - protein, 9 aa, Homo Sapiens
TALPQAAAA

SEQ ID NO: 483436 - protein, 9 aa, Homo Sapiens
GGKENGCLS

SEQ ID NO: 483437 - protein, 9 aa, Homo Sapiens
CAGNGDDGL

SEQ ID NO: 483438 - protein, 9 aa, Homo Sapiens
MMALQYSQK

SEQ ID NO: 483439 - protein, 9 aa, Homo Sapiens
RPCLNGCTC

SEQ ID NO: 483440 - protein, 9 aa, Homo Sapiens
AGIARWIPW

SEQ ID NO: 483441 - protein, 9 aa, Homo Sapiens
VQKDEKLIG

SEQ ID NO: 483442 - protein, 9 aa, Homo Sapiens
SLSWAFSLA

SEQ ID NO: 483443 - protein, 9 aa, Homo Sapiens
FYGFKEKDY

SEQ ID NO: 483444 - protein, 9 aa, Homo Sapiens
GDLLMSLEI

SEQ ID NO: 483445 - protein, 9 aa, Homo Sapiens
DMTTDWGGW

SEQ ID NO: 483446 - protein, 9 aa, Homo Sapiens
STCLNEKSL

SEQ ID NO: 483447 - protein, 9 aa, Homo Sapiens
DPPDGDPGL

SEQ ID NO: 483448 - protein, 9 aa, Homo Sapiens
FAPSFTAPS

SEQ ID NO: 483449 - protein, 9 aa, Homo Sapiens
TVRTCCPGL

SEQ ID NO: 483450 - protein, 9 aa, Homo Sapiens
VSSEKPPGF

SEQ ID NO: 483451 - protein, 9 aa, Homo Sapiens
IVAREERGV

SEQ ID NO: 483452 - protein, 9 aa, Homo Sapiens
LVMLIGARY

SEQ ID NO: 483453 - protein, 9 aa, Homo Sapiens
RNQEHESKV

SEQ ID NO: 483454 - protein, 9 aa, Homo Sapiens
DYLLSVWKS

SEQ ID NO: 483455 - protein, 9 aa, Homo Sapiens
AGHGGAAGG

SEQ ID NO: 483456 - protein, 9 aa, Homo Sapiens
PLLQQKLAA

SEQ ID NO: 483457 - protein, 9 aa, Homo Sapiens
NILEQILRI

SEQ ID NO: 483458 - protein, 9 aa, Homo Sapiens
ARLALAMDL

SEQ ID NO: 483459 - protein, 9 aa, Homo Sapiens
ESLAEMLKA

SEQ ID NO: 483460 - protein, 9 aa, Homo Sapiens
WCKMCSESG

SEQ ID NO: 483461 - protein, 9 aa, Homo Sapiens
PKRQRTGDH

SEQ ID NO: 483462 - protein, 9 aa, Homo Sapiens
NKETCEHND

SEQ ID NO: 483463 - protein, 9 aa, Homo Sapiens
HKAFSTCVS

SEQ ID NO: 483464 - protein, 9 aa, Homo Sapiens
SPSTTPSPP

SEQ ID NO: 483465 - protein, 9 aa, Homo Sapiens
KILKLLLAD

SEQ ID NO: 483466 - protein, 9 aa, Homo Sapiens
ALQYSQKIK

SEQ ID NO: 483467 - protein, 9 aa, Homo Sapiens
RRLGSPKPE

SEQ ID NO: 483468 - protein, 9 aa, Homo Sapiens
IQGCKVNNV

SEQ ID NO: 483469 - protein, 9 aa, Homo Sapiens
VSRPCLNGC

SEQ ID NO: 483470 - protein, 9 aa, Homo Sapiens
AEKPYECNQ

SEQ ID NO: 483471 - protein, 9 aa, Homo Sapiens
ASSLPQCLM

SEQ ID NO: 483472 - protein, 9 aa, Homo Sapiens
YRLQQQQQQ

SEQ ID NO: 483473 - protein, 9 aa, Homo Sapiens
ATCQNSIYE

SEQ ID NO: 483474 - protein, 9 aa, Homo Sapiens
KGPKRQRTG

SEQ ID NO: 483475 - protein, 9 aa, Homo Sapiens
RVILCWACH

SEQ ID NO: 483476 - protein, 9 aa, Homo Sapiens
GRDQLTQPC

SEQ ID NO: 483477 - protein, 9 aa, Homo Sapiens
MYRDGVGDG

SEQ ID NO: 483478 - protein, 9 aa, Homo Sapiens
KIYTCCIEL

SEQ ID NO: 483479 - protein, 9 aa, Homo Sapiens
DALPALPVF

SEQ ID NO: 483480 - protein, 9 aa, Homo Sapiens
TLPGHGTLD

SEQ ID NO: 483481 - protein, 9 aa, Homo Sapiens
EFDTNTTDI

SEQ ID NO: 483482 - protein, 9 aa, Homo Sapiens
NSRLEQSLN

SEQ ID NO: 483483 - protein, 9 aa, Homo Sapiens
ALIRFLETE

SEQ ID NO: 483484 - protein, 9 aa, Homo Sapiens
NDACDHGCS

SEQ ID NO: 483485 - protein, 9 aa, Homo Sapiens
DVIGVAETG

SEQ ID NO: 483486 - protein, 9 aa, Homo Sapiens
MGDPEPAIH

SEQ ID NO: 483487 - protein, 9 aa, Homo Sapiens
PGRAGGRQL

SEQ ID NO: 483488 - protein, 9 aa, Homo Sapiens
LPQAAAAAA

SEQ ID NO: 483489 - protein, 9 aa, Homo Sapiens
LRCKAMGDP

SEQ ID NO: 483490 - protein, 9 aa, Homo Sapiens
LETQDLTML

SEQ ID NO: 483491 - protein, 9 aa, Homo Sapiens
RDVRACSST

SEQ ID NO: 483492 - protein, 9 aa, Homo Sapiens
QLFQLNMTA

SEQ ID NO: 483493 - protein, 9 aa, Homo Sapiens
LKLRLRDFL

SEQ ID NO: 483494 - protein, 9 aa, Homo Sapiens
TTDWGGWIV

SEQ ID NO: 483495 - protein, 9 aa, Homo Sapiens
VPAEVSKTH

SEQ ID NO: 483496 - protein, 9 aa, Homo Sapiens
LGGAHCTEA

SEQ ID NO: 483497 - protein, 9 aa, Homo Sapiens
REEQSWTVV

SEQ ID NO: 483498 - protein, 9 aa, Homo Sapiens
VSKQLSSFE

SEQ ID NO: 483499 - protein, 9 aa, Homo Sapiens
SYKGNILEQ

SEQ ID NO: 483500 - protein, 9 aa, Homo Sapiens
LTQCLVVQS

SEQ ID NO: 483501 - protein, 9 aa, Homo Sapiens
VTKTDHLVE

SEQ ID NO: 483502 - protein, 9 aa, Homo Sapiens
GVMFQQMGI

SEQ ID NO: 483503 - protein, 9 aa, Homo Sapiens
DGALDVVVL

SEQ ID NO: 483504 - protein, 9 aa, Homo Sapiens
SSSWEPDLF

SEQ ID NO: 483505 - protein, 9 aa, Homo Sapiens
LSQSLYYGQ

SEQ ID NO: 483506 - protein, 9 aa, Homo Sapiens
SEKETGIDV

SEQ ID NO: 483507 - protein, 9 aa, Homo Sapiens
WFQRGMREE

SEQ ID NO: 483508 - protein, 9 aa, Homo Sapiens
PFGLLRHLQ

SEQ ID NO: 483509 - protein, 9 aa, Homo Sapiens
PQIQPRHRS

SEQ ID NO: 483510 - protein, 9 aa, Homo Sapiens
QLGPNGLPM

SEQ ID NO: 483511 - protein, 9 aa, Homo Sapiens
MDLSSATAV

SEQ ID NO: 483512 - protein, 9 aa, Homo Sapiens
RATQYICML

SEQ ID NO: 483513 - protein, 9 aa, Homo Sapiens
DLFPHQQQC

SEQ ID NO: 483514 - protein, 9 aa, Homo Sapiens
EEQSWTVVE

SEQ ID NO: 483515 - protein, 9 aa, Homo Sapiens
QEDQVGVMF

SEQ ID NO: 483516 - protein, 9 aa, Homo Sapiens
DFERAWRED

SEQ ID NO: 483517 - protein, 9 aa, Homo Sapiens
DNSHVTRMT

SEQ ID NO: 483518 - protein, 9 aa, Homo Sapiens
RRTGSEEEA

SEQ ID NO: 483519 - protein, 9 aa, Homo Sapiens
SSLQDGHTE

SEQ ID NO: 483520 - protein, 9 aa, Homo Sapiens
AEMLKANQT

SEQ ID NO: 483521 - protein, 9 aa, Homo Sapiens
TPSPVFLME

SEQ ID NO: 483522 - protein, 9 aa, Homo Sapiens
TEFYKEALR

SEQ ID NO: 483523 - protein, 9 aa, Homo Sapiens
LLLLRVILC

SEQ ID NO: 483524 - protein, 9 aa, Homo Sapiens
ITDRRQHTV

SEQ ID NO: 483525 - protein, 9 aa, Homo Sapiens
HTACGLGAA

SEQ ID NO: 483526 - protein, 9 aa, Homo Sapiens
MEQPSFDRQ

SEQ ID NO: 483527 - protein, 9 aa, Homo Sapiens
KVTEASTGT

SEQ ID NO: 483528 - protein, 9 aa, Homo Sapiens
SSITYDLPL

SEQ ID NO: 483529 - protein, 9 aa, Homo Sapiens
QCTSRTITQ

SEQ ID NO: 483530 - protein, 9 aa, Homo Sapiens
KYGVECVAF

SEQ ID NO: 483531 - protein, 9 aa, Homo Sapiens
LDLDDLVFT

SEQ ID NO: 483532 - protein, 9 aa, Homo Sapiens
RSRLSLLRP

SEQ ID NO: 483533 - protein, 9 aa, Homo Sapiens
DLYPPRRQG

SEQ ID NO: 483534 - protein, 9 aa, Homo Sapiens
KGSRNDFHM

SEQ ID NO: 483535 - protein, 9 aa, Homo Sapiens
VKKSSMAKL

SEQ ID NO: 483536 - protein, 9 aa, Homo Sapiens
AGGGAGHGG

SEQ ID NO: 483537 - protein, 9 aa, Homo Sapiens
KPYICKECS

SEQ ID NO: 483538 - protein, 9 aa, Homo Sapiens
TNIYMFNLA

SEQ ID NO: 483539 - protein, 9 aa, Homo Sapiens
GTMWFICDG

SEQ ID NO: 483540 - protein, 9 aa, Homo Sapiens
IAIIQQLSP

SEQ ID NO: 483541 - protein, 9 aa, Homo Sapiens
QVGTYRCYS

SEQ ID NO: 483542 - protein, 9 aa, Homo Sapiens
SQAPLGYKD

SEQ ID NO: 483543 - protein, 9 aa, Homo Sapiens
NDGVNDEKD

SEQ ID NO: 483544 - protein, 9 aa, Homo Sapiens
DWGGWIVFQ

SEQ ID NO: 483545 - protein, 9 aa, Homo Sapiens
KADALPALP

SEQ ID NO: 483546 - protein, 9 aa, Homo Sapiens
PLHVTDPSS

SEQ ID NO: 483547 - protein, 9 aa, Homo Sapiens
RAFSRSYFL

SEQ ID NO: 483548 - protein, 9 aa, Homo Sapiens
VKLRGRLCR

SEQ ID NO: 483549 - protein, 9 aa, Homo Sapiens
LKMEQLVSN

SEQ ID NO: 483550 - protein, 9 aa, Homo Sapiens
RLLHSVKNS

SEQ ID NO: 483551 - protein, 9 aa, Homo Sapiens
CKAMGDPEP

SEQ ID NO: 483552 - protein, 9 aa, Homo Sapiens
EGPISFQET

SEQ ID NO: 483553 - protein, 9 aa, Homo Sapiens
QLFVGTMTL

SEQ ID NO: 483554 - protein, 9 aa, Homo Sapiens
QNLDGALDV

SEQ ID NO: 483555 - protein, 9 aa, Homo Sapiens
ERFSLAPCL

SEQ ID NO: 483556 - protein, 9 aa, Homo Sapiens
GCKVNNVNV

SEQ ID NO: 483557 - protein, 9 aa, Homo Sapiens
RPQKQEMKN

SEQ ID NO: 483558 - protein, 9 aa, Homo Sapiens
CVQLSLSDG

SEQ ID NO: 483559 - protein, 9 aa, Homo Sapiens
IYLLHLASA

SEQ ID NO: 483560 - protein, 9 aa, Homo Sapiens
RYLAFVHPM

SEQ ID NO: 483561 - protein, 9 aa, Homo Sapiens
TPSPPATPT

SEQ ID NO: 483562 - protein, 9 aa, Homo Sapiens
MQTDQEGGS

SEQ ID NO: 483563 - protein, 9 aa, Homo Sapiens
WTVVEATLA

SEQ ID NO: 483564 - protein, 9 aa, Homo Sapiens
DAFKSRLHE

SEQ ID NO: 483565 - protein, 9 aa, Homo Sapiens
FMMALQYSQ

SEQ ID NO: 483566 - protein, 9 aa, Homo Sapiens
ARPSLNTAL

SEQ ID NO: 483567 - protein, 9 aa, Homo Sapiens
EKGQKKHFQ

SEQ ID NO: 483568 - protein, 9 aa, Homo Sapiens
YLAPLENFN

SEQ ID NO: 483569 - protein, 9 aa, Homo Sapiens
PARTNNFNL

SEQ ID NO: 483570 - protein, 9 aa, Homo Sapiens
PVTPFDTKW

SEQ ID NO: 483571 - protein, 9 aa, Homo Sapiens
FVGTMTLLS

SEQ ID NO: 483572 - protein, 9 aa, Homo Sapiens
SATLRQLRG

SEQ ID NO: 483573 - protein, 9 aa, Homo Sapiens
EIEHVFLAN

SEQ ID NO: 483574 - protein, 9 aa, Homo Sapiens
GKRVEGPEV

SEQ ID NO: 483575 - protein, 9 aa, Homo Sapiens
GVNDEKDNC

SEQ ID NO: 483576 - protein, 9 aa, Homo Sapiens
FSRRESSSW

SEQ ID NO: 483577 - protein, 9 aa, Homo Sapiens
SLSDGSSFG

SEQ ID NO: 483578 - protein, 9 aa, Homo Sapiens
RFSLAPCLL

SEQ ID NO: 483579 - protein, 9 aa, Homo Sapiens
LCSERLIRT

SEQ ID NO: 483580 - protein, 9 aa, Homo Sapiens
VDAHRLRGN

SEQ ID NO: 483581 - protein, 9 aa, Homo Sapiens
RRQVAGHSR

SEQ ID NO: 483582 - protein, 9 aa, Homo Sapiens
ESKVDSPKR

SEQ ID NO: 483583 - protein, 9 aa, Homo Sapiens
MLGRQVLPP

SEQ ID NO: 483584 - protein, 9 aa, Homo Sapiens
ALVDLTFPG

SEQ ID NO: 483585 - protein, 9 aa, Homo Sapiens
TMTLLSGVL

SEQ ID NO: 483586 - protein, 9 aa, Homo Sapiens
ILKLLLADL

SEQ ID NO: 483587 - protein, 9 aa, Homo Sapiens
SDGSSFGKN

SEQ ID NO: 483588 - protein, 9 aa, Homo Sapiens
CGLGAAEMP

SEQ ID NO: 483589 - protein, 9 aa, Homo Sapiens
MKASLSLRK

SEQ ID NO: 483590 - protein, 9 aa, Homo Sapiens
RMFCHLSFR

SEQ ID NO: 483591 - protein, 9 aa, Homo Sapiens
GYKDPVSLR

SEQ ID NO: 483592 - protein, 9 aa, Homo Sapiens
SCTVKENVC

SEQ ID NO: 483593 - protein, 9 aa, Homo Sapiens
KEVKPQALS

SEQ ID NO: 483594 - protein, 9 aa, Homo Sapiens
GYSGATCQN

SEQ ID NO: 483595 - protein, 9 aa, Homo Sapiens
APPSTRPSH

SEQ ID NO: 483596 - protein, 9 aa, Homo Sapiens
VNTILPIKT

SEQ ID NO: 483597 - protein, 9 aa, Homo Sapiens
TDPSSVSTG

SEQ ID NO: 483598 - protein, 9 aa, Homo Sapiens
ALEEFKALV

SEQ ID NO: 483599 - protein, 9 aa, Homo Sapiens
TTPSPPATP

SEQ ID NO: 483600 - protein, 9 aa, Homo Sapiens
RKRSRLSLL

SEQ ID NO: 483601 - protein, 9 aa, Homo Sapiens
HESKVDSPK

SEQ ID NO: 483602 - protein, 9 aa, Homo Sapiens
DGFETHLRV

SEQ ID NO: 483603 - protein, 9 aa, Homo Sapiens
GKTQNRVCR

SEQ ID NO: 483604 - protein, 9 aa, Homo Sapiens
FQALAEEGA

SEQ ID NO: 483605 - protein, 9 aa, Homo Sapiens
APPPAARPS

SEQ ID NO: 483606 - protein, 9 aa, Homo Sapiens
HQWVTALPQ

SEQ ID NO: 483607 - protein, 9 aa, Homo Sapiens
GAARTKAFS

SEQ ID NO: 483608 - protein, 9 aa, Homo Sapiens
MNHLNTIAK

SEQ ID NO: 483609 - protein, 9 aa, Homo Sapiens
IRSLQQLLD

SEQ ID NO: 483610 - protein, 9 aa, Homo Sapiens
KPVRVYLSQ

SEQ ID NO: 483611 - protein, 9 aa, Homo Sapiens
PSHSLPESS

SEQ ID NO: 483612 - protein, 9 aa, Homo Sapiens
PGLTGYPGR

SEQ ID NO: 483613 - protein, 9 aa, Homo Sapiens
ETQDLTMLP

SEQ ID NO: 483614 - protein, 9 aa, Homo Sapiens
IVYFTGTLA

SEQ ID NO: 483615 - protein, 9 aa, Homo Sapiens
SNSNNEVTL

SEQ ID NO: 483616 - protein, 9 aa, Homo Sapiens
LMSLEILRN

SEQ ID NO: 483617 - protein, 9 aa, Homo Sapiens
RQPLVEQLE

SEQ ID NO: 483618 - protein, 9 aa, Homo Sapiens
SSNSTLRIS

SEQ ID NO: 483619 - protein, 9 aa, Homo Sapiens
GIPTPGRSL

SEQ ID NO: 483620 - protein, 9 aa, Homo Sapiens
FQVVQPSFP

SEQ ID NO: 483621 - protein, 9 aa, Homo Sapiens
WLMEGALEV

SEQ ID NO: 483622 - protein, 9 aa, Homo Sapiens
AKEWVFGCD

SEQ ID NO: 483623 - protein, 9 aa, Homo Sapiens
GEAPDHCYE

SEQ ID NO: 483624 - protein, 9 aa, Homo Sapiens
NSTLRISPC

SEQ ID NO: 483625 - protein, 9 aa, Homo Sapiens
RKIYTCCIE

SEQ ID NO: 483626 - protein, 9 aa, Homo Sapiens
LLQELASSL

SEQ ID NO: 483627 - protein, 9 aa, Homo Sapiens
AFVHPMKSR

SEQ ID NO: 483628 - protein, 9 aa, Homo Sapiens
QNRDVIGVA

SEQ ID NO: 483629 - protein, 9 aa, Homo Sapiens
VTPFDTKWT

SEQ ID NO: 483630 - protein, 9 aa, Homo Sapiens
IEHVFLANL

SEQ ID NO: 483631 - protein, 9 aa, Homo Sapiens
TGARATTTC

SEQ ID NO: 483632 - protein, 9 aa, Homo Sapiens
NDRQCSRHA

SEQ ID NO: 483633 - protein, 9 aa, Homo Sapiens
KSKYNEDFE

SEQ ID NO: 483634 - protein, 9 aa, Homo Sapiens
LRISPCLLE

SEQ ID NO: 483635 - protein, 9 aa, Homo Sapiens
LHMQLAYPN

SEQ ID NO: 483636 - protein, 9 aa, Homo Sapiens
PGFLSEVKA

SEQ ID NO: 483637 - protein, 9 aa, Homo Sapiens
QNGWSETFP

SEQ ID NO: 483638 - protein, 9 aa, Homo Sapiens
LSWFQRGMR

SEQ ID NO: 483639 - protein, 9 aa, Homo Sapiens
FTYTLRNQQ

SEQ ID NO: 483640 - protein, 9 aa, Homo Sapiens
PSRIIMYRD

SEQ ID NO: 483641 - protein, 9 aa, Homo Sapiens
RVHHKLHTC

SEQ ID NO: 483642 - protein, 9 aa, Homo Sapiens
RGYDNSHVT

SEQ ID NO: 483643 - protein, 9 aa, Homo Sapiens
RDQLTQPCG

SEQ ID NO: 483644 - protein, 9 aa, Homo Sapiens
KQTVKMLGV

SEQ ID NO: 483645 - protein, 9 aa, Homo Sapiens
LHESNSKVN

SEQ ID NO: 483646 - protein, 9 aa, Homo Sapiens
LNTIAKHGC

SEQ ID NO: 483647 - protein, 9 aa, Homo Sapiens
KSRLHESNS

SEQ ID NO: 483648 - protein, 9 aa, Homo Sapiens
AKSKHALFW

SEQ ID NO: 483649 - protein, 9 aa, Homo Sapiens
SMSIDRSTV

SEQ ID NO: 483650 - protein, 9 aa, Homo Sapiens
IKILGDYYY

SEQ ID NO: 483651 - protein, 9 aa, Homo Sapiens
DGDPGLPER

SEQ ID NO: 483652 - protein, 9 aa, Homo Sapiens
TGSALLALQ

SEQ ID NO: 483653 - protein, 9 aa, Homo Sapiens
CTGLERIPR

SEQ ID NO: 483654 - protein, 9 aa, Homo Sapiens
PAREQIPSS

SEQ ID NO: 483655 - protein, 9 aa, Homo Sapiens
GTRFRAMAI

SEQ ID NO: 483656 - protein, 9 aa, Homo Sapiens
VKSLCSERL

SEQ ID NO: 483657 - protein, 9 aa, Homo Sapiens
FGKPVRVYL

SEQ ID NO: 483658 - protein, 9 aa, Homo Sapiens
SVSAAVFED

SEQ ID NO: 483659 - protein, 9 aa, Homo Sapiens
LGTFQALHG

SEQ ID NO: 483660 - protein, 9 aa, Homo Sapiens
PLILNCESK

SEQ ID NO: 483661 - protein, 9 aa, Homo Sapiens
CDMTTDWGG

SEQ ID NO: 483662 - protein, 9 aa, Homo Sapiens
ERYAELYRL

SEQ ID NO: 483663 - protein, 9 aa, Homo Sapiens
NLETLKGQA

SEQ ID NO: 483664 - protein, 9 aa, Homo Sapiens
WKVRQRPQI

SEQ ID NO: 483665 - protein, 9 aa, Homo Sapiens
SQDQSLDLF

SEQ ID NO: 483666 - protein, 9 aa, Homo Sapiens
PSSVSTGHA

SEQ ID NO: 483667 - protein, 9 aa, Homo Sapiens
LEQSLNVRE

SEQ ID NO: 483668 - protein, 9 aa, Homo Sapiens
LFRILDVAQ

SEQ ID NO: 483669 - protein, 9 aa, Homo Sapiens
KRVTTPYKY

SEQ ID NO: 483670 - protein, 9 aa, Homo Sapiens
SLQPRFYRR

SEQ ID NO: 483671 - protein, 9 aa, Homo Sapiens
KEWVFGCDL

SEQ ID NO: 483672 - protein, 9 aa, Homo Sapiens
MWFICDGCG

SEQ ID NO: 483673 - protein, 9 aa, Homo Sapiens
TTDIALKVF

SEQ ID NO: 483674 - protein, 9 aa, Homo Sapiens
SQSTLQSWY

SEQ ID NO: 483675 - protein, 9 aa, Homo Sapiens
QSLDLFLFL

SEQ ID NO: 483676 - protein, 9 aa, Homo Sapiens
KRVEGPEVA

SEQ ID NO: 483677 - protein, 9 aa, Homo Sapiens
WSEADREPC

SEQ ID NO: 483678 - protein, 9 aa, Homo Sapiens
STDSQSTLQ

SEQ ID NO: 483679 - protein, 9 aa, Homo Sapiens
KLKAPRPRA

SEQ ID NO: 483680 - protein, 9 aa, Homo Sapiens
RETGSALLA

SEQ ID NO: 483681 - protein, 9 aa, Homo Sapiens
AGDLLMSLE

SEQ ID NO: 483682 - protein, 9 aa, Homo Sapiens
EQIPSSDSS

SEQ ID NO: 483683 - protein, 9 aa, Homo Sapiens
MRRTGSEEE

SEQ ID NO: 483684 - protein, 9 aa, Homo Sapiens
GTYFKIRAI

SEQ ID NO: 483685 - protein, 9 aa, Homo Sapiens
RMDTNTRNP

SEQ ID NO: 483686 - protein, 9 aa, Homo Sapiens
TEKGQKKHF

SEQ ID NO: 483687 - protein, 9 aa, Homo Sapiens
LMATASAPQ

SEQ ID NO: 483688 - protein, 9 aa, Homo Sapiens
TCADVNECD

SEQ ID NO: 483689 - protein, 9 aa, Homo Sapiens
KTHQNSYQP

SEQ ID NO: 483690 - protein, 9 aa, Homo Sapiens
FLSEVKALS

SEQ ID NO: 483691 - protein, 9 aa, Homo Sapiens
VSSYIAHLR

SEQ ID NO: 483692 - protein, 9 aa, Homo Sapiens
GKVFARCEN

SEQ ID NO: 483693 - protein, 9 aa, Homo Sapiens
RLALAMDLS

SEQ ID NO: 483694 - protein, 9 aa, Homo Sapiens
KLRGRLCRI

SEQ ID NO: 483695 - protein, 9 aa, Homo Sapiens
QVLDLDDLV

SEQ ID NO: 483696 - protein, 9 aa, Homo Sapiens
DLYLHMQLA

SEQ ID NO: 483697 - protein, 9 aa, Homo Sapiens
RSAVEYIRS

SEQ ID NO: 483698 - protein, 9 aa, Homo Sapiens
PHFPKAFLS

SEQ ID NO: 483699 - protein, 9 aa, Homo Sapiens
VFELGLCSF

SEQ ID NO: 483700 - protein, 9 aa, Homo Sapiens
ARIPDSIAI

SEQ ID NO: 483701 - protein, 9 aa, Homo Sapiens
NYCADYEKN

SEQ ID NO: 483702 - protein, 9 aa, Homo Sapiens
SPSSNSTLR

SEQ ID NO: 483703 - protein, 9 aa, Homo Sapiens
VEPTTEYTA

SEQ ID NO: 483704 - protein, 9 aa, Homo Sapiens
DQAKLFRIL

SEQ ID NO: 483705 - protein, 9 aa, Homo Sapiens
VSPGQPGTP

SEQ ID NO: 483706 - protein, 9 aa, Homo Sapiens
TPWLTPIVS

SEQ ID NO: 483707 - protein, 9 aa, Homo Sapiens
KKRALIRFL

SEQ ID NO: 483708 - protein, 9 aa, Homo Sapiens
LQLEQRKEL

SEQ ID NO: 483709 - protein, 9 aa, Homo Sapiens
MGFKMMNGK

SEQ ID NO: 483710 - protein, 9 aa, Homo Sapiens
LGQDTADSW

SEQ ID NO: 483711 - protein, 9 aa, Homo Sapiens
YAGDLLMSL

SEQ ID NO: 483712 - protein, 9 aa, Homo Sapiens
KGSFRPMWV

SEQ ID NO: 483713 - protein, 9 aa, Homo Sapiens
CKVNNVNVV

SEQ ID NO: 483714 - protein, 9 aa, Homo Sapiens
LDLKKNVAR

SEQ ID NO: 483715 - protein, 9 aa, Homo Sapiens
EVKALSAVS

SEQ ID NO: 483716 - protein, 9 aa, Homo Sapiens
KKLMLWKET

SEQ ID NO: 483717 - protein, 9 aa, Homo Sapiens
MIYVTEKGQ

SEQ ID NO: 483718 - protein, 9 aa, Homo Sapiens
ALDRWEMST

SEQ ID NO: 483719 - protein, 9 aa, Homo Sapiens
ACGLGAAEM

SEQ ID NO: 483720 - protein, 9 aa, Homo Sapiens
DCAPPPAAR

SEQ ID NO: 483721 - protein, 9 aa, Homo Sapiens
TRFRAMAIY

SEQ ID NO: 483722 - protein, 9 aa, Homo Sapiens
CSMQTDQEG

SEQ ID NO: 483723 - protein, 9 aa, Homo Sapiens
SLAPCLLGS

SEQ ID NO: 483724 - protein, 9 aa, Homo Sapiens
WLRKRYPTN

SEQ ID NO: 483725 - protein, 9 aa, Homo Sapiens
DTILSTAHM

SEQ ID NO: 483726 - protein, 9 aa, Homo Sapiens
ASEDMKTCA

SEQ ID NO: 483727 - protein, 9 aa, Homo Sapiens
LVEQLEDYT

SEQ ID NO: 483728 - protein, 9 aa, Homo Sapiens
DLLMSLEIL

SEQ ID NO: 483729 - protein, 9 aa, Homo Sapiens
LEMAYGVMY

SEQ ID NO: 483730 - protein, 9 aa, Homo Sapiens
QLEDYTLQV

SEQ ID NO: 483731 - protein, 9 aa, Homo Sapiens
NNEVTLGQD

SEQ ID NO: 483732 - protein, 9 aa, Homo Sapiens
SFQETSATS

SEQ ID NO: 483733 - protein, 9 aa, Homo Sapiens
QPRFYRRTG

SEQ ID NO: 483734 - protein, 9 aa, Homo Sapiens
LGGFFFFFF

SEQ ID NO: 483735 - protein, 9 aa, Homo Sapiens
KVRLQLEMA

SEQ ID NO: 483736 - protein, 9 aa, Homo Sapiens
YTCPHFPKA

SEQ ID NO: 483737 - protein, 9 aa, Homo Sapiens
ITDIIVYFT

SEQ ID NO: 483738 - protein, 9 aa, Homo Sapiens
VAPMLNPFT

SEQ ID NO: 483739 - protein, 9 aa, Homo Sapiens
KKEVKPQAL

SEQ ID NO: 483740 - protein, 9 aa, Homo Sapiens
TREQQEIYY

SEQ ID NO: 483741 - protein, 9 aa, Homo Sapiens
ERLKMEQLV

SEQ ID NO: 483742 - protein, 9 aa, Homo Sapiens
GKGLIHTDI

SEQ ID NO: 483743 - protein, 9 aa, Homo Sapiens
ARKGPAREQ

SEQ ID NO: 483744 - protein, 9 aa, Homo Sapiens
TEFKVVLYL

SEQ ID NO: 483745 - protein, 9 aa, Homo Sapiens
PALPVFCVA

SEQ ID NO: 483746 - protein, 9 aa, Homo Sapiens
STTFGEKLN

SEQ ID NO: 483747 - protein, 9 aa, Homo Sapiens
SWAGIARWI

SEQ ID NO: 483748 - protein, 9 aa, Homo Sapiens
SQGDTILST

SEQ ID NO: 483749 - protein, 9 aa, Homo Sapiens
QNRVCREYF

SEQ ID NO: 483750 - protein, 9 aa, Homo Sapiens
SRNDFHMDL

SEQ ID NO: 483751 - protein, 9 aa, Homo Sapiens
VNSSCSRMS

SEQ ID NO: 483752 - protein, 9 aa, Homo Sapiens
IVAYRLGIK

SEQ ID NO: 483753 - protein, 9 aa, Homo Sapiens
LGMMVWQCG

SEQ ID NO: 483754 - protein, 9 aa, Homo Sapiens
GYSQGMLDL

SEQ ID NO: 483755 - protein, 9 aa, Homo Sapiens
NVREELRHF

SEQ ID NO: 483756 - protein, 9 aa, Homo Sapiens
PRARPNPFG

SEQ ID NO: 483757 - protein, 9 aa, Homo Sapiens
RWIPWTIHF

SEQ ID NO: 483758 - protein, 9 aa, Homo Sapiens
DYFLKLRMD

SEQ ID NO: 483759 - protein, 9 aa, Homo Sapiens
GLKQWNKRW

SEQ ID NO: 483760 - protein, 9 aa, Homo Sapiens
VDGVKYWLS

SEQ ID NO: 483761 - protein, 9 aa, Homo Sapiens
VYFTGTLAE

SEQ ID NO: 483762 - protein, 9 aa, Homo Sapiens
KLGMLGRQV

SEQ ID NO: 483763 - protein, 9 aa, Homo Sapiens
MALYGTTSE

SEQ ID NO: 483764 - protein, 9 aa, Homo Sapiens
PKVSNVVEF

SEQ ID NO: 483765 - protein, 9 aa, Homo Sapiens
VLTQCLVVQ

SEQ ID NO: 483766 - protein, 9 aa, Homo Sapiens
TPGSHFVGV

SEQ ID NO: 483767 - protein, 9 aa, Homo Sapiens
AGVNSSCSR

SEQ ID NO: 483768 - protein, 9 aa, Homo Sapiens
YKDPVSLRR

SEQ ID NO: 483769 - protein, 9 aa, Homo Sapiens
RISPCLLES

SEQ ID NO: 483770 - protein, 9 aa, Homo Sapiens
PERVNTILP

SEQ ID NO: 483771 - protein, 9 aa, Homo Sapiens
RVSKQLSSF

SEQ ID NO: 483772 - protein, 9 aa, Homo Sapiens
PHTACGLGA

SEQ ID NO: 483773 - protein, 9 aa, Homo Sapiens
ELVESGDLQ

SEQ ID NO: 483774 - protein, 9 aa, Homo Sapiens
ADVNECDLN

SEQ ID NO: 483775 - protein, 9 aa, Homo Sapiens
FSQEQEIRW

SEQ ID NO: 483776 - protein, 9 aa, Homo Sapiens
TCCIELVES

SEQ ID NO: 483777 - protein, 9 aa, Homo Sapiens
ERGVDPYLA

SEQ ID NO: 483778 - protein, 9 aa, Homo Sapiens
LGHKYGVEC

SEQ ID NO: 483779 - protein, 9 aa, Homo Sapiens
NGKQHIVLK

SEQ ID NO: 483780 - protein, 9 aa, Homo Sapiens
LHHPVQGSA

SEQ ID NO: 483781 - protein, 9 aa, Homo Sapiens
SRLEQSLNV

SEQ ID NO: 483782 - protein, 9 aa, Homo Sapiens
LRVILCWAC

SEQ ID NO: 483783 - protein, 9 aa, Homo Sapiens
QYVQRPLSL

SEQ ID NO: 483784 - protein, 9 aa, Homo Sapiens
NTTDIALKV

SEQ ID NO: 483785 - protein, 9 aa, Homo Sapiens
TVLQVQCTS

SEQ ID NO: 483786 - protein, 9 aa, Homo Sapiens
LRQAPLPSG

SEQ ID NO: 483787 - protein, 9 aa, Homo Sapiens
WIPWTIHFC

SEQ ID NO: 483788 - protein, 9 aa, Homo Sapiens
STHDPPDGD

SEQ ID NO: 483789 - protein, 9 aa, Homo Sapiens
PLVEQLEDY

SEQ ID NO: 483790 - protein, 9 aa, Homo Sapiens
WKVQKDEKL

SEQ ID NO: 483791 - protein, 9 aa, Homo Sapiens
QEIEHVFLA

SEQ ID NO: 483792 - protein, 9 aa, Homo Sapiens
GKLGVPGLT

SEQ ID NO: 483793 - protein, 9 aa, Homo Sapiens
PWLTPIVSE

SEQ ID NO: 483794 - protein, 9 aa, Homo Sapiens
CQNSIYEPS

SEQ ID NO: 483795 - protein, 9 aa, Homo Sapiens
VTEKGQKKH

SEQ ID NO: 483796 - protein, 9 aa, Homo Sapiens
LNFGVLELQ

SEQ ID NO: 483797 - protein, 9 aa, Homo Sapiens
DVVQGNPKL

SEQ ID NO: 483798 - protein, 9 aa, Homo Sapiens
EANTQDTKN

SEQ ID NO: 483799 - protein, 9 aa, Homo Sapiens
PPAARPSLN

SEQ ID NO: 483800 - protein, 9 aa, Homo Sapiens
LQYSQKIKK

SEQ ID NO: 483801 - protein, 9 aa, Homo Sapiens
KPQALSMSN

SEQ ID NO: 483802 - protein, 9 aa, Homo Sapiens
LFRNCTQNG

SEQ ID NO: 483803 - protein, 9 aa, Homo Sapiens
AFKSRLHES

SEQ ID NO: 483804 - protein, 9 aa, Homo Sapiens
PSVSAAVFE

SEQ ID NO: 483805 - protein, 9 aa, Homo Sapiens
DTNTTDIAL

SEQ ID NO: 483806 - protein, 9 aa, Homo Sapiens
ILEQILRIP

SEQ ID NO: 483807 - protein, 9 aa, Homo Sapiens
RPYTCPHFP

SEQ ID NO: 483808 - protein, 9 aa, Homo Sapiens
EKKEVKPQA

SEQ ID NO: 483809 - protein, 9 aa, Homo Sapiens
ILGDYYYCV

SEQ ID NO: 483810 - protein, 9 aa, Homo Sapiens
HLLKLIKVK

SEQ ID NO: 483811 - protein, 9 aa, Homo Sapiens
FYRRTGVTL

SEQ ID NO: 483812 - protein, 9 aa, Homo Sapiens
TDCKRRPGK

SEQ ID NO: 483813 - protein, 9 aa, Homo Sapiens
RLKMEQLVS

SEQ ID NO: 483814 - protein, 9 aa, Homo Sapiens
RESSSWEPD

SEQ ID NO: 483815 - protein, 9 aa, Homo Sapiens
TGLKFSFLR

SEQ ID NO: 483816 - protein, 9 aa, Homo Sapiens
CPKRRRQGR

SEQ ID NO: 483817 - protein, 9 aa, Homo Sapiens
GALDVVVLK

SEQ ID NO: 483818 - protein, 9 aa, Homo Sapiens
AAVSLPGSP

SEQ ID NO: 483819 - protein, 9 aa, Homo Sapiens
KDYVIISHN

SEQ ID NO: 483820 - protein, 9 aa, Homo Sapiens
SVWKSIVDF

SEQ ID NO: 483821 - protein, 9 aa, Homo Sapiens
NTILPIKTV

SEQ ID NO: 483822 - protein, 9 aa, Homo Sapiens
KINSTSGKH

SEQ ID NO: 483823 - protein, 9 aa, Homo Sapiens
PPDGDPGLP

SEQ ID NO: 483824 - protein, 9 aa, Homo Sapiens
DDYFLKLRM

SEQ ID NO: 483825 - protein, 9 aa, Homo Sapiens
NQEHESKVD

SEQ ID NO: 483826 - protein, 9 aa, Homo Sapiens
LCALCLDRF

SEQ ID NO: 483827 - protein, 9 aa, Homo Sapiens
DTSQGDTIL

SEQ ID NO: 483828 - protein, 9 aa, Homo Sapiens
KLPLSWFQR

SEQ ID NO: 483829 - protein, 9 aa, Homo Sapiens
WAGIARWIP

SEQ ID NO: 483830 - protein, 9 aa, Homo Sapiens
LMEGALEVH

SEQ ID NO: 483831 - protein, 9 aa, Homo Sapiens
RWWQDFCSV

SEQ ID NO: 483832 - protein, 9 aa, Homo Sapiens
VSLPGSPAP

SEQ ID NO: 483833 - protein, 9 aa, Homo Sapiens
RNCTQNGWS

SEQ ID NO: 483834 - protein, 9 aa, Homo Sapiens
PSTRPSHSL

SEQ ID NO: 483835 - protein, 9 aa, Homo Sapiens
KGTNHNGNI

SEQ ID NO: 483836 - protein, 9 aa, Homo Sapiens
PELTTLPGH

SEQ ID NO: 483837 - protein, 9 aa, Homo Sapiens
VTALPQAAA

SEQ ID NO: 483838 - protein, 9 aa, Homo Sapiens
HSPELTTLP

SEQ ID NO: 483839 - protein, 9 aa, Homo Sapiens
YLLSVWKSI

SEQ ID NO: 483840 - protein, 9 aa, Homo Sapiens
EQHERLLHS

SEQ ID NO: 483841 - protein, 9 aa, Homo Sapiens
GEVETPTPT

SEQ ID NO: 483842 - protein, 9 aa, Homo Sapiens
TWKVQKDEK

SEQ ID NO: 483843 - protein, 9 aa, Homo Sapiens
HNDRQCSRH

SEQ ID NO: 483844 - protein, 9 aa, Homo Sapiens
QKDEKLIGL

SEQ ID NO: 483845 - protein, 9 aa, Homo Sapiens
HERLLHSVK

SEQ ID NO: 483846 - protein, 9 aa, Homo Sapiens
NVSPGQPGT

SEQ ID NO: 483847 - protein, 9 aa, Homo Sapiens
KLCAKGHSA

SEQ ID NO: 483848 - protein, 9 aa, Homo Sapiens
AEEQPGEPF

SEQ ID NO: 483849 - protein, 9 aa, Homo Sapiens
DPYLAPLEN

SEQ ID NO: 483850 - protein, 9 aa, Homo Sapiens
CTAEKLGGF

SEQ ID NO: 483851 - protein, 9 aa, Homo Sapiens
KNDQDHYTN

SEQ ID NO: 483852 - protein, 9 aa, Homo Sapiens
SWSSYHNNL

SEQ ID NO: 483853 - protein, 9 aa, Homo Sapiens
QQCVQLSLS

SEQ ID NO: 483854 - protein, 9 aa, Homo Sapiens
DMDLSSATA

SEQ ID NO: 483855 - protein, 9 aa, Homo Sapiens
ELVKAAEEQ

SEQ ID NO: 483856 - protein, 9 aa, Homo Sapiens
ITGRTLNWR

SEQ ID NO: 483857 - protein, 9 aa, Homo Sapiens
RAEGALEPW

SEQ ID NO: 483858 - protein, 9 aa, Homo Sapiens
EKDYVIISH

SEQ ID NO: 483859 - protein, 9 aa, Homo Sapiens
ATPTPTSPT

SEQ ID NO: 483860 - protein, 9 aa, Homo Sapiens
GLLETLNFG

SEQ ID NO: 483861 - protein, 9 aa, Homo Sapiens
RATNSTCLN

SEQ ID NO: 483862 - protein, 9 aa, Homo Sapiens
GPRARPNPF

SEQ ID NO: 483863 - protein, 9 aa, Homo Sapiens
STLQSWYLC

SEQ ID NO: 483864 - protein, 9 aa, Homo Sapiens
RGRLCRITE

SEQ ID NO: 483865 - protein, 9 aa, Homo Sapiens
TFVASMSID

SEQ ID NO: 483866 - protein, 9 aa, Homo Sapiens
ISWSSYHNN

SEQ ID NO: 483867 - protein, 9 aa, Homo Sapiens
NGCTCHMLS

SEQ ID NO: 483868 - protein, 9 aa, Homo Sapiens
LKLRMDTNT

SEQ ID NO: 483869 - protein, 9 aa, Homo Sapiens
AYAKGPVQG

SEQ ID NO: 483870 - protein, 9 aa, Homo Sapiens
PEPPTTGLK

SEQ ID NO: 483871 - protein, 9 aa, Homo Sapiens
FMEQPSFDR

SEQ ID NO: 483872 - protein, 9 aa, Homo Sapiens
KVRQRPQIQ

SEQ ID NO: 483873 - protein, 9 aa, Homo Sapiens
GHGGAAGGG

SEQ ID NO: 483874 - protein, 9 aa, Homo Sapiens
IKKKLGMLG

SEQ ID NO: 483875 - protein, 9 aa, Homo Sapiens
ADSWAGIAR

SEQ ID NO: 483876 - protein, 9 aa, Homo Sapiens
GRAGGRQLE

SEQ ID NO: 483877 - protein, 9 aa, Homo Sapiens
SKVDSPKRT

SEQ ID NO: 483878 - protein, 9 aa, Homo Sapiens
SVISITNAG

SEQ ID NO: 483879 - protein, 9 aa, Homo Sapiens
SAVEYIRSL

SEQ ID NO: 483880 - protein, 9 aa, Homo Sapiens
GMLGRQVLP

SEQ ID NO: 483881 - protein, 9 aa, Homo Sapiens
SWSEADREP

SEQ ID NO: 483882 - protein, 9 aa, Homo Sapiens
EDFERAWRE

SEQ ID NO: 483883 - protein, 9 aa, Homo Sapiens
EDRQSLLQQ

SEQ ID NO: 483884 - protein, 9 aa, Homo Sapiens
VSSEPWDPE

SEQ ID NO: 483885 - protein, 9 aa, Homo Sapiens
EFKALVDLT

SEQ ID NO: 483886 - protein, 9 aa, Homo Sapiens
DRWEMSTGQ

SEQ ID NO: 483887 - protein, 9 aa, Homo Sapiens
DGTYFKIRA

SEQ ID NO: 483888 - protein, 9 aa, Homo Sapiens
SIYLLHLAS

SEQ ID NO: 483889 - protein, 9 aa, Homo Sapiens
RLEQSLNVR

SEQ ID NO: 483890 - protein, 9 aa, Homo Sapiens
GQYGVETVK

SEQ ID NO: 483891 - protein, 9 aa, Homo Sapiens
ALPQAAAAA

SEQ ID NO: 483892 - protein, 9 aa, Homo Sapiens
QSWYLCYKG

SEQ ID NO: 483893 - protein, 9 aa, Homo Sapiens
CSSTPCANN

SEQ ID NO: 483894 - protein, 9 aa, Homo Sapiens
PQLFVGTMT

SEQ ID NO: 483895 - protein, 9 aa, Homo Sapiens
ERIPRDSSY

SEQ ID NO: 483896 - protein, 9 aa, Homo Sapiens
LEEFKALVD

SEQ ID NO: 483897 - protein, 9 aa, Homo Sapiens
YCDMTTDWG

SEQ ID NO: 483898 - protein, 9 aa, Homo Sapiens
ADTHTLVDA

SEQ ID NO: 483899 - protein, 9 aa, Homo Sapiens
SCFTFQGLC

SEQ ID NO: 483900 - protein, 9 aa, Homo Sapiens
ESLTLSHNS

SEQ ID NO: 483901 - protein, 9 aa, Homo Sapiens
VPREYGSFQ

SEQ ID NO: 483902 - protein, 9 aa, Homo Sapiens
LIRFLETEL

SEQ ID NO: 483903 - protein, 9 aa, Homo Sapiens
LPPCLSASP

SEQ ID NO: 483904 - protein, 9 aa, Homo Sapiens
QEQEIRWEL

SEQ ID NO: 483905 - protein, 9 aa, Homo Sapiens
PSFDRQAPD

SEQ ID NO: 483906 - protein, 9 aa, Homo Sapiens
FLANLWYSF

SEQ ID NO: 483907 - protein, 9 aa, Homo Sapiens
ALPVFCVAA

SEQ ID NO: 483908 - protein, 9 aa, Homo Sapiens
KMLIFQVRK

SEQ ID NO: 483909 - protein, 9 aa, Homo Sapiens
LRVNHLGHF

SEQ ID NO: 483910 - protein, 9 aa, Homo Sapiens
HCQTRLEQI

SEQ ID NO: 483911 - protein, 9 aa, Homo Sapiens
AYGVMYGEN

SEQ ID NO: 483912 - protein, 9 aa, Homo Sapiens
CLHFSALQL

SEQ ID NO: 483913 - protein, 9 aa, Homo Sapiens
QDFCSVFAT

SEQ ID NO: 483914 - protein, 9 aa, Homo Sapiens
TYTLRNQQV

SEQ ID NO: 483915 - protein, 9 aa, Homo Sapiens
AQNISNCSM

SEQ ID NO: 483916 - protein, 9 aa, Homo Sapiens
SEADREPCV

SEQ ID NO: 483917 - protein, 9 aa, Homo Sapiens
KKCWNTSGH

SEQ ID NO: 483918 - protein, 9 aa, Homo Sapiens
QCPKRRRQG

SEQ ID NO: 483919 - protein, 9 aa, Homo Sapiens
YICMLLRYL

SEQ ID NO: 483920 - protein, 9 aa, Homo Sapiens
AGVSCFTFQ

SEQ ID NO: 483921 - protein, 9 aa, Homo Sapiens
VGVMFQQMG

SEQ ID NO: 483922 - protein, 9 aa, Homo Sapiens
FVTATDVVQ

SEQ ID NO: 483923 - protein, 9 aa, Homo Sapiens
ARNFDERVF

SEQ ID NO: 483924 - protein, 9 aa, Homo Sapiens
VLVGYKCLE

SEQ ID NO: 483925 - protein, 9 aa, Homo Sapiens
VFARCENLK

SEQ ID NO: 483926 - protein, 9 aa, Homo Sapiens
LGDYYYCVS

SEQ ID NO: 483927 - protein, 9 aa, Homo Sapiens
AAGVNSSCS

SEQ ID NO: 483928 - protein, 9 aa, Homo Sapiens
PHQQQCVQL

SEQ ID NO: 483929 - protein, 9 aa, Homo Sapiens
EDLYLHMQL

SEQ ID NO: 483930 - protein, 9 aa, Homo Sapiens
LFKQASSGL

SEQ ID NO: 483931 - protein, 9 aa, Homo Sapiens
VSKTHQNSY

SEQ ID NO: 483932 - protein, 9 aa, Homo Sapiens
ATPERVNTI

SEQ ID NO: 483933 - protein, 9 aa, Homo Sapiens
LEQILRIPF

SEQ ID NO: 483934 - protein, 9 aa, Homo Sapiens
RDQPQFQNL

SEQ ID NO: 483935 - protein, 9 aa, Homo Sapiens
VIGVAETGS

SEQ ID NO: 483936 - protein, 9 aa, Homo Sapiens
DDLVFTQGS

SEQ ID NO: 483937 - protein, 9 aa, Homo Sapiens
IAVMPGGGI

SEQ ID NO: 483938 - protein, 9 aa, Homo Sapiens
QNISNCSMQ

SEQ ID NO: 483939 - protein, 9 aa, Homo Sapiens
PENLTNGAC

SEQ ID NO: 483940 - protein, 9 aa, Homo Sapiens
KVQKDEKLI

SEQ ID NO: 483941 - protein, 9 aa, Homo Sapiens
GSRNDFHMD

SEQ ID NO: 483942 - protein, 9 aa, Homo Sapiens
PQFAFYDNT

SEQ ID NO: 483943 - protein, 9 aa, Homo Sapiens
ARSKKNQSC

SEQ ID NO: 483944 - protein, 9 aa, Homo Sapiens
VFGKPVRVY

SEQ ID NO: 483945 - protein, 9 aa, Homo Sapiens
QRKELWREG

SEQ ID NO: 483946 - protein, 9 aa, Homo Sapiens
KRIPNTKDI

SEQ ID NO: 483947 - protein, 9 aa, Homo Sapiens
QPSFPDSNT

SEQ ID NO: 483948 - protein, 9 aa, Homo Sapiens
STSRSRITK

SEQ ID NO: 483949 - protein, 9 aa, Homo Sapiens
EIYYKEKIP

SEQ ID NO: 483950 - protein, 9 aa, Homo Sapiens
LTPIVSEGT

SEQ ID NO: 483951 - protein, 9 aa, Homo Sapiens
PRAPRRARA

SEQ ID NO: 483952 - protein, 9 aa, Homo Sapiens
KKKGSAKEW

SEQ ID NO: 483953 - protein, 9 aa, Homo Sapiens
RRESSSWEP

SEQ ID NO: 483954 - protein, 9 aa, Homo Sapiens
SAGGGAGHG

SEQ ID NO: 483955 - protein, 9 aa, Homo Sapiens
VTGPFATAG

SEQ ID NO: 483956 - protein, 9 aa, Homo Sapiens
EWRVRVNSA

SEQ ID NO: 483957 - protein, 9 aa, Homo Sapiens
SKEPRQQRV

SEQ ID NO: 483958 - protein, 9 aa, Homo Sapiens
TSPTCRAHQ

SEQ ID NO: 483959 - protein, 9 aa, Homo Sapiens
NVARVWFCN

SEQ ID NO: 483960 - protein, 9 aa, Homo Sapiens
VAKVEESPE

SEQ ID NO: 483961 - protein, 9 aa, Homo Sapiens
AILMLVSPS

SEQ ID NO: 483962 - protein, 9 aa, Homo Sapiens
DMKTCADVN

SEQ ID NO: 483963 - protein, 9 aa, Homo Sapiens
YFSQEQEIR

SEQ ID NO: 483964 - protein, 9 aa, Homo Sapiens
HTSFFAPSF

SEQ ID NO: 483965 - protein, 9 aa, Homo Sapiens
FEQLSTTFG

SEQ ID NO: 483966 - protein, 9 aa, Homo Sapiens
AEKLGGFFF

SEQ ID NO: 483967 - protein, 9 aa, Homo Sapiens
GDYEKATEF

SEQ ID NO: 483968 - protein, 9 aa, Homo Sapiens
KSNGRATAL

SEQ ID NO: 483969 - protein, 9 aa, Homo Sapiens
VSRLTEWLR

SEQ ID NO: 483970 - protein, 9 aa, Homo Sapiens
LGMLGRQVL

SEQ ID NO: 483971 - protein, 9 aa, Homo Sapiens
LVTKTDHLV

SEQ ID NO: 483972 - protein, 9 aa, Homo Sapiens
KKKRALIRF

SEQ ID NO: 483973 - protein, 9 aa, Homo Sapiens
TPTSPTCRA

SEQ ID NO: 483974 - protein, 9 aa, Homo Sapiens
ALVLKKVTE

SEQ ID NO: 483975 - protein, 9 aa, Homo Sapiens
IRTGEKPYT

SEQ ID NO: 483976 - protein, 9 aa, Homo Sapiens
QEGEVETPT

SEQ ID NO: 483977 - protein, 9 aa, Homo Sapiens
PNPFGLLRH

SEQ ID NO: 483978 - protein, 9 aa, Homo Sapiens
ANLWYSFQD

SEQ ID NO: 483979 - protein, 9 aa, Homo Sapiens
ARATTTCWA

SEQ ID NO: 483980 - protein, 9 aa, Homo Sapiens
VHHKLHTCE

SEQ ID NO: 483981 - protein, 9 aa, Homo Sapiens
TGLGGLEAP

SEQ ID NO: 483982 - protein, 9 aa, Homo Sapiens
TITDIIVYF

SEQ ID NO: 483983 - protein, 9 aa, Homo Sapiens
LAPPSTRPS

SEQ ID NO: 483984 - protein, 9 aa, Homo Sapiens
SEVKALSAV

SEQ ID NO: 483985 - protein, 9 aa, Homo Sapiens
TQDLTMLPR

SEQ ID NO: 483986 - protein, 9 aa, Homo Sapiens
GMAFAVLTQ

SEQ ID NO: 483987 - protein, 9 aa, Homo Sapiens
HFSALQLSH

SEQ ID NO: 483988 - protein, 9 aa, Homo Sapiens
PLGYKDPVS

SEQ ID NO: 483989 - protein, 9 aa, Homo Sapiens
SVIVAREER

SEQ ID NO: 483990 - protein, 9 aa, Homo Sapiens
NGACAGNGD

SEQ ID NO: 483991 - protein, 9 aa, Homo Sapiens
FKATSDEKD

SEQ ID NO: 483992 - protein, 9 aa, Homo Sapiens
HLRLKGSRN

SEQ ID NO: 483993 - protein, 9 aa, Homo Sapiens
HVKRVTTPY

SEQ ID NO: 483994 - protein, 9 aa, Homo Sapiens
LPALPVFCV

SEQ ID NO: 483995 - protein, 9 aa, Homo Sapiens
CTSRTITQS

SEQ ID NO: 483996 - protein, 9 aa, Homo Sapiens
LSHNSMIAL

SEQ ID NO: 483997 - protein, 9 aa, Homo Sapiens
FKGSFRPMW

SEQ ID NO: 483998 - protein, 9 aa, Homo Sapiens
PLTLRYIYG

SEQ ID NO: 483999 - protein, 9 aa, Homo Sapiens
MKLGVENCY

SEQ ID NO: 484000 - protein, 9 aa, Homo Sapiens
RNDFHMDLR

SEQ ID NO: 484001 - protein, 9 aa, Homo Sapiens
DLDDLVFTQ

SEQ ID NO: 484002 - protein, 9 aa, Homo Sapiens
VFLANLWYS

SEQ ID NO: 484003 - protein, 9 aa, Homo Sapiens
CIELVESGD

SEQ ID NO: 484004 - protein, 9 aa, Homo Sapiens
DGPDHARLY

SEQ ID NO: 484005 - protein, 9 aa, Homo Sapiens
SGRAGAPET

SEQ ID NO: 484006 - protein, 9 aa, Homo Sapiens
DLFLFLCLV

SEQ ID NO: 484007 - protein, 9 aa, Homo Sapiens
EMIAGSAAT

SEQ ID NO: 484008 - protein, 9 aa, Homo Sapiens
LKLIKVKGP

SEQ ID NO: 484009 - protein, 9 aa, Homo Sapiens
REPCVDGWV

SEQ ID NO: 484010 - protein, 9 aa, Homo Sapiens
DVRACSSTP

SEQ ID NO: 484011 - protein, 9 aa, Homo Sapiens
DASCMTLVD

SEQ ID NO: 484012 - protein, 9 aa, Homo Sapiens
PNTKDIDSS

SEQ ID NO: 484013 - protein, 9 aa, Homo Sapiens
QEGQPLILN

SEQ ID NO: 484014 - protein, 9 aa, Homo Sapiens
ECQKMLIFQ

SEQ ID NO: 484015 - protein, 9 aa, Homo Sapiens
KQEMKNDQD

SEQ ID NO: 484016 - protein, 9 aa, Homo Sapiens
LVSNFPPGS

SEQ ID NO: 484017 - protein, 9 aa, Homo Sapiens
SAPIQECWY

SEQ ID NO: 484018 - protein, 9 aa, Homo Sapiens
TADSWAGIA

SEQ ID NO: 484019 - protein, 9 aa, Homo Sapiens
ICDGCGIAC

SEQ ID NO: 484020 - protein, 9 aa, Homo Sapiens
RATLRCKAM

SEQ ID NO: 484021 - protein, 9 aa, Homo Sapiens
LSHVNYCAD

SEQ ID NO: 484022 - protein, 9 aa, Homo Sapiens
GSAPIQECW

SEQ ID NO: 484023 - protein, 9 aa, Homo Sapiens
IQKRKKVKK

SEQ ID NO: 484024 - protein, 9 aa, Homo Sapiens
RYAELYRLQ

SEQ ID NO: 484025 - protein, 9 aa, Homo Sapiens
WALAEFQAL

SEQ ID NO: 484026 - protein, 9 aa, Homo Sapiens
VEVLVIPAR

SEQ ID NO: 484027 - protein, 9 aa, Homo Sapiens
EQSWTVVEA

SEQ ID NO: 484028 - protein, 9 aa, Homo Sapiens
TYFKIRAIY

SEQ ID NO: 484029 - protein, 9 aa, Homo Sapiens
EVETPTPTE

SEQ ID NO: 484030 - protein, 9 aa, Homo Sapiens
LNGSAPIQE

SEQ ID NO: 484031 - protein, 9 aa, Homo Sapiens
HGGAAGGGV

SEQ ID NO: 484032 - protein, 9 aa, Homo Sapiens
NAFRMALYG

SEQ ID NO: 484033 - protein, 9 aa, Homo Sapiens
CSCHVIALS

SEQ ID NO: 484034 - protein, 9 aa, Homo Sapiens
SCSFSRRES

SEQ ID NO: 484035 - protein, 9 aa, Homo Sapiens
LFRATQYIC

SEQ ID NO: 484036 - protein, 9 aa, Homo Sapiens
GNLHYFVSN

SEQ ID NO: 484037 - protein, 9 aa, Homo Sapiens
KKKTEFLDV

SEQ ID NO: 484038 - protein, 9 aa, Homo Sapiens
TLRLVSSYI

SEQ ID NO: 484039 - protein, 9 aa, Homo Sapiens
MYIFGGFYS

SEQ ID NO: 484040 - protein, 9 aa, Homo Sapiens
RGTSSNSNN

SEQ ID NO: 484041 - protein, 9 aa, Homo Sapiens
LDEVSPRRN

SEQ ID NO: 484042 - protein, 9 aa, Homo Sapiens
KEKDYVIIS

SEQ ID NO: 484043 - protein, 9 aa, Homo Sapiens
DALTEIQKI

SEQ ID NO: 484044 - protein, 9 aa, Homo Sapiens
MLVSPSHQL

SEQ ID NO: 484045 - protein, 9 aa, Homo Sapiens
ERLLHSVKN

SEQ ID NO: 484046 - protein, 9 aa, Homo Sapiens
RSKKNQSCG

SEQ ID NO: 484047 - protein, 9 aa, Homo Sapiens
RLVSSYIAH

SEQ ID NO: 484048 - protein, 9 aa, Homo Sapiens
EVISPTEFK

SEQ ID NO: 484049 - protein, 9 aa, Homo Sapiens
LDGALDVVV

SEQ ID NO: 484050 - protein, 9 aa, Homo Sapiens
SFPDSNTIT

SEQ ID NO: 484051 - protein, 9 aa, Homo Sapiens
VGTMTLLSG

SEQ ID NO: 484052 - protein, 9 aa, Homo Sapiens
TTGARATTT

SEQ ID NO: 484053 - protein, 9 aa, Homo Sapiens
FATAGIFAT

SEQ ID NO: 484054 - protein, 9 aa, Homo Sapiens
PATPTPTSP

SEQ ID NO: 484055 - protein, 9 aa, Homo Sapiens
SMIALKPIL

SEQ ID NO: 484056 - protein, 9 aa, Homo Sapiens
RTCCPGLGG

SEQ ID NO: 484057 - protein, 9 aa, Homo Sapiens
KIRAIYDKP

SEQ ID NO: 484058 - protein, 9 aa, Homo Sapiens
LLLLLRVIL

SEQ ID NO: 484059 - protein, 9 aa, Homo Sapiens
DVDNSPLSP

SEQ ID NO: 484060 - protein, 9 aa, Homo Sapiens
TSSNSNNEV

SEQ ID NO: 484061 - protein, 9 aa, Homo Sapiens
GFLSEVKAL

SEQ ID NO: 484062 - protein, 9 aa, Homo Sapiens
DMWLMEGAL

SEQ ID NO: 484063 - protein, 9 aa, Homo Sapiens
IAGSAATLI

SEQ ID NO: 484064 - protein, 9 aa, Homo Sapiens
ANGDYEKAT

SEQ ID NO: 484065 - protein, 9 aa, Homo Sapiens
PSSNSTLRI

SEQ ID NO: 484066 - protein, 9 aa, Homo Sapiens
LIHTDITDR

SEQ ID NO: 484067 - protein, 9 aa, Homo Sapiens
EPDLFPHQQ

SEQ ID NO: 484068 - protein, 9 aa, Homo Sapiens
THRLFNESV

SEQ ID NO: 484069 - protein, 9 aa, Homo Sapiens
LQSWYLCYK

SEQ ID NO: 484070 - protein, 9 aa, Homo Sapiens
LKADALPAL

SEQ ID NO: 484071 - protein, 9 aa, Homo Sapiens
SEDQRAVGV

SEQ ID NO: 484072 - protein, 9 aa, Homo Sapiens
GKPVRVYLS

SEQ ID NO: 484073 - protein, 9 aa, Homo Sapiens
SCTRDVVKS

SEQ ID NO: 484074 - protein, 9 aa, Homo Sapiens
PGTGLGGLE

SEQ ID NO: 484075 - protein, 9 aa, Homo Sapiens
LGVPGLTGY

SEQ ID NO: 484076 - protein, 9 aa, Homo Sapiens
SFSCSFSRR

SEQ ID NO: 484077 - protein, 9 aa, Homo Sapiens
KKYTGDRSS

SEQ ID NO: 484078 - protein, 9 aa, Homo Sapiens
SKTHQNSYQ

SEQ ID NO: 484079 - protein, 9 aa, Homo Sapiens
SFVEPFQCH

SEQ ID NO: 484080 - protein, 9 aa, Homo Sapiens
EYTAEEEEG

SEQ ID NO: 484081 - protein, 9 aa, Homo Sapiens
NTSGHCRKQ

SEQ ID NO: 484082 - protein, 9 aa, Homo Sapiens
RVDGVKYWL

SEQ ID NO: 484083 - protein, 9 aa, Homo Sapiens
LRLVSSYIA

SEQ ID NO: 484084 - protein, 9 aa, Homo Sapiens
HVNYCADYE

SEQ ID NO: 484085 - protein, 9 aa, Homo Sapiens
LLQALNEMR

SEQ ID NO: 484086 - protein, 9 aa, Homo Sapiens
VRTWDLPSG

SEQ ID NO: 484087 - protein, 9 aa, Homo Sapiens
PSTHDPPDG

SEQ ID NO: 484088 - protein, 9 aa, Homo Sapiens
MFNLALADT

SEQ ID NO: 484089 - protein, 9 aa, Homo Sapiens
LVGYKCLES

SEQ ID NO: 484090 - protein, 9 aa, Homo Sapiens
LKKVTEAST

SEQ ID NO: 484091 - protein, 9 aa, Homo Sapiens
LPVFCVAAL

SEQ ID NO: 484092 - protein, 9 aa, Homo Sapiens
SSPLGSSAA

SEQ ID NO: 484093 - protein, 9 aa, Homo Sapiens
LSRSLSSSP

SEQ ID NO: 484094 - protein, 9 aa, Homo Sapiens
STGQLPATR

SEQ ID NO: 484095 - protein, 9 aa, Homo Sapiens
TLCALCLDR

SEQ ID NO: 484096 - protein, 9 aa, Homo Sapiens
SLEILRNVT

SEQ ID NO: 484097 - protein, 9 aa, Homo Sapiens
LKANQTLKH

SEQ ID NO: 484098 - protein, 9 aa, Homo Sapiens
IWDASCMTL

SEQ ID NO: 484099 - protein, 9 aa, Homo Sapiens
DIDSSEDEK

SEQ ID NO: 484100 - protein, 9 aa, Homo Sapiens
RRVPAEVSK

SEQ ID NO: 484101 - protein, 9 aa, Homo Sapiens
KKKSEKETG

SEQ ID NO: 484102 - protein, 9 aa, Homo Sapiens
LKGSRNDFH

SEQ ID NO: 484103 - protein, 9 aa, Homo Sapiens
NNFNLETLK

SEQ ID NO: 484104 - protein, 9 aa, Homo Sapiens
HPVQGSAAG

SEQ ID NO: 484105 - protein, 9 aa, Homo Sapiens
QQQCVQLSL

SEQ ID NO: 484106 - protein, 9 aa, Homo Sapiens
EGALEPWCH

SEQ ID NO: 484107 - protein, 9 aa, Homo Sapiens
DLKKNVARV

SEQ ID NO: 484108 - protein, 9 aa, Homo Sapiens
VLDGAGIPF

SEQ ID NO: 484109 - protein, 9 aa, Homo Sapiens
APEDLYLHM

SEQ ID NO: 484110 - protein, 9 aa, Homo Sapiens
PATRETGSA

SEQ ID NO: 484111 - protein, 9 aa, Homo Sapiens
SLFRNCTQN

SEQ ID NO: 484112 - protein, 9 aa, Homo Sapiens
CAEKQLKLR

SEQ ID NO: 484113 - protein, 9 aa, Homo Sapiens
MTADASFLA

SEQ ID NO: 484114 - protein, 9 aa, Homo Sapiens
AEGALEPWC

SEQ ID NO: 484115 - protein, 9 aa, Homo Sapiens
TSAQVGTYR

SEQ ID NO: 484116 - protein, 9 aa, Homo Sapiens
EDMWLMEGA

SEQ ID NO: 484117 - protein, 9 aa, Homo Sapiens
WKGTNHNGN

SEQ ID NO: 484118 - protein, 9 aa, Homo Sapiens
WDWSTYPAD

SEQ ID NO: 484119 - protein, 9 aa, Homo Sapiens
SCGLLETLN

SEQ ID NO: 484120 - protein, 9 aa, Homo Sapiens
IMKLGVENC

SEQ ID NO: 484121 - protein, 9 aa, Homo Sapiens
RIPRDSSYE

SEQ ID NO: 484122 - protein, 9 aa, Homo Sapiens
VKYWLSKNK

SEQ ID NO: 484123 - protein, 9 aa, Homo Sapiens
EADREPCVD

SEQ ID NO: 484124 - protein, 9 aa, Homo Sapiens
LRLKGSRND

SEQ ID NO: 484125 - protein, 9 aa, Homo Sapiens
SLTLSHNSM

SEQ ID NO: 484126 - protein, 9 aa, Homo Sapiens
AKMGKGKRV

SEQ ID NO: 484127 - protein, 9 aa, Homo Sapiens
SLQDGHTEM

SEQ ID NO: 484128 - protein, 9 aa, Homo Sapiens
NVCLLLASC

SEQ ID NO: 484129 - protein, 9 aa, Homo Sapiens
PRESFSCSF

SEQ ID NO: 484130 - protein, 9 aa, Homo Sapiens
MFCHLSFRE

SEQ ID NO: 484131 - protein, 9 aa, Homo Sapiens
TFTLCALCL

SEQ ID NO: 484132 - protein, 9 aa, Homo Sapiens
SRDRKSGRR

SEQ ID NO: 484133 - protein, 9 aa, Homo Sapiens
GSAKEWVFG

SEQ ID NO: 484134 - protein, 9 aa, Homo Sapiens
SKLDTLRLV

SEQ ID NO: 484135 - protein, 9 aa, Homo Sapiens
WSWFLFWKP

SEQ ID NO: 484136 - protein, 9 aa, Homo Sapiens
SGQLLAIYY

SEQ ID NO: 484137 - protein, 9 aa, Homo Sapiens
LLLRVILCW

SEQ ID NO: 484138 - protein, 9 aa, Homo Sapiens
YIILQLEQR

SEQ ID NO: 484139 - protein, 9 aa, Homo Sapiens
KDPTCRPKV

SEQ ID NO: 484140 - protein, 9 aa, Homo Sapiens
KYGGIFAAV

SEQ ID NO: 484141 - protein, 9 aa, Homo Sapiens
NSSCSRMSA

SEQ ID NO: 484142 - protein, 9 aa, Homo Sapiens
WFLFWKPVQ

SEQ ID NO: 484143 - protein, 9 aa, Homo Sapiens
AKVEESPET

SEQ ID NO: 484144 - protein, 9 aa, Homo Sapiens
ALPALPVFC

SEQ ID NO: 484145 - protein, 9 aa, Homo Sapiens
AKGRIAVMP

SEQ ID NO: 484146 - protein, 9 aa, Homo Sapiens
APMLNPFTY

SEQ ID NO: 484147 - protein, 9 aa, Homo Sapiens
YPADYGQPN

SEQ ID NO: 484148 - protein, 9 aa, Homo Sapiens
VPRATNSTC

SEQ ID NO: 484149 - protein, 9 aa, Homo Sapiens
RQVAGHSRG

SEQ ID NO: 484150 - protein, 9 aa, Homo Sapiens
MQNAAGVNS

SEQ ID NO: 484151 - protein, 9 aa, Homo Sapiens
LLHQDRLQY

SEQ ID NO: 484152 - protein, 9 aa, Homo Sapiens
VKRVTTPYK

SEQ ID NO: 484153 - protein, 9 aa, Homo Sapiens
YLSYKGNIL

SEQ ID NO: 484154 - protein, 9 aa, Homo Sapiens
TQSQDQSLD

SEQ ID NO: 484155 - protein, 9 aa, Homo Sapiens
DIKIWDASC

SEQ ID NO: 484156 - protein, 9 aa, Homo Sapiens
QVAGHSRGP

SEQ ID NO: 484157 - protein, 9 aa, Homo Sapiens
NHLNTIAKH

SEQ ID NO: 484158 - protein, 9 aa, Homo Sapiens
WECHDGLSF

SEQ ID NO: 484159 - protein, 9 aa, Homo Sapiens
SSNSNNEVT

SEQ ID NO: 484160 - protein, 9 aa, Homo Sapiens
QALSMSNLH

SEQ ID NO: 484161 - protein, 9 aa, Homo Sapiens
YLAFVHPMK

SEQ ID NO: 484162 - protein, 9 aa, Homo Sapiens
PLPRYALCL

SEQ ID NO: 484163 - protein, 9 aa, Homo Sapiens
RKGPAREQI

SEQ ID NO: 484164 - protein, 9 aa, Homo Sapiens
EMNAVRRQA

SEQ ID NO: 484165 - protein, 9 aa, Homo Sapiens
LEPWCHKHS

SEQ ID NO: 484166 - protein, 9 aa, Homo Sapiens
QPSFDRQAP

SEQ ID NO: 484167 - protein, 9 aa, Homo Sapiens
LDLVAPILA

SEQ ID NO: 484168 - protein, 9 aa, Homo Sapiens
VQGKTQNRV

SEQ ID NO: 484169 - protein, 9 aa, Homo Sapiens
KAAEEQPGE

SEQ ID NO: 484170 - protein, 9 aa, Homo Sapiens
PLSSVPSPA

SEQ ID NO: 484171 - protein, 9 aa, Homo Sapiens
LRMDTNTRN

SEQ ID NO: 484172 - protein, 9 aa, Homo Sapiens
QWVTALPQA

SEQ ID NO: 484173 - protein, 9 aa, Homo Sapiens
ISAAMDCSV

SEQ ID NO: 484174 - protein, 9 aa, Homo Sapiens
SWFQRGMRE

SEQ ID NO: 484175 - protein, 9 aa, Homo Sapiens
EYMPSRIIM

SEQ ID NO: 484176 - protein, 9 aa, Homo Sapiens
PERGDPSPS

SEQ ID NO: 484177 - protein, 9 aa, Homo Sapiens
GSFQSFVTE

SEQ ID NO: 484178 - protein, 9 aa, Homo Sapiens
VTYFFYQAV

SEQ ID NO: 484179 - protein, 9 aa, Homo Sapiens
YLFILKARN

SEQ ID NO: 484180 - protein, 9 aa, Homo Sapiens
KKKEEMNAV

SEQ ID NO: 484181 - protein, 9 aa, Homo Sapiens
GAPETQGPA

SEQ ID NO: 484182 - protein, 9 aa, Homo Sapiens
HHPVQGSAA

SEQ ID NO: 484183 - protein, 9 aa, Homo Sapiens
EGEQGPGRA

SEQ ID NO: 484184 - protein, 9 aa, Homo Sapiens
KLFCHYNQF

SEQ ID NO: 484185 - protein, 9 aa, Homo Sapiens
SALQLSHRY

SEQ ID NO: 484186 - protein, 9 aa, Homo Sapiens
RQRPQIQPR

SEQ ID NO: 484187 - protein, 9 aa, Homo Sapiens
DLVTKTDHL

SEQ ID NO: 484188 - protein, 9 aa, Homo Sapiens
ARRPSPGTT

SEQ ID NO: 484189 - protein, 9 aa, Homo Sapiens
TRFNTAASY

SEQ ID NO: 484190 - protein, 9 aa, Homo Sapiens
CHDGLSFGR

SEQ ID NO: 484191 - protein, 9 aa, Homo Sapiens
KDIDSSEDE

SEQ ID NO: 484192 - protein, 9 aa, Homo Sapiens
YIRSLQQLL

SEQ ID NO: 484193 - protein, 9 aa, Homo Sapiens
SRKPPMKAS

SEQ ID NO: 484194 - protein, 9 aa, Homo Sapiens
PDSIAIIQQ

SEQ ID NO: 484195 - protein, 9 aa, Homo Sapiens
SSTPCANNR

SEQ ID NO: 484196 - protein, 9 aa, Homo Sapiens
PAARPSLNT

SEQ ID NO: 484197 - protein, 9 aa, Homo Sapiens
REGRLPPCL

SEQ ID NO: 484198 - protein, 9 aa, Homo Sapiens
KRNQEHESK

SEQ ID NO: 484199 - protein, 9 aa, Homo Sapiens
RHCQTRLEQ

SEQ ID NO: 484200 - protein, 9 aa, Homo Sapiens
GRIAVMPGG

SEQ ID NO: 484201 - protein, 9 aa, Homo Sapiens
VVEATLARL

SEQ ID NO: 484202 - protein, 9 aa, Homo Sapiens
DWSTYPADY

SEQ ID NO: 484203 - protein, 9 aa, Homo Sapiens
AADLVTKTD

SEQ ID NO: 484204 - protein, 9 aa, Homo Sapiens
QMELDREEK

SEQ ID NO: 484205 - protein, 9 aa, Homo Sapiens
PPATPTPTS

SEQ ID NO: 484206 - protein, 9 aa, Homo Sapiens
PPPAARPSL

SEQ ID NO: 484207 - protein, 9 aa, Homo Sapiens
EHESKVDSP

SEQ ID NO: 484208 - protein, 9 aa, Homo Sapiens
ERGDPSPST

SEQ ID NO: 484209 - protein, 9 aa, Homo Sapiens
KALVDLTFP

SEQ ID NO: 484210 - protein, 9 aa, Homo Sapiens
HELTNVLDG

SEQ ID NO: 484211 - protein, 9 aa, Homo Sapiens
ETREQQEIY

SEQ ID NO: 484212 - protein, 9 aa, Homo Sapiens
DCKRRPGKK

SEQ ID NO: 484213 - protein, 9 aa, Homo Sapiens
DRSTVGVAA

SEQ ID NO: 484214 - protein, 9 aa, Homo Sapiens
EQPSFDRQA

SEQ ID NO: 484215 - protein, 9 aa, Homo Sapiens
AVSLPGSPA

SEQ ID NO: 484216 - protein, 9 aa, Homo Sapiens
FILSNLNFF

SEQ ID NO: 484217 - protein, 9 aa, Homo Sapiens
ISVISITNA

SEQ ID NO: 484218 - protein, 9 aa, Homo Sapiens
ETQGPAAPG

SEQ ID NO: 484219 - protein, 9 aa, Homo Sapiens
PGFKATSDE

SEQ ID NO: 484220 - protein, 9 aa, Homo Sapiens
VHITLILML

SEQ ID NO: 484221 - protein, 9 aa, Homo Sapiens
LDVDNSPLS

SEQ ID NO: 484222 - protein, 9 aa, Homo Sapiens
LVIPARSKK

SEQ ID NO: 484223 - protein, 9 aa, Homo Sapiens
TTTCWAACA

SEQ ID NO: 484224 - protein, 9 aa, Homo Sapiens
SEKPPGFKA

SEQ ID NO: 484225 - protein, 9 aa, Homo Sapiens
ECVAFSPNM

SEQ ID NO: 484226 - protein, 9 aa, Homo Sapiens
LVFELGLCS

SEQ ID NO: 484227 - protein, 9 aa, Homo Sapiens
GAQNISNCS

SEQ ID NO: 484228 - protein, 9 aa, Homo Sapiens
TCPHFPKAF

SEQ ID NO: 484229 - protein, 9 aa, Homo Sapiens
KVELLQGTK

SEQ ID NO: 484230 - protein, 9 aa, Homo Sapiens
GQDTADSWA

SEQ ID NO: 484231 - protein, 9 aa, Homo Sapiens
GCGGSGGGG

SEQ ID NO: 484232 - protein, 9 aa, Homo Sapiens
GGGAGHGGA

SEQ ID NO: 484233 - protein, 9 aa, Homo Sapiens
ITYDLPLSS

SEQ ID NO: 484234 - protein, 9 aa, Homo Sapiens
PSFPDSNTI

SEQ ID NO: 484235 - protein, 9 aa, Homo Sapiens
YAKGPVQGY

SEQ ID NO: 484236 - protein, 9 aa, Homo Sapiens
MCSESGLPS

SEQ ID NO: 484237 - protein, 9 aa, Homo Sapiens
SEDMKTCAD

SEQ ID NO: 484238 - protein, 9 aa, Homo Sapiens
ALNEMRADA

SEQ ID NO: 484239 - protein, 9 aa, Homo Sapiens
LDTLRLVSS

SEQ ID NO: 484240 - protein, 9 aa, Homo Sapiens
TDWGGWIVF

SEQ ID NO: 484241 - protein, 9 aa, Homo Sapiens
YKGNILEQI

SEQ ID NO: 484242 - protein, 9 aa, Homo Sapiens
TCSCHVIAL

SEQ ID NO: 484243 - protein, 9 aa, Homo Sapiens
LKAPRPRAP

SEQ ID NO: 484244 - protein, 9 aa, Homo Sapiens
RQKYGGIFA

SEQ ID NO: 484245 - protein, 9 aa, Homo Sapiens
VQPSFPDSN

SEQ ID NO: 484246 - protein, 9 aa, Homo Sapiens
LEGWLPSIK

SEQ ID NO: 484247 - protein, 9 aa, Homo Sapiens
TIAKHGCCS

SEQ ID NO: 484248 - protein, 9 aa, Homo Sapiens
QYHRDFGLW

SEQ ID NO: 484249 - protein, 9 aa, Homo Sapiens
PFDTKWTPS

SEQ ID NO: 484250 - protein, 9 aa, Homo Sapiens
GPLLRLVAK

SEQ ID NO: 484251 - protein, 9 aa, Homo Sapiens
HKVRLQLEM

SEQ ID NO: 484252 - protein, 9 aa, Homo Sapiens
ETRRKSKYN

SEQ ID NO: 484253 - protein, 9 aa, Homo Sapiens
LAPCLLGSR

SEQ ID NO: 484254 - protein, 9 aa, Homo Sapiens
MLDLVAPIL

SEQ ID NO: 484255 - protein, 9 aa, Homo Sapiens
VAGHSRGPR

SEQ ID NO: 484256 - protein, 9 aa, Homo Sapiens
QRGMREEMS

SEQ ID NO: 484257 - protein, 9 aa, Homo Sapiens
SFSRRESSS

SEQ ID NO: 484258 - protein, 9 aa, Homo Sapiens
KTCADVNEC

SEQ ID NO: 484259 - protein, 9 aa, Homo Sapiens
LQEDQVGVM

SEQ ID NO: 484260 - protein, 9 aa, Homo Sapiens
RLVAKVEES

SEQ ID NO: 484261 - protein, 9 aa, Homo Sapiens
VLLQALNEM

SEQ ID NO: 484262 - protein, 9 aa, Homo Sapiens
LKQWNKRWF

SEQ ID NO: 484263 - protein, 9 aa, Homo Sapiens
SLAFTRKSF

SEQ ID NO: 484264 - protein, 9 aa, Homo Sapiens
EVSKTHQNS

SEQ ID NO: 484265 - protein, 9 aa, Homo Sapiens
NVNKGTTPL

SEQ ID NO: 484266 - protein, 9 aa, Homo Sapiens
SVRTWDLPS

SEQ ID NO: 484267 - protein, 9 aa, Homo Sapiens
AVMPGGGIT

SEQ ID NO: 484268 - protein, 9 aa, Homo Sapiens
GGRAALGGS

SEQ ID NO: 484269 - protein, 9 aa, Homo Sapiens
ELASSLPQC

SEQ ID NO: 484270 - protein, 9 aa, Homo Sapiens
CVVGPNHAV

SEQ ID NO: 484271 - protein, 9 aa, Homo Sapiens
PYGWECHDG

SEQ ID NO: 484272 - protein, 9 aa, Homo Sapiens
GTMTLLSGV

SEQ ID NO: 484273 - protein, 9 aa, Homo Sapiens
QLSSFEVNS

SEQ ID NO: 484274 - protein, 9 aa, Homo Sapiens
EMSTGQLPA

SEQ ID NO: 484275 - protein, 9 aa, Homo Sapiens
ALEPWCHKH

SEQ ID NO: 484276 - protein, 9 aa, Homo Sapiens
ATQYICMLL

SEQ ID NO: 484277 - protein, 9 aa, Homo Sapiens
MEANTQDTK

SEQ ID NO: 484278 - protein, 9 aa, Homo Sapiens
VQRPLSLTR

SEQ ID NO: 484279 - protein, 9 aa, Homo Sapiens
SGGSGGRAA

SEQ ID NO: 484280 - protein, 9 aa, Homo Sapiens
VARVWFCNQ

SEQ ID NO: 484281 - protein, 9 aa, Homo Sapiens
AKNELHIVE

SEQ ID NO: 484282 - protein, 9 aa, Homo Sapiens
NTKDIDSSE

SEQ ID NO: 484283 - protein, 9 aa, Homo Sapiens
AKGPVQGYR

SEQ ID NO: 484284 - protein, 9 aa, Homo Sapiens
TLNFGVLEL

SEQ ID NO: 484285 - protein, 9 aa, Homo Sapiens
TSSPEPPTT

SEQ ID NO: 484286 - protein, 9 aa, Homo Sapiens
RLSLLRPVS

SEQ ID NO: 484287 - protein, 9 aa, Homo Sapiens
TYDLPLSSV

SEQ ID NO: 484288 - protein, 9 aa, Homo Sapiens
NSMIALKPI

SEQ ID NO: 484289 - protein, 9 aa, Homo Sapiens
LSTDQEGEV

SEQ ID NO: 484290 - protein, 9 aa, Homo Sapiens
GLIHTDITD

SEQ ID NO: 484291 - protein, 9 aa, Homo Sapiens
CFTFQGLCP

SEQ ID NO: 484292 - protein, 9 aa, Homo Sapiens
LRQVIQQNP

SEQ ID NO: 484293 - protein, 9 aa, Homo Sapiens
ENLTNGACA

SEQ ID NO: 484294 - protein, 9 aa, Homo Sapiens
EPAVGCPLL

SEQ ID NO: 484295 - protein, 9 aa, Homo Sapiens
YLLHLASAD

SEQ ID NO: 484296 - protein, 9 aa, Homo Sapiens
GSNVSPGQP

SEQ ID NO: 484297 - protein, 9 aa, Homo Sapiens
HFMEQPSFD

SEQ ID NO: 484298 - protein, 9 aa, Homo Sapiens
IIMYRDGVG

SEQ ID NO: 484299 - protein, 9 aa, Homo Sapiens
QVVQPSFPD

SEQ ID NO: 484300 - protein, 9 aa, Homo Sapiens
GFKATSDEK

SEQ ID NO: 484301 - protein, 9 aa, Homo Sapiens
DTEALSQRL

SEQ ID NO: 484302 - protein, 9 aa, Homo Sapiens
RSYFLREHR

SEQ ID NO: 484303 - protein, 9 aa, Homo Sapiens
GLGGAHCTE

SEQ ID NO: 484304 - protein, 9 aa, Homo Sapiens
QNAAGVNSS

SEQ ID NO: 484305 - protein, 9 aa, Homo Sapiens
KIWDASCMT

SEQ ID NO: 484306 - protein, 9 aa, Homo Sapiens
LPERGDPSP

SEQ ID NO: 484307 - protein, 9 aa, Homo Sapiens
LRPSVSAAV

SEQ ID NO: 484308 - protein, 9 aa, Homo Sapiens
EDRVDGVKY

SEQ ID NO: 484309 - protein, 9 aa, Homo Sapiens
FILKARNFD

SEQ ID NO: 484310 - protein, 9 aa, Homo Sapiens
HTRSHTAEK

SEQ ID NO: 484311 - protein, 9 aa, Homo Sapiens
AAMDCSVRT

SEQ ID NO: 484312 - protein, 9 aa, Homo Sapiens
LNMTADASF

SEQ ID NO: 484313 - protein, 9 aa, Homo Sapiens
PALSQSLYY

SEQ ID NO: 484314 - protein, 9 aa, Homo Sapiens
IQKILKLLL

SEQ ID NO: 484315 - protein, 9 aa, Homo Sapiens
FELGLCSFQ

SEQ ID NO: 484316 - protein, 9 aa, Homo Sapiens
LKDTEALSQ

SEQ ID NO: 484317 - protein, 9 aa, Homo Sapiens
VMWKVRQRP

SEQ ID NO: 484318 - protein, 9 aa, Homo Sapiens
LLRVILCWA

SEQ ID NO: 484319 - protein, 9 aa, Homo Sapiens
IIVYFTGTL

SEQ ID NO: 484320 - protein, 9 aa, Homo Sapiens
TKDIDSSED

SEQ ID NO: 484321 - protein, 9 aa, Homo Sapiens
QKKKEEMNA

SEQ ID NO: 484322 - protein, 9 aa, Homo Sapiens
VGMDCEIHV

SEQ ID NO: 484323 - protein, 9 aa, Homo Sapiens
GSFRPMWVT

SEQ ID NO: 484324 - protein, 9 aa, Homo Sapiens
DFCSVFATN

SEQ ID NO: 484325 - protein, 9 aa, Homo Sapiens
PDLLHQDRL

SEQ ID NO: 484326 - protein, 9 aa, Homo Sapiens
GSSFGKNGR

SEQ ID NO: 484327 - protein, 9 aa, Homo Sapiens
ETGIDVEKK

SEQ ID NO: 484328 - protein, 9 aa, Homo Sapiens
KVKKSSMAK

SEQ ID NO: 484329 - protein, 9 aa, Homo Sapiens
FWKPVQLDR

SEQ ID NO: 484330 - protein, 9 aa, Homo Sapiens
HGLVSTRSA

SEQ ID NO: 484331 - protein, 9 aa, Homo Sapiens
FDAEIMKLG

SEQ ID NO: 484332 - protein, 9 aa, Homo Sapiens
LHSVKNSML

SEQ ID NO: 484333 - protein, 9 aa, Homo Sapiens
EDMKTCADV

SEQ ID NO: 484334 - protein, 9 aa, Homo Sapiens
HLRVNHLGH

SEQ ID NO: 484335 - protein, 9 aa, Homo Sapiens
NESVPESSA

SEQ ID NO: 484336 - protein, 9 aa, Homo Sapiens
YDLRPSVSA

SEQ ID NO: 484337 - protein, 9 aa, Homo Sapiens
DELTTALEL

SEQ ID NO: 484338 - protein, 9 aa, Homo Sapiens
EAPDHCYES

SEQ ID NO: 484339 - protein, 9 aa, Homo Sapiens
VIVAREERG

SEQ ID NO: 484340 - protein, 9 aa, Homo Sapiens
TPTPTSPTC

SEQ ID NO: 484341 - protein, 9 aa, Homo Sapiens
GTTGARATT

SEQ ID NO: 484342 - protein, 9 aa, Homo Sapiens
LPLSSVPSP

SEQ ID NO: 484343 - protein, 9 aa, Homo Sapiens
QPRLHHPVQ

SEQ ID NO: 484344 - protein, 9 aa, Homo Sapiens
EEMNAVRRQ

SEQ ID NO: 484345 - protein, 9 aa, Homo Sapiens
ENPERFSLA

SEQ ID NO: 484346 - protein, 9 aa, Homo Sapiens
KVTPQFISK

SEQ ID NO: 484347 - protein, 9 aa, Homo Sapiens
MLIFQVRKK

SEQ ID NO: 484348 - protein, 9 aa, Homo Sapiens
REYGSFQSF

SEQ ID NO: 484349 - protein, 9 aa, Homo Sapiens
TSFFAPSFT

SEQ ID NO: 484350 - protein, 9 aa, Homo Sapiens
PDGPDHARL

SEQ ID NO: 484351 - protein, 9 aa, Homo Sapiens
SCAKRQKVE

SEQ ID NO: 484352 - protein, 9 aa, Homo Sapiens
HFPKAFLSA

SEQ ID NO: 484353 - protein, 9 aa, Homo Sapiens
LQLSHRYPR

SEQ ID NO: 484354 - protein, 9 aa, Homo Sapiens
ASLEGWLPS

SEQ ID NO: 484355 - protein, 9 aa, Homo Sapiens
DTMIYVTEK

SEQ ID NO: 484356 - protein, 9 aa, Homo Sapiens
DEACPDGGK

SEQ ID NO: 484357 - protein, 9 aa, Homo Sapiens
PPCLSASPQ

SEQ ID NO: 484358 - protein, 9 aa, Homo Sapiens
ASCTRDVVK

SEQ ID NO: 484359 - protein, 9 aa, Homo Sapiens
FRILDVAQD

SEQ ID NO: 484360 - protein, 9 aa, Homo Sapiens
APCQLGPNG

SEQ ID NO: 484361 - protein, 9 aa, Homo Sapiens
LAMDLSRRV

SEQ ID NO: 484362 - protein, 9 aa, Homo Sapiens
LSWAFSLAS

SEQ ID NO: 484363 - protein, 9 aa, Homo Sapiens
IHVYCQWQP

SEQ ID NO: 484364 - protein, 9 aa, Homo Sapiens
INSTSGKHK

SEQ ID NO: 484365 - protein, 9 aa, Homo Sapiens
GIKQAGQQR

SEQ ID NO: 484366 - protein, 9 aa, Homo Sapiens
TLSHNSMIA

SEQ ID NO: 484367 - protein, 9 aa, Homo Sapiens
EWLRKRYPT

SEQ ID NO: 484368 - protein, 9 aa, Homo Sapiens
REQQEIYYK

SEQ ID NO: 484369 - protein, 9 aa, Homo Sapiens
SDSATLRQL

SEQ ID NO: 484370 - protein, 9 aa, Homo Sapiens
PRFYRRTGV

SEQ ID NO: 484371 - protein, 9 aa, Homo Sapiens
IHTDITDRR

SEQ ID NO: 484372 - protein, 9 aa, Homo Sapiens
DGVNDEKDN

SEQ ID NO: 484373 - protein, 9 aa, Homo Sapiens
STGDTRIFL

SEQ ID NO: 484374 - protein, 9 aa, Homo Sapiens
GHKYGVECV

SEQ ID NO: 484375 - protein, 9 aa, Homo Sapiens
ISVVVKQPA

SEQ ID NO: 484376 - protein, 9 aa, Homo Sapiens
VGTMWFICD

SEQ ID NO: 484377 - protein, 9 aa, Homo Sapiens
LSTAHMSVT

SEQ ID NO: 484378 - protein, 9 aa, Homo Sapiens
TPIVSEGTF

SEQ ID NO: 484379 - protein, 9 aa, Homo Sapiens
DQCPKRRRQ

SEQ ID NO: 484380 - protein, 9 aa, Homo Sapiens
LEDYTLQVN

SEQ ID NO: 484381 - protein, 9 aa, Homo Sapiens
LNGCTCHML

SEQ ID NO: 484382 - protein, 9 aa, Homo Sapiens
TPDLLHQDR

SEQ ID NO: 484383 - protein, 9 aa, Homo Sapiens
PAGVSCFTF

SEQ ID NO: 484384 - protein, 9 aa, Homo Sapiens
VFLLEDGRV

SEQ ID NO: 484385 - protein, 9 aa, Homo Sapiens
WRVRVNSAY

SEQ ID NO: 484386 - protein, 9 aa, Homo Sapiens
GPDAPAAVS

SEQ ID NO: 484387 - protein, 9 aa, Homo Sapiens
FQNLRQVIQ

SEQ ID NO: 484388 - protein, 9 aa, Homo Sapiens
ATALGDGTL

SEQ ID NO: 484389 - protein, 9 aa, Homo Sapiens
IQECWYRDG

SEQ ID NO: 484390 - protein, 9 aa, Homo Sapiens
ATRETGSAL

SEQ ID NO: 484391 - protein, 9 aa, Homo Sapiens
KSKGPKRQR

SEQ ID NO: 484392 - protein, 9 aa, Homo Sapiens
LNVREELRH

SEQ ID NO: 484393 - protein, 9 aa, Homo Sapiens
PTCRPKVSN

SEQ ID NO: 484394 - protein, 9 aa, Homo Sapiens
SRSASLSWA

SEQ ID NO: 484395 - protein, 9 aa, Homo Sapiens
FKSRLHESN

SEQ ID NO: 484396 - protein, 9 aa, Homo Sapiens
ELEASKEPR

SEQ ID NO: 484397 - protein, 9 aa, Homo Sapiens
LASQSGQLL

SEQ ID NO: 484398 - protein, 9 aa, Homo Sapiens
SLVMLIGAR

SEQ ID NO: 484399 - protein, 9 aa, Homo Sapiens
MLPFCGPQK

SEQ ID NO: 484400 - protein, 9 aa, Homo Sapiens
TDIIVYFTG

SEQ ID NO: 484401 - protein, 9 aa, Homo Sapiens
VSTRSAQPS

SEQ ID NO: 484402 - protein, 9 aa, Homo Sapiens
QKRKKVKKS

SEQ ID NO: 484403 - protein, 9 aa, Homo Sapiens
YGQLFQLNM

SEQ ID NO: 484404 - protein, 9 aa, Homo Sapiens
PAAKMGKGK

SEQ ID NO: 484405 - protein, 9 aa, Homo Sapiens
KGHSAQARL

SEQ ID NO: 484406 - protein, 9 aa, Homo Sapiens
MTLLSGVLT

SEQ ID NO: 484407 - protein, 9 aa, Homo Sapiens
NVELGMMVW

SEQ ID NO: 484408 - protein, 9 aa, Homo Sapiens
DKSLLDEVS

SEQ ID NO: 484409 - protein, 9 aa, Homo Sapiens
FRQPLVEQL

SEQ ID NO: 484410 - protein, 9 aa, Homo Sapiens
NVSVLMKPS

SEQ ID NO: 484411 - protein, 9 aa, Homo Sapiens
LEKSEKLDE

SEQ ID NO: 484412 - protein, 9 aa, Homo Sapiens
FDTNTTDIA

SEQ ID NO: 484413 - protein, 9 aa, Homo Sapiens
SSEPWDPEK

SEQ ID NO: 484414 - protein, 9 aa, Homo Sapiens
ELYKELEKS

SEQ ID NO: 484415 - protein, 9 aa, Homo Sapiens
VIPARSKKN

SEQ ID NO: 484416 - protein, 9 aa, Homo Sapiens
TTLPGHGTL

SEQ ID NO: 484417 - protein, 9 aa, Homo Sapiens
CSESGLPSE

SEQ ID NO: 484418 - protein, 9 aa, Homo Sapiens
MPQLIVQME

SEQ ID NO: 484419 - protein, 9 aa, Homo Sapiens
LTPAGVSCF

SEQ ID NO: 484420 - protein, 9 aa, Homo Sapiens
ALELVDSCI

SEQ ID NO: 484421 - protein, 9 aa, Homo Sapiens
SKGPKRQRT

SEQ ID NO: 484422 - protein, 9 aa, Homo Sapiens
YLCYKGADP

SEQ ID NO: 484423 - protein, 9 aa, Homo Sapiens
GKGKRVEGP

SEQ ID NO: 484424 - protein, 9 aa, Homo Sapiens
APAAVSLPG

SEQ ID NO: 484425 - protein, 9 aa, Homo Sapiens
GKLKAPRPR

SEQ ID NO: 484426 - protein, 9 aa, Homo Sapiens
KMGKGKRVE

SEQ ID NO: 484427 - protein, 9 aa, Homo Sapiens
ATNSTCLNE

SEQ ID NO: 484428 - protein, 9 aa, Homo Sapiens
RLPPCLSAS

SEQ ID NO: 484429 - protein, 9 aa, Homo Sapiens
VGYKCLEST

SEQ ID NO: 484430 - protein, 9 aa, Homo Sapiens
LPSGMMTGT

SEQ ID NO: 484431 - protein, 9 aa, Homo Sapiens
NEMRADAEA

SEQ ID NO: 484432 - protein, 9 aa, Homo Sapiens
IVQMELDRE

SEQ ID NO: 484433 - protein, 9 aa, Homo Sapiens
LPRYALCLI

SEQ ID NO: 484434 - protein, 9 aa, Homo Sapiens
RPSHSLPES

SEQ ID NO: 484435 - protein, 9 aa, Homo Sapiens
RRKSKYNED

SEQ ID NO: 484436 - protein, 9 aa, Homo Sapiens
CMTLVDKFN

SEQ ID NO: 484437 - protein, 9 aa, Homo Sapiens
DLSSATAVL

SEQ ID NO: 484438 - protein, 9 aa, Homo Sapiens
GLPERGDPS

SEQ ID NO: 484439 - protein, 9 aa, Homo Sapiens
SFFAPSFTA

SEQ ID NO: 484440 - protein, 9 aa, Homo Sapiens
LAFVHPMKS

SEQ ID NO: 484441 - protein, 9 aa, Homo Sapiens
VELGMMVWQ

SEQ ID NO: 484442 - protein, 9 aa, Homo Sapiens
GGFYSVLLN

SEQ ID NO: 484443 - protein, 9 aa, Homo Sapiens
THPQFAFYD

SEQ ID NO: 484444 - protein, 9 aa, Homo Sapiens
GENVELGMM

SEQ ID NO: 484445 - protein, 9 aa, Homo Sapiens
SWYLCYKGA

SEQ ID NO: 484446 - protein, 9 aa, Homo Sapiens
KILGDYYYC

SEQ ID NO: 484447 - protein, 9 aa, Homo Sapiens
YGSFQSFVT

SEQ ID NO: 484448 - protein, 9 aa, Homo Sapiens
ILQLEQRKE

SEQ ID NO: 484449 - protein, 9 aa, Homo Sapiens
SCHVIALSL

SEQ ID NO: 484450 - protein, 9 aa, Homo Sapiens
YIFGGFYSV

SEQ ID NO: 484451 - protein, 9 aa, Homo Sapiens
RIIMYRDGV

SEQ ID NO: 484452 - protein, 9 aa, Homo Sapiens
VAYDLRPSV

SEQ ID NO: 484453 - protein, 9 aa, Homo Sapiens
YFILSNLNF

SEQ ID NO: 484454 - protein, 9 aa, Homo Sapiens
ARVWFCNQR

SEQ ID NO: 484455 - protein, 9 aa, Homo Sapiens
LHLASADFL

SEQ ID NO: 484456 - protein, 9 aa, Homo Sapiens
RKKQKHETR

SEQ ID NO: 484457 - protein, 9 aa, Homo Sapiens
HDPPDGDPG

SEQ ID NO: 484458 - protein, 9 aa, Homo Sapiens
SASLSWAFS

SEQ ID NO: 484459 - protein, 9 aa, Homo Sapiens
KCGKLKAPR

SEQ ID NO: 484460 - protein, 9 aa, Homo Sapiens
EMEEAPTHL

SEQ ID NO: 484461 - protein, 9 aa, Homo Sapiens
IGQYGVETV

SEQ ID NO: 484462 - protein, 9 aa, Homo Sapiens
HLSFREWLV

SEQ ID NO: 484463 - protein, 9 aa, Homo Sapiens
ADREPCVDG

SEQ ID NO: 484464 - protein, 9 aa, Homo Sapiens
QMCAEKQLK

SEQ ID NO: 484465 - protein, 9 aa, Homo Sapiens
WESRKPPMK

SEQ ID NO: 484466 - protein, 9 aa, Homo Sapiens
RTNNFNLET

SEQ ID NO: 484467 - protein, 9 aa, Homo Sapiens
RFNTAASYG

SEQ ID NO: 484468 - protein, 9 aa, Homo Sapiens
QGSEDQRAV

SEQ ID NO: 484469 - protein, 9 aa, Homo Sapiens
STSGKHKAF

SEQ ID NO: 484470 - protein, 9 aa, Homo Sapiens
QLRGDTPYL

SEQ ID NO: 484471 - protein, 9 aa, Homo Sapiens
CADYEKNKL

SEQ ID NO: 484472 - protein, 9 aa, Homo Sapiens
DQLTQPCGG

SEQ ID NO: 484473 - protein, 9 aa, Homo Sapiens
DPRESFSCS

SEQ ID NO: 484474 - protein, 9 aa, Homo Sapiens
RSLQQLLDE

SEQ ID NO: 484475 - protein, 9 aa, Homo Sapiens
NEVTLGQDT

SEQ ID NO: 484476 - protein, 9 aa, Homo Sapiens
APRRARARR

SEQ ID NO: 484477 - protein, 9 aa, Homo Sapiens
LHTSFFAPS

SEQ ID NO: 484478 - protein, 9 aa, Homo Sapiens
PTPTSPTCR

SEQ ID NO: 484479 - protein, 9 aa, Homo Sapiens
QAKGRIAVM

SEQ ID NO: 484480 - protein, 9 aa, Homo Sapiens
GWECHDGLS

SEQ ID NO: 484481 - protein, 9 aa, Homo Sapiens
KHETRRKSK

SEQ ID NO: 484482 - protein, 9 aa, Homo Sapiens
FNTAASYGL

SEQ ID NO: 484483 - protein, 9 aa, Homo Sapiens
QYWVERHCQ

SEQ ID NO: 484484 - protein, 9 aa, Homo Sapiens
FFGCWNLNL

SEQ ID NO: 484485 - protein, 9 aa, Homo Sapiens
YDNSHVTRM

SEQ ID NO: 484486 - protein, 9 aa, Homo Sapiens
VRKKQKHET

SEQ ID NO: 484487 - protein, 9 aa, Homo Sapiens
SPSTSRSRI

SEQ ID NO: 484488 - protein, 9 aa, Homo Sapiens
VTDPSSVST

SEQ ID NO: 484489 - protein, 9 aa, Homo Sapiens
LQELASSLP

SEQ ID NO: 484490 - protein, 9 aa, Homo Sapiens
MPGLMGSNV

SEQ ID NO: 484491 - protein, 9 aa, Homo Sapiens
RKSGRRLGS

SEQ ID NO: 484492 - protein, 9 aa, Homo Sapiens
RNAFRMALY

SEQ ID NO: 484493 - protein, 9 aa, Homo Sapiens
GSEEEACGV

SEQ ID NO: 484494 - protein, 9 aa, Homo Sapiens
FARCENLKI

SEQ ID NO: 484495 - protein, 9 aa, Homo Sapiens
IYLFILKAR

SEQ ID NO: 484496 - protein, 9 aa, Homo Sapiens
EVKPQALSM

SEQ ID NO: 484497 - protein, 9 aa, Homo Sapiens
FKIRAIYDK

SEQ ID NO: 484498 - protein, 9 aa, Homo Sapiens
YICKECSKA

SEQ ID NO: 484499 - protein, 9 aa, Homo Sapiens
PISFQETSA

SEQ ID NO: 484500 - protein, 9 aa, Homo Sapiens
LELEDRQSL

SEQ ID NO: 484501 - protein, 9 aa, Homo Sapiens
EPWDPEKDT

SEQ ID NO: 484502 - protein, 9 aa, Homo Sapiens
LPELHLLKL

SEQ ID NO: 484503 - protein, 9 aa, Homo Sapiens
SRGPRLSLR

SEQ ID NO: 484504 - protein, 9 aa, Homo Sapiens
LYKNDSCTV

SEQ ID NO: 484505 - protein, 9 aa, Homo Sapiens
QLIVQMELD

SEQ ID NO: 484506 - protein, 9 aa, Homo Sapiens
LSVWKSIVD

SEQ ID NO: 484507 - protein, 9 aa, Homo Sapiens
VGPNHAVFL

SEQ ID NO: 484508 - protein, 9 aa, Homo Sapiens
NKGTTPLAP

SEQ ID NO: 484509 - protein, 9 aa, Homo Sapiens
LSSATAVLG

SEQ ID NO: 484510 - protein, 9 aa, Homo Sapiens
YHSPELTTL

SEQ ID NO: 484511 - protein, 9 aa, Homo Sapiens
SRIIMYRDG

SEQ ID NO: 484512 - protein, 9 aa, Homo Sapiens
LSYKGNILE

SEQ ID NO: 484513 - protein, 9 aa, Homo Sapiens
AMDCSVRTW

SEQ ID NO: 484514 - protein, 9 aa, Homo Sapiens
ARPNPFGLL

SEQ ID NO: 484515 - protein, 9 aa, Homo Sapiens
EQYDQAKLF

SEQ ID NO: 484516 - protein, 9 aa, Homo Sapiens
HRRGEGAAL

SEQ ID NO: 484517 - protein, 9 aa, Homo Sapiens
AKKKLLKDT

SEQ ID NO: 484518 - protein, 9 aa, Homo Sapiens
QTDQEGGSM

SEQ ID NO: 484519 - protein, 9 aa, Homo Sapiens
TACGLGAAE

SEQ ID NO: 484520 - protein, 9 aa, Homo Sapiens
PGTGLETQD

SEQ ID NO: 484521 - protein, 9 aa, Homo Sapiens
QSGQLLAIY

SEQ ID NO: 484522 - protein, 9 aa, Homo Sapiens
IAKHGCCST

SEQ ID NO: 484523 - protein, 9 aa, Homo Sapiens
CHLSFREWL

SEQ ID NO: 484524 - protein, 9 aa, Homo Sapiens
THTLVDAHR

SEQ ID NO: 484525 - protein, 9 aa, Homo Sapiens
RPGTGLGGL

SEQ ID NO: 484526 - protein, 9 aa, Homo Sapiens
HPALSQSLY

SEQ ID NO: 484527 - protein, 9 aa, Homo Sapiens
ANQTLKHLW

SEQ ID NO: 484528 - protein, 9 aa, Homo Sapiens
SRLHESNSK

SEQ ID NO: 484529 - protein, 9 aa, Homo Sapiens
LAKSKHALF

SEQ ID NO: 484530 - protein, 9 aa, Homo Sapiens
EKATEFYKE

SEQ ID NO: 484531 - protein, 9 aa, Homo Sapiens
FMGFKMMNG

SEQ ID NO: 484532 - protein, 9 aa, Homo Sapiens
KVSNVVEFS

SEQ ID NO: 484533 - protein, 9 aa, Homo Sapiens
KRRRQGRDQ

SEQ ID NO: 484534 - protein, 9 aa, Homo Sapiens
GSAATLITH

SEQ ID NO: 484535 - protein, 9 aa, Homo Sapiens
WAFSLASAD

SEQ ID NO: 484536 - protein, 9 aa, Homo Sapiens
TAEKPYECN

SEQ ID NO: 484537 - protein, 9 aa, Homo Sapiens
TCQNSIYEP

SEQ ID NO: 484538 - protein, 9 aa, Homo Sapiens
FQETSATSG

SEQ ID NO: 484539 - protein, 9 aa, Homo Sapiens
KQLSSFEVN

SEQ ID NO: 484540 - protein, 9 aa, Homo Sapiens
CCGRGYDNS

SEQ ID NO: 484541 - protein, 9 aa, Homo Sapiens
QVGVMFQQM

SEQ ID NO: 484542 - protein, 9 aa, Homo Sapiens
VATEWRVRV

SEQ ID NO: 484543 - protein, 9 aa, Homo Sapiens
TGSEEEACG

SEQ ID NO: 484544 - protein, 9 aa, Homo Sapiens
FRPMWVTLD

SEQ ID NO: 484545 - protein, 9 aa, Homo Sapiens
SAPANVNKG

SEQ ID NO: 484546 - protein, 9 aa, Homo Sapiens
ASEILPLTL

SEQ ID NO: 484547 - protein, 9 aa, Homo Sapiens
MELDREEKD

SEQ ID NO: 484548 - protein, 9 aa, Homo Sapiens
YYYCVSGLP

SEQ ID NO: 484549 - protein, 9 aa, Homo Sapiens
FKALVDLTF

SEQ ID NO: 484550 - protein, 9 aa, Homo Sapiens
ATTTCWAAC

SEQ ID NO: 484551 - protein, 9 aa, Homo Sapiens
LRLVAKVEE

SEQ ID NO: 484552 - protein, 9 aa, Homo Sapiens
RSASLSWAF

SEQ ID NO: 484553 - protein, 9 aa, Homo Sapiens
SGKHKAFST

SEQ ID NO: 484554 - protein, 9 aa, Homo Sapiens
APGPATRET

SEQ ID NO: 484555 - protein, 9 aa, Homo Sapiens
SITNAGAGG

SEQ ID NO: 484556 - protein, 9 aa, Homo Sapiens
HSVKNSMLQ

SEQ ID NO: 484557 - protein, 9 aa, Homo Sapiens
YEKKYTGDR

SEQ ID NO: 484558 - protein, 9 aa, Homo Sapiens
LMKPSKPLC

SEQ ID NO: 484559 - protein, 9 aa, Homo Sapiens
AKHGCCSTD

SEQ ID NO: 484560 - protein, 9 aa, Homo Sapiens
RLHHPVQGS

SEQ ID NO: 484561 - protein, 9 aa, Homo Sapiens
CPVTPFDTK

SEQ ID NO: 484562 - protein, 9 aa, Homo Sapiens
GQLFQLNMT

SEQ ID NO: 484563 - protein, 9 aa, Homo Sapiens
DVEPTTEYT

SEQ ID NO: 484564 - protein, 9 aa, Homo Sapiens
VSCAKRQKV

SEQ ID NO: 484565 - protein, 9 aa, Homo Sapiens
LEGPISFQE

SEQ ID NO: 484566 - protein, 9 aa, Homo Sapiens
FLFWKPVQL

SEQ ID NO: 484567 - protein, 9 aa, Homo Sapiens
PDHCYESLR

SEQ ID NO: 484568 - protein, 9 aa, Homo Sapiens
GMLDLVAPI

SEQ ID NO: 484569 - protein, 9 aa, Homo Sapiens
QPSSVKSLC

SEQ ID NO: 484570 - protein, 9 aa, Homo Sapiens
LSLLRPVSA

SEQ ID NO: 484571 - protein, 9 aa, Homo Sapiens
YKCLESTAS

SEQ ID NO: 484572 - protein, 9 aa, Homo Sapiens
PLTQYHRDF

SEQ ID NO: 484573 - protein, 9 aa, Homo Sapiens
SEPWDPEKD

SEQ ID NO: 484574 - protein, 9 aa, Homo Sapiens
AATPERVNT

SEQ ID NO: 484575 - protein, 9 aa, Homo Sapiens
VVQPSFPDS

SEQ ID NO: 484576 - protein, 9 aa, Homo Sapiens
PHALVLKKV

SEQ ID NO: 484577 - protein, 9 aa, Homo Sapiens
ADGFETHLR

SEQ ID NO: 484578 - protein, 9 aa, Homo Sapiens
GDPGLPERG

SEQ ID NO: 484579 - protein, 9 aa, Homo Sapiens
HNDACDHGC

SEQ ID NO: 484580 - protein, 9 aa, Homo Sapiens
HRLFNESVP

SEQ ID NO: 484581 - protein, 9 aa, Homo Sapiens
PGLMGSNVS

SEQ ID NO: 484582 - protein, 9 aa, Homo Sapiens
PGPATRETG

SEQ ID NO: 484583 - protein, 9 aa, Homo Sapiens
KKKLLKDTE

SEQ ID NO: 484584 - protein, 9 aa, Homo Sapiens
TKKLMLWKE

SEQ ID NO: 484585 - protein, 9 aa, Homo Sapiens
DFQVVQPSF

SEQ ID NO: 484586 - protein, 9 aa, Homo Sapiens
FGFVSSEPW

SEQ ID NO: 484587 - protein, 9 aa, Homo Sapiens
KRQKVELLQ

SEQ ID NO: 484588 - protein, 9 aa, Homo Sapiens
SKVSRLTEW

SEQ ID NO: 484589 - protein, 9 aa, Homo Sapiens
SASPSTSRS

SEQ ID NO: 484590 - protein, 9 aa, Homo Sapiens
ECSKAFNCS

SEQ ID NO: 484591 - protein, 9 aa, Homo Sapiens
RSAQPSLKV

SEQ ID NO: 484592 - protein, 9 aa, Homo Sapiens
KPLPRYALC

SEQ ID NO: 484593 - protein, 9 aa, Homo Sapiens
ITLILMLPF

SEQ ID NO: 484594 - protein, 9 aa, Homo Sapiens
CCPGLGGAH

SEQ ID NO: 484595 - protein, 9 aa, Homo Sapiens
PLEERRSYG

SEQ ID NO: 484596 - protein, 9 aa, Homo Sapiens
QRMHTGEKL

SEQ ID NO: 484597 - protein, 9 aa, Homo Sapiens
GVNSSCSRM

SEQ ID NO: 484598 - protein, 9 aa, Homo Sapiens
LSSSPLGSS

SEQ ID NO: 484599 - protein, 9 aa, Homo Sapiens
RSLSSSPLG

SEQ ID NO: 484600 - protein, 9 aa, Homo Sapiens
EHVKRVTTP

SEQ ID NO: 484601 - protein, 9 aa, Homo Sapiens
GVETVKIVR

SEQ ID NO: 484602 - protein, 9 aa, Homo Sapiens
IVSSLVMLI

SEQ ID NO: 484603 - protein, 9 aa, Homo Sapiens
IFAAVEGAY

SEQ ID NO: 484604 - protein, 9 aa, Homo Sapiens
SLGAGAKNE

SEQ ID NO: 484605 - protein, 9 aa, Homo Sapiens
GYKCLESTA

SEQ ID NO: 484606 - protein, 9 aa, Homo Sapiens
EVTLGQDTA

SEQ ID NO: 484607 - protein, 9 aa, Homo Sapiens
PSHQLHTPM

SEQ ID NO: 484608 - protein, 9 aa, Homo Sapiens
HTDITDRRQ

SEQ ID NO: 484609 - protein, 9 aa, Homo Sapiens
MCAEKQLKL

SEQ ID NO: 484610 - protein, 9 aa, Homo Sapiens
DTHTLVDAH

SEQ ID NO: 484611 - protein, 9 aa, Homo Sapiens
QSLLQQELR

SEQ ID NO: 484612 - protein, 9 aa, Homo Sapiens
NFSVIVARE

SEQ ID NO: 484613 - protein, 9 aa, Homo Sapiens
GDPSPSTTP

SEQ ID NO: 484614 - protein, 9 aa, Homo Sapiens
SRLTEWLRK

SEQ ID NO: 484615 - protein, 9 aa, Homo Sapiens
LTGYPGRQG

SEQ ID NO: 484616 - protein, 9 aa, Homo Sapiens
LPHTACGLG

SEQ ID NO: 484617 - protein, 9 aa, Homo Sapiens
SKHALFWAQ

SEQ ID NO: 484618 - protein, 9 aa, Homo Sapiens
SLLDEVSPR

SEQ ID NO: 484619 - protein, 9 aa, Homo Sapiens
CGKLKAPRP

SEQ ID NO: 484620 - protein, 9 aa, Homo Sapiens
PLPSGMMTG

SEQ ID NO: 484621 - protein, 9 aa, Homo Sapiens
GMMVWQCGG

SEQ ID NO: 484622 - protein, 9 aa, Homo Sapiens
SGAARTKAF

SEQ ID NO: 484623 - protein, 9 aa, Homo Sapiens
IGSASPSTS

SEQ ID NO: 484624 - protein, 9 aa, Homo Sapiens
VLCIPSGAA

SEQ ID NO: 484625 - protein, 9 aa, Homo Sapiens
RKSKYNEDF

SEQ ID NO: 484626 - protein, 9 aa, Homo Sapiens
EKDHKVRLQ

SEQ ID NO: 484627 - protein, 9 aa, Homo Sapiens
LHRWWQDFC

SEQ ID NO: 484628 - protein, 9 aa, Homo Sapiens
SPPATPTPT

SEQ ID NO: 484629 - protein, 9 aa, Homo Sapiens
TLKTHKIIR

SEQ ID NO: 484630 - protein, 9 aa, Homo Sapiens
EQQEIYYKE

SEQ ID NO: 484631 - protein, 9 aa, Homo Sapiens
VMFQQMGIL

SEQ ID NO: 484632 - protein, 9 aa, Homo Sapiens
RPQIQPRHR

SEQ ID NO: 484633 - protein, 9 aa, Homo Sapiens
TRRKSKYNE

SEQ ID NO: 484634 - protein, 9 aa, Homo Sapiens
MENYEQELC

SEQ ID NO: 484635 - protein, 9 aa, Homo Sapiens
LLVATEWRV

SEQ ID NO: 484636 - protein, 9 aa, Homo Sapiens
ATEFYKEAL

SEQ ID NO: 484637 - protein, 9 aa, Homo Sapiens
GRAALGGSG

SEQ ID NO: 484638 - protein, 9 aa, Homo Sapiens
LLLASCTRD

SEQ ID NO: 484639 - protein, 9 aa, Homo Sapiens
FCHYNQFIR

SEQ ID NO: 484640 - protein, 9 aa, Homo Sapiens
ASNFSVIVA

SEQ ID NO: 484641 - protein, 9 aa, Homo Sapiens
HTEMEEAPT

SEQ ID NO: 484642 - protein, 9 aa, Homo Sapiens
EEQPGEPFE

SEQ ID NO: 484643 - protein, 9 aa, Homo Sapiens
PEDLYLHMQ

SEQ ID NO: 484644 - protein, 9 aa, Homo Sapiens
QLVSNFPPG

SEQ ID NO: 484645 - protein, 9 aa, Homo Sapiens
PAVGCPLLQ

SEQ ID NO: 484646 - protein, 9 aa, Homo Sapiens
ESRKPPMKA

SEQ ID NO: 484647 - protein, 9 aa, Homo Sapiens
GVDPYLAPL

SEQ ID NO: 484648 - protein, 9 aa, Homo Sapiens
GASLEGWLP

SEQ ID NO: 484649 - protein, 9 aa, Homo Sapiens
CYKGADPRE

SEQ ID NO: 484650 - protein, 9 aa, Homo Sapiens
TLHGLVSTR

SEQ ID NO: 484651 - protein, 9 aa, Homo Sapiens
APPTKKLML

SEQ ID NO: 484652 - protein, 9 aa, Homo Sapiens
EQGPGRAGG

SEQ ID NO: 484653 - protein, 9 aa, Homo Sapiens
PSPSTTPSP

SEQ ID NO: 484654 - protein, 9 aa, Homo Sapiens
YSQGMLDLV

SEQ ID NO: 484655 - protein, 9 aa, Homo Sapiens
KKNQSCGGK

SEQ ID NO: 484656 - protein, 9 aa, Homo Sapiens
FGLLRHLQG

SEQ ID NO: 484657 - protein, 9 aa, Homo Sapiens
YCPVTPFDT

SEQ ID NO: 484658 - protein, 9 aa, Homo Sapiens
TREMIAGSA

SEQ ID NO: 484659 - protein, 9 aa, Homo Sapiens
GVSCFTFQG

SEQ ID NO: 484660 - protein, 9 aa, Homo Sapiens
CSFSRRESS

SEQ ID NO: 484661 - protein, 9 aa, Homo Sapiens
SIAIIQQLS

SEQ ID NO: 484662 - protein, 9 aa, Homo Sapiens
SPTEFKVVL

SEQ ID NO: 484663 - protein, 9 aa, Homo Sapiens
APANVNKGT

SEQ ID NO: 484664 - protein, 9 aa, Homo Sapiens
HRDFGLWTT

SEQ ID NO: 484665 - protein, 9 aa, Homo Sapiens
FFIVSSLVM

SEQ ID NO: 484666 - protein, 9 aa, Homo Sapiens
ESRNAFRMA

SEQ ID NO: 484667 - protein, 9 aa, Homo Sapiens
QYICMLLRY

SEQ ID NO: 484668 - protein, 9 aa, Homo Sapiens
YALCLINMG

SEQ ID NO: 484669 - protein, 9 aa, Homo Sapiens
QLSHVNYCA

SEQ ID NO: 484670 - protein, 9 aa, Homo Sapiens
LTLSHNSMI

SEQ ID NO: 484671 - protein, 9 aa, Homo Sapiens
QHERLLHSV

SEQ ID NO: 484672 - protein, 9 aa, Homo Sapiens
CLNGCTCHM

SEQ ID NO: 484673 - protein, 9 aa, Homo Sapiens
EMAYGVMYG

SEQ ID NO: 484674 - protein, 9 aa, Homo Sapiens
TALELVDSC

SEQ ID NO: 484675 - protein, 9 aa, Homo Sapiens
TRSAQPSLK

SEQ ID NO: 484676 - protein, 9 aa, Homo Sapiens
AFRMALYGT

SEQ ID NO: 484677 - protein, 9 aa, Homo Sapiens
KHALFWAQR

SEQ ID NO: 484678 - protein, 9 aa, Homo Sapiens
CQLGPNGLP

SEQ ID NO: 484679 - protein, 9 aa, Homo Sapiens
DLPLSSVPS

SEQ ID NO: 484680 - protein, 9 aa, Homo Sapiens
TSGKHKAFS

SEQ ID NO: 484681 - protein, 9 aa, Homo Sapiens
KGRIAVMPG

SEQ ID NO: 484682 - protein, 9 aa, Homo Sapiens
PAYAKGPVQ

SEQ ID NO: 484683 - protein, 9 aa, Homo Sapiens
EFQALAEEG

SEQ ID NO: 484684 - protein, 9 aa, Homo Sapiens
RMGPVTSAQ

SEQ ID NO: 484685 - protein, 9 aa, Homo Sapiens
NHNGNIHGE

SEQ ID NO: 484686 - protein, 9 aa, Homo Sapiens
VDNSPLSPP

SEQ ID NO: 484687 - protein, 9 aa, Homo Sapiens
IDRSTVGVA

SEQ ID NO: 484688 - protein, 9 aa, Homo Sapiens
KVSRLTEWL

SEQ ID NO: 484689 - protein, 9 aa, Homo Sapiens
HLNTIAKHG

SEQ ID NO: 484690 - protein, 9 aa, Homo Sapiens
FSALQLSHR

SEQ ID NO: 484691 - protein, 9 aa, Homo Sapiens
GFVSSEPWD

SEQ ID NO: 484692 - protein, 9 aa, Homo Sapiens
VISPTEFKV

SEQ ID NO: 484693 - protein, 9 aa, Homo Sapiens
LLTLTPWLT

SEQ ID NO: 484694 - protein, 9 aa, Homo Sapiens
KAMGDPEPA

SEQ ID NO: 484695 - protein, 9 aa, Homo Sapiens
LYRLQQQQQ

SEQ ID NO: 484696 - protein, 9 aa, Homo Sapiens
KKGSAKEWV

SEQ ID NO: 484697 - protein, 9 aa, Homo Sapiens
TMIYVTEKG

SEQ ID NO: 484698 - protein, 9 aa, Homo Sapiens
GGAGHGGAA

SEQ ID NO: 484699 - protein, 9 aa, Homo Sapiens
LLHLASADF

SEQ ID NO: 484700 - protein, 9 aa, Homo Sapiens
PWDPEKDTK

SEQ ID NO: 484701 - protein, 9 aa, Homo Sapiens
SITYDLPLS

SEQ ID NO: 484702 - protein, 9 aa, Homo Sapiens
EYGNLHYFV

SEQ ID NO: 484703 - protein, 9 aa, Homo Sapiens
VECVAFSPN

SEQ ID NO: 484704 - protein, 9 aa, Homo Sapiens
DTPDLLHQD

SEQ ID NO: 484705 - protein, 9 aa, Homo Sapiens
SPEPPTTGL

SEQ ID NO: 484706 - protein, 9 aa, Homo Sapiens
IHELTNVLD

SEQ ID NO: 484707 - protein, 9 aa, Homo Sapiens
AARPSLNTA

SEQ ID NO: 484708 - protein, 9 aa, Homo Sapiens
RCKAMGDPE

SEQ ID NO: 484709 - protein, 9 aa, Homo Sapiens
LIFQVRKKQ

SEQ ID NO: 484710 - protein, 9 aa, Homo Sapiens
KVFARCENL

SEQ ID NO: 484711 - protein, 9 aa, Homo Sapiens
RIKILGDYY

SEQ ID NO: 484712 - protein, 9 aa, Homo Sapiens
LVVGMDCEI

SEQ ID NO: 484713 - protein, 9 aa, Homo Sapiens
GFKEKDYVI

SEQ ID NO: 484714 - protein, 9 aa, Homo Sapiens
PDEACPDGG

SEQ ID NO: 484715 - protein, 9 aa, Homo Sapiens
LETLNFGVL

SEQ ID NO: 484716 - protein, 9 aa, Homo Sapiens
SSSPLGSSA

SEQ ID NO: 484717 - protein, 9 aa, Homo Sapiens
QQLSHVNYC

SEQ ID NO: 484718 - protein, 9 aa, Homo Sapiens
PETQGPAAP

SEQ ID NO: 484719 - protein, 9 aa, Homo Sapiens
FPHQQQCVQ

SEQ ID NO: 484720 - protein, 9 aa, Homo Sapiens
NCESKGKPL

SEQ ID NO: 484721 - protein, 9 aa, Homo Sapiens
EMLHNDACD

SEQ ID NO: 484722 - protein, 9 aa, Homo Sapiens
FPTHPQFAF

SEQ ID NO: 484723 - protein, 9 aa, Homo Sapiens
YLASQSGQL

SEQ ID NO: 484724 - protein, 9 aa, Homo Sapiens
QGLRQAPLP

SEQ ID NO: 484725 - protein, 9 aa, Homo Sapiens
KMEQLVSNF

SEQ ID NO: 484726 - protein, 9 aa, Homo Sapiens
TTPLHVTDP

SEQ ID NO: 484727 - protein, 9 aa, Homo Sapiens
VGCPLLQQK

SEQ ID NO: 484728 - protein, 9 aa, Homo Sapiens
QSLNVREEL

SEQ ID NO: 484729 - protein, 9 aa, Homo Sapiens
CSVRTWDLP

SEQ ID NO: 484730 - protein, 9 aa, Homo Sapiens
GCTCHMLSR

SEQ ID NO: 484731 - protein, 9 aa, Homo Sapiens
EQEIRWELY

SEQ ID NO: 484732 - protein, 9 aa, Homo Sapiens
MDTNTRNPW

SEQ ID NO: 484733 - protein, 9 aa, Homo Sapiens
MVTGPFATA

SEQ ID NO: 484734 - protein, 9 aa, Homo Sapiens
PARSKKNQS

SEQ ID NO: 484735 - protein, 9 aa, Homo Sapiens
HVFLANLWY

SEQ ID NO: 484736 - protein, 9 aa, Homo Sapiens
ESIGQYGVE

SEQ ID NO: 484737 - protein, 9 aa, Homo Sapiens
PQFISKKDP

SEQ ID NO: 484738 - protein, 9 aa, Homo Sapiens
TQNGWSETF

SEQ ID NO: 484739 - protein, 9 aa, Homo Sapiens
QDGHTEMEE

SEQ ID NO: 484740 - protein, 9 aa, Homo Sapiens
CSKAFNCSS

SEQ ID NO: 484741 - protein, 9 aa, Homo Sapiens
EPPAYAKGP

SEQ ID NO: 484742 - protein, 9 aa, Homo Sapiens
FFYQAVDDV

SEQ ID NO: 484743 - protein, 9 aa, Homo Sapiens
NAAGVNSSC

SEQ ID NO: 484744 - protein, 9 aa, Homo Sapiens
FTFQGLCPG

SEQ ID NO: 484745 - protein, 9 aa, Homo Sapiens
SCHTDCKRR

SEQ ID NO: 484746 - protein, 9 aa, Homo Sapiens
ANSIQGCKV

SEQ ID NO: 484747 - protein, 9 aa, Homo Sapiens
CPDGGKENG

SEQ ID NO: 484748 - protein, 9 aa, Homo Sapiens
LDVEPTTEY

SEQ ID NO: 484749 - protein, 9 aa, Homo Sapiens
YDQAKLFRI

SEQ ID NO: 484750 - protein, 9 aa, Homo Sapiens
KNQSCGGKA

SEQ ID NO: 484751 - protein, 9 aa, Homo Sapiens
KSLLDEVSP

SEQ ID NO: 484752 - protein, 9 aa, Homo Sapiens
CTQNGWSET

SEQ ID NO: 484753 - protein, 9 aa, Homo Sapiens
EPWCHKHSV

SEQ ID NO: 484754 - protein, 9 aa, Homo Sapiens
ALAEEGAAA

SEQ ID NO: 484755 - protein, 9 aa, Homo Sapiens
MLWKETGGV

SEQ ID NO: 484756 - protein, 9 aa, Homo Sapiens
KCWNTSGHC

SEQ ID NO: 484757 - protein, 9 aa, Homo Sapiens
QGDTILSTA

SEQ ID NO: 484758 - protein, 9 aa, Homo Sapiens
LMLPFCGPQ

SEQ ID NO: 484759 - protein, 9 aa, Homo Sapiens
AFAVLTQCL

SEQ ID NO: 484760 - protein, 9 aa, Homo Sapiens
MHTGEKLYE

SEQ ID NO: 484761 - protein, 9 aa, Homo Sapiens
MWKVRQRPQ

SEQ ID NO: 484762 - protein, 9 aa, Homo Sapiens
LHGLVSTRS

SEQ ID NO: 484763 - protein, 9 aa, Homo Sapiens
QFQNLRQVI

SEQ ID NO: 484764 - protein, 9 aa, Homo Sapiens
LRYQVLQSE

SEQ ID NO: 484765 - protein, 9 aa, Homo Sapiens
IKQAGQQRW

SEQ ID NO: 484766 - protein, 9 aa, Homo Sapiens
SGGRAALGG

SEQ ID NO: 484767 - protein, 9 aa, Homo Sapiens
GPATRETGS

SEQ ID NO: 484768 - protein, 9 aa, Homo Sapiens
FFAPSFTAP

SEQ ID NO: 484769 - protein, 9 aa, Homo Sapiens
CAKRQKVEL

SEQ ID NO: 484770 - protein, 9 aa, Homo Sapiens
LERLFYEKK

SEQ ID NO: 484771 - protein, 9 aa, Homo Sapiens
MVWQCGGSM

SEQ ID NO: 484772 - protein, 9 aa, Homo Sapiens
MMVWQCGGS

SEQ ID NO: 484773 - protein, 9 aa, Homo Sapiens
SKYNEDFER

SEQ ID NO: 484774 - protein, 9 aa, Homo Sapiens
ARCENLKIH

SEQ ID NO: 484775 - protein, 9 aa, Homo Sapiens
GRSLAFTRK

SEQ ID NO: 484776 - protein, 9 aa, Homo Sapiens
EPRQQRVKR

SEQ ID NO: 484777 - protein, 9 aa, Homo Sapiens
EQAKGRIAV

SEQ ID NO: 484778 - protein, 9 aa, Homo Sapiens
TLRCKAMGD

SEQ ID NO: 484779 - protein, 9 aa, Homo Sapiens
LCRITENGL

SEQ ID NO: 484780 - protein, 9 aa, Homo Sapiens
GVPGLTGYP

SEQ ID NO: 484781 - protein, 9 aa, Homo Sapiens
RQGRDQLTQ

SEQ ID NO: 484782 - protein, 9 aa, Homo Sapiens
EKPPGFKAT

SEQ ID NO: 484783 - protein, 9 aa, Homo Sapiens
GFFIVSSLV

SEQ ID NO: 484784 - protein, 9 aa, Homo Sapiens
YHNNLLASS

SEQ ID NO: 484785 - protein, 9 aa, Homo Sapiens
GSGGRAALG

SEQ ID NO: 484786 - protein, 9 aa, Homo Sapiens
GNILEQILR

SEQ ID NO: 484787 - protein, 9 aa, Homo Sapiens
FSCSFSRRE

SEQ ID NO: 484788 - protein, 9 aa, Homo Sapiens
LEERRSYGE

SEQ ID NO: 484789 - protein, 9 aa, Homo Sapiens
SFQSFVTEV

SEQ ID NO: 484790 - protein, 9 aa, Homo Sapiens
MNAVRRQAE

SEQ ID NO: 484791 - protein, 9 aa, Homo Sapiens
GTGLETQDL

SEQ ID NO: 484792 - protein, 9 aa, Homo Sapiens
SAQVGTYRC

SEQ ID NO: 484793 - protein, 9 aa, Homo Sapiens
NLHYFVSNR

SEQ ID NO: 484794 - protein, 9 aa, Homo Sapiens
EDELTTALE

SEQ ID NO: 484795 - protein, 9 aa, Homo Sapiens
MGPVTSAQV

SEQ ID NO: 484796 - protein, 9 aa, Homo Sapiens
GGCGGSGGG

SEQ ID NO: 484797 - protein, 9 aa, Homo Sapiens
ELEDRQSLL

SEQ ID NO: 484798 - protein, 9 aa, Homo Sapiens
APLGYKDPV

SEQ ID NO: 484799 - protein, 9 aa, Homo Sapiens
TLRQLRGDT

SEQ ID NO: 484800 - protein, 9 aa, Homo Sapiens
LSLTRFDVA

SEQ ID NO: 484801 - protein, 9 aa, Homo Sapiens
RLFYEKKYT

SEQ ID NO: 484802 - protein, 9 aa, Homo Sapiens
KLRMDTNTR

SEQ ID NO: 484803 - protein, 9 aa, Homo Sapiens
PMKASLSLR

SEQ ID NO: 484804 - protein, 9 aa, Homo Sapiens
PTKKLMLWK

SEQ ID NO: 484805 - protein, 9 aa, Homo Sapiens
SPELTTLPG

SEQ ID NO: 484806 - protein, 9 aa, Homo Sapiens
KGPVQGYRL

SEQ ID NO: 484807 - protein, 9 aa, Homo Sapiens
LTNVLDGAG

SEQ ID NO: 484808 - protein, 9 aa, Homo Sapiens
SEEEACGVW

SEQ ID NO: 484809 - protein, 9 aa, Homo Sapiens
PANVNKGTT

SEQ ID NO: 484810 - protein, 9 aa, Homo Sapiens
RARRPSPGT

SEQ ID NO: 484811 - protein, 9 aa, Homo Sapiens
CQKMLIFQV

SEQ ID NO: 484812 - protein, 9 aa, Homo Sapiens
DVDMDLSSA

SEQ ID NO: 484813 - protein, 9 aa, Homo Sapiens
GDAPEDLYL

SEQ ID NO: 484814 - protein, 9 aa, Homo Sapiens
SKAFNCSSS

SEQ ID NO: 484815 - protein, 9 aa, Homo Sapiens
RDVPLTQYH

SEQ ID NO: 484816 - protein, 9 aa, Homo Sapiens
NSHVTRMTK

SEQ ID NO: 484817 - protein, 9 aa, Homo Sapiens
QSFPTHPQF

SEQ ID NO: 484818 - protein, 9 aa, Homo Sapiens
DQEGEVETP

SEQ ID NO: 484819 - protein, 9 aa, Homo Sapiens
FERAWREDL

SEQ ID NO: 484820 - protein, 9 aa, Homo Sapiens
AAEEQPGEP

SEQ ID NO: 484821 - protein, 9 aa, Homo Sapiens
DCEIHVYCQ

SEQ ID NO: 484822 - protein, 9 aa, Homo Sapiens
FETHLRVNH

SEQ ID NO: 484823 - protein, 9 aa, Homo Sapiens
KKLGMLGRQ

SEQ ID NO: 484824 - protein, 9 aa, Homo Sapiens
GFETHLRVN

SEQ ID NO: 484825 - protein, 9 aa, Homo Sapiens
MSTGQLPAT

SEQ ID NO: 484826 - protein, 9 aa, Homo Sapiens
PFATAGIFA

SEQ ID NO: 484827 - protein, 9 aa, Homo Sapiens
IDRYLAFVH

SEQ ID NO: 484828 - protein, 9 aa, Homo Sapiens
CTVKENVCI

SEQ ID NO: 484829 - protein, 9 aa, Homo Sapiens
VSNVVEFSV

SEQ ID NO: 484830 - protein, 9 aa, Homo Sapiens
ESGLPSEMQ

SEQ ID NO: 484831 - protein, 9 aa, Homo Sapiens
NELHIVEAE

SEQ ID NO: 484832 - protein, 9 aa, Homo Sapiens
MRPGTGLGG

SEQ ID NO: 484833 - protein, 9 aa, Homo Sapiens
IDSSEDEKH

SEQ ID NO: 484834 - protein, 9 aa, Homo Sapiens
PTTGLKFSF

SEQ ID NO: 484835 - protein, 9 aa, Homo Sapiens
NIYMFNLAL

SEQ ID NO: 484836 - protein, 9 aa, Homo Sapiens
AAKMGKGKR

SEQ ID NO: 484837 - protein, 9 aa, Homo Sapiens
QDRLQYLQE

SEQ ID NO: 484838 - protein, 9 aa, Homo Sapiens
DAHRLRGNL

SEQ ID NO: 484839 - protein, 9 aa, Homo Sapiens
PFTYTLRNQ

SEQ ID NO: 484840 - protein, 9 aa, Homo Sapiens
RRSYGERND

SEQ ID NO: 484841 - protein, 9 aa, Homo Sapiens
MATASAPQA

SEQ ID NO: 484842 - protein, 9 aa, Homo Sapiens
QPVQGKTQN

SEQ ID NO: 484843 - protein, 9 aa, Homo Sapiens
WDPEKDTKE

SEQ ID NO: 484844 - protein, 9 aa, Homo Sapiens
LTTLPGHGT

SEQ ID NO: 484845 - protein, 9 aa, Homo Sapiens
GSASPSTSR

SEQ ID NO: 484846 - protein, 9 aa, Homo Sapiens
ILKARNFDE

SEQ ID NO: 484847 - protein, 9 aa, Homo Sapiens
ERLFYEKKY

SEQ ID NO: 484848 - protein, 9 aa, Homo Sapiens
DSQSTLQSW

SEQ ID NO: 484849 - protein, 9 aa, Homo Sapiens
KKQKHETRR

SEQ ID NO: 484850 - protein, 9 aa, Homo Sapiens
ALTEIQKIL

SEQ ID NO: 484851 - protein, 9 aa, Homo Sapiens
HRWWQDFCS

SEQ ID NO: 484852 - protein, 9 aa, Homo Sapiens
ACSSTPCAN

SEQ ID NO: 484853 - protein, 9 aa, Homo Sapiens
NRDVIGVAE

SEQ ID NO: 484854 - protein, 9 aa, Homo Sapiens
ASCMTLVDK

SEQ ID NO: 484855 - protein, 9 aa, Homo Sapiens
ALAMDLSRR

SEQ ID NO: 484856 - protein, 9 aa, Homo Sapiens
FGKNGRGTS

SEQ ID NO: 484857 - protein, 9 aa, Homo Sapiens
LALAMDLSR

SEQ ID NO: 484858 - protein, 9 aa, Homo Sapiens
YESIGQYGV

SEQ ID NO: 484859 - protein, 9 aa, Homo Sapiens
SSFEVNSIN

SEQ ID NO: 484860 - protein, 9 aa, Homo Sapiens
SNSTLRISP

SEQ ID NO: 484861 - protein, 9 aa, Homo Sapiens
GPFATAGIF

SEQ ID NO: 484862 - protein, 9 aa, Homo Sapiens
RLKGSRNDF

SEQ ID NO: 484863 - protein, 9 aa, Homo Sapiens
CADVNECDL

SEQ ID NO: 484864 - protein, 9 aa, Homo Sapiens
RVNTILPIK

SEQ ID NO: 484865 - protein, 9 aa, Homo Sapiens
HCYESLRVT

SEQ ID NO: 484866 - protein, 9 aa, Homo Sapiens
YHRDFGLWT

SEQ ID NO: 484867 - protein, 9 aa, Homo Sapiens
ASIARQLRY

SEQ ID NO: 484868 - protein, 9 aa, Homo Sapiens
SNGRATALG

SEQ ID NO: 484869 - protein, 9 aa, Homo Sapiens
MKLFVDIDA

SEQ ID NO: 484870 - protein, 9 aa, Homo Sapiens
RKPLPRYAL

SEQ ID NO: 484871 - protein, 9 aa, Homo Sapiens
PLLRLVAKV

SEQ ID NO: 484872 - protein, 9 aa, Homo Sapiens
KLGGFFFFF

SEQ ID NO: 484873 - protein, 9 aa, Homo Sapiens
CWNTSGHCR

SEQ ID NO: 484874 - protein, 9 aa, Homo Sapiens
GSGGSGGRA

SEQ ID NO: 484875 - protein, 9 aa, Homo Sapiens
KLLKDTEAL

SEQ ID NO: 484876 - protein, 9 aa, Homo Sapiens
HKYGVECVA

SEQ ID NO: 484877 - protein, 9 aa, Homo Sapiens
KVSCAKRQK

SEQ ID NO: 484878 - protein, 9 aa, Homo Sapiens
ATLRQLRGD

SEQ ID NO: 484879 - protein, 9 aa, Homo Sapiens
KMCSESGLP

SEQ ID NO: 484880 - protein, 9 aa, Homo Sapiens
KYWKGTNHN

SEQ ID NO: 484881 - protein, 9 aa, Homo Sapiens
NDQDHYTNT

SEQ ID NO: 484882 - protein, 9 aa, Homo Sapiens
EVLVIPARS

SEQ ID NO: 484883 - protein, 9 aa, Homo Sapiens
RISCHTDCK

SEQ ID NO: 484884 - protein, 9 aa, Homo Sapiens
LMVTGPFAT

SEQ ID NO: 484885 - protein, 9 aa, Homo Sapiens
ANVNKGTTP

SEQ ID NO: 484886 - protein, 9 aa, Homo Sapiens
PRPRAPRRA

SEQ ID NO: 484887 - protein, 9 aa, Homo Sapiens
RARPNPFGL

SEQ ID NO: 484888 - protein, 9 aa, Homo Sapiens
ELEKSEKLD

SEQ ID NO: 484889 - protein, 9 aa, Homo Sapiens
EQLVSNFPP

SEQ ID NO: 484890 - protein, 9 aa, Homo Sapiens
VRQRPQIQP

SEQ ID NO: 484891 - protein, 9 aa, Homo Sapiens
SWTVVEATL

SEQ ID NO: 484892 - protein, 9 aa, Homo Sapiens
TQYICMLLR

SEQ ID NO: 484893 - protein, 9 aa, Homo Sapiens
DREPCVDGW

SEQ ID NO: 484894 - protein, 9 aa, Homo Sapiens
SAKEWVFGC

SEQ ID NO: 484895 - protein, 9 aa, Homo Sapiens
YMPSRIIMY

SEQ ID NO: 484896 - protein, 9 aa, Homo Sapiens
GPISFQETS

SEQ ID NO: 484897 - protein, 9 aa, Homo Sapiens
RMALYGTTS

SEQ ID NO: 484898 - protein, 9 aa, Homo Sapiens
VVVLKFEMG

SEQ ID NO: 484899 - protein, 9 aa, Homo Sapiens
WCHKHSVEV

SEQ ID NO: 484900 - protein, 9 aa, Homo Sapiens
WFICDGCGI

SEQ ID NO: 484901 - protein, 9 aa, Homo Sapiens
VFLMEANTQ

SEQ ID NO: 484902 - protein, 9 aa, Homo Sapiens
RFRAMAIYK

SEQ ID NO: 484903 - protein, 9 aa, Homo Sapiens
MLNPFTYTL

SEQ ID NO: 484904 - protein, 9 aa, Homo Sapiens
CDGCGIACA

SEQ ID NO: 484905 - protein, 9 aa, Homo Sapiens
KDTEALSQR

SEQ ID NO: 484906 - protein, 9 aa, Homo Sapiens
RWELYDIFR

SEQ ID NO: 484907 - protein, 9 aa, Homo Sapiens
ISCHTDCKR

SEQ ID NO: 484908 - protein, 9 aa, Homo Sapiens
PEPAVGCPL

SEQ ID NO: 484909 - protein, 9 aa, Homo Sapiens
LLETLNFGV

SEQ ID NO: 484910 - protein, 9 aa, Homo Sapiens
YFKIRAIYD

SEQ ID NO: 484911 - protein, 9 aa, Homo Sapiens
SRNAFRMAL

SEQ ID NO: 484912 - protein, 9 aa, Homo Sapiens
EDQVGVMFQ

SEQ ID NO: 484913 - protein, 9 aa, Homo Sapiens
KKNVARVWF

SEQ ID NO: 484914 - protein, 9 aa, Homo Sapiens
RRPSPGTTG

SEQ ID NO: 484915 - protein, 9 aa, Homo Sapiens
GPGRAGGRQ

SEQ ID NO: 484916 - protein, 9 aa, Homo Sapiens
KKTEFLDVD

SEQ ID NO: 484917 - protein, 9 aa, Homo Sapiens
KYTGDRSSN

SEQ ID NO: 484918 - protein, 9 aa, Homo Sapiens
GEQGPGRAG

SEQ ID NO: 484919 - protein, 9 aa, Homo Sapiens
QLEDPDGPD

SEQ ID NO: 484920 - protein, 9 aa, Homo Sapiens
LDVVVLKFE

SEQ ID NO: 484921 - protein, 9 aa, Homo Sapiens
LSDGSSFGK

SEQ ID NO: 484922 - protein, 9 aa, Homo Sapiens
RDVIGVAET

SEQ ID NO: 484923 - protein, 9 aa, Homo Sapiens
MDLYPPRRQ

SEQ ID NO: 484924 - protein, 9 aa, Homo Sapiens
SHVNYCADY

SEQ ID NO: 484925 - protein, 9 aa, Homo Sapiens
LMEANTQDT

SEQ ID NO: 484926 - protein, 9 aa, Homo Sapiens
LERIPRDSS

SEQ ID NO: 484927 - protein, 9 aa, Homo Sapiens
GLMGSNVSP

SEQ ID NO: 484928 - protein, 9 aa, Homo Sapiens
FKEKDYVII

SEQ ID NO: 484929 - protein, 9 aa, Homo Sapiens
ILMLVSPSH

SEQ ID NO: 484930 - protein, 9 aa, Homo Sapiens
FRNCTQNGW

SEQ ID NO: 484931 - protein, 9 aa, Homo Sapiens
VENPERFSL

SEQ ID NO: 484932 - protein, 9 aa, Homo Sapiens
GVGPYGWEC

SEQ ID NO: 484933 - protein, 9 aa, Homo Sapiens
TALGDGTLE

SEQ ID NO: 484934 - protein, 9 aa, Homo Sapiens
TPLHVTDPS

SEQ ID NO: 484935 - protein, 9 aa, Homo Sapiens
PPGFKATSD

SEQ ID NO: 484936 - protein, 9 aa, Homo Sapiens
LFVGTMTLL

SEQ ID NO: 484937 - protein, 9 aa, Homo Sapiens
KPPMKASLS

SEQ ID NO: 484938 - protein, 9 aa, Homo Sapiens
WEPPAYAKG

SEQ ID NO: 484939 - protein, 9 aa, Homo Sapiens
QGCKVNNVN

SEQ ID NO: 484940 - protein, 9 aa, Homo Sapiens
DPSPSTTPS

SEQ ID NO: 484941 - protein, 9 aa, Homo Sapiens
FVDIDADTR

SEQ ID NO: 484942 - protein, 9 aa, Homo Sapiens
NLDGALDVV

SEQ ID NO: 484943 - protein, 9 aa, Homo Sapiens
LTLRYIYGC

SEQ ID NO: 484944 - protein, 9 aa, Homo Sapiens
GRLPPCLSA

SEQ ID NO: 484945 - protein, 9 aa, Homo Sapiens
YAELYRLQQ

SEQ ID NO: 484946 - protein, 9 aa, Homo Sapiens
NDSCTVKEN

SEQ ID NO: 484947 - protein, 9 aa, Homo Sapiens
EFKVVLYLN

SEQ ID NO: 484948 - protein, 9 aa, Homo Sapiens
EQPGEPFEI

SEQ ID NO: 484949 - protein, 9 aa, Homo Sapiens
LFHKLFCHY

SEQ ID NO: 484950 - protein, 9 aa, Homo Sapiens
KTTEFDTNT

SEQ ID NO: 484951 - protein, 9 aa, Homo Sapiens
GRGTSSNSN

SEQ ID NO: 484952 - protein, 9 aa, Homo Sapiens
QAPLPSGMM

SEQ ID NO: 484953 - protein, 9 aa, Homo Sapiens
TMWFICDGC

SEQ ID NO: 484954 - protein, 9 aa, Homo Sapiens
LFVDIDADT

SEQ ID NO: 484955 - protein, 9 aa, Homo Sapiens
NGWSETFPR

SEQ ID NO: 484956 - protein, 9 aa, Homo Sapiens
VTATDVVQG

SEQ ID NO: 484957 - protein, 9 aa, Homo Sapiens
PNHAVFLLE

SEQ ID NO: 484958 - protein, 9 aa, Homo Sapiens
LQKKKEEMN

SEQ ID NO: 484959 - protein, 9 aa, Homo Sapiens
GCRKPLPRY

SEQ ID NO: 484960 - protein, 9 aa, Homo Sapiens
HVTDPSSVS

SEQ ID NO: 484961 - protein, 9 aa, Homo Sapiens
RVNHLGHFL

SEQ ID NO: 484962 - protein, 9 aa, Homo Sapiens
YWLSKNKGP

SEQ ID NO: 484963 - protein, 9 aa, Homo Sapiens
GHTEMEEAP

SEQ ID NO: 484964 - protein, 9 aa, Homo Sapiens
SPGTTGARA

SEQ ID NO: 484965 - protein, 9 aa, Homo Sapiens
LEQRKELWR

SEQ ID NO: 484966 - protein, 9 aa, Homo Sapiens
TRMFCHLSF

SEQ ID NO: 484967 - protein, 9 aa, Homo Sapiens
LSNLNFFGC

SEQ ID NO: 484968 - protein, 9 aa, Homo Sapiens
PGRSLAFTR

SEQ ID NO: 484969 - protein, 9 aa, Homo Sapiens
RLCRITENG

SEQ ID NO: 484970 - protein, 9 aa, Homo Sapiens
MWVTLDTED

SEQ ID NO: 484971 - protein, 9 aa, Homo Sapiens
TQGPAAPGT

SEQ ID NO: 484972 - protein, 9 aa, Homo Sapiens
IKKKRALIR

SEQ ID NO: 484973 - protein, 9 aa, Homo Sapiens
GGGGGCGGS

SEQ ID NO: 484974 - protein, 9 aa, Homo Sapiens
QRHPALSQS

SEQ ID NO: 484975 - protein, 9 aa, Homo Sapiens
YWKGTNHNG

SEQ ID NO: 484976 - protein, 9 aa, Homo Sapiens
PRYALCLIN

SEQ ID NO: 484977 - protein, 9 aa, Homo Sapiens
SRRESSSWE

SEQ ID NO: 484978 - protein, 9 aa, Homo Sapiens
PAEVSKTHQ

SEQ ID NO: 484979 - protein, 9 aa, Homo Sapiens
RQKVELLQG

SEQ ID NO: 484980 - protein, 9 aa, Homo Sapiens
QASSGLKQW

SEQ ID NO: 484981 - protein, 9 aa, Homo Sapiens
ESSSWEPDL

SEQ ID NO: 484982 - protein, 9 aa, Homo Sapiens
KVVLYLNQM

SEQ ID NO: 484983 - protein, 9 aa, Homo Sapiens
DDDDNDGVN

SEQ ID NO: 484984 - protein, 9 aa, Homo Sapiens
NGDYEKATE

SEQ ID NO: 484985 - protein, 9 aa, Homo Sapiens
QKYGGIFAA

SEQ ID NO: 484986 - protein, 9 aa, Homo Sapiens
WREDLTIKR

SEQ ID NO: 484987 - protein, 9 aa, Homo Sapiens
VRACSSTPC

SEQ ID NO: 484988 - protein, 9 aa, Homo Sapiens
QGKTQNRVC

SEQ ID NO: 484989 - protein, 9 aa, Homo Sapiens
TLRISPCLL

SEQ ID NO: 484990 - protein, 9 aa, Homo Sapiens
QLSLSDGSS

SEQ ID NO: 484991 - protein, 9 aa, Homo Sapiens
PMWVTLDTE

SEQ ID NO: 484992 - protein, 9 aa, Homo Sapiens
GPVTSAQVG

SEQ ID NO: 484993 - protein, 9 aa, Homo Sapiens
YWVERHCQT

SEQ ID NO: 484994 - protein, 9 aa, Homo Sapiens
VVPSITRFN

SEQ ID NO: 484995 - protein, 9 aa, Homo Sapiens
PEMLHNDAC

SEQ ID NO: 484996 - protein, 9 aa, Homo Sapiens
ISITNAGAG

SEQ ID NO: 484997 - protein, 9 aa, Homo Sapiens
MLGVVVFAF

SEQ ID NO: 484998 - protein, 9 aa, Homo Sapiens
NFNLETLKG

SEQ ID NO: 484999 - protein, 9 aa, Homo Sapiens
VLMKPSKPL

SEQ ID NO: 485000 - protein, 9 aa, Homo Sapiens
HESNSKVNL

SEQ ID NO: 485001 - protein, 9 aa, Homo Sapiens
VAYRLGIKQ

SEQ ID NO: 485002 - protein, 9 aa, Homo Sapiens
DRYLAFVHP

SEQ ID NO: 485003 - protein, 9 aa, Homo Sapiens
AYRLGIKQA

SEQ ID NO: 485004 - protein, 9 aa, Homo Sapiens
GGFFFFFFE

SEQ ID NO: 485005 - protein, 9 aa, Homo Sapiens
ECWYRDGVL

SEQ ID NO: 485006 - protein, 9 aa, Homo Sapiens
DAPAAVSLP

SEQ ID NO: 485007 - protein, 9 aa, Homo Sapiens
GYTEYKVTP

SEQ ID NO: 485008 - protein, 9 aa, Homo Sapiens
LYPPRRQGL

SEQ ID NO: 485009 - protein, 9 aa, Homo Sapiens
LLKDTEALS

SEQ ID NO: 485010 - protein, 9 aa, Homo Sapiens
QFAFYDNTS

SEQ ID NO: 485011 - protein, 9 aa, Homo Sapiens
KTEFLDVDN

SEQ ID NO: 485012 - protein, 9 aa, Homo Sapiens
TRSHTAEKP

SEQ ID NO: 485013 - protein, 9 aa, Homo Sapiens
LVATEWRVR

SEQ ID NO: 485014 - protein, 9 aa, Homo Sapiens
GTGLGGLEA

SEQ ID NO: 485015 - protein, 9 aa, Homo Sapiens
ACDHGCSRW

SEQ ID NO: 485016 - protein, 9 aa, Homo Sapiens
WVTALPQAA

SEQ ID NO: 485017 - protein, 9 aa, Homo Sapiens
FSLAPCLLG

SEQ ID NO: 485018 - protein, 9 aa, Homo Sapiens
YKNDSCTVK

SEQ ID NO: 485019 - protein, 9 aa, Homo Sapiens
RARARRPSP

SEQ ID NO: 485020 - protein, 9 aa, Homo Sapiens
PQLIVQMEL

SEQ ID NO: 485021 - protein, 9 aa, Homo Sapiens
QALAEEGAA

SEQ ID NO: 485022 - protein, 9 aa, Homo Sapiens
EPTTEYTAE

SEQ ID NO: 485023 - protein, 9 aa, Homo Sapiens
SPTCRAHQA

SEQ ID NO: 485024 - protein, 9 aa, Homo Sapiens
IARWIPWTI

SEQ ID NO: 485025 - protein, 9 aa, Homo Sapiens
EEFKALVDL

SEQ ID NO: 485026 - protein, 9 aa, Homo Sapiens
SRSYFLREH

SEQ ID NO: 485027 - protein, 9 aa, Homo Sapiens
SLAEMLKAN

SEQ ID NO: 485028 - protein, 9 aa, Homo Sapiens
QNSIYEPSC

SEQ ID NO: 485029 - protein, 9 aa, Homo Sapiens
GFLLLLLRV

SEQ ID NO: 485030 - protein, 9 aa, Homo Sapiens
CAKGHSAQA

SEQ ID NO: 485031 - protein, 9 aa, Homo Sapiens
GCPLLQQKL

SEQ ID NO: 485032 - protein, 9 aa, Homo Sapiens
VRTCCPGLG

SEQ ID NO: 485033 - protein, 9 aa, Homo Sapiens
GFYSVLLND

SEQ ID NO: 485034 - protein, 9 aa, Homo Sapiens
DHCYESLRV

SEQ ID NO: 485035 - protein, 9 aa, Homo Sapiens
SFRPMWVTL

SEQ ID NO: 485036 - protein, 9 aa, Homo Sapiens
RACSSTPCA

SEQ ID NO: 485037 - protein, 9 aa, Homo Sapiens
LTTALELVD

SEQ ID NO: 485038 - protein, 9 aa, Homo Sapiens
CLESTASND

SEQ ID NO: 485039 - protein, 9 aa, Homo Sapiens
KANQTLKHL

SEQ ID NO: 485040 - protein, 9 aa, Homo Sapiens
VVVKQPAFI

SEQ ID NO: 485041 - protein, 9 aa, Homo Sapiens
LTLTPWLTP

SEQ ID NO: 485042 - protein, 9 aa, Homo Sapiens
NVLDGAGIP

SEQ ID NO: 485043 - protein, 9 aa, Homo Sapiens
TQRHPALSQ

SEQ ID NO: 485044 - protein, 9 aa, Homo Sapiens
MRIKILGDY

SEQ ID NO: 485045 - protein, 9 aa, Homo Sapiens
DPTCRPKVS

SEQ ID NO: 485046 - protein, 9 aa, Homo Sapiens
TNHNGNIHG

SEQ ID NO: 485047 - protein, 9 aa, Homo Sapiens
ATWKVQKDE

SEQ ID NO: 485048 - protein, 9 aa, Homo Sapiens
ISPGTGLET

SEQ ID NO: 485049 - protein, 9 aa, Homo Sapiens
EALEEFKAL

SEQ ID NO: 485050 - protein, 9 aa, Homo Sapiens
TLILMLPFC

SEQ ID NO: 485051 - protein, 9 aa, Homo Sapiens
SLCSERLIR

SEQ ID NO: 485052 - protein, 9 aa, Homo Sapiens
QAKLFRILD

SEQ ID NO: 485053 - protein, 9 aa, Homo Sapiens
QNLRQVIQQ

SEQ ID NO: 485054 - protein, 9 aa, Homo Sapiens
PQKQEMKND

SEQ ID NO: 485055 - protein, 9 aa, Homo Sapiens
PSTSRSRIT

SEQ ID NO: 485056 - protein, 9 aa, Homo Sapiens
TKPQGASLE

SEQ ID NO: 485057 - protein, 9 aa, Homo Sapiens
AKGHSAQAR

SEQ ID NO: 485058 - protein, 9 aa, Homo Sapiens
PGLGGAHCT

SEQ ID NO: 485059 - protein, 9 aa, Homo Sapiens
TYPADYGQP

SEQ ID NO: 485060 - protein, 9 aa, Homo Sapiens
MAYGVMYGE

SEQ ID NO: 485061 - protein, 9 aa, Homo Sapiens
QEIYYKEKI

SEQ ID NO: 485062 - protein, 9 aa, Homo Sapiens
LARLALAMD

SEQ ID NO: 485063 - protein, 9 aa, Homo Sapiens
KLDLKKNVA

SEQ ID NO: 485064 - protein, 9 aa, Homo Sapiens
RIPDSIAII

SEQ ID NO: 485065 - protein, 9 aa, Homo Sapiens
LAEEGAAAA

SEQ ID NO: 485066 - protein, 9 aa, Homo Sapiens
TTFGEKLNK

SEQ ID NO: 485067 - protein, 9 aa, Homo Sapiens
LSHRYPRIQ

SEQ ID NO: 485068 - protein, 9 aa, Homo Sapiens
LSLSDGSSF

SEQ ID NO: 485069 - protein, 9 aa, Homo Sapiens
ERRSYGERN

SEQ ID NO: 485070 - protein, 9 aa, Homo Sapiens
FIVSSLVML

SEQ ID NO: 485071 - protein, 9 aa, Homo Sapiens
MKPSKPLCS

SEQ ID NO: 485072 - protein, 9 aa, Homo Sapiens
SSLPQCLML

SEQ ID NO: 485073 - protein, 9 aa, Homo Sapiens
MNGKQHIVL

SEQ ID NO: 485074 - protein, 9 aa, Homo Sapiens
GRATALGDG

SEQ ID NO: 485075 - protein, 9 aa, Homo Sapiens
IYVTEKGQK

SEQ ID NO: 485076 - protein, 9 aa, Homo Sapiens
KSRVFMMAL

SEQ ID NO: 485077 - protein, 9 aa, Homo Sapiens
HSAQARLPR

SEQ ID NO: 485078 - protein, 9 aa, Homo Sapiens
GMDCEIHVY

SEQ ID NO: 485079 - protein, 9 aa, Homo Sapiens
SGRRLGSPK

SEQ ID NO: 485080 - protein, 9 aa, Homo Sapiens
AREGRLPPC

SEQ ID NO: 485081 - protein, 9 aa, Homo Sapiens
SKAFSTCSC

SEQ ID NO: 485082 - protein, 9 aa, Homo Sapiens
NHAVFLLED

SEQ ID NO: 485083 - protein, 9 aa, Homo Sapiens
LKVGSALGI

SEQ ID NO: 485084 - protein, 9 aa, Homo Sapiens
YTAEEEEGV

SEQ ID NO: 485085 - protein, 9 aa, Homo Sapiens
DSIAIIQQL

SEQ ID NO: 485086 - protein, 9 aa, Homo Sapiens
ATASAPQAT

SEQ ID NO: 485087 - protein, 9 aa, Homo Sapiens
DVPLTQYHR

SEQ ID NO: 485088 - protein, 9 aa, Homo Sapiens
TDVVQGNPK

SEQ ID NO: 485089 - protein, 9 aa, Homo Sapiens
KTDHLVEDL

SEQ ID NO: 485090 - protein, 9 aa, Homo Sapiens
FPSTHDPPD

SEQ ID NO: 485091 - protein, 9 aa, Homo Sapiens
LCYKGADPR

SEQ ID NO: 485092 - protein, 9 aa, Homo Sapiens
LVEYGNLHY

SEQ ID NO: 485093 - protein, 9 aa, Homo Sapiens
VSISVISIT

SEQ ID NO: 485094 - protein, 9 aa, Homo Sapiens
IIQQLSPKE

SEQ ID NO: 485095 - protein, 9 aa, Homo Sapiens
SFEVNSINP

SEQ ID NO: 485096 - protein, 9 aa, Homo Sapiens
PTTEYTAEE

SEQ ID NO: 485097 - protein, 9 aa, Homo Sapiens
SGEKKCWNT

SEQ ID NO: 485098 - protein, 9 aa, Homo Sapiens
AWREDLTIK

SEQ ID NO: 485099 - protein, 9 aa, Homo Sapiens
CLLLASCTR

SEQ ID NO: 485100 - protein, 9 aa, Homo Sapiens
NGRATALGD

SEQ ID NO: 485101 - protein, 9 aa, Homo Sapiens
EACPDGGKE

SEQ ID NO: 485102 - protein, 9 aa, Homo Sapiens
SISVISITN

SEQ ID NO: 485103 - protein, 9 aa, Homo Sapiens
EKETGIDVE

SEQ ID NO: 485104 - protein, 9 aa, Homo Sapiens
SQSGQLLAI

SEQ ID NO: 485105 - protein, 9 aa, Homo Sapiens
FQSFVTEVS

SEQ ID NO: 485106 - protein, 9 aa, Homo Sapiens
ACPDGGKEN

SEQ ID NO: 485107 - protein, 9 aa, Homo Sapiens
VKALSAVSS

SEQ ID NO: 485108 - protein, 9 aa, Homo Sapiens
FFDAEIMKL

SEQ ID NO: 485109 - protein, 9 aa, Homo Sapiens
NSNNEVTLG

SEQ ID NO: 485110 - protein, 9 aa, Homo Sapiens
ESNSKVNLV

SEQ ID NO: 485111 - protein, 9 aa, Homo Sapiens
AVEYIRSLQ

SEQ ID NO: 485112 - protein, 9 aa, Homo Sapiens
ECAEDMWLM

SEQ ID NO: 485113 - protein, 9 aa, Homo Sapiens
IFQVRKKQK

SEQ ID NO: 485114 - protein, 9 aa, Homo Sapiens
IKIWDASCM

SEQ ID NO: 485115 - protein, 9 aa, Homo Sapiens
GHSAQARLP

SEQ ID NO: 485116 - protein, 9 aa, Homo Sapiens
DIIVYFTGT

SEQ ID NO: 485117 - protein, 9 aa, Homo Sapiens
HPQFAFYDN

SEQ ID NO: 485118 - protein, 9 aa, Homo Sapiens
VVGPNHAVF

SEQ ID NO: 485119 - protein, 9 aa, Homo Sapiens
KDPVSLRRG

SEQ ID NO: 485120 - protein, 9 aa, Homo Sapiens
SLDLFLFLC

SEQ ID NO: 485121 - protein, 9 aa, Homo Sapiens
LVSSYIAHL

SEQ ID NO: 485122 - protein, 9 aa, Homo Sapiens
KHFMEQPSF

SEQ ID NO: 485123 - protein, 9 aa, Homo Sapiens
EDTPDLLHQ

SEQ ID NO: 485124 - protein, 9 aa, Homo Sapiens
RAGGRQLEP

SEQ ID NO: 485125 - protein, 9 aa, Homo Sapiens
DTLRLVSSY

SEQ ID NO: 485126 - protein, 9 aa, Homo Sapiens
QCLVVQSSL

SEQ ID NO: 485127 - protein, 9 aa, Homo Sapiens
QEHVKRVTT

SEQ ID NO: 485128 - protein, 9 aa, Homo Sapiens
ERLFHKLFC

SEQ ID NO: 485129 - protein, 9 aa, Homo Sapiens
ALFWAQRKE

SEQ ID NO: 485130 - protein, 9 aa, Homo Sapiens
QVQCTSRTI

SEQ ID NO: 485131 - protein, 9 aa, Homo Sapiens
FSRSYFLRE

SEQ ID NO: 485132 - protein, 9 aa, Homo Sapiens
RGDPSPSTT

SEQ ID NO: 485133 - protein, 9 aa, Homo Sapiens
ELYRLQQQQ

SEQ ID NO: 485134 - protein, 9 aa, Homo Sapiens
PRDSSYEQE

SEQ ID NO: 485135 - protein, 9 aa, Homo Sapiens
AVFLLEDGR

SEQ ID NO: 485136 - protein, 9 aa, Homo Sapiens
DDNDGVNDE

SEQ ID NO: 485137 - protein, 9 aa, Homo Sapiens
CYESLRVTS

SEQ ID NO: 485138 - protein, 9 aa, Homo Sapiens
SKQLSSFEV

SEQ ID NO: 485139 - protein, 9 aa, Homo Sapiens
FDTMIYVTE

SEQ ID NO: 485140 - protein, 9 aa, Homo Sapiens
VQGNPKLNL

SEQ ID NO: 485141 - protein, 9 aa, Homo Sapiens
TTPYKYPRK

SEQ ID NO: 485142 - protein, 9 aa, Homo Sapiens
LLQQELRER

SEQ ID NO: 485143 - protein, 9 aa, Homo Sapiens
SVLMKPSKP

SEQ ID NO: 485144 - protein, 9 aa, Homo Sapiens
STDQEGEVE

SEQ ID NO: 485145 - protein, 9 aa, Homo Sapiens
VPSITRFNT

SEQ ID NO: 485146 - protein, 9 aa, Homo Sapiens
PRQKYGGIF

SEQ ID NO: 485147 - protein, 9 aa, Homo Sapiens
SQEQEIRWE

SEQ ID NO: 485148 - protein, 9 aa, Homo Sapiens
SESGLPSEM

SEQ ID NO: 485149 - protein, 9 aa, Homo Sapiens
FKMMNGKQH

SEQ ID NO: 485150 - protein, 9 aa, Homo Sapiens
PPTTGLKFS

SEQ ID NO: 485151 - protein, 9 aa, Homo Sapiens
SADFLFLSC

SEQ ID NO: 485152 - protein, 9 aa, Homo Sapiens
YRRTGVTLY

SEQ ID NO: 485153 - protein, 9 aa, Homo Sapiens
AWCKMCSES

SEQ ID NO: 485154 - protein, 9 aa, Homo Sapiens
TFMGFKMMN

SEQ ID NO: 485155 - protein, 9 aa, Homo Sapiens
GPYGWECHD

SEQ ID NO: 485156 - protein, 9 aa, Homo Sapiens
QLLPHTACG

SEQ ID NO: 485157 - protein, 9 aa, Homo Sapiens
VFPSTHDPP

SEQ ID NO: 485158 - protein, 9 aa, Homo Sapiens
CSTDSQSTL

SEQ ID NO: 485159 - protein, 9 aa, Homo Sapiens
STPPPGTRF

SEQ ID NO: 485160 - protein, 9 aa, Homo Sapiens
RPSLNTALL

SEQ ID NO: 485161 - protein, 9 aa, Homo Sapiens
EERRSYGER

SEQ ID NO: 485162 - protein, 9 aa, Homo Sapiens
LDRWEMSTG

SEQ ID NO: 485163 - protein, 9 aa, Homo Sapiens
DLSRSLSSS

SEQ ID NO: 485164 - protein, 9 aa, Homo Sapiens
VKENVCIID

SEQ ID NO: 485165 - protein, 9 aa, Homo Sapiens
TPRQKYGGI

SEQ ID NO: 485166 - protein, 9 aa, Homo Sapiens
KRKKVKKSS

SEQ ID NO: 485167 - protein, 9 aa, Homo Sapiens
EYKVTPQFI

SEQ ID NO: 485168 - protein, 9 aa, Homo Sapiens
ENVELGMMV

SEQ ID NO: 485169 - protein, 9 aa, Homo Sapiens
LSEVKALSA

SEQ ID NO: 485170 - protein, 9 aa, Homo Sapiens
FNLETLKGQ

SEQ ID NO: 485171 - protein, 9 aa, Homo Sapiens
FLKLRMDTN

SEQ ID NO: 485172 - protein, 9 aa, Homo Sapiens
QWDWSTYPA

SEQ ID NO: 485173 - protein, 9 aa, Homo Sapiens
PVGTMWFIC

SEQ ID NO: 485174 - protein, 9 aa, Homo Sapiens
TFYGFKEKD

SEQ ID NO: 485175 - protein, 9 aa, Homo Sapiens
ELTTLPGHG

SEQ ID NO: 485176 - protein, 9 aa, Homo Sapiens
TKRNQEHES

SEQ ID NO: 485177 - protein, 9 aa, Homo Sapiens
CCIELVESG

SEQ ID NO: 485178 - protein, 9 aa, Homo Sapiens
IMYRDGVGD

SEQ ID NO: 485179 - protein, 9 aa, Homo Sapiens
PDHARLYYI

SEQ ID NO: 485180 - protein, 9 aa, Homo Sapiens
MAFAVLTQC

SEQ ID NO: 485181 - protein, 9 aa, Homo Sapiens
DPGLPERGD

SEQ ID NO: 485182 - protein, 9 aa, Homo Sapiens
SPSHQLHTP

SEQ ID NO: 485183 - protein, 9 aa, Homo Sapiens
HSRKRSRLS

SEQ ID NO: 485184 - protein, 9 aa, Homo Sapiens
GGIFAAVEG

SEQ ID NO: 485185 - protein, 9 aa, Homo Sapiens
KNVARVWFC

SEQ ID NO: 485186 - protein, 9 aa, Homo Sapiens
EHVFLANLW

SEQ ID NO: 485187 - protein, 9 aa, Homo Sapiens
FWAQRKENE

SEQ ID NO: 485188 - protein, 9 aa, Homo Sapiens
IPNTKDIDS

SEQ ID NO: 485189 - protein, 9 aa, Homo Sapiens
GDYYYCVSG

SEQ ID NO: 485190 - protein, 9 aa, Homo Sapiens
SNFSVIVAR

SEQ ID NO: 485191 - protein, 9 aa, Homo Sapiens
VQLSLSDGS

SEQ ID NO: 485192 - protein, 9 aa, Homo Sapiens
TLTPWLTPI

SEQ ID NO: 485193 - protein, 9 aa, Homo Sapiens
GAGHGGAAG

SEQ ID NO: 485194 - protein, 9 aa, Homo Sapiens
YFTGTLAET

SEQ ID NO: 485195 - protein, 9 aa, Homo Sapiens
HNNLLASSD

SEQ ID NO: 485196 - protein, 9 aa, Homo Sapiens
CAEDMWLME

SEQ ID NO: 485197 - protein, 9 aa, Homo Sapiens
DSWAGIARW

SEQ ID NO: 485198 - protein, 9 aa, Homo Sapiens
LSSFEVNSI

SEQ ID NO: 485199 - protein, 9 aa, Homo Sapiens
ALHGMQFLH

SEQ ID NO: 485200 - protein, 9 aa, Homo Sapiens
VSAAVFEDS

SEQ ID NO: 485201 - protein, 9 aa, Homo Sapiens
PSTTPSPPA

SEQ ID NO: 485202 - protein, 9 aa, Homo Sapiens
ASMSIDRST

SEQ ID NO: 485203 - protein, 9 aa, Homo Sapiens
FCSVFATND

SEQ ID NO: 485204 - protein, 9 aa, Homo Sapiens
GKENGCLSG

SEQ ID NO: 485205 - protein, 9 aa, Homo Sapiens
NQSCGGKAG

SEQ ID NO: 485206 - protein, 9 aa, Homo Sapiens
GAKNELHIV

SEQ ID NO: 485207 - protein, 9 aa, Homo Sapiens
TATDVVQGN

SEQ ID NO: 485208 - protein, 9 aa, Homo Sapiens
IPSGAARTK

SEQ ID NO: 485209 - protein, 9 aa, Homo Sapiens
VVGMDCEIH

SEQ ID NO: 485210 - protein, 9 aa, Homo Sapiens
SYGERNDAA

SEQ ID NO: 485211 - protein, 9 aa, Homo Sapiens
ADVLDQCPK

SEQ ID NO: 485212 - protein, 9 aa, Homo Sapiens
TCCPGLGGA

SEQ ID NO: 485213 - protein, 9 aa, Homo Sapiens
RPSPGTTGA

SEQ ID NO: 485214 - protein, 9 aa, Homo Sapiens
SVSISVISI

SEQ ID NO: 485215 - protein, 9 aa, Homo Sapiens
PRVSKQLSS

SEQ ID NO: 485216 - protein, 9 aa, Homo Sapiens
FAADVLDQC

SEQ ID NO: 485217 - protein, 9 aa, Homo Sapiens
YGWECHDGL

SEQ ID NO: 485218 - protein, 9 aa, Homo Sapiens
KLDTLRLVS

SEQ ID NO: 485219 - protein, 9 aa, Homo Sapiens
ETHLRVNHL

SEQ ID NO: 485220 - protein, 9 aa, Homo Sapiens
FVSSEPWDP

SEQ ID NO: 485221 - protein, 9 aa, Homo Sapiens
KTQNRVCRE

SEQ ID NO: 485222 - protein, 9 aa, Homo Sapiens
IARQLRYQV

SEQ ID NO: 485223 - protein, 9 aa, Homo Sapiens
SLTRFDVAV

SEQ ID NO: 485224 - protein, 9 aa, Homo Sapiens
ILMLPFCGP

SEQ ID NO: 485225 - protein, 9 aa, Homo Sapiens
AKRQKVELL

SEQ ID NO: 485226 - protein, 9 aa, Homo Sapiens
VYCDMTTDW

SEQ ID NO: 485227 - protein, 9 aa, Homo Sapiens
GVECVAFSP

SEQ ID NO: 485228 - protein, 9 aa, Homo Sapiens
FMASEILPL

SEQ ID NO: 485229 - protein, 9 aa, Homo Sapiens
ALVEYGNLH

SEQ ID NO: 485230 - protein, 9 aa, Homo Sapiens
HLASADFLF

SEQ ID NO: 485231 - protein, 9 aa, Homo Sapiens
NGSAPIQEC

SEQ ID NO: 485232 - protein, 9 aa, Homo Sapiens
AQVGTYRCY

SEQ ID NO: 485233 - protein, 9 aa, Homo Sapiens
STTPSPPAT

SEQ ID NO: 485234 - protein, 9 aa, Homo Sapiens
ASADFLFLS

SEQ ID NO: 485235 - protein, 9 aa, Homo Sapiens
YGVETVKIV

SEQ ID NO: 485236 - protein, 9 aa, Homo Sapiens
ACAGNGDDG

SEQ ID NO: 485237 - protein, 9 aa, Homo Sapiens
PDGDPGLPE

SEQ ID NO: 485238 - protein, 9 aa, Homo Sapiens
RLHESNSKV

SEQ ID NO: 485239 - protein, 9 aa, Homo Sapiens
ERAWREDLT

SEQ ID NO: 485240 - protein, 9 aa, Homo Sapiens
LTNGACAGN

SEQ ID NO: 485241 - protein, 9 aa, Homo Sapiens
TPFDTKWTP

SEQ ID NO: 485242 - protein, 9 aa, Homo Sapiens
KNDSCTVKE

SEQ ID NO: 485243 - protein, 9 aa, Homo Sapiens
LGEAPDHCY

SEQ ID NO: 485244 - protein, 9 aa, Homo Sapiens
VETPTPTES

SEQ ID NO: 485245 - protein, 9 aa, Homo Sapiens
IEQAKGRIA

SEQ ID NO: 485246 - protein, 9 aa, Homo Sapiens
PDAPAAVSL

SEQ ID NO: 485247 - protein, 9 aa, Homo Sapiens
LLASCTRDV

SEQ ID NO: 485248 - protein, 9 aa, Homo Sapiens
SAAMDCSVR

SEQ ID NO: 485249 - protein, 9 aa, Homo Sapiens
QSWTVVEAT

SEQ ID NO: 485250 - protein, 9 aa, Homo Sapiens
ATSWSEADR

SEQ ID NO: 485251 - protein, 9 aa, Homo Sapiens
TSWSEADRE

SEQ ID NO: 485252 - protein, 9 aa, Homo Sapiens
LDQCPKRRR

SEQ ID NO: 485253 - protein, 9 aa, Homo Sapiens
FTHRLFNES

SEQ ID NO: 485254 - protein, 9 aa, Homo Sapiens
STRSAQPSL

SEQ ID NO: 485255 - protein, 9 aa, Homo Sapiens
SSGLKQWNK

SEQ ID NO: 485256 - protein, 9 aa, Homo Sapiens
CLDRFRAAT

SEQ ID NO: 485257 - protein, 9 aa, Homo Sapiens
TGLETQDLT

SEQ ID NO: 485258 - protein, 9 aa, Homo Sapiens
YCADYEKNK

SEQ ID NO: 485259 - protein, 9 aa, Homo Sapiens
MEGALEVHL

SEQ ID NO: 485260 - protein, 9 aa, Homo Sapiens
GLETQDLTM

SEQ ID NO: 485261 - protein, 9 aa, Homo Sapiens
QQEIYYKEK

SEQ ID NO: 485262 - protein, 9 aa, Homo Sapiens
SSQAPLGYK

SEQ ID NO: 485263 - protein, 9 aa, Homo Sapiens
FQCHRRGEG

SEQ ID NO: 485264 - protein, 9 aa, Homo Sapiens
WLTPIVSEG

SEQ ID NO: 485265 - protein, 9 aa, Homo Sapiens
ENYEQELCG

SEQ ID NO: 485266 - protein, 9 aa, Homo Sapiens
RPMWVTLDT

SEQ ID NO: 485267 - protein, 9 aa, Homo Sapiens
LSFREWLVW

SEQ ID NO: 485268 - protein, 9 aa, Homo Sapiens
CCSTDSQST

SEQ ID NO: 485269 - protein, 9 aa, Homo Sapiens
AREQIPSSD

SEQ ID NO: 485270 - protein, 9 aa, Homo Sapiens
FVEPFQCHR

SEQ ID NO: 485271 - protein, 9 aa, Homo Sapiens
MTTDWGGWI

SEQ ID NO: 485272 - protein, 9 aa, Homo Sapiens
CLSASPQPS

SEQ ID NO: 485273 - protein, 9 aa, Homo Sapiens
SFPTHPQFA

SEQ ID NO: 485274 - protein, 9 aa, Homo Sapiens
LVDLTFPGS

SEQ ID NO: 485275 - protein, 9 aa, Homo Sapiens
SWEPDLFPH

SEQ ID NO: 485276 - protein, 9 aa, Homo Sapiens
DVPREYGSF

SEQ ID NO: 485277 - protein, 9 aa, Homo Sapiens
CKMCSESGL

SEQ ID NO: 485278 - protein, 9 aa, Homo Sapiens
KHTRSHTAE

SEQ ID NO: 485279 - protein, 9 aa, Homo Sapiens
LVSPSHQLH

SEQ ID NO: 485280 - protein, 9 aa, Homo Sapiens
CAPPPAARP

SEQ ID NO: 485281 - protein, 9 aa, Homo Sapiens
SRSLSSSPL

SEQ ID NO: 485282 - protein, 9 aa, Homo Sapiens
HHKLHTCEK

SEQ ID NO: 485283 - protein, 9 aa, Homo Sapiens
DDDNDGVND

SEQ ID NO: 485284 - protein, 9 aa, Homo Sapiens
MLGHKYGVE

SEQ ID NO: 485285 - protein, 9 aa, Homo Sapiens
IDADTRLSR

SEQ ID NO: 485286 - protein, 9 aa, Homo Sapiens
KQAGQQRWW

SEQ ID NO: 485287 - protein, 9 aa, Homo Sapiens
AQGSEDQRA

SEQ ID NO: 485288 - protein, 9 aa, Homo Sapiens
QDTADSWAG

SEQ ID NO: 485289 - protein, 9 aa, Homo Sapiens
SLLQQELRE

SEQ ID NO: 485290 - protein, 9 aa, Homo Sapiens
NFGVLELQE

SEQ ID NO: 485291 - protein, 9 aa, Homo Sapiens
QLRYQVLQS

SEQ ID NO: 485292 - protein, 9 aa, Homo Sapiens
AREEQSWTV

SEQ ID NO: 485293 - protein, 9 aa, Homo Sapiens
EPPTTGLKF

SEQ ID NO: 485294 - protein, 9 aa, Homo Sapiens
TNGACAGNG

SEQ ID NO: 485295 - protein, 9 aa, Homo Sapiens
FSTCSCHVI

SEQ ID NO: 485296 - protein, 9 aa, Homo Sapiens
KCTGLERIP

SEQ ID NO: 485297 - protein, 9 aa, Homo Sapiens
ELQKKKEEM

SEQ ID NO: 485298 - protein, 9 aa, Homo Sapiens
QKQEMKNDQ

SEQ ID NO: 485299 - protein, 9 aa, Homo Sapiens
ICKECSKAF

SEQ ID NO: 485300 - protein, 9 aa, Homo Sapiens
DAPEDLYLH

SEQ ID NO: 485301 - protein, 9 aa, Homo Sapiens
SGLPSEMQD

SEQ ID NO: 485302 - protein, 9 aa, Homo Sapiens
KPKFYLCST

SEQ ID NO: 485303 - protein, 9 aa, Homo Sapiens
GLQNRDVIG

SEQ ID NO: 485304 - protein, 9 aa, Homo Sapiens
ELGLCSFQG

SEQ ID NO: 485305 - protein, 9 aa, Homo Sapiens
EQLEDYTLQ

SEQ ID NO: 485306 - protein, 9 aa, Homo Sapiens
RRARARRPS

SEQ ID NO: 485307 - protein, 9 aa, Homo Sapiens
CSERLIRTS

SEQ ID NO: 485308 - protein, 9 aa, Homo Sapiens
TSAADLVTK

SEQ ID NO: 485309 - protein, 9 aa, Homo Sapiens
LQDGHTEME

SEQ ID NO: 485310 - protein, 9 aa, Homo Sapiens
RYQVLQSED

SEQ ID NO: 485311 - protein, 9 aa, Homo Sapiens
KKVKKSSMA

SEQ ID NO: 485312 - protein, 9 aa, Homo Sapiens
DSATLRQLR

SEQ ID NO: 485313 - protein, 9 aa, Homo Sapiens
LHNDACDHG

SEQ ID NO: 485314 - protein, 9 aa, Homo Sapiens
TDSQSTLQS

SEQ ID NO: 485315 - protein, 9 aa, Homo Sapiens
VRPYTCPHF

SEQ ID NO: 485316 - protein, 9 aa, Homo Sapiens
IRFLETELV

SEQ ID NO: 485317 - protein, 9 aa, Homo Sapiens
KKKLGMLGR

SEQ ID NO: 485318 - protein, 9 aa, Homo Sapiens
QYGVETVKI

SEQ ID NO: 485319 - protein, 9 aa, Homo Sapiens
DVVVLKFEM

SEQ ID NO: 485320 - protein, 9 aa, Homo Sapiens
EQLSTTFGE

SEQ ID NO: 485321 - protein, 9 aa, Homo Sapiens
ASAPANVNK

SEQ ID NO: 485322 - protein, 9 aa, Homo Sapiens
QRPQIQPRH

SEQ ID NO: 485323 - protein, 9 aa, Homo Sapiens
SKKNQSCGG

SEQ ID NO: 485324 - protein, 9 aa, Homo Sapiens
SGATCQNSI

SEQ ID NO: 485325 - protein, 9 aa, Homo Sapiens
NGLPMPGCW

SEQ ID NO: 485326 - protein, 9 aa, Homo Sapiens
GRAFSRSYF

SEQ ID NO: 485327 - protein, 9 aa, Homo Sapiens
LSSVPSPAY

SEQ ID NO: 485328 - protein, 9 aa, Homo Sapiens
PREYGSFQS

SEQ ID NO: 485329 - protein, 9 aa, Homo Sapiens
VSPSHQLHT

SEQ ID NO: 485330 - protein, 9 aa, Homo Sapiens
LRQLRGDTP

SEQ ID NO: 485331 - protein, 9 aa, Homo Sapiens
CLNEKSLQL

SEQ ID NO: 485332 - protein, 9 aa, Homo Sapiens
TEFLDVDNS

SEQ ID NO: 485333 - protein, 9 aa, Homo Sapiens
KMPQLIVQM

SEQ ID NO: 485334 - protein, 9 aa, Homo Sapiens
AMDLSRRVA

SEQ ID NO: 485335 - protein, 9 aa, Homo Sapiens
KLFRILDVA

SEQ ID NO: 485336 - protein, 9 aa, Homo Sapiens
ECHDGLSFG

SEQ ID NO: 485337 - protein, 9 aa, Homo Sapiens
GALEPWCHK

SEQ ID NO: 485338 - protein, 9 aa, Homo Sapiens
EKKCWNTSG

SEQ ID NO: 485339 - protein, 9 aa, Homo Sapiens
GRLCRITEN

SEQ ID NO: 485340 - protein, 9 aa, Homo Sapiens
YGERNDAAP

SEQ ID NO: 485341 - protein, 9 aa, Homo Sapiens
QPLVEQLED

SEQ ID NO: 485342 - protein, 9 aa, Homo Sapiens
NRVCREYFS

SEQ ID NO: 485343 - protein, 9 aa, Homo Sapiens
GGSGGRAAL

SEQ ID NO: 485344 - protein, 9 aa, Homo Sapiens
VVQGNPKLN

SEQ ID NO: 485345 - protein, 9 aa, Homo Sapiens
RLTEWLRKR

SEQ ID NO: 485346 - protein, 9 aa, Homo Sapiens
ILSTAHMSV

SEQ ID NO: 485347 - protein, 9 aa, Homo Sapiens
DLLHQDRLQ

SEQ ID NO: 485348 - protein, 9 aa, Homo Sapiens
DPDKSLLDE

SEQ ID NO: 485349 - protein, 9 aa, Homo Sapiens
SSLVMLIGA

SEQ ID NO: 485350 - protein, 9 aa, Homo Sapiens
NKYWKGTNH

SEQ ID NO: 485351 - protein, 9 aa, Homo Sapiens
TPERVNTIL

SEQ ID NO: 485352 - protein, 9 aa, Homo Sapiens
KTHKIIRTG

SEQ ID NO: 485353 - protein, 9 aa, Homo Sapiens
TLGQDTADS

SEQ ID NO: 485354 - protein, 9 aa, Homo Sapiens
FLMATASAP

SEQ ID NO: 485355 - protein, 9 aa, Homo Sapiens
LCSTTTAST

SEQ ID NO: 485356 - protein, 9 aa, Homo Sapiens
PIGLQNRDV

SEQ ID NO: 485357 - protein, 9 aa, Homo Sapiens
CHRRGEGAA

SEQ ID NO: 485358 - protein, 9 aa, Homo Sapiens
EIRWELYDI

SEQ ID NO: 485359 - protein, 9 aa, Homo Sapiens
TILPIKTVN

SEQ ID NO: 485360 - protein, 9 aa, Homo Sapiens
MKLCAKGHS

SEQ ID NO: 485361 - protein, 9 aa, Homo Sapiens
YASNFSVIV

SEQ ID NO: 485362 - protein, 9 aa, Homo Sapiens
STRPSHSLP

SEQ ID NO: 485363 - protein, 9 aa, Homo Sapiens
AARTKAFST

SEQ ID NO: 485364 - protein, 9 aa, Homo Sapiens
RLFNESVPE

SEQ ID NO: 485365 - protein, 9 aa, Homo Sapiens
VASMSIDRS

SEQ ID NO: 485366 - protein, 9 aa, Homo Sapiens
PQALSMSNL

SEQ ID NO: 485367 - protein, 9 aa, Homo Sapiens
SLNVREELR

SEQ ID NO: 485368 - protein, 9 aa, Homo Sapiens
LAQQISVVV

SEQ ID NO: 485369 - protein, 9 aa, Homo Sapiens
PIQECWYRD

SEQ ID NO: 485370 - protein, 9 aa, Homo Sapiens
IECQKMLIF

SEQ ID NO: 485371 - protein, 9 aa, Homo Sapiens
NLRQVIQQN

SEQ ID NO: 485372 - protein, 9 aa, Homo Sapiens
EILPLTLRY

SEQ ID NO: 485373 - protein, 9 aa, Homo Sapiens
GFFFFFFEM

SEQ ID NO: 485374 - protein, 9 aa, Homo Sapiens
KTRMFCHLS

SEQ ID NO: 485375 - protein, 9 aa, Homo Sapiens
TGLERIPRD

SEQ ID NO: 485376 - protein, 9 aa, Homo Sapiens
RESFSCSFS

SEQ ID NO: 485377 - protein, 9 aa, Homo Sapiens
VTPQFISKK

SEQ ID NO: 485378 - protein, 9 aa, Homo Sapiens
QKMLIFQVR

SEQ ID NO: 485379 - protein, 9 aa, Homo Sapiens
AYDLRPSVS

SEQ ID NO: 485380 - protein, 9 aa, Homo Sapiens
TTEYTAEEE

SEQ ID NO: 485381 - protein, 9 aa, Homo Sapiens
LVSTRSAQP

SEQ ID NO: 485382 - protein, 9 aa, Homo Sapiens
FQVRKKQKH

SEQ ID NO: 485383 - protein, 9 aa, Homo Sapiens
ILNVSVLMK

SEQ ID NO: 485384 - protein, 9 aa, Homo Sapiens
WNTSGHCRK

SEQ ID NO: 485385 - protein, 9 aa, Homo Sapiens
QGNPKLNLA

SEQ ID NO: 485386 - protein, 9 aa, Homo Sapiens
SIKKKRALI

SEQ ID NO: 485387 - protein, 9 aa, Homo Sapiens
CKRRPGKKF

SEQ ID NO: 485388 - protein, 9 aa, Homo Sapiens
YGNLHYFVS

SEQ ID NO: 485389 - protein, 9 aa, Homo Sapiens
FFFFFFEME

SEQ ID NO: 485390 - protein, 9 aa, Homo Sapiens
LHLLKLIKV

SEQ ID NO: 485391 - protein, 9 aa, Homo Sapiens
LHQDRLQYL

SEQ ID NO: 485392 - protein, 9 aa, Homo Sapiens
TATNIYMFN

SEQ ID NO: 485393 - protein, 9 aa, Homo Sapiens
KEEMNAVRR

SEQ ID NO: 485394 - protein, 9 aa, Homo Sapiens
TNVLDGAGI

SEQ ID NO: 485395 - protein, 9 aa, Homo Sapiens
VLQVQCTSR

SEQ ID NO: 485396 - protein, 9 aa, Homo Sapiens
QLKLRLRDF

SEQ ID NO: 485397 - protein, 9 aa, Homo Sapiens
KSEKETGID

SEQ ID NO: 485398 - protein, 9 aa, Homo Sapiens
VFTHRLFNE

SEQ ID NO: 485399 - protein, 9 aa, Homo Sapiens
WVERHCQTR

SEQ ID NO: 485400 - protein, 9 aa, Homo Sapiens
EGEVETPTP

SEQ ID NO: 485401 - protein, 9 aa, Homo Sapiens
KDEKLIGLM

SEQ ID NO: 485402 - protein, 9 aa, Homo Sapiens
GQLLPHTAC

SEQ ID NO: 485403 - protein, 9 aa, Homo Sapiens
FNESVPESS

SEQ ID NO: 485404 - protein, 9 aa, Homo Sapiens
SGLKQWNKR

SEQ ID NO: 485405 - protein, 9 aa, Homo Sapiens
VLDLDDLVF

SEQ ID NO: 485406 - protein, 9 aa, Homo Sapiens
FICDGCGIA

SEQ ID NO: 485407 - protein, 9 aa, Homo Sapiens
NGRGTSSNS

SEQ ID NO: 485408 - protein, 9 aa, Homo Sapiens
LVDAHRLRG

SEQ ID NO: 485409 - protein, 9 aa, Homo Sapiens
EGRLPPCLS

SEQ ID NO: 485410 - protein, 9 aa, Homo Sapiens
APLPSGMMT

SEQ ID NO: 485411 - protein, 9 aa, Homo Sapiens
TLLSGVLTL

SEQ ID NO: 485412 - protein, 9 aa, Homo Sapiens
ATDVVQGNP

SEQ ID NO: 485413 - protein, 9 aa, Homo Sapiens
VETVKIVRI

SEQ ID NO: 485414 - protein, 9 aa, Homo Sapiens
KQKHETRRK

SEQ ID NO: 485415 - protein, 9 aa, Homo Sapiens
DGVKYWLSK

SEQ ID NO: 485416 - protein, 9 aa, Homo Sapiens
RAALGGSGS

SEQ ID NO: 485417 - protein, 9 aa, Homo Sapiens
IPRDSSYEQ

SEQ ID NO: 485418 - protein, 9 aa, Homo Sapiens
NSTSGKHKA

SEQ ID NO: 485419 - protein, 9 aa, Homo Sapiens
HITLILMLP

SEQ ID NO: 485420 - protein, 9 aa, Homo Sapiens
LVKAAEEQP

SEQ ID NO: 485421 - protein, 9 aa, Homo Sapiens
SHTAEKPYE

SEQ ID NO: 485422 - protein, 9 aa, Homo Sapiens
ARWIPWTIH

SEQ ID NO: 485423 - protein, 9 aa, Homo Sapiens
QKILKLLLA

SEQ ID NO: 485424 - protein, 9 aa, Homo Sapiens
EKKYTGDRS

SEQ ID NO: 485425 - protein, 9 aa, Homo Sapiens
HMKLCAKGH

SEQ ID NO: 485426 - protein, 9 aa, Homo Sapiens
CALCLDRFR

SEQ ID NO: 485427 - protein, 9 aa, Homo Sapiens
RTGDHALGF

SEQ ID NO: 485428 - protein, 9 aa, Homo Sapiens
MWSWFLFWK

SEQ ID NO: 485429 - protein, 9 aa, Homo Sapiens
SLAQQISVV

SEQ ID NO: 485430 - protein, 9 aa, Homo Sapiens
KFYLCSTTT

SEQ ID NO: 485431 - protein, 9 aa, Homo Sapiens
KSKHALFWA

SEQ ID NO: 485432 - protein, 9 aa, Homo Sapiens
NSTCLNEKS

SEQ ID NO: 485433 - protein, 9 aa, Homo Sapiens
DPDGPDHAR

SEQ ID NO: 485434 - protein, 9 aa, Homo Sapiens
LSIDRYLAF

SEQ ID NO: 485435 - protein, 9 aa, Homo Sapiens
FQYVQRPLS

SEQ ID NO: 485436 - protein, 9 aa, Homo Sapiens
WQDFCSVFA

SEQ ID NO: 485437 - protein, 9 aa, Homo Sapiens
SPVFLMEAN

SEQ ID NO: 485438 - protein, 9 aa, Homo Sapiens
LLMSLEILR

SEQ ID NO: 485439 - protein, 9 aa, Homo Sapiens
QGRDQLTQP

SEQ ID NO: 485440 - protein, 9 aa, Homo Sapiens
RVFMMALQY

SEQ ID NO: 485441 - protein, 9 aa, Homo Sapiens
ESVPESSAV

SEQ ID NO: 485442 - protein, 9 aa, Homo Sapiens
RPSVSAAVF

SEQ ID NO: 485443 - protein, 9 aa, Homo Sapiens
YFLREHRRI

SEQ ID NO: 485444 - protein, 9 aa, Homo Sapiens
KARNFDERV

SEQ ID NO: 485445 - protein, 9 aa, Homo Sapiens
PCLSASPQP

SEQ ID NO: 485446 - protein, 9 aa, Homo Sapiens
TQCLVVQSS

SEQ ID NO: 485447 - protein, 9 aa, Homo Sapiens
CPGLGGAHC

SEQ ID NO: 485448 - protein, 9 aa, Homo Sapiens
YKVTPQFIS

SEQ ID NO: 485449 - protein, 9 aa, Homo Sapiens
KELEKSEKL

SEQ ID NO: 485450 - protein, 9 aa, Homo Sapiens
DSCTVKENV

SEQ ID NO: 485451 - protein, 9 aa, Homo Sapiens
DTADSWAGI

SEQ ID NO: 485452 - protein, 9 aa, Homo Sapiens
SIGQYGVET

SEQ ID NO: 485453 - protein, 9 aa, Homo Sapiens
QKVELLQGT

SEQ ID NO: 485454 - protein, 9 aa, Homo Sapiens
RAWREDLTI

SEQ ID NO: 485455 - protein, 9 aa, Homo Sapiens
SRLSLLRPV

SEQ ID NO: 485456 - protein, 9 aa, Homo Sapiens
LFWAQRKEN

SEQ ID NO: 485457 - protein, 9 aa, Homo Sapiens
SPGTGLETQ

SEQ ID NO: 485458 - protein, 9 aa, Homo Sapiens
RSYGERNDA

SEQ ID NO: 485459 - protein, 9 aa, Homo Sapiens
TFGEKLNKV

SEQ ID NO: 485460 - protein, 9 aa, Homo Sapiens
SSDSATLRQ

SEQ ID NO: 485461 - protein, 9 aa, Homo Sapiens
QCHRRGEGA

SEQ ID NO: 485462 - protein, 9 aa, Homo Sapiens
QELASSLPQ

SEQ ID NO: 485463 - protein, 9 aa, Homo Sapiens
PYLAPLENF

SEQ ID NO: 485464 - protein, 9 aa, Homo Sapiens
AVLTQCLVV

SEQ ID NO: 485465 - protein, 9 aa, Homo Sapiens
PFQCHRRGE

SEQ ID NO: 485466 - protein, 9 aa, Homo Sapiens
LGIKQAGQQ

SEQ ID NO: 485467 - protein, 9 aa, Homo Sapiens
THLRVNHLG

SEQ ID NO: 485468 - protein, 9 aa, Homo Sapiens
LLAIYYLAK

SEQ ID NO: 485469 - protein, 9 aa, Homo Sapiens
NNLLASSDY

SEQ ID NO: 485470 - protein, 9 aa, Homo Sapiens
DRKSGRRLG

SEQ ID NO: 485471 - protein, 9 aa, Homo Sapiens
QALHGMQFL

SEQ ID NO: 485472 - protein, 9 aa, Homo Sapiens
VNYCADYEK

SEQ ID NO: 485473 - protein, 9 aa, Homo Sapiens
KRALIRFLE

SEQ ID NO: 485474 - protein, 9 aa, Homo Sapiens
WSTYPADYG

SEQ ID NO: 485475 - protein, 9 aa, Homo Sapiens
ELHLLKLIK

SEQ ID NO: 485476 - protein, 9 aa, Homo Sapiens
SLEGWLPSI

SEQ ID NO: 485477 - protein, 9 aa, Homo Sapiens
ASKEPRQQR

SEQ ID NO: 485478 - protein, 9 aa, Homo Sapiens
VDIDADTRL

SEQ ID NO: 485479 - protein, 9 aa, Homo Sapiens
RAPRRARAR

SEQ ID NO: 485480 - protein, 9 aa, Homo Sapiens
ALGDGTLEI

SEQ ID NO: 485481 - protein, 9 aa, Homo Sapiens
FLDVDNSPL

SEQ ID NO: 485482 - protein, 9 aa, Homo Sapiens
RQLRYQVLQ

SEQ ID NO: 485483 - protein, 9 aa, Homo Sapiens
LVHITLILM

SEQ ID NO: 485484 - protein, 9 aa, Homo Sapiens
VGPYGWECH

SEQ ID NO: 485485 - protein, 9 aa, Homo Sapiens
ASLSWAFSL

SEQ ID NO: 485486 - protein, 9 aa, Homo Sapiens
ERVNTILPI

SEQ ID NO: 485487 - protein, 9 aa, Homo Sapiens
ATEWRVRVN

SEQ ID NO: 485488 - protein, 9 aa, Homo Sapiens
EKSEKLDEQ

SEQ ID NO: 485489 - protein, 9 aa, Homo Sapiens
MLHNDACDH

SEQ ID NO: 485490 - protein, 9 aa, Homo Sapiens
FSALVEYGN

SEQ ID NO: 485491 - protein, 9 aa, Homo Sapiens
LIKVKGPRY

SEQ ID NO: 485492 - protein, 9 aa, Homo Sapiens
QRTGDHALG

SEQ ID NO: 485493 - protein, 9 aa, Homo Sapiens
GADPRESFS

SEQ ID NO: 485494 - protein, 9 aa, Homo Sapiens
TKTDHLVED

SEQ ID NO: 485495 - protein, 9 aa, Homo Sapiens
LKARNFDER

SEQ ID NO: 485496 - protein, 9 aa, Homo Sapiens
MWLMEGALE

SEQ ID NO: 485497 - protein, 9 aa, Homo Sapiens
FHKLFCHYN

SEQ ID NO: 485498 - protein, 9 aa, Homo Sapiens
QGPGRAGGR

SEQ ID NO: 485499 - protein, 9 aa, Homo Sapiens
DEKKEVKPQ

SEQ ID NO: 485500 - protein, 9 aa, Homo Sapiens
KAFSTCSCH

SEQ ID NO: 485501 - protein, 9 aa, Homo Sapiens
QDERGVDPY

SEQ ID NO: 485502 - protein, 9 aa, Homo Sapiens
TVVPSITRF

SEQ ID NO: 485503 - protein, 9 aa, Homo Sapiens
YRLGIKQAG

SEQ ID NO: 485504 - protein, 9 aa, Homo Sapiens
VQCTSRTIT

SEQ ID NO: 485505 - protein, 9 aa, Homo Sapiens
CEHNDRQCS

SEQ ID NO: 485506 - protein, 9 aa, Homo Sapiens
MPGFLSEVK

SEQ ID NO: 485507 - protein, 9 aa, Homo Sapiens
LFCHYNQFI

SEQ ID NO: 485508 - protein, 9 aa, Homo Sapiens
YKELEKSEK

SEQ ID NO: 485509 - protein, 9 aa, Homo Sapiens
PSLHTSFFA

SEQ ID NO: 485510 - protein, 9 aa, Homo Sapiens
TDIHELTNV

SEQ ID NO: 485511 - protein, 9 aa, Homo Sapiens
HETRRKSKY

SEQ ID NO: 485512 - protein, 9 aa, Homo Sapiens
RYALCLINM

SEQ ID NO: 485513 - protein, 9 aa, Homo Sapiens
RSLAFTRKS

SEQ ID NO: 485514 - protein, 9 aa, Homo Sapiens
YGGIFAAVE

SEQ ID NO: 485515 - protein, 9 aa, Homo Sapiens
FGGFYSVLL

SEQ ID NO: 485516 - protein, 9 aa, Homo Sapiens
ALCLDRFRA

SEQ ID NO: 485517 - protein, 9 aa, Homo Sapiens
VRLQLEMAY

SEQ ID NO: 485518 - protein, 9 aa, Homo Sapiens
KVEESPETA

SEQ ID NO: 485519 - protein, 9 aa, Homo Sapiens
FAVLTQCLV

SEQ ID NO: 485520 - protein, 9 aa, Homo Sapiens
LEDPDGPDH

SEQ ID NO: 485521 - protein, 9 aa, Homo Sapiens
GVLLQALNE

SEQ ID NO: 485522 - protein, 9 aa, Homo Sapiens
ASPSTSRSR

SEQ ID NO: 485523 - protein, 9 aa, Homo Sapiens
VLLVATEWR

SEQ ID NO: 485524 - protein, 9 aa, Homo Sapiens
VTLGQDTAD

SEQ ID NO: 485525 - protein, 9 aa, Homo Sapiens
YVQRPLSLT

SEQ ID NO: 485526 - protein, 9 aa, Homo Sapiens
KKSEKETGI

SEQ ID NO: 485527 - protein, 9 aa, Homo Sapiens
QQISVVVKQ

SEQ ID NO: 485528 - protein, 9 aa, Homo Sapiens
MCCGRGYDN

SEQ ID NO: 485529 - protein, 9 aa, Homo Sapiens
AEKQLKLRL

SEQ ID NO: 485530 - protein, 9 aa, Homo Sapiens
EDPDGPDHA

SEQ ID NO: 485531 - protein, 9 aa, Homo Sapiens
VSLAQQISV

SEQ ID NO: 485532 - protein, 9 aa, Homo Sapiens
CSTTTASTK

SEQ ID NO: 485533 - protein, 9 aa, Homo Sapiens
LIQKRKKVK

SEQ ID NO: 485534 - protein, 9 aa, Homo Sapiens
AIKKKLGML

SEQ ID NO: 485535 - protein, 9 aa, Homo Sapiens
PRQQRVKRW

SEQ ID NO: 485536 - protein, 9 aa, Homo Sapiens
CGLLETLNF

SEQ ID NO: 485537 - protein, 9 aa, Homo Sapiens
CRKPLPRYA

SEQ ID NO: 485538 - protein, 9 aa, Homo Sapiens
LAFTRKSFH

SEQ ID NO: 485539 - protein, 9 aa, Homo Sapiens
NPERFSLAP

SEQ ID NO: 485540 - protein, 9 aa, Homo Sapiens
TDQEGEVET

SEQ ID NO: 485541 - protein, 9 aa, Homo Sapiens
LKTHKIIRT

SEQ ID NO: 485542 - protein, 9 aa, Homo Sapiens
KQASSGLKQ

SEQ ID NO: 485543 - protein, 9 aa, Homo Sapiens
RDRKSGRRL

SEQ ID NO: 485544 - protein, 9 aa, Homo Sapiens
ADPRESFSC

SEQ ID NO: 485545 - protein, 9 aa, Homo Sapiens
RLFRATQYI

SEQ ID NO: 485546 - protein, 9 aa, Homo Sapiens
PRQVLDLDD

SEQ ID NO: 485547 - protein, 9 aa, Homo Sapiens
PKFYLCSTT

SEQ ID NO: 485548 - protein, 9 aa, Homo Sapiens
GLCSFQGFV

SEQ ID NO: 485549 - protein, 9 aa, Homo Sapiens
GILNVSVLM

SEQ ID NO: 485550 - protein, 9 aa, Homo Sapiens
CLAPPSTRP

SEQ ID NO: 485551 - protein, 9 aa, Homo Sapiens
LASCTRDVV

SEQ ID NO: 485552 - protein, 9 aa, Homo Sapiens
EMKNDQDHY

SEQ ID NO: 485553 - protein, 9 aa, Homo Sapiens
IPARSKKNQ

SEQ ID NO: 485554 - protein, 9 aa, Homo Sapiens
FRATQYICM

SEQ ID NO: 485555 - protein, 9 aa, Homo Sapiens
LRGRLCRIT

SEQ ID NO: 485556 - protein, 9 aa, Homo Sapiens
TGYSGATCQ

SEQ ID NO: 485557 - protein, 9 aa, Homo Sapiens
YTEYKVTPQ

SEQ ID NO: 485558 - protein, 9 aa, Homo Sapiens
IFGGFYSVL

SEQ ID NO: 485559 - protein, 9 aa, Homo Sapiens
VDMDLSSAT

SEQ ID NO: 485560 - protein, 9 aa, Homo Sapiens
HQDRLQYLQ

SEQ ID NO: 485561 - protein, 9 aa, Homo Sapiens
CTCHMLSRD

SEQ ID NO: 485562 - protein, 9 aa, Homo Sapiens
MALQYSQKI

SEQ ID NO: 485563 - protein, 9 aa, Homo Sapiens
RLGIKQAGQ

SEQ ID NO: 485564 - protein, 9 aa, Homo Sapiens
QGASLEGWL

SEQ ID NO: 485565 - protein, 9 aa, Homo Sapiens
RLVFELGLC

SEQ ID NO: 485566 - protein, 9 aa, Homo Sapiens
PSGAARTKA

SEQ ID NO: 485567 - protein, 9 aa, Homo Sapiens
YNEDFERAW

SEQ ID NO: 485568 - protein, 9 aa, Homo Sapiens
AVGYSQGML

SEQ ID NO: 485569 - protein, 9 aa, Homo Sapiens
QIPSSDSSA

SEQ ID NO: 485570 - protein, 9 aa, Homo Sapiens
DIDADTRLS

SEQ ID NO: 485571 - protein, 9 aa, Homo Sapiens
GSEDQRAVG

SEQ ID NO: 485572 - protein, 9 aa, Homo Sapiens
VSCFTFQGL

SEQ ID NO: 485573 - protein, 9 aa, Homo Sapiens
LNVSVLMKP

SEQ ID NO: 485574 - protein, 9 aa, Homo Sapiens
KCLESTASN

SEQ ID NO: 485575 - protein, 9 aa, Homo Sapiens
QGMLDLVAP

SEQ ID NO: 485576 - protein, 9 aa, Homo Sapiens
LMLVSPSHQ

SEQ ID NO: 485577 - protein, 9 aa, Homo Sapiens
GARATTTCW

SEQ ID NO: 485578 - protein, 9 aa, Homo Sapiens
PVFLMEANT

SEQ ID NO: 485579 - protein, 9 aa, Homo Sapiens
PTCRAHQAA

SEQ ID NO: 485580 - protein, 9 aa, Homo Sapiens
YSVLLNDIL

SEQ ID NO: 485581 - protein, 9 aa, Homo Sapiens
KMMNGKQHI

SEQ ID NO: 485582 - protein, 9 aa, Homo Sapiens
KQLKLRLRD

SEQ ID NO: 485583 - protein, 9 aa, Homo Sapiens
QVRKKQKHE

SEQ ID NO: 485584 - protein, 9 aa, Homo Sapiens
VKMLGVVVF

SEQ ID NO: 485585 - protein, 9 aa, Homo Sapiens
QLSTTFGEK

SEQ ID NO: 485586 - protein, 9 aa, Homo Sapiens
KLMLWKETG

SEQ ID NO: 485587 - protein, 9 aa, Homo Sapiens
ARTKAFSTC

SEQ ID NO: 485588 - protein, 9 aa, Homo Sapiens
YSGATCQNS

SEQ ID NO: 485589 - protein, 9 aa, Homo Sapiens
AGAPETQGP

SEQ ID NO: 485590 - protein, 9 aa, Homo Sapiens
QISVVVKQP

SEQ ID NO: 485591 - protein, 9 aa, Homo Sapiens
LILNCESKG

SEQ ID NO: 485592 - protein, 9 aa, Homo Sapiens
YNVTFLLFL

SEQ ID NO: 485593 - protein, 9 aa, Homo Sapiens
IWCQLQSAH

SEQ ID NO: 485594 - protein, 9 aa, Homo Sapiens
FQPVRDNSP

SEQ ID NO: 485595 - protein, 9 aa, Homo Sapiens
ALGLSASDR

SEQ ID NO: 485596 - protein, 9 aa, Homo Sapiens
TLGRHVKQL

SEQ ID NO: 485597 - protein, 9 aa, Homo Sapiens
KAPSTQKKF

SEQ ID NO: 485598 - protein, 9 aa, Homo Sapiens
SRPQIAEMS

SEQ ID NO: 485599 - protein, 9 aa, Homo Sapiens
DSAEKEDSR

SEQ ID NO: 485600 - protein, 9 aa, Homo Sapiens
PALSIYELI

SEQ ID NO: 485601 - protein, 9 aa, Homo Sapiens
VSILTVCDA

SEQ ID NO: 485602 - protein, 9 aa, Homo Sapiens
DLDGADPDE

SEQ ID NO: 485603 - protein, 9 aa, Homo Sapiens
AAQRCPRGH

SEQ ID NO: 485604 - protein, 9 aa, Homo Sapiens
GEETVHITQ

SEQ ID NO: 485605 - protein, 9 aa, Homo Sapiens
VVVHERVPD

SEQ ID NO: 485606 - protein, 9 aa, Homo Sapiens
VHPELLSES

SEQ ID NO: 485607 - protein, 9 aa, Homo Sapiens
TFTVLRAFD

SEQ ID NO: 485608 - protein, 9 aa, Homo Sapiens
VQACIDCVY

SEQ ID NO: 485609 - protein, 9 aa, Homo Sapiens
ELTTDERLR

SEQ ID NO: 485610 - protein, 9 aa, Homo Sapiens
NSPAPQEGT

SEQ ID NO: 485611 - protein, 9 aa, Homo Sapiens
TVHITQTAE

SEQ ID NO: 485612 - protein, 9 aa, Homo Sapiens
AETAQAQAA

SEQ ID NO: 485613 - protein, 9 aa, Homo Sapiens
ERDGSAQAL

SEQ ID NO: 485614 - protein, 9 aa, Homo Sapiens
LVTQQSVPT

SEQ ID NO: 485615 - protein, 9 aa, Homo Sapiens
CRKHRNQRV

SEQ ID NO: 485616 - protein, 9 aa, Homo Sapiens
MEVLGWCLE

SEQ ID NO: 485617 - protein, 9 aa, Homo Sapiens
ASHSQWEGF

SEQ ID NO: 485618 - protein, 9 aa, Homo Sapiens
QTGDIGIYR

SEQ ID NO: 485619 - protein, 9 aa, Homo Sapiens
EDDGAEMSQ

SEQ ID NO: 485620 - protein, 9 aa, Homo Sapiens
GDVTDEDDG

SEQ ID NO: 485621 - protein, 9 aa, Homo Sapiens
TPVCGADGF

SEQ ID NO: 485622 - protein, 9 aa, Homo Sapiens
QKKKPSKHK

SEQ ID NO: 485623 - protein, 9 aa, Homo Sapiens
LVLGAAAEA

SEQ ID NO: 485624 - protein, 9 aa, Homo Sapiens
SSLASVSRQ

SEQ ID NO: 485625 - protein, 9 aa, Homo Sapiens
PPASQPILV

SEQ ID NO: 485626 - protein, 9 aa, Homo Sapiens
SYASNNVPN

SEQ ID NO: 485627 - protein, 9 aa, Homo Sapiens
NTEDFSSPQ

SEQ ID NO: 485628 - protein, 9 aa, Homo Sapiens
IHRLSAKSL

SEQ ID NO: 485629 - protein, 9 aa, Homo Sapiens
LKDHILPHT

SEQ ID NO: 485630 - protein, 9 aa, Homo Sapiens
IFIQHQKCN

SEQ ID NO: 485631 - protein, 9 aa, Homo Sapiens
TVFGHRLRV

SEQ ID NO: 485632 - protein, 9 aa, Homo Sapiens
TNPNLKDIY

SEQ ID NO: 485633 - protein, 9 aa, Homo Sapiens
TAAQRCPRG

SEQ ID NO: 485634 - protein, 9 aa, Homo Sapiens
HQKCNISEI

SEQ ID NO: 485635 - protein, 9 aa, Homo Sapiens
YKVVMLGAE

SEQ ID NO: 485636 - protein, 9 aa, Homo Sapiens
PPGSQRFLQ

SEQ ID NO: 485637 - protein, 9 aa, Homo Sapiens
VSSLASVSR

SEQ ID NO: 485638 - protein, 9 aa, Homo Sapiens
RLGLSASWG

SEQ ID NO: 485639 - protein, 9 aa, Homo Sapiens
PGEETVHIT

SEQ ID NO: 485640 - protein, 9 aa, Homo Sapiens
KNFKGCRES

SEQ ID NO: 485641 - protein, 9 aa, Homo Sapiens
ENEQYNSDE

SEQ ID NO: 485642 - protein, 9 aa, Homo Sapiens
AATLRFQAG

SEQ ID NO: 485643 - protein, 9 aa, Homo Sapiens
NQRVPEDSE

SEQ ID NO: 485644 - protein, 9 aa, Homo Sapiens
FDSVSMAHS

SEQ ID NO: 485645 - protein, 9 aa, Homo Sapiens
FEVRVACPG

SEQ ID NO: 485646 - protein, 9 aa, Homo Sapiens
LSRPIDCSS

SEQ ID NO: 485647 - protein, 9 aa, Homo Sapiens
SVWNTEDFS

SEQ ID NO: 485648 - protein, 9 aa, Homo Sapiens
IKDIMDKLD

SEQ ID NO: 485649 - protein, 9 aa, Homo Sapiens
SGDKAPSTQ

SEQ ID NO: 485650 - protein, 9 aa, Homo Sapiens
CLQIFIQHQ

SEQ ID NO: 485651 - protein, 9 aa, Homo Sapiens
VCGADGFTY

SEQ ID NO: 485652 - protein, 9 aa, Homo Sapiens
DIMDKLDQQ

SEQ ID NO: 485653 - protein, 9 aa, Homo Sapiens
LKHKRSRDR

SEQ ID NO: 485654 - protein, 9 aa, Homo Sapiens
AERDVEAQP

SEQ ID NO: 485655 - protein, 9 aa, Homo Sapiens
LGAAAEATG

SEQ ID NO: 485656 - protein, 9 aa, Homo Sapiens
RDGSAQALC

SEQ ID NO: 485657 - protein, 9 aa, Homo Sapiens
RQFKQEFKA

SEQ ID NO: 485658 - protein, 9 aa, Homo Sapiens
SKHAALLYN

SEQ ID NO: 485659 - protein, 9 aa, Homo Sapiens
FSKEEEEIK

SEQ ID NO: 485660 - protein, 9 aa, Homo Sapiens
LGWCLESSQ

SEQ ID NO: 485661 - protein, 9 aa, Homo Sapiens
DHPPGAWHW

SEQ ID NO: 485662 - protein, 9 aa, Homo Sapiens
QAATLRFQA

SEQ ID NO: 485663 - protein, 9 aa, Homo Sapiens
SQRRLKSRT

SEQ ID NO: 485664 - protein, 9 aa, Homo Sapiens
PVDKEKCGM

SEQ ID NO: 485665 - protein, 9 aa, Homo Sapiens
TGNCVNGDD

SEQ ID NO: 485666 - protein, 9 aa, Homo Sapiens
QFKQEFKAK

SEQ ID NO: 485667 - protein, 9 aa, Homo Sapiens
LTFITHIGC

SEQ ID NO: 485668 - protein, 9 aa, Homo Sapiens
FSHHRIHTG

SEQ ID NO: 485669 - protein, 9 aa, Homo Sapiens
SPAPQEGTP

SEQ ID NO: 485670 - protein, 9 aa, Homo Sapiens
NASETAWMI

SEQ ID NO: 485671 - protein, 9 aa, Homo Sapiens
AGSLRLGLS

SEQ ID NO: 485672 - protein, 9 aa, Homo Sapiens
AQAQAASLE

SEQ ID NO: 485673 - protein, 9 aa, Homo Sapiens
LGRHVKQLV

SEQ ID NO: 485674 - protein, 9 aa, Homo Sapiens
PYKCEQYEK

SEQ ID NO: 485675 - protein, 9 aa, Homo Sapiens
DCSSRMLFV

SEQ ID NO: 485676 - protein, 9 aa, Homo Sapiens
SCDTKPEVI

SEQ ID NO: 485677 - protein, 9 aa, Homo Sapiens
TEGTESQSS

SEQ ID NO: 485678 - protein, 9 aa, Homo Sapiens
PAPQEGTPR

SEQ ID NO: 485679 - protein, 9 aa, Homo Sapiens
CDGIFCTPQ

SEQ ID NO: 485680 - protein, 9 aa, Homo Sapiens
AFICRKHRN

SEQ ID NO: 485681 - protein, 9 aa, Homo Sapiens
LEHGTNPNL

SEQ ID NO: 485682 - protein, 9 aa, Homo Sapiens
PVCGADGFT

SEQ ID NO: 485683 - protein, 9 aa, Homo Sapiens
PSRRSRSQR

SEQ ID NO: 485684 - protein, 9 aa, Homo Sapiens
AQFQQPICS

SEQ ID NO: 485685 - protein, 9 aa, Homo Sapiens
GQAATLRFQ

SEQ ID NO: 485686 - protein, 9 aa, Homo Sapiens
MMALTFITH

SEQ ID NO: 485687 - protein, 9 aa, Homo Sapiens
VILLEHGTN

SEQ ID NO: 485688 - protein, 9 aa, Homo Sapiens
KEELEQRKE

SEQ ID NO: 485689 - protein, 9 aa, Homo Sapiens
GHQERDGSA

SEQ ID NO: 485690 - protein, 9 aa, Homo Sapiens
SRLQTGDIG

SEQ ID NO: 485691 - protein, 9 aa, Homo Sapiens
QALCPAGAS

SEQ ID NO: 485692 - protein, 9 aa, Homo Sapiens
SRSQRDRGR

SEQ ID NO: 485693 - protein, 9 aa, Homo Sapiens
DRYTVGQAV

SEQ ID NO: 485694 - protein, 9 aa, Homo Sapiens
LLKHKRSRD

SEQ ID NO: 485695 - protein, 9 aa, Homo Sapiens
QFQQPICSA

SEQ ID NO: 485696 - protein, 9 aa, Homo Sapiens
CGAINMGDA

SEQ ID NO: 485697 - protein, 9 aa, Homo Sapiens
VDKEKCGMG

SEQ ID NO: 485698 - protein, 9 aa, Homo Sapiens
KCGCTRCSV

SEQ ID NO: 485699 - protein, 9 aa, Homo Sapiens
AQRCPRGHQ

SEQ ID NO: 485700 - protein, 9 aa, Homo Sapiens
LHQAQTAAQ

SEQ ID NO: 485701 - protein, 9 aa, Homo Sapiens
MANDNSTVR

SEQ ID NO: 485702 - protein, 9 aa, Homo Sapiens
DGQAATLRF

SEQ ID NO: 485703 - protein, 9 aa, Homo Sapiens
QALVANNAS

SEQ ID NO: 485704 - protein, 9 aa, Homo Sapiens
DGIFCTPQY

SEQ ID NO: 485705 - protein, 9 aa, Homo Sapiens
GWESARHMQ

SEQ ID NO: 485706 - protein, 9 aa, Homo Sapiens
NDREKLAES

SEQ ID NO: 485707 - protein, 9 aa, Homo Sapiens
TGDIGIYRC

SEQ ID NO: 485708 - protein, 9 aa, Homo Sapiens
GESDSPCDL

SEQ ID NO: 485709 - protein, 9 aa, Homo Sapiens
MKYMLQKTD

SEQ ID NO: 485710 - protein, 9 aa, Homo Sapiens
PQIAEMSLY

SEQ ID NO: 485711 - protein, 9 aa, Homo Sapiens
EESGKVYAL

SEQ ID NO: 485712 - protein, 9 aa, Homo Sapiens
RGQVTVFGH

SEQ ID NO: 485713 - protein, 9 aa, Homo Sapiens
LVANNASET

SEQ ID NO: 485714 - protein, 9 aa, Homo Sapiens
LIINFSYIN

SEQ ID NO: 485715 - protein, 9 aa, Homo Sapiens
DGADPDEGP

SEQ ID NO: 485716 - protein, 9 aa, Homo Sapiens
TKCLPLHDQ

SEQ ID NO: 485717 - protein, 9 aa, Homo Sapiens
DEDDGAEMS

SEQ ID NO: 485718 - protein, 9 aa, Homo Sapiens
IDIWCQLQS

SEQ ID NO: 485719 - protein, 9 aa, Homo Sapiens
LSVWNTEDF

SEQ ID NO: 485720 - protein, 9 aa, Homo Sapiens
PDNRSTLKR

SEQ ID NO: 485721 - protein, 9 aa, Homo Sapiens
FSYINLNPR

SEQ ID NO: 485722 - protein, 9 aa, Homo Sapiens
GADPDEGPN

SEQ ID NO: 485723 - protein, 9 aa, Homo Sapiens
ERDVEAQPG

SEQ ID NO: 485724 - protein, 9 aa, Homo Sapiens
VCDATTGVC

SEQ ID NO: 485725 - protein, 9 aa, Homo Sapiens
RVACPGRDR

SEQ ID NO: 485726 - protein, 9 aa, Homo Sapiens
YEKAFVRSY

SEQ ID NO: 485727 - protein, 9 aa, Homo Sapiens
HTTNTYPDN

SEQ ID NO: 485728 - protein, 9 aa, Homo Sapiens
YQKKKPSKH

SEQ ID NO: 485729 - protein, 9 aa, Homo Sapiens
KGCRESINY

SEQ ID NO: 485730 - protein, 9 aa, Homo Sapiens
SSNSDSSDS

SEQ ID NO: 485731 - protein, 9 aa, Homo Sapiens
LGAEGVGKS

SEQ ID NO: 485732 - protein, 9 aa, Homo Sapiens
GDKAPSTQK

SEQ ID NO: 485733 - protein, 9 aa, Homo Sapiens
KLAGTKRKF

SEQ ID NO: 485734 - protein, 9 aa, Homo Sapiens
TTNTYPDNR

SEQ ID NO: 485735 - protein, 9 aa, Homo Sapiens
YYEEWPALS

SEQ ID NO: 485736 - protein, 9 aa, Homo Sapiens
VLGWCLESS

SEQ ID NO: 485737 - protein, 9 aa, Homo Sapiens
CLPLHDQPH

SEQ ID NO: 485738 - protein, 9 aa, Homo Sapiens
HPPGAWHWE

SEQ ID NO: 485739 - protein, 9 aa, Homo Sapiens
EGFAVQKDH

SEQ ID NO: 485740 - protein, 9 aa, Homo Sapiens
QPVRDNSPA

SEQ ID NO: 485741 - protein, 9 aa, Homo Sapiens
GSCLYLKLT

SEQ ID NO: 485742 - protein, 9 aa, Homo Sapiens
RHMQQKMKE

SEQ ID NO: 485743 - protein, 9 aa, Homo Sapiens
GLSQRRLKS

SEQ ID NO: 485744 - protein, 9 aa, Homo Sapiens
KDHILPHTT

SEQ ID NO: 485745 - protein, 9 aa, Homo Sapiens
QGVNMGFGE

SEQ ID NO: 485746 - protein, 9 aa, Homo Sapiens
LLSRPIDCS

SEQ ID NO: 485747 - protein, 9 aa, Homo Sapiens
LGLSASDRY

SEQ ID NO: 485748 - protein, 9 aa, Homo Sapiens
SHFKFKEHC

SEQ ID NO: 485749 - protein, 9 aa, Homo Sapiens
VYLMFYEIT

SEQ ID NO: 485750 - protein, 9 aa, Homo Sapiens
VLRDMKEEL

SEQ ID NO: 485751 - protein, 9 aa, Homo Sapiens
EKKRPFFPR

SEQ ID NO: 485752 - protein, 9 aa, Homo Sapiens
FSSPQLTDD

SEQ ID NO: 485753 - protein, 9 aa, Homo Sapiens
SLIGNDARV

SEQ ID NO: 485754 - protein, 9 aa, Homo Sapiens
SEGKTEGTE

SEQ ID NO: 485755 - protein, 9 aa, Homo Sapiens
GRCWGPGSD

SEQ ID NO: 485756 - protein, 9 aa, Homo Sapiens
EGKTEGTES

SEQ ID NO: 485757 - protein, 9 aa, Homo Sapiens
KKKGKDSAE

SEQ ID NO: 485758 - protein, 9 aa, Homo Sapiens
PVRDNSPAP

SEQ ID NO: 485759 - protein, 9 aa, Homo Sapiens
GIIFFSSPI

SEQ ID NO: 485760 - protein, 9 aa, Homo Sapiens
LKTLSQGSC

SEQ ID NO: 485761 - protein, 9 aa, Homo Sapiens
EISSLAHHL

SEQ ID NO: 485762 - protein, 9 aa, Homo Sapiens
HMFRTAHND

SEQ ID NO: 485763 - protein, 9 aa, Homo Sapiens
WQMARQNSE

SEQ ID NO: 485764 - protein, 9 aa, Homo Sapiens
EEEEIKFIY

SEQ ID NO: 485765 - protein, 9 aa, Homo Sapiens
QRMAGPEQG

SEQ ID NO: 485766 - protein, 9 aa, Homo Sapiens
ETVHITQTA

SEQ ID NO: 485767 - protein, 9 aa, Homo Sapiens
FTYLSACFA

SEQ ID NO: 485768 - protein, 9 aa, Homo Sapiens
HFNAPIARD

SEQ ID NO: 485769 - protein, 9 aa, Homo Sapiens
PGSQRFLQK

SEQ ID NO: 485770 - protein, 9 aa, Homo Sapiens
DKEKCGMGP

SEQ ID NO: 485771 - protein, 9 aa, Homo Sapiens
YMLQKTDRR

SEQ ID NO: 485772 - protein, 9 aa, Homo Sapiens
KEIRRKFGS

SEQ ID NO: 485773 - protein, 9 aa, Homo Sapiens
LSESSGDDG

SEQ ID NO: 485774 - protein, 9 aa, Homo Sapiens
LQIFIQHQK

SEQ ID NO: 485775 - protein, 9 aa, Homo Sapiens
QWEGFAVQK

SEQ ID NO: 485776 - protein, 9 aa, Homo Sapiens
FICRKHRNQ

SEQ ID NO: 485777 - protein, 9 aa, Homo Sapiens
EVSAPNMQG

SEQ ID NO: 485778 - protein, 9 aa, Homo Sapiens
LLQASMEVL

SEQ ID NO: 485779 - protein, 9 aa, Homo Sapiens
CQLQSAHLK

SEQ ID NO: 485780 - protein, 9 aa, Homo Sapiens
LLWPKSPES

SEQ ID NO: 485781 - protein, 9 aa, Homo Sapiens
ARVCQEDSH

SEQ ID NO: 485782 - protein, 9 aa, Homo Sapiens
YEEWPALSI

SEQ ID NO: 485783 - protein, 9 aa, Homo Sapiens
CVYHQKTVF

SEQ ID NO: 485784 - protein, 9 aa, Homo Sapiens
TSGSEKKKK

SEQ ID NO: 485785 - protein, 9 aa, Homo Sapiens
IDCSSRMLF

SEQ ID NO: 485786 - protein, 9 aa, Homo Sapiens
QQSQFSHHR

SEQ ID NO: 485787 - protein, 9 aa, Homo Sapiens
QLIINFSYI

SEQ ID NO: 485788 - protein, 9 aa, Homo Sapiens
ARHMQQKMK

SEQ ID NO: 485789 - protein, 9 aa, Homo Sapiens
GFPRRNIEF

SEQ ID NO: 485790 - protein, 9 aa, Homo Sapiens
VMLQDKPYP

SEQ ID NO: 485791 - protein, 9 aa, Homo Sapiens
FIQHQKCNI

SEQ ID NO: 485792 - protein, 9 aa, Homo Sapiens
VSQISTTSS

SEQ ID NO: 485793 - protein, 9 aa, Homo Sapiens
YPDNRSTLK

SEQ ID NO: 485794 - protein, 9 aa, Homo Sapiens
INFSYINLN

SEQ ID NO: 485795 - protein, 9 aa, Homo Sapiens
GSLRLGLSA

SEQ ID NO: 485796 - protein, 9 aa, Homo Sapiens
IKFIYSEDD

SEQ ID NO: 485797 - protein, 9 aa, Homo Sapiens
RNQRVPEDS

SEQ ID NO: 485798 - protein, 9 aa, Homo Sapiens
MARQNSEIW

SEQ ID NO: 485799 - protein, 9 aa, Homo Sapiens
GASHSQWEG

SEQ ID NO: 485800 - protein, 9 aa, Homo Sapiens
SAQALCPAG

SEQ ID NO: 485801 - protein, 9 aa, Homo Sapiens
EELEQRKEK

SEQ ID NO: 485802 - protein, 9 aa, Homo Sapiens
DERKDLLPK

SEQ ID NO: 485803 - protein, 9 aa, Homo Sapiens
LRAFDSVSM

SEQ ID NO: 485804 - protein, 9 aa, Homo Sapiens
FKTKCLPLH

SEQ ID NO: 485805 - protein, 9 aa, Homo Sapiens
RVTLGRHVK

SEQ ID NO: 485806 - protein, 9 aa, Homo Sapiens
TVHPELLSE

SEQ ID NO: 485807 - protein, 9 aa, Homo Sapiens
HHTTNTYPD

SEQ ID NO: 485808 - protein, 9 aa, Homo Sapiens
TDEDDGAEM

SEQ ID NO: 485809 - protein, 9 aa, Homo Sapiens
CRESINYNG

SEQ ID NO: 485810 - protein, 9 aa, Homo Sapiens
RKARRLQRM

SEQ ID NO: 485811 - protein, 9 aa, Homo Sapiens
LTVCDATTG

SEQ ID NO: 485812 - protein, 9 aa, Homo Sapiens
HFDHFHPCV

SEQ ID NO: 485813 - protein, 9 aa, Homo Sapiens
GTLPVDKEK

SEQ ID NO: 485814 - protein, 9 aa, Homo Sapiens
SAEGRSKAL

SEQ ID NO: 485815 - protein, 9 aa, Homo Sapiens
LSAKSLLQT

SEQ ID NO: 485816 - protein, 9 aa, Homo Sapiens
LEVRKKETE

SEQ ID NO: 485817 - protein, 9 aa, Homo Sapiens
ANNASETAW

SEQ ID NO: 485818 - protein, 9 aa, Homo Sapiens
ICDGIFCTP

SEQ ID NO: 485819 - protein, 9 aa, Homo Sapiens
IQALVANNA

SEQ ID NO: 485820 - protein, 9 aa, Homo Sapiens
VYHQKTVFS

SEQ ID NO: 485821 - protein, 9 aa, Homo Sapiens
KVVMLGAEG

SEQ ID NO: 485822 - protein, 9 aa, Homo Sapiens
ELLWPKSPE

SEQ ID NO: 485823 - protein, 9 aa, Homo Sapiens
ELLSESSGD

SEQ ID NO: 485824 - protein, 9 aa, Homo Sapiens
GWQMARQNS

SEQ ID NO: 485825 - protein, 9 aa, Homo Sapiens
GGIIFFSSP

SEQ ID NO: 485826 - protein, 9 aa, Homo Sapiens
TQKKFALSP

SEQ ID NO: 485827 - protein, 9 aa, Homo Sapiens
QRFLQKKRH

SEQ ID NO: 485828 - protein, 9 aa, Homo Sapiens
RCPRGHQER

SEQ ID NO: 485829 - protein, 9 aa, Homo Sapiens
QERDGSAQA

SEQ ID NO: 485830 - protein, 9 aa, Homo Sapiens
RMGDMGPCG

SEQ ID NO: 485831 - protein, 9 aa, Homo Sapiens
SQRFLQKKR

SEQ ID NO: 485832 - protein, 9 aa, Homo Sapiens
DNSPAPQEG

SEQ ID NO: 485833 - protein, 9 aa, Homo Sapiens
AGTKRKFTD

SEQ ID NO: 485834 - protein, 9 aa, Homo Sapiens
ASAPGVSQI

SEQ ID NO: 485835 - protein, 9 aa, Homo Sapiens
RYHFNAPIA

SEQ ID NO: 485836 - protein, 9 aa, Homo Sapiens
NGESDSPCD

SEQ ID NO: 485837 - protein, 9 aa, Homo Sapiens
GDSWSPDLH

SEQ ID NO: 485838 - protein, 9 aa, Homo Sapiens
KAFNQQSQF

SEQ ID NO: 485839 - protein, 9 aa, Homo Sapiens
LEKKRPFFP

SEQ ID NO: 485840 - protein, 9 aa, Homo Sapiens
GPPAQFQQP

SEQ ID NO: 485841 - protein, 9 aa, Homo Sapiens
AHNDREKLA

SEQ ID NO: 485842 - protein, 9 aa, Homo Sapiens
QLMEMGFPR

SEQ ID NO: 485843 - protein, 9 aa, Homo Sapiens
VTDEDDGAE

SEQ ID NO: 485844 - protein, 9 aa, Homo Sapiens
KRKFTDYHQ

SEQ ID NO: 485845 - protein, 9 aa, Homo Sapiens
RSQRDRGRR

SEQ ID NO: 485846 - protein, 9 aa, Homo Sapiens
LPLHDQPHG

SEQ ID NO: 485847 - protein, 9 aa, Homo Sapiens
ESARHMQQK

SEQ ID NO: 485848 - protein, 9 aa, Homo Sapiens
HRNQRVPED

SEQ ID NO: 485849 - protein, 9 aa, Homo Sapiens
SESLIGNDA

SEQ ID NO: 485850 - protein, 9 aa, Homo Sapiens
DDCQTLTKT

SEQ ID NO: 485851 - protein, 9 aa, Homo Sapiens
AAEATGGEH

SEQ ID NO: 485852 - protein, 9 aa, Homo Sapiens
TELPALRYH

SEQ ID NO: 485853 - protein, 9 aa, Homo Sapiens
IGNDARVCQ

SEQ ID NO: 485854 - protein, 9 aa, Homo Sapiens
HTTGNCVNG

SEQ ID NO: 485855 - protein, 9 aa, Homo Sapiens
QRKLAGTKR

SEQ ID NO: 485856 - protein, 9 aa, Homo Sapiens
VSAPNMQGE

SEQ ID NO: 485857 - protein, 9 aa, Homo Sapiens
VFGHRLRVH

SEQ ID NO: 485858 - protein, 9 aa, Homo Sapiens
WESARHMQQ

SEQ ID NO: 485859 - protein, 9 aa, Homo Sapiens
ETAQAQAAS

SEQ ID NO: 485860 - protein, 9 aa, Homo Sapiens
GFTYLSACF

SEQ ID NO: 485861 - protein, 9 aa, Homo Sapiens
PRRNIEFAL

SEQ ID NO: 485862 - protein, 9 aa, Homo Sapiens
LQRMAGPEQ

SEQ ID NO: 485863 - protein, 9 aa, Homo Sapiens
HFKFKEHCP

SEQ ID NO: 485864 - protein, 9 aa, Homo Sapiens
PALRYHFNA

SEQ ID NO: 485865 - protein, 9 aa, Homo Sapiens
QVTVFGHRL

SEQ ID NO: 485866 - protein, 9 aa, Homo Sapiens
KNYGSLLIS

SEQ ID NO: 485867 - protein, 9 aa, Homo Sapiens
YHFNAPIAR

SEQ ID NO: 485868 - protein, 9 aa, Homo Sapiens
EFKAKYPNS

SEQ ID NO: 485869 - protein, 9 aa, Homo Sapiens
RHTDHDRIF

SEQ ID NO: 485870 - protein, 9 aa, Homo Sapiens
NDARVCQED

SEQ ID NO: 485871 - protein, 9 aa, Homo Sapiens
DLNEWLGSN

SEQ ID NO: 485872 - protein, 9 aa, Homo Sapiens
FCTPQYLNP

SEQ ID NO: 485873 - protein, 9 aa, Homo Sapiens
RAQRVSSRR

SEQ ID NO: 485874 - protein, 9 aa, Homo Sapiens
LRLGLSASW

SEQ ID NO: 485875 - protein, 9 aa, Homo Sapiens
QYEKAFVRS

SEQ ID NO: 485876 - protein, 9 aa, Homo Sapiens
FPRRNIEFA

SEQ ID NO: 485877 - protein, 9 aa, Homo Sapiens
LQTGDIGIY

SEQ ID NO: 485878 - protein, 9 aa, Homo Sapiens
NNGESDSPC

SEQ ID NO: 485879 - protein, 9 aa, Homo Sapiens
EDFSSPQLT

SEQ ID NO: 485880 - protein, 9 aa, Homo Sapiens
DTENEQYNS

SEQ ID NO: 485881 - protein, 9 aa, Homo Sapiens
EAQPGGGAG

SEQ ID NO: 485882 - protein, 9 aa, Homo Sapiens
GNCVNGDDC

SEQ ID NO: 485883 - protein, 9 aa, Homo Sapiens
RPQIAEMSL

SEQ ID NO: 485884 - protein, 9 aa, Homo Sapiens
SSSASAPGV

SEQ ID NO: 485885 - protein, 9 aa, Homo Sapiens
VTDVMLQDK

SEQ ID NO: 485886 - protein, 9 aa, Homo Sapiens
SRRLGRRGS

SEQ ID NO: 485887 - protein, 9 aa, Homo Sapiens
KPPPASQPI

SEQ ID NO: 485888 - protein, 9 aa, Homo Sapiens
LLEHGTNPN

SEQ ID NO: 485889 - protein, 9 aa, Homo Sapiens
RGTLPVDKE

SEQ ID NO: 485890 - protein, 9 aa, Homo Sapiens
KDLLPKKIE

SEQ ID NO: 485891 - protein, 9 aa, Homo Sapiens
ILPHTTICP

SEQ ID NO: 485892 - protein, 9 aa, Homo Sapiens
EAIQLIINF

SEQ ID NO: 485893 - protein, 9 aa, Homo Sapiens
ASDRYTVGQ

SEQ ID NO: 485894 - protein, 9 aa, Homo Sapiens
ASNNVPNML

SEQ ID NO: 485895 - protein, 9 aa, Homo Sapiens
NSEIWSSTE

SEQ ID NO: 485896 - protein, 9 aa, Homo Sapiens
KGKDSAEKE

SEQ ID NO: 485897 - protein, 9 aa, Homo Sapiens
ESDSPCDLK

SEQ ID NO: 485898 - protein, 9 aa, Homo Sapiens
PYYEEWPAL

SEQ ID NO: 485899 - protein, 9 aa, Homo Sapiens
IIGNMYSRT

SEQ ID NO: 485900 - protein, 9 aa, Homo Sapiens
KEHCPMVFR

SEQ ID NO: 485901 - protein, 9 aa, Homo Sapiens
AKYVRLSCD

SEQ ID NO: 485902 - protein, 9 aa, Homo Sapiens
WEGFAVQKD

SEQ ID NO: 485903 - protein, 9 aa, Homo Sapiens
RNSFEVRVA

SEQ ID NO: 485904 - protein, 9 aa, Homo Sapiens
AQALCPAGA

SEQ ID NO: 485905 - protein, 9 aa, Homo Sapiens
GADGFTYLS

SEQ ID NO: 485906 - protein, 9 aa, Homo Sapiens
EMKYMLQKT

SEQ ID NO: 485907 - protein, 9 aa, Homo Sapiens
NDYLEKKRP

SEQ ID NO: 485908 - protein, 9 aa, Homo Sapiens
PPAPPGSQR

SEQ ID NO: 485909 - protein, 9 aa, Homo Sapiens
QSAEGRSKA

SEQ ID NO: 485910 - protein, 9 aa, Homo Sapiens
QAQTAAQRC

SEQ ID NO: 485911 - protein, 9 aa, Homo Sapiens
YRQFKQEFK

SEQ ID NO: 485912 - protein, 9 aa, Homo Sapiens
PPAQFQQPI

SEQ ID NO: 485913 - protein, 9 aa, Homo Sapiens
LSCDTKPEV

SEQ ID NO: 485914 - protein, 9 aa, Homo Sapiens
QEMIDIWCQ

SEQ ID NO: 485915 - protein, 9 aa, Homo Sapiens
SQPILVSTV

SEQ ID NO: 485916 - protein, 9 aa, Homo Sapiens
FFSSPILDL

SEQ ID NO: 485917 - protein, 9 aa, Homo Sapiens
EMEFEIQLL

SEQ ID NO: 485918 - protein, 9 aa, Homo Sapiens
ASETAWMIG

SEQ ID NO: 485919 - protein, 9 aa, Homo Sapiens
FKSFKTKCL

SEQ ID NO: 485920 - protein, 9 aa, Homo Sapiens
AAAEATGGE

SEQ ID NO: 485921 - protein, 9 aa, Homo Sapiens
SILTVCDAT

SEQ ID NO: 485922 - protein, 9 aa, Homo Sapiens
IFFSSPILD

SEQ ID NO: 485923 - protein, 9 aa, Homo Sapiens
AWHWEKCGC

SEQ ID NO: 485924 - protein, 9 aa, Homo Sapiens
QKPRIFSSG

SEQ ID NO: 485925 - protein, 9 aa, Homo Sapiens
FGHRLRVHN

SEQ ID NO: 485926 - protein, 9 aa, Homo Sapiens
HTDHDRIFN

SEQ ID NO: 485927 - protein, 9 aa, Homo Sapiens
LDGADPDEG

SEQ ID NO: 485928 - protein, 9 aa, Homo Sapiens
CGQAGDSWS

SEQ ID NO: 485929 - protein, 9 aa, Homo Sapiens
KKRPFFPRF

SEQ ID NO: 485930 - protein, 9 aa, Homo Sapiens
KHRNQRVPE

SEQ ID NO: 485931 - protein, 9 aa, Homo Sapiens
FSSPILDLS

SEQ ID NO: 485932 - protein, 9 aa, Homo Sapiens
ASSKNYGSL

SEQ ID NO: 485933 - protein, 9 aa, Homo Sapiens
IFCTPQYLN

SEQ ID NO: 485934 - protein, 9 aa, Homo Sapiens
LTYRNLIGP

SEQ ID NO: 485935 - protein, 9 aa, Homo Sapiens
QPILVSTVA

SEQ ID NO: 485936 - protein, 9 aa, Homo Sapiens
FKQEFKAKY

SEQ ID NO: 485937 - protein, 9 aa, Homo Sapiens
SQFSHHRIH

SEQ ID NO: 485938 - protein, 9 aa, Homo Sapiens
TENEQYNSD

SEQ ID NO: 485939 - protein, 9 aa, Homo Sapiens
FRTAHNDRE

SEQ ID NO: 485940 - protein, 9 aa, Homo Sapiens
MGFGEISSL

SEQ ID NO: 485941 - protein, 9 aa, Homo Sapiens
QPICSASPP

SEQ ID NO: 485942 - protein, 9 aa, Homo Sapiens
QEVSAPNMQ

SEQ ID NO: 485943 - protein, 9 aa, Homo Sapiens
SQGSCLYLK

SEQ ID NO: 485944 - protein, 9 aa, Homo Sapiens
DHFHPCVAL

SEQ ID NO: 485945 - protein, 9 aa, Homo Sapiens
SDSSNSDSS

SEQ ID NO: 485946 - protein, 9 aa, Homo Sapiens
KDHPPGAWH

SEQ ID NO: 485947 - protein, 9 aa, Homo Sapiens
QTAAQRCPR

SEQ ID NO: 485948 - protein, 9 aa, Homo Sapiens
GNDARVCQE

SEQ ID NO: 485949 - protein, 9 aa, Homo Sapiens
ALTFITHIG

SEQ ID NO: 485950 - protein, 9 aa, Homo Sapiens
NYGSLLISG

SEQ ID NO: 485951 - protein, 9 aa, Homo Sapiens
ELRIKDIMD

SEQ ID NO: 485952 - protein, 9 aa, Homo Sapiens
GANRGLSQR

SEQ ID NO: 485953 - protein, 9 aa, Homo Sapiens
SHSQWEGFA

SEQ ID NO: 485954 - protein, 9 aa, Homo Sapiens
FGEISSLAH

SEQ ID NO: 485955 - protein, 9 aa, Homo Sapiens
MAGPEQGPG

SEQ ID NO: 485956 - protein, 9 aa, Homo Sapiens
SSASAPGVS

SEQ ID NO: 485957 - protein, 9 aa, Homo Sapiens
FYPGEETVH

SEQ ID NO: 485958 - protein, 9 aa, Homo Sapiens
AWMVTDVML

SEQ ID NO: 485959 - protein, 9 aa, Homo Sapiens
LQKPRIFSS

SEQ ID NO: 485960 - protein, 9 aa, Homo Sapiens
KFGSFIWEQ

SEQ ID NO: 485961 - protein, 9 aa, Homo Sapiens
FAVQKDHPP

SEQ ID NO: 485962 - protein, 9 aa, Homo Sapiens
MGDMGPCGA

SEQ ID NO: 485963 - protein, 9 aa, Homo Sapiens
RKDLLPKKI

SEQ ID NO: 485964 - protein, 9 aa, Homo Sapiens
DAIQALVAN

SEQ ID NO: 485965 - protein, 9 aa, Homo Sapiens
QNSEIWSST

SEQ ID NO: 485966 - protein, 9 aa, Homo Sapiens
QMARQNSEI

SEQ ID NO: 485967 - protein, 9 aa, Homo Sapiens
DVMLQDKPY

SEQ ID NO: 485968 - protein, 9 aa, Homo Sapiens
GKKKGKDSA

SEQ ID NO: 485969 - protein, 9 aa, Homo Sapiens
TLEYMPTFI

SEQ ID NO: 485970 - protein, 9 aa, Homo Sapiens
KLEVRKKET

SEQ ID NO: 485971 - protein, 9 aa, Homo Sapiens
WLGSNTTTF

SEQ ID NO: 485972 - protein, 9 aa, Homo Sapiens
GCRESINYN

SEQ ID NO: 485973 - protein, 9 aa, Homo Sapiens
KARRLQRMA

SEQ ID NO: 485974 - protein, 9 aa, Homo Sapiens
QKKFALSPQ

SEQ ID NO: 485975 - protein, 9 aa, Homo Sapiens
RRKFGSFIW

SEQ ID NO: 485976 - protein, 9 aa, Homo Sapiens
HILPHTTIC

SEQ ID NO: 485977 - protein, 9 aa, Homo Sapiens
ESEGKTEGT

SEQ ID NO: 485978 - protein, 9 aa, Homo Sapiens
RRLQRMAGP

SEQ ID NO: 485979 - protein, 9 aa, Homo Sapiens
IESISELQP

SEQ ID NO: 485980 - protein, 9 aa, Homo Sapiens
VWNTEDFSS

SEQ ID NO: 485981 - protein, 9 aa, Homo Sapiens
ESLIGNDAR

SEQ ID NO: 485982 - protein, 9 aa, Homo Sapiens
IAEMSLYER

SEQ ID NO: 485983 - protein, 9 aa, Homo Sapiens
ELEQRKEKE

SEQ ID NO: 485984 - protein, 9 aa, Homo Sapiens
EETVHITQT

SEQ ID NO: 485985 - protein, 9 aa, Homo Sapiens
LCPAGASHS

SEQ ID NO: 485986 - protein, 9 aa, Homo Sapiens
LRYHFNAPI

SEQ ID NO: 485987 - protein, 9 aa, Homo Sapiens
IIHQEVSAP

SEQ ID NO: 485988 - protein, 9 aa, Homo Sapiens
PAPPGSQRF

SEQ ID NO: 485989 - protein, 9 aa, Homo Sapiens
QHQKCNISE

SEQ ID NO: 485990 - protein, 9 aa, Homo Sapiens
FHPCVALTT

SEQ ID NO: 485991 - protein, 9 aa, Homo Sapiens
DIWCQLQSA

SEQ ID NO: 485992 - protein, 9 aa, Homo Sapiens
RAKYVRLSC

SEQ ID NO: 485993 - protein, 9 aa, Homo Sapiens
HFHPCVALT

SEQ ID NO: 485994 - protein, 9 aa, Homo Sapiens
APPGSQRFL

SEQ ID NO: 485995 - protein, 9 aa, Homo Sapiens
RFSKEEEEI

SEQ ID NO: 485996 - protein, 9 aa, Homo Sapiens
SVPTERIPN

SEQ ID NO: 485997 - protein, 9 aa, Homo Sapiens
LSQGSCLYL

SEQ ID NO: 485998 - protein, 9 aa, Homo Sapiens
RLKLEVRKK

SEQ ID NO: 485999 - protein, 9 aa, Homo Sapiens
QRVSSRRLG

SEQ ID NO: 486000 - protein, 9 aa, Homo Sapiens
KCEQYEKAF

SEQ ID NO: 486001 - protein, 9 aa, Homo Sapiens
EQYEKAFVR

SEQ ID NO: 486002 - protein, 9 aa, Homo Sapiens
SYVSVHEES

SEQ ID NO: 486003 - protein, 9 aa, Homo Sapiens
SSRPQIAEM

SEQ ID NO: 486004 - protein, 9 aa, Homo Sapiens
FKAERDVEA

SEQ ID NO: 486005 - protein, 9 aa, Homo Sapiens
IIFFSSPIL

SEQ ID NO: 486006 - protein, 9 aa, Homo Sapiens
LLDLDGADP

SEQ ID NO: 486007 - protein, 9 aa, Homo Sapiens
HFSQEIFTL

SEQ ID NO: 486008 - protein, 9 aa, Homo Sapiens
YHTTGNCVN

SEQ ID NO: 486009 - protein, 9 aa, Homo Sapiens
HAALLYNVT

SEQ ID NO: 486010 - protein, 9 aa, Homo Sapiens
EMGFPRRNI

SEQ ID NO: 486011 - protein, 9 aa, Homo Sapiens
AEGVGKSAM

SEQ ID NO: 486012 - protein, 9 aa, Homo Sapiens
TEDFSSPQL

SEQ ID NO: 486013 - protein, 9 aa, Homo Sapiens
FDHFHPCVA

SEQ ID NO: 486014 - protein, 9 aa, Homo Sapiens
GSSRPQIAE

SEQ ID NO: 486015 - protein, 9 aa, Homo Sapiens
SLDRHTDHD

SEQ ID NO: 486016 - protein, 9 aa, Homo Sapiens
VTLGRHVKQ

SEQ ID NO: 486017 - protein, 9 aa, Homo Sapiens
VQKDHPPGA

SEQ ID NO: 486018 - protein, 9 aa, Homo Sapiens
VMLGAEGVG

SEQ ID NO: 486019 - protein, 9 aa, Homo Sapiens
IQLIINFSY

SEQ ID NO: 486020 - protein, 9 aa, Homo Sapiens
RDNSPAPQE

SEQ ID NO: 486021 - protein, 9 aa, Homo Sapiens
GQVTVFGHR

SEQ ID NO: 486022 - protein, 9 aa, Homo Sapiens
NMGFGEISS

SEQ ID NO: 486023 - protein, 9 aa, Homo Sapiens
CPYYEEWPA

SEQ ID NO: 486024 - protein, 9 aa, Homo Sapiens
FTSFIMVVV

SEQ ID NO: 486025 - protein, 9 aa, Homo Sapiens
ILVSTVAPG

SEQ ID NO: 486026 - protein, 9 aa, Homo Sapiens
SDSDSSNSD

SEQ ID NO: 486027 - protein, 9 aa, Homo Sapiens
AVILLEHGT

SEQ ID NO: 486028 - protein, 9 aa, Homo Sapiens
FITHIGCGL

SEQ ID NO: 486029 - protein, 9 aa, Homo Sapiens
HSRLKLEVR

SEQ ID NO: 486030 - protein, 9 aa, Homo Sapiens
LWPKSPESC

SEQ ID NO: 486031 - protein, 9 aa, Homo Sapiens
LGLSASWGE

SEQ ID NO: 486032 - protein, 9 aa, Homo Sapiens
MFRTAHNDR

SEQ ID NO: 486033 - protein, 9 aa, Homo Sapiens
VSVHEESGK

SEQ ID NO: 486034 - protein, 9 aa, Homo Sapiens
HNDREKLAE

SEQ ID NO: 486035 - protein, 9 aa, Homo Sapiens
SELLWPKSP

SEQ ID NO: 486036 - protein, 9 aa, Homo Sapiens
SQEIFTLEY

SEQ ID NO: 486037 - protein, 9 aa, Homo Sapiens
SLRLGLSAS

SEQ ID NO: 486038 - protein, 9 aa, Homo Sapiens
AFNQQSQFS

SEQ ID NO: 486039 - protein, 9 aa, Homo Sapiens
PNMLANLMN

SEQ ID NO: 486040 - protein, 9 aa, Homo Sapiens
DNRSTLKRL

SEQ ID NO: 486041 - protein, 9 aa, Homo Sapiens
LSSYVSVHE

SEQ ID NO: 486042 - protein, 9 aa, Homo Sapiens
NTYPDNRST

SEQ ID NO: 486043 - protein, 9 aa, Homo Sapiens
APCGQAGDS

SEQ ID NO: 486044 - protein, 9 aa, Homo Sapiens
SRPIDCSSR

SEQ ID NO: 486045 - protein, 9 aa, Homo Sapiens
DRHTDHDRI

SEQ ID NO: 486046 - protein, 9 aa, Homo Sapiens
TYCSRLLKH

SEQ ID NO: 486047 - protein, 9 aa, Homo Sapiens
PIDCSSRML

SEQ ID NO: 486048 - protein, 9 aa, Homo Sapiens
VRLSCDTKP

SEQ ID NO: 486049 - protein, 9 aa, Homo Sapiens
FEIQLLREA

SEQ ID NO: 486050 - protein, 9 aa, Homo Sapiens
DYLEKKRPF

SEQ ID NO: 486051 - protein, 9 aa, Homo Sapiens
ANDNSTVRC

SEQ ID NO: 486052 - protein, 9 aa, Homo Sapiens
NVPNMLANL

SEQ ID NO: 486053 - protein, 9 aa, Homo Sapiens
SLLLDLDGA

SEQ ID NO: 486054 - protein, 9 aa, Homo Sapiens
VGEVHCEGD

SEQ ID NO: 486055 - protein, 9 aa, Homo Sapiens
ILTVCDATT

SEQ ID NO: 486056 - protein, 9 aa, Homo Sapiens
VVHERVPDM

SEQ ID NO: 486057 - protein, 9 aa, Homo Sapiens
QKDHPPGAW

SEQ ID NO: 486058 - protein, 9 aa, Homo Sapiens
SETAWMIGL

SEQ ID NO: 486059 - protein, 9 aa, Homo Sapiens
AVQKDHPPG

SEQ ID NO: 486060 - protein, 9 aa, Homo Sapiens
RLTYRNLIG

SEQ ID NO: 486061 - protein, 9 aa, Homo Sapiens
TDVMLQDKP

SEQ ID NO: 486062 - protein, 9 aa, Homo Sapiens
CTYCSRLLK

SEQ ID NO: 486063 - protein, 9 aa, Homo Sapiens
GNMYSRTDQ

SEQ ID NO: 486064 - protein, 9 aa, Homo Sapiens
PSHFKFKEH

SEQ ID NO: 486065 - protein, 9 aa, Homo Sapiens
KCTYCSRLL

SEQ ID NO: 486066 - protein, 9 aa, Homo Sapiens
KPYKCEQYE

SEQ ID NO: 486067 - protein, 9 aa, Homo Sapiens
AALLYNVTF

SEQ ID NO: 486068 - protein, 9 aa, Homo Sapiens
RAFDSVSMA

SEQ ID NO: 486069 - protein, 9 aa, Homo Sapiens
RLQRMAGPE

SEQ ID NO: 486070 - protein, 9 aa, Homo Sapiens
MGFPRRNIE

SEQ ID NO: 486071 - protein, 9 aa, Homo Sapiens
SSSDSDSSN

SEQ ID NO: 486072 - protein, 9 aa, Homo Sapiens
LDRHTDHDR

SEQ ID NO: 486073 - protein, 9 aa, Homo Sapiens
ACIDCVYHQ

SEQ ID NO: 486074 - protein, 9 aa, Homo Sapiens
LYHTTGNCV

SEQ ID NO: 486075 - protein, 9 aa, Homo Sapiens
YKCEQYEKA

SEQ ID NO: 486076 - protein, 9 aa, Homo Sapiens
EWPALSIYE

SEQ ID NO: 486077 - protein, 9 aa, Homo Sapiens
LRIKDIMDK

SEQ ID NO: 486078 - protein, 9 aa, Homo Sapiens
QEIFTLEYM

SEQ ID NO: 486079 - protein, 9 aa, Homo Sapiens
MLGAEGVGK

SEQ ID NO: 486080 - protein, 9 aa, Homo Sapiens
DSVSMAHSR

SEQ ID NO: 486081 - protein, 9 aa, Homo Sapiens
TYPDNRSTL

SEQ ID NO: 486082 - protein, 9 aa, Homo Sapiens
ASMEVLGWC

SEQ ID NO: 486083 - protein, 9 aa, Homo Sapiens
SKHKGQCHT

SEQ ID NO: 486084 - protein, 9 aa, Homo Sapiens
TTGNCVNGD

SEQ ID NO: 486085 - protein, 9 aa, Homo Sapiens
SCLQIFIQH

SEQ ID NO: 486086 - protein, 9 aa, Homo Sapiens
DEMEFEIQL

SEQ ID NO: 486087 - protein, 9 aa, Homo Sapiens
AIQALVANN

SEQ ID NO: 486088 - protein, 9 aa, Homo Sapiens
GKDSAEKED

SEQ ID NO: 486089 - protein, 9 aa, Homo Sapiens
PSKHKGQCH

SEQ ID NO: 486090 - protein, 9 aa, Homo Sapiens
QRCPRGHQE

SEQ ID NO: 486091 - protein, 9 aa, Homo Sapiens
ALQISRLQT

SEQ ID NO: 486092 - protein, 9 aa, Homo Sapiens
WPALSIYEL

SEQ ID NO: 486093 - protein, 9 aa, Homo Sapiens
NFKGCRESI

SEQ ID NO: 486094 - protein, 9 aa, Homo Sapiens
YASNNVPNM

SEQ ID NO: 486095 - protein, 9 aa, Homo Sapiens
HDRIFNIHS

SEQ ID NO: 486096 - protein, 9 aa, Homo Sapiens
NEQYNSDEQ

SEQ ID NO: 486097 - protein, 9 aa, Homo Sapiens
QYNSDEQND

SEQ ID NO: 486098 - protein, 9 aa, Homo Sapiens
LPALRYHFN

SEQ ID NO: 486099 - protein, 9 aa, Homo Sapiens
TSFIMVVVH

SEQ ID NO: 486100 - protein, 9 aa, Homo Sapiens
RRLGRRGSR

SEQ ID NO: 486101 - protein, 9 aa, Homo Sapiens
VHCEGDAIQ

SEQ ID NO: 486102 - protein, 9 aa, Homo Sapiens
KDIMDKLDQ

SEQ ID NO: 486103 - protein, 9 aa, Homo Sapiens
SASDRYTVG

SEQ ID NO: 486104 - protein, 9 aa, Homo Sapiens
VNMGFGEIS

SEQ ID NO: 486105 - protein, 9 aa, Homo Sapiens
KIESISELQ

SEQ ID NO: 486106 - protein, 9 aa, Homo Sapiens
LKVLHQAQT

SEQ ID NO: 486107 - protein, 9 aa, Homo Sapiens
VNLTIHRLS

SEQ ID NO: 486108 - protein, 9 aa, Homo Sapiens
QAQAASLEK

SEQ ID NO: 486109 - protein, 9 aa, Homo Sapiens
QISRLQTGD

SEQ ID NO: 486110 - protein, 9 aa, Homo Sapiens
HRLSAKSLL

SEQ ID NO: 486111 - protein, 9 aa, Homo Sapiens
HITQTAEGL

SEQ ID NO: 486112 - protein, 9 aa, Homo Sapiens
NNVPNMLAN

SEQ ID NO: 486113 - protein, 9 aa, Homo Sapiens
KCLPLHDQP

SEQ ID NO: 486114 - protein, 9 aa, Homo Sapiens
GDAIQALVA

SEQ ID NO: 486115 - protein, 9 aa, Homo Sapiens
PGPPAQFQQ

SEQ ID NO: 486116 - protein, 9 aa, Homo Sapiens
RSRSQRDRG

SEQ ID NO: 486117 - protein, 9 aa, Homo Sapiens
NMYSRTDQK

SEQ ID NO: 486118 - protein, 9 aa, Homo Sapiens
RTAHNDREK

SEQ ID NO: 486119 - protein, 9 aa, Homo Sapiens
GQAGDSWSP

SEQ ID NO: 486120 - protein, 9 aa, Homo Sapiens
PGAWHWEKC

SEQ ID NO: 486121 - protein, 9 aa, Homo Sapiens
QGSCLYLKL

SEQ ID NO: 486122 - protein, 9 aa, Homo Sapiens
GSLLLDLDG

SEQ ID NO: 486123 - protein, 9 aa, Homo Sapiens
KDSAEKEDS

SEQ ID NO: 486124 - protein, 9 aa, Homo Sapiens
SQWEGFAVQ

SEQ ID NO: 486125 - protein, 9 aa, Homo Sapiens
EMSLYERQA

SEQ ID NO: 486126 - protein, 9 aa, Homo Sapiens
DKLNNGESD

SEQ ID NO: 486127 - protein, 9 aa, Homo Sapiens
CIDCVYHQK

SEQ ID NO: 486128 - protein, 9 aa, Homo Sapiens
EGTESQSSE

SEQ ID NO: 486129 - protein, 9 aa, Homo Sapiens
VGGIIFFSS

SEQ ID NO: 486130 - protein, 9 aa, Homo Sapiens
TAQAQAASL

SEQ ID NO: 486131 - protein, 9 aa, Homo Sapiens
GSLLISGST

SEQ ID NO: 486132 - protein, 9 aa, Homo Sapiens
RHVKQLVES

SEQ ID NO: 486133 - protein, 9 aa, Homo Sapiens
KHAALLYNV

SEQ ID NO: 486134 - protein, 9 aa, Homo Sapiens
RRGTLPVDK

SEQ ID NO: 486135 - protein, 9 aa, Homo Sapiens
VALGLSASD

SEQ ID NO: 486136 - protein, 9 aa, Homo Sapiens
SESSGDDGQ

SEQ ID NO: 486137 - protein, 9 aa, Homo Sapiens
LQKEIRRKF

SEQ ID NO: 486138 - protein, 9 aa, Homo Sapiens
MIDIWCQLQ

SEQ ID NO: 486139 - protein, 9 aa, Homo Sapiens
SDGQAATLR

SEQ ID NO: 486140 - protein, 9 aa, Homo Sapiens
RDMKEELEQ

SEQ ID NO: 486141 - protein, 9 aa, Homo Sapiens
PRIFSSGLM

SEQ ID NO: 486142 - protein, 9 aa, Homo Sapiens
TDHDRIFNI

SEQ ID NO: 486143 - protein, 9 aa, Homo Sapiens
DCVYHQKTV

SEQ ID NO: 486144 - protein, 9 aa, Homo Sapiens
KYMLQKTDR

SEQ ID NO: 486145 - protein, 9 aa, Homo Sapiens
RLRSLAQRW

SEQ ID NO: 486146 - protein, 9 aa, Homo Sapiens
HIGCGLSSI

SEQ ID NO: 486147 - protein, 9 aa, Homo Sapiens
CWGPGSDDC

SEQ ID NO: 486148 - protein, 9 aa, Homo Sapiens
CEGDAIQAL

SEQ ID NO: 486149 - protein, 9 aa, Homo Sapiens
ILLEHGTNP

SEQ ID NO: 486150 - protein, 9 aa, Homo Sapiens
AVQACIDCV

SEQ ID NO: 486151 - protein, 9 aa, Homo Sapiens
LYRQFKQEF

SEQ ID NO: 486152 - protein, 9 aa, Homo Sapiens
PTERIPNMY

SEQ ID NO: 486153 - protein, 9 aa, Homo Sapiens
AQNVSILTV

SEQ ID NO: 486154 - protein, 9 aa, Homo Sapiens
QACIDCVYH

SEQ ID NO: 486155 - protein, 9 aa, Homo Sapiens
SASAPGVSQ

SEQ ID NO: 486156 - protein, 9 aa, Homo Sapiens
LRSLAQRWQ

SEQ ID NO: 486157 - protein, 9 aa, Homo Sapiens
ALSIYELIA

SEQ ID NO: 486158 - protein, 9 aa, Homo Sapiens
HSHAGSLRL

SEQ ID NO: 486159 - protein, 9 aa, Homo Sapiens
KFKEHCPMV

SEQ ID NO: 486160 - protein, 9 aa, Homo Sapiens
PFFPRFFFL

SEQ ID NO: 486161 - protein, 9 aa, Homo Sapiens
EAAETAQAQ

SEQ ID NO: 486162 - protein, 9 aa, Homo Sapiens
MKEELEQRK

SEQ ID NO: 486163 - protein, 9 aa, Homo Sapiens
PHTTICPVV

SEQ ID NO: 486164 - protein, 9 aa, Homo Sapiens
PGVSQISTT

SEQ ID NO: 486165 - protein, 9 aa, Homo Sapiens
YSRTDQKDL

SEQ ID NO: 486166 - protein, 9 aa, Homo Sapiens
TLPVDKEKC

SEQ ID NO: 486167 - protein, 9 aa, Homo Sapiens
EWLGSNTTT

SEQ ID NO: 486168 - protein, 9 aa, Homo Sapiens
IDCVYHQKT

SEQ ID NO: 486169 - protein, 9 aa, Homo Sapiens
KAERDVEAQ

SEQ ID NO: 486170 - protein, 9 aa, Homo Sapiens
MGPCGAINM

SEQ ID NO: 486171 - protein, 9 aa, Homo Sapiens
KEEEEIKFI

SEQ ID NO: 486172 - protein, 9 aa, Homo Sapiens
EEWPALSIY

SEQ ID NO: 486173 - protein, 9 aa, Homo Sapiens
RVSSRRLGR

SEQ ID NO: 486174 - protein, 9 aa, Homo Sapiens
HQAQTAAQR

SEQ ID NO: 486175 - protein, 9 aa, Homo Sapiens
ASQPILVST

SEQ ID NO: 486176 - protein, 9 aa, Homo Sapiens
PCGAINMGD

SEQ ID NO: 486177 - protein, 9 aa, Homo Sapiens
LLSESSGDD

SEQ ID NO: 486178 - protein, 9 aa, Homo Sapiens
EMIDIWCQL

SEQ ID NO: 486179 - protein, 9 aa, Homo Sapiens
QFSHHRIHT

SEQ ID NO: 486180 - protein, 9 aa, Homo Sapiens
DHILPHTTI

SEQ ID NO: 486181 - protein, 9 aa, Homo Sapiens
KESEGKTEG

SEQ ID NO: 486182 - protein, 9 aa, Homo Sapiens
RDVEAQPGG

SEQ ID NO: 486183 - protein, 9 aa, Homo Sapiens
VPNMLANLM

SEQ ID NO: 486184 - protein, 9 aa, Homo Sapiens
DARVCQEDS

SEQ ID NO: 486185 - protein, 9 aa, Homo Sapiens
QAGDSWSPD

SEQ ID NO: 486186 - protein, 9 aa, Homo Sapiens
GAAAEATGG

SEQ ID NO: 486187 - protein, 9 aa, Homo Sapiens
TFITHIGCG

SEQ ID NO: 486188 - protein, 9 aa, Homo Sapiens
NMLANLMNQ

SEQ ID NO: 486189 - protein, 9 aa, Homo Sapiens
ICRKHRNQR

SEQ ID NO: 486190 - protein, 9 aa, Homo Sapiens
SAEKEDSRS

SEQ ID NO: 486191 - protein, 9 aa, Homo Sapiens
GFTSFIMVV

SEQ ID NO: 486192 - protein, 9 aa, Homo Sapiens
LYNVTFLLF

SEQ ID NO: 486193 - protein, 8 aa, Homo Sapiens
EPIYRVLS

SEQ ID NO: 486194 - protein, 9 aa, Homo Sapiens
LTIHRLSAK

SEQ ID NO: 486195 - protein, 9 aa, Homo Sapiens
DMKEELEQR

SEQ ID NO: 486196 - protein, 9 aa, Homo Sapiens
SFIMVVVHE

SEQ ID NO: 486197 - protein, 9 aa, Homo Sapiens
PSELLWPKS

SEQ ID NO: 486198 - protein, 9 aa, Homo Sapiens
IQLLREALQ

SEQ ID NO: 486199 - protein, 9 aa, Homo Sapiens
EVHCEGDAI

SEQ ID NO: 486200 - protein, 9 aa, Homo Sapiens
NLTIHRLSA

SEQ ID NO: 486201 - protein, 9 aa, Homo Sapiens
LQASMEVLG

SEQ ID NO: 486202 - protein, 9 aa, Homo Sapiens
HPELLSESS

SEQ ID NO: 486203 - protein, 9 aa, Homo Sapiens
ITHIGCGLS

SEQ ID NO: 486204 - protein, 9 aa, Homo Sapiens
ESISELQPK

SEQ ID NO: 486205 - protein, 9 aa, Homo Sapiens
SRLLKHKRS

SEQ ID NO: 486206 - protein, 9 aa, Homo Sapiens
YCSRLLKHK

SEQ ID NO: 486207 - protein, 9 aa, Homo Sapiens
VTQQSVPTE

SEQ ID NO: 486208 - protein, 9 aa, Homo Sapiens
VHITQTAEG

SEQ ID NO: 486209 - protein, 9 aa, Homo Sapiens
IDEMEFEIQ

SEQ ID NO: 486210 - protein, 9 aa, Homo Sapiens
VTAWMVTDV

SEQ ID NO: 486211 - protein, 9 aa, Homo Sapiens
DREKLAESL

SEQ ID NO: 486212 - protein, 9 aa, Homo Sapiens
AGKKKGKDS

SEQ ID NO: 486213 - protein, 9 aa, Homo Sapiens
RPFFPRFFF

SEQ ID NO: 486214 - protein, 9 aa, Homo Sapiens
IINFSYINL

SEQ ID NO: 486215 - protein, 9 aa, Homo Sapiens
KPDLQKPRI

SEQ ID NO: 486216 - protein, 9 aa, Homo Sapiens
GKTEGTESQ

SEQ ID NO: 486217 - protein, 9 aa, Homo Sapiens
PPPASQPIL

SEQ ID NO: 486218 - protein, 9 aa, Homo Sapiens
HLFIIHQEV

SEQ ID NO: 486219 - protein, 9 aa, Homo Sapiens
IGNMYSRTD

SEQ ID NO: 486220 - protein, 9 aa, Homo Sapiens
AAETAQAQA

SEQ ID NO: 486221 - protein, 9 aa, Homo Sapiens
FIIHQEVSA

SEQ ID NO: 486222 - protein, 9 aa, Homo Sapiens
FSQEIFTLE

SEQ ID NO: 486223 - protein, 9 aa, Homo Sapiens
SMEVLGWCL

SEQ ID NO: 486224 - protein, 9 aa, Homo Sapiens
SSKNYGSLL

SEQ ID NO: 486225 - protein, 9 aa, Homo Sapiens
SELQPKPYN

SEQ ID NO: 486226 - protein, 9 aa, Homo Sapiens
ERKIESISE

SEQ ID NO: 486227 - protein, 9 aa, Homo Sapiens
FQQPICSAS

SEQ ID NO: 486228 - protein, 9 aa, Homo Sapiens
VRDNSPAPQ

SEQ ID NO: 486229 - protein, 9 aa, Homo Sapiens
GPGWESARH

SEQ ID NO: 486230 - protein, 9 aa, Homo Sapiens
LPVDKEKCG

SEQ ID NO: 486231 - protein, 9 aa, Homo Sapiens
QNVSILTVC

SEQ ID NO: 486232 - protein, 9 aa, Homo Sapiens
LLLSRPIDC

SEQ ID NO: 486233 - protein, 9 aa, Homo Sapiens
RLLKHKRSR

SEQ ID NO: 486234 - protein, 9 aa, Homo Sapiens
PGSDDCQTL

SEQ ID NO: 486235 - protein, 9 aa, Homo Sapiens
NRGLSQRRL

SEQ ID NO: 486236 - protein, 9 aa, Homo Sapiens
RKFTDYHQW

SEQ ID NO: 486237 - protein, 9 aa, Homo Sapiens
SDRYTVGQA

SEQ ID NO: 486238 - protein, 9 aa, Homo Sapiens
SAKSLLQTK

SEQ ID NO: 486239 - protein, 9 aa, Homo Sapiens
VVMLGAEGV

SEQ ID NO: 486240 - protein, 9 aa, Homo Sapiens
GAEGVGKSA

SEQ ID NO: 486241 - protein, 9 aa, Homo Sapiens
EATGGEHWK

SEQ ID NO: 486242 - protein, 9 aa, Homo Sapiens
IFTLEYMPT

SEQ ID NO: 486243 - protein, 9 aa, Homo Sapiens
QAASLEKNK

SEQ ID NO: 486244 - protein, 9 aa, Homo Sapiens
SARHMQQKM

SEQ ID NO: 486245 - protein, 9 aa, Homo Sapiens
NVTFLLFLM

SEQ ID NO: 486246 - protein, 9 aa, Homo Sapiens
DGSAQALCP

SEQ ID NO: 486247 - protein, 9 aa, Homo Sapiens
YGSLLISGS

SEQ ID NO: 486248 - protein, 9 aa, Homo Sapiens
SEIWSSTEE

SEQ ID NO: 486249 - protein, 9 aa, Homo Sapiens
EEEIKFIYS

SEQ ID NO: 486250 - protein, 9 aa, Homo Sapiens
WNTEDFSSP

SEQ ID NO: 486251 - protein, 9 aa, Homo Sapiens
ALVANNASE

SEQ ID NO: 486252 - protein, 9 aa, Homo Sapiens
VRVACPGRD

SEQ ID NO: 486253 - protein, 9 aa, Homo Sapiens
HQERDGSAQ

SEQ ID NO: 486254 - protein, 9 aa, Homo Sapiens
EHCPMVFRN

SEQ ID NO: 486255 - protein, 9 aa, Homo Sapiens
TLRFQAGKH

SEQ ID NO: 486256 - protein, 9 aa, Homo Sapiens
HQEVSAPNM

SEQ ID NO: 486257 - protein, 9 aa, Homo Sapiens
ERKDLLPKK

SEQ ID NO: 486258 - protein, 9 aa, Homo Sapiens
HAGSLRLGL

SEQ ID NO: 486259 - protein, 9 aa, Homo Sapiens
MALTFITHI

SEQ ID NO: 486260 - protein, 9 aa, Homo Sapiens
WMIGLPHCL

SEQ ID NO: 486261 - protein, 9 aa, Homo Sapiens
RGLSQRRLK

SEQ ID NO: 486262 - protein, 9 aa, Homo Sapiens
VPTERIPNM

SEQ ID NO: 486263 - protein, 9 aa, Homo Sapiens
EEIKFIYSE

SEQ ID NO: 486264 - protein, 9 aa, Homo Sapiens
ATLRFQAGK

SEQ ID NO: 486265 - protein, 9 aa, Homo Sapiens
NSFEVRVAC

SEQ ID NO: 486266 - protein, 9 aa, Homo Sapiens
RGANRGLSQ

SEQ ID NO: 486267 - protein, 9 aa, Homo Sapiens
GTKRKFTDY

SEQ ID NO: 486268 - protein, 9 aa, Homo Sapiens
GTNPNLKDI

SEQ ID NO: 486269 - protein, 9 aa, Homo Sapiens
TDERLRSLA

SEQ ID NO: 486270 - protein, 9 aa, Homo Sapiens
HCPMVFRNL

SEQ ID NO: 486271 - protein, 9 aa, Homo Sapiens
CPAGASHSQ

SEQ ID NO: 486272 - protein, 9 aa, Homo Sapiens
THIGCGLSS

SEQ ID NO: 486273 - protein, 9 aa, Homo Sapiens
PDLQKPRIF

SEQ ID NO: 486274 - protein, 9 aa, Homo Sapiens
AQTAAQRCP

SEQ ID NO: 486275 - protein, 9 aa, Homo Sapiens
LQISRLQTG

SEQ ID NO: 486276 - protein, 9 aa, Homo Sapiens
SDPSELLWP

SEQ ID NO: 486277 - protein, 9 aa, Homo Sapiens
KKGKDSAEK

SEQ ID NO: 486278 - protein, 9 aa, Homo Sapiens
GSDDCQTLT

SEQ ID NO: 486279 - protein, 9 aa, Homo Sapiens
RIKDIMDKL

SEQ ID NO: 486280 - protein, 9 aa, Homo Sapiens
CSSRMLFVF

SEQ ID NO: 486281 - protein, 9 aa, Homo Sapiens
EIDLNEWLG

SEQ ID NO: 486282 - protein, 9 aa, Homo Sapiens
NCVNGDDCM

SEQ ID NO: 486283 - protein, 9 aa, Homo Sapiens
ARRLQRMAG

SEQ ID NO: 486284 - protein, 9 aa, Homo Sapiens
AQAASLEKN

SEQ ID NO: 486285 - protein, 9 aa, Homo Sapiens
RGHQERDGS

SEQ ID NO: 486286 - protein, 9 aa, Homo Sapiens
MVTDVMLQD

SEQ ID NO: 486287 - protein, 9 aa, Homo Sapiens
NSDSSDSSD

SEQ ID NO: 486288 - protein, 9 aa, Homo Sapiens
SKEEEEIKF

SEQ ID NO: 486289 - protein, 9 aa, Homo Sapiens
LSQRRLKSR

SEQ ID NO: 486290 - protein, 9 aa, Homo Sapiens
VHEESGKVY

SEQ ID NO: 486291 - protein, 9 aa, Homo Sapiens
RKLAGTKRK

SEQ ID NO: 486292 - protein, 9 aa, Homo Sapiens
MEFEIQLLR

SEQ ID NO: 486293 - protein, 9 aa, Homo Sapiens
IHQEVSAPN

SEQ ID NO: 486294 - protein, 9 aa, Homo Sapiens
LNNGESDSP

SEQ ID NO: 486295 - protein, 9 aa, Homo Sapiens
HCEGDAIQA

SEQ ID NO: 486296 - protein, 9 aa, Homo Sapiens
NFSYINLNP

SEQ ID NO: 486297 - protein, 9 aa, Homo Sapiens
VACPGRDRR

SEQ ID NO: 486298 - protein, 9 aa, Homo Sapiens
LRLTYRNLI

SEQ ID NO: 486299 - protein, 9 aa, Homo Sapiens
GSNTTTFFH

SEQ ID NO: 486300 - protein, 9 aa, Homo Sapiens
RMAGPEQGP

SEQ ID NO: 486301 - protein, 9 aa, Homo Sapiens
VANNASETA

SEQ ID NO: 486302 - protein, 9 aa, Homo Sapiens
LVGEVHCEG

SEQ ID NO: 486303 - protein, 9 aa, Homo Sapiens
TAHNDREKL

SEQ ID NO: 486304 - protein, 9 aa, Homo Sapiens
GVGGIIFFS

SEQ ID NO: 486305 - protein, 9 aa, Homo Sapiens
EIKFIYSED

SEQ ID NO: 486306 - protein, 9 aa, Homo Sapiens
TVCDATTGV

SEQ ID NO: 486307 - protein, 9 aa, Homo Sapiens
ALCPAGASH

SEQ ID NO: 486308 - protein, 9 aa, Homo Sapiens
DLLPKKIEI

SEQ ID NO: 486309 - protein, 9 aa, Homo Sapiens
MVVVHERVP

SEQ ID NO: 486310 - protein, 9 aa, Homo Sapiens
VSRQRNLFG

SEQ ID NO: 486311 - protein, 9 aa, Homo Sapiens
SCLYLKLTF

SEQ ID NO: 486312 - protein, 9 aa, Homo Sapiens
DVEAQPGGG

SEQ ID NO: 486313 - protein, 9 aa, Homo Sapiens
RKQSAEGRS

SEQ ID NO: 486314 - protein, 9 aa, Homo Sapiens
ADGFTYLSA

SEQ ID NO: 486315 - protein, 9 aa, Homo Sapiens
VLGAAAEAT

SEQ ID NO: 486316 - protein, 9 aa, Homo Sapiens
EGDVTDEDD

SEQ ID NO: 486317 - protein, 9 aa, Homo Sapiens
GSAQALCPA

SEQ ID NO: 486318 - protein, 9 aa, Homo Sapiens
SLLISGSTP

SEQ ID NO: 486319 - protein, 9 aa, Homo Sapiens
RLSAKSLLQ

SEQ ID NO: 486320 - protein, 9 aa, Homo Sapiens
GFGEISSLA

SEQ ID NO: 486321 - protein, 9 aa, Homo Sapiens
TKRKFTDYH

SEQ ID NO: 486322 - protein, 9 aa, Homo Sapiens
QLLREALQS

SEQ ID NO: 486323 - protein, 9 aa, Homo Sapiens
YLEKKRPFF

SEQ ID NO: 486324 - protein, 9 aa, Homo Sapiens
PQEMIDIWC

SEQ ID NO: 486325 - protein, 9 aa, Homo Sapiens
YVSVHEESG

SEQ ID NO: 486326 - protein, 9 aa, Homo Sapiens
CPRGHQERD

SEQ ID NO: 486327 - protein, 9 aa, Homo Sapiens
LNEWLGSNT

SEQ ID NO: 486328 - protein, 9 aa, Homo Sapiens
DSSNSDSSD

SEQ ID NO: 486329 - protein, 9 aa, Homo Sapiens
CVNGDDCMF

SEQ ID NO: 486330 - protein, 9 aa, Homo Sapiens
IFSSGLMVS

SEQ ID NO: 486331 - protein, 9 aa, Homo Sapiens
CVYLMFYEI

SEQ ID NO: 486332 - protein, 9 aa, Homo Sapiens
SHAGSLRLG

SEQ ID NO: 486333 - protein, 9 aa, Homo Sapiens
SVDERKDLL

SEQ ID NO: 486334 - protein, 9 aa, Homo Sapiens
EHGTNPNLK

SEQ ID NO: 486335 - protein, 9 aa, Homo Sapiens
QHSRLKLEV

SEQ ID NO: 486336 - protein, 9 aa, Homo Sapiens
SNNVPNMLA

SEQ ID NO: 486337 - protein, 9 aa, Homo Sapiens
ATGGEHWKE

SEQ ID NO: 486338 - protein, 9 aa, Homo Sapiens
DSDSSNSDS

SEQ ID NO: 486339 - protein, 9 aa, Homo Sapiens
ASVSRQRNL

SEQ ID NO: 486340 - protein, 9 aa, Homo Sapiens
HEESGKVYA

SEQ ID NO: 486341 - protein, 9 aa, Homo Sapiens
SVSRQRNLF

SEQ ID NO: 486342 - protein, 9 aa, Homo Sapiens
EVLGWCLES

SEQ ID NO: 486343 - protein, 9 aa, Homo Sapiens
VALTTDHIE

SEQ ID NO: 486344 - protein, 9 aa, Homo Sapiens
GEVHCEGDA

SEQ ID NO: 486345 - protein, 9 aa, Homo Sapiens
HKGQCHTRQ

SEQ ID NO: 486346 - protein, 9 aa, Homo Sapiens
QIAEMSLYE

SEQ ID NO: 486347 - protein, 9 aa, Homo Sapiens
KVLHQAQTA

SEQ ID NO: 486348 - protein, 9 aa, Homo Sapiens
KTEGTESQS

SEQ ID NO: 486349 - protein, 9 aa, Homo Sapiens
RPSRRSRSQ

SEQ ID NO: 486350 - protein, 9 aa, Homo Sapiens
TVLRAFDSV

SEQ ID NO: 486351 - protein, 9 aa, Homo Sapiens
AGDSWSPDL

SEQ ID NO: 486352 - protein, 9 aa, Homo Sapiens
YVRLSCDTK

SEQ ID NO: 486353 - protein, 9 aa, Homo Sapiens
KICDGIFCT

SEQ ID NO: 486354 - protein, 9 aa, Homo Sapiens
KQEFKAKYP

SEQ ID NO: 486355 - protein, 9 aa, Homo Sapiens
PLKDHILPH

SEQ ID NO: 486356 - protein, 9 aa, Homo Sapiens
MDKLDQQIP

SEQ ID NO: 486357 - protein, 9 aa, Homo Sapiens
PPGAWHWEK

SEQ ID NO: 486358 - protein, 9 aa, Homo Sapiens
QASMEVLGW

SEQ ID NO: 486359 - protein, 9 aa, Homo Sapiens
DPSELLWPK

SEQ ID NO: 486360 - protein, 9 aa, Homo Sapiens
SISELQPKP

SEQ ID NO: 486361 - protein, 9 aa, Homo Sapiens
RKNFKGCRE

SEQ ID NO: 486362 - protein, 9 aa, Homo Sapiens
CEQYEKAFV

SEQ ID NO: 486363 - protein, 9 aa, Homo Sapiens
CSRLLKHKR

SEQ ID NO: 486364 - protein, 9 aa, Homo Sapiens
QQSVPTERI

SEQ ID NO: 486365 - protein, 9 aa, Homo Sapiens
DSWSPDLHP

SEQ ID NO: 486366 - protein, 9 aa, Homo Sapiens
NDNSTVRCF

SEQ ID NO: 486367 - protein, 9 aa, Homo Sapiens
RIFSSGLMV

SEQ ID NO: 486368 - protein, 9 aa, Homo Sapiens
FKEHCPMVF

SEQ ID NO: 486369 - protein, 9 aa, Homo Sapiens
KPRIFSSGL

SEQ ID NO: 486370 - protein, 9 aa, Homo Sapiens
TLSQGSCLY

SEQ ID NO: 486371 - protein, 9 aa, Homo Sapiens
EVRVACPGR

SEQ ID NO: 486372 - protein, 9 aa, Homo Sapiens
QIFIQHQKC

SEQ ID NO: 486373 - protein, 9 aa, Homo Sapiens
QQPICSASP

SEQ ID NO: 486374 - protein, 9 aa, Homo Sapiens
PGWESARHM

SEQ ID NO: 486375 - protein, 9 aa, Homo Sapiens
NTVHPELLS

SEQ ID NO: 486376 - protein, 9 aa, Homo Sapiens
FSLDRHTDH

SEQ ID NO: 486377 - protein, 9 aa, Homo Sapiens
GLSASDRYT

SEQ ID NO: 486378 - protein, 9 aa, Homo Sapiens
RFQAGKHNY

SEQ ID NO: 486379 - protein, 9 aa, Homo Sapiens
LIGNDARVC

SEQ ID NO: 486380 - protein, 9 aa, Homo Sapiens
DGAEMSQRM

SEQ ID NO: 486381 - protein, 9 aa, Homo Sapiens
MRMGDMGPC

SEQ ID NO: 486382 - protein, 9 aa, Homo Sapiens
SVHEESGKV

SEQ ID NO: 486383 - protein, 9 aa, Homo Sapiens
LEYMPTFIQ

SEQ ID NO: 486384 - protein, 9 aa, Homo Sapiens
MYSRTDQKD

SEQ ID NO: 486385 - protein, 9 aa, Homo Sapiens
DELTTDERL

SEQ ID NO: 486386 - protein, 9 aa, Homo Sapiens
AEATGGEHW

SEQ ID NO: 486387 - protein, 9 aa, Homo Sapiens
VKQLVESVF

SEQ ID NO: 486388 - protein, 9 aa, Homo Sapiens
NQQSQFSHH

SEQ ID NO: 486389 - protein, 9 aa, Homo Sapiens
AEGRSKALS

SEQ ID NO: 486390 - protein, 9 aa, Homo Sapiens
KRPFFPRFF

SEQ ID NO: 486391 - protein, 9 aa, Homo Sapiens
SAPGVSQIS

SEQ ID NO: 486392 - protein, 9 aa, Homo Sapiens
HGTNPNLKD

SEQ ID NO: 486393 - protein, 9 aa, Homo Sapiens
VLRAFDSVS

SEQ ID NO: 486394 - protein, 9 aa, Homo Sapiens
LRFQAGKHN

SEQ ID NO: 486395 - protein, 9 aa, Homo Sapiens
AGASHSQWE

SEQ ID NO: 486396 - protein, 9 aa, Homo Sapiens
EIFTLEYMP

SEQ ID NO: 486397 - protein, 9 aa, Homo Sapiens
EKSDPSELL

SEQ ID NO: 486398 - protein, 9 aa, Homo Sapiens
NEWLGSNTT

SEQ ID NO: 486399 - protein, 9 aa, Homo Sapiens
SKNYGSLLI

SEQ ID NO: 486400 - protein, 9 aa, Homo Sapiens
CRAQRVSSR

SEQ ID NO: 486401 - protein, 9 aa, Homo Sapiens
NNASETAWM

SEQ ID NO: 486402 - protein, 9 aa, Homo Sapiens
LEMKYMLQK

SEQ ID NO: 486403 - protein, 9 aa, Homo Sapiens
EGDAIQALV

SEQ ID NO: 486404 - protein, 9 aa, Homo Sapiens
KKICDGIFC

SEQ ID NO: 486405 - protein, 9 aa, Homo Sapiens
GIFCTPQYL

SEQ ID NO: 486406 - protein, 9 aa, Homo Sapiens
PAGASHSQW

SEQ ID NO: 486407 - protein, 9 aa, Homo Sapiens
CGADGFTYL

SEQ ID NO: 486408 - protein, 9 aa, Homo Sapiens
LMEMGFPRR

SEQ ID NO: 486409 - protein, 9 aa, Homo Sapiens
PCGQAGDSW

SEQ ID NO: 486410 - protein, 9 aa, Homo Sapiens
HPCVALTTD

SEQ ID NO: 486411 - protein, 9 aa, Homo Sapiens
PILVSTVAP

SEQ ID NO: 486412 - protein, 9 aa, Homo Sapiens
DLEMKYMLQ

SEQ ID NO: 486413 - protein, 9 aa, Homo Sapiens
AEMSLYERQ

SEQ ID NO: 486414 - protein, 9 aa, Homo Sapiens
DDGAEMSQR

SEQ ID NO: 486415 - protein, 9 aa, Homo Sapiens
GFAVQKDHP

SEQ ID NO: 486416 - protein, 9 aa, Homo Sapiens
VNGDDCMFS

SEQ ID NO: 486417 - protein, 9 aa, Homo Sapiens
KQLVESVFK

SEQ ID NO: 486418 - protein, 9 aa, Homo Sapiens
ALRYHFNAP

SEQ ID NO: 486419 - protein, 9 aa, Homo Sapiens
SRRSRSQRD

SEQ ID NO: 486420 - protein, 9 aa, Homo Sapiens
TNTYPDNRS

SEQ ID NO: 486421 - protein, 9 aa, Homo Sapiens
EIQLLREAL

SEQ ID NO: 486422 - protein, 9 aa, Homo Sapiens
KPSKHKGQC

SEQ ID NO: 486423 - protein, 9 aa, Homo Sapiens
NSDEQNDTQ

SEQ ID NO: 486424 - protein, 9 aa, Homo Sapiens
APGVSQIST

SEQ ID NO: 486425 - protein, 9 aa, Homo Sapiens
AQRVSSRRL

SEQ ID NO: 486426 - protein, 9 aa, Homo Sapiens
QKEIRRKFG

SEQ ID NO: 486427 - protein, 9 aa, Homo Sapiens
RKFGSFIWE

SEQ ID NO: 486428 - protein, 9 aa, Homo Sapiens
SRTDQKDLA

SEQ ID NO: 486429 - protein, 9 aa, Homo Sapiens
KEKCGMGPS

SEQ ID NO: 486430 - protein, 9 aa, Homo Sapiens
DERLRSLAQ

SEQ ID NO: 486431 - protein, 9 aa, Homo Sapiens
ANRGLSQRR

SEQ ID NO: 486432 - protein, 9 aa, Homo Sapiens
KTKCLPLHD

SEQ ID NO: 486433 - protein, 9 aa, Homo Sapiens
GFKAERDVE

SEQ ID NO: 486434 - protein, 9 aa, Homo Sapiens
KKPSKHKGQ

SEQ ID NO: 486435 - protein, 9 aa, Homo Sapiens
AIQLIINFS

SEQ ID NO: 486436 - protein, 9 aa, Homo Sapiens
DGFTYLSAC

SEQ ID NO: 486437 - protein, 9 aa, Homo Sapiens
RQNSEIWSS

SEQ ID NO: 486438 - protein, 9 aa, Homo Sapiens
TAWMIGLPH

SEQ ID NO: 486439 - protein, 9 aa, Homo Sapiens
GTESQSSEN

SEQ ID NO: 486440 - protein, 9 aa, Homo Sapiens
RFLQKKRHG

SEQ ID NO: 486441 - protein, 9 aa, Homo Sapiens
GSVDERKDL

SEQ ID NO: 486442 - protein, 9 aa, Homo Sapiens
CTPQYLNPS

SEQ ID NO: 486443 - protein, 9 aa, Homo Sapiens
GHRLRVHNR

SEQ ID NO: 486444 - protein, 9 aa, Homo Sapiens
LKLEVRKKE

SEQ ID NO: 486445 - protein, 9 aa, Homo Sapiens
LDLDGADPD

SEQ ID NO: 486446 - protein, 9 aa, Homo Sapiens
PRGHQERDG

SEQ ID NO: 486447 - protein, 9 aa, Homo Sapiens
ALLYNVTFL

SEQ ID NO: 486448 - protein, 9 aa, Homo Sapiens
SLASVSRQR

SEQ ID NO: 486449 - protein, 9 aa, Homo Sapiens
APSTQKKFA

SEQ ID NO: 486450 - protein, 9 aa, Homo Sapiens
VLHQAQTAA

SEQ ID NO: 486451 - protein, 9 aa, Homo Sapiens
KSFKTKCLP

SEQ ID NO: 486452 - protein, 9 aa, Homo Sapiens
MEMGFPRRN

SEQ ID NO: 486453 - protein, 9 aa, Homo Sapiens
SRQRNLFGR

SEQ ID NO: 486454 - protein, 9 aa, Homo Sapiens
IQHQKCNIS

SEQ ID NO: 486455 - protein, 9 aa, Homo Sapiens
STQKKFALS

SEQ ID NO: 486456 - protein, 9 aa, Homo Sapiens
CLYLKLTFD

SEQ ID NO: 486457 - protein, 9 aa, Homo Sapiens
DKLDQQIPP

SEQ ID NO: 486458 - protein, 9 aa, Homo Sapiens
GPCGAINMG

SEQ ID NO: 486459 - protein, 9 aa, Homo Sapiens
LLISGSTPK

SEQ ID NO: 486460 - protein, 9 aa, Homo Sapiens
AFDSVSMAH

SEQ ID NO: 486461 - protein, 9 aa, Homo Sapiens
FKGCRESIN

SEQ ID NO: 486462 - protein, 9 aa, Homo Sapiens
PASQPILVS

SEQ ID NO: 486463 - protein, 9 aa, Homo Sapiens
EQYNSDEQN

SEQ ID NO: 486464 - protein, 9 aa, Homo Sapiens
EKCGCTRCS

SEQ ID NO: 486465 - protein, 9 aa, Homo Sapiens
QSQFSHHRI

SEQ ID NO: 486466 - protein, 9 aa, Homo Sapiens
DLQKPRIFS

SEQ ID NO: 486467 - protein, 9 aa, Homo Sapiens
TAWMVTDVM

SEQ ID NO: 486468 - protein, 9 aa, Homo Sapiens
RQRNLFGRQ

SEQ ID NO: 486469 - protein, 9 aa, Homo Sapiens
RSDKLNNGE

SEQ ID NO: 486470 - protein, 9 aa, Homo Sapiens
DHDRIFNIH

SEQ ID NO: 486471 - protein, 9 aa, Homo Sapiens
IRRKFGSFI

SEQ ID NO: 486472 - protein, 9 aa, Homo Sapiens
WCQLQSAHL

SEQ ID NO: 486473 - protein, 9 aa, Homo Sapiens
LLLDLDGAD

SEQ ID NO: 486474 - protein, 9 aa, Homo Sapiens
FIMVVVHER

SEQ ID NO: 486475 - protein, 9 aa, Homo Sapiens
TIHRLSAKS

SEQ ID NO: 486476 - protein, 9 aa, Homo Sapiens
LQDLEMKYM

SEQ ID NO: 486477 - protein, 9 aa, Homo Sapiens
KQSAEGRSK

SEQ ID NO: 486478 - protein, 9 aa, Homo Sapiens
SSYVSVHEE

SEQ ID NO: 486479 - protein, 9 aa, Homo Sapiens
VSSRRLGRR

SEQ ID NO: 486480 - protein, 9 aa, Homo Sapiens
YNSDEQNDT

SEQ ID NO: 486481 - protein, 9 aa, Homo Sapiens
QIIGNMYSR

SEQ ID NO: 486482 - protein, 9 aa, Homo Sapiens
LPHTTICPV

SEQ ID NO: 486483 - protein, 9 aa, Homo Sapiens
PAQFQQPIC

SEQ ID NO: 486484 - protein, 9 aa, Homo Sapiens
KYVRLSCDT

SEQ ID NO: 486485 - protein, 9 aa, Homo Sapiens
FTVLRAFDS

SEQ ID NO: 486486 - protein, 9 aa, Homo Sapiens
SRLKLEVRK

SEQ ID NO: 486487 - protein, 9 aa, Homo Sapiens
KLNNGESDS

SEQ ID NO: 486488 - protein, 9 aa, Homo Sapiens
HRLRVHNRN

SEQ ID NO: 486489 - protein, 9 aa, Homo Sapiens
ETAWMIGLP

SEQ ID NO: 486490 - protein, 9 aa, Homo Sapiens
LLYNVTFLL

SEQ ID NO: 486491 - protein, 9 aa, Homo Sapiens
GEISSLAHH

SEQ ID NO: 486492 - protein, 9 aa, Homo Sapiens
KKKPSKHKG

SEQ ID NO: 486493 - protein, 9 aa, Homo Sapiens
MLQKTDRRI

SEQ ID NO: 486494 - protein, 9 aa, Homo Sapiens
SQRDRGRRR

SEQ ID NO: 486495 - protein, 9 aa, Homo Sapiens
VDERKDLLP

SEQ ID NO: 486496 - protein, 9 aa, Homo Sapiens
VEAQPGGGA

SEQ ID NO: 486497 - protein, 9 aa, Homo Sapiens
DKAPSTQKK

SEQ ID NO: 486498 - protein, 9 aa, Homo Sapiens
ELPALRYHF

SEQ ID NO: 486499 - protein, 9 aa, Homo Sapiens
CVALTTDHI

SEQ ID NO: 486500 - protein, 9 aa, Homo Sapiens
VRGANRGLS

SEQ ID NO: 486501 - protein, 9 aa, Homo Sapiens
SRKNFKGCR

SEQ ID NO: 486502 - protein, 9 aa, Homo Sapiens
LEQRKEKEG

SEQ ID NO: 486503 - protein, 9 aa, Homo Sapiens
DMGPCGAIN

SEQ ID NO: 486504 - protein, 9 aa, Homo Sapiens
HMQQKMKET

SEQ ID NO: 486505 - protein, 9 aa, Homo Sapiens
ERLRSLAQR

SEQ ID NO: 486506 - protein, 9 aa, Homo Sapiens
IMVVVHERV

SEQ ID NO: 486507 - protein, 9 aa, Homo Sapiens
QDLEMKYML

SEQ ID NO: 486508 - protein, 9 aa, Homo Sapiens
HWEKCGCTR

SEQ ID NO: 486509 - protein, 9 aa, Homo Sapiens
EVRKKETER

SEQ ID NO: 486510 - protein, 9 aa, Homo Sapiens
LFIIHQEVS

SEQ ID NO: 486511 - protein, 9 aa, Homo Sapiens
IMDKLDQQI

SEQ ID NO: 486512 - protein, 9 aa, Homo Sapiens
TQQSVPTER

SEQ ID NO: 486513 - protein, 9 aa, Homo Sapiens
LGSVDERKD

SEQ ID NO: 486514 - protein, 9 aa, Homo Sapiens
RKHRNQRVP

SEQ ID NO: 486515 - protein, 9 aa, Homo Sapiens
AWMIGLPHC

SEQ ID NO: 486516 - protein, 9 aa, Homo Sapiens
HTTICPVVL

SEQ ID NO: 486517 - protein, 9 aa, Homo Sapiens
SFKTKCLPL

SEQ ID NO: 486518 - protein, 9 aa, Homo Sapiens
ISELQPKPY

SEQ ID NO: 486519 - protein, 9 aa, Homo Sapiens
HVKQLVESV

SEQ ID NO: 486520 - protein, 9 aa, Homo Sapiens
VRKKETERK

SEQ ID NO: 486521 - protein, 9 aa, Homo Sapiens
LGSNTTTFF

SEQ ID NO: 486522 - protein, 9 aa, Homo Sapiens
WHWEKCGCT

SEQ ID NO: 486523 - protein, 9 aa, Homo Sapiens
PCVALTTDH

SEQ ID NO: 486524 - protein, 9 aa, Homo Sapiens
EGVGKSAMT

SEQ ID NO: 486525 - protein, 9 aa, Homo Sapiens
RESINYNGV

SEQ ID NO: 486526 - protein, 9 aa, Homo Sapiens
RPIDCSSRM

SEQ ID NO: 486527 - protein, 9 aa, Homo Sapiens
WGPGSDDCQ

SEQ ID NO: 486528 - protein, 9 aa, Homo Sapiens
GDMGPCGAI

SEQ ID NO: 486529 - protein, 9 aa, Homo Sapiens
QEFKAKYPN

SEQ ID NO: 486530 - protein, 9 aa, Homo Sapiens
SDKLNNGES

SEQ ID NO: 486531 - protein, 9 aa, Homo Sapiens
TTDERLRSL

SEQ ID NO: 486532 - protein, 9 aa, Homo Sapiens
FNQQSQFSH

SEQ ID NO: 486533 - protein, 9 aa, Homo Sapiens
LRDMKEELE

SEQ ID NO: 486534 - protein, 9 aa, Homo Sapiens
ARQNSEIWS

SEQ ID NO: 486535 - protein, 9 aa, Homo Sapiens
FKAKYPNSP

SEQ ID NO: 486536 - protein, 9 aa, Homo Sapiens
LSASDRYTV

SEQ ID NO: 486537 - protein, 9 aa, Homo Sapiens
VTVFGHRLR

SEQ ID NO: 486538 - protein, 9 aa, Homo Sapiens
WEKCGCTRC

SEQ ID NO: 486539 - protein, 9 aa, Homo Sapiens
RLQTGDIGI

SEQ ID NO: 486540 - protein, 9 aa, Homo Sapiens
KGVGGIIFF

SEQ ID NO: 486541 - protein, 9 aa, Homo Sapiens
LAGTKRKFT

SEQ ID NO: 486542 - protein, 9 aa, Homo Sapiens
KTLSQGSCL

SEQ ID NO: 486543 - protein, 9 aa, Homo Sapiens
PELLSESSG

SEQ ID NO: 486544 - protein, 9 aa, Homo Sapiens
CGCTRCSVC

SEQ ID NO: 486545 - protein, 9 aa, Homo Sapiens
WMVTDVMLQ

SEQ ID NO: 486546 - protein, 9 aa, Homo Sapiens
LASVSRQRN

SEQ ID NO: 486547 - protein, 9 aa, Homo Sapiens
GRHVKQLVE

SEQ ID NO: 486548 - protein, 9 aa, Homo Sapiens
ISRLQTGDI

SEQ ID NO: 486549 - protein, 9 aa, Homo Sapiens
KSDPSELLW

SEQ ID NO: 486550 - protein, 9 aa, Homo Sapiens
FGSFIWEQD

SEQ ID NO: 486551 - protein, 9 aa, Homo Sapiens
VRPSRRSRS

SEQ ID NO: 486552 - protein, 9 aa, Homo Sapiens
GAWHWEKCG

SEQ ID NO: 486553 - protein, 9 aa, Homo Sapiens
EIRRKFGSF

SEQ ID NO: 486554 - protein, 9 aa, Homo Sapiens
LTTDERLRS

SEQ ID NO: 486555 - protein, 9 aa, Homo Sapiens
GVNMGFGEI

SEQ ID NO: 486556 - protein, 9 aa, Homo Sapiens
GVSQISTTS

SEQ ID NO: 486557 - protein, 9 aa, Homo Sapiens
FTLEYMPTF

SEQ ID NO: 486558 - protein, 9 aa, Homo Sapiens
SSRRLGRRG

SEQ ID NO: 486559 - protein, 9 aa, Homo Sapiens
DFSSPQLTD

SEQ ID NO: 486560 - protein, 9 aa, Homo Sapiens
KFKSFKTKC

SEQ ID NO: 486561 - protein, 9 aa, Homo Sapiens
NVSILTVCD

SEQ ID NO: 486562 - protein, 9 aa, Homo Sapiens
QSVPTERIP

SEQ ID NO: 486563 - protein, 9 aa, Homo Sapiens
EFEIQLLRE

SEQ ID NO: 486564 - protein, 9 aa, Homo Sapiens
SGSEKKKKV

SEQ ID NO: 486565 - protein, 9 aa, Homo Sapiens
TERIPNMYY

SEQ ID NO: 486566 - protein, 9 aa, Homo Sapiens
SNSDSSDSS

SEQ ID NO: 486567 - protein, 9 aa, Homo Sapiens
GPGSDDCQT

SEQ ID NO: 486568 - protein, 9 aa, Homo Sapiens
RKIESISEL

SEQ ID NO: 486569 - protein, 9 aa, Homo Sapiens
RCWGPGSDD

SEQ ID NO: 486570 - protein, 9 aa, Homo Sapiens
SFEVRVACP

SEQ ID NO: 486571 - protein, 9 aa, Homo Sapiens
PSTQKKFAL

SEQ ID NO: 486572 - protein, 9 aa, Homo Sapiens
KHKGQCHTR

SEQ ID NO: 486573 - protein, 9 aa, Homo Sapiens
RTDQKDLAP

SEQ ID NO: 486574 - protein, 9 aa, Homo Sapiens
IDLNEWLGS

SEQ ID NO: 486575 - protein, 9 aa, Homo Sapiens
QERKIESIS

SEQ ID NO: 486576 - protein, 9 aa, Homo Sapiens
FKFKEHCPM

SEQ ID NO: 486577 - protein, 9 aa, Homo Sapiens
HSQWEGFAV

SEQ ID NO: 486578 - protein, 9 aa, Homo Sapiens
VQLMEMGFP

SEQ ID NO: 486579 - protein, 9 aa, Homo Sapiens
DVTDEDDGA

SEQ ID NO: 486580 - protein, 9 aa, Homo Sapiens
RLSCDTKPE

SEQ ID NO: 486581 - protein, 9 aa, Homo Sapiens
SDDCQTLTK

SEQ ID NO: 486582 - protein, 9 aa, Homo Sapiens
YPGEETVHI

SEQ ID NO: 486583 - protein, 9 aa, Homo Sapiens
CDTKPEVIL

SEQ ID NO: 486584 - protein, 9 aa, Homo Sapiens
SWSPDLHPV

SEQ ID NO: 486585 - protein, 9 aa, Homo Sapiens
GSQRFLQKK

SEQ ID NO: 486586 - protein, 9 aa, Homo Sapiens
PDTENEQYN

SEQ ID NO: 486587 - protein, 9 aa, Homo Sapiens
SKHKIGNEG

SEQ ID NO: 486588 - protein, 9 aa, Homo Sapiens
LKTRGIFQT

SEQ ID NO: 486589 - protein, 9 aa, Homo Sapiens
LKVNMYSSN

SEQ ID NO: 486590 - protein, 9 aa, Homo Sapiens
YLLGLVVMH

SEQ ID NO: 486591 - protein, 9 aa, Homo Sapiens
DFMKAALDI

SEQ ID NO: 486592 - protein, 9 aa, Homo Sapiens
ASEKDIVHC

SEQ ID NO: 486593 - protein, 9 aa, Homo Sapiens
QEQTTKDSV

SEQ ID NO: 486594 - protein, 9 aa, Homo Sapiens
LWLLNDFKT

SEQ ID NO: 486595 - protein, 9 aa, Homo Sapiens
QKCMAMCMD

SEQ ID NO: 486596 - protein, 9 aa, Homo Sapiens
FEISKVSLV

SEQ ID NO: 486597 - protein, 9 aa, Homo Sapiens
QCLNTSSKK

SEQ ID NO: 486598 - protein, 9 aa, Homo Sapiens
LYVPIITLA

SEQ ID NO: 486599 - protein, 9 aa, Homo Sapiens
VTFLLLAGW

SEQ ID NO: 486600 - protein, 9 aa, Homo Sapiens
GECGKGFLQ

SEQ ID NO: 486601 - protein, 9 aa, Homo Sapiens
AIDSKFEGL

SEQ ID NO: 486602 - protein, 9 aa, Homo Sapiens
SGKHKAFST

SEQ ID NO: 486603 - protein, 9 aa, Homo Sapiens
LEETPKEDD

SEQ ID NO: 486604 - protein, 9 aa, Homo Sapiens
KDPTKVMVP

SEQ ID NO: 486605 - protein, 9 aa, Homo Sapiens
SPFQVLVKK

SEQ ID NO: 486606 - protein, 9 aa, Homo Sapiens
SPESPGAEG

SEQ ID NO: 486607 - protein, 9 aa, Homo Sapiens
SELQTYVDL

SEQ ID NO: 486608 - protein, 9 aa, Homo Sapiens
NFRSNRPQM

SEQ ID NO: 486609 - protein, 9 aa, Homo Sapiens
WNLPPPAPT

SEQ ID NO: 486610 - protein, 9 aa, Homo Sapiens
IAVLDQESP

SEQ ID NO: 486611 - protein, 9 aa, Homo Sapiens
GRQRERFHV

SEQ ID NO: 486612 - protein, 9 aa, Homo Sapiens
SQEEDVTEE

SEQ ID NO: 486613 - protein, 9 aa, Homo Sapiens
FLQHSNLVT

SEQ ID NO: 486614 - protein, 9 aa, Homo Sapiens
EFEAYKHTV

SEQ ID NO: 486615 - protein, 9 aa, Homo Sapiens
LAYAKVWHL

SEQ ID NO: 486616 - protein, 9 aa, Homo Sapiens
AKNEPPVPL

SEQ ID NO: 486617 - protein, 9 aa, Homo Sapiens
IVQACHDFM

SEQ ID NO: 486618 - protein, 9 aa, Homo Sapiens
FFWLPCPMS

SEQ ID NO: 486619 - protein, 9 aa, Homo Sapiens
QHGPVSEAK

SEQ ID NO: 486620 - protein, 9 aa, Homo Sapiens
LDVVEVDPS

SEQ ID NO: 486621 - protein, 9 aa, Homo Sapiens
PRVSRAENY

SEQ ID NO: 486622 - protein, 9 aa, Homo Sapiens
KEKVKPGPP

SEQ ID NO: 486623 - protein, 9 aa, Homo Sapiens
LEGIRMCRQ

SEQ ID NO: 486624 - protein, 9 aa, Homo Sapiens
FSPQGSIQV

SEQ ID NO: 486625 - protein, 9 aa, Homo Sapiens
ERKLEQANN

SEQ ID NO: 486626 - protein, 9 aa, Homo Sapiens
YLDPNYVLS

SEQ ID NO: 486627 - protein, 9 aa, Homo Sapiens
QDSSSQEED

SEQ ID NO: 486628 - protein, 9 aa, Homo Sapiens
EGRQRERFH

SEQ ID NO: 486629 - protein, 9 aa, Homo Sapiens
MMSNSSSEM

SEQ ID NO: 486630 - protein, 9 aa, Homo Sapiens
VRVWNEDDD

SEQ ID NO: 486631 - protein, 9 aa, Homo Sapiens
KDNNEDKKI

SEQ ID NO: 486632 - protein, 9 aa, Homo Sapiens
SCFVTFLLL

SEQ ID NO: 486633 - protein, 9 aa, Homo Sapiens
RPVDLEMTP

SEQ ID NO: 486634 - protein, 9 aa, Homo Sapiens
MGKSNSSVV

SEQ ID NO: 486635 - protein, 9 aa, Homo Sapiens
PPKTRHMSA

SEQ ID NO: 486636 - protein, 9 aa, Homo Sapiens
PTPPGEKKA

SEQ ID NO: 486637 - protein, 9 aa, Homo Sapiens
EALVHVLVL

SEQ ID NO: 486638 - protein, 9 aa, Homo Sapiens
LSPQAELHF

SEQ ID NO: 486639 - protein, 9 aa, Homo Sapiens
DNKSLKTHS

SEQ ID NO: 486640 - protein, 9 aa, Homo Sapiens
VNVIGLAND

SEQ ID NO: 486641 - protein, 9 aa, Homo Sapiens
LLIMMFKMI

SEQ ID NO: 486642 - protein, 9 aa, Homo Sapiens
ATCNTSGSQ

SEQ ID NO: 486643 - protein, 9 aa, Homo Sapiens
SQDKILTNK

SEQ ID NO: 486644 - protein, 9 aa, Homo Sapiens
SGKRSHACG

SEQ ID NO: 486645 - protein, 9 aa, Homo Sapiens
KRSDRIYWY

SEQ ID NO: 486646 - protein, 9 aa, Homo Sapiens
HYGSASGLN

SEQ ID NO: 486647 - protein, 9 aa, Homo Sapiens
WSYEEDSQC

SEQ ID NO: 486648 - protein, 9 aa, Homo Sapiens
PLQDQLLPS

SEQ ID NO: 486649 - protein, 9 aa, Homo Sapiens
ADIATSEVP

SEQ ID NO: 486650 - protein, 9 aa, Homo Sapiens
VQANKHATS

SEQ ID NO: 486651 - protein, 9 aa, Homo Sapiens
ENEKEKPNS

SEQ ID NO: 486652 - protein, 9 aa, Homo Sapiens
VTSLSLVST

SEQ ID NO: 486653 - protein, 9 aa, Homo Sapiens
VYFSESGSL

SEQ ID NO: 486654 - protein, 9 aa, Homo Sapiens
GVNSLSCLC

SEQ ID NO: 486655 - protein, 9 aa, Homo Sapiens
ALQNKVQAL

SEQ ID NO: 486656 - protein, 9 aa, Homo Sapiens
PGAGESSEN

SEQ ID NO: 486657 - protein, 9 aa, Homo Sapiens
AVTARTSLG

SEQ ID NO: 486658 - protein, 9 aa, Homo Sapiens
SPMDSSYAK

SEQ ID NO: 486659 - protein, 9 aa, Homo Sapiens
CGKGFLQHS

SEQ ID NO: 486660 - protein, 9 aa, Homo Sapiens
ALKFLKGRK

SEQ ID NO: 486661 - protein, 9 aa, Homo Sapiens
KEKCKNAAK

SEQ ID NO: 486662 - protein, 9 aa, Homo Sapiens
FQMARTKKA

SEQ ID NO: 486663 - protein, 9 aa, Homo Sapiens
LQDSGRVDR

SEQ ID NO: 486664 - protein, 9 aa, Homo Sapiens
NYETLVCLK

SEQ ID NO: 486665 - protein, 9 aa, Homo Sapiens
NVIGLANDS

SEQ ID NO: 486666 - protein, 9 aa, Homo Sapiens
SPQAELHFW

SEQ ID NO: 486667 - protein, 9 aa, Homo Sapiens
PECFVVGKG

SEQ ID NO: 486668 - protein, 9 aa, Homo Sapiens
GSGDSGKRS

SEQ ID NO: 486669 - protein, 9 aa, Homo Sapiens
KHKAFSTCV

SEQ ID NO: 486670 - protein, 9 aa, Homo Sapiens
VLGRWDLFR

SEQ ID NO: 486671 - protein, 9 aa, Homo Sapiens
KRLREAGVA

SEQ ID NO: 486672 - protein, 9 aa, Homo Sapiens
HSGGDRTGT

SEQ ID NO: 486673 - protein, 9 aa, Homo Sapiens
VEVDPSTHC

SEQ ID NO: 486674 - protein, 9 aa, Homo Sapiens
SNYETLVCL

SEQ ID NO: 486675 - protein, 9 aa, Homo Sapiens
AKYKDGNEV

SEQ ID NO: 486676 - protein, 9 aa, Homo Sapiens
CAFSPQGSI

SEQ ID NO: 486677 - protein, 9 aa, Homo Sapiens
TSKDSEKDE

SEQ ID NO: 486678 - protein, 9 aa, Homo Sapiens
NTSGGLSRL

SEQ ID NO: 486679 - protein, 9 aa, Homo Sapiens
FLKNDDQHN

SEQ ID NO: 486680 - protein, 9 aa, Homo Sapiens
IKDALDSGK

SEQ ID NO: 486681 - protein, 9 aa, Homo Sapiens
YSLICHDIC

SEQ ID NO: 486682 - protein, 9 aa, Homo Sapiens
KVQICRYKD

SEQ ID NO: 486683 - protein, 9 aa, Homo Sapiens
MEATCNTSG

SEQ ID NO: 486684 - protein, 9 aa, Homo Sapiens
DGWKKVYNS

SEQ ID NO: 486685 - protein, 9 aa, Homo Sapiens
QGPTLPPTP

SEQ ID NO: 486686 - protein, 9 aa, Homo Sapiens
LPFIRLDFS

SEQ ID NO: 486687 - protein, 9 aa, Homo Sapiens
EKQLEATAR

SEQ ID NO: 486688 - protein, 9 aa, Homo Sapiens
DPLDLGYKV

SEQ ID NO: 486689 - protein, 9 aa, Homo Sapiens
SVNLLSPHS

SEQ ID NO: 486690 - protein, 9 aa, Homo Sapiens
GDSEVSALA

SEQ ID NO: 486691 - protein, 9 aa, Homo Sapiens
FVVGKGPPK

SEQ ID NO: 486692 - protein, 9 aa, Homo Sapiens
LFVAMLATI

SEQ ID NO: 486693 - protein, 9 aa, Homo Sapiens
CNHEHQNMQ

SEQ ID NO: 486694 - protein, 9 aa, Homo Sapiens
IDMSMKHRY

SEQ ID NO: 486695 - protein, 9 aa, Homo Sapiens
VSLVSALPH

SEQ ID NO: 486696 - protein, 9 aa, Homo Sapiens
VGSSKTRGE

SEQ ID NO: 486697 - protein, 9 aa, Homo Sapiens
QDRGASPMD

SEQ ID NO: 486698 - protein, 9 aa, Homo Sapiens
PKRKSIVPA

SEQ ID NO: 486699 - protein, 9 aa, Homo Sapiens
EPQEEVGKE

SEQ ID NO: 486700 - protein, 9 aa, Homo Sapiens
VTVTTISGL

SEQ ID NO: 486701 - protein, 9 aa, Homo Sapiens
FLLLAGWIL

SEQ ID NO: 486702 - protein, 9 aa, Homo Sapiens
SEMDVQEPN

SEQ ID NO: 486703 - protein, 9 aa, Homo Sapiens
GAAEEDSSV

SEQ ID NO: 486704 - protein, 9 aa, Homo Sapiens
GNTTFLEQS

SEQ ID NO: 486705 - protein, 9 aa, Homo Sapiens
ELHFWMMRR

SEQ ID NO: 486706 - protein, 9 aa, Homo Sapiens
LLAYAKVWH

SEQ ID NO: 486707 - protein, 9 aa, Homo Sapiens
NRPVEILIH

SEQ ID NO: 486708 - protein, 9 aa, Homo Sapiens
DQAHHLPIQ

SEQ ID NO: 486709 - protein, 9 aa, Homo Sapiens
AHSLLASTT

SEQ ID NO: 486710 - protein, 9 aa, Homo Sapiens
LKLLELLFD

SEQ ID NO: 486711 - protein, 9 aa, Homo Sapiens
SWQSVLLSH

SEQ ID NO: 486712 - protein, 9 aa, Homo Sapiens
KTRGERVID

SEQ ID NO: 486713 - protein, 9 aa, Homo Sapiens
RTNNLNVET

SEQ ID NO: 486714 - protein, 9 aa, Homo Sapiens
SRCRVRPAC

SEQ ID NO: 486715 - protein, 9 aa, Homo Sapiens
PASPCGEPQ

SEQ ID NO: 486716 - protein, 9 aa, Homo Sapiens
SFPQQLCKT

SEQ ID NO: 486717 - protein, 9 aa, Homo Sapiens
SGLDLSGAR

SEQ ID NO: 486718 - protein, 9 aa, Homo Sapiens
KIPHQGPTL

SEQ ID NO: 486719 - protein, 9 aa, Homo Sapiens
PYPVQMKSS

SEQ ID NO: 486720 - protein, 9 aa, Homo Sapiens
KVAATKDDK

SEQ ID NO: 486721 - protein, 9 aa, Homo Sapiens
EAKLERRWE

SEQ ID NO: 486722 - protein, 9 aa, Homo Sapiens
LALANLGRA

SEQ ID NO: 486723 - protein, 9 aa, Homo Sapiens
FQNIACLCS

SEQ ID NO: 486724 - protein, 9 aa, Homo Sapiens
ANQVLSCNF

SEQ ID NO: 486725 - protein, 9 aa, Homo Sapiens
QDQTYIPPG

SEQ ID NO: 486726 - protein, 9 aa, Homo Sapiens
LAELPFIRL

SEQ ID NO: 486727 - protein, 9 aa, Homo Sapiens
ENLLDSDHQ

SEQ ID NO: 486728 - protein, 9 aa, Homo Sapiens
VAILTRNIV

SEQ ID NO: 486729 - protein, 9 aa, Homo Sapiens
VRLQGRMRG

SEQ ID NO: 486730 - protein, 9 aa, Homo Sapiens
DGNEVWLYA

SEQ ID NO: 486731 - protein, 9 aa, Homo Sapiens
AFQQLVYFS

SEQ ID NO: 486732 - protein, 9 aa, Homo Sapiens
DCMNGSIFQ

SEQ ID NO: 486733 - protein, 9 aa, Homo Sapiens
FTASVCLIF

SEQ ID NO: 486734 - protein, 9 aa, Homo Sapiens
SDNKDDDIH

SEQ ID NO: 486735 - protein, 9 aa, Homo Sapiens
MLAWINESV

SEQ ID NO: 486736 - protein, 9 aa, Homo Sapiens
GLALANLGR

SEQ ID NO: 486737 - protein, 9 aa, Homo Sapiens
TQAIKDALD

SEQ ID NO: 486738 - protein, 9 aa, Homo Sapiens
HDFMKAALD

SEQ ID NO: 486739 - protein, 9 aa, Homo Sapiens
NSLSCLCRP

SEQ ID NO: 486740 - protein, 9 aa, Homo Sapiens
SEVSALAAS

SEQ ID NO: 486741 - protein, 9 aa, Homo Sapiens
DDTITMQLM

SEQ ID NO: 486742 - protein, 9 aa, Homo Sapiens
ESGIVQSKL

SEQ ID NO: 486743 - protein, 9 aa, Homo Sapiens
CCTRDPGVR

SEQ ID NO: 486744 - protein, 9 aa, Homo Sapiens
VKKDARRTR

SEQ ID NO: 486745 - protein, 9 aa, Homo Sapiens
GPEGEKRRR

SEQ ID NO: 486746 - protein, 9 aa, Homo Sapiens
HTVEDMQLC

SEQ ID NO: 486747 - protein, 9 aa, Homo Sapiens
EEDSSVSAP

SEQ ID NO: 486748 - protein, 9 aa, Homo Sapiens
KRRCSVKQK

SEQ ID NO: 486749 - protein, 9 aa, Homo Sapiens
TVTVTTISG

SEQ ID NO: 486750 - protein, 9 aa, Homo Sapiens
AGEKGPFGE

SEQ ID NO: 486751 - protein, 9 aa, Homo Sapiens
KHTVEDMQL

SEQ ID NO: 486752 - protein, 9 aa, Homo Sapiens
LKEKSKISK

SEQ ID NO: 486753 - protein, 9 aa, Homo Sapiens
LCSNAMKHL

SEQ ID NO: 486754 - protein, 9 aa, Homo Sapiens
ATRVGAFLK

SEQ ID NO: 486755 - protein, 9 aa, Homo Sapiens
LGYKVQICR

SEQ ID NO: 486756 - protein, 9 aa, Homo Sapiens
STPGLGHAP

SEQ ID NO: 486757 - protein, 9 aa, Homo Sapiens
LDNSEQKCM

SEQ ID NO: 486758 - protein, 9 aa, Homo Sapiens
SHELQDNFR

SEQ ID NO: 486759 - protein, 9 aa, Homo Sapiens
TFPNFLLVW

SEQ ID NO: 486760 - protein, 9 aa, Homo Sapiens
RLQGRMRGG

SEQ ID NO: 486761 - protein, 9 aa, Homo Sapiens
ENIEKSIYN

SEQ ID NO: 486762 - protein, 9 aa, Homo Sapiens
GVDMRAEVA

SEQ ID NO: 486763 - protein, 9 aa, Homo Sapiens
HFWMMRREN

SEQ ID NO: 486764 - protein, 9 aa, Homo Sapiens
QHSCFSLFS

SEQ ID NO: 486765 - protein, 9 aa, Homo Sapiens
YSLTVQAAD

SEQ ID NO: 486766 - protein, 9 aa, Homo Sapiens
VKKIAMQEI

SEQ ID NO: 486767 - protein, 9 aa, Homo Sapiens
DNKDDDIHI

SEQ ID NO: 486768 - protein, 9 aa, Homo Sapiens
QNIACLCSN

SEQ ID NO: 486769 - protein, 9 aa, Homo Sapiens
LFSGTNVTA

SEQ ID NO: 486770 - protein, 9 aa, Homo Sapiens
FYETEGFES

SEQ ID NO: 486771 - protein, 9 aa, Homo Sapiens
YFSAILLID

SEQ ID NO: 486772 - protein, 9 aa, Homo Sapiens
DIDYIASTN

SEQ ID NO: 486773 - protein, 9 aa, Homo Sapiens
RRLANFTSL

SEQ ID NO: 486774 - protein, 9 aa, Homo Sapiens
PFVKGLQNR

SEQ ID NO: 486775 - protein, 9 aa, Homo Sapiens
KEKVPKEKV

SEQ ID NO: 486776 - protein, 9 aa, Homo Sapiens
EIRDHCAKR

SEQ ID NO: 486777 - protein, 9 aa, Homo Sapiens
NGVKIKRSD

SEQ ID NO: 486778 - protein, 9 aa, Homo Sapiens
NKIKTESGR

SEQ ID NO: 486779 - protein, 9 aa, Homo Sapiens
IPLCDAKEE

SEQ ID NO: 486780 - protein, 9 aa, Homo Sapiens
YKDGEAFKY

SEQ ID NO: 486781 - protein, 9 aa, Homo Sapiens
ENESQSSEP

SEQ ID NO: 486782 - protein, 9 aa, Homo Sapiens
GGETCKQGC

SEQ ID NO: 486783 - protein, 9 aa, Homo Sapiens
NDSVRSLKL

SEQ ID NO: 486784 - protein, 9 aa, Homo Sapiens
GKRSHACGY

SEQ ID NO: 486785 - protein, 9 aa, Homo Sapiens
RFEVRASEN

SEQ ID NO: 486786 - protein, 9 aa, Homo Sapiens
TPGLGHAPR

SEQ ID NO: 486787 - protein, 9 aa, Homo Sapiens
ANAGCYTCQ

SEQ ID NO: 486788 - protein, 9 aa, Homo Sapiens
DEMDPEIEQ

SEQ ID NO: 486789 - protein, 9 aa, Homo Sapiens
ENGVKWRQL

SEQ ID NO: 486790 - protein, 9 aa, Homo Sapiens
PQCFILSGQ

SEQ ID NO: 486791 - protein, 9 aa, Homo Sapiens
IATSEVPGS

SEQ ID NO: 486792 - protein, 9 aa, Homo Sapiens
WPSSEKIAA

SEQ ID NO: 486793 - protein, 9 aa, Homo Sapiens
SHQYVVDDT

SEQ ID NO: 486794 - protein, 9 aa, Homo Sapiens
LSSAKNEPP

SEQ ID NO: 486795 - protein, 9 aa, Homo Sapiens
AHNLLLAYA

SEQ ID NO: 486796 - protein, 9 aa, Homo Sapiens
PGDSEVSAL

SEQ ID NO: 486797 - protein, 9 aa, Homo Sapiens
QPSPSLRRC

SEQ ID NO: 486798 - protein, 9 aa, Homo Sapiens
DTLLEETPK

SEQ ID NO: 486799 - protein, 9 aa, Homo Sapiens
IACLCSNAM

SEQ ID NO: 486800 - protein, 9 aa, Homo Sapiens
GKAAFFPPP

SEQ ID NO: 486801 - protein, 9 aa, Homo Sapiens
SPAAKGNIS

SEQ ID NO: 486802 - protein, 9 aa, Homo Sapiens
HHLPIQMDP

SEQ ID NO: 486803 - protein, 9 aa, Homo Sapiens
VSERNLLKV

SEQ ID NO: 486804 - protein, 9 aa, Homo Sapiens
QMARTKKAC

SEQ ID NO: 486805 - protein, 9 aa, Homo Sapiens
VGYHVIQRV

SEQ ID NO: 486806 - protein, 9 aa, Homo Sapiens
RDYENESQS

SEQ ID NO: 486807 - protein, 9 aa, Homo Sapiens
LLKLLELLF

SEQ ID NO: 486808 - protein, 9 aa, Homo Sapiens
FQTKFLSQI

SEQ ID NO: 486809 - protein, 9 aa, Homo Sapiens
TKPSISSSN

SEQ ID NO: 486810 - protein, 9 aa, Homo Sapiens
VMHLWLVIV

SEQ ID NO: 486811 - protein, 9 aa, Homo Sapiens
DRGASPMDS

SEQ ID NO: 486812 - protein, 9 aa, Homo Sapiens
SVNMMAQNL

SEQ ID NO: 486813 - protein, 9 aa, Homo Sapiens
KKTSGHKAG

SEQ ID NO: 486814 - protein, 9 aa, Homo Sapiens
FMSLESTHP

SEQ ID NO: 486815 - protein, 9 aa, Homo Sapiens
LVSEEDKQF

SEQ ID NO: 486816 - protein, 9 aa, Homo Sapiens
KILSPLLSK

SEQ ID NO: 486817 - protein, 9 aa, Homo Sapiens
EVDPSTHCY

SEQ ID NO: 486818 - protein, 9 aa, Homo Sapiens
HLEETNSSS

SEQ ID NO: 486819 - protein, 9 aa, Homo Sapiens
PYCCTRDPG

SEQ ID NO: 486820 - protein, 9 aa, Homo Sapiens
DKGKRDACF

SEQ ID NO: 486821 - protein, 9 aa, Homo Sapiens
DSLSSTSKD

SEQ ID NO: 486822 - protein, 9 aa, Homo Sapiens
GLRSEHRDK

SEQ ID NO: 486823 - protein, 9 aa, Homo Sapiens
KSAVSYELP

SEQ ID NO: 486824 - protein, 9 aa, Homo Sapiens
EALKKSVSK

SEQ ID NO: 486825 - protein, 9 aa, Homo Sapiens
QFKLEVCLF

SEQ ID NO: 486826 - protein, 9 aa, Homo Sapiens
KHYGNYTCV

SEQ ID NO: 486827 - protein, 9 aa, Homo Sapiens
SDYKAKLTQ

SEQ ID NO: 486828 - protein, 9 aa, Homo Sapiens
QVSQFLHTY

SEQ ID NO: 486829 - protein, 9 aa, Homo Sapiens
LVCCQIPLY

SEQ ID NO: 486830 - protein, 9 aa, Homo Sapiens
LFKNVCEQG

SEQ ID NO: 486831 - protein, 9 aa, Homo Sapiens
MNPLTSTPV

SEQ ID NO: 486832 - protein, 9 aa, Homo Sapiens
PQQLCKTLK

SEQ ID NO: 486833 - protein, 9 aa, Homo Sapiens
IHLENIEKS

SEQ ID NO: 486834 - protein, 9 aa, Homo Sapiens
TARTSLGIT

SEQ ID NO: 486835 - protein, 9 aa, Homo Sapiens
GQKPYECNQ

SEQ ID NO: 486836 - protein, 9 aa, Homo Sapiens
KEEQQCLES

SEQ ID NO: 486837 - protein, 9 aa, Homo Sapiens
RRCSVKQKR

SEQ ID NO: 486838 - protein, 9 aa, Homo Sapiens
PRPQDLRRS

SEQ ID NO: 486839 - protein, 9 aa, Homo Sapiens
LEVLSTPMP

SEQ ID NO: 486840 - protein, 9 aa, Homo Sapiens
SLDSHHHLV

SEQ ID NO: 486841 - protein, 9 aa, Homo Sapiens
CKAYLVGLF

SEQ ID NO: 486842 - protein, 9 aa, Homo Sapiens
DYKAKLTQI

SEQ ID NO: 486843 - protein, 9 aa, Homo Sapiens
LLLTDTPCF

SEQ ID NO: 486844 - protein, 9 aa, Homo Sapiens
EDKNKIKTE

SEQ ID NO: 486845 - protein, 9 aa, Homo Sapiens
ELQTYVDLL

SEQ ID NO: 486846 - protein, 9 aa, Homo Sapiens
TDNKSLKTH

SEQ ID NO: 486847 - protein, 9 aa, Homo Sapiens
QRGSGKSEA

SEQ ID NO: 486848 - protein, 9 aa, Homo Sapiens
LLSKNGAFR

SEQ ID NO: 486849 - protein, 9 aa, Homo Sapiens
TESHQYVVD

SEQ ID NO: 486850 - protein, 9 aa, Homo Sapiens
GPSDTPKEI

SEQ ID NO: 486851 - protein, 9 aa, Homo Sapiens
PPYVKKHSG

SEQ ID NO: 486852 - protein, 9 aa, Homo Sapiens
KVSEVEQEL

SEQ ID NO: 486853 - protein, 9 aa, Homo Sapiens
CGAQMYIFV

SEQ ID NO: 486854 - protein, 9 aa, Homo Sapiens
EVWLYAGIV

SEQ ID NO: 486855 - protein, 9 aa, Homo Sapiens
IQMDPLIAN

SEQ ID NO: 486856 - protein, 9 aa, Homo Sapiens
DFKKFQNEI

SEQ ID NO: 486857 - protein, 9 aa, Homo Sapiens
ADSDAWVLQ

SEQ ID NO: 486858 - protein, 9 aa, Homo Sapiens
CSKRSSHHR

SEQ ID NO: 486859 - protein, 9 aa, Homo Sapiens
CKTLKSLTH

SEQ ID NO: 486860 - protein, 9 aa, Homo Sapiens
FLELAKSVL

SEQ ID NO: 486861 - protein, 9 aa, Homo Sapiens
DSSVSAPPS

SEQ ID NO: 486862 - protein, 9 aa, Homo Sapiens
RLLLKLLEL

SEQ ID NO: 486863 - protein, 9 aa, Homo Sapiens
KRDACFFFS

SEQ ID NO: 486864 - protein, 9 aa, Homo Sapiens
VARLCAKAE

SEQ ID NO: 486865 - protein, 9 aa, Homo Sapiens
EVCLFKSEN

SEQ ID NO: 486866 - protein, 9 aa, Homo Sapiens
PGEKKAVSG

SEQ ID NO: 486867 - protein, 9 aa, Homo Sapiens
TGDNQYYCK

SEQ ID NO: 486868 - protein, 9 aa, Homo Sapiens
DKFRAYDWG

SEQ ID NO: 486869 - protein, 9 aa, Homo Sapiens
QECQHQFQG

SEQ ID NO: 486870 - protein, 9 aa, Homo Sapiens
ECGKGFLQH

SEQ ID NO: 486871 - protein, 9 aa, Homo Sapiens
NLCFMDICY

SEQ ID NO: 486872 - protein, 9 aa, Homo Sapiens
LTVYSATEG

SEQ ID NO: 486873 - protein, 9 aa, Homo Sapiens
TANSRQEFQ

SEQ ID NO: 486874 - protein, 9 aa, Homo Sapiens
YCKNCASLQ

SEQ ID NO: 486875 - protein, 9 aa, Homo Sapiens
FNFHTDNKS

SEQ ID NO: 486876 - protein, 9 aa, Homo Sapiens
KFDGDMKQE

SEQ ID NO: 486877 - protein, 9 aa, Homo Sapiens
FLKEVWVST

SEQ ID NO: 486878 - protein, 9 aa, Homo Sapiens
IQECQHQFQ

SEQ ID NO: 486879 - protein, 9 aa, Homo Sapiens
CGKALSSSH

SEQ ID NO: 486880 - protein, 9 aa, Homo Sapiens
QDLRRSVKH

SEQ ID NO: 486881 - protein, 9 aa, Homo Sapiens
DWLLQKKKY

SEQ ID NO: 486882 - protein, 9 aa, Homo Sapiens
VPKEKVKPG

SEQ ID NO: 486883 - protein, 9 aa, Homo Sapiens
TIVQHSCFS

SEQ ID NO: 486884 - protein, 9 aa, Homo Sapiens
ASLRFPKVA

SEQ ID NO: 486885 - protein, 9 aa, Homo Sapiens
KALKLLPPA

SEQ ID NO: 486886 - protein, 9 aa, Homo Sapiens
EKPNSRSKK

SEQ ID NO: 486887 - protein, 9 aa, Homo Sapiens
NTTFLEQSK

SEQ ID NO: 486888 - protein, 9 aa, Homo Sapiens
ALQEACKAY

SEQ ID NO: 486889 - protein, 9 aa, Homo Sapiens
FKKFQNEII

SEQ ID NO: 486890 - protein, 9 aa, Homo Sapiens
IVQSKLDSD

SEQ ID NO: 486891 - protein, 9 aa, Homo Sapiens
SIIRATHSK

SEQ ID NO: 486892 - protein, 9 aa, Homo Sapiens
VLTLYVPII

SEQ ID NO: 486893 - protein, 9 aa, Homo Sapiens
SLFSWGQLN

SEQ ID NO: 486894 - protein, 9 aa, Homo Sapiens
KNEPPVPLV

SEQ ID NO: 486895 - protein, 9 aa, Homo Sapiens
ESVNMMAQN

SEQ ID NO: 486896 - protein, 9 aa, Homo Sapiens
GDFKKFQNE

SEQ ID NO: 486897 - protein, 9 aa, Homo Sapiens
ASVCLIFGM

SEQ ID NO: 486898 - protein, 9 aa, Homo Sapiens
PCPMSAMWP

SEQ ID NO: 486899 - protein, 9 aa, Homo Sapiens
YGNKNNFKE

SEQ ID NO: 486900 - protein, 9 aa, Homo Sapiens
PPKLSAQSL

SEQ ID NO: 486901 - protein, 9 aa, Homo Sapiens
GVKIKRSDR

SEQ ID NO: 486902 - protein, 9 aa, Homo Sapiens
ELLESVNMM

SEQ ID NO: 486903 - protein, 9 aa, Homo Sapiens
IRDHCAKRL

SEQ ID NO: 486904 - protein, 9 aa, Homo Sapiens
VCSMFTASV

SEQ ID NO: 486905 - protein, 9 aa, Homo Sapiens
SDKFRAYDW

SEQ ID NO: 486906 - protein, 9 aa, Homo Sapiens
FAVEECMTA

SEQ ID NO: 486907 - protein, 9 aa, Homo Sapiens
SYNACGAQM

SEQ ID NO: 486908 - protein, 9 aa, Homo Sapiens
VVNQSTGEA

SEQ ID NO: 486909 - protein, 9 aa, Homo Sapiens
IFNFHTDNK

SEQ ID NO: 486910 - protein, 9 aa, Homo Sapiens
PKTRHMSAC

SEQ ID NO: 486911 - protein, 9 aa, Homo Sapiens
SNEDQHDAY

SEQ ID NO: 486912 - protein, 9 aa, Homo Sapiens
CPALQNKVQ

SEQ ID NO: 486913 - protein, 9 aa, Homo Sapiens
VENEKEKPN

SEQ ID NO: 486914 - protein, 9 aa, Homo Sapiens
HRRAAGGWN

SEQ ID NO: 486915 - protein, 9 aa, Homo Sapiens
IAVGNHGLQ

SEQ ID NO: 486916 - protein, 9 aa, Homo Sapiens
RCSVAVKMR

SEQ ID NO: 486917 - protein, 9 aa, Homo Sapiens
TRGCSQPKR

SEQ ID NO: 486918 - protein, 9 aa, Homo Sapiens
ATAIDSKFE

SEQ ID NO: 486919 - protein, 9 aa, Homo Sapiens
SSQEEDVTE

SEQ ID NO: 486920 - protein, 9 aa, Homo Sapiens
LVHVLVLDA

SEQ ID NO: 486921 - protein, 9 aa, Homo Sapiens
PEVTQAIKD

SEQ ID NO: 486922 - protein, 9 aa, Homo Sapiens
HCALAYTME

SEQ ID NO: 486923 - protein, 9 aa, Homo Sapiens
KIAAEFNKE

SEQ ID NO: 486924 - protein, 9 aa, Homo Sapiens
DLKNLPISV

SEQ ID NO: 486925 - protein, 9 aa, Homo Sapiens
MNFSEAQVQ

SEQ ID NO: 486926 - protein, 9 aa, Homo Sapiens
SIEPGVKLI

SEQ ID NO: 486927 - protein, 9 aa, Homo Sapiens
CTKCTLFTD

SEQ ID NO: 486928 - protein, 9 aa, Homo Sapiens
RKSYKFKFQ

SEQ ID NO: 486929 - protein, 9 aa, Homo Sapiens
EKSIYNHTS

SEQ ID NO: 486930 - protein, 9 aa, Homo Sapiens
HSESKDTSL

SEQ ID NO: 486931 - protein, 9 aa, Homo Sapiens
DSNEDQHDA

SEQ ID NO: 486932 - protein, 9 aa, Homo Sapiens
CYLTPSGYL

SEQ ID NO: 486933 - protein, 9 aa, Homo Sapiens
KKSFSLKEK

SEQ ID NO: 486934 - protein, 9 aa, Homo Sapiens
CPAYGALAL

SEQ ID NO: 486935 - protein, 9 aa, Homo Sapiens
IQSTPGLGH

SEQ ID NO: 486936 - protein, 9 aa, Homo Sapiens
YREQLKLLT

SEQ ID NO: 486937 - protein, 9 aa, Homo Sapiens
VPGSKDDLV

SEQ ID NO: 486938 - protein, 9 aa, Homo Sapiens
LVKDIVGYH

SEQ ID NO: 486939 - protein, 9 aa, Homo Sapiens
FSSLFADLR

SEQ ID NO: 486940 - protein, 9 aa, Homo Sapiens
LHQHFKQEQ

SEQ ID NO: 486941 - protein, 9 aa, Homo Sapiens
GHTGRRCKS

SEQ ID NO: 486942 - protein, 9 aa, Homo Sapiens
RLKTRGIFQ

SEQ ID NO: 486943 - protein, 9 aa, Homo Sapiens
GVGYYSHQV

SEQ ID NO: 486944 - protein, 9 aa, Homo Sapiens
CKTQKTNGH

SEQ ID NO: 486945 - protein, 9 aa, Homo Sapiens
EEKMIGQFS

SEQ ID NO: 486946 - protein, 9 aa, Homo Sapiens
QFTSNRDFE

SEQ ID NO: 486947 - protein, 9 aa, Homo Sapiens
KNNFKEEQQ

SEQ ID NO: 486948 - protein, 9 aa, Homo Sapiens
VAAPYCCTR

SEQ ID NO: 486949 - protein, 9 aa, Homo Sapiens
KVAQQPLIN

SEQ ID NO: 486950 - protein, 9 aa, Homo Sapiens
WETSLDSHH

SEQ ID NO: 486951 - protein, 9 aa, Homo Sapiens
KSVINGCKG

SEQ ID NO: 486952 - protein, 9 aa, Homo Sapiens
HYLVGAGIT

SEQ ID NO: 486953 - protein, 9 aa, Homo Sapiens
GSASGLNKD

SEQ ID NO: 486954 - protein, 9 aa, Homo Sapiens
IEPPIGSPE

SEQ ID NO: 486955 - protein, 9 aa, Homo Sapiens
LRGLPVQAN

SEQ ID NO: 486956 - protein, 9 aa, Homo Sapiens
AFKYWYENH

SEQ ID NO: 486957 - protein, 9 aa, Homo Sapiens
IITGSENGT

SEQ ID NO: 486958 - protein, 9 aa, Homo Sapiens
CKNAAKTRR

SEQ ID NO: 486959 - protein, 9 aa, Homo Sapiens
CPWCYKRSW

SEQ ID NO: 486960 - protein, 9 aa, Homo Sapiens
NPDVYCSKY

SEQ ID NO: 486961 - protein, 9 aa, Homo Sapiens
KKSVSKKRE

SEQ ID NO: 486962 - protein, 9 aa, Homo Sapiens
VIHYLEDCQ

SEQ ID NO: 486963 - protein, 9 aa, Homo Sapiens
LNLHQHFKQ

SEQ ID NO: 486964 - protein, 9 aa, Homo Sapiens
LIPVKDKLV

SEQ ID NO: 486965 - protein, 9 aa, Homo Sapiens
SGDFKKFQN

SEQ ID NO: 486966 - protein, 9 aa, Homo Sapiens
PRTTQSLVL

SEQ ID NO: 486967 - protein, 9 aa, Homo Sapiens
LLASTTEPA

SEQ ID NO: 486968 - protein, 9 aa, Homo Sapiens
GAYKAEPRP

SEQ ID NO: 486969 - protein, 9 aa, Homo Sapiens
FTLSTFPNF

SEQ ID NO: 486970 - protein, 9 aa, Homo Sapiens
KNPSHYGSA

SEQ ID NO: 486971 - protein, 9 aa, Homo Sapiens
DSLDRCYLT

SEQ ID NO: 486972 - protein, 9 aa, Homo Sapiens
SLTVQAADN

SEQ ID NO: 486973 - protein, 9 aa, Homo Sapiens
QAELHFWMM

SEQ ID NO: 486974 - protein, 9 aa, Homo Sapiens
WQSQDGQKN

SEQ ID NO: 486975 - protein, 9 aa, Homo Sapiens
EKVPKEKVK

SEQ ID NO: 486976 - protein, 9 aa, Homo Sapiens
CMSNNTGIQ

SEQ ID NO: 486977 - protein, 9 aa, Homo Sapiens
VDLLKAENL

SEQ ID NO: 486978 - protein, 9 aa, Homo Sapiens
LDLGYKVQI

SEQ ID NO: 486979 - protein, 9 aa, Homo Sapiens
ADAKSLTSA

SEQ ID NO: 486980 - protein, 9 aa, Homo Sapiens
WYKNGVKIK

SEQ ID NO: 486981 - protein, 9 aa, Homo Sapiens
NIGLSVIIS

SEQ ID NO: 486982 - protein, 9 aa, Homo Sapiens
PAAKGNISV

SEQ ID NO: 486983 - protein, 9 aa, Homo Sapiens
PPRPQDLRR

SEQ ID NO: 486984 - protein, 9 aa, Homo Sapiens
LSEICEFVS

SEQ ID NO: 486985 - protein, 9 aa, Homo Sapiens
PVTSLSLVS

SEQ ID NO: 486986 - protein, 9 aa, Homo Sapiens
QSSEPKLGE

SEQ ID NO: 486987 - protein, 9 aa, Homo Sapiens
LAKSVLNYF

SEQ ID NO: 486988 - protein, 9 aa, Homo Sapiens
ALALAAPRS

SEQ ID NO: 486989 - protein, 9 aa, Homo Sapiens
PMPFIIGVN

SEQ ID NO: 486990 - protein, 9 aa, Homo Sapiens
ILVNTQTRP

SEQ ID NO: 486991 - protein, 9 aa, Homo Sapiens
SSTKLARIE

SEQ ID NO: 486992 - protein, 9 aa, Homo Sapiens
VDLEMTPSF

SEQ ID NO: 486993 - protein, 9 aa, Homo Sapiens
IASTNNMDG

SEQ ID NO: 486994 - protein, 9 aa, Homo Sapiens
RPHSETEEM

SEQ ID NO: 486995 - protein, 9 aa, Homo Sapiens
LSQGGETCK

SEQ ID NO: 486996 - protein, 9 aa, Homo Sapiens
SLLSSAKNE

SEQ ID NO: 486997 - protein, 9 aa, Homo Sapiens
NGTLEAKLE

SEQ ID NO: 486998 - protein, 9 aa, Homo Sapiens
KSTSSGHTE

SEQ ID NO: 486999 - protein, 9 aa, Homo Sapiens
GQSGQEDKN

SEQ ID NO: 487000 - protein, 9 aa, Homo Sapiens
QKTNGHRNH

SEQ ID NO: 487001 - protein, 9 aa, Homo Sapiens
YEEDSQCLH

SEQ ID NO: 487002 - protein, 9 aa, Homo Sapiens
YENESQSSE

SEQ ID NO: 487003 - protein, 9 aa, Homo Sapiens
WPLQDQLLP

SEQ ID NO: 487004 - protein, 9 aa, Homo Sapiens
ELPFIRLDF

SEQ ID NO: 487005 - protein, 9 aa, Homo Sapiens
LVLTITPRP

SEQ ID NO: 487006 - protein, 9 aa, Homo Sapiens
NLPPPAPTS

SEQ ID NO: 487007 - protein, 9 aa, Homo Sapiens
HLWLVIVAL

SEQ ID NO: 487008 - protein, 9 aa, Homo Sapiens
TSLNQLGKR

SEQ ID NO: 487009 - protein, 9 aa, Homo Sapiens
ILSPLLSKT

SEQ ID NO: 487010 - protein, 9 aa, Homo Sapiens
VNMMAQNLP

SEQ ID NO: 487011 - protein, 9 aa, Homo Sapiens
VRLPYPVQM

SEQ ID NO: 487012 - protein, 9 aa, Homo Sapiens
FEKKDNNED

SEQ ID NO: 487013 - protein, 9 aa, Homo Sapiens
SQRKMDPAE

SEQ ID NO: 487014 - protein, 9 aa, Homo Sapiens
GPAGMAPQG

SEQ ID NO: 487015 - protein, 9 aa, Homo Sapiens
IIEELENFQ

SEQ ID NO: 487016 - protein, 9 aa, Homo Sapiens
ALDPEDRPK

SEQ ID NO: 487017 - protein, 9 aa, Homo Sapiens
ENGRVLFSA

SEQ ID NO: 487018 - protein, 9 aa, Homo Sapiens
NKEDPDCMK

SEQ ID NO: 487019 - protein, 9 aa, Homo Sapiens
EQTTKDSVM

SEQ ID NO: 487020 - protein, 9 aa, Homo Sapiens
TEPATAFTP

SEQ ID NO: 487021 - protein, 9 aa, Homo Sapiens
AVQSPRAHS

SEQ ID NO: 487022 - protein, 9 aa, Homo Sapiens
LANDSVRSL

SEQ ID NO: 487023 - protein, 9 aa, Homo Sapiens
MIELSNMLG

SEQ ID NO: 487024 - protein, 9 aa, Homo Sapiens
SVCLIFGMI

SEQ ID NO: 487025 - protein, 9 aa, Homo Sapiens
DMRAEVAIL

SEQ ID NO: 487026 - protein, 9 aa, Homo Sapiens
DNLADAKSL

SEQ ID NO: 487027 - protein, 9 aa, Homo Sapiens
NAQQVSQFL

SEQ ID NO: 487028 - protein, 9 aa, Homo Sapiens
ENFQKDSQS

SEQ ID NO: 487029 - protein, 9 aa, Homo Sapiens
IVHCALAYT

SEQ ID NO: 487030 - protein, 9 aa, Homo Sapiens
EQDQTYIPP

SEQ ID NO: 487031 - protein, 9 aa, Homo Sapiens
PKFSEEEIK

SEQ ID NO: 487032 - protein, 9 aa, Homo Sapiens
EECMTAEFR

SEQ ID NO: 487033 - protein, 9 aa, Homo Sapiens
GTNVTAPRP

SEQ ID NO: 487034 - protein, 9 aa, Homo Sapiens
CQLKVNMYS

SEQ ID NO: 487035 - protein, 9 aa, Homo Sapiens
DDQFPKQAE

SEQ ID NO: 487036 - protein, 9 aa, Homo Sapiens
CFVTFLLLA

SEQ ID NO: 487037 - protein, 9 aa, Homo Sapiens
VTTISGLDL

SEQ ID NO: 487038 - protein, 9 aa, Homo Sapiens
QTYVDLLKA

SEQ ID NO: 487039 - protein, 9 aa, Homo Sapiens
VFVTEGNNV

SEQ ID NO: 487040 - protein, 9 aa, Homo Sapiens
ERNLLKVSE

SEQ ID NO: 487041 - protein, 9 aa, Homo Sapiens
YLEDCQYSQ

SEQ ID NO: 487042 - protein, 9 aa, Homo Sapiens
HITTDIVML

SEQ ID NO: 487043 - protein, 9 aa, Homo Sapiens
TTEPATAFT

SEQ ID NO: 487044 - protein, 9 aa, Homo Sapiens
ETSLDSHHH

SEQ ID NO: 487045 - protein, 9 aa, Homo Sapiens
KGFSQSPQL

SEQ ID NO: 487046 - protein, 9 aa, Homo Sapiens
RKLLHELAL

SEQ ID NO: 487047 - protein, 9 aa, Homo Sapiens
GKQSSADSD

SEQ ID NO: 487048 - protein, 9 aa, Homo Sapiens
ETLHKALKL

SEQ ID NO: 487049 - protein, 9 aa, Homo Sapiens
LANFTSLSD

SEQ ID NO: 487050 - protein, 9 aa, Homo Sapiens
PKEILTRIG

SEQ ID NO: 487051 - protein, 9 aa, Homo Sapiens
RSNRPQMRP

SEQ ID NO: 487052 - protein, 9 aa, Homo Sapiens
SSFISHADL

SEQ ID NO: 487053 - protein, 9 aa, Homo Sapiens
KHRMSKHKI

SEQ ID NO: 487054 - protein, 9 aa, Homo Sapiens
MELLESVNM

SEQ ID NO: 487055 - protein, 9 aa, Homo Sapiens
APSLPRPKR

SEQ ID NO: 487056 - protein, 9 aa, Homo Sapiens
LPEQPVRKA

SEQ ID NO: 487057 - protein, 9 aa, Homo Sapiens
DKQFTSNRD

SEQ ID NO: 487058 - protein, 9 aa, Homo Sapiens
NKNNFKEEQ

SEQ ID NO: 487059 - protein, 9 aa, Homo Sapiens
ENTSGGLSR

SEQ ID NO: 487060 - protein, 9 aa, Homo Sapiens
LELAKSVLN

SEQ ID NO: 487061 - protein, 9 aa, Homo Sapiens
DATAIDSKF

SEQ ID NO: 487062 - protein, 9 aa, Homo Sapiens
RPQDLRRSV

SEQ ID NO: 487063 - protein, 9 aa, Homo Sapiens
VEEKMIGQF

SEQ ID NO: 487064 - protein, 9 aa, Homo Sapiens
STHPSQLLS

SEQ ID NO: 487065 - protein, 9 aa, Homo Sapiens
SLICHDICK

SEQ ID NO: 487066 - protein, 9 aa, Homo Sapiens
SKRSSHHRS

SEQ ID NO: 487067 - protein, 9 aa, Homo Sapiens
QHLKGDFGA

SEQ ID NO: 487068 - protein, 9 aa, Homo Sapiens
KSLTSAQKE

SEQ ID NO: 487069 - protein, 9 aa, Homo Sapiens
KVPKEKVKP

SEQ ID NO: 487070 - protein, 9 aa, Homo Sapiens
YKNGVKIKR

SEQ ID NO: 487071 - protein, 9 aa, Homo Sapiens
TASSSVAAV

SEQ ID NO: 487072 - protein, 9 aa, Homo Sapiens
SAVSYELPS

SEQ ID NO: 487073 - protein, 9 aa, Homo Sapiens
GDDQFPKQA

SEQ ID NO: 487074 - protein, 9 aa, Homo Sapiens
RRCKTQKTN

SEQ ID NO: 487075 - protein, 9 aa, Homo Sapiens
PSLRRCKTQ

SEQ ID NO: 487076 - protein, 9 aa, Homo Sapiens
SETEVEEKM

SEQ ID NO: 487077 - protein, 9 aa, Homo Sapiens
NMPFVKGLQ

SEQ ID NO: 487078 - protein, 9 aa, Homo Sapiens
TCVDGVNSL

SEQ ID NO: 487079 - protein, 9 aa, Homo Sapiens
SAQSLDKNS

SEQ ID NO: 487080 - protein, 9 aa, Homo Sapiens
DPEVTQAIK

SEQ ID NO: 487081 - protein, 9 aa, Homo Sapiens
NPSHYGSAS

SEQ ID NO: 487082 - protein, 9 aa, Homo Sapiens
ASTNNMDGH

SEQ ID NO: 487083 - protein, 9 aa, Homo Sapiens
HQNMQRMAV

SEQ ID NO: 487084 - protein, 9 aa, Homo Sapiens
TMPFQLDGE

SEQ ID NO: 487085 - protein, 9 aa, Homo Sapiens
QSGQEDKNK

SEQ ID NO: 487086 - protein, 9 aa, Homo Sapiens
KAIEVIQAA

SEQ ID NO: 487087 - protein, 9 aa, Homo Sapiens
TTIVQHSCF

SEQ ID NO: 487088 - protein, 9 aa, Homo Sapiens
NYNPDVYCS

SEQ ID NO: 487089 - protein, 9 aa, Homo Sapiens
PISVLVKFP

SEQ ID NO: 487090 - protein, 9 aa, Homo Sapiens
RHSLETASS

SEQ ID NO: 487091 - protein, 9 aa, Homo Sapiens
SSHHRSQSS

SEQ ID NO: 487092 - protein, 9 aa, Homo Sapiens
GEKKAVSGP

SEQ ID NO: 487093 - protein, 9 aa, Homo Sapiens
AGNTTFLEQ

SEQ ID NO: 487094 - protein, 9 aa, Homo Sapiens
PLDLGYKVQ

SEQ ID NO: 487095 - protein, 9 aa, Homo Sapiens
PLPVTSLSL

SEQ ID NO: 487096 - protein, 9 aa, Homo Sapiens
QKRSGTLLG

SEQ ID NO: 487097 - protein, 9 aa, Homo Sapiens
QNHLEETNS

SEQ ID NO: 487098 - protein, 9 aa, Homo Sapiens
RVWNEDDDI

SEQ ID NO: 487099 - protein, 9 aa, Homo Sapiens
QKPYECNQC

SEQ ID NO: 487100 - protein, 9 aa, Homo Sapiens
KEKHENGVK

SEQ ID NO: 487101 - protein, 9 aa, Homo Sapiens
GLLLTVETT

SEQ ID NO: 487102 - protein, 9 aa, Homo Sapiens
NHLEETNSS

SEQ ID NO: 487103 - protein, 9 aa, Homo Sapiens
YPTVLGRWD

SEQ ID NO: 487104 - protein, 9 aa, Homo Sapiens
EAYKHTVED

SEQ ID NO: 487105 - protein, 9 aa, Homo Sapiens
VDNLADAKS

SEQ ID NO: 487106 - protein, 9 aa, Homo Sapiens
VRTPQIRKC

SEQ ID NO: 487107 - protein, 9 aa, Homo Sapiens
ICHDICKNL

SEQ ID NO: 487108 - protein, 9 aa, Homo Sapiens
TKAIEVIQA

SEQ ID NO: 487109 - protein, 9 aa, Homo Sapiens
GSGVLKCGI

SEQ ID NO: 487110 - protein, 9 aa, Homo Sapiens
DFLKQIFVE

SEQ ID NO: 487111 - protein, 9 aa, Homo Sapiens
FLVLLNVTL

SEQ ID NO: 487112 - protein, 9 aa, Homo Sapiens
VLGSGSGVL

SEQ ID NO: 487113 - protein, 9 aa, Homo Sapiens
KNGAFRAEE

SEQ ID NO: 487114 - protein, 9 aa, Homo Sapiens
AVLTLYVPI

SEQ ID NO: 487115 - protein, 9 aa, Homo Sapiens
WYLKEPPRK

SEQ ID NO: 487116 - protein, 9 aa, Homo Sapiens
VDDTITMQL

SEQ ID NO: 487117 - protein, 9 aa, Homo Sapiens
PNGTLEAKL

SEQ ID NO: 487118 - protein, 9 aa, Homo Sapiens
CLKVLGQTE

SEQ ID NO: 487119 - protein, 9 aa, Homo Sapiens
AENTSGGLS

SEQ ID NO: 487120 - protein, 9 aa, Homo Sapiens
RMFWETSLD

SEQ ID NO: 487121 - protein, 9 aa, Homo Sapiens
PEQPVRKAK

SEQ ID NO: 487122 - protein, 9 aa, Homo Sapiens
ALSSSHSFQ

SEQ ID NO: 487123 - protein, 9 aa, Homo Sapiens
NVTLILADL

SEQ ID NO: 487124 - protein, 9 aa, Homo Sapiens
PVKDKLVDP

SEQ ID NO: 487125 - protein, 9 aa, Homo Sapiens
SQSSEPKLG

SEQ ID NO: 487126 - protein, 9 aa, Homo Sapiens
HENINFKQS

SEQ ID NO: 487127 - protein, 9 aa, Homo Sapiens
YKAEPRPVA

SEQ ID NO: 487128 - protein, 9 aa, Homo Sapiens
GDMKQEPGM

SEQ ID NO: 487129 - protein, 9 aa, Homo Sapiens
YLVGAGITD

SEQ ID NO: 487130 - protein, 9 aa, Homo Sapiens
LCDAKEEIR

SEQ ID NO: 487131 - protein, 9 aa, Homo Sapiens
EKPYKSEEC

SEQ ID NO: 487132 - protein, 9 aa, Homo Sapiens
HIKPSVEPA

SEQ ID NO: 487133 - protein, 9 aa, Homo Sapiens
KSFSLKEKS

SEQ ID NO: 487134 - protein, 9 aa, Homo Sapiens
YKAKLTQIR

SEQ ID NO: 487135 - protein, 9 aa, Homo Sapiens
PSPSLRRCK

SEQ ID NO: 487136 - protein, 9 aa, Homo Sapiens
SALAASLLE

SEQ ID NO: 487137 - protein, 9 aa, Homo Sapiens
HVLVLDAND

SEQ ID NO: 487138 - protein, 9 aa, Homo Sapiens
DVVNQSTGE

SEQ ID NO: 487139 - protein, 9 aa, Homo Sapiens
TEKHYGNYT

SEQ ID NO: 487140 - protein, 9 aa, Homo Sapiens
NLADAKSLT

SEQ ID NO: 487141 - protein, 9 aa, Homo Sapiens
HTGRRCKSV

SEQ ID NO: 487142 - protein, 9 aa, Homo Sapiens
YSATEGYVA

SEQ ID NO: 487143 - protein, 9 aa, Homo Sapiens
KENMNFSEA

SEQ ID NO: 487144 - protein, 9 aa, Homo Sapiens
GEKGPFGEA

SEQ ID NO: 487145 - protein, 9 aa, Homo Sapiens
SEKDIVHCA

SEQ ID NO: 487146 - protein, 9 aa, Homo Sapiens
YSDSAELDG

SEQ ID NO: 487147 - protein, 9 aa, Homo Sapiens
EWWSCTKCT

SEQ ID NO: 487148 - protein, 9 aa, Homo Sapiens
TGLDRANAG

SEQ ID NO: 487149 - protein, 9 aa, Homo Sapiens
GEPQEEVGK

SEQ ID NO: 487150 - protein, 9 aa, Homo Sapiens
HQYVVDDTI

SEQ ID NO: 487151 - protein, 9 aa, Homo Sapiens
GRTYSLTVQ

SEQ ID NO: 487152 - protein, 9 aa, Homo Sapiens
LFADLRTHT

SEQ ID NO: 487153 - protein, 9 aa, Homo Sapiens
DAKSLTSAQ

SEQ ID NO: 487154 - protein, 9 aa, Homo Sapiens
MRAEVAILT

SEQ ID NO: 487155 - protein, 9 aa, Homo Sapiens
GDNQYYCKN

SEQ ID NO: 487156 - protein, 9 aa, Homo Sapiens
KDKHRMSKH

SEQ ID NO: 487157 - protein, 9 aa, Homo Sapiens
TYGLALANL

SEQ ID NO: 487158 - protein, 9 aa, Homo Sapiens
CEQGRWSER

SEQ ID NO: 487159 - protein, 9 aa, Homo Sapiens
IGLSVIISF

SEQ ID NO: 487160 - protein, 9 aa, Homo Sapiens
QRKMDPAEE

SEQ ID NO: 487161 - protein, 9 aa, Homo Sapiens
HTTTKEPVP

SEQ ID NO: 487162 - protein, 9 aa, Homo Sapiens
NVCEQGRWS

SEQ ID NO: 487163 - protein, 9 aa, Homo Sapiens
ELRRHSLET

SEQ ID NO: 487164 - protein, 9 aa, Homo Sapiens
YGIMSSDSA

SEQ ID NO: 487165 - protein, 9 aa, Homo Sapiens
TCNTSGSQT

SEQ ID NO: 487166 - protein, 9 aa, Homo Sapiens
KRLRGCLNS

SEQ ID NO: 487167 - protein, 9 aa, Homo Sapiens
LEAVPSHLN

SEQ ID NO: 487168 - protein, 9 aa, Homo Sapiens
DILTVYSAT

SEQ ID NO: 487169 - protein, 9 aa, Homo Sapiens
PGSKDDLVA

SEQ ID NO: 487170 - protein, 9 aa, Homo Sapiens
HFQPLEMMT

SEQ ID NO: 487171 - protein, 9 aa, Homo Sapiens
VCEQGRWSE

SEQ ID NO: 487172 - protein, 9 aa, Homo Sapiens
PIIITGSEN

SEQ ID NO: 487173 - protein, 9 aa, Homo Sapiens
NTGIQISKE

SEQ ID NO: 487174 - protein, 9 aa, Homo Sapiens
CYPTSAVQS

SEQ ID NO: 487175 - protein, 9 aa, Homo Sapiens
DIATSEVPG

SEQ ID NO: 487176 - protein, 9 aa, Homo Sapiens
YSIITLMMN

SEQ ID NO: 487177 - protein, 9 aa, Homo Sapiens
SHVFYETEG

SEQ ID NO: 487178 - protein, 9 aa, Homo Sapiens
DKHRMSKHK

SEQ ID NO: 487179 - protein, 9 aa, Homo Sapiens
GEESGIVQS

SEQ ID NO: 487180 - protein, 9 aa, Homo Sapiens
VLSTPMPFI

SEQ ID NO: 487181 - protein, 9 aa, Homo Sapiens
TEVEEKMIG

SEQ ID NO: 487182 - protein, 9 aa, Homo Sapiens
SKVSLVSAL

SEQ ID NO: 487183 - protein, 9 aa, Homo Sapiens
RGPRIPKHE

SEQ ID NO: 487184 - protein, 9 aa, Homo Sapiens
TCKQGCPGR

SEQ ID NO: 487185 - protein, 9 aa, Homo Sapiens
QNEIILKLD

SEQ ID NO: 487186 - protein, 9 aa, Homo Sapiens
PSTHCYGLF

SEQ ID NO: 487187 - protein, 9 aa, Homo Sapiens
CAKAERKAA

SEQ ID NO: 487188 - protein, 9 aa, Homo Sapiens
KTYGLALAN

SEQ ID NO: 487189 - protein, 9 aa, Homo Sapiens
CAVLTLYVP

SEQ ID NO: 487190 - protein, 9 aa, Homo Sapiens
LSTFPNFLL

SEQ ID NO: 487191 - protein, 9 aa, Homo Sapiens
LSKTPPMPL

SEQ ID NO: 487192 - protein, 9 aa, Homo Sapiens
KVRVWNEDD

SEQ ID NO: 487193 - protein, 9 aa, Homo Sapiens
TRGIFQTKF

SEQ ID NO: 487194 - protein, 9 aa, Homo Sapiens
QPAFQQLVY

SEQ ID NO: 487195 - protein, 9 aa, Homo Sapiens
GLDNAGNTT

SEQ ID NO: 487196 - protein, 9 aa, Homo Sapiens
IELSNMLGQ

SEQ ID NO: 487197 - protein, 9 aa, Homo Sapiens
RDFLKQIFV

SEQ ID NO: 487198 - protein, 9 aa, Homo Sapiens
SSEMDVQEP

SEQ ID NO: 487199 - protein, 9 aa, Homo Sapiens
KHSGGDRTG

SEQ ID NO: 487200 - protein, 9 aa, Homo Sapiens
KRSGTLLGI

SEQ ID NO: 487201 - protein, 9 aa, Homo Sapiens
KKFQNEIIL

SEQ ID NO: 487202 - protein, 9 aa, Homo Sapiens
EHYERKLEQ

SEQ ID NO: 487203 - protein, 9 aa, Homo Sapiens
LSGQRGSGK

SEQ ID NO: 487204 - protein, 9 aa, Homo Sapiens
KKIAMQEIK

SEQ ID NO: 487205 - protein, 9 aa, Homo Sapiens
CEFVSGRFP

SEQ ID NO: 487206 - protein, 9 aa, Homo Sapiens
VAKMSAYHH

SEQ ID NO: 487207 - protein, 9 aa, Homo Sapiens
MAPQGMPGL

SEQ ID NO: 487208 - protein, 9 aa, Homo Sapiens
PLMVIHYLE

SEQ ID NO: 487209 - protein, 9 aa, Homo Sapiens
FTSNRDFET

SEQ ID NO: 487210 - protein, 9 aa, Homo Sapiens
LKLLTAENT

SEQ ID NO: 487211 - protein, 9 aa, Homo Sapiens
APNGTLEAK

SEQ ID NO: 487212 - protein, 9 aa, Homo Sapiens
NLLKVSEVE

SEQ ID NO: 487213 - protein, 9 aa, Homo Sapiens
QFLHTYSAA

SEQ ID NO: 487214 - protein, 9 aa, Homo Sapiens
TFNYNPDVY

SEQ ID NO: 487215 - protein, 9 aa, Homo Sapiens
HLIPLGHQV

SEQ ID NO: 487216 - protein, 9 aa, Homo Sapiens
NNLNVETLK

SEQ ID NO: 487217 - protein, 9 aa, Homo Sapiens
SDSQRKMDP

SEQ ID NO: 487218 - protein, 9 aa, Homo Sapiens
IKPSVEPAP

SEQ ID NO: 487219 - protein, 9 aa, Homo Sapiens
VILVNTQTR

SEQ ID NO: 487220 - protein, 9 aa, Homo Sapiens
GVLKCGIAV

SEQ ID NO: 487221 - protein, 9 aa, Homo Sapiens
VQSPRAHSA

SEQ ID NO: 487222 - protein, 9 aa, Homo Sapiens
KKGKDLDPE

SEQ ID NO: 487223 - protein, 9 aa, Homo Sapiens
PIQMDPLIA

SEQ ID NO: 487224 - protein, 9 aa, Homo Sapiens
NVNPVILVN

SEQ ID NO: 487225 - protein, 9 aa, Homo Sapiens
HVGPKEKPL

SEQ ID NO: 487226 - protein, 9 aa, Homo Sapiens
VWQQVIRPF

SEQ ID NO: 487227 - protein, 9 aa, Homo Sapiens
NRPQMRPLS

SEQ ID NO: 487228 - protein, 9 aa, Homo Sapiens
LDNAGNTTF

SEQ ID NO: 487229 - protein, 9 aa, Homo Sapiens
SLNQLGKRQ

SEQ ID NO: 487230 - protein, 9 aa, Homo Sapiens
GWNLPPPAP

SEQ ID NO: 487231 - protein, 9 aa, Homo Sapiens
DSPAAKGNI

SEQ ID NO: 487232 - protein, 9 aa, Homo Sapiens
TDIVMLNPA

SEQ ID NO: 487233 - protein, 9 aa, Homo Sapiens
GLRLIHYLV

SEQ ID NO: 487234 - protein, 9 aa, Homo Sapiens
EVRRLANFT

SEQ ID NO: 487235 - protein, 9 aa, Homo Sapiens
EETPKEDDE

SEQ ID NO: 487236 - protein, 9 aa, Homo Sapiens
GYYSHQVGR

SEQ ID NO: 487237 - protein, 9 aa, Homo Sapiens
NSTNLEGKI

SEQ ID NO: 487238 - protein, 9 aa, Homo Sapiens
KKHSGGDRT

SEQ ID NO: 487239 - protein, 9 aa, Homo Sapiens
ANLGRANER

SEQ ID NO: 487240 - protein, 9 aa, Homo Sapiens
FISHADLIK

SEQ ID NO: 487241 - protein, 9 aa, Homo Sapiens
SLLASTTEP

SEQ ID NO: 487242 - protein, 9 aa, Homo Sapiens
SYDEYADSN

SEQ ID NO: 487243 - protein, 9 aa, Homo Sapiens
RSSHHRSQS

SEQ ID NO: 487244 - protein, 9 aa, Homo Sapiens
TTDIVMLNP

SEQ ID NO: 487245 - protein, 9 aa, Homo Sapiens
RTHGGQKPY

SEQ ID NO: 487246 - protein, 9 aa, Homo Sapiens
KPLMVIHYL

SEQ ID NO: 487247 - protein, 9 aa, Homo Sapiens
LLKVSEVEQ

SEQ ID NO: 487248 - protein, 9 aa, Homo Sapiens
FQKDSQSLK

SEQ ID NO: 487249 - protein, 9 aa, Homo Sapiens
YVGESEGAV

SEQ ID NO: 487250 - protein, 9 aa, Homo Sapiens
LNVETLKGQ

SEQ ID NO: 487251 - protein, 9 aa, Homo Sapiens
MRPLSPGES

SEQ ID NO: 487252 - protein, 9 aa, Homo Sapiens
YPTSAVQSP

SEQ ID NO: 487253 - protein, 9 aa, Homo Sapiens
PAPSLPRPK

SEQ ID NO: 487254 - protein, 9 aa, Homo Sapiens
RELFQMART

SEQ ID NO: 487255 - protein, 9 aa, Homo Sapiens
LGLVVMHLW

SEQ ID NO: 487256 - protein, 9 aa, Homo Sapiens
ATNSTNLEG

SEQ ID NO: 487257 - protein, 9 aa, Homo Sapiens
NKEEPRALY

SEQ ID NO: 487258 - protein, 9 aa, Homo Sapiens
LFSWGQLNF

SEQ ID NO: 487259 - protein, 9 aa, Homo Sapiens
IFQTKFLSQ

SEQ ID NO: 487260 - protein, 9 aa, Homo Sapiens
QVLVKKDAR

SEQ ID NO: 487261 - protein, 9 aa, Homo Sapiens
VFYETEGFE

SEQ ID NO: 487262 - protein, 9 aa, Homo Sapiens
ASEAENTSG

SEQ ID NO: 487263 - protein, 9 aa, Homo Sapiens
KPRGDFPST

SEQ ID NO: 487264 - protein, 9 aa, Homo Sapiens
GEKPYKSEE

SEQ ID NO: 487265 - protein, 9 aa, Homo Sapiens
CSNAMKHLP

SEQ ID NO: 487266 - protein, 9 aa, Homo Sapiens
RSEHRDKMN

SEQ ID NO: 487267 - protein, 9 aa, Homo Sapiens
PAFQQLVYF

SEQ ID NO: 487268 - protein, 9 aa, Homo Sapiens
NRWFREFQH

SEQ ID NO: 487269 - protein, 9 aa, Homo Sapiens
GHTEISSPR

SEQ ID NO: 487270 - protein, 9 aa, Homo Sapiens
SLVSALPHL

SEQ ID NO: 487271 - protein, 9 aa, Homo Sapiens
QVGRPVLRT

SEQ ID NO: 487272 - protein, 9 aa, Homo Sapiens
SPCGEPQEE

SEQ ID NO: 487273 - protein, 9 aa, Homo Sapiens
HKAGDKKAN

SEQ ID NO: 487274 - protein, 9 aa, Homo Sapiens
LSEGMNPLT

SEQ ID NO: 487275 - protein, 9 aa, Homo Sapiens
ANSRQEFQH

SEQ ID NO: 487276 - protein, 9 aa, Homo Sapiens
LNTSSKKGK

SEQ ID NO: 487277 - protein, 9 aa, Homo Sapiens
PSTIHVSGP

SEQ ID NO: 487278 - protein, 9 aa, Homo Sapiens
KVYNSLEPH

SEQ ID NO: 487279 - protein, 9 aa, Homo Sapiens
RKLEQANNL

SEQ ID NO: 487280 - protein, 9 aa, Homo Sapiens
KYMLVKDIV

SEQ ID NO: 487281 - protein, 9 aa, Homo Sapiens
KKDARRTRS

SEQ ID NO: 487282 - protein, 9 aa, Homo Sapiens
CHDFMKAAL

SEQ ID NO: 487283 - protein, 9 aa, Homo Sapiens
KDDDIHIDA

SEQ ID NO: 487284 - protein, 9 aa, Homo Sapiens
HKAFSTCVS

SEQ ID NO: 487285 - protein, 9 aa, Homo Sapiens
HGPAGMAPQ

SEQ ID NO: 487286 - protein, 9 aa, Homo Sapiens
ITTDIVMLN

SEQ ID NO: 487287 - protein, 9 aa, Homo Sapiens
ACFFFSLCT

SEQ ID NO: 487288 - protein, 9 aa, Homo Sapiens
LVSERNLLK

SEQ ID NO: 487289 - protein, 9 aa, Homo Sapiens
AYKAEPRPV

SEQ ID NO: 487290 - protein, 9 aa, Homo Sapiens
VKDPTKVMV

SEQ ID NO: 487291 - protein, 9 aa, Homo Sapiens
RRHSLETAS

SEQ ID NO: 487292 - protein, 9 aa, Homo Sapiens
QSKLDSDFN

SEQ ID NO: 487293 - protein, 9 aa, Homo Sapiens
KEKKSFSLK

SEQ ID NO: 487294 - protein, 9 aa, Homo Sapiens
SVQLNLTKI

SEQ ID NO: 487295 - protein, 9 aa, Homo Sapiens
ALVHVLVLD

SEQ ID NO: 487296 - protein, 9 aa, Homo Sapiens
HRMSKHKIG

SEQ ID NO: 487297 - protein, 9 aa, Homo Sapiens
GFAGEKGPF

SEQ ID NO: 487298 - protein, 9 aa, Homo Sapiens
HTFNRPVEI

SEQ ID NO: 487299 - protein, 9 aa, Homo Sapiens
LRRCKTQKT

SEQ ID NO: 487300 - protein, 9 aa, Homo Sapiens
DLLKAENLV

SEQ ID NO: 487301 - protein, 9 aa, Homo Sapiens
EVCDKEALL

SEQ ID NO: 487302 - protein, 9 aa, Homo Sapiens
GGEVTLHFQ

SEQ ID NO: 487303 - protein, 9 aa, Homo Sapiens
WSCTKCTLF

SEQ ID NO: 487304 - protein, 9 aa, Homo Sapiens
KQFTSNRDF

SEQ ID NO: 487305 - protein, 9 aa, Homo Sapiens
FSWQSVLLS

SEQ ID NO: 487306 - protein, 9 aa, Homo Sapiens
VVMHLWLVI

SEQ ID NO: 487307 - protein, 9 aa, Homo Sapiens
HDICKNLKV

SEQ ID NO: 487308 - protein, 9 aa, Homo Sapiens
AKRLREAGV

SEQ ID NO: 487309 - protein, 9 aa, Homo Sapiens
VAASTHIGE

SEQ ID NO: 487310 - protein, 9 aa, Homo Sapiens
FVTFLLLAG

SEQ ID NO: 487311 - protein, 9 aa, Homo Sapiens
DRRFINFQF

SEQ ID NO: 487312 - protein, 9 aa, Homo Sapiens
NHGLQERDR

SEQ ID NO: 487313 - protein, 9 aa, Homo Sapiens
RMVRELFQM

SEQ ID NO: 487314 - protein, 9 aa, Homo Sapiens
GLTDGFLVF

SEQ ID NO: 487315 - protein, 9 aa, Homo Sapiens
FMKAALDIS

SEQ ID NO: 487316 - protein, 9 aa, Homo Sapiens
KLEVCLFKS

SEQ ID NO: 487317 - protein, 9 aa, Homo Sapiens
AVSYELPSL

SEQ ID NO: 487318 - protein, 9 aa, Homo Sapiens
LGPRTTQSL

SEQ ID NO: 487319 - protein, 9 aa, Homo Sapiens
ARLCAKAER

SEQ ID NO: 487320 - protein, 9 aa, Homo Sapiens
QLAGSVAKM

SEQ ID NO: 487321 - protein, 9 aa, Homo Sapiens
IEQAYEKFC

SEQ ID NO: 487322 - protein, 9 aa, Homo Sapiens
TSFPQQLCK

SEQ ID NO: 487323 - protein, 9 aa, Homo Sapiens
FQHLKGDFG

SEQ ID NO: 487324 - protein, 9 aa, Homo Sapiens
CACLEAKRL

SEQ ID NO: 487325 - protein, 9 aa, Homo Sapiens
PAGMAPQGM

SEQ ID NO: 487326 - protein, 9 aa, Homo Sapiens
LLETKRDPN

SEQ ID NO: 487327 - protein, 9 aa, Homo Sapiens
WQGPEGEKR

SEQ ID NO: 487328 - protein, 9 aa, Homo Sapiens
PSANYSDSA

SEQ ID NO: 487329 - protein, 9 aa, Homo Sapiens
LSNMLGQER

SEQ ID NO: 487330 - protein, 9 aa, Homo Sapiens
AKNVTNYDL

SEQ ID NO: 487331 - protein, 9 aa, Homo Sapiens
RKSRPHSET

SEQ ID NO: 487332 - protein, 9 aa, Homo Sapiens
HGEEGLFLL

SEQ ID NO: 487333 - protein, 9 aa, Homo Sapiens
SLVSTGDTT

SEQ ID NO: 487334 - protein, 9 aa, Homo Sapiens
EDKQFTSNR

SEQ ID NO: 487335 - protein, 9 aa, Homo Sapiens
QHFQPLEMM

SEQ ID NO: 487336 - protein, 9 aa, Homo Sapiens
SESSFISHA

SEQ ID NO: 487337 - protein, 9 aa, Homo Sapiens
SEGMNPLTS

SEQ ID NO: 487338 - protein, 9 aa, Homo Sapiens
CCDHQDDCC

SEQ ID NO: 487339 - protein, 9 aa, Homo Sapiens
TIVTGERSQ

SEQ ID NO: 487340 - protein, 9 aa, Homo Sapiens
VLVKKDARR

SEQ ID NO: 487341 - protein, 9 aa, Homo Sapiens
KIKRSDRIY

SEQ ID NO: 487342 - protein, 9 aa, Homo Sapiens
GNYVFWTDC

SEQ ID NO: 487343 - protein, 9 aa, Homo Sapiens
SECKQNALG

SEQ ID NO: 487344 - protein, 9 aa, Homo Sapiens
CSVKQKRSG

SEQ ID NO: 487345 - protein, 9 aa, Homo Sapiens
SEICEFVSG

SEQ ID NO: 487346 - protein, 9 aa, Homo Sapiens
THIGESSLS

SEQ ID NO: 487347 - protein, 9 aa, Homo Sapiens
PGLGHAPRT

SEQ ID NO: 487348 - protein, 9 aa, Homo Sapiens
PCFALPQGL

SEQ ID NO: 487349 - protein, 9 aa, Homo Sapiens
TSLSDLHKF

SEQ ID NO: 487350 - protein, 9 aa, Homo Sapiens
VVGKGPPKI

SEQ ID NO: 487351 - protein, 9 aa, Homo Sapiens
CNTSGSQTR

SEQ ID NO: 487352 - protein, 9 aa, Homo Sapiens
EMDPEIEQA

SEQ ID NO: 487353 - protein, 9 aa, Homo Sapiens
FPKQAELSG

SEQ ID NO: 487354 - protein, 9 aa, Homo Sapiens
DGFLVFLPF

SEQ ID NO: 487355 - protein, 9 aa, Homo Sapiens
CKQGCPGRN

SEQ ID NO: 487356 - protein, 9 aa, Homo Sapiens
LSANSLYEP

SEQ ID NO: 487357 - protein, 9 aa, Homo Sapiens
SGSGDSGKR

SEQ ID NO: 487358 - protein, 9 aa, Homo Sapiens
HTEISSPRI

SEQ ID NO: 487359 - protein, 9 aa, Homo Sapiens
QQVIRPFLT

SEQ ID NO: 487360 - protein, 9 aa, Homo Sapiens
VVDDTITMQ

SEQ ID NO: 487361 - protein, 9 aa, Homo Sapiens
IRPFLTTIV

SEQ ID NO: 487362 - protein, 9 aa, Homo Sapiens
SSENNSDRS

SEQ ID NO: 487363 - protein, 9 aa, Homo Sapiens
DQLLPSDGI

SEQ ID NO: 487364 - protein, 9 aa, Homo Sapiens
LIHYLVGAG

SEQ ID NO: 487365 - protein, 9 aa, Homo Sapiens
MLYLQGCSM

SEQ ID NO: 487366 - protein, 9 aa, Homo Sapiens
NGVLEGIRM

SEQ ID NO: 487367 - protein, 9 aa, Homo Sapiens
NLLDSDHQE

SEQ ID NO: 487368 - protein, 9 aa, Homo Sapiens
TLPPTPHLP

SEQ ID NO: 487369 - protein, 9 aa, Homo Sapiens
GAQMYIFVA

SEQ ID NO: 487370 - protein, 9 aa, Homo Sapiens
TDCMNGSIF

SEQ ID NO: 487371 - protein, 9 aa, Homo Sapiens
LASTTEPAT

SEQ ID NO: 487372 - protein, 9 aa, Homo Sapiens
KCMAMCMDR

SEQ ID NO: 487373 - protein, 9 aa, Homo Sapiens
TEISSPRIQ

SEQ ID NO: 487374 - protein, 9 aa, Homo Sapiens
ERDRLDPLK

SEQ ID NO: 487375 - protein, 9 aa, Homo Sapiens
TIQASYFVT

SEQ ID NO: 487376 - protein, 9 aa, Homo Sapiens
NSEQKCMAM

SEQ ID NO: 487377 - protein, 9 aa, Homo Sapiens
NPVILVNTQ

SEQ ID NO: 487378 - protein, 9 aa, Homo Sapiens
WCYKRSWFS

SEQ ID NO: 487379 - protein, 9 aa, Homo Sapiens
QSVLLSHQR

SEQ ID NO: 487380 - protein, 9 aa, Homo Sapiens
RQEFQHLKG

SEQ ID NO: 487381 - protein, 9 aa, Homo Sapiens
FVSGRFPYY

SEQ ID NO: 487382 - protein, 9 aa, Homo Sapiens
KKDNNEDKK

SEQ ID NO: 487383 - protein, 9 aa, Homo Sapiens
FEESECKQN

SEQ ID NO: 487384 - protein, 9 aa, Homo Sapiens
YAKVWHLYN

SEQ ID NO: 487385 - protein, 9 aa, Homo Sapiens
FQNEIILKL

SEQ ID NO: 487386 - protein, 9 aa, Homo Sapiens
ADIDYIAST

SEQ ID NO: 487387 - protein, 9 aa, Homo Sapiens
VETTKPSIS

SEQ ID NO: 487388 - protein, 9 aa, Homo Sapiens
HADLIKFFK

SEQ ID NO: 487389 - protein, 9 aa, Homo Sapiens
KLERRWESL

SEQ ID NO: 487390 - protein, 9 aa, Homo Sapiens
LFLGNLCFM

SEQ ID NO: 487391 - protein, 9 aa, Homo Sapiens
TNSTNLEGK

SEQ ID NO: 487392 - protein, 9 aa, Homo Sapiens
SHSGSEKQL

SEQ ID NO: 487393 - protein, 9 aa, Homo Sapiens
TLVSETEVE

SEQ ID NO: 487394 - protein, 9 aa, Homo Sapiens
YAALAHYFS

SEQ ID NO: 487395 - protein, 9 aa, Homo Sapiens
FVVCQLKVN

SEQ ID NO: 487396 - protein, 9 aa, Homo Sapiens
PVFITSLLQ

SEQ ID NO: 487397 - protein, 9 aa, Homo Sapiens
NKRKSYKFK

SEQ ID NO: 487398 - protein, 9 aa, Homo Sapiens
QWLCNHEHQ

SEQ ID NO: 487399 - protein, 9 aa, Homo Sapiens
KLLTAENTM

SEQ ID NO: 487400 - protein, 9 aa, Homo Sapiens
HVFYETEGF

SEQ ID NO: 487401 - protein, 9 aa, Homo Sapiens
YVDLLKAEN

SEQ ID NO: 487402 - protein, 9 aa, Homo Sapiens
VAHNLLLAY

SEQ ID NO: 487403 - protein, 9 aa, Homo Sapiens
PFQLDGEGF

SEQ ID NO: 487404 - protein, 9 aa, Homo Sapiens
MAMCMDRYM

SEQ ID NO: 487405 - protein, 9 aa, Homo Sapiens
NEVWLYAGI

SEQ ID NO: 487406 - protein, 9 aa, Homo Sapiens
PFLTTIVQH

SEQ ID NO: 487407 - protein, 9 aa, Homo Sapiens
SRWPLQDQL

SEQ ID NO: 487408 - protein, 9 aa, Homo Sapiens
QLKVNMYSS

SEQ ID NO: 487409 - protein, 9 aa, Homo Sapiens
RHMSACWQD

SEQ ID NO: 487410 - protein, 9 aa, Homo Sapiens
GIQSTPGLG

SEQ ID NO: 487411 - protein, 9 aa, Homo Sapiens
NCSASRRIH

SEQ ID NO: 487412 - protein, 9 aa, Homo Sapiens
EFQHLKGDF

SEQ ID NO: 487413 - protein, 9 aa, Homo Sapiens
ICEFVSGRF

SEQ ID NO: 487414 - protein, 9 aa, Homo Sapiens
FWINKDAVT

SEQ ID NO: 487415 - protein, 9 aa, Homo Sapiens
NYSDSAELD

SEQ ID NO: 487416 - protein, 9 aa, Homo Sapiens
QNTGISQDK

SEQ ID NO: 487417 - protein, 9 aa, Homo Sapiens
VASLRFPKV

SEQ ID NO: 487418 - protein, 9 aa, Homo Sapiens
QAYEKFCLE

SEQ ID NO: 487419 - protein, 9 aa, Homo Sapiens
PSQFLVKVP

SEQ ID NO: 487420 - protein, 9 aa, Homo Sapiens
AVAAPYCCT

SEQ ID NO: 487421 - protein, 9 aa, Homo Sapiens
RPQMRPLSP

SEQ ID NO: 487422 - protein, 9 aa, Homo Sapiens
STNLEGKII

SEQ ID NO: 487423 - protein, 9 aa, Homo Sapiens
KDGEAFKYW

SEQ ID NO: 487424 - protein, 9 aa, Homo Sapiens
QTRGCSQPK

SEQ ID NO: 487425 - protein, 9 aa, Homo Sapiens
KQDRGASPM

SEQ ID NO: 487426 - protein, 9 aa, Homo Sapiens
WKSAVSYEL

SEQ ID NO: 487427 - protein, 9 aa, Homo Sapiens
HGQPSPSLR

SEQ ID NO: 487428 - protein, 9 aa, Homo Sapiens
RTPQIRKCT

SEQ ID NO: 487429 - protein, 9 aa, Homo Sapiens
QLYHSDKFR

SEQ ID NO: 487430 - protein, 9 aa, Homo Sapiens
FPNFLLVWQ

SEQ ID NO: 487431 - protein, 9 aa, Homo Sapiens
VKPPPTING

SEQ ID NO: 487432 - protein, 9 aa, Homo Sapiens
PAYGALALA

SEQ ID NO: 487433 - protein, 9 aa, Homo Sapiens
VMALQEACK

SEQ ID NO: 487434 - protein, 9 aa, Homo Sapiens
YKHTVEDMQ

SEQ ID NO: 487435 - protein, 9 aa, Homo Sapiens
GHRNHRKKF

SEQ ID NO: 487436 - protein, 9 aa, Homo Sapiens
FLEVSFTLS

SEQ ID NO: 487437 - protein, 9 aa, Homo Sapiens
DNQYYCKNC

SEQ ID NO: 487438 - protein, 9 aa, Homo Sapiens
MVKKIAMQE

SEQ ID NO: 487439 - protein, 9 aa, Homo Sapiens
PSSTKLARI

SEQ ID NO: 487440 - protein, 9 aa, Homo Sapiens
GPPKISNKV

SEQ ID NO: 487441 - protein, 9 aa, Homo Sapiens
KVFVTEGNN

SEQ ID NO: 487442 - protein, 9 aa, Homo Sapiens
RNLLKVSEV

SEQ ID NO: 487443 - protein, 9 aa, Homo Sapiens
SDHQELIGD

SEQ ID NO: 487444 - protein, 9 aa, Homo Sapiens
VVCQLKVNM

SEQ ID NO: 487445 - protein, 9 aa, Homo Sapiens
LENIEKSIY

SEQ ID NO: 487446 - protein, 9 aa, Homo Sapiens
AFQEQTTKD

SEQ ID NO: 487447 - protein, 9 aa, Homo Sapiens
MSAMWPSAN

SEQ ID NO: 487448 - protein, 9 aa, Homo Sapiens
YYPPRPQDL

SEQ ID NO: 487449 - protein, 9 aa, Homo Sapiens
QKDSQSLKD

SEQ ID NO: 487450 - protein, 9 aa, Homo Sapiens
SSTSKDSEK

SEQ ID NO: 487451 - protein, 9 aa, Homo Sapiens
ANGPSDTPK

SEQ ID NO: 487452 - protein, 9 aa, Homo Sapiens
MDVQEPNIV

SEQ ID NO: 487453 - protein, 9 aa, Homo Sapiens
EKGPFGEAG

SEQ ID NO: 487454 - protein, 9 aa, Homo Sapiens
PTVLGRWDL

SEQ ID NO: 487455 - protein, 9 aa, Homo Sapiens
VAKYKDGNE

SEQ ID NO: 487456 - protein, 9 aa, Homo Sapiens
KRSWFSGCF

SEQ ID NO: 487457 - protein, 9 aa, Homo Sapiens
PPIGSPESP

SEQ ID NO: 487458 - protein, 9 aa, Homo Sapiens
MYLFVAMLA

SEQ ID NO: 487459 - protein, 9 aa, Homo Sapiens
DSPVPGSKD

SEQ ID NO: 487460 - protein, 9 aa, Homo Sapiens
MPFIIGVNA

SEQ ID NO: 487461 - protein, 9 aa, Homo Sapiens
SVAVKMRAG

SEQ ID NO: 487462 - protein, 9 aa, Homo Sapiens
TEDDFAVPS

SEQ ID NO: 487463 - protein, 9 aa, Homo Sapiens
GGAGPGGAY

SEQ ID NO: 487464 - protein, 9 aa, Homo Sapiens
FHTDNKSLK

SEQ ID NO: 487465 - protein, 9 aa, Homo Sapiens
KPYKSEECG

SEQ ID NO: 487466 - protein, 9 aa, Homo Sapiens
DIVGYHVIQ

SEQ ID NO: 487467 - protein, 9 aa, Homo Sapiens
WLLQKKKYE

SEQ ID NO: 487468 - protein, 9 aa, Homo Sapiens
RFKDACGNS

SEQ ID NO: 487469 - protein, 9 aa, Homo Sapiens
QLETLHKAL

SEQ ID NO: 487470 - protein, 9 aa, Homo Sapiens
SIKSHVFYE

SEQ ID NO: 487471 - protein, 9 aa, Homo Sapiens
SCNFLPPNL

SEQ ID NO: 487472 - protein, 9 aa, Homo Sapiens
HQGPTLPPT

SEQ ID NO: 487473 - protein, 9 aa, Homo Sapiens
GLDRANAGC

SEQ ID NO: 487474 - protein, 9 aa, Homo Sapiens
SESKDTSLK

SEQ ID NO: 487475 - protein, 9 aa, Homo Sapiens
YSCPAYGAL

SEQ ID NO: 487476 - protein, 9 aa, Homo Sapiens
HTDATAIDS

SEQ ID NO: 487477 - protein, 9 aa, Homo Sapiens
MLVKDIVGY

SEQ ID NO: 487478 - protein, 9 aa, Homo Sapiens
RTYSLTVQA

SEQ ID NO: 487479 - protein, 9 aa, Homo Sapiens
VTLHFQFEG

SEQ ID NO: 487480 - protein, 9 aa, Homo Sapiens
RQRERFHVG

SEQ ID NO: 487481 - protein, 9 aa, Homo Sapiens
LRQMGYTKA

SEQ ID NO: 487482 - protein, 9 aa, Homo Sapiens
KKKASEPRK

SEQ ID NO: 487483 - protein, 9 aa, Homo Sapiens
HLSPQAELH

SEQ ID NO: 487484 - protein, 9 aa, Homo Sapiens
KRGPRIPKH

SEQ ID NO: 487485 - protein, 9 aa, Homo Sapiens
TISGLDLSG

SEQ ID NO: 487486 - protein, 9 aa, Homo Sapiens
STIHVSGPR

SEQ ID NO: 487487 - protein, 9 aa, Homo Sapiens
ELENFQKDS

SEQ ID NO: 487488 - protein, 9 aa, Homo Sapiens
QSSADSDAW

SEQ ID NO: 487489 - protein, 9 aa, Homo Sapiens
CFVVGKGPP

SEQ ID NO: 487490 - protein, 9 aa, Homo Sapiens
TAEFRKYNN

SEQ ID NO: 487491 - protein, 9 aa, Homo Sapiens
FLVFLPFDT

SEQ ID NO: 487492 - protein, 9 aa, Homo Sapiens
NSLEPHHEV

SEQ ID NO: 487493 - protein, 9 aa, Homo Sapiens
KTPPMPLIL

SEQ ID NO: 487494 - protein, 9 aa, Homo Sapiens
NNKRKSYKF

SEQ ID NO: 487495 - protein, 9 aa, Homo Sapiens
RIHPESLQG

SEQ ID NO: 487496 - protein, 9 aa, Homo Sapiens
EKEKHENGV

SEQ ID NO: 487497 - protein, 9 aa, Homo Sapiens
AKMSAYHHG

SEQ ID NO: 487498 - protein, 9 aa, Homo Sapiens
PEKFDGDMK

SEQ ID NO: 487499 - protein, 9 aa, Homo Sapiens
TVSVGSSKT

SEQ ID NO: 487500 - protein, 9 aa, Homo Sapiens
PCGEPQEEV

SEQ ID NO: 487501 - protein, 9 aa, Homo Sapiens
FGFEISKVS

SEQ ID NO: 487502 - protein, 9 aa, Homo Sapiens
QDGQKNIED

SEQ ID NO: 487503 - protein, 9 aa, Homo Sapiens
SFLEVSFTL

SEQ ID NO: 487504 - protein, 9 aa, Homo Sapiens
NFSEAQVQA

SEQ ID NO: 487505 - protein, 9 aa, Homo Sapiens
QASYFVTDK

SEQ ID NO: 487506 - protein, 9 aa, Homo Sapiens
LTAHDQLKA

SEQ ID NO: 487507 - protein, 9 aa, Homo Sapiens
KQKRSGTLL

SEQ ID NO: 487508 - protein, 9 aa, Homo Sapiens
NYKAVGLLD

SEQ ID NO: 487509 - protein, 9 aa, Homo Sapiens
GQDSEPSVN

SEQ ID NO: 487510 - protein, 9 aa, Homo Sapiens
THSKAGGLP

SEQ ID NO: 487511 - protein, 9 aa, Homo Sapiens
SFTLSTFPN

SEQ ID NO: 487512 - protein, 9 aa, Homo Sapiens
TVFEKKDNN

SEQ ID NO: 487513 - protein, 9 aa, Homo Sapiens
LQNKVQALS

SEQ ID NO: 487514 - protein, 9 aa, Homo Sapiens
ARMVRELFQ

SEQ ID NO: 487515 - protein, 9 aa, Homo Sapiens
VWKENMNFS

SEQ ID NO: 487516 - protein, 9 aa, Homo Sapiens
PFIRLDFSC

SEQ ID NO: 487517 - protein, 9 aa, Homo Sapiens
QLYFKLWNL

SEQ ID NO: 487518 - protein, 9 aa, Homo Sapiens
DDSLSSTSK

SEQ ID NO: 487519 - protein, 9 aa, Homo Sapiens
SPPKLSAQS

SEQ ID NO: 487520 - protein, 9 aa, Homo Sapiens
LQDQLLPSD

SEQ ID NO: 487521 - protein, 9 aa, Homo Sapiens
QDSLDRCYL

SEQ ID NO: 487522 - protein, 9 aa, Homo Sapiens
EGIRMCRQG

SEQ ID NO: 487523 - protein, 9 aa, Homo Sapiens
LVCLKVLGQ

SEQ ID NO: 487524 - protein, 9 aa, Homo Sapiens
GAVRETFRK

SEQ ID NO: 487525 - protein, 9 aa, Homo Sapiens
VLDQESPNV

SEQ ID NO: 487526 - protein, 9 aa, Homo Sapiens
EQPVRKAKM

SEQ ID NO: 487527 - protein, 9 aa, Homo Sapiens
SSAKNEPPV

SEQ ID NO: 487528 - protein, 9 aa, Homo Sapiens
KDARRTRSF

SEQ ID NO: 487529 - protein, 9 aa, Homo Sapiens
FLLVWQQVI

SEQ ID NO: 487530 - protein, 9 aa, Homo Sapiens
SEQKCMAMC

SEQ ID NO: 487531 - protein, 9 aa, Homo Sapiens
NQPRLLLKL

SEQ ID NO: 487532 - protein, 9 aa, Homo Sapiens
PFQVLVKKD

SEQ ID NO: 487533 - protein, 9 aa, Homo Sapiens
KDKGKRDAC

SEQ ID NO: 487534 - protein, 9 aa, Homo Sapiens
NIEKSIYNH

SEQ ID NO: 487535 - protein, 9 aa, Homo Sapiens
LEQDQTYIP

SEQ ID NO: 487536 - protein, 9 aa, Homo Sapiens
IQASYFVTD

SEQ ID NO: 487537 - protein, 9 aa, Homo Sapiens
TDAGKIPLC

SEQ ID NO: 487538 - protein, 9 aa, Homo Sapiens
DACGNSEDW

SEQ ID NO: 487539 - protein, 9 aa, Homo Sapiens
MKHRYKLNG

SEQ ID NO: 487540 - protein, 9 aa, Homo Sapiens
EETMPFQLD

SEQ ID NO: 487541 - protein, 9 aa, Homo Sapiens
KSGVKVAAT

SEQ ID NO: 487542 - protein, 9 aa, Homo Sapiens
NGHRNHRKK

SEQ ID NO: 487543 - protein, 9 aa, Homo Sapiens
FAGEKGPFG

SEQ ID NO: 487544 - protein, 9 aa, Homo Sapiens
TSSKKGKDL

SEQ ID NO: 487545 - protein, 9 aa, Homo Sapiens
MPMYSFLSN

SEQ ID NO: 487546 - protein, 9 aa, Homo Sapiens
LEVSFTLST

SEQ ID NO: 487547 - protein, 9 aa, Homo Sapiens
KDGWKKVYN

SEQ ID NO: 487548 - protein, 9 aa, Homo Sapiens
VWNEDDDIK

SEQ ID NO: 487549 - protein, 9 aa, Homo Sapiens
GIRMCRQGF

SEQ ID NO: 487550 - protein, 9 aa, Homo Sapiens
NKDAVTART

SEQ ID NO: 487551 - protein, 9 aa, Homo Sapiens
ASPMDSSYA

SEQ ID NO: 487552 - protein, 9 aa, Homo Sapiens
HGLQERDRM

SEQ ID NO: 487553 - protein, 9 aa, Homo Sapiens
LLTAENTML

SEQ ID NO: 487554 - protein, 9 aa, Homo Sapiens
TQKTNGHRN

SEQ ID NO: 487555 - protein, 9 aa, Homo Sapiens
NNSDRSSVN

SEQ ID NO: 487556 - protein, 9 aa, Homo Sapiens
KIHGEEGLF

SEQ ID NO: 487557 - protein, 9 aa, Homo Sapiens
ACLCSNAMK

SEQ ID NO: 487558 - protein, 9 aa, Homo Sapiens
GALALAAPR

SEQ ID NO: 487559 - protein, 9 aa, Homo Sapiens
SQFLVKVPI

SEQ ID NO: 487560 - protein, 9 aa, Homo Sapiens
GMNPLTSTP

SEQ ID NO: 487561 - protein, 9 aa, Homo Sapiens
VYNSLEPHH

SEQ ID NO: 487562 - protein, 9 aa, Homo Sapiens
VSDKFLKEV

SEQ ID NO: 487563 - protein, 9 aa, Homo Sapiens
STSGKHKAF

SEQ ID NO: 487564 - protein, 9 aa, Homo Sapiens
AFSPQGSIQ

SEQ ID NO: 487565 - protein, 9 aa, Homo Sapiens
DPEIEQAYE

SEQ ID NO: 487566 - protein, 9 aa, Homo Sapiens
INSTSGKHK

SEQ ID NO: 487567 - protein, 9 aa, Homo Sapiens
PASTKVPQC

SEQ ID NO: 487568 - protein, 9 aa, Homo Sapiens
RPRVSRAEN

SEQ ID NO: 487569 - protein, 9 aa, Homo Sapiens
HSLETASSS

SEQ ID NO: 487570 - protein, 9 aa, Homo Sapiens
LAHYFSAIL

SEQ ID NO: 487571 - protein, 9 aa, Homo Sapiens
QNATNIGLS

SEQ ID NO: 487572 - protein, 9 aa, Homo Sapiens
IGGPPKTRH

SEQ ID NO: 487573 - protein, 9 aa, Homo Sapiens
DQTYIPPGE

SEQ ID NO: 487574 - protein, 9 aa, Homo Sapiens
TEGNNVALT

SEQ ID NO: 487575 - protein, 9 aa, Homo Sapiens
TGEKPYKSE

SEQ ID NO: 487576 - protein, 9 aa, Homo Sapiens
RNLENIQAG

SEQ ID NO: 487577 - protein, 9 aa, Homo Sapiens
NMIELSNML

SEQ ID NO: 487578 - protein, 9 aa, Homo Sapiens
LGEESGIVQ

SEQ ID NO: 487579 - protein, 9 aa, Homo Sapiens
FQEQTTKDS

SEQ ID NO: 487580 - protein, 9 aa, Homo Sapiens
QEIRDHCAK

SEQ ID NO: 487581 - protein, 9 aa, Homo Sapiens
GNKNNFKEE

SEQ ID NO: 487582 - protein, 9 aa, Homo Sapiens
FNYNPDVYC

SEQ ID NO: 487583 - protein, 9 aa, Homo Sapiens
GEPTTSPVS

SEQ ID NO: 487584 - protein, 9 aa, Homo Sapiens
NFQFQDSNS

SEQ ID NO: 487585 - protein, 9 aa, Homo Sapiens
DMKQEPGMY

SEQ ID NO: 487586 - protein, 9 aa, Homo Sapiens
SAMWPSANP

SEQ ID NO: 487587 - protein, 9 aa, Homo Sapiens
APQGMPGLG

SEQ ID NO: 487588 - protein, 9 aa, Homo Sapiens
FTHTTTKEP

SEQ ID NO: 487589 - protein, 9 aa, Homo Sapiens
DIVMLNPAN

SEQ ID NO: 487590 - protein, 9 aa, Homo Sapiens
FWLPCPMSA

SEQ ID NO: 487591 - protein, 9 aa, Homo Sapiens
PRLQDSSSQ

SEQ ID NO: 487592 - protein, 9 aa, Homo Sapiens
SRQEFQHLK

SEQ ID NO: 487593 - protein, 9 aa, Homo Sapiens
FKTNDPYRS

SEQ ID NO: 487594 - protein, 9 aa, Homo Sapiens
RLRKSRPHS

SEQ ID NO: 487595 - protein, 9 aa, Homo Sapiens
ANPCITPPS

SEQ ID NO: 487596 - protein, 9 aa, Homo Sapiens
YNSLEPHHE

SEQ ID NO: 487597 - protein, 9 aa, Homo Sapiens
SLESTHPSQ

SEQ ID NO: 487598 - protein, 9 aa, Homo Sapiens
GKGFSQSPQ

SEQ ID NO: 487599 - protein, 9 aa, Homo Sapiens
RWEKEKHEN

SEQ ID NO: 487600 - protein, 9 aa, Homo Sapiens
GVFLVLLNV

SEQ ID NO: 487601 - protein, 9 aa, Homo Sapiens
FPSTIHVSG

SEQ ID NO: 487602 - protein, 9 aa, Homo Sapiens
SGIVQSKLD

SEQ ID NO: 487603 - protein, 9 aa, Homo Sapiens
MGYTKAIEV

SEQ ID NO: 487604 - protein, 9 aa, Homo Sapiens
KVSLVSALP

SEQ ID NO: 487605 - protein, 9 aa, Homo Sapiens
LTSLNQLGK

SEQ ID NO: 487606 - protein, 9 aa, Homo Sapiens
ACYCPWCYK

SEQ ID NO: 487607 - protein, 9 aa, Homo Sapiens
WIIVEILKE

SEQ ID NO: 487608 - protein, 9 aa, Homo Sapiens
HQFDVVNQS

SEQ ID NO: 487609 - protein, 9 aa, Homo Sapiens
LKQIFVEAK

SEQ ID NO: 487610 - protein, 9 aa, Homo Sapiens
KSRPHSETE

SEQ ID NO: 487611 - protein, 9 aa, Homo Sapiens
VRKAKMQES

SEQ ID NO: 487612 - protein, 9 aa, Homo Sapiens
VACPALQNK

SEQ ID NO: 487613 - protein, 9 aa, Homo Sapiens
CGECGKGFL

SEQ ID NO: 487614 - protein, 9 aa, Homo Sapiens
CHTDATAID

SEQ ID NO: 487615 - protein, 9 aa, Homo Sapiens
ARFKDACGN

SEQ ID NO: 487616 - protein, 9 aa, Homo Sapiens
ATSFEESEC

SEQ ID NO: 487617 - protein, 9 aa, Homo Sapiens
WFREFQHGP

SEQ ID NO: 487618 - protein, 9 aa, Homo Sapiens
INYKAVGLL

SEQ ID NO: 487619 - protein, 9 aa, Homo Sapiens
SHYGSASGL

SEQ ID NO: 487620 - protein, 9 aa, Homo Sapiens
SGDSGKRSH

SEQ ID NO: 487621 - protein, 9 aa, Homo Sapiens
PQAELHFWM

SEQ ID NO: 487622 - protein, 9 aa, Homo Sapiens
KASEPRKVI

SEQ ID NO: 487623 - protein, 9 aa, Homo Sapiens
LSSEALVHV

SEQ ID NO: 487624 - protein, 9 aa, Homo Sapiens
TSLKQRIQN

SEQ ID NO: 487625 - protein, 9 aa, Homo Sapiens
GTALKFLKG

SEQ ID NO: 487626 - protein, 9 aa, Homo Sapiens
KGQDSEPSV

SEQ ID NO: 487627 - protein, 9 aa, Homo Sapiens
KEKSKISKN

SEQ ID NO: 487628 - protein, 9 aa, Homo Sapiens
ELGLTDGFL

SEQ ID NO: 487629 - protein, 9 aa, Homo Sapiens
YSIGLEQDQ

SEQ ID NO: 487630 - protein, 9 aa, Homo Sapiens
MLQMWQGPE

SEQ ID NO: 487631 - protein, 9 aa, Homo Sapiens
SEPSVNLLS

SEQ ID NO: 487632 - protein, 9 aa, Homo Sapiens
VNQSTGEAF

SEQ ID NO: 487633 - protein, 9 aa, Homo Sapiens
LTWSRCRVR

SEQ ID NO: 487634 - protein, 9 aa, Homo Sapiens
QPRLLLKLL

SEQ ID NO: 487635 - protein, 9 aa, Homo Sapiens
KEDPDCMKA

SEQ ID NO: 487636 - protein, 9 aa, Homo Sapiens
KNDDQHNCL

SEQ ID NO: 487637 - protein, 9 aa, Homo Sapiens
SSSQEEDVT

SEQ ID NO: 487638 - protein, 9 aa, Homo Sapiens
AAPYCCTRD

SEQ ID NO: 487639 - protein, 9 aa, Homo Sapiens
IGSPESPGA

SEQ ID NO: 487640 - protein, 9 aa, Homo Sapiens
LLQDSGRVD

SEQ ID NO: 487641 - protein, 9 aa, Homo Sapiens
GLLSKNGAF

SEQ ID NO: 487642 - protein, 9 aa, Homo Sapiens
IYPTVLGRW

SEQ ID NO: 487643 - protein, 9 aa, Homo Sapiens
KINSTSGKH

SEQ ID NO: 487644 - protein, 9 aa, Homo Sapiens
QESPNVKNN

SEQ ID NO: 487645 - protein, 9 aa, Homo Sapiens
PACCDHQDD

SEQ ID NO: 487646 - protein, 9 aa, Homo Sapiens
SSSEMDVQE

SEQ ID NO: 487647 - protein, 9 aa, Homo Sapiens
YVHRPVDLE

SEQ ID NO: 487648 - protein, 9 aa, Homo Sapiens
LKKSVSKKR

SEQ ID NO: 487649 - protein, 9 aa, Homo Sapiens
KGFLQHSNL

SEQ ID NO: 487650 - protein, 9 aa, Homo Sapiens
GRRCKSVIN

SEQ ID NO: 487651 - protein, 9 aa, Homo Sapiens
HSDYKAKLT

SEQ ID NO: 487652 - protein, 9 aa, Homo Sapiens
LINSSHELQ

SEQ ID NO: 487653 - protein, 9 aa, Homo Sapiens
PRPKRKSIV

SEQ ID NO: 487654 - protein, 9 aa, Homo Sapiens
HEPMYLFVA

SEQ ID NO: 487655 - protein, 9 aa, Homo Sapiens
ACPALQNKV

SEQ ID NO: 487656 - protein, 9 aa, Homo Sapiens
TKRDPNLQV

SEQ ID NO: 487657 - protein, 9 aa, Homo Sapiens
VTEGNNVAL

SEQ ID NO: 487658 - protein, 9 aa, Homo Sapiens
PEIADIATS

SEQ ID NO: 487659 - protein, 9 aa, Homo Sapiens
TKRDPNLQQ

SEQ ID NO: 487660 - protein, 9 aa, Homo Sapiens
RCKTQKTNG

SEQ ID NO: 487661 - protein, 9 aa, Homo Sapiens
KMSAYHHGE

SEQ ID NO: 487662 - protein, 9 aa, Homo Sapiens
ETTKPSISS

SEQ ID NO: 487663 - protein, 9 aa, Homo Sapiens
SLCHTDATA

SEQ ID NO: 487664 - protein, 9 aa, Homo Sapiens
GMAPQGMPG

SEQ ID NO: 487665 - protein, 9 aa, Homo Sapiens
STLSEGMNP

SEQ ID NO: 487666 - protein, 9 aa, Homo Sapiens
NMMAQNLPY

SEQ ID NO: 487667 - protein, 9 aa, Homo Sapiens
TDTPCFALP

SEQ ID NO: 487668 - protein, 9 aa, Homo Sapiens
LLLKLLELL

SEQ ID NO: 487669 - protein, 9 aa, Homo Sapiens
KAVGLLDPS

SEQ ID NO: 487670 - protein, 9 aa, Homo Sapiens
CGKGFSQSP

SEQ ID NO: 487671 - protein, 9 aa, Homo Sapiens
KLEQANNLY

SEQ ID NO: 487672 - protein, 9 aa, Homo Sapiens
QGKKKTSGH

SEQ ID NO: 487673 - protein, 9 aa, Homo Sapiens
EVFFLKNDD

SEQ ID NO: 487674 - protein, 9 aa, Homo Sapiens
QGGETCKQG

SEQ ID NO: 487675 - protein, 9 aa, Homo Sapiens
LQDSSSQEE

SEQ ID NO: 487676 - protein, 9 aa, Homo Sapiens
EELENFQKD

SEQ ID NO: 487677 - protein, 9 aa, Homo Sapiens
NEDDDIKSR

SEQ ID NO: 487678 - protein, 9 aa, Homo Sapiens
TTKDSVMLN

SEQ ID NO: 487679 - protein, 9 aa, Homo Sapiens
IGESSLSEE

SEQ ID NO: 487680 - protein, 9 aa, Homo Sapiens
ETEVEEKMI

SEQ ID NO: 487681 - protein, 9 aa, Homo Sapiens
INKDAVTAR

SEQ ID NO: 487682 - protein, 9 aa, Homo Sapiens
DKNKIKTES

SEQ ID NO: 487683 - protein, 9 aa, Homo Sapiens
ERSQYLVTA

SEQ ID NO: 487684 - protein, 9 aa, Homo Sapiens
WASEAENTS

SEQ ID NO: 487685 - protein, 9 aa, Homo Sapiens
GGDDQFPKQ

SEQ ID NO: 487686 - protein, 9 aa, Homo Sapiens
LEVCLFKSE

SEQ ID NO: 487687 - protein, 9 aa, Homo Sapiens
KVISYNACG

SEQ ID NO: 487688 - protein, 9 aa, Homo Sapiens
STHIGESSL

SEQ ID NO: 487689 - protein, 9 aa, Homo Sapiens
KSIYNHTSD

SEQ ID NO: 487690 - protein, 9 aa, Homo Sapiens
QTKFLSQIE

SEQ ID NO: 487691 - protein, 9 aa, Homo Sapiens
LETLHKALK

SEQ ID NO: 487692 - protein, 9 aa, Homo Sapiens
QLCKTLKSL

SEQ ID NO: 487693 - protein, 9 aa, Homo Sapiens
QPLEMMTCF

SEQ ID NO: 487694 - protein, 9 aa, Homo Sapiens
SVSAPPSRL

SEQ ID NO: 487695 - protein, 9 aa, Homo Sapiens
RDACFFFSL

SEQ ID NO: 487696 - protein, 9 aa, Homo Sapiens
LVSTGDTTP

SEQ ID NO: 487697 - protein, 9 aa, Homo Sapiens
NVALTGVCV

SEQ ID NO: 487698 - protein, 9 aa, Homo Sapiens
ESTHPSQLL

SEQ ID NO: 487699 - protein, 9 aa, Homo Sapiens
GDSGKRSHA

SEQ ID NO: 487700 - protein, 9 aa, Homo Sapiens
LSCNFLPPN

SEQ ID NO: 487701 - protein, 9 aa, Homo Sapiens
YGALALAAP

SEQ ID NO: 487702 - protein, 9 aa, Homo Sapiens
PYAKHIKPS

SEQ ID NO: 487703 - protein, 9 aa, Homo Sapiens
ESSENNSDR

SEQ ID NO: 487704 - protein, 9 aa, Homo Sapiens
PWCYKRSWF

SEQ ID NO: 487705 - protein, 9 aa, Homo Sapiens
CLNTSSKKG

SEQ ID NO: 487706 - protein, 9 aa, Homo Sapiens
DDSIKSHVF

SEQ ID NO: 487707 - protein, 9 aa, Homo Sapiens
LADAKSLTS

SEQ ID NO: 487708 - protein, 9 aa, Homo Sapiens
LLNDFKTND

SEQ ID NO: 487709 - protein, 9 aa, Homo Sapiens
VSYELPSLH

SEQ ID NO: 487710 - protein, 9 aa, Homo Sapiens
LANKHTFNR

SEQ ID NO: 487711 - protein, 9 aa, Homo Sapiens
TDADSPAAK

SEQ ID NO: 487712 - protein, 9 aa, Homo Sapiens
CMNGSIFQL

SEQ ID NO: 487713 - protein, 9 aa, Homo Sapiens
VNMYSSNSG

SEQ ID NO: 487714 - protein, 9 aa, Homo Sapiens
KPVCNQVQC

SEQ ID NO: 487715 - protein, 9 aa, Homo Sapiens
ASRWPLQDQ

SEQ ID NO: 487716 - protein, 9 aa, Homo Sapiens
DPTKVMVPP

SEQ ID NO: 487717 - protein, 9 aa, Homo Sapiens
FSIIRATHS

SEQ ID NO: 487718 - protein, 9 aa, Homo Sapiens
PDAYQSFTH

SEQ ID NO: 487719 - protein, 9 aa, Homo Sapiens
MFTASVCLI

SEQ ID NO: 487720 - protein, 9 aa, Homo Sapiens
LETASSSVA

SEQ ID NO: 487721 - protein, 9 aa, Homo Sapiens
ADSPAAKGN

SEQ ID NO: 487722 - protein, 9 aa, Homo Sapiens
QDQLLPSDG

SEQ ID NO: 487723 - protein, 9 aa, Homo Sapiens
ALDTLLEET

SEQ ID NO: 487724 - protein, 9 aa, Homo Sapiens
SKKGKDLDP

SEQ ID NO: 487725 - protein, 9 aa, Homo Sapiens
LDPEDRPKF

SEQ ID NO: 487726 - protein, 9 aa, Homo Sapiens
KEPPRKLLH

SEQ ID NO: 487727 - protein, 9 aa, Homo Sapiens
LCFMDICYT

SEQ ID NO: 487728 - protein, 9 aa, Homo Sapiens
KSYKFKFQR

SEQ ID NO: 487729 - protein, 9 aa, Homo Sapiens
PIGSPESPG

SEQ ID NO: 487730 - protein, 9 aa, Homo Sapiens
NLNVETLKG

SEQ ID NO: 487731 - protein, 9 aa, Homo Sapiens
QYLVTALEP

SEQ ID NO: 487732 - protein, 9 aa, Homo Sapiens
FVTEGNNVA

SEQ ID NO: 487733 - protein, 9 aa, Homo Sapiens
NQLGKRQLL

SEQ ID NO: 487734 - protein, 9 aa, Homo Sapiens
NVTNYDLCS

SEQ ID NO: 487735 - protein, 9 aa, Homo Sapiens
REFQHGPVS

SEQ ID NO: 487736 - protein, 9 aa, Homo Sapiens
HRSQSSLTI

SEQ ID NO: 487737 - protein, 9 aa, Homo Sapiens
STSKDSEKD

SEQ ID NO: 487738 - protein, 9 aa, Homo Sapiens
GIQISKELN

SEQ ID NO: 487739 - protein, 9 aa, Homo Sapiens
RDGTFNYNP

SEQ ID NO: 487740 - protein, 9 aa, Homo Sapiens
NNTGIQISK

SEQ ID NO: 487741 - protein, 9 aa, Homo Sapiens
NSLIAVGNH

SEQ ID NO: 487742 - protein, 9 aa, Homo Sapiens
HGHCGLLSK

SEQ ID NO: 487743 - protein, 9 aa, Homo Sapiens
TPPGEKKAV

SEQ ID NO: 487744 - protein, 9 aa, Homo Sapiens
LFQMARTKK

SEQ ID NO: 487745 - protein, 9 aa, Homo Sapiens
GPRIPKHEN

SEQ ID NO: 487746 - protein, 9 aa, Homo Sapiens
QSQDGQKNI

SEQ ID NO: 487747 - protein, 9 aa, Homo Sapiens
LYFKLWNLI

SEQ ID NO: 487748 - protein, 9 aa, Homo Sapiens
PVPGSKDDL

SEQ ID NO: 487749 - protein, 9 aa, Homo Sapiens
NIQAGRGQV

SEQ ID NO: 487750 - protein, 9 aa, Homo Sapiens
KSEECGKTF

SEQ ID NO: 487751 - protein, 9 aa, Homo Sapiens
LLAGWILSH

SEQ ID NO: 487752 - protein, 9 aa, Homo Sapiens
EAVPSHLNV

SEQ ID NO: 487753 - protein, 9 aa, Homo Sapiens
CKSVINGCK

SEQ ID NO: 487754 - protein, 9 aa, Homo Sapiens
SNRPQMRPL

SEQ ID NO: 487755 - protein, 9 aa, Homo Sapiens
ISQDKILTN

SEQ ID NO: 487756 - protein, 9 aa, Homo Sapiens
GQLNFFFWL

SEQ ID NO: 487757 - protein, 9 aa, Homo Sapiens
KEILTRIGS

SEQ ID NO: 487758 - protein, 9 aa, Homo Sapiens
MATRVGAFL

SEQ ID NO: 487759 - protein, 9 aa, Homo Sapiens
DDFAVPSST

SEQ ID NO: 487760 - protein, 9 aa, Homo Sapiens
TRKQLERDR

SEQ ID NO: 487761 - protein, 9 aa, Homo Sapiens
VAATKDDKE

SEQ ID NO: 487762 - protein, 9 aa, Homo Sapiens
CFFFSLCTD

SEQ ID NO: 487763 - protein, 9 aa, Homo Sapiens
STNNMDGHI

SEQ ID NO: 487764 - protein, 9 aa, Homo Sapiens
IHYLVGAGI

SEQ ID NO: 487765 - protein, 9 aa, Homo Sapiens
SHLHMPMYS

SEQ ID NO: 487766 - protein, 9 aa, Homo Sapiens
KCTLFTDQA

SEQ ID NO: 487767 - protein, 9 aa, Homo Sapiens
ELSNMLGQE

SEQ ID NO: 487768 - protein, 9 aa, Homo Sapiens
LVLLNVTLI

SEQ ID NO: 487769 - protein, 9 aa, Homo Sapiens
LGNLCFMDI

SEQ ID NO: 487770 - protein, 9 aa, Homo Sapiens
AKGNISVQI

SEQ ID NO: 487771 - protein, 9 aa, Homo Sapiens
NESVQLNLT

SEQ ID NO: 487772 - protein, 9 aa, Homo Sapiens
AGHTGRRCK

SEQ ID NO: 487773 - protein, 9 aa, Homo Sapiens
CRVRPACVR

SEQ ID NO: 487774 - protein, 9 aa, Homo Sapiens
VYSATEGYV

SEQ ID NO: 487775 - protein, 9 aa, Homo Sapiens
RQMGYTKAI

SEQ ID NO: 487776 - protein, 9 aa, Homo Sapiens
EISKVSLVS

SEQ ID NO: 487777 - protein, 9 aa, Homo Sapiens
CSMPAVAEV

SEQ ID NO: 487778 - protein, 9 aa, Homo Sapiens
CNFLPPNLG

SEQ ID NO: 487779 - protein, 9 aa, Homo Sapiens
GKALSSSHS

SEQ ID NO: 487780 - protein, 9 aa, Homo Sapiens
QDPVSDKFL

SEQ ID NO: 487781 - protein, 9 aa, Homo Sapiens
DSDAWVLQF

SEQ ID NO: 487782 - protein, 9 aa, Homo Sapiens
ATNIGLSVI

SEQ ID NO: 487783 - protein, 9 aa, Homo Sapiens
TTKPSISSS

SEQ ID NO: 487784 - protein, 9 aa, Homo Sapiens
LEPGKAAFF

SEQ ID NO: 487785 - protein, 9 aa, Homo Sapiens
NQVQCHPYL

SEQ ID NO: 487786 - protein, 9 aa, Homo Sapiens
SGQEDKNKI

SEQ ID NO: 487787 - protein, 9 aa, Homo Sapiens
TAPRPGQKR

SEQ ID NO: 487788 - protein, 9 aa, Homo Sapiens
LLDPSADLS

SEQ ID NO: 487789 - protein, 9 aa, Homo Sapiens
RDPNLQVSQ

SEQ ID NO: 487790 - protein, 9 aa, Homo Sapiens
KKAVSGPMP

SEQ ID NO: 487791 - protein, 9 aa, Homo Sapiens
LQGCSMPAV

SEQ ID NO: 487792 - protein, 9 aa, Homo Sapiens
SRPHSETEE

SEQ ID NO: 487793 - protein, 9 aa, Homo Sapiens
LDTLLEETP

SEQ ID NO: 487794 - protein, 9 aa, Homo Sapiens
SASRRIHPE

SEQ ID NO: 487795 - protein, 9 aa, Homo Sapiens
AVEGHITTD

SEQ ID NO: 487796 - protein, 9 aa, Homo Sapiens
HCAKRLREA

SEQ ID NO: 487797 - protein, 9 aa, Homo Sapiens
SEAENTSGG

SEQ ID NO: 487798 - protein, 9 aa, Homo Sapiens
LAWINESVQ

SEQ ID NO: 487799 - protein, 9 aa, Homo Sapiens
PSHYGSASG

SEQ ID NO: 487800 - protein, 9 aa, Homo Sapiens
HRPVDLEMT

SEQ ID NO: 487801 - protein, 9 aa, Homo Sapiens
NESQSSEPK

SEQ ID NO: 487802 - protein, 9 aa, Homo Sapiens
IIRATHSKA

SEQ ID NO: 487803 - protein, 9 aa, Homo Sapiens
AELPFIRLD

SEQ ID NO: 487804 - protein, 9 aa, Homo Sapiens
FLKQIFVEA

SEQ ID NO: 487805 - protein, 9 aa, Homo Sapiens
AQLAGSVAK

SEQ ID NO: 487806 - protein, 9 aa, Homo Sapiens
VTEKHYGNY

SEQ ID NO: 487807 - protein, 9 aa, Homo Sapiens
EDSSVSAPP

SEQ ID NO: 487808 - protein, 9 aa, Homo Sapiens
LLTAHDQLK

SEQ ID NO: 487809 - protein, 9 aa, Homo Sapiens
DQFPKQAEL

SEQ ID NO: 487810 - protein, 9 aa, Homo Sapiens
LAASLLEEQ

SEQ ID NO: 487811 - protein, 9 aa, Homo Sapiens
ACLEAKRLR

SEQ ID NO: 487812 - protein, 9 aa, Homo Sapiens
AKLERRWES

SEQ ID NO: 487813 - protein, 9 aa, Homo Sapiens
IMPARTNNL

SEQ ID NO: 487814 - protein, 9 aa, Homo Sapiens
TNVTEKHYG

SEQ ID NO: 487815 - protein, 9 aa, Homo Sapiens
KRSSHHRSQ

SEQ ID NO: 487816 - protein, 9 aa, Homo Sapiens
GSEKQLEAT

SEQ ID NO: 487817 - protein, 9 aa, Homo Sapiens
AKRLRGCLN

SEQ ID NO: 487818 - protein, 9 aa, Homo Sapiens
PGGAYKAEP

SEQ ID NO: 487819 - protein, 9 aa, Homo Sapiens
LPISVLVKF

SEQ ID NO: 487820 - protein, 9 aa, Homo Sapiens
KFQNEIILK

SEQ ID NO: 487821 - protein, 9 aa, Homo Sapiens
VQLNLTKIE

SEQ ID NO: 487822 - protein, 9 aa, Homo Sapiens
TKGGEVTLH

SEQ ID NO: 487823 - protein, 9 aa, Homo Sapiens
PKLSAQSLD

SEQ ID NO: 487824 - protein, 9 aa, Homo Sapiens
VTNYDLCSI

SEQ ID NO: 487825 - protein, 9 aa, Homo Sapiens
KQSSADSDA

SEQ ID NO: 487826 - protein, 9 aa, Homo Sapiens
QRPRVSRAE

SEQ ID NO: 487827 - protein, 9 aa, Homo Sapiens
QNRHNYGRF

SEQ ID NO: 487828 - protein, 9 aa, Homo Sapiens
VAVKMRAGS

SEQ ID NO: 487829 - protein, 9 aa, Homo Sapiens
TDPEVTQAI

SEQ ID NO: 487830 - protein, 9 aa, Homo Sapiens
FAIQPWPSS

SEQ ID NO: 487831 - protein, 9 aa, Homo Sapiens
LAGSVAKMS

SEQ ID NO: 487832 - protein, 9 aa, Homo Sapiens
GDFPSTIHV

SEQ ID NO: 487833 - protein, 9 aa, Homo Sapiens
YKSTSSGHT

SEQ ID NO: 487834 - protein, 9 aa, Homo Sapiens
YRLRKSRPH

SEQ ID NO: 487835 - protein, 9 aa, Homo Sapiens
HNKEDPDCM

SEQ ID NO: 487836 - protein, 9 aa, Homo Sapiens
YNACGAQMY

SEQ ID NO: 487837 - protein, 9 aa, Homo Sapiens
LGLTDGFLV

SEQ ID NO: 487838 - protein, 9 aa, Homo Sapiens
LLSKTPPMP

SEQ ID NO: 487839 - protein, 9 aa, Homo Sapiens
RWPLQDQLL

SEQ ID NO: 487840 - protein, 9 aa, Homo Sapiens
LETKRDPNL

SEQ ID NO: 487841 - protein, 9 aa, Homo Sapiens
VCQLKVNMY

SEQ ID NO: 487842 - protein, 9 aa, Homo Sapiens
QQLCKTLKS

SEQ ID NO: 487843 - protein, 9 aa, Homo Sapiens
LDGLEPGKA

SEQ ID NO: 487844 - protein, 9 aa, Homo Sapiens
VGYYSHQVG

SEQ ID NO: 487845 - protein, 9 aa, Homo Sapiens
QDSEPSVNL

SEQ ID NO: 487846 - protein, 9 aa, Homo Sapiens
EEDKQFTSN

SEQ ID NO: 487847 - protein, 9 aa, Homo Sapiens
DKFLKEVWV

SEQ ID NO: 487848 - protein, 9 aa, Homo Sapiens
EEEIKPLPP

SEQ ID NO: 487849 - protein, 9 aa, Homo Sapiens
LPGMEATCN

SEQ ID NO: 487850 - protein, 9 aa, Homo Sapiens
GISQDKILT

SEQ ID NO: 487851 - protein, 9 aa, Homo Sapiens
HLENIEKSI

SEQ ID NO: 487852 - protein, 9 aa, Homo Sapiens
CPMSAMWPS

SEQ ID NO: 487853 - protein, 9 aa, Homo Sapiens
RATHSKAGG

SEQ ID NO: 487854 - protein, 9 aa, Homo Sapiens
CSVAVKMRA

SEQ ID NO: 487855 - protein, 9 aa, Homo Sapiens
FIRLDFSCN

SEQ ID NO: 487856 - protein, 9 aa, Homo Sapiens
CYKRSWFSG

SEQ ID NO: 487857 - protein, 9 aa, Homo Sapiens
ACCDHQDDC

SEQ ID NO: 487858 - protein, 9 aa, Homo Sapiens
IMELLESVN

SEQ ID NO: 487859 - protein, 9 aa, Homo Sapiens
YPVQMKSSG

SEQ ID NO: 487860 - protein, 9 aa, Homo Sapiens
ITTIAVLDQ

SEQ ID NO: 487861 - protein, 9 aa, Homo Sapiens
QMRPLSPGE

SEQ ID NO: 487862 - protein, 9 aa, Homo Sapiens
RSTRKQLER

SEQ ID NO: 487863 - protein, 9 aa, Homo Sapiens
VHVLVLDAN

SEQ ID NO: 487864 - protein, 9 aa, Homo Sapiens
RESKDHATF

SEQ ID NO: 487865 - protein, 9 aa, Homo Sapiens
ANYSDSAEL

SEQ ID NO: 487866 - protein, 9 aa, Homo Sapiens
ERVARLCAK

SEQ ID NO: 487867 - protein, 9 aa, Homo Sapiens
DNAGNTTFL

SEQ ID NO: 487868 - protein, 9 aa, Homo Sapiens
RAAGGWNLP

SEQ ID NO: 487869 - protein, 9 aa, Homo Sapiens
GGQKPYECN

SEQ ID NO: 487870 - protein, 9 aa, Homo Sapiens
NGRVLFSAD

SEQ ID NO: 487871 - protein, 9 aa, Homo Sapiens
DGDMKQEPG

SEQ ID NO: 487872 - protein, 9 aa, Homo Sapiens
MKEKCKNAA

SEQ ID NO: 487873 - protein, 9 aa, Homo Sapiens
LILLLIPVK

SEQ ID NO: 487874 - protein, 9 aa, Homo Sapiens
AVDNLADAK

SEQ ID NO: 487875 - protein, 9 aa, Homo Sapiens
ENMNFSEAQ

SEQ ID NO: 487876 - protein, 9 aa, Homo Sapiens
FHVGPKEKP

SEQ ID NO: 487877 - protein, 9 aa, Homo Sapiens
IKRSDRIYW

SEQ ID NO: 487878 - protein, 9 aa, Homo Sapiens
WSRCRVRPA

SEQ ID NO: 487879 - protein, 9 aa, Homo Sapiens
LSTKQQKLY

SEQ ID NO: 487880 - protein, 9 aa, Homo Sapiens
FITSLLQDS

SEQ ID NO: 487881 - protein, 9 aa, Homo Sapiens
MIVGRTYSL

SEQ ID NO: 487882 - protein, 9 aa, Homo Sapiens
EKCKNAAKT

SEQ ID NO: 487883 - protein, 9 aa, Homo Sapiens
KDAVTARTS

SEQ ID NO: 487884 - protein, 9 aa, Homo Sapiens
HHRSQSSLT

SEQ ID NO: 487885 - protein, 9 aa, Homo Sapiens
KFSEEEIKP

SEQ ID NO: 487886 - protein, 9 aa, Homo Sapiens
GWIIVEILK

SEQ ID NO: 487887 - protein, 9 aa, Homo Sapiens
MFWETSLDS

SEQ ID NO: 487888 - protein, 9 aa, Homo Sapiens
LTPSGYLEL

SEQ ID NO: 487889 - protein, 9 aa, Homo Sapiens
QELIGDYSK

SEQ ID NO: 487890 - protein, 9 aa, Homo Sapiens
VKQKRSGTL

SEQ ID NO: 487891 - protein, 9 aa, Homo Sapiens
MKQEPGMYR

SEQ ID NO: 487892 - protein, 9 aa, Homo Sapiens
TTIAVLDQE

SEQ ID NO: 487893 - protein, 9 aa, Homo Sapiens
TWSRCRVRP

SEQ ID NO: 487894 - protein, 9 aa, Homo Sapiens
GTFNYNPDV

SEQ ID NO: 487895 - protein, 9 aa, Homo Sapiens
EIKAKNVTN

SEQ ID NO: 487896 - protein, 9 aa, Homo Sapiens
RRFINFQFQ

SEQ ID NO: 487897 - protein, 9 aa, Homo Sapiens
WKKVYNSLE

SEQ ID NO: 487898 - protein, 9 aa, Homo Sapiens
VNLLSPHSK

SEQ ID NO: 487899 - protein, 9 aa, Homo Sapiens
THGGQKPYE

SEQ ID NO: 487900 - protein, 8 aa, Homo Sapiens
PALRPALL

SEQ ID NO: 487901 - protein, 9 aa, Homo Sapiens
PEDRPKFQQ

SEQ ID NO: 487902 - protein, 9 aa, Homo Sapiens
RMRGGLLRE

SEQ ID NO: 487903 - protein, 9 aa, Homo Sapiens
EIKPLPPTL

SEQ ID NO: 487904 - protein, 9 aa, Homo Sapiens
SLIAVGNHG

SEQ ID NO: 487905 - protein, 9 aa, Homo Sapiens
KGLRSEHRD

SEQ ID NO: 487906 - protein, 9 aa, Homo Sapiens
KNKIKTESG

SEQ ID NO: 487907 - protein, 9 aa, Homo Sapiens
WNEDDDIKS

SEQ ID NO: 487908 - protein, 9 aa, Homo Sapiens
ALRQMGYTK

SEQ ID NO: 487909 - protein, 9 aa, Homo Sapiens
RRPAKDAHL

SEQ ID NO: 487910 - protein, 9 aa, Homo Sapiens
KVHLSDSQR

SEQ ID NO: 487911 - protein, 9 aa, Homo Sapiens
LKQRIQNLS

SEQ ID NO: 487912 - protein, 9 aa, Homo Sapiens
HNLLLAYAK

SEQ ID NO: 487913 - protein, 9 aa, Homo Sapiens
GEVTLHFQF

SEQ ID NO: 487914 - protein, 9 aa, Homo Sapiens
LPVQANKHA

SEQ ID NO: 487915 - protein, 9 aa, Homo Sapiens
LLNVTLILA

SEQ ID NO: 487916 - protein, 9 aa, Homo Sapiens
WQSVLLSHQ

SEQ ID NO: 487917 - protein, 9 aa, Homo Sapiens
SPLLIMMFK

SEQ ID NO: 487918 - protein, 9 aa, Homo Sapiens
FKMIFNQTS

SEQ ID NO: 487919 - protein, 9 aa, Homo Sapiens
ASPCGEPQE

SEQ ID NO: 487920 - protein, 9 aa, Homo Sapiens
NFFFWLPCP

SEQ ID NO: 487921 - protein, 9 aa, Homo Sapiens
VCDKEALLG

SEQ ID NO: 487922 - protein, 9 aa, Homo Sapiens
HQHFKQEQE

SEQ ID NO: 487923 - protein, 9 aa, Homo Sapiens
KMEIKAKNV

SEQ ID NO: 487924 - protein, 9 aa, Homo Sapiens
KTSGHKAGD

SEQ ID NO: 487925 - protein, 9 aa, Homo Sapiens
SEALVHVLV

SEQ ID NO: 487926 - protein, 9 aa, Homo Sapiens
IAAEFNKEE

SEQ ID NO: 487927 - protein, 9 aa, Homo Sapiens
VVIILEAVP

SEQ ID NO: 487928 - protein, 9 aa, Homo Sapiens
EESECKQNA

SEQ ID NO: 487929 - protein, 9 aa, Homo Sapiens
LDRCYLTPS

SEQ ID NO: 487930 - protein, 9 aa, Homo Sapiens
DGVNSLSCL

SEQ ID NO: 487931 - protein, 9 aa, Homo Sapiens
SGVLKCGIA

SEQ ID NO: 487932 - protein, 9 aa, Homo Sapiens
SAVQSPRAH

SEQ ID NO: 487933 - protein, 9 aa, Homo Sapiens
CQHQFQGRR

SEQ ID NO: 487934 - protein, 9 aa, Homo Sapiens
SSGHTEISS

SEQ ID NO: 487935 - protein, 9 aa, Homo Sapiens
LSAQSLDKN

SEQ ID NO: 487936 - protein, 9 aa, Homo Sapiens
IRMCRQGFP

SEQ ID NO: 487937 - protein, 9 aa, Homo Sapiens
VDPSTHCYG

SEQ ID NO: 487938 - protein, 9 aa, Homo Sapiens
STKVPQCSP

SEQ ID NO: 487939 - protein, 9 aa, Homo Sapiens
EVRASENGR

SEQ ID NO: 487940 - protein, 9 aa, Homo Sapiens
PFGEAGTAG

SEQ ID NO: 487941 - protein, 9 aa, Homo Sapiens
VRASENGRV

SEQ ID NO: 487942 - protein, 9 aa, Homo Sapiens
DDHIDWLLQ

SEQ ID NO: 487943 - protein, 9 aa, Homo Sapiens
FKSENKVVD

SEQ ID NO: 487944 - protein, 9 aa, Homo Sapiens
ETPKEDDEH

SEQ ID NO: 487945 - protein, 9 aa, Homo Sapiens
VSSGSTETT

SEQ ID NO: 487946 - protein, 9 aa, Homo Sapiens
QACHDFMKA

SEQ ID NO: 487947 - protein, 9 aa, Homo Sapiens
KNVNPVILV

SEQ ID NO: 487948 - protein, 9 aa, Homo Sapiens
VTQAIKDAL

SEQ ID NO: 487949 - protein, 9 aa, Homo Sapiens
TPCFALPQG

SEQ ID NO: 487950 - protein, 9 aa, Homo Sapiens
ETRCSVAVK

SEQ ID NO: 487951 - protein, 9 aa, Homo Sapiens
VVEVDPSTH

SEQ ID NO: 487952 - protein, 9 aa, Homo Sapiens
PEETMPFQL

SEQ ID NO: 487953 - protein, 9 aa, Homo Sapiens
EPRKVIVLV

SEQ ID NO: 487954 - protein, 9 aa, Homo Sapiens
RFPKVAQQP

SEQ ID NO: 487955 - protein, 9 aa, Homo Sapiens
KAVSGPMPD

SEQ ID NO: 487956 - protein, 9 aa, Homo Sapiens
LCHTDATAI

SEQ ID NO: 487957 - protein, 9 aa, Homo Sapiens
PLDGLEPGK

SEQ ID NO: 487958 - protein, 9 aa, Homo Sapiens
ANKHTFNRP

SEQ ID NO: 487959 - protein, 9 aa, Homo Sapiens
KEKPNSRSK

SEQ ID NO: 487960 - protein, 9 aa, Homo Sapiens
GHCGLLSKN

SEQ ID NO: 487961 - protein, 9 aa, Homo Sapiens
LKEVWVSTA

SEQ ID NO: 487962 - protein, 9 aa, Homo Sapiens
ADLWLLNDF

SEQ ID NO: 487963 - protein, 9 aa, Homo Sapiens
LEQANNLYM

SEQ ID NO: 487964 - protein, 9 aa, Homo Sapiens
KCAFSPQGS

SEQ ID NO: 487965 - protein, 9 aa, Homo Sapiens
HYFSAILLI

SEQ ID NO: 487966 - protein, 9 aa, Homo Sapiens
PSTLSANSL

SEQ ID NO: 487967 - protein, 9 aa, Homo Sapiens
LTGKQSSAD

SEQ ID NO: 487968 - protein, 9 aa, Homo Sapiens
GVLEGIRMC

SEQ ID NO: 487969 - protein, 9 aa, Homo Sapiens
FLKGRKIKL

SEQ ID NO: 487970 - protein, 9 aa, Homo Sapiens
LQHSNLVTH

SEQ ID NO: 487971 - protein, 9 aa, Homo Sapiens
NATNIGLSV

SEQ ID NO: 487972 - protein, 9 aa, Homo Sapiens
TEVFFLKND

SEQ ID NO: 487973 - protein, 9 aa, Homo Sapiens
KAAFFPPPA

SEQ ID NO: 487974 - protein, 9 aa, Homo Sapiens
CHDICKNLK

SEQ ID NO: 487975 - protein, 9 aa, Homo Sapiens
VFWTDCMNG

SEQ ID NO: 487976 - protein, 9 aa, Homo Sapiens
NKDDDIHID

SEQ ID NO: 487977 - protein, 9 aa, Homo Sapiens
EKVHLSDSQ

SEQ ID NO: 487978 - protein, 9 aa, Homo Sapiens
ANDSVRSLK

SEQ ID NO: 487979 - protein, 9 aa, Homo Sapiens
TLANKHTFN

SEQ ID NO: 487980 - protein, 9 aa, Homo Sapiens
VGKGPPKIS

SEQ ID NO: 487981 - protein, 9 aa, Homo Sapiens
TIMKCAFSP

SEQ ID NO: 487982 - protein, 9 aa, Homo Sapiens
YNPDVYCSK

SEQ ID NO: 487983 - protein, 9 aa, Homo Sapiens
GPFGEAGTA

SEQ ID NO: 487984 - protein, 9 aa, Homo Sapiens
GEAFKYWYE

SEQ ID NO: 487985 - protein, 9 aa, Homo Sapiens
KSVLNYFQP

SEQ ID NO: 487986 - protein, 9 aa, Homo Sapiens
PESPGAEGC

SEQ ID NO: 487987 - protein, 9 aa, Homo Sapiens
TVLGRWDLF

SEQ ID NO: 487988 - protein, 9 aa, Homo Sapiens
FLLLTDTPC

SEQ ID NO: 487989 - protein, 9 aa, Homo Sapiens
QLVYFSESG

SEQ ID NO: 487990 - protein, 9 aa, Homo Sapiens
ACYSLICHD

SEQ ID NO: 487991 - protein, 9 aa, Homo Sapiens
VGESEGAVR

SEQ ID NO: 487992 - protein, 9 aa, Homo Sapiens
TPMPFIIGV

SEQ ID NO: 487993 - protein, 9 aa, Homo Sapiens
RMCRQGFPN

SEQ ID NO: 487994 - protein, 9 aa, Homo Sapiens
QAGRGQVLV

SEQ ID NO: 487995 - protein, 9 aa, Homo Sapiens
DRLLPSANY

SEQ ID NO: 487996 - protein, 9 aa, Homo Sapiens
KTLKSLTHL

SEQ ID NO: 487997 - protein, 9 aa, Homo Sapiens
IHPESLQGA

SEQ ID NO: 487998 - protein, 9 aa, Homo Sapiens
LKEPPRKLL

SEQ ID NO: 487999 - protein, 9 aa, Homo Sapiens
ASEPRKVIV

SEQ ID NO: 488000 - protein, 9 aa, Homo Sapiens
SLPRPKRKS

SEQ ID NO: 488001 - protein, 9 aa, Homo Sapiens
WTEVFFLKN

SEQ ID NO: 488002 - protein, 9 aa, Homo Sapiens
DQLKATLPE

SEQ ID NO: 488003 - protein, 9 aa, Homo Sapiens
MLYVKPPPT

SEQ ID NO: 488004 - protein, 9 aa, Homo Sapiens
LVYNATNST

SEQ ID NO: 488005 - protein, 9 aa, Homo Sapiens
IKAKNVTNY

SEQ ID NO: 488006 - protein, 9 aa, Homo Sapiens
DMSMKHRYK

SEQ ID NO: 488007 - protein, 9 aa, Homo Sapiens
NFHTDNKSL

SEQ ID NO: 488008 - protein, 9 aa, Homo Sapiens
CKPVKGWII

SEQ ID NO: 488009 - protein, 9 aa, Homo Sapiens
AHHLPIQMD

SEQ ID NO: 488010 - protein, 9 aa, Homo Sapiens
VSKKREESY

SEQ ID NO: 488011 - protein, 9 aa, Homo Sapiens
VLTQNATNI

SEQ ID NO: 488012 - protein, 9 aa, Homo Sapiens
DPVSDKFLK

SEQ ID NO: 488013 - protein, 9 aa, Homo Sapiens
GNLCFMDIC

SEQ ID NO: 488014 - protein, 9 aa, Homo Sapiens
TVTTISGLD

SEQ ID NO: 488015 - protein, 9 aa, Homo Sapiens
VAMLATIDL

SEQ ID NO: 488016 - protein, 9 aa, Homo Sapiens
KKKTSGHKA

SEQ ID NO: 488017 - protein, 9 aa, Homo Sapiens
WSPLLIMMF

SEQ ID NO: 488018 - protein, 9 aa, Homo Sapiens
EFVSGRFPY

SEQ ID NO: 488019 - protein, 9 aa, Homo Sapiens
LKFLKGRKI

SEQ ID NO: 488020 - protein, 9 aa, Homo Sapiens
IVGRTYSLT

SEQ ID NO: 488021 - protein, 9 aa, Homo Sapiens
ADLIKFFKT

SEQ ID NO: 488022 - protein, 9 aa, Homo Sapiens
KLYYPPRPQ

SEQ ID NO: 488023 - protein, 9 aa, Homo Sapiens
LNAQQVSQF

SEQ ID NO: 488024 - protein, 9 aa, Homo Sapiens
EHSDYKAKL

SEQ ID NO: 488025 - protein, 9 aa, Homo Sapiens
EIADIATSE

SEQ ID NO: 488026 - protein, 9 aa, Homo Sapiens
SQYREQLKL

SEQ ID NO: 488027 - protein, 9 aa, Homo Sapiens
KDACGNSED

SEQ ID NO: 488028 - protein, 9 aa, Homo Sapiens
LVSETEVEE

SEQ ID NO: 488029 - protein, 9 aa, Homo Sapiens
GKRDACFFF

SEQ ID NO: 488030 - protein, 9 aa, Homo Sapiens
KGPPKISNK

SEQ ID NO: 488031 - protein, 9 aa, Homo Sapiens
VEECMTAEF

SEQ ID NO: 488032 - protein, 9 aa, Homo Sapiens
INFQFQDSN

SEQ ID NO: 488033 - protein, 9 aa, Homo Sapiens
QCKPVKGWI

SEQ ID NO: 488034 - protein, 9 aa, Homo Sapiens
QRERFHVGP

SEQ ID NO: 488035 - protein, 9 aa, Homo Sapiens
FWETSLDSH

SEQ ID NO: 488036 - protein, 9 aa, Homo Sapiens
CALAYTMER

SEQ ID NO: 488037 - protein, 9 aa, Homo Sapiens
PRGDFPSTI

SEQ ID NO: 488038 - protein, 9 aa, Homo Sapiens
SKDDLVAGA

SEQ ID NO: 488039 - protein, 9 aa, Homo Sapiens
HLHMPMYSF

SEQ ID NO: 488040 - protein, 9 aa, Homo Sapiens
YLFVAMLAT

SEQ ID NO: 488041 - protein, 9 aa, Homo Sapiens
SERNLLKVS

SEQ ID NO: 488042 - protein, 9 aa, Homo Sapiens
KLLHELALS

SEQ ID NO: 488043 - protein, 9 aa, Homo Sapiens
CYGNKNNFK

SEQ ID NO: 488044 - protein, 9 aa, Homo Sapiens
VTAPRPGQK

SEQ ID NO: 488045 - protein, 9 aa, Homo Sapiens
AVGLLDPSA

SEQ ID NO: 488046 - protein, 9 aa, Homo Sapiens
YPPRPQDLR

SEQ ID NO: 488047 - protein, 9 aa, Homo Sapiens
GFQNIACLC

SEQ ID NO: 488048 - protein, 9 aa, Homo Sapiens
LLLAYAKVW

SEQ ID NO: 488049 - protein, 9 aa, Homo Sapiens
SFTHTTTKE

SEQ ID NO: 488050 - protein, 9 aa, Homo Sapiens
CKQNALGKC

SEQ ID NO: 488051 - protein, 9 aa, Homo Sapiens
IVQHSCFSL

SEQ ID NO: 488052 - protein, 9 aa, Homo Sapiens
CVDGVNSLS

SEQ ID NO: 488053 - protein, 9 aa, Homo Sapiens
PFMSLESTH

SEQ ID NO: 488054 - protein, 9 aa, Homo Sapiens
PRKLLHELA

SEQ ID NO: 488055 - protein, 9 aa, Homo Sapiens
TYVDLLKAE

SEQ ID NO: 488056 - protein, 9 aa, Homo Sapiens
YCPWCYKRS

SEQ ID NO: 488057 - protein, 9 aa, Homo Sapiens
EVSALAASL

SEQ ID NO: 488058 - protein, 9 aa, Homo Sapiens
EVSFTLSTF

SEQ ID NO: 488059 - protein, 9 aa, Homo Sapiens
LCRNLENIQ

SEQ ID NO: 488060 - protein, 9 aa, Homo Sapiens
DRIKVRVWN

SEQ ID NO: 488061 - protein, 9 aa, Homo Sapiens
KAKLTQIRQ

SEQ ID NO: 488062 - protein, 9 aa, Homo Sapiens
KKVYNSLEP

SEQ ID NO: 488063 - protein, 9 aa, Homo Sapiens
HFSIIRATH

SEQ ID NO: 488064 - protein, 9 aa, Homo Sapiens
NSEDWNKVS

SEQ ID NO: 488065 - protein, 9 aa, Homo Sapiens
REEVCDKEA

SEQ ID NO: 488066 - protein, 9 aa, Homo Sapiens
HELQDNFRE

SEQ ID NO: 488067 - protein, 9 aa, Homo Sapiens
LDTNMIELS

SEQ ID NO: 488068 - protein, 9 aa, Homo Sapiens
VNTQTRPYG

SEQ ID NO: 488069 - protein, 9 aa, Homo Sapiens
YTRDFLKQI

SEQ ID NO: 488070 - protein, 9 aa, Homo Sapiens
RFINFQFQD

SEQ ID NO: 488071 - protein, 9 aa, Homo Sapiens
NLPISVLVK

SEQ ID NO: 488072 - protein, 9 aa, Homo Sapiens
VTGERSQYL

SEQ ID NO: 488073 - protein, 9 aa, Homo Sapiens
MSMKHRYKL

SEQ ID NO: 488074 - protein, 9 aa, Homo Sapiens
PCCACLEAK

SEQ ID NO: 488075 - protein, 9 aa, Homo Sapiens
LMVIHYLED

SEQ ID NO: 488076 - protein, 9 aa, Homo Sapiens
QGRRWNCTT

SEQ ID NO: 488077 - protein, 9 aa, Homo Sapiens
PQGMPGLGP

SEQ ID NO: 488078 - protein, 9 aa, Homo Sapiens
ENIQAGRGQ

SEQ ID NO: 488079 - protein, 9 aa, Homo Sapiens
TLSTFPNFL

SEQ ID NO: 488080 - protein, 9 aa, Homo Sapiens
DYTRDFLKQ

SEQ ID NO: 488081 - protein, 9 aa, Homo Sapiens
QANNLYMEL

SEQ ID NO: 488082 - protein, 9 aa, Homo Sapiens
TSSGHTEIS

SEQ ID NO: 488083 - protein, 9 aa, Homo Sapiens
KRQNDKIHG

SEQ ID NO: 488084 - protein, 9 aa, Homo Sapiens
GSSKTRGER

SEQ ID NO: 488085 - protein, 9 aa, Homo Sapiens
GERSQYLVT

SEQ ID NO: 488086 - protein, 9 aa, Homo Sapiens
CRNLENIQA

SEQ ID NO: 488087 - protein, 9 aa, Homo Sapiens
VSVGSSKTR

SEQ ID NO: 488088 - protein, 9 aa, Homo Sapiens
DGLEPGKAA

SEQ ID NO: 488089 - protein, 9 aa, Homo Sapiens
QVLSCNFLP

SEQ ID NO: 488090 - protein, 9 aa, Homo Sapiens
ILLLIPVKD

SEQ ID NO: 488091 - protein, 9 aa, Homo Sapiens
TVYSATEGY

SEQ ID NO: 488092 - protein, 9 aa, Homo Sapiens
WLCNHEHQN

SEQ ID NO: 488093 - protein, 9 aa, Homo Sapiens
CCACLEAKR

SEQ ID NO: 488094 - protein, 9 aa, Homo Sapiens
HSETEEMGD

SEQ ID NO: 488095 - protein, 9 aa, Homo Sapiens
INESVQLNL

SEQ ID NO: 488096 - protein, 9 aa, Homo Sapiens
KHENGVKWR

SEQ ID NO: 488097 - protein, 9 aa, Homo Sapiens
DAVTARTSL

SEQ ID NO: 488098 - protein, 9 aa, Homo Sapiens
QHQFQGRRW

SEQ ID NO: 488099 - protein, 9 aa, Homo Sapiens
YFAIQPWPS

SEQ ID NO: 488100 - protein, 9 aa, Homo Sapiens
SYEEDSQCL

SEQ ID NO: 488101 - protein, 9 aa, Homo Sapiens
QLFSGTNVT

SEQ ID NO: 488102 - protein, 9 aa, Homo Sapiens
NPLTSTPVS

SEQ ID NO: 488103 - protein, 9 aa, Homo Sapiens
DPSTHCYGL

SEQ ID NO: 488104 - protein, 9 aa, Homo Sapiens
RSGDFKKFQ

SEQ ID NO: 488105 - protein, 9 aa, Homo Sapiens
LFKSENKVV

SEQ ID NO: 488106 - protein, 9 aa, Homo Sapiens
KDGNEVWLY

SEQ ID NO: 488107 - protein, 9 aa, Homo Sapiens
QLGKRQLLS

SEQ ID NO: 488108 - protein, 9 aa, Homo Sapiens
RRIHPESLQ

SEQ ID NO: 488109 - protein, 9 aa, Homo Sapiens
HVLQHFQPL

SEQ ID NO: 488110 - protein, 9 aa, Homo Sapiens
NKHTFNRPV

SEQ ID NO: 488111 - protein, 9 aa, Homo Sapiens
YYCKNCASL

SEQ ID NO: 488112 - protein, 9 aa, Homo Sapiens
PWPSSEKIA

SEQ ID NO: 488113 - protein, 9 aa, Homo Sapiens
HQELIGDYS

SEQ ID NO: 488114 - protein, 9 aa, Homo Sapiens
LYVKPPPTI

SEQ ID NO: 488115 - protein, 9 aa, Homo Sapiens
GCSQPKRVK

SEQ ID NO: 488116 - protein, 9 aa, Homo Sapiens
LGHAPRTSS

SEQ ID NO: 488117 - protein, 9 aa, Homo Sapiens
SQDGQKNIE

SEQ ID NO: 488118 - protein, 9 aa, Homo Sapiens
DSQCLHIQS

SEQ ID NO: 488119 - protein, 9 aa, Homo Sapiens
DSEPSVNLL

SEQ ID NO: 488120 - protein, 9 aa, Homo Sapiens
LEWWSCTKC

SEQ ID NO: 488121 - protein, 9 aa, Homo Sapiens
YHSDKFRAY

SEQ ID NO: 488122 - protein, 9 aa, Homo Sapiens
HATFSDIYL

SEQ ID NO: 488123 - protein, 9 aa, Homo Sapiens
VKGLQNRHN

SEQ ID NO: 488124 - protein, 9 aa, Homo Sapiens
CMTAEFRKY

SEQ ID NO: 488125 - protein, 9 aa, Homo Sapiens
YEALKKSVS

SEQ ID NO: 488126 - protein, 9 aa, Homo Sapiens
QEFQHLKGD

SEQ ID NO: 488127 - protein, 9 aa, Homo Sapiens
CAKRLREAG

SEQ ID NO: 488128 - protein, 9 aa, Homo Sapiens
ASENGRVLF

SEQ ID NO: 488129 - protein, 9 aa, Homo Sapiens
KLIESTDAE

SEQ ID NO: 488130 - protein, 9 aa, Homo Sapiens
LLTDTPCFA

SEQ ID NO: 488131 - protein, 9 aa, Homo Sapiens
RKVIVLVNK

SEQ ID NO: 488132 - protein, 9 aa, Homo Sapiens
ILEAVPSHL

SEQ ID NO: 488133 - protein, 9 aa, Homo Sapiens
FKQEQEGVE

SEQ ID NO: 488134 - protein, 9 aa, Homo Sapiens
AKYGRRSAT

SEQ ID NO: 488135 - protein, 9 aa, Homo Sapiens
INSSHELQD

SEQ ID NO: 488136 - protein, 9 aa, Homo Sapiens
NSSHELQDN

SEQ ID NO: 488137 - protein, 9 aa, Homo Sapiens
ESECKQNAL

SEQ ID NO: 488138 - protein, 9 aa, Homo Sapiens
MQWLCNHEH

SEQ ID NO: 488139 - protein, 9 aa, Homo Sapiens
CWALDPEDR

SEQ ID NO: 488140 - protein, 9 aa, Homo Sapiens
QHFKQEQEG

SEQ ID NO: 488141 - protein, 9 aa, Homo Sapiens
NNFKEEQQC

SEQ ID NO: 488142 - protein, 9 aa, Homo Sapiens
SAILLIDHQ

SEQ ID NO: 488143 - protein, 9 aa, Homo Sapiens
EEIKPLPPT

SEQ ID NO: 488144 - protein, 9 aa, Homo Sapiens
GQEDKNKIK

SEQ ID NO: 488145 - protein, 9 aa, Homo Sapiens
RGGLLREAP

SEQ ID NO: 488146 - protein, 9 aa, Homo Sapiens
IITLMMNPL

SEQ ID NO: 488147 - protein, 9 aa, Homo Sapiens
ADLRTHTGE

SEQ ID NO: 488148 - protein, 9 aa, Homo Sapiens
VSFTLSTFP

SEQ ID NO: 488149 - protein, 9 aa, Homo Sapiens
GESEGAVRE

SEQ ID NO: 488150 - protein, 9 aa, Homo Sapiens
SGSHSGSEK

SEQ ID NO: 488151 - protein, 9 aa, Homo Sapiens
FQHGPVSEA

SEQ ID NO: 488152 - protein, 9 aa, Homo Sapiens
AIKDALDSG

SEQ ID NO: 488153 - protein, 9 aa, Homo Sapiens
DQESPNVKN

SEQ ID NO: 488154 - protein, 9 aa, Homo Sapiens
SGVKVAATK

SEQ ID NO: 488155 - protein, 9 aa, Homo Sapiens
ASRRIHPES

SEQ ID NO: 488156 - protein, 9 aa, Homo Sapiens
QSLVLTITP

SEQ ID NO: 488157 - protein, 9 aa, Homo Sapiens
EIEQAYEKF

SEQ ID NO: 488158 - protein, 9 aa, Homo Sapiens
KQIFVEAKL

SEQ ID NO: 488159 - protein, 9 aa, Homo Sapiens
IKSHVFYET

SEQ ID NO: 488160 - protein, 9 aa, Homo Sapiens
SWGQLNFFF

SEQ ID NO: 488161 - protein, 9 aa, Homo Sapiens
YKVQICRYK

SEQ ID NO: 488162 - protein, 9 aa, Homo Sapiens
DRPKFQQLV

SEQ ID NO: 488163 - protein, 9 aa, Homo Sapiens
TEFEAYKHT

SEQ ID NO: 488164 - protein, 9 aa, Homo Sapiens
HSLLASTTE

SEQ ID NO: 488165 - protein, 9 aa, Homo Sapiens
TALKFLKGR

SEQ ID NO: 488166 - protein, 9 aa, Homo Sapiens
PMSAMWPSA

SEQ ID NO: 488167 - protein, 9 aa, Homo Sapiens
VEGKAQNHL

SEQ ID NO: 488168 - protein, 9 aa, Homo Sapiens
LVNTQTRPY

SEQ ID NO: 488169 - protein, 9 aa, Homo Sapiens
PVSDKFLKE

SEQ ID NO: 488170 - protein, 9 aa, Homo Sapiens
LLEWWSCTK

SEQ ID NO: 488171 - protein, 9 aa, Homo Sapiens
HIDWLLQKK

SEQ ID NO: 488172 - protein, 9 aa, Homo Sapiens
DGEAFKYWY

SEQ ID NO: 488173 - protein, 9 aa, Homo Sapiens
AVPSSTKLA

SEQ ID NO: 488174 - protein, 9 aa, Homo Sapiens
LKEKVPKEK

SEQ ID NO: 488175 - protein, 9 aa, Homo Sapiens
QQVSQFLHT

SEQ ID NO: 488176 - protein, 9 aa, Homo Sapiens
DRCYLTPSG

SEQ ID NO: 488177 - protein, 9 aa, Homo Sapiens
YLQGCSMPA

SEQ ID NO: 488178 - protein, 9 aa, Homo Sapiens
GKAQNHLEE

SEQ ID NO: 488179 - protein, 9 aa, Homo Sapiens
LPRPKRKSI

SEQ ID NO: 488180 - protein, 9 aa, Homo Sapiens
SSVSAPPSR

SEQ ID NO: 488181 - protein, 9 aa, Homo Sapiens
KHENINFKQ

SEQ ID NO: 488182 - protein, 9 aa, Homo Sapiens
SPVPGSKDD

SEQ ID NO: 488183 - protein, 9 aa, Homo Sapiens
NIACLCSNA

SEQ ID NO: 488184 - protein, 9 aa, Homo Sapiens
PVSSGSTET

SEQ ID NO: 488185 - protein, 9 aa, Homo Sapiens
MVIHYLEDC

SEQ ID NO: 488186 - protein, 9 aa, Homo Sapiens
YVFWTDCMN

SEQ ID NO: 488187 - protein, 9 aa, Homo Sapiens
VKLIESTDA

SEQ ID NO: 488188 - protein, 9 aa, Homo Sapiens
VRELFQMAR

SEQ ID NO: 488189 - protein, 9 aa, Homo Sapiens
TRHMSACWQ

SEQ ID NO: 488190 - protein, 9 aa, Homo Sapiens
DCMKAKVPL

SEQ ID NO: 488191 - protein, 9 aa, Homo Sapiens
PPEETMPFQ

SEQ ID NO: 488192 - protein, 9 aa, Homo Sapiens
HFKQEQEGV

SEQ ID NO: 488193 - protein, 9 aa, Homo Sapiens
EPGKAAFFP

SEQ ID NO: 488194 - protein, 9 aa, Homo Sapiens
SLETASSSV

SEQ ID NO: 488195 - protein, 9 aa, Homo Sapiens
KCKNAAKTR

SEQ ID NO: 488196 - protein, 9 aa, Homo Sapiens
KEALLGMDL

SEQ ID NO: 488197 - protein, 9 aa, Homo Sapiens
YKRSWFSGC

SEQ ID NO: 488198 - protein, 9 aa, Homo Sapiens
DKMNRMRQR

SEQ ID NO: 488199 - protein, 9 aa, Homo Sapiens
FGVFLVLLN

SEQ ID NO: 488200 - protein, 9 aa, Homo Sapiens
YYKDGEAFK

SEQ ID NO: 488201 - protein, 9 aa, Homo Sapiens
KDSEKDEKD

SEQ ID NO: 488202 - protein, 9 aa, Homo Sapiens
EATCNTSGS

SEQ ID NO: 488203 - protein, 9 aa, Homo Sapiens
RDHCAKRLR

SEQ ID NO: 488204 - protein, 9 aa, Homo Sapiens
NGTVRIWHS

SEQ ID NO: 488205 - protein, 9 aa, Homo Sapiens
ALANLGRAN

SEQ ID NO: 488206 - protein, 9 aa, Homo Sapiens
GGWNLPPPA

SEQ ID NO: 488207 - protein, 9 aa, Homo Sapiens
CLCSNAMKH

SEQ ID NO: 488208 - protein, 9 aa, Homo Sapiens
LTLYVPIIT

SEQ ID NO: 488209 - protein, 9 aa, Homo Sapiens
RPFLTTIVQ

SEQ ID NO: 488210 - protein, 9 aa, Homo Sapiens
LLDSDHQEL

SEQ ID NO: 488211 - protein, 9 aa, Homo Sapiens
TSLDSHHHL

SEQ ID NO: 488212 - protein, 9 aa, Homo Sapiens
RSLLSSAKN

SEQ ID NO: 488213 - protein, 9 aa, Homo Sapiens
VGLLDPSAD

SEQ ID NO: 488214 - protein, 9 aa, Homo Sapiens
YADSNEDQH

SEQ ID NO: 488215 - protein, 9 aa, Homo Sapiens
KAERKAAEA

SEQ ID NO: 488216 - protein, 9 aa, Homo Sapiens
GIVQSKLDS

SEQ ID NO: 488217 - protein, 9 aa, Homo Sapiens
YVKPPPTIN

SEQ ID NO: 488218 - protein, 9 aa, Homo Sapiens
SGSGVLKCG

SEQ ID NO: 488219 - protein, 9 aa, Homo Sapiens
DFAVPSSTK

SEQ ID NO: 488220 - protein, 9 aa, Homo Sapiens
TAIDSKFEG

SEQ ID NO: 488221 - protein, 9 aa, Homo Sapiens
NEDQHDAYL

SEQ ID NO: 488222 - protein, 9 aa, Homo Sapiens
EKKDNNEDK

SEQ ID NO: 488223 - protein, 9 aa, Homo Sapiens
TNMIELSNM

SEQ ID NO: 488224 - protein, 9 aa, Homo Sapiens
VTARTSLGI

SEQ ID NO: 488225 - protein, 9 aa, Homo Sapiens
FLTTIVQHS

SEQ ID NO: 488226 - protein, 9 aa, Homo Sapiens
DSEVSALAA

SEQ ID NO: 488227 - protein, 9 aa, Homo Sapiens
YAFQEQTTK

SEQ ID NO: 488228 - protein, 9 aa, Homo Sapiens
APSQFLVKV

SEQ ID NO: 488229 - protein, 9 aa, Homo Sapiens
SQFLHTYSA

SEQ ID NO: 488230 - protein, 9 aa, Homo Sapiens
GLDLSGARL

SEQ ID NO: 488231 - protein, 9 aa, Homo Sapiens
LPSANYSDS

SEQ ID NO: 488232 - protein, 9 aa, Homo Sapiens
LGKRQLLSV

SEQ ID NO: 488233 - protein, 9 aa, Homo Sapiens
ISKVSLVSA

SEQ ID NO: 488234 - protein, 9 aa, Homo Sapiens
QLDGEGFGD

SEQ ID NO: 488235 - protein, 9 aa, Homo Sapiens
AEVAILTRN

SEQ ID NO: 488236 - protein, 9 aa, Homo Sapiens
DAYQSFTHT

SEQ ID NO: 488237 - protein, 9 aa, Homo Sapiens
SLLQDSGRV

SEQ ID NO: 488238 - protein, 9 aa, Homo Sapiens
VKKHSGGDR

SEQ ID NO: 488239 - protein, 9 aa, Homo Sapiens
QGCSMPAVA

SEQ ID NO: 488240 - protein, 9 aa, Homo Sapiens
NKSLKTHSV

SEQ ID NO: 488241 - protein, 9 aa, Homo Sapiens
LGSGSGVLK

SEQ ID NO: 488242 - protein, 9 aa, Homo Sapiens
KQLERDRLD

SEQ ID NO: 488243 - protein, 9 aa, Homo Sapiens
SFLSNLSFL

SEQ ID NO: 488244 - protein, 9 aa, Homo Sapiens
LRFPKVAQQ

SEQ ID NO: 488245 - protein, 9 aa, Homo Sapiens
ECKQNALGK

SEQ ID NO: 488246 - protein, 9 aa, Homo Sapiens
KFRAYDWGN

SEQ ID NO: 488247 - protein, 9 aa, Homo Sapiens
IHVLQHFQP

SEQ ID NO: 488248 - protein, 9 aa, Homo Sapiens
ASYFVTDKI

SEQ ID NO: 488249 - protein, 9 aa, Homo Sapiens
SGIQSTPGL

SEQ ID NO: 488250 - protein, 9 aa, Homo Sapiens
KLYIGSTAG

SEQ ID NO: 488251 - protein, 9 aa, Homo Sapiens
DKEALLGMD

SEQ ID NO: 488252 - protein, 9 aa, Homo Sapiens
TDSPVPGSK

SEQ ID NO: 488253 - protein, 9 aa, Homo Sapiens
KYKDGNEVW

SEQ ID NO: 488254 - protein, 9 aa, Homo Sapiens
TKQQKLYIG

SEQ ID NO: 488255 - protein, 9 aa, Homo Sapiens
LCKTLKSLT

SEQ ID NO: 488256 - protein, 9 aa, Homo Sapiens
KSVSKKREE

SEQ ID NO: 488257 - protein, 9 aa, Homo Sapiens
PGVKLIEST

SEQ ID NO: 488258 - protein, 9 aa, Homo Sapiens
SNSSSEMDV

SEQ ID NO: 488259 - protein, 9 aa, Homo Sapiens
ITGSENGTV

SEQ ID NO: 488260 - protein, 9 aa, Homo Sapiens
AVSGPMPDS

SEQ ID NO: 488261 - protein, 9 aa, Homo Sapiens
EQAYEKFCL

SEQ ID NO: 488262 - protein, 9 aa, Homo Sapiens
SENGTVRIW

SEQ ID NO: 488263 - protein, 9 aa, Homo Sapiens
ICAVLTLYV

SEQ ID NO: 488264 - protein, 9 aa, Homo Sapiens
VLQHFQPLE

SEQ ID NO: 488265 - protein, 9 aa, Homo Sapiens
TLLEETPKE

SEQ ID NO: 488266 - protein, 9 aa, Homo Sapiens
TNNLNVETL

SEQ ID NO: 488267 - protein, 9 aa, Homo Sapiens
FLKEKVPKE

SEQ ID NO: 488268 - protein, 9 aa, Homo Sapiens
RLQDSSSQE

SEQ ID NO: 488269 - protein, 9 aa, Homo Sapiens
GLLDPSADL

SEQ ID NO: 488270 - protein, 9 aa, Homo Sapiens
LLLAGWILS

SEQ ID NO: 488271 - protein, 9 aa, Homo Sapiens
FYSIITLMM

SEQ ID NO: 488272 - protein, 9 aa, Homo Sapiens
QHDAAQLYF

SEQ ID NO: 488273 - protein, 9 aa, Homo Sapiens
DAVAAPYCC

SEQ ID NO: 488274 - protein, 9 aa, Homo Sapiens
VQMKSSGPP

SEQ ID NO: 488275 - protein, 9 aa, Homo Sapiens
NKHATSAKN

SEQ ID NO: 488276 - protein, 9 aa, Homo Sapiens
RYEALKKSV

SEQ ID NO: 488277 - protein, 9 aa, Homo Sapiens
AGGWNLPPP

SEQ ID NO: 488278 - protein, 9 aa, Homo Sapiens
IYYKDGEAF

SEQ ID NO: 488279 - protein, 9 aa, Homo Sapiens
ESKDHATFS

SEQ ID NO: 488280 - protein, 9 aa, Homo Sapiens
MVRELFQMA

SEQ ID NO: 488281 - protein, 9 aa, Homo Sapiens
LDSDHQELI

SEQ ID NO: 488282 - protein, 9 aa, Homo Sapiens
VKMRAGSQL

SEQ ID NO: 488283 - protein, 9 aa, Homo Sapiens
MSLESTHPS

SEQ ID NO: 488284 - protein, 9 aa, Homo Sapiens
ITGLDRANA

SEQ ID NO: 488285 - protein, 9 aa, Homo Sapiens
AVEECMTAE

SEQ ID NO: 488286 - protein, 9 aa, Homo Sapiens
ALAASLLEE

SEQ ID NO: 488287 - protein, 9 aa, Homo Sapiens
GKKKTSGHK

SEQ ID NO: 488288 - protein, 9 aa, Homo Sapiens
LTVTNVTEK

SEQ ID NO: 488289 - protein, 9 aa, Homo Sapiens
QGRWSERLM

SEQ ID NO: 488290 - protein, 9 aa, Homo Sapiens
MKCAFSPQG

SEQ ID NO: 488291 - protein, 9 aa, Homo Sapiens
ESHQYVVDD

SEQ ID NO: 488292 - protein, 9 aa, Homo Sapiens
AALAHYFSA

SEQ ID NO: 488293 - protein, 9 aa, Homo Sapiens
QEACKAYLV

SEQ ID NO: 488294 - protein, 9 aa, Homo Sapiens
DSQRKMDPA

SEQ ID NO: 488295 - protein, 9 aa, Homo Sapiens
VVKDPTKVM

SEQ ID NO: 488296 - protein, 9 aa, Homo Sapiens
RPEIADIAT

SEQ ID NO: 488297 - protein, 9 aa, Homo Sapiens
NYVFWTDCM

SEQ ID NO: 488298 - protein, 9 aa, Homo Sapiens
LCAKAERKA

SEQ ID NO: 488299 - protein, 9 aa, Homo Sapiens
WQQVIRPFL

SEQ ID NO: 488300 - protein, 9 aa, Homo Sapiens
AKDAHLPRL

SEQ ID NO: 488301 - protein, 9 aa, Homo Sapiens
KGKDLDPEV

SEQ ID NO: 488302 - protein, 9 aa, Homo Sapiens
GFEISKVSL

SEQ ID NO: 488303 - protein, 9 aa, Homo Sapiens
TLSEICEFV

SEQ ID NO: 488304 - protein, 9 aa, Homo Sapiens
MGDRRFINF

SEQ ID NO: 488305 - protein, 9 aa, Homo Sapiens
KTNGHRNHR

SEQ ID NO: 488306 - protein, 9 aa, Homo Sapiens
GGAYKAEPR

SEQ ID NO: 488307 - protein, 9 aa, Homo Sapiens
VQACHDFMK

SEQ ID NO: 488308 - protein, 9 aa, Homo Sapiens
FGEAGTAGP

SEQ ID NO: 488309 - protein, 9 aa, Homo Sapiens
DVVEVDPST

SEQ ID NO: 488310 - protein, 9 aa, Homo Sapiens
LERDRLDPL

SEQ ID NO: 488311 - protein, 9 aa, Homo Sapiens
KAKNVTNYD

SEQ ID NO: 488312 - protein, 9 aa, Homo Sapiens
LTDTPCFAL

SEQ ID NO: 488313 - protein, 9 aa, Homo Sapiens
AVPSHLNVD

SEQ ID NO: 488314 - protein, 9 aa, Homo Sapiens
GYKVQICRY

SEQ ID NO: 488315 - protein, 9 aa, Homo Sapiens
RALDTLLEE

SEQ ID NO: 488316 - protein, 9 aa, Homo Sapiens
VLILLLIPV

SEQ ID NO: 488317 - protein, 9 aa, Homo Sapiens
GHKAGDKKA

SEQ ID NO: 488318 - protein, 9 aa, Homo Sapiens
FTSLSDLHK

SEQ ID NO: 488319 - protein, 9 aa, Homo Sapiens
HQFQGRRWN

SEQ ID NO: 488320 - protein, 9 aa, Homo Sapiens
LIMMFKMIF

SEQ ID NO: 488321 - protein, 9 aa, Homo Sapiens
SLDRCYLTP

SEQ ID NO: 488322 - protein, 9 aa, Homo Sapiens
FSWGQLNFF

SEQ ID NO: 488323 - protein, 9 aa, Homo Sapiens
LGLDNAGNT

SEQ ID NO: 488324 - protein, 9 aa, Homo Sapiens
QPVRKAKMQ

SEQ ID NO: 488325 - protein, 9 aa, Homo Sapiens
SEKQLEATA

SEQ ID NO: 488326 - protein, 9 aa, Homo Sapiens
TDATAIDSK

SEQ ID NO: 488327 - protein, 9 aa, Homo Sapiens
EKHENGVKW

SEQ ID NO: 488328 - protein, 9 aa, Homo Sapiens
KGWIIVEIL

SEQ ID NO: 488329 - protein, 9 aa, Homo Sapiens
AAKGNISVQ

SEQ ID NO: 488330 - protein, 9 aa, Homo Sapiens
RGLPVQANK

SEQ ID NO: 488331 - protein, 9 aa, Homo Sapiens
EKKSFSLKE

SEQ ID NO: 488332 - protein, 9 aa, Homo Sapiens
NLGRANERV

SEQ ID NO: 488333 - protein, 9 aa, Homo Sapiens
AKSVLNYFQ

SEQ ID NO: 488334 - protein, 9 aa, Homo Sapiens
SAEPYAKHI

SEQ ID NO: 488335 - protein, 9 aa, Homo Sapiens
MKAALDISI

SEQ ID NO: 488336 - protein, 9 aa, Homo Sapiens
PYKSEECGK

SEQ ID NO: 488337 - protein, 9 aa, Homo Sapiens
NNEDKKIDF

SEQ ID NO: 488338 - protein, 9 aa, Homo Sapiens
KDSVMLNGF

SEQ ID NO: 488339 - protein, 9 aa, Homo Sapiens
CSQPKRVKF

SEQ ID NO: 488340 - protein, 9 aa, Homo Sapiens
PHSETEEMG

SEQ ID NO: 488341 - protein, 9 aa, Homo Sapiens
GSKDDLVAG

SEQ ID NO: 488342 - protein, 9 aa, Homo Sapiens
KLINSSHEL

SEQ ID NO: 488343 - protein, 9 aa, Homo Sapiens
VIILEAVPS

SEQ ID NO: 488344 - protein, 9 aa, Homo Sapiens
LVVMHLWLV

SEQ ID NO: 488345 - protein, 9 aa, Homo Sapiens
PSLPRPKRK

SEQ ID NO: 488346 - protein, 9 aa, Homo Sapiens
DLGYKVQIC

SEQ ID NO: 488347 - protein, 9 aa, Homo Sapiens
FKLEVCLFK

SEQ ID NO: 488348 - protein, 9 aa, Homo Sapiens
LLEETPKED

SEQ ID NO: 488349 - protein, 9 aa, Homo Sapiens
DEQLETLHK

SEQ ID NO: 488350 - protein, 9 aa, Homo Sapiens
EFQHGPVSE

SEQ ID NO: 488351 - protein, 9 aa, Homo Sapiens
MALQEACKA

SEQ ID NO: 488352 - protein, 9 aa, Homo Sapiens
AHYFSAILL

SEQ ID NO: 488353 - protein, 9 aa, Homo Sapiens
SHADLIKFF

SEQ ID NO: 488354 - protein, 9 aa, Homo Sapiens
QYYCKNCAS

SEQ ID NO: 488355 - protein, 9 aa, Homo Sapiens
EGKDKHRMS

SEQ ID NO: 488356 - protein, 9 aa, Homo Sapiens
LPIQMDPLI

SEQ ID NO: 488357 - protein, 9 aa, Homo Sapiens
IPHQGPTLP

SEQ ID NO: 488358 - protein, 9 aa, Homo Sapiens
ADSNEDQHD

SEQ ID NO: 488359 - protein, 9 aa, Homo Sapiens
LYHSDKFRA

SEQ ID NO: 488360 - protein, 9 aa, Homo Sapiens
SCPAYGALA

SEQ ID NO: 488361 - protein, 9 aa, Homo Sapiens
AAEEDSSVS

SEQ ID NO: 488362 - protein, 9 aa, Homo Sapiens
SEEEIKPLP

SEQ ID NO: 488363 - protein, 9 aa, Homo Sapiens
SDKFLKEVW

SEQ ID NO: 488364 - protein, 9 aa, Homo Sapiens
SNNTGIQIS

SEQ ID NO: 488365 - protein, 9 aa, Homo Sapiens
EICEFVSGR

SEQ ID NO: 488366 - protein, 9 aa, Homo Sapiens
CFALPQGLL

SEQ ID NO: 488367 - protein, 9 aa, Homo Sapiens
KQAELSGPE

SEQ ID NO: 488368 - protein, 9 aa, Homo Sapiens
SDIDMSMKH

SEQ ID NO: 488369 - protein, 9 aa, Homo Sapiens
EACKAYLVG

SEQ ID NO: 488370 - protein, 9 aa, Homo Sapiens
NQSTGEAFR

SEQ ID NO: 488371 - protein, 9 aa, Homo Sapiens
LLKAENLVL

SEQ ID NO: 488372 - protein, 9 aa, Homo Sapiens
YGSASGLNK

SEQ ID NO: 488373 - protein, 9 aa, Homo Sapiens
SHQVGRPVL

SEQ ID NO: 488374 - protein, 9 aa, Homo Sapiens
LLLTVETTK

SEQ ID NO: 488375 - protein, 9 aa, Homo Sapiens
FVKGLQNRH

SEQ ID NO: 488376 - protein, 9 aa, Homo Sapiens
SLKEKSKIS

SEQ ID NO: 488377 - protein, 9 aa, Homo Sapiens
ANFTSLSDL

SEQ ID NO: 488378 - protein, 9 aa, Homo Sapiens
EESGIVQSK

SEQ ID NO: 488379 - protein, 9 aa, Homo Sapiens
KNVCEQGRW

SEQ ID NO: 488380 - protein, 9 aa, Homo Sapiens
TQSLVLTIT

SEQ ID NO: 488381 - protein, 9 aa, Homo Sapiens
EMDVQEPNI

SEQ ID NO: 488382 - protein, 9 aa, Homo Sapiens
DLLETKRDP

SEQ ID NO: 488383 - protein, 9 aa, Homo Sapiens
NLHQHFKQE

SEQ ID NO: 488384 - protein, 9 aa, Homo Sapiens
GLQNRHNYG

SEQ ID NO: 488385 - protein, 9 aa, Homo Sapiens
SLSCLCRPG

SEQ ID NO: 488386 - protein, 9 aa, Homo Sapiens
RANAGCYTC

SEQ ID NO: 488387 - protein, 9 aa, Homo Sapiens
KRKSIVPAP

SEQ ID NO: 488388 - protein, 9 aa, Homo Sapiens
PMYLFVAML

SEQ ID NO: 488389 - protein, 9 aa, Homo Sapiens
GYTKAIEVI

SEQ ID NO: 488390 - protein, 9 aa, Homo Sapiens
HENGVKWRQ

SEQ ID NO: 488391 - protein, 9 aa, Homo Sapiens
QSTPGLGHA

SEQ ID NO: 488392 - protein, 9 aa, Homo Sapiens
TRDFLKQIF

SEQ ID NO: 488393 - protein, 9 aa, Homo Sapiens
CSASRRIHP

SEQ ID NO: 488394 - protein, 9 aa, Homo Sapiens
GKGFLQHSN

SEQ ID NO: 488395 - protein, 9 aa, Homo Sapiens
AASTHIGES

SEQ ID NO: 488396 - protein, 9 aa, Homo Sapiens
TGERSQYLV

SEQ ID NO: 488397 - protein, 9 aa, Homo Sapiens
FSEEEIKPL

SEQ ID NO: 488398 - protein, 9 aa, Homo Sapiens
MPFQLDGEG

SEQ ID NO: 488399 - protein, 9 aa, Homo Sapiens
KILTNKQKQ

SEQ ID NO: 488400 - protein, 9 aa, Homo Sapiens
RCSKRSSHH

SEQ ID NO: 488401 - protein, 9 aa, Homo Sapiens
VISYNACGA

SEQ ID NO: 488402 - protein, 9 aa, Homo Sapiens
NGPSDTPKE

SEQ ID NO: 488403 - protein, 9 aa, Homo Sapiens
DLPEQPVRK

SEQ ID NO: 488404 - protein, 9 aa, Homo Sapiens
TNGHRNHRK

SEQ ID NO: 488405 - protein, 9 aa, Homo Sapiens
QKLYIGSTA

SEQ ID NO: 488406 - protein, 9 aa, Homo Sapiens
MQSRLECLK

SEQ ID NO: 488407 - protein, 9 aa, Homo Sapiens
GIFQTKFLS

SEQ ID NO: 488408 - protein, 9 aa, Homo Sapiens
VSEEDKQFT

SEQ ID NO: 488409 - protein, 9 aa, Homo Sapiens
VSAPPSRLS

SEQ ID NO: 488410 - protein, 9 aa, Homo Sapiens
AATKDDKED

SEQ ID NO: 488411 - protein, 9 aa, Homo Sapiens
EELGLTDGF

SEQ ID NO: 488412 - protein, 9 aa, Homo Sapiens
DLWLLNDFK

SEQ ID NO: 488413 - protein, 9 aa, Homo Sapiens
QMDPLIANN

SEQ ID NO: 488414 - protein, 9 aa, Homo Sapiens
KPLPPTLEK

SEQ ID NO: 488415 - protein, 9 aa, Homo Sapiens
QAIKDALDS

SEQ ID NO: 488416 - protein, 9 aa, Homo Sapiens
TKVMVPPSS

SEQ ID NO: 488417 - protein, 9 aa, Homo Sapiens
ILSGQRGSG

SEQ ID NO: 488418 - protein, 9 aa, Homo Sapiens
EQGRWSERL

SEQ ID NO: 488419 - protein, 9 aa, Homo Sapiens
DGTFNYNPD

SEQ ID NO: 488420 - protein, 9 aa, Homo Sapiens
TVLNLHQHF

SEQ ID NO: 488421 - protein, 9 aa, Homo Sapiens
VLKCGIAVA

SEQ ID NO: 488422 - protein, 9 aa, Homo Sapiens
EDSQCLHIQ

SEQ ID NO: 488423 - protein, 9 aa, Homo Sapiens
LYYPPRPQD

SEQ ID NO: 488424 - protein, 9 aa, Homo Sapiens
KKKKASEPR

SEQ ID NO: 488425 - protein, 9 aa, Homo Sapiens
ASTKVPQCS

SEQ ID NO: 488426 - protein, 9 aa, Homo Sapiens
RHERTHGGQ

SEQ ID NO: 488427 - protein, 9 aa, Homo Sapiens
YLKEPPRKL

SEQ ID NO: 488428 - protein, 9 aa, Homo Sapiens
TLHFQFEGG

SEQ ID NO: 488429 - protein, 9 aa, Homo Sapiens
VKGWIIVEI

SEQ ID NO: 488430 - protein, 9 aa, Homo Sapiens
WPSANPCIT

SEQ ID NO: 488431 - protein, 9 aa, Homo Sapiens
PKRVKFTLN

SEQ ID NO: 488432 - protein, 9 aa, Homo Sapiens
SMKHRYKLN

SEQ ID NO: 488433 - protein, 9 aa, Homo Sapiens
KKASEPRKV

SEQ ID NO: 488434 - protein, 9 aa, Homo Sapiens
QEIKLLKQL

SEQ ID NO: 488435 - protein, 9 aa, Homo Sapiens
WGREEVCDK

SEQ ID NO: 488436 - protein, 9 aa, Homo Sapiens
QVQCHPYLN

SEQ ID NO: 488437 - protein, 9 aa, Homo Sapiens
YLFLGNLCF

SEQ ID NO: 488438 - protein, 9 aa, Homo Sapiens
ESLPSTLSA

SEQ ID NO: 488439 - protein, 9 aa, Homo Sapiens
LLGLVVMHL

SEQ ID NO: 488440 - protein, 9 aa, Homo Sapiens
DTVVIILEA

SEQ ID NO: 488441 - protein, 9 aa, Homo Sapiens
LSPLLSKTP

SEQ ID NO: 488442 - protein, 9 aa, Homo Sapiens
ENNSDRSSV

SEQ ID NO: 488443 - protein, 9 aa, Homo Sapiens
SGGDRTGTH

SEQ ID NO: 488444 - protein, 9 aa, Homo Sapiens
KGRKIKLVN

SEQ ID NO: 488445 - protein, 9 aa, Homo Sapiens
DFSEEHAGC

SEQ ID NO: 488446 - protein, 9 aa, Homo Sapiens
VSALAASLL

SEQ ID NO: 488447 - protein, 9 aa, Homo Sapiens
MGLRLIHYL

SEQ ID NO: 488448 - protein, 9 aa, Homo Sapiens
SGTNVTAPR

SEQ ID NO: 488449 - protein, 9 aa, Homo Sapiens
FQLDGEGFG

SEQ ID NO: 488450 - protein, 9 aa, Homo Sapiens
MPFVKGLQN

SEQ ID NO: 488451 - protein, 9 aa, Homo Sapiens
ENLKGGDYL

SEQ ID NO: 488452 - protein, 9 aa, Homo Sapiens
EHLIPLGHQ

SEQ ID NO: 488453 - protein, 9 aa, Homo Sapiens
EAENTSGGL

SEQ ID NO: 488454 - protein, 9 aa, Homo Sapiens
PNSRSKKAT

SEQ ID NO: 488455 - protein, 9 aa, Homo Sapiens
EFNKEEPRA

SEQ ID NO: 488456 - protein, 9 aa, Homo Sapiens
EPYAKHIKP

SEQ ID NO: 488457 - protein, 9 aa, Homo Sapiens
SKDHATFSD

SEQ ID NO: 488458 - protein, 9 aa, Homo Sapiens
HIGESSLSE

SEQ ID NO: 488459 - protein, 9 aa, Homo Sapiens
NTSSKKGKD

SEQ ID NO: 488460 - protein, 9 aa, Homo Sapiens
LESVNMMAQ

SEQ ID NO: 488461 - protein, 9 aa, Homo Sapiens
GAGPGGAYK

SEQ ID NO: 488462 - protein, 9 aa, Homo Sapiens
TQNATNIGL

SEQ ID NO: 488463 - protein, 9 aa, Homo Sapiens
SFSLKEKSK

SEQ ID NO: 488464 - protein, 9 aa, Homo Sapiens
DNNEDKKID

SEQ ID NO: 488465 - protein, 9 aa, Homo Sapiens
MQEIKLLKQ

SEQ ID NO: 488466 - protein, 9 aa, Homo Sapiens
LHMPMYSFL

SEQ ID NO: 488467 - protein, 9 aa, Homo Sapiens
AAEFNKEEP

SEQ ID NO: 488468 - protein, 9 aa, Homo Sapiens
CDKEALLGM

SEQ ID NO: 488469 - protein, 9 aa, Homo Sapiens
EYADSNEDQ

SEQ ID NO: 488470 - protein, 9 aa, Homo Sapiens
FKNVCEQGR

SEQ ID NO: 488471 - protein, 9 aa, Homo Sapiens
LLVWQQVIR

SEQ ID NO: 488472 - protein, 9 aa, Homo Sapiens
VGRTYSLTV

SEQ ID NO: 488473 - protein, 9 aa, Homo Sapiens
TSGKHKAFS

SEQ ID NO: 488474 - protein, 9 aa, Homo Sapiens
ATHSKAGGL

SEQ ID NO: 488475 - protein, 9 aa, Homo Sapiens
DRANAGCYT

SEQ ID NO: 488476 - protein, 9 aa, Homo Sapiens
GNNVALTGV

SEQ ID NO: 488477 - protein, 9 aa, Homo Sapiens
TLVCLKVLG

SEQ ID NO: 488478 - protein, 9 aa, Homo Sapiens
YDEYADSNE

SEQ ID NO: 488479 - protein, 9 aa, Homo Sapiens
LQEACKAYL

SEQ ID NO: 488480 - protein, 9 aa, Homo Sapiens
AEEDSSVSA

SEQ ID NO: 488481 - protein, 9 aa, Homo Sapiens
VFFLKNDDQ

SEQ ID NO: 488482 - protein, 9 aa, Homo Sapiens
MCRQGFPNR

SEQ ID NO: 488483 - protein, 9 aa, Homo Sapiens
MRVAASTHI

SEQ ID NO: 488484 - protein, 9 aa, Homo Sapiens
SFEESECKQ

SEQ ID NO: 488485 - protein, 9 aa, Homo Sapiens
EKDIVHCAL

SEQ ID NO: 488486 - protein, 9 aa, Homo Sapiens
FDGDMKQEP

SEQ ID NO: 488487 - protein, 9 aa, Homo Sapiens
TTSPVSSGS

SEQ ID NO: 488488 - protein, 9 aa, Homo Sapiens
MKAKVPLGD

SEQ ID NO: 488489 - protein, 9 aa, Homo Sapiens
LVYFSESGS

SEQ ID NO: 488490 - protein, 9 aa, Homo Sapiens
KTQKTNGHR

SEQ ID NO: 488491 - protein, 9 aa, Homo Sapiens
QQLVYFSES

SEQ ID NO: 488492 - protein, 9 aa, Homo Sapiens
FSAILLIDH

SEQ ID NO: 488493 - protein, 9 aa, Homo Sapiens
SCFSLFSWG

SEQ ID NO: 488494 - protein, 9 aa, Homo Sapiens
CNQVQCHPY

SEQ ID NO: 488495 - protein, 9 aa, Homo Sapiens
QCLHIQSLL

SEQ ID NO: 488496 - protein, 9 aa, Homo Sapiens
VPSSTKLAR

SEQ ID NO: 488497 - protein, 9 aa, Homo Sapiens
RAEVAILTR

SEQ ID NO: 488498 - protein, 9 aa, Homo Sapiens
STHCYGLFI

SEQ ID NO: 488499 - protein, 9 aa, Homo Sapiens
AAGGWNLPP

SEQ ID NO: 488500 - protein, 9 aa, Homo Sapiens
GSDIDMSMK

SEQ ID NO: 488501 - protein, 9 aa, Homo Sapiens
ECQHQFQGR

SEQ ID NO: 488502 - protein, 9 aa, Homo Sapiens
DPEDRPKFQ

SEQ ID NO: 488503 - protein, 9 aa, Homo Sapiens
IRKCTLILM

SEQ ID NO: 488504 - protein, 9 aa, Homo Sapiens
TKDSVMLNG

SEQ ID NO: 488505 - protein, 9 aa, Homo Sapiens
VTNVTEKHY

SEQ ID NO: 488506 - protein, 9 aa, Homo Sapiens
ETMPFQLDG

SEQ ID NO: 488507 - protein, 9 aa, Homo Sapiens
NFQKDSQSL

SEQ ID NO: 488508 - protein, 9 aa, Homo Sapiens
SKDSEKDEK

SEQ ID NO: 488509 - protein, 9 aa, Homo Sapiens
EMLQMWQGP

SEQ ID NO: 488510 - protein, 9 aa, Homo Sapiens
RLCAKAERK

SEQ ID NO: 488511 - protein, 9 aa, Homo Sapiens
LALAAPRSE

SEQ ID NO: 488512 - protein, 9 aa, Homo Sapiens
PTSAVQSPR

SEQ ID NO: 488513 - protein, 9 aa, Homo Sapiens
EQANNLYME

SEQ ID NO: 488514 - protein, 9 aa, Homo Sapiens
RWTEVFFLK

SEQ ID NO: 488515 - protein, 9 aa, Homo Sapiens
VPEKFDGDM

SEQ ID NO: 488516 - protein, 9 aa, Homo Sapiens
EHQNMQRMA

SEQ ID NO: 488517 - protein, 9 aa, Homo Sapiens
TVTNVTEKH

SEQ ID NO: 488518 - protein, 9 aa, Homo Sapiens
TRCSVAVKM

SEQ ID NO: 488519 - protein, 9 aa, Homo Sapiens
MWPSANPCI

SEQ ID NO: 488520 - protein, 9 aa, Homo Sapiens
FKEEQQCLE

SEQ ID NO: 488521 - protein, 9 aa, Homo Sapiens
IHYLEDCQY

SEQ ID NO: 488522 - protein, 9 aa, Homo Sapiens
KGPFGEAGT

SEQ ID NO: 488523 - protein, 9 aa, Homo Sapiens
DVRLQGRMR

SEQ ID NO: 488524 - protein, 9 aa, Homo Sapiens
QSTGEAFRL

SEQ ID NO: 488525 - protein, 9 aa, Homo Sapiens
IIVEILKEG

SEQ ID NO: 488526 - protein, 9 aa, Homo Sapiens
NEKEKPNSR

SEQ ID NO: 488527 - protein, 9 aa, Homo Sapiens
NFLLVWQQV

SEQ ID NO: 488528 - protein, 9 aa, Homo Sapiens
YKSEECGKT

SEQ ID NO: 488529 - protein, 9 aa, Homo Sapiens
GSVAKMSAY

SEQ ID NO: 488530 - protein, 9 aa, Homo Sapiens
HTDNKSLKT

SEQ ID NO: 488531 - protein, 9 aa, Homo Sapiens
TNVTAPRPG

SEQ ID NO: 488532 - protein, 9 aa, Homo Sapiens
GFLQHSNLV

SEQ ID NO: 488533 - protein, 9 aa, Homo Sapiens
TYSLTVQAA

SEQ ID NO: 488534 - protein, 9 aa, Homo Sapiens
LAPSQFLVK

SEQ ID NO: 488535 - protein, 9 aa, Homo Sapiens
LWKSAVSYE

SEQ ID NO: 488536 - protein, 9 aa, Homo Sapiens
SENNSDRSS

SEQ ID NO: 488537 - protein, 9 aa, Homo Sapiens
GNSEDWNKV

SEQ ID NO: 488538 - protein, 9 aa, Homo Sapiens
LSCLCRPGY

SEQ ID NO: 488539 - protein, 9 aa, Homo Sapiens
KQLYHSDKF

SEQ ID NO: 488540 - protein, 9 aa, Homo Sapiens
FSLKEKSKI

SEQ ID NO: 488541 - protein, 9 aa, Homo Sapiens
AILTRNIVI

SEQ ID NO: 488542 - protein, 9 aa, Homo Sapiens
GFLVFLPFD

SEQ ID NO: 488543 - protein, 9 aa, Homo Sapiens
NGVKWRQLE

SEQ ID NO: 488544 - protein, 9 aa, Homo Sapiens
EQLKLLTAE

SEQ ID NO: 488545 - protein, 9 aa, Homo Sapiens
LESTHPSQL

SEQ ID NO: 488546 - protein, 9 aa, Homo Sapiens
PLLIMMFKM

SEQ ID NO: 488547 - protein, 9 aa, Homo Sapiens
STSSGHTEI

SEQ ID NO: 488548 - protein, 9 aa, Homo Sapiens
RVAASTHIG

SEQ ID NO: 488549 - protein, 9 aa, Homo Sapiens
AVWKENMNF

SEQ ID NO: 488550 - protein, 9 aa, Homo Sapiens
EPTTSPVSS

SEQ ID NO: 488551 - protein, 9 aa, Homo Sapiens
MHLWLVIVA

SEQ ID NO: 488552 - protein, 9 aa, Homo Sapiens
GDRRFINFQ

SEQ ID NO: 488553 - protein, 9 aa, Homo Sapiens
ELPSLHNSS

SEQ ID NO: 488554 - protein, 9 aa, Homo Sapiens
TDGFLVFLP

SEQ ID NO: 488555 - protein, 9 aa, Homo Sapiens
FDVVNQSTG

SEQ ID NO: 488556 - protein, 9 aa, Homo Sapiens
MQRPRVSRA

SEQ ID NO: 488557 - protein, 9 aa, Homo Sapiens
LLEVLSTPM

SEQ ID NO: 488558 - protein, 9 aa, Homo Sapiens
LVKKDARRT

SEQ ID NO: 488559 - protein, 9 aa, Homo Sapiens
GGDYLDPNY

SEQ ID NO: 488560 - protein, 9 aa, Homo Sapiens
FSDIYLNNV

SEQ ID NO: 488561 - protein, 9 aa, Homo Sapiens
TGKQSSADS

SEQ ID NO: 488562 - protein, 9 aa, Homo Sapiens
IVGYHVIQR

SEQ ID NO: 488563 - protein, 9 aa, Homo Sapiens
ETCKQGCPG

SEQ ID NO: 488564 - protein, 9 aa, Homo Sapiens
GPGGAYKAE

SEQ ID NO: 488565 - protein, 9 aa, Homo Sapiens
QSLDKNSGP

SEQ ID NO: 488566 - protein, 9 aa, Homo Sapiens
NFTSLSDLH

SEQ ID NO: 488567 - protein, 9 aa, Homo Sapiens
TSGHKAGDK

SEQ ID NO: 488568 - protein, 9 aa, Homo Sapiens
LTTIVQHSC

SEQ ID NO: 488569 - protein, 9 aa, Homo Sapiens
QISKELNYL

SEQ ID NO: 488570 - protein, 9 aa, Homo Sapiens
GLEQDQTYI

SEQ ID NO: 488571 - protein, 9 aa, Homo Sapiens
VQHSCFSLF

SEQ ID NO: 488572 - protein, 9 aa, Homo Sapiens
CSGSGDSGK

SEQ ID NO: 488573 - protein, 9 aa, Homo Sapiens
SEPRKVIVL

SEQ ID NO: 488574 - protein, 9 aa, Homo Sapiens
DDDIHIDAI

SEQ ID NO: 488575 - protein, 9 aa, Homo Sapiens
ASTTEPATA

SEQ ID NO: 488576 - protein, 9 aa, Homo Sapiens
ANKHATSAK

SEQ ID NO: 488577 - protein, 9 aa, Homo Sapiens
HRDKMNRMR

SEQ ID NO: 488578 - protein, 9 aa, Homo Sapiens
VGEPTTSPV

SEQ ID NO: 488579 - protein, 9 aa, Homo Sapiens
EVVRLPYPV

SEQ ID NO: 488580 - protein, 9 aa, Homo Sapiens
LAGWILSHL

SEQ ID NO: 488581 - protein, 9 aa, Homo Sapiens
KLSAQSLDK

SEQ ID NO: 488582 - protein, 9 aa, Homo Sapiens
THTTTKEPV

SEQ ID NO: 488583 - protein, 9 aa, Homo Sapiens
VKVPIKGLA

SEQ ID NO: 488584 - protein, 9 aa, Homo Sapiens
TIAVLDQES

SEQ ID NO: 488585 - protein, 9 aa, Homo Sapiens
PKEKVKPGP

SEQ ID NO: 488586 - protein, 9 aa, Homo Sapiens
ALANQVLSC

SEQ ID NO: 488587 - protein, 9 aa, Homo Sapiens
RLIHYLVGA

SEQ ID NO: 488588 - protein, 9 aa, Homo Sapiens
PTTSPVSSG

SEQ ID NO: 488589 - protein, 9 aa, Homo Sapiens
PVCNQVQCH

SEQ ID NO: 488590 - protein, 9 aa, Homo Sapiens
RCKSVINGC

SEQ ID NO: 488591 - protein, 9 aa, Homo Sapiens
HCYPTSAVQ

SEQ ID NO: 488592 - protein, 9 aa, Homo Sapiens
STVSVGSSK

SEQ ID NO: 488593 - protein, 9 aa, Homo Sapiens
YKPVCNQVQ

SEQ ID NO: 488594 - protein, 9 aa, Homo Sapiens
RRMFWETSL

SEQ ID NO: 488595 - protein, 9 aa, Homo Sapiens
CYSLICHDI

SEQ ID NO: 488596 - protein, 9 aa, Homo Sapiens
KIAMQEIKL

SEQ ID NO: 488597 - protein, 9 aa, Homo Sapiens
RGPACCDHQ

SEQ ID NO: 488598 - protein, 9 aa, Homo Sapiens
NQVLSCNFL

SEQ ID NO: 488599 - protein, 9 aa, Homo Sapiens
VKIKRSDRI

SEQ ID NO: 488600 - protein, 9 aa, Homo Sapiens
DHCAKRLRE

SEQ ID NO: 488601 - protein, 9 aa, Homo Sapiens
NKIAAEFNK

SEQ ID NO: 488602 - protein, 9 aa, Homo Sapiens
WWSCTKCTL

SEQ ID NO: 488603 - protein, 9 aa, Homo Sapiens
IILEAVPSH

SEQ ID NO: 488604 - protein, 9 aa, Homo Sapiens
KQLEATARE

SEQ ID NO: 488605 - protein, 9 aa, Homo Sapiens
TEGYVAYRD

SEQ ID NO: 488606 - protein, 9 aa, Homo Sapiens
ISKLINSSH

SEQ ID NO: 488607 - protein, 9 aa, Homo Sapiens
TLSEGMNPL

SEQ ID NO: 488608 - protein, 9 aa, Homo Sapiens
QFPKQAELS

SEQ ID NO: 488609 - protein, 9 aa, Homo Sapiens
QYREQLKLL

SEQ ID NO: 488610 - protein, 9 aa, Homo Sapiens
AGSVAKMSA

SEQ ID NO: 488611 - protein, 9 aa, Homo Sapiens
EPMYLFVAM

SEQ ID NO: 488612 - protein, 9 aa, Homo Sapiens
VCLKVLGQT

SEQ ID NO: 488613 - protein, 9 aa, Homo Sapiens
YKDGNEVWL

SEQ ID NO: 488614 - protein, 9 aa, Homo Sapiens
TFLLLAGWI

SEQ ID NO: 488615 - protein, 9 aa, Homo Sapiens
FFFWLPCPM

SEQ ID NO: 488616 - protein, 9 aa, Homo Sapiens
KRKSYKFKF

SEQ ID NO: 488617 - protein, 9 aa, Homo Sapiens
QIPLYGIMS

SEQ ID NO: 488618 - protein, 9 aa, Homo Sapiens
SCTKCTLFT

SEQ ID NO: 488619 - protein, 9 aa, Homo Sapiens
YIASTNNMD

SEQ ID NO: 488620 - protein, 9 aa, Homo Sapiens
LNFFFWLPC

SEQ ID NO: 488621 - protein, 9 aa, Homo Sapiens
AARPEIADI

SEQ ID NO: 488622 - protein, 9 aa, Homo Sapiens
RWFREFQHG

SEQ ID NO: 488623 - protein, 9 aa, Homo Sapiens
QGRMRGGLL

SEQ ID NO: 488624 - protein, 9 aa, Homo Sapiens
KAKYGRRSA

SEQ ID NO: 488625 - protein, 9 aa, Homo Sapiens
PALQNKVQA

SEQ ID NO: 488626 - protein, 9 aa, Homo Sapiens
EPPIGSPES

SEQ ID NO: 488627 - protein, 9 aa, Homo Sapiens
SIITLMMNP

SEQ ID NO: 488628 - protein, 9 aa, Homo Sapiens
SLRRCKTQK

SEQ ID NO: 488629 - protein, 9 aa, Homo Sapiens
LPSTLSANS

SEQ ID NO: 488630 - protein, 9 aa, Homo Sapiens
PVILVNTQT

SEQ ID NO: 488631 - protein, 9 aa, Homo Sapiens
SLLTAHDQL

SEQ ID NO: 488632 - protein, 9 aa, Homo Sapiens
LDQESPNVK

SEQ ID NO: 488633 - protein, 9 aa, Homo Sapiens
KDAHLPRLV

SEQ ID NO: 488634 - protein, 9 aa, Homo Sapiens
CYCPWCYKR

SEQ ID NO: 488635 - protein, 9 aa, Homo Sapiens
NGVGYYSHQ

SEQ ID NO: 488636 - protein, 9 aa, Homo Sapiens
IIITGSENG

SEQ ID NO: 488637 - protein, 9 aa, Homo Sapiens
CLEAKRLRG

SEQ ID NO: 488638 - protein, 9 aa, Homo Sapiens
GQPSPSLRR

SEQ ID NO: 488639 - protein, 9 aa, Homo Sapiens
AEFNKEEPR

SEQ ID NO: 488640 - protein, 9 aa, Homo Sapiens
VSETEVEEK

SEQ ID NO: 488641 - protein, 9 aa, Homo Sapiens
NQYYCKNCA

SEQ ID NO: 488642 - protein, 9 aa, Homo Sapiens
SYFVTDKIT

SEQ ID NO: 488643 - protein, 9 aa, Homo Sapiens
ISVLVKFPT

SEQ ID NO: 488644 - protein, 9 aa, Homo Sapiens
LVKVPIKGL

SEQ ID NO: 488645 - protein, 9 aa, Homo Sapiens
EVLSTPMPF

SEQ ID NO: 488646 - protein, 9 aa, Homo Sapiens
GQRGSGKSE

SEQ ID NO: 488647 - protein, 9 aa, Homo Sapiens
LPYPVQMKS

SEQ ID NO: 488648 - protein, 9 aa, Homo Sapiens
NSIEHSDYK

SEQ ID NO: 488649 - protein, 9 aa, Homo Sapiens
VIRPFLTTI

SEQ ID NO: 488650 - protein, 9 aa, Homo Sapiens
LKATLPEAD

SEQ ID NO: 488651 - protein, 9 aa, Homo Sapiens
SPVSSGSTE

SEQ ID NO: 488652 - protein, 9 aa, Homo Sapiens
AYGALALAA

SEQ ID NO: 488653 - protein, 9 aa, Homo Sapiens
MSNSSSEMD

SEQ ID NO: 488654 - protein, 9 aa, Homo Sapiens
SSKKGKDLD

SEQ ID NO: 488655 - protein, 9 aa, Homo Sapiens
QLLPSDGIS

SEQ ID NO: 488656 - protein, 9 aa, Homo Sapiens
QDKILTNKQ

SEQ ID NO: 488657 - protein, 9 aa, Homo Sapiens
NSRSKKATN

SEQ ID NO: 488658 - protein, 9 aa, Homo Sapiens
YVKKHSGGD

SEQ ID NO: 488659 - protein, 9 aa, Homo Sapiens
IAMQEIKLL

SEQ ID NO: 488660 - protein, 9 aa, Homo Sapiens
QFQGRRWNC

SEQ ID NO: 488661 - protein, 9 aa, Homo Sapiens
FSLFSWGQL

SEQ ID NO: 488662 - protein, 9 aa, Homo Sapiens
NDPLDLGYK

SEQ ID NO: 488663 - protein, 9 aa, Homo Sapiens
FFLKNDDQH

SEQ ID NO: 488664 - protein, 9 aa, Homo Sapiens
RDPNLQQAP

SEQ ID NO: 488665 - protein, 9 aa, Homo Sapiens
TQDLLETKR

SEQ ID NO: 488666 - protein, 9 aa, Homo Sapiens
NAGCYTCQV

SEQ ID NO: 488667 - protein, 9 aa, Homo Sapiens
DNSEQKCMA

SEQ ID NO: 488668 - protein, 9 aa, Homo Sapiens
ERTHGGQKP

SEQ ID NO: 488669 - protein, 9 aa, Homo Sapiens
ETKRDPNLQ

SEQ ID NO: 488670 - protein, 9 aa, Homo Sapiens
NLVVKDPTK

SEQ ID NO: 488671 - protein, 9 aa, Homo Sapiens
QGMPGLGPI

SEQ ID NO: 488672 - protein, 9 aa, Homo Sapiens
LLIPVKDKL

SEQ ID NO: 488673 - protein, 9 aa, Homo Sapiens
LKNLPISVL

SEQ ID NO: 488674 - protein, 9 aa, Homo Sapiens
KMVKKIAMQ

SEQ ID NO: 488675 - protein, 9 aa, Homo Sapiens
ACGNSEDWN

SEQ ID NO: 488676 - protein, 9 aa, Homo Sapiens
SGSEKQLEA

SEQ ID NO: 488677 - protein, 9 aa, Homo Sapiens
PGMEATCNT

SEQ ID NO: 488678 - protein, 9 aa, Homo Sapiens
GRESLPSTL

SEQ ID NO: 488679 - protein, 9 aa, Homo Sapiens
QMWQGPEGE

SEQ ID NO: 488680 - protein, 9 aa, Homo Sapiens
PEELAELPF

SEQ ID NO: 488681 - protein, 9 aa, Homo Sapiens
RTTQSLVLT

SEQ ID NO: 488682 - protein, 9 aa, Homo Sapiens
ELFKNVCEQ

SEQ ID NO: 488683 - protein, 9 aa, Homo Sapiens
SGQRGSGKS

SEQ ID NO: 488684 - protein, 9 aa, Homo Sapiens
ILTVYSATE

SEQ ID NO: 488685 - protein, 9 aa, Homo Sapiens
YMLVKDIVG

SEQ ID NO: 488686 - protein, 9 aa, Homo Sapiens
PHQGPTLPP

SEQ ID NO: 488687 - protein, 9 aa, Homo Sapiens
KDIVHCALA

SEQ ID NO: 488688 - protein, 9 aa, Homo Sapiens
LPVTSLSLV

SEQ ID NO: 488689 - protein, 9 aa, Homo Sapiens
ESKDTSLKQ

SEQ ID NO: 488690 - protein, 9 aa, Homo Sapiens
HDQLKATLP

SEQ ID NO: 488691 - protein, 9 aa, Homo Sapiens
AQQVSQFLH

SEQ ID NO: 488692 - protein, 9 aa, Homo Sapiens
PDCMKAKVP

SEQ ID NO: 488693 - protein, 9 aa, Homo Sapiens
QSPRAHSAQ

SEQ ID NO: 488694 - protein, 9 aa, Homo Sapiens
ARRRPAKDA

SEQ ID NO: 488695 - protein, 9 aa, Homo Sapiens
VLSCNFLPP

SEQ ID NO: 488696 - protein, 9 aa, Homo Sapiens
FSEEHAGCP

SEQ ID NO: 488697 - protein, 9 aa, Homo Sapiens
CDHQDDCCC

SEQ ID NO: 488698 - protein, 9 aa, Homo Sapiens
KNIEDELTT

SEQ ID NO: 488699 - protein, 9 aa, Homo Sapiens
VEGHITTDI

SEQ ID NO: 488700 - protein, 9 aa, Homo Sapiens
QAHHLPIQM

SEQ ID NO: 488701 - protein, 9 aa, Homo Sapiens
GGPPKTRHM

SEQ ID NO: 488702 - protein, 9 aa, Homo Sapiens
QPWPSSEKI

SEQ ID NO: 488703 - protein, 9 aa, Homo Sapiens
IADIATSEV

SEQ ID NO: 488704 - protein, 9 aa, Homo Sapiens
LCNHEHQNM

SEQ ID NO: 488705 - protein, 9 aa, Homo Sapiens
LEAKLERRW

SEQ ID NO: 488706 - protein, 9 aa, Homo Sapiens
SDTPKEILT

SEQ ID NO: 488707 - protein, 9 aa, Homo Sapiens
NAGNTTFLE

SEQ ID NO: 488708 - protein, 9 aa, Homo Sapiens
GPRTTQSLV

SEQ ID NO: 488709 - protein, 9 aa, Homo Sapiens
LDRANAGCY

SEQ ID NO: 488710 - protein, 9 aa, Homo Sapiens
LSSSHSFQI

SEQ ID NO: 488711 - protein, 9 aa, Homo Sapiens
MTAEFRKYN

SEQ ID NO: 488712 - protein, 9 aa, Homo Sapiens
GSENGTVRI

SEQ ID NO: 488713 - protein, 9 aa, Homo Sapiens
SLRFPKVAQ

SEQ ID NO: 488714 - protein, 9 aa, Homo Sapiens
NHEHQNMQR

SEQ ID NO: 488715 - protein, 9 aa, Homo Sapiens
RVCSMFTAS

SEQ ID NO: 488716 - protein, 9 aa, Homo Sapiens
IMMFKMIFN

SEQ ID NO: 488717 - protein, 9 aa, Homo Sapiens
VKVAATKDD

SEQ ID NO: 488718 - protein, 9 aa, Homo Sapiens
LVWQQVIRP

SEQ ID NO: 488719 - protein, 9 aa, Homo Sapiens
AKHIKPSVE

SEQ ID NO: 488720 - protein, 9 aa, Homo Sapiens
HEHQNMQRM

SEQ ID NO: 488721 - protein, 9 aa, Homo Sapiens
AYFAIQPWP

SEQ ID NO: 488722 - protein, 9 aa, Homo Sapiens
EMIVGRTYS

SEQ ID NO: 488723 - protein, 9 aa, Homo Sapiens
SIGLEQDQT

SEQ ID NO: 488724 - protein, 9 aa, Homo Sapiens
GHITTDIVM

SEQ ID NO: 488725 - protein, 9 aa, Homo Sapiens
SAKNEPPVP

SEQ ID NO: 488726 - protein, 9 aa, Homo Sapiens
SATEGYVAY

SEQ ID NO: 488727 - protein, 9 aa, Homo Sapiens
NTGISQDKI

SEQ ID NO: 488728 - protein, 9 aa, Homo Sapiens
QEEDVTEET

SEQ ID NO: 488729 - protein, 9 aa, Homo Sapiens
LANQVLSCN

SEQ ID NO: 488730 - protein, 9 aa, Homo Sapiens
ISHADLIKF

SEQ ID NO: 488731 - protein, 9 aa, Homo Sapiens
VFEKKDNNE

SEQ ID NO: 488732 - protein, 9 aa, Homo Sapiens
STKQQKLYI

SEQ ID NO: 488733 - protein, 9 aa, Homo Sapiens
AADIDYIAS

SEQ ID NO: 488734 - protein, 9 aa, Homo Sapiens
MYSFLSNLS

SEQ ID NO: 488735 - protein, 9 aa, Homo Sapiens
ARPEIADIA

SEQ ID NO: 488736 - protein, 9 aa, Homo Sapiens
LRSLLSSAK

SEQ ID NO: 488737 - protein, 9 aa, Homo Sapiens
DTSLKQRIQ

SEQ ID NO: 488738 - protein, 9 aa, Homo Sapiens
SKDTSLKQR

SEQ ID NO: 488739 - protein, 9 aa, Homo Sapiens
VDGVNSLSC

SEQ ID NO: 488740 - protein, 9 aa, Homo Sapiens
GLPVQANKH

SEQ ID NO: 488741 - protein, 9 aa, Homo Sapiens
DHATFSDIY

SEQ ID NO: 488742 - protein, 9 aa, Homo Sapiens
DSPPKLSAQ

SEQ ID NO: 488743 - protein, 9 aa, Homo Sapiens
VLNLHQHFK

SEQ ID NO: 488744 - protein, 9 aa, Homo Sapiens
EQLETLHKA

SEQ ID NO: 488745 - protein, 9 aa, Homo Sapiens
FEAYKHTVE

SEQ ID NO: 488746 - protein, 9 aa, Homo Sapiens
SADSDAWVL

SEQ ID NO: 488747 - protein, 9 aa, Homo Sapiens
KDDLVAGAT

SEQ ID NO: 488748 - protein, 9 aa, Homo Sapiens
PMYSFLSNL

SEQ ID NO: 488749 - protein, 9 aa, Homo Sapiens
TASVCLIFG

SEQ ID NO: 488750 - protein, 9 aa, Homo Sapiens
YKAVGLLDP

SEQ ID NO: 488751 - protein, 9 aa, Homo Sapiens
RLANFTSLS

SEQ ID NO: 488752 - protein, 9 aa, Homo Sapiens
QPKRVKFTL

SEQ ID NO: 488753 - protein, 9 aa, Homo Sapiens
AYKHTVEDM

SEQ ID NO: 488754 - protein, 9 aa, Homo Sapiens
LQHFQPLEM

SEQ ID NO: 488755 - protein, 9 aa, Homo Sapiens
KNVTNYDLC

SEQ ID NO: 488756 - protein, 9 aa, Homo Sapiens
NMYSSNSGP

SEQ ID NO: 488757 - protein, 9 aa, Homo Sapiens
LRSEHRDKM

SEQ ID NO: 488758 - protein, 9 aa, Homo Sapiens
LQGRMRGGL

SEQ ID NO: 488759 - protein, 9 aa, Homo Sapiens
PRIPKHENI

SEQ ID NO: 488760 - protein, 9 aa, Homo Sapiens
VQCHPYLNQ

SEQ ID NO: 488761 - protein, 9 aa, Homo Sapiens
KRVKFTLNM

SEQ ID NO: 488762 - protein, 9 aa, Homo Sapiens
GVACPALQN

SEQ ID NO: 488763 - protein, 9 aa, Homo Sapiens
YSFLSNLSF

SEQ ID NO: 488764 - protein, 9 aa, Homo Sapiens
AVLDQESPN

SEQ ID NO: 488765 - protein, 9 aa, Homo Sapiens
KVMVPPSSM

SEQ ID NO: 488766 - protein, 9 aa, Homo Sapiens
PTLPPTPHL

SEQ ID NO: 488767 - protein, 9 aa, Homo Sapiens
ALSSEALVH

SEQ ID NO: 488768 - protein, 9 aa, Homo Sapiens
YVVDDTITM

SEQ ID NO: 488769 - protein, 9 aa, Homo Sapiens
ELAKSVLNY

SEQ ID NO: 488770 - protein, 9 aa, Homo Sapiens
AGPGGAYKA

SEQ ID NO: 488771 - protein, 9 aa, Homo Sapiens
LSSTSKDSE

SEQ ID NO: 488772 - protein, 9 aa, Homo Sapiens
AKAERKAAE

SEQ ID NO: 488773 - protein, 9 aa, Homo Sapiens
QSFTHTTTK

SEQ ID NO: 488774 - protein, 9 aa, Homo Sapiens
ENGTVRIWH

SEQ ID NO: 488775 - protein, 9 aa, Homo Sapiens
DLDTNMIEL

SEQ ID NO: 488776 - protein, 9 aa, Homo Sapiens
FLVKVPIKG

SEQ ID NO: 488777 - protein, 9 aa, Homo Sapiens
TFNRPVEIL

SEQ ID NO: 488778 - protein, 9 aa, Homo Sapiens
GLVVMHLWL

SEQ ID NO: 488779 - protein, 9 aa, Homo Sapiens
HDAAQLYFK

SEQ ID NO: 488780 - protein, 9 aa, Homo Sapiens
PARTNNLNV

SEQ ID NO: 488781 - protein, 9 aa, Homo Sapiens
WINKDAVTA

SEQ ID NO: 488782 - protein, 9 aa, Homo Sapiens
PSANPCITP

SEQ ID NO: 488783 - protein, 9 aa, Homo Sapiens
EVTLHFQFE

SEQ ID NO: 488784 - protein, 9 aa, Homo Sapiens
IYVHRPVDL

SEQ ID NO: 488785 - protein, 9 aa, Homo Sapiens
VNSLSCLCR

SEQ ID NO: 488786 - protein, 9 aa, Homo Sapiens
ITSLLQDSG

SEQ ID NO: 488787 - protein, 9 aa, Homo Sapiens
DHIDWLLQK

SEQ ID NO: 488788 - protein, 9 aa, Homo Sapiens
RRDGTFNYN

SEQ ID NO: 488789 - protein, 9 aa, Homo Sapiens
RGIFQTKFL

SEQ ID NO: 488790 - protein, 9 aa, Homo Sapiens
RRAAGGWNL

SEQ ID NO: 488791 - protein, 9 aa, Homo Sapiens
TSFEESECK

SEQ ID NO: 488792 - protein, 9 aa, Homo Sapiens
YYSHQVGRP

SEQ ID NO: 488793 - protein, 9 aa, Homo Sapiens
AYAKVWHLY

SEQ ID NO: 488794 - protein, 9 aa, Homo Sapiens
TTQSLVLTI

SEQ ID NO: 488795 - protein, 9 aa, Homo Sapiens
KDTSLKQRI

SEQ ID NO: 488796 - protein, 9 aa, Homo Sapiens
TVEDMQLCA

SEQ ID NO: 488797 - protein, 9 aa, Homo Sapiens
LRKSRPHSE

SEQ ID NO: 488798 - protein, 9 aa, Homo Sapiens
AMQEIKLLK

SEQ ID NO: 488799 - protein, 9 aa, Homo Sapiens
DKIHGEEGL

SEQ ID NO: 488800 - protein, 9 aa, Homo Sapiens
YLTPSGYLE

SEQ ID NO: 488801 - protein, 9 aa, Homo Sapiens
EAFKYWYEN

SEQ ID NO: 488802 - protein, 9 aa, Homo Sapiens
EGHITTDIV

SEQ ID NO: 488803 - protein, 9 aa, Homo Sapiens
ACHDFMKAA

SEQ ID NO: 488804 - protein, 9 aa, Homo Sapiens
LQTYVDLLK

SEQ ID NO: 488805 - protein, 9 aa, Homo Sapiens
LLQKKKYEE

SEQ ID NO: 488806 - protein, 9 aa, Homo Sapiens
PQDLRRSVK

SEQ ID NO: 488807 - protein, 9 aa, Homo Sapiens
KRQLLSVVK

SEQ ID NO: 488808 - protein, 9 aa, Homo Sapiens
FQGRRWNCT

SEQ ID NO: 488809 - protein, 9 aa, Homo Sapiens
RKAKMQESG

SEQ ID NO: 488810 - protein, 9 aa, Homo Sapiens
RCRVRPACV

SEQ ID NO: 488811 - protein, 9 aa, Homo Sapiens
KGGEVTLHF

SEQ ID NO: 488812 - protein, 9 aa, Homo Sapiens
RMSKHKIGN

SEQ ID NO: 488813 - protein, 9 aa, Homo Sapiens
DPDCMKAKV

SEQ ID NO: 488814 - protein, 9 aa, Homo Sapiens
KRSHACGYS

SEQ ID NO: 488815 - protein, 9 aa, Homo Sapiens
FNKIAAEFN

SEQ ID NO: 488816 - protein, 9 aa, Homo Sapiens
FKLWNLIKD

SEQ ID NO: 488817 - protein, 9 aa, Homo Sapiens
GCSMPAVAE

SEQ ID NO: 488818 - protein, 9 aa, Homo Sapiens
VQSKLDSDF

SEQ ID NO: 488819 - protein, 9 aa, Homo Sapiens
SKNGAFRAE

SEQ ID NO: 488820 - protein, 9 aa, Homo Sapiens
SLPSTLSAN

SEQ ID NO: 488821 - protein, 9 aa, Homo Sapiens
RQNDKIHGE

SEQ ID NO: 488822 - protein, 9 aa, Homo Sapiens
GSPESPGAE

SEQ ID NO: 488823 - protein, 9 aa, Homo Sapiens
HSDKFRAYD

SEQ ID NO: 488824 - protein, 9 aa, Homo Sapiens
VWPIYPTVL

SEQ ID NO: 488825 - protein, 9 aa, Homo Sapiens
APYCCTRDP

SEQ ID NO: 488826 - protein, 9 aa, Homo Sapiens
RRRPAKDAH

SEQ ID NO: 488827 - protein, 9 aa, Homo Sapiens
SHICAVLTL

SEQ ID NO: 488828 - protein, 9 aa, Homo Sapiens
ISYNACGAQ

SEQ ID NO: 488829 - protein, 9 aa, Homo Sapiens
IEHSDYKAK

SEQ ID NO: 488830 - protein, 9 aa, Homo Sapiens
NDKIHGEEG

SEQ ID NO: 488831 - protein, 9 aa, Homo Sapiens
FEVRASENG

SEQ ID NO: 488832 - protein, 9 aa, Homo Sapiens
LLPSANYSD

SEQ ID NO: 488833 - protein, 9 aa, Homo Sapiens
RDKMNRMRQ

SEQ ID NO: 488834 - protein, 9 aa, Homo Sapiens
LLVYNATNS

SEQ ID NO: 488835 - protein, 9 aa, Homo Sapiens
NTGVACPAL

SEQ ID NO: 488836 - protein, 9 aa, Homo Sapiens
TKCTLFTDQ

SEQ ID NO: 488837 - protein, 9 aa, Homo Sapiens
HKALKLLPP

SEQ ID NO: 488838 - protein, 9 aa, Homo Sapiens
PYVKKHSGG

SEQ ID NO: 488839 - protein, 9 aa, Homo Sapiens
KKSGVKVAA

SEQ ID NO: 488840 - protein, 9 aa, Homo Sapiens
TPKEILTRI

SEQ ID NO: 488841 - protein, 9 aa, Homo Sapiens
GTLEAKLER

SEQ ID NO: 488842 - protein, 9 aa, Homo Sapiens
ESEGAVRET

SEQ ID NO: 488843 - protein, 9 aa, Homo Sapiens
DEYADSNED

SEQ ID NO: 488844 - protein, 9 aa, Homo Sapiens
NATNSTNLE

SEQ ID NO: 488845 - protein, 9 aa, Homo Sapiens
QDLLETKRD

SEQ ID NO: 488846 - protein, 9 aa, Homo Sapiens
PIYPTVLGR

SEQ ID NO: 488847 - protein, 9 aa, Homo Sapiens
CFILSGQRG

SEQ ID NO: 488848 - protein, 9 aa, Homo Sapiens
RPAKDAHLP

SEQ ID NO: 488849 - protein, 9 aa, Homo Sapiens
LQTFLELAK

SEQ ID NO: 488850 - protein, 9 aa, Homo Sapiens
DHQELIGDY

SEQ ID NO: 488851 - protein, 9 aa, Homo Sapiens
QANKHATSA

SEQ ID NO: 488852 - protein, 9 aa, Homo Sapiens
PSDTPKEIL

SEQ ID NO: 488853 - protein, 9 aa, Homo Sapiens
RKQLERDRL

SEQ ID NO: 488854 - protein, 9 aa, Homo Sapiens
SVGSSKTRG

SEQ ID NO: 488855 - protein, 9 aa, Homo Sapiens
IQPWPSSEK

SEQ ID NO: 488856 - protein, 9 aa, Homo Sapiens
HSCFSLFSW

SEQ ID NO: 488857 - protein, 9 aa, Homo Sapiens
ERDYENESQ

SEQ ID NO: 488858 - protein, 9 aa, Homo Sapiens
PGKAAFFPP

SEQ ID NO: 488859 - protein, 9 aa, Homo Sapiens
NSSSEMDVQ

SEQ ID NO: 488860 - protein, 9 aa, Homo Sapiens
GPTLPPTPH

SEQ ID NO: 488861 - protein, 9 aa, Homo Sapiens
VKDIVGYHV

SEQ ID NO: 488862 - protein, 9 aa, Homo Sapiens
SSLFADLRT

SEQ ID NO: 488863 - protein, 9 aa, Homo Sapiens
LKVSEVEQE

SEQ ID NO: 488864 - protein, 9 aa, Homo Sapiens
IGLANDSVR

SEQ ID NO: 488865 - protein, 9 aa, Homo Sapiens
IQAGRGQVL

SEQ ID NO: 488866 - protein, 9 aa, Homo Sapiens
SVSKKREES

SEQ ID NO: 488867 - protein, 9 aa, Homo Sapiens
EAYFAIQPW

SEQ ID NO: 488868 - protein, 9 aa, Homo Sapiens
HTGEKPYKS

SEQ ID NO: 488869 - protein, 9 aa, Homo Sapiens
WGQLNFFFW

SEQ ID NO: 488870 - protein, 9 aa, Homo Sapiens
AEPYAKHIK

SEQ ID NO: 488871 - protein, 9 aa, Homo Sapiens
SANPCITPP

SEQ ID NO: 488872 - protein, 9 aa, Homo Sapiens
VVASLRFPK

SEQ ID NO: 488873 - protein, 9 aa, Homo Sapiens
SEGAVRETF

SEQ ID NO: 488874 - protein, 9 aa, Homo Sapiens
YNATNSTNL

SEQ ID NO: 488875 - protein, 9 aa, Homo Sapiens
SENGRVLFS

SEQ ID NO: 488876 - protein, 9 aa, Homo Sapiens
AEFRKYNNN

SEQ ID NO: 488877 - protein, 9 aa, Homo Sapiens
RDRLDPLKS

SEQ ID NO: 488878 - protein, 9 aa, Homo Sapiens
STPMPFIIG

SEQ ID NO: 488879 - protein, 9 aa, Homo Sapiens
IKQLYHSDK

SEQ ID NO: 488880 - protein, 9 aa, Homo Sapiens
TVETTKPSI

SEQ ID NO: 488881 - protein, 9 aa, Homo Sapiens
YFVTDKITR

SEQ ID NO: 488882 - protein, 9 aa, Homo Sapiens
KDIVGYHVI

SEQ ID NO: 488883 - protein, 9 aa, Homo Sapiens
LSLVSTGDT

SEQ ID NO: 488884 - protein, 9 aa, Homo Sapiens
EINYKAVGL

SEQ ID NO: 488885 - protein, 9 aa, Homo Sapiens
AQSLDKNSG

SEQ ID NO: 488886 - protein, 9 aa, Homo Sapiens
YVNVIGLAN

SEQ ID NO: 488887 - protein, 9 aa, Homo Sapiens
AGESSENNS

SEQ ID NO: 488888 - protein, 9 aa, Homo Sapiens
VHRPVDLEM

SEQ ID NO: 488889 - protein, 9 aa, Homo Sapiens
PVQANKHAT

SEQ ID NO: 488890 - protein, 9 aa, Homo Sapiens
DSDHQELIG

SEQ ID NO: 488891 - protein, 9 aa, Homo Sapiens
QKKKYEEAL

SEQ ID NO: 488892 - protein, 9 aa, Homo Sapiens
LTVETTKPS

SEQ ID NO: 488893 - protein, 9 aa, Homo Sapiens
NIHVLQHFQ

SEQ ID NO: 488894 - protein, 9 aa, Homo Sapiens
LQKKKYEEA

SEQ ID NO: 488895 - protein, 9 aa, Homo Sapiens
IPVKDKLVD

SEQ ID NO: 488896 - protein, 9 aa, Homo Sapiens
KHTFNRPVE

SEQ ID NO: 488897 - protein, 9 aa, Homo Sapiens
GETCKQGCP

SEQ ID NO: 488898 - protein, 9 aa, Homo Sapiens
HSKAGGLPG

SEQ ID NO: 488899 - protein, 9 aa, Homo Sapiens
ISIEPGVKL

SEQ ID NO: 488900 - protein, 9 aa, Homo Sapiens
MLTWSRCRV

SEQ ID NO: 488901 - protein, 9 aa, Homo Sapiens
HGGQKPYEC

SEQ ID NO: 488902 - protein, 9 aa, Homo Sapiens
RVARLCAKA

SEQ ID NO: 488903 - protein, 9 aa, Homo Sapiens
SPARRRPAK

SEQ ID NO: 488904 - protein, 9 aa, Homo Sapiens
GMEATCNTS

SEQ ID NO: 488905 - protein, 9 aa, Homo Sapiens
HLSDSQRKM

SEQ ID NO: 488906 - protein, 9 aa, Homo Sapiens
SQYLVTALE

SEQ ID NO: 488907 - protein, 9 aa, Homo Sapiens
VHLSDSQRK

SEQ ID NO: 488908 - protein, 9 aa, Homo Sapiens
ATKDDKEDP

SEQ ID NO: 488909 - protein, 9 aa, Homo Sapiens
LYLQGCSMP

SEQ ID NO: 488910 - protein, 9 aa, Homo Sapiens
IRATHSKAG

SEQ ID NO: 488911 - protein, 9 aa, Homo Sapiens
SFSSLFADL

SEQ ID NO: 488912 - protein, 9 aa, Homo Sapiens
GWKKVYNSL

SEQ ID NO: 488913 - protein, 9 aa, Homo Sapiens
YELPSLHNS

SEQ ID NO: 488914 - protein, 9 aa, Homo Sapiens
LLSSAKNEP

SEQ ID NO: 488915 - protein, 9 aa, Homo Sapiens
GRMRGGLLR

SEQ ID NO: 488916 - protein, 9 aa, Homo Sapiens
CGLLSKNGA

SEQ ID NO: 488917 - protein, 9 aa, Homo Sapiens
LDSHHHLVA

SEQ ID NO: 488918 - protein, 9 aa, Homo Sapiens
PVKGWIIVE

SEQ ID NO: 488919 - protein, 9 aa, Homo Sapiens
LTDGFLVFL

SEQ ID NO: 488920 - protein, 9 aa, Homo Sapiens
RSQYLVTAL

SEQ ID NO: 488921 - protein, 9 aa, Homo Sapiens
SYELPSLHN

SEQ ID NO: 488922 - protein, 9 aa, Homo Sapiens
HCGLLSKNG

SEQ ID NO: 488923 - protein, 9 aa, Homo Sapiens
ITLMMNPLI

SEQ ID NO: 488924 - protein, 9 aa, Homo Sapiens
EELAELPFI

SEQ ID NO: 488925 - protein, 9 aa, Homo Sapiens
VCLFKSENK

SEQ ID NO: 488926 - protein, 9 aa, Homo Sapiens
LSTPMPFII

SEQ ID NO: 488927 - protein, 9 aa, Homo Sapiens
GKRQLLSVV

SEQ ID NO: 488928 - protein, 9 aa, Homo Sapiens
TPPYVKKHS

SEQ ID NO: 488929 - protein, 9 aa, Homo Sapiens
SLSLVSTGD

SEQ ID NO: 488930 - protein, 9 aa, Homo Sapiens
EVTQAIKDA

SEQ ID NO: 488931 - protein, 9 aa, Homo Sapiens
VTDKITRIN

SEQ ID NO: 488932 - protein, 9 aa, Homo Sapiens
KSHVFYETE

SEQ ID NO: 488933 - protein, 9 aa, Homo Sapiens
ALKKSVSKK

SEQ ID NO: 488934 - protein, 9 aa, Homo Sapiens
MFKMIFNQT

SEQ ID NO: 488935 - protein, 9 aa, Homo Sapiens
QKNIEDELT

SEQ ID NO: 488936 - protein, 9 aa, Homo Sapiens
AWINESVQL

SEQ ID NO: 488937 - protein, 9 aa, Homo Sapiens
HICAVLTLY

SEQ ID NO: 488938 - protein, 9 aa, Homo Sapiens
MSNNTGIQI

SEQ ID NO: 488939 - protein, 9 aa, Homo Sapiens
STTEPATAF

SEQ ID NO: 488940 - protein, 9 aa, Homo Sapiens
HMPMYSFLS

SEQ ID NO: 488941 - protein, 9 aa, Homo Sapiens
PPGEKKAVS

SEQ ID NO: 488942 - protein, 9 aa, Homo Sapiens
DYENESQSS

SEQ ID NO: 488943 - protein, 9 aa, Homo Sapiens
TFLELAKSV

SEQ ID NO: 488944 - protein, 9 aa, Homo Sapiens
KMRAGSQLG

SEQ ID NO: 488945 - protein, 9 aa, Homo Sapiens
PVQMKSSGP

SEQ ID NO: 488946 - protein, 9 aa, Homo Sapiens
LKGRKIKLV

SEQ ID NO: 488947 - protein, 9 aa, Homo Sapiens
QCGKALSSS

SEQ ID NO: 488948 - protein, 9 aa, Homo Sapiens
QIFVEAKLR

SEQ ID NO: 488949 - protein, 9 aa, Homo Sapiens
WALDPEDRP

SEQ ID NO: 488950 - protein, 9 aa, Homo Sapiens
SPSLRRCKT

SEQ ID NO: 488951 - protein, 9 aa, Homo Sapiens
DIEPPIGSP

SEQ ID NO: 488952 - protein, 9 aa, Homo Sapiens
RIFNFHTDN

SEQ ID NO: 488953 - protein, 9 aa, Homo Sapiens
DICKNLKVK

SEQ ID NO: 488954 - protein, 9 aa, Homo Sapiens
SMFTASVCL

SEQ ID NO: 488955 - protein, 9 aa, Homo Sapiens
EKEKPNSRS

SEQ ID NO: 488956 - protein, 9 aa, Homo Sapiens
AELHFWMMR

SEQ ID NO: 488957 - protein, 9 aa, Homo Sapiens
RGASPMDSS

SEQ ID NO: 488958 - protein, 9 aa, Homo Sapiens
EVAILTRNI

SEQ ID NO: 488959 - protein, 9 aa, Homo Sapiens
VSFSSLFAD

SEQ ID NO: 488960 - protein, 9 aa, Homo Sapiens
EPGVKLIES

SEQ ID NO: 488961 - protein, 9 aa, Homo Sapiens
FQPLEMMTC

SEQ ID NO: 488962 - protein, 9 aa, Homo Sapiens
AVWPIYPTV

SEQ ID NO: 488963 - protein, 9 aa, Homo Sapiens
PQMRPLSPG

SEQ ID NO: 488964 - protein, 9 aa, Homo Sapiens
HSGSEKQLE

SEQ ID NO: 488965 - protein, 9 aa, Homo Sapiens
GKIPLCDAK

SEQ ID NO: 488966 - protein, 9 aa, Homo Sapiens
IGTALKFLK

SEQ ID NO: 488967 - protein, 9 aa, Homo Sapiens
KTRGIFQTK

SEQ ID NO: 488968 - protein, 9 aa, Homo Sapiens
SSKTRGERV

SEQ ID NO: 488969 - protein, 9 aa, Homo Sapiens
QLKLLTAEN

SEQ ID NO: 488970 - protein, 9 aa, Homo Sapiens
FAVPSSTKL

SEQ ID NO: 488971 - protein, 9 aa, Homo Sapiens
DTNMIELSN

SEQ ID NO: 488972 - protein, 9 aa, Homo Sapiens
PQIRKCTLI

SEQ ID NO: 488973 - protein, 9 aa, Homo Sapiens
MWQGPEGEK

SEQ ID NO: 488974 - protein, 9 aa, Homo Sapiens
VLEGIRMCR

SEQ ID NO: 488975 - protein, 9 aa, Homo Sapiens
GASPMDSSY

SEQ ID NO: 488976 - protein, 9 aa, Homo Sapiens
SKTPPMPLI

SEQ ID NO: 488977 - protein, 9 aa, Homo Sapiens
KVPIKGLAG

SEQ ID NO: 488978 - protein, 9 aa, Homo Sapiens
TNIGLSVII

SEQ ID NO: 488979 - protein, 9 aa, Homo Sapiens
STRKQLERD

SEQ ID NO: 488980 - protein, 9 aa, Homo Sapiens
FQVLVKKDA

SEQ ID NO: 488981 - protein, 9 aa, Homo Sapiens
CMAMCMDRY

SEQ ID NO: 488982 - protein, 9 aa, Homo Sapiens
DACFFFSLC

SEQ ID NO: 488983 - protein, 9 aa, Homo Sapiens
CLFKSENKV

SEQ ID NO: 488984 - protein, 9 aa, Homo Sapiens
KAQNHLEET

SEQ ID NO: 488985 - protein, 9 aa, Homo Sapiens
FNKEEPRAL

SEQ ID NO: 488986 - protein, 9 aa, Homo Sapiens
KNLPISVLV

SEQ ID NO: 488987 - protein, 9 aa, Homo Sapiens
DGFVNNKRK

SEQ ID NO: 488988 - protein, 9 aa, Homo Sapiens
DFKTNDPYR

SEQ ID NO: 488989 - protein, 9 aa, Homo Sapiens
RVSRAENYQ

SEQ ID NO: 488990 - protein, 9 aa, Homo Sapiens
AYQSFTHTT

SEQ ID NO: 488991 - protein, 9 aa, Homo Sapiens
PLLSKTPPM

SEQ ID NO: 488992 - protein, 9 aa, Homo Sapiens
ENQPRLLLK

SEQ ID NO: 488993 - protein, 9 aa, Homo Sapiens
AQNHLEETN

SEQ ID NO: 488994 - protein, 9 aa, Homo Sapiens
FPQQLCKTL

SEQ ID NO: 488995 - protein, 9 aa, Homo Sapiens
KLLELLFDK

SEQ ID NO: 488996 - protein, 9 aa, Homo Sapiens
ERFHVGPKE

SEQ ID NO: 488997 - protein, 9 aa, Homo Sapiens
RLLPSANYS

SEQ ID NO: 488998 - protein, 9 aa, Homo Sapiens
HYERKLEQA

SEQ ID NO: 488999 - protein, 9 aa, Homo Sapiens
IEPGVKLIE

SEQ ID NO: 489000 - protein, 9 aa, Homo Sapiens
EPPRKLLHE

SEQ ID NO: 489001 - protein, 9 aa, Homo Sapiens
NDFKTNDPY

SEQ ID NO: 489002 - protein, 9 aa, Homo Sapiens
ETLVCLKVL

SEQ ID NO: 489003 - protein, 9 aa, Homo Sapiens
AHDQLKATL

SEQ ID NO: 489004 - protein, 9 aa, Homo Sapiens
VNPVILVNT

SEQ ID NO: 489005 - protein, 9 aa, Homo Sapiens
EVEEKMIGQ

SEQ ID NO: 489006 - protein, 9 aa, Homo Sapiens
DSGKRSHAC

SEQ ID NO: 489007 - protein, 9 aa, Homo Sapiens
YFKLWNLIK

SEQ ID NO: 489008 - protein, 9 aa, Homo Sapiens
QEDKNKIKT

SEQ ID NO: 489009 - protein, 9 aa, Homo Sapiens
KIPLCDAKE

SEQ ID NO: 489010 - protein, 9 aa, Homo Sapiens
LTQNATNIG

SEQ ID NO: 489011 - protein, 9 aa, Homo Sapiens
GKIPHQGPT

SEQ ID NO: 489012 - protein, 9 aa, Homo Sapiens
IPKHENINF

SEQ ID NO: 489013 - protein, 9 aa, Homo Sapiens
KRDPNLQQA

SEQ ID NO: 489014 - protein, 9 aa, Homo Sapiens
PRLLLKLLE

SEQ ID NO: 489015 - protein, 9 aa, Homo Sapiens
AKSLTSAQK

SEQ ID NO: 489016 - protein, 9 aa, Homo Sapiens
RESLPSTLS

SEQ ID NO: 489017 - protein, 9 aa, Homo Sapiens
GVKLIESTD

SEQ ID NO: 489018 - protein, 9 aa, Homo Sapiens
LENIQAGRG

SEQ ID NO: 489019 - protein, 9 aa, Homo Sapiens
DYIASTNNM

SEQ ID NO: 489020 - protein, 9 aa, Homo Sapiens
PEDLKNLPI

SEQ ID NO: 489021 - protein, 9 aa, Homo Sapiens
IKPLPPTLE

SEQ ID NO: 489022 - protein, 9 aa, Homo Sapiens
LRLIHYLVG

SEQ ID NO: 489023 - protein, 9 aa, Homo Sapiens
RGDFPSTIH

SEQ ID NO: 489024 - protein, 9 aa, Homo Sapiens
KFLKGRKIK

SEQ ID NO: 489025 - protein, 9 aa, Homo Sapiens
LLLIPVKDK

SEQ ID NO: 489026 - protein, 9 aa, Homo Sapiens
PQGSIQVDR

SEQ ID NO: 489027 - protein, 9 aa, Homo Sapiens
EKFDGDMKQ

SEQ ID NO: 489028 - protein, 9 aa, Homo Sapiens
EKRQNDKIH

SEQ ID NO: 489029 - protein, 9 aa, Homo Sapiens
NLKGGDYLD

SEQ ID NO: 489030 - protein, 9 aa, Homo Sapiens
SKTRGERVI

SEQ ID NO: 489031 - protein, 9 aa, Homo Sapiens
RERFHVGPK

SEQ ID NO: 489032 - protein, 9 aa, Homo Sapiens
SKLINSSHE

SEQ ID NO: 489033 - protein, 9 aa, Homo Sapiens
DIVHCALAY

SEQ ID NO: 489034 - protein, 9 aa, Homo Sapiens
NIEDELTTG

SEQ ID NO: 489035 - protein, 9 aa, Homo Sapiens
ECFVVGKGP

SEQ ID NO: 489036 - protein, 9 aa, Homo Sapiens
ATFSDIYLN

SEQ ID NO: 489037 - protein, 9 aa, Homo Sapiens
PPRKLLHEL

SEQ ID NO: 489038 - protein, 9 aa, Homo Sapiens
EGAVRETFR

SEQ ID NO: 489039 - protein, 9 aa, Homo Sapiens
EGMNPLTST

SEQ ID NO: 489040 - protein, 9 aa, Homo Sapiens
PLPGMEATC

SEQ ID NO: 489041 - protein, 9 aa, Homo Sapiens
EDRPKFQQL

SEQ ID NO: 489042 - protein, 9 aa, Homo Sapiens
STLSANSLY

SEQ ID NO: 489043 - protein, 9 aa, Homo Sapiens
DFPSTIHVS

SEQ ID NO: 489044 - protein, 9 aa, Homo Sapiens
TSTLSEGMN

SEQ ID NO: 489045 - protein, 9 aa, Homo Sapiens
LSKNGAFRA

SEQ ID NO: 489046 - protein, 9 aa, Homo Sapiens
KPVKGWIIV

SEQ ID NO: 489047 - protein, 9 aa, Homo Sapiens
WPIYPTVLG

SEQ ID NO: 489048 - protein, 9 aa, Homo Sapiens
ISGLDLSGA

SEQ ID NO: 489049 - protein, 9 aa, Homo Sapiens
SEEDKQFTS

SEQ ID NO: 489050 - protein, 9 aa, Homo Sapiens
QLKATLPEA

SEQ ID NO: 489051 - protein, 9 aa, Homo Sapiens
SGHKAGDKK

SEQ ID NO: 489052 - protein, 9 aa, Homo Sapiens
FKDACGNSE

SEQ ID NO: 489053 - protein, 9 aa, Homo Sapiens
TLHKALKLL

SEQ ID NO: 489054 - protein, 9 aa, Homo Sapiens
GNHGLQERD

SEQ ID NO: 489055 - protein, 9 aa, Homo Sapiens
FSGTNVTAP

SEQ ID NO: 489056 - protein, 9 aa, Homo Sapiens
PARRRPAKD

SEQ ID NO: 489057 - protein, 9 aa, Homo Sapiens
LKGGDYLDP

SEQ ID NO: 489058 - protein, 9 aa, Homo Sapiens
TFSDIYLNN

SEQ ID NO: 489059 - protein, 9 aa, Homo Sapiens
MEIKAKNVT

SEQ ID NO: 489060 - protein, 9 aa, Homo Sapiens
DIDMSMKHR

SEQ ID NO: 489061 - protein, 9 aa, Homo Sapiens
LQNRHNYGR

SEQ ID NO: 489062 - protein, 9 aa, Homo Sapiens
FVTDKITRI

SEQ ID NO: 489063 - protein, 9 aa, Homo Sapiens
ARTNNLNVE

SEQ ID NO: 489064 - protein, 9 aa, Homo Sapiens
GKGPPKISN

SEQ ID NO: 489065 - protein, 9 aa, Homo Sapiens
QIRKCTLIL

SEQ ID NO: 489066 - protein, 9 aa, Homo Sapiens
TEMLQMWQG

SEQ ID NO: 489067 - protein, 9 aa, Homo Sapiens
KPNSRSKKA

SEQ ID NO: 489068 - protein, 9 aa, Homo Sapiens
PTKVMVPPS

SEQ ID NO: 489069 - protein, 9 aa, Homo Sapiens
EPSVNLLSP

SEQ ID NO: 489070 - protein, 9 aa, Homo Sapiens
KTRHMSACW

SEQ ID NO: 489071 - protein, 9 aa, Homo Sapiens
GSGSGVLKC

SEQ ID NO: 489072 - protein, 9 aa, Homo Sapiens
IGLEQDQTY

SEQ ID NO: 489073 - protein, 9 aa, Homo Sapiens
KALSSSHSF

SEQ ID NO: 489074 - protein, 9 aa, Homo Sapiens
KQGCPGRNP

SEQ ID NO: 489075 - protein, 9 aa, Homo Sapiens
DLEMTPSFT

SEQ ID NO: 489076 - protein, 9 aa, Homo Sapiens
VSGRFPYYR

SEQ ID NO: 489077 - protein, 9 aa, Homo Sapiens
FINFQFQDS

SEQ ID NO: 489078 - protein, 9 aa, Homo Sapiens
WLPCPMSAM

SEQ ID NO: 489079 - protein, 9 aa, Homo Sapiens
VNNKRKSYK

SEQ ID NO: 489080 - protein, 9 aa, Homo Sapiens
SGGDDQFPK

SEQ ID NO: 489081 - protein, 9 aa, Homo Sapiens
PKHENINFK

SEQ ID NO: 489082 - protein, 9 aa, Homo Sapiens
PKVAQQPLI

SEQ ID NO: 489083 - protein, 9 aa, Homo Sapiens
VHCALAYTM

SEQ ID NO: 489084 - protein, 9 aa, Homo Sapiens
HYLEDCQYS

SEQ ID NO: 489085 - protein, 9 aa, Homo Sapiens
LLESVNMMA

SEQ ID NO: 489086 - protein, 9 aa, Homo Sapiens
EHRDKMNRM

SEQ ID NO: 489087 - protein, 9 aa, Homo Sapiens
GDYLDPNYV

SEQ ID NO: 489088 - protein, 9 aa, Homo Sapiens
YQSFTHTTT

SEQ ID NO: 489089 - protein, 9 aa, Homo Sapiens
YTKAIEVIQ

SEQ ID NO: 489090 - protein, 9 aa, Homo Sapiens
LSDSQRKMD

SEQ ID NO: 489091 - protein, 9 aa, Homo Sapiens
WINESVQLN

SEQ ID NO: 489092 - protein, 9 aa, Homo Sapiens
EDDFAVPSS

SEQ ID NO: 489093 - protein, 9 aa, Homo Sapiens
PLYGIMSSD

SEQ ID NO: 489094 - protein, 9 aa, Homo Sapiens
PQEEVGKEE

SEQ ID NO: 489095 - protein, 9 aa, Homo Sapiens
KGGDYLDPN

SEQ ID NO: 489096 - protein, 9 aa, Homo Sapiens
EAKRLRGCL

SEQ ID NO: 489097 - protein, 9 aa, Homo Sapiens
PVRKAKMQE

SEQ ID NO: 489098 - protein, 9 aa, Homo Sapiens
IQISKELNY

SEQ ID NO: 489099 - protein, 9 aa, Homo Sapiens
EKHYGNYTC

SEQ ID NO: 489100 - protein, 9 aa, Homo Sapiens
QLNFFFWLP

SEQ ID NO: 489101 - protein, 9 aa, Homo Sapiens
EKKAVSGPM

SEQ ID NO: 489102 - protein, 9 aa, Homo Sapiens
LQMWQGPEG

SEQ ID NO: 489103 - protein, 9 aa, Homo Sapiens
FADLRTHTG

SEQ ID NO: 489104 - protein, 9 aa, Homo Sapiens
AAQLYFKLW

SEQ ID NO: 489105 - protein, 9 aa, Homo Sapiens
ESSFISHAD

SEQ ID NO: 489106 - protein, 9 aa, Homo Sapiens
RIPKHENIN

SEQ ID NO: 489107 - protein, 9 aa, Homo Sapiens
LVVKDPTKV

SEQ ID NO: 489108 - protein, 9 aa, Homo Sapiens
AVGNHGLQE

SEQ ID NO: 489109 - protein, 9 aa, Homo Sapiens
VLLSHQRTH

SEQ ID NO: 489110 - protein, 9 aa, Homo Sapiens
GLEPGKAAF

SEQ ID NO: 489111 - protein, 9 aa, Homo Sapiens
ACKAYLVGL

SEQ ID NO: 489112 - protein, 9 aa, Homo Sapiens
NVTAPRPGQ

SEQ ID NO: 489113 - protein, 9 aa, Homo Sapiens
CIHLENIEK

SEQ ID NO: 489114 - protein, 9 aa, Homo Sapiens
VFLKEKVPK

SEQ ID NO: 489115 - protein, 9 aa, Homo Sapiens
STKGGEVTL

SEQ ID NO: 489116 - protein, 9 aa, Homo Sapiens
DTPCFALPQ

SEQ ID NO: 489117 - protein, 9 aa, Homo Sapiens
LMMNPLIYS

SEQ ID NO: 489118 - protein, 9 aa, Homo Sapiens
STIQASYFV

SEQ ID NO: 489119 - protein, 9 aa, Homo Sapiens
ALAHYFSAI

SEQ ID NO: 489120 - protein, 9 aa, Homo Sapiens
VFITSLLQD

SEQ ID NO: 489121 - protein, 9 aa, Homo Sapiens
VYNATNSTN

SEQ ID NO: 489122 - protein, 9 aa, Homo Sapiens
SPLLSKTPP

SEQ ID NO: 489123 - protein, 9 aa, Homo Sapiens
VCCQIPLYG

SEQ ID NO: 489124 - protein, 9 aa, Homo Sapiens
SLKQRIQNL

SEQ ID NO: 489125 - protein, 9 aa, Homo Sapiens
DGQKNIEDE

SEQ ID NO: 489126 - protein, 9 aa, Homo Sapiens
GVKVAATKD

SEQ ID NO: 489127 - protein, 9 aa, Homo Sapiens
SSADSDAWV

SEQ ID NO: 489128 - protein, 9 aa, Homo Sapiens
EQKCMAMCM

SEQ ID NO: 489129 - protein, 9 aa, Homo Sapiens
RCSVKQKRS

SEQ ID NO: 489130 - protein, 9 aa, Homo Sapiens
DKILTNKQK

SEQ ID NO: 489131 - protein, 9 aa, Homo Sapiens
HMSACWQDG

SEQ ID NO: 489132 - protein, 9 aa, Homo Sapiens
EEDSQCLHI

SEQ ID NO: 489133 - protein, 9 aa, Homo Sapiens
KGLQNRHNY

SEQ ID NO: 489134 - protein, 9 aa, Homo Sapiens
WKENMNFSE

SEQ ID NO: 489135 - protein, 9 aa, Homo Sapiens
QTTKDSVML

SEQ ID NO: 489136 - protein, 9 aa, Homo Sapiens
YFSESGSLG

SEQ ID NO: 489137 - protein, 9 aa, Homo Sapiens
GLANDSVRS

SEQ ID NO: 489138 - protein, 9 aa, Homo Sapiens
CTRDPGVRW

SEQ ID NO: 489139 - protein, 9 aa, Homo Sapiens
INRWFREFQ

SEQ ID NO: 489140 - protein, 9 aa, Homo Sapiens
GSHSGSEKQ

SEQ ID NO: 489141 - protein, 9 aa, Homo Sapiens
NACGAQMYI

SEQ ID NO: 489142 - protein, 9 aa, Homo Sapiens
LKNPSHYGS

SEQ ID NO: 489143 - protein, 9 aa, Homo Sapiens
FSEAQVQAL

SEQ ID NO: 489144 - protein, 9 aa, Homo Sapiens
VRRLANFTS

SEQ ID NO: 489145 - protein, 9 aa, Homo Sapiens
ILGLDNAGN

SEQ ID NO: 489146 - protein, 9 aa, Homo Sapiens
AVKMRAGSQ

SEQ ID NO: 489147 - protein, 9 aa, Homo Sapiens
ELAELPFIR

SEQ ID NO: 489148 - protein, 9 aa, Homo Sapiens
IMKCAFSPQ

SEQ ID NO: 489149 - protein, 9 aa, Homo Sapiens
IEKSIYNHT

SEQ ID NO: 489150 - protein, 9 aa, Homo Sapiens
KNGVKIKRS

SEQ ID NO: 489151 - protein, 9 aa, Homo Sapiens
TGRRCKSVI

SEQ ID NO: 489152 - protein, 9 aa, Homo Sapiens
GKSNSSVVS

SEQ ID NO: 489153 - protein, 9 aa, Homo Sapiens
FILSGQRGS

SEQ ID NO: 489154 - protein, 9 aa, Homo Sapiens
PSVNLLSPH

SEQ ID NO: 489155 - protein, 9 aa, Homo Sapiens
QTFLELAKS

SEQ ID NO: 489156 - protein, 9 aa, Homo Sapiens
NFKEEQQCL

SEQ ID NO: 489157 - protein, 9 aa, Homo Sapiens
LITGLDRAN

SEQ ID NO: 489158 - protein, 9 aa, Homo Sapiens
CQIPLYGIM

SEQ ID NO: 489159 - protein, 9 aa, Homo Sapiens
SGHTEISSP

SEQ ID NO: 489160 - protein, 9 aa, Homo Sapiens
FKYWYENHN

SEQ ID NO: 489161 - protein, 9 aa, Homo Sapiens
DLRTHTGEK

SEQ ID NO: 489162 - protein, 9 aa, Homo Sapiens
LEAKRLRGC

SEQ ID NO: 489163 - protein, 9 aa, Homo Sapiens
SQPKRVKFT

SEQ ID NO: 489164 - protein, 9 aa, Homo Sapiens
QCFILSGQR

SEQ ID NO: 489165 - protein, 9 aa, Homo Sapiens
DSIKSHVFY

SEQ ID NO: 489166 - protein, 9 aa, Homo Sapiens
KKPLMVIHY

SEQ ID NO: 489167 - protein, 9 aa, Homo Sapiens
FQQLVYFSE

SEQ ID NO: 489168 - protein, 9 aa, Homo Sapiens
YCCTRDPGV

SEQ ID NO: 489169 - protein, 9 aa, Homo Sapiens
LNQLGKRQL

SEQ ID NO: 489170 - protein, 9 aa, Homo Sapiens
VVRLPYPVQ

SEQ ID NO: 489171 - protein, 9 aa, Homo Sapiens
AIQPWPSSE

SEQ ID NO: 489172 - protein, 9 aa, Homo Sapiens
VLLNVTLIL

SEQ ID NO: 489173 - protein, 9 aa, Homo Sapiens
QDLPEQPVR

SEQ ID NO: 489174 - protein, 9 aa, Homo Sapiens
QFLVKVPIK

SEQ ID NO: 489175 - protein, 9 aa, Homo Sapiens
KRDPNLQVS

SEQ ID NO: 489176 - protein, 9 aa, Homo Sapiens
TLSANSLYE

SEQ ID NO: 489177 - protein, 9 aa, Homo Sapiens
ATVFEKKDN

SEQ ID NO: 489178 - protein, 9 aa, Homo Sapiens
TGVACPALQ

SEQ ID NO: 489179 - protein, 9 aa, Homo Sapiens
QDSGRVDRY

SEQ ID NO: 489180 - protein, 9 aa, Homo Sapiens
DADSPAAKG

SEQ ID NO: 489181 - protein, 9 aa, Homo Sapiens
ETASSSVAA

SEQ ID NO: 489182 - protein, 9 aa, Homo Sapiens
AGKIPLCDA

SEQ ID NO: 489183 - protein, 9 aa, Homo Sapiens
ELFQMARTK

SEQ ID NO: 489184 - protein, 9 aa, Homo Sapiens
NNVALTGVC

SEQ ID NO: 489185 - protein, 9 aa, Homo Sapiens
PEIEQAYEK

SEQ ID NO: 489186 - protein, 9 aa, Homo Sapiens
MRGGLLREA

SEQ ID NO: 489187 - protein, 9 aa, Homo Sapiens
FREFQHGPV

SEQ ID NO: 489188 - protein, 9 aa, Homo Sapiens
DTPKEILTR

SEQ ID NO: 489189 - protein, 9 aa, Homo Sapiens
NSTSGKHKA

SEQ ID NO: 489190 - protein, 9 aa, Homo Sapiens
LENFQKDSQ

SEQ ID NO: 489191 - protein, 9 aa, Homo Sapiens
NVTEKHYGN

SEQ ID NO: 489192 - protein, 9 aa, Homo Sapiens
QEEVGKEEE

SEQ ID NO: 489193 - protein, 9 aa, Homo Sapiens
TRVGAFLKN

SEQ ID NO: 489194 - protein, 9 aa, Homo Sapiens
QLERDRLDP

SEQ ID NO: 489195 - protein, 9 aa, Homo Sapiens
TLEAKLERR

SEQ ID NO: 489196 - protein, 9 aa, Homo Sapiens
SSEALVHVL

SEQ ID NO: 489197 - protein, 9 aa, Homo Sapiens
SPQGSIQVD

SEQ ID NO: 489198 - protein, 9 aa, Homo Sapiens
QQKLYIGST

SEQ ID NO: 489199 - protein, 9 aa, Homo Sapiens
GFVNNKRKS

SEQ ID NO: 489200 - protein, 9 aa, Homo Sapiens
GNEVWLYAG

SEQ ID NO: 489201 - protein, 9 aa, Homo Sapiens
AQLYFKLWN

SEQ ID NO: 489202 - protein, 9 aa, Homo Sapiens
TGSENGTVR

SEQ ID NO: 489203 - protein, 9 aa, Homo Sapiens
RGCSQPKRV

SEQ ID NO: 489204 - protein, 9 aa, Homo Sapiens
LLTVETTKP

SEQ ID NO: 489205 - protein, 9 aa, Homo Sapiens
SFISHADLI

SEQ ID NO: 489206 - protein, 9 aa, Homo Sapiens
TTISGLDLS

SEQ ID NO: 489207 - protein, 9 aa, Homo Sapiens
ELSTKQQKL

SEQ ID NO: 489208 - protein, 9 aa, Homo Sapiens
CCQIPLYGI

SEQ ID NO: 489209 - protein, 9 aa, Homo Sapiens
HERTHGGQK

SEQ ID NO: 489210 - protein, 9 aa, Homo Sapiens
RCYLTPSGY

SEQ ID NO: 489211 - protein, 9 aa, Homo Sapiens
KVNMYSSNS

SEQ ID NO: 489212 - protein, 9 aa, Homo Sapiens
EDPDCMKAK

SEQ ID NO: 489213 - protein, 9 aa, Homo Sapiens
CKNCASLQN

SEQ ID NO: 489214 - protein, 9 aa, Homo Sapiens
KHRYKLNGG

SEQ ID NO: 489215 - protein, 9 aa, Homo Sapiens
LKCGIAVAP

SEQ ID NO: 489216 - protein, 9 aa, Homo Sapiens
SQCLHIQSL

SEQ ID NO: 489217 - protein, 9 aa, Homo Sapiens
KGNISVQIL

SEQ ID NO: 489218 - protein, 9 aa, Homo Sapiens
IKVRVWNED

SEQ ID NO: 489219 - protein, 9 aa, Homo Sapiens
KDWASEAEN

SEQ ID NO: 489220 - protein, 9 aa, Homo Sapiens
LNDFKTNDP

SEQ ID NO: 489221 - protein, 9 aa, Homo Sapiens
LVGAGITDQ

SEQ ID NO: 489222 - protein, 9 aa, Homo Sapiens
TSLSLVSTG

SEQ ID NO: 489223 - protein, 9 aa, Homo Sapiens
FPKVAQQPL

SEQ ID NO: 489224 - protein, 9 aa, Homo Sapiens
SLSSTSKDS

SEQ ID NO: 489225 - protein, 9 aa, Homo Sapiens
YSTKGGEVT

SEQ ID NO: 489226 - protein, 9 aa, Homo Sapiens
RFHVGPKEK

SEQ ID NO: 489227 - protein, 9 aa, Homo Sapiens
MYLFLGNLC

SEQ ID NO: 489228 - protein, 9 aa, Homo Sapiens
PVDLEMTPS

SEQ ID NO: 489229 - protein, 9 aa, Homo Sapiens
NLENIQAGR

SEQ ID NO: 489230 - protein, 9 aa, Homo Sapiens
GQKNIEDEL

SEQ ID NO: 489231 - protein, 9 aa, Homo Sapiens
SVKQKRSGT

SEQ ID NO: 489232 - protein, 9 aa, Homo Sapiens
KQQKLYIGS

SEQ ID NO: 489233 - protein, 9 aa, Homo Sapiens
SVLLSHQRT

SEQ ID NO: 489234 - protein, 9 aa, Homo Sapiens
NSRQEFQHL

SEQ ID NO: 489235 - protein, 9 aa, Homo Sapiens
FVNNKRKSY

SEQ ID NO: 489236 - protein, 9 aa, Homo Sapiens
FLGNLCFMD

SEQ ID NO: 489237 - protein, 9 aa, Homo Sapiens
IVTGERSQY

SEQ ID NO: 489238 - protein, 9 aa, Homo Sapiens
KGKRDACFF

SEQ ID NO: 489239 - protein, 9 aa, Homo Sapiens
RASENGRVL

SEQ ID NO: 489240 - protein, 9 aa, Homo Sapiens
IPLYGIMSS

SEQ ID NO: 489241 - protein, 9 aa, Homo Sapiens
EEVCDKEAL

SEQ ID NO: 489242 - protein, 9 aa, Homo Sapiens
SSHELQDNF

SEQ ID NO: 489243 - protein, 9 aa, Homo Sapiens
LHKALKLLP

SEQ ID NO: 489244 - protein, 9 aa, Homo Sapiens
SQGGETCKQ

SEQ ID NO: 489245 - protein, 9 aa, Homo Sapiens
EGKAQNHLE

SEQ ID NO: 489246 - protein, 9 aa, Homo Sapiens
ATDAGKIPL

SEQ ID NO: 489247 - protein, 9 aa, Homo Sapiens
FRSNRPQMR

SEQ ID NO: 489248 - protein, 9 aa, Homo Sapiens
GLGHAPRTS

SEQ ID NO: 489249 - protein, 9 aa, Homo Sapiens
GPPKTRHMS

SEQ ID NO: 489250 - protein, 9 aa, Homo Sapiens
PNFLLVWQQ

SEQ ID NO: 489251 - protein, 9 aa, Homo Sapiens
LHFWMMRRE

SEQ ID NO: 489252 - protein, 9 aa, Homo Sapiens
CSMFTASVC

SEQ ID NO: 489253 - protein, 9 aa, Homo Sapiens
VDMRAEVAI

SEQ ID NO: 489254 - protein, 9 aa, Homo Sapiens
TPQIRKCTL

SEQ ID NO: 489255 - protein, 9 aa, Homo Sapiens
KYVGESEGA

SEQ ID NO: 489256 - protein, 9 aa, Homo Sapiens
ESQSSEPKL

SEQ ID NO: 489257 - protein, 9 aa, Homo Sapiens
TVVIILEAV

SEQ ID NO: 489258 - protein, 9 aa, Homo Sapiens
MDPEIEQAY

SEQ ID NO: 489259 - protein, 9 aa, Homo Sapiens
CMKAKVPLG

SEQ ID NO: 489260 - protein, 9 aa, Homo Sapiens
TAHDQLKAT

SEQ ID NO: 489261 - protein, 9 aa, Homo Sapiens
SIEHSDYKA

SEQ ID NO: 489262 - protein, 9 aa, Homo Sapiens
HPESLQGAD

SEQ ID NO: 489263 - protein, 9 aa, Homo Sapiens
ACGAQMYIF

SEQ ID NO: 489264 - protein, 9 aa, Homo Sapiens
YGLALANLG

SEQ ID NO: 489265 - protein, 9 aa, Homo Sapiens
NKYVGESEG

SEQ ID NO: 489266 - protein, 9 aa, Homo Sapiens
QKQDRGASP

SEQ ID NO: 489267 - protein, 9 aa, Homo Sapiens
HQVGRPVLR

SEQ ID NO: 489268 - protein, 9 aa, Homo Sapiens
TLYVPIITL

SEQ ID NO: 489269 - protein, 9 aa, Homo Sapiens
QNDKIHGEE

SEQ ID NO: 489270 - protein, 9 aa, Homo Sapiens
PKQAELSGP

SEQ ID NO: 489271 - protein, 9 aa, Homo Sapiens
TGIQISKEL

SEQ ID NO: 489272 - protein, 9 aa, Homo Sapiens
KAYLVGLFE

SEQ ID NO: 489273 - protein, 9 aa, Homo Sapiens
LHEPMYLFV

SEQ ID NO: 489274 - protein, 9 aa, Homo Sapiens
CFSLFSWGQ

SEQ ID NO: 489275 - protein, 9 aa, Homo Sapiens
RIKVRVWNE

SEQ ID NO: 489276 - protein, 9 aa, Homo Sapiens
STFPNFLLV

SEQ ID NO: 489277 - protein, 9 aa, Homo Sapiens
NMNFSEAQV

SEQ ID NO: 489278 - protein, 9 aa, Homo Sapiens
LEMTPSFTV

SEQ ID NO: 489279 - protein, 9 aa, Homo Sapiens
THPSQLLSG

SEQ ID NO: 489280 - protein, 9 aa, Homo Sapiens
SRRIHPESL

SEQ ID NO: 489281 - protein, 9 aa, Homo Sapiens
QCHPYLNQS

SEQ ID NO: 489282 - protein, 9 aa, Homo Sapiens
ASTHIGESS

SEQ ID NO: 489283 - protein, 9 aa, Homo Sapiens
MSKHKIGNE

SEQ ID NO: 489284 - protein, 9 aa, Homo Sapiens
DSSSQEEDV

SEQ ID NO: 489285 - protein, 9 aa, Homo Sapiens
RRCKSVING

SEQ ID NO: 489286 - protein, 9 aa, Homo Sapiens
HENLKGGDY

SEQ ID NO: 489287 - protein, 9 aa, Homo Sapiens
QMGYTKAIE

SEQ ID NO: 489288 - protein, 9 aa, Homo Sapiens
TSPVSSGST

SEQ ID NO: 489289 - protein, 9 aa, Homo Sapiens
LIAVGNHGL

SEQ ID NO: 489290 - protein, 9 aa, Homo Sapiens
SLVLTITPR

SEQ ID NO: 489291 - protein, 9 aa, Homo Sapiens
WLLNDFKTN

SEQ ID NO: 489292 - protein, 9 aa, Homo Sapiens
VFLVLLNVT

SEQ ID NO: 489293 - protein, 9 aa, Homo Sapiens
PRKVIVLVN

SEQ ID NO: 489294 - protein, 9 aa, Homo Sapiens
QTYIPPGES

SEQ ID NO: 489295 - protein, 9 aa, Homo Sapiens
TSLLQDSGR

SEQ ID NO: 489296 - protein, 9 aa, Homo Sapiens
VCNQVQCHP

SEQ ID NO: 489297 - protein, 9 aa, Homo Sapiens
RHQFDVVNQ

SEQ ID NO: 489298 - protein, 9 aa, Homo Sapiens
SLFADLRTH

SEQ ID NO: 489299 - protein, 9 aa, Homo Sapiens
SASGLNKDG

SEQ ID NO: 489300 - protein, 9 aa, Homo Sapiens
VKDKLVDPI

SEQ ID NO: 489301 - protein, 9 aa, Homo Sapiens
VSQFLHTYS

SEQ ID NO: 489302 - protein, 9 aa, Homo Sapiens
MDFSEEHAG

SEQ ID NO: 489303 - protein, 9 aa, Homo Sapiens
KNCASLQNA

SEQ ID NO: 489304 - protein, 9 aa, Homo Sapiens
GPACCDHQD

SEQ ID NO: 489305 - protein, 9 aa, Homo Sapiens
LPCPMSAMW

SEQ ID NO: 489306 - protein, 9 aa, Homo Sapiens
CCWALDPED

SEQ ID NO: 489307 - protein, 9 aa, Homo Sapiens
MPARTNNLN

SEQ ID NO: 489308 - protein, 9 aa, Homo Sapiens
DYLDPNYVL

SEQ ID NO: 489309 - protein, 9 aa, Homo Sapiens
KDHATFSDI

SEQ ID NO: 489310 - protein, 9 aa, Homo Sapiens
GAGESSENN

SEQ ID NO: 489311 - protein, 9 aa, Homo Sapiens
REQLKLLTA

SEQ ID NO: 489312 - protein, 9 aa, Homo Sapiens
CGNSEDWNK

SEQ ID NO: 489313 - protein, 9 aa, Homo Sapiens
WTDCMNGSI

SEQ ID NO: 489314 - protein, 9 aa, Homo Sapiens
IEELENFQK

SEQ ID NO: 489315 - protein, 9 aa, Homo Sapiens
TIHVSGPRL

SEQ ID NO: 489316 - protein, 9 aa, Homo Sapiens
DWASEAENT

SEQ ID NO: 489317 - protein, 9 aa, Homo Sapiens
QGPEGEKRR

SEQ ID NO: 489318 - protein, 9 aa, Homo Sapiens
YAKHIKPSV

SEQ ID NO: 489319 - protein, 9 aa, Homo Sapiens
AMWPSANPC

SEQ ID NO: 489320 - protein, 9 aa, Homo Sapiens
AGMAPQGMP

SEQ ID NO: 489321 - protein, 9 aa, Homo Sapiens
LKNDDQHNC

SEQ ID NO: 489322 - protein, 9 aa, Homo Sapiens
LYGIMSSDS

SEQ ID NO: 489323 - protein, 9 aa, Homo Sapiens
PLCDAKEEI

SEQ ID NO: 489324 - protein, 9 aa, Homo Sapiens
IHGEEGLFL

SEQ ID NO: 489325 - protein, 9 aa, Homo Sapiens
SVAKMSAYH

SEQ ID NO: 489326 - protein, 9 aa, Homo Sapiens
HLNAQQVSQ

SEQ ID NO: 489327 - protein, 9 aa, Homo Sapiens
EGNNVALTG

SEQ ID NO: 489328 - protein, 9 aa, Homo Sapiens
YSHQVGRPV

SEQ ID NO: 489329 - protein, 9 aa, Homo Sapiens
VGNHGLQER

SEQ ID NO: 489330 - protein, 9 aa, Homo Sapiens
SEHRDKMNR

SEQ ID NO: 489331 - protein, 9 aa, Homo Sapiens
FWTDCMNGS

SEQ ID NO: 489332 - protein, 9 aa, Homo Sapiens
HLPIQMDPL

SEQ ID NO: 489333 - protein, 9 aa, Homo Sapiens
SANYSDSAE

SEQ ID NO: 489334 - protein, 9 aa, Homo Sapiens
QVIRPFLTT

SEQ ID NO: 489335 - protein, 9 aa, Homo Sapiens
RPKRKSIVP

SEQ ID NO: 489336 - protein, 9 aa, Homo Sapiens
LWSYEEDSQ

SEQ ID NO: 489337 - protein, 9 aa, Homo Sapiens
TLMMNPLIY

SEQ ID NO: 489338 - protein, 9 aa, Homo Sapiens
DAGKIPLCD

SEQ ID NO: 489339 - protein, 9 aa, Homo Sapiens
TGISQDKIL

SEQ ID NO: 489340 - protein, 9 aa, Homo Sapiens
CFMDICYTS

SEQ ID NO: 489341 - protein, 9 aa, Homo Sapiens
TSAVQSPRA

SEQ ID NO: 489342 - protein, 9 aa, Homo Sapiens
VIGLANDSV

SEQ ID NO: 489343 - protein, 9 aa, Homo Sapiens
RLPYPVQMK

SEQ ID NO: 489344 - protein, 9 aa, Homo Sapiens
QFDVVNQST

SEQ ID NO: 489345 - protein, 9 aa, Homo Sapiens
KHIKPSVEP

SEQ ID NO: 489346 - protein, 9 aa, Homo Sapiens
SISIEPGVK

SEQ ID NO: 489347 - protein, 9 aa, Homo Sapiens
DQKQDRGAS

SEQ ID NO: 489348 - protein, 9 aa, Homo Sapiens
CGEPQEEVG

SEQ ID NO: 489349 - protein, 9 aa, Homo Sapiens
SEECGKTFS

SEQ ID NO: 489350 - protein, 9 aa, Homo Sapiens
QSRLECLKE

SEQ ID NO: 489351 - protein, 9 aa, Homo Sapiens
ESNYETLVC

SEQ ID NO: 489352 - protein, 9 aa, Homo Sapiens
IDYIASTNN

SEQ ID NO: 489353 - protein, 9 aa, Homo Sapiens
QYVVDDTIT

SEQ ID NO: 489354 - protein, 9 aa, Homo Sapiens
FNRPVEILI

SEQ ID NO: 489355 - protein, 9 aa, Homo Sapiens
MMFKMIFNQ

SEQ ID NO: 489356 - protein, 9 aa, Homo Sapiens
ECMTAEFRK

SEQ ID NO: 489357 - protein, 9 aa, Homo Sapiens
SHHRSQSSL

SEQ ID NO: 489358 - protein, 9 aa, Homo Sapiens
LANLGRANE

SEQ ID NO: 489359 - protein, 9 aa, Homo Sapiens
DAAQLYFKL

SEQ ID NO: 489360 - protein, 9 aa, Homo Sapiens
GESSENNSD

SEQ ID NO: 489361 - protein, 9 aa, Homo Sapiens
YETLVCLKV

SEQ ID NO: 489362 - protein, 9 aa, Homo Sapiens
LEETNSSSQ

SEQ ID NO: 489363 - protein, 9 aa, Homo Sapiens
KFLKEVWVS

SEQ ID NO: 489364 - protein, 9 aa, Homo Sapiens
GREEVCDKE

SEQ ID NO: 489365 - protein, 9 aa, Homo Sapiens
GKDKHRMSK

SEQ ID NO: 489366 - protein, 9 aa, Homo Sapiens
WEKEKHENG

SEQ ID NO: 489367 - protein, 9 aa, Homo Sapiens
HPSQLLSGL

SEQ ID NO: 489368 - protein, 9 aa, Homo Sapiens
EDLKNLPIS

SEQ ID NO: 489369 - protein, 9 aa, Homo Sapiens
MELSTKQQK

SEQ ID NO: 489370 - protein, 9 aa, Homo Sapiens
ATEGYVAYR

SEQ ID NO: 489371 - protein, 9 aa, Homo Sapiens
FVAMLATID

SEQ ID NO: 489372 - protein, 9 aa, Homo Sapiens
LICHDICKN

SEQ ID NO: 489373 - protein, 9 aa, Homo Sapiens
IDWLLQKKK

SEQ ID NO: 489374 - protein, 9 aa, Homo Sapiens
YERKLEQAN

SEQ ID NO: 489375 - protein, 9 aa, Homo Sapiens
ESVQLNLTK

SEQ ID NO: 489376 - protein, 9 aa, Homo Sapiens
PAKDAHLPR

SEQ ID NO: 489377 - protein, 9 aa, Homo Sapiens
LRRHSLETA

SEQ ID NO: 489378 - protein, 9 aa, Homo Sapiens
NLLLAYAKV

SEQ ID NO: 489379 - protein, 9 aa, Homo Sapiens
LNVTLILAD

SEQ ID NO: 489380 - protein, 9 aa, Homo Sapiens
TSSTAHQHI

SEQ ID NO: 489381 - protein, 9 aa, Homo Sapiens
CPGEPPHLS

SEQ ID NO: 489382 - protein, 9 aa, Homo Sapiens
KPKLDCKVG

SEQ ID NO: 489383 - protein, 9 aa, Homo Sapiens
PEVAFKAGC

SEQ ID NO: 489384 - protein, 9 aa, Homo Sapiens
NVETGTWEC

SEQ ID NO: 489385 - protein, 9 aa, Homo Sapiens
ECVCPFPQC

SEQ ID NO: 489386 - protein, 9 aa, Homo Sapiens
EYPNFKEEA

SEQ ID NO: 489387 - protein, 9 aa, Homo Sapiens
SSGTTDSSL

SEQ ID NO: 489388 - protein, 9 aa, Homo Sapiens
QQPLGRAMC

SEQ ID NO: 489389 - protein, 9 aa, Homo Sapiens
GRALLHVAL

SEQ ID NO: 489390 - protein, 9 aa, Homo Sapiens
QFDSFVVHF

SEQ ID NO: 489391 - protein, 9 aa, Homo Sapiens
TLPCPWWPT

SEQ ID NO: 489392 - protein, 9 aa, Homo Sapiens
TASQTAIQV

SEQ ID NO: 489393 - protein, 9 aa, Homo Sapiens
QEEIMVQGM

SEQ ID NO: 489394 - protein, 9 aa, Homo Sapiens
TKFSTGQKK

SEQ ID NO: 489395 - protein, 9 aa, Homo Sapiens
FNVETGTWE

SEQ ID NO: 489396 - protein, 9 aa, Homo Sapiens
VEMPTASQT

SEQ ID NO: 489397 - protein, 9 aa, Homo Sapiens
SQGMTAAHD

SEQ ID NO: 489398 - protein, 9 aa, Homo Sapiens
LQRWLEDSN

SEQ ID NO: 489399 - protein, 9 aa, Homo Sapiens
TQQWPAEGT

SEQ ID NO: 489400 - protein, 9 aa, Homo Sapiens
GQIPVGGEG

SEQ ID NO: 489401 - protein, 9 aa, Homo Sapiens
GAELEARDR

SEQ ID NO: 489402 - protein, 9 aa, Homo Sapiens
VPNHGLAGP

SEQ ID NO: 489403 - protein, 9 aa, Homo Sapiens
GQKYTPHKD

SEQ ID NO: 489404 - protein, 9 aa, Homo Sapiens
KWKNRIVAC

SEQ ID NO: 489405 - protein, 9 aa, Homo Sapiens
NHVLIYLNK

SEQ ID NO: 489406 - protein, 9 aa, Homo Sapiens
PTLPTLRPL

SEQ ID NO: 489407 - protein, 9 aa, Homo Sapiens
WNGIYTVKD

SEQ ID NO: 489408 - protein, 9 aa, Homo Sapiens
NFEGRRYDC

SEQ ID NO: 489409 - protein, 9 aa, Homo Sapiens
VGKKMRPQT

SEQ ID NO: 489410 - protein, 9 aa, Homo Sapiens
EHSCAGSAW

SEQ ID NO: 489411 - protein, 9 aa, Homo Sapiens
DSFVVHFKD

SEQ ID NO: 489412 - protein, 9 aa, Homo Sapiens
DLFSSIQCP

SEQ ID NO: 489413 - protein, 9 aa, Homo Sapiens
ILRNMGNLK

SEQ ID NO: 489414 - protein, 9 aa, Homo Sapiens
ALKYENYFS

SEQ ID NO: 489415 - protein, 9 aa, Homo Sapiens
KYTPHKDNQ

SEQ ID NO: 489416 - protein, 9 aa, Homo Sapiens
VLSPKAVHR

SEQ ID NO: 489417 - protein, 9 aa, Homo Sapiens
NVGPLVAGV

SEQ ID NO: 489418 - protein, 9 aa, Homo Sapiens
GHYFKKCLG

SEQ ID NO: 489419 - protein, 9 aa, Homo Sapiens
LVAGVIGAR

SEQ ID NO: 489420 - protein, 9 aa, Homo Sapiens
FPAPSQRLM

SEQ ID NO: 489421 - protein, 9 aa, Homo Sapiens
LGSVTIAQG

SEQ ID NO: 489422 - protein, 9 aa, Homo Sapiens
SALADCRVG

SEQ ID NO: 489423 - protein, 9 aa, Homo Sapiens
QPPEAPHQP

SEQ ID NO: 489424 - protein, 9 aa, Homo Sapiens
FQRQLTVLI

SEQ ID NO: 489425 - protein, 9 aa, Homo Sapiens
LRRLAHGTA

SEQ ID NO: 489426 - protein, 9 aa, Homo Sapiens
PRLGCVLSL

SEQ ID NO: 489427 - protein, 9 aa, Homo Sapiens
PIKRGRSCS

SEQ ID NO: 489428 - protein, 9 aa, Homo Sapiens
FLLDWSLGA

SEQ ID NO: 489429 - protein, 9 aa, Homo Sapiens
TSSISTGQA

SEQ ID NO: 489430 - protein, 9 aa, Homo Sapiens
MDYKATIYL

SEQ ID NO: 489431 - protein, 9 aa, Homo Sapiens
RIGTKFSTG

SEQ ID NO: 489432 - protein, 9 aa, Homo Sapiens
DNTVTEYIY

SEQ ID NO: 489433 - protein, 9 aa, Homo Sapiens
WPAEGTDYA

SEQ ID NO: 489434 - protein, 9 aa, Homo Sapiens
PAGCPQMCP

SEQ ID NO: 489435 - protein, 9 aa, Homo Sapiens
ALADCRVGK

SEQ ID NO: 489436 - protein, 9 aa, Homo Sapiens
DGGRPPHSA

SEQ ID NO: 489437 - protein, 9 aa, Homo Sapiens
PLITKEDRN

SEQ ID NO: 489438 - protein, 9 aa, Homo Sapiens
KAGCLAHTS

SEQ ID NO: 489439 - protein, 9 aa, Homo Sapiens
NPGPRRRGH

SEQ ID NO: 489440 - protein, 9 aa, Homo Sapiens
LSGATSHSS

SEQ ID NO: 489441 - protein, 9 aa, Homo Sapiens
ITSSTAHQH

SEQ ID NO: 489442 - protein, 9 aa, Homo Sapiens
SPFFSPVLL

SEQ ID NO: 489443 - protein, 9 aa, Homo Sapiens
ASFLLDWSL

SEQ ID NO: 489444 - protein, 9 aa, Homo Sapiens
WTLDRQELE

SEQ ID NO: 489445 - protein, 9 aa, Homo Sapiens
AKVIQTSFQ

SEQ ID NO: 489446 - protein, 9 aa, Homo Sapiens
PPAGPMYPR

SEQ ID NO: 489447 - protein, 9 aa, Homo Sapiens
ELSLEQWLW

SEQ ID NO: 489448 - protein, 9 aa, Homo Sapiens
ISGLTHEIE

SEQ ID NO: 489449 - protein, 9 aa, Homo Sapiens
RQELESKFN

SEQ ID NO: 489450 - protein, 9 aa, Homo Sapiens
LEDSNIQAS

SEQ ID NO: 489451 - protein, 9 aa, Homo Sapiens
QRQVIMSPL

SEQ ID NO: 489452 - protein, 9 aa, Homo Sapiens
SSSEQVILH

SEQ ID NO: 489453 - protein, 9 aa, Homo Sapiens
RGHTTAPRI

SEQ ID NO: 489454 - protein, 9 aa, Homo Sapiens
AVFSSSFSI

SEQ ID NO: 489455 - protein, 9 aa, Homo Sapiens
QGHGAVPAG

SEQ ID NO: 489456 - protein, 9 aa, Homo Sapiens
PLVAGVIGA

SEQ ID NO: 489457 - protein, 9 aa, Homo Sapiens
PTQQWPAEG

SEQ ID NO: 489458 - protein, 9 aa, Homo Sapiens
TTTAGGMAE

SEQ ID NO: 489459 - protein, 9 aa, Homo Sapiens
REARGQIPV

SEQ ID NO: 489460 - protein, 9 aa, Homo Sapiens
EARLEVRGQ

SEQ ID NO: 489461 - protein, 9 aa, Homo Sapiens
LLDWSLGAL

SEQ ID NO: 489462 - protein, 9 aa, Homo Sapiens
YVPNHGLAG

SEQ ID NO: 489463 - protein, 9 aa, Homo Sapiens
SGATSHSSS

SEQ ID NO: 489464 - protein, 9 aa, Homo Sapiens
GGRPPHSAT

SEQ ID NO: 489465 - protein, 9 aa, Homo Sapiens
AKPDCVITC

SEQ ID NO: 489466 - protein, 9 aa, Homo Sapiens
PCSQRDHRS

SEQ ID NO: 489467 - protein, 9 aa, Homo Sapiens
NSNYKNGWI

SEQ ID NO: 489468 - protein, 9 aa, Homo Sapiens
MAKPDCVIT

SEQ ID NO: 489469 - protein, 9 aa, Homo Sapiens
NIRIGTKFS

SEQ ID NO: 489470 - protein, 9 aa, Homo Sapiens
PLQDQLLPS

SEQ ID NO: 489471 - protein, 9 aa, Homo Sapiens
HGITSSTAH

SEQ ID NO: 489472 - protein, 9 aa, Homo Sapiens
SVGSTLGAG

SEQ ID NO: 489473 - protein, 9 aa, Homo Sapiens
TAGGMAEVA

SEQ ID NO: 489474 - protein, 9 aa, Homo Sapiens
TLPTLRPLT

SEQ ID NO: 489475 - protein, 9 aa, Homo Sapiens
PFLGARELY

SEQ ID NO: 489476 - protein, 9 aa, Homo Sapiens
PPLRILTGH

SEQ ID NO: 489477 - protein, 9 aa, Homo Sapiens
PHKDNQVKL

SEQ ID NO: 489478 - protein, 9 aa, Homo Sapiens
LGCQLQLPN

SEQ ID NO: 489479 - protein, 9 aa, Homo Sapiens
KKVNQAFKT

SEQ ID NO: 489480 - protein, 9 aa, Homo Sapiens
HQLLQLRRL

SEQ ID NO: 489481 - protein, 9 aa, Homo Sapiens
EHNTGNIRP

SEQ ID NO: 489482 - protein, 9 aa, Homo Sapiens
SELSLEQWL

SEQ ID NO: 489483 - protein, 9 aa, Homo Sapiens
RSATLSLIQ

SEQ ID NO: 489484 - protein, 9 aa, Homo Sapiens
SSSSGTTDS

SEQ ID NO: 489485 - protein, 9 aa, Homo Sapiens
GRAMCIVDV

SEQ ID NO: 489486 - protein, 9 aa, Homo Sapiens
NNREMSRIF

SEQ ID NO: 489487 - protein, 9 aa, Homo Sapiens
QAEVDEVID

SEQ ID NO: 489488 - protein, 9 aa, Homo Sapiens
EMSRIFHYI

SEQ ID NO: 489489 - protein, 9 aa, Homo Sapiens
VIVNTYLNE

SEQ ID NO: 489490 - protein, 9 aa, Homo Sapiens
MCPGEPPHL

SEQ ID NO: 489491 - protein, 9 aa, Homo Sapiens
RRSPSFQYF

SEQ ID NO: 489492 - protein, 9 aa, Homo Sapiens
QLDNFFCEV

SEQ ID NO: 489493 - protein, 9 aa, Homo Sapiens
CVITCDGKN

SEQ ID NO: 489494 - protein, 9 aa, Homo Sapiens
LLHVALRNR

SEQ ID NO: 489495 - protein, 9 aa, Homo Sapiens
GPRRRGHWV

SEQ ID NO: 489496 - protein, 9 aa, Homo Sapiens
INVGPLVAG

SEQ ID NO: 489497 - protein, 9 aa, Homo Sapiens
QWPAEGTDY

SEQ ID NO: 489498 - protein, 9 aa, Homo Sapiens
YTEGRALLH

SEQ ID NO: 489499 - protein, 9 aa, Homo Sapiens
GGVTHANSN

SEQ ID NO: 489500 - protein, 9 aa, Homo Sapiens
STLDLVALS

SEQ ID NO: 489501 - protein, 9 aa, Homo Sapiens
RLKNNREMS

SEQ ID NO: 489502 - protein, 9 aa, Homo Sapiens
IQWVYGATP

SEQ ID NO: 489503 - protein, 9 aa, Homo Sapiens
VIQTSFQRA

SEQ ID NO: 489504 - protein, 9 aa, Homo Sapiens
ILRSATLSL

SEQ ID NO: 489505 - protein, 9 aa, Homo Sapiens
TPLAVFSSS

SEQ ID NO: 489506 - protein, 9 aa, Homo Sapiens
SYKPSPFFS

SEQ ID NO: 489507 - protein, 9 aa, Homo Sapiens
NQLDNFFCE

SEQ ID NO: 489508 - protein, 9 aa, Homo Sapiens
QIPVGGEGP

SEQ ID NO: 489509 - protein, 9 aa, Homo Sapiens
WSLGALPER

SEQ ID NO: 489510 - protein, 9 aa, Homo Sapiens
PWWPTLPTL

SEQ ID NO: 489511 - protein, 9 aa, Homo Sapiens
VGYFDLIGC

SEQ ID NO: 489512 - protein, 9 aa, Homo Sapiens
DQLLPSDGI

SEQ ID NO: 489513 - protein, 9 aa, Homo Sapiens
GFWFSRLTT

SEQ ID NO: 489514 - protein, 9 aa, Homo Sapiens
YVSSEGTEQ

SEQ ID NO: 489515 - protein, 9 aa, Homo Sapiens
RSYETWNGI

SEQ ID NO: 489516 - protein, 9 aa, Homo Sapiens
WVREHNTGN

SEQ ID NO: 489517 - protein, 9 aa, Homo Sapiens
YSSMFEDNT

SEQ ID NO: 489518 - protein, 9 aa, Homo Sapiens
AGGMTPTAF

SEQ ID NO: 489519 - protein, 9 aa, Homo Sapiens
EQVILHLKG

SEQ ID NO: 489520 - protein, 9 aa, Homo Sapiens
CKYIVDSMG

SEQ ID NO: 489521 - protein, 9 aa, Homo Sapiens
HGAVPAGCP

SEQ ID NO: 489522 - protein, 9 aa, Homo Sapiens
PNCTVLYPS

SEQ ID NO: 489523 - protein, 9 aa, Homo Sapiens
SPAPLLPGN

SEQ ID NO: 489524 - protein, 9 aa, Homo Sapiens
ETAKVIQTS

SEQ ID NO: 489525 - protein, 9 aa, Homo Sapiens
VFNVETGTW

SEQ ID NO: 489526 - protein, 9 aa, Homo Sapiens
LPTLRPLTP

SEQ ID NO: 489527 - protein, 9 aa, Homo Sapiens
QVIMSPLIT

SEQ ID NO: 489528 - protein, 9 aa, Homo Sapiens
AGPAPGAHA

SEQ ID NO: 489529 - protein, 9 aa, Homo Sapiens
PGNLLGGGS

SEQ ID NO: 489530 - protein, 9 aa, Homo Sapiens
IPVGGEGPQ

SEQ ID NO: 489531 - protein, 9 aa, Homo Sapiens
TAKVIQTSF

SEQ ID NO: 489532 - protein, 9 aa, Homo Sapiens
EYLGRSIFS

SEQ ID NO: 489533 - protein, 9 aa, Homo Sapiens
AVSGVDVGC

SEQ ID NO: 489534 - protein, 9 aa, Homo Sapiens
NLNGFWFSR

SEQ ID NO: 489535 - protein, 9 aa, Homo Sapiens
AGCLAHTSL

SEQ ID NO: 489536 - protein, 9 aa, Homo Sapiens
SCEGSSVES

SEQ ID NO: 489537 - protein, 9 aa, Homo Sapiens
VGINVGPLV

SEQ ID NO: 489538 - protein, 9 aa, Homo Sapiens
KTLKRCTTT

SEQ ID NO: 489539 - protein, 9 aa, Homo Sapiens
QVILHLKGS

SEQ ID NO: 489540 - protein, 9 aa, Homo Sapiens
YEDKNFEGR

SEQ ID NO: 489541 - protein, 9 aa, Homo Sapiens
RHLSHDVSG

SEQ ID NO: 489542 - protein, 9 aa, Homo Sapiens
EQEEIMVQG

SEQ ID NO: 489543 - protein, 9 aa, Homo Sapiens
MVPIKNQVF

SEQ ID NO: 489544 - protein, 9 aa, Homo Sapiens
DHGITSSTA

SEQ ID NO: 489545 - protein, 9 aa, Homo Sapiens
RQLTVLIGY

SEQ ID NO: 489546 - protein, 9 aa, Homo Sapiens
VNGAELEAR

SEQ ID NO: 489547 - protein, 9 aa, Homo Sapiens
LQLRRLAHG

SEQ ID NO: 489548 - protein, 9 aa, Homo Sapiens
VRLPVEGHH

SEQ ID NO: 489549 - protein, 9 aa, Homo Sapiens
ILTGHSHTH

SEQ ID NO: 489550 - protein, 9 aa, Homo Sapiens
FEGRRYDCD

SEQ ID NO: 489551 - protein, 9 aa, Homo Sapiens
SSTKQCVDS

SEQ ID NO: 489552 - protein, 9 aa, Homo Sapiens
GCVGGPTCS

SEQ ID NO: 489553 - protein, 9 aa, Homo Sapiens
RESSWGSGP

SEQ ID NO: 489554 - protein, 9 aa, Homo Sapiens
LPLTRSHSN

SEQ ID NO: 489555 - protein, 9 aa, Homo Sapiens
CKWKNRIVA

SEQ ID NO: 489556 - protein, 9 aa, Homo Sapiens
TTACGRQAL

SEQ ID NO: 489557 - protein, 9 aa, Homo Sapiens
IQPFLGARE

SEQ ID NO: 489558 - protein, 9 aa, Homo Sapiens
GMTAAHDFF

SEQ ID NO: 489559 - protein, 9 aa, Homo Sapiens
FSSSFSISL

SEQ ID NO: 489560 - protein, 9 aa, Homo Sapiens
AMAKPDCVI

SEQ ID NO: 489561 - protein, 9 aa, Homo Sapiens
LAGPAPGAH

SEQ ID NO: 489562 - protein, 9 aa, Homo Sapiens
TTAPRIREL

SEQ ID NO: 489563 - protein, 9 aa, Homo Sapiens
VAQHLAPTY

SEQ ID NO: 489564 - protein, 9 aa, Homo Sapiens
CTLVEVTEQ

SEQ ID NO: 489565 - protein, 9 aa, Homo Sapiens
RECRRSPSF

SEQ ID NO: 489566 - protein, 9 aa, Homo Sapiens
SDYSCEGSS

SEQ ID NO: 489567 - protein, 9 aa, Homo Sapiens
NVREMALRH

SEQ ID NO: 489568 - protein, 9 aa, Homo Sapiens
GHWLALLPA

SEQ ID NO: 489569 - protein, 9 aa, Homo Sapiens
HGLAGPAPG

SEQ ID NO: 489570 - protein, 9 aa, Homo Sapiens
PTAFSSQHT

SEQ ID NO: 489571 - protein, 9 aa, Homo Sapiens
PLSSPVHEP

SEQ ID NO: 489572 - protein, 9 aa, Homo Sapiens
WQVRYSYLQ

SEQ ID NO: 489573 - protein, 9 aa, Homo Sapiens
PVCGSGEGL

SEQ ID NO: 489574 - protein, 9 aa, Homo Sapiens
ASQTAIQVN

SEQ ID NO: 489575 - protein, 9 aa, Homo Sapiens
SMFEDNTVT

SEQ ID NO: 489576 - protein, 9 aa, Homo Sapiens
PTGTLPCPW

SEQ ID NO: 489577 - protein, 9 aa, Homo Sapiens
PEERALKYE

SEQ ID NO: 489578 - protein, 9 aa, Homo Sapiens
IRIGTKFST

SEQ ID NO: 489579 - protein, 9 aa, Homo Sapiens
ITLWLQRWL

SEQ ID NO: 489580 - protein, 9 aa, Homo Sapiens
SSTTACGRQ

SEQ ID NO: 489581 - protein, 9 aa, Homo Sapiens
DEYLGRSIF

SEQ ID NO: 489582 - protein, 9 aa, Homo Sapiens
GMYHRRIIV

SEQ ID NO: 489583 - protein, 9 aa, Homo Sapiens
EELNKLLGS

SEQ ID NO: 489584 - protein, 9 aa, Homo Sapiens
KVIQTSFQR

SEQ ID NO: 489585 - protein, 9 aa, Homo Sapiens
ARDRDGYAA

SEQ ID NO: 489586 - protein, 9 aa, Homo Sapiens
TDLTGDAVR

SEQ ID NO: 489587 - protein, 9 aa, Homo Sapiens
TSHSSSTTA

SEQ ID NO: 489588 - protein, 9 aa, Homo Sapiens
RFNTVFNVE

SEQ ID NO: 489589 - protein, 9 aa, Homo Sapiens
NYTEGRALL

SEQ ID NO: 489590 - protein, 9 aa, Homo Sapiens
PPSPASLGS

SEQ ID NO: 489591 - protein, 9 aa, Homo Sapiens
DSSLEKIKV

SEQ ID NO: 489592 - protein, 9 aa, Homo Sapiens
GAGCVGGPT

SEQ ID NO: 489593 - protein, 9 aa, Homo Sapiens
FEDNTVTEY

SEQ ID NO: 489594 - protein, 9 aa, Homo Sapiens
SGNATRNCL

SEQ ID NO: 489595 - protein, 9 aa, Homo Sapiens
KATIYLRQR

SEQ ID NO: 489596 - protein, 9 aa, Homo Sapiens
RNMGNLKPR

SEQ ID NO: 489597 - protein, 9 aa, Homo Sapiens
FDSFVVHFK

SEQ ID NO: 489598 - protein, 9 aa, Homo Sapiens
TAPRIRELV

SEQ ID NO: 489599 - protein, 9 aa, Homo Sapiens
VGEVLHVKS

SEQ ID NO: 489600 - protein, 9 aa, Homo Sapiens
HLLAFPAPS

SEQ ID NO: 489601 - protein, 9 aa, Homo Sapiens
ANSNYKNGW

SEQ ID NO: 489602 - protein, 9 aa, Homo Sapiens
EYFCKAHSD

SEQ ID NO: 489603 - protein, 9 aa, Homo Sapiens
HPMPEERAL

SEQ ID NO: 489604 - protein, 9 aa, Homo Sapiens
SNMDYKATI

SEQ ID NO: 489605 - protein, 9 aa, Homo Sapiens
PKLDCKVGY

SEQ ID NO: 489606 - protein, 9 aa, Homo Sapiens
VELNSCKWK

SEQ ID NO: 489607 - protein, 9 aa, Homo Sapiens
PKAVHRFLP

SEQ ID NO: 489608 - protein, 9 aa, Homo Sapiens
DEDHGITSS

SEQ ID NO: 489609 - protein, 9 aa, Homo Sapiens
FKKCLGLVN

SEQ ID NO: 489610 - protein, 9 aa, Homo Sapiens
LRRDDMWEQ

SEQ ID NO: 489611 - protein, 9 aa, Homo Sapiens
LTSESDYSC

SEQ ID NO: 489612 - protein, 9 aa, Homo Sapiens
IKRGRSCSL

SEQ ID NO: 489613 - protein, 9 aa, Homo Sapiens
CEVPQVIKL

SEQ ID NO: 489614 - protein, 9 aa, Homo Sapiens
AGSAWASMF

SEQ ID NO: 489615 - protein, 9 aa, Homo Sapiens
KSESLAPPL

SEQ ID NO: 489616 - protein, 9 aa, Homo Sapiens
ILGCQLQLP

SEQ ID NO: 489617 - protein, 9 aa, Homo Sapiens
PRIRELVSY

SEQ ID NO: 489618 - protein, 9 aa, Homo Sapiens
ALLPAQGHG

SEQ ID NO: 489619 - protein, 9 aa, Homo Sapiens
VVIVNTYLN

SEQ ID NO: 489620 - protein, 9 aa, Homo Sapiens
PGAHADPHL

SEQ ID NO: 489621 - protein, 9 aa, Homo Sapiens
PAQGHGAVP

SEQ ID NO: 489622 - protein, 9 aa, Homo Sapiens
TPHKDNQVK

SEQ ID NO: 489623 - protein, 9 aa, Homo Sapiens
PDCVITCDG

SEQ ID NO: 489624 - protein, 9 aa, Homo Sapiens
GRWWILGSA

SEQ ID NO: 489625 - protein, 9 aa, Homo Sapiens
HSNFVAILD

SEQ ID NO: 489626 - protein, 9 aa, Homo Sapiens
TAAHDFFQG

SEQ ID NO: 489627 - protein, 9 aa, Homo Sapiens
VREMALRHL

SEQ ID NO: 489628 - protein, 9 aa, Homo Sapiens
HFKDKDGPQ

SEQ ID NO: 489629 - protein, 9 aa, Homo Sapiens
PVGGEGPQK

SEQ ID NO: 489630 - protein, 9 aa, Homo Sapiens
TDLFSSIQC

SEQ ID NO: 489631 - protein, 9 aa, Homo Sapiens
GGMTPTAFS

SEQ ID NO: 489632 - protein, 9 aa, Homo Sapiens
PTASQTAIQ

SEQ ID NO: 489633 - protein, 9 aa, Homo Sapiens
RGQIPVGGE

SEQ ID NO: 489634 - protein, 9 aa, Homo Sapiens
QGDTARESS

SEQ ID NO: 489635 - protein, 9 aa, Homo Sapiens
NHGLAGPAP

SEQ ID NO: 489636 - protein, 9 aa, Homo Sapiens
RGHWVQPGV

SEQ ID NO: 489637 - protein, 9 aa, Homo Sapiens
CGSGEGLQP

SEQ ID NO: 489638 - protein, 9 aa, Homo Sapiens
DLTGDAVRL

SEQ ID NO: 489639 - protein, 9 aa, Homo Sapiens
LRILTGHSH

SEQ ID NO: 489640 - protein, 9 aa, Homo Sapiens
ADSNRNDLL

SEQ ID NO: 489641 - protein, 9 aa, Homo Sapiens
SFQRASYPD

SEQ ID NO: 489642 - protein, 9 aa, Homo Sapiens
SARSYETWN

SEQ ID NO: 489643 - protein, 9 aa, Homo Sapiens
LLSRLSSRY

SEQ ID NO: 489644 - protein, 9 aa, Homo Sapiens
RRLAHGTAG

SEQ ID NO: 489645 - protein, 9 aa, Homo Sapiens
LMQLLWTIL

SEQ ID NO: 489646 - protein, 9 aa, Homo Sapiens
AHDFFQGTR

SEQ ID NO: 489647 - protein, 9 aa, Homo Sapiens
GGGSGGHGE

SEQ ID NO: 489648 - protein, 9 aa, Homo Sapiens
QMCPGEPPH

SEQ ID NO: 489649 - protein, 9 aa, Homo Sapiens
SILSIQALF

SEQ ID NO: 489650 - protein, 9 aa, Homo Sapiens
LRNMGNLKP

SEQ ID NO: 489651 - protein, 9 aa, Homo Sapiens
KPIGSLHPR

SEQ ID NO: 489652 - protein, 9 aa, Homo Sapiens
RVGKKMRPQ

SEQ ID NO: 489653 - protein, 9 aa, Homo Sapiens
PEAPHQPTE

SEQ ID NO: 489654 - protein, 9 aa, Homo Sapiens
IAPIEDPED

SEQ ID NO: 489655 - protein, 9 aa, Homo Sapiens
SRWPLQDQL

SEQ ID NO: 489656 - protein, 9 aa, Homo Sapiens
LDLVALSVG

SEQ ID NO: 489657 - protein, 9 aa, Homo Sapiens
LNGFWFSRL

SEQ ID NO: 489658 - protein, 9 aa, Homo Sapiens
KWSCTLKKV

SEQ ID NO: 489659 - protein, 9 aa, Homo Sapiens
EVAQHLAPT

SEQ ID NO: 489660 - protein, 9 aa, Homo Sapiens
RVVIVNTYL

SEQ ID NO: 489661 - protein, 9 aa, Homo Sapiens
GLIQWVYGA

SEQ ID NO: 489662 - protein, 9 aa, Homo Sapiens
NYKNGWIVM

SEQ ID NO: 489663 - protein, 9 aa, Homo Sapiens
DYKATIYLR

SEQ ID NO: 489664 - protein, 9 aa, Homo Sapiens
GKDEYLGRS

SEQ ID NO: 489665 - protein, 9 aa, Homo Sapiens
FFCEVPQVI

SEQ ID NO: 489666 - protein, 9 aa, Homo Sapiens
RIRELVSYP

SEQ ID NO: 489667 - protein, 9 aa, Homo Sapiens
LPCPWWPTL

SEQ ID NO: 489668 - protein, 9 aa, Homo Sapiens
CSKHPVAAA

SEQ ID NO: 489669 - protein, 9 aa, Homo Sapiens
PSFPPTGEK

SEQ ID NO: 489670 - protein, 9 aa, Homo Sapiens
LTVLIGYDV

SEQ ID NO: 489671 - protein, 9 aa, Homo Sapiens
EVDEVIDSK

SEQ ID NO: 489672 - protein, 9 aa, Homo Sapiens
LNIRIGTKF

SEQ ID NO: 489673 - protein, 9 aa, Homo Sapiens
KVNQAFKTL

SEQ ID NO: 489674 - protein, 9 aa, Homo Sapiens
TLNEAIMHE

SEQ ID NO: 489675 - protein, 9 aa, Homo Sapiens
CLCMEEIEG

SEQ ID NO: 489676 - protein, 9 aa, Homo Sapiens
LSPKAVHRF

SEQ ID NO: 489677 - protein, 9 aa, Homo Sapiens
AFPAPSQRL

SEQ ID NO: 489678 - protein, 9 aa, Homo Sapiens
KISGLTHEI

SEQ ID NO: 489679 - protein, 9 aa, Homo Sapiens
PTYGDKAFE

SEQ ID NO: 489680 - protein, 9 aa, Homo Sapiens
RSIPNCTVL

SEQ ID NO: 489681 - protein, 9 aa, Homo Sapiens
ASPRYTTAR

SEQ ID NO: 489682 - protein, 9 aa, Homo Sapiens
SSEQVILHL

SEQ ID NO: 489683 - protein, 9 aa, Homo Sapiens
EGTEQEEIM

SEQ ID NO: 489684 - protein, 9 aa, Homo Sapiens
SGLIQWVYG

SEQ ID NO: 489685 - protein, 9 aa, Homo Sapiens
VLYPSDAIS

SEQ ID NO: 489686 - protein, 9 aa, Homo Sapiens
VGCLEVEDR

SEQ ID NO: 489687 - protein, 9 aa, Homo Sapiens
VSSEGTEQE

SEQ ID NO: 489688 - protein, 9 aa, Homo Sapiens
APGAHADPH

SEQ ID NO: 489689 - protein, 9 aa, Homo Sapiens
THEIEPIRH

SEQ ID NO: 489690 - protein, 9 aa, Homo Sapiens
PIGSLHPRL

SEQ ID NO: 489691 - protein, 9 aa, Homo Sapiens
HKDNQVKLE

SEQ ID NO: 489692 - protein, 9 aa, Homo Sapiens
LKKVKEDSS

SEQ ID NO: 489693 - protein, 9 aa, Homo Sapiens
QGMTAAHDF

SEQ ID NO: 489694 - protein, 9 aa, Homo Sapiens
ETYIRQRQV

SEQ ID NO: 489695 - protein, 9 aa, Homo Sapiens
SSRYVPNHG

SEQ ID NO: 489696 - protein, 9 aa, Homo Sapiens
AKPSPSFPP

SEQ ID NO: 489697 - protein, 9 aa, Homo Sapiens
QTSFQRASY

SEQ ID NO: 489698 - protein, 9 aa, Homo Sapiens
NREMSRIFH

SEQ ID NO: 489699 - protein, 9 aa, Homo Sapiens
SATLSLIQF

SEQ ID NO: 489700 - protein, 9 aa, Homo Sapiens
DNLWQVRYS

SEQ ID NO: 489701 - protein, 9 aa, Homo Sapiens
QDGGRPPHS

SEQ ID NO: 489702 - protein, 9 aa, Homo Sapiens
VDVGCLEVE

SEQ ID NO: 489703 - protein, 9 aa, Homo Sapiens
PAEGTDYAI

SEQ ID NO: 489704 - protein, 9 aa, Homo Sapiens
TRILRSATL

SEQ ID NO: 489705 - protein, 9 aa, Homo Sapiens
TIAQACKYI

SEQ ID NO: 489706 - protein, 9 aa, Homo Sapiens
ADCRVGKKM

SEQ ID NO: 489707 - protein, 9 aa, Homo Sapiens
LCVYVHDQG

SEQ ID NO: 489708 - protein, 9 aa, Homo Sapiens
DSNRNDLLV

SEQ ID NO: 489709 - protein, 9 aa, Homo Sapiens
QPCSQRDHR

SEQ ID NO: 489710 - protein, 9 aa, Homo Sapiens
QEVENSVKH

SEQ ID NO: 489711 - protein, 9 aa, Homo Sapiens
SFQYFPSNN

SEQ ID NO: 489712 - protein, 9 aa, Homo Sapiens
NTGNIRPVD

SEQ ID NO: 489713 - protein, 9 aa, Homo Sapiens
DVYRYPSQD

SEQ ID NO: 489714 - protein, 9 aa, Homo Sapiens
EDHGITSST

SEQ ID NO: 489715 - protein, 9 aa, Homo Sapiens
VAQPPEAPH

SEQ ID NO: 489716 - protein, 9 aa, Homo Sapiens
VETGTWECG

SEQ ID NO: 489717 - protein, 9 aa, Homo Sapiens
AGCVGGPTC

SEQ ID NO: 489718 - protein, 9 aa, Homo Sapiens
GHTTAPRIR

SEQ ID NO: 489719 - protein, 9 aa, Homo Sapiens
VLIGYDVTD

SEQ ID NO: 489720 - protein, 9 aa, Homo Sapiens
WSCTLKKVK

SEQ ID NO: 489721 - protein, 9 aa, Homo Sapiens
LHVKSESLA

SEQ ID NO: 489722 - protein, 9 aa, Homo Sapiens
TLDLVALSV

SEQ ID NO: 489723 - protein, 9 aa, Homo Sapiens
MHEYPNFKE

SEQ ID NO: 489724 - protein, 9 aa, Homo Sapiens
FNTVFNVET

SEQ ID NO: 489725 - protein, 9 aa, Homo Sapiens
NTVFNVETG

SEQ ID NO: 489726 - protein, 9 aa, Homo Sapiens
HEYPNFKEE

SEQ ID NO: 489727 - protein, 9 aa, Homo Sapiens
EGTPLAVFS

SEQ ID NO: 489728 - protein, 9 aa, Homo Sapiens
MNDALHGGW

SEQ ID NO: 489729 - protein, 9 aa, Homo Sapiens
VITCDGKNL

SEQ ID NO: 489730 - protein, 9 aa, Homo Sapiens
CVGGPTCSV

SEQ ID NO: 489731 - protein, 9 aa, Homo Sapiens
AVHRFLPMV

SEQ ID NO: 489732 - protein, 9 aa, Homo Sapiens
VGPLVAGVI

SEQ ID NO: 489733 - protein, 9 aa, Homo Sapiens
EVTEQEVEN

SEQ ID NO: 489734 - protein, 9 aa, Homo Sapiens
CKVGYFDLI

SEQ ID NO: 489735 - protein, 9 aa, Homo Sapiens
PIEDPEDTN

SEQ ID NO: 489736 - protein, 9 aa, Homo Sapiens
SFQLCVYVH

SEQ ID NO: 489737 - protein, 9 aa, Homo Sapiens
DLVALSVGS

SEQ ID NO: 489738 - protein, 9 aa, Homo Sapiens
LEARDRDGY

SEQ ID NO: 489739 - protein, 9 aa, Homo Sapiens
NSNGLSIGT

SEQ ID NO: 489740 - protein, 9 aa, Homo Sapiens
YMFRGVSII

SEQ ID NO: 489741 - protein, 9 aa, Homo Sapiens
GAHADPHLF

SEQ ID NO: 489742 - protein, 9 aa, Homo Sapiens
FFLATYLPI

SEQ ID NO: 489743 - protein, 9 aa, Homo Sapiens
ATYLPISNP

SEQ ID NO: 489744 - protein, 9 aa, Homo Sapiens
KETYPNECV

SEQ ID NO: 489745 - protein, 9 aa, Homo Sapiens
SNGLSIGTV

SEQ ID NO: 489746 - protein, 9 aa, Homo Sapiens
PSQRLMQLL

SEQ ID NO: 489747 - protein, 9 aa, Homo Sapiens
VHEPPQLEE

SEQ ID NO: 489748 - protein, 9 aa, Homo Sapiens
DSGGGGGGS

SEQ ID NO: 489749 - protein, 9 aa, Homo Sapiens
FLATYLPIS

SEQ ID NO: 489750 - protein, 9 aa, Homo Sapiens
HRFLPMVDA

SEQ ID NO: 489751 - protein, 9 aa, Homo Sapiens
ECRRSPSFQ

SEQ ID NO: 489752 - protein, 9 aa, Homo Sapiens
SLLCSKHPV

SEQ ID NO: 489753 - protein, 9 aa, Homo Sapiens
FCEVPQVIK

SEQ ID NO: 489754 - protein, 9 aa, Homo Sapiens
IILRNMGNL

SEQ ID NO: 489755 - protein, 9 aa, Homo Sapiens
QPLGRAMCI

SEQ ID NO: 489756 - protein, 9 aa, Homo Sapiens
HTHPMLLSR

SEQ ID NO: 489757 - protein, 9 aa, Homo Sapiens
RLAHGTAGL

SEQ ID NO: 489758 - protein, 9 aa, Homo Sapiens
KTDSAKPSP

SEQ ID NO: 489759 - protein, 9 aa, Homo Sapiens
LYLRSVIAP

SEQ ID NO: 489760 - protein, 9 aa, Homo Sapiens
SNCLCMEEI

SEQ ID NO: 489761 - protein, 9 aa, Homo Sapiens
LPPLRILTG

SEQ ID NO: 489762 - protein, 9 aa, Homo Sapiens
TRSHSNFVA

SEQ ID NO: 489763 - protein, 9 aa, Homo Sapiens
VFSSSFSIS

SEQ ID NO: 489764 - protein, 9 aa, Homo Sapiens
SSSTTACGR

SEQ ID NO: 489765 - protein, 9 aa, Homo Sapiens
GDAVRLPVE

SEQ ID NO: 489766 - protein, 9 aa, Homo Sapiens
QMKLRRDDM

SEQ ID NO: 489767 - protein, 9 aa, Homo Sapiens
RRIIVSPTG

SEQ ID NO: 489768 - protein, 9 aa, Homo Sapiens
LQDQLLPSD

SEQ ID NO: 489769 - protein, 9 aa, Homo Sapiens
INYTEGRAL

SEQ ID NO: 489770 - protein, 9 aa, Homo Sapiens
EGRRYDCDC

SEQ ID NO: 489771 - protein, 9 aa, Homo Sapiens
AFSSQHTAG

SEQ ID NO: 489772 - protein, 9 aa, Homo Sapiens
TKEDRNAIE

SEQ ID NO: 489773 - protein, 9 aa, Homo Sapiens
REMALRHLS

SEQ ID NO: 489774 - protein, 9 aa, Homo Sapiens
NATRNCLEK

SEQ ID NO: 489775 - protein, 9 aa, Homo Sapiens
EGTDYAIYL

SEQ ID NO: 489776 - protein, 9 aa, Homo Sapiens
NCTVLYPSD

SEQ ID NO: 489777 - protein, 9 aa, Homo Sapiens
SGLTHEIEP

SEQ ID NO: 489778 - protein, 9 aa, Homo Sapiens
CPQMCPGEP

SEQ ID NO: 489779 - protein, 9 aa, Homo Sapiens
LNSCKWKNR

SEQ ID NO: 489780 - protein, 9 aa, Homo Sapiens
MPTASQTAI

SEQ ID NO: 489781 - protein, 9 aa, Homo Sapiens
HTTAPRIRE

SEQ ID NO: 489782 - protein, 9 aa, Homo Sapiens
FQLCVYVHD

SEQ ID NO: 489783 - protein, 9 aa, Homo Sapiens
DMVPIKNQV

SEQ ID NO: 489784 - protein, 9 aa, Homo Sapiens
AHADPHLFR

SEQ ID NO: 489785 - protein, 9 aa, Homo Sapiens
QTAIQVNGN

SEQ ID NO: 489786 - protein, 9 aa, Homo Sapiens
TVLYPSDAI

SEQ ID NO: 489787 - protein, 9 aa, Homo Sapiens
HSDAGAVKS

SEQ ID NO: 489788 - protein, 9 aa, Homo Sapiens
EAPHQPTER

SEQ ID NO: 489789 - protein, 9 aa, Homo Sapiens
ILHLKGSDY

SEQ ID NO: 489790 - protein, 9 aa, Homo Sapiens
RASPRYTTA

SEQ ID NO: 489791 - protein, 9 aa, Homo Sapiens
ILGSAWSGA

SEQ ID NO: 489792 - protein, 9 aa, Homo Sapiens
HLAPTYGDK

SEQ ID NO: 489793 - protein, 9 aa, Homo Sapiens
DCRVGKKMR

SEQ ID NO: 489794 - protein, 9 aa, Homo Sapiens
NEAIMHEYP

SEQ ID NO: 489795 - protein, 9 aa, Homo Sapiens
SNYKNGWIV

SEQ ID NO: 489796 - protein, 9 aa, Homo Sapiens
PMDVYRYPS

SEQ ID NO: 489797 - protein, 9 aa, Homo Sapiens
QSQPMDVYR

SEQ ID NO: 489798 - protein, 9 aa, Homo Sapiens
KCLGLVNGI

SEQ ID NO: 489799 - protein, 9 aa, Homo Sapiens
IRELVSYPK

SEQ ID NO: 489800 - protein, 9 aa, Homo Sapiens
MYHRRIIVS

SEQ ID NO: 489801 - protein, 9 aa, Homo Sapiens
PIRASPRYT

SEQ ID NO: 489802 - protein, 9 aa, Homo Sapiens
DVLSPKAVH

SEQ ID NO: 489803 - protein, 9 aa, Homo Sapiens
VYRYPSQDP

SEQ ID NO: 489804 - protein, 9 aa, Homo Sapiens
LAVFSSSFS

SEQ ID NO: 489805 - protein, 9 aa, Homo Sapiens
ASLLLLLLR

SEQ ID NO: 489806 - protein, 9 aa, Homo Sapiens
DPGPAPPSP

SEQ ID NO: 489807 - protein, 9 aa, Homo Sapiens
NGIYTVKDC

SEQ ID NO: 489808 - protein, 9 aa, Homo Sapiens
LGRAMCIVD

SEQ ID NO: 489809 - protein, 9 aa, Homo Sapiens
VTHANSNYK

SEQ ID NO: 489810 - protein, 9 aa, Homo Sapiens
LGHYFKKCL

SEQ ID NO: 489811 - protein, 9 aa, Homo Sapiens
YPRLGPEPA

SEQ ID NO: 489812 - protein, 9 aa, Homo Sapiens
RALKYENYF

SEQ ID NO: 489813 - protein, 9 aa, Homo Sapiens
FKTLKRCTT

SEQ ID NO: 489814 - protein, 9 aa, Homo Sapiens
TLDRQELES

SEQ ID NO: 489815 - protein, 9 aa, Homo Sapiens
HSHTHPMLL

SEQ ID NO: 489816 - protein, 9 aa, Homo Sapiens
TFYEDKNFE

SEQ ID NO: 489817 - protein, 9 aa, Homo Sapiens
PSFQLCVYV

SEQ ID NO: 489818 - protein, 9 aa, Homo Sapiens
SLGALPERP

SEQ ID NO: 489819 - protein, 9 aa, Homo Sapiens
VHRFLPMVD

SEQ ID NO: 489820 - protein, 9 aa, Homo Sapiens
SQPMDVYRY

SEQ ID NO: 489821 - protein, 9 aa, Homo Sapiens
GTDYAIYLA

SEQ ID NO: 489822 - protein, 9 aa, Homo Sapiens
YSRSGNATR

SEQ ID NO: 489823 - protein, 9 aa, Homo Sapiens
ATSHSSSTT

SEQ ID NO: 489824 - protein, 9 aa, Homo Sapiens
SQTAIQVNG

SEQ ID NO: 489825 - protein, 9 aa, Homo Sapiens
STKQCVDSN

SEQ ID NO: 489826 - protein, 9 aa, Homo Sapiens
LATYLPISN

SEQ ID NO: 489827 - protein, 9 aa, Homo Sapiens
HVKSESLAP

SEQ ID NO: 489828 - protein, 9 aa, Homo Sapiens
FMKQMNDAL

SEQ ID NO: 489829 - protein, 9 aa, Homo Sapiens
GGHWLALLP

SEQ ID NO: 489830 - protein, 9 aa, Homo Sapiens
PNECVCPFP

SEQ ID NO: 489831 - protein, 9 aa, Homo Sapiens
SFVVHFKDK

SEQ ID NO: 489832 - protein, 9 aa, Homo Sapiens
HIQPFLGAR

SEQ ID NO: 489833 - protein, 9 aa, Homo Sapiens
EDNTVTEYI

SEQ ID NO: 489834 - protein, 9 aa, Homo Sapiens
WWPTLPTLR

SEQ ID NO: 489835 - protein, 9 aa, Homo Sapiens
SIPNCTVLY

SEQ ID NO: 489836 - protein, 9 aa, Homo Sapiens
WLEDSNIQA

SEQ ID NO: 489837 - protein, 9 aa, Homo Sapiens
PFVCRQCKQ

SEQ ID NO: 489838 - protein, 9 aa, Homo Sapiens
LHPRLGCVL

SEQ ID NO: 489839 - protein, 9 aa, Homo Sapiens
SQLRVVIVN

SEQ ID NO: 489840 - protein, 9 aa, Homo Sapiens
SNRNDLLVY

SEQ ID NO: 489841 - protein, 9 aa, Homo Sapiens
APRIRELVS

SEQ ID NO: 489842 - protein, 9 aa, Homo Sapiens
VSPTGTLPC

SEQ ID NO: 489843 - protein, 9 aa, Homo Sapiens
NKLLGSVTI

SEQ ID NO: 489844 - protein, 9 aa, Homo Sapiens
LADCRVGKK

SEQ ID NO: 489845 - protein, 9 aa, Homo Sapiens
KPDCVITCD

SEQ ID NO: 489846 - protein, 9 aa, Homo Sapiens
SQRLMQLLW

SEQ ID NO: 489847 - protein, 9 aa, Homo Sapiens
LCMEEIEGS

SEQ ID NO: 489848 - protein, 9 aa, Homo Sapiens
VALSVGSTL

SEQ ID NO: 489849 - protein, 9 aa, Homo Sapiens
LCSKHPVAA

SEQ ID NO: 489850 - protein, 9 aa, Homo Sapiens
CTVLYPSDA

SEQ ID NO: 489851 - protein, 9 aa, Homo Sapiens
ACGRQALPV

SEQ ID NO: 489852 - protein, 9 aa, Homo Sapiens
LLQLRRLAH

SEQ ID NO: 489853 - protein, 9 aa, Homo Sapiens
SGTTDSSLE

SEQ ID NO: 489854 - protein, 9 aa, Homo Sapiens
LQPCSQRDH

SEQ ID NO: 489855 - protein, 9 aa, Homo Sapiens
WVYGATPLF

SEQ ID NO: 489856 - protein, 9 aa, Homo Sapiens
DQVGKDEYL

SEQ ID NO: 489857 - protein, 9 aa, Homo Sapiens
WLALLPAQG

SEQ ID NO: 489858 - protein, 9 aa, Homo Sapiens
ETYPNECVC

SEQ ID NO: 489859 - protein, 9 aa, Homo Sapiens
GGSGGHGEY

SEQ ID NO: 489860 - protein, 9 aa, Homo Sapiens
KDEYLGRSI

SEQ ID NO: 489861 - protein, 9 aa, Homo Sapiens
KTIRSNSNG

SEQ ID NO: 489862 - protein, 9 aa, Homo Sapiens
VGGEGPQKT

SEQ ID NO: 489863 - protein, 9 aa, Homo Sapiens
TGHSHTHPM

SEQ ID NO: 489864 - protein, 9 aa, Homo Sapiens
QCPSNWNPC

SEQ ID NO: 489865 - protein, 9 aa, Homo Sapiens
GLTHEIEPI

SEQ ID NO: 489866 - protein, 9 aa, Homo Sapiens
VTHTPGFGD

SEQ ID NO: 489867 - protein, 9 aa, Homo Sapiens
ALSVGSTLG

SEQ ID NO: 489868 - protein, 9 aa, Homo Sapiens
ATLSLIQFF

SEQ ID NO: 489869 - protein, 9 aa, Homo Sapiens
VHFKDKDGP

SEQ ID NO: 489870 - protein, 9 aa, Homo Sapiens
VIAPIEDPE

SEQ ID NO: 489871 - protein, 9 aa, Homo Sapiens
IMHEYPNFK

SEQ ID NO: 489872 - protein, 9 aa, Homo Sapiens
RILRSATLS

SEQ ID NO: 489873 - protein, 9 aa, Homo Sapiens
LLPAQGHGA

SEQ ID NO: 489874 - protein, 9 aa, Homo Sapiens
ASNCLCMEE

SEQ ID NO: 489875 - protein, 9 aa, Homo Sapiens
SNSNGLSIG

SEQ ID NO: 489876 - protein, 9 aa, Homo Sapiens
GEVLHVKSE

SEQ ID NO: 489877 - protein, 9 aa, Homo Sapiens
MTPTAFSSQ

SEQ ID NO: 489878 - protein, 9 aa, Homo Sapiens
LRSVIAPIE

SEQ ID NO: 489879 - protein, 9 aa, Homo Sapiens
KVGYFDLIG

SEQ ID NO: 489880 - protein, 9 aa, Homo Sapiens
WTILGCQLQ

SEQ ID NO: 489881 - protein, 9 aa, Homo Sapiens
TWNGIYTVK

SEQ ID NO: 489882 - protein, 9 aa, Homo Sapiens
LSVGSTLGA

SEQ ID NO: 489883 - protein, 9 aa, Homo Sapiens
TTDSSLEKI

SEQ ID NO: 489884 - protein, 9 aa, Homo Sapiens
AMCIVDVCH

SEQ ID NO: 489885 - protein, 9 aa, Homo Sapiens
ARESSWGSG

SEQ ID NO: 489886 - protein, 9 aa, Homo Sapiens
EVIDSKRYL

SEQ ID NO: 489887 - protein, 9 aa, Homo Sapiens
LPAQGHGAV

SEQ ID NO: 489888 - protein, 9 aa, Homo Sapiens
DALHGGWTT

SEQ ID NO: 489889 - protein, 9 aa, Homo Sapiens
AQGHGAVPA

SEQ ID NO: 489890 - protein, 9 aa, Homo Sapiens
HGGHWLALL

SEQ ID NO: 489891 - protein, 9 aa, Homo Sapiens
GHGAVPAGC

SEQ ID NO: 489892 - protein, 9 aa, Homo Sapiens
FVVHFKDKD

SEQ ID NO: 489893 - protein, 9 aa, Homo Sapiens
TDSAKPSPS

SEQ ID NO: 489894 - protein, 9 aa, Homo Sapiens
THPMLLSRL

SEQ ID NO: 489895 - protein, 9 aa, Homo Sapiens
IPFFLATYL

SEQ ID NO: 489896 - protein, 9 aa, Homo Sapiens
LFRHGGHWL

SEQ ID NO: 489897 - protein, 9 aa, Homo Sapiens
DTSSISTGQ

SEQ ID NO: 489898 - protein, 9 aa, Homo Sapiens
PEPPAGPMY

SEQ ID NO: 489899 - protein, 9 aa, Homo Sapiens
YPNECVCPF

SEQ ID NO: 489900 - protein, 9 aa, Homo Sapiens
GPLVAGVIG

SEQ ID NO: 489901 - protein, 9 aa, Homo Sapiens
AFKAGCLAH

SEQ ID NO: 489902 - protein, 9 aa, Homo Sapiens
HRSEHSCAG

SEQ ID NO: 489903 - protein, 9 aa, Homo Sapiens
QLTVLIGYD

SEQ ID NO: 489904 - protein, 9 aa, Homo Sapiens
TARESSWGS

SEQ ID NO: 489905 - protein, 9 aa, Homo Sapiens
AVRLPVEGH

SEQ ID NO: 489906 - protein, 9 aa, Homo Sapiens
ESDYSCEGS

SEQ ID NO: 489907 - protein, 9 aa, Homo Sapiens
DYSCEGSSV

SEQ ID NO: 489908 - protein, 9 aa, Homo Sapiens
SGEGLQPCS

SEQ ID NO: 489909 - protein, 9 aa, Homo Sapiens
QPMDVYRYP

SEQ ID NO: 489910 - protein, 9 aa, Homo Sapiens
PAPSQRLMQ

SEQ ID NO: 489911 - protein, 9 aa, Homo Sapiens
RLMQLLWTI

SEQ ID NO: 489912 - protein, 9 aa, Homo Sapiens
PDRTIAQAC

SEQ ID NO: 489913 - protein, 9 aa, Homo Sapiens
LGARELYFP

SEQ ID NO: 489914 - protein, 9 aa, Homo Sapiens
KLTVTHTPG

SEQ ID NO: 489915 - protein, 9 aa, Homo Sapiens
TACGRQALP

SEQ ID NO: 489916 - protein, 9 aa, Homo Sapiens
GSGGHGEYL

SEQ ID NO: 489917 - protein, 9 aa, Homo Sapiens
KICCIGAGC

SEQ ID NO: 489918 - protein, 9 aa, Homo Sapiens
AQHLAPTYG

SEQ ID NO: 489919 - protein, 9 aa, Homo Sapiens
DSKRYLDFE

SEQ ID NO: 489920 - protein, 9 aa, Homo Sapiens
NDLLVYQIV

SEQ ID NO: 489921 - protein, 9 aa, Homo Sapiens
MDVYRYPSQ

SEQ ID NO: 489922 - protein, 9 aa, Homo Sapiens
QALFSHLLA

SEQ ID NO: 489923 - protein, 9 aa, Homo Sapiens
LPGNLLGGG

SEQ ID NO: 489924 - protein, 9 aa, Homo Sapiens
QLCVYVHDQ

SEQ ID NO: 489925 - protein, 9 aa, Homo Sapiens
EARDRDGYA

SEQ ID NO: 489926 - protein, 9 aa, Homo Sapiens
PMYPRLGPE

SEQ ID NO: 489927 - protein, 9 aa, Homo Sapiens
ASRWPLQDQ

SEQ ID NO: 489928 - protein, 9 aa, Homo Sapiens
LSRLSSRYV

SEQ ID NO: 489929 - protein, 9 aa, Homo Sapiens
GSLHPRLGC

SEQ ID NO: 489930 - protein, 9 aa, Homo Sapiens
PSPSFPPTG

SEQ ID NO: 489931 - protein, 9 aa, Homo Sapiens
KLDCKVGYF

SEQ ID NO: 489932 - protein, 9 aa, Homo Sapiens
NECVCPFPQ

SEQ ID NO: 489933 - protein, 9 aa, Homo Sapiens
SLHPRLGCV

SEQ ID NO: 489934 - protein, 9 aa, Homo Sapiens
SPSFQYFPS

SEQ ID NO: 489935 - protein, 9 aa, Homo Sapiens
MPSFQLCVY

SEQ ID NO: 489936 - protein, 9 aa, Homo Sapiens
QRWLEDSNI

SEQ ID NO: 489937 - protein, 9 aa, Homo Sapiens
YETWNGIYT

SEQ ID NO: 489938 - protein, 9 aa, Homo Sapiens
KDNQVKLEY

SEQ ID NO: 489939 - protein, 9 aa, Homo Sapiens
CMWCSSTKQ

SEQ ID NO: 489940 - protein, 9 aa, Homo Sapiens
KYSSMFEDN

SEQ ID NO: 489941 - protein, 9 aa, Homo Sapiens
HPVAAAAAA

SEQ ID NO: 489942 - protein, 9 aa, Homo Sapiens
LTRILRSAT

SEQ ID NO: 489943 - protein, 9 aa, Homo Sapiens
PHSATAALS

SEQ ID NO: 489944 - protein, 9 aa, Homo Sapiens
RRRGHWVQP

SEQ ID NO: 489945 - protein, 9 aa, Homo Sapiens
LPVCGSGEG

SEQ ID NO: 489946 - protein, 9 aa, Homo Sapiens
GTEQEEIMV

SEQ ID NO: 489947 - protein, 9 aa, Homo Sapiens
VNTYLNENG

SEQ ID NO: 489948 - protein, 9 aa, Homo Sapiens
EKPFVCRQC

SEQ ID NO: 489949 - protein, 9 aa, Homo Sapiens
IRQRQVIMS

SEQ ID NO: 489950 - protein, 9 aa, Homo Sapiens
IYLNKVSNQ

SEQ ID NO: 489951 - protein, 9 aa, Homo Sapiens
HRRIIVSPT

SEQ ID NO: 489952 - protein, 9 aa, Homo Sapiens
RYTTARNTA

SEQ ID NO: 489953 - protein, 9 aa, Homo Sapiens
MGNLKPRGS

SEQ ID NO: 489954 - protein, 9 aa, Homo Sapiens
TEQEVENSV

SEQ ID NO: 489955 - protein, 9 aa, Homo Sapiens
LSDNLWQVR

SEQ ID NO: 489956 - protein, 9 aa, Homo Sapiens
TYKVDMVPI

SEQ ID NO: 489957 - protein, 9 aa, Homo Sapiens
VVNGAELEA

SEQ ID NO: 489958 - protein, 9 aa, Homo Sapiens
IIVSPTGTL

SEQ ID NO: 489959 - protein, 9 aa, Homo Sapiens
KRGRSCSLL

SEQ ID NO: 489960 - protein, 9 aa, Homo Sapiens
APTYGDKAF

SEQ ID NO: 489961 - protein, 9 aa, Homo Sapiens
ALPVCGSGE

SEQ ID NO: 489962 - protein, 9 aa, Homo Sapiens
GNATRNCLE

SEQ ID NO: 489963 - protein, 9 aa, Homo Sapiens
QHLAPTYGD

SEQ ID NO: 489964 - protein, 9 aa, Homo Sapiens
DKNFEGRRY

SEQ ID NO: 489965 - protein, 9 aa, Homo Sapiens
GLQPCSQRD

SEQ ID NO: 489966 - protein, 9 aa, Homo Sapiens
PPIPFFLAT

SEQ ID NO: 489967 - protein, 9 aa, Homo Sapiens
LNKLLGSVT

SEQ ID NO: 489968 - protein, 9 aa, Homo Sapiens
LTGHSHTHP

SEQ ID NO: 489969 - protein, 9 aa, Homo Sapiens
KVKEDSSFV

SEQ ID NO: 489970 - protein, 9 aa, Homo Sapiens
APPSPASLG

SEQ ID NO: 489971 - protein, 9 aa, Homo Sapiens
NKVSNQTLS

SEQ ID NO: 489972 - protein, 9 aa, Homo Sapiens
DADSNRNDL

SEQ ID NO: 489973 - protein, 9 aa, Homo Sapiens
SNFVAILDL

SEQ ID NO: 489974 - protein, 9 aa, Homo Sapiens
SLLLLLLRL

SEQ ID NO: 489975 - protein, 9 aa, Homo Sapiens
GEYFCKAHS

SEQ ID NO: 489976 - protein, 9 aa, Homo Sapiens
RQVIMSPLI

SEQ ID NO: 489977 - protein, 9 aa, Homo Sapiens
IPNCTVLYP

SEQ ID NO: 489978 - protein, 9 aa, Homo Sapiens
TEGRALLHV

SEQ ID NO: 489979 - protein, 9 aa, Homo Sapiens
PVHEPPQLE

SEQ ID NO: 489980 - protein, 9 aa, Homo Sapiens
SSMFEDNTV

SEQ ID NO: 489981 - protein, 9 aa, Homo Sapiens
LGMYHRRII

SEQ ID NO: 489982 - protein, 9 aa, Homo Sapiens
AIMHEYPNF

SEQ ID NO: 489983 - protein, 9 aa, Homo Sapiens
HEPPQLEEE

SEQ ID NO: 489984 - protein, 9 aa, Homo Sapiens
GHWVQPGVE

SEQ ID NO: 489985 - protein, 9 aa, Homo Sapiens
ESNMDYKAT

SEQ ID NO: 489986 - protein, 9 aa, Homo Sapiens
SSISTGQAT

SEQ ID NO: 489987 - protein, 9 aa, Homo Sapiens
ALFSHLLAF

SEQ ID NO: 489988 - protein, 9 aa, Homo Sapiens
LWLQRWLED

SEQ ID NO: 489989 - protein, 9 aa, Homo Sapiens
AGCPQMCPG

SEQ ID NO: 489990 - protein, 9 aa, Homo Sapiens
TAIQVNGNL

SEQ ID NO: 489991 - protein, 9 aa, Homo Sapiens
SYETWNGIY

SEQ ID NO: 489992 - protein, 9 aa, Homo Sapiens
GARELYFPE

SEQ ID NO: 489993 - protein, 9 aa, Homo Sapiens
SESDYSCEG

SEQ ID NO: 489994 - protein, 9 aa, Homo Sapiens
QLLQLRRLA

SEQ ID NO: 489995 - protein, 9 aa, Homo Sapiens
EDKNFEGRR

SEQ ID NO: 489996 - protein, 9 aa, Homo Sapiens
AVELNSCKW

SEQ ID NO: 489997 - protein, 9 aa, Homo Sapiens
GTTDSSLEK

SEQ ID NO: 489998 - protein, 9 aa, Homo Sapiens
RALLHVALR

SEQ ID NO: 489999 - protein, 9 aa, Homo Sapiens
FRHGGHWLA

SEQ ID NO: 490000 - protein, 9 aa, Homo Sapiens
APLLPGNLL

SEQ ID NO: 490001 - protein, 9 aa, Homo Sapiens
SEHSCAGSA

SEQ ID NO: 490002 - protein, 9 aa, Homo Sapiens
TGRWWILGS

SEQ ID NO: 490003 - protein, 9 aa, Homo Sapiens
VNQAFKTLK

SEQ ID NO: 490004 - protein, 9 aa, Homo Sapiens
PMLLSRLSS

SEQ ID NO: 490005 - protein, 9 aa, Homo Sapiens
CLEVEDRDL

SEQ ID NO: 490006 - protein, 9 aa, Homo Sapiens
GATSHSSST

SEQ ID NO: 490007 - protein, 9 aa, Homo Sapiens
IQCPSNWNP

SEQ ID NO: 490008 - protein, 9 aa, Homo Sapiens
RWWILGSAW

SEQ ID NO: 490009 - protein, 9 aa, Homo Sapiens
LTVTHTPGF

SEQ ID NO: 490010 - protein, 9 aa, Homo Sapiens
QCVDSNAYI

SEQ ID NO: 490011 - protein, 9 aa, Homo Sapiens
WWILGSAWS

SEQ ID NO: 490012 - protein, 9 aa, Homo Sapiens
SQRDHRSEH

SEQ ID NO: 490013 - protein, 9 aa, Homo Sapiens
GMTPTAFSS

SEQ ID NO: 490014 - protein, 9 aa, Homo Sapiens
NTVTEYIYH

SEQ ID NO: 490015 - protein, 9 aa, Homo Sapiens
MALRHLSHD

SEQ ID NO: 490016 - protein, 9 aa, Homo Sapiens
LVALSVGST

SEQ ID NO: 490017 - protein, 9 aa, Homo Sapiens
QWVYGATPL

SEQ ID NO: 490018 - protein, 9 aa, Homo Sapiens
GVDVGCLEV

SEQ ID NO: 490019 - protein, 9 aa, Homo Sapiens
CPSNWNPCG

SEQ ID NO: 490020 - protein, 9 aa, Homo Sapiens
SIQCPSNWN

SEQ ID NO: 490021 - protein, 9 aa, Homo Sapiens
VCRQCKQSF

SEQ ID NO: 490022 - protein, 9 aa, Homo Sapiens
CEGSSVESL

SEQ ID NO: 490023 - protein, 9 aa, Homo Sapiens
CVCPFPQCR

SEQ ID NO: 490024 - protein, 9 aa, Homo Sapiens
ESALADCRV

SEQ ID NO: 490025 - protein, 9 aa, Homo Sapiens
PLLPGNLLG

SEQ ID NO: 490026 - protein, 9 aa, Homo Sapiens
TLSLIQFFS

SEQ ID NO: 490027 - protein, 9 aa, Homo Sapiens
EGLQPCSQR

SEQ ID NO: 490028 - protein, 9 aa, Homo Sapiens
GGGGSGGHG

SEQ ID NO: 490029 - protein, 9 aa, Homo Sapiens
PRRRGHWVQ

SEQ ID NO: 490030 - protein, 9 aa, Homo Sapiens
ELNSCKWKN

SEQ ID NO: 490031 - protein, 9 aa, Homo Sapiens
LAFPAPSQR

SEQ ID NO: 490032 - protein, 9 aa, Homo Sapiens
QLLWTILGC

SEQ ID NO: 490033 - protein, 9 aa, Homo Sapiens
YLNKVSNQT

SEQ ID NO: 490034 - protein, 9 aa, Homo Sapiens
VIMSPLITS

SEQ ID NO: 490035 - protein, 9 aa, Homo Sapiens
KFSTGQKKK

SEQ ID NO: 490036 - protein, 9 aa, Homo Sapiens
YTPHKDNQV

SEQ ID NO: 490037 - protein, 9 aa, Homo Sapiens
CTLKKVKED

SEQ ID NO: 490038 - protein, 9 aa, Homo Sapiens
VGKDEYLGR

SEQ ID NO: 490039 - protein, 9 aa, Homo Sapiens
RQALPVCGS

SEQ ID NO: 490040 - protein, 9 aa, Homo Sapiens
HDFFQGTRA

SEQ ID NO: 490041 - protein, 9 aa, Homo Sapiens
RGVSIIADR

SEQ ID NO: 490042 - protein, 9 aa, Homo Sapiens
ATYKVDMVP

SEQ ID NO: 490043 - protein, 9 aa, Homo Sapiens
PAPLSSPVH

SEQ ID NO: 490044 - protein, 9 aa, Homo Sapiens
TDEDHGITS

SEQ ID NO: 490045 - protein, 9 aa, Homo Sapiens
SVIAPIEDP

SEQ ID NO: 490046 - protein, 9 aa, Homo Sapiens
LENVAQPPE

SEQ ID NO: 490047 - protein, 9 aa, Homo Sapiens
SKHPVAAAA

SEQ ID NO: 490048 - protein, 9 aa, Homo Sapiens
WPLQDQLLP

SEQ ID NO: 490049 - protein, 9 aa, Homo Sapiens
AFKTLKRCT

SEQ ID NO: 490050 - protein, 9 aa, Homo Sapiens
AEGTDYAIY

SEQ ID NO: 490051 - protein, 9 aa, Homo Sapiens
RSEHSCAGS

SEQ ID NO: 490052 - protein, 9 aa, Homo Sapiens
TGDAVRLPV

SEQ ID NO: 490053 - protein, 9 aa, Homo Sapiens
HLFRHGGHW

SEQ ID NO: 490054 - protein, 9 aa, Homo Sapiens
GQFDSFVVH

SEQ ID NO: 490055 - protein, 9 aa, Homo Sapiens
CKAHSDAGA

SEQ ID NO: 490056 - protein, 9 aa, Homo Sapiens
THTPGFGDQ

SEQ ID NO: 490057 - protein, 9 aa, Homo Sapiens
SSSGTTDSS

SEQ ID NO: 490058 - protein, 9 aa, Homo Sapiens
DRNAIEMEE

SEQ ID NO: 490059 - protein, 9 aa, Homo Sapiens
CPWWPTLPT

SEQ ID NO: 490060 - protein, 9 aa, Homo Sapiens
LRHLSHDVS

SEQ ID NO: 490061 - protein, 9 aa, Homo Sapiens
KNNREMSRI

SEQ ID NO: 490062 - protein, 9 aa, Homo Sapiens
SDWTLDRQE

SEQ ID NO: 490063 - protein, 9 aa, Homo Sapiens
GPAPGAHAD

SEQ ID NO: 490064 - protein, 9 aa, Homo Sapiens
TLKKVKEDS

SEQ ID NO: 490065 - protein, 9 aa, Homo Sapiens
ILSDNLWQV

SEQ ID NO: 490066 - protein, 9 aa, Homo Sapiens
DSAKPSPSF

SEQ ID NO: 490067 - protein, 9 aa, Homo Sapiens
SPVHEPPQL

SEQ ID NO: 490068 - protein, 9 aa, Homo Sapiens
CCIGAGCVG

SEQ ID NO: 490069 - protein, 9 aa, Homo Sapiens
QRQLTVLIG

SEQ ID NO: 490070 - protein, 9 aa, Homo Sapiens
HYFKKCLGL

SEQ ID NO: 490071 - protein, 9 aa, Homo Sapiens
LFSHLLAFP

SEQ ID NO: 490072 - protein, 9 aa, Homo Sapiens
VDEVIDSKR

SEQ ID NO: 490073 - protein, 9 aa, Homo Sapiens
YASNCLCME

SEQ ID NO: 490074 - protein, 9 aa, Homo Sapiens
QVGKDEYLG

SEQ ID NO: 490075 - protein, 9 aa, Homo Sapiens
RAMCIVDVC

SEQ ID NO: 490076 - protein, 9 aa, Homo Sapiens
GTKFSTGQK

SEQ ID NO: 490077 - protein, 9 aa, Homo Sapiens
QRDHRSEHS

SEQ ID NO: 490078 - protein, 9 aa, Homo Sapiens
SLILSDNLW

SEQ ID NO: 490079 - protein, 9 aa, Homo Sapiens
RHGGHWLAL

SEQ ID NO: 490080 - protein, 9 aa, Homo Sapiens
RRGHWVQPG

SEQ ID NO: 490081 - protein, 9 aa, Homo Sapiens
EMALRHLSH

SEQ ID NO: 490082 - protein, 9 aa, Homo Sapiens
GLAGPAPGA

SEQ ID NO: 490083 - protein, 9 aa, Homo Sapiens
GRPPHSATA

SEQ ID NO: 490084 - protein, 9 aa, Homo Sapiens
SCTLKKVKE

SEQ ID NO: 490085 - protein, 9 aa, Homo Sapiens
SPKAVHRFL

SEQ ID NO: 490086 - protein, 9 aa, Homo Sapiens
VAFKAGCLA

SEQ ID NO: 490087 - protein, 9 aa, Homo Sapiens
NSSSSGTTD

SEQ ID NO: 490088 - protein, 9 aa, Homo Sapiens
PSILSIQAL

SEQ ID NO: 490089 - protein, 9 aa, Homo Sapiens
GCLEVEDRD

SEQ ID NO: 490090 - protein, 9 aa, Homo Sapiens
CLAHTSLGA

SEQ ID NO: 490091 - protein, 9 aa, Homo Sapiens
SCSELSLEQ

SEQ ID NO: 490092 - protein, 9 aa, Homo Sapiens
QDQLLPSDG

SEQ ID NO: 490093 - protein, 9 aa, Homo Sapiens
LAHGTAGLV

SEQ ID NO: 490094 - protein, 9 aa, Homo Sapiens
PAPGAHADP

SEQ ID NO: 490095 - protein, 9 aa, Homo Sapiens
QMNDALHGG

SEQ ID NO: 490096 - protein, 9 aa, Homo Sapiens
PFFLATYLP

SEQ ID NO: 490097 - protein, 9 aa, Homo Sapiens
CRVGKKMRP

SEQ ID NO: 490098 - protein, 9 aa, Homo Sapiens
LEQWLWSIF

SEQ ID NO: 490099 - protein, 9 aa, Homo Sapiens
SESNMDYKA

SEQ ID NO: 490100 - protein, 9 aa, Homo Sapiens
TTAGGMAEV

SEQ ID NO: 490101 - protein, 9 aa, Homo Sapiens
FVCRQCKQS

SEQ ID NO: 490102 - protein, 9 aa, Homo Sapiens
TSESDYSCE

SEQ ID NO: 490103 - protein, 9 aa, Homo Sapiens
EDRNAIEME

SEQ ID NO: 490104 - protein, 9 aa, Homo Sapiens
FVAMVYMFR

SEQ ID NO: 490105 - protein, 9 aa, Homo Sapiens
CGQKYTPHK

SEQ ID NO: 490106 - protein, 9 aa, Homo Sapiens
HNTGNIRPV

SEQ ID NO: 490107 - protein, 9 aa, Homo Sapiens
TAFSSQHTA

SEQ ID NO: 490108 - protein, 9 aa, Homo Sapiens
KNFEGRRYD

SEQ ID NO: 490109 - protein, 9 aa, Homo Sapiens
HADPHLFRH

SEQ ID NO: 490110 - protein, 9 aa, Homo Sapiens
VILHLKGSD

SEQ ID NO: 490111 - protein, 9 aa, Homo Sapiens
TLVEVTEQE

SEQ ID NO: 490112 - protein, 9 aa, Homo Sapiens
SHSSSTTAC

SEQ ID NO: 490113 - protein, 9 aa, Homo Sapiens
FKAGCLAHT

SEQ ID NO: 490114 - protein, 9 aa, Homo Sapiens
SMPSFQLCV

SEQ ID NO: 490115 - protein, 9 aa, Homo Sapiens
REHNTGNIR

SEQ ID NO: 490116 - protein, 9 aa, Homo Sapiens
NTYLNENGY

SEQ ID NO: 490117 - protein, 9 aa, Homo Sapiens
KLKLTVTHT

SEQ ID NO: 490118 - protein, 9 aa, Homo Sapiens
CPQGDTARE

SEQ ID NO: 490119 - protein, 9 aa, Homo Sapiens
SPSFPPTGE

SEQ ID NO: 490120 - protein, 9 aa, Homo Sapiens
LNKVSNQTL

SEQ ID NO: 490121 - protein, 9 aa, Homo Sapiens
MFRGVSIIA

SEQ ID NO: 490122 - protein, 9 aa, Homo Sapiens
MVYMFRGVS

SEQ ID NO: 490123 - protein, 9 aa, Homo Sapiens
EAIMHEYPN

SEQ ID NO: 490124 - protein, 9 aa, Homo Sapiens
VPAGCPQMC

SEQ ID NO: 490125 - protein, 9 aa, Homo Sapiens
RSVIAPIED

SEQ ID NO: 490126 - protein, 9 aa, Homo Sapiens
PPHSATAAL

SEQ ID NO: 490127 - protein, 9 aa, Homo Sapiens
NVAQPPEAP

SEQ ID NO: 490128 - protein, 9 aa, Homo Sapiens
GAMAKPDCV

SEQ ID NO: 490129 - protein, 9 aa, Homo Sapiens
MAEVAPDAV

SEQ ID NO: 490130 - protein, 9 aa, Homo Sapiens
HWVQPGVEL

SEQ ID NO: 490131 - protein, 9 aa, Homo Sapiens
MPEERALKY

SEQ ID NO: 490132 - protein, 9 aa, Homo Sapiens
HSATAALSV

SEQ ID NO: 490133 - protein, 9 aa, Homo Sapiens
SSEGTEQEE

SEQ ID NO: 490134 - protein, 9 aa, Homo Sapiens
LWVREHNTG

SEQ ID NO: 490135 - protein, 9 aa, Homo Sapiens
SESLAPPLC

SEQ ID NO: 490136 - protein, 9 aa, Homo Sapiens
DAVRLPVEG

SEQ ID NO: 490137 - protein, 9 aa, Homo Sapiens
TPTAFSSQH

SEQ ID NO: 490138 - protein, 9 aa, Homo Sapiens
MFEDNTVTE

SEQ ID NO: 490139 - protein, 9 aa, Homo Sapiens
LSSRYVPNH

SEQ ID NO: 490140 - protein, 9 aa, Homo Sapiens
VIDSKRYLD

SEQ ID NO: 490141 - protein, 9 aa, Homo Sapiens
LRVVIVNTY

SEQ ID NO: 490142 - protein, 9 aa, Homo Sapiens
QLRVVIVNT

SEQ ID NO: 490143 - protein, 9 aa, Homo Sapiens
NLLGGGSDS

SEQ ID NO: 490144 - protein, 9 aa, Homo Sapiens
GRQALPVCG

SEQ ID NO: 490145 - protein, 9 aa, Homo Sapiens
YESMPSFQL

SEQ ID NO: 490146 - protein, 9 aa, Homo Sapiens
SIQALFSHL

SEQ ID NO: 490147 - protein, 9 aa, Homo Sapiens
DCKVGYFDL

SEQ ID NO: 490148 - protein, 9 aa, Homo Sapiens
SLEQWLWSI

SEQ ID NO: 490149 - protein, 9 aa, Homo Sapiens
VLKISGLTH

SEQ ID NO: 490150 - protein, 9 aa, Homo Sapiens
KLPLTRSHS

SEQ ID NO: 490151 - protein, 9 aa, Homo Sapiens
RELWVREHN

SEQ ID NO: 490152 - protein, 9 aa, Homo Sapiens
PKETYPNEC

SEQ ID NO: 490153 - protein, 9 aa, Homo Sapiens
NMDYKATIY

SEQ ID NO: 490154 - protein, 9 aa, Homo Sapiens
QTGRWWILG

SEQ ID NO: 490155 - protein, 9 aa, Homo Sapiens
HEIEPIRHS

SEQ ID NO: 490156 - protein, 9 aa, Homo Sapiens
IGSLHPRLG

SEQ ID NO: 490157 - protein, 9 aa, Homo Sapiens
SKTIRSNSN

SEQ ID NO: 490158 - protein, 9 aa, Homo Sapiens
TILGCQLQL

SEQ ID NO: 490159 - protein, 9 aa, Homo Sapiens
VVHFKDKDG

SEQ ID NO: 490160 - protein, 9 aa, Homo Sapiens
QRLMQLLWT

SEQ ID NO: 490161 - protein, 9 aa, Homo Sapiens
VLIYLNKVS

SEQ ID NO: 490162 - protein, 9 aa, Homo Sapiens
YGATPLFGL

SEQ ID NO: 490163 - protein, 9 aa, Homo Sapiens
YKPSPFFSP

SEQ ID NO: 490164 - protein, 9 aa, Homo Sapiens
SCKWKNRIV

SEQ ID NO: 490165 - protein, 9 aa, Homo Sapiens
PQGDTARES

SEQ ID NO: 490166 - protein, 9 aa, Homo Sapiens
ALRHLSHDV

SEQ ID NO: 490167 - protein, 9 aa, Homo Sapiens
YLRSVIAPI

SEQ ID NO: 490168 - protein, 9 aa, Homo Sapiens
LHGGWTTKM

SEQ ID NO: 490169 - protein, 9 aa, Homo Sapiens
ALLHVALRN

SEQ ID NO: 490170 - protein, 9 aa, Homo Sapiens
SSPVHEPPQ

SEQ ID NO: 490171 - protein, 9 aa, Homo Sapiens
PHLSGATSH

SEQ ID NO: 490172 - protein, 9 aa, Homo Sapiens
THANSNYKN

SEQ ID NO: 490173 - protein, 9 aa, Homo Sapiens
DNFFCEVPQ

SEQ ID NO: 490174 - protein, 9 aa, Homo Sapiens
EYSRSGNAT

SEQ ID NO: 490175 - protein, 9 aa, Homo Sapiens
LAVELNSCK

SEQ ID NO: 490176 - protein, 9 aa, Homo Sapiens
MLLSRLSSR

SEQ ID NO: 490177 - protein, 9 aa, Homo Sapiens
NGAELEARD

SEQ ID NO: 490178 - protein, 9 aa, Homo Sapiens
SRSGNATRN

SEQ ID NO: 490179 - protein, 9 aa, Homo Sapiens
YFKKCLGLV

SEQ ID NO: 490180 - protein, 9 aa, Homo Sapiens
SSSFSISLV

SEQ ID NO: 490181 - protein, 9 aa, Homo Sapiens
AGPMYPRLG

SEQ ID NO: 490182 - protein, 9 aa, Homo Sapiens
VLHVKSESL

SEQ ID NO: 490183 - protein, 9 aa, Homo Sapiens
HASFLLDWS

SEQ ID NO: 490184 - protein, 9 aa, Homo Sapiens
QQWPAEGTD

SEQ ID NO: 490185 - protein, 9 aa, Homo Sapiens
RVGINVGPL

SEQ ID NO: 490186 - protein, 9 aa, Homo Sapiens
YFCKAHSDA

SEQ ID NO: 490187 - protein, 9 aa, Homo Sapiens
RPPHSATAA

SEQ ID NO: 490188 - protein, 9 aa, Homo Sapiens
LALLPAQGH

SEQ ID NO: 490189 - protein, 9 aa, Homo Sapiens
LTRSHSNFV

SEQ ID NO: 490190 - protein, 9 aa, Homo Sapiens
GVTHANSNY

SEQ ID NO: 490191 - protein, 9 aa, Homo Sapiens
IRASPRYTT

SEQ ID NO: 490192 - protein, 9 aa, Homo Sapiens
EVPQVIKLA

SEQ ID NO: 490193 - protein, 9 aa, Homo Sapiens
ARGQIPVGG

SEQ ID NO: 490194 - protein, 9 aa, Homo Sapiens
LDWSLGALP

SEQ ID NO: 490195 - protein, 9 aa, Homo Sapiens
PLAVFSSSF

SEQ ID NO: 490196 - protein, 9 aa, Homo Sapiens
TKQCVDSNA

SEQ ID NO: 490197 - protein, 9 aa, Homo Sapiens
GAVPAGCPQ

SEQ ID NO: 490198 - protein, 9 aa, Homo Sapiens
AKPKLDCKV

SEQ ID NO: 490199 - protein, 9 aa, Homo Sapiens
ILSIQALFS

SEQ ID NO: 490200 - protein, 9 aa, Homo Sapiens
RSGNATRNC

SEQ ID NO: 490201 - protein, 9 aa, Homo Sapiens
HPMLLSRLS

SEQ ID NO: 490202 - protein, 9 aa, Homo Sapiens
LIILRNMGN

SEQ ID NO: 490203 - protein, 9 aa, Homo Sapiens
RYVPNHGLA

SEQ ID NO: 490204 - protein, 9 aa, Homo Sapiens
NDALHGGWT

SEQ ID NO: 490205 - protein, 9 aa, Homo Sapiens
SSSDWTLDR

SEQ ID NO: 490206 - protein, 9 aa, Homo Sapiens
AAHDFFQGT

SEQ ID NO: 490207 - protein, 9 aa, Homo Sapiens
FYEDKNFEG

SEQ ID NO: 490208 - protein, 9 aa, Homo Sapiens
SPASLGSPA

SEQ ID NO: 490209 - protein, 9 aa, Homo Sapiens
QACKYIVDS

SEQ ID NO: 490210 - protein, 9 aa, Homo Sapiens
AMVYMFRGV

SEQ ID NO: 490211 - protein, 9 aa, Homo Sapiens
CGRQALPVC

SEQ ID NO: 490212 - protein, 9 aa, Homo Sapiens
AQACKYIVD

SEQ ID NO: 490213 - protein, 9 aa, Homo Sapiens
CAGSAWASM

SEQ ID NO: 490214 - protein, 9 aa, Homo Sapiens
LFSSIQCPS

SEQ ID NO: 490215 - protein, 9 aa, Homo Sapiens
PRYTTARNT

SEQ ID NO: 490216 - protein, 9 aa, Homo Sapiens
DGATYKVDM

SEQ ID NO: 490217 - protein, 9 aa, Homo Sapiens
KHPVAAAAA

SEQ ID NO: 490218 - protein, 9 aa, Homo Sapiens
YIRQRQVIM

SEQ ID NO: 490219 - protein, 9 aa, Homo Sapiens
LTDLTGDAV

SEQ ID NO: 490220 - protein, 9 aa, Homo Sapiens
KPSPFFSPV

SEQ ID NO: 490221 - protein, 9 aa, Homo Sapiens
EQEVENSVK

SEQ ID NO: 490222 - protein, 9 aa, Homo Sapiens
SHTHPMLLS

SEQ ID NO: 490223 - protein, 9 aa, Homo Sapiens
SNHVLIYLN

SEQ ID NO: 490224 - protein, 9 aa, Homo Sapiens
PPHLSGATS

SEQ ID NO: 490225 - protein, 9 aa, Homo Sapiens
VCGSGEGLQ

SEQ ID NO: 490226 - protein, 9 aa, Homo Sapiens
CMEEIEGSV

SEQ ID NO: 490227 - protein, 9 aa, Homo Sapiens
ATRNCLEKA

SEQ ID NO: 490228 - protein, 9 aa, Homo Sapiens
WFSRLTTND

SEQ ID NO: 490229 - protein, 9 aa, Homo Sapiens
MKQMNDALH

SEQ ID NO: 490230 - protein, 9 aa, Homo Sapiens
VYGATPLFG

SEQ ID NO: 490231 - protein, 9 aa, Homo Sapiens
LWTILGCQL

SEQ ID NO: 490232 - protein, 9 aa, Homo Sapiens
EARGQIPVG

SEQ ID NO: 490233 - protein, 9 aa, Homo Sapiens
FLGARELYF

SEQ ID NO: 490234 - protein, 9 aa, Homo Sapiens
DRTIAQACK

SEQ ID NO: 490235 - protein, 9 aa, Homo Sapiens
DRQELESKF

SEQ ID NO: 490236 - protein, 9 aa, Homo Sapiens
GTLPCPWWP

SEQ ID NO: 490237 - protein, 9 aa, Homo Sapiens
HSSSTTACG

SEQ ID NO: 490238 - protein, 9 aa, Homo Sapiens
LHLKGSDYS

SEQ ID NO: 490239 - protein, 9 aa, Homo Sapiens
KLRRDDMWE

SEQ ID NO: 490240 - protein, 9 aa, Homo Sapiens
LIQWVYGAT

SEQ ID NO: 490241 - protein, 9 aa, Homo Sapiens
LGSAWSGAP

SEQ ID NO: 490242 - protein, 9 aa, Homo Sapiens
PAGPMYPRL

SEQ ID NO: 490243 - protein, 9 aa, Homo Sapiens
GEGLQPCSQ

SEQ ID NO: 490244 - protein, 9 aa, Homo Sapiens
ITKEDRNAI

SEQ ID NO: 490245 - protein, 9 aa, Homo Sapiens
LYPSDAIST

SEQ ID NO: 490246 - protein, 9 aa, Homo Sapiens
SRLSSRYVP

SEQ ID NO: 490247 - protein, 9 aa, Homo Sapiens
ENVAQPPEA

SEQ ID NO: 490248 - protein, 9 aa, Homo Sapiens
ADPHLFRHG

SEQ ID NO: 490249 - protein, 9 aa, Homo Sapiens
RSGLIQWVY

SEQ ID NO: 490250 - protein, 9 aa, Homo Sapiens
ILGHYFKKC

SEQ ID NO: 490251 - protein, 9 aa, Homo Sapiens
SPRYTTARN

SEQ ID NO: 490252 - protein, 9 aa, Homo Sapiens
FCKAHSDAG

SEQ ID NO: 490253 - protein, 9 aa, Homo Sapiens
AVPAGCPQM

SEQ ID NO: 490254 - protein, 9 aa, Homo Sapiens
VAMVYMFRG

SEQ ID NO: 490255 - protein, 9 aa, Homo Sapiens
PSFQYFPSN

SEQ ID NO: 490256 - protein, 9 aa, Homo Sapiens
PSPFFSPVL

SEQ ID NO: 490257 - protein, 9 aa, Homo Sapiens
ISESNMDYK

SEQ ID NO: 490258 - protein, 9 aa, Homo Sapiens
HWLALLPAQ

SEQ ID NO: 490259 - protein, 9 aa, Homo Sapiens
ELNKLLGSV

SEQ ID NO: 490260 - protein, 9 aa, Homo Sapiens
SSIQCPSNW

SEQ ID NO: 490261 - protein, 9 aa, Homo Sapiens
LILSDNLWQ

SEQ ID NO: 490262 - protein, 9 aa, Homo Sapiens
AHSDAGAVK

SEQ ID NO: 490263 - protein, 9 aa, Homo Sapiens
EVTTTAGGM

SEQ ID NO: 490264 - protein, 9 aa, Homo Sapiens
IQTSFQRAS

SEQ ID NO: 490265 - protein, 9 aa, Homo Sapiens
MCIVDVCHA

SEQ ID NO: 490266 - protein, 9 aa, Homo Sapiens
TGTLPCPWW

SEQ ID NO: 490267 - protein, 9 aa, Homo Sapiens
WPTLPTLRP

SEQ ID NO: 490268 - protein, 9 aa, Homo Sapiens
LKYENYFSA

SEQ ID NO: 490269 - protein, 9 aa, Homo Sapiens
TYPNECVCP

SEQ ID NO: 490270 - protein, 9 aa, Homo Sapiens
AEVDEVIDS

SEQ ID NO: 490271 - protein, 9 aa, Homo Sapiens
SHLLAFPAP

SEQ ID NO: 490272 - protein, 9 aa, Homo Sapiens
APIEDPEDT

SEQ ID NO: 490273 - protein, 9 aa, Homo Sapiens
LCNLNGFWF

SEQ ID NO: 490274 - protein, 9 aa, Homo Sapiens
ERALKYENY

SEQ ID NO: 490275 - protein, 9 aa, Homo Sapiens
RDPGPAPPS

SEQ ID NO: 490276 - protein, 9 aa, Homo Sapiens
AQDGGRPPH

SEQ ID NO: 490277 - protein, 9 aa, Homo Sapiens
VKLKLTVTH

SEQ ID NO: 490278 - protein, 9 aa, Homo Sapiens
MQLLWTILG

SEQ ID NO: 490279 - protein, 9 aa, Homo Sapiens
LITKEDRNA

SEQ ID NO: 490280 - protein, 9 aa, Homo Sapiens
PPEAPHQPT

SEQ ID NO: 490281 - protein, 9 aa, Homo Sapiens
DHRSEHSCA

SEQ ID NO: 490282 - protein, 9 aa, Homo Sapiens
QALPVCGSG

SEQ ID NO: 490283 - protein, 9 aa, Homo Sapiens
SRYVPNHGL

SEQ ID NO: 490284 - protein, 9 aa, Homo Sapiens
SPQSQPMDV

SEQ ID NO: 490285 - protein, 9 aa, Homo Sapiens
VDYASNCLC

SEQ ID NO: 490286 - protein, 9 aa, Homo Sapiens
LDRQELESK

SEQ ID NO: 490287 - protein, 9 aa, Homo Sapiens
NMGNLKPRG

SEQ ID NO: 490288 - protein, 9 aa, Homo Sapiens
FEYSRSGNA

SEQ ID NO: 490289 - protein, 9 aa, Homo Sapiens
IQALFSHLL

SEQ ID NO: 490290 - protein, 9 aa, Homo Sapiens
CRRSPSFQY

SEQ ID NO: 490291 - protein, 9 aa, Homo Sapiens
KEDRNAIEM

SEQ ID NO: 490292 - protein, 9 aa, Homo Sapiens
VTEQEVENS

SEQ ID NO: 490293 - protein, 9 aa, Homo Sapiens
GPMYPRLGP

SEQ ID NO: 490294 - protein, 9 aa, Homo Sapiens
LTGDAVRLP

SEQ ID NO: 490295 - protein, 9 aa, Homo Sapiens
GATYKVDMV

SEQ ID NO: 490296 - protein, 9 aa, Homo Sapiens
HLSHDVSGA

SEQ ID NO: 490297 - protein, 9 aa, Homo Sapiens
RWPLQDQLL

SEQ ID NO: 490298 - protein, 9 aa, Homo Sapiens
FSHLLAFPA

SEQ ID NO: 490299 - protein, 9 aa, Homo Sapiens
KLLGSVTIA

SEQ ID NO: 490300 - protein, 9 aa, Homo Sapiens
KPSPSFPPT

SEQ ID NO: 490301 - protein, 9 aa, Homo Sapiens
ETWNGIYTV

SEQ ID NO: 490302 - protein, 9 aa, Homo Sapiens
RILTGHSHT

SEQ ID NO: 490303 - protein, 9 aa, Homo Sapiens
EVLHVKSES

SEQ ID NO: 490304 - protein, 9 aa, Homo Sapiens
RDHRSEHSC

SEQ ID NO: 490305 - protein, 9 aa, Homo Sapiens
SGVDVGCLE

SEQ ID NO: 490306 - protein, 9 aa, Homo Sapiens
SEVAQHLAP

SEQ ID NO: 490307 - protein, 9 aa, Homo Sapiens
CLGLVNGIV

SEQ ID NO: 490308 - protein, 9 aa, Homo Sapiens
PFFSPVLLP

SEQ ID NO: 490309 - protein, 9 aa, Homo Sapiens
RLSSRYVPN

SEQ ID NO: 490310 - protein, 9 aa, Homo Sapiens
QAFQRQLTV

SEQ ID NO: 490311 - protein, 9 aa, Homo Sapiens
TVFNVETGT

SEQ ID NO: 490312 - protein, 9 aa, Homo Sapiens
QKYTPHKDN

SEQ ID NO: 490313 - protein, 9 aa, Homo Sapiens
HTPGFGDQI

SEQ ID NO: 490314 - protein, 9 aa, Homo Sapiens
ELEARDRDG

SEQ ID NO: 490315 - protein, 9 aa, Homo Sapiens
SEQVILHLK

SEQ ID NO: 490316 - protein, 9 aa, Homo Sapiens
LSSPVHEPP

SEQ ID NO: 490317 - protein, 9 aa, Homo Sapiens
PIPFFLATY

SEQ ID NO: 490318 - protein, 9 aa, Homo Sapiens
KVDMVPIKN

SEQ ID NO: 490319 - protein, 9 aa, Homo Sapiens
RELYFPERV

SEQ ID NO: 490320 - protein, 9 aa, Homo Sapiens
LWQVRYSYL

SEQ ID NO: 490321 - protein, 9 aa, Homo Sapiens
YTTARNTAA

SEQ ID NO: 490322 - protein, 9 aa, Homo Sapiens
RWLEDSNIQ

SEQ ID NO: 490323 - protein, 9 aa, Homo Sapiens
LKKVNQAFK

SEQ ID NO: 490324 - protein, 9 aa, Homo Sapiens
PNHGLAGPA

SEQ ID NO: 490325 - protein, 9 aa, Homo Sapiens
AGEYFCKAH

SEQ ID NO: 490326 - protein, 9 aa, Homo Sapiens
YLGRSIFSP

SEQ ID NO: 490327 - protein, 9 aa, Homo Sapiens
VTTTAGGMA

SEQ ID NO: 490328 - protein, 9 aa, Homo Sapiens
IDSKRYLDF

SEQ ID NO: 490329 - protein, 9 aa, Homo Sapiens
PGEPPHLSG

SEQ ID NO: 490330 - protein, 9 aa, Homo Sapiens
PLTRSHSNF

SEQ ID NO: 490331 - protein, 9 aa, Homo Sapiens
WILGSAWSG

SEQ ID NO: 490332 - protein, 9 aa, Homo Sapiens
EVAFKAGCL

SEQ ID NO: 490333 - protein, 9 aa, Homo Sapiens
HPRLGCVLS

SEQ ID NO: 490334 - protein, 9 aa, Homo Sapiens
LDNFFCEVP

SEQ ID NO: 490335 - protein, 9 aa, Homo Sapiens
DPHLFRHGG

SEQ ID NO: 490336 - protein, 9 aa, Homo Sapiens
IVSPTGTLP

SEQ ID NO: 490337 - protein, 9 aa, Homo Sapiens
NRNDLLVYQ

SEQ ID NO: 490338 - protein, 9 aa, Homo Sapiens
CIGAGCVGG

SEQ ID NO: 490339 - protein, 9 aa, Homo Sapiens
YSCEGSSVE

SEQ ID NO: 490340 - protein, 9 aa, Homo Sapiens
GNLLGGGSD

SEQ ID NO: 490341 - protein, 9 aa, Homo Sapiens
LKLTVTHTP

SEQ ID NO: 490342 - protein, 9 aa, Homo Sapiens
EMPTASQTA

SEQ ID NO: 490343 - protein, 9 aa, Homo Sapiens
TLCNLNGFW

SEQ ID NO: 490344 - protein, 9 aa, Homo Sapiens
ARSYETWNG

SEQ ID NO: 490345 - protein, 9 aa, Homo Sapiens
ESMPSFQLC

SEQ ID NO: 490346 - protein, 9 aa, Homo Sapiens
KPFVCRQCK

SEQ ID NO: 490347 - protein, 9 aa, Homo Sapiens
HSCAGSAWA

SEQ ID NO: 490348 - protein, 9 aa, Homo Sapiens
NGLSIGTVF

SEQ ID NO: 490349 - protein, 9 aa, Homo Sapiens
VKEDSSFVS

SEQ ID NO: 490350 - protein, 9 aa, Homo Sapiens
LNEAIMHEY

SEQ ID NO: 490351 - protein, 9 aa, Homo Sapiens
CSSTKQCVD

SEQ ID NO: 490352 - protein, 9 aa, Homo Sapiens
YTDEDHGIT

SEQ ID NO: 490353 - protein, 9 aa, Homo Sapiens
RLGCVLSLP

SEQ ID NO: 490354 - protein, 9 aa, Homo Sapiens
SFLLDWSLG

SEQ ID NO: 490355 - protein, 9 aa, Homo Sapiens
GSVTIAQGG

SEQ ID NO: 490356 - protein, 9 aa, Homo Sapiens
MKLRRDDMW

SEQ ID NO: 490357 - protein, 9 aa, Homo Sapiens
FQYFPSNNY

SEQ ID NO: 490358 - protein, 9 aa, Homo Sapiens
ALNIRIGTK

SEQ ID NO: 490359 - protein, 9 aa, Homo Sapiens
VYMFRGVSI

SEQ ID NO: 490360 - protein, 9 aa, Homo Sapiens
SISTGQATP

SEQ ID NO: 490361 - protein, 9 aa, Homo Sapiens
AGGMAEVAP

SEQ ID NO: 490362 - protein, 9 aa, Homo Sapiens
TLWLQRWLE

SEQ ID NO: 490363 - protein, 9 aa, Homo Sapiens
CSELSLEQW

SEQ ID NO: 490364 - protein, 9 aa, Homo Sapiens
GSGEGLQPC

SEQ ID NO: 490365 - protein, 9 aa, Homo Sapiens
CSQRDHRSE

SEQ ID NO: 490366 - protein, 9 aa, Homo Sapiens
SEGTEQEEI

SEQ ID NO: 490367 - protein, 9 aa, Homo Sapiens
GINVGPLVA

SEQ ID NO: 490368 - protein, 9 aa, Homo Sapiens
VEVTEQEVE

SEQ ID NO: 490369 - protein, 9 aa, Homo Sapiens
GDTARESSW

SEQ ID NO: 490370 - protein, 9 aa, Homo Sapiens
TYIRQRQVI

SEQ ID NO: 490371 - protein, 9 aa, Homo Sapiens
LRSATLSLI

SEQ ID NO: 490372 - protein, 9 aa, Homo Sapiens
PGPAPPSPA

SEQ ID NO: 490373 - protein, 9 aa, Homo Sapiens
RSNSNGLSI

SEQ ID NO: 490374 - protein, 9 aa, Homo Sapiens
GEKPFVCRQ

SEQ ID NO: 490375 - protein, 9 aa, Homo Sapiens
TIRSNSNGL

SEQ ID NO: 490376 - protein, 9 aa, Homo Sapiens
AQPPEAPHQ

SEQ ID NO: 490377 - protein, 9 aa, Homo Sapiens
GGGGGSGGH

SEQ ID NO: 490378 - protein, 9 aa, Homo Sapiens
KAVHRFLPM

SEQ ID NO: 490379 - protein, 9 aa, Homo Sapiens
PTLRPLTPW

SEQ ID NO: 490380 - protein, 9 aa, Homo Sapiens
YKATIYLRQ

SEQ ID NO: 490381 - protein, 9 aa, Homo Sapiens
ARELYFPER

SEQ ID NO: 490382 - protein, 9 aa, Homo Sapiens
GGMAEVAPD

SEQ ID NO: 490383 - protein, 9 aa, Homo Sapiens
PCPWWPTLP

SEQ ID NO: 490384 - protein, 9 aa, Homo Sapiens
LDCKVGYFD

SEQ ID NO: 490385 - protein, 9 aa, Homo Sapiens
DWSLGALPE

SEQ ID NO: 490386 - protein, 9 aa, Homo Sapiens
APLSSPVHE

SEQ ID NO: 490387 - protein, 9 aa, Homo Sapiens
GNLKPRGSF

SEQ ID NO: 490388 - protein, 9 aa, Homo Sapiens
LIYLNKVSN

SEQ ID NO: 490389 - protein, 9 aa, Homo Sapiens
APSQRLMQL

SEQ ID NO: 490390 - protein, 9 aa, Homo Sapiens
DEVIDSKRY

SEQ ID NO: 490391 - protein, 9 aa, Homo Sapiens
LTHEIEPIR

SEQ ID NO: 490392 - protein, 9 aa, Homo Sapiens
LKNNREMSR

SEQ ID NO: 490393 - protein, 9 aa, Homo Sapiens
PHLFRHGGH

SEQ ID NO: 490394 - protein, 9 aa, Homo Sapiens
KAHSDAGAV

SEQ ID NO: 490395 - protein, 9 aa, Homo Sapiens
LSLEQWLWS

SEQ ID NO: 490396 - protein, 9 aa, Homo Sapiens
GCPQMCPGE

SEQ ID NO: 490397 - protein, 9 aa, Homo Sapiens
WCSSTKQCV

SEQ ID NO: 490398 - protein, 9 aa, Homo Sapiens
DTARESSWG

SEQ ID NO: 490399 - protein, 9 aa, Homo Sapiens
VSGVDVGCL

SEQ ID NO: 490400 - protein, 9 aa, Homo Sapiens
ICCIGAGCV

SEQ ID NO: 490401 - protein, 9 aa, Homo Sapiens
CNLNGFWFS

SEQ ID NO: 490402 - protein, 9 aa, Homo Sapiens
EPPHLSGAT

SEQ ID NO: 490403 - protein, 9 aa, Homo Sapiens
VDMVPIKNQ

SEQ ID NO: 490404 - protein, 9 aa, Homo Sapiens
EPPAGPMYP

SEQ ID NO: 490405 - protein, 9 aa, Homo Sapiens
MWCSSTKQC

SEQ ID NO: 490406 - protein, 9 aa, Homo Sapiens
RIIVSPTGT

SEQ ID NO: 490407 - protein, 9 aa, Homo Sapiens
TVLIGYDVT

SEQ ID NO: 490408 - protein, 9 aa, Homo Sapiens
GMAEVAPDA

SEQ ID NO: 490409 - protein, 9 aa, Homo Sapiens
PFSCSELSL

SEQ ID NO: 490410 - protein, 9 aa, Homo Sapiens
TYLPISNPE

SEQ ID NO: 490411 - protein, 9 aa, Homo Sapiens
NCLCMEEIE

SEQ ID NO: 490412 - protein, 9 aa, Homo Sapiens
MTAAHDFFQ

SEQ ID NO: 490413 - protein, 9 aa, Homo Sapiens
HLSGATSHS

SEQ ID NO: 490414 - protein, 9 aa, Homo Sapiens
LLCSKHPVA

SEQ ID NO: 490415 - protein, 9 aa, Homo Sapiens
GQQPLGRAM

SEQ ID NO: 490416 - protein, 9 aa, Homo Sapiens
DCVITCDGK

SEQ ID NO: 490417 - protein, 9 aa, Homo Sapiens
ALHGGWTTK

SEQ ID NO: 490418 - protein, 9 aa, Homo Sapiens
TDADSNRND

SEQ ID NO: 490419 - protein, 9 aa, Homo Sapiens
FRGVSIIAD

SEQ ID NO: 490420 - protein, 9 aa, Homo Sapiens
EGRALLHVA

SEQ ID NO: 490421 - protein, 9 aa, Homo Sapiens
PGPRRRGHW

SEQ ID NO: 490422 - protein, 9 aa, Homo Sapiens
LKISGLTHE

SEQ ID NO: 490423 - protein, 9 aa, Homo Sapiens
VPIRASPRY

SEQ ID NO: 490424 - protein, 9 aa, Homo Sapiens
TSFQRASYP

SEQ ID NO: 490425 - protein, 9 aa, Homo Sapiens
YPLITKEDR

SEQ ID NO: 490426 - protein, 9 aa, Homo Sapiens
SAKPSPSFP

SEQ ID NO: 490427 - protein, 9 aa, Homo Sapiens
KQMNDALHG

SEQ ID NO: 490428 - protein, 9 aa, Homo Sapiens
KKCLGLVNG

SEQ ID NO: 490429 - protein, 9 aa, Homo Sapiens
ACKYIVDSM

SEQ ID NO: 490430 - protein, 9 aa, Homo Sapiens
DLLVYQIVE

SEQ ID NO: 490431 - protein, 9 aa, Homo Sapiens
GITSSTAHQ

SEQ ID NO: 490432 - protein, 9 aa, Homo Sapiens
DWTLDRQEL

SEQ ID NO: 490433 - protein, 9 aa, Homo Sapiens
STTACGRQA

SEQ ID NO: 490434 - protein, 9 aa, Homo Sapiens
QLRRLAHGT

SEQ ID NO: 490435 - protein, 9 aa, Homo Sapiens
LRFNTVFNV

SEQ ID NO: 490436 - protein, 9 aa, Homo Sapiens
LLAFPAPSQ

SEQ ID NO: 490437 - protein, 9 aa, Homo Sapiens
DVGCLEVED

SEQ ID NO: 490438 - protein, 9 aa, Homo Sapiens
PLGRAMCIV

SEQ ID NO: 490439 - protein, 9 aa, Homo Sapiens
FWFSRLTTN

SEQ ID NO: 490440 - protein, 9 aa, Homo Sapiens
VREHNTGNI

SEQ ID NO: 490441 - protein, 9 aa, Homo Sapiens
PSPASLGSP

SEQ ID NO: 490442 - protein, 9 aa, Homo Sapiens
SGGHGEYLQ

SEQ ID NO: 490443 - protein, 9 aa, Homo Sapiens
LLGSVTIAQ

SEQ ID NO: 490444 - protein, 9 aa, Homo Sapiens
RRLKNNREM

SEQ ID NO: 490445 - protein, 9 aa, Homo Sapiens
NDQVGKDEY

SEQ ID NO: 490446 - protein, 9 aa, Homo Sapiens
GPAPPSPAS

SEQ ID NO: 490447 - protein, 9 aa, Homo Sapiens
MYPRLGPEP

SEQ ID NO: 490448 - protein, 9 aa, Homo Sapiens
QLLPSDGIS

SEQ ID NO: 490449 - protein, 9 aa, Homo Sapiens
FSSIQCPSN

SEQ ID NO: 490450 - protein, 9 aa, Homo Sapiens
REMSRIFHY

SEQ ID NO: 490451 - protein, 9 aa, Homo Sapiens
MSRIFHYIK

SEQ ID NO: 490452 - protein, 9 aa, Homo Sapiens
GEPPHLSGA

SEQ ID NO: 490453 - protein, 9 aa, Homo Sapiens
TEQEEIMVQ

SEQ ID NO: 490454 - protein, 9 aa, Homo Sapiens
PLRILTGHS

SEQ ID NO: 490455 - protein, 9 aa, Homo Sapiens
AFQRQLTVL

SEQ ID NO: 490456 - protein, 9 aa, Homo Sapiens
IGTKFSTGQ

SEQ ID NO: 490457 - protein, 9 aa, Homo Sapiens
RTIAQACKY

SEQ ID NO: 490458 - protein, 9 aa, Homo Sapiens
SVTIAQGGV

SEQ ID NO: 490459 - protein, 9 aa, Homo Sapiens
GCPQGDTAR

SEQ ID NO: 490460 - protein, 9 aa, Homo Sapiens
SSDWTLDRQ

SEQ ID NO: 490461 - protein, 9 aa, Homo Sapiens
LVEVTEQEV

SEQ ID NO: 490462 - protein, 9 aa, Homo Sapiens
SDNLWQVRY

SEQ ID NO: 490463 - protein, 9 aa, Homo Sapiens
GHSHTHPML

SEQ ID NO: 490464 - protein, 9 aa, Homo Sapiens
IGAGCVGGP

SEQ ID NO: 490465 - protein, 9 aa, Homo Sapiens
NGFWFSRLT

SEQ ID NO: 490466 - protein, 9 aa, Homo Sapiens
HVLIYLNKV

SEQ ID NO: 490467 - protein, 9 aa, Homo Sapiens
ELWVREHNT

SEQ ID NO: 490468 - protein, 9 aa, Homo Sapiens
GCLAHTSLG

SEQ ID NO: 490469 - protein, 9 aa, Homo Sapiens
PAPLLPGNL

SEQ ID NO: 490470 - protein, 9 aa, Homo Sapiens
SHSNFVAIL

SEQ ID NO: 490471 - protein, 9 aa, Homo Sapiens
SPTGTLPCP

SEQ ID NO: 490472 - protein, 9 aa, Homo Sapiens
NSCKWKNRI

SEQ ID NO: 490473 - protein, 9 aa, Homo Sapiens
LLWTILGCQ

SEQ ID NO: 490474 - protein, 9 aa, Homo Sapiens
RSHSNFVAI

SEQ ID NO: 490475 - protein, 9 aa, Homo Sapiens
NFFCEVPQV

SEQ ID NO: 490476 - protein, 9 aa, Homo Sapiens
YHRRIIVSP

SEQ ID NO: 490477 - protein, 9 aa, Homo Sapiens
KKVKEDSSF

SEQ ID NO: 490478 - protein, 9 aa, Homo Sapiens
GCQLQLPNR

SEQ ID NO: 490479 - protein, 9 aa, Homo Sapiens
EQTGRWWIL

SEQ ID NO: 490480 - protein, 9 aa, Homo Sapiens
PQSQPMDVY

SEQ ID NO: 490481 - protein, 9 aa, Homo Sapiens
YKVDMVPIK

SEQ ID NO: 490482 - protein, 9 aa, Homo Sapiens
IRSNSNGLS

SEQ ID NO: 490483 - protein, 9 aa, Homo Sapiens
SCAGSAWAS

SEQ ID NO: 490484 - protein, 9 aa, Homo Sapiens
ISTGQATPL

SEQ ID NO: 490485 - protein, 9 aa, Homo Sapiens
NQAFKTLKR

SEQ ID NO: 490486 - protein, 9 aa, Homo Sapiens
IVNTYLNEN

SEQ ID NO: 490487 - protein, 9 aa, Homo Sapiens
NLWQVRYSY

SEQ ID NO: 490488 - protein, 9 aa, Homo Sapiens
QPFLGAREL

SEQ ID NO: 490489 - protein, 9 aa, Homo Sapiens
PMPEERALK

SEQ ID NO: 490490 - protein, 9 aa, Homo Sapiens
EERALKYEN

SEQ ID NO: 490491 - protein, 9 aa, Homo Sapiens
DYASNCLCM

SEQ ID NO: 490492 - protein, 9 aa, Homo Sapiens
VKSESLAPP

SEQ ID NO: 490493 - protein, 9 aa, Homo Sapiens
PQMCPGEPP

SEQ ID NO: 490494 - protein, 9 aa, Homo Sapiens
HANSNYKNG

SEQ ID NO: 490495 - protein, 9 aa, Homo Sapiens
PSQGMTAAH

SEQ ID NO: 490496 - protein, 9 aa, Homo Sapiens
WLQRWLEDS

SEQ ID NO: 490497 - protein, 9 aa, Homo Sapiens
RSPSFQYFP

SEQ ID NO: 490498 - protein, 9 aa, Homo Sapiens
RQRQVIMSP

SEQ ID NO: 490499 - protein, 9 aa, Homo Sapiens
TVTHTPGFG

SEQ ID NO: 490500 - protein, 9 aa, Homo Sapiens
RNAIEMEED

SEQ ID NO: 490501 - protein, 9 aa, Homo Sapiens
RNDLLVYQI

SEQ ID NO: 490502 - protein, 9 aa, Homo Sapiens
LLPGNLLGG

SEQ ID NO: 490503 - protein, 9 aa, Homo Sapiens
IAQACKYIV

SEQ ID NO: 490504 - protein, 9 aa, Homo Sapiens
LAPTYGDKA

SEQ ID NO: 490505 - protein, 9 aa, Homo Sapiens
NLKPRGSFE

SEQ ID NO: 490506 - protein, 9 aa, Homo Sapiens
QAFKTLKRC

SEQ ID NO: 490507 - protein, 9 aa, Homo Sapiens
TDSSLEKIK

SEQ ID NO: 490508 - protein, 9 aa, Homo Sapiens
FSCSELSLE

SEQ ID NO: 490509 - protein, 9 aa, Homo Sapiens
LSIQALFSH

SEQ ID NO: 490510 - protein, 9 aa, Homo Sapiens
AELEARDRD

SEQ ID NO: 490511 - protein, 9 aa, Homo Sapiens
HLKGSDYSW

SEQ ID NO: 490512 - protein, 9 aa, Homo Sapiens
LRVKGLAGF

SEQ ID NO: 490513 - protein, 9 aa, Homo Sapiens
WLKFPRSWR

SEQ ID NO: 490514 - protein, 9 aa, Homo Sapiens
GPLYAPPPP

SEQ ID NO: 490515 - protein, 9 aa, Homo Sapiens
MGPCMDRST

SEQ ID NO: 490516 - protein, 9 aa, Homo Sapiens
ELAFFPLCL

SEQ ID NO: 490517 - protein, 9 aa, Homo Sapiens
MSVIRPHWP

SEQ ID NO: 490518 - protein, 9 aa, Homo Sapiens
SRSHESPKP

SEQ ID NO: 490519 - protein, 9 aa, Homo Sapiens
ELCVAWHQC

SEQ ID NO: 490520 - protein, 9 aa, Homo Sapiens
VINHMSGKA

SEQ ID NO: 490521 - protein, 9 aa, Homo Sapiens
NTLLGMATQ

SEQ ID NO: 490522 - protein, 9 aa, Homo Sapiens
VFEEHFFGG

SEQ ID NO: 490523 - protein, 9 aa, Homo Sapiens
HNVCKDYLD

SEQ ID NO: 490524 - protein, 9 aa, Homo Sapiens
MYGAMLQTD

SEQ ID NO: 490525 - protein, 9 aa, Homo Sapiens
PFRFSFQVQ

SEQ ID NO: 490526 - protein, 9 aa, Homo Sapiens
QSIRRFLLN

SEQ ID NO: 490527 - protein, 9 aa, Homo Sapiens
CYSLHEFSL

SEQ ID NO: 490528 - protein, 9 aa, Homo Sapiens
IKQAVSREI

SEQ ID NO: 490529 - protein, 9 aa, Homo Sapiens
VMYGAMLQT

SEQ ID NO: 490530 - protein, 9 aa, Homo Sapiens
KDYLDRSFR

SEQ ID NO: 490531 - protein, 9 aa, Homo Sapiens
CSFLLVARI

SEQ ID NO: 490532 - protein, 9 aa, Homo Sapiens
VTEILSQIP

SEQ ID NO: 490533 - protein, 9 aa, Homo Sapiens
RKSTVSLNK

SEQ ID NO: 490534 - protein, 9 aa, Homo Sapiens
SAMYRRLFE

SEQ ID NO: 490535 - protein, 9 aa, Homo Sapiens
LRKAYGNSE

SEQ ID NO: 490536 - protein, 9 aa, Homo Sapiens
KSRAIGNNF

SEQ ID NO: 490537 - protein, 9 aa, Homo Sapiens
TGTSGLRAI

SEQ ID NO: 490538 - protein, 9 aa, Homo Sapiens
KAYGNSEWN

SEQ ID NO: 490539 - protein, 9 aa, Homo Sapiens
HFFQCGTYV

SEQ ID NO: 490540 - protein, 9 aa, Homo Sapiens
DYRAIGGRI

SEQ ID NO: 490541 - protein, 9 aa, Homo Sapiens
ITRCWLRDG

SEQ ID NO: 490542 - protein, 9 aa, Homo Sapiens
VRNWQDEDV

SEQ ID NO: 490543 - protein, 9 aa, Homo Sapiens
QDIEAVKEK

SEQ ID NO: 490544 - protein, 9 aa, Homo Sapiens
GEGAGIIFI

SEQ ID NO: 490545 - protein, 9 aa, Homo Sapiens
VTKSQQDAL

SEQ ID NO: 490546 - protein, 9 aa, Homo Sapiens
LHLSGTIKL

SEQ ID NO: 490547 - protein, 9 aa, Homo Sapiens
TSGTIENNK

SEQ ID NO: 490548 - protein, 9 aa, Homo Sapiens
PEADKYRIT

SEQ ID NO: 490549 - protein, 9 aa, Homo Sapiens
FQDIEAVKE

SEQ ID NO: 490550 - protein, 9 aa, Homo Sapiens
KVGDIVDVL

SEQ ID NO: 490551 - protein, 9 aa, Homo Sapiens
WTLCEGIYL

SEQ ID NO: 490552 - protein, 9 aa, Homo Sapiens
QLGEFHLRV

SEQ ID NO: 490553 - protein, 9 aa, Homo Sapiens
PEESDNELE

SEQ ID NO: 490554 - protein, 9 aa, Homo Sapiens
QNLIRMAMA

SEQ ID NO: 490555 - protein, 9 aa, Homo Sapiens
LKIGYDYKL

SEQ ID NO: 490556 - protein, 9 aa, Homo Sapiens
TFRLIGEKN

SEQ ID NO: 490557 - protein, 9 aa, Homo Sapiens
LAIFLYKPP

SEQ ID NO: 490558 - protein, 9 aa, Homo Sapiens
TSLSGITQK

SEQ ID NO: 490559 - protein, 9 aa, Homo Sapiens
NTNLRETLP

SEQ ID NO: 490560 - protein, 9 aa, Homo Sapiens
ADKYRITYA

SEQ ID NO: 490561 - protein, 9 aa, Homo Sapiens
MELSQIAGN

SEQ ID NO: 490562 - protein, 9 aa, Homo Sapiens
LSPSTSSAS

SEQ ID NO: 490563 - protein, 9 aa, Homo Sapiens
KTLLKIGYD

SEQ ID NO: 490564 - protein, 9 aa, Homo Sapiens
DSLGGRVSV

SEQ ID NO: 490565 - protein, 9 aa, Homo Sapiens
HMCIFTCTH

SEQ ID NO: 490566 - protein, 9 aa, Homo Sapiens
TKTFLHPHK

SEQ ID NO: 490567 - protein, 9 aa, Homo Sapiens
VCKDYLDRS

SEQ ID NO: 490568 - protein, 9 aa, Homo Sapiens
AYLILVKHG

SEQ ID NO: 490569 - protein, 9 aa, Homo Sapiens
FSEVISMWK

SEQ ID NO: 490570 - protein, 9 aa, Homo Sapiens
PSPLAGLPE

SEQ ID NO: 490571 - protein, 9 aa, Homo Sapiens
VLHPRSLGL

SEQ ID NO: 490572 - protein, 9 aa, Homo Sapiens
MQIRLLTAE

SEQ ID NO: 490573 - protein, 9 aa, Homo Sapiens
THIVQLLPL

SEQ ID NO: 490574 - protein, 9 aa, Homo Sapiens
AAIKKQQDF

SEQ ID NO: 490575 - protein, 9 aa, Homo Sapiens
KDEIKQAVS

SEQ ID NO: 490576 - protein, 9 aa, Homo Sapiens
ANKLFMLKI

SEQ ID NO: 490577 - protein, 9 aa, Homo Sapiens
ESDNELEQA

SEQ ID NO: 490578 - protein, 9 aa, Homo Sapiens
FQCISGIFI

SEQ ID NO: 490579 - protein, 9 aa, Homo Sapiens
GARQGQQQG

SEQ ID NO: 490580 - protein, 9 aa, Homo Sapiens
LFLKMAVTY

SEQ ID NO: 490581 - protein, 9 aa, Homo Sapiens
LHDGQTHPA

SEQ ID NO: 490582 - protein, 9 aa, Homo Sapiens
GIGKAKLCS

SEQ ID NO: 490583 - protein, 9 aa, Homo Sapiens
NVATHHLYQ

SEQ ID NO: 490584 - protein, 9 aa, Homo Sapiens
THAISSAQG

SEQ ID NO: 490585 - protein, 9 aa, Homo Sapiens
KKENDFAQF

SEQ ID NO: 490586 - protein, 9 aa, Homo Sapiens
VKIPEIKAE

SEQ ID NO: 490587 - protein, 9 aa, Homo Sapiens
QSAALAWNN

SEQ ID NO: 490588 - protein, 9 aa, Homo Sapiens
KFQPELKER

SEQ ID NO: 490589 - protein, 9 aa, Homo Sapiens
QVLICVRLE

SEQ ID NO: 490590 - protein, 9 aa, Homo Sapiens
TLVQCLTSF

SEQ ID NO: 490591 - protein, 9 aa, Homo Sapiens
EAVEAYTRT

SEQ ID NO: 490592 - protein, 9 aa, Homo Sapiens
LEGVSRLFS

SEQ ID NO: 490593 - protein, 9 aa, Homo Sapiens
PCCVSQDLQ

SEQ ID NO: 490594 - protein, 9 aa, Homo Sapiens
AARELGYLL

SEQ ID NO: 490595 - protein, 9 aa, Homo Sapiens
LGVPGLEAD

SEQ ID NO: 490596 - protein, 9 aa, Homo Sapiens
STAHVMPSN

SEQ ID NO: 490597 - protein, 9 aa, Homo Sapiens
TIVDKEIFQ

SEQ ID NO: 490598 - protein, 9 aa, Homo Sapiens
ASGQMGPCM

SEQ ID NO: 490599 - protein, 9 aa, Homo Sapiens
LAWNNSRVS

SEQ ID NO: 490600 - protein, 9 aa, Homo Sapiens
PRAQHAAAH

SEQ ID NO: 490601 - protein, 9 aa, Homo Sapiens
KRKERLMRS

SEQ ID NO: 490602 - protein, 9 aa, Homo Sapiens
LTMTTINTN

SEQ ID NO: 490603 - protein, 9 aa, Homo Sapiens
MKDKLKKIA

SEQ ID NO: 490604 - protein, 9 aa, Homo Sapiens
HILPCEDDG

SEQ ID NO: 490605 - protein, 9 aa, Homo Sapiens
FRTTQTPSL

SEQ ID NO: 490606 - protein, 9 aa, Homo Sapiens
LKKIAKMRL

SEQ ID NO: 490607 - protein, 9 aa, Homo Sapiens
SIADAHPPG

SEQ ID NO: 490608 - protein, 9 aa, Homo Sapiens
ATVRSLEGH

SEQ ID NO: 490609 - protein, 9 aa, Homo Sapiens
KEKKYFQDI

SEQ ID NO: 490610 - protein, 9 aa, Homo Sapiens
FDLRTTVLY

SEQ ID NO: 490611 - protein, 9 aa, Homo Sapiens
EAYLILVKH

SEQ ID NO: 490612 - protein, 9 aa, Homo Sapiens
EQAVSAGVP

SEQ ID NO: 490613 - protein, 9 aa, Homo Sapiens
VCFIAKTVS

SEQ ID NO: 490614 - protein, 9 aa, Homo Sapiens
TMFSSVCSR

SEQ ID NO: 490615 - protein, 9 aa, Homo Sapiens
MQTKDHRER

SEQ ID NO: 490616 - protein, 9 aa, Homo Sapiens
DLIFSGMPD

SEQ ID NO: 490617 - protein, 9 aa, Homo Sapiens
LSDWFKIGD

SEQ ID NO: 490618 - protein, 9 aa, Homo Sapiens
STSPGELDG

SEQ ID NO: 490619 - protein, 9 aa, Homo Sapiens
LRVEQECLL

SEQ ID NO: 490620 - protein, 9 aa, Homo Sapiens
ACPPHSRSH

SEQ ID NO: 490621 - protein, 9 aa, Homo Sapiens
QATNSEGHS

SEQ ID NO: 490622 - protein, 9 aa, Homo Sapiens
NRHTGLSNG

SEQ ID NO: 490623 - protein, 9 aa, Homo Sapiens
QAFNERGER

SEQ ID NO: 490624 - protein, 9 aa, Homo Sapiens
VDPEEKKKI

SEQ ID NO: 490625 - protein, 9 aa, Homo Sapiens
LKIFYFAFP

SEQ ID NO: 490626 - protein, 9 aa, Homo Sapiens
CNYFWTLCE

SEQ ID NO: 490627 - protein, 9 aa, Homo Sapiens
QMLLVIVVL

SEQ ID NO: 490628 - protein, 9 aa, Homo Sapiens
NGTEAFDFW

SEQ ID NO: 490629 - protein, 9 aa, Homo Sapiens
ARQGQQQGK

SEQ ID NO: 490630 - protein, 9 aa, Homo Sapiens
DGECSSPGR

SEQ ID NO: 490631 - protein, 9 aa, Homo Sapiens
LASCHYQAC

SEQ ID NO: 490632 - protein, 9 aa, Homo Sapiens
HKTVLTEAT

SEQ ID NO: 490633 - protein, 9 aa, Homo Sapiens
SQSLITLST

SEQ ID NO: 490634 - protein, 9 aa, Homo Sapiens
RKTNCGYES

SEQ ID NO: 490635 - protein, 9 aa, Homo Sapiens
SEVISMWKK

SEQ ID NO: 490636 - protein, 9 aa, Homo Sapiens
VACAAPRAQ

SEQ ID NO: 490637 - protein, 9 aa, Homo Sapiens
QFGQDAVPE

SEQ ID NO: 490638 - protein, 9 aa, Homo Sapiens
EKNLLCITK

SEQ ID NO: 490639 - protein, 9 aa, Homo Sapiens
LKSDFYRFD

SEQ ID NO: 490640 - protein, 9 aa, Homo Sapiens
RCGTARRSD

SEQ ID NO: 490641 - protein, 9 aa, Homo Sapiens
LADPTRKTN

SEQ ID NO: 490642 - protein, 9 aa, Homo Sapiens
VDRAKMHQD

SEQ ID NO: 490643 - protein, 9 aa, Homo Sapiens
FITRCWLRD

SEQ ID NO: 490644 - protein, 9 aa, Homo Sapiens
ENNCHFLRV

SEQ ID NO: 490645 - protein, 9 aa, Homo Sapiens
LNHKWFVCD

SEQ ID NO: 490646 - protein, 9 aa, Homo Sapiens
TLCEGIYLH

SEQ ID NO: 490647 - protein, 9 aa, Homo Sapiens
FQDGYILRS

SEQ ID NO: 490648 - protein, 9 aa, Homo Sapiens
TVLYICERH

SEQ ID NO: 490649 - protein, 9 aa, Homo Sapiens
QVFEEHFFG

SEQ ID NO: 490650 - protein, 9 aa, Homo Sapiens
GIIKKGLVT

SEQ ID NO: 490651 - protein, 9 aa, Homo Sapiens
EVFATPKKC

SEQ ID NO: 490652 - protein, 9 aa, Homo Sapiens
TAFAAPPPQ

SEQ ID NO: 490653 - protein, 9 aa, Homo Sapiens
VGNTLLGMA

SEQ ID NO: 490654 - protein, 9 aa, Homo Sapiens
YIHTHTFYV

SEQ ID NO: 490655 - protein, 9 aa, Homo Sapiens
GYSLDKLGR

SEQ ID NO: 490656 - protein, 9 aa, Homo Sapiens
QTCVYFCAS

SEQ ID NO: 490657 - protein, 9 aa, Homo Sapiens
ARELGYLLE

SEQ ID NO: 490658 - protein, 9 aa, Homo Sapiens
VKRVGNTLL

SEQ ID NO: 490659 - protein, 9 aa, Homo Sapiens
HLAEGRHGS

SEQ ID NO: 490660 - protein, 9 aa, Homo Sapiens
GKAKLCSMK

SEQ ID NO: 490661 - protein, 9 aa, Homo Sapiens
AWGQDVLHP

SEQ ID NO: 490662 - protein, 9 aa, Homo Sapiens
EAAVQKRVE

SEQ ID NO: 490663 - protein, 9 aa, Homo Sapiens
SCFPNTFLA

SEQ ID NO: 490664 - protein, 9 aa, Homo Sapiens
CTACKCSHL

SEQ ID NO: 490665 - protein, 9 aa, Homo Sapiens
MSPLSDASL

SEQ ID NO: 490666 - protein, 9 aa, Homo Sapiens
PYIPFRNAA

SEQ ID NO: 490667 - protein, 9 aa, Homo Sapiens
QVLAGSYSF

SEQ ID NO: 490668 - protein, 9 aa, Homo Sapiens
QPSVPEESD

SEQ ID NO: 490669 - protein, 9 aa, Homo Sapiens
ASQAFNERG

SEQ ID NO: 490670 - protein, 9 aa, Homo Sapiens
RGEDDSLAI

SEQ ID NO: 490671 - protein, 9 aa, Homo Sapiens
VDGLGRLVA

SEQ ID NO: 490672 - protein, 9 aa, Homo Sapiens
MSSDSSESP

SEQ ID NO: 490673 - protein, 9 aa, Homo Sapiens
SSGSQATNS

SEQ ID NO: 490674 - protein, 9 aa, Homo Sapiens
DFSHHPKFI

SEQ ID NO: 490675 - protein, 9 aa, Homo Sapiens
GIATLQVDS

SEQ ID NO: 490676 - protein, 9 aa, Homo Sapiens
QDGYILRSE

SEQ ID NO: 490677 - protein, 9 aa, Homo Sapiens
QERATAQVL

SEQ ID NO: 490678 - protein, 9 aa, Homo Sapiens
LKDTSRSHE

SEQ ID NO: 490679 - protein, 9 aa, Homo Sapiens
HGLFEGIIQ

SEQ ID NO: 490680 - protein, 9 aa, Homo Sapiens
TALLTVFHG

SEQ ID NO: 490681 - protein, 9 aa, Homo Sapiens
NHKKKHMRW

SEQ ID NO: 490682 - protein, 9 aa, Homo Sapiens
QQVNPTKAV

SEQ ID NO: 490683 - protein, 9 aa, Homo Sapiens
AVDGLGRLV

SEQ ID NO: 490684 - protein, 9 aa, Homo Sapiens
SVCSRNRHS

SEQ ID NO: 490685 - protein, 9 aa, Homo Sapiens
QFALTGMTV

SEQ ID NO: 490686 - protein, 9 aa, Homo Sapiens
HRERMIRGR

SEQ ID NO: 490687 - protein, 9 aa, Homo Sapiens
NDILAILSP

SEQ ID NO: 490688 - protein, 9 aa, Homo Sapiens
NLQRQFQGP

SEQ ID NO: 490689 - protein, 9 aa, Homo Sapiens
TSFQTIVDK

SEQ ID NO: 490690 - protein, 9 aa, Homo Sapiens
SSSCDSDLS

SEQ ID NO: 490691 - protein, 9 aa, Homo Sapiens
VTHLAEGRH

SEQ ID NO: 490692 - protein, 9 aa, Homo Sapiens
TNVRENNYT

SEQ ID NO: 490693 - protein, 9 aa, Homo Sapiens
WRTATTPYL

SEQ ID NO: 490694 - protein, 9 aa, Homo Sapiens
YRSPQANAS

SEQ ID NO: 490695 - protein, 9 aa, Homo Sapiens
SPLAASRPL

SEQ ID NO: 490696 - protein, 9 aa, Homo Sapiens
LPAGMINAS

SEQ ID NO: 490697 - protein, 9 aa, Homo Sapiens
SLEPEDFSA

SEQ ID NO: 490698 - protein, 9 aa, Homo Sapiens
AYCRSMTKL

SEQ ID NO: 490699 - protein, 9 aa, Homo Sapiens
TPEQSANLQ

SEQ ID NO: 490700 - protein, 9 aa, Homo Sapiens
RITYAYFAG

SEQ ID NO: 490701 - protein, 9 aa, Homo Sapiens
WPKPTITWK

SEQ ID NO: 490702 - protein, 9 aa, Homo Sapiens
EGAATSVKD

SEQ ID NO: 490703 - protein, 9 aa, Homo Sapiens
LSTFSHFFL

SEQ ID NO: 490704 - protein, 9 aa, Homo Sapiens
IRPHWPYFT

SEQ ID NO: 490705 - protein, 9 aa, Homo Sapiens
ERICYSQRL

SEQ ID NO: 490706 - protein, 9 aa, Homo Sapiens
FSGTVTFGA

SEQ ID NO: 490707 - protein, 9 aa, Homo Sapiens
TKIPWKTCW

SEQ ID NO: 490708 - protein, 9 aa, Homo Sapiens
HTGTLHPED

SEQ ID NO: 490709 - protein, 9 aa, Homo Sapiens
ACKCSHLGN

SEQ ID NO: 490710 - protein, 9 aa, Homo Sapiens
PEDFSAVTM

SEQ ID NO: 490711 - protein, 9 aa, Homo Sapiens
AEDAHLKHE

SEQ ID NO: 490712 - protein, 9 aa, Homo Sapiens
ASRCTCQGT

SEQ ID NO: 490713 - protein, 9 aa, Homo Sapiens
ELSAMYRRL

SEQ ID NO: 490714 - protein, 9 aa, Homo Sapiens
FQIPIVLIS

SEQ ID NO: 490715 - protein, 9 aa, Homo Sapiens
LSFQVFSNK

SEQ ID NO: 490716 - protein, 9 aa, Homo Sapiens
KIPWKTCWR

SEQ ID NO: 490717 - protein, 9 aa, Homo Sapiens
SRHPGSCAS

SEQ ID NO: 490718 - protein, 9 aa, Homo Sapiens
SETNTLFRR

SEQ ID NO: 490719 - protein, 9 aa, Homo Sapiens
GKGFSKSSM

SEQ ID NO: 490720 - protein, 9 aa, Homo Sapiens
QSGFNRKFK

SEQ ID NO: 490721 - protein, 9 aa, Homo Sapiens
RTQEAAVQK

SEQ ID NO: 490722 - protein, 9 aa, Homo Sapiens
WNCEGTALV

SEQ ID NO: 490723 - protein, 9 aa, Homo Sapiens
VEAAEDAHL

SEQ ID NO: 490724 - protein, 9 aa, Homo Sapiens
EITAYAAIK

SEQ ID NO: 490725 - protein, 9 aa, Homo Sapiens
FRRNSLASK

SEQ ID NO: 490726 - protein, 9 aa, Homo Sapiens
TLTLRPAAS

SEQ ID NO: 490727 - protein, 9 aa, Homo Sapiens
VSAGVPVEV

SEQ ID NO: 490728 - protein, 9 aa, Homo Sapiens
PFRNAAYGS

SEQ ID NO: 490729 - protein, 9 aa, Homo Sapiens
AGNLMTPPI

SEQ ID NO: 490730 - protein, 9 aa, Homo Sapiens
KLQHFFQCG

SEQ ID NO: 490731 - protein, 9 aa, Homo Sapiens
TCMHMCIFT

SEQ ID NO: 490732 - protein, 9 aa, Homo Sapiens
QDEDVYRRL

SEQ ID NO: 490733 - protein, 9 aa, Homo Sapiens
TINTNLRET

SEQ ID NO: 490734 - protein, 9 aa, Homo Sapiens
QNFMYMRQL

SEQ ID NO: 490735 - protein, 9 aa, Homo Sapiens
YRLQEAPKR

SEQ ID NO: 490736 - protein, 9 aa, Homo Sapiens
QVFSNKLLE

SEQ ID NO: 490737 - protein, 9 aa, Homo Sapiens
WINTHIVQL

SEQ ID NO: 490738 - protein, 9 aa, Homo Sapiens
SGLRAISKA

SEQ ID NO: 490739 - protein, 9 aa, Homo Sapiens
LHEPLALPA

SEQ ID NO: 490740 - protein, 9 aa, Homo Sapiens
EIASRDLGV

SEQ ID NO: 490741 - protein, 9 aa, Homo Sapiens
QEKQEEAIT

SEQ ID NO: 490742 - protein, 9 aa, Homo Sapiens
LLNLSCQSC

SEQ ID NO: 490743 - protein, 9 aa, Homo Sapiens
CVLESKPPR

SEQ ID NO: 490744 - protein, 9 aa, Homo Sapiens
RCTCQGTSP

SEQ ID NO: 490745 - protein, 9 aa, Homo Sapiens
QLASCHYQA

SEQ ID NO: 490746 - protein, 9 aa, Homo Sapiens
YSTFGALYI

SEQ ID NO: 490747 - protein, 9 aa, Homo Sapiens
FSQLHLRRV

SEQ ID NO: 490748 - protein, 9 aa, Homo Sapiens
IYTHIYIHT

SEQ ID NO: 490749 - protein, 9 aa, Homo Sapiens
LRKVREELK

SEQ ID NO: 490750 - protein, 9 aa, Homo Sapiens
GLFEGIIQD

SEQ ID NO: 490751 - protein, 9 aa, Homo Sapiens
VSVGKQNST

SEQ ID NO: 490752 - protein, 9 aa, Homo Sapiens
FRNAAYGSC

SEQ ID NO: 490753 - protein, 9 aa, Homo Sapiens
DGLGRLVAC

SEQ ID NO: 490754 - protein, 9 aa, Homo Sapiens
GSWFGFGFC

SEQ ID NO: 490755 - protein, 9 aa, Homo Sapiens
STFSHFFLF

SEQ ID NO: 490756 - protein, 9 aa, Homo Sapiens
FLTAYFCYV

SEQ ID NO: 490757 - protein, 9 aa, Homo Sapiens
SSCDSDLSL

SEQ ID NO: 490758 - protein, 9 aa, Homo Sapiens
CLLTAFRCG

SEQ ID NO: 490759 - protein, 9 aa, Homo Sapiens
STKSLMTPS

SEQ ID NO: 490760 - protein, 9 aa, Homo Sapiens
IKKGLVTYM

SEQ ID NO: 490761 - protein, 9 aa, Homo Sapiens
QLHLRRVEA

SEQ ID NO: 490762 - protein, 9 aa, Homo Sapiens
EILSQIPNN

SEQ ID NO: 490763 - protein, 9 aa, Homo Sapiens
KVEIKNATP

SEQ ID NO: 490764 - protein, 9 aa, Homo Sapiens
TKSPTFKFS

SEQ ID NO: 490765 - protein, 9 aa, Homo Sapiens
ETELFSEVI

SEQ ID NO: 490766 - protein, 9 aa, Homo Sapiens
GSSSCDSDL

SEQ ID NO: 490767 - protein, 9 aa, Homo Sapiens
EDVYRRLSR

SEQ ID NO: 490768 - protein, 9 aa, Homo Sapiens
GCMTQVFEE

SEQ ID NO: 490769 - protein, 9 aa, Homo Sapiens
SPALSIVEG

SEQ ID NO: 490770 - protein, 9 aa, Homo Sapiens
VFPNGKMAL

SEQ ID NO: 490771 - protein, 9 aa, Homo Sapiens
GIKCSCCEM

SEQ ID NO: 490772 - protein, 9 aa, Homo Sapiens
VARIVEEDC

SEQ ID NO: 490773 - protein, 9 aa, Homo Sapiens
VEAAATAQQ

SEQ ID NO: 490774 - protein, 9 aa, Homo Sapiens
RVSVIVTGA

SEQ ID NO: 490775 - protein, 9 aa, Homo Sapiens
FIRWTTFVS

SEQ ID NO: 490776 - protein, 9 aa, Homo Sapiens
MPDAPGLWM

SEQ ID NO: 490777 - protein, 9 aa, Homo Sapiens
CVRLELCVA

SEQ ID NO: 490778 - protein, 9 aa, Homo Sapiens
MFTKARGSR

SEQ ID NO: 490779 - protein, 9 aa, Homo Sapiens
PNGKMALLA

SEQ ID NO: 490780 - protein, 9 aa, Homo Sapiens
TQVFEEHFF

SEQ ID NO: 490781 - protein, 9 aa, Homo Sapiens
MLADYRAIG

SEQ ID NO: 490782 - protein, 9 aa, Homo Sapiens
TMGISWFNS

SEQ ID NO: 490783 - protein, 9 aa, Homo Sapiens
AEGAATSVK

SEQ ID NO: 490784 - protein, 9 aa, Homo Sapiens
LAHHRKIQT

SEQ ID NO: 490785 - protein, 9 aa, Homo Sapiens
APFVLISDM

SEQ ID NO: 490786 - protein, 9 aa, Homo Sapiens
ISGIFIHTL

SEQ ID NO: 490787 - protein, 9 aa, Homo Sapiens
LEAYLILVK

SEQ ID NO: 490788 - protein, 9 aa, Homo Sapiens
ARGRGRGVG

SEQ ID NO: 490789 - protein, 9 aa, Homo Sapiens
QHTRSVGRG

SEQ ID NO: 490790 - protein, 9 aa, Homo Sapiens
THKIGSVAE

SEQ ID NO: 490791 - protein, 9 aa, Homo Sapiens
RTDTMFTSP

SEQ ID NO: 490792 - protein, 9 aa, Homo Sapiens
GRGRGVGRN

SEQ ID NO: 490793 - protein, 9 aa, Homo Sapiens
DVLVGNSME

SEQ ID NO: 490794 - protein, 9 aa, Homo Sapiens
GLAIFLYKP

SEQ ID NO: 490795 - protein, 9 aa, Homo Sapiens
FTAALSLEL

SEQ ID NO: 490796 - protein, 9 aa, Homo Sapiens
RSPLAASRP

SEQ ID NO: 490797 - protein, 9 aa, Homo Sapiens
RSLEGHGVK

SEQ ID NO: 490798 - protein, 9 aa, Homo Sapiens
RTLEIQPGF

SEQ ID NO: 490799 - protein, 9 aa, Homo Sapiens
CTCQGTSPH

SEQ ID NO: 490800 - protein, 9 aa, Homo Sapiens
ELSDWFKIG

SEQ ID NO: 490801 - protein, 9 aa, Homo Sapiens
STFGALYIP

SEQ ID NO: 490802 - protein, 9 aa, Homo Sapiens
DWFKIGDLT

SEQ ID NO: 490803 - protein, 9 aa, Homo Sapiens
QTKDHRERM

SEQ ID NO: 490804 - protein, 9 aa, Homo Sapiens
NYLRKRKER

SEQ ID NO: 490805 - protein, 9 aa, Homo Sapiens
EPVFPNGKM

SEQ ID NO: 490806 - protein, 9 aa, Homo Sapiens
LLRSIADAH

SEQ ID NO: 490807 - protein, 9 aa, Homo Sapiens
NHFRQAQVT

SEQ ID NO: 490808 - protein, 9 aa, Homo Sapiens
MWKVQQRAQ

SEQ ID NO: 490809 - protein, 9 aa, Homo Sapiens
ILHTLNSTF

SEQ ID NO: 490810 - protein, 9 aa, Homo Sapiens
FTCTHACIC

SEQ ID NO: 490811 - protein, 9 aa, Homo Sapiens
LSAMYRRLF

SEQ ID NO: 490812 - protein, 9 aa, Homo Sapiens
GMPDAPGLW

SEQ ID NO: 490813 - protein, 9 aa, Homo Sapiens
GCTACKCSH

SEQ ID NO: 490814 - protein, 9 aa, Homo Sapiens
INVAQLKFY

SEQ ID NO: 490815 - protein, 9 aa, Homo Sapiens
TFLASKMEP

SEQ ID NO: 490816 - protein, 9 aa, Homo Sapiens
VEAYTRTLE

SEQ ID NO: 490817 - protein, 9 aa, Homo Sapiens
ISDMAYVIN

SEQ ID NO: 490818 - protein, 9 aa, Homo Sapiens
WVCGFLWFQ

SEQ ID NO: 490819 - protein, 9 aa, Homo Sapiens
TDTMFTSPK

SEQ ID NO: 490820 - protein, 9 aa, Homo Sapiens
MRIPSLFPS

SEQ ID NO: 490821 - protein, 9 aa, Homo Sapiens
LVSVGKQNS

SEQ ID NO: 490822 - protein, 9 aa, Homo Sapiens
HEFSLTGNP

SEQ ID NO: 490823 - protein, 9 aa, Homo Sapiens
LQYQHTRSV

SEQ ID NO: 490824 - protein, 9 aa, Homo Sapiens
FHLRNGLHH

SEQ ID NO: 490825 - protein, 9 aa, Homo Sapiens
IDCEQVLAG

SEQ ID NO: 490826 - protein, 9 aa, Homo Sapiens
GEKNLLCIT

SEQ ID NO: 490827 - protein, 9 aa, Homo Sapiens
QSPARHRSP

SEQ ID NO: 490828 - protein, 9 aa, Homo Sapiens
EEIGKIKNR

SEQ ID NO: 490829 - protein, 9 aa, Homo Sapiens
LLAKAGCFA

SEQ ID NO: 490830 - protein, 9 aa, Homo Sapiens
FLLNIQLTY

SEQ ID NO: 490831 - protein, 9 aa, Homo Sapiens
LLNIQLTYR

SEQ ID NO: 490832 - protein, 9 aa, Homo Sapiens
QNLDRMGVM

SEQ ID NO: 490833 - protein, 9 aa, Homo Sapiens
VCGFLWFQI

SEQ ID NO: 490834 - protein, 9 aa, Homo Sapiens
RKIQTGEKP

SEQ ID NO: 490835 - protein, 9 aa, Homo Sapiens
AKMHQDLVF

SEQ ID NO: 490836 - protein, 9 aa, Homo Sapiens
HFFLFHMAA

SEQ ID NO: 490837 - protein, 9 aa, Homo Sapiens
VDKEIFQTE

SEQ ID NO: 490838 - protein, 9 aa, Homo Sapiens
PEQSANLQK

SEQ ID NO: 490839 - protein, 9 aa, Homo Sapiens
AFVKLTNEN

SEQ ID NO: 490840 - protein, 9 aa, Homo Sapiens
CTKFYEFSL

SEQ ID NO: 490841 - protein, 9 aa, Homo Sapiens
VRKVGAPSR

SEQ ID NO: 490842 - protein, 9 aa, Homo Sapiens
SKPPRSCHL

SEQ ID NO: 490843 - protein, 9 aa, Homo Sapiens
SGFNRKFKC

SEQ ID NO: 490844 - protein, 9 aa, Homo Sapiens
VLVGNSMET

SEQ ID NO: 490845 - protein, 9 aa, Homo Sapiens
PSLFPSPEE

SEQ ID NO: 490846 - protein, 9 aa, Homo Sapiens
KKGLVTYMA

SEQ ID NO: 490847 - protein, 9 aa, Homo Sapiens
LPELAVRKV

SEQ ID NO: 490848 - protein, 9 aa, Homo Sapiens
AAWLHLSGT

SEQ ID NO: 490849 - protein, 9 aa, Homo Sapiens
GLYPHVLRK

SEQ ID NO: 490850 - protein, 9 aa, Homo Sapiens
KKIAKMRLS

SEQ ID NO: 490851 - protein, 9 aa, Homo Sapiens
PEVKIPEIK

SEQ ID NO: 490852 - protein, 9 aa, Homo Sapiens
FVCTQCGCA

SEQ ID NO: 490853 - protein, 9 aa, Homo Sapiens
QAVSREIVA

SEQ ID NO: 490854 - protein, 9 aa, Homo Sapiens
SRSHPESWP

SEQ ID NO: 490855 - protein, 9 aa, Homo Sapiens
RNYIPQGCT

SEQ ID NO: 490856 - protein, 9 aa, Homo Sapiens
RNAAYGSCN

SEQ ID NO: 490857 - protein, 9 aa, Homo Sapiens
MEPSQNTIS

SEQ ID NO: 490858 - protein, 9 aa, Homo Sapiens
RNLQRQFQG

SEQ ID NO: 490859 - protein, 9 aa, Homo Sapiens
ATGTSGLRA

SEQ ID NO: 490860 - protein, 9 aa, Homo Sapiens
LDLYDNHIE

SEQ ID NO: 490861 - protein, 9 aa, Homo Sapiens
IEKELSAMY

SEQ ID NO: 490862 - protein, 9 aa, Homo Sapiens
NVCKDYLDR

SEQ ID NO: 490863 - protein, 9 aa, Homo Sapiens
SQNHFRQAQ

SEQ ID NO: 490864 - protein, 9 aa, Homo Sapiens
LAGSYSFTW

SEQ ID NO: 490865 - protein, 9 aa, Homo Sapiens
MFSVDFTDE

SEQ ID NO: 490866 - protein, 9 aa, Homo Sapiens
LRTDTMFTS

SEQ ID NO: 490867 - protein, 9 aa, Homo Sapiens
TIAPGRRGQ

SEQ ID NO: 490868 - protein, 9 aa, Homo Sapiens
DGSSSCDSD

SEQ ID NO: 490869 - protein, 9 aa, Homo Sapiens
YLVEWEADF

SEQ ID NO: 490870 - protein, 9 aa, Homo Sapiens
LGGRVSVIV

SEQ ID NO: 490871 - protein, 9 aa, Homo Sapiens
RFQSIRRFL

SEQ ID NO: 490872 - protein, 9 aa, Homo Sapiens
ERATAQVLL

SEQ ID NO: 490873 - protein, 9 aa, Homo Sapiens
LTRTQEAAV

SEQ ID NO: 490874 - protein, 9 aa, Homo Sapiens
WAWINTHIV

SEQ ID NO: 490875 - protein, 9 aa, Homo Sapiens
TEVGARLQV

SEQ ID NO: 490876 - protein, 9 aa, Homo Sapiens
GNIRCEDIH

SEQ ID NO: 490877 - protein, 9 aa, Homo Sapiens
TASRCTCQG

SEQ ID NO: 490878 - protein, 9 aa, Homo Sapiens
AWHQCPGGA

SEQ ID NO: 490879 - protein, 9 aa, Homo Sapiens
RTLGLHFHL

SEQ ID NO: 490880 - protein, 9 aa, Homo Sapiens
FLWFQIPIV

SEQ ID NO: 490881 - protein, 9 aa, Homo Sapiens
IMDADFSHH

SEQ ID NO: 490882 - protein, 9 aa, Homo Sapiens
LRSHHCTVA

SEQ ID NO: 490883 - protein, 9 aa, Homo Sapiens
PLDYAAEGT

SEQ ID NO: 490884 - protein, 9 aa, Homo Sapiens
DKLKKIAKM

SEQ ID NO: 490885 - protein, 9 aa, Homo Sapiens
RSHPESWPP

SEQ ID NO: 490886 - protein, 9 aa, Homo Sapiens
YMLLQACRL

SEQ ID NO: 490887 - protein, 9 aa, Homo Sapiens
SDFYRFDID

SEQ ID NO: 490888 - protein, 9 aa, Homo Sapiens
TNDILAILS

SEQ ID NO: 490889 - protein, 9 aa, Homo Sapiens
VDFTDEVTS

SEQ ID NO: 490890 - protein, 9 aa, Homo Sapiens
CAFRERPAL

SEQ ID NO: 490891 - protein, 9 aa, Homo Sapiens
ARKSSSRSG

SEQ ID NO: 490892 - protein, 9 aa, Homo Sapiens
TRTQEAAVQ

SEQ ID NO: 490893 - protein, 9 aa, Homo Sapiens
QLHEPLALP

SEQ ID NO: 490894 - protein, 9 aa, Homo Sapiens
IFTCTHACI

SEQ ID NO: 490895 - protein, 9 aa, Homo Sapiens
ENVATHHLY

SEQ ID NO: 490896 - protein, 9 aa, Homo Sapiens
PEDQLASCH

SEQ ID NO: 490897 - protein, 9 aa, Homo Sapiens
SGIFIHTLS

SEQ ID NO: 490898 - protein, 9 aa, Homo Sapiens
FSTSPGELD

SEQ ID NO: 490899 - protein, 9 aa, Homo Sapiens
PNIHKTVLT

SEQ ID NO: 490900 - protein, 9 aa, Homo Sapiens
ELRSHHCTV

SEQ ID NO: 490901 - protein, 9 aa, Homo Sapiens
GTAFAAPPP

SEQ ID NO: 490902 - protein, 9 aa, Homo Sapiens
CNTMFSSVC

SEQ ID NO: 490903 - protein, 9 aa, Homo Sapiens
GVCSFLLVA

SEQ ID NO: 490904 - protein, 9 aa, Homo Sapiens
QLTSLSGIT

SEQ ID NO: 490905 - protein, 9 aa, Homo Sapiens
GDMRVDWAR

SEQ ID NO: 490906 - protein, 9 aa, Homo Sapiens
MLKREMKPK

SEQ ID NO: 490907 - protein, 9 aa, Homo Sapiens
GHVFTATPA

SEQ ID NO: 490908 - protein, 9 aa, Homo Sapiens
KRVGNTLLG

SEQ ID NO: 490909 - protein, 9 aa, Homo Sapiens
SPARLYLTG

SEQ ID NO: 490910 - protein, 9 aa, Homo Sapiens
CPGGAHAAW

SEQ ID NO: 490911 - protein, 9 aa, Homo Sapiens
ISSTHAISS

SEQ ID NO: 490912 - protein, 9 aa, Homo Sapiens
PLCLSSKCI

SEQ ID NO: 490913 - protein, 9 aa, Homo Sapiens
VGARLQVHQ

SEQ ID NO: 490914 - protein, 9 aa, Homo Sapiens
NGSLRFSTS

SEQ ID NO: 490915 - protein, 9 aa, Homo Sapiens
IPSLFPSPE

SEQ ID NO: 490916 - protein, 9 aa, Homo Sapiens
EKKKILLNL

SEQ ID NO: 490917 - protein, 9 aa, Homo Sapiens
LHFHLRNGL

SEQ ID NO: 490918 - protein, 9 aa, Homo Sapiens
RENVATHHL

SEQ ID NO: 490919 - protein, 9 aa, Homo Sapiens
GKIKNRHTG

SEQ ID NO: 490920 - protein, 9 aa, Homo Sapiens
GSKEFNNNC

SEQ ID NO: 490921 - protein, 9 aa, Homo Sapiens
SVIVTGAAP

SEQ ID NO: 490922 - protein, 9 aa, Homo Sapiens
GPVNASKGF

SEQ ID NO: 490923 - protein, 9 aa, Homo Sapiens
MAGLVLVAL

SEQ ID NO: 490924 - protein, 9 aa, Homo Sapiens
AGFGAGVRC

SEQ ID NO: 490925 - protein, 9 aa, Homo Sapiens
TGGDMRVDW

SEQ ID NO: 490926 - protein, 9 aa, Homo Sapiens
QGYSLDKLG

SEQ ID NO: 490927 - protein, 9 aa, Homo Sapiens
PLGSTKSLM

SEQ ID NO: 490928 - protein, 9 aa, Homo Sapiens
IATKTFLHP

SEQ ID NO: 490929 - protein, 9 aa, Homo Sapiens
RATAQVLLD

SEQ ID NO: 490930 - protein, 9 aa, Homo Sapiens
KHGLFEGII

SEQ ID NO: 490931 - protein, 9 aa, Homo Sapiens
LKKFQPELK

SEQ ID NO: 490932 - protein, 9 aa, Homo Sapiens
SQAFNERGE

SEQ ID NO: 490933 - protein, 9 aa, Homo Sapiens
PSTSSASSR

SEQ ID NO: 490934 - protein, 9 aa, Homo Sapiens
RSKEARKKA

SEQ ID NO: 490935 - protein, 9 aa, Homo Sapiens
TMFTSPKPT

SEQ ID NO: 490936 - protein, 9 aa, Homo Sapiens
VLSWEDKLV

SEQ ID NO: 490937 - protein, 9 aa, Homo Sapiens
LSQIAGNLM

SEQ ID NO: 490938 - protein, 9 aa, Homo Sapiens
ARERPAEGD

SEQ ID NO: 490939 - protein, 9 aa, Homo Sapiens
QARNQNFMY

SEQ ID NO: 490940 - protein, 9 aa, Homo Sapiens
ASRDLGVPG

SEQ ID NO: 490941 - protein, 9 aa, Homo Sapiens
EVKRVGNTL

SEQ ID NO: 490942 - protein, 9 aa, Homo Sapiens
QSQVKLQHF

SEQ ID NO: 490943 - protein, 9 aa, Homo Sapiens
GVMKPHRYR

SEQ ID NO: 490944 - protein, 9 aa, Homo Sapiens
ELQSAFVKL

SEQ ID NO: 490945 - protein, 9 aa, Homo Sapiens
NFPLGSTKS

SEQ ID NO: 490946 - protein, 9 aa, Homo Sapiens
SFSGTVTFG

SEQ ID NO: 490947 - protein, 9 aa, Homo Sapiens
PTTLSEEQA

SEQ ID NO: 490948 - protein, 9 aa, Homo Sapiens
AAFSQLHLR

SEQ ID NO: 490949 - protein, 9 aa, Homo Sapiens
LTAVDGLGR

SEQ ID NO: 490950 - protein, 9 aa, Homo Sapiens
RSHVTALLT

SEQ ID NO: 490951 - protein, 9 aa, Homo Sapiens
ILQCKVCGW

SEQ ID NO: 490952 - protein, 9 aa, Homo Sapiens
LRTKIPWKT

SEQ ID NO: 490953 - protein, 9 aa, Homo Sapiens
LVHQGIKCS

SEQ ID NO: 490954 - protein, 9 aa, Homo Sapiens
ATAQQLTAV

SEQ ID NO: 490955 - protein, 9 aa, Homo Sapiens
YLLEQRTVK

SEQ ID NO: 490956 - protein, 9 aa, Homo Sapiens
IINYLRKRK

SEQ ID NO: 490957 - protein, 9 aa, Homo Sapiens
TSPHTGTLH

SEQ ID NO: 490958 - protein, 9 aa, Homo Sapiens
PQERATAQV

SEQ ID NO: 490959 - protein, 9 aa, Homo Sapiens
GSCFLRTDT

SEQ ID NO: 490960 - protein, 9 aa, Homo Sapiens
EKKYFQDIE

SEQ ID NO: 490961 - protein, 9 aa, Homo Sapiens
NLMTPPISP

SEQ ID NO: 490962 - protein, 9 aa, Homo Sapiens
SPKPTASRC

SEQ ID NO: 490963 - protein, 9 aa, Homo Sapiens
AEVKRVGNT

SEQ ID NO: 490964 - protein, 9 aa, Homo Sapiens
TNLRETLPK

SEQ ID NO: 490965 - protein, 9 aa, Homo Sapiens
PLPELAVRK

SEQ ID NO: 490966 - protein, 9 aa, Homo Sapiens
SGGIATLQV

SEQ ID NO: 490967 - protein, 9 aa, Homo Sapiens
DVAQAHTHA

SEQ ID NO: 490968 - protein, 9 aa, Homo Sapiens
GTLHPEDQL

SEQ ID NO: 490969 - protein, 9 aa, Homo Sapiens
LAGRWNCEG

SEQ ID NO: 490970 - protein, 9 aa, Homo Sapiens
IHTHTFYVS

SEQ ID NO: 490971 - protein, 9 aa, Homo Sapiens
TIYSTFGAL

SEQ ID NO: 490972 - protein, 9 aa, Homo Sapiens
LSFRTTQTP

SEQ ID NO: 490973 - protein, 9 aa, Homo Sapiens
PSQSLITLS

SEQ ID NO: 490974 - protein, 9 aa, Homo Sapiens
FHALFLKMA

SEQ ID NO: 490975 - protein, 9 aa, Homo Sapiens
CWLRDGLKP

SEQ ID NO: 490976 - protein, 9 aa, Homo Sapiens
ATIEEAYCR

SEQ ID NO: 490977 - protein, 9 aa, Homo Sapiens
MSKRNHKKK

SEQ ID NO: 490978 - protein, 9 aa, Homo Sapiens
SPQNLTLQA

SEQ ID NO: 490979 - protein, 9 aa, Homo Sapiens
KPYLTVYQM

SEQ ID NO: 490980 - protein, 9 aa, Homo Sapiens
SIRRFLLNI

SEQ ID NO: 490981 - protein, 9 aa, Homo Sapiens
LDLWTLIAG

SEQ ID NO: 490982 - protein, 9 aa, Homo Sapiens
ARLWKWLKF

SEQ ID NO: 490983 - protein, 9 aa, Homo Sapiens
YIPQGCTKF

SEQ ID NO: 490984 - protein, 9 aa, Homo Sapiens
MHMCIFTCT

SEQ ID NO: 490985 - protein, 9 aa, Homo Sapiens
ITLSFRTTQ

SEQ ID NO: 490986 - protein, 9 aa, Homo Sapiens
KQLSFQVFS

SEQ ID NO: 490987 - protein, 9 aa, Homo Sapiens
LLLQCVTHL

SEQ ID NO: 490988 - protein, 9 aa, Homo Sapiens
NQNFMYMRQ

SEQ ID NO: 490989 - protein, 9 aa, Homo Sapiens
WSLEPEDFS

SEQ ID NO: 490990 - protein, 9 aa, Homo Sapiens
INTNLRETL

SEQ ID NO: 490991 - protein, 9 aa, Homo Sapiens
LTIAPGRRG

SEQ ID NO: 490992 - protein, 9 aa, Homo Sapiens
GQTHPALDM

SEQ ID NO: 490993 - protein, 9 aa, Homo Sapiens
SQEKQEEAI

SEQ ID NO: 490994 - protein, 9 aa, Homo Sapiens
KYFQDIEAV

SEQ ID NO: 490995 - protein, 9 aa, Homo Sapiens
EMINTREKA

SEQ ID NO: 490996 - protein, 9 aa, Homo Sapiens
RAPFVLISD

SEQ ID NO: 490997 - protein, 9 aa, Homo Sapiens
IIKKGLVTY

SEQ ID NO: 490998 - protein, 9 aa, Homo Sapiens
SDSVKKELL

SEQ ID NO: 490999 - protein, 9 aa, Homo Sapiens
SGKAVSAGT

SEQ ID NO: 491000 - protein, 9 aa, Homo Sapiens
ADFRIYNMT

SEQ ID NO: 491001 - protein, 9 aa, Homo Sapiens
TAVTAIGPV

SEQ ID NO: 491002 - protein, 9 aa, Homo Sapiens
EGHGVKIAR

SEQ ID NO: 491003 - protein, 9 aa, Homo Sapiens
PRPPQGRPQ

SEQ ID NO: 491004 - protein, 9 aa, Homo Sapiens
DHRERMIRG

SEQ ID NO: 491005 - protein, 9 aa, Homo Sapiens
KSQEKQEEA

SEQ ID NO: 491006 - protein, 9 aa, Homo Sapiens
ERPAEGDRG

SEQ ID NO: 491007 - protein, 9 aa, Homo Sapiens
LRSISNNCS

SEQ ID NO: 491008 - protein, 9 aa, Homo Sapiens
HRNLQRQFQ

SEQ ID NO: 491009 - protein, 9 aa, Homo Sapiens
TTVLYICER

SEQ ID NO: 491010 - protein, 9 aa, Homo Sapiens
AGQPGLLIL

SEQ ID NO: 491011 - protein, 9 aa, Homo Sapiens
HTHANPRGR

SEQ ID NO: 491012 - protein, 9 aa, Homo Sapiens
IQAQPDSLT

SEQ ID NO: 491013 - protein, 9 aa, Homo Sapiens
ETNTLFRRN

SEQ ID NO: 491014 - protein, 9 aa, Homo Sapiens
FNRKFKCTE

SEQ ID NO: 491015 - protein, 9 aa, Homo Sapiens
GLRAISKAP

SEQ ID NO: 491016 - protein, 9 aa, Homo Sapiens
SSSSRMQGL

SEQ ID NO: 491017 - protein, 9 aa, Homo Sapiens
AKKRVVQML

SEQ ID NO: 491018 - protein, 9 aa, Homo Sapiens
FWEKPPLPV

SEQ ID NO: 491019 - protein, 9 aa, Homo Sapiens
LVACAAPRA

SEQ ID NO: 491020 - protein, 9 aa, Homo Sapiens
AFSQLHLRR

SEQ ID NO: 491021 - protein, 9 aa, Homo Sapiens
NLTLQAPGE

SEQ ID NO: 491022 - protein, 9 aa, Homo Sapiens
SHFFLFHMA

SEQ ID NO: 491023 - protein, 9 aa, Homo Sapiens
SIELAFFPL

SEQ ID NO: 491024 - protein, 9 aa, Homo Sapiens
IELTCPKSF

SEQ ID NO: 491025 - protein, 9 aa, Homo Sapiens
AILSPEGER

SEQ ID NO: 491026 - protein, 9 aa, Homo Sapiens
RSAAQNLDR

SEQ ID NO: 491027 - protein, 9 aa, Homo Sapiens
RHTGLSNGN

SEQ ID NO: 491028 - protein, 9 aa, Homo Sapiens
APGTAFAAP

SEQ ID NO: 491029 - protein, 9 aa, Homo Sapiens
LLKSQEKQE

SEQ ID NO: 491030 - protein, 9 aa, Homo Sapiens
SGTIENNKD

SEQ ID NO: 491031 - protein, 9 aa, Homo Sapiens
LACLLLAKA

SEQ ID NO: 491032 - protein, 9 aa, Homo Sapiens
GALYIPLLL

SEQ ID NO: 491033 - protein, 9 aa, Homo Sapiens
IKNFHILPC

SEQ ID NO: 491034 - protein, 9 aa, Homo Sapiens
KNFHILPCE

SEQ ID NO: 491035 - protein, 9 aa, Homo Sapiens
LPHLAYNKE

SEQ ID NO: 491036 - protein, 9 aa, Homo Sapiens
VRLELCVAW

SEQ ID NO: 491037 - protein, 9 aa, Homo Sapiens
QAAEGAATS

SEQ ID NO: 491038 - protein, 9 aa, Homo Sapiens
QVDRAKMHQ

SEQ ID NO: 491039 - protein, 9 aa, Homo Sapiens
LVEWEADFE

SEQ ID NO: 491040 - protein, 9 aa, Homo Sapiens
IGVCSFLLV

SEQ ID NO: 491041 - protein, 9 aa, Homo Sapiens
ARLPHLAYN

SEQ ID NO: 491042 - protein, 9 aa, Homo Sapiens
LWKWLKFPR

SEQ ID NO: 491043 - protein, 9 aa, Homo Sapiens
KFDLRTTVL

SEQ ID NO: 491044 - protein, 9 aa, Homo Sapiens
MKPKSDRPR

SEQ ID NO: 491045 - protein, 9 aa, Homo Sapiens
SLDLYDNHI

SEQ ID NO: 491046 - protein, 9 aa, Homo Sapiens
RENNCHFLR

SEQ ID NO: 491047 - protein, 9 aa, Homo Sapiens
IKNRHTGLS

SEQ ID NO: 491048 - protein, 9 aa, Homo Sapiens
IAEQAVSAG

SEQ ID NO: 491049 - protein, 9 aa, Homo Sapiens
SMSSDSSES

SEQ ID NO: 491050 - protein, 9 aa, Homo Sapiens
DAPGLWMGS

SEQ ID NO: 491051 - protein, 9 aa, Homo Sapiens
TAYAAIKEN

SEQ ID NO: 491052 - protein, 9 aa, Homo Sapiens
STTVLRTTP

SEQ ID NO: 491053 - protein, 9 aa, Homo Sapiens
CLFGGIIKK

SEQ ID NO: 491054 - protein, 9 aa, Homo Sapiens
KIPEIKAEQ

SEQ ID NO: 491055 - protein, 9 aa, Homo Sapiens
QDGECSSPG

SEQ ID NO: 491056 - protein, 9 aa, Homo Sapiens
LRLGAVFSC

SEQ ID NO: 491057 - protein, 9 aa, Homo Sapiens
KQSPARHRS

SEQ ID NO: 491058 - protein, 9 aa, Homo Sapiens
TVARVTKPD

SEQ ID NO: 491059 - protein, 9 aa, Homo Sapiens
AAQNLDRMG

SEQ ID NO: 491060 - protein, 9 aa, Homo Sapiens
VFATPKKCA

SEQ ID NO: 491061 - protein, 9 aa, Homo Sapiens
SGEQNMMTN

SEQ ID NO: 491062 - protein, 9 aa, Homo Sapiens
FTSPKPTAS

SEQ ID NO: 491063 - protein, 9 aa, Homo Sapiens
TLLKIGYDY

SEQ ID NO: 491064 - protein, 9 aa, Homo Sapiens
KSKPYLTVY

SEQ ID NO: 491065 - protein, 9 aa, Homo Sapiens
PHLAYNKEN

SEQ ID NO: 491066 - protein, 9 aa, Homo Sapiens
TGEGAGIIF

SEQ ID NO: 491067 - protein, 9 aa, Homo Sapiens
EEACQLREL

SEQ ID NO: 491068 - protein, 9 aa, Homo Sapiens
AAPQDGECS

SEQ ID NO: 491069 - protein, 9 aa, Homo Sapiens
YCRSMTKLA

SEQ ID NO: 491070 - protein, 9 aa, Homo Sapiens
YIPFRNAAY

SEQ ID NO: 491071 - protein, 9 aa, Homo Sapiens
GSPARLYLT

SEQ ID NO: 491072 - protein, 9 aa, Homo Sapiens
RRNSLASKS

SEQ ID NO: 491073 - protein, 9 aa, Homo Sapiens
QSLITLSTA

SEQ ID NO: 491074 - protein, 9 aa, Homo Sapiens
MRVDWARPG

SEQ ID NO: 491075 - protein, 9 aa, Homo Sapiens
NNCSVVSDR

SEQ ID NO: 491076 - protein, 9 aa, Homo Sapiens
RGVGRNSKQ

SEQ ID NO: 491077 - protein, 9 aa, Homo Sapiens
HSRSHPESW

SEQ ID NO: 491078 - protein, 9 aa, Homo Sapiens
VFSCPWRSS

SEQ ID NO: 491079 - protein, 9 aa, Homo Sapiens
AQVLLDHPF

SEQ ID NO: 491080 - protein, 9 aa, Homo Sapiens
RWNCEGTAL

SEQ ID NO: 491081 - protein, 9 aa, Homo Sapiens
QRHVTQSGF

SEQ ID NO: 491082 - protein, 9 aa, Homo Sapiens
PKLAWVGHV

SEQ ID NO: 491083 - protein, 9 aa, Homo Sapiens
SMEISFSGT

SEQ ID NO: 491084 - protein, 9 aa, Homo Sapiens
VKLQHFFQC

SEQ ID NO: 491085 - protein, 9 aa, Homo Sapiens
KEMSKRNHK

SEQ ID NO: 491086 - protein, 9 aa, Homo Sapiens
SPFVTKSQQ

SEQ ID NO: 491087 - protein, 9 aa, Homo Sapiens
RSGGIATLQ

SEQ ID NO: 491088 - protein, 9 aa, Homo Sapiens
NCKLKERIE

SEQ ID NO: 491089 - protein, 9 aa, Homo Sapiens
LQVHQVLIC

SEQ ID NO: 491090 - protein, 9 aa, Homo Sapiens
RSCHLWATE

SEQ ID NO: 491091 - protein, 9 aa, Homo Sapiens
TSPGELDGG

SEQ ID NO: 491092 - protein, 9 aa, Homo Sapiens
RNLTFLDLC

SEQ ID NO: 491093 - protein, 9 aa, Homo Sapiens
QGIKCSCCE

SEQ ID NO: 491094 - protein, 9 aa, Homo Sapiens
KLMRIPSLF

SEQ ID NO: 491095 - protein, 9 aa, Homo Sapiens
IINYMSSLI

SEQ ID NO: 491096 - protein, 9 aa, Homo Sapiens
SPQRKQSPA

SEQ ID NO: 491097 - protein, 9 aa, Homo Sapiens
HPHKLMIML

SEQ ID NO: 491098 - protein, 9 aa, Homo Sapiens
PAGMINASV

SEQ ID NO: 491099 - protein, 9 aa, Homo Sapiens
CSRNRHSQN

SEQ ID NO: 491100 - protein, 9 aa, Homo Sapiens
SRPLSPSTS

SEQ ID NO: 491101 - protein, 9 aa, Homo Sapiens
LHEFSLTGN

SEQ ID NO: 491102 - protein, 9 aa, Homo Sapiens
FHTVYCHLE

SEQ ID NO: 491103 - protein, 9 aa, Homo Sapiens
MTYLEPSLR

SEQ ID NO: 491104 - protein, 9 aa, Homo Sapiens
WCLHDGQTH

SEQ ID NO: 491105 - protein, 9 aa, Homo Sapiens
TPYLVEWEA

SEQ ID NO: 491106 - protein, 9 aa, Homo Sapiens
YRITYAYFA

SEQ ID NO: 491107 - protein, 9 aa, Homo Sapiens
QCPGGAHAA

SEQ ID NO: 491108 - protein, 9 aa, Homo Sapiens
ELSQIAGNL

SEQ ID NO: 491109 - protein, 9 aa, Homo Sapiens
LIDCEQVLA

SEQ ID NO: 491110 - protein, 9 aa, Homo Sapiens
AQAAEGAAT

SEQ ID NO: 491111 - protein, 9 aa, Homo Sapiens
QTGEKPFKC

SEQ ID NO: 491112 - protein, 9 aa, Homo Sapiens
RRHEMINTR

SEQ ID NO: 491113 - protein, 9 aa, Homo Sapiens
QALRELALP

SEQ ID NO: 491114 - protein, 9 aa, Homo Sapiens
LLTAELVVP

SEQ ID NO: 491115 - protein, 9 aa, Homo Sapiens
HLEGVSRLF

SEQ ID NO: 491116 - protein, 9 aa, Homo Sapiens
EQNMMTNVR

SEQ ID NO: 491117 - protein, 9 aa, Homo Sapiens
FRLIGEKNL

SEQ ID NO: 491118 - protein, 9 aa, Homo Sapiens
QLLSCFPNT

SEQ ID NO: 491119 - protein, 9 aa, Homo Sapiens
FPRSWRLGL

SEQ ID NO: 491120 - protein, 9 aa, Homo Sapiens
AREKEEQCE

SEQ ID NO: 491121 - protein, 9 aa, Homo Sapiens
KGRALVSDS

SEQ ID NO: 491122 - protein, 9 aa, Homo Sapiens
RKAYGNSEW

SEQ ID NO: 491123 - protein, 9 aa, Homo Sapiens
AIGNNFATS

SEQ ID NO: 491124 - protein, 9 aa, Homo Sapiens
KQKEKKYFQ

SEQ ID NO: 491125 - protein, 9 aa, Homo Sapiens
TLRPAASGS

SEQ ID NO: 491126 - protein, 9 aa, Homo Sapiens
LFEGIIQDG

SEQ ID NO: 491127 - protein, 9 aa, Homo Sapiens
HEGPLYAPP

SEQ ID NO: 491128 - protein, 9 aa, Homo Sapiens
TLEIQPGFI

SEQ ID NO: 491129 - protein, 9 aa, Homo Sapiens
NLRETLPKI

SEQ ID NO: 491130 - protein, 9 aa, Homo Sapiens
AMLQTDDED

SEQ ID NO: 491131 - protein, 9 aa, Homo Sapiens
GNLKKFQPE

SEQ ID NO: 491132 - protein, 9 aa, Homo Sapiens
LGRLVACAA

SEQ ID NO: 491133 - protein, 9 aa, Homo Sapiens
MMTNVRENN

SEQ ID NO: 491134 - protein, 9 aa, Homo Sapiens
ARRSDSRDG

SEQ ID NO: 491135 - protein, 9 aa, Homo Sapiens
ADAHPPGTA

SEQ ID NO: 491136 - protein, 9 aa, Homo Sapiens
KAVSAGTSS

SEQ ID NO: 491137 - protein, 9 aa, Homo Sapiens
RAIGNNFAT

SEQ ID NO: 491138 - protein, 9 aa, Homo Sapiens
KSQQDALLQ

SEQ ID NO: 491139 - protein, 9 aa, Homo Sapiens
HFRQAQVTL

SEQ ID NO: 491140 - protein, 9 aa, Homo Sapiens
YSKIISSTH

SEQ ID NO: 491141 - protein, 9 aa, Homo Sapiens
NLLKSQEKQ

SEQ ID NO: 491142 - protein, 9 aa, Homo Sapiens
NGCMTQVFE

SEQ ID NO: 491143 - protein, 9 aa, Homo Sapiens
AVCNIVNNK

SEQ ID NO: 491144 - protein, 9 aa, Homo Sapiens
IKNATPDTA

SEQ ID NO: 491145 - protein, 9 aa, Homo Sapiens
SDWFKIGDL

SEQ ID NO: 491146 - protein, 9 aa, Homo Sapiens
MEISFSGTV

SEQ ID NO: 491147 - protein, 9 aa, Homo Sapiens
TQKNFMNIL

SEQ ID NO: 491148 - protein, 9 aa, Homo Sapiens
QCKVCGWPK

SEQ ID NO: 491149 - protein, 9 aa, Homo Sapiens
KMKDKLKKI

SEQ ID NO: 491150 - protein, 9 aa, Homo Sapiens
KAGCFADLN

SEQ ID NO: 491151 - protein, 9 aa, Homo Sapiens
ISFSGTVTF

SEQ ID NO: 491152 - protein, 9 aa, Homo Sapiens
PFVLISDMA

SEQ ID NO: 491153 - protein, 9 aa, Homo Sapiens
SSPALSIVE

SEQ ID NO: 491154 - protein, 9 aa, Homo Sapiens
QNLTLQAPG

SEQ ID NO: 491155 - protein, 9 aa, Homo Sapiens
AGIIFIIDD

SEQ ID NO: 491156 - protein, 9 aa, Homo Sapiens
TTQTPSLLL

SEQ ID NO: 491157 - protein, 9 aa, Homo Sapiens
NEKYGNIRC

SEQ ID NO: 491158 - protein, 9 aa, Homo Sapiens
AVTAIGPVN

SEQ ID NO: 491159 - protein, 9 aa, Homo Sapiens
VHQVLICVR

SEQ ID NO: 491160 - protein, 9 aa, Homo Sapiens
KIFYFAFPF

SEQ ID NO: 491161 - protein, 9 aa, Homo Sapiens
ACLFGGIIK

SEQ ID NO: 491162 - protein, 9 aa, Homo Sapiens
IATLQVDSW

SEQ ID NO: 491163 - protein, 9 aa, Homo Sapiens
FNFQGYSLD

SEQ ID NO: 491164 - protein, 9 aa, Homo Sapiens
VVSRGQLVS

SEQ ID NO: 491165 - protein, 9 aa, Homo Sapiens
HLRRVEAAA

SEQ ID NO: 491166 - protein, 9 aa, Homo Sapiens
HMFTKARGS

SEQ ID NO: 491167 - protein, 9 aa, Homo Sapiens
FLFHMAANM

SEQ ID NO: 491168 - protein, 9 aa, Homo Sapiens
LTAELVVPL

SEQ ID NO: 491169 - protein, 9 aa, Homo Sapiens
TVIAIDIDP

SEQ ID NO: 491170 - protein, 9 aa, Homo Sapiens
RVEAAATAQ

SEQ ID NO: 491171 - protein, 9 aa, Homo Sapiens
KIQTGEKPF

SEQ ID NO: 491172 - protein, 9 aa, Homo Sapiens
EKFDLRTTV

SEQ ID NO: 491173 - protein, 9 aa, Homo Sapiens
KAVDEKVRE

SEQ ID NO: 491174 - protein, 9 aa, Homo Sapiens
NLDRMGVMT

SEQ ID NO: 491175 - protein, 9 aa, Homo Sapiens
PELAVRKVG

SEQ ID NO: 491176 - protein, 9 aa, Homo Sapiens
PKSFVVAGP

SEQ ID NO: 491177 - protein, 9 aa, Homo Sapiens
RSIADAHPP

SEQ ID NO: 491178 - protein, 9 aa, Homo Sapiens
NKEMSKRNH

SEQ ID NO: 491179 - protein, 9 aa, Homo Sapiens
KLEVFATPK

SEQ ID NO: 491180 - protein, 9 aa, Homo Sapiens
SCHYQACPP

SEQ ID NO: 491181 - protein, 9 aa, Homo Sapiens
LQKVEIKNA

SEQ ID NO: 491182 - protein, 9 aa, Homo Sapiens
IGPVNASKG

SEQ ID NO: 491183 - protein, 9 aa, Homo Sapiens
FDIDTNTWM

SEQ ID NO: 491184 - protein, 9 aa, Homo Sapiens
FTDEVTSEP

SEQ ID NO: 491185 - protein, 9 aa, Homo Sapiens
IQKTLLKIG

SEQ ID NO: 491186 - protein, 9 aa, Homo Sapiens
LAYNKENLK

SEQ ID NO: 491187 - protein, 9 aa, Homo Sapiens
VLLTEVGAR

SEQ ID NO: 491188 - protein, 9 aa, Homo Sapiens
FQTIVDKEI

SEQ ID NO: 491189 - protein, 9 aa, Homo Sapiens
SAAQNLDRM

SEQ ID NO: 491190 - protein, 9 aa, Homo Sapiens
ITLSTAHVM

SEQ ID NO: 491191 - protein, 9 aa, Homo Sapiens
PGRRGQYEM

SEQ ID NO: 491192 - protein, 9 aa, Homo Sapiens
GIIFIIDDT

SEQ ID NO: 491193 - protein, 9 aa, Homo Sapiens
LLKIGYDYK

SEQ ID NO: 491194 - protein, 9 aa, Homo Sapiens
RRFLLNIQL

SEQ ID NO: 491195 - protein, 9 aa, Homo Sapiens
GAMLQTDDE

SEQ ID NO: 491196 - protein, 9 aa, Homo Sapiens
NLRRHEMIN

SEQ ID NO: 491197 - protein, 9 aa, Homo Sapiens
NMTYLEPSL

SEQ ID NO: 491198 - protein, 9 aa, Homo Sapiens
YGNSEWNTV

SEQ ID NO: 491199 - protein, 9 aa, Homo Sapiens
RFLLNIQLT

SEQ ID NO: 491200 - protein, 9 aa, Homo Sapiens
SKESSRARK

SEQ ID NO: 491201 - protein, 9 aa, Homo Sapiens
FFLFHMAAN

SEQ ID NO: 491202 - protein, 9 aa, Homo Sapiens
LLEAYLILV

SEQ ID NO: 491203 - protein, 9 aa, Homo Sapiens
NYIQKTLLK

SEQ ID NO: 491204 - protein, 9 aa, Homo Sapiens
DLGVPGLEA

SEQ ID NO: 491205 - protein, 9 aa, Homo Sapiens
CMDRSTLTL

SEQ ID NO: 491206 - protein, 9 aa, Homo Sapiens
TCPKSFVVA

SEQ ID NO: 491207 - protein, 9 aa, Homo Sapiens
IFIHTLSPG

SEQ ID NO: 491208 - protein, 9 aa, Homo Sapiens
STGYYLEGW

SEQ ID NO: 491209 - protein, 9 aa, Homo Sapiens
GFSDHMFTK

SEQ ID NO: 491210 - protein, 9 aa, Homo Sapiens
SCHLWATET

SEQ ID NO: 491211 - protein, 9 aa, Homo Sapiens
FQSIRRFLL

SEQ ID NO: 491212 - protein, 9 aa, Homo Sapiens
LQSAFVKLT

SEQ ID NO: 491213 - protein, 9 aa, Homo Sapiens
TNTLFRRNS

SEQ ID NO: 491214 - protein, 9 aa, Homo Sapiens
AAPSQTCVY

SEQ ID NO: 491215 - protein, 9 aa, Homo Sapiens
MINASVPIR

SEQ ID NO: 491216 - protein, 9 aa, Homo Sapiens
VLAGSYSFT

SEQ ID NO: 491217 - protein, 9 aa, Homo Sapiens
CMTQVFEEH

SEQ ID NO: 491218 - protein, 9 aa, Homo Sapiens
LVTKSPTFK

SEQ ID NO: 491219 - protein, 9 aa, Homo Sapiens
YFQDIEAVK

SEQ ID NO: 491220 - protein, 9 aa, Homo Sapiens
TPKGRALVS

SEQ ID NO: 491221 - protein, 9 aa, Homo Sapiens
GSQATNSEG

SEQ ID NO: 491222 - protein, 9 aa, Homo Sapiens
LGNVLSWED

SEQ ID NO: 491223 - protein, 9 aa, Homo Sapiens
VDYMEPSQN

SEQ ID NO: 491224 - protein, 9 aa, Homo Sapiens
SPPMWAPRT

SEQ ID NO: 491225 - protein, 9 aa, Homo Sapiens
STLTRTQEA

SEQ ID NO: 491226 - protein, 9 aa, Homo Sapiens
YGAMLQTDD

SEQ ID NO: 491227 - protein, 9 aa, Homo Sapiens
LIRMAMAGL

SEQ ID NO: 491228 - protein, 9 aa, Homo Sapiens
KEEACQLRE

SEQ ID NO: 491229 - protein, 9 aa, Homo Sapiens
DFYRFDIDT

SEQ ID NO: 491230 - protein, 9 aa, Homo Sapiens
TAELVVPLW

SEQ ID NO: 491231 - protein, 9 aa, Homo Sapiens
DPTRKTNCG

SEQ ID NO: 491232 - protein, 9 aa, Homo Sapiens
KTNCGYESG

SEQ ID NO: 491233 - protein, 9 aa, Homo Sapiens
FYRFDIDTN

SEQ ID NO: 491234 - protein, 9 aa, Homo Sapiens
AMVSKRENV

SEQ ID NO: 491235 - protein, 9 aa, Homo Sapiens
RISFKINVA

SEQ ID NO: 491236 - protein, 9 aa, Homo Sapiens
YMEPSQNTI

SEQ ID NO: 491237 - protein, 9 aa, Homo Sapiens
VLYICERHF

SEQ ID NO: 491238 - protein, 9 aa, Homo Sapiens
GAATSVKDL

SEQ ID NO: 491239 - protein, 9 aa, Homo Sapiens
SWPPSPPMW

SEQ ID NO: 491240 - protein, 9 aa, Homo Sapiens
KIEKELSAM

SEQ ID NO: 491241 - protein, 9 aa, Homo Sapiens
EQVLAGSYS

SEQ ID NO: 491242 - protein, 9 aa, Homo Sapiens
NASVPIRNI

SEQ ID NO: 491243 - protein, 9 aa, Homo Sapiens
LYAPPPPAP

SEQ ID NO: 491244 - protein, 9 aa, Homo Sapiens
SRARKSSSR

SEQ ID NO: 491245 - protein, 9 aa, Homo Sapiens
VLDLWTLIA

SEQ ID NO: 491246 - protein, 9 aa, Homo Sapiens
AVQKASQAF

SEQ ID NO: 491247 - protein, 9 aa, Homo Sapiens
AAHVLLTEV

SEQ ID NO: 491248 - protein, 9 aa, Homo Sapiens
DGYSQNHFR

SEQ ID NO: 491249 - protein, 9 aa, Homo Sapiens
SFQVFSNKL

SEQ ID NO: 491250 - protein, 9 aa, Homo Sapiens
VSREIVAIS

SEQ ID NO: 491251 - protein, 9 aa, Homo Sapiens
RACGLIMFR

SEQ ID NO: 491252 - protein, 9 aa, Homo Sapiens
SQDLQPLTI

SEQ ID NO: 491253 - protein, 9 aa, Homo Sapiens
LVQCLTSFT

SEQ ID NO: 491254 - protein, 9 aa, Homo Sapiens
KREMKPKSD

SEQ ID NO: 491255 - protein, 9 aa, Homo Sapiens
SHESPKPGK

SEQ ID NO: 491256 - protein, 9 aa, Homo Sapiens
LLEQRTVKM

SEQ ID NO: 491257 - protein, 9 aa, Homo Sapiens
RAKMHQDLV

SEQ ID NO: 491258 - protein, 9 aa, Homo Sapiens
APAPGTAFA

SEQ ID NO: 491259 - protein, 9 aa, Homo Sapiens
LSVPIPGGC

SEQ ID NO: 491260 - protein, 9 aa, Homo Sapiens
PELKERFCM

SEQ ID NO: 491261 - protein, 9 aa, Homo Sapiens
GIQDVLVGN

SEQ ID NO: 491262 - protein, 9 aa, Homo Sapiens
PHEGPLYAP

SEQ ID NO: 491263 - protein, 9 aa, Homo Sapiens
ADFSHHPKF

SEQ ID NO: 491264 - protein, 9 aa, Homo Sapiens
EAAEDAHLK

SEQ ID NO: 491265 - protein, 9 aa, Homo Sapiens
RNSLASKSV

SEQ ID NO: 491266 - protein, 9 aa, Homo Sapiens
QLVSVGKQN

SEQ ID NO: 491267 - protein, 9 aa, Homo Sapiens
ITCDDFKSG

SEQ ID NO: 491268 - protein, 9 aa, Homo Sapiens
KKILLNLSC

SEQ ID NO: 491269 - protein, 9 aa, Homo Sapiens
TVLTEATVG

SEQ ID NO: 491270 - protein, 9 aa, Homo Sapiens
EPLALPALD

SEQ ID NO: 491271 - protein, 9 aa, Homo Sapiens
LRTTVLYIC

SEQ ID NO: 491272 - protein, 9 aa, Homo Sapiens
YAAIKENQE

SEQ ID NO: 491273 - protein, 9 aa, Homo Sapiens
GGRELSDWF

SEQ ID NO: 491274 - protein, 9 aa, Homo Sapiens
ADPTRKTNC

SEQ ID NO: 491275 - protein, 9 aa, Homo Sapiens
TLHPEDQLA

SEQ ID NO: 491276 - protein, 9 aa, Homo Sapiens
RGRGVGRNS

SEQ ID NO: 491277 - protein, 9 aa, Homo Sapiens
RHGSPARLY

SEQ ID NO: 491278 - protein, 9 aa, Homo Sapiens
PLALPALDE

SEQ ID NO: 491279 - protein, 9 aa, Homo Sapiens
TKFPSSRRK

SEQ ID NO: 491280 - protein, 9 aa, Homo Sapiens
RQFQGPMAA

SEQ ID NO: 491281 - protein, 9 aa, Homo Sapiens
DKIINYLRK

SEQ ID NO: 491282 - protein, 9 aa, Homo Sapiens
EMRPFRFSF

SEQ ID NO: 491283 - protein, 9 aa, Homo Sapiens
VLLDHPFLL

SEQ ID NO: 491284 - protein, 9 aa, Homo Sapiens
NYFWTLCEG

SEQ ID NO: 491285 - protein, 9 aa, Homo Sapiens
FNERGERLG

SEQ ID NO: 491286 - protein, 9 aa, Homo Sapiens
IMWWESLLF

SEQ ID NO: 491287 - protein, 9 aa, Homo Sapiens
EQCEKYGPD

SEQ ID NO: 491288 - protein, 9 aa, Homo Sapiens
LELCVAWHQ

SEQ ID NO: 491289 - protein, 9 aa, Homo Sapiens
ANLQKWAAN

SEQ ID NO: 491290 - protein, 9 aa, Homo Sapiens
YAAEGTESS

SEQ ID NO: 491291 - protein, 9 aa, Homo Sapiens
VYQMMDFIN

SEQ ID NO: 491292 - protein, 9 aa, Homo Sapiens
ALFLKMAVT

SEQ ID NO: 491293 - protein, 9 aa, Homo Sapiens
TVLRTTPNY

SEQ ID NO: 491294 - protein, 9 aa, Homo Sapiens
KVQQRAQIQ

SEQ ID NO: 491295 - protein, 9 aa, Homo Sapiens
YMSSLIVGD

SEQ ID NO: 491296 - protein, 9 aa, Homo Sapiens
LYGLVHQGI

SEQ ID NO: 491297 - protein, 9 aa, Homo Sapiens
IHTLSPGSV

SEQ ID NO: 491298 - protein, 9 aa, Homo Sapiens
AHVLLTEVG

SEQ ID NO: 491299 - protein, 9 aa, Homo Sapiens
KEIFQTEIR

SEQ ID NO: 491300 - protein, 9 aa, Homo Sapiens
WTLIAGQPG

SEQ ID NO: 491301 - protein, 9 aa, Homo Sapiens
YSWAWINTH

SEQ ID NO: 491302 - protein, 9 aa, Homo Sapiens
SVAENAFSD

SEQ ID NO: 491303 - protein, 9 aa, Homo Sapiens
RLIGEKNLL

SEQ ID NO: 491304 - protein, 9 aa, Homo Sapiens
AEGRHGSPA

SEQ ID NO: 491305 - protein, 9 aa, Homo Sapiens
LAILSPEGE

SEQ ID NO: 491306 - protein, 9 aa, Homo Sapiens
RVEQECLLT

SEQ ID NO: 491307 - protein, 9 aa, Homo Sapiens
AIKKQQDFM

SEQ ID NO: 491308 - protein, 9 aa, Homo Sapiens
EMKPKSDRP

SEQ ID NO: 491309 - protein, 9 aa, Homo Sapiens
QDSLGGRVS

SEQ ID NO: 491310 - protein, 9 aa, Homo Sapiens
CSVVSDRDQ

SEQ ID NO: 491311 - protein, 9 aa, Homo Sapiens
IQDVLVGNS

SEQ ID NO: 491312 - protein, 9 aa, Homo Sapiens
ACRLVLHSR

SEQ ID NO: 491313 - protein, 9 aa, Homo Sapiens
FKIGDLTSK

SEQ ID NO: 491314 - protein, 9 aa, Homo Sapiens
PTAVTAIGP

SEQ ID NO: 491315 - protein, 9 aa, Homo Sapiens
FAAPPPQSR

SEQ ID NO: 491316 - protein, 9 aa, Homo Sapiens
QIRLLTAEL

SEQ ID NO: 491317 - protein, 9 aa, Homo Sapiens
VVQMLLVIV

SEQ ID NO: 491318 - protein, 9 aa, Homo Sapiens
GGIIKKGLV

SEQ ID NO: 491319 - protein, 9 aa, Homo Sapiens
SRMQGLVCQ

SEQ ID NO: 491320 - protein, 9 aa, Homo Sapiens
INHMSGKAV

SEQ ID NO: 491321 - protein, 9 aa, Homo Sapiens
RRNYIPQGC

SEQ ID NO: 491322 - protein, 9 aa, Homo Sapiens
DKYRITYAY

SEQ ID NO: 491323 - protein, 9 aa, Homo Sapiens
NATPDTAYR

SEQ ID NO: 491324 - protein, 9 aa, Homo Sapiens
VYDLLTIAP

SEQ ID NO: 491325 - protein, 9 aa, Homo Sapiens
KKQQDFMTT

SEQ ID NO: 491326 - protein, 9 aa, Homo Sapiens
KLRKAYGNS

SEQ ID NO: 491327 - protein, 9 aa, Homo Sapiens
ELKERFCMN

SEQ ID NO: 491328 - protein, 9 aa, Homo Sapiens
TKSQQDALL

SEQ ID NO: 491329 - protein, 9 aa, Homo Sapiens
VMRLRTKIP

SEQ ID NO: 491330 - protein, 9 aa, Homo Sapiens
TQTPSLLLY

SEQ ID NO: 491331 - protein, 9 aa, Homo Sapiens
KLFMLKIFY

SEQ ID NO: 491332 - protein, 9 aa, Homo Sapiens
FEEHFFGGA

SEQ ID NO: 491333 - protein, 9 aa, Homo Sapiens
AWNNSRVSP

SEQ ID NO: 491334 - protein, 9 aa, Homo Sapiens
ILRENNCHF

SEQ ID NO: 491335 - protein, 9 aa, Homo Sapiens
FLRTDTMFT

SEQ ID NO: 491336 - protein, 9 aa, Homo Sapiens
ELSSPFVTK

SEQ ID NO: 491337 - protein, 9 aa, Homo Sapiens
KCSHLGNNC

SEQ ID NO: 491338 - protein, 9 aa, Homo Sapiens
LATGTSGLR

SEQ ID NO: 491339 - protein, 9 aa, Homo Sapiens
LDEAAPVEF

SEQ ID NO: 491340 - protein, 9 aa, Homo Sapiens
LGLYPHVLR

SEQ ID NO: 491341 - protein, 9 aa, Homo Sapiens
QEAPKRSPL

SEQ ID NO: 491342 - protein, 9 aa, Homo Sapiens
KQQDFMTTM

SEQ ID NO: 491343 - protein, 9 aa, Homo Sapiens
GEDDSLAIK

SEQ ID NO: 491344 - protein, 9 aa, Homo Sapiens
QIAGNLMTP

SEQ ID NO: 491345 - protein, 9 aa, Homo Sapiens
YDNHIEEIS

SEQ ID NO: 491346 - protein, 9 aa, Homo Sapiens
QKIKNFHIL

SEQ ID NO: 491347 - protein, 9 aa, Homo Sapiens
LFHALFLKM

SEQ ID NO: 491348 - protein, 9 aa, Homo Sapiens
YFWTLCEGI

SEQ ID NO: 491349 - protein, 9 aa, Homo Sapiens
VSYTRVWDF

SEQ ID NO: 491350 - protein, 9 aa, Homo Sapiens
SWFGFGFCG

SEQ ID NO: 491351 - protein, 9 aa, Homo Sapiens
TQEIASRDL

SEQ ID NO: 491352 - protein, 9 aa, Homo Sapiens
FPNTFLASK

SEQ ID NO: 491353 - protein, 9 aa, Homo Sapiens
THPALDMCQ

SEQ ID NO: 491354 - protein, 9 aa, Homo Sapiens
MRLRTKIPW

SEQ ID NO: 491355 - protein, 9 aa, Homo Sapiens
APSQTCVYF

SEQ ID NO: 491356 - protein, 9 aa, Homo Sapiens
MGISWFNSH

SEQ ID NO: 491357 - protein, 9 aa, Homo Sapiens
GRELSDWFK

SEQ ID NO: 491358 - protein, 9 aa, Homo Sapiens
YTHIYIHTH

SEQ ID NO: 491359 - protein, 9 aa, Homo Sapiens
QFQGPMAAI

SEQ ID NO: 491360 - protein, 9 aa, Homo Sapiens
LEGHGVKIA

SEQ ID NO: 491361 - protein, 9 aa, Homo Sapiens
IRWTTFVSK

SEQ ID NO: 491362 - protein, 9 aa, Homo Sapiens
EKELSAMYR

SEQ ID NO: 491363 - protein, 9 aa, Homo Sapiens
YCHLEGVSR

SEQ ID NO: 491364 - protein, 9 aa, Homo Sapiens
KRNHKKKHM

SEQ ID NO: 491365 - protein, 9 aa, Homo Sapiens
FKSGEKRLI

SEQ ID NO: 491366 - protein, 9 aa, Homo Sapiens
PHTGTLHPE

SEQ ID NO: 491367 - protein, 9 aa, Homo Sapiens
QKASQAFNE

SEQ ID NO: 491368 - protein, 9 aa, Homo Sapiens
AQAHTHANP

SEQ ID NO: 491369 - protein, 9 aa, Homo Sapiens
SQLHLRRVE

SEQ ID NO: 491370 - protein, 9 aa, Homo Sapiens
RIPSLFPSP

SEQ ID NO: 491371 - protein, 9 aa, Homo Sapiens
YSQNHFRQA

SEQ ID NO: 491372 - protein, 9 aa, Homo Sapiens
DLYDNHIEE

SEQ ID NO: 491373 - protein, 9 aa, Homo Sapiens
MHQDLVFQY

SEQ ID NO: 491374 - protein, 9 aa, Homo Sapiens
DFRIYNMTY

SEQ ID NO: 491375 - protein, 9 aa, Homo Sapiens
VSDSVKKEL

SEQ ID NO: 491376 - protein, 9 aa, Homo Sapiens
QLSFQVFSN

SEQ ID NO: 491377 - protein, 9 aa, Homo Sapiens
TIHVSYTRV

SEQ ID NO: 491378 - protein, 9 aa, Homo Sapiens
SGITQKNFM

SEQ ID NO: 491379 - protein, 9 aa, Homo Sapiens
VPEESDNEL

SEQ ID NO: 491380 - protein, 9 aa, Homo Sapiens
RRKSTVSLN

SEQ ID NO: 491381 - protein, 9 aa, Homo Sapiens
GQPGLLILF

SEQ ID NO: 491382 - protein, 9 aa, Homo Sapiens
WESLLFLTA

SEQ ID NO: 491383 - protein, 9 aa, Homo Sapiens
RELRVEQEC

SEQ ID NO: 491384 - protein, 9 aa, Homo Sapiens
SKSSMSSDS

SEQ ID NO: 491385 - protein, 9 aa, Homo Sapiens
GQQQGKKKA

SEQ ID NO: 491386 - protein, 9 aa, Homo Sapiens
VQCLTSFTA

SEQ ID NO: 491387 - protein, 9 aa, Homo Sapiens
APGRRGQYE

SEQ ID NO: 491388 - protein, 9 aa, Homo Sapiens
NYMSSLIVG

SEQ ID NO: 491389 - protein, 9 aa, Homo Sapiens
QKEKKYFQD

SEQ ID NO: 491390 - protein, 9 aa, Homo Sapiens
SPHTGTLHP

SEQ ID NO: 491391 - protein, 9 aa, Homo Sapiens
MKPHRYRPG

SEQ ID NO: 491392 - protein, 9 aa, Homo Sapiens
GAPHEGPLY

SEQ ID NO: 491393 - protein, 9 aa, Homo Sapiens
LHPEDQLAS

SEQ ID NO: 491394 - protein, 9 aa, Homo Sapiens
SSPFVTKSQ

SEQ ID NO: 491395 - protein, 9 aa, Homo Sapiens
RTKIPWKTC

SEQ ID NO: 491396 - protein, 9 aa, Homo Sapiens
WVRNWQDED

SEQ ID NO: 491397 - protein, 9 aa, Homo Sapiens
GLQDGSSSC

SEQ ID NO: 491398 - protein, 9 aa, Homo Sapiens
LQACRLVLH

SEQ ID NO: 491399 - protein, 9 aa, Homo Sapiens
VHQGIKCSC

SEQ ID NO: 491400 - protein, 9 aa, Homo Sapiens
DEAAPVEFA

SEQ ID NO: 491401 - protein, 9 aa, Homo Sapiens
AAVLLMRSK

SEQ ID NO: 491402 - protein, 9 aa, Homo Sapiens
SRAIGNNFA

SEQ ID NO: 491403 - protein, 9 aa, Homo Sapiens
SANLQKWAA

SEQ ID NO: 491404 - protein, 9 aa, Homo Sapiens
NSSSSRMQG

SEQ ID NO: 491405 - protein, 9 aa, Homo Sapiens
ESTGHATPL

SEQ ID NO: 491406 - protein, 9 aa, Homo Sapiens
RKQSPARHR

SEQ ID NO: 491407 - protein, 9 aa, Homo Sapiens
VPERRGSPV

SEQ ID NO: 491408 - protein, 9 aa, Homo Sapiens
EAAIKKQQD

SEQ ID NO: 491409 - protein, 9 aa, Homo Sapiens
SRDLGVPGL

SEQ ID NO: 491410 - protein, 9 aa, Homo Sapiens
MTYRSPQAN

SEQ ID NO: 491411 - protein, 9 aa, Homo Sapiens
FNITCDDFK

SEQ ID NO: 491412 - protein, 9 aa, Homo Sapiens
QPGLLILFI

SEQ ID NO: 491413 - protein, 9 aa, Homo Sapiens
CGLIMFRRC

SEQ ID NO: 491414 - protein, 9 aa, Homo Sapiens
QIKRLLEAY

SEQ ID NO: 491415 - protein, 9 aa, Homo Sapiens
RLVEAAEDA

SEQ ID NO: 491416 - protein, 9 aa, Homo Sapiens
SHPESWPPS

SEQ ID NO: 491417 - protein, 9 aa, Homo Sapiens
MTKFPSSRR

SEQ ID NO: 491418 - protein, 9 aa, Homo Sapiens
EKMKDKLKK

SEQ ID NO: 491419 - protein, 9 aa, Homo Sapiens
AEGTESSSI

SEQ ID NO: 491420 - protein, 9 aa, Homo Sapiens
ALPALDEAA

SEQ ID NO: 491421 - protein, 9 aa, Homo Sapiens
IADAHPPGT

SEQ ID NO: 491422 - protein, 9 aa, Homo Sapiens
NCSVVSDRD

SEQ ID NO: 491423 - protein, 9 aa, Homo Sapiens
ISFKINVAQ

SEQ ID NO: 491424 - protein, 9 aa, Homo Sapiens
ESWPPSPPM

SEQ ID NO: 491425 - protein, 9 aa, Homo Sapiens
ILAILSPEG

SEQ ID NO: 491426 - protein, 9 aa, Homo Sapiens
HVSYTRVWD

SEQ ID NO: 491427 - protein, 9 aa, Homo Sapiens
APRAQHAAA

SEQ ID NO: 491428 - protein, 9 aa, Homo Sapiens
PQRKQSPAR

SEQ ID NO: 491429 - protein, 9 aa, Homo Sapiens
GRHGSPARL

SEQ ID NO: 491430 - protein, 9 aa, Homo Sapiens
MLPAGMINA

SEQ ID NO: 491431 - protein, 9 aa, Homo Sapiens
FEGIIQDGK

SEQ ID NO: 491432 - protein, 9 aa, Homo Sapiens
GWPKPTITW

SEQ ID NO: 491433 - protein, 9 aa, Homo Sapiens
TDEVTSEPL

SEQ ID NO: 491434 - protein, 9 aa, Homo Sapiens
IGNNFATSP

SEQ ID NO: 491435 - protein, 9 aa, Homo Sapiens
CFLRTDTMF

SEQ ID NO: 491436 - protein, 9 aa, Homo Sapiens
VPIPGGCNG

SEQ ID NO: 491437 - protein, 9 aa, Homo Sapiens
DLCQCQLEQ

SEQ ID NO: 491438 - protein, 9 aa, Homo Sapiens
SWSELGGGQ

SEQ ID NO: 491439 - protein, 9 aa, Homo Sapiens
RRSDSRDGT

SEQ ID NO: 491440 - protein, 9 aa, Homo Sapiens
YIYTHIYIH

SEQ ID NO: 491441 - protein, 9 aa, Homo Sapiens
NKDLGGHFF

SEQ ID NO: 491442 - protein, 9 aa, Homo Sapiens
AASRPLSPS

SEQ ID NO: 491443 - protein, 9 aa, Homo Sapiens
SLSGITQKN

SEQ ID NO: 491444 - protein, 9 aa, Homo Sapiens
EMSKRNHKK

SEQ ID NO: 491445 - protein, 9 aa, Homo Sapiens
AANKLFMLK

SEQ ID NO: 491446 - protein, 9 aa, Homo Sapiens
DWARPGCRP

SEQ ID NO: 491447 - protein, 9 aa, Homo Sapiens
VCTQCGCAF

SEQ ID NO: 491448 - protein, 9 aa, Homo Sapiens
FMLKIFYFA

SEQ ID NO: 491449 - protein, 9 aa, Homo Sapiens
EDAHLKHEF

SEQ ID NO: 491450 - protein, 9 aa, Homo Sapiens
HWPYFTDYM

SEQ ID NO: 491451 - protein, 9 aa, Homo Sapiens
PQNLTLQAP

SEQ ID NO: 491452 - protein, 9 aa, Homo Sapiens
RNQKHGLFE

SEQ ID NO: 491453 - protein, 9 aa, Homo Sapiens
CRLVLHSRC

SEQ ID NO: 491454 - protein, 9 aa, Homo Sapiens
LIGEKNLLC

SEQ ID NO: 491455 - protein, 9 aa, Homo Sapiens
AVINHMSGK

SEQ ID NO: 491456 - protein, 9 aa, Homo Sapiens
TKLMRIPSL

SEQ ID NO: 491457 - protein, 9 aa, Homo Sapiens
YQHTRSVGR

SEQ ID NO: 491458 - protein, 9 aa, Homo Sapiens
KQVRLQYQH

SEQ ID NO: 491459 - protein, 9 aa, Homo Sapiens
RTEITAYAA

SEQ ID NO: 491460 - protein, 9 aa, Homo Sapiens
PGGCNGDIQ

SEQ ID NO: 491461 - protein, 9 aa, Homo Sapiens
CFIAKTVSE

SEQ ID NO: 491462 - protein, 9 aa, Homo Sapiens
LAEGRHGSP

SEQ ID NO: 491463 - protein, 9 aa, Homo Sapiens
REHLREKKL

SEQ ID NO: 491464 - protein, 9 aa, Homo Sapiens
APVEFAAAA

SEQ ID NO: 491465 - protein, 9 aa, Homo Sapiens
STHAISSAQ

SEQ ID NO: 491466 - protein, 9 aa, Homo Sapiens
GTARRSDSR

SEQ ID NO: 491467 - protein, 9 aa, Homo Sapiens
SRCTCQGTS

SEQ ID NO: 491468 - protein, 9 aa, Homo Sapiens
GLHFHLRNG

SEQ ID NO: 491469 - protein, 9 aa, Homo Sapiens
HEMINTREK

SEQ ID NO: 491470 - protein, 9 aa, Homo Sapiens
GFNRKFKCT

SEQ ID NO: 491471 - protein, 9 aa, Homo Sapiens
LVARIVEED

SEQ ID NO: 491472 - protein, 9 aa, Homo Sapiens
RVGNTLLGM

SEQ ID NO: 491473 - protein, 9 aa, Homo Sapiens
IAQVDYMEP

SEQ ID NO: 491474 - protein, 9 aa, Homo Sapiens
RERMIRGRE

SEQ ID NO: 491475 - protein, 9 aa, Homo Sapiens
NNKDLGGHF

SEQ ID NO: 491476 - protein, 9 aa, Homo Sapiens
VTAIGPVNA

SEQ ID NO: 491477 - protein, 9 aa, Homo Sapiens
AWLHLSGTI

SEQ ID NO: 491478 - protein, 9 aa, Homo Sapiens
VTSTTVLRT

SEQ ID NO: 491479 - protein, 9 aa, Homo Sapiens
VGNSMETLI

SEQ ID NO: 491480 - protein, 9 aa, Homo Sapiens
DVLHPRSLG

SEQ ID NO: 491481 - protein, 9 aa, Homo Sapiens
GNVLSWEDK

SEQ ID NO: 491482 - protein, 9 aa, Homo Sapiens
EGGCTACKC

SEQ ID NO: 491483 - protein, 9 aa, Homo Sapiens
LGSTKSLMT

SEQ ID NO: 491484 - protein, 9 aa, Homo Sapiens
HHRKIQTGE

SEQ ID NO: 491485 - protein, 9 aa, Homo Sapiens
LSGTIKLLL

SEQ ID NO: 491486 - protein, 9 aa, Homo Sapiens
QKWAANSFE

SEQ ID NO: 491487 - protein, 9 aa, Homo Sapiens
AIGPVNASK

SEQ ID NO: 491488 - protein, 9 aa, Homo Sapiens
CTVARVTKP

SEQ ID NO: 491489 - protein, 9 aa, Homo Sapiens
SSRARKSSS

SEQ ID NO: 491490 - protein, 9 aa, Homo Sapiens
AVDEKVRER

SEQ ID NO: 491491 - protein, 9 aa, Homo Sapiens
MEDRGEDDS

SEQ ID NO: 491492 - protein, 9 aa, Homo Sapiens
QLECRIINY

SEQ ID NO: 491493 - protein, 9 aa, Homo Sapiens
KRGPSPLAG

SEQ ID NO: 491494 - protein, 9 aa, Homo Sapiens
NFQGYSLDK

SEQ ID NO: 491495 - protein, 9 aa, Homo Sapiens
LNLSCQSCT

SEQ ID NO: 491496 - protein, 9 aa, Homo Sapiens
GYSQNHFRQ

SEQ ID NO: 491497 - protein, 9 aa, Homo Sapiens
PGSWFGFGF

SEQ ID NO: 491498 - protein, 9 aa, Homo Sapiens
SDSRDGTPL

SEQ ID NO: 491499 - protein, 9 aa, Homo Sapiens
HLRNGLHHQ

SEQ ID NO: 491500 - protein, 9 aa, Homo Sapiens
MMACNYFWT

SEQ ID NO: 491501 - protein, 9 aa, Homo Sapiens
CQLRELREG

SEQ ID NO: 491502 - protein, 9 aa, Homo Sapiens
ELGGGQVPK

SEQ ID NO: 491503 - protein, 9 aa, Homo Sapiens
QVNPTKAVC

SEQ ID NO: 491504 - protein, 9 aa, Homo Sapiens
LLEMRPFRF

SEQ ID NO: 491505 - protein, 9 aa, Homo Sapiens
AVRKVGAPS

SEQ ID NO: 491506 - protein, 9 aa, Homo Sapiens
GPEADKYRI

SEQ ID NO: 491507 - protein, 9 aa, Homo Sapiens
ALDEAAPVE

SEQ ID NO: 491508 - protein, 9 aa, Homo Sapiens
DSKLEVFAT

SEQ ID NO: 491509 - protein, 9 aa, Homo Sapiens
AMYRRLFEP

SEQ ID NO: 491510 - protein, 9 aa, Homo Sapiens
AVSAGVPVE

SEQ ID NO: 491511 - protein, 9 aa, Homo Sapiens
RKVREELKS

SEQ ID NO: 491512 - protein, 9 aa, Homo Sapiens
ARLQVHQVL

SEQ ID NO: 491513 - protein, 9 aa, Homo Sapiens
ELFSEVISM

SEQ ID NO: 491514 - protein, 9 aa, Homo Sapiens
GGIGKAKLC

SEQ ID NO: 491515 - protein, 9 aa, Homo Sapiens
TSGLRAISK

SEQ ID NO: 491516 - protein, 9 aa, Homo Sapiens
LILFIRWTT

SEQ ID NO: 491517 - protein, 9 aa, Homo Sapiens
TLIAGQPGL

SEQ ID NO: 491518 - protein, 9 aa, Homo Sapiens
FTKARGSRL

SEQ ID NO: 491519 - protein, 9 aa, Homo Sapiens
RDLGVPGLE

SEQ ID NO: 491520 - protein, 9 aa, Homo Sapiens
DRAKMHQDL

SEQ ID NO: 491521 - protein, 9 aa, Homo Sapiens
RIINYMSSL

SEQ ID NO: 491522 - protein, 9 aa, Homo Sapiens
SHHCTVARV

SEQ ID NO: 491523 - protein, 9 aa, Homo Sapiens
SAFVKLTNE

SEQ ID NO: 491524 - protein, 9 aa, Homo Sapiens
SFLLVARIV

SEQ ID NO: 491525 - protein, 9 aa, Homo Sapiens
QDFMTTMDA

SEQ ID NO: 491526 - protein, 9 aa, Homo Sapiens
KPKSDRPRK

SEQ ID NO: 491527 - protein, 9 aa, Homo Sapiens
GRLVACAAP

SEQ ID NO: 491528 - protein, 9 aa, Homo Sapiens
AAATAQQLT

SEQ ID NO: 491529 - protein, 9 aa, Homo Sapiens
NHIEEISGL

SEQ ID NO: 491530 - protein, 9 aa, Homo Sapiens
VWSLEPEDF

SEQ ID NO: 491531 - protein, 9 aa, Homo Sapiens
TQSGFNRKF

SEQ ID NO: 491532 - protein, 9 aa, Homo Sapiens
QRDVAQAHT

SEQ ID NO: 491533 - protein, 9 aa, Homo Sapiens
LRRHEMINT

SEQ ID NO: 491534 - protein, 9 aa, Homo Sapiens
RPAASGSCF

SEQ ID NO: 491535 - protein, 9 aa, Homo Sapiens
DEIKQAVSR

SEQ ID NO: 491536 - protein, 9 aa, Homo Sapiens
GTIHVSYTR

SEQ ID NO: 491537 - protein, 9 aa, Homo Sapiens
AATIILREN

SEQ ID NO: 491538 - protein, 9 aa, Homo Sapiens
TPYIPFRNA

SEQ ID NO: 491539 - protein, 9 aa, Homo Sapiens
HAAWLHLSG

SEQ ID NO: 491540 - protein, 9 aa, Homo Sapiens
SFQTIVDKE

SEQ ID NO: 491541 - protein, 9 aa, Homo Sapiens
GEFHLRVKG

SEQ ID NO: 491542 - protein, 9 aa, Homo Sapiens
LNKPNIHKT

SEQ ID NO: 491543 - protein, 9 aa, Homo Sapiens
FSDHMFTKA

SEQ ID NO: 491544 - protein, 9 aa, Homo Sapiens
PGSCASGQM

SEQ ID NO: 491545 - protein, 9 aa, Homo Sapiens
PTASRCTCQ

SEQ ID NO: 491546 - protein, 9 aa, Homo Sapiens
ATGGVMKPH

SEQ ID NO: 491547 - protein, 9 aa, Homo Sapiens
LFHTVYCHL

SEQ ID NO: 491548 - protein, 9 aa, Homo Sapiens
AVFSCPWRS

SEQ ID NO: 491549 - protein, 9 aa, Homo Sapiens
RLQYQHTRS

SEQ ID NO: 491550 - protein, 9 aa, Homo Sapiens
YNKEMSKRN

SEQ ID NO: 491551 - protein, 9 aa, Homo Sapiens
QRKQSPARH

SEQ ID NO: 491552 - protein, 9 aa, Homo Sapiens
LKFPRSWRL

SEQ ID NO: 491553 - protein, 9 aa, Homo Sapiens
SRSAAQNLD

SEQ ID NO: 491554 - protein, 9 aa, Homo Sapiens
KWVTEILSQ

SEQ ID NO: 491555 - protein, 9 aa, Homo Sapiens
ELRVEQECL

SEQ ID NO: 491556 - protein, 9 aa, Homo Sapiens
RELSDWFKI

SEQ ID NO: 491557 - protein, 9 aa, Homo Sapiens
GTSPHTGTL

SEQ ID NO: 491558 - protein, 9 aa, Homo Sapiens
SPSTSSASS

SEQ ID NO: 491559 - protein, 9 aa, Homo Sapiens
PEEERICYS

SEQ ID NO: 491560 - protein, 9 aa, Homo Sapiens
LRRVEAAAT

SEQ ID NO: 491561 - protein, 9 aa, Homo Sapiens
MDRSTLTLR

SEQ ID NO: 491562 - protein, 9 aa, Homo Sapiens
MCIFTCTHA

SEQ ID NO: 491563 - protein, 9 aa, Homo Sapiens
MLRILHTLN

SEQ ID NO: 491564 - protein, 9 aa, Homo Sapiens
LLSCSTGYY

SEQ ID NO: 491565 - protein, 9 aa, Homo Sapiens
GFLWFQIPI

SEQ ID NO: 491566 - protein, 9 aa, Homo Sapiens
FPKSMEISF

SEQ ID NO: 491567 - protein, 9 aa, Homo Sapiens
KENDFAQFG

SEQ ID NO: 491568 - protein, 9 aa, Homo Sapiens
GCNGDIQQV

SEQ ID NO: 491569 - protein, 9 aa, Homo Sapiens
QLTAVDGLG

SEQ ID NO: 491570 - protein, 9 aa, Homo Sapiens
WVTEILSQI

SEQ ID NO: 491571 - protein, 9 aa, Homo Sapiens
TELFSEVIS

SEQ ID NO: 491572 - protein, 9 aa, Homo Sapiens
TMTTINTNL

SEQ ID NO: 491573 - protein, 9 aa, Homo Sapiens
IASRDLGVP

SEQ ID NO: 491574 - protein, 9 aa, Homo Sapiens
LSEEQALRE

SEQ ID NO: 491575 - protein, 9 aa, Homo Sapiens
SGRSSPALS

SEQ ID NO: 491576 - protein, 9 aa, Homo Sapiens
ILESRHPGS

SEQ ID NO: 491577 - protein, 9 aa, Homo Sapiens
SLFPSPEEP

SEQ ID NO: 491578 - protein, 9 aa, Homo Sapiens
KESSRARKS

SEQ ID NO: 491579 - protein, 9 aa, Homo Sapiens
HLREKKLNS

SEQ ID NO: 491580 - protein, 9 aa, Homo Sapiens
DFWEKPPLP

SEQ ID NO: 491581 - protein, 9 aa, Homo Sapiens
NTFLASKME

SEQ ID NO: 491582 - protein, 9 aa, Homo Sapiens
EKVGDIVDV

SEQ ID NO: 491583 - protein, 9 aa, Homo Sapiens
RRLVEAAED

SEQ ID NO: 491584 - protein, 9 aa, Homo Sapiens
ASGSCFLRT

SEQ ID NO: 491585 - protein, 9 aa, Homo Sapiens
PSGRSSPAL

SEQ ID NO: 491586 - protein, 9 aa, Homo Sapiens
DFKSGEKRL

SEQ ID NO: 491587 - protein, 9 aa, Homo Sapiens
VTGGDMRVD

SEQ ID NO: 491588 - protein, 9 aa, Homo Sapiens
KVCGWPKPT

SEQ ID NO: 491589 - protein, 9 aa, Homo Sapiens
WEPVFPNGK

SEQ ID NO: 491590 - protein, 9 aa, Homo Sapiens
KELSAMYRR

SEQ ID NO: 491591 - protein, 9 aa, Homo Sapiens
VSVIVTGAA

SEQ ID NO: 491592 - protein, 9 aa, Homo Sapiens
EGIIQDGKI

SEQ ID NO: 491593 - protein, 9 aa, Homo Sapiens
VRLQYQHTR

SEQ ID NO: 491594 - protein, 9 aa, Homo Sapiens
RLRTKIPWK

SEQ ID NO: 491595 - protein, 9 aa, Homo Sapiens
FSSVCSRNR

SEQ ID NO: 491596 - protein, 9 aa, Homo Sapiens
NNCHFLRVD

SEQ ID NO: 491597 - protein, 9 aa, Homo Sapiens
RREKVGDIV

SEQ ID NO: 491598 - protein, 9 aa, Homo Sapiens
CGWPKPTIT

SEQ ID NO: 491599 - protein, 9 aa, Homo Sapiens
EFNNNCKLK

SEQ ID NO: 491600 - protein, 9 aa, Homo Sapiens
AFDFWEKPP

SEQ ID NO: 491601 - protein, 9 aa, Homo Sapiens
TRSGGIATL

SEQ ID NO: 491602 - protein, 9 aa, Homo Sapiens
RVKGLAGFA

SEQ ID NO: 491603 - protein, 9 aa, Homo Sapiens
FQPELKERF

SEQ ID NO: 491604 - protein, 9 aa, Homo Sapiens
ILLNLSCQS

SEQ ID NO: 491605 - protein, 9 aa, Homo Sapiens
WFKIGDLTS

SEQ ID NO: 491606 - protein, 9 aa, Homo Sapiens
AAEGAATSV

SEQ ID NO: 491607 - protein, 9 aa, Homo Sapiens
ATTPYLVEW

SEQ ID NO: 491608 - protein, 9 aa, Homo Sapiens
PSQTCVYFC

SEQ ID NO: 491609 - protein, 9 aa, Homo Sapiens
KEEQCEKYG

SEQ ID NO: 491610 - protein, 9 aa, Homo Sapiens
TSSASSRET

SEQ ID NO: 491611 - protein, 9 aa, Homo Sapiens
VSWSELGGG

SEQ ID NO: 491612 - protein, 9 aa, Homo Sapiens
KIKNRHTGL

SEQ ID NO: 491613 - protein, 9 aa, Homo Sapiens
LVLHSRCCR

SEQ ID NO: 491614 - protein, 9 aa, Homo Sapiens
GVGRNSKQQ

SEQ ID NO: 491615 - protein, 9 aa, Homo Sapiens
PPVPACEPS

SEQ ID NO: 491616 - protein, 9 aa, Homo Sapiens
LSCSTGYYL

SEQ ID NO: 491617 - protein, 9 aa, Homo Sapiens
SQTCVYFCA

SEQ ID NO: 491618 - protein, 9 aa, Homo Sapiens
YGLVHQGIK

SEQ ID NO: 491619 - protein, 9 aa, Homo Sapiens
LVEAAEDAH

SEQ ID NO: 491620 - protein, 9 aa, Homo Sapiens
GISWFNSHS

SEQ ID NO: 491621 - protein, 9 aa, Homo Sapiens
RNWQDEDVY

SEQ ID NO: 491622 - protein, 9 aa, Homo Sapiens
EKPPVPACE

SEQ ID NO: 491623 - protein, 9 aa, Homo Sapiens
AVEAYTRTL

SEQ ID NO: 491624 - protein, 9 aa, Homo Sapiens
CVSQDLQPL

SEQ ID NO: 491625 - protein, 9 aa, Homo Sapiens
DDIAQVDYM

SEQ ID NO: 491626 - protein, 9 aa, Homo Sapiens
SMEDRGEDD

SEQ ID NO: 491627 - protein, 9 aa, Homo Sapiens
RLGAVFSCP

SEQ ID NO: 491628 - protein, 9 aa, Homo Sapiens
QPELKERFC

SEQ ID NO: 491629 - protein, 9 aa, Homo Sapiens
KKRALSMSP

SEQ ID NO: 491630 - protein, 9 aa, Homo Sapiens
NWQDEDVYR

SEQ ID NO: 491631 - protein, 9 aa, Homo Sapiens
TVSEYNFPQ

SEQ ID NO: 491632 - protein, 9 aa, Homo Sapiens
LGSPQNLTL

SEQ ID NO: 491633 - protein, 9 aa, Homo Sapiens
FFGTIHVSY

SEQ ID NO: 491634 - protein, 9 aa, Homo Sapiens
PKSDRPRKV

SEQ ID NO: 491635 - protein, 9 aa, Homo Sapiens
RERPLVTKS

SEQ ID NO: 491636 - protein, 9 aa, Homo Sapiens
AEGDRGPRA

SEQ ID NO: 491637 - protein, 9 aa, Homo Sapiens
ESSRARKSS

SEQ ID NO: 491638 - protein, 9 aa, Homo Sapiens
ELTCPKSFV

SEQ ID NO: 491639 - protein, 9 aa, Homo Sapiens
LHVTDASSE

SEQ ID NO: 491640 - protein, 9 aa, Homo Sapiens
RLFHALFLK

SEQ ID NO: 491641 - protein, 9 aa, Homo Sapiens
RALVSDSVK

SEQ ID NO: 491642 - protein, 9 aa, Homo Sapiens
LQEAPKRSP

SEQ ID NO: 491643 - protein, 9 aa, Homo Sapiens
GNSEWNTVE

SEQ ID NO: 491644 - protein, 9 aa, Homo Sapiens
TACKCSHLG

SEQ ID NO: 491645 - protein, 9 aa, Homo Sapiens
FQGYSLDKL

SEQ ID NO: 491646 - protein, 9 aa, Homo Sapiens
CVTHLAEGR

SEQ ID NO: 491647 - protein, 9 aa, Homo Sapiens
KEARKKAFA

SEQ ID NO: 491648 - protein, 9 aa, Homo Sapiens
RMAMAGLVL

SEQ ID NO: 491649 - protein, 9 aa, Homo Sapiens
AQFGQDAVP

SEQ ID NO: 491650 - protein, 9 aa, Homo Sapiens
EQALRELAL

SEQ ID NO: 491651 - protein, 9 aa, Homo Sapiens
PVPACEPSL

SEQ ID NO: 491652 - protein, 9 aa, Homo Sapiens
VGDIVDVLS

SEQ ID NO: 491653 - protein, 9 aa, Homo Sapiens
LRENNCHFL

SEQ ID NO: 491654 - protein, 9 aa, Homo Sapiens
GNLMTPPIS

SEQ ID NO: 491655 - protein, 9 aa, Homo Sapiens
MAMAGLVLV

SEQ ID NO: 491656 - protein, 9 aa, Homo Sapiens
RNGTEAFDF

SEQ ID NO: 491657 - protein, 9 aa, Homo Sapiens
NHMSGKAVS

SEQ ID NO: 491658 - protein, 9 aa, Homo Sapiens
NLTFLDLCQ

SEQ ID NO: 491659 - protein, 9 aa, Homo Sapiens
LFEHHKAVD

SEQ ID NO: 491660 - protein, 9 aa, Homo Sapiens
ITMFFNGLA

SEQ ID NO: 491661 - protein, 9 aa, Homo Sapiens
HQCPGGAHA

SEQ ID NO: 491662 - protein, 9 aa, Homo Sapiens
VSEYNFPQF

SEQ ID NO: 491663 - protein, 9 aa, Homo Sapiens
KIKNFHILP

SEQ ID NO: 491664 - protein, 9 aa, Homo Sapiens
TIAEQAVSA

SEQ ID NO: 491665 - protein, 9 aa, Homo Sapiens
RKDEIKQAV

SEQ ID NO: 491666 - protein, 9 aa, Homo Sapiens
LVGNSMETL

SEQ ID NO: 491667 - protein, 9 aa, Homo Sapiens
LYDNHIEEI

SEQ ID NO: 491668 - protein, 9 aa, Homo Sapiens
IISSTHAIS

SEQ ID NO: 491669 - protein, 9 aa, Homo Sapiens
SLDKLGRVY

SEQ ID NO: 491670 - protein, 9 aa, Homo Sapiens
CMHMCIFTC

SEQ ID NO: 491671 - protein, 9 aa, Homo Sapiens
KIISSTHAI

SEQ ID NO: 491672 - protein, 9 aa, Homo Sapiens
LKREMKPKS

SEQ ID NO: 491673 - protein, 9 aa, Homo Sapiens
AAPRAQHAA

SEQ ID NO: 491674 - protein, 9 aa, Homo Sapiens
IAWGQDVLH

SEQ ID NO: 491675 - protein, 9 aa, Homo Sapiens
SSESTGHAT

SEQ ID NO: 491676 - protein, 9 aa, Homo Sapiens
IGKIKNRHT

SEQ ID NO: 491677 - protein, 9 aa, Homo Sapiens
IGSVAENAF

SEQ ID NO: 491678 - protein, 9 aa, Homo Sapiens
RDRAPFVLI

SEQ ID NO: 491679 - protein, 9 aa, Homo Sapiens
SCASGQMGP

SEQ ID NO: 491680 - protein, 9 aa, Homo Sapiens
PSPLPELAV

SEQ ID NO: 491681 - protein, 9 aa, Homo Sapiens
VPLNHKWFV

SEQ ID NO: 491682 - protein, 9 aa, Homo Sapiens
LYPHVLRKV

SEQ ID NO: 491683 - protein, 9 aa, Homo Sapiens
NPTKAVCNI

SEQ ID NO: 491684 - protein, 9 aa, Homo Sapiens
RSDSRDGTP

SEQ ID NO: 491685 - protein, 9 aa, Homo Sapiens
ESLLFLTAY

SEQ ID NO: 491686 - protein, 9 aa, Homo Sapiens
QCLTSFTAA

SEQ ID NO: 491687 - protein, 9 aa, Homo Sapiens
LESKPPRSC

SEQ ID NO: 491688 - protein, 9 aa, Homo Sapiens
EAAATAQQL

SEQ ID NO: 491689 - protein, 9 aa, Homo Sapiens
QVRLQYQHT

SEQ ID NO: 491690 - protein, 9 aa, Homo Sapiens
MFFNGLAIF

SEQ ID NO: 491691 - protein, 9 aa, Homo Sapiens
LRSIADAHP

SEQ ID NO: 491692 - protein, 9 aa, Homo Sapiens
GHGVKIARA

SEQ ID NO: 491693 - protein, 9 aa, Homo Sapiens
LETIQAQPD

SEQ ID NO: 491694 - protein, 9 aa, Homo Sapiens
KARGSRLNK

SEQ ID NO: 491695 - protein, 9 aa, Homo Sapiens
ATPDTAYRD

SEQ ID NO: 491696 - protein, 9 aa, Homo Sapiens
EKWVTEILS

SEQ ID NO: 491697 - protein, 9 aa, Homo Sapiens
FRQAQVTLI

SEQ ID NO: 491698 - protein, 9 aa, Homo Sapiens
LVMWKVQQR

SEQ ID NO: 491699 - protein, 9 aa, Homo Sapiens
KPPRSCHLW

SEQ ID NO: 491700 - protein, 9 aa, Homo Sapiens
SSTHAISSA

SEQ ID NO: 491701 - protein, 9 aa, Homo Sapiens
RPFRFSFQV

SEQ ID NO: 491702 - protein, 9 aa, Homo Sapiens
PTKAVCNIV

SEQ ID NO: 491703 - protein, 9 aa, Homo Sapiens
VYTNDILAI

SEQ ID NO: 491704 - protein, 9 aa, Homo Sapiens
DLLTIAPGR

SEQ ID NO: 491705 - protein, 9 aa, Homo Sapiens
IAGNLMTPP

SEQ ID NO: 491706 - protein, 9 aa, Homo Sapiens
LHPHKLMIM

SEQ ID NO: 491707 - protein, 9 aa, Homo Sapiens
SYSKIISST

SEQ ID NO: 491708 - protein, 9 aa, Homo Sapiens
KILLNLSCQ

SEQ ID NO: 491709 - protein, 9 aa, Homo Sapiens
DASSESTGH

SEQ ID NO: 491710 - protein, 9 aa, Homo Sapiens
GMINASVPI

SEQ ID NO: 491711 - protein, 9 aa, Homo Sapiens
GPCMDRSTL

SEQ ID NO: 491712 - protein, 9 aa, Homo Sapiens
AAPVEFAAA

SEQ ID NO: 491713 - protein, 9 aa, Homo Sapiens
AFAAPPPQS

SEQ ID NO: 491714 - protein, 9 aa, Homo Sapiens
GSSGSQATN

SEQ ID NO: 491715 - protein, 9 aa, Homo Sapiens
ATIILRENN

SEQ ID NO: 491716 - protein, 9 aa, Homo Sapiens
ILTGEGAGI

SEQ ID NO: 491717 - protein, 9 aa, Homo Sapiens
IGGRIQPKN

SEQ ID NO: 491718 - protein, 9 aa, Homo Sapiens
NAAYGSCNF

SEQ ID NO: 491719 - protein, 9 aa, Homo Sapiens
PNFQDGYIL

SEQ ID NO: 491720 - protein, 9 aa, Homo Sapiens
HPEDQLASC

SEQ ID NO: 491721 - protein, 9 aa, Homo Sapiens
LLAKKRVVQ

SEQ ID NO: 491722 - protein, 9 aa, Homo Sapiens
EKKLNSLKL

SEQ ID NO: 491723 - protein, 9 aa, Homo Sapiens
PPSREKPPV

SEQ ID NO: 491724 - protein, 9 aa, Homo Sapiens
RAIGGRIQP

SEQ ID NO: 491725 - protein, 9 aa, Homo Sapiens
SPLPELAVR

SEQ ID NO: 491726 - protein, 9 aa, Homo Sapiens
CNGDIQQVG

SEQ ID NO: 491727 - protein, 9 aa, Homo Sapiens
TGMTVIAID

SEQ ID NO: 491728 - protein, 9 aa, Homo Sapiens
DYLDRSFRA

SEQ ID NO: 491729 - protein, 9 aa, Homo Sapiens
AELQSAFVK

SEQ ID NO: 491730 - protein, 9 aa, Homo Sapiens
KFPRSWRLG

SEQ ID NO: 491731 - protein, 9 aa, Homo Sapiens
DFSAVTMER

SEQ ID NO: 491732 - protein, 9 aa, Homo Sapiens
VGHVFTATP

SEQ ID NO: 491733 - protein, 9 aa, Homo Sapiens
EFHLRVKGL

SEQ ID NO: 491734 - protein, 9 aa, Homo Sapiens
VLAGRWNCE

SEQ ID NO: 491735 - protein, 9 aa, Homo Sapiens
QQGKKKAEG

SEQ ID NO: 491736 - protein, 9 aa, Homo Sapiens
GHPRPPQGR

SEQ ID NO: 491737 - protein, 9 aa, Homo Sapiens
FGGIIKKGL

SEQ ID NO: 491738 - protein, 9 aa, Homo Sapiens
AHAAWLHLS

SEQ ID NO: 491739 - protein, 9 aa, Homo Sapiens
KLKKIAKMR

SEQ ID NO: 491740 - protein, 9 aa, Homo Sapiens
QMGPCMDRS

SEQ ID NO: 491741 - protein, 9 aa, Homo Sapiens
QEEAITLLK

SEQ ID NO: 491742 - protein, 9 aa, Homo Sapiens
REKVGDIVD

SEQ ID NO: 491743 - protein, 9 aa, Homo Sapiens
HMSGKAVSA

SEQ ID NO: 491744 - protein, 9 aa, Homo Sapiens
HQGIKCSCC

SEQ ID NO: 491745 - protein, 9 aa, Homo Sapiens
EEQCEKYGP

SEQ ID NO: 491746 - protein, 9 aa, Homo Sapiens
HQVLICVRL

SEQ ID NO: 491747 - protein, 9 aa, Homo Sapiens
TDCAGYNLI

SEQ ID NO: 491748 - protein, 9 aa, Homo Sapiens
FIAKTVSEY

SEQ ID NO: 491749 - protein, 9 aa, Homo Sapiens
KFPSSRRKS

SEQ ID NO: 491750 - protein, 9 aa, Homo Sapiens
DACYSLHEF

SEQ ID NO: 491751 - protein, 9 aa, Homo Sapiens
EVKIPEIKA

SEQ ID NO: 491752 - protein, 9 aa, Homo Sapiens
KTVSEYNFP

SEQ ID NO: 491753 - protein, 9 aa, Homo Sapiens
SPLAGLPEE

SEQ ID NO: 491754 - protein, 9 aa, Homo Sapiens
PHSRSHPES

SEQ ID NO: 491755 - protein, 9 aa, Homo Sapiens
KLAWVGHVF

SEQ ID NO: 491756 - protein, 9 aa, Homo Sapiens
KRLLEAYLI

SEQ ID NO: 491757 - protein, 9 aa, Homo Sapiens
RMQGLVCQS

SEQ ID NO: 491758 - protein, 9 aa, Homo Sapiens
TLRSISNNC

SEQ ID NO: 491759 - protein, 9 aa, Homo Sapiens
RPLSPSTSS

SEQ ID NO: 491760 - protein, 9 aa, Homo Sapiens
DAHLKHEFD

SEQ ID NO: 491761 - protein, 9 aa, Homo Sapiens
LEMRPFRFS

SEQ ID NO: 491762 - protein, 9 aa, Homo Sapiens
NFHILPCED

SEQ ID NO: 491763 - protein, 9 aa, Homo Sapiens
LAASRPLSP

SEQ ID NO: 491764 - protein, 9 aa, Homo Sapiens
FRFSFQVQL

SEQ ID NO: 491765 - protein, 9 aa, Homo Sapiens
YSLHEFSLT

SEQ ID NO: 491766 - protein, 9 aa, Homo Sapiens
EVGARLQVH

SEQ ID NO: 491767 - protein, 9 aa, Homo Sapiens
TLACLLLAK

SEQ ID NO: 491768 - protein, 9 aa, Homo Sapiens
ALYIPLLLM

SEQ ID NO: 491769 - protein, 9 aa, Homo Sapiens
HKWFVCDLT

SEQ ID NO: 491770 - protein, 9 aa, Homo Sapiens
PLAGLPEEG

SEQ ID NO: 491771 - protein, 9 aa, Homo Sapiens
GFGAGVRCS

SEQ ID NO: 491772 - protein, 9 aa, Homo Sapiens
RQGQQQGKK

SEQ ID NO: 491773 - protein, 9 aa, Homo Sapiens
YQACPPHSR

SEQ ID NO: 491774 - protein, 9 aa, Homo Sapiens
QVHQVLICV

SEQ ID NO: 491775 - protein, 9 aa, Homo Sapiens
EKEEQCEKY

SEQ ID NO: 491776 - protein, 9 aa, Homo Sapiens
ACNYFWTLC

SEQ ID NO: 491777 - protein, 9 aa, Homo Sapiens
QKHGLFEGI

SEQ ID NO: 491778 - protein, 9 aa, Homo Sapiens
DYAAEGTES

SEQ ID NO: 491779 - protein, 9 aa, Homo Sapiens
AVALSDREL

SEQ ID NO: 491780 - protein, 9 aa, Homo Sapiens
YAPPPPAPH

SEQ ID NO: 491781 - protein, 9 aa, Homo Sapiens
ENNKDLGGH

SEQ ID NO: 491782 - protein, 9 aa, Homo Sapiens
QHNVCKDYL

SEQ ID NO: 491783 - protein, 9 aa, Homo Sapiens
KNHKQLSFQ

SEQ ID NO: 491784 - protein, 9 aa, Homo Sapiens
NSMETLIQT

SEQ ID NO: 491785 - protein, 9 aa, Homo Sapiens
TSTTVLRTT

SEQ ID NO: 491786 - protein, 9 aa, Homo Sapiens
STLTLRPAA

SEQ ID NO: 491787 - protein, 9 aa, Homo Sapiens
DRGEDDSLA

SEQ ID NO: 491788 - protein, 9 aa, Homo Sapiens
CTQCGCAFR

SEQ ID NO: 491789 - protein, 9 aa, Homo Sapiens
SNNCSVVSD

SEQ ID NO: 491790 - protein, 9 aa, Homo Sapiens
RLQVHQVLI

SEQ ID NO: 491791 - protein, 9 aa, Homo Sapiens
EQECLLTAF

SEQ ID NO: 491792 - protein, 9 aa, Homo Sapiens
EDRGEDDSL

SEQ ID NO: 491793 - protein, 9 aa, Homo Sapiens
QACRLVLHS

SEQ ID NO: 491794 - protein, 9 aa, Homo Sapiens
VIRPHWPYF

SEQ ID NO: 491795 - protein, 9 aa, Homo Sapiens
CLLLAKAGC

SEQ ID NO: 491796 - protein, 9 aa, Homo Sapiens
HIEEISGLS

SEQ ID NO: 491797 - protein, 9 aa, Homo Sapiens
PLSPSTSSA

SEQ ID NO: 491798 - protein, 9 aa, Homo Sapiens
APQDGECSS

SEQ ID NO: 491799 - protein, 9 aa, Homo Sapiens
PHVLRKVRE

SEQ ID NO: 491800 - protein, 9 aa, Homo Sapiens
IRMAMAGLV

SEQ ID NO: 491801 - protein, 9 aa, Homo Sapiens
GSVAENAFS

SEQ ID NO: 491802 - protein, 9 aa, Homo Sapiens
RKRKERLMR

SEQ ID NO: 491803 - protein, 9 aa, Homo Sapiens
SKIISSTHA

SEQ ID NO: 491804 - protein, 9 aa, Homo Sapiens
YRFDIDTNT

SEQ ID NO: 491805 - protein, 9 aa, Homo Sapiens
VLLSCSTGY

SEQ ID NO: 491806 - protein, 9 aa, Homo Sapiens
HLSGTIKLL

SEQ ID NO: 491807 - protein, 9 aa, Homo Sapiens
WLHLSGTIK

SEQ ID NO: 491808 - protein, 9 aa, Homo Sapiens
FQGPMAAIS

SEQ ID NO: 491809 - protein, 9 aa, Homo Sapiens
FTRSGGIAT

SEQ ID NO: 491810 - protein, 9 aa, Homo Sapiens
LKMAVTYSR

SEQ ID NO: 491811 - protein, 9 aa, Homo Sapiens
KTFLHPHKL

SEQ ID NO: 491812 - protein, 9 aa, Homo Sapiens
ELGYLLEQR

SEQ ID NO: 491813 - protein, 9 aa, Homo Sapiens
YLTVYQMMD

SEQ ID NO: 491814 - protein, 9 aa, Homo Sapiens
VYCHLEGVS

SEQ ID NO: 491815 - protein, 9 aa, Homo Sapiens
EGDRGPRAA

SEQ ID NO: 491816 - protein, 9 aa, Homo Sapiens
IRRFLLNIQ

SEQ ID NO: 491817 - protein, 9 aa, Homo Sapiens
YQMMDFINL

SEQ ID NO: 491818 - protein, 9 aa, Homo Sapiens
ALRACGLIM

SEQ ID NO: 491819 - protein, 9 aa, Homo Sapiens
HPALDMCQE

SEQ ID NO: 491820 - protein, 9 aa, Homo Sapiens
VCGWPKPTI

SEQ ID NO: 491821 - protein, 9 aa, Homo Sapiens
ESRHPGSCA

SEQ ID NO: 491822 - protein, 9 aa, Homo Sapiens
AWVGHVFTA

SEQ ID NO: 491823 - protein, 9 aa, Homo Sapiens
AWINTHIVQ

SEQ ID NO: 491824 - protein, 9 aa, Homo Sapiens
ANFPLGSTK

SEQ ID NO: 491825 - protein, 9 aa, Homo Sapiens
SKRENVATH

SEQ ID NO: 491826 - protein, 9 aa, Homo Sapiens
HPGSCASGQ

SEQ ID NO: 491827 - protein, 9 aa, Homo Sapiens
DHMFTKARG

SEQ ID NO: 491828 - protein, 9 aa, Homo Sapiens
APHEGPLYA

SEQ ID NO: 491829 - protein, 9 aa, Homo Sapiens
SPQPSVPEE

SEQ ID NO: 491830 - protein, 9 aa, Homo Sapiens
HKQLSFQVF

SEQ ID NO: 491831 - protein, 9 aa, Homo Sapiens
VAENAFSDP

SEQ ID NO: 491832 - protein, 9 aa, Homo Sapiens
AMAGLVLVA

SEQ ID NO: 491833 - protein, 9 aa, Homo Sapiens
MTVIAIDID

SEQ ID NO: 491834 - protein, 9 aa, Homo Sapiens
TAIGPVNAS

SEQ ID NO: 491835 - protein, 9 aa, Homo Sapiens
MFRRCLIPK

SEQ ID NO: 491836 - protein, 9 aa, Homo Sapiens
QEAAVQKRV

SEQ ID NO: 491837 - protein, 9 aa, Homo Sapiens
KIRTEITAY

SEQ ID NO: 491838 - protein, 9 aa, Homo Sapiens
GTIKLLLQC

SEQ ID NO: 491839 - protein, 9 aa, Homo Sapiens
RGRGRGVGR

SEQ ID NO: 491840 - protein, 9 aa, Homo Sapiens
QSANLQKWA

SEQ ID NO: 491841 - protein, 9 aa, Homo Sapiens
STSSASSRE

SEQ ID NO: 491842 - protein, 9 aa, Homo Sapiens
FIHTLSPGS

SEQ ID NO: 491843 - protein, 9 aa, Homo Sapiens
DRGPRAARG

SEQ ID NO: 491844 - protein, 9 aa, Homo Sapiens
SLKSDFYRF

SEQ ID NO: 491845 - protein, 9 aa, Homo Sapiens
EGRHGSPAR

SEQ ID NO: 491846 - protein, 9 aa, Homo Sapiens
LAAPSQTCV

SEQ ID NO: 491847 - protein, 9 aa, Homo Sapiens
RIYNMTYLE

SEQ ID NO: 491848 - protein, 9 aa, Homo Sapiens
APATGGVMK

SEQ ID NO: 491849 - protein, 9 aa, Homo Sapiens
DRAPFVLIS

SEQ ID NO: 491850 - protein, 9 aa, Homo Sapiens
RATIEEAYC

SEQ ID NO: 491851 - protein, 9 aa, Homo Sapiens
SPQPRPPWL

SEQ ID NO: 491852 - protein, 9 aa, Homo Sapiens
TVRSLEGHG

SEQ ID NO: 491853 - protein, 9 aa, Homo Sapiens
LTGMTVIAI

SEQ ID NO: 491854 - protein, 9 aa, Homo Sapiens
LMRIPSLFP

SEQ ID NO: 491855 - protein, 9 aa, Homo Sapiens
TYRSPQANA

SEQ ID NO: 491856 - protein, 9 aa, Homo Sapiens
VLIDCEQVL

SEQ ID NO: 491857 - protein, 9 aa, Homo Sapiens
AALAWNNSR

SEQ ID NO: 491858 - protein, 9 aa, Homo Sapiens
AKAGCFADL

SEQ ID NO: 491859 - protein, 9 aa, Homo Sapiens
GQDVLHPRS

SEQ ID NO: 491860 - protein, 9 aa, Homo Sapiens
NQKHGLFEG

SEQ ID NO: 491861 - protein, 9 aa, Homo Sapiens
IYSTFGALY

SEQ ID NO: 491862 - protein, 9 aa, Homo Sapiens
CSTGYYLEG

SEQ ID NO: 491863 - protein, 9 aa, Homo Sapiens
FLDLCQCQL

SEQ ID NO: 491864 - protein, 9 aa, Homo Sapiens
EAAPVEFAA

SEQ ID NO: 491865 - protein, 9 aa, Homo Sapiens
CGTARRSDS

SEQ ID NO: 491866 - protein, 9 aa, Homo Sapiens
FAQFGQDAV

SEQ ID NO: 491867 - protein, 9 aa, Homo Sapiens
LLFLTAYFC

SEQ ID NO: 491868 - protein, 9 aa, Homo Sapiens
LTSFTAALS

SEQ ID NO: 491869 - protein, 9 aa, Homo Sapiens
INYMSSLIV

SEQ ID NO: 491870 - protein, 9 aa, Homo Sapiens
KGFSKSSMS

SEQ ID NO: 491871 - protein, 9 aa, Homo Sapiens
HESPKPGKF

SEQ ID NO: 491872 - protein, 9 aa, Homo Sapiens
KSSSRSGLS

SEQ ID NO: 491873 - protein, 9 aa, Homo Sapiens
FFPLCLSSK

SEQ ID NO: 491874 - protein, 9 aa, Homo Sapiens
VPACEPSLP

SEQ ID NO: 491875 - protein, 9 aa, Homo Sapiens
ERPLVTKSP

SEQ ID NO: 491876 - protein, 9 aa, Homo Sapiens
KSPTFKFSK

SEQ ID NO: 491877 - protein, 9 aa, Homo Sapiens
WTTFVSKGE

SEQ ID NO: 491878 - protein, 9 aa, Homo Sapiens
RARKSSSRS

SEQ ID NO: 491879 - protein, 9 aa, Homo Sapiens
IKCSCCEMN

SEQ ID NO: 491880 - protein, 9 aa, Homo Sapiens
SMMYKEGKF

SEQ ID NO: 491881 - protein, 9 aa, Homo Sapiens
SGPNFQDGY

SEQ ID NO: 491882 - protein, 9 aa, Homo Sapiens
MNYIQKTLL

SEQ ID NO: 491883 - protein, 9 aa, Homo Sapiens
RMLRILHTL

SEQ ID NO: 491884 - protein, 9 aa, Homo Sapiens
LAGLPEEGP

SEQ ID NO: 491885 - protein, 9 aa, Homo Sapiens
PSREKPPVP

SEQ ID NO: 491886 - protein, 9 aa, Homo Sapiens
KKLNSLKLK

SEQ ID NO: 491887 - protein, 9 aa, Homo Sapiens
VTALLTVFH

SEQ ID NO: 491888 - protein, 9 aa, Homo Sapiens
AAEGTESSS

SEQ ID NO: 491889 - protein, 9 aa, Homo Sapiens
QQDFMTTMD

SEQ ID NO: 491890 - protein, 9 aa, Homo Sapiens
YTRTLEIQP

SEQ ID NO: 491891 - protein, 9 aa, Homo Sapiens
QDVLHPRSL

SEQ ID NO: 491892 - protein, 9 aa, Homo Sapiens
TGYYLEGWR

SEQ ID NO: 491893 - protein, 9 aa, Homo Sapiens
NIHKTVLTE

SEQ ID NO: 491894 - protein, 9 aa, Homo Sapiens
EAFDFWEKP

SEQ ID NO: 491895 - protein, 9 aa, Homo Sapiens
VNPTKAVCN

SEQ ID NO: 491896 - protein, 9 aa, Homo Sapiens
TQCGCAFRE

SEQ ID NO: 491897 - protein, 9 aa, Homo Sapiens
IPFRNAAYG

SEQ ID NO: 491898 - protein, 9 aa, Homo Sapiens
TKKRALSMS

SEQ ID NO: 491899 - protein, 9 aa, Homo Sapiens
CQHNVCKDY

SEQ ID NO: 491900 - protein, 9 aa, Homo Sapiens
LREKKLNSL

SEQ ID NO: 491901 - protein, 9 aa, Homo Sapiens
MQGLVCQSC

SEQ ID NO: 491902 - protein, 9 aa, Homo Sapiens
DFAQFGQDA

SEQ ID NO: 491903 - protein, 9 aa, Homo Sapiens
LRCGTARRS

SEQ ID NO: 491904 - protein, 9 aa, Homo Sapiens
DYMEPSQNT

SEQ ID NO: 491905 - protein, 9 aa, Homo Sapiens
LQDGSSSCD

SEQ ID NO: 491906 - protein, 9 aa, Homo Sapiens
QGTSPHTGT

SEQ ID NO: 491907 - protein, 9 aa, Homo Sapiens
GVCFIAKTV

SEQ ID NO: 491908 - protein, 9 aa, Homo Sapiens
HIVQLLPLG

SEQ ID NO: 491909 - protein, 9 aa, Homo Sapiens
PFVTKSQQD

SEQ ID NO: 491910 - protein, 9 aa, Homo Sapiens
NHKWFVCDL

SEQ ID NO: 491911 - protein, 9 aa, Homo Sapiens
SSRSHVTAL

SEQ ID NO: 491912 - protein, 9 aa, Homo Sapiens
KRVVQMLLV

SEQ ID NO: 491913 - protein, 9 aa, Homo Sapiens
AGMINASVP

SEQ ID NO: 491914 - protein, 9 aa, Homo Sapiens
ARNQNFMYM

SEQ ID NO: 491915 - protein, 9 aa, Homo Sapiens
VEVPLNHKW

SEQ ID NO: 491916 - protein, 9 aa, Homo Sapiens
GIFIHTLSP

SEQ ID NO: 491917 - protein, 9 aa, Homo Sapiens
LTLQAPGEP

SEQ ID NO: 491918 - protein, 9 aa, Homo Sapiens
LQCVTHLAE

SEQ ID NO: 491919 - protein, 9 aa, Homo Sapiens
LTGEGAGII

SEQ ID NO: 491920 - protein, 9 aa, Homo Sapiens
SIELTCPKS

SEQ ID NO: 491921 - protein, 9 aa, Homo Sapiens
SLEGHGVKI

SEQ ID NO: 491922 - protein, 9 aa, Homo Sapiens
LTCPKSFVV

SEQ ID NO: 491923 - protein, 9 aa, Homo Sapiens
CGFLWFQIP

SEQ ID NO: 491924 - protein, 9 aa, Homo Sapiens
CSASMMYKE

SEQ ID NO: 491925 - protein, 9 aa, Homo Sapiens
EPSGRSSPA

SEQ ID NO: 491926 - protein, 9 aa, Homo Sapiens
KEKMKDKLK

SEQ ID NO: 491927 - protein, 9 aa, Homo Sapiens
EGPLYAPPP

SEQ ID NO: 491928 - protein, 9 aa, Homo Sapiens
CPPHSRSHP

SEQ ID NO: 491929 - protein, 9 aa, Homo Sapiens
SCSASMMYK

SEQ ID NO: 491930 - protein, 9 aa, Homo Sapiens
QYQHTRSVG

SEQ ID NO: 491931 - protein, 9 aa, Homo Sapiens
YIIIMDADF

SEQ ID NO: 491932 - protein, 9 aa, Homo Sapiens
LLTIAPGRR

SEQ ID NO: 491933 - protein, 9 aa, Homo Sapiens
ASVPIRNIR

SEQ ID NO: 491934 - protein, 9 aa, Homo Sapiens
DRLFHALFL

SEQ ID NO: 491935 - protein, 9 aa, Homo Sapiens
VLRKVREEL

SEQ ID NO: 491936 - protein, 9 aa, Homo Sapiens
PYLTVYQMM

SEQ ID NO: 491937 - protein, 9 aa, Homo Sapiens
HEPLALPAL

SEQ ID NO: 491938 - protein, 9 aa, Homo Sapiens
ATAQAAEGA

SEQ ID NO: 491939 - protein, 9 aa, Homo Sapiens
LSMSPLSDA

SEQ ID NO: 491940 - protein, 9 aa, Homo Sapiens
EQIKRLLEA

SEQ ID NO: 491941 - protein, 9 aa, Homo Sapiens
HPRPPQGRP

SEQ ID NO: 491942 - protein, 9 aa, Homo Sapiens
SKLEVFATP

SEQ ID NO: 491943 - protein, 9 aa, Homo Sapiens
SGSCFLRTD

SEQ ID NO: 491944 - protein, 9 aa, Homo Sapiens
QACPPHSRS

SEQ ID NO: 491945 - protein, 9 aa, Homo Sapiens
TIILRENNC

SEQ ID NO: 491946 - protein, 9 aa, Homo Sapiens
LKSQEKQEE

SEQ ID NO: 491947 - protein, 9 aa, Homo Sapiens
LQHFFQCGT

SEQ ID NO: 491948 - protein, 9 aa, Homo Sapiens
EVPLNHKWF

SEQ ID NO: 491949 - protein, 9 aa, Homo Sapiens
TRCWLRDGL

SEQ ID NO: 491950 - protein, 9 aa, Homo Sapiens
PQPRPPWLK

SEQ ID NO: 491951 - protein, 9 aa, Homo Sapiens
LDKLGRVYA

SEQ ID NO: 491952 - protein, 9 aa, Homo Sapiens
GARGRGRGV

SEQ ID NO: 491953 - protein, 9 aa, Homo Sapiens
HHKAVDEKV

SEQ ID NO: 491954 - protein, 9 aa, Homo Sapiens
LICVRLELC

SEQ ID NO: 491955 - protein, 9 aa, Homo Sapiens
RSISNNCSV

SEQ ID NO: 491956 - protein, 9 aa, Homo Sapiens
KLLRSIADA

SEQ ID NO: 491957 - protein, 9 aa, Homo Sapiens
ECRIINYMS

SEQ ID NO: 491958 - protein, 9 aa, Homo Sapiens
RICYSQRLR

SEQ ID NO: 491959 - protein, 9 aa, Homo Sapiens
AAAFSQLHL

SEQ ID NO: 491960 - protein, 9 aa, Homo Sapiens
PHWPYFTDY

SEQ ID NO: 491961 - protein, 9 aa, Homo Sapiens
LGEFHLRVK

SEQ ID NO: 491962 - protein, 9 aa, Homo Sapiens
CVAWHQCPG

SEQ ID NO: 491963 - protein, 9 aa, Homo Sapiens
FVTKSQQDA

SEQ ID NO: 491964 - protein, 9 aa, Homo Sapiens
GRLADPTRK

SEQ ID NO: 491965 - protein, 9 aa, Homo Sapiens
SSVCSRNRH

SEQ ID NO: 491966 - protein, 9 aa, Homo Sapiens
RHPGSCASG

SEQ ID NO: 491967 - protein, 9 aa, Homo Sapiens
FPSSRRKST

SEQ ID NO: 491968 - protein, 9 aa, Homo Sapiens
ICVRLELCV

SEQ ID NO: 491969 - protein, 9 aa, Homo Sapiens
CHLWATETL

SEQ ID NO: 491970 - protein, 9 aa, Homo Sapiens
SSRMQGLVC

SEQ ID NO: 491971 - protein, 9 aa, Homo Sapiens
LTFLDLCQC

SEQ ID NO: 491972 - protein, 9 aa, Homo Sapiens
FSHHPKFIP

SEQ ID NO: 491973 - protein, 9 aa, Homo Sapiens
TLFRRNSLA

SEQ ID NO: 491974 - protein, 9 aa, Homo Sapiens
TAQQLTAVD

SEQ ID NO: 491975 - protein, 9 aa, Homo Sapiens
AFNERGERL

SEQ ID NO: 491976 - protein, 9 aa, Homo Sapiens
TKAVCNIVN

SEQ ID NO: 491977 - protein, 9 aa, Homo Sapiens
AQQLTAVDG

SEQ ID NO: 491978 - protein, 9 aa, Homo Sapiens
AAAHVLLTE

SEQ ID NO: 491979 - protein, 9 aa, Homo Sapiens
KDSAVALSD

SEQ ID NO: 491980 - protein, 9 aa, Homo Sapiens
AGYNLIHLV

SEQ ID NO: 491981 - protein, 9 aa, Homo Sapiens
ALLTVFHGR

SEQ ID NO: 491982 - protein, 9 aa, Homo Sapiens
SASMMYKEG

SEQ ID NO: 491983 - protein, 9 aa, Homo Sapiens
RSTLTLRPA

SEQ ID NO: 491984 - protein, 9 aa, Homo Sapiens
QCVTHLAEG

SEQ ID NO: 491985 - protein, 9 aa, Homo Sapiens
FAAAAFSQL

SEQ ID NO: 491986 - protein, 9 aa, Homo Sapiens
LFPSPEEPP

SEQ ID NO: 491987 - protein, 9 aa, Homo Sapiens
WWESLLFLT

SEQ ID NO: 491988 - protein, 9 aa, Homo Sapiens
QGKKKAEGG

SEQ ID NO: 491989 - protein, 9 aa, Homo Sapiens
LWTLIAGQP

SEQ ID NO: 491990 - protein, 9 aa, Homo Sapiens
QEIASRDLG

SEQ ID NO: 491991 - protein, 9 aa, Homo Sapiens
HLWATETLS

SEQ ID NO: 491992 - protein, 9 aa, Homo Sapiens
LRILHTLNS

SEQ ID NO: 491993 - protein, 9 aa, Homo Sapiens
KDKLKKIAK

SEQ ID NO: 491994 - protein, 9 aa, Homo Sapiens
ATKTFLHPH

SEQ ID NO: 491995 - protein, 9 aa, Homo Sapiens
IGEKNLLCI

SEQ ID NO: 491996 - protein, 9 aa, Homo Sapiens
KNLLCITKD

SEQ ID NO: 491997 - protein, 9 aa, Homo Sapiens
RSHHCTVAR

SEQ ID NO: 491998 - protein, 9 aa, Homo Sapiens
SREKPPVPA

SEQ ID NO: 491999 - protein, 9 aa, Homo Sapiens
EETHKIGSV

SEQ ID NO: 492000 - protein, 9 aa, Homo Sapiens
GTEAFDFWE

SEQ ID NO: 492001 - protein, 9 aa, Homo Sapiens
RPPQGRPQG

SEQ ID NO: 492002 - protein, 9 aa, Homo Sapiens
SGSQATNSE

SEQ ID NO: 492003 - protein, 9 aa, Homo Sapiens
PSSRRKSTV

SEQ ID NO: 492004 - protein, 9 aa, Homo Sapiens
CKDYLDRSF

SEQ ID NO: 492005 - protein, 9 aa, Homo Sapiens
SMSPLSDAS

SEQ ID NO: 492006 - protein, 9 aa, Homo Sapiens
YRAIGGRIQ

SEQ ID NO: 492007 - protein, 9 aa, Homo Sapiens
PRSCHLWAT

SEQ ID NO: 492008 - protein, 9 aa, Homo Sapiens
AAPAPGTAF

SEQ ID NO: 492009 - protein, 9 aa, Homo Sapiens
CFLRLGAVF

SEQ ID NO: 492010 - protein, 9 aa, Homo Sapiens
RHEMINTRE

SEQ ID NO: 492011 - protein, 9 aa, Homo Sapiens
PARLYLTGA

SEQ ID NO: 492012 - protein, 9 aa, Homo Sapiens
ISWFNSHSI

SEQ ID NO: 492013 - protein, 9 aa, Homo Sapiens
ITYAYFAGG

SEQ ID NO: 492014 - protein, 9 aa, Homo Sapiens
LIMFRRCLI

SEQ ID NO: 492015 - protein, 9 aa, Homo Sapiens
LRTTPNYSH

SEQ ID NO: 492016 - protein, 9 aa, Homo Sapiens
AKLCSMKER

SEQ ID NO: 492017 - protein, 9 aa, Homo Sapiens
NFMYMRQLS

SEQ ID NO: 492018 - protein, 9 aa, Homo Sapiens
TLGSPQNLT

SEQ ID NO: 492019 - protein, 9 aa, Homo Sapiens
EISFSGTVT

SEQ ID NO: 492020 - protein, 9 aa, Homo Sapiens
GTSGLRAIS

SEQ ID NO: 492021 - protein, 9 aa, Homo Sapiens
EEERICYSQ

SEQ ID NO: 492022 - protein, 9 aa, Homo Sapiens
VLICVRLEL

SEQ ID NO: 492023 - protein, 9 aa, Homo Sapiens
FGQDAVPES

SEQ ID NO: 492024 - protein, 9 aa, Homo Sapiens
FWTLCEGIY

SEQ ID NO: 492025 - protein, 9 aa, Homo Sapiens
VEQECLLTA

SEQ ID NO: 492026 - protein, 9 aa, Homo Sapiens
CDSDLSLSS

SEQ ID NO: 492027 - protein, 9 aa, Homo Sapiens
HGSPARLYL

SEQ ID NO: 492028 - protein, 9 aa, Homo Sapiens
GLGRLVACA

SEQ ID NO: 492029 - protein, 9 aa, Homo Sapiens
RPLVTKSPT

SEQ ID NO: 492030 - protein, 9 aa, Homo Sapiens
TAQVLLDHP

SEQ ID NO: 492031 - protein, 9 aa, Homo Sapiens
YLDRSFRAQ

SEQ ID NO: 492032 - protein, 9 aa, Homo Sapiens
TQEAAVQKR

SEQ ID NO: 492033 - protein, 9 aa, Homo Sapiens
WSELGGGQV

SEQ ID NO: 492034 - protein, 9 aa, Homo Sapiens
SELGGGQVP

SEQ ID NO: 492035 - protein, 9 aa, Homo Sapiens
QPLTILYYI

SEQ ID NO: 492036 - protein, 9 aa, Homo Sapiens
SRGQLVSVG

SEQ ID NO: 492037 - protein, 9 aa, Homo Sapiens
FSLTGNPLL

SEQ ID NO: 492038 - protein, 9 aa, Homo Sapiens
MEPEEERIC

SEQ ID NO: 492039 - protein, 9 aa, Homo Sapiens
FLRLGAVFS

SEQ ID NO: 492040 - protein, 9 aa, Homo Sapiens
QSAFVKLTN

SEQ ID NO: 492041 - protein, 9 aa, Homo Sapiens
QQQGKKKAE

SEQ ID NO: 492042 - protein, 9 aa, Homo Sapiens
PNTFLASKM

SEQ ID NO: 492043 - protein, 9 aa, Homo Sapiens
LEPEDFSAV

SEQ ID NO: 492044 - protein, 9 aa, Homo Sapiens
VMWKVQQRA

SEQ ID NO: 492045 - protein, 9 aa, Homo Sapiens
TTEPSGRSS

SEQ ID NO: 492046 - protein, 9 aa, Homo Sapiens
VKIEKELSA

SEQ ID NO: 492047 - protein, 9 aa, Homo Sapiens
TFLDLCQCQ

SEQ ID NO: 492048 - protein, 9 aa, Homo Sapiens
LLGNVLSWE

SEQ ID NO: 492049 - protein, 9 aa, Homo Sapiens
GGVMKPHRY

SEQ ID NO: 492050 - protein, 9 aa, Homo Sapiens
HLRVKGLAG

SEQ ID NO: 492051 - protein, 9 aa, Homo Sapiens
ISLDLYDNH

SEQ ID NO: 492052 - protein, 9 aa, Homo Sapiens
YFFGTIHVS

SEQ ID NO: 492053 - protein, 9 aa, Homo Sapiens
GYNLIHLVA

SEQ ID NO: 492054 - protein, 9 aa, Homo Sapiens
TLSTAHVMP

SEQ ID NO: 492055 - protein, 9 aa, Homo Sapiens
GRWNCEGTA

SEQ ID NO: 492056 - protein, 9 aa, Homo Sapiens
LLVARIVEE

SEQ ID NO: 492057 - protein, 9 aa, Homo Sapiens
PPSPPMWAP

SEQ ID NO: 492058 - protein, 9 aa, Homo Sapiens
ALVSDSVKK

SEQ ID NO: 492059 - protein, 9 aa, Homo Sapiens
EIKNATPDT

SEQ ID NO: 492060 - protein, 9 aa, Homo Sapiens
HGVKIARAL

SEQ ID NO: 492061 - protein, 9 aa, Homo Sapiens
TKDHRERMI

SEQ ID NO: 492062 - protein, 9 aa, Homo Sapiens
DTMFTSPKP

SEQ ID NO: 492063 - protein, 9 aa, Homo Sapiens
IIIMDADFS

SEQ ID NO: 492064 - protein, 9 aa, Homo Sapiens
HVTDASSES

SEQ ID NO: 492065 - protein, 9 aa, Homo Sapiens
GPSPLAGLP

SEQ ID NO: 492066 - protein, 9 aa, Homo Sapiens
RILHTLNST

SEQ ID NO: 492067 - protein, 9 aa, Homo Sapiens
RGQLVSVGK

SEQ ID NO: 492068 - protein, 9 aa, Homo Sapiens
SKEFNNNCK

SEQ ID NO: 492069 - protein, 9 aa, Homo Sapiens
TAQAAEGAA

SEQ ID NO: 492070 - protein, 9 aa, Homo Sapiens
VLESKPPRS

SEQ ID NO: 492071 - protein, 9 aa, Homo Sapiens
DIAQVDYME

SEQ ID NO: 492072 - protein, 9 aa, Homo Sapiens
SFTAALSLE

SEQ ID NO: 492073 - protein, 9 aa, Homo Sapiens
NGLAIFLYK

SEQ ID NO: 492074 - protein, 9 aa, Homo Sapiens
KINVAQLKF

SEQ ID NO: 492075 - protein, 9 aa, Homo Sapiens
HQKIKNFHI

SEQ ID NO: 492076 - protein, 9 aa, Homo Sapiens
NDGYSQNHF

SEQ ID NO: 492077 - protein, 9 aa, Homo Sapiens
LALPALDEA

SEQ ID NO: 492078 - protein, 9 aa, Homo Sapiens
GECSSPGRG

SEQ ID NO: 492079 - protein, 9 aa, Homo Sapiens
PTRKTNCGY

SEQ ID NO: 492080 - protein, 9 aa, Homo Sapiens
GARLQVHQV

SEQ ID NO: 492081 - protein, 9 aa, Homo Sapiens
AQNLDRMGV

SEQ ID NO: 492082 - protein, 9 aa, Homo Sapiens
TEPSGRSSP

SEQ ID NO: 492083 - protein, 9 aa, Homo Sapiens
QILESRHPG

SEQ ID NO: 492084 - protein, 9 aa, Homo Sapiens
LRACGLIMF

SEQ ID NO: 492085 - protein, 9 aa, Homo Sapiens
SLAHHRKIQ

SEQ ID NO: 492086 - protein, 9 aa, Homo Sapiens
GMTVIAIDI

SEQ ID NO: 492087 - protein, 9 aa, Homo Sapiens
LPTTMGISW

SEQ ID NO: 492088 - protein, 9 aa, Homo Sapiens
QQLTAVDGL

SEQ ID NO: 492089 - protein, 9 aa, Homo Sapiens
INYLRKRKE

SEQ ID NO: 492090 - protein, 9 aa, Homo Sapiens
FKINVAQLK

SEQ ID NO: 492091 - protein, 9 aa, Homo Sapiens
QTHPALDMC

SEQ ID NO: 492092 - protein, 9 aa, Homo Sapiens
PATGGVMKP

SEQ ID NO: 492093 - protein, 9 aa, Homo Sapiens
SCSTGYYLE

SEQ ID NO: 492094 - protein, 9 aa, Homo Sapiens
LQKWAANSF

SEQ ID NO: 492095 - protein, 9 aa, Homo Sapiens
SSRRKSTVS

SEQ ID NO: 492096 - protein, 9 aa, Homo Sapiens
SVDFTDEVT

SEQ ID NO: 492097 - protein, 9 aa, Homo Sapiens
VQMLLVIVV

SEQ ID NO: 492098 - protein, 9 aa, Homo Sapiens
VLRTTPNYS

SEQ ID NO: 492099 - protein, 9 aa, Homo Sapiens
DKEIFQTEI

SEQ ID NO: 492100 - protein, 9 aa, Homo Sapiens
RFTRSGGIA

SEQ ID NO: 492101 - protein, 9 aa, Homo Sapiens
SLFEHHKAV

SEQ ID NO: 492102 - protein, 9 aa, Homo Sapiens
AATAQAAEG

SEQ ID NO: 492103 - protein, 9 aa, Homo Sapiens
NHKQLSFQV

SEQ ID NO: 492104 - protein, 9 aa, Homo Sapiens
IQILESRHP

SEQ ID NO: 492105 - protein, 9 aa, Homo Sapiens
LAELQSAFV

SEQ ID NO: 492106 - protein, 9 aa, Homo Sapiens
RCEDIHSMR

SEQ ID NO: 492107 - protein, 9 aa, Homo Sapiens
EIGKIKNRH

SEQ ID NO: 492108 - protein, 9 aa, Homo Sapiens
RGPSPLAGL

SEQ ID NO: 492109 - protein, 9 aa, Homo Sapiens
ICYSQRLRG

SEQ ID NO: 492110 - protein, 9 aa, Homo Sapiens
NYAKEEACQ

SEQ ID NO: 492111 - protein, 9 aa, Homo Sapiens
QTDDEDDLM

SEQ ID NO: 492112 - protein, 9 aa, Homo Sapiens
KMPEVKIPE

SEQ ID NO: 492113 - protein, 9 aa, Homo Sapiens
RELGYLLEQ

SEQ ID NO: 492114 - protein, 9 aa, Homo Sapiens
MRPFRFSFQ

SEQ ID NO: 492115 - protein, 9 aa, Homo Sapiens
LPALDEAAP

SEQ ID NO: 492116 - protein, 9 aa, Homo Sapiens
KKYFQDIEA

SEQ ID NO: 492117 - protein, 9 aa, Homo Sapiens
HLAYNKENL

SEQ ID NO: 492118 - protein, 9 aa, Homo Sapiens
DSMEDRGED

SEQ ID NO: 492119 - protein, 9 aa, Homo Sapiens
QWEPVFPNG

SEQ ID NO: 492120 - protein, 9 aa, Homo Sapiens
NMMTNVREN

SEQ ID NO: 492121 - protein, 9 aa, Homo Sapiens
RLLTAELVV

SEQ ID NO: 492122 - protein, 9 aa, Homo Sapiens
CSMKERKLE

SEQ ID NO: 492123 - protein, 9 aa, Homo Sapiens
QVKLQHFFQ

SEQ ID NO: 492124 - protein, 9 aa, Homo Sapiens
IAKTVSEYN

SEQ ID NO: 492125 - protein, 9 aa, Homo Sapiens
MAEERPGSW

SEQ ID NO: 492126 - protein, 9 aa, Homo Sapiens
PKRGPSPLA

SEQ ID NO: 492127 - protein, 9 aa, Homo Sapiens
LRPAASGSC

SEQ ID NO: 492128 - protein, 9 aa, Homo Sapiens
EQSANLQKW

SEQ ID NO: 492129 - protein, 9 aa, Homo Sapiens
RCWLRDGLK

SEQ ID NO: 492130 - protein, 9 aa, Homo Sapiens
KDTSRSHES

SEQ ID NO: 492131 - protein, 9 aa, Homo Sapiens
SLHEFSLTG

SEQ ID NO: 492132 - protein, 9 aa, Homo Sapiens
HVFTATPAE

SEQ ID NO: 492133 - protein, 9 aa, Homo Sapiens
EVISMWKKI

SEQ ID NO: 492134 - protein, 9 aa, Homo Sapiens
CIFTCTHAC

SEQ ID NO: 492135 - protein, 9 aa, Homo Sapiens
QGQQQGKKK

SEQ ID NO: 492136 - protein, 9 aa, Homo Sapiens
TIKLLLQCV

SEQ ID NO: 492137 - protein, 9 aa, Homo Sapiens
LITLSTAHV

SEQ ID NO: 492138 - protein, 9 aa, Homo Sapiens
YQSAALAWN

SEQ ID NO: 492139 - protein, 9 aa, Homo Sapiens
NKPNIHKTV

SEQ ID NO: 492140 - protein, 9 aa, Homo Sapiens
PQDGECSSP

SEQ ID NO: 492141 - protein, 9 aa, Homo Sapiens
NSEWNTVER

SEQ ID NO: 492142 - protein, 9 aa, Homo Sapiens
LGGGQVPKG

SEQ ID NO: 492143 - protein, 9 aa, Homo Sapiens
HKAVDEKVR

SEQ ID NO: 492144 - protein, 9 aa, Homo Sapiens
PEEKKKILL

SEQ ID NO: 492145 - protein, 9 aa, Homo Sapiens
NNCKLKERI

SEQ ID NO: 492146 - protein, 9 aa, Homo Sapiens
VWVRNWQDE

SEQ ID NO: 492147 - protein, 9 aa, Homo Sapiens
LLMRSKEAR

SEQ ID NO: 492148 - protein, 9 aa, Homo Sapiens
EFSLTGNPL

SEQ ID NO: 492149 - protein, 9 aa, Homo Sapiens
RPAEGDRGP

SEQ ID NO: 492150 - protein, 9 aa, Homo Sapiens
KFNFQGYSL

SEQ ID NO: 492151 - protein, 9 aa, Homo Sapiens
NLLCITKDK

SEQ ID NO: 492152 - protein, 9 aa, Homo Sapiens
INASVPIRN

SEQ ID NO: 492153 - protein, 9 aa, Homo Sapiens
FNGLAIFLY

SEQ ID NO: 492154 - protein, 9 aa, Homo Sapiens
GEQNMMTNV

SEQ ID NO: 492155 - protein, 9 aa, Homo Sapiens
SWFNSHSIY

SEQ ID NO: 492156 - protein, 9 aa, Homo Sapiens
EIKQAVSRE

SEQ ID NO: 492157 - protein, 9 aa, Homo Sapiens
HKIGSVAEN

SEQ ID NO: 492158 - protein, 9 aa, Homo Sapiens
NDFAQFGQD

SEQ ID NO: 492159 - protein, 9 aa, Homo Sapiens
FEHHKAVDE

SEQ ID NO: 492160 - protein, 9 aa, Homo Sapiens
HTVYCHLEG

SEQ ID NO: 492161 - protein, 9 aa, Homo Sapiens
QTIVDKEIF

SEQ ID NO: 492162 - protein, 9 aa, Homo Sapiens
CQCQLEQLS

SEQ ID NO: 492163 - protein, 9 aa, Homo Sapiens
SESTGHATP

SEQ ID NO: 492164 - protein, 9 aa, Homo Sapiens
KSDRPRKVR

SEQ ID NO: 492165 - protein, 9 aa, Homo Sapiens
PQGCTKFYE

SEQ ID NO: 492166 - protein, 9 aa, Homo Sapiens
AASGSCFLR

SEQ ID NO: 492167 - protein, 9 aa, Homo Sapiens
LESRHPGSC

SEQ ID NO: 492168 - protein, 9 aa, Homo Sapiens
IVDKEIFQT

SEQ ID NO: 492169 - protein, 9 aa, Homo Sapiens
KEGKFRYRR

SEQ ID NO: 492170 - protein, 9 aa, Homo Sapiens
SLGGRVSVI

SEQ ID NO: 492171 - protein, 9 aa, Homo Sapiens
KNATPDTAY

SEQ ID NO: 492172 - protein, 9 aa, Homo Sapiens
QCEKYGPDY

SEQ ID NO: 492173 - protein, 9 aa, Homo Sapiens
AAEDAHLKH

SEQ ID NO: 492174 - protein, 9 aa, Homo Sapiens
MTNVRENNY

SEQ ID NO: 492175 - protein, 9 aa, Homo Sapiens
EATDCAGYN

SEQ ID NO: 492176 - protein, 9 aa, Homo Sapiens
IPLDYAAEG

SEQ ID NO: 492177 - protein, 9 aa, Homo Sapiens
SQVKLQHFF

SEQ ID NO: 492178 - protein, 9 aa, Homo Sapiens
SVGKQNSTM

SEQ ID NO: 492179 - protein, 9 aa, Homo Sapiens
RLVACAAPR

SEQ ID NO: 492180 - protein, 9 aa, Homo Sapiens
PYLVEWEAD

SEQ ID NO: 492181 - protein, 9 aa, Homo Sapiens
ELKDTSRSH

SEQ ID NO: 492182 - protein, 9 aa, Homo Sapiens
AHTHANPRG

SEQ ID NO: 492183 - protein, 9 aa, Homo Sapiens
DILAILSPE

SEQ ID NO: 492184 - protein, 9 aa, Homo Sapiens
EDQLASCHY

SEQ ID NO: 492185 - protein, 9 aa, Homo Sapiens
QVLLDHPFL

SEQ ID NO: 492186 - protein, 9 aa, Homo Sapiens
VSKRENVAT

SEQ ID NO: 492187 - protein, 9 aa, Homo Sapiens
EERPGSWFG

SEQ ID NO: 492188 - protein, 9 aa, Homo Sapiens
KYGNIRCED

SEQ ID NO: 492189 - protein, 9 aa, Homo Sapiens
IKRLLEAYL

SEQ ID NO: 492190 - protein, 9 aa, Homo Sapiens
PSVPEESDN

SEQ ID NO: 492191 - protein, 9 aa, Homo Sapiens
SKRNHKKKH

SEQ ID NO: 492192 - protein, 9 aa, Homo Sapiens
KPPVPACEP

SEQ ID NO: 492193 - protein, 9 aa, Homo Sapiens
LHLRRVEAA

SEQ ID NO: 492194 - protein, 9 aa, Homo Sapiens
LDLCQCQLE

SEQ ID NO: 492195 - protein, 9 aa, Homo Sapiens
TVYCHLEGV

SEQ ID NO: 492196 - protein, 9 aa, Homo Sapiens
QGPMAAISF

SEQ ID NO: 492197 - protein, 9 aa, Homo Sapiens
KRSPLAASR

SEQ ID NO: 492198 - protein, 9 aa, Homo Sapiens
RCFLRLGAV

SEQ ID NO: 492199 - protein, 9 aa, Homo Sapiens
GTIENNKDL

SEQ ID NO: 492200 - protein, 9 aa, Homo Sapiens
VALSDRELP

SEQ ID NO: 492201 - protein, 9 aa, Homo Sapiens
AATAQQLTA

SEQ ID NO: 492202 - protein, 9 aa, Homo Sapiens
QRMLRILHT

SEQ ID NO: 492203 - protein, 9 aa, Homo Sapiens
TLSEEQALR

SEQ ID NO: 492204 - protein, 9 aa, Homo Sapiens
FALTGMTVI

SEQ ID NO: 492205 - protein, 9 aa, Homo Sapiens
QGGHPRPPQ

SEQ ID NO: 492206 - protein, 9 aa, Homo Sapiens
YLRKRKERL

SEQ ID NO: 492207 - protein, 9 aa, Homo Sapiens
TIQAQPDSL

SEQ ID NO: 492208 - protein, 9 aa, Homo Sapiens
LQPLTILYY

SEQ ID NO: 492209 - protein, 9 aa, Homo Sapiens
FFNGLAIFL

SEQ ID NO: 492210 - protein, 9 aa, Homo Sapiens
ALSMSPLSD

SEQ ID NO: 492211 - protein, 9 aa, Homo Sapiens
TLTRTQEAA

SEQ ID NO: 492212 - protein, 9 aa, Homo Sapiens
KASQAFNER

SEQ ID NO: 492213 - protein, 9 aa, Homo Sapiens
PGLLILFIR

SEQ ID NO: 492214 - protein, 9 aa, Homo Sapiens
HVTALLTVF

SEQ ID NO: 492215 - protein, 9 aa, Homo Sapiens
KAREKEEQC

SEQ ID NO: 492216 - protein, 9 aa, Homo Sapiens
SAGVPVEVI

SEQ ID NO: 492217 - protein, 9 aa, Homo Sapiens
FGTIHVSYT

SEQ ID NO: 492218 - protein, 9 aa, Homo Sapiens
GVIQILESR

SEQ ID NO: 492219 - protein, 9 aa, Homo Sapiens
GKLLRSIAD

SEQ ID NO: 492220 - protein, 9 aa, Homo Sapiens
SPGELDGGI

SEQ ID NO: 492221 - protein, 9 aa, Homo Sapiens
QEQARNQNF

SEQ ID NO: 492222 - protein, 9 aa, Homo Sapiens
IIMDADFSH

SEQ ID NO: 492223 - protein, 9 aa, Homo Sapiens
TEITAYAAI

SEQ ID NO: 492224 - protein, 9 aa, Homo Sapiens
DSAVALSDR

SEQ ID NO: 492225 - protein, 9 aa, Homo Sapiens
VAWHQCPGG

SEQ ID NO: 492226 - protein, 9 aa, Homo Sapiens
IPWKTCWRY

SEQ ID NO: 492227 - protein, 9 aa, Homo Sapiens
MRSKEARKK

SEQ ID NO: 492228 - protein, 9 aa, Homo Sapiens
LTLRPAASG

SEQ ID NO: 492229 - protein, 9 aa, Homo Sapiens
AETELFSEV

SEQ ID NO: 492230 - protein, 9 aa, Homo Sapiens
IENNKDLGG

SEQ ID NO: 492231 - protein, 9 aa, Homo Sapiens
MWWESLLFL

SEQ ID NO: 492232 - protein, 9 aa, Homo Sapiens
PPMWAPRTL

SEQ ID NO: 492233 - protein, 9 aa, Homo Sapiens
AYGNSEWNT

SEQ ID NO: 492234 - protein, 9 aa, Homo Sapiens
ADYRAIGGR

SEQ ID NO: 492235 - protein, 9 aa, Homo Sapiens
RHVTQSGFN

SEQ ID NO: 492236 - protein, 9 aa, Homo Sapiens
IKKQQDFMT

SEQ ID NO: 492237 - protein, 9 aa, Homo Sapiens
CQGTSPHTG

SEQ ID NO: 492238 - protein, 9 aa, Homo Sapiens
FHILPCEDD

SEQ ID NO: 492239 - protein, 9 aa, Homo Sapiens
YNMTYLEPS

SEQ ID NO: 492240 - protein, 9 aa, Homo Sapiens
TTMGISWFN

SEQ ID NO: 492241 - protein, 9 aa, Homo Sapiens
EAPKRSPLA

SEQ ID NO: 492242 - protein, 9 aa, Homo Sapiens
KDHRERMIR

SEQ ID NO: 492243 - protein, 9 aa, Homo Sapiens
FGAGVRCSL

SEQ ID NO: 492244 - protein, 9 aa, Homo Sapiens
LVSDSVKKE

SEQ ID NO: 492245 - protein, 9 aa, Homo Sapiens
GLLILFIRW

SEQ ID NO: 492246 - protein, 9 aa, Homo Sapiens
LISDMAYVI

SEQ ID NO: 492247 - protein, 9 aa, Homo Sapiens
QVDYMEPSQ

SEQ ID NO: 492248 - protein, 9 aa, Homo Sapiens
YGMFSVDFT

SEQ ID NO: 492249 - protein, 9 aa, Homo Sapiens
QLRELREGA

SEQ ID NO: 492250 - protein, 9 aa, Homo Sapiens
GPKRGPSPL

SEQ ID NO: 492251 - protein, 9 aa, Homo Sapiens
EQMQTKDHR

SEQ ID NO: 492252 - protein, 9 aa, Homo Sapiens
KKRVVQMLL

SEQ ID NO: 492253 - protein, 9 aa, Homo Sapiens
KQEEAITLL

SEQ ID NO: 492254 - protein, 9 aa, Homo Sapiens
SCFLRTDTM

SEQ ID NO: 492255 - protein, 9 aa, Homo Sapiens
SAPATGGVM

SEQ ID NO: 492256 - protein, 9 aa, Homo Sapiens
TRTLEIQPG

SEQ ID NO: 492257 - protein, 9 aa, Homo Sapiens
IHVSYTRVW

SEQ ID NO: 492258 - protein, 9 aa, Homo Sapiens
TMFFNGLAI

SEQ ID NO: 492259 - protein, 9 aa, Homo Sapiens
LTKKRALSM

SEQ ID NO: 492260 - protein, 9 aa, Homo Sapiens
REKEEQCEK

SEQ ID NO: 492261 - protein, 9 aa, Homo Sapiens
AAAAFSQLH

SEQ ID NO: 492262 - protein, 9 aa, Homo Sapiens
LYIPLLLML

SEQ ID NO: 492263 - protein, 9 aa, Homo Sapiens
KIGSVAENA

SEQ ID NO: 492264 - protein, 9 aa, Homo Sapiens
APLLGNVLS

SEQ ID NO: 492265 - protein, 9 aa, Homo Sapiens
ISNNCSVVS

SEQ ID NO: 492266 - protein, 9 aa, Homo Sapiens
NYIPQGCTK

SEQ ID NO: 492267 - protein, 9 aa, Homo Sapiens
VRFTRSGGI

SEQ ID NO: 492268 - protein, 9 aa, Homo Sapiens
RLLEAYLIL

SEQ ID NO: 492269 - protein, 9 aa, Homo Sapiens
LHTLNSTFS

SEQ ID NO: 492270 - protein, 9 aa, Homo Sapiens
MACNYFWTL

SEQ ID NO: 492271 - protein, 9 aa, Homo Sapiens
FSHFFLFHM

SEQ ID NO: 492272 - protein, 9 aa, Homo Sapiens
SDHMFTKAR

SEQ ID NO: 492273 - protein, 9 aa, Homo Sapiens
TSFTAALSL

SEQ ID NO: 492274 - protein, 9 aa, Homo Sapiens
PKSMEISFS

SEQ ID NO: 492275 - protein, 9 aa, Homo Sapiens
GFSKSSMSS

SEQ ID NO: 492276 - protein, 9 aa, Homo Sapiens
GSTKSLMTP

SEQ ID NO: 492277 - protein, 9 aa, Homo Sapiens
SKPYLTVYQ

SEQ ID NO: 492278 - protein, 9 aa, Homo Sapiens
EGAGIIFII

SEQ ID NO: 492279 - protein, 9 aa, Homo Sapiens
FGALYIPLL

SEQ ID NO: 492280 - protein, 9 aa, Homo Sapiens
FLHPHKLMI

SEQ ID NO: 492281 - protein, 9 aa, Homo Sapiens
FSKSSMSSD

SEQ ID NO: 492282 - protein, 9 aa, Homo Sapiens
HYQACPPHS

SEQ ID NO: 492283 - protein, 9 aa, Homo Sapiens
NTMFSSVCS

SEQ ID NO: 492284 - protein, 9 aa, Homo Sapiens
RRVEAAATA

SEQ ID NO: 492285 - protein, 9 aa, Homo Sapiens
PIPGGCNGD

SEQ ID NO: 492286 - protein, 9 aa, Homo Sapiens
LSGITQKNF

SEQ ID NO: 492287 - protein, 9 aa, Homo Sapiens
KPNIHKTVL

SEQ ID NO: 492288 - protein, 9 aa, Homo Sapiens
NAQFITRCW

SEQ ID NO: 492289 - protein, 9 aa, Homo Sapiens
NLIRMAMAG

SEQ ID NO: 492290 - protein, 9 aa, Homo Sapiens
TFGALYIPL

SEQ ID NO: 492291 - protein, 9 aa, Homo Sapiens
KYRISFKIN

SEQ ID NO: 492292 - protein, 9 aa, Homo Sapiens
QQRAQIQPR

SEQ ID NO: 492293 - protein, 9 aa, Homo Sapiens
YGSKEFNNN

SEQ ID NO: 492294 - protein, 9 aa, Homo Sapiens
WFVCDLTQA

SEQ ID NO: 492295 - protein, 9 aa, Homo Sapiens
ALAWNNSRV

SEQ ID NO: 492296 - protein, 9 aa, Homo Sapiens
LGAVFSCPW

SEQ ID NO: 492297 - protein, 9 aa, Homo Sapiens
PGGAHAAWL

SEQ ID NO: 492298 - protein, 9 aa, Homo Sapiens
MVSKRENVA

SEQ ID NO: 492299 - protein, 9 aa, Homo Sapiens
YRISFKINV

SEQ ID NO: 492300 - protein, 9 aa, Homo Sapiens
KLETIQAQP

SEQ ID NO: 492301 - protein, 9 aa, Homo Sapiens
HCTVARVTK

SEQ ID NO: 492302 - protein, 9 aa, Homo Sapiens
NLKKFQPEL

SEQ ID NO: 492303 - protein, 9 aa, Homo Sapiens
HDGQTHPAL

SEQ ID NO: 492304 - protein, 9 aa, Homo Sapiens
QAVSAGVPV

SEQ ID NO: 492305 - protein, 9 aa, Homo Sapiens
EAYCRSMTK

SEQ ID NO: 492306 - protein, 9 aa, Homo Sapiens
EEKKKILLN

SEQ ID NO: 492307 - protein, 9 aa, Homo Sapiens
WFQIPIVLI

SEQ ID NO: 492308 - protein, 9 aa, Homo Sapiens
KLCSMKERK

SEQ ID NO: 492309 - protein, 9 aa, Homo Sapiens
GNTLLGMAT

SEQ ID NO: 492310 - protein, 9 aa, Homo Sapiens
TEAFDFWEK

SEQ ID NO: 492311 - protein, 9 aa, Homo Sapiens
GGHPRPPQG

SEQ ID NO: 492312 - protein, 9 aa, Homo Sapiens
FSFQVQLAS

SEQ ID NO: 492313 - protein, 9 aa, Homo Sapiens
SQRMLRILH

SEQ ID NO: 492314 - protein, 9 aa, Homo Sapiens
IPQGCTKFY

SEQ ID NO: 492315 - protein, 9 aa, Homo Sapiens
MSGKAVSAG

SEQ ID NO: 492316 - protein, 9 aa, Homo Sapiens
IEEAYCRSM

SEQ ID NO: 492317 - protein, 9 aa, Homo Sapiens
LQRQFQGPM

SEQ ID NO: 492318 - protein, 9 aa, Homo Sapiens
SFKINVAQL

SEQ ID NO: 492319 - protein, 9 aa, Homo Sapiens
PESWPPSPP

SEQ ID NO: 492320 - protein, 9 aa, Homo Sapiens
TTPYLVEWE

SEQ ID NO: 492321 - protein, 9 aa, Homo Sapiens
GRVSVIVTG

SEQ ID NO: 492322 - protein, 9 aa, Homo Sapiens
LLLAKAGCF

SEQ ID NO: 492323 - protein, 9 aa, Homo Sapiens
FSGMPDAPG

SEQ ID NO: 492324 - protein, 9 aa, Homo Sapiens
IILRENNCH

SEQ ID NO: 492325 - protein, 9 aa, Homo Sapiens
ILFIRWTTF

SEQ ID NO: 492326 - protein, 9 aa, Homo Sapiens
AGRWNCEGT

SEQ ID NO: 492327 - protein, 9 aa, Homo Sapiens
ALTGMTVIA

SEQ ID NO: 492328 - protein, 9 aa, Homo Sapiens
HFHLRNGLH

SEQ ID NO: 492329 - protein, 9 aa, Homo Sapiens
GPNFQDGYI

SEQ ID NO: 492330 - protein, 9 aa, Homo Sapiens
AEERPGSWF

SEQ ID NO: 492331 - protein, 9 aa, Homo Sapiens
CAAPRAQHA

SEQ ID NO: 492332 - protein, 9 aa, Homo Sapiens
RFSFQVQLA

SEQ ID NO: 492333 - protein, 9 aa, Homo Sapiens
FPNGKMALL

SEQ ID NO: 492334 - protein, 9 aa, Homo Sapiens
NFQDGYILR

SEQ ID NO: 492335 - protein, 9 aa, Homo Sapiens
QAHTHANPR

SEQ ID NO: 492336 - protein, 9 aa, Homo Sapiens
CASGQMGPC

SEQ ID NO: 492337 - protein, 9 aa, Homo Sapiens
RLQEAPKRS

SEQ ID NO: 492338 - protein, 9 aa, Homo Sapiens
AVTSTTVLR

SEQ ID NO: 492339 - protein, 9 aa, Homo Sapiens
YAEVKRVGN

SEQ ID NO: 492340 - protein, 9 aa, Homo Sapiens
WQDEDVYRR

SEQ ID NO: 492341 - protein, 9 aa, Homo Sapiens
RSSPALSIV

SEQ ID NO: 492342 - protein, 9 aa, Homo Sapiens
QKTLLKIGY

SEQ ID NO: 492343 - protein, 9 aa, Homo Sapiens
GSCASGQMG

SEQ ID NO: 492344 - protein, 9 aa, Homo Sapiens
PAETELFSE

SEQ ID NO: 492345 - protein, 9 aa, Homo Sapiens
SCDSDLSLS

SEQ ID NO: 492346 - protein, 9 aa, Homo Sapiens
IYIYTHIYI

SEQ ID NO: 492347 - protein, 9 aa, Homo Sapiens
RWTTFVSKG

SEQ ID NO: 492348 - protein, 9 aa, Homo Sapiens
SRSHVTALL

SEQ ID NO: 492349 - protein, 9 aa, Homo Sapiens
EHLREKKLN

SEQ ID NO: 492350 - protein, 9 aa, Homo Sapiens
GGDMRVDWA

SEQ ID NO: 492351 - protein, 9 aa, Homo Sapiens
TQNLIRMAM

SEQ ID NO: 492352 - protein, 9 aa, Homo Sapiens
TRKTNCGYE

SEQ ID NO: 492353 - protein, 9 aa, Homo Sapiens
MLKIFYFAF

SEQ ID NO: 492354 - protein, 9 aa, Homo Sapiens
IHKTVLTEA

SEQ ID NO: 492355 - protein, 9 aa, Homo Sapiens
IIFIIDDTT

SEQ ID NO: 492356 - protein, 9 aa, Homo Sapiens
NFATSPRVV

SEQ ID NO: 492357 - protein, 9 aa, Homo Sapiens
LREHLREKK

SEQ ID NO: 492358 - protein, 9 aa, Homo Sapiens
GCAFRERPA

SEQ ID NO: 492359 - protein, 9 aa, Homo Sapiens
PKPTASRCT

SEQ ID NO: 492360 - protein, 9 aa, Homo Sapiens
CRIINYMSS

SEQ ID NO: 492361 - protein, 9 aa, Homo Sapiens
ASMMYKEGK

SEQ ID NO: 492362 - protein, 9 aa, Homo Sapiens
LLSCFPNTF

SEQ ID NO: 492363 - protein, 9 aa, Homo Sapiens
SKEARKKAF

SEQ ID NO: 492364 - protein, 9 aa, Homo Sapiens
MFTSPKPTA

SEQ ID NO: 492365 - protein, 9 aa, Homo Sapiens
FVLISDMAY

SEQ ID NO: 492366 - protein, 9 aa, Homo Sapiens
GDRGPRAAR

SEQ ID NO: 492367 - protein, 9 aa, Homo Sapiens
DGQTHPALD

SEQ ID NO: 492368 - protein, 9 aa, Homo Sapiens
ECLLTAFRC

SEQ ID NO: 492369 - protein, 9 aa, Homo Sapiens
RPGSWFGFG

SEQ ID NO: 492370 - protein, 9 aa, Homo Sapiens
LTEVGARLQ

SEQ ID NO: 492371 - protein, 9 aa, Homo Sapiens
DQLASCHYQ

SEQ ID NO: 492372 - protein, 9 aa, Homo Sapiens
GLIMFRRCL

SEQ ID NO: 492373 - protein, 9 aa, Homo Sapiens
FDFWEKPPL

SEQ ID NO: 492374 - protein, 9 aa, Homo Sapiens
FPLGSTKSL

SEQ ID NO: 492375 - protein, 9 aa, Homo Sapiens
TSRSAAQNL

SEQ ID NO: 492376 - protein, 9 aa, Homo Sapiens
ECSSPGRGS

SEQ ID NO: 492377 - protein, 9 aa, Homo Sapiens
DLRTTVLYI

SEQ ID NO: 492378 - protein, 9 aa, Homo Sapiens
TTVLRTTPN

SEQ ID NO: 492379 - protein, 9 aa, Homo Sapiens
GAGIIFIID

SEQ ID NO: 492380 - protein, 9 aa, Homo Sapiens
LFSEVISMW

SEQ ID NO: 492381 - protein, 9 aa, Homo Sapiens
ETIQAQPDS

SEQ ID NO: 492382 - protein, 9 aa, Homo Sapiens
VQVDRAKMH

SEQ ID NO: 492383 - protein, 9 aa, Homo Sapiens
GLVHQGIKC

SEQ ID NO: 492384 - protein, 9 aa, Homo Sapiens
EADKYRITY

SEQ ID NO: 492385 - protein, 9 aa, Homo Sapiens
NLQKWAANS

SEQ ID NO: 492386 - protein, 9 aa, Homo Sapiens
LEVFATPKK

SEQ ID NO: 492387 - protein, 9 aa, Homo Sapiens
LCLSSKCIA

SEQ ID NO: 492388 - protein, 9 aa, Homo Sapiens
KEFNNNCKL

SEQ ID NO: 492389 - protein, 9 aa, Homo Sapiens
ERPGSWFGF

SEQ ID NO: 492390 - protein, 9 aa, Homo Sapiens
CLHDGQTHP

SEQ ID NO: 492391 - protein, 9 aa, Homo Sapiens
ITAYAAIKE

SEQ ID NO: 492392 - protein, 9 aa, Homo Sapiens
LFGGIIKKG

SEQ ID NO: 492393 - protein, 9 aa, Homo Sapiens
SVPIPGGCN

SEQ ID NO: 492394 - protein, 9 aa, Homo Sapiens
LSTLTRTQE

SEQ ID NO: 492395 - protein, 9 aa, Homo Sapiens
KSVSWSELG

SEQ ID NO: 492396 - protein, 9 aa, Homo Sapiens
QHAAAHVLL

SEQ ID NO: 492397 - protein, 9 aa, Homo Sapiens
LLTEVGARL

SEQ ID NO: 492398 - protein, 9 aa, Homo Sapiens
YDLLTIAPG

SEQ ID NO: 492399 - protein, 9 aa, Homo Sapiens
SAALAWNNS

SEQ ID NO: 492400 - protein, 9 aa, Homo Sapiens
NVRENNYTY

SEQ ID NO: 492401 - protein, 9 aa, Homo Sapiens
TCQGTSPHT

SEQ ID NO: 492402 - protein, 9 aa, Homo Sapiens
GRALVSDSV

SEQ ID NO: 492403 - protein, 9 aa, Homo Sapiens
KSMEISFSG

SEQ ID NO: 492404 - protein, 9 aa, Homo Sapiens
ASRPLSPST

SEQ ID NO: 492405 - protein, 9 aa, Homo Sapiens
IKMPEVKIP

SEQ ID NO: 492406 - protein, 9 aa, Homo Sapiens
LFMLKIFYF

SEQ ID NO: 492407 - protein, 9 aa, Homo Sapiens
PKRSPLAAS

SEQ ID NO: 492408 - protein, 9 aa, Homo Sapiens
VQQRAQIQP

SEQ ID NO: 492409 - protein, 9 aa, Homo Sapiens
KWLKFPRSW

SEQ ID NO: 492410 - protein, 9 aa, Homo Sapiens
RPTTLSEEQ

SEQ ID NO: 492411 - protein, 9 aa, Homo Sapiens
VSRGQLVSV

SEQ ID NO: 492412 - protein, 9 aa, Homo Sapiens
AQHAAAHVL

SEQ ID NO: 492413 - protein, 9 aa, Homo Sapiens
ITQKNFMNI

SEQ ID NO: 492414 - protein, 9 aa, Homo Sapiens
DADFSHHPK

SEQ ID NO: 492415 - protein, 9 aa, Homo Sapiens
GQLVSVGKQ

SEQ ID NO: 492416 - protein, 9 aa, Homo Sapiens
RVVQMLLVI

SEQ ID NO: 492417 - protein, 9 aa, Homo Sapiens
KWFVCDLTQ

SEQ ID NO: 492418 - protein, 9 aa, Homo Sapiens
ACYSLHEFS

SEQ ID NO: 492419 - protein, 9 aa, Homo Sapiens
DVLDLWTLI

SEQ ID NO: 492420 - protein, 9 aa, Homo Sapiens
VTQSGFNRK

SEQ ID NO: 492421 - protein, 9 aa, Homo Sapiens
RLADPTRKT

SEQ ID NO: 492422 - protein, 9 aa, Homo Sapiens
SPARHRSPM

SEQ ID NO: 492423 - protein, 9 aa, Homo Sapiens
CEGTALVTV

SEQ ID NO: 492424 - protein, 9 aa, Homo Sapiens
WKWLKFPRS

SEQ ID NO: 492425 - protein, 9 aa, Homo Sapiens
ACGLIMFRR

SEQ ID NO: 492426 - protein, 9 aa, Homo Sapiens
SMSVIRPHW

SEQ ID NO: 492427 - protein, 9 aa, Homo Sapiens
FLKMAVTYS

SEQ ID NO: 492428 - protein, 9 aa, Homo Sapiens
LWATETLSV

SEQ ID NO: 492429 - protein, 9 aa, Homo Sapiens
GITQKNFMN

SEQ ID NO: 492430 - protein, 9 aa, Homo Sapiens
HHQKIKNFH

SEQ ID NO: 492431 - protein, 9 aa, Homo Sapiens
FMYMRQLSD

SEQ ID NO: 492432 - protein, 9 aa, Homo Sapiens
IAGQPGLLI

SEQ ID NO: 492433 - protein, 9 aa, Homo Sapiens
LAWVGHVFT

SEQ ID NO: 492434 - protein, 8 aa, Homo Sapiens
DAVLLEHF

SEQ ID NO: 492435 - protein, 9 aa, Homo Sapiens
VSQDLQPLT

SEQ ID NO: 492436 - protein, 9 aa, Homo Sapiens
FRIYNMTYL

SEQ ID NO: 492437 - protein, 9 aa, Homo Sapiens
MDADFSHHP

SEQ ID NO: 492438 - protein, 9 aa, Homo Sapiens
LADYRAIGG

SEQ ID NO: 492439 - protein, 9 aa, Homo Sapiens
GKAVSAGTS

SEQ ID NO: 492440 - protein, 9 aa, Homo Sapiens
EEATDCAGY

SEQ ID NO: 492441 - protein, 9 aa, Homo Sapiens
WVGHVFTAT

SEQ ID NO: 492442 - protein, 9 aa, Homo Sapiens
SVQVDRAKM

SEQ ID NO: 492443 - protein, 9 aa, Homo Sapiens
SAVALSDRE

SEQ ID NO: 492444 - protein, 9 aa, Homo Sapiens
IAPGRRGQY

SEQ ID NO: 492445 - protein, 9 aa, Homo Sapiens
LSTAHVMPS

SEQ ID NO: 492446 - protein, 9 aa, Homo Sapiens
CISGIFIHT

SEQ ID NO: 492447 - protein, 9 aa, Homo Sapiens
AYNKENLKT

SEQ ID NO: 492448 - protein, 9 aa, Homo Sapiens
IKLLLQCVT

SEQ ID NO: 492449 - protein, 9 aa, Homo Sapiens
MLQTDDEDD

SEQ ID NO: 492450 - protein, 9 aa, Homo Sapiens
WHQCPGGAH

SEQ ID NO: 492451 - protein, 9 aa, Homo Sapiens
SSMSVIRPH

SEQ ID NO: 492452 - protein, 9 aa, Homo Sapiens
CCVSQDLQP

SEQ ID NO: 492453 - protein, 9 aa, Homo Sapiens
AANFPLGST

SEQ ID NO: 492454 - protein, 9 aa, Homo Sapiens
MMYKEGKFR

SEQ ID NO: 492455 - protein, 9 aa, Homo Sapiens
QLAELQSAF

SEQ ID NO: 492456 - protein, 9 aa, Homo Sapiens
PAPGTAFAA

SEQ ID NO: 492457 - protein, 9 aa, Homo Sapiens
CARLPHLAY

SEQ ID NO: 492458 - protein, 9 aa, Homo Sapiens
ELAVRKVGA

SEQ ID NO: 492459 - protein, 9 aa, Homo Sapiens
GAHAAWLHL

SEQ ID NO: 492460 - protein, 9 aa, Homo Sapiens
SVSWSELGG

SEQ ID NO: 492461 - protein, 9 aa, Homo Sapiens
PFVCTQCGC

SEQ ID NO: 492462 - protein, 9 aa, Homo Sapiens
FATPKKCAV

SEQ ID NO: 492463 - protein, 9 aa, Homo Sapiens
CSSPGRGSA

SEQ ID NO: 492464 - protein, 9 aa, Homo Sapiens
EFAAAAFSQ

SEQ ID NO: 492465 - protein, 9 aa, Homo Sapiens
MTQVFEEHF

SEQ ID NO: 492466 - protein, 9 aa, Homo Sapiens
FHLRVKGLA

SEQ ID NO: 492467 - protein, 9 aa, Homo Sapiens
PLNHKWFVC

SEQ ID NO: 492468 - protein, 9 aa, Homo Sapiens
LQTDDEDDL

SEQ ID NO: 492469 - protein, 9 aa, Homo Sapiens
HTLNSTFSS

SEQ ID NO: 492470 - protein, 9 aa, Homo Sapiens
RLWKWLKFP

SEQ ID NO: 492471 - protein, 9 aa, Homo Sapiens
GNNFATSPR

SEQ ID NO: 492472 - protein, 9 aa, Homo Sapiens
VMKPHRYRP

SEQ ID NO: 492473 - protein, 9 aa, Homo Sapiens
RKDSAVALS

SEQ ID NO: 492474 - protein, 9 aa, Homo Sapiens
EEQALRELA

SEQ ID NO: 492475 - protein, 9 aa, Homo Sapiens
ILSQIPNNG

SEQ ID NO: 492476 - protein, 9 aa, Homo Sapiens
TKARGSRLN

SEQ ID NO: 492477 - protein, 9 aa, Homo Sapiens
VIQILESRH

SEQ ID NO: 492478 - protein, 9 aa, Homo Sapiens
ACLLLAKAG

SEQ ID NO: 492479 - protein, 9 aa, Homo Sapiens
SGTIKLLLQ

SEQ ID NO: 492480 - protein, 9 aa, Homo Sapiens
GKSVSWSEL

SEQ ID NO: 492481 - protein, 9 aa, Homo Sapiens
EIKMPEVKI

SEQ ID NO: 492482 - protein, 9 aa, Homo Sapiens
QECLLTAFR

SEQ ID NO: 492483 - protein, 9 aa, Homo Sapiens
TLSFRTTQT

SEQ ID NO: 492484 - protein, 9 aa, Homo Sapiens
IRCEDIHSM

SEQ ID NO: 492485 - protein, 9 aa, Homo Sapiens
RLELCVAWH

SEQ ID NO: 492486 - protein, 9 aa, Homo Sapiens
SGQMGPCMD

SEQ ID NO: 492487 - protein, 9 aa, Homo Sapiens
CKVCGWPKP

SEQ ID NO: 492488 - protein, 9 aa, Homo Sapiens
PAVTSTTVL

SEQ ID NO: 492489 - protein, 9 aa, Homo Sapiens
ATDCAGYNL

SEQ ID NO: 492490 - protein, 9 aa, Homo Sapiens
HIYIHTHTF

SEQ ID NO: 492491 - protein, 9 aa, Homo Sapiens
IPGGCNGDI

SEQ ID NO: 492492 - protein, 9 aa, Homo Sapiens
LMRSKEARK

SEQ ID NO: 492493 - protein, 9 aa, Homo Sapiens
QNMMTNVRE

SEQ ID NO: 492494 - protein, 9 aa, Homo Sapiens
GGRVSVIVT

SEQ ID NO: 492495 - protein, 9 aa, Homo Sapiens
LFLTAYFCY

SEQ ID NO: 492496 - protein, 9 aa, Homo Sapiens
YPHVLRKVR

SEQ ID NO: 492497 - protein, 9 aa, Homo Sapiens
GGCNGDIQQ

SEQ ID NO: 492498 - protein, 9 aa, Homo Sapiens
SEEQALREL

SEQ ID NO: 492499 - protein, 9 aa, Homo Sapiens
SSSRMQGLV

SEQ ID NO: 492500 - protein, 9 aa, Homo Sapiens
KKYRISFKI

SEQ ID NO: 492501 - protein, 9 aa, Homo Sapiens
GYLLEQRTV

SEQ ID NO: 492502 - protein, 9 aa, Homo Sapiens
SYTRVWDFI

SEQ ID NO: 492503 - protein, 9 aa, Homo Sapiens
GQMGPCMDR

SEQ ID NO: 492504 - protein, 9 aa, Homo Sapiens
LTSLSGITQ

SEQ ID NO: 492505 - protein, 9 aa, Homo Sapiens
NLSCQSCTF

SEQ ID NO: 492506 - protein, 9 aa, Homo Sapiens
SSPGRGSAA

SEQ ID NO: 492507 - protein, 9 aa, Homo Sapiens
QCISGIFIH

SEQ ID NO: 492508 - protein, 9 aa, Homo Sapiens
WKVQQRAQI

SEQ ID NO: 492509 - protein, 9 aa, Homo Sapiens
CRSMTKLAK

SEQ ID NO: 492510 - protein, 9 aa, Homo Sapiens
DTPYIPFRN

SEQ ID NO: 492511 - protein, 9 aa, Homo Sapiens
GGIATLQVD

SEQ ID NO: 492512 - protein, 9 aa, Homo Sapiens
AYAAIKENQ

SEQ ID NO: 492513 - protein, 9 aa, Homo Sapiens
MTTINTNLR

SEQ ID NO: 492514 - protein, 9 aa, Homo Sapiens
SGKLLRSIA

SEQ ID NO: 492515 - protein, 9 aa, Homo Sapiens
WPPSPPMWA

SEQ ID NO: 492516 - protein, 9 aa, Homo Sapiens
SFRTTQTPS

SEQ ID NO: 492517 - protein, 9 aa, Homo Sapiens
DFTDEVTSE

SEQ ID NO: 492518 - protein, 9 aa, Homo Sapiens
NKLFMLKIF

SEQ ID NO: 492519 - protein, 9 aa, Homo Sapiens
SWAWINTHI

SEQ ID NO: 492520 - protein, 9 aa, Homo Sapiens
VDWARPGCR

SEQ ID NO: 492521 - protein, 9 aa, Homo Sapiens
ILSPEGERV

SEQ ID NO: 492522 - protein, 9 aa, Homo Sapiens
ATAQVLLDH

SEQ ID NO: 492523 - protein, 9 aa, Homo Sapiens
GGCTACKCS

SEQ ID NO: 492524 - protein, 9 aa, Homo Sapiens
TFSHFFLFH

SEQ ID NO: 492525 - protein, 9 aa, Homo Sapiens
CFPNTFLAS

SEQ ID NO: 492526 - protein, 9 aa, Homo Sapiens
SSMSSDSSE

SEQ ID NO: 492527 - protein, 9 aa, Homo Sapiens
PNAQFITRC

SEQ ID NO: 492528 - protein, 9 aa, Homo Sapiens
RSHESPKPG

SEQ ID NO: 492529 - protein, 9 aa, Homo Sapiens
SWEDKLVEA

SEQ ID NO: 492530 - protein, 9 aa, Homo Sapiens
IMFRRCLIP

SEQ ID NO: 492531 - protein, 9 aa, Homo Sapiens
TVYQMMDFI

SEQ ID NO: 492532 - protein, 9 aa, Homo Sapiens
CHYQACPPH

SEQ ID NO: 492533 - protein, 9 aa, Homo Sapiens
QDGSSSCDS

SEQ ID NO: 492534 - protein, 9 aa, Homo Sapiens
TVMRLRTKI

SEQ ID NO: 492535 - protein, 9 aa, Homo Sapiens
CAGYNLIHL

SEQ ID NO: 492536 - protein, 9 aa, Homo Sapiens
KSSMSSDSS

SEQ ID NO: 492537 - protein, 9 aa, Homo Sapiens
RAISKAPSM

SEQ ID NO: 492538 - protein, 9 aa, Homo Sapiens
TATTPYLVE

SEQ ID NO: 492539 - protein, 9 aa, Homo Sapiens
YKEGKFRYR

SEQ ID NO: 492540 - protein, 9 aa, Homo Sapiens
SLRFSTSPG

SEQ ID NO: 492541 - protein, 9 aa, Homo Sapiens
TCTHACICV

SEQ ID NO: 492542 - protein, 9 aa, Homo Sapiens
QTPSLLLYV

SEQ ID NO: 492543 - protein, 9 aa, Homo Sapiens
RAQHAAAHV

SEQ ID NO: 492544 - protein, 9 aa, Homo Sapiens
GRSSPALSI

SEQ ID NO: 492545 - protein, 9 aa, Homo Sapiens
DCAGYNLIH

SEQ ID NO: 492546 - protein, 9 aa, Homo Sapiens
RVDWARPGC

SEQ ID NO: 492547 - protein, 9 aa, Homo Sapiens
LRNGLHHQV

SEQ ID NO: 492548 - protein, 9 aa, Homo Sapiens
NTHIVQLLP

SEQ ID NO: 492549 - protein, 9 aa, Homo Sapiens
LLQCVTHLA

SEQ ID NO: 492550 - protein, 9 aa, Homo Sapiens
SFVVAGPSR

SEQ ID NO: 492551 - protein, 9 aa, Homo Sapiens
LHPRSLGLG

SEQ ID NO: 492552 - protein, 9 aa, Homo Sapiens
AIGGRIQPK

SEQ ID NO: 492553 - protein, 9 aa, Homo Sapiens
LRFSTSPGE

SEQ ID NO: 492554 - protein, 9 aa, Homo Sapiens
CKQVRLQYQ

SEQ ID NO: 492555 - protein, 9 aa, Homo Sapiens
CGCAFRERP

SEQ ID NO: 492556 - protein, 9 aa, Homo Sapiens
SVIRPHWPY

SEQ ID NO: 492557 - protein, 9 aa, Homo Sapiens
LSQIPNNGL

SEQ ID NO: 492558 - protein, 9 aa, Homo Sapiens
SSPQPRPPW

SEQ ID NO: 492559 - protein, 9 aa, Homo Sapiens
SQIAGNLMT

SEQ ID NO: 492560 - protein, 9 aa, Homo Sapiens
QHFFQCGTY

SEQ ID NO: 492561 - protein, 9 aa, Homo Sapiens
TTINTNLRE

SEQ ID NO: 492562 - protein, 9 aa, Homo Sapiens
INTHIVQLL

SEQ ID NO: 492563 - protein, 9 aa, Homo Sapiens
LEKWVTEIL

SEQ ID NO: 492564 - protein, 9 aa, Homo Sapiens
GDIVDVLSD

SEQ ID NO: 492565 - protein, 9 aa, Homo Sapiens
VCNIVNNKM

SEQ ID NO: 492566 - protein, 9 aa, Homo Sapiens
SLLFLTAYF

SEQ ID NO: 492567 - protein, 9 aa, Homo Sapiens
IYIHTHTFY

SEQ ID NO: 492568 - protein, 9 aa, Homo Sapiens
AQVLLSCST

SEQ ID NO: 492569 - protein, 9 aa, Homo Sapiens
EERICYSQR

SEQ ID NO: 492570 - protein, 9 aa, Homo Sapiens
HALFLKMAV

SEQ ID NO: 492571 - protein, 9 aa, Homo Sapiens
EQLAELQSA

SEQ ID NO: 492572 - protein, 9 aa, Homo Sapiens
PCMDRSTLT

SEQ ID NO: 492573 - protein, 9 aa, Homo Sapiens
GNSMETLIQ

SEQ ID NO: 492574 - protein, 9 aa, Homo Sapiens
RDVAQAHTH

SEQ ID NO: 492575 - protein, 9 aa, Homo Sapiens
QKVEIKNAT

SEQ ID NO: 492576 - protein, 9 aa, Homo Sapiens
KTIAEQAVS

SEQ ID NO: 492577 - protein, 9 aa, Homo Sapiens
LCSMKERKL

SEQ ID NO: 492578 - protein, 9 aa, Homo Sapiens
AQVDYMEPS

SEQ ID NO: 492579 - protein, 9 aa, Homo Sapiens
KRENVATHH

SEQ ID NO: 492580 - protein, 9 aa, Homo Sapiens
MFSSVCSRN

SEQ ID NO: 492581 - protein, 9 aa, Homo Sapiens
AYTRTLEIQ

SEQ ID NO: 492582 - protein, 9 aa, Homo Sapiens
CLTSFTAAL

SEQ ID NO: 492583 - protein, 9 aa, Homo Sapiens
RMLADYRAI

SEQ ID NO: 492584 - protein, 9 aa, Homo Sapiens
ARHRSPMRE

SEQ ID NO: 492585 - protein, 9 aa, Homo Sapiens
HLERKDSAV

SEQ ID NO: 492586 - protein, 9 aa, Homo Sapiens
LQLVMWKVQ

SEQ ID NO: 492587 - protein, 9 aa, Homo Sapiens
IQFALTGMT

SEQ ID NO: 492588 - protein, 9 aa, Homo Sapiens
HHCTVARVT

SEQ ID NO: 492589 - protein, 9 aa, Homo Sapiens
RLPHLAYNK

SEQ ID NO: 492590 - protein, 9 aa, Homo Sapiens
FSVDFTDEV

SEQ ID NO: 492591 - protein, 9 aa, Homo Sapiens
PDAPGLWMG

SEQ ID NO: 492592 - protein, 9 aa, Homo Sapiens
AEAAIKKQQ

SEQ ID NO: 492593 - protein, 9 aa, Homo Sapiens
RERPAEGDR

SEQ ID NO: 492594 - protein, 9 aa, Homo Sapiens
RPHWPYFTD

SEQ ID NO: 492595 - protein, 9 aa, Homo Sapiens
LAKAGCFAD

SEQ ID NO: 492596 - protein, 9 aa, Homo Sapiens
TCDDFKSGE

SEQ ID NO: 492597 - protein, 9 aa, Homo Sapiens
VQKASQAFN

SEQ ID NO: 492598 - protein, 9 aa, Homo Sapiens
PALDEAAPV

SEQ ID NO: 492599 - protein, 9 aa, Homo Sapiens
RKLRKAYGN

SEQ ID NO: 492600 - protein, 9 aa, Homo Sapiens
KQAVSREIV

SEQ ID NO: 492601 - protein, 9 aa, Homo Sapiens
IQTGEKPFK

SEQ ID NO: 492602 - protein, 9 aa, Homo Sapiens
PGVIQILES

SEQ ID NO: 492603 - protein, 9 aa, Homo Sapiens
ERKDSAVAL

SEQ ID NO: 492604 - protein, 9 aa, Homo Sapiens
HAAAHVLLT

SEQ ID NO: 492605 - protein, 9 aa, Homo Sapiens
LECRIINYM

SEQ ID NO: 492606 - protein, 9 aa, Homo Sapiens
VLLMRSKEA

SEQ ID NO: 492607 - protein, 9 aa, Homo Sapiens
GCTKFYEFS

SEQ ID NO: 492608 - protein, 9 aa, Homo Sapiens
KRALSMSPL

SEQ ID NO: 492609 - protein, 9 aa, Homo Sapiens
DEDVYRRLS

SEQ ID NO: 492610 - protein, 9 aa, Homo Sapiens
FNNNCKLKE

SEQ ID NO: 492611 - protein, 9 aa, Homo Sapiens
DDSKLEVFA

SEQ ID NO: 492612 - protein, 9 aa, Homo Sapiens
MPEVKIPEI

SEQ ID NO: 492613 - protein, 9 aa, Homo Sapiens
EPEEERICY

SEQ ID NO: 492614 - protein, 9 aa, Homo Sapiens
IYNMTYLEP

SEQ ID NO: 492615 - protein, 9 aa, Homo Sapiens
YIQKTLLKI

SEQ ID NO: 492616 - protein, 9 aa, Homo Sapiens
LAFFPLCLS

SEQ ID NO: 492617 - protein, 9 aa, Homo Sapiens
VTKSPTFKF

SEQ ID NO: 492618 - protein, 9 aa, Homo Sapiens
AVLLMRSKE

SEQ ID NO: 492619 - protein, 9 aa, Homo Sapiens
TEILSQIPN

SEQ ID NO: 492620 - protein, 9 aa, Homo Sapiens
FPLCLSSKC

SEQ ID NO: 492621 - protein, 9 aa, Homo Sapiens
KPTASRCTC

SEQ ID NO: 492622 - protein, 9 aa, Homo Sapiens
ESKPPRSCH

SEQ ID NO: 492623 - protein, 9 aa, Homo Sapiens
GSLRFSTSP

SEQ ID NO: 492624 - protein, 9 aa, Homo Sapiens
LCQCQLEQL

SEQ ID NO: 492625 - protein, 9 aa, Homo Sapiens
KTVLTEATV

SEQ ID NO: 492626 - protein, 9 aa, Homo Sapiens
ASCHYQACP

SEQ ID NO: 492627 - protein, 9 aa, Homo Sapiens
AKEEACQLR

SEQ ID NO: 492628 - protein, 9 aa, Homo Sapiens
EPEDFSAVT

SEQ ID NO: 492629 - protein, 9 aa, Homo Sapiens
TGGVMKPHR

SEQ ID NO: 492630 - protein, 9 aa, Homo Sapiens
KKFQPELKE

SEQ ID NO: 492631 - protein, 9 aa, Homo Sapiens
ATNSEGHSE

SEQ ID NO: 492632 - protein, 9 aa, Homo Sapiens
NCEGTALVT

SEQ ID NO: 492633 - protein, 9 aa, Homo Sapiens
PAEGDRGPR

SEQ ID NO: 492634 - protein, 9 aa, Homo Sapiens
PVNASKGFG

SEQ ID NO: 492635 - protein, 9 aa, Homo Sapiens
NNFATSPRV

SEQ ID NO: 492636 - protein, 9 aa, Homo Sapiens
EEAYCRSMT

SEQ ID NO: 492637 - protein, 9 aa, Homo Sapiens
CYSQRLRGT

SEQ ID NO: 492638 - protein, 9 aa, Homo Sapiens
LRAISKAPS

SEQ ID NO: 492639 - protein, 9 aa, Homo Sapiens
DPEEKKKIL

SEQ ID NO: 492640 - protein, 9 aa, Homo Sapiens
REKKLNSLK

SEQ ID NO: 492641 - protein, 9 aa, Homo Sapiens
LTVYQMMDF

SEQ ID NO: 492642 - protein, 9 aa, Homo Sapiens
LCVAWHQCP

SEQ ID NO: 492643 - protein, 9 aa, Homo Sapiens
LWFQIPIVL

SEQ ID NO: 492644 - protein, 9 aa, Homo Sapiens
KPGVIQILE

SEQ ID NO: 492645 - protein, 9 aa, Homo Sapiens
YNLIHLVAT

SEQ ID NO: 492646 - protein, 9 aa, Homo Sapiens
VEFAAAAFS

SEQ ID NO: 492647 - protein, 9 aa, Homo Sapiens
LPNSSSSRM

SEQ ID NO: 492648 - protein, 9 aa, Homo Sapiens
LERKDSAVA

SEQ ID NO: 492649 - protein, 9 aa, Homo Sapiens
RFSTSPGEL

SEQ ID NO: 492650 - protein, 9 aa, Homo Sapiens
FSAVTMERF

SEQ ID NO: 492651 - protein, 9 aa, Homo Sapiens
WGQDVLHPR

SEQ ID NO: 492652 - protein, 9 aa, Homo Sapiens
MYKEGKFRY

SEQ ID NO: 492653 - protein, 9 aa, Homo Sapiens
LLTVFHGRC

SEQ ID NO: 492654 - protein, 9 aa, Homo Sapiens
KSDFYRFDI

SEQ ID NO: 492655 - protein, 9 aa, Homo Sapiens
PKGRALVSD

SEQ ID NO: 492656 - protein, 9 aa, Homo Sapiens
RKSSSRSGL

SEQ ID NO: 492657 - protein, 9 aa, Homo Sapiens
QVLLSCSTG

SEQ ID NO: 492658 - protein, 9 aa, Homo Sapiens
LFIRWTTFV

SEQ ID NO: 492659 - protein, 9 aa, Homo Sapiens
PVFPNGKMA

SEQ ID NO: 492660 - protein, 9 aa, Homo Sapiens
IGKAKLCSM

SEQ ID NO: 492661 - protein, 9 aa, Homo Sapiens
VGRNSKQQL

SEQ ID NO: 492662 - protein, 9 aa, Homo Sapiens
TCVYFCASS

SEQ ID NO: 492663 - protein, 9 aa, Homo Sapiens
NNNCKLKER

SEQ ID NO: 492664 - protein, 9 aa, Homo Sapiens
NIPLDYAAE

SEQ ID NO: 492665 - protein, 9 aa, Homo Sapiens
CDDFKSGEK

SEQ ID NO: 492666 - protein, 9 aa, Homo Sapiens
EACQLRELR

SEQ ID NO: 492667 - protein, 9 aa, Homo Sapiens
QIPIVLISQ

SEQ ID NO: 492668 - protein, 9 aa, Homo Sapiens
YTNDILAIL

SEQ ID NO: 492669 - protein, 9 aa, Homo Sapiens
NFNITCDDF

SEQ ID NO: 492670 - protein, 9 aa, Homo Sapiens
TGTLHPEDQ

SEQ ID NO: 492671 - protein, 9 aa, Homo Sapiens
KAVCNIVNN

SEQ ID NO: 492672 - protein, 9 aa, Homo Sapiens
HVTQSGFNR

SEQ ID NO: 492673 - protein, 9 aa, Homo Sapiens
PADFRIYNM

SEQ ID NO: 492674 - protein, 9 aa, Homo Sapiens
DLQPLTILY

SEQ ID NO: 492675 - protein, 9 aa, Homo Sapiens
EDFSAVTME

SEQ ID NO: 492676 - protein, 9 aa, Homo Sapiens
TSPKPTASR

SEQ ID NO: 492677 - protein, 9 aa, Homo Sapiens
EQARNQNFM

SEQ ID NO: 492678 - protein, 9 aa, Homo Sapiens
EAYTRTLEI

SEQ ID NO: 492679 - protein, 9 aa, Homo Sapiens
ACAAPRAQH

SEQ ID NO: 492680 - protein, 9 aa, Homo Sapiens
REKPPVPAC

SEQ ID NO: 492681 - protein, 9 aa, Homo Sapiens
LTLGSPQNL

SEQ ID NO: 492682 - protein, 9 aa, Homo Sapiens
GNIPLDYAA

SEQ ID NO: 492683 - protein, 9 aa, Homo Sapiens
MAGFGAGVR

SEQ ID NO: 492684 - protein, 9 aa, Homo Sapiens
AQFITRCWL

SEQ ID NO: 492685 - protein, 9 aa, Homo Sapiens
GGAHAAWLH

SEQ ID NO: 492686 - protein, 9 aa, Homo Sapiens
LAVRKVGAP

SEQ ID NO: 492687 - protein, 9 aa, Homo Sapiens
KMHQDLVFQ

SEQ ID NO: 492688 - protein, 9 aa, Homo Sapiens
ENDFAQFGQ

SEQ ID NO: 492689 - protein, 9 aa, Homo Sapiens
QEGGCTACK

SEQ ID NO: 492690 - protein, 9 aa, Homo Sapiens
PLVTKSPTF

SEQ ID NO: 492691 - protein, 9 aa, Homo Sapiens
KNRHTGLSN

SEQ ID NO: 492692 - protein, 9 aa, Homo Sapiens
NITCDDFKS

SEQ ID NO: 492693 - protein, 9 aa, Homo Sapiens
PPRSCHLWA

SEQ ID NO: 492694 - protein, 9 aa, Homo Sapiens
RLVLHSRCC

SEQ ID NO: 492695 - protein, 9 aa, Homo Sapiens
IFSGMPDAP

SEQ ID NO: 492696 - protein, 9 aa, Homo Sapiens
MINTREKAQ

SEQ ID NO: 492697 - protein, 9 aa, Homo Sapiens
DNHIEEISG

SEQ ID NO: 492698 - protein, 9 aa, Homo Sapiens
EESDNELEQ

SEQ ID NO: 492699 - protein, 9 aa, Homo Sapiens
AVLAGRWNC

SEQ ID NO: 492700 - protein, 9 aa, Homo Sapiens
IELAFFPLC

SEQ ID NO: 492701 - protein, 9 aa, Homo Sapiens
TSRSHESPK

SEQ ID NO: 492702 - protein, 9 aa, Homo Sapiens
EAARELGYL

SEQ ID NO: 492703 - protein, 9 aa, Homo Sapiens
NVLSWEDKL

SEQ ID NO: 492704 - protein, 9 aa, Homo Sapiens
REMKPKSDR

SEQ ID NO: 492705 - protein, 9 aa, Homo Sapiens
CKCSHLGNN

SEQ ID NO: 492706 - protein, 9 aa, Homo Sapiens
GMFSVDFTD

SEQ ID NO: 492707 - protein, 9 aa, Homo Sapiens
GSPQNLTLQ

SEQ ID NO: 492708 - protein, 9 aa, Homo Sapiens
HYQSAALAW

SEQ ID NO: 492709 - protein, 9 aa, Homo Sapiens
TFLHPHKLM

SEQ ID NO: 492710 - protein, 9 aa, Homo Sapiens
PVPERRGSP

SEQ ID NO: 492711 - protein, 9 aa, Homo Sapiens
PQPSVPEES

SEQ ID NO: 492712 - protein, 9 aa, Homo Sapiens
PPHSRSHPE

SEQ ID NO: 492713 - protein, 9 aa, Homo Sapiens
AKTVSEYNF

SEQ ID NO: 492714 - protein, 9 aa, Homo Sapiens
NTREKAQIC

SEQ ID NO: 492715 - protein, 9 aa, Homo Sapiens
TIENNKDLG

SEQ ID NO: 492716 - protein, 9 aa, Homo Sapiens
TDDEDDLME

SEQ ID NO: 492717 - protein, 9 aa, Homo Sapiens
TIATKTFLH

SEQ ID NO: 492718 - protein, 9 aa, Homo Sapiens
PLAASRPLS

SEQ ID NO: 492719 - protein, 9 aa, Homo Sapiens
QDVLVGNSM

SEQ ID NO: 492720 - protein, 9 aa, Homo Sapiens
SQATNSEGH

SEQ ID NO: 492721 - protein, 9 aa, Homo Sapiens
RTATTPYLV

SEQ ID NO: 492722 - protein, 9 aa, Homo Sapiens
ATPKKCAVP

SEQ ID NO: 492723 - protein, 9 aa, Homo Sapiens
DTSRSHESP

SEQ ID NO: 492724 - protein, 9 aa, Homo Sapiens
RNHKKKHMR

SEQ ID NO: 492725 - protein, 9 aa, Homo Sapiens
VTDASSEST

SEQ ID NO: 492726 - protein, 9 aa, Homo Sapiens
PSPPMWAPR

SEQ ID NO: 492727 - protein, 9 aa, Homo Sapiens
VITMFFNGL

SEQ ID NO: 492728 - protein, 9 aa, Homo Sapiens
HRKIQTGEK

SEQ ID NO: 492729 - protein, 9 aa, Homo Sapiens
PARHRSPMR

SEQ ID NO: 492730 - protein, 9 aa, Homo Sapiens
ASSESTGHA

SEQ ID NO: 492731 - protein, 9 aa, Homo Sapiens
QDLQPLTIL

SEQ ID NO: 492732 - protein, 9 aa, Homo Sapiens
LLSTFSHFF

SEQ ID NO: 492733 - protein, 9 aa, Homo Sapiens
EKQEEAITL

SEQ ID NO: 492734 - protein, 9 aa, Homo Sapiens
VAQAHTHAN

SEQ ID NO: 492735 - protein, 9 aa, Homo Sapiens
PAASGSCFL

SEQ ID NO: 492736 - protein, 9 aa, Homo Sapiens
QQSQVKLQH

SEQ ID NO: 492737 - protein, 9 aa, Homo Sapiens
DMRVDWARP

SEQ ID NO: 492738 - protein, 9 aa, Homo Sapiens
CEDIHSMRC

SEQ ID NO: 492739 - protein, 9 aa, Homo Sapiens
THLAEGRHG

SEQ ID NO: 492740 - protein, 9 aa, Homo Sapiens
KQRDVAQAH

SEQ ID NO: 492741 - protein, 9 aa, Homo Sapiens
NTLFRRNSL

SEQ ID NO: 492742 - protein, 9 aa, Homo Sapiens
SRRKSTVSL

SEQ ID NO: 492743 - protein, 9 aa, Homo Sapiens
VARVTKPDF

SEQ ID NO: 492744 - protein, 9 aa, Homo Sapiens
VEIKNATPD

SEQ ID NO: 492745 - protein, 9 aa, Homo Sapiens
HVLLTEVGA

SEQ ID NO: 492746 - protein, 9 aa, Homo Sapiens
ACQLRELRE

SEQ ID NO: 492747 - protein, 9 aa, Homo Sapiens
EHHKAVDEK

SEQ ID NO: 492748 - protein, 9 aa, Homo Sapiens
PVEFAAAAF

SEQ ID NO: 492749 - protein, 9 aa, Homo Sapiens
WNNSRVSPV

SEQ ID NO: 492750 - protein, 9 aa, Homo Sapiens
INTREKAQI

SEQ ID NO: 492751 - protein, 9 aa, Homo Sapiens
FQVFSNKLL

SEQ ID NO: 492752 - protein, 9 aa, Homo Sapiens
AEQAVSAGV

SEQ ID NO: 492753 - protein, 9 aa, Homo Sapiens
LSWEDKLVE

SEQ ID NO: 492754 - protein, 9 aa, Homo Sapiens
VKGLAGFAR

SEQ ID NO: 492755 - protein, 9 aa, Homo Sapiens
RRREKVGDI

SEQ ID NO: 492756 - protein, 9 aa, Homo Sapiens
LIAGQPGLL

SEQ ID NO: 492757 - protein, 9 aa, Homo Sapiens
FLLVARIVE

SEQ ID NO: 492758 - protein, 9 aa, Homo Sapiens
MLREHLREK

SEQ ID NO: 492759 - protein, 9 aa, Homo Sapiens
LGLHFHLRN

SEQ ID NO: 492760 - protein, 9 aa, Homo Sapiens
LTSRSAAQN

SEQ ID NO: 492761 - protein, 9 aa, Homo Sapiens
LLILFIRWT

SEQ ID NO: 492762 - protein, 9 aa, Homo Sapiens
KIINYLRKR

SEQ ID NO: 492763 - protein, 9 aa, Homo Sapiens
TTLSEEQAL

SEQ ID NO: 492764 - protein, 9 aa, Homo Sapiens
AIAWGQDVL

SEQ ID NO: 492765 - protein, 9 aa, Homo Sapiens
TAVDGLGRL

SEQ ID NO: 492766 - protein, 9 aa, Homo Sapiens
LRKRKERLM

SEQ ID NO: 492767 - protein, 9 aa, Homo Sapiens
ITSGTIENN

SEQ ID NO: 492768 - protein, 9 aa, Homo Sapiens
KRERPLVTK

SEQ ID NO: 492769 - protein, 9 aa, Homo Sapiens
LRRREKVGD

SEQ ID NO: 492770 - protein, 9 aa, Homo Sapiens
QFITRCWLR

SEQ ID NO: 492771 - protein, 9 aa, Homo Sapiens
HPESWPPSP

SEQ ID NO: 492772 - protein, 9 aa, Homo Sapiens
LFRRNSLAS

SEQ ID NO: 492773 - protein, 9 aa, Homo Sapiens
REQWEPVFP

SEQ ID NO: 492774 - protein, 9 aa, Homo Sapiens
SGMPDAPGL

SEQ ID NO: 492775 - protein, 9 aa, Homo Sapiens
IRLLTAELV

SEQ ID NO: 492776 - protein, 9 aa, Homo Sapiens
QMQTKDHRE

SEQ ID NO: 492777 - protein, 9 aa, Homo Sapiens
AVSREIVAI

SEQ ID NO: 492778 - protein, 9 aa, Homo Sapiens
ETHKIGSVA

SEQ ID NO: 492779 - protein, 9 aa, Homo Sapiens
LDYAAEGTE

SEQ ID NO: 492780 - protein, 9 aa, Homo Sapiens
TDASSESTG

SEQ ID NO: 492781 - protein, 9 aa, Homo Sapiens
EKAREKEEQ

SEQ ID NO: 492782 - protein, 9 aa, Homo Sapiens
PTTMGISWF

SEQ ID NO: 492783 - protein, 9 aa, Homo Sapiens
CPKSFVVAG

SEQ ID NO: 492784 - protein, 9 aa, Homo Sapiens
QGCTKFYEF

SEQ ID NO: 492785 - protein, 9 aa, Homo Sapiens
RFDIDTNTW

SEQ ID NO: 492786 - protein, 9 aa, Homo Sapiens
TLGLHFHLR

SEQ ID NO: 492787 - protein, 9 aa, Homo Sapiens
QRQFQGPMA

SEQ ID NO: 492788 - protein, 9 aa, Homo Sapiens
TIEEAYCRS

SEQ ID NO: 492789 - protein, 9 aa, Homo Sapiens
DCEQVLAGS

SEQ ID NO: 492790 - protein, 9 aa, Homo Sapiens
EKYGNIRCE

SEQ ID NO: 492791 - protein, 9 aa, Homo Sapiens
PLYAPPPPA

SEQ ID NO: 492792 - protein, 9 aa, Homo Sapiens
PNSSSSRMQ

SEQ ID NO: 492793 - protein, 9 aa, Homo Sapiens
LIFSGMPDA

SEQ ID NO: 492794 - protein, 9 aa, Homo Sapiens
KLLLQCVTH

SEQ ID NO: 492795 - protein, 9 aa, Homo Sapiens
VDEKVRERL

SEQ ID NO: 492796 - protein, 9 aa, Homo Sapiens
QCGCAFRER

SEQ ID NO: 492797 - protein, 9 aa, Homo Sapiens
APKRSPLAA

SEQ ID NO: 492798 - protein, 9 aa, Homo Sapiens
HVLRKVREE

SEQ ID NO: 492799 - protein, 9 aa, Homo Sapiens
QLVMWKVQQ

SEQ ID NO: 492800 - protein, 9 aa, Homo Sapiens
SVPEESDNE

SEQ ID NO: 492801 - protein, 9 aa, Homo Sapiens
YAKEEACQL

SEQ ID NO: 492802 - protein, 9 aa, Homo Sapiens
AFFPLCLSS

SEQ ID NO: 492803 - protein, 9 aa, Homo Sapiens
TLPTTMGIS

SEQ ID NO: 492804 - protein, 9 aa, Homo Sapiens
KAKLCSMKE

SEQ ID NO: 492805 - protein, 9 aa, Homo Sapiens
FATSPRVVV

SEQ ID NO: 492806 - protein, 9 aa, Homo Sapiens
DIVDVLSDT

SEQ ID NO: 492807 - protein, 9 aa, Homo Sapiens
RSPQANASP

SEQ ID NO: 492808 - protein, 9 aa, Homo Sapiens
IRTEITAYA

SEQ ID NO: 492809 - protein, 9 aa, Homo Sapiens
KSFVVAGPS

SEQ ID NO: 492810 - protein, 9 aa, Homo Sapiens
RTTQTPSLL

SEQ ID NO: 492811 - protein, 9 aa, Homo Sapiens
SISNNCSVV

SEQ ID NO: 492812 - protein, 9 aa, Homo Sapiens
DPKLAWVGH

SEQ ID NO: 492813 - protein, 9 aa, Homo Sapiens
AHHRKIQTG

SEQ ID NO: 492814 - protein, 9 aa, Homo Sapiens
LSCFPNTFL

SEQ ID NO: 492815 - protein, 9 aa, Homo Sapiens
DDFKSGEKR

SEQ ID NO: 492816 - protein, 9 aa, Homo Sapiens
PGTAFAAPP

SEQ ID NO: 492817 - protein, 9 aa, Homo Sapiens
LGYLLEQRT

SEQ ID NO: 492818 - protein, 9 aa, Homo Sapiens
YSLDKLGRV

SEQ ID NO: 492819 - protein, 9 aa, Homo Sapiens
VRSLEGHGV

SEQ ID NO: 492820 - protein, 9 aa, Homo Sapiens
RALSMSPLS

SEQ ID NO: 492821 - protein, 9 aa, Homo Sapiens
GRGVGRNSK

SEQ ID NO: 492822 - protein, 9 aa, Homo Sapiens
CEQVLAGSY

SEQ ID NO: 492823 - protein, 9 aa, Homo Sapiens
RTTVLYICE

SEQ ID NO: 492824 - protein, 9 aa, Homo Sapiens
CHLEGVSRL

SEQ ID NO: 492825 - protein, 9 aa, Homo Sapiens
SHVTALLTV

SEQ ID NO: 492826 - protein, 9 aa, Homo Sapiens
VLISDMAYV

SEQ ID NO: 492827 - protein, 9 aa, Homo Sapiens
IPEIKAEQQ

SEQ ID NO: 492828 - protein, 9 aa, Homo Sapiens
TKSLMTPSG

SEQ ID NO: 492829 - protein, 9 aa, Homo Sapiens
KKKILLNLS

SEQ ID NO: 492830 - protein, 9 aa, Homo Sapiens
ELAAPSQTC

SEQ ID NO: 492831 - protein, 9 aa, Homo Sapiens
VATHHLYQA

SEQ ID NO: 492832 - protein, 9 aa, Homo Sapiens
VCSFLLVAR

SEQ ID NO: 492833 - protein, 9 aa, Homo Sapiens
LAKKRVVQM

SEQ ID NO: 492834 - protein, 9 aa, Homo Sapiens
THIYIHTHT

SEQ ID NO: 492835 - protein, 9 aa, Homo Sapiens
LQCKVCGWP

SEQ ID NO: 492836 - protein, 9 aa, Homo Sapiens
QNHFRQAQV

SEQ ID NO: 492837 - protein, 9 aa, Homo Sapiens
VCSRNRHSQ

SEQ ID NO: 492838 - protein, 9 aa, Homo Sapiens
YGNIRCEDI

SEQ ID NO: 492839 - protein, 9 aa, Homo Sapiens
GAVFSCPWR

SEQ ID NO: 492840 - protein, 9 aa, Homo Sapiens
EQWEPVFPN

SEQ ID NO: 492841 - protein, 9 aa, Homo Sapiens
NIRCEDIHS

SEQ ID NO: 492842 - protein, 9 aa, Homo Sapiens
DRSTLTLRP

SEQ ID NO: 492843 - protein, 9 aa, Homo Sapiens
EEHFFGGAE

SEQ ID NO: 492844 - protein, 9 aa, Homo Sapiens
DLWTLIAGQ

SEQ ID NO: 492845 - protein, 9 aa, Homo Sapiens
RNQNFMYMR

SEQ ID NO: 492846 - protein, 9 aa, Homo Sapiens
LSSPFVTKS

SEQ ID NO: 492847 - protein, 9 aa, Homo Sapiens
KYRITYAYF

SEQ ID NO: 492848 - protein, 9 aa, Homo Sapiens
TARRSDSRD

SEQ ID NO: 492849 - protein, 9 aa, Homo Sapiens
SLITLSTAH

SEQ ID NO: 492850 - protein, 9 aa, Homo Sapiens
PLLGNVLSW

SEQ ID NO: 492851 - protein, 9 aa, Homo Sapiens
FIRTMSLIA

SEQ ID NO: 492852 - protein, 9 aa, Homo Sapiens
TISDEEIHN

SEQ ID NO: 492853 - protein, 9 aa, Homo Sapiens
KYWQHPHSF

SEQ ID NO: 492854 - protein, 9 aa, Homo Sapiens
DQGEYECVA

SEQ ID NO: 492855 - protein, 9 aa, Homo Sapiens
SSCAISLCK

SEQ ID NO: 492856 - protein, 9 aa, Homo Sapiens
LKGFINDDH

SEQ ID NO: 492857 - protein, 9 aa, Homo Sapiens
GFPVRHGKI

SEQ ID NO: 492858 - protein, 9 aa, Homo Sapiens
KQRTGITED

SEQ ID NO: 492859 - protein, 9 aa, Homo Sapiens
SVPWKTHSE

SEQ ID NO: 492860 - protein, 9 aa, Homo Sapiens
LSPLLASFF

SEQ ID NO: 492861 - protein, 9 aa, Homo Sapiens
VRGQGTFCS

SEQ ID NO: 492862 - protein, 9 aa, Homo Sapiens
LHKDGVVLF

SEQ ID NO: 492863 - protein, 9 aa, Homo Sapiens
REGEGKEKL

SEQ ID NO: 492864 - protein, 9 aa, Homo Sapiens
NGLRYHQAY

SEQ ID NO: 492865 - protein, 9 aa, Homo Sapiens
AQHAKNGHP

SEQ ID NO: 492866 - protein, 9 aa, Homo Sapiens
QKSLAAEEQ

SEQ ID NO: 492867 - protein, 9 aa, Homo Sapiens
SGVTGWRET

SEQ ID NO: 492868 - protein, 9 aa, Homo Sapiens
LFLGLGGLE

SEQ ID NO: 492869 - protein, 9 aa, Homo Sapiens
NRARILAPV

SEQ ID NO: 492870 - protein, 9 aa, Homo Sapiens
NPHGCCLYS

SEQ ID NO: 492871 - protein, 9 aa, Homo Sapiens
AAQASPEPD

SEQ ID NO: 492872 - protein, 9 aa, Homo Sapiens
DDHDEDEGE

SEQ ID NO: 492873 - protein, 9 aa, Homo Sapiens
LRHDVMADV

SEQ ID NO: 492874 - protein, 9 aa, Homo Sapiens
PSFAGPPFG

SEQ ID NO: 492875 - protein, 9 aa, Homo Sapiens
CPASLAPLG

SEQ ID NO: 492876 - protein, 9 aa, Homo Sapiens
SPFVHPATP

SEQ ID NO: 492877 - protein, 9 aa, Homo Sapiens
TEGPGECPS

SEQ ID NO: 492878 - protein, 9 aa, Homo Sapiens
QTQEQRTQT

SEQ ID NO: 492879 - protein, 9 aa, Homo Sapiens
GLHAFQERL

SEQ ID NO: 492880 - protein, 9 aa, Homo Sapiens
SIASPFVHP

SEQ ID NO: 492881 - protein, 9 aa, Homo Sapiens
NAVESGNKK

SEQ ID NO: 492882 - protein, 9 aa, Homo Sapiens
LSPEKLKEV

SEQ ID NO: 492883 - protein, 9 aa, Homo Sapiens
CTDNPLLHA

SEQ ID NO: 492884 - protein, 9 aa, Homo Sapiens
SNASSVCSE

SEQ ID NO: 492885 - protein, 9 aa, Homo Sapiens
PSMSISACS

SEQ ID NO: 492886 - protein, 9 aa, Homo Sapiens
DESLNSVKY

SEQ ID NO: 492887 - protein, 9 aa, Homo Sapiens
THSEADYKR

SEQ ID NO: 492888 - protein, 9 aa, Homo Sapiens
IPDKGDTTP

SEQ ID NO: 492889 - protein, 9 aa, Homo Sapiens
LGISEKSKS

SEQ ID NO: 492890 - protein, 9 aa, Homo Sapiens
PGPPGLCTP

SEQ ID NO: 492891 - protein, 9 aa, Homo Sapiens
KKRPSATNM

SEQ ID NO: 492892 - protein, 9 aa, Homo Sapiens
EADGQCSVD

SEQ ID NO: 492893 - protein, 9 aa, Homo Sapiens
MATSQYPYS

SEQ ID NO: 492894 - protein, 9 aa, Homo Sapiens
LDCSLASVF

SEQ ID NO: 492895 - protein, 9 aa, Homo Sapiens
PKKRPSATN

SEQ ID NO: 492896 - protein, 9 aa, Homo Sapiens
DLAACAQFD

SEQ ID NO: 492897 - protein, 9 aa, Homo Sapiens
IQAPPRLLQ

SEQ ID NO: 492898 - protein, 9 aa, Homo Sapiens
FKVLLLFQE

SEQ ID NO: 492899 - protein, 9 aa, Homo Sapiens
EVNGRDYHF

SEQ ID NO: 492900 - protein, 9 aa, Homo Sapiens
ILEKKHSGA

SEQ ID NO: 492901 - protein, 9 aa, Homo Sapiens
DMVAGCRLL

SEQ ID NO: 492902 - protein, 9 aa, Homo Sapiens
RWQETARTL

SEQ ID NO: 492903 - protein, 9 aa, Homo Sapiens
DDRPKTRSQ

SEQ ID NO: 492904 - protein, 9 aa, Homo Sapiens
ELPDSVPHT

SEQ ID NO: 492905 - protein, 9 aa, Homo Sapiens
SNKTLLALE

SEQ ID NO: 492906 - protein, 9 aa, Homo Sapiens
SRPLAAGIN

SEQ ID NO: 492907 - protein, 9 aa, Homo Sapiens
LGLGGLECL

SEQ ID NO: 492908 - protein, 9 aa, Homo Sapiens
NLSRKMCQQ

SEQ ID NO: 492909 - protein, 9 aa, Homo Sapiens
AACNALRDE

SEQ ID NO: 492910 - protein, 9 aa, Homo Sapiens
ETVFSQVLT

SEQ ID NO: 492911 - protein, 9 aa, Homo Sapiens
LGEASLQPS

SEQ ID NO: 492912 - protein, 9 aa, Homo Sapiens
IRPFKQRKS

SEQ ID NO: 492913 - protein, 9 aa, Homo Sapiens
EKNGTIWFY

SEQ ID NO: 492914 - protein, 9 aa, Homo Sapiens
SPNKVMALK

SEQ ID NO: 492915 - protein, 9 aa, Homo Sapiens
PGFPVSFPL

SEQ ID NO: 492916 - protein, 9 aa, Homo Sapiens
GIELFVAGI

SEQ ID NO: 492917 - protein, 9 aa, Homo Sapiens
KNGTIWFYD

SEQ ID NO: 492918 - protein, 9 aa, Homo Sapiens
RAERAQSKL

SEQ ID NO: 492919 - protein, 9 aa, Homo Sapiens
PKHFRRPEP

SEQ ID NO: 492920 - protein, 9 aa, Homo Sapiens
SDMKFQAPT

SEQ ID NO: 492921 - protein, 9 aa, Homo Sapiens
EQEDGKEEE

SEQ ID NO: 492922 - protein, 9 aa, Homo Sapiens
VSFPLAYPP

SEQ ID NO: 492923 - protein, 9 aa, Homo Sapiens
PGGVHYRTN

SEQ ID NO: 492924 - protein, 9 aa, Homo Sapiens
ICKLAWQPK

SEQ ID NO: 492925 - protein, 9 aa, Homo Sapiens
KEEEQRAAC

SEQ ID NO: 492926 - protein, 9 aa, Homo Sapiens
EPSWGPLDE

SEQ ID NO: 492927 - protein, 9 aa, Homo Sapiens
KLVGMEDDE

SEQ ID NO: 492928 - protein, 9 aa, Homo Sapiens
ELMAMYVAA

SEQ ID NO: 492929 - protein, 9 aa, Homo Sapiens
ISDEEIHNE

SEQ ID NO: 492930 - protein, 9 aa, Homo Sapiens
SELSNPSKT

SEQ ID NO: 492931 - protein, 9 aa, Homo Sapiens
TLKWDSCAA

SEQ ID NO: 492932 - protein, 9 aa, Homo Sapiens
LSLIEYYKW

SEQ ID NO: 492933 - protein, 9 aa, Homo Sapiens
MNSLEKQET

SEQ ID NO: 492934 - protein, 9 aa, Homo Sapiens
PWVVGRELT

SEQ ID NO: 492935 - protein, 9 aa, Homo Sapiens
RERAHGEEL

SEQ ID NO: 492936 - protein, 9 aa, Homo Sapiens
LFHEKMHVV

SEQ ID NO: 492937 - protein, 9 aa, Homo Sapiens
MLSSCAISL

SEQ ID NO: 492938 - protein, 9 aa, Homo Sapiens
YGHMEEGAS

SEQ ID NO: 492939 - protein, 9 aa, Homo Sapiens
CHWTLPNNT

SEQ ID NO: 492940 - protein, 9 aa, Homo Sapiens
LRHLMPNLG

SEQ ID NO: 492941 - protein, 9 aa, Homo Sapiens
AISCFTNSQ

SEQ ID NO: 492942 - protein, 9 aa, Homo Sapiens
EVVVTVSGA

SEQ ID NO: 492943 - protein, 9 aa, Homo Sapiens
HLAQGARAV

SEQ ID NO: 492944 - protein, 9 aa, Homo Sapiens
QAARQRKAA

SEQ ID NO: 492945 - protein, 9 aa, Homo Sapiens
IPKDKSWKV

SEQ ID NO: 492946 - protein, 9 aa, Homo Sapiens
LSQGDLSHS

SEQ ID NO: 492947 - protein, 9 aa, Homo Sapiens
RLQLNGNVQ

SEQ ID NO: 492948 - protein, 9 aa, Homo Sapiens
VKQACCQFL

SEQ ID NO: 492949 - protein, 9 aa, Homo Sapiens
IFGLPREVV

SEQ ID NO: 492950 - protein, 9 aa, Homo Sapiens
WIKVARECR

SEQ ID NO: 492951 - protein, 9 aa, Homo Sapiens
FGLSIRLTG

SEQ ID NO: 492952 - protein, 9 aa, Homo Sapiens
LWALPPSRA

SEQ ID NO: 492953 - protein, 9 aa, Homo Sapiens
QTNVINVPG

SEQ ID NO: 492954 - protein, 9 aa, Homo Sapiens
SLNFLYGTM

SEQ ID NO: 492955 - protein, 9 aa, Homo Sapiens
ELDMMVPLQ

SEQ ID NO: 492956 - protein, 9 aa, Homo Sapiens
QHERDAIYE

SEQ ID NO: 492957 - protein, 9 aa, Homo Sapiens
SLHCEGQTR

SEQ ID NO: 492958 - protein, 9 aa, Homo Sapiens
QPQPWTQVD

SEQ ID NO: 492959 - protein, 9 aa, Homo Sapiens
LKLTCAGPA

SEQ ID NO: 492960 - protein, 9 aa, Homo Sapiens
CFLIVAHSN

SEQ ID NO: 492961 - protein, 9 aa, Homo Sapiens
GNRMQESQK

SEQ ID NO: 492962 - protein, 9 aa, Homo Sapiens
ATESAHSIE

SEQ ID NO: 492963 - protein, 9 aa, Homo Sapiens
YTGEKPYEC

SEQ ID NO: 492964 - protein, 9 aa, Homo Sapiens
KRDYEVNGR

SEQ ID NO: 492965 - protein, 9 aa, Homo Sapiens
YLSSSHWSC

SEQ ID NO: 492966 - protein, 9 aa, Homo Sapiens
WSDDQSNNP

SEQ ID NO: 492967 - protein, 9 aa, Homo Sapiens
RLCKLIKKF

SEQ ID NO: 492968 - protein, 9 aa, Homo Sapiens
GSECFQDPE

SEQ ID NO: 492969 - protein, 9 aa, Homo Sapiens
YRELEYESG

SEQ ID NO: 492970 - protein, 9 aa, Homo Sapiens
WQRQWMGDG

SEQ ID NO: 492971 - protein, 9 aa, Homo Sapiens
SLNHLAQGA

SEQ ID NO: 492972 - protein, 9 aa, Homo Sapiens
SSSNPPTLA

SEQ ID NO: 492973 - protein, 9 aa, Homo Sapiens
RLFSRVIPK

SEQ ID NO: 492974 - protein, 9 aa, Homo Sapiens
TCQPTVPYH

SEQ ID NO: 492975 - protein, 9 aa, Homo Sapiens
CSYPSAIDP

SEQ ID NO: 492976 - protein, 9 aa, Homo Sapiens
EEGEVGEKI

SEQ ID NO: 492977 - protein, 9 aa, Homo Sapiens
AKGKEYLAC

SEQ ID NO: 492978 - protein, 9 aa, Homo Sapiens
APVHKAAEN

SEQ ID NO: 492979 - protein, 9 aa, Homo Sapiens
LFVAGIGPD

SEQ ID NO: 492980 - protein, 9 aa, Homo Sapiens
ASGVTGWRE

SEQ ID NO: 492981 - protein, 9 aa, Homo Sapiens
GFPVSFPLA

SEQ ID NO: 492982 - protein, 9 aa, Homo Sapiens
SLKIISRYL

SEQ ID NO: 492983 - protein, 9 aa, Homo Sapiens
KTRSKQEIA

SEQ ID NO: 492984 - protein, 9 aa, Homo Sapiens
LENYSPASM

SEQ ID NO: 492985 - protein, 9 aa, Homo Sapiens
LNGSAEFDG

SEQ ID NO: 492986 - protein, 9 aa, Homo Sapiens
VYDIPDLLV

SEQ ID NO: 492987 - protein, 9 aa, Homo Sapiens
PKASPKSEA

SEQ ID NO: 492988 - protein, 9 aa, Homo Sapiens
FHSSLSSDY

SEQ ID NO: 492989 - protein, 9 aa, Homo Sapiens
QNLENDEDA

SEQ ID NO: 492990 - protein, 9 aa, Homo Sapiens
APGPLGQSV

SEQ ID NO: 492991 - protein, 9 aa, Homo Sapiens
ISLCKSVKA

SEQ ID NO: 492992 - protein, 9 aa, Homo Sapiens
DLSHSPRKK

SEQ ID NO: 492993 - protein, 9 aa, Homo Sapiens
SRFFCRISS

SEQ ID NO: 492994 - protein, 9 aa, Homo Sapiens
FPLAYPPPQ

SEQ ID NO: 492995 - protein, 9 aa, Homo Sapiens
VQARNLFAQ

SEQ ID NO: 492996 - protein, 9 aa, Homo Sapiens
DSSDSSNSD

SEQ ID NO: 492997 - protein, 9 aa, Homo Sapiens
HKDGVVLFK

SEQ ID NO: 492998 - protein, 9 aa, Homo Sapiens
GECKWPGCQ

SEQ ID NO: 492999 - protein, 9 aa, Homo Sapiens
NCCNTKNPP

SEQ ID NO: 493000 - protein, 9 aa, Homo Sapiens
LQRQKLERE

SEQ ID NO: 493001 - protein, 9 aa, Homo Sapiens
LLFASASHG

SEQ ID NO: 493002 - protein, 9 aa, Homo Sapiens
QKNCSVPLA

SEQ ID NO: 493003 - protein, 9 aa, Homo Sapiens
QFDSSRQSR

SEQ ID NO: 493004 - protein, 9 aa, Homo Sapiens
NGNVQLELA

SEQ ID NO: 493005 - protein, 9 aa, Homo Sapiens
GVSLSLRHC

SEQ ID NO: 493006 - protein, 9 aa, Homo Sapiens
QEDLDKTAG

SEQ ID NO: 493007 - protein, 9 aa, Homo Sapiens
GVPRGEVLD

SEQ ID NO: 493008 - protein, 9 aa, Homo Sapiens
SINELKQQP

SEQ ID NO: 493009 - protein, 9 aa, Homo Sapiens
IYINNLNEN

SEQ ID NO: 493010 - protein, 9 aa, Homo Sapiens
QLAGQSLLR

SEQ ID NO: 493011 - protein, 9 aa, Homo Sapiens
AAVAMPSFA

SEQ ID NO: 493012 - protein, 9 aa, Homo Sapiens
PVHKAAENS

SEQ ID NO: 493013 - protein, 9 aa, Homo Sapiens
SSGTDSTIT

SEQ ID NO: 493014 - protein, 9 aa, Homo Sapiens
RNIGDLFLN

SEQ ID NO: 493015 - protein, 9 aa, Homo Sapiens
SRGAIYFIP

SEQ ID NO: 493016 - protein, 9 aa, Homo Sapiens
RALLIHEKN

SEQ ID NO: 493017 - protein, 9 aa, Homo Sapiens
PPQTAQHAK

SEQ ID NO: 493018 - protein, 9 aa, Homo Sapiens
TSLNHLAQG

SEQ ID NO: 493019 - protein, 9 aa, Homo Sapiens
LDETPPESP

SEQ ID NO: 493020 - protein, 9 aa, Homo Sapiens
LSSSHWSCG

SEQ ID NO: 493021 - protein, 9 aa, Homo Sapiens
SISACSQSS

SEQ ID NO: 493022 - protein, 9 aa, Homo Sapiens
KLHFESIQT

SEQ ID NO: 493023 - protein, 9 aa, Homo Sapiens
DAAQASPEP

SEQ ID NO: 493024 - protein, 9 aa, Homo Sapiens
LKCVKTSHF

SEQ ID NO: 493025 - protein, 9 aa, Homo Sapiens
LQELGPEPE

SEQ ID NO: 493026 - protein, 9 aa, Homo Sapiens
ENELAGSRK

SEQ ID NO: 493027 - protein, 9 aa, Homo Sapiens
AVFSVFSVC

SEQ ID NO: 493028 - protein, 9 aa, Homo Sapiens
SLPPACSES

SEQ ID NO: 493029 - protein, 9 aa, Homo Sapiens
HSEADYKRH

SEQ ID NO: 493030 - protein, 9 aa, Homo Sapiens
KNGHPQALP

SEQ ID NO: 493031 - protein, 9 aa, Homo Sapiens
AANIFEGIR

SEQ ID NO: 493032 - protein, 9 aa, Homo Sapiens
PEGDWQRQW

SEQ ID NO: 493033 - protein, 9 aa, Homo Sapiens
VHGRLETTY

SEQ ID NO: 493034 - protein, 9 aa, Homo Sapiens
FVHPATPIS

SEQ ID NO: 493035 - protein, 9 aa, Homo Sapiens
PQFLCDIKH

SEQ ID NO: 493036 - protein, 9 aa, Homo Sapiens
HDCSCTDNP

SEQ ID NO: 493037 - protein, 9 aa, Homo Sapiens
KEEEKKVDS

SEQ ID NO: 493038 - protein, 9 aa, Homo Sapiens
LVGMEDDEP

SEQ ID NO: 493039 - protein, 9 aa, Homo Sapiens
LGGLECLLL

SEQ ID NO: 493040 - protein, 9 aa, Homo Sapiens
PWHPMKPGG

SEQ ID NO: 493041 - protein, 9 aa, Homo Sapiens
TFRRHFLEI

SEQ ID NO: 493042 - protein, 9 aa, Homo Sapiens
YRQSLKIIS

SEQ ID NO: 493043 - protein, 9 aa, Homo Sapiens
RLWRKKFPP

SEQ ID NO: 493044 - protein, 9 aa, Homo Sapiens
KWDKFAYLY

SEQ ID NO: 493045 - protein, 9 aa, Homo Sapiens
RKVILMYPI

SEQ ID NO: 493046 - protein, 9 aa, Homo Sapiens
SKLPSWPGA

SEQ ID NO: 493047 - protein, 9 aa, Homo Sapiens
LIPNVLGEG

SEQ ID NO: 493048 - protein, 9 aa, Homo Sapiens
KLMYLDLSG

SEQ ID NO: 493049 - protein, 9 aa, Homo Sapiens
QRQKLEREE

SEQ ID NO: 493050 - protein, 9 aa, Homo Sapiens
ASSCFLIVA

SEQ ID NO: 493051 - protein, 9 aa, Homo Sapiens
LEFPILEKQ

SEQ ID NO: 493052 - protein, 9 aa, Homo Sapiens
ALFQLSNVT

SEQ ID NO: 493053 - protein, 9 aa, Homo Sapiens
LEQGKEPWV

SEQ ID NO: 493054 - protein, 9 aa, Homo Sapiens
YIYLSKRRV

SEQ ID NO: 493055 - protein, 9 aa, Homo Sapiens
KKHSGAATG

SEQ ID NO: 493056 - protein, 9 aa, Homo Sapiens
CVKTSHFFP

SEQ ID NO: 493057 - protein, 9 aa, Homo Sapiens
TPTVQEDSE

SEQ ID NO: 493058 - protein, 9 aa, Homo Sapiens
CEVKEPRHG

SEQ ID NO: 493059 - protein, 9 aa, Homo Sapiens
FLPIETKCR

SEQ ID NO: 493060 - protein, 9 aa, Homo Sapiens
KLYQVKGNK

SEQ ID NO: 493061 - protein, 9 aa, Homo Sapiens
TLRLSAEGT

SEQ ID NO: 493062 - protein, 9 aa, Homo Sapiens
RKEAKRIAR

SEQ ID NO: 493063 - protein, 9 aa, Homo Sapiens
HWTLPNNTE

SEQ ID NO: 493064 - protein, 9 aa, Homo Sapiens
MYKLTFELL

SEQ ID NO: 493065 - protein, 9 aa, Homo Sapiens
QNTIDLRVL

SEQ ID NO: 493066 - protein, 9 aa, Homo Sapiens
PHFNRKRLC

SEQ ID NO: 493067 - protein, 9 aa, Homo Sapiens
SCAISLCKS

SEQ ID NO: 493068 - protein, 9 aa, Homo Sapiens
NPPGDLNTP

SEQ ID NO: 493069 - protein, 9 aa, Homo Sapiens
TIAGLMSML

SEQ ID NO: 493070 - protein, 9 aa, Homo Sapiens
LLCIHNEEE

SEQ ID NO: 493071 - protein, 9 aa, Homo Sapiens
APWHPMKPG

SEQ ID NO: 493072 - protein, 9 aa, Homo Sapiens
DDQSNNPFS

SEQ ID NO: 493073 - protein, 9 aa, Homo Sapiens
FTEALEQSN

SEQ ID NO: 493074 - protein, 9 aa, Homo Sapiens
ATFVCELFH

SEQ ID NO: 493075 - protein, 9 aa, Homo Sapiens
KFKSGFSQV

SEQ ID NO: 493076 - protein, 9 aa, Homo Sapiens
GKMNALNKV

SEQ ID NO: 493077 - protein, 9 aa, Homo Sapiens
RAASVRRRS

SEQ ID NO: 493078 - protein, 9 aa, Homo Sapiens
LGLRKLSSK

SEQ ID NO: 493079 - protein, 9 aa, Homo Sapiens
QSCPVCRWR

SEQ ID NO: 493080 - protein, 9 aa, Homo Sapiens
IINAVESGN

SEQ ID NO: 493081 - protein, 9 aa, Homo Sapiens
CSVDRSLLK

SEQ ID NO: 493082 - protein, 9 aa, Homo Sapiens
NIFEGIRIE

SEQ ID NO: 493083 - protein, 9 aa, Homo Sapiens
AIETLMKNF

SEQ ID NO: 493084 - protein, 9 aa, Homo Sapiens
TKRWLEYNL

SEQ ID NO: 493085 - protein, 9 aa, Homo Sapiens
ETARTLCAF

SEQ ID NO: 493086 - protein, 9 aa, Homo Sapiens
VLSELDMMV

SEQ ID NO: 493087 - protein, 9 aa, Homo Sapiens
PLLETVFSQ

SEQ ID NO: 493088 - protein, 9 aa, Homo Sapiens
LKKYRAAAF

SEQ ID NO: 493089 - protein, 9 aa, Homo Sapiens
NHKLLQYGH

SEQ ID NO: 493090 - protein, 9 aa, Homo Sapiens
PWKQRTGIT

SEQ ID NO: 493091 - protein, 9 aa, Homo Sapiens
STRERAHGE

SEQ ID NO: 493092 - protein, 9 aa, Homo Sapiens
APKSQTKGR

SEQ ID NO: 493093 - protein, 9 aa, Homo Sapiens
IRQISRPLA

SEQ ID NO: 493094 - protein, 9 aa, Homo Sapiens
SGYEGANMG

SEQ ID NO: 493095 - protein, 9 aa, Homo Sapiens
YLRLWRKKF

SEQ ID NO: 493096 - protein, 9 aa, Homo Sapiens
YHQAYAHLD

SEQ ID NO: 493097 - protein, 9 aa, Homo Sapiens
AGVTSKFVS

SEQ ID NO: 493098 - protein, 9 aa, Homo Sapiens
DSHDEHPFP

SEQ ID NO: 493099 - protein, 9 aa, Homo Sapiens
HEKNTSSAM

SEQ ID NO: 493100 - protein, 9 aa, Homo Sapiens
LTMNSLEKQ

SEQ ID NO: 493101 - protein, 9 aa, Homo Sapiens
GMCYLHAKG

SEQ ID NO: 493102 - protein, 9 aa, Homo Sapiens
EGLAQKKFP

SEQ ID NO: 493103 - protein, 9 aa, Homo Sapiens
LKLRWELEE

SEQ ID NO: 493104 - protein, 9 aa, Homo Sapiens
LPQHERDAI

SEQ ID NO: 493105 - protein, 9 aa, Homo Sapiens
GLLYIIGIL

SEQ ID NO: 493106 - protein, 9 aa, Homo Sapiens
RASGVTGWR

SEQ ID NO: 493107 - protein, 9 aa, Homo Sapiens
GLECLLLAV

SEQ ID NO: 493108 - protein, 9 aa, Homo Sapiens
EAQTMMKLI

SEQ ID NO: 493109 - protein, 9 aa, Homo Sapiens
NENMEHNEQ

SEQ ID NO: 493110 - protein, 9 aa, Homo Sapiens
LSNGTAAHP

SEQ ID NO: 493111 - protein, 9 aa, Homo Sapiens
EEFLELSPE

SEQ ID NO: 493112 - protein, 9 aa, Homo Sapiens
KYCRALEEN

SEQ ID NO: 493113 - protein, 9 aa, Homo Sapiens
SSPRRRSYS

SEQ ID NO: 493114 - protein, 9 aa, Homo Sapiens
QAVWAVGNI

SEQ ID NO: 493115 - protein, 9 aa, Homo Sapiens
ARTLCAFNS

SEQ ID NO: 493116 - protein, 9 aa, Homo Sapiens
LLTILPKEL

SEQ ID NO: 493117 - protein, 9 aa, Homo Sapiens
ASEDTPEVP

SEQ ID NO: 493118 - protein, 9 aa, Homo Sapiens
NDDHDEDEG

SEQ ID NO: 493119 - protein, 9 aa, Homo Sapiens
GGVVDPVHR

SEQ ID NO: 493120 - protein, 9 aa, Homo Sapiens
FSSGGSPAA

SEQ ID NO: 493121 - protein, 9 aa, Homo Sapiens
NKKDHTLGN

SEQ ID NO: 493122 - protein, 9 aa, Homo Sapiens
TKNAKRNYL

SEQ ID NO: 493123 - protein, 9 aa, Homo Sapiens
AVTKRKRCA

SEQ ID NO: 493124 - protein, 9 aa, Homo Sapiens
AGHFQNKHP

SEQ ID NO: 493125 - protein, 9 aa, Homo Sapiens
GTIWFYDLL

SEQ ID NO: 493126 - protein, 9 aa, Homo Sapiens
SSHWSCGAP

SEQ ID NO: 493127 - protein, 9 aa, Homo Sapiens
YNLDHTDSS

SEQ ID NO: 493128 - protein, 9 aa, Homo Sapiens
NICYGWHHP

SEQ ID NO: 493129 - protein, 9 aa, Homo Sapiens
HGHLAGAKG

SEQ ID NO: 493130 - protein, 9 aa, Homo Sapiens
SVLQELGPE

SEQ ID NO: 493131 - protein, 9 aa, Homo Sapiens
DANSNASSV

SEQ ID NO: 493132 - protein, 9 aa, Homo Sapiens
TKRKRCAVA

SEQ ID NO: 493133 - protein, 9 aa, Homo Sapiens
AFLYPYMEG

SEQ ID NO: 493134 - protein, 9 aa, Homo Sapiens
RSLAKNGMD

SEQ ID NO: 493135 - protein, 9 aa, Homo Sapiens
HSPRKKDRK

SEQ ID NO: 493136 - protein, 9 aa, Homo Sapiens
QNPFSSGGS

SEQ ID NO: 493137 - protein, 9 aa, Homo Sapiens
AVWAVGNIA

SEQ ID NO: 493138 - protein, 9 aa, Homo Sapiens
INAAIKRLL

SEQ ID NO: 493139 - protein, 9 aa, Homo Sapiens
LCKLIKKFQ

SEQ ID NO: 493140 - protein, 9 aa, Homo Sapiens
FSVFSVCAC

SEQ ID NO: 493141 - protein, 9 aa, Homo Sapiens
AGPPLSNGT

SEQ ID NO: 493142 - protein, 9 aa, Homo Sapiens
CSLAQAQYD

SEQ ID NO: 493143 - protein, 9 aa, Homo Sapiens
PPPATGNML

SEQ ID NO: 493144 - protein, 9 aa, Homo Sapiens
SKLPKHFRR

SEQ ID NO: 493145 - protein, 9 aa, Homo Sapiens
LTAAETRGT

SEQ ID NO: 493146 - protein, 9 aa, Homo Sapiens
KRKRCAVAL

SEQ ID NO: 493147 - protein, 9 aa, Homo Sapiens
ESPTRALPR

SEQ ID NO: 493148 - protein, 9 aa, Homo Sapiens
LRYHQAYAH

SEQ ID NO: 493149 - protein, 9 aa, Homo Sapiens
AYAHLDPEN

SEQ ID NO: 493150 - protein, 9 aa, Homo Sapiens
LCTPHQEDG

SEQ ID NO: 493151 - protein, 9 aa, Homo Sapiens
AIRELQRQK

SEQ ID NO: 493152 - protein, 9 aa, Homo Sapiens
RHQLIYTGE

SEQ ID NO: 493153 - protein, 9 aa, Homo Sapiens
SDSSNSDSS

SEQ ID NO: 493154 - protein, 9 aa, Homo Sapiens
KGFVKIAFT

SEQ ID NO: 493155 - protein, 9 aa, Homo Sapiens
GPKGSRRPE

SEQ ID NO: 493156 - protein, 9 aa, Homo Sapiens
TDNPLLHAV

SEQ ID NO: 493157 - protein, 9 aa, Homo Sapiens
PLSNGTAAH

SEQ ID NO: 493158 - protein, 9 aa, Homo Sapiens
SPTLTLSPH

SEQ ID NO: 493159 - protein, 9 aa, Homo Sapiens
LLWALPPSR

SEQ ID NO: 493160 - protein, 9 aa, Homo Sapiens
KMNALNKVN

SEQ ID NO: 493161 - protein, 9 aa, Homo Sapiens
EVVGVFTVA

SEQ ID NO: 493162 - protein, 9 aa, Homo Sapiens
NVPSERPFY

SEQ ID NO: 493163 - protein, 9 aa, Homo Sapiens
TSSLTPPKD

SEQ ID NO: 493164 - protein, 9 aa, Homo Sapiens
SYSRQTSDS

SEQ ID NO: 493165 - protein, 9 aa, Homo Sapiens
SCFLIVAHS

SEQ ID NO: 493166 - protein, 9 aa, Homo Sapiens
FVDGLHSDE

SEQ ID NO: 493167 - protein, 9 aa, Homo Sapiens
QRAACNALR

SEQ ID NO: 493168 - protein, 9 aa, Homo Sapiens
RSLRAQLEL

SEQ ID NO: 493169 - protein, 9 aa, Homo Sapiens
DTEGLAQKK

SEQ ID NO: 493170 - protein, 9 aa, Homo Sapiens
WFYDLLAQQ

SEQ ID NO: 493171 - protein, 9 aa, Homo Sapiens
CLFTINKKD

SEQ ID NO: 493172 - protein, 9 aa, Homo Sapiens
AMTLDLYHS

SEQ ID NO: 493173 - protein, 9 aa, Homo Sapiens
AGNARHGPV

SEQ ID NO: 493174 - protein, 9 aa, Homo Sapiens
ERKQQLDKC

SEQ ID NO: 493175 - protein, 9 aa, Homo Sapiens
YGISHHSSA

SEQ ID NO: 493176 - protein, 9 aa, Homo Sapiens
QWVQILAEG

SEQ ID NO: 493177 - protein, 9 aa, Homo Sapiens
IHNEPEERP

SEQ ID NO: 493178 - protein, 9 aa, Homo Sapiens
TQEQRTQTN

SEQ ID NO: 493179 - protein, 9 aa, Homo Sapiens
LWVTQPHPH

SEQ ID NO: 493180 - protein, 9 aa, Homo Sapiens
WELEEAALQ

SEQ ID NO: 493181 - protein, 9 aa, Homo Sapiens
ESAHKCPTC

SEQ ID NO: 493182 - protein, 9 aa, Homo Sapiens
ILAPVLILD

SEQ ID NO: 493183 - protein, 9 aa, Homo Sapiens
ILPTCQPTV

SEQ ID NO: 493184 - protein, 9 aa, Homo Sapiens
GGLTAAGVT

SEQ ID NO: 493185 - protein, 9 aa, Homo Sapiens
MPDPAGPNG

SEQ ID NO: 493186 - protein, 9 aa, Homo Sapiens
NVLGEGIYA

SEQ ID NO: 493187 - protein, 9 aa, Homo Sapiens
TGMCYPLRS

SEQ ID NO: 493188 - protein, 9 aa, Homo Sapiens
SLEKQETVC

SEQ ID NO: 493189 - protein, 9 aa, Homo Sapiens
VDQITDLPS

SEQ ID NO: 493190 - protein, 9 aa, Homo Sapiens
GNKKAEIAA

SEQ ID NO: 493191 - protein, 9 aa, Homo Sapiens
REEGEVGEK

SEQ ID NO: 493192 - protein, 9 aa, Homo Sapiens
EDSEEEEVD

SEQ ID NO: 493193 - protein, 9 aa, Homo Sapiens
NLILKKYRA

SEQ ID NO: 493194 - protein, 9 aa, Homo Sapiens
LTYVVSHVP

SEQ ID NO: 493195 - protein, 9 aa, Homo Sapiens
NIGDLFLNG

SEQ ID NO: 493196 - protein, 9 aa, Homo Sapiens
MQSGYEGAN

SEQ ID NO: 493197 - protein, 9 aa, Homo Sapiens
ISKQAALLG

SEQ ID NO: 493198 - protein, 9 aa, Homo Sapiens
LHAGFKMIS

SEQ ID NO: 493199 - protein, 9 aa, Homo Sapiens
DPMPCACGQ

SEQ ID NO: 493200 - protein, 9 aa, Homo Sapiens
KLSSGNIGE

SEQ ID NO: 493201 - protein, 9 aa, Homo Sapiens
VKTSHFFPS

SEQ ID NO: 493202 - protein, 9 aa, Homo Sapiens
KQEIAEILC

SEQ ID NO: 493203 - protein, 9 aa, Homo Sapiens
KEPWVVGRE

SEQ ID NO: 493204 - protein, 9 aa, Homo Sapiens
QYPDCKLSS

SEQ ID NO: 493205 - protein, 9 aa, Homo Sapiens
QRSLRAQLE

SEQ ID NO: 493206 - protein, 9 aa, Homo Sapiens
WKQRTGITE

SEQ ID NO: 493207 - protein, 9 aa, Homo Sapiens
TAGHFQNKH

SEQ ID NO: 493208 - protein, 9 aa, Homo Sapiens
VAMPSFAGP

SEQ ID NO: 493209 - protein, 9 aa, Homo Sapiens
VPEPHSLTA

SEQ ID NO: 493210 - protein, 9 aa, Homo Sapiens
KAPAEEDLL

SEQ ID NO: 493211 - protein, 9 aa, Homo Sapiens
RVHLPQAAA

SEQ ID NO: 493212 - protein, 9 aa, Homo Sapiens
WRATDELGL

SEQ ID NO: 493213 - protein, 9 aa, Homo Sapiens
SACKAMVGH

SEQ ID NO: 493214 - protein, 9 aa, Homo Sapiens
GGIELFVAG

SEQ ID NO: 493215 - protein, 9 aa, Homo Sapiens
TTAISCFTN

SEQ ID NO: 493216 - protein, 9 aa, Homo Sapiens
ESDQGEYEC

SEQ ID NO: 493217 - protein, 9 aa, Homo Sapiens
VVVTVSGAT

SEQ ID NO: 493218 - protein, 9 aa, Homo Sapiens
NMEHNEQKE

SEQ ID NO: 493219 - protein, 9 aa, Homo Sapiens
STVEDIAAQ

SEQ ID NO: 493220 - protein, 9 aa, Homo Sapiens
AEPSWGPLD

SEQ ID NO: 493221 - protein, 9 aa, Homo Sapiens
EIKSATDRD

SEQ ID NO: 493222 - protein, 9 aa, Homo Sapiens
YEDGSGGPV

SEQ ID NO: 493223 - protein, 9 aa, Homo Sapiens
KMCQQEQTS

SEQ ID NO: 493224 - protein, 9 aa, Homo Sapiens
KKSAFLEAH

SEQ ID NO: 493225 - protein, 9 aa, Homo Sapiens
VPAPKSQTK

SEQ ID NO: 493226 - protein, 9 aa, Homo Sapiens
KLGRGEFLH

SEQ ID NO: 493227 - protein, 9 aa, Homo Sapiens
TRVQHALPA

SEQ ID NO: 493228 - protein, 9 aa, Homo Sapiens
LPDLLSWKA

SEQ ID NO: 493229 - protein, 9 aa, Homo Sapiens
NGHLPAVAT

SEQ ID NO: 493230 - protein, 9 aa, Homo Sapiens
NSATESAHS

SEQ ID NO: 493231 - protein, 9 aa, Homo Sapiens
MKPQGFRIE

SEQ ID NO: 493232 - protein, 9 aa, Homo Sapiens
MQESAHKCP

SEQ ID NO: 493233 - protein, 9 aa, Homo Sapiens
YSAKDEAHP

SEQ ID NO: 493234 - protein, 9 aa, Homo Sapiens
RKGFVKIAF

SEQ ID NO: 493235 - protein, 9 aa, Homo Sapiens
RHSSDFDTQ

SEQ ID NO: 493236 - protein, 9 aa, Homo Sapiens
ACAQFDSSR

SEQ ID NO: 493237 - protein, 9 aa, Homo Sapiens
RHCPSKCRL

SEQ ID NO: 493238 - protein, 9 aa, Homo Sapiens
LQAIKDLDG

SEQ ID NO: 493239 - protein, 9 aa, Homo Sapiens
SSPNKVMAL

SEQ ID NO: 493240 - protein, 9 aa, Homo Sapiens
EHGHLAGAK

SEQ ID NO: 493241 - protein, 9 aa, Homo Sapiens
IKEMTQAPY

SEQ ID NO: 493242 - protein, 9 aa, Homo Sapiens
WHPMKPGGV

SEQ ID NO: 493243 - protein, 9 aa, Homo Sapiens
LGIQTSCDD

SEQ ID NO: 493244 - protein, 9 aa, Homo Sapiens
RLETTYGQT

SEQ ID NO: 493245 - protein, 9 aa, Homo Sapiens
RISCRLKTY

SEQ ID NO: 493246 - protein, 9 aa, Homo Sapiens
TCCERVRTY

SEQ ID NO: 493247 - protein, 9 aa, Homo Sapiens
SATNMLSHQ

SEQ ID NO: 493248 - protein, 9 aa, Homo Sapiens
ESAKGKEYL

SEQ ID NO: 493249 - protein, 9 aa, Homo Sapiens
AYCVVSTSA

SEQ ID NO: 493250 - protein, 9 aa, Homo Sapiens
QGKEPWVVG

SEQ ID NO: 493251 - protein, 9 aa, Homo Sapiens
IEYYKWDKF

SEQ ID NO: 493252 - protein, 9 aa, Homo Sapiens
PCWVTVLSA

SEQ ID NO: 493253 - protein, 9 aa, Homo Sapiens
LEAHCLVQE

SEQ ID NO: 493254 - protein, 9 aa, Homo Sapiens
GHGDTNRVE

SEQ ID NO: 493255 - protein, 9 aa, Homo Sapiens
KEVINSLEM

SEQ ID NO: 493256 - protein, 9 aa, Homo Sapiens
SDDQSNNPF

SEQ ID NO: 493257 - protein, 9 aa, Homo Sapiens
DSSNSDSSN

SEQ ID NO: 493258 - protein, 9 aa, Homo Sapiens
PSDLFPMSP

SEQ ID NO: 493259 - protein, 9 aa, Homo Sapiens
PPGDLNTPA

SEQ ID NO: 493260 - protein, 9 aa, Homo Sapiens
DLLTEELTQ

SEQ ID NO: 493261 - protein, 9 aa, Homo Sapiens
NGSAEFDGK

SEQ ID NO: 493262 - protein, 9 aa, Homo Sapiens
KLPKHFRRP

SEQ ID NO: 493263 - protein, 9 aa, Homo Sapiens
PQHERDAIY

SEQ ID NO: 493264 - protein, 9 aa, Homo Sapiens
TDGDRLRLK

SEQ ID NO: 493265 - protein, 9 aa, Homo Sapiens
NQCSSSKNP

SEQ ID NO: 493266 - protein, 9 aa, Homo Sapiens
PEVPGLGSG

SEQ ID NO: 493267 - protein, 9 aa, Homo Sapiens
ENLAPWHPM

SEQ ID NO: 493268 - protein, 9 aa, Homo Sapiens
CQLSPLGFS

SEQ ID NO: 493269 - protein, 9 aa, Homo Sapiens
VLGDNCLSK

SEQ ID NO: 493270 - protein, 9 aa, Homo Sapiens
TNHPGKKFV

SEQ ID NO: 493271 - protein, 9 aa, Homo Sapiens
RSLTRHSSD

SEQ ID NO: 493272 - protein, 9 aa, Homo Sapiens
IVGLHAFQE

SEQ ID NO: 493273 - protein, 9 aa, Homo Sapiens
RSKQEIAEI

SEQ ID NO: 493274 - protein, 9 aa, Homo Sapiens
SRQTSDSSM

SEQ ID NO: 493275 - protein, 9 aa, Homo Sapiens
ELLKLRWEL

SEQ ID NO: 493276 - protein, 9 aa, Homo Sapiens
ATHSLNFLY

SEQ ID NO: 493277 - protein, 9 aa, Homo Sapiens
CYGWHHPLN

SEQ ID NO: 493278 - protein, 9 aa, Homo Sapiens
VAKIMMGKV

SEQ ID NO: 493279 - protein, 9 aa, Homo Sapiens
KIISRYLRE

SEQ ID NO: 493280 - protein, 9 aa, Homo Sapiens
SNSDSSNSS

SEQ ID NO: 493281 - protein, 9 aa, Homo Sapiens
TTTKLASEE

SEQ ID NO: 493282 - protein, 9 aa, Homo Sapiens
VFQAGNVPS

SEQ ID NO: 493283 - protein, 9 aa, Homo Sapiens
AKNGHPQAL

SEQ ID NO: 493284 - protein, 9 aa, Homo Sapiens
RSFIRTMSL

SEQ ID NO: 493285 - protein, 9 aa, Homo Sapiens
EQKYPYMVE

SEQ ID NO: 493286 - protein, 9 aa, Homo Sapiens
LSDFYSGSP

SEQ ID NO: 493287 - protein, 9 aa, Homo Sapiens
AHKCPTCGR

SEQ ID NO: 493288 - protein, 9 aa, Homo Sapiens
LAPWHPMKP

SEQ ID NO: 493289 - protein, 9 aa, Homo Sapiens
SLTRHSSDF

SEQ ID NO: 493290 - protein, 9 aa, Homo Sapiens
SMVSKEVNC

SEQ ID NO: 493291 - protein, 9 aa, Homo Sapiens
EEKAQEIFN

SEQ ID NO: 493292 - protein, 9 aa, Homo Sapiens
GAKGGGQGG

SEQ ID NO: 493293 - protein, 9 aa, Homo Sapiens
LLLRQKLHF

SEQ ID NO: 493294 - protein, 9 aa, Homo Sapiens
VGTEGLCGP

SEQ ID NO: 493295 - protein, 9 aa, Homo Sapiens
DKGDTTPEK

SEQ ID NO: 493296 - protein, 9 aa, Homo Sapiens
DAIYEEESR

SEQ ID NO: 493297 - protein, 9 aa, Homo Sapiens
AVVPCWVTV

SEQ ID NO: 493298 - protein, 9 aa, Homo Sapiens
WRKKFPPRG

SEQ ID NO: 493299 - protein, 9 aa, Homo Sapiens
VFSVCACAT

SEQ ID NO: 493300 - protein, 9 aa, Homo Sapiens
GRCESLRVV

SEQ ID NO: 493301 - protein, 9 aa, Homo Sapiens
MFGNKRHTD

SEQ ID NO: 493302 - protein, 9 aa, Homo Sapiens
VHRVHLPQA

SEQ ID NO: 493303 - protein, 9 aa, Homo Sapiens
FYPQRFFKV

SEQ ID NO: 493304 - protein, 9 aa, Homo Sapiens
VNGRDYHFV

SEQ ID NO: 493305 - protein, 9 aa, Homo Sapiens
CKAMVGHEM

SEQ ID NO: 493306 - protein, 9 aa, Homo Sapiens
AGRNIGDLF

SEQ ID NO: 493307 - protein, 9 aa, Homo Sapiens
TRSKQEIAE

SEQ ID NO: 493308 - protein, 9 aa, Homo Sapiens
YTEYNEEKN

SEQ ID NO: 493309 - protein, 9 aa, Homo Sapiens
SDQGEYECV

SEQ ID NO: 493310 - protein, 9 aa, Homo Sapiens
VGLHAFQER

SEQ ID NO: 493311 - protein, 9 aa, Homo Sapiens
GNKVSDMKF

SEQ ID NO: 493312 - protein, 9 aa, Homo Sapiens
PHSGDCLVL

SEQ ID NO: 493313 - protein, 9 aa, Homo Sapiens
PHSPSDLFP

SEQ ID NO: 493314 - protein, 9 aa, Homo Sapiens
KKHHPHSGD

SEQ ID NO: 493315 - protein, 9 aa, Homo Sapiens
QPWTQVDDL

SEQ ID NO: 493316 - protein, 9 aa, Homo Sapiens
VDGLHSDES

SEQ ID NO: 493317 - protein, 9 aa, Homo Sapiens
NAIMFGNKR

SEQ ID NO: 493318 - protein, 9 aa, Homo Sapiens
QRQWMGDGE

SEQ ID NO: 493319 - protein, 9 aa, Homo Sapiens
RATDELGLL

SEQ ID NO: 493320 - protein, 9 aa, Homo Sapiens
QCSVDRSLL

SEQ ID NO: 493321 - protein, 9 aa, Homo Sapiens
QLVLVNDAP

SEQ ID NO: 493322 - protein, 9 aa, Homo Sapiens
VRPGFPVSF

SEQ ID NO: 493323 - protein, 9 aa, Homo Sapiens
SSSPNKVMA

SEQ ID NO: 493324 - protein, 9 aa, Homo Sapiens
IHNEEEMKF

SEQ ID NO: 493325 - protein, 9 aa, Homo Sapiens
VQLQGSQLR

SEQ ID NO: 493326 - protein, 9 aa, Homo Sapiens
GLVMFQDVT

SEQ ID NO: 493327 - protein, 9 aa, Homo Sapiens
KHSGAATGF

SEQ ID NO: 493328 - protein, 9 aa, Homo Sapiens
NDQAVVKIC

SEQ ID NO: 493329 - protein, 9 aa, Homo Sapiens
VPNWHESAK

SEQ ID NO: 493330 - protein, 9 aa, Homo Sapiens
TLHMQESAH

SEQ ID NO: 493331 - protein, 9 aa, Homo Sapiens
SVRRRSIPG

SEQ ID NO: 493332 - protein, 9 aa, Homo Sapiens
KIAVMSTGE

SEQ ID NO: 493333 - protein, 9 aa, Homo Sapiens
SGNKKAEIA

SEQ ID NO: 493334 - protein, 9 aa, Homo Sapiens
QHALPAGTY

SEQ ID NO: 493335 - protein, 9 aa, Homo Sapiens
PNKVMALKD

SEQ ID NO: 493336 - protein, 9 aa, Homo Sapiens
FKSKARYLV

SEQ ID NO: 493337 - protein, 9 aa, Homo Sapiens
AHPFSITPG

SEQ ID NO: 493338 - protein, 9 aa, Homo Sapiens
FSIKLLYFL

SEQ ID NO: 493339 - protein, 9 aa, Homo Sapiens
ENLLNVSKP

SEQ ID NO: 493340 - protein, 9 aa, Homo Sapiens
PTPSWSLHC

SEQ ID NO: 493341 - protein, 9 aa, Homo Sapiens
EGESVLELG

SEQ ID NO: 493342 - protein, 9 aa, Homo Sapiens
DQHKNSYYP

SEQ ID NO: 493343 - protein, 9 aa, Homo Sapiens
HCLVQEEKK

SEQ ID NO: 493344 - protein, 9 aa, Homo Sapiens
LMAMYVAAA

SEQ ID NO: 493345 - protein, 9 aa, Homo Sapiens
KIPSIRPFK

SEQ ID NO: 493346 - protein, 9 aa, Homo Sapiens
VKIAFTHGA

SEQ ID NO: 493347 - protein, 9 aa, Homo Sapiens
SCFTNSQET

SEQ ID NO: 493348 - protein, 9 aa, Homo Sapiens
DLHILQVAF

SEQ ID NO: 493349 - protein, 9 aa, Homo Sapiens
ACSQSSSVN

SEQ ID NO: 493350 - protein, 9 aa, Homo Sapiens
MPSSACKAM

SEQ ID NO: 493351 - protein, 9 aa, Homo Sapiens
RGRACPSTG

SEQ ID NO: 493352 - protein, 9 aa, Homo Sapiens
VNICYGWHH

SEQ ID NO: 493353 - protein, 9 aa, Homo Sapiens
GEQEDGKEE

SEQ ID NO: 493354 - protein, 9 aa, Homo Sapiens
KTMSCQGRG

SEQ ID NO: 493355 - protein, 9 aa, Homo Sapiens
DMKFQAPTG

SEQ ID NO: 493356 - protein, 9 aa, Homo Sapiens
VLEQLLTIL

SEQ ID NO: 493357 - protein, 9 aa, Homo Sapiens
PSIRPFKQR

SEQ ID NO: 493358 - protein, 9 aa, Homo Sapiens
SDSHDEHPF

SEQ ID NO: 493359 - protein, 9 aa, Homo Sapiens
ERCRSPRRR

SEQ ID NO: 493360 - protein, 9 aa, Homo Sapiens
ETLMKNFHQ

SEQ ID NO: 493361 - protein, 9 aa, Homo Sapiens
KYRPRVQHR

SEQ ID NO: 493362 - protein, 9 aa, Homo Sapiens
SPSDLFPMS

SEQ ID NO: 493363 - protein, 9 aa, Homo Sapiens
KVRECQLEV

SEQ ID NO: 493364 - protein, 9 aa, Homo Sapiens
FHFLAGVPR

SEQ ID NO: 493365 - protein, 9 aa, Homo Sapiens
PLWVTQPHP

SEQ ID NO: 493366 - protein, 9 aa, Homo Sapiens
DFGQLVLVN

SEQ ID NO: 493367 - protein, 9 aa, Homo Sapiens
YSCPKGYQL

SEQ ID NO: 493368 - protein, 9 aa, Homo Sapiens
ALNKVNKVI

SEQ ID NO: 493369 - protein, 9 aa, Homo Sapiens
GRACPSTGQ

SEQ ID NO: 493370 - protein, 9 aa, Homo Sapiens
IKQDPRRWG

SEQ ID NO: 493371 - protein, 9 aa, Homo Sapiens
FVKIAFTHG

SEQ ID NO: 493372 - protein, 9 aa, Homo Sapiens
PLTMNSLEK

SEQ ID NO: 493373 - protein, 9 aa, Homo Sapiens
RSVLFNPHG

SEQ ID NO: 493374 - protein, 9 aa, Homo Sapiens
KNWEKLGRG

SEQ ID NO: 493375 - protein, 9 aa, Homo Sapiens
IRTMSLIAQ

SEQ ID NO: 493376 - protein, 9 aa, Homo Sapiens
IFEGIRIEK

SEQ ID NO: 493377 - protein, 9 aa, Homo Sapiens
MRMKPWLEM

SEQ ID NO: 493378 - protein, 9 aa, Homo Sapiens
GTKRWLEYN

SEQ ID NO: 493379 - protein, 9 aa, Homo Sapiens
VRQCKSLLP

SEQ ID NO: 493380 - protein, 9 aa, Homo Sapiens
MQWVQILAE

SEQ ID NO: 493381 - protein, 9 aa, Homo Sapiens
KRIAREREE

SEQ ID NO: 493382 - protein, 9 aa, Homo Sapiens
QQEQTSYMV

SEQ ID NO: 493383 - protein, 9 aa, Homo Sapiens
NFIRMAVAG

SEQ ID NO: 493384 - protein, 9 aa, Homo Sapiens
KKLVRYFLD

SEQ ID NO: 493385 - protein, 9 aa, Homo Sapiens
IQNPFSSGG

SEQ ID NO: 493386 - protein, 9 aa, Homo Sapiens
CIHIPKSII

SEQ ID NO: 493387 - protein, 9 aa, Homo Sapiens
QLNGNVQLE

SEQ ID NO: 493388 - protein, 9 aa, Homo Sapiens
AERLDMVAG

SEQ ID NO: 493389 - protein, 9 aa, Homo Sapiens
LSLRVWMCG

SEQ ID NO: 493390 - protein, 9 aa, Homo Sapiens
ENPPGDLNT

SEQ ID NO: 493391 - protein, 9 aa, Homo Sapiens
QGLSKLPSW

SEQ ID NO: 493392 - protein, 9 aa, Homo Sapiens
NIIIAFLYP

SEQ ID NO: 493393 - protein, 9 aa, Homo Sapiens
SEECITAGH

SEQ ID NO: 493394 - protein, 9 aa, Homo Sapiens
LQEADGQCS

SEQ ID NO: 493395 - protein, 9 aa, Homo Sapiens
TFHSSLSSD

SEQ ID NO: 493396 - protein, 9 aa, Homo Sapiens
QSLKIISRY

SEQ ID NO: 493397 - protein, 9 aa, Homo Sapiens
NNNDQAVVK

SEQ ID NO: 493398 - protein, 9 aa, Homo Sapiens
TLLHSPPPE

SEQ ID NO: 493399 - protein, 9 aa, Homo Sapiens
VGLVTLTEG

SEQ ID NO: 493400 - protein, 9 aa, Homo Sapiens
MIKLLKKKQ

SEQ ID NO: 493401 - protein, 9 aa, Homo Sapiens
NAKRNYLNV

SEQ ID NO: 493402 - protein, 9 aa, Homo Sapiens
VLACKDGWV

SEQ ID NO: 493403 - protein, 9 aa, Homo Sapiens
EKSELPDSV

SEQ ID NO: 493404 - protein, 9 aa, Homo Sapiens
LPLINSLIR

SEQ ID NO: 493405 - protein, 9 aa, Homo Sapiens
LPSTHTENE

SEQ ID NO: 493406 - protein, 9 aa, Homo Sapiens
RLDMVAGCR

SEQ ID NO: 493407 - protein, 9 aa, Homo Sapiens
QEIAEILCN

SEQ ID NO: 493408 - protein, 9 aa, Homo Sapiens
IKSATDRDL

SEQ ID NO: 493409 - protein, 9 aa, Homo Sapiens
GVTSKFVSK

SEQ ID NO: 493410 - protein, 9 aa, Homo Sapiens
RIPGIYGIL

SEQ ID NO: 493411 - protein, 9 aa, Homo Sapiens
HESRSCRDK

SEQ ID NO: 493412 - protein, 9 aa, Homo Sapiens
LELMAMYVA

SEQ ID NO: 493413 - protein, 9 aa, Homo Sapiens
EGSPGEQPQ

SEQ ID NO: 493414 - protein, 9 aa, Homo Sapiens
GLRKLSSKT

SEQ ID NO: 493415 - protein, 9 aa, Homo Sapiens
ISGFKTKAK

SEQ ID NO: 493416 - protein, 9 aa, Homo Sapiens
CAQFDSSRQ

SEQ ID NO: 493417 - protein, 9 aa, Homo Sapiens
AERAQSKLE

SEQ ID NO: 493418 - protein, 9 aa, Homo Sapiens
AFMKGTGCR

SEQ ID NO: 493419 - protein, 9 aa, Homo Sapiens
PDGFPVGPT

SEQ ID NO: 493420 - protein, 9 aa, Homo Sapiens
CKLSSGNIG

SEQ ID NO: 493421 - protein, 9 aa, Homo Sapiens
AGIGPDGHI

SEQ ID NO: 493422 - protein, 9 aa, Homo Sapiens
VVKICITRI

SEQ ID NO: 493423 - protein, 9 aa, Homo Sapiens
HILQVAFRG

SEQ ID NO: 493424 - protein, 9 aa, Homo Sapiens
TDWSDDQSN

SEQ ID NO: 493425 - protein, 9 aa, Homo Sapiens
GCQTLCEDL

SEQ ID NO: 493426 - protein, 9 aa, Homo Sapiens
KDTEITCCE

SEQ ID NO: 493427 - protein, 9 aa, Homo Sapiens
LTAVAQADP

SEQ ID NO: 493428 - protein, 9 aa, Homo Sapiens
LINSLIRVL

SEQ ID NO: 493429 - protein, 9 aa, Homo Sapiens
ELLVLEQLL

SEQ ID NO: 493430 - protein, 9 aa, Homo Sapiens
TTLKWDSCA

SEQ ID NO: 493431 - protein, 9 aa, Homo Sapiens
VLELGAGPS

SEQ ID NO: 493432 - protein, 9 aa, Homo Sapiens
DSFTTFFSK

SEQ ID NO: 493433 - protein, 9 aa, Homo Sapiens
YSRDSLGWK

SEQ ID NO: 493434 - protein, 9 aa, Homo Sapiens
LYQVKGNKN

SEQ ID NO: 493435 - protein, 9 aa, Homo Sapiens
KGDTTPEKP

SEQ ID NO: 493436 - protein, 9 aa, Homo Sapiens
TEMDKIRKN

SEQ ID NO: 493437 - protein, 9 aa, Homo Sapiens
NNDQAVVKI

SEQ ID NO: 493438 - protein, 9 aa, Homo Sapiens
RVLSFVCAL

SEQ ID NO: 493439 - protein, 9 aa, Homo Sapiens
VGRGKTMSC

SEQ ID NO: 493440 - protein, 9 aa, Homo Sapiens
RLRHDVMAD

SEQ ID NO: 493441 - protein, 9 aa, Homo Sapiens
AEEQAARQR

SEQ ID NO: 493442 - protein, 9 aa, Homo Sapiens
NGNGLNNTP

SEQ ID NO: 493443 - protein, 9 aa, Homo Sapiens
SPSSSSPNK

SEQ ID NO: 493444 - protein, 9 aa, Homo Sapiens
ITDLPSNDF

SEQ ID NO: 493445 - protein, 9 aa, Homo Sapiens
RDSLGWKLF

SEQ ID NO: 493446 - protein, 9 aa, Homo Sapiens
QCWCVDKYE

SEQ ID NO: 493447 - protein, 9 aa, Homo Sapiens
EELGLATLG

SEQ ID NO: 493448 - protein, 9 aa, Homo Sapiens
QISRPLAAG

SEQ ID NO: 493449 - protein, 9 aa, Homo Sapiens
GHLSCDIKE

SEQ ID NO: 493450 - protein, 9 aa, Homo Sapiens
FKSGFSQVS

SEQ ID NO: 493451 - protein, 9 aa, Homo Sapiens
QETTTKLAS

SEQ ID NO: 493452 - protein, 9 aa, Homo Sapiens
RVQLQGSQL

SEQ ID NO: 493453 - protein, 9 aa, Homo Sapiens
RPLAAGINL

SEQ ID NO: 493454 - protein, 9 aa, Homo Sapiens
SSGGSPAAE

SEQ ID NO: 493455 - protein, 9 aa, Homo Sapiens
FTDGGEEKA

SEQ ID NO: 493456 - protein, 9 aa, Homo Sapiens
SFTFPELIR

SEQ ID NO: 493457 - protein, 9 aa, Homo Sapiens
KQAIAHLQK

SEQ ID NO: 493458 - protein, 9 aa, Homo Sapiens
EFQRQERHQ

SEQ ID NO: 493459 - protein, 9 aa, Homo Sapiens
SAHKCPTCG

SEQ ID NO: 493460 - protein, 9 aa, Homo Sapiens
IIPLESASR

SEQ ID NO: 493461 - protein, 9 aa, Homo Sapiens
LRQKLHFES

SEQ ID NO: 493462 - protein, 9 aa, Homo Sapiens
VDKEKGYIY

SEQ ID NO: 493463 - protein, 9 aa, Homo Sapiens
APVLILDKM

SEQ ID NO: 493464 - protein, 9 aa, Homo Sapiens
SSVPWKTHS

SEQ ID NO: 493465 - protein, 9 aa, Homo Sapiens
VYKRSAVQQ

SEQ ID NO: 493466 - protein, 9 aa, Homo Sapiens
HVLGTRQSL

SEQ ID NO: 493467 - protein, 9 aa, Homo Sapiens
DKCLKLSRK

SEQ ID NO: 493468 - protein, 9 aa, Homo Sapiens
PSESSVLQE

SEQ ID NO: 493469 - protein, 9 aa, Homo Sapiens
ENSNLISGF

SEQ ID NO: 493470 - protein, 9 aa, Homo Sapiens
ICYGWHHPL

SEQ ID NO: 493471 - protein, 9 aa, Homo Sapiens
LLPRASKPP

SEQ ID NO: 493472 - protein, 9 aa, Homo Sapiens
KCGAGRNIG

SEQ ID NO: 493473 - protein, 9 aa, Homo Sapiens
ETRGTGEES

SEQ ID NO: 493474 - protein, 9 aa, Homo Sapiens
VMAANIFEG

SEQ ID NO: 493475 - protein, 9 aa, Homo Sapiens
EPPLSPLLA

SEQ ID NO: 493476 - protein, 9 aa, Homo Sapiens
EGMCYLHAK

SEQ ID NO: 493477 - protein, 9 aa, Homo Sapiens
YEVNGRDYH

SEQ ID NO: 493478 - protein, 9 aa, Homo Sapiens
QTLCEDLGQ

SEQ ID NO: 493479 - protein, 9 aa, Homo Sapiens
SYPSAIDPE

SEQ ID NO: 493480 - protein, 9 aa, Homo Sapiens
TARTLCAFN

SEQ ID NO: 493481 - protein, 9 aa, Homo Sapiens
ESHVLGTRQ

SEQ ID NO: 493482 - protein, 9 aa, Homo Sapiens
LPNNTEENT

SEQ ID NO: 493483 - protein, 9 aa, Homo Sapiens
PLDEGSEPP

SEQ ID NO: 493484 - protein, 9 aa, Homo Sapiens
DLGRCESLR

SEQ ID NO: 493485 - protein, 9 aa, Homo Sapiens
YPYSAKDEA

SEQ ID NO: 493486 - protein, 9 aa, Homo Sapiens
IPNVLGEGI

SEQ ID NO: 493487 - protein, 9 aa, Homo Sapiens
LNHLAQGAR

SEQ ID NO: 493488 - protein, 9 aa, Homo Sapiens
ECTLAVDLW

SEQ ID NO: 493489 - protein, 9 aa, Homo Sapiens
PTCQPTVPY

SEQ ID NO: 493490 - protein, 9 aa, Homo Sapiens
EEHNSINEL

SEQ ID NO: 493491 - protein, 9 aa, Homo Sapiens
PDKGDTTPE

SEQ ID NO: 493492 - protein, 9 aa, Homo Sapiens
HESAKGKEY

SEQ ID NO: 493493 - protein, 9 aa, Homo Sapiens
VLLAAPPAH

SEQ ID NO: 493494 - protein, 9 aa, Homo Sapiens
PVRHGKIKL

SEQ ID NO: 493495 - protein, 9 aa, Homo Sapiens
HFIDNQGQV

SEQ ID NO: 493496 - protein, 9 aa, Homo Sapiens
KSQKTVLKD

SEQ ID NO: 493497 - protein, 9 aa, Homo Sapiens
QGDLSHSPR

SEQ ID NO: 493498 - protein, 9 aa, Homo Sapiens
HSLTAVAQA

SEQ ID NO: 493499 - protein, 9 aa, Homo Sapiens
SKYNLYRKD

SEQ ID NO: 493500 - protein, 9 aa, Homo Sapiens
QGARAVLQN

SEQ ID NO: 493501 - protein, 9 aa, Homo Sapiens
ALAERLDMV

SEQ ID NO: 493502 - protein, 9 aa, Homo Sapiens
SGASCLCCQ

SEQ ID NO: 493503 - protein, 9 aa, Homo Sapiens
FAGPPFGAE

SEQ ID NO: 493504 - protein, 9 aa, Homo Sapiens
EKLQLVTGT

SEQ ID NO: 493505 - protein, 9 aa, Homo Sapiens
QETARTLCA

SEQ ID NO: 493506 - protein, 9 aa, Homo Sapiens
LSYDLTAMT

SEQ ID NO: 493507 - protein, 9 aa, Homo Sapiens
SEINRMIQR

SEQ ID NO: 493508 - protein, 9 aa, Homo Sapiens
EDKKLVRYF

SEQ ID NO: 493509 - protein, 9 aa, Homo Sapiens
SWPGAQGVE

SEQ ID NO: 493510 - protein, 9 aa, Homo Sapiens
YGSFVKKIV

SEQ ID NO: 493511 - protein, 9 aa, Homo Sapiens
VLVNDAPRA

SEQ ID NO: 493512 - protein, 9 aa, Homo Sapiens
LLYIIGILF

SEQ ID NO: 493513 - protein, 9 aa, Homo Sapiens
SEKSELPDS

SEQ ID NO: 493514 - protein, 9 aa, Homo Sapiens
RWIKQDPRR

SEQ ID NO: 493515 - protein, 9 aa, Homo Sapiens
DKYENELAG

SEQ ID NO: 493516 - protein, 9 aa, Homo Sapiens
DPTALQEEE

SEQ ID NO: 493517 - protein, 9 aa, Homo Sapiens
LGNGCHKLM

SEQ ID NO: 493518 - protein, 9 aa, Homo Sapiens
LICSRHFWT

SEQ ID NO: 493519 - protein, 9 aa, Homo Sapiens
FEGIRIEKS

SEQ ID NO: 493520 - protein, 9 aa, Homo Sapiens
VTKRKRCAV

SEQ ID NO: 493521 - protein, 9 aa, Homo Sapiens
LTNYAYCVV

SEQ ID NO: 493522 - protein, 9 aa, Homo Sapiens
LLRNCCNTK

SEQ ID NO: 493523 - protein, 9 aa, Homo Sapiens
NNTEENTEL

SEQ ID NO: 493524 - protein, 9 aa, Homo Sapiens
HGCCLYSGC

SEQ ID NO: 493525 - protein, 9 aa, Homo Sapiens
SSSLLCIHN

SEQ ID NO: 493526 - protein, 9 aa, Homo Sapiens
NEPEERPAP

SEQ ID NO: 493527 - protein, 9 aa, Homo Sapiens
VTIGIVPPE

SEQ ID NO: 493528 - protein, 9 aa, Homo Sapiens
LNSVKYANR

SEQ ID NO: 493529 - protein, 9 aa, Homo Sapiens
INKKDHTLG

SEQ ID NO: 493530 - protein, 9 aa, Homo Sapiens
QVFQAGNVP

SEQ ID NO: 493531 - protein, 9 aa, Homo Sapiens
ASPFVHPAT

SEQ ID NO: 493532 - protein, 9 aa, Homo Sapiens
LVRQCKSLL

SEQ ID NO: 493533 - protein, 9 aa, Homo Sapiens
GLTAAGVTR

SEQ ID NO: 493534 - protein, 9 aa, Homo Sapiens
CQTLCEDLG

SEQ ID NO: 493535 - protein, 9 aa, Homo Sapiens
PVTGMCYPL

SEQ ID NO: 493536 - protein, 9 aa, Homo Sapiens
WVVGRELTR

SEQ ID NO: 493537 - protein, 9 aa, Homo Sapiens
SSSHWSCGA

SEQ ID NO: 493538 - protein, 9 aa, Homo Sapiens
HKQSESAHG

SEQ ID NO: 493539 - protein, 9 aa, Homo Sapiens
TSAAHLENY

SEQ ID NO: 493540 - protein, 9 aa, Homo Sapiens
DSCSLAQAQ

SEQ ID NO: 493541 - protein, 9 aa, Homo Sapiens
DLSQPQPWT

SEQ ID NO: 493542 - protein, 9 aa, Homo Sapiens
IYTGEKPYE

SEQ ID NO: 493543 - protein, 9 aa, Homo Sapiens
LAACAQFDS

SEQ ID NO: 493544 - protein, 9 aa, Homo Sapiens
TTELLFASA

SEQ ID NO: 493545 - protein, 9 aa, Homo Sapiens
DINAAIKRL

SEQ ID NO: 493546 - protein, 9 aa, Homo Sapiens
NWEKLGRGE

SEQ ID NO: 493547 - protein, 9 aa, Homo Sapiens
MLTSTTSAV

SEQ ID NO: 493548 - protein, 9 aa, Homo Sapiens
QKIPSIRPF

SEQ ID NO: 493549 - protein, 9 aa, Homo Sapiens
QAIKDLDGM

SEQ ID NO: 493550 - protein, 9 aa, Homo Sapiens
SQASANLGG

SEQ ID NO: 493551 - protein, 9 aa, Homo Sapiens
TGWRETPGP

SEQ ID NO: 493552 - protein, 9 aa, Homo Sapiens
TALQEEEKQ

SEQ ID NO: 493553 - protein, 9 aa, Homo Sapiens
GLLLSLPAA

SEQ ID NO: 493554 - protein, 9 aa, Homo Sapiens
FQDVTVYFS

SEQ ID NO: 493555 - protein, 9 aa, Homo Sapiens
EDMYKLTFE

SEQ ID NO: 493556 - protein, 9 aa, Homo Sapiens
SKTESERKD

SEQ ID NO: 493557 - protein, 9 aa, Homo Sapiens
TKMGDVACT

SEQ ID NO: 493558 - protein, 9 aa, Homo Sapiens
SPGNKVSDM

SEQ ID NO: 493559 - protein, 9 aa, Homo Sapiens
GLNNTPRFK

SEQ ID NO: 493560 - protein, 9 aa, Homo Sapiens
DWQRQWMGD

SEQ ID NO: 493561 - protein, 9 aa, Homo Sapiens
GEEQEEEDG

SEQ ID NO: 493562 - protein, 9 aa, Homo Sapiens
KAVTKRKRC

SEQ ID NO: 493563 - protein, 9 aa, Homo Sapiens
QEQAVWAVG

SEQ ID NO: 493564 - protein, 9 aa, Homo Sapiens
IISYLRIFI

SEQ ID NO: 493565 - protein, 9 aa, Homo Sapiens
NKRHTDVQF

SEQ ID NO: 493566 - protein, 9 aa, Homo Sapiens
VVPIPKGSA

SEQ ID NO: 493567 - protein, 9 aa, Homo Sapiens
NWDVFYKRN

SEQ ID NO: 493568 - protein, 9 aa, Homo Sapiens
IPKGSAFFC

SEQ ID NO: 493569 - protein, 9 aa, Homo Sapiens
SRKYRPRVQ

SEQ ID NO: 493570 - protein, 9 aa, Homo Sapiens
SCSTFHSSL

SEQ ID NO: 493571 - protein, 9 aa, Homo Sapiens
LVQYPDCKL

SEQ ID NO: 493572 - protein, 9 aa, Homo Sapiens
DGSECFQDP

SEQ ID NO: 493573 - protein, 9 aa, Homo Sapiens
QTPTVQEDS

SEQ ID NO: 493574 - protein, 9 aa, Homo Sapiens
RGQGTFCSF

SEQ ID NO: 493575 - protein, 9 aa, Homo Sapiens
FLGLGGLEC

SEQ ID NO: 493576 - protein, 9 aa, Homo Sapiens
QEQTSYMVV

SEQ ID NO: 493577 - protein, 9 aa, Homo Sapiens
LSIRLTGNR

SEQ ID NO: 493578 - protein, 9 aa, Homo Sapiens
PALELMAMY

SEQ ID NO: 493579 - protein, 9 aa, Homo Sapiens
FSEQHLKTL

SEQ ID NO: 493580 - protein, 9 aa, Homo Sapiens
DDKTKNAKR

SEQ ID NO: 493581 - protein, 9 aa, Homo Sapiens
GSADGSECF

SEQ ID NO: 493582 - protein, 9 aa, Homo Sapiens
PMKPGGVLI

SEQ ID NO: 493583 - protein, 9 aa, Homo Sapiens
GERISAPKR

SEQ ID NO: 493584 - protein, 9 aa, Homo Sapiens
LLLAAAAAG

SEQ ID NO: 493585 - protein, 9 aa, Homo Sapiens
RTYVRSLAK

SEQ ID NO: 493586 - protein, 9 aa, Homo Sapiens
VMFQDVTVY

SEQ ID NO: 493587 - protein, 9 aa, Homo Sapiens
GKEKLSLEA

SEQ ID NO: 493588 - protein, 9 aa, Homo Sapiens
SNKELEKYK

SEQ ID NO: 493589 - protein, 9 aa, Homo Sapiens
KSVATHNIE

SEQ ID NO: 493590 - protein, 9 aa, Homo Sapiens
KSGFSQVSM

SEQ ID NO: 493591 - protein, 9 aa, Homo Sapiens
QGFRIEIKS

SEQ ID NO: 493592 - protein, 9 aa, Homo Sapiens
PPAGPPLSN

SEQ ID NO: 493593 - protein, 9 aa, Homo Sapiens
FIYQVSTHK

SEQ ID NO: 493594 - protein, 9 aa, Homo Sapiens
AHLENYSPA

SEQ ID NO: 493595 - protein, 9 aa, Homo Sapiens
GDNCEVKEP

SEQ ID NO: 493596 - protein, 9 aa, Homo Sapiens
HGVKAVTKR

SEQ ID NO: 493597 - protein, 9 aa, Homo Sapiens
EASLQPSPT

SEQ ID NO: 493598 - protein, 9 aa, Homo Sapiens
DKKLVRYFL

SEQ ID NO: 493599 - protein, 9 aa, Homo Sapiens
GKGEEQEEE

SEQ ID NO: 493600 - protein, 9 aa, Homo Sapiens
DLLVGNGCL

SEQ ID NO: 493601 - protein, 9 aa, Homo Sapiens
PPQKIPSIR

SEQ ID NO: 493602 - protein, 9 aa, Homo Sapiens
GYIYLSKRR

SEQ ID NO: 493603 - protein, 9 aa, Homo Sapiens
GNVQLELAQ

SEQ ID NO: 493604 - protein, 9 aa, Homo Sapiens
HEEDDNHDD

SEQ ID NO: 493605 - protein, 9 aa, Homo Sapiens
AAQEDLDKT

SEQ ID NO: 493606 - protein, 9 aa, Homo Sapiens
CWVTVLSAK

SEQ ID NO: 493607 - protein, 9 aa, Homo Sapiens
RSYSRQTSD

SEQ ID NO: 493608 - protein, 9 aa, Homo Sapiens
KAHKYLRLW

SEQ ID NO: 493609 - protein, 9 aa, Homo Sapiens
AAENSNLIS

SEQ ID NO: 493610 - protein, 9 aa, Homo Sapiens
SQKTVLKDA

SEQ ID NO: 493611 - protein, 9 aa, Homo Sapiens
GTAPKIAVM

SEQ ID NO: 493612 - protein, 9 aa, Homo Sapiens
LQSDTECTL

SEQ ID NO: 493613 - protein, 9 aa, Homo Sapiens
IPLESASRP

SEQ ID NO: 493614 - protein, 9 aa, Homo Sapiens
SQKTAAEGT

SEQ ID NO: 493615 - protein, 9 aa, Homo Sapiens
KLKQAIAHL

SEQ ID NO: 493616 - protein, 9 aa, Homo Sapiens
GQREGEGKE

SEQ ID NO: 493617 - protein, 9 aa, Homo Sapiens
FNPHGCCLY

SEQ ID NO: 493618 - protein, 9 aa, Homo Sapiens
REVVVTVSG

SEQ ID NO: 493619 - protein, 9 aa, Homo Sapiens
PRVQHRSRA

SEQ ID NO: 493620 - protein, 9 aa, Homo Sapiens
GAGRNIGDL

SEQ ID NO: 493621 - protein, 9 aa, Homo Sapiens
LPSNDFQMM

SEQ ID NO: 493622 - protein, 9 aa, Homo Sapiens
HPVEKLQES

SEQ ID NO: 493623 - protein, 9 aa, Homo Sapiens
LRHGLIPNV

SEQ ID NO: 493624 - protein, 9 aa, Homo Sapiens
VPGNGFAHP

SEQ ID NO: 493625 - protein, 9 aa, Homo Sapiens
WGPSRGRAC

SEQ ID NO: 493626 - protein, 9 aa, Homo Sapiens
DPQALLQAI

SEQ ID NO: 493627 - protein, 9 aa, Homo Sapiens
RWTRQKLVE

SEQ ID NO: 493628 - protein, 9 aa, Homo Sapiens
VAGIGPDGH

SEQ ID NO: 493629 - protein, 9 aa, Homo Sapiens
SKPLPKQLW

SEQ ID NO: 493630 - protein, 9 aa, Homo Sapiens
KCEEGEDKE

SEQ ID NO: 493631 - protein, 9 aa, Homo Sapiens
ELLHFIDNQ

SEQ ID NO: 493632 - protein, 9 aa, Homo Sapiens
SADKEVINS

SEQ ID NO: 493633 - protein, 9 aa, Homo Sapiens
VTNFKEVCD

SEQ ID NO: 493634 - protein, 9 aa, Homo Sapiens
GSDTEGLAQ

SEQ ID NO: 493635 - protein, 9 aa, Homo Sapiens
KIEMTPMVF

SEQ ID NO: 493636 - protein, 9 aa, Homo Sapiens
MKFQAPTGE

SEQ ID NO: 493637 - protein, 9 aa, Homo Sapiens
PYSAKDEAH

SEQ ID NO: 493638 - protein, 9 aa, Homo Sapiens
KNWDVFYKR

SEQ ID NO: 493639 - protein, 9 aa, Homo Sapiens
SFQPILKSY

SEQ ID NO: 493640 - protein, 9 aa, Homo Sapiens
LIRKGSYNP

SEQ ID NO: 493641 - protein, 9 aa, Homo Sapiens
RPKRDYEVN

SEQ ID NO: 493642 - protein, 9 aa, Homo Sapiens
GRLETTYGQ

SEQ ID NO: 493643 - protein, 9 aa, Homo Sapiens
RELQRQKLE

SEQ ID NO: 493644 - protein, 9 aa, Homo Sapiens
KEPRHGNLY

SEQ ID NO: 493645 - protein, 9 aa, Homo Sapiens
MLEMATSQY

SEQ ID NO: 493646 - protein, 9 aa, Homo Sapiens
GFTLLLAAA

SEQ ID NO: 493647 - protein, 9 aa, Homo Sapiens
IASKYNLYR

SEQ ID NO: 493648 - protein, 9 aa, Homo Sapiens
DKSWKVAKI

SEQ ID NO: 493649 - protein, 9 aa, Homo Sapiens
DPLDAFAQG

SEQ ID NO: 493650 - protein, 8 aa, Homo Sapiens
RRADTRDG

SEQ ID NO: 493651 - protein, 9 aa, Homo Sapiens
VTGMCYPLR

SEQ ID NO: 493652 - protein, 9 aa, Homo Sapiens
FINDDHDED

SEQ ID NO: 493653 - protein, 9 aa, Homo Sapiens
EEQRAACNA

SEQ ID NO: 493654 - protein, 9 aa, Homo Sapiens
WGPLDEGSE

SEQ ID NO: 493655 - protein, 9 aa, Homo Sapiens
SAVQQAPID

SEQ ID NO: 493656 - protein, 9 aa, Homo Sapiens
PQRFFKVLL

SEQ ID NO: 493657 - protein, 9 aa, Homo Sapiens
VIPKYCRAL

SEQ ID NO: 493658 - protein, 9 aa, Homo Sapiens
LDEGSEPPT

SEQ ID NO: 493659 - protein, 9 aa, Homo Sapiens
STTELLFAS

SEQ ID NO: 493660 - protein, 9 aa, Homo Sapiens
DKEKGYIYL

SEQ ID NO: 493661 - protein, 9 aa, Homo Sapiens
DYEVNGRDY

SEQ ID NO: 493662 - protein, 9 aa, Homo Sapiens
EAGVTSKFV

SEQ ID NO: 493663 - protein, 9 aa, Homo Sapiens
LNVSKPLPK

SEQ ID NO: 493664 - protein, 9 aa, Homo Sapiens
NFDESLNSV

SEQ ID NO: 493665 - protein, 9 aa, Homo Sapiens
LCIHNEEEM

SEQ ID NO: 493666 - protein, 9 aa, Homo Sapiens
LTEELTQRL

SEQ ID NO: 493667 - protein, 9 aa, Homo Sapiens
CRLQLNGNV

SEQ ID NO: 493668 - protein, 9 aa, Homo Sapiens
LHKIVLGIQ

SEQ ID NO: 493669 - protein, 9 aa, Homo Sapiens
GLVTLTEGP

SEQ ID NO: 493670 - protein, 9 aa, Homo Sapiens
TLKCLSLVP

SEQ ID NO: 493671 - protein, 9 aa, Homo Sapiens
YENELAGSR

SEQ ID NO: 493672 - protein, 9 aa, Homo Sapiens
RDAIYEEES

SEQ ID NO: 493673 - protein, 9 aa, Homo Sapiens
QLSNVTLIL

SEQ ID NO: 493674 - protein, 9 aa, Homo Sapiens
FHEVNGPRA

SEQ ID NO: 493675 - protein, 9 aa, Homo Sapiens
ITCCERVRT

SEQ ID NO: 493676 - protein, 9 aa, Homo Sapiens
KHEFQRQER

SEQ ID NO: 493677 - protein, 9 aa, Homo Sapiens
HVLPSTHTE

SEQ ID NO: 493678 - protein, 9 aa, Homo Sapiens
SGGFTLLLA

SEQ ID NO: 493679 - protein, 9 aa, Homo Sapiens
ANSETVAKL

SEQ ID NO: 493680 - protein, 9 aa, Homo Sapiens
PIPKGSAFF

SEQ ID NO: 493681 - protein, 9 aa, Homo Sapiens
TGHDCSCTD

SEQ ID NO: 493682 - protein, 9 aa, Homo Sapiens
SESKYWQHP

SEQ ID NO: 493683 - protein, 9 aa, Homo Sapiens
MVAGCRLLP

SEQ ID NO: 493684 - protein, 9 aa, Homo Sapiens
SRPRGKRDK

SEQ ID NO: 493685 - protein, 9 aa, Homo Sapiens
DFGLSIRLT

SEQ ID NO: 493686 - protein, 9 aa, Homo Sapiens
INAVESGNK

SEQ ID NO: 493687 - protein, 9 aa, Homo Sapiens
ACLFTINKK

SEQ ID NO: 493688 - protein, 9 aa, Homo Sapiens
LLHFIDNQG

SEQ ID NO: 493689 - protein, 9 aa, Homo Sapiens
CRWRVEHVQ

SEQ ID NO: 493690 - protein, 9 aa, Homo Sapiens
VPSMSISAC

SEQ ID NO: 493691 - protein, 9 aa, Homo Sapiens
IGIVPPERQ

SEQ ID NO: 493692 - protein, 9 aa, Homo Sapiens
FKMISKQAA

SEQ ID NO: 493693 - protein, 9 aa, Homo Sapiens
EGLCGPPFC

SEQ ID NO: 493694 - protein, 9 aa, Homo Sapiens
LLRHLMPNL

SEQ ID NO: 493695 - protein, 9 aa, Homo Sapiens
FRRHFLEIK

SEQ ID NO: 493696 - protein, 9 aa, Homo Sapiens
ILSTRSLNG

SEQ ID NO: 493697 - protein, 9 aa, Homo Sapiens
SPCQLSPLG

SEQ ID NO: 493698 - protein, 9 aa, Homo Sapiens
KICITRITT

SEQ ID NO: 493699 - protein, 9 aa, Homo Sapiens
CYLHAKGVI

SEQ ID NO: 493700 - protein, 9 aa, Homo Sapiens
RPHIKKATQ

SEQ ID NO: 493701 - protein, 9 aa, Homo Sapiens
SAFMKGTGC

SEQ ID NO: 493702 - protein, 9 aa, Homo Sapiens
LQPSPTQSV

SEQ ID NO: 493703 - protein, 9 aa, Homo Sapiens
TQRSLRAQL

SEQ ID NO: 493704 - protein, 9 aa, Homo Sapiens
GEKPYKMWR

SEQ ID NO: 493705 - protein, 9 aa, Homo Sapiens
RQSLKIISR

SEQ ID NO: 493706 - protein, 9 aa, Homo Sapiens
PDLLVGNGC

SEQ ID NO: 493707 - protein, 9 aa, Homo Sapiens
YKSLKKNEI

SEQ ID NO: 493708 - protein, 9 aa, Homo Sapiens
NSLEKQETV

SEQ ID NO: 493709 - protein, 9 aa, Homo Sapiens
GLAAEGKYE

SEQ ID NO: 493710 - protein, 9 aa, Homo Sapiens
GLIPNVLGE

SEQ ID NO: 493711 - protein, 9 aa, Homo Sapiens
YVVSHVPLG

SEQ ID NO: 493712 - protein, 9 aa, Homo Sapiens
DDDANSNAS

SEQ ID NO: 493713 - protein, 9 aa, Homo Sapiens
ENQTPLWVT

SEQ ID NO: 493714 - protein, 9 aa, Homo Sapiens
KRSAVQQAP

SEQ ID NO: 493715 - protein, 9 aa, Homo Sapiens
ACPSTGQPP

SEQ ID NO: 493716 - protein, 9 aa, Homo Sapiens
KEMTQAPYL

SEQ ID NO: 493717 - protein, 9 aa, Homo Sapiens
KEKGYIYLS

SEQ ID NO: 493718 - protein, 9 aa, Homo Sapiens
FSKYQLHKD

SEQ ID NO: 493719 - protein, 9 aa, Homo Sapiens
AAEEDDLDC

SEQ ID NO: 493720 - protein, 9 aa, Homo Sapiens
AVVTQSAKA

SEQ ID NO: 493721 - protein, 9 aa, Homo Sapiens
PDPAGPNGH

SEQ ID NO: 493722 - protein, 9 aa, Homo Sapiens
STITFPTLT

SEQ ID NO: 493723 - protein, 9 aa, Homo Sapiens
DVHTFGHCC

SEQ ID NO: 493724 - protein, 9 aa, Homo Sapiens
NKMIKLLKK

SEQ ID NO: 493725 - protein, 9 aa, Homo Sapiens
LSKLPSWPG

SEQ ID NO: 493726 - protein, 9 aa, Homo Sapiens
KPYKMWRLW

SEQ ID NO: 493727 - protein, 9 aa, Homo Sapiens
LTVEQKYPY

SEQ ID NO: 493728 - protein, 9 aa, Homo Sapiens
KGGNPHGWR

SEQ ID NO: 493729 - protein, 9 aa, Homo Sapiens
SNKMIKLLK

SEQ ID NO: 493730 - protein, 9 aa, Homo Sapiens
PTSSLTPPK

SEQ ID NO: 493731 - protein, 9 aa, Homo Sapiens
IYKLFENIR

SEQ ID NO: 493732 - protein, 9 aa, Homo Sapiens
PTALQEEEK

SEQ ID NO: 493733 - protein, 9 aa, Homo Sapiens
WAVGNIAGD

SEQ ID NO: 493734 - protein, 9 aa, Homo Sapiens
DLAGPKGSR

SEQ ID NO: 493735 - protein, 9 aa, Homo Sapiens
VRRRSIPGA

SEQ ID NO: 493736 - protein, 9 aa, Homo Sapiens
SCGFHEVNG

SEQ ID NO: 493737 - protein, 9 aa, Homo Sapiens
MLDALANAV

SEQ ID NO: 493738 - protein, 9 aa, Homo Sapiens
NLTRHQLIY

SEQ ID NO: 493739 - protein, 9 aa, Homo Sapiens
LLNGSAEFD

SEQ ID NO: 493740 - protein, 9 aa, Homo Sapiens
LHSDESTLE

SEQ ID NO: 493741 - protein, 9 aa, Homo Sapiens
FQRQERHQM

SEQ ID NO: 493742 - protein, 9 aa, Homo Sapiens
GRWIKQDPR

SEQ ID NO: 493743 - protein, 9 aa, Homo Sapiens
PSSSSPNKV

SEQ ID NO: 493744 - protein, 9 aa, Homo Sapiens
LSCDIKEER

SEQ ID NO: 493745 - protein, 9 aa, Homo Sapiens
KNCSVPLAE

SEQ ID NO: 493746 - protein, 9 aa, Homo Sapiens
EGDNCEVKE

SEQ ID NO: 493747 - protein, 9 aa, Homo Sapiens
HHSSAFHDD

SEQ ID NO: 493748 - protein, 9 aa, Homo Sapiens
GPVAMGPGS

SEQ ID NO: 493749 - protein, 9 aa, Homo Sapiens
WQRVLSFVC

SEQ ID NO: 493750 - protein, 9 aa, Homo Sapiens
GLAQKKFPR

SEQ ID NO: 493751 - protein, 9 aa, Homo Sapiens
CKLIKKFQD

SEQ ID NO: 493752 - protein, 9 aa, Homo Sapiens
MYLDLSGCT

SEQ ID NO: 493753 - protein, 9 aa, Homo Sapiens
PPERYLSLP

SEQ ID NO: 493754 - protein, 9 aa, Homo Sapiens
IHIPKSIIK

SEQ ID NO: 493755 - protein, 9 aa, Homo Sapiens
QYGHMEEGA

SEQ ID NO: 493756 - protein, 9 aa, Homo Sapiens
KALKLVGME

SEQ ID NO: 493757 - protein, 9 aa, Homo Sapiens
ELGLLLSLP

SEQ ID NO: 493758 - protein, 9 aa, Homo Sapiens
KAMVGHEMA

SEQ ID NO: 493759 - protein, 9 aa, Homo Sapiens
PELPDSVPH

SEQ ID NO: 493760 - protein, 9 aa, Homo Sapiens
VVDPVHRVH

SEQ ID NO: 493761 - protein, 9 aa, Homo Sapiens
KTQRSLRAQ

SEQ ID NO: 493762 - protein, 9 aa, Homo Sapiens
RDYEVNGRD

SEQ ID NO: 493763 - protein, 9 aa, Homo Sapiens
KVAKIMMGK

SEQ ID NO: 493764 - protein, 9 aa, Homo Sapiens
SLQGLVMFQ

SEQ ID NO: 493765 - protein, 9 aa, Homo Sapiens
SCDIKEERK

SEQ ID NO: 493766 - protein, 9 aa, Homo Sapiens
DDNHDDDVS

SEQ ID NO: 493767 - protein, 8 aa, Homo Sapiens
MTITRTYL

SEQ ID NO: 493768 - protein, 9 aa, Homo Sapiens
FFKVLLLFQ

SEQ ID NO: 493769 - protein, 9 aa, Homo Sapiens
DVFYKRNST

SEQ ID NO: 493770 - protein, 9 aa, Homo Sapiens
SVCACATLR

SEQ ID NO: 493771 - protein, 9 aa, Homo Sapiens
AHDSQAKVA

SEQ ID NO: 493772 - protein, 9 aa, Homo Sapiens
PLKMALDLD

SEQ ID NO: 493773 - protein, 9 aa, Homo Sapiens
SELPDSVPH

SEQ ID NO: 493774 - protein, 9 aa, Homo Sapiens
PPELPDSVP

SEQ ID NO: 493775 - protein, 9 aa, Homo Sapiens
SIKEMTQAP

SEQ ID NO: 493776 - protein, 9 aa, Homo Sapiens
HAGFKMISK

SEQ ID NO: 493777 - protein, 9 aa, Homo Sapiens
RRNEDKTIA

SEQ ID NO: 493778 - protein, 9 aa, Homo Sapiens
KDPLDAFAQ

SEQ ID NO: 493779 - protein, 9 aa, Homo Sapiens
EQAARQRKA

SEQ ID NO: 493780 - protein, 9 aa, Homo Sapiens
RWLEYNLDH

SEQ ID NO: 493781 - protein, 9 aa, Homo Sapiens
GGVHYRTNI

SEQ ID NO: 493782 - protein, 9 aa, Homo Sapiens
YRKDIKERA

SEQ ID NO: 493783 - protein, 9 aa, Homo Sapiens
YNNAKQKKL

SEQ ID NO: 493784 - protein, 9 aa, Homo Sapiens
HNEEEMKFL

SEQ ID NO: 493785 - protein, 9 aa, Homo Sapiens
CKWPGCQTL

SEQ ID NO: 493786 - protein, 9 aa, Homo Sapiens
VSKEVNCLK

SEQ ID NO: 493787 - protein, 9 aa, Homo Sapiens
PSSACKAMV

SEQ ID NO: 493788 - protein, 9 aa, Homo Sapiens
ERAIETLMK

SEQ ID NO: 493789 - protein, 9 aa, Homo Sapiens
IKLLYFLLS

SEQ ID NO: 493790 - protein, 9 aa, Homo Sapiens
VQYRELFEE

SEQ ID NO: 493791 - protein, 9 aa, Homo Sapiens
HMQESAHKC

SEQ ID NO: 493792 - protein, 9 aa, Homo Sapiens
KRWLEYNLD

SEQ ID NO: 493793 - protein, 9 aa, Homo Sapiens
LEVFLRLEM

SEQ ID NO: 493794 - protein, 9 aa, Homo Sapiens
NCSVPLAEH

SEQ ID NO: 493795 - protein, 9 aa, Homo Sapiens
PTEDPMPCA

SEQ ID NO: 493796 - protein, 9 aa, Homo Sapiens
GHFFDLPDL

SEQ ID NO: 493797 - protein, 9 aa, Homo Sapiens
SDLWYCPYG

SEQ ID NO: 493798 - protein, 9 aa, Homo Sapiens
PASLAPLGI

SEQ ID NO: 493799 - protein, 9 aa, Homo Sapiens
PAPKSQTKG

SEQ ID NO: 493800 - protein, 9 aa, Homo Sapiens
PWKTHSEAD

SEQ ID NO: 493801 - protein, 9 aa, Homo Sapiens
RQKLVEEGE

SEQ ID NO: 493802 - protein, 9 aa, Homo Sapiens
FSVCACATL

SEQ ID NO: 493803 - protein, 9 aa, Homo Sapiens
IAGLMSMLT

SEQ ID NO: 493804 - protein, 9 aa, Homo Sapiens
VFSKYQLHK

SEQ ID NO: 493805 - protein, 9 aa, Homo Sapiens
AKSSFQTHI

SEQ ID NO: 493806 - protein, 9 aa, Homo Sapiens
TQSAKAPAE

SEQ ID NO: 493807 - protein, 9 aa, Homo Sapiens
EFLELSPEK

SEQ ID NO: 493808 - protein, 9 aa, Homo Sapiens
LEKKHSGAA

SEQ ID NO: 493809 - protein, 9 aa, Homo Sapiens
SKPRQMKRP

SEQ ID NO: 493810 - protein, 9 aa, Homo Sapiens
LQCKHEFQR

SEQ ID NO: 493811 - protein, 9 aa, Homo Sapiens
PNGHLPAVA

SEQ ID NO: 493812 - protein, 9 aa, Homo Sapiens
FSQVSMFFT

SEQ ID NO: 493813 - protein, 9 aa, Homo Sapiens
IWFYDLLAQ

SEQ ID NO: 493814 - protein, 9 aa, Homo Sapiens
EDGSGGPVA

SEQ ID NO: 493815 - protein, 9 aa, Homo Sapiens
PLINSLIRV

SEQ ID NO: 493816 - protein, 9 aa, Homo Sapiens
KTYISNKYG

SEQ ID NO: 493817 - protein, 9 aa, Homo Sapiens
CCQFLESQL

SEQ ID NO: 493818 - protein, 9 aa, Homo Sapiens
AQNLKLTCA

SEQ ID NO: 493819 - protein, 9 aa, Homo Sapiens
CIHNEEEMK

SEQ ID NO: 493820 - protein, 9 aa, Homo Sapiens
LSTRSLNGL

SEQ ID NO: 493821 - protein, 9 aa, Homo Sapiens
SLTAVAQAD

SEQ ID NO: 493822 - protein, 9 aa, Homo Sapiens
SRVRGQGTF

SEQ ID NO: 493823 - protein, 9 aa, Homo Sapiens
HAKNGHPQA

SEQ ID NO: 493824 - protein, 9 aa, Homo Sapiens
PLGFSGEEL

SEQ ID NO: 493825 - protein, 9 aa, Homo Sapiens
NKVSDMKFQ

SEQ ID NO: 493826 - protein, 9 aa, Homo Sapiens
EVFLRLEMC

SEQ ID NO: 493827 - protein, 9 aa, Homo Sapiens
KYKEKCFIK

SEQ ID NO: 493828 - protein, 9 aa, Homo Sapiens
VVGRELTRG

SEQ ID NO: 493829 - protein, 9 aa, Homo Sapiens
LDAFAQGEV

SEQ ID NO: 493830 - protein, 9 aa, Homo Sapiens
LILKKYRAA

SEQ ID NO: 493831 - protein, 9 aa, Homo Sapiens
ASELLHFID

SEQ ID NO: 493832 - protein, 9 aa, Homo Sapiens
LYIIGILFL

SEQ ID NO: 493833 - protein, 9 aa, Homo Sapiens
LWYCPYGSF

SEQ ID NO: 493834 - protein, 9 aa, Homo Sapiens
ILKKYRAAA

SEQ ID NO: 493835 - protein, 9 aa, Homo Sapiens
FLEIKSATD

SEQ ID NO: 493836 - protein, 9 aa, Homo Sapiens
QSKPRQMKR

SEQ ID NO: 493837 - protein, 9 aa, Homo Sapiens
LRLKGGNPH

SEQ ID NO: 493838 - protein, 9 aa, Homo Sapiens
GLHPTEDPM

SEQ ID NO: 493839 - protein, 9 aa, Homo Sapiens
KPPAGPPLS

SEQ ID NO: 493840 - protein, 9 aa, Homo Sapiens
GRGKTMSCQ

SEQ ID NO: 493841 - protein, 9 aa, Homo Sapiens
KPWLEMQIN

SEQ ID NO: 493842 - protein, 9 aa, Homo Sapiens
EASEDTPEV

SEQ ID NO: 493843 - protein, 9 aa, Homo Sapiens
DDFGQLVLV

SEQ ID NO: 493844 - protein, 9 aa, Homo Sapiens
KPRQMKRPL

SEQ ID NO: 493845 - protein, 9 aa, Homo Sapiens
KGSAFFCLS

SEQ ID NO: 493846 - protein, 9 aa, Homo Sapiens
KKLYQVKGN

SEQ ID NO: 493847 - protein, 9 aa, Homo Sapiens
AFDPKEYPY

SEQ ID NO: 493848 - protein, 9 aa, Homo Sapiens
SLNGLVKNI

SEQ ID NO: 493849 - protein, 9 aa, Homo Sapiens
YRLLGHVLP

SEQ ID NO: 493850 - protein, 9 aa, Homo Sapiens
LVTLTEGPG

SEQ ID NO: 493851 - protein, 9 aa, Homo Sapiens
SLFVLACKD

SEQ ID NO: 493852 - protein, 9 aa, Homo Sapiens
HAFQERLNS

SEQ ID NO: 493853 - protein, 9 aa, Homo Sapiens
DQEGGGQSQ

SEQ ID NO: 493854 - protein, 9 aa, Homo Sapiens
DNCLSKNYE

SEQ ID NO: 493855 - protein, 9 aa, Homo Sapiens
PDIYRRKVI

SEQ ID NO: 493856 - protein, 9 aa, Homo Sapiens
CITAGHFQN

SEQ ID NO: 493857 - protein, 9 aa, Homo Sapiens
NFKEVCDEI

SEQ ID NO: 493858 - protein, 9 aa, Homo Sapiens
KHGDKWGEP

SEQ ID NO: 493859 - protein, 9 aa, Homo Sapiens
GPNGHLPAV

SEQ ID NO: 493860 - protein, 9 aa, Homo Sapiens
ASAMVRSQA

SEQ ID NO: 493861 - protein, 9 aa, Homo Sapiens
TESAPGPLG

SEQ ID NO: 493862 - protein, 9 aa, Homo Sapiens
VDLSQPQPW

SEQ ID NO: 493863 - protein, 9 aa, Homo Sapiens
PTLASESAR

SEQ ID NO: 493864 - protein, 9 aa, Homo Sapiens
QMKRPLEDA

SEQ ID NO: 493865 - protein, 9 aa, Homo Sapiens
ESGSGTEAK

SEQ ID NO: 493866 - protein, 9 aa, Homo Sapiens
AISLCKSVK

SEQ ID NO: 493867 - protein, 9 aa, Homo Sapiens
TKNPPGCYR

SEQ ID NO: 493868 - protein, 9 aa, Homo Sapiens
LKLVGMEDD

SEQ ID NO: 493869 - protein, 9 aa, Homo Sapiens
NKFDEKENV

SEQ ID NO: 493870 - protein, 9 aa, Homo Sapiens
GGQSQLSSV

SEQ ID NO: 493871 - protein, 9 aa, Homo Sapiens
LLQLAGQSL

SEQ ID NO: 493872 - protein, 9 aa, Homo Sapiens
TYVRSLAKN

SEQ ID NO: 493873 - protein, 9 aa, Homo Sapiens
RKMCQQEQT

SEQ ID NO: 493874 - protein, 9 aa, Homo Sapiens
EEKNKEAEE

SEQ ID NO: 493875 - protein, 9 aa, Homo Sapiens
GNMLDALAN

SEQ ID NO: 493876 - protein, 9 aa, Homo Sapiens
AKRNYLNVL

SEQ ID NO: 493877 - protein, 9 aa, Homo Sapiens
LRWTRQKLV

SEQ ID NO: 493878 - protein, 9 aa, Homo Sapiens
DIYRRKVIL

SEQ ID NO: 493879 - protein, 9 aa, Homo Sapiens
LPRAASVRR

SEQ ID NO: 493880 - protein, 9 aa, Homo Sapiens
LFASASHGA

SEQ ID NO: 493881 - protein, 9 aa, Homo Sapiens
KQSKPRQMK

SEQ ID NO: 493882 - protein, 9 aa, Homo Sapiens
VHYRTNIQT

SEQ ID NO: 493883 - protein, 9 aa, Homo Sapiens
LAVDLWSLG

SEQ ID NO: 493884 - protein, 9 aa, Homo Sapiens
PEMKPQGFR

SEQ ID NO: 493885 - protein, 9 aa, Homo Sapiens
VAHSNPGEL

SEQ ID NO: 493886 - protein, 9 aa, Homo Sapiens
GDWQRQWMG

SEQ ID NO: 493887 - protein, 9 aa, Homo Sapiens
GRWRGRAKS

SEQ ID NO: 493888 - protein, 9 aa, Homo Sapiens
KLTEKMYSE

SEQ ID NO: 493889 - protein, 9 aa, Homo Sapiens
YLSKRRVSP

SEQ ID NO: 493890 - protein, 9 aa, Homo Sapiens
LPSWPGAQG

SEQ ID NO: 493891 - protein, 9 aa, Homo Sapiens
LMKNFHQYS

SEQ ID NO: 493892 - protein, 9 aa, Homo Sapiens
AKAPAEEDL

SEQ ID NO: 493893 - protein, 9 aa, Homo Sapiens
WKLIESNDT

SEQ ID NO: 493894 - protein, 9 aa, Homo Sapiens
GLPREVVVT

SEQ ID NO: 493895 - protein, 9 aa, Homo Sapiens
PMPCACGQE

SEQ ID NO: 493896 - protein, 9 aa, Homo Sapiens
RPKALKLVG

SEQ ID NO: 493897 - protein, 9 aa, Homo Sapiens
KRDKKRSRT

SEQ ID NO: 493898 - protein, 9 aa, Homo Sapiens
DSEEEEVDE

SEQ ID NO: 493899 - protein, 9 aa, Homo Sapiens
DYRSNQWRY

SEQ ID NO: 493900 - protein, 9 aa, Homo Sapiens
APPAHQLHR

SEQ ID NO: 493901 - protein, 9 aa, Homo Sapiens
ELEYESGSG

SEQ ID NO: 493902 - protein, 9 aa, Homo Sapiens
YPTDWSDDQ

SEQ ID NO: 493903 - protein, 9 aa, Homo Sapiens
AHLQKVGER

SEQ ID NO: 493904 - protein, 9 aa, Homo Sapiens
THNIEMEAA

SEQ ID NO: 493905 - protein, 9 aa, Homo Sapiens
ERTCIQFSI

SEQ ID NO: 493906 - protein, 9 aa, Homo Sapiens
ADRPHIKKA

SEQ ID NO: 493907 - protein, 9 aa, Homo Sapiens
RIFIAVLKI

SEQ ID NO: 493908 - protein, 9 aa, Homo Sapiens
ENLWLSNVF

SEQ ID NO: 493909 - protein, 9 aa, Homo Sapiens
KSLLPRASK

SEQ ID NO: 493910 - protein, 9 aa, Homo Sapiens
ENIKKDELK

SEQ ID NO: 493911 - protein, 9 aa, Homo Sapiens
RCRSPRRRK

SEQ ID NO: 493912 - protein, 9 aa, Homo Sapiens
PKGSAFFCL

SEQ ID NO: 493913 - protein, 9 aa, Homo Sapiens
ATGNMLDAL

SEQ ID NO: 493914 - protein, 9 aa, Homo Sapiens
KVILMYPIL

SEQ ID NO: 493915 - protein, 9 aa, Homo Sapiens
CPSKCRLHP

SEQ ID NO: 493916 - protein, 9 aa, Homo Sapiens
CGPPFCHQA

SEQ ID NO: 493917 - protein, 9 aa, Homo Sapiens
VQLELAQVL

SEQ ID NO: 493918 - protein, 9 aa, Homo Sapiens
TNMLSHQLV

SEQ ID NO: 493919 - protein, 9 aa, Homo Sapiens
LYMLTKMGD

SEQ ID NO: 493920 - protein, 9 aa, Homo Sapiens
CCNTKNPPG

SEQ ID NO: 493921 - protein, 9 aa, Homo Sapiens
HFESIQTYT

SEQ ID NO: 493922 - protein, 9 aa, Homo Sapiens
VVDLSQPQP

SEQ ID NO: 493923 - protein, 9 aa, Homo Sapiens
TITFPTLTE

SEQ ID NO: 493924 - protein, 9 aa, Homo Sapiens
LQSCPVCRW

SEQ ID NO: 493925 - protein, 9 aa, Homo Sapiens
PKSEACSLS

SEQ ID NO: 493926 - protein, 9 aa, Homo Sapiens
WPGCQTLCE

SEQ ID NO: 493927 - protein, 9 aa, Homo Sapiens
LEKYKEKCF

SEQ ID NO: 493928 - protein, 9 aa, Homo Sapiens
SSFQTHIRI

SEQ ID NO: 493929 - protein, 9 aa, Homo Sapiens
RRRSIPGAA

SEQ ID NO: 493930 - protein, 9 aa, Homo Sapiens
RTCGGGVSL

SEQ ID NO: 493931 - protein, 9 aa, Homo Sapiens
MADVHTFGH

SEQ ID NO: 493932 - protein, 9 aa, Homo Sapiens
TTVADRPHI

SEQ ID NO: 493933 - protein, 9 aa, Homo Sapiens
NNTPRFKRR

SEQ ID NO: 493934 - protein, 9 aa, Homo Sapiens
VTLTEGPGE

SEQ ID NO: 493935 - protein, 9 aa, Homo Sapiens
LYRKDIKER

SEQ ID NO: 493936 - protein, 9 aa, Homo Sapiens
GEGEQEDGK

SEQ ID NO: 493937 - protein, 9 aa, Homo Sapiens
KAQEIFNKY

SEQ ID NO: 493938 - protein, 9 aa, Homo Sapiens
RSLIGGAGN

SEQ ID NO: 493939 - protein, 9 aa, Homo Sapiens
ELYRQSLKI

SEQ ID NO: 493940 - protein, 9 aa, Homo Sapiens
SIKLLYFLL

SEQ ID NO: 493941 - protein, 9 aa, Homo Sapiens
RHLMPNLGS

SEQ ID NO: 493942 - protein, 9 aa, Homo Sapiens
QKTAAEGTL

SEQ ID NO: 493943 - protein, 9 aa, Homo Sapiens
EVLYMLTKM

SEQ ID NO: 493944 - protein, 9 aa, Homo Sapiens
HSGDCLVLS

SEQ ID NO: 493945 - protein, 9 aa, Homo Sapiens
EMDKIRKNL

SEQ ID NO: 493946 - protein, 9 aa, Homo Sapiens
SEGMKSTVD

SEQ ID NO: 493947 - protein, 9 aa, Homo Sapiens
RPSATNMLS

SEQ ID NO: 493948 - protein, 9 aa, Homo Sapiens
MKSTVDLHQ

SEQ ID NO: 493949 - protein, 9 aa, Homo Sapiens
NKVMALKDV

SEQ ID NO: 493950 - protein, 9 aa, Homo Sapiens
TTHPEKRYD

SEQ ID NO: 493951 - protein, 9 aa, Homo Sapiens
MFQDVTVYF

SEQ ID NO: 493952 - protein, 9 aa, Homo Sapiens
CGDLLTEEL

SEQ ID NO: 493953 - protein, 9 aa, Homo Sapiens
QRVLSFVCA

SEQ ID NO: 493954 - protein, 9 aa, Homo Sapiens
LTAAGVTRD

SEQ ID NO: 493955 - protein, 9 aa, Homo Sapiens
INSLEMFLP

SEQ ID NO: 493956 - protein, 9 aa, Homo Sapiens
ETLQNPKYE

SEQ ID NO: 493957 - protein, 9 aa, Homo Sapiens
QARKSQKTV

SEQ ID NO: 493958 - protein, 9 aa, Homo Sapiens
VIWNKVHHK

SEQ ID NO: 493959 - protein, 9 aa, Homo Sapiens
YLHAKGVIH

SEQ ID NO: 493960 - protein, 9 aa, Homo Sapiens
RLSAEGTVT

SEQ ID NO: 493961 - protein, 9 aa, Homo Sapiens
LLQAIKDLD

SEQ ID NO: 493962 - protein, 9 aa, Homo Sapiens
SLNSVKYAN

SEQ ID NO: 493963 - protein, 9 aa, Homo Sapiens
RLKGGNPHG

SEQ ID NO: 493964 - protein, 9 aa, Homo Sapiens
FTFPELIRK

SEQ ID NO: 493965 - protein, 9 aa, Homo Sapiens
PRQMKRPLE

SEQ ID NO: 493966 - protein, 9 aa, Homo Sapiens
KGEEQEEED

SEQ ID NO: 493967 - protein, 9 aa, Homo Sapiens
IFSEQHLKT

SEQ ID NO: 493968 - protein, 9 aa, Homo Sapiens
WKVAKIMMG

SEQ ID NO: 493969 - protein, 9 aa, Homo Sapiens
GSNKMIKLL

SEQ ID NO: 493970 - protein, 9 aa, Homo Sapiens
SSDSSNSDS

SEQ ID NO: 493971 - protein, 9 aa, Homo Sapiens
YDLTAMTLD

SEQ ID NO: 493972 - protein, 9 aa, Homo Sapiens
KVDLPLINS

SEQ ID NO: 493973 - protein, 9 aa, Homo Sapiens
SGDIRTLHP

SEQ ID NO: 493974 - protein, 9 aa, Homo Sapiens
AFTHGASLV

SEQ ID NO: 493975 - protein, 9 aa, Homo Sapiens
SAPKREIYC

SEQ ID NO: 493976 - protein, 9 aa, Homo Sapiens
LKQAIAHLQ

SEQ ID NO: 493977 - protein, 9 aa, Homo Sapiens
ETTTKLASE

SEQ ID NO: 493978 - protein, 9 aa, Homo Sapiens
DDANSNASS

SEQ ID NO: 493979 - protein, 9 aa, Homo Sapiens
GAGNARHGP

SEQ ID NO: 493980 - protein, 9 aa, Homo Sapiens
NLNENIKKD

SEQ ID NO: 493981 - protein, 9 aa, Homo Sapiens
RFPQNTIDL

SEQ ID NO: 493982 - protein, 9 aa, Homo Sapiens
QKPRQKKAL

SEQ ID NO: 493983 - protein, 9 aa, Homo Sapiens
LMSLFVLAC

SEQ ID NO: 493984 - protein, 9 aa, Homo Sapiens
LGTRQSLDE

SEQ ID NO: 493985 - protein, 9 aa, Homo Sapiens
WQETARTLC

SEQ ID NO: 493986 - protein, 9 aa, Homo Sapiens
PVLILDKMS

SEQ ID NO: 493987 - protein, 9 aa, Homo Sapiens
QGPWCYTTH

SEQ ID NO: 493988 - protein, 9 aa, Homo Sapiens
LFNPHGCCL

SEQ ID NO: 493989 - protein, 9 aa, Homo Sapiens
DSSVPWKTH

SEQ ID NO: 493990 - protein, 9 aa, Homo Sapiens
SESRGAIYF

SEQ ID NO: 493991 - protein, 9 aa, Homo Sapiens
SSNPPTLAS

SEQ ID NO: 493992 - protein, 9 aa, Homo Sapiens
GFKIHPVEK

SEQ ID NO: 493993 - protein, 9 aa, Homo Sapiens
MKSETKLTE

SEQ ID NO: 493994 - protein, 9 aa, Homo Sapiens
GNVPSERPF

SEQ ID NO: 493995 - protein, 9 aa, Homo Sapiens
LMPNLGSPI

SEQ ID NO: 493996 - protein, 9 aa, Homo Sapiens
LAAEGKYEE

SEQ ID NO: 493997 - protein, 9 aa, Homo Sapiens
HQDYTTQNF

SEQ ID NO: 493998 - protein, 9 aa, Homo Sapiens
LFTLTNYAY

SEQ ID NO: 493999 - protein, 9 aa, Homo Sapiens
GESVLELGA

SEQ ID NO: 494000 - protein, 9 aa, Homo Sapiens
PPLSNGTAA

SEQ ID NO: 494001 - protein, 9 aa, Homo Sapiens
ALDSITSIK

SEQ ID NO: 494002 - protein, 9 aa, Homo Sapiens
VAMGPGSLR

SEQ ID NO: 494003 - protein, 9 aa, Homo Sapiens
PKDPDSQPP

SEQ ID NO: 494004 - protein, 9 aa, Homo Sapiens
GFINDDHDE

SEQ ID NO: 494005 - protein, 9 aa, Homo Sapiens
TSIKEMTQA

SEQ ID NO: 494006 - protein, 9 aa, Homo Sapiens
LAAVTPLNE

SEQ ID NO: 494007 - protein, 9 aa, Homo Sapiens
LFSRVIPKY

SEQ ID NO: 494008 - protein, 9 aa, Homo Sapiens
SQLRQLQQE

SEQ ID NO: 494009 - protein, 9 aa, Homo Sapiens
VLFNPHGCC

SEQ ID NO: 494010 - protein, 9 aa, Homo Sapiens
VPICSGASC

SEQ ID NO: 494011 - protein, 9 aa, Homo Sapiens
QAKVASLRG

SEQ ID NO: 494012 - protein, 9 aa, Homo Sapiens
ISCRLKTYI

SEQ ID NO: 494013 - protein, 9 aa, Homo Sapiens
RHFLEIKSA

SEQ ID NO: 494014 - protein, 9 aa, Homo Sapiens
GFSQVSMFF

SEQ ID NO: 494015 - protein, 9 aa, Homo Sapiens
LLVGNGCLG

SEQ ID NO: 494016 - protein, 9 aa, Homo Sapiens
LTQCSYPSA

SEQ ID NO: 494017 - protein, 9 aa, Homo Sapiens
ELGLATLGY

SEQ ID NO: 494018 - protein, 9 aa, Homo Sapiens
ALSPTLTLS

SEQ ID NO: 494019 - protein, 9 aa, Homo Sapiens
DLWYCPYGS

SEQ ID NO: 494020 - protein, 9 aa, Homo Sapiens
SVPLAAVTP

SEQ ID NO: 494021 - protein, 9 aa, Homo Sapiens
LVMFQDVTV

SEQ ID NO: 494022 - protein, 9 aa, Homo Sapiens
IYRRKVILM

SEQ ID NO: 494023 - protein, 9 aa, Homo Sapiens
LKTLKCLSL

SEQ ID NO: 494024 - protein, 9 aa, Homo Sapiens
AFLTQGWGR

SEQ ID NO: 494025 - protein, 9 aa, Homo Sapiens
KIHPVEKLQ

SEQ ID NO: 494026 - protein, 9 aa, Homo Sapiens
LCGPPFCHQ

SEQ ID NO: 494027 - protein, 9 aa, Homo Sapiens
CERVRTYWI

SEQ ID NO: 494028 - protein, 9 aa, Homo Sapiens
GQKPYKCNE

SEQ ID NO: 494029 - protein, 9 aa, Homo Sapiens
FEDMYKLTF

SEQ ID NO: 494030 - protein, 9 aa, Homo Sapiens
ISHHSSAFH

SEQ ID NO: 494031 - protein, 9 aa, Homo Sapiens
QKKALEFPI

SEQ ID NO: 494032 - protein, 9 aa, Homo Sapiens
EKPYKMWRL

SEQ ID NO: 494033 - protein, 9 aa, Homo Sapiens
KKALEFPIL

SEQ ID NO: 494034 - protein, 9 aa, Homo Sapiens
KNTSSAMAG

SEQ ID NO: 494035 - protein, 9 aa, Homo Sapiens
FRMMSCGFH

SEQ ID NO: 494036 - protein, 9 aa, Homo Sapiens
INNLNENIK

SEQ ID NO: 494037 - protein, 9 aa, Homo Sapiens
PLAAGINLM

SEQ ID NO: 494038 - protein, 9 aa, Homo Sapiens
EKNKEAEEL

SEQ ID NO: 494039 - protein, 9 aa, Homo Sapiens
ILAEGWATP

SEQ ID NO: 494040 - protein, 9 aa, Homo Sapiens
NSETVAKLV

SEQ ID NO: 494041 - protein, 9 aa, Homo Sapiens
SSLTPPKDP

SEQ ID NO: 494042 - protein, 9 aa, Homo Sapiens
MIRQISRPL

SEQ ID NO: 494043 - protein, 9 aa, Homo Sapiens
RFQSSDYRS

SEQ ID NO: 494044 - protein, 9 aa, Homo Sapiens
HNEPEERPA

SEQ ID NO: 494045 - protein, 9 aa, Homo Sapiens
SLAAEEQAA

SEQ ID NO: 494046 - protein, 9 aa, Homo Sapiens
PAHQLHRAH

SEQ ID NO: 494047 - protein, 9 aa, Homo Sapiens
LYRQSLKII

SEQ ID NO: 494048 - protein, 9 aa, Homo Sapiens
NPILYNLIL

SEQ ID NO: 494049 - protein, 9 aa, Homo Sapiens
SLQPSPTQS

SEQ ID NO: 494050 - protein, 9 aa, Homo Sapiens
QPILKSYYT

SEQ ID NO: 494051 - protein, 9 aa, Homo Sapiens
YRRKVILMY

SEQ ID NO: 494052 - protein, 9 aa, Homo Sapiens
YRRNEDKTI

SEQ ID NO: 494053 - protein, 9 aa, Homo Sapiens
TDLPSNDFQ

SEQ ID NO: 494054 - protein, 9 aa, Homo Sapiens
WDVFYKRNS

SEQ ID NO: 494055 - protein, 9 aa, Homo Sapiens
GIVPPERQE

SEQ ID NO: 494056 - protein, 9 aa, Homo Sapiens
AVNICYGWH

SEQ ID NO: 494057 - protein, 9 aa, Homo Sapiens
GGPLSDFYS

SEQ ID NO: 494058 - protein, 9 aa, Homo Sapiens
ELFHEKMHV

SEQ ID NO: 494059 - protein, 9 aa, Homo Sapiens
NIRKGSYAI

SEQ ID NO: 494060 - protein, 9 aa, Homo Sapiens
MVSKEVNCL

SEQ ID NO: 494061 - protein, 9 aa, Homo Sapiens
CKLAWQPKS

SEQ ID NO: 494062 - protein, 9 aa, Homo Sapiens
LLQYGHMEE

SEQ ID NO: 494063 - protein, 9 aa, Homo Sapiens
SAAHLENYS

SEQ ID NO: 494064 - protein, 9 aa, Homo Sapiens
ISDFGLSIR

SEQ ID NO: 494065 - protein, 9 aa, Homo Sapiens
PFSSGGSPA

SEQ ID NO: 494066 - protein, 9 aa, Homo Sapiens
RGRAKSPGV

SEQ ID NO: 494067 - protein, 9 aa, Homo Sapiens
VSKNGNGLN

SEQ ID NO: 494068 - protein, 9 aa, Homo Sapiens
KCVKTSHFF

SEQ ID NO: 494069 - protein, 9 aa, Homo Sapiens
ADSLTQCSY

SEQ ID NO: 494070 - protein, 9 aa, Homo Sapiens
AHGEELDED

SEQ ID NO: 494071 - protein, 9 aa, Homo Sapiens
CQQEQTSYM

SEQ ID NO: 494072 - protein, 9 aa, Homo Sapiens
LDKCLKLSR

SEQ ID NO: 494073 - protein, 9 aa, Homo Sapiens
PGVQARNLF

SEQ ID NO: 494074 - protein, 9 aa, Homo Sapiens
CYTTHPEKR

SEQ ID NO: 494075 - protein, 9 aa, Homo Sapiens
LLVLEQLLT

SEQ ID NO: 494076 - protein, 9 aa, Homo Sapiens
TRGTGEESR

SEQ ID NO: 494077 - protein, 9 aa, Homo Sapiens
SDLAGPKGS

SEQ ID NO: 494078 - protein, 9 aa, Homo Sapiens
DEDAAQASP

SEQ ID NO: 494079 - protein, 9 aa, Homo Sapiens
LPFNGIIPL

SEQ ID NO: 494080 - protein, 9 aa, Homo Sapiens
GPPLSNGTA

SEQ ID NO: 494081 - protein, 9 aa, Homo Sapiens
SCSLAQAQY

SEQ ID NO: 494082 - protein, 9 aa, Homo Sapiens
DGLHSDEST

SEQ ID NO: 494083 - protein, 9 aa, Homo Sapiens
SIRPFKQRK

SEQ ID NO: 494084 - protein, 9 aa, Homo Sapiens
KRPSATNML

SEQ ID NO: 494085 - protein, 9 aa, Homo Sapiens
LPLTMNSLE

SEQ ID NO: 494086 - protein, 9 aa, Homo Sapiens
PQALLQAIK

SEQ ID NO: 494087 - protein, 9 aa, Homo Sapiens
MKGTGCRAL

SEQ ID NO: 494088 - protein, 9 aa, Homo Sapiens
DAHDSQAKV

SEQ ID NO: 494089 - protein, 9 aa, Homo Sapiens
CEGQTRSYC

SEQ ID NO: 494090 - protein, 9 aa, Homo Sapiens
GGLECLLLA

SEQ ID NO: 494091 - protein, 9 aa, Homo Sapiens
KGSRRPEVE

SEQ ID NO: 494092 - protein, 9 aa, Homo Sapiens
LCKSVKAEY

SEQ ID NO: 494093 - protein, 9 aa, Homo Sapiens
LAQKKFPRH

SEQ ID NO: 494094 - protein, 9 aa, Homo Sapiens
TEDPMPCAC

SEQ ID NO: 494095 - protein, 9 aa, Homo Sapiens
WVQILAEGW

SEQ ID NO: 494096 - protein, 9 aa, Homo Sapiens
RGRSFIRTM

SEQ ID NO: 494097 - protein, 9 aa, Homo Sapiens
HHPHSGDCL

SEQ ID NO: 494098 - protein, 9 aa, Homo Sapiens
VVGKGEEQE

SEQ ID NO: 494099 - protein, 9 aa, Homo Sapiens
INIIIAFLY

SEQ ID NO: 494100 - protein, 9 aa, Homo Sapiens
YDIPDLLVG

SEQ ID NO: 494101 - protein, 9 aa, Homo Sapiens
ERRKEAKRI

SEQ ID NO: 494102 - protein, 9 aa, Homo Sapiens
KHFRRPEPS

SEQ ID NO: 494103 - protein, 9 aa, Homo Sapiens
AKSPGVPVA

SEQ ID NO: 494104 - protein, 9 aa, Homo Sapiens
LFQLSNVTL

SEQ ID NO: 494105 - protein, 9 aa, Homo Sapiens
QHAKNGHPQ

SEQ ID NO: 494106 - protein, 9 aa, Homo Sapiens
QGRWIKQDP

SEQ ID NO: 494107 - protein, 9 aa, Homo Sapiens
DGKEEEKKV

SEQ ID NO: 494108 - protein, 9 aa, Homo Sapiens
DIRTEMDKI

SEQ ID NO: 494109 - protein, 9 aa, Homo Sapiens
SELLHFIDN

SEQ ID NO: 494110 - protein, 9 aa, Homo Sapiens
QSSDYRSNQ

SEQ ID NO: 494111 - protein, 9 aa, Homo Sapiens
LRIFIAVLK

SEQ ID NO: 494112 - protein, 9 aa, Homo Sapiens
EDKTIAPCG

SEQ ID NO: 494113 - protein, 9 aa, Homo Sapiens
RIFGLPREV

SEQ ID NO: 494114 - protein, 9 aa, Homo Sapiens
RNEDKTIAP

SEQ ID NO: 494115 - protein, 9 aa, Homo Sapiens
IPKYCRALE

SEQ ID NO: 494116 - protein, 9 aa, Homo Sapiens
HYRTNIQTF

SEQ ID NO: 494117 - protein, 9 aa, Homo Sapiens
LPPACSESE

SEQ ID NO: 494118 - protein, 9 aa, Homo Sapiens
SLIGGAGNA

SEQ ID NO: 494119 - protein, 9 aa, Homo Sapiens
ALEFPILEK

SEQ ID NO: 494120 - protein, 9 aa, Homo Sapiens
FNKFDEKEN

SEQ ID NO: 494121 - protein, 9 aa, Homo Sapiens
EGTVTFEDV

SEQ ID NO: 494122 - protein, 9 aa, Homo Sapiens
SCGAPGQDT

SEQ ID NO: 494123 - protein, 9 aa, Homo Sapiens
HGEELDEDL

SEQ ID NO: 494124 - protein, 9 aa, Homo Sapiens
TRHQLIYTG

SEQ ID NO: 494125 - protein, 9 aa, Homo Sapiens
IVLGIQTSC

SEQ ID NO: 494126 - protein, 9 aa, Homo Sapiens
NEEKNKEAE

SEQ ID NO: 494127 - protein, 9 aa, Homo Sapiens
RKQSKPRQM

SEQ ID NO: 494128 - protein, 9 aa, Homo Sapiens
APKIAVMST

SEQ ID NO: 494129 - protein, 9 aa, Homo Sapiens
NRVEAPRLI

SEQ ID NO: 494130 - protein, 9 aa, Homo Sapiens
WCYTTHPEK

SEQ ID NO: 494131 - protein, 9 aa, Homo Sapiens
LRKLSSKTR

SEQ ID NO: 494132 - protein, 9 aa, Homo Sapiens
HPMKPGGVL

SEQ ID NO: 494133 - protein, 9 aa, Homo Sapiens
GKKFVFDFM

SEQ ID NO: 494134 - protein, 9 aa, Homo Sapiens
LSSKTRASE

SEQ ID NO: 494135 - protein, 9 aa, Homo Sapiens
FDSSRQSRS

SEQ ID NO: 494136 - protein, 9 aa, Homo Sapiens
PAVGSRFFC

SEQ ID NO: 494137 - protein, 9 aa, Homo Sapiens
NLPQHERDA

SEQ ID NO: 494138 - protein, 9 aa, Homo Sapiens
AQGARAVLQ

SEQ ID NO: 494139 - protein, 9 aa, Homo Sapiens
LAGAKGGGQ

SEQ ID NO: 494140 - protein, 9 aa, Homo Sapiens
HKAAENSNL

SEQ ID NO: 494141 - protein, 9 aa, Homo Sapiens
YTTQNFIRM

SEQ ID NO: 494142 - protein, 9 aa, Homo Sapiens
TSKFVSKNG

SEQ ID NO: 494143 - protein, 9 aa, Homo Sapiens
IYLSKRRVS

SEQ ID NO: 494144 - protein, 9 aa, Homo Sapiens
REKRERCRS

SEQ ID NO: 494145 - protein, 9 aa, Homo Sapiens
KGVKQACCQ

SEQ ID NO: 494146 - protein, 9 aa, Homo Sapiens
VGGILPTCQ

SEQ ID NO: 494147 - protein, 9 aa, Homo Sapiens
LQEEEKQSL

SEQ ID NO: 494148 - protein, 9 aa, Homo Sapiens
DKVRECQLE

SEQ ID NO: 494149 - protein, 9 aa, Homo Sapiens
RLLGHVLPS

SEQ ID NO: 494150 - protein, 9 aa, Homo Sapiens
NKNIRATER

SEQ ID NO: 494151 - protein, 9 aa, Homo Sapiens
EDIAAQEDL

SEQ ID NO: 494152 - protein, 9 aa, Homo Sapiens
QGEYECVAT

SEQ ID NO: 494153 - protein, 9 aa, Homo Sapiens
LEYESGSGT

SEQ ID NO: 494154 - protein, 9 aa, Homo Sapiens
MMSCGFHEV

SEQ ID NO: 494155 - protein, 9 aa, Homo Sapiens
EQEEEDGMR

SEQ ID NO: 494156 - protein, 9 aa, Homo Sapiens
AQEDLDKTA

SEQ ID NO: 494157 - protein, 9 aa, Homo Sapiens
LVLEQLLTI

SEQ ID NO: 494158 - protein, 9 aa, Homo Sapiens
PSWSLHCEG

SEQ ID NO: 494159 - protein, 9 aa, Homo Sapiens
GSRFFCRIS

SEQ ID NO: 494160 - protein, 9 aa, Homo Sapiens
PQLGTAPKI

SEQ ID NO: 494161 - protein, 9 aa, Homo Sapiens
ITEDITYQQ

SEQ ID NO: 494162 - protein, 9 aa, Homo Sapiens
HDVNQCSSS

SEQ ID NO: 494163 - protein, 9 aa, Homo Sapiens
GGILPTCQP

SEQ ID NO: 494164 - protein, 9 aa, Homo Sapiens
DTNRVEAPR

SEQ ID NO: 494165 - protein, 9 aa, Homo Sapiens
PTLTLSPHI

SEQ ID NO: 494166 - protein, 9 aa, Homo Sapiens
MAMYVAAAM

SEQ ID NO: 494167 - protein, 9 aa, Homo Sapiens
KHITVFVPA

SEQ ID NO: 494168 - protein, 9 aa, Homo Sapiens
QEDGKEEEK

SEQ ID NO: 494169 - protein, 9 aa, Homo Sapiens
ASEEHVNTK

SEQ ID NO: 494170 - protein, 9 aa, Homo Sapiens
GVKQACCQF

SEQ ID NO: 494171 - protein, 9 aa, Homo Sapiens
SVGTEGLCG

SEQ ID NO: 494172 - protein, 9 aa, Homo Sapiens
GSGGPVAMG

SEQ ID NO: 494173 - protein, 9 aa, Homo Sapiens
AACAQFDSS

SEQ ID NO: 494174 - protein, 9 aa, Homo Sapiens
KEVCDEIKS

SEQ ID NO: 494175 - protein, 8 aa, Homo Sapiens
NGEYRGRG

SEQ ID NO: 494176 - protein, 9 aa, Homo Sapiens
LDMVAGCRL

SEQ ID NO: 494177 - protein, 9 aa, Homo Sapiens
FLFLGLGGL

SEQ ID NO: 494178 - protein, 9 aa, Homo Sapiens
RTLCAFNSS

SEQ ID NO: 494179 - protein, 9 aa, Homo Sapiens
AMPDPAGPN

SEQ ID NO: 494180 - protein, 9 aa, Homo Sapiens
RGSDTEGLA

SEQ ID NO: 494181 - protein, 9 aa, Homo Sapiens
FRIEIKSKN

SEQ ID NO: 494182 - protein, 9 aa, Homo Sapiens
PQKIPSIRP

SEQ ID NO: 494183 - protein, 9 aa, Homo Sapiens
ALKCVKTSH

SEQ ID NO: 494184 - protein, 9 aa, Homo Sapiens
RKRLCKLIK

SEQ ID NO: 494185 - protein, 9 aa, Homo Sapiens
IYGILGDLG

SEQ ID NO: 494186 - protein, 9 aa, Homo Sapiens
QRKDLGRCE

SEQ ID NO: 494187 - protein, 9 aa, Homo Sapiens
ALLDRETLQ

SEQ ID NO: 494188 - protein, 9 aa, Homo Sapiens
NSLFKSKAR

SEQ ID NO: 494189 - protein, 9 aa, Homo Sapiens
AGLMSMLTS

SEQ ID NO: 494190 - protein, 9 aa, Homo Sapiens
KMGDVACTK

SEQ ID NO: 494191 - protein, 9 aa, Homo Sapiens
GQSQLSSVL

SEQ ID NO: 494192 - protein, 9 aa, Homo Sapiens
GGAGNARHG

SEQ ID NO: 494193 - protein, 9 aa, Homo Sapiens
NGTIWFYDL

SEQ ID NO: 494194 - protein, 9 aa, Homo Sapiens
KKRSILICS

SEQ ID NO: 494195 - protein, 9 aa, Homo Sapiens
LNGNVQLEL

SEQ ID NO: 494196 - protein, 9 aa, Homo Sapiens
SQVSMFFTH

SEQ ID NO: 494197 - protein, 9 aa, Homo Sapiens
SDFGLSIRL

SEQ ID NO: 494198 - protein, 9 aa, Homo Sapiens
FVAGYKSLK

SEQ ID NO: 494199 - protein, 9 aa, Homo Sapiens
KNSYYPRGD

SEQ ID NO: 494200 - protein, 9 aa, Homo Sapiens
VGVFTVADK

SEQ ID NO: 494201 - protein, 9 aa, Homo Sapiens
ALLIHEKNT

SEQ ID NO: 494202 - protein, 9 aa, Homo Sapiens
KHIEDKKLV

SEQ ID NO: 494203 - protein, 9 aa, Homo Sapiens
IIISYLRIF

SEQ ID NO: 494204 - protein, 9 aa, Homo Sapiens
ISRVRGQGT

SEQ ID NO: 494205 - protein, 9 aa, Homo Sapiens
KSWKVAKIM

SEQ ID NO: 494206 - protein, 9 aa, Homo Sapiens
LSSCAISLC

SEQ ID NO: 494207 - protein, 9 aa, Homo Sapiens
TGEKPYKMW

SEQ ID NO: 494208 - protein, 9 aa, Homo Sapiens
RKYRPRVQH

SEQ ID NO: 494209 - protein, 9 aa, Homo Sapiens
GEEKAQEIF

SEQ ID NO: 494210 - protein, 9 aa, Homo Sapiens
NKVHHKTEF

SEQ ID NO: 494211 - protein, 9 aa, Homo Sapiens
VDLPLINSL

SEQ ID NO: 494212 - protein, 9 aa, Homo Sapiens
KTSHFFPSV

SEQ ID NO: 494213 - protein, 9 aa, Homo Sapiens
TTQNFIRMA

SEQ ID NO: 494214 - protein, 9 aa, Homo Sapiens
SWSLHCEGQ

SEQ ID NO: 494215 - protein, 9 aa, Homo Sapiens
DYTTQNFIR

SEQ ID NO: 494216 - protein, 9 aa, Homo Sapiens
AENSNLISG

SEQ ID NO: 494217 - protein, 9 aa, Homo Sapiens
YPQRFFKVL

SEQ ID NO: 494218 - protein, 9 aa, Homo Sapiens
DWSDDQSNN

SEQ ID NO: 494219 - protein, 9 aa, Homo Sapiens
SQARKSQKT

SEQ ID NO: 494220 - protein, 9 aa, Homo Sapiens
PVTIGIVPP

SEQ ID NO: 494221 - protein, 9 aa, Homo Sapiens
ENDEDAAQA

SEQ ID NO: 494222 - protein, 9 aa, Homo Sapiens
DRQAVVPCW

SEQ ID NO: 494223 - protein, 9 aa, Homo Sapiens
WGRTYQAWQ

SEQ ID NO: 494224 - protein, 9 aa, Homo Sapiens
CKDGWVDIM

SEQ ID NO: 494225 - protein, 9 aa, Homo Sapiens
YLTNHPGKK

SEQ ID NO: 494226 - protein, 9 aa, Homo Sapiens
SKYWQHPHS

SEQ ID NO: 494227 - protein, 9 aa, Homo Sapiens
LKGGNPHGW

SEQ ID NO: 494228 - protein, 9 aa, Homo Sapiens
TVEQKYPYM

SEQ ID NO: 494229 - protein, 9 aa, Homo Sapiens
QFISRVRGQ

SEQ ID NO: 494230 - protein, 9 aa, Homo Sapiens
DEEIHNEPE

SEQ ID NO: 494231 - protein, 9 aa, Homo Sapiens
LETTYGQTG

SEQ ID NO: 494232 - protein, 9 aa, Homo Sapiens
DQSNNPFSS

SEQ ID NO: 494233 - protein, 9 aa, Homo Sapiens
HPGKKFVFD

SEQ ID NO: 494234 - protein, 9 aa, Homo Sapiens
QYRSLTRHS

SEQ ID NO: 494235 - protein, 9 aa, Homo Sapiens
PIETKCRGL

SEQ ID NO: 494236 - protein, 9 aa, Homo Sapiens
HEISEINRM

SEQ ID NO: 494237 - protein, 9 aa, Homo Sapiens
QWMGDGEGH

SEQ ID NO: 494238 - protein, 9 aa, Homo Sapiens
LTFELLGEG

SEQ ID NO: 494239 - protein, 9 aa, Homo Sapiens
CGGGVSLSL

SEQ ID NO: 494240 - protein, 9 aa, Homo Sapiens
VTSKFVSKN

SEQ ID NO: 494241 - protein, 9 aa, Homo Sapiens
LNKVNKVIS

SEQ ID NO: 494242 - protein, 9 aa, Homo Sapiens
QAYAHLDPE

SEQ ID NO: 494243 - protein, 9 aa, Homo Sapiens
VLGEGIYAR

SEQ ID NO: 494244 - protein, 9 aa, Homo Sapiens
GVVDPVHRV

SEQ ID NO: 494245 - protein, 9 aa, Homo Sapiens
IDPSSGDIR

SEQ ID NO: 494246 - protein, 9 aa, Homo Sapiens
LHLPEALSP

SEQ ID NO: 494247 - protein, 9 aa, Homo Sapiens
PITRMRMKP

SEQ ID NO: 494248 - protein, 9 aa, Homo Sapiens
MTLDLYHSN

SEQ ID NO: 494249 - protein, 9 aa, Homo Sapiens
RKGSYAIPG

SEQ ID NO: 494250 - protein, 9 aa, Homo Sapiens
GKEPWVVGR

SEQ ID NO: 494251 - protein, 9 aa, Homo Sapiens
GSRLLNGSA

SEQ ID NO: 494252 - protein, 9 aa, Homo Sapiens
EKNTSSAMA

SEQ ID NO: 494253 - protein, 9 aa, Homo Sapiens
MPNLGSPIE

SEQ ID NO: 494254 - protein, 9 aa, Homo Sapiens
NTSSAMAGS

SEQ ID NO: 494255 - protein, 9 aa, Homo Sapiens
GTDSTITFP

SEQ ID NO: 494256 - protein, 9 aa, Homo Sapiens
NPSKTESER

SEQ ID NO: 494257 - protein, 9 aa, Homo Sapiens
SPEKLKEVI

SEQ ID NO: 494258 - protein, 9 aa, Homo Sapiens
QAPPRLLQL

SEQ ID NO: 494259 - protein, 9 aa, Homo Sapiens
LQLAGQSLL

SEQ ID NO: 494260 - protein, 9 aa, Homo Sapiens
HLAGAKGGG

SEQ ID NO: 494261 - protein, 9 aa, Homo Sapiens
RKQQLDKCL

SEQ ID NO: 494262 - protein, 9 aa, Homo Sapiens
EHNEQKEQK

SEQ ID NO: 494263 - protein, 9 aa, Homo Sapiens
GPSAFMKGT

SEQ ID NO: 494264 - protein, 9 aa, Homo Sapiens
YGILGDLGA

SEQ ID NO: 494265 - protein, 9 aa, Homo Sapiens
VSLSLRHCD

SEQ ID NO: 494266 - protein, 9 aa, Homo Sapiens
ENSLFKSKA

SEQ ID NO: 494267 - protein, 9 aa, Homo Sapiens
GDLSHSPRK

SEQ ID NO: 494268 - protein, 9 aa, Homo Sapiens
KQKKLRFDV

SEQ ID NO: 494269 - protein, 9 aa, Homo Sapiens
TPTSSVPLA

SEQ ID NO: 494270 - protein, 9 aa, Homo Sapiens
SPRRRSYSR

SEQ ID NO: 494271 - protein, 9 aa, Homo Sapiens
GQGGLAAEG

SEQ ID NO: 494272 - protein, 9 aa, Homo Sapiens
SEKLQLVTG

SEQ ID NO: 494273 - protein, 9 aa, Homo Sapiens
VVPCWVTVL

SEQ ID NO: 494274 - protein, 9 aa, Homo Sapiens
HQLIYTGEK

SEQ ID NO: 494275 - protein, 9 aa, Homo Sapiens
GISHHSSAF

SEQ ID NO: 494276 - protein, 9 aa, Homo Sapiens
MDKIRKNLG

SEQ ID NO: 494277 - protein, 9 aa, Homo Sapiens
ELISESKYW

SEQ ID NO: 494278 - protein, 9 aa, Homo Sapiens
QILAEGWAT

SEQ ID NO: 494279 - protein, 9 aa, Homo Sapiens
SMSISACSQ

SEQ ID NO: 494280 - protein, 9 aa, Homo Sapiens
SHSPRKKDR

SEQ ID NO: 494281 - protein, 9 aa, Homo Sapiens
SQYPYSECQ

SEQ ID NO: 494282 - protein, 9 aa, Homo Sapiens
PSSGDIRTL

SEQ ID NO: 494283 - protein, 9 aa, Homo Sapiens
PPRLLQLAG

SEQ ID NO: 494284 - protein, 9 aa, Homo Sapiens
VPIPKGSAF

SEQ ID NO: 494285 - protein, 9 aa, Homo Sapiens
FIPIMEDGG

SEQ ID NO: 494286 - protein, 9 aa, Homo Sapiens
AVAMPSFAG

SEQ ID NO: 494287 - protein, 9 aa, Homo Sapiens
CPVCRWRVE

SEQ ID NO: 494288 - protein, 9 aa, Homo Sapiens
AIKDLDGMD

SEQ ID NO: 494289 - protein, 9 aa, Homo Sapiens
ATGHDCSCT

SEQ ID NO: 494290 - protein, 9 aa, Homo Sapiens
EDTTLKWDS

SEQ ID NO: 494291 - protein, 9 aa, Homo Sapiens
RQAVVPCWV

SEQ ID NO: 494292 - protein, 9 aa, Homo Sapiens
LAQAQYDTP

SEQ ID NO: 494293 - protein, 9 aa, Homo Sapiens
GYVLGFKIH

SEQ ID NO: 494294 - protein, 9 aa, Homo Sapiens
TRQSLDESH

SEQ ID NO: 494295 - protein, 9 aa, Homo Sapiens
NSVKYANRA

SEQ ID NO: 494296 - protein, 9 aa, Homo Sapiens
HSDESTLEH

SEQ ID NO: 494297 - protein, 9 aa, Homo Sapiens
NDEDAAQAS

SEQ ID NO: 494298 - protein, 9 aa, Homo Sapiens
GPLDEGSEP

SEQ ID NO: 494299 - protein, 9 aa, Homo Sapiens
LSNVTLILS

SEQ ID NO: 494300 - protein, 9 aa, Homo Sapiens
RACPSTGQP

SEQ ID NO: 494301 - protein, 9 aa, Homo Sapiens
KGNKNIRAT

SEQ ID NO: 494302 - protein, 9 aa, Homo Sapiens
CQFLESQLD

SEQ ID NO: 494303 - protein, 9 aa, Homo Sapiens
TFPELIRKG

SEQ ID NO: 494304 - protein, 9 aa, Homo Sapiens
KYNLYRKDI

SEQ ID NO: 494305 - protein, 9 aa, Homo Sapiens
NCLKSEIRN

SEQ ID NO: 494306 - protein, 9 aa, Homo Sapiens
LAVVTQSAK

SEQ ID NO: 494307 - protein, 9 aa, Homo Sapiens
WRLWQSFQP

SEQ ID NO: 494308 - protein, 9 aa, Homo Sapiens
ATLRLSAEG

SEQ ID NO: 494309 - protein, 9 aa, Homo Sapiens
LELSPEKLK

SEQ ID NO: 494310 - protein, 9 aa, Homo Sapiens
WQSFQPILK

SEQ ID NO: 494311 - protein, 9 aa, Homo Sapiens
AIYFIPIME

SEQ ID NO: 494312 - protein, 9 aa, Homo Sapiens
QNFIRMAVA

SEQ ID NO: 494313 - protein, 9 aa, Homo Sapiens
ESDSHDEHP

SEQ ID NO: 494314 - protein, 9 aa, Homo Sapiens
TTRVQHALP

SEQ ID NO: 494315 - protein, 9 aa, Homo Sapiens
PKEYPYSAK

SEQ ID NO: 494316 - protein, 9 aa, Homo Sapiens
LQGSQLRQL

SEQ ID NO: 494317 - protein, 9 aa, Homo Sapiens
QNSATESAH

SEQ ID NO: 494318 - protein, 9 aa, Homo Sapiens
EDTPEVPGL

SEQ ID NO: 494319 - protein, 9 aa, Homo Sapiens
AQTMMKLIH

SEQ ID NO: 494320 - protein, 9 aa, Homo Sapiens
ANMGFSAWI

SEQ ID NO: 494321 - protein, 9 aa, Homo Sapiens
FKIHPVEKL

SEQ ID NO: 494322 - protein, 9 aa, Homo Sapiens
SICKLAWQP

SEQ ID NO: 494323 - protein, 9 aa, Homo Sapiens
GEYECVATN

SEQ ID NO: 494324 - protein, 9 aa, Homo Sapiens
KTGNGKHVP

SEQ ID NO: 494325 - protein, 9 aa, Homo Sapiens
KIFPLKMAL

SEQ ID NO: 494326 - protein, 9 aa, Homo Sapiens
KTLKCLSLV

SEQ ID NO: 494327 - protein, 9 aa, Homo Sapiens
PYKMWRLWQ

SEQ ID NO: 494328 - protein, 9 aa, Homo Sapiens
GYKSLKKNE

SEQ ID NO: 494329 - protein, 9 aa, Homo Sapiens
CKHEFQRQE

SEQ ID NO: 494330 - protein, 9 aa, Homo Sapiens
HSGAATGFL

SEQ ID NO: 494331 - protein, 9 aa, Homo Sapiens
GSQLRQLQQ

SEQ ID NO: 494332 - protein, 9 aa, Homo Sapiens
QGEVFIGSK

SEQ ID NO: 494333 - protein, 9 aa, Homo Sapiens
TAPKIAVMS

SEQ ID NO: 494334 - protein, 9 aa, Homo Sapiens
LSLPGSLKW

SEQ ID NO: 494335 - protein, 9 aa, Homo Sapiens
LEGESVLEL

SEQ ID NO: 494336 - protein, 9 aa, Homo Sapiens
TLPNNTEEN

SEQ ID NO: 494337 - protein, 9 aa, Homo Sapiens
LHILQVAFR

SEQ ID NO: 494338 - protein, 9 aa, Homo Sapiens
RECQLEVFL

SEQ ID NO: 494339 - protein, 9 aa, Homo Sapiens
NESHVLGTR

SEQ ID NO: 494340 - protein, 9 aa, Homo Sapiens
AGPKGSRRP

SEQ ID NO: 494341 - protein, 9 aa, Homo Sapiens
SLYENQTPL

SEQ ID NO: 494342 - protein, 9 aa, Homo Sapiens
HDEHPFPGD

SEQ ID NO: 494343 - protein, 9 aa, Homo Sapiens
IASPFVHPA

SEQ ID NO: 494344 - protein, 9 aa, Homo Sapiens
QHESRSCRD

SEQ ID NO: 494345 - protein, 9 aa, Homo Sapiens
AETRGTGEE

SEQ ID NO: 494346 - protein, 9 aa, Homo Sapiens
FLELSPEKL

SEQ ID NO: 494347 - protein, 9 aa, Homo Sapiens
ISGDLHILQ

SEQ ID NO: 494348 - protein, 9 aa, Homo Sapiens
PKGSRRPEV

SEQ ID NO: 494349 - protein, 9 aa, Homo Sapiens
APPRLLQLA

SEQ ID NO: 494350 - protein, 9 aa, Homo Sapiens
LCAFNSSVQ

SEQ ID NO: 494351 - protein, 9 aa, Homo Sapiens
GVKAVTKRK

SEQ ID NO: 494352 - protein, 9 aa, Homo Sapiens
RTGITEDIT

SEQ ID NO: 494353 - protein, 9 aa, Homo Sapiens
GWGRTYQAW

SEQ ID NO: 494354 - protein, 9 aa, Homo Sapiens
EGKEKLSLE

SEQ ID NO: 494355 - protein, 9 aa, Homo Sapiens
LTQGWGRTY

SEQ ID NO: 494356 - protein, 9 aa, Homo Sapiens
NYINENMEH

SEQ ID NO: 494357 - protein, 9 aa, Homo Sapiens
KKDHTLGNI

SEQ ID NO: 494358 - protein, 9 aa, Homo Sapiens
KEKVVPIPK

SEQ ID NO: 494359 - protein, 9 aa, Homo Sapiens
RGKRDKKRS

SEQ ID NO: 494360 - protein, 9 aa, Homo Sapiens
GMCYPLRSC

SEQ ID NO: 494361 - protein, 9 aa, Homo Sapiens
QSDLAGPKG

SEQ ID NO: 494362 - protein, 9 aa, Homo Sapiens
CFLPIETKC

SEQ ID NO: 494363 - protein, 9 aa, Homo Sapiens
SSPCQLSPL

SEQ ID NO: 494364 - protein, 9 aa, Homo Sapiens
DSSRQSRSG

SEQ ID NO: 494365 - protein, 9 aa, Homo Sapiens
GKEEEKKVD

SEQ ID NO: 494366 - protein, 9 aa, Homo Sapiens
ALPAGTYAH

SEQ ID NO: 494367 - protein, 9 aa, Homo Sapiens
RRRSYSRQT

SEQ ID NO: 494368 - protein, 9 aa, Homo Sapiens
HLSCDIKEE

SEQ ID NO: 494369 - protein, 9 aa, Homo Sapiens
VFTVADKDG

SEQ ID NO: 494370 - protein, 9 aa, Homo Sapiens
CSVLSPVVG

SEQ ID NO: 494371 - protein, 9 aa, Homo Sapiens
LTRHSSDFD

SEQ ID NO: 494372 - protein, 9 aa, Homo Sapiens
AYYSRDSLG

SEQ ID NO: 494373 - protein, 9 aa, Homo Sapiens
QKPYKCNEC

SEQ ID NO: 494374 - protein, 9 aa, Homo Sapiens
EEPPKASPK

SEQ ID NO: 494375 - protein, 9 aa, Homo Sapiens
QCHWTLPNN

SEQ ID NO: 494376 - protein, 9 aa, Homo Sapiens
MKLIHPKLV

SEQ ID NO: 494377 - protein, 9 aa, Homo Sapiens
IIIAFLYPY

SEQ ID NO: 494378 - protein, 9 aa, Homo Sapiens
PYRRNEDKT

SEQ ID NO: 494379 - protein, 9 aa, Homo Sapiens
GFVKIAFTH

SEQ ID NO: 494380 - protein, 9 aa, Homo Sapiens
DGFPVGPTV

SEQ ID NO: 494381 - protein, 9 aa, Homo Sapiens
YILEKKHSG

SEQ ID NO: 494382 - protein, 9 aa, Homo Sapiens
ERYLSLPGS

SEQ ID NO: 494383 - protein, 9 aa, Homo Sapiens
NPPTLASES

SEQ ID NO: 494384 - protein, 9 aa, Homo Sapiens
RSHEEDDNH

SEQ ID NO: 494385 - protein, 9 aa, Homo Sapiens
GLHSDESTL

SEQ ID NO: 494386 - protein, 9 aa, Homo Sapiens
LKPPHPGSS

SEQ ID NO: 494387 - protein, 9 aa, Homo Sapiens
LMGHLSCDI

SEQ ID NO: 494388 - protein, 9 aa, Homo Sapiens
QDYTTQNFI

SEQ ID NO: 494389 - protein, 9 aa, Homo Sapiens
SCTDNPLLH

SEQ ID NO: 494390 - protein, 9 aa, Homo Sapiens
SSACKAMVG

SEQ ID NO: 494391 - protein, 9 aa, Homo Sapiens
PNVLGEGIY

SEQ ID NO: 494392 - protein, 9 aa, Homo Sapiens
CWCVDKYEN

SEQ ID NO: 494393 - protein, 9 aa, Homo Sapiens
MCYPLRSCA

SEQ ID NO: 494394 - protein, 9 aa, Homo Sapiens
AEGTVTFED

SEQ ID NO: 494395 - protein, 9 aa, Homo Sapiens
LEIKSATDR

SEQ ID NO: 494396 - protein, 9 aa, Homo Sapiens
AAIKRLLGS

SEQ ID NO: 494397 - protein, 9 aa, Homo Sapiens
PSVKHGDKW

SEQ ID NO: 494398 - protein, 9 aa, Homo Sapiens
LVLVNDAPR

SEQ ID NO: 494399 - protein, 9 aa, Homo Sapiens
PQNTIDLRV

SEQ ID NO: 494400 - protein, 9 aa, Homo Sapiens
VEELGLATL

SEQ ID NO: 494401 - protein, 9 aa, Homo Sapiens
DLFPMSPSV

SEQ ID NO: 494402 - protein, 9 aa, Homo Sapiens
LEVLYMLTK

SEQ ID NO: 494403 - protein, 9 aa, Homo Sapiens
ETKLTEKMY

SEQ ID NO: 494404 - protein, 9 aa, Homo Sapiens
EVNCLKSEI

SEQ ID NO: 494405 - protein, 9 aa, Homo Sapiens
GFHFLAGVP

SEQ ID NO: 494406 - protein, 9 aa, Homo Sapiens
GPLGQSVAP

SEQ ID NO: 494407 - protein, 9 aa, Homo Sapiens
ERAQSKLES

SEQ ID NO: 494408 - protein, 9 aa, Homo Sapiens
SKNGNGLNN

SEQ ID NO: 494409 - protein, 9 aa, Homo Sapiens
LLETVFSQV

SEQ ID NO: 494410 - protein, 9 aa, Homo Sapiens
GIVDMLTYV

SEQ ID NO: 494411 - protein, 9 aa, Homo Sapiens
AHKYLRLWR

SEQ ID NO: 494412 - protein, 9 aa, Homo Sapiens
ERDAIYEEE

SEQ ID NO: 494413 - protein, 9 aa, Homo Sapiens
SELDMMVPL

SEQ ID NO: 494414 - protein, 9 aa, Homo Sapiens
ATHNIEMEA

SEQ ID NO: 494415 - protein, 9 aa, Homo Sapiens
RGHKHITVF

SEQ ID NO: 494416 - protein, 9 aa, Homo Sapiens
TYLTNHPGK

SEQ ID NO: 494417 - protein, 9 aa, Homo Sapiens
RKDIKERAL

SEQ ID NO: 494418 - protein, 9 aa, Homo Sapiens
LDALANAVC

SEQ ID NO: 494419 - protein, 9 aa, Homo Sapiens
AGAKGGGQG

SEQ ID NO: 494420 - protein, 9 aa, Homo Sapiens
KLFENIRKG

SEQ ID NO: 494421 - protein, 9 aa, Homo Sapiens
IPDLLVGNG

SEQ ID NO: 494422 - protein, 9 aa, Homo Sapiens
VLTVEQKYP

SEQ ID NO: 494423 - protein, 9 aa, Homo Sapiens
SLFKSKARY

SEQ ID NO: 494424 - protein, 9 aa, Homo Sapiens
NLAGKPVIC

SEQ ID NO: 494425 - protein, 9 aa, Homo Sapiens
YYKWDKFAY

SEQ ID NO: 494426 - protein, 9 aa, Homo Sapiens
HFLEIKSAT

SEQ ID NO: 494427 - protein, 9 aa, Homo Sapiens
ESVLELGAG

SEQ ID NO: 494428 - protein, 9 aa, Homo Sapiens
SFAGPPFGA

SEQ ID NO: 494429 - protein, 9 aa, Homo Sapiens
SMMPSSACK

SEQ ID NO: 494430 - protein, 9 aa, Homo Sapiens
QHRSRAQRC

SEQ ID NO: 494431 - protein, 9 aa, Homo Sapiens
DHEPPLSPL

SEQ ID NO: 494432 - protein, 9 aa, Homo Sapiens
SGGGPLSDF

SEQ ID NO: 494433 - protein, 9 aa, Homo Sapiens
ESQKTAAEG

SEQ ID NO: 494434 - protein, 9 aa, Homo Sapiens
EVGEKIEMT

SEQ ID NO: 494435 - protein, 9 aa, Homo Sapiens
SSCSVLSPV

SEQ ID NO: 494436 - protein, 9 aa, Homo Sapiens
LLSQARKSQ

SEQ ID NO: 494437 - protein, 9 aa, Homo Sapiens
ESDTVIWNK

SEQ ID NO: 494438 - protein, 9 aa, Homo Sapiens
RAQSKLESC

SEQ ID NO: 494439 - protein, 9 aa, Homo Sapiens
VQQAPIDMS

SEQ ID NO: 494440 - protein, 9 aa, Homo Sapiens
LESASRPRK

SEQ ID NO: 494441 - protein, 9 aa, Homo Sapiens
LISNKELEK

SEQ ID NO: 494442 - protein, 9 aa, Homo Sapiens
LGDNCLSKN

SEQ ID NO: 494443 - protein, 9 aa, Homo Sapiens
RWRVEHVQH

SEQ ID NO: 494444 - protein, 9 aa, Homo Sapiens
QVLTREEWL

SEQ ID NO: 494445 - protein, 9 aa, Homo Sapiens
FEIDPSSGD

SEQ ID NO: 494446 - protein, 9 aa, Homo Sapiens
CRLKTYISN

SEQ ID NO: 494447 - protein, 9 aa, Homo Sapiens
TEELTQRLL

SEQ ID NO: 494448 - protein, 9 aa, Homo Sapiens
FRRPEPSKP

SEQ ID NO: 494449 - protein, 9 aa, Homo Sapiens
NHLAQGARA

SEQ ID NO: 494450 - protein, 9 aa, Homo Sapiens
AIRHCPSKC

SEQ ID NO: 494451 - protein, 9 aa, Homo Sapiens
FNSVDQHKN

SEQ ID NO: 494452 - protein, 9 aa, Homo Sapiens
LVEEGEPPG

SEQ ID NO: 494453 - protein, 9 aa, Homo Sapiens
SDEEIHNEP

SEQ ID NO: 494454 - protein, 9 aa, Homo Sapiens
ELTQRLLPP

SEQ ID NO: 494455 - protein, 9 aa, Homo Sapiens
GFRIEIKSK

SEQ ID NO: 494456 - protein, 9 aa, Homo Sapiens
CLSKNYEET

SEQ ID NO: 494457 - protein, 9 aa, Homo Sapiens
VAGYKSLKK

SEQ ID NO: 494458 - protein, 9 aa, Homo Sapiens
APLGISEKS

SEQ ID NO: 494459 - protein, 9 aa, Homo Sapiens
VPWKTHSEA

SEQ ID NO: 494460 - protein, 9 aa, Homo Sapiens
GRIPGIYGI

SEQ ID NO: 494461 - protein, 9 aa, Homo Sapiens
FTTFFSKTG

SEQ ID NO: 494462 - protein, 9 aa, Homo Sapiens
QGLVMFQDV

SEQ ID NO: 494463 - protein, 9 aa, Homo Sapiens
LNNTPRFKR

SEQ ID NO: 494464 - protein, 9 aa, Homo Sapiens
RKLSSKTRA

SEQ ID NO: 494465 - protein, 9 aa, Homo Sapiens
NLLNVSKPL

SEQ ID NO: 494466 - protein, 9 aa, Homo Sapiens
TRSLNGLVK

SEQ ID NO: 494467 - protein, 9 aa, Homo Sapiens
NGIIPLESA

SEQ ID NO: 494468 - protein, 9 aa, Homo Sapiens
HLENYSPAS

SEQ ID NO: 494469 - protein, 9 aa, Homo Sapiens
AIAHLQKVG

SEQ ID NO: 494470 - protein, 9 aa, Homo Sapiens
ERLDMVAGC

SEQ ID NO: 494471 - protein, 9 aa, Homo Sapiens
EQPQGGGAG

SEQ ID NO: 494472 - protein, 9 aa, Homo Sapiens
PGNGFAHPF

SEQ ID NO: 494473 - protein, 9 aa, Homo Sapiens
SFIRTMSLI

SEQ ID NO: 494474 - protein, 9 aa, Homo Sapiens
FELSLRVWM

SEQ ID NO: 494475 - protein, 9 aa, Homo Sapiens
QELGPEPEV

SEQ ID NO: 494476 - protein, 9 aa, Homo Sapiens
NSNASSVCS

SEQ ID NO: 494477 - protein, 9 aa, Homo Sapiens
LAGKPVICA

SEQ ID NO: 494478 - protein, 9 aa, Homo Sapiens
CQPTVPYHT

SEQ ID NO: 494479 - protein, 9 aa, Homo Sapiens
PPKASPKSE

SEQ ID NO: 494480 - protein, 9 aa, Homo Sapiens
ITSIKEMTQ

SEQ ID NO: 494481 - protein, 9 aa, Homo Sapiens
DFYSGSPTS

SEQ ID NO: 494482 - protein, 9 aa, Homo Sapiens
AVELTAAET

SEQ ID NO: 494483 - protein, 9 aa, Homo Sapiens
GVFTVADKD

SEQ ID NO: 494484 - protein, 9 aa, Homo Sapiens
RHGKIKLSP

SEQ ID NO: 494485 - protein, 9 aa, Homo Sapiens
VKAVTKRKR

SEQ ID NO: 494486 - protein, 9 aa, Homo Sapiens
TKLTEKMYS

SEQ ID NO: 494487 - protein, 9 aa, Homo Sapiens
QKNWDVFYK

SEQ ID NO: 494488 - protein, 9 aa, Homo Sapiens
TVAKLVFQR

SEQ ID NO: 494489 - protein, 9 aa, Homo Sapiens
GIQGRWIKQ

SEQ ID NO: 494490 - protein, 9 aa, Homo Sapiens
DLDCSLASV

SEQ ID NO: 494491 - protein, 9 aa, Homo Sapiens
AMYVAAAMH

SEQ ID NO: 494492 - protein, 9 aa, Homo Sapiens
LASEEHVNT

SEQ ID NO: 494493 - protein, 9 aa, Homo Sapiens
KPRQKKALE

SEQ ID NO: 494494 - protein, 9 aa, Homo Sapiens
ESPATHSLN

SEQ ID NO: 494495 - protein, 9 aa, Homo Sapiens
DNHDDDVST

SEQ ID NO: 494496 - protein, 9 aa, Homo Sapiens
KREIYCHYC

SEQ ID NO: 494497 - protein, 9 aa, Homo Sapiens
AGNVPSERP

SEQ ID NO: 494498 - protein, 9 aa, Homo Sapiens
YVLGFKIHP

SEQ ID NO: 494499 - protein, 9 aa, Homo Sapiens
MSSEKSELP

SEQ ID NO: 494500 - protein, 9 aa, Homo Sapiens
ISSGTDSTI

SEQ ID NO: 494501 - protein, 9 aa, Homo Sapiens
YRSLTRHSS

SEQ ID NO: 494502 - protein, 9 aa, Homo Sapiens
GDPGPPGLC

SEQ ID NO: 494503 - protein, 9 aa, Homo Sapiens
MTSAAHLEN

SEQ ID NO: 494504 - protein, 9 aa, Homo Sapiens
RIPGVQARN

SEQ ID NO: 494505 - protein, 9 aa, Homo Sapiens
LAQGARAVL

SEQ ID NO: 494506 - protein, 9 aa, Homo Sapiens
LIESNDTIL

SEQ ID NO: 494507 - protein, 9 aa, Homo Sapiens
PEALSPTLT

SEQ ID NO: 494508 - protein, 9 aa, Homo Sapiens
VDPVLTVEQ

SEQ ID NO: 494509 - protein, 9 aa, Homo Sapiens
FSNFLLTKL

SEQ ID NO: 494510 - protein, 9 aa, Homo Sapiens
TAMTLDLYH

SEQ ID NO: 494511 - protein, 9 aa, Homo Sapiens
KTKAKLVGL

SEQ ID NO: 494512 - protein, 9 aa, Homo Sapiens
YPSESSVLQ

SEQ ID NO: 494513 - protein, 9 aa, Homo Sapiens
MEHNEQKEQ

SEQ ID NO: 494514 - protein, 9 aa, Homo Sapiens
QSFQPILKS

SEQ ID NO: 494515 - protein, 9 aa, Homo Sapiens
EDAAQASPE

SEQ ID NO: 494516 - protein, 9 aa, Homo Sapiens
KVSDMKFQA

SEQ ID NO: 494517 - protein, 9 aa, Homo Sapiens
GHVLPSTHT

SEQ ID NO: 494518 - protein, 9 aa, Homo Sapiens
NLAPWHPMK

SEQ ID NO: 494519 - protein, 9 aa, Homo Sapiens
KRSILICSR

SEQ ID NO: 494520 - protein, 9 aa, Homo Sapiens
RAANSETVA

SEQ ID NO: 494521 - protein, 9 aa, Homo Sapiens
LFPMSPSVY

SEQ ID NO: 494522 - protein, 9 aa, Homo Sapiens
CGFHEVNGP

SEQ ID NO: 494523 - protein, 9 aa, Homo Sapiens
VAEKNGTIW

SEQ ID NO: 494524 - protein, 9 aa, Homo Sapiens
LPREVVVTV

SEQ ID NO: 494525 - protein, 9 aa, Homo Sapiens
GRNIGDLFL

SEQ ID NO: 494526 - protein, 9 aa, Homo Sapiens
TERKQQLDK

SEQ ID NO: 494527 - protein, 9 aa, Homo Sapiens
DSLTQCSYP

SEQ ID NO: 494528 - protein, 9 aa, Homo Sapiens
EQRTQTNVI

SEQ ID NO: 494529 - protein, 9 aa, Homo Sapiens
YKRSAVQQA

SEQ ID NO: 494530 - protein, 9 aa, Homo Sapiens
EDPMPCACG

SEQ ID NO: 494531 - protein, 9 aa, Homo Sapiens
NSKLPKHFR

SEQ ID NO: 494532 - protein, 9 aa, Homo Sapiens
GSCSTFHSS

SEQ ID NO: 494533 - protein, 9 aa, Homo Sapiens
DIAAQEDLD

SEQ ID NO: 494534 - protein, 9 aa, Homo Sapiens
TKCRGLQES

SEQ ID NO: 494535 - protein, 9 aa, Homo Sapiens
YQLHKDGVV

SEQ ID NO: 494536 - protein, 9 aa, Homo Sapiens
GIYGILGDL

SEQ ID NO: 494537 - protein, 9 aa, Homo Sapiens
SNPSKTESE

SEQ ID NO: 494538 - protein, 9 aa, Homo Sapiens
ADKDGKADP

SEQ ID NO: 494539 - protein, 9 aa, Homo Sapiens
GNGFAHPFS

SEQ ID NO: 494540 - protein, 9 aa, Homo Sapiens
FFCRISSWR

SEQ ID NO: 494541 - protein, 9 aa, Homo Sapiens
SKQEIAEIL

SEQ ID NO: 494542 - protein, 9 aa, Homo Sapiens
AAHLENYSP

SEQ ID NO: 494543 - protein, 9 aa, Homo Sapiens
SKFVSKNGP

SEQ ID NO: 494544 - protein, 9 aa, Homo Sapiens
MVRSQASAN

SEQ ID NO: 494545 - protein, 9 aa, Homo Sapiens
VPDGFPVGP

SEQ ID NO: 494546 - protein, 9 aa, Homo Sapiens
LPEALSPTL

SEQ ID NO: 494547 - protein, 9 aa, Homo Sapiens
GSPGEQPQG

SEQ ID NO: 494548 - protein, 9 aa, Homo Sapiens
SSREKRERC

SEQ ID NO: 494549 - protein, 9 aa, Homo Sapiens
SPATHSLNF

SEQ ID NO: 494550 - protein, 9 aa, Homo Sapiens
RVQHALPAG

SEQ ID NO: 494551 - protein, 9 aa, Homo Sapiens
QHKNSYYPR

SEQ ID NO: 494552 - protein, 9 aa, Homo Sapiens
NFELSLRVW

SEQ ID NO: 494553 - protein, 9 aa, Homo Sapiens
DLPSNDFQM

SEQ ID NO: 494554 - protein, 9 aa, Homo Sapiens
YALLGLRKL

SEQ ID NO: 494555 - protein, 9 aa, Homo Sapiens
NGSADGSEC

SEQ ID NO: 494556 - protein, 9 aa, Homo Sapiens
ADKEVINSL

SEQ ID NO: 494557 - protein, 9 aa, Homo Sapiens
PSAFMKGTG

SEQ ID NO: 494558 - protein, 9 aa, Homo Sapiens
ENSKLPKHF

SEQ ID NO: 494559 - protein, 9 aa, Homo Sapiens
EGEDKEEAM

SEQ ID NO: 494560 - protein, 9 aa, Homo Sapiens
ETTYGQTGD

SEQ ID NO: 494561 - protein, 9 aa, Homo Sapiens
LKNAIMFGN

SEQ ID NO: 494562 - protein, 9 aa, Homo Sapiens
AAAYYSRDS

SEQ ID NO: 494563 - protein, 9 aa, Homo Sapiens
QSTTELLFA

SEQ ID NO: 494564 - protein, 9 aa, Homo Sapiens
TLASESARI

SEQ ID NO: 494565 - protein, 9 aa, Homo Sapiens
GPSRGRACP

SEQ ID NO: 494566 - protein, 9 aa, Homo Sapiens
SKNYEETAA

SEQ ID NO: 494567 - protein, 9 aa, Homo Sapiens
WSCGAPGQD

SEQ ID NO: 494568 - protein, 9 aa, Homo Sapiens
LLKLRWELE

SEQ ID NO: 494569 - protein, 9 aa, Homo Sapiens
LFSKKHHPH

SEQ ID NO: 494570 - protein, 9 aa, Homo Sapiens
PGDLNTPAL

SEQ ID NO: 494571 - protein, 9 aa, Homo Sapiens
KMWRLWQSF

SEQ ID NO: 494572 - protein, 9 aa, Homo Sapiens
LSPTLTLSP

SEQ ID NO: 494573 - protein, 9 aa, Homo Sapiens
TRQKLVEEG

SEQ ID NO: 494574 - protein, 9 aa, Homo Sapiens
EEDDLDCSL

SEQ ID NO: 494575 - protein, 9 aa, Homo Sapiens
APKREIYCH

SEQ ID NO: 494576 - protein, 9 aa, Homo Sapiens
QSDTECTLA

SEQ ID NO: 494577 - protein, 9 aa, Homo Sapiens
AMVRSQASA

SEQ ID NO: 494578 - protein, 9 aa, Homo Sapiens
GITEDITYQ

SEQ ID NO: 494579 - protein, 9 aa, Homo Sapiens
TDELGLLLS

SEQ ID NO: 494580 - protein, 9 aa, Homo Sapiens
FELLGEGAY

SEQ ID NO: 494581 - protein, 9 aa, Homo Sapiens
KVDMQWVQI

SEQ ID NO: 494582 - protein, 9 aa, Homo Sapiens
LQLNGNVQL

SEQ ID NO: 494583 - protein, 9 aa, Homo Sapiens
NSNLISGFD

SEQ ID NO: 494584 - protein, 9 aa, Homo Sapiens
VRECQLEVF

SEQ ID NO: 494585 - protein, 9 aa, Homo Sapiens
RAHGEELDE

SEQ ID NO: 494586 - protein, 9 aa, Homo Sapiens
EGANMGFSA

SEQ ID NO: 494587 - protein, 9 aa, Homo Sapiens
QARNLFAQI

SEQ ID NO: 494588 - protein, 9 aa, Homo Sapiens
FYICGLLYI

SEQ ID NO: 494589 - protein, 9 aa, Homo Sapiens
RQCKSLLPR

SEQ ID NO: 494590 - protein, 9 aa, Homo Sapiens
DPSEKLQLV

SEQ ID NO: 494591 - protein, 9 aa, Homo Sapiens
GRSFIRTMS

SEQ ID NO: 494592 - protein, 9 aa, Homo Sapiens
QCKSLLPRA

SEQ ID NO: 494593 - protein, 9 aa, Homo Sapiens
HSPPPELPD

SEQ ID NO: 494594 - protein, 9 aa, Homo Sapiens
QKYPYMVEW

SEQ ID NO: 494595 - protein, 9 aa, Homo Sapiens
SKEVNCLKS

SEQ ID NO: 494596 - protein, 9 aa, Homo Sapiens
AVVKICITR

SEQ ID NO: 494597 - protein, 9 aa, Homo Sapiens
PNWHESAKG

SEQ ID NO: 494598 - protein, 9 aa, Homo Sapiens
SEQHLKTLK

SEQ ID NO: 494599 - protein, 9 aa, Homo Sapiens
TMSCQGRGR

SEQ ID NO: 494600 - protein, 9 aa, Homo Sapiens
DNCEVKEPR

SEQ ID NO: 494601 - protein, 9 aa, Homo Sapiens
LQGLVMFQD

SEQ ID NO: 494602 - protein, 9 aa, Homo Sapiens
PKGYQLIGS

SEQ ID NO: 494603 - protein, 9 aa, Homo Sapiens
MAANIFEGI

SEQ ID NO: 494604 - protein, 9 aa, Homo Sapiens
EECITAGHF

SEQ ID NO: 494605 - protein, 9 aa, Homo Sapiens
NGLVKNIPQ

SEQ ID NO: 494606 - protein, 9 aa, Homo Sapiens
LSELDMMVP

SEQ ID NO: 494607 - protein, 9 aa, Homo Sapiens
EKRERCRSP

SEQ ID NO: 494608 - protein, 9 aa, Homo Sapiens
FTLLLAAAA

SEQ ID NO: 494609 - protein, 9 aa, Homo Sapiens
RETLQNPKY

SEQ ID NO: 494610 - protein, 9 aa, Homo Sapiens
HFRRPEPSK

SEQ ID NO: 494611 - protein, 9 aa, Homo Sapiens
LQVAFRGDS

SEQ ID NO: 494612 - protein, 9 aa, Homo Sapiens
TRERAHGEE

SEQ ID NO: 494613 - protein, 9 aa, Homo Sapiens
VKYANRARN

SEQ ID NO: 494614 - protein, 9 aa, Homo Sapiens
IETKCRGLQ

SEQ ID NO: 494615 - protein, 9 aa, Homo Sapiens
NSELSNPSK

SEQ ID NO: 494616 - protein, 9 aa, Homo Sapiens
YRELFEENG

SEQ ID NO: 494617 - protein, 9 aa, Homo Sapiens
KIRKNLGMC

SEQ ID NO: 494618 - protein, 9 aa, Homo Sapiens
SDLFPMSPS

SEQ ID NO: 494619 - protein, 9 aa, Homo Sapiens
PPLSLPPAC

SEQ ID NO: 494620 - protein, 9 aa, Homo Sapiens
GQCSVDRSL

SEQ ID NO: 494621 - protein, 9 aa, Homo Sapiens
ADVHTFGHC

SEQ ID NO: 494622 - protein, 9 aa, Homo Sapiens
WHHPLNWLM

SEQ ID NO: 494623 - protein, 9 aa, Homo Sapiens
FDESLNSVK

SEQ ID NO: 494624 - protein, 9 aa, Homo Sapiens
HKYLRLWRK

SEQ ID NO: 494625 - protein, 9 aa, Homo Sapiens
PNNTEENTE

SEQ ID NO: 494626 - protein, 9 aa, Homo Sapiens
TTKLASEEH

SEQ ID NO: 494627 - protein, 9 aa, Homo Sapiens
VQEDSEEEE

SEQ ID NO: 494628 - protein, 9 aa, Homo Sapiens
FIRMAVAGL

SEQ ID NO: 494629 - protein, 9 aa, Homo Sapiens
FLSTRERAH

SEQ ID NO: 494630 - protein, 9 aa, Homo Sapiens
YLSLPGSLK

SEQ ID NO: 494631 - protein, 9 aa, Homo Sapiens
ATESAPGPL

SEQ ID NO: 494632 - protein, 9 aa, Homo Sapiens
EHNSINELK

SEQ ID NO: 494633 - protein, 9 aa, Homo Sapiens
SGFPVRHGK

SEQ ID NO: 494634 - protein, 9 aa, Homo Sapiens
QLLENQKNC

SEQ ID NO: 494635 - protein, 9 aa, Homo Sapiens
VNQCSSSKN

SEQ ID NO: 494636 - protein, 9 aa, Homo Sapiens
EYNEEKNKE

SEQ ID NO: 494637 - protein, 9 aa, Homo Sapiens
HFFPSVVRK

SEQ ID NO: 494638 - protein, 9 aa, Homo Sapiens
LTSTTSAVP

SEQ ID NO: 494639 - protein, 9 aa, Homo Sapiens
RAQLELPAI

SEQ ID NO: 494640 - protein, 9 aa, Homo Sapiens
ACKAMVGHE

SEQ ID NO: 494641 - protein, 9 aa, Homo Sapiens
FQSSDYRSN

SEQ ID NO: 494642 - protein, 9 aa, Homo Sapiens
SSVLQELGP

SEQ ID NO: 494643 - protein, 9 aa, Homo Sapiens
RQKLEREEE

SEQ ID NO: 494644 - protein, 9 aa, Homo Sapiens
PLSLPPACS

SEQ ID NO: 494645 - protein, 9 aa, Homo Sapiens
PLESASRPR

SEQ ID NO: 494646 - protein, 9 aa, Homo Sapiens
CTMREGEIP

SEQ ID NO: 494647 - protein, 9 aa, Homo Sapiens
EKAQEIFNK

SEQ ID NO: 494648 - protein, 9 aa, Homo Sapiens
NMGFSAWIG

SEQ ID NO: 494649 - protein, 9 aa, Homo Sapiens
QVALFQLSN

SEQ ID NO: 494650 - protein, 9 aa, Homo Sapiens
MSISACSQS

SEQ ID NO: 494651 - protein, 9 aa, Homo Sapiens
PACSESEVL

SEQ ID NO: 494652 - protein, 9 aa, Homo Sapiens
FSADKEVIN

SEQ ID NO: 494653 - protein, 9 aa, Homo Sapiens
QAGNVPSER

SEQ ID NO: 494654 - protein, 9 aa, Homo Sapiens
TLAVDLWSL

SEQ ID NO: 494655 - protein, 9 aa, Homo Sapiens
MCYLHAKGV

SEQ ID NO: 494656 - protein, 9 aa, Homo Sapiens
GTEGLCGPP

SEQ ID NO: 494657 - protein, 9 aa, Homo Sapiens
QLIGSSSAT

SEQ ID NO: 494658 - protein, 9 aa, Homo Sapiens
SVDQHKNSY

SEQ ID NO: 494659 - protein, 9 aa, Homo Sapiens
PVVGKGEEQ

SEQ ID NO: 494660 - protein, 9 aa, Homo Sapiens
YCPYGSFVK

SEQ ID NO: 494661 - protein, 9 aa, Homo Sapiens
SLKPPHPGS

SEQ ID NO: 494662 - protein, 9 aa, Homo Sapiens
ISYLRIFIA

SEQ ID NO: 494663 - protein, 9 aa, Homo Sapiens
NNAKQKKLR

SEQ ID NO: 494664 - protein, 9 aa, Homo Sapiens
GPWCYTTHP

SEQ ID NO: 494665 - protein, 9 aa, Homo Sapiens
NHPGKKFVF

SEQ ID NO: 494666 - protein, 9 aa, Homo Sapiens
NFSADKEVI

SEQ ID NO: 494667 - protein, 9 aa, Homo Sapiens
KELEKYKEK

SEQ ID NO: 494668 - protein, 9 aa, Homo Sapiens
FVCALVVCF

SEQ ID NO: 494669 - protein, 9 aa, Homo Sapiens
FGSGFPVRH

SEQ ID NO: 494670 - protein, 9 aa, Homo Sapiens
ELFVAGIGP

SEQ ID NO: 494671 - protein, 9 aa, Homo Sapiens
EPRHGNLYD

SEQ ID NO: 494672 - protein, 9 aa, Homo Sapiens
STHKQSESA

SEQ ID NO: 494673 - protein, 9 aa, Homo Sapiens
YENQTPLWV

SEQ ID NO: 494674 - protein, 9 aa, Homo Sapiens
VALFQLSNV

SEQ ID NO: 494675 - protein, 9 aa, Homo Sapiens
GLMSMLTST

SEQ ID NO: 494676 - protein, 9 aa, Homo Sapiens
NARHGPVWK

SEQ ID NO: 494677 - protein, 9 aa, Homo Sapiens
EEQAARQRK

SEQ ID NO: 494678 - protein, 9 aa, Homo Sapiens
VFSVFSVCA

SEQ ID NO: 494679 - protein, 9 aa, Homo Sapiens
VPLAAVTPL

SEQ ID NO: 494680 - protein, 9 aa, Homo Sapiens
FKTRSKQEI

SEQ ID NO: 494681 - protein, 9 aa, Homo Sapiens
ISNKELEKY

SEQ ID NO: 494682 - protein, 9 aa, Homo Sapiens
RQKKALEFP

SEQ ID NO: 494683 - protein, 9 aa, Homo Sapiens
PQPWTQVDD

SEQ ID NO: 494684 - protein, 9 aa, Homo Sapiens
GWRETPGPT

SEQ ID NO: 494685 - protein, 9 aa, Homo Sapiens
RARILAPVL

SEQ ID NO: 494686 - protein, 9 aa, Homo Sapiens
PRLLQLAGQ

SEQ ID NO: 494687 - protein, 9 aa, Homo Sapiens
STFHSSLSS

SEQ ID NO: 494688 - protein, 9 aa, Homo Sapiens
WQHPHSFKY

SEQ ID NO: 494689 - protein, 9 aa, Homo Sapiens
FQTHIRIHR

SEQ ID NO: 494690 - protein, 9 aa, Homo Sapiens
SLAPLGISE

SEQ ID NO: 494691 - protein, 9 aa, Homo Sapiens
DSQAKVASL

SEQ ID NO: 494692 - protein, 9 aa, Homo Sapiens
PEEDIVGLH

SEQ ID NO: 494693 - protein, 9 aa, Homo Sapiens
PSATNMLSH

SEQ ID NO: 494694 - protein, 9 aa, Homo Sapiens
LLLLLLWAL

SEQ ID NO: 494695 - protein, 9 aa, Homo Sapiens
AKGGGQGGD

SEQ ID NO: 494696 - protein, 9 aa, Homo Sapiens
AMKSETKLT

SEQ ID NO: 494697 - protein, 9 aa, Homo Sapiens
ISRPLAAGI

SEQ ID NO: 494698 - protein, 9 aa, Homo Sapiens
LSTRERAHG

SEQ ID NO: 494699 - protein, 9 aa, Homo Sapiens
FFVDGLHSD

SEQ ID NO: 494700 - protein, 9 aa, Homo Sapiens
VYGSCSTFH

SEQ ID NO: 494701 - protein, 9 aa, Homo Sapiens
QNLKLTCAG

SEQ ID NO: 494702 - protein, 9 aa, Homo Sapiens
LPTCQPTVP

SEQ ID NO: 494703 - protein, 9 aa, Homo Sapiens
AASVRRRSI

SEQ ID NO: 494704 - protein, 9 aa, Homo Sapiens
KDPDSQPPS

SEQ ID NO: 494705 - protein, 9 aa, Homo Sapiens
PQTAQHAKN

SEQ ID NO: 494706 - protein, 9 aa, Homo Sapiens
HSSAFHDDD

SEQ ID NO: 494707 - protein, 9 aa, Homo Sapiens
ITFPTLTET

SEQ ID NO: 494708 - protein, 9 aa, Homo Sapiens
LHCEGQTRS

SEQ ID NO: 494709 - protein, 9 aa, Homo Sapiens
DFFKTRSKQ

SEQ ID NO: 494710 - protein, 9 aa, Homo Sapiens
VQEQAVWAV

SEQ ID NO: 494711 - protein, 9 aa, Homo Sapiens
VRSVLFNPH

SEQ ID NO: 494712 - protein, 9 aa, Homo Sapiens
YAHLDPENK

SEQ ID NO: 494713 - protein, 9 aa, Homo Sapiens
VQYPDCKLS

SEQ ID NO: 494714 - protein, 9 aa, Homo Sapiens
TSHFFPSVV

SEQ ID NO: 494715 - protein, 9 aa, Homo Sapiens
HLQKVGERL

SEQ ID NO: 494716 - protein, 9 aa, Homo Sapiens
RSCRDKYGL

SEQ ID NO: 494717 - protein, 9 aa, Homo Sapiens
DPVHRVHLP

SEQ ID NO: 494718 - protein, 9 aa, Homo Sapiens
FLERGHKHI

SEQ ID NO: 494719 - protein, 9 aa, Homo Sapiens
ENQKNCSVP

SEQ ID NO: 494720 - protein, 9 aa, Homo Sapiens
AELLKLRWE

SEQ ID NO: 494721 - protein, 9 aa, Homo Sapiens
SACHDVNQC

SEQ ID NO: 494722 - protein, 9 aa, Homo Sapiens
GGPVAMGPG

SEQ ID NO: 494723 - protein, 9 aa, Homo Sapiens
DPQLGTAPK

SEQ ID NO: 494724 - protein, 9 aa, Homo Sapiens
IRHCPSKCR

SEQ ID NO: 494725 - protein, 9 aa, Homo Sapiens
KVLLLFQEG

SEQ ID NO: 494726 - protein, 9 aa, Homo Sapiens
KSFTAKSSF

SEQ ID NO: 494727 - protein, 9 aa, Homo Sapiens
TNSQETKKI

SEQ ID NO: 494728 - protein, 9 aa, Homo Sapiens
ENIRKGSYA

SEQ ID NO: 494729 - protein, 9 aa, Homo Sapiens
SADGSECFQ

SEQ ID NO: 494730 - protein, 9 aa, Homo Sapiens
ISAPKREIY

SEQ ID NO: 494731 - protein, 9 aa, Homo Sapiens
CNTKNPPGC

SEQ ID NO: 494732 - protein, 9 aa, Homo Sapiens
GDRLRLKGG

SEQ ID NO: 494733 - protein, 9 aa, Homo Sapiens
NENIKKDEL

SEQ ID NO: 494734 - protein, 9 aa, Homo Sapiens
KHHPHSGDC

SEQ ID NO: 494735 - protein, 9 aa, Homo Sapiens
KLASEEHVN

SEQ ID NO: 494736 - protein, 9 aa, Homo Sapiens
AFLEAHCLV

SEQ ID NO: 494737 - protein, 9 aa, Homo Sapiens
SWGPLDEGS

SEQ ID NO: 494738 - protein, 9 aa, Homo Sapiens
VTERKQQLD

SEQ ID NO: 494739 - protein, 9 aa, Homo Sapiens
EDGKEEEKK

SEQ ID NO: 494740 - protein, 9 aa, Homo Sapiens
AGYKSLKKN

SEQ ID NO: 494741 - protein, 9 aa, Homo Sapiens
RRKVILMYP

SEQ ID NO: 494742 - protein, 9 aa, Homo Sapiens
PKSIIKLDE

SEQ ID NO: 494743 - protein, 9 aa, Homo Sapiens
EQRAACNAL

SEQ ID NO: 494744 - protein, 9 aa, Homo Sapiens
AGPNGHLPA

SEQ ID NO: 494745 - protein, 9 aa, Homo Sapiens
IAHLQKVGE

SEQ ID NO: 494746 - protein, 9 aa, Homo Sapiens
TSESDSHDE

SEQ ID NO: 494747 - protein, 9 aa, Homo Sapiens
AQHESRSCR

SEQ ID NO: 494748 - protein, 9 aa, Homo Sapiens
WYCPYGSFV

SEQ ID NO: 494749 - protein, 9 aa, Homo Sapiens
HPHSGDCLV

SEQ ID NO: 494750 - protein, 9 aa, Homo Sapiens
TEGLCGPPF

SEQ ID NO: 494751 - protein, 9 aa, Homo Sapiens
LGLATLGYK

SEQ ID NO: 494752 - protein, 9 aa, Homo Sapiens
EIPQFLCDI

SEQ ID NO: 494753 - protein, 9 aa, Homo Sapiens
AQVFQAGNV

SEQ ID NO: 494754 - protein, 9 aa, Homo Sapiens
SCSVLSPVV

SEQ ID NO: 494755 - protein, 9 aa, Homo Sapiens
RPRVQHRSR

SEQ ID NO: 494756 - protein, 9 aa, Homo Sapiens
ISEINRMIQ

SEQ ID NO: 494757 - protein, 9 aa, Homo Sapiens
WEKLGRGEF

SEQ ID NO: 494758 - protein, 9 aa, Homo Sapiens
SAKGKEYLA

SEQ ID NO: 494759 - protein, 9 aa, Homo Sapiens
SATESAHSI

SEQ ID NO: 494760 - protein, 9 aa, Homo Sapiens
DRFSNFLLT

SEQ ID NO: 494761 - protein, 9 aa, Homo Sapiens
PPTLASESA

SEQ ID NO: 494762 - protein, 9 aa, Homo Sapiens
VDPVHRVHL

SEQ ID NO: 494763 - protein, 9 aa, Homo Sapiens
DGDRLRLKG

SEQ ID NO: 494764 - protein, 9 aa, Homo Sapiens
LAAGINLMI

SEQ ID NO: 494765 - protein, 9 aa, Homo Sapiens
ELSLRVWMC

SEQ ID NO: 494766 - protein, 9 aa, Homo Sapiens
QSQLSSVLR

SEQ ID NO: 494767 - protein, 9 aa, Homo Sapiens
VDLHQKLGK

SEQ ID NO: 494768 - protein, 9 aa, Homo Sapiens
PICSGASCL

SEQ ID NO: 494769 - protein, 9 aa, Homo Sapiens
PREVVVTVS

SEQ ID NO: 494770 - protein, 9 aa, Homo Sapiens
KNYEETAAA

SEQ ID NO: 494771 - protein, 9 aa, Homo Sapiens
DGSGGPVAM

SEQ ID NO: 494772 - protein, 9 aa, Homo Sapiens
EDDLDCSLA

SEQ ID NO: 494773 - protein, 9 aa, Homo Sapiens
VCRWRVEHV

SEQ ID NO: 494774 - protein, 9 aa, Homo Sapiens
NTKNPPGCY

SEQ ID NO: 494775 - protein, 9 aa, Homo Sapiens
KASPKSEAC

SEQ ID NO: 494776 - protein, 9 aa, Homo Sapiens
LSSGNIGED

SEQ ID NO: 494777 - protein, 9 aa, Homo Sapiens
FMKGTGCRA

SEQ ID NO: 494778 - protein, 9 aa, Homo Sapiens
MYVAAAMHD

SEQ ID NO: 494779 - protein, 9 aa, Homo Sapiens
NLFAQIAGA

SEQ ID NO: 494780 - protein, 9 aa, Homo Sapiens
FLTQGWGRT

SEQ ID NO: 494781 - protein, 9 aa, Homo Sapiens
EYYKWDKFA

SEQ ID NO: 494782 - protein, 9 aa, Homo Sapiens
SSAFHDDDM

SEQ ID NO: 494783 - protein, 9 aa, Homo Sapiens
TNVINVPGE

SEQ ID NO: 494784 - protein, 9 aa, Homo Sapiens
APPERYLSL

SEQ ID NO: 494785 - protein, 9 aa, Homo Sapiens
RAACNALRD

SEQ ID NO: 494786 - protein, 9 aa, Homo Sapiens
YLRIFIAVL

SEQ ID NO: 494787 - protein, 9 aa, Homo Sapiens
LLDRETLQN

SEQ ID NO: 494788 - protein, 9 aa, Homo Sapiens
ILICSRHFW

SEQ ID NO: 494789 - protein, 9 aa, Homo Sapiens
KYSCPKGYQ

SEQ ID NO: 494790 - protein, 9 aa, Homo Sapiens
SCRDKYGLD

SEQ ID NO: 494791 - protein, 9 aa, Homo Sapiens
HDEDEGEED

SEQ ID NO: 494792 - protein, 9 aa, Homo Sapiens
GLSIRLTGN

SEQ ID NO: 494793 - protein, 9 aa, Homo Sapiens
TDGGEEKAQ

SEQ ID NO: 494794 - protein, 9 aa, Homo Sapiens
AYGISHHSS

SEQ ID NO: 494795 - protein, 9 aa, Homo Sapiens
QRQERHQMG

SEQ ID NO: 494796 - protein, 9 aa, Homo Sapiens
DEHPFPGDG

SEQ ID NO: 494797 - protein, 9 aa, Homo Sapiens
DRLRLKGGN

SEQ ID NO: 494798 - protein, 9 aa, Homo Sapiens
YWQHPHSFK

SEQ ID NO: 494799 - protein, 9 aa, Homo Sapiens
LPKHFRRPE

SEQ ID NO: 494800 - protein, 9 aa, Homo Sapiens
SVKYANRAR

SEQ ID NO: 494801 - protein, 9 aa, Homo Sapiens
YISNKYGKN

SEQ ID NO: 494802 - protein, 9 aa, Homo Sapiens
KLRWELEEA

SEQ ID NO: 494803 - protein, 9 aa, Homo Sapiens
DIVGLHAFQ

SEQ ID NO: 494804 - protein, 9 aa, Homo Sapiens
EAHCLVQEE

SEQ ID NO: 494805 - protein, 9 aa, Homo Sapiens
MLTKMGDVA

SEQ ID NO: 494806 - protein, 9 aa, Homo Sapiens
CALVVCFPE

SEQ ID NO: 494807 - protein, 9 aa, Homo Sapiens
IVQYRELFE

SEQ ID NO: 494808 - protein, 9 aa, Homo Sapiens
DDLDCSLAS

SEQ ID NO: 494809 - protein, 9 aa, Homo Sapiens
YRPRVQHRS

SEQ ID NO: 494810 - protein, 9 aa, Homo Sapiens
QPTVPYHTI

SEQ ID NO: 494811 - protein, 9 aa, Homo Sapiens
KRERCRSPR

SEQ ID NO: 494812 - protein, 9 aa, Homo Sapiens
GAATGFLKL

SEQ ID NO: 494813 - protein, 9 aa, Homo Sapiens
KMALDLDTG

SEQ ID NO: 494814 - protein, 9 aa, Homo Sapiens
SGDLHILQV

SEQ ID NO: 494815 - protein, 9 aa, Homo Sapiens
RVRGQGTFC

SEQ ID NO: 494816 - protein, 9 aa, Homo Sapiens
MDDRPKTRS

SEQ ID NO: 494817 - protein, 9 aa, Homo Sapiens
FVVDLSQPQ

SEQ ID NO: 494818 - protein, 9 aa, Homo Sapiens
SRDSLGWKL

SEQ ID NO: 494819 - protein, 9 aa, Homo Sapiens
LGGLTAAGV

SEQ ID NO: 494820 - protein, 9 aa, Homo Sapiens
GHFQNKHPN

SEQ ID NO: 494821 - protein, 9 aa, Homo Sapiens
LWQSFQPIL

SEQ ID NO: 494822 - protein, 9 aa, Homo Sapiens
QSAKAPAEE

SEQ ID NO: 494823 - protein, 9 aa, Homo Sapiens
GFPVGPTVS

SEQ ID NO: 494824 - protein, 9 aa, Homo Sapiens
NLKLTCAGP

SEQ ID NO: 494825 - protein, 9 aa, Homo Sapiens
NAKQKKLRF

SEQ ID NO: 494826 - protein, 9 aa, Homo Sapiens
ALPPSRAAQ

SEQ ID NO: 494827 - protein, 9 aa, Homo Sapiens
HDSQAKVAS

SEQ ID NO: 494828 - protein, 9 aa, Homo Sapiens
CSRHFWTIL

SEQ ID NO: 494829 - protein, 9 aa, Homo Sapiens
LDMMVPLQL

SEQ ID NO: 494830 - protein, 9 aa, Homo Sapiens
LKTYISNKY

SEQ ID NO: 494831 - protein, 9 aa, Homo Sapiens
SDFYSGSPT

SEQ ID NO: 494832 - protein, 9 aa, Homo Sapiens
RLKTYISNK

SEQ ID NO: 494833 - protein, 9 aa, Homo Sapiens
HSSLSSDYD

SEQ ID NO: 494834 - protein, 9 aa, Homo Sapiens
AAEEQAARQ

SEQ ID NO: 494835 - protein, 9 aa, Homo Sapiens
ATDELGLLL

SEQ ID NO: 494836 - protein, 9 aa, Homo Sapiens
ITRMRMKPW

SEQ ID NO: 494837 - protein, 9 aa, Homo Sapiens
IWNKVHHKT

SEQ ID NO: 494838 - protein, 9 aa, Homo Sapiens
ENLGEASLQ

SEQ ID NO: 494839 - protein, 9 aa, Homo Sapiens
LSPLGFSGE

SEQ ID NO: 494840 - protein, 9 aa, Homo Sapiens
TEITCCERV

SEQ ID NO: 494841 - protein, 9 aa, Homo Sapiens
VATHNIEME

SEQ ID NO: 494842 - protein, 9 aa, Homo Sapiens
DLTAMTLDL

SEQ ID NO: 494843 - protein, 9 aa, Homo Sapiens
GIIPLESAS

SEQ ID NO: 494844 - protein, 9 aa, Homo Sapiens
CNLAGKPVI

SEQ ID NO: 494845 - protein, 9 aa, Homo Sapiens
ELLFASASH

SEQ ID NO: 494846 - protein, 9 aa, Homo Sapiens
VGSRLLNGS

SEQ ID NO: 494847 - protein, 9 aa, Homo Sapiens
LAAAAAGRG

SEQ ID NO: 494848 - protein, 9 aa, Homo Sapiens
QAVVPCWVT

SEQ ID NO: 494849 - protein, 9 aa, Homo Sapiens
GMKSTVDLH

SEQ ID NO: 494850 - protein, 9 aa, Homo Sapiens
LEQSNKTLL

SEQ ID NO: 494851 - protein, 9 aa, Homo Sapiens
HSLNFLYGT

SEQ ID NO: 494852 - protein, 9 aa, Homo Sapiens
GSGGGPLSD

SEQ ID NO: 494853 - protein, 9 aa, Homo Sapiens
IMFGNKRHT

SEQ ID NO: 494854 - protein, 9 aa, Homo Sapiens
TIAPCGAIA

SEQ ID NO: 494855 - protein, 9 aa, Homo Sapiens
KGYIYLSKR

SEQ ID NO: 494856 - protein, 9 aa, Homo Sapiens
NCLSKNYEE

SEQ ID NO: 494857 - protein, 9 aa, Homo Sapiens
RFFKVLLLF

SEQ ID NO: 494858 - protein, 9 aa, Homo Sapiens
SLTPPKDPD

SEQ ID NO: 494859 - protein, 9 aa, Homo Sapiens
YESGSGTEA

SEQ ID NO: 494860 - protein, 9 aa, Homo Sapiens
HQAYAHLDP

SEQ ID NO: 494861 - protein, 9 aa, Homo Sapiens
TAKSSFQTH

SEQ ID NO: 494862 - protein, 9 aa, Homo Sapiens
RRSYSRQTS

SEQ ID NO: 494863 - protein, 9 aa, Homo Sapiens
EQGKEPWVV

SEQ ID NO: 494864 - protein, 9 aa, Homo Sapiens
IKVARECRI

SEQ ID NO: 494865 - protein, 9 aa, Homo Sapiens
KVMALKDVR

SEQ ID NO: 494866 - protein, 9 aa, Homo Sapiens
HFEEHNSIN

SEQ ID NO: 494867 - protein, 9 aa, Homo Sapiens
IHEKNTSSA

SEQ ID NO: 494868 - protein, 9 aa, Homo Sapiens
SESSVLQEL

SEQ ID NO: 494869 - protein, 9 aa, Homo Sapiens
LAGVPRGEV

SEQ ID NO: 494870 - protein, 9 aa, Homo Sapiens
LACKDGWVD

SEQ ID NO: 494871 - protein, 9 aa, Homo Sapiens
PRGKRDKKR

SEQ ID NO: 494872 - protein, 9 aa, Homo Sapiens
RRKEAKRIA

SEQ ID NO: 494873 - protein, 9 aa, Homo Sapiens
SPKSEACSL

SEQ ID NO: 494874 - protein, 9 aa, Homo Sapiens
KLPSWPGAQ

SEQ ID NO: 494875 - protein, 9 aa, Homo Sapiens
ICSGASCLC

SEQ ID NO: 494876 - protein, 9 aa, Homo Sapiens
GTRQSLDES

SEQ ID NO: 494877 - protein, 9 aa, Homo Sapiens
RSLNGLVKN

SEQ ID NO: 494878 - protein, 9 aa, Homo Sapiens
QHLKTLKCL

SEQ ID NO: 494879 - protein, 9 aa, Homo Sapiens
AMPSFAGPP

SEQ ID NO: 494880 - protein, 9 aa, Homo Sapiens
LLDETPPES

SEQ ID NO: 494881 - protein, 9 aa, Homo Sapiens
SCRLKTYIS

SEQ ID NO: 494882 - protein, 9 aa, Homo Sapiens
EEMMDDRPK

SEQ ID NO: 494883 - protein, 9 aa, Homo Sapiens
DKIRKNLGM

SEQ ID NO: 494884 - protein, 9 aa, Homo Sapiens
ALKLVGMED

SEQ ID NO: 494885 - protein, 9 aa, Homo Sapiens
RTQTNVINV

SEQ ID NO: 494886 - protein, 9 aa, Homo Sapiens
QERRKEAKR

SEQ ID NO: 494887 - protein, 9 aa, Homo Sapiens
SCPVCRWRV

SEQ ID NO: 494888 - protein, 9 aa, Homo Sapiens
ASVRRRSIP

SEQ ID NO: 494889 - protein, 9 aa, Homo Sapiens
SQPQPWTQV

SEQ ID NO: 494890 - protein, 9 aa, Homo Sapiens
GDNCLSKNY

SEQ ID NO: 494891 - protein, 9 aa, Homo Sapiens
SECFQDPEK

SEQ ID NO: 494892 - protein, 9 aa, Homo Sapiens
TGCRALVIA

SEQ ID NO: 494893 - protein, 9 aa, Homo Sapiens
RQISRPLAA

SEQ ID NO: 494894 - protein, 9 aa, Homo Sapiens
RKSQKTVLK

SEQ ID NO: 494895 - protein, 9 aa, Homo Sapiens
WLEYNLDHT

SEQ ID NO: 494896 - protein, 9 aa, Homo Sapiens
CRDKYGLDR

SEQ ID NO: 494897 - protein, 9 aa, Homo Sapiens
LIYTGEKPY

SEQ ID NO: 494898 - protein, 9 aa, Homo Sapiens
WSPVTIGIV

SEQ ID NO: 494899 - protein, 9 aa, Homo Sapiens
AFAQGEVFI

SEQ ID NO: 494900 - protein, 9 aa, Homo Sapiens
NWHESAKGK

SEQ ID NO: 494901 - protein, 9 aa, Homo Sapiens
SSDYRSNQW

SEQ ID NO: 494902 - protein, 9 aa, Homo Sapiens
YMLTKMGDV

SEQ ID NO: 494903 - protein, 9 aa, Homo Sapiens
SAIRHCPSK

SEQ ID NO: 494904 - protein, 9 aa, Homo Sapiens
TKLASEEHV

SEQ ID NO: 494905 - protein, 9 aa, Homo Sapiens
DKWGEPSRC

SEQ ID NO: 494906 - protein, 9 aa, Homo Sapiens
FSRVIPKYC

SEQ ID NO: 494907 - protein, 9 aa, Homo Sapiens
SHEEDDNHD

SEQ ID NO: 494908 - protein, 9 aa, Homo Sapiens
DMMVPLQLL

SEQ ID NO: 494909 - protein, 9 aa, Homo Sapiens
KLSSKTRAS

SEQ ID NO: 494910 - protein, 9 aa, Homo Sapiens
IPGVQARNL

SEQ ID NO: 494911 - protein, 9 aa, Homo Sapiens
KEYPYSAKD

SEQ ID NO: 494912 - protein, 9 aa, Homo Sapiens
IVDMLTYVV

SEQ ID NO: 494913 - protein, 9 aa, Homo Sapiens
ACNALRDEV

SEQ ID NO: 494914 - protein, 9 aa, Homo Sapiens
NTEENTELV

SEQ ID NO: 494915 - protein, 9 aa, Homo Sapiens
HKLLQYGHM

SEQ ID NO: 494916 - protein, 9 aa, Homo Sapiens
GYLSSSHWS

SEQ ID NO: 494917 - protein, 9 aa, Homo Sapiens
LTNHPGKKF

SEQ ID NO: 494918 - protein, 9 aa, Homo Sapiens
VGKGEEQEE

SEQ ID NO: 494919 - protein, 9 aa, Homo Sapiens
HFLAGVPRG

SEQ ID NO: 494920 - protein, 9 aa, Homo Sapiens
KTLHMQESA

SEQ ID NO: 494921 - protein, 9 aa, Homo Sapiens
QVAFRGDSF

SEQ ID NO: 494922 - protein, 9 aa, Homo Sapiens
LIHEKNTSS

SEQ ID NO: 494923 - protein, 9 aa, Homo Sapiens
PNLGSPIEL

SEQ ID NO: 494924 - protein, 9 aa, Homo Sapiens
PKMTSAAHL

SEQ ID NO: 494925 - protein, 9 aa, Homo Sapiens
HNSINELKQ

SEQ ID NO: 494926 - protein, 9 aa, Homo Sapiens
GVTGWRETP

SEQ ID NO: 494927 - protein, 9 aa, Homo Sapiens
GEVGEKIEM

SEQ ID NO: 494928 - protein, 9 aa, Homo Sapiens
FISRVRGQG

SEQ ID NO: 494929 - protein, 9 aa, Homo Sapiens
SFVCALVVC

SEQ ID NO: 494930 - protein, 8 aa, Homo Sapiens
KKEELKQH

SEQ ID NO: 494931 - protein, 9 aa, Homo Sapiens
QVTNFKEVC

SEQ ID NO: 494932 - protein, 9 aa, Homo Sapiens
CFQDPEKSD

SEQ ID NO: 494933 - protein, 9 aa, Homo Sapiens
SGGSPAAEA

SEQ ID NO: 494934 - protein, 9 aa, Homo Sapiens
GNKRHTDVQ

SEQ ID NO: 494935 - protein, 9 aa, Homo Sapiens
EGDPSEKLQ

SEQ ID NO: 494936 - protein, 9 aa, Homo Sapiens
AVGNIAGDS

SEQ ID NO: 494937 - protein, 9 aa, Homo Sapiens
WKTHSEADY

SEQ ID NO: 494938 - protein, 9 aa, Homo Sapiens
FGNKRHTDV

SEQ ID NO: 494939 - protein, 9 aa, Homo Sapiens
EKGYIYLSK

SEQ ID NO: 494940 - protein, 9 aa, Homo Sapiens
LHFIDNQGQ

SEQ ID NO: 494941 - protein, 9 aa, Homo Sapiens
LGQGGLAAE

SEQ ID NO: 494942 - protein, 9 aa, Homo Sapiens
NGRDYHFVT

SEQ ID NO: 494943 - protein, 9 aa, Homo Sapiens
KMTSAAHLE

SEQ ID NO: 494944 - protein, 9 aa, Homo Sapiens
MMVPLQLLI

SEQ ID NO: 494945 - protein, 9 aa, Homo Sapiens
PPACSESEV

SEQ ID NO: 494946 - protein, 9 aa, Homo Sapiens
PPAHQLHRA

SEQ ID NO: 494947 - protein, 9 aa, Homo Sapiens
TLCAFNSSV

SEQ ID NO: 494948 - protein, 9 aa, Homo Sapiens
TMREGEIPQ

SEQ ID NO: 494949 - protein, 9 aa, Homo Sapiens
QTPLWVTQP

SEQ ID NO: 494950 - protein, 9 aa, Homo Sapiens
DPKEYPYSA

SEQ ID NO: 494951 - protein, 9 aa, Homo Sapiens
RLWQSFQPI

SEQ ID NO: 494952 - protein, 9 aa, Homo Sapiens
VMADVHTFG

SEQ ID NO: 494953 - protein, 9 aa, Homo Sapiens
RISAPKREI

SEQ ID NO: 494954 - protein, 9 aa, Homo Sapiens
TPEVPGLGS

SEQ ID NO: 494955 - protein, 9 aa, Homo Sapiens
FTHGASLVP

SEQ ID NO: 494956 - protein, 9 aa, Homo Sapiens
KEKLSLEAH

SEQ ID NO: 494957 - protein, 9 aa, Homo Sapiens
AHSIEIYVP

SEQ ID NO: 494958 - protein, 9 aa, Homo Sapiens
ACHDVNQCS

SEQ ID NO: 494959 - protein, 9 aa, Homo Sapiens
GHDCSCTDN

SEQ ID NO: 494960 - protein, 9 aa, Homo Sapiens
PKIAVMSTG

SEQ ID NO: 494961 - protein, 9 aa, Homo Sapiens
EQSNKTLLA

SEQ ID NO: 494962 - protein, 9 aa, Homo Sapiens
SVFSVCACA

SEQ ID NO: 494963 - protein, 9 aa, Homo Sapiens
TSQYPYSEC

SEQ ID NO: 494964 - protein, 9 aa, Homo Sapiens
SLRVWMCGG

SEQ ID NO: 494965 - protein, 9 aa, Homo Sapiens
EQERRKEAK

SEQ ID NO: 494966 - protein, 9 aa, Homo Sapiens
GQLGHGDTN

SEQ ID NO: 494967 - protein, 9 aa, Homo Sapiens
EAQKNWDVF

SEQ ID NO: 494968 - protein, 9 aa, Homo Sapiens
LRLWRKKFP

SEQ ID NO: 494969 - protein, 9 aa, Homo Sapiens
TMSLIAQDH

SEQ ID NO: 494970 - protein, 9 aa, Homo Sapiens
LFKSKARYL

SEQ ID NO: 494971 - protein, 9 aa, Homo Sapiens
NLYRKDIKE

SEQ ID NO: 494972 - protein, 9 aa, Homo Sapiens
SVKHGDKWG

SEQ ID NO: 494973 - protein, 9 aa, Homo Sapiens
GKRDKKRSR

SEQ ID NO: 494974 - protein, 9 aa, Homo Sapiens
ANIFEGIRI

SEQ ID NO: 494975 - protein, 9 aa, Homo Sapiens
KEAKRIARE

SEQ ID NO: 494976 - protein, 9 aa, Homo Sapiens
ASPKSEACS

SEQ ID NO: 494977 - protein, 9 aa, Homo Sapiens
VFYKRNSTN

SEQ ID NO: 494978 - protein, 9 aa, Homo Sapiens
EEIHNEPEE

SEQ ID NO: 494979 - protein, 9 aa, Homo Sapiens
LAPVLILDK

SEQ ID NO: 494980 - protein, 9 aa, Homo Sapiens
PAGPNGHLP

SEQ ID NO: 494981 - protein, 9 aa, Homo Sapiens
RTDSCSLAQ

SEQ ID NO: 494982 - protein, 9 aa, Homo Sapiens
GNARHGPVW

SEQ ID NO: 494983 - protein, 9 aa, Homo Sapiens
VPEMKPQGF

SEQ ID NO: 494984 - protein, 9 aa, Homo Sapiens
LRAQLELPA

SEQ ID NO: 494985 - protein, 9 aa, Homo Sapiens
PPATGNMLD

SEQ ID NO: 494986 - protein, 9 aa, Homo Sapiens
CALAERLDM

SEQ ID NO: 494987 - protein, 9 aa, Homo Sapiens
TYISNKYGK

SEQ ID NO: 494988 - protein, 9 aa, Homo Sapiens
KGYQLIGSS

SEQ ID NO: 494989 - protein, 9 aa, Homo Sapiens
PSEKLQLVT

SEQ ID NO: 494990 - protein, 9 aa, Homo Sapiens
RTYQAWQQP

SEQ ID NO: 494991 - protein, 9 aa, Homo Sapiens
QQAPIDMSK

SEQ ID NO: 494992 - protein, 9 aa, Homo Sapiens
FLYPYMEGA

SEQ ID NO: 494993 - protein, 9 aa, Homo Sapiens
DCSLASVFR

SEQ ID NO: 494994 - protein, 9 aa, Homo Sapiens
QCKHEFQRQ

SEQ ID NO: 494995 - protein, 9 aa, Homo Sapiens
DLPDLLSWK

SEQ ID NO: 494996 - protein, 9 aa, Homo Sapiens
RPGFPVSFP

SEQ ID NO: 494997 - protein, 9 aa, Homo Sapiens
QESAHKCPT

SEQ ID NO: 494998 - protein, 9 aa, Homo Sapiens
NSVDQHKNS

SEQ ID NO: 494999 - protein, 9 aa, Homo Sapiens
QLRQLQQEA

SEQ ID NO: 495000 - protein, 9 aa, Homo Sapiens
EPWVVGREL

SEQ ID NO: 495001 - protein, 9 aa, Homo Sapiens
SGFKTKAKL

SEQ ID NO: 495002 - protein, 9 aa, Homo Sapiens
RKHIEDKKL

SEQ ID NO: 495003 - protein, 9 aa, Homo Sapiens
VINSLEMFL

SEQ ID NO: 495004 - protein, 9 aa, Homo Sapiens
GQLVLVNDA

SEQ ID NO: 495005 - protein, 9 aa, Homo Sapiens
LDHEPPLSP

SEQ ID NO: 495006 - protein, 9 aa, Homo Sapiens
HGLIPNVLG

SEQ ID NO: 495007 - protein, 9 aa, Homo Sapiens
VGSRFFCRI

SEQ ID NO: 495008 - protein, 9 aa, Homo Sapiens
NAQHESRSC

SEQ ID NO: 495009 - protein, 9 aa, Homo Sapiens
KSLKKNEIL

SEQ ID NO: 495010 - protein, 9 aa, Homo Sapiens
ELTAAETRG

SEQ ID NO: 495011 - protein, 9 aa, Homo Sapiens
QRTGITEDI

SEQ ID NO: 495012 - protein, 9 aa, Homo Sapiens
KHFEEHNSI

SEQ ID NO: 495013 - protein, 9 aa, Homo Sapiens
FTINKKDHT

SEQ ID NO: 495014 - protein, 9 aa, Homo Sapiens
SEEHVNTKV

SEQ ID NO: 495015 - protein, 9 aa, Homo Sapiens
SVLELGAGP

SEQ ID NO: 495016 - protein, 9 aa, Homo Sapiens
KLTFELLGE

SEQ ID NO: 495017 - protein, 9 aa, Homo Sapiens
VFSQVLTRE

SEQ ID NO: 495018 - protein, 9 aa, Homo Sapiens
HFFDLPDLL

SEQ ID NO: 495019 - protein, 9 aa, Homo Sapiens
LLRQKLHFE

SEQ ID NO: 495020 - protein, 9 aa, Homo Sapiens
KLVEEGEPP

SEQ ID NO: 495021 - protein, 9 aa, Homo Sapiens
LGDQEGGGQ

SEQ ID NO: 495022 - protein, 9 aa, Homo Sapiens
EAELLKLRW

SEQ ID NO: 495023 - protein, 9 aa, Homo Sapiens
RHGLIPNVL

SEQ ID NO: 495024 - protein, 9 aa, Homo Sapiens
HNIEMEAAS

SEQ ID NO: 495025 - protein, 9 aa, Homo Sapiens
VWAVGNIAG

SEQ ID NO: 495026 - protein, 9 aa, Homo Sapiens
LTRHQLIYT

SEQ ID NO: 495027 - protein, 9 aa, Homo Sapiens
QFLESQLDP

SEQ ID NO: 495028 - protein, 9 aa, Homo Sapiens
HIKKATQAA

SEQ ID NO: 495029 - protein, 9 aa, Homo Sapiens
AGFKMISKQ

SEQ ID NO: 495030 - protein, 9 aa, Homo Sapiens
RQKLHFESI

SEQ ID NO: 495031 - protein, 9 aa, Homo Sapiens
FSEDTTLKW

SEQ ID NO: 495032 - protein, 9 aa, Homo Sapiens
LKMALDLDT

SEQ ID NO: 495033 - protein, 9 aa, Homo Sapiens
KWGEPSRCD

SEQ ID NO: 495034 - protein, 9 aa, Homo Sapiens
NKKAEIAAE

SEQ ID NO: 495035 - protein, 9 aa, Homo Sapiens
FGLPREVVV

SEQ ID NO: 495036 - protein, 9 aa, Homo Sapiens
LAAPPAHQL

SEQ ID NO: 495037 - protein, 9 aa, Homo Sapiens
MQESQKTAA

SEQ ID NO: 495038 - protein, 9 aa, Homo Sapiens
DTTLKWDSC

SEQ ID NO: 495039 - protein, 9 aa, Homo Sapiens
CNALRDEVG

SEQ ID NO: 495040 - protein, 9 aa, Homo Sapiens
VYRLLGHVL

SEQ ID NO: 495041 - protein, 9 aa, Homo Sapiens
LWRKKFPPR

SEQ ID NO: 495042 - protein, 9 aa, Homo Sapiens
ISESKYWQH

SEQ ID NO: 495043 - protein, 9 aa, Homo Sapiens
YINNLNENI

SEQ ID NO: 495044 - protein, 9 aa, Homo Sapiens
NKELEKYKE

SEQ ID NO: 495045 - protein, 9 aa, Homo Sapiens
NKIPDKGDT

SEQ ID NO: 495046 - protein, 9 aa, Homo Sapiens
LHAKGVIHK

SEQ ID NO: 495047 - protein, 9 aa, Homo Sapiens
GYQLIGSSS

SEQ ID NO: 495048 - protein, 9 aa, Homo Sapiens
MFNKFDEKE

SEQ ID NO: 495049 - protein, 9 aa, Homo Sapiens
MNALNKVNK

SEQ ID NO: 495050 - protein, 9 aa, Homo Sapiens
FIAVLKIPS

SEQ ID NO: 495051 - protein, 9 aa, Homo Sapiens
MPSFAGPPF

SEQ ID NO: 495052 - protein, 9 aa, Homo Sapiens
GFAHPFSIT

SEQ ID NO: 495053 - protein, 9 aa, Homo Sapiens
HKNSYYPRG

SEQ ID NO: 495054 - protein, 9 aa, Homo Sapiens
LYNLILKKY

SEQ ID NO: 495055 - protein, 9 aa, Homo Sapiens
TTYGQTGDT

SEQ ID NO: 495056 - protein, 9 aa, Homo Sapiens
TDSTITFPT

SEQ ID NO: 495057 - protein, 9 aa, Homo Sapiens
LTEKMYSEP

SEQ ID NO: 495058 - protein, 9 aa, Homo Sapiens
NAKSICKLA

SEQ ID NO: 495059 - protein, 9 aa, Homo Sapiens
LDLDTGSNG

SEQ ID NO: 495060 - protein, 9 aa, Homo Sapiens
TVIWNKVHH

SEQ ID NO: 495061 - protein, 9 aa, Homo Sapiens
VERAIETLM

SEQ ID NO: 495062 - protein, 9 aa, Homo Sapiens
RCHRFQSSD

SEQ ID NO: 495063 - protein, 9 aa, Homo Sapiens
CAISLCKSV

SEQ ID NO: 495064 - protein, 9 aa, Homo Sapiens
ILQVAFRGD

SEQ ID NO: 495065 - protein, 9 aa, Homo Sapiens
GGGVSLSLR

SEQ ID NO: 495066 - protein, 9 aa, Homo Sapiens
PEEMMDDRP

SEQ ID NO: 495067 - protein, 9 aa, Homo Sapiens
QGSQLRQLQ

SEQ ID NO: 495068 - protein, 9 aa, Homo Sapiens
VLGTRQSLD

SEQ ID NO: 495069 - protein, 9 aa, Homo Sapiens
CKSLLPRAS

SEQ ID NO: 495070 - protein, 9 aa, Homo Sapiens
WPGAQGVEP

SEQ ID NO: 495071 - protein, 9 aa, Homo Sapiens
DTECTLAVD

SEQ ID NO: 495072 - protein, 9 aa, Homo Sapiens
TPPKDPDSQ

SEQ ID NO: 495073 - protein, 9 aa, Homo Sapiens
GFKMISKQA

SEQ ID NO: 495074 - protein, 9 aa, Homo Sapiens
QESQKTAAE

SEQ ID NO: 495075 - protein, 9 aa, Homo Sapiens
TEYNEEKNK

SEQ ID NO: 495076 - protein, 9 aa, Homo Sapiens
LHVLSELDM

SEQ ID NO: 495077 - protein, 9 aa, Homo Sapiens
TMNSLEKQE

SEQ ID NO: 495078 - protein, 9 aa, Homo Sapiens
LAERLDMVA

SEQ ID NO: 495079 - protein, 9 aa, Homo Sapiens
LGRGEFLHL

SEQ ID NO: 495080 - protein, 9 aa, Homo Sapiens
CSLASVFRV

SEQ ID NO: 495081 - protein, 9 aa, Homo Sapiens
VGMEDDEPP

SEQ ID NO: 495082 - protein, 9 aa, Homo Sapiens
DMQWVQILA

SEQ ID NO: 495083 - protein, 9 aa, Homo Sapiens
RKRCAVALW

SEQ ID NO: 495084 - protein, 9 aa, Homo Sapiens
HRVHLPQAA

SEQ ID NO: 495085 - protein, 9 aa, Homo Sapiens
MGHLSCDIK

SEQ ID NO: 495086 - protein, 9 aa, Homo Sapiens
VLILDKMSE

SEQ ID NO: 495087 - protein, 9 aa, Homo Sapiens
SRSCRDKYG

SEQ ID NO: 495088 - protein, 9 aa, Homo Sapiens
PLSDFYSGS

SEQ ID NO: 495089 - protein, 9 aa, Homo Sapiens
CLKSEIRNI

SEQ ID NO: 495090 - protein, 9 aa, Homo Sapiens
QLVTGTNVY

SEQ ID NO: 495091 - protein, 9 aa, Homo Sapiens
VGPTVSPRR

SEQ ID NO: 495092 - protein, 9 aa, Homo Sapiens
QACCQFLES

SEQ ID NO: 495093 - protein, 9 aa, Homo Sapiens
ATNMLSHQL

SEQ ID NO: 495094 - protein, 9 aa, Homo Sapiens
LIHLPGGVH

SEQ ID NO: 495095 - protein, 9 aa, Homo Sapiens
THPEKRYDY

SEQ ID NO: 495096 - protein, 9 aa, Homo Sapiens
AGGIELFVA

SEQ ID NO: 495097 - protein, 9 aa, Homo Sapiens
KNPPGCYRY

SEQ ID NO: 495098 - protein, 9 aa, Homo Sapiens
PCQLSPLGF

SEQ ID NO: 495099 - protein, 9 aa, Homo Sapiens
RNCCNTKNP

SEQ ID NO: 495100 - protein, 9 aa, Homo Sapiens
CQLEVFLRL

SEQ ID NO: 495101 - protein, 9 aa, Homo Sapiens
NSLIRVLQN

SEQ ID NO: 495102 - protein, 9 aa, Homo Sapiens
QKLHFESIQ

SEQ ID NO: 495103 - protein, 9 aa, Homo Sapiens
NQTPLWVTQ

SEQ ID NO: 495104 - protein, 9 aa, Homo Sapiens
LLGLRKLSS

SEQ ID NO: 495105 - protein, 9 aa, Homo Sapiens
ECKWPGCQT

SEQ ID NO: 495106 - protein, 9 aa, Homo Sapiens
IDLRVLESS

SEQ ID NO: 495107 - protein, 9 aa, Homo Sapiens
VADKDGKAD

SEQ ID NO: 495108 - protein, 9 aa, Homo Sapiens
LLIHEKNTS

SEQ ID NO: 495109 - protein, 9 aa, Homo Sapiens
QSNNPFSST

SEQ ID NO: 495110 - protein, 9 aa, Homo Sapiens
EMATSQYPY

SEQ ID NO: 495111 - protein, 9 aa, Homo Sapiens
IKEERKIKG

SEQ ID NO: 495112 - protein, 9 aa, Homo Sapiens
KNGNGLNNT

SEQ ID NO: 495113 - protein, 9 aa, Homo Sapiens
EYECVATNS

SEQ ID NO: 495114 - protein, 9 aa, Homo Sapiens
DAFAQGEVF

SEQ ID NO: 495115 - protein, 9 aa, Homo Sapiens
CSGASCLCC

SEQ ID NO: 495116 - protein, 9 aa, Homo Sapiens
YIIGILFLL

SEQ ID NO: 495117 - protein, 9 aa, Homo Sapiens
LLAAPPAHQ

SEQ ID NO: 495118 - protein, 9 aa, Homo Sapiens
GSGFPVRHG

SEQ ID NO: 495119 - protein, 9 aa, Homo Sapiens
KTYLTNHPG

SEQ ID NO: 495120 - protein, 9 aa, Homo Sapiens
IGGAGNARH

SEQ ID NO: 495121 - protein, 9 aa, Homo Sapiens
TGITEDITY

SEQ ID NO: 495122 - protein, 9 aa, Homo Sapiens
PFNGIIPLE

SEQ ID NO: 495123 - protein, 9 aa, Homo Sapiens
INSLIRVLQ

SEQ ID NO: 495124 - protein, 9 aa, Homo Sapiens
LHAFQERLN

SEQ ID NO: 495125 - protein, 9 aa, Homo Sapiens
EEEQRAACN

SEQ ID NO: 495126 - protein, 9 aa, Homo Sapiens
RSILICSRH

SEQ ID NO: 495127 - protein, 9 aa, Homo Sapiens
CSVPLAEHL

SEQ ID NO: 495128 - protein, 9 aa, Homo Sapiens
YYRELEYES

SEQ ID NO: 495129 - protein, 9 aa, Homo Sapiens
HGKIKLSPE

SEQ ID NO: 495130 - protein, 9 aa, Homo Sapiens
HMEEGASPP

SEQ ID NO: 495131 - protein, 9 aa, Homo Sapiens
SSLLCIHNE

SEQ ID NO: 495132 - protein, 9 aa, Homo Sapiens
RMMSCGFHE

SEQ ID NO: 495133 - protein, 9 aa, Homo Sapiens
ASLQPSPTQ

SEQ ID NO: 495134 - protein, 9 aa, Homo Sapiens
YLLGGLTAA

SEQ ID NO: 495135 - protein, 9 aa, Homo Sapiens
LFEENGSLY

SEQ ID NO: 495136 - protein, 9 aa, Homo Sapiens
QREGEGKEK

SEQ ID NO: 495137 - protein, 9 aa, Homo Sapiens
ALLQAIKDL

SEQ ID NO: 495138 - protein, 9 aa, Homo Sapiens
MSSCSVLSP

SEQ ID NO: 495139 - protein, 9 aa, Homo Sapiens
NTKHEISEI

SEQ ID NO: 495140 - protein, 9 aa, Homo Sapiens
KPPHPGSST

SEQ ID NO: 495141 - protein, 9 aa, Homo Sapiens
TKSVATHNI

SEQ ID NO: 495142 - protein, 9 aa, Homo Sapiens
FINIIIAFL

SEQ ID NO: 495143 - protein, 9 aa, Homo Sapiens
HRFQSSDYR

SEQ ID NO: 495144 - protein, 9 aa, Homo Sapiens
ESSRPRGKR

SEQ ID NO: 495145 - protein, 9 aa, Homo Sapiens
PNIVQYREL

SEQ ID NO: 495146 - protein, 9 aa, Homo Sapiens
TEALEQSNK

SEQ ID NO: 495147 - protein, 9 aa, Homo Sapiens
TLMKNFHQY

SEQ ID NO: 495148 - protein, 9 aa, Homo Sapiens
YVRSLAKNG

SEQ ID NO: 495149 - protein, 9 aa, Homo Sapiens
EKKHSGAAT

SEQ ID NO: 495150 - protein, 9 aa, Homo Sapiens
SFTTFFSKT

SEQ ID NO: 495151 - protein, 9 aa, Homo Sapiens
DIPDLLVGN

SEQ ID NO: 495152 - protein, 9 aa, Homo Sapiens
IIGILFLLI

SEQ ID NO: 495153 - protein, 9 aa, Homo Sapiens
ILGDLGAID

SEQ ID NO: 495154 - protein, 9 aa, Homo Sapiens
ALLSQARKS

SEQ ID NO: 495155 - protein, 9 aa, Homo Sapiens
EGDDFGQLV

SEQ ID NO: 495156 - protein, 9 aa, Homo Sapiens
EENLLNVSK

SEQ ID NO: 495157 - protein, 9 aa, Homo Sapiens
LCPASLAPL

SEQ ID NO: 495158 - protein, 9 aa, Homo Sapiens
EYPYSAKDE

SEQ ID NO: 495159 - protein, 9 aa, Homo Sapiens
NNLNENIKK

SEQ ID NO: 495160 - protein, 9 aa, Homo Sapiens
VRAANSETV

SEQ ID NO: 495161 - protein, 9 aa, Homo Sapiens
ILMYPILST

SEQ ID NO: 495162 - protein, 9 aa, Homo Sapiens
GANMGFSAW

SEQ ID NO: 495163 - protein, 9 aa, Homo Sapiens
DTEITCCER

SEQ ID NO: 495164 - protein, 9 aa, Homo Sapiens
LLSLIEYYK

SEQ ID NO: 495165 - protein, 9 aa, Homo Sapiens
YSRQTSDSS

SEQ ID NO: 495166 - protein, 9 aa, Homo Sapiens
VKEPRHGNL

SEQ ID NO: 495167 - protein, 9 aa, Homo Sapiens
WIKQDPRRW

SEQ ID NO: 495168 - protein, 9 aa, Homo Sapiens
LRAERAQSK

SEQ ID NO: 495169 - protein, 9 aa, Homo Sapiens
LAAEEQAAR

SEQ ID NO: 495170 - protein, 9 aa, Homo Sapiens
PAGPPLSNG

SEQ ID NO: 495171 - protein, 9 aa, Homo Sapiens
AAEGKYEEY

SEQ ID NO: 495172 - protein, 9 aa, Homo Sapiens
GGEEKAQEI

SEQ ID NO: 495173 - protein, 9 aa, Homo Sapiens
LGHVLPSTH

SEQ ID NO: 495174 - protein, 9 aa, Homo Sapiens
GLAAAYYSR

SEQ ID NO: 495175 - protein, 9 aa, Homo Sapiens
PGIYGILGD

SEQ ID NO: 495176 - protein, 9 aa, Homo Sapiens
RLLQLAGQS

SEQ ID NO: 495177 - protein, 9 aa, Homo Sapiens
LKCEEGEDK

SEQ ID NO: 495178 - protein, 9 aa, Homo Sapiens
LRWELEEAA

SEQ ID NO: 495179 - protein, 9 aa, Homo Sapiens
IQTSCDDTA

SEQ ID NO: 495180 - protein, 9 aa, Homo Sapiens
LEYNLDHTD

SEQ ID NO: 495181 - protein, 9 aa, Homo Sapiens
VRSQASANL

SEQ ID NO: 495182 - protein, 9 aa, Homo Sapiens
AQKNWDVFY

SEQ ID NO: 495183 - protein, 9 aa, Homo Sapiens
EAKRIARER

SEQ ID NO: 495184 - protein, 9 aa, Homo Sapiens
HLPEALSPT

SEQ ID NO: 495185 - protein, 9 aa, Homo Sapiens
CGLLYIIGI

SEQ ID NO: 495186 - protein, 9 aa, Homo Sapiens
EALEQSNKT

SEQ ID NO: 495187 - protein, 9 aa, Homo Sapiens
YEGANMGFS

SEQ ID NO: 495188 - protein, 9 aa, Homo Sapiens
QLIYTGEKP

SEQ ID NO: 495189 - protein, 9 aa, Homo Sapiens
PLSPLLASF

SEQ ID NO: 495190 - protein, 9 aa, Homo Sapiens
SVKCGAGRN

SEQ ID NO: 495191 - protein, 9 aa, Homo Sapiens
QASANLGGV

SEQ ID NO: 495192 - protein, 9 aa, Homo Sapiens
QDVTVYFSR

SEQ ID NO: 495193 - protein, 9 aa, Homo Sapiens
CTLAVDLWS

SEQ ID NO: 495194 - protein, 9 aa, Homo Sapiens
LGTAPKIAV

SEQ ID NO: 495195 - protein, 9 aa, Homo Sapiens
QYPYSECQN

SEQ ID NO: 495196 - protein, 9 aa, Homo Sapiens
GWHHPLNWL

SEQ ID NO: 495197 - protein, 9 aa, Homo Sapiens
LTQRLLPPL

SEQ ID NO: 495198 - protein, 9 aa, Homo Sapiens
ELQRQKLER

SEQ ID NO: 495199 - protein, 9 aa, Homo Sapiens
CEEGEDKEE

SEQ ID NO: 495200 - protein, 9 aa, Homo Sapiens
ESKYWQHPH

SEQ ID NO: 495201 - protein, 9 aa, Homo Sapiens
WLSNVFIEE

SEQ ID NO: 495202 - protein, 9 aa, Homo Sapiens
YICGLLYII

SEQ ID NO: 495203 - protein, 9 aa, Homo Sapiens
SKPPAGPPL

SEQ ID NO: 495204 - protein, 9 aa, Homo Sapiens
NGKMNALNK

SEQ ID NO: 495205 - protein, 9 aa, Homo Sapiens
VLGIQTSCD

SEQ ID NO: 495206 - protein, 9 aa, Homo Sapiens
PERYLSLPG

SEQ ID NO: 495207 - protein, 9 aa, Homo Sapiens
YKLFENIRK

SEQ ID NO: 495208 - protein, 9 aa, Homo Sapiens
IPKSIIKLD

SEQ ID NO: 495209 - protein, 9 aa, Homo Sapiens
SPGEQPQGG

SEQ ID NO: 495210 - protein, 9 aa, Homo Sapiens
KEENLLNVS

SEQ ID NO: 495211 - protein, 9 aa, Homo Sapiens
LHSPPPELP

SEQ ID NO: 495212 - protein, 9 aa, Homo Sapiens
SRGSDTEGL

SEQ ID NO: 495213 - protein, 9 aa, Homo Sapiens
LLTEELTQR

SEQ ID NO: 495214 - protein, 9 aa, Homo Sapiens
VQHALPAGT

SEQ ID NO: 495215 - protein, 9 aa, Homo Sapiens
NLGEASLQP

SEQ ID NO: 495216 - protein, 9 aa, Homo Sapiens
TEGLAQKKF

SEQ ID NO: 495217 - protein, 9 aa, Homo Sapiens
QTAQHAKNG

SEQ ID NO: 495218 - protein, 9 aa, Homo Sapiens
VNCLKSEIR

SEQ ID NO: 495219 - protein, 9 aa, Homo Sapiens
TFELLGEGA

SEQ ID NO: 495220 - protein, 9 aa, Homo Sapiens
IEGMCYLHA

SEQ ID NO: 495221 - protein, 9 aa, Homo Sapiens
TVQEDSEEE

SEQ ID NO: 495222 - protein, 9 aa, Homo Sapiens
LLHSPPPEL

SEQ ID NO: 495223 - protein, 9 aa, Homo Sapiens
TKAKLVGLE

SEQ ID NO: 495224 - protein, 9 aa, Homo Sapiens
LLLWALPPS

SEQ ID NO: 495225 - protein, 9 aa, Homo Sapiens
QAVVKICIT

SEQ ID NO: 495226 - protein, 9 aa, Homo Sapiens
DVFSKYQLH

SEQ ID NO: 495227 - protein, 9 aa, Homo Sapiens
TNYAYCVVS

SEQ ID NO: 495228 - protein, 9 aa, Homo Sapiens
KSIIKLDEE

SEQ ID NO: 495229 - protein, 9 aa, Homo Sapiens
SHWSCGAPG

SEQ ID NO: 495230 - protein, 9 aa, Homo Sapiens
KDHTLGNII

SEQ ID NO: 495231 - protein, 9 aa, Homo Sapiens
DSITSIKEM

SEQ ID NO: 495232 - protein, 9 aa, Homo Sapiens
CPSTGQPPC

SEQ ID NO: 495233 - protein, 9 aa, Homo Sapiens
AANSETVAK

SEQ ID NO: 495234 - protein, 9 aa, Homo Sapiens
PKREIYCHY

SEQ ID NO: 495235 - protein, 9 aa, Homo Sapiens
VVGVFTVAD

SEQ ID NO: 495236 - protein, 9 aa, Homo Sapiens
YINENMEHN

SEQ ID NO: 495237 - protein, 9 aa, Homo Sapiens
TQTPTVQED

SEQ ID NO: 495238 - protein, 9 aa, Homo Sapiens
AHQLHRAHY

SEQ ID NO: 495239 - protein, 9 aa, Homo Sapiens
LEKQETVCI

SEQ ID NO: 495240 - protein, 9 aa, Homo Sapiens
GDDFGQLVL

SEQ ID NO: 495241 - protein, 9 aa, Homo Sapiens
EMMDDRPKT

SEQ ID NO: 495242 - protein, 9 aa, Homo Sapiens
IRKGSYAIP

SEQ ID NO: 495243 - protein, 9 aa, Homo Sapiens
NVFIEESVD

SEQ ID NO: 495244 - protein, 9 aa, Homo Sapiens
DVNQCSSSK

SEQ ID NO: 495245 - protein, 9 aa, Homo Sapiens
TLGYKIKFY

SEQ ID NO: 495246 - protein, 9 aa, Homo Sapiens
AIKRLLGSQ

SEQ ID NO: 495247 - protein, 9 aa, Homo Sapiens
CPKGYQLIG

SEQ ID NO: 495248 - protein, 9 aa, Homo Sapiens
TRHSSDFDT

SEQ ID NO: 495249 - protein, 9 aa, Homo Sapiens
RELFEENGS

SEQ ID NO: 495250 - protein, 9 aa, Homo Sapiens
PLAAVTPLN

SEQ ID NO: 495251 - protein, 9 aa, Homo Sapiens
YNEEKNKEA

SEQ ID NO: 495252 - protein, 9 aa, Homo Sapiens
TAEPSWGPL

SEQ ID NO: 495253 - protein, 9 aa, Homo Sapiens
HPEKRYDYC

SEQ ID NO: 495254 - protein, 9 aa, Homo Sapiens
LSFVCALVV

SEQ ID NO: 495255 - protein, 9 aa, Homo Sapiens
MKRPLEDAI

SEQ ID NO: 495256 - protein, 9 aa, Homo Sapiens
PSKTESERK

SEQ ID NO: 495257 - protein, 9 aa, Homo Sapiens
VDKYENELA

SEQ ID NO: 495258 - protein, 9 aa, Homo Sapiens
SEDTPEVPG

SEQ ID NO: 495259 - protein, 9 aa, Homo Sapiens
LSNPSKTES

SEQ ID NO: 495260 - protein, 9 aa, Homo Sapiens
ARKSQKTVL

SEQ ID NO: 495261 - protein, 9 aa, Homo Sapiens
IESNDTILE

SEQ ID NO: 495262 - protein, 9 aa, Homo Sapiens
RVIPKYCRA

SEQ ID NO: 495263 - protein, 9 aa, Homo Sapiens
PHSLTAVAQ

SEQ ID NO: 495264 - protein, 9 aa, Homo Sapiens
EALSPTLTL

SEQ ID NO: 495265 - protein, 9 aa, Homo Sapiens
AVGSRFFCR

SEQ ID NO: 495266 - protein, 9 aa, Homo Sapiens
SSSSPNKVM

SEQ ID NO: 495267 - protein, 9 aa, Homo Sapiens
PEPHSLTAV

SEQ ID NO: 495268 - protein, 9 aa, Homo Sapiens
LLGGLTAAG

SEQ ID NO: 495269 - protein, 9 aa, Homo Sapiens
ASKYNLYRK

SEQ ID NO: 495270 - protein, 9 aa, Homo Sapiens
ANSNASSVC

SEQ ID NO: 495271 - protein, 9 aa, Homo Sapiens
DRPHIKKAT

SEQ ID NO: 495272 - protein, 9 aa, Homo Sapiens
TFEAGVTSK

SEQ ID NO: 495273 - protein, 9 aa, Homo Sapiens
PRRRSYSRQ

SEQ ID NO: 495274 - protein, 9 aa, Homo Sapiens
QLHKDGVVL

SEQ ID NO: 495275 - protein, 9 aa, Homo Sapiens
TRMRMKPWL

SEQ ID NO: 495276 - protein, 9 aa, Homo Sapiens
ARVQLQGSQ

SEQ ID NO: 495277 - protein, 9 aa, Homo Sapiens
ETVAKLVFQ

SEQ ID NO: 495278 - protein, 9 aa, Homo Sapiens
SSEASELLH

SEQ ID NO: 495279 - protein, 9 aa, Homo Sapiens
MALDLDTGS

SEQ ID NO: 495280 - protein, 9 aa, Homo Sapiens
SPLLASFFS

SEQ ID NO: 495281 - protein, 9 aa, Homo Sapiens
DGQCSVDRS

SEQ ID NO: 495282 - protein, 9 aa, Homo Sapiens
FFKTRSKQE

SEQ ID NO: 495283 - protein, 9 aa, Homo Sapiens
PVCRWRVEH

SEQ ID NO: 495284 - protein, 9 aa, Homo Sapiens
LSRTDSCSL

SEQ ID NO: 495285 - protein, 9 aa, Homo Sapiens
SLPGSLKWE

SEQ ID NO: 495286 - protein, 9 aa, Homo Sapiens
IKLLKKKQK

SEQ ID NO: 495287 - protein, 9 aa, Homo Sapiens
PVEQVTNFK

SEQ ID NO: 495288 - protein, 9 aa, Homo Sapiens
TFVCELFHE

SEQ ID NO: 495289 - protein, 9 aa, Homo Sapiens
IEDKKLVRY

SEQ ID NO: 495290 - protein, 9 aa, Homo Sapiens
DELYRQSLK

SEQ ID NO: 495291 - protein, 9 aa, Homo Sapiens
IETLMKNFH

SEQ ID NO: 495292 - protein, 9 aa, Homo Sapiens
LTEGPGECP

SEQ ID NO: 495293 - protein, 9 aa, Homo Sapiens
GNGLNNTPR

SEQ ID NO: 495294 - protein, 9 aa, Homo Sapiens
RRHFLEIKS

SEQ ID NO: 495295 - protein, 9 aa, Homo Sapiens
GARAVLQNT

SEQ ID NO: 495296 - protein, 9 aa, Homo Sapiens
FDPKEYPYS

SEQ ID NO: 495297 - protein, 9 aa, Homo Sapiens
THSLNFLYG

SEQ ID NO: 495298 - protein, 9 aa, Homo Sapiens
TDSCSLAQA

SEQ ID NO: 495299 - protein, 9 aa, Homo Sapiens
ISACSQSSS

SEQ ID NO: 495300 - protein, 9 aa, Homo Sapiens
RQMKRPLED

SEQ ID NO: 495301 - protein, 9 aa, Homo Sapiens
HWSCGAPGQ

SEQ ID NO: 495302 - protein, 9 aa, Homo Sapiens
NASSVCSER

SEQ ID NO: 495303 - protein, 9 aa, Homo Sapiens
GCHKLMYLD

SEQ ID NO: 495304 - protein, 9 aa, Homo Sapiens
TKHEISEIN

SEQ ID NO: 495305 - protein, 9 aa, Homo Sapiens
NSSSLLCIH

SEQ ID NO: 495306 - protein, 9 aa, Homo Sapiens
SYNNAKQKK

SEQ ID NO: 495307 - protein, 9 aa, Homo Sapiens
TTFFSKTGN

SEQ ID NO: 495308 - protein, 9 aa, Homo Sapiens
WVTVLSAKV

SEQ ID NO: 495309 - protein, 9 aa, Homo Sapiens
FSKKHHPHS

SEQ ID NO: 495310 - protein, 9 aa, Homo Sapiens
SFTAKSSFQ

SEQ ID NO: 495311 - protein, 9 aa, Homo Sapiens
LGFSGEELP

SEQ ID NO: 495312 - protein, 9 aa, Homo Sapiens
IPALELMAM

SEQ ID NO: 495313 - protein, 9 aa, Homo Sapiens
SAFLEAHCL

SEQ ID NO: 495314 - protein, 9 aa, Homo Sapiens
FGQLVLVND

SEQ ID NO: 495315 - protein, 9 aa, Homo Sapiens
KHEISEINR

SEQ ID NO: 495316 - protein, 9 aa, Homo Sapiens
EGGGQSQLS

SEQ ID NO: 495317 - protein, 9 aa, Homo Sapiens
NLENDEDAA

SEQ ID NO: 495318 - protein, 9 aa, Homo Sapiens
PLGISEKSK

SEQ ID NO: 495319 - protein, 9 aa, Homo Sapiens
AVQQAPIDM

SEQ ID NO: 495320 - protein, 9 aa, Homo Sapiens
RMKPWLEMQ

SEQ ID NO: 495321 - protein, 9 aa, Homo Sapiens
GDLHILQVA

SEQ ID NO: 495322 - protein, 9 aa, Homo Sapiens
EQHLKTLKC

SEQ ID NO: 495323 - protein, 9 aa, Homo Sapiens
KSEACSLSA

SEQ ID NO: 495324 - protein, 9 aa, Homo Sapiens
SKYQLHKDG

SEQ ID NO: 495325 - protein, 9 aa, Homo Sapiens
KASSCFLIV

SEQ ID NO: 495326 - protein, 9 aa, Homo Sapiens
MREGEIPQF

SEQ ID NO: 495327 - protein, 9 aa, Homo Sapiens
KMIKLLKKK

SEQ ID NO: 495328 - protein, 9 aa, Homo Sapiens
SPVTIGIVP

SEQ ID NO: 495329 - protein, 9 aa, Homo Sapiens
YQLIGSSSA

SEQ ID NO: 495330 - protein, 9 aa, Homo Sapiens
DDWKLIESN

SEQ ID NO: 495331 - protein, 9 aa, Homo Sapiens
MELLVLEQL

SEQ ID NO: 495332 - protein, 9 aa, Homo Sapiens
LLLSLPAAG

SEQ ID NO: 495333 - protein, 9 aa, Homo Sapiens
EGEQEDGKE

SEQ ID NO: 495334 - protein, 9 aa, Homo Sapiens
SDTECTLAV

SEQ ID NO: 495335 - protein, 9 aa, Homo Sapiens
RGKTMSCQG

SEQ ID NO: 495336 - protein, 9 aa, Homo Sapiens
CRSPRRRKS

SEQ ID NO: 495337 - protein, 9 aa, Homo Sapiens
EYESGSGTE

SEQ ID NO: 495338 - protein, 9 aa, Homo Sapiens
FSQVLTREE

SEQ ID NO: 495339 - protein, 9 aa, Homo Sapiens
TSSVPLAAV

SEQ ID NO: 495340 - protein, 9 aa, Homo Sapiens
EKIEMTPMV

SEQ ID NO: 495341 - protein, 9 aa, Homo Sapiens
FEEHNSINE

SEQ ID NO: 495342 - protein, 9 aa, Homo Sapiens
LETVFSQVL

SEQ ID NO: 495343 - protein, 9 aa, Homo Sapiens
AQLELPAIR

SEQ ID NO: 495344 - protein, 9 aa, Homo Sapiens
SVLFNPHGC

SEQ ID NO: 495345 - protein, 9 aa, Homo Sapiens
TQCSYPSAI

SEQ ID NO: 495346 - protein, 9 aa, Homo Sapiens
KIVLGIQTS

SEQ ID NO: 495347 - protein, 9 aa, Homo Sapiens
RNSPSLKPP

SEQ ID NO: 495348 - protein, 9 aa, Homo Sapiens
SDYRSNQWR

SEQ ID NO: 495349 - protein, 9 aa, Homo Sapiens
QEQRTQTNV

SEQ ID NO: 495350 - protein, 9 aa, Homo Sapiens
QTSCDDTAA

SEQ ID NO: 495351 - protein, 9 aa, Homo Sapiens
IELFVAGIG

SEQ ID NO: 495352 - protein, 9 aa, Homo Sapiens
GDQEGGGQS

SEQ ID NO: 495353 - protein, 9 aa, Homo Sapiens
LPIETKCRG

SEQ ID NO: 495354 - protein, 9 aa, Homo Sapiens
RQWMGDGEG

SEQ ID NO: 495355 - protein, 9 aa, Homo Sapiens
YAPVTGMCY

SEQ ID NO: 495356 - protein, 9 aa, Homo Sapiens
ESFTFPELI

SEQ ID NO: 495357 - protein, 9 aa, Homo Sapiens
EVEELGLAT

SEQ ID NO: 495358 - protein, 9 aa, Homo Sapiens
KTKNAKRNY

SEQ ID NO: 495359 - protein, 9 aa, Homo Sapiens
SLAQAQYDT

SEQ ID NO: 495360 - protein, 9 aa, Homo Sapiens
QITDLPSND

SEQ ID NO: 495361 - protein, 9 aa, Homo Sapiens
IVAHSNPGE

SEQ ID NO: 495362 - protein, 9 aa, Homo Sapiens
DLRVLESSP

SEQ ID NO: 495363 - protein, 9 aa, Homo Sapiens
QLELPAIRQ

SEQ ID NO: 495364 - protein, 9 aa, Homo Sapiens
KKLKQAIAH

SEQ ID NO: 495365 - protein, 9 aa, Homo Sapiens
DPSSGDIRT

SEQ ID NO: 495366 - protein, 9 aa, Homo Sapiens
PLGQSVAPI

SEQ ID NO: 495367 - protein, 9 aa, Homo Sapiens
VKICITRIT

SEQ ID NO: 495368 - protein, 9 aa, Homo Sapiens
SNVFIEESV

SEQ ID NO: 495369 - protein, 9 aa, Homo Sapiens
TEDITYQQP

SEQ ID NO: 495370 - protein, 9 aa, Homo Sapiens
TYVVSHVPL

SEQ ID NO: 495371 - protein, 9 aa, Homo Sapiens
QALLQAIKD

SEQ ID NO: 495372 - protein, 9 aa, Homo Sapiens
NKVNKVISS

SEQ ID NO: 495373 - protein, 9 aa, Homo Sapiens
ALEQSNKTL

SEQ ID NO: 495374 - protein, 9 aa, Homo Sapiens
PELIRKGSY

SEQ ID NO: 495375 - protein, 9 aa, Homo Sapiens
DLLSWKATG

SEQ ID NO: 495376 - protein, 9 aa, Homo Sapiens
DELGSNKMI

SEQ ID NO: 495377 - protein, 9 aa, Homo Sapiens
CELFHEKMH

SEQ ID NO: 495378 - protein, 9 aa, Homo Sapiens
KSELPDSVP

SEQ ID NO: 495379 - protein, 9 aa, Homo Sapiens
YGWHHPLNW

SEQ ID NO: 495380 - protein, 9 aa, Homo Sapiens
LLGHVLPST

SEQ ID NO: 495381 - protein, 9 aa, Homo Sapiens
KPQGFRIEI

SEQ ID NO: 495382 - protein, 9 aa, Homo Sapiens
SRVIPKYCR

SEQ ID NO: 495383 - protein, 9 aa, Homo Sapiens
FTVADKDGK

SEQ ID NO: 495384 - protein, 9 aa, Homo Sapiens
TVADRPHIK

SEQ ID NO: 495385 - protein, 9 aa, Homo Sapiens
QLEVFLRLE

SEQ ID NO: 495386 - protein, 9 aa, Homo Sapiens
GEKIEMTPM

SEQ ID NO: 495387 - protein, 9 aa, Homo Sapiens
YKWDKFAYL

SEQ ID NO: 495388 - protein, 9 aa, Homo Sapiens
QGGGAGGRG

SEQ ID NO: 495389 - protein, 9 aa, Homo Sapiens
SRGRACPST

SEQ ID NO: 495390 - protein, 9 aa, Homo Sapiens
TAAETRGTG

SEQ ID NO: 495391 - protein, 9 aa, Homo Sapiens
KAAENSNLI

SEQ ID NO: 495392 - protein, 9 aa, Homo Sapiens
SNDFQMMIK

SEQ ID NO: 495393 - protein, 9 aa, Homo Sapiens
NLFTLTNYA

SEQ ID NO: 495394 - protein, 9 aa, Homo Sapiens
PSLKPPHPG

SEQ ID NO: 495395 - protein, 9 aa, Homo Sapiens
TRVGSRLLN

SEQ ID NO: 495396 - protein, 9 aa, Homo Sapiens
PATHSLNFL

SEQ ID NO: 495397 - protein, 9 aa, Homo Sapiens
VPCWVTVLS

SEQ ID NO: 495398 - protein, 9 aa, Homo Sapiens
QLLTILPKE

SEQ ID NO: 495399 - protein, 9 aa, Homo Sapiens
ESLNSVKYA

SEQ ID NO: 495400 - protein, 9 aa, Homo Sapiens
VIQNPFSSG

SEQ ID NO: 495401 - protein, 9 aa, Homo Sapiens
SHFFPSVVR

SEQ ID NO: 495402 - protein, 9 aa, Homo Sapiens
MSLIAQDHR

SEQ ID NO: 495403 - protein, 9 aa, Homo Sapiens
TGNMLDALA

SEQ ID NO: 495404 - protein, 9 aa, Homo Sapiens
WFLERGHKH

SEQ ID NO: 495405 - protein, 9 aa, Homo Sapiens
ELSNPSKTE

SEQ ID NO: 495406 - protein, 9 aa, Homo Sapiens
TEKMYSEPK

SEQ ID NO: 495407 - protein, 9 aa, Homo Sapiens
NFNSVDQHK

SEQ ID NO: 495408 - protein, 9 aa, Homo Sapiens
QAIAHLQKV

SEQ ID NO: 495409 - protein, 9 aa, Homo Sapiens
EISEINRMI

SEQ ID NO: 495410 - protein, 9 aa, Homo Sapiens
NKTLLALEG

SEQ ID NO: 495411 - protein, 9 aa, Homo Sapiens
KIPDKGDTT

SEQ ID NO: 495412 - protein, 9 aa, Homo Sapiens
TLTEGPGEC

SEQ ID NO: 495413 - protein, 9 aa, Homo Sapiens
FAYGISHHS

SEQ ID NO: 495414 - protein, 9 aa, Homo Sapiens
CFTNSQETK

SEQ ID NO: 495415 - protein, 9 aa, Homo Sapiens
MSMLTSTTS

SEQ ID NO: 495416 - protein, 9 aa, Homo Sapiens
HIEDKKLVR

SEQ ID NO: 495417 - protein, 9 aa, Homo Sapiens
IAFLYPYME

SEQ ID NO: 495418 - protein, 9 aa, Homo Sapiens
KSICKLAWQ

SEQ ID NO: 495419 - protein, 9 aa, Homo Sapiens
PRNSPSLKP

SEQ ID NO: 495420 - protein, 9 aa, Homo Sapiens
LTCAGPAPA

SEQ ID NO: 495421 - protein, 9 aa, Homo Sapiens
HVLLAAPPA

SEQ ID NO: 495422 - protein, 9 aa, Homo Sapiens
KTIAPCGAI

SEQ ID NO: 495423 - protein, 9 aa, Homo Sapiens
HIPKSIIKL

SEQ ID NO: 495424 - protein, 9 aa, Homo Sapiens
LSLRHCDSP

SEQ ID NO: 495425 - protein, 9 aa, Homo Sapiens
GNGCHKLMY

SEQ ID NO: 495426 - protein, 9 aa, Homo Sapiens
NALNKVNKV

SEQ ID NO: 495427 - protein, 9 aa, Homo Sapiens
KNISGFKTK

SEQ ID NO: 495428 - protein, 9 aa, Homo Sapiens
HCPSKCRLH

SEQ ID NO: 495429 - protein, 9 aa, Homo Sapiens
EEQEEEDGM

SEQ ID NO: 495430 - protein, 9 aa, Homo Sapiens
AQGEVFIGS

SEQ ID NO: 495431 - protein, 9 aa, Homo Sapiens
VPPERQESP

SEQ ID NO: 495432 - protein, 9 aa, Homo Sapiens
FFDLPDLLS

SEQ ID NO: 495433 - protein, 9 aa, Homo Sapiens
VDQHKNSYY

SEQ ID NO: 495434 - protein, 9 aa, Homo Sapiens
PSWGPLDEG

SEQ ID NO: 495435 - protein, 9 aa, Homo Sapiens
MKNFHQYSV

SEQ ID NO: 495436 - protein, 9 aa, Homo Sapiens
MISKQAALL

SEQ ID NO: 495437 - protein, 9 aa, Homo Sapiens
LAPLGISEK

SEQ ID NO: 495438 - protein, 9 aa, Homo Sapiens
SPRKKDRKN

SEQ ID NO: 495439 - protein, 9 aa, Homo Sapiens
ATLGYKIKF

SEQ ID NO: 495440 - protein, 9 aa, Homo Sapiens
GGLAAEGKY

SEQ ID NO: 495441 - protein, 9 aa, Homo Sapiens
EQAVWAVGN

SEQ ID NO: 495442 - protein, 9 aa, Homo Sapiens
LDLEGESVL

SEQ ID NO: 495443 - protein, 9 aa, Homo Sapiens
LFENIRKGS

SEQ ID NO: 495444 - protein, 9 aa, Homo Sapiens
SFTNKIPDK

SEQ ID NO: 495445 - protein, 9 aa, Homo Sapiens
EELTQRLLP

SEQ ID NO: 495446 - protein, 9 aa, Homo Sapiens
GLATLGYKI

SEQ ID NO: 495447 - protein, 9 aa, Homo Sapiens
TESAHSIEI

SEQ ID NO: 495448 - protein, 9 aa, Homo Sapiens
DRPKTRSQE

SEQ ID NO: 495449 - protein, 9 aa, Homo Sapiens
RSAVQQAPI

SEQ ID NO: 495450 - protein, 9 aa, Homo Sapiens
KYLRLWRKK

SEQ ID NO: 495451 - protein, 9 aa, Homo Sapiens
TENLWLSNV

SEQ ID NO: 495452 - protein, 9 aa, Homo Sapiens
LDSITSIKE

SEQ ID NO: 495453 - protein, 9 aa, Homo Sapiens
SYDLTAMTL

SEQ ID NO: 495454 - protein, 9 aa, Homo Sapiens
EEDDNHDDD

SEQ ID NO: 495455 - protein, 9 aa, Homo Sapiens
EESDQGEYE

SEQ ID NO: 495456 - protein, 9 aa, Homo Sapiens
PILSTRSLN

SEQ ID NO: 495457 - protein, 9 aa, Homo Sapiens
SNVTLILSV

SEQ ID NO: 495458 - protein, 9 aa, Homo Sapiens
LLAAAAAGR

SEQ ID NO: 495459 - protein, 9 aa, Homo Sapiens
GGDINAAIK

SEQ ID NO: 495460 - protein, 9 aa, Homo Sapiens
GPRNSPSLK

SEQ ID NO: 495461 - protein, 9 aa, Homo Sapiens
DPGPPGLCT

SEQ ID NO: 495462 - protein, 9 aa, Homo Sapiens
FPLRAERAQ

SEQ ID NO: 495463 - protein, 9 aa, Homo Sapiens
RHDVMADVH

SEQ ID NO: 495464 - protein, 9 aa, Homo Sapiens
TELLFASAS

SEQ ID NO: 495465 - protein, 9 aa, Homo Sapiens
KVVPIPKGS

SEQ ID NO: 495466 - protein, 9 aa, Homo Sapiens
KEEAMVVAV

SEQ ID NO: 495467 - protein, 9 aa, Homo Sapiens
FENIRKGSY

SEQ ID NO: 495468 - protein, 9 aa, Homo Sapiens
RVQHRSRAQ

SEQ ID NO: 495469 - protein, 9 aa, Homo Sapiens
ATENLWLSN

SEQ ID NO: 495470 - protein, 9 aa, Homo Sapiens
PRAASVRRR

SEQ ID NO: 495471 - protein, 9 aa, Homo Sapiens
PVGPTVSPR

SEQ ID NO: 495472 - protein, 9 aa, Homo Sapiens
KTAAEGTLR

SEQ ID NO: 495473 - protein, 9 aa, Homo Sapiens
WSLHCEGQT

SEQ ID NO: 495474 - protein, 9 aa, Homo Sapiens
HFNRKRLCK

SEQ ID NO: 495475 - protein, 9 aa, Homo Sapiens
CVDKYENEL

SEQ ID NO: 495476 - protein, 9 aa, Homo Sapiens
RPRGKRDKK

SEQ ID NO: 495477 - protein, 9 aa, Homo Sapiens
NYAYCVVST

SEQ ID NO: 495478 - protein, 9 aa, Homo Sapiens
EDIVGLHAF

SEQ ID NO: 495479 - protein, 9 aa, Homo Sapiens
YNLYRKDIK

SEQ ID NO: 495480 - protein, 9 aa, Homo Sapiens
KNAKRNYLN

SEQ ID NO: 495481 - protein, 9 aa, Homo Sapiens
ASEGMKSTV

SEQ ID NO: 495482 - protein, 9 aa, Homo Sapiens
SLLCIHNEE

SEQ ID NO: 495483 - protein, 9 aa, Homo Sapiens
DCSCTDNPL

SEQ ID NO: 495484 - protein, 9 aa, Homo Sapiens
LEQLLTILP

SEQ ID NO: 495485 - protein, 9 aa, Homo Sapiens
AAGVTRDFW

SEQ ID NO: 495486 - protein, 9 aa, Homo Sapiens
SACSQSSSV

SEQ ID NO: 495487 - protein, 9 aa, Homo Sapiens
GRTYQAWQQ

SEQ ID NO: 495488 - protein, 9 aa, Homo Sapiens
SGGPVAMGP

SEQ ID NO: 495489 - protein, 9 aa, Homo Sapiens
PKRDYEVNG

SEQ ID NO: 495490 - protein, 9 aa, Homo Sapiens
KCRGLQESS

SEQ ID NO: 495491 - protein, 9 aa, Homo Sapiens
IQFSIKLLY

SEQ ID NO: 495492 - protein, 9 aa, Homo Sapiens
AGVPRGEVL

SEQ ID NO: 495493 - protein, 9 aa, Homo Sapiens
SRTDSCSLA

SEQ ID NO: 495494 - protein, 9 aa, Homo Sapiens
RLRLKGGNP

SEQ ID NO: 495495 - protein, 9 aa, Homo Sapiens
YAYCVVSTS

SEQ ID NO: 495496 - protein, 9 aa, Homo Sapiens
LFVLACKDG

SEQ ID NO: 495497 - protein, 9 aa, Homo Sapiens
RAAVAMPSF

SEQ ID NO: 495498 - protein, 9 aa, Homo Sapiens
HLPGGVHYR

SEQ ID NO: 495499 - protein, 9 aa, Homo Sapiens
QGGLAAEGK

SEQ ID NO: 495500 - protein, 9 aa, Homo Sapiens
SQRKDLGRC

SEQ ID NO: 495501 - protein, 9 aa, Homo Sapiens
VSDMKFQAP

SEQ ID NO: 495502 - protein, 9 aa, Homo Sapiens
LRVWMCGGS

SEQ ID NO: 495503 - protein, 9 aa, Homo Sapiens
RTCIQFSIK

SEQ ID NO: 495504 - protein, 9 aa, Homo Sapiens
TECTLAVDL

SEQ ID NO: 495505 - protein, 9 aa, Homo Sapiens
PEKLKEVIS

SEQ ID NO: 495506 - protein, 9 aa, Homo Sapiens
PSWPGAQGV

SEQ ID NO: 495507 - protein, 9 aa, Homo Sapiens
LIEYYKWDK

SEQ ID NO: 495508 - protein, 9 aa, Homo Sapiens
FQPILKSYY

SEQ ID NO: 495509 - protein, 9 aa, Homo Sapiens
QCSSSKNPC

SEQ ID NO: 495510 - protein, 9 aa, Homo Sapiens
SAPGPLGQS

SEQ ID NO: 495511 - protein, 9 aa, Homo Sapiens
AASAMVRSQ

SEQ ID NO: 495512 - protein, 9 aa, Homo Sapiens
QEADGQCSV

SEQ ID NO: 495513 - protein, 9 aa, Homo Sapiens
CPYGSFVKK

SEQ ID NO: 495514 - protein, 9 aa, Homo Sapiens
SETKLTEKM

SEQ ID NO: 495515 - protein, 9 aa, Homo Sapiens
NGLNNTPRF

SEQ ID NO: 495516 - protein, 9 aa, Homo Sapiens
SEESDQGEY

SEQ ID NO: 495517 - protein, 9 aa, Homo Sapiens
EGMKSTVDL

SEQ ID NO: 495518 - protein, 9 aa, Homo Sapiens
EPPKASPKS

SEQ ID NO: 495519 - protein, 9 aa, Homo Sapiens
IFSEDTTLK

SEQ ID NO: 495520 - protein, 9 aa, Homo Sapiens
VLPSTHTEN

SEQ ID NO: 495521 - protein, 9 aa, Homo Sapiens
CPSVKHGDK

SEQ ID NO: 495522 - protein, 9 aa, Homo Sapiens
SESDSHDEH

SEQ ID NO: 495523 - protein, 9 aa, Homo Sapiens
GLGGLECLL

SEQ ID NO: 495524 - protein, 9 aa, Homo Sapiens
QKKLRFDVF

SEQ ID NO: 495525 - protein, 9 aa, Homo Sapiens
ELIRKGSYN

SEQ ID NO: 495526 - protein, 9 aa, Homo Sapiens
IKDLDGMDA

SEQ ID NO: 495527 - protein, 9 aa, Homo Sapiens
AHCLVQEEK

SEQ ID NO: 495528 - protein, 9 aa, Homo Sapiens
KSLAAEEQA

SEQ ID NO: 495529 - protein, 9 aa, Homo Sapiens
FTLTNYAYC

SEQ ID NO: 495530 - protein, 9 aa, Homo Sapiens
ACSESEVLE

SEQ ID NO: 495531 - protein, 9 aa, Homo Sapiens
VAVFSVFSV

SEQ ID NO: 495532 - protein, 9 aa, Homo Sapiens
CTPHQEDGK

SEQ ID NO: 495533 - protein, 9 aa, Homo Sapiens
VHERDRFSN

SEQ ID NO: 495534 - protein, 9 aa, Homo Sapiens
PSVGTEGLC

SEQ ID NO: 495535 - protein, 9 aa, Homo Sapiens
AVAQADPLV

SEQ ID NO: 495536 - protein, 9 aa, Homo Sapiens
SLSLRHCDS

SEQ ID NO: 495537 - protein, 9 aa, Homo Sapiens
AATLRLSAE

SEQ ID NO: 495538 - protein, 9 aa, Homo Sapiens
MPITRMRMK

SEQ ID NO: 495539 - protein, 9 aa, Homo Sapiens
KTESERKDE

SEQ ID NO: 495540 - protein, 9 aa, Homo Sapiens
LTPPKDPDS

SEQ ID NO: 495541 - protein, 9 aa, Homo Sapiens
VKKRSILIC

SEQ ID NO: 495542 - protein, 9 aa, Homo Sapiens
SLIEYYKWD

SEQ ID NO: 495543 - protein, 9 aa, Homo Sapiens
GKFKSGFSQ

SEQ ID NO: 495544 - protein, 9 aa, Homo Sapiens
CDIKEERKI

SEQ ID NO: 495545 - protein, 9 aa, Homo Sapiens
YPLRSCALN

SEQ ID NO: 495546 - protein, 9 aa, Homo Sapiens
GSIASPFVH

SEQ ID NO: 495547 - protein, 9 aa, Homo Sapiens
MKPGGVLIL

SEQ ID NO: 495548 - protein, 9 aa, Homo Sapiens
HPFSITPGI

SEQ ID NO: 495549 - protein, 9 aa, Homo Sapiens
GGGPLSDFY

SEQ ID NO: 495550 - protein, 9 aa, Homo Sapiens
SRLLNGSAE

SEQ ID NO: 495551 - protein, 9 aa, Homo Sapiens
SDDDANSNA

SEQ ID NO: 495552 - protein, 9 aa, Homo Sapiens
HFQNKHPNM

SEQ ID NO: 495553 - protein, 9 aa, Homo Sapiens
ADGQCSVDR

SEQ ID NO: 495554 - protein, 9 aa, Homo Sapiens
QLQGSQLRQ

SEQ ID NO: 495555 - protein, 9 aa, Homo Sapiens
ASCLCCQQS

SEQ ID NO: 495556 - protein, 9 aa, Homo Sapiens
RILAPVLIL

SEQ ID NO: 495557 - protein, 9 aa, Homo Sapiens
RELEYESGS

SEQ ID NO: 495558 - protein, 9 aa, Homo Sapiens
MMPSSACKA

SEQ ID NO: 495559 - protein, 9 aa, Homo Sapiens
IFIAVLKIP

SEQ ID NO: 495560 - protein, 9 aa, Homo Sapiens
WGIQGRWIK

SEQ ID NO: 495561 - protein, 9 aa, Homo Sapiens
SPPPELPDS

SEQ ID NO: 495562 - protein, 9 aa, Homo Sapiens
RFSNFLLTK

SEQ ID NO: 495563 - protein, 9 aa, Homo Sapiens
AKRIARERE

SEQ ID NO: 495564 - protein, 9 aa, Homo Sapiens
DLNTPALKK

SEQ ID NO: 495565 - protein, 9 aa, Homo Sapiens
EKLKEVISL

SEQ ID NO: 495566 - protein, 9 aa, Homo Sapiens
EPHSLTAVA

SEQ ID NO: 495567 - protein, 9 aa, Homo Sapiens
DETPPESPT

SEQ ID NO: 495568 - protein, 9 aa, Homo Sapiens
VLGFKIHPV

SEQ ID NO: 495569 - protein, 9 aa, Homo Sapiens
NAAIKRLLG

SEQ ID NO: 495570 - protein, 9 aa, Homo Sapiens
KRNYLNVLP

SEQ ID NO: 495571 - protein, 9 aa, Homo Sapiens
QYRELFEEN

SEQ ID NO: 495572 - protein, 9 aa, Homo Sapiens
HEFQRQERH

SEQ ID NO: 495573 - protein, 9 aa, Homo Sapiens
IPQFLCDIK

SEQ ID NO: 495574 - protein, 9 aa, Homo Sapiens
GHMEEGASP

SEQ ID NO: 495575 - protein, 9 aa, Homo Sapiens
GEASEDTPE

SEQ ID NO: 495576 - protein, 9 aa, Homo Sapiens
SCPKGYQLI

SEQ ID NO: 495577 - protein, 9 aa, Homo Sapiens
NMLSHQLVS

SEQ ID NO: 495578 - protein, 9 aa, Homo Sapiens
GEDKEEAMV

SEQ ID NO: 495579 - protein, 9 aa, Homo Sapiens
PYGSFVKKI

SEQ ID NO: 495580 - protein, 9 aa, Homo Sapiens
VCELFHEKM

SEQ ID NO: 495581 - protein, 9 aa, Homo Sapiens
ELDPTALQE

SEQ ID NO: 495582 - protein, 9 aa, Homo Sapiens
LDPTALQEE

SEQ ID NO: 495583 - protein, 9 aa, Homo Sapiens
TNFKEVCDE

SEQ ID NO: 495584 - protein, 9 aa, Homo Sapiens
VQHRSRAQR

SEQ ID NO: 495585 - protein, 9 aa, Homo Sapiens
YNLILKKYR

SEQ ID NO: 495586 - protein, 9 aa, Homo Sapiens
INELKQQPI

SEQ ID NO: 495587 - protein, 9 aa, Homo Sapiens
CSTFHSSLS

SEQ ID NO: 495588 - protein, 9 aa, Homo Sapiens
IPGIYGILG

SEQ ID NO: 495589 - protein, 9 aa, Homo Sapiens
GILGDLGAI

SEQ ID NO: 495590 - protein, 9 aa, Homo Sapiens
SQVLTREEW

SEQ ID NO: 495591 - protein, 9 aa, Homo Sapiens
GPPGLCTPH

SEQ ID NO: 495592 - protein, 9 aa, Homo Sapiens
KNAIMFGNK

SEQ ID NO: 495593 - protein, 9 aa, Homo Sapiens
ALPLTMNSL

SEQ ID NO: 495594 - protein, 9 aa, Homo Sapiens
EMKPQGFRI

SEQ ID NO: 495595 - protein, 9 aa, Homo Sapiens
KLLQYGHME

SEQ ID NO: 495596 - protein, 9 aa, Homo Sapiens
HTGEKPYKM

SEQ ID NO: 495597 - protein, 9 aa, Homo Sapiens
FQLSNVTLI

SEQ ID NO: 495598 - protein, 9 aa, Homo Sapiens
GGQREGEGK

SEQ ID NO: 495599 - protein, 9 aa, Homo Sapiens
AIYEEESRH

SEQ ID NO: 495600 - protein, 9 aa, Homo Sapiens
SLRAQLELP

SEQ ID NO: 495601 - protein, 9 aa, Homo Sapiens
QLGHGDTNR

SEQ ID NO: 495602 - protein, 9 aa, Homo Sapiens
SGTDSTITF

SEQ ID NO: 495603 - protein, 9 aa, Homo Sapiens
KLIHPKLVK

SEQ ID NO: 495604 - protein, 9 aa, Homo Sapiens
DWKLIESND

SEQ ID NO: 495605 - protein, 9 aa, Homo Sapiens
DELGLLLSL

SEQ ID NO: 495606 - protein, 9 aa, Homo Sapiens
KMISKQAAL

SEQ ID NO: 495607 - protein, 9 aa, Homo Sapiens
VHKAAENSN

SEQ ID NO: 495608 - protein, 9 aa, Homo Sapiens
GFKTKAKLV

SEQ ID NO: 495609 - protein, 9 aa, Homo Sapiens
LASESARII

SEQ ID NO: 495610 - protein, 9 aa, Homo Sapiens
EDDNHDDDV

SEQ ID NO: 495611 - protein, 9 aa, Homo Sapiens
QNPKYELII

SEQ ID NO: 495612 - protein, 9 aa, Homo Sapiens
EYNLDHTDS

SEQ ID NO: 495613 - protein, 9 aa, Homo Sapiens
TAQHAKNGH

SEQ ID NO: 495614 - protein, 9 aa, Homo Sapiens
ESAHSIEIY

SEQ ID NO: 495615 - protein, 9 aa, Homo Sapiens
NSQETKKIS

SEQ ID NO: 495616 - protein, 9 aa, Homo Sapiens
QKLVEEGEP

SEQ ID NO: 495617 - protein, 9 aa, Homo Sapiens
DPAGPNGHL

SEQ ID NO: 495618 - protein, 9 aa, Homo Sapiens
DEDAHDSQA

SEQ ID NO: 495619 - protein, 9 aa, Homo Sapiens
LSNVFIEES

SEQ ID NO: 495620 - protein, 9 aa, Homo Sapiens
ELLLRQKLH

SEQ ID NO: 495621 - protein, 9 aa, Homo Sapiens
SNPPTLASE

SEQ ID NO: 495622 - protein, 9 aa, Homo Sapiens
LGSPIELIF

SEQ ID NO: 495623 - protein, 9 aa, Homo Sapiens
QCSYPSAID

SEQ ID NO: 495624 - protein, 9 aa, Homo Sapiens
SDTVIWNKV

SEQ ID NO: 495625 - protein, 9 aa, Homo Sapiens
AAVPDGFPV

SEQ ID NO: 495626 - protein, 9 aa, Homo Sapiens
GAPPERYLS

SEQ ID NO: 495627 - protein, 9 aa, Homo Sapiens
LHMQESAHK

SEQ ID NO: 495628 - protein, 9 aa, Homo Sapiens
TVADKDGKA

SEQ ID NO: 495629 - protein, 9 aa, Homo Sapiens
VRSLAKNGM

SEQ ID NO: 495630 - protein, 9 aa, Homo Sapiens
LELDPTALQ

SEQ ID NO: 495631 - protein, 9 aa, Homo Sapiens
NDDKTKNAK

SEQ ID NO: 495632 - protein, 9 aa, Homo Sapiens
VLSFVCALV

SEQ ID NO: 495633 - protein, 9 aa, Homo Sapiens
LTKMGDVAC

SEQ ID NO: 495634 - protein, 9 aa, Homo Sapiens
LLLLLWALP

SEQ ID NO: 495635 - protein, 9 aa, Homo Sapiens
NMLDALANA

SEQ ID NO: 495636 - protein, 9 aa, Homo Sapiens
PGKFKSGFS

SEQ ID NO: 495637 - protein, 9 aa, Homo Sapiens
PESPTRALP

SEQ ID NO: 495638 - protein, 9 aa, Homo Sapiens
WCVDKYENE

SEQ ID NO: 495639 - protein, 9 aa, Homo Sapiens
NVTLILSVY

SEQ ID NO: 495640 - protein, 9 aa, Homo Sapiens
MCQQEQTSY

SEQ ID NO: 495641 - protein, 9 aa, Homo Sapiens
GDIRTLHPF

SEQ ID NO: 495642 - protein, 9 aa, Homo Sapiens
GRAKSPGVP

SEQ ID NO: 495643 - protein, 9 aa, Homo Sapiens
SLCKSVKAE

SEQ ID NO: 495644 - protein, 9 aa, Homo Sapiens
EDAHDSQAK

SEQ ID NO: 495645 - protein, 9 aa, Homo Sapiens
FPVGPTVSP

SEQ ID NO: 495646 - protein, 9 aa, Homo Sapiens
LENQKNCSV

SEQ ID NO: 495647 - protein, 9 aa, Homo Sapiens
FAHPFSITP

SEQ ID NO: 495648 - protein, 9 aa, Homo Sapiens
GVQARNLFA

SEQ ID NO: 495649 - protein, 9 aa, Homo Sapiens
YKLTFELLG

SEQ ID NO: 495650 - protein, 9 aa, Homo Sapiens
HVLSELDMM

SEQ ID NO: 495651 - protein, 9 aa, Homo Sapiens
DQAVVKICI

SEQ ID NO: 495652 - protein, 9 aa, Homo Sapiens
SNDTILEST

SEQ ID NO: 495653 - protein, 9 aa, Homo Sapiens
LTSESDSHD

SEQ ID NO: 495654 - protein, 9 aa, Homo Sapiens
GVFVAGYKS

SEQ ID NO: 495655 - protein, 9 aa, Homo Sapiens
MMKLIHPKL

SEQ ID NO: 495656 - protein, 9 aa, Homo Sapiens
SAHSIEIYV

SEQ ID NO: 495657 - protein, 9 aa, Homo Sapiens
DPVLTVEQK

SEQ ID NO: 495658 - protein, 9 aa, Homo Sapiens
DHDEDEGEE

SEQ ID NO: 495659 - protein, 9 aa, Homo Sapiens
SMLTSTTSA

SEQ ID NO: 495660 - protein, 9 aa, Homo Sapiens
ECITAGHFQ

SEQ ID NO: 495661 - protein, 9 aa, Homo Sapiens
TNKIPDKGD

SEQ ID NO: 495662 - protein, 9 aa, Homo Sapiens
SKKHHPHSG

SEQ ID NO: 495663 - protein, 9 aa, Homo Sapiens
SRKMCQQEQ

SEQ ID NO: 495664 - protein, 9 aa, Homo Sapiens
KYQLHKDGV

SEQ ID NO: 495665 - protein, 9 aa, Homo Sapiens
YSDDDANSN

SEQ ID NO: 495666 - protein, 9 aa, Homo Sapiens
ERGHKHITV

SEQ ID NO: 495667 - protein, 9 aa, Homo Sapiens
ETKCRGLQE

SEQ ID NO: 495668 - protein, 9 aa, Homo Sapiens
GDLLTEELT

SEQ ID NO: 495669 - protein, 9 aa, Homo Sapiens
FTAKSSFQT

SEQ ID NO: 495670 - protein, 9 aa, Homo Sapiens
EWIKNWEKL

SEQ ID NO: 495671 - protein, 9 aa, Homo Sapiens
DLPLINSLI

SEQ ID NO: 495672 - protein, 9 aa, Homo Sapiens
VGEKIEMTP

SEQ ID NO: 495673 - protein, 9 aa, Homo Sapiens
HDVMADVHT

SEQ ID NO: 495674 - protein, 9 aa, Homo Sapiens
GVHYRTNIQ

SEQ ID NO: 495675 - protein, 9 aa, Homo Sapiens
GFHEVNGPR

SEQ ID NO: 495676 - protein, 9 aa, Homo Sapiens
TLTNYAYCV

SEQ ID NO: 495677 - protein, 9 aa, Homo Sapiens
RDRFSNFLL

SEQ ID NO: 495678 - protein, 9 aa, Homo Sapiens
DVMADVHTF

SEQ ID NO: 495679 - protein, 9 aa, Homo Sapiens
CYPLRSCAL

SEQ ID NO: 495680 - protein, 9 aa, Homo Sapiens
SHHSSAFHD

SEQ ID NO: 495681 - protein, 9 aa, Homo Sapiens
ISCFTNSQE

SEQ ID NO: 495682 - protein, 9 aa, Homo Sapiens
IHPVEKLQE

SEQ ID NO: 495683 - protein, 9 aa, Homo Sapiens
ESSVLQELG

SEQ ID NO: 495684 - protein, 9 aa, Homo Sapiens
FLAGVPRGE

SEQ ID NO: 495685 - protein, 9 aa, Homo Sapiens
ELFEENGSL

SEQ ID NO: 495686 - protein, 9 aa, Homo Sapiens
VSKPLPKQL

SEQ ID NO: 495687 - protein, 9 aa, Homo Sapiens
YKMWRLWQS

SEQ ID NO: 495688 - protein, 9 aa, Homo Sapiens
FASASHGAI

SEQ ID NO: 495689 - protein, 9 aa, Homo Sapiens
LGSNKMIKL

SEQ ID NO: 495690 - protein, 9 aa, Homo Sapiens
QSNKTLLAL

SEQ ID NO: 495691 - protein, 9 aa, Homo Sapiens
KLEREEEAL

SEQ ID NO: 495692 - protein, 9 aa, Homo Sapiens
KGKEYLACI

SEQ ID NO: 495693 - protein, 9 aa, Homo Sapiens
GHKHITVFV

SEQ ID NO: 495694 - protein, 9 aa, Homo Sapiens
AEEDDLDCS

SEQ ID NO: 495695 - protein, 9 aa, Homo Sapiens
KSKARYLVC

SEQ ID NO: 495696 - protein, 9 aa, Homo Sapiens
NPFSSGGSP

SEQ ID NO: 495697 - protein, 9 aa, Homo Sapiens
IRKGSYNPV

SEQ ID NO: 495698 - protein, 9 aa, Homo Sapiens
CRISSWRNS

SEQ ID NO: 495699 - protein, 9 aa, Homo Sapiens
TQGWGRTYQ

SEQ ID NO: 495700 - protein, 9 aa, Homo Sapiens
KLQLVTGTN

SEQ ID NO: 495701 - protein, 9 aa, Homo Sapiens
TQNFIRMAV

SEQ ID NO: 495702 - protein, 9 aa, Homo Sapiens
KSTVDLHQK

SEQ ID NO: 495703 - protein, 9 aa, Homo Sapiens
AGPAPASCQ

SEQ ID NO: 495704 - protein, 9 aa, Homo Sapiens
YFIPIMEDG

SEQ ID NO: 495705 - protein, 9 aa, Homo Sapiens
KGFINDDHD

SEQ ID NO: 495706 - protein, 9 aa, Homo Sapiens
EVINSLEMF

SEQ ID NO: 495707 - protein, 9 aa, Homo Sapiens
GSGGFTLLL

SEQ ID NO: 495708 - protein, 9 aa, Homo Sapiens
NGFHFLAGV

SEQ ID NO: 495709 - protein, 9 aa, Homo Sapiens
FVAGIGPDG

SEQ ID NO: 495710 - protein, 9 aa, Homo Sapiens
AIMFGNKRH

SEQ ID NO: 495711 - protein, 9 aa, Homo Sapiens
DTPEVPGLG

SEQ ID NO: 495712 - protein, 9 aa, Homo Sapiens
ESNDTILES

SEQ ID NO: 495713 - protein, 9 aa, Homo Sapiens
STRSLNGLV

SEQ ID NO: 495714 - protein, 9 aa, Homo Sapiens
RESSRPRGK

SEQ ID NO: 495715 - protein, 9 aa, Homo Sapiens
TVEDIAAQE

SEQ ID NO: 495716 - protein, 9 aa, Homo Sapiens
PPKDPDSQP

SEQ ID NO: 495717 - protein, 9 aa, Homo Sapiens
QGWGRTYQA

SEQ ID NO: 495718 - protein, 9 aa, Homo Sapiens
PILYNLILK

SEQ ID NO: 495719 - protein, 9 aa, Homo Sapiens
LVGNGCLGS

SEQ ID NO: 495720 - protein, 9 aa, Homo Sapiens
CHKLMYLDL

SEQ ID NO: 495721 - protein, 9 aa, Homo Sapiens
KGERISAPK

SEQ ID NO: 495722 - protein, 9 aa, Homo Sapiens
VEQKYPYMV

SEQ ID NO: 495723 - protein, 9 aa, Homo Sapiens
NKEAEELAR

SEQ ID NO: 495724 - protein, 9 aa, Homo Sapiens
KQQLDKCLK

SEQ ID NO: 495725 - protein, 9 aa, Homo Sapiens
RMQESQKTA

SEQ ID NO: 495726 - protein, 9 aa, Homo Sapiens
AVPDGFPVG

SEQ ID NO: 495727 - protein, 9 aa, Homo Sapiens
FVLACKDGW

SEQ ID NO: 495728 - protein, 9 aa, Homo Sapiens
GAIYFIPIM

SEQ ID NO: 495729 - protein, 9 aa, Homo Sapiens
VADRPHIKK

SEQ ID NO: 495730 - protein, 9 aa, Homo Sapiens
QRFFKVLLL

SEQ ID NO: 495731 - protein, 9 aa, Homo Sapiens
NLWLSNVFI

SEQ ID NO: 495732 - protein, 9 aa, Homo Sapiens
KIAFTHGAS

SEQ ID NO: 495733 - protein, 9 aa, Homo Sapiens
FLDHEPPLS

SEQ ID NO: 495734 - protein, 9 aa, Homo Sapiens
MMDDRPKTR

SEQ ID NO: 495735 - protein, 9 aa, Homo Sapiens
ERDRFSNFL

SEQ ID NO: 495736 - protein, 9 aa, Homo Sapiens
SLTQCSYPS

SEQ ID NO: 495737 - protein, 9 aa, Homo Sapiens
FTNSQETKK

SEQ ID NO: 495738 - protein, 9 aa, Homo Sapiens
PLDAFAQGE

SEQ ID NO: 495739 - protein, 9 aa, Homo Sapiens
NTIDLRVLE

SEQ ID NO: 495740 - protein, 9 aa, Homo Sapiens
PPLSPLLAS

SEQ ID NO: 495741 - protein, 9 aa, Homo Sapiens
GNKNIRATE

SEQ ID NO: 495742 - protein, 9 aa, Homo Sapiens
VLYMLTKMG

SEQ ID NO: 495743 - protein, 9 aa, Homo Sapiens
ESAPGPLGQ

SEQ ID NO: 495744 - protein, 9 aa, Homo Sapiens
RYHQAYAHL

SEQ ID NO: 495745 - protein, 9 aa, Homo Sapiens
ERAHGEELD

SEQ ID NO: 495746 - protein, 9 aa, Homo Sapiens
PVAMGPGSL

SEQ ID NO: 495747 - protein, 9 aa, Homo Sapiens
HERDRFSNF

SEQ ID NO: 495748 - protein, 9 aa, Homo Sapiens
LELGAGPSG

SEQ ID NO: 495749 - protein, 9 aa, Homo Sapiens
EKVVPIPKG

SEQ ID NO: 495750 - protein, 9 aa, Homo Sapiens
ACCQFLESQ

SEQ ID NO: 495751 - protein, 9 aa, Homo Sapiens
GDTNRVEAP

SEQ ID NO: 495752 - protein, 9 aa, Homo Sapiens
IYQVSTHKQ

SEQ ID NO: 495753 - protein, 9 aa, Homo Sapiens
KFVSKNGPG

SEQ ID NO: 495754 - protein, 9 aa, Homo Sapiens
FPELIRKGS

SEQ ID NO: 495755 - protein, 9 aa, Homo Sapiens
RWELEEAAL

SEQ ID NO: 495756 - protein, 9 aa, Homo Sapiens
TQSTTELLF

SEQ ID NO: 495757 - protein, 9 aa, Homo Sapiens
SSGDIRTLH

SEQ ID NO: 495758 - protein, 9 aa, Homo Sapiens
PPPELPDSV

SEQ ID NO: 495759 - protein, 9 aa, Homo Sapiens
GDKWGEPSR

SEQ ID NO: 495760 - protein, 9 aa, Homo Sapiens
STVDLHQKL

SEQ ID NO: 495761 - protein, 9 aa, Homo Sapiens
EVKEPRHGN

SEQ ID NO: 495762 - protein, 9 aa, Homo Sapiens
VILMYPILS

SEQ ID NO: 495763 - protein, 9 aa, Homo Sapiens
TLSYDLTAM

SEQ ID NO: 495764 - protein, 9 aa, Homo Sapiens
IVPPERQES

SEQ ID NO: 495765 - protein, 9 aa, Homo Sapiens
AQFDSSRQS

SEQ ID NO: 495766 - protein, 9 aa, Homo Sapiens
QVKGNKNIR

SEQ ID NO: 495767 - protein, 9 aa, Homo Sapiens
SEDTTLKWD

SEQ ID NO: 495768 - protein, 9 aa, Homo Sapiens
IAAQEDLDK

SEQ ID NO: 495769 - protein, 9 aa, Homo Sapiens
HKLMYLDLS

SEQ ID NO: 495770 - protein, 9 aa, Homo Sapiens
DCIHIPKSI

SEQ ID NO: 495771 - protein, 9 aa, Homo Sapiens
CHRFQSSDY

SEQ ID NO: 495772 - protein, 9 aa, Homo Sapiens
VISDFGLSI

SEQ ID NO: 495773 - protein, 9 aa, Homo Sapiens
LHPTEDPMP

SEQ ID NO: 495774 - protein, 9 aa, Homo Sapiens
SAKAPAEED

SEQ ID NO: 495775 - protein, 9 aa, Homo Sapiens
SGFSQVSMF

SEQ ID NO: 495776 - protein, 9 aa, Homo Sapiens
GVGLVTLTE

SEQ ID NO: 495777 - protein, 9 aa, Homo Sapiens
RLLNGSAEF

SEQ ID NO: 495778 - protein, 9 aa, Homo Sapiens
EEDIVGLHA

SEQ ID NO: 495779 - protein, 9 aa, Homo Sapiens
LAAAYYSRD

SEQ ID NO: 495780 - protein, 9 aa, Homo Sapiens
QEDSEEEEV

SEQ ID NO: 495781 - protein, 9 aa, Homo Sapiens
SSNSDSSNS

SEQ ID NO: 495782 - protein, 9 aa, Homo Sapiens
VDMLTYVVS

SEQ ID NO: 495783 - protein, 9 aa, Homo Sapiens
PTDWSDDQS

SEQ ID NO: 495784 - protein, 9 aa, Homo Sapiens
RNLFAQIAG

SEQ ID NO: 495785 - protein, 9 aa, Homo Sapiens
IAVNICYGW

SEQ ID NO: 495786 - protein, 9 aa, Homo Sapiens
AVESGNKKA

SEQ ID NO: 495787 - protein, 9 aa, Homo Sapiens
PFVHPATPI

SEQ ID NO: 495788 - protein, 9 aa, Homo Sapiens
TCIQFSIKL

SEQ ID NO: 495789 - protein, 9 aa, Homo Sapiens
LPGGVHYRT

SEQ ID NO: 495790 - protein, 9 aa, Homo Sapiens
ENMEHNEQK

SEQ ID NO: 495791 - protein, 9 aa, Homo Sapiens
NTPTSSVPL

SEQ ID NO: 495792 - protein, 9 aa, Homo Sapiens
KWPGCQTLC

SEQ ID NO: 495793 - protein, 9 aa, Homo Sapiens
ESRGAIYFI

SEQ ID NO: 495794 - protein, 9 aa, Homo Sapiens
NRMQESQKT

SEQ ID NO: 495795 - protein, 9 aa, Homo Sapiens
FKTKAKLVG

SEQ ID NO: 495796 - protein, 9 aa, Homo Sapiens
QRTQTNVIN

SEQ ID NO: 495797 - protein, 9 aa, Homo Sapiens
YQVKGNKNI

SEQ ID NO: 495798 - protein, 9 aa, Homo Sapiens
AKGVIHKDL

SEQ ID NO: 495799 - protein, 9 aa, Homo Sapiens
EKVDLPLIN

SEQ ID NO: 495800 - protein, 9 aa, Homo Sapiens
YLGSIASPF

SEQ ID NO: 495801 - protein, 9 aa, Homo Sapiens
PGKKFVFDF

SEQ ID NO: 495802 - protein, 9 aa, Homo Sapiens
EGEVGEKIE

SEQ ID NO: 495803 - protein, 9 aa, Homo Sapiens
RWGIQGRWI

SEQ ID NO: 495804 - protein, 9 aa, Homo Sapiens
NDDWKLIES

SEQ ID NO: 495805 - protein, 9 aa, Homo Sapiens
KVHHKTEFG

SEQ ID NO: 495806 - protein, 9 aa, Homo Sapiens
ERISAPKRE

SEQ ID NO: 495807 - protein, 9 aa, Homo Sapiens
KYENELAGS

SEQ ID NO: 495808 - protein, 9 aa, Homo Sapiens
QLDKCLKLS

SEQ ID NO: 495809 - protein, 9 aa, Homo Sapiens
IIAFLYPYM

SEQ ID NO: 495810 - protein, 9 aa, Homo Sapiens
PHGCCLYSG

SEQ ID NO: 495811 - protein, 9 aa, Homo Sapiens
RFFCRISSW

SEQ ID NO: 495812 - protein, 9 aa, Homo Sapiens
LSHSPRKKD

SEQ ID NO: 495813 - protein, 9 aa, Homo Sapiens
QFSIKLLYF

SEQ ID NO: 495814 - protein, 9 aa, Homo Sapiens
AGVTRDFWV

SEQ ID NO: 495815 - protein, 9 aa, Homo Sapiens
KVARECRIL

SEQ ID NO: 495816 - protein, 9 aa, Homo Sapiens
LNENIKKDE

SEQ ID NO: 495817 - protein, 9 aa, Homo Sapiens
FVCELFHEK

SEQ ID NO: 495818 - protein, 9 aa, Homo Sapiens
DTVIWNKVH

SEQ ID NO: 495819 - protein, 9 aa, Homo Sapiens
LNGLVKNIP

SEQ ID NO: 495820 - protein, 9 aa, Homo Sapiens
LERGHKHIT

SEQ ID NO: 495821 - protein, 9 aa, Homo Sapiens
TLLLAAAAA

SEQ ID NO: 495822 - protein, 9 aa, Homo Sapiens
KRLCKLIKK

SEQ ID NO: 495823 - protein, 9 aa, Homo Sapiens
NTPALKKRV

SEQ ID NO: 495824 - protein, 9 aa, Homo Sapiens
NISGFKTKA

SEQ ID NO: 495825 - protein, 9 aa, Homo Sapiens
ALDLDTGSN

SEQ ID NO: 495826 - protein, 9 aa, Homo Sapiens
ATSQYPYSE

SEQ ID NO: 495827 - protein, 9 aa, Homo Sapiens
VCALVVCFP

SEQ ID NO: 495828 - protein, 9 aa, Homo Sapiens
GHLAGAKGG

SEQ ID NO: 495829 - protein, 9 aa, Homo Sapiens
ELSPEKLKE

SEQ ID NO: 495830 - protein, 9 aa, Homo Sapiens
SITSIKEMT

SEQ ID NO: 495831 - protein, 9 aa, Homo Sapiens
SGSGTEAKT

SEQ ID NO: 495832 - protein, 9 aa, Homo Sapiens
DKEEAMVVA

SEQ ID NO: 495833 - protein, 9 aa, Homo Sapiens
QKLEREEEA

SEQ ID NO: 495834 - protein, 9 aa, Homo Sapiens
SHVLGTRQS

SEQ ID NO: 495835 - protein, 9 aa, Homo Sapiens
PLRAERAQS

SEQ ID NO: 495836 - protein, 9 aa, Homo Sapiens
RWRGRAKSP

SEQ ID NO: 495837 - protein, 9 aa, Homo Sapiens
YPSAIDPEA

SEQ ID NO: 495838 - protein, 9 aa, Homo Sapiens
MSCGFHEVN

SEQ ID NO: 495839 - protein, 9 aa, Homo Sapiens
TPSWSLHCE

SEQ ID NO: 495840 - protein, 9 aa, Homo Sapiens
HKHITVFVP

SEQ ID NO: 495841 - protein, 9 aa, Homo Sapiens
PPPQKIPSI

SEQ ID NO: 495842 - protein, 9 aa, Homo Sapiens
KLRFDVFQE

SEQ ID NO: 495843 - protein, 9 aa, Homo Sapiens
QQYRSLTRH

SEQ ID NO: 495844 - protein, 9 aa, Homo Sapiens
ARNLFAQIA

SEQ ID NO: 495845 - protein, 9 aa, Homo Sapiens
SREKRERCR

SEQ ID NO: 495846 - protein, 9 aa, Homo Sapiens
RQSLDESHQ

SEQ ID NO: 495847 - protein, 9 aa, Homo Sapiens
NLGSPIELI

SEQ ID NO: 495848 - protein, 9 aa, Homo Sapiens
HCEGQTRSY

SEQ ID NO: 495849 - protein, 9 aa, Homo Sapiens
ADGSECFQD

SEQ ID NO: 495850 - protein, 9 aa, Homo Sapiens
PKYCRALEE

SEQ ID NO: 495851 - protein, 9 aa, Homo Sapiens
CCERVRTYW

SEQ ID NO: 495852 - protein, 9 aa, Homo Sapiens
HDIRTEMDK

SEQ ID NO: 495853 - protein, 9 aa, Homo Sapiens
RVGSRLLNG

SEQ ID NO: 495854 - protein, 9 aa, Homo Sapiens
PDLLSWKAT

SEQ ID NO: 495855 - protein, 9 aa, Homo Sapiens
IPSIRPFKQ

SEQ ID NO: 495856 - protein, 9 aa, Homo Sapiens
SPLGFSGEE

SEQ ID NO: 495857 - protein, 9 aa, Homo Sapiens
SSACHDVNQ

SEQ ID NO: 495858 - protein, 9 aa, Homo Sapiens
IRTEMDKIR

SEQ ID NO: 495859 - protein, 9 aa, Homo Sapiens
WRVEHVQHV

SEQ ID NO: 495860 - protein, 9 aa, Homo Sapiens
KALEFPILE

SEQ ID NO: 495861 - protein, 9 aa, Homo Sapiens
SAEGTVTFE

SEQ ID NO: 495862 - protein, 9 aa, Homo Sapiens
PVHRVHLPQ

SEQ ID NO: 495863 - protein, 9 aa, Homo Sapiens
HERDAIYEE

SEQ ID NO: 495864 - protein, 9 aa, Homo Sapiens
HGDKWGEPS

SEQ ID NO: 495865 - protein, 9 aa, Homo Sapiens
SEFFVDGLH

SEQ ID NO: 495866 - protein, 9 aa, Homo Sapiens
ILVRQCKSL

SEQ ID NO: 495867 - protein, 9 aa, Homo Sapiens
VKGNKNIRA

SEQ ID NO: 495868 - protein, 9 aa, Homo Sapiens
SLLPRASKP

SEQ ID NO: 495869 - protein, 9 aa, Homo Sapiens
FEAGVTSKF

SEQ ID NO: 495870 - protein, 9 aa, Homo Sapiens
GGFTLLLAA

SEQ ID NO: 495871 - protein, 9 aa, Homo Sapiens
KRLLGSQPS

SEQ ID NO: 495872 - protein, 9 aa, Homo Sapiens
WALPPSRAA

SEQ ID NO: 495873 - protein, 9 aa, Homo Sapiens
NIEMEAASS

SEQ ID NO: 495874 - protein, 9 aa, Homo Sapiens
LWLSNVFIE

SEQ ID NO: 495875 - protein, 9 aa, Homo Sapiens
LSKNYEETA

SEQ ID NO: 495876 - protein, 9 aa, Homo Sapiens
GQGTFCSFD

SEQ ID NO: 495877 - protein, 9 aa, Homo Sapiens
TPLWVTQPH

SEQ ID NO: 495878 - protein, 9 aa, Homo Sapiens
GAQVFQAGN

SEQ ID NO: 495879 - protein, 9 aa, Homo Sapiens
KGTGCRALV

SEQ ID NO: 495880 - protein, 9 aa, Homo Sapiens
LMYLDLSGC

SEQ ID NO: 495881 - protein, 9 aa, Homo Sapiens
TVFSQVLTR

SEQ ID NO: 495882 - protein, 9 aa, Homo Sapiens
TCAGPAPAS

SEQ ID NO: 495883 - protein, 9 aa, Homo Sapiens
LGSIASPFV

SEQ ID NO: 495884 - protein, 9 aa, Homo Sapiens
KSPGVPVAK

SEQ ID NO: 495885 - protein, 9 aa, Homo Sapiens
ICSRHFWTI

SEQ ID NO: 495886 - protein, 9 aa, Homo Sapiens
REGEIPQFL

SEQ ID NO: 495887 - protein, 9 aa, Homo Sapiens
QEEEKQSLL

SEQ ID NO: 495888 - protein, 9 aa, Homo Sapiens
QGTKRWLEY

SEQ ID NO: 495889 - protein, 9 aa, Homo Sapiens
LQLVTGTNV

SEQ ID NO: 495890 - protein, 9 aa, Homo Sapiens
QSEESDQGE

SEQ ID NO: 495891 - protein, 9 aa, Homo Sapiens
NHDDDVSTE

SEQ ID NO: 495892 - protein, 9 aa, Homo Sapiens
RTEMDKIRK

SEQ ID NO: 495893 - protein, 9 aa, Homo Sapiens
FPVRHGKIK

SEQ ID NO: 495894 - protein, 9 aa, Homo Sapiens
LLNVSKPLP

SEQ ID NO: 495895 - protein, 9 aa, Homo Sapiens
HEPPLSPLL

SEQ ID NO: 495896 - protein, 9 aa, Homo Sapiens
LSAEGTVTF

SEQ ID NO: 495897 - protein, 9 aa, Homo Sapiens
PGEQPQGGG

SEQ ID NO: 495898 - protein, 9 aa, Homo Sapiens
HGDTNRVEA

SEQ ID NO: 495899 - protein, 9 aa, Homo Sapiens
AVIQNPFSS

SEQ ID NO: 495900 - protein, 9 aa, Homo Sapiens
IRELQRQKL

SEQ ID NO: 495901 - protein, 9 aa, Homo Sapiens
SVATHNIEM

SEQ ID NO: 495902 - protein, 9 aa, Homo Sapiens
QEAQKNWDV

SEQ ID NO: 495903 - protein, 9 aa, Homo Sapiens
SFPLAYPPP

SEQ ID NO: 495904 - protein, 9 aa, Homo Sapiens
AAYYSRDSL

SEQ ID NO: 495905 - protein, 9 aa, Homo Sapiens
AEKNGTIWF

SEQ ID NO: 495906 - protein, 9 aa, Homo Sapiens
LAGPKGSRR

SEQ ID NO: 495907 - protein, 9 aa, Homo Sapiens
IQGRWIKQD

SEQ ID NO: 495908 - protein, 9 aa, Homo Sapiens
GASCLCCQQ

SEQ ID NO: 495909 - protein, 9 aa, Homo Sapiens
NEDKTIAPC

SEQ ID NO: 495910 - protein, 9 aa, Homo Sapiens
NFLLTKLRD

SEQ ID NO: 495911 - protein, 9 aa, Homo Sapiens
ELEKYKEKC

SEQ ID NO: 495912 - protein, 9 aa, Homo Sapiens
VQILAEGWA

SEQ ID NO: 495913 - protein, 9 aa, Homo Sapiens
SSEKSELPD

SEQ ID NO: 495914 - protein, 9 aa, Homo Sapiens
LYPYMEGAS

SEQ ID NO: 495915 - protein, 9 aa, Homo Sapiens
PSRGRACPS

SEQ ID NO: 495916 - protein, 9 aa, Homo Sapiens
RAKSPGVPV

SEQ ID NO: 495917 - protein, 9 aa, Homo Sapiens
DKEVINSLE

SEQ ID NO: 495918 - protein, 9 aa, Homo Sapiens
QLGTAPKIA

SEQ ID NO: 495919 - protein, 9 aa, Homo Sapiens
HGRWRGRAK

SEQ ID NO: 495920 - protein, 9 aa, Homo Sapiens
TAISCFTNS

SEQ ID NO: 495921 - protein, 9 aa, Homo Sapiens
LECLLLAVM

SEQ ID NO: 495922 - protein, 9 aa, Homo Sapiens
PKALKLVGM

SEQ ID NO: 495923 - protein, 9 aa, Homo Sapiens
MKPWLEMQI

SEQ ID NO: 495924 - protein, 9 aa, Homo Sapiens
FNGIIPLES

SEQ ID NO: 495925 - protein, 9 aa, Homo Sapiens
IFPLKMALD

SEQ ID NO: 495926 - protein, 9 aa, Homo Sapiens
LTAMTLDLY

SEQ ID NO: 495927 - protein, 9 aa, Homo Sapiens
HKIVLGIQT

SEQ ID NO: 495928 - protein, 9 aa, Homo Sapiens
GEGKEKLSL

SEQ ID NO: 495929 - protein, 9 aa, Homo Sapiens
EVPGLGSGG

SEQ ID NO: 495930 - protein, 9 aa, Homo Sapiens
EGEGKEKLS

SEQ ID NO: 495931 - protein, 9 aa, Homo Sapiens
PPGLCTPHQ

SEQ ID NO: 495932 - protein, 9 aa, Homo Sapiens
NSDSSNSSD

SEQ ID NO: 495933 - protein, 9 aa, Homo Sapiens
LISESKYWQ

SEQ ID NO: 495934 - protein, 9 aa, Homo Sapiens
EASELLHFI

SEQ ID NO: 495935 - protein, 9 aa, Homo Sapiens
GLSKLPSWP

SEQ ID NO: 495936 - protein, 9 aa, Homo Sapiens
SSRSAIRHC

SEQ ID NO: 495937 - protein, 9 aa, Homo Sapiens
CRGLQESSH

SEQ ID NO: 495938 - protein, 9 aa, Homo Sapiens
VKCGAGRNI

SEQ ID NO: 495939 - protein, 9 aa, Homo Sapiens
PRQKKALEF

SEQ ID NO: 495940 - protein, 9 aa, Homo Sapiens
RMRMKPWLE

SEQ ID NO: 495941 - protein, 9 aa, Homo Sapiens
LPAGTYAHT

SEQ ID NO: 495942 - protein, 9 aa, Homo Sapiens
VKHGDKWGE

SEQ ID NO: 495943 - protein, 9 aa, Homo Sapiens
LSLPPACSE

SEQ ID NO: 495944 - protein, 9 aa, Homo Sapiens
LRLSAEGTV

SEQ ID NO: 495945 - protein, 9 aa, Homo Sapiens
LSQPQPWTQ

SEQ ID NO: 495946 - protein, 9 aa, Homo Sapiens
FDLPDLLSW

SEQ ID NO: 495947 - protein, 9 aa, Homo Sapiens
QEGGGQSQL

SEQ ID NO: 495948 - protein, 9 aa, Homo Sapiens
VVTQSAKAP

SEQ ID NO: 495949 - protein, 9 aa, Homo Sapiens
ASLAPLGIS

SEQ ID NO: 495950 - protein, 9 aa, Homo Sapiens
SQAKVASLR

SEQ ID NO: 495951 - protein, 9 aa, Homo Sapiens
KLTCAGPAP

SEQ ID NO: 495952 - protein, 9 aa, Homo Sapiens
TMMKLIHPK

SEQ ID NO: 495953 - protein, 9 aa, Homo Sapiens
KDKSWKVAK

SEQ ID NO: 495954 - protein, 9 aa, Homo Sapiens
EPHSPSDLF

SEQ ID NO: 495955 - protein, 9 aa, Homo Sapiens
PTSSVPLAA

SEQ ID NO: 495956 - protein, 9 aa, Homo Sapiens
ICGLLYIIG

SEQ ID NO: 495957 - protein, 9 aa, Homo Sapiens
EEGEDKEEA

SEQ ID NO: 495958 - protein, 9 aa, Homo Sapiens
KDLGRCESL

SEQ ID NO: 495959 - protein, 9 aa, Homo Sapiens
CSQSSSVNS

SEQ ID NO: 495960 - protein, 9 aa, Homo Sapiens
GEQPQGGGA

SEQ ID NO: 495961 - protein, 9 aa, Homo Sapiens
KGVFVAGYK

SEQ ID NO: 495962 - protein, 9 aa, Homo Sapiens
FPLKMALDL

SEQ ID NO: 495963 - protein, 9 aa, Homo Sapiens
IAFTHGASL

SEQ ID NO: 495964 - protein, 9 aa, Homo Sapiens
LIHPKLVKF

SEQ ID NO: 495965 - protein, 9 aa, Homo Sapiens
LYENQTPLW

SEQ ID NO: 495966 - protein, 9 aa, Homo Sapiens
HNEQKEQKS

SEQ ID NO: 495967 - protein, 9 aa, Homo Sapiens
PATGNMLDA

SEQ ID NO: 495968 - protein, 9 aa, Homo Sapiens
SQGDLSHSP

SEQ ID NO: 495969 - protein, 9 aa, Homo Sapiens
SCLCCQQSS

SEQ ID NO: 495970 - protein, 9 aa, Homo Sapiens
CMLEMATSQ

SEQ ID NO: 495971 - protein, 9 aa, Homo Sapiens
LATLGYKIK

SEQ ID NO: 495972 - protein, 9 aa, Homo Sapiens
ETPPESPTR

SEQ ID NO: 495973 - protein, 9 aa, Homo Sapiens
RCESLRVVC

SEQ ID NO: 495974 - protein, 9 aa, Homo Sapiens
NQKNCSVPL

SEQ ID NO: 495975 - protein, 9 aa, Homo Sapiens
TIWFYDLLA

SEQ ID NO: 495976 - protein, 9 aa, Homo Sapiens
TATFVCELF

SEQ ID NO: 495977 - protein, 9 aa, Homo Sapiens
VGNIAGDST

SEQ ID NO: 495978 - protein, 9 aa, Homo Sapiens
TVRAANSET

SEQ ID NO: 495979 - protein, 9 aa, Homo Sapiens
DQITDLPSN

SEQ ID NO: 495980 - protein, 9 aa, Homo Sapiens
DKTKNAKRN

SEQ ID NO: 495981 - protein, 9 aa, Homo Sapiens
PWCYTTHPE

SEQ ID NO: 495982 - protein, 9 aa, Homo Sapiens
GLCGPPFCH

SEQ ID NO: 495983 - protein, 9 aa, Homo Sapiens
FQAGNVPSE

SEQ ID NO: 495984 - protein, 9 aa, Homo Sapiens
KSETKLTEK

SEQ ID NO: 495985 - protein, 9 aa, Homo Sapiens
YVMAANIFE

SEQ ID NO: 495986 - protein, 9 aa, Homo Sapiens
ESRSCRDKY

SEQ ID NO: 495987 - protein, 9 aa, Homo Sapiens
TVDLHQKLG

SEQ ID NO: 495988 - protein, 9 aa, Homo Sapiens
GDINAAIKR

SEQ ID NO: 495989 - protein, 9 aa, Homo Sapiens
ALLGLRKLS

SEQ ID NO: 495990 - protein, 9 aa, Homo Sapiens
NENSLFKSK

SEQ ID NO: 495991 - protein, 9 aa, Homo Sapiens
LGRCESLRV

SEQ ID NO: 495992 - protein, 9 aa, Homo Sapiens
KARYLVCRK

SEQ ID NO: 495993 - protein, 9 aa, Homo Sapiens
PVLTVEQKY

SEQ ID NO: 495994 - protein, 9 aa, Homo Sapiens
HDDDVSTEY

SEQ ID NO: 495995 - protein, 9 aa, Homo Sapiens
LQSDLAGPK

SEQ ID NO: 495996 - protein, 9 aa, Homo Sapiens
QEEEDGMRL

SEQ ID NO: 495997 - protein, 9 aa, Homo Sapiens
KLAWQPKSG

SEQ ID NO: 495998 - protein, 9 aa, Homo Sapiens
ASDLWYCPY

SEQ ID NO: 495999 - protein, 9 aa, Homo Sapiens
LPPSRAAQP

SEQ ID NO: 496000 - protein, 9 aa, Homo Sapiens
SAMVRSQAS

SEQ ID NO: 496001 - protein, 9 aa, Homo Sapiens
TLQNPKYEL

SEQ ID NO: 496002 - protein, 9 aa, Homo Sapiens
EITCCERVR

SEQ ID NO: 496003 - protein, 9 aa, Homo Sapiens
AAPPAHQLH

SEQ ID NO: 496004 - protein, 9 aa, Homo Sapiens
EGEIPQFLC

SEQ ID NO: 496005 - protein, 9 aa, Homo Sapiens
LFYPQRFFK

SEQ ID NO: 496006 - protein, 9 aa, Homo Sapiens
VFVAGYKSL

SEQ ID NO: 496007 - protein, 9 aa, Homo Sapiens
PGCQTLCED

SEQ ID NO: 496008 - protein, 9 aa, Homo Sapiens
KRPKALKLV

SEQ ID NO: 496009 - protein, 9 aa, Homo Sapiens
SETVAKLVF

SEQ ID NO: 496010 - protein, 9 aa, Homo Sapiens
CAGPAPASC

SEQ ID NO: 496011 - protein, 9 aa, Homo Sapiens
GLRYHQAYA

SEQ ID NO: 496012 - protein, 9 aa, Homo Sapiens
FHEKMHVVW

SEQ ID NO: 496013 - protein, 9 aa, Homo Sapiens
SPSLKPPHP

SEQ ID NO: 496014 - protein, 9 aa, Homo Sapiens
ALELMAMYV

SEQ ID NO: 496015 - protein, 9 aa, Homo Sapiens
IKRLLGSQP

SEQ ID NO: 496016 - protein, 9 aa, Homo Sapiens
GLCTPHQED

SEQ ID NO: 496017 - protein, 9 aa, Homo Sapiens
INDDHDEDE

SEQ ID NO: 496018 - protein, 9 aa, Homo Sapiens
DRETLQNPK

SEQ ID NO: 496019 - protein, 9 aa, Homo Sapiens
DIKEERKIK

SEQ ID NO: 496020 - protein, 9 aa, Homo Sapiens
YTTHPEKRY

SEQ ID NO: 496021 - protein, 9 aa, Homo Sapiens
LRNCCNTKN

SEQ ID NO: 496022 - protein, 9 aa, Homo Sapiens
RAIETLMKN

SEQ ID NO: 496023 - protein, 9 aa, Homo Sapiens
KQSESAHGR

SEQ ID NO: 496024 - protein, 9 aa, Homo Sapiens
HEVNGPRAS

SEQ ID NO: 496025 - protein, 9 aa, Homo Sapiens
TQTNVINVP

SEQ ID NO: 496026 - protein, 9 aa, Homo Sapiens
CSESEVLEE

SEQ ID NO: 496027 - protein, 9 aa, Homo Sapiens
AAETRGTGE

SEQ ID NO: 496028 - protein, 9 aa, Homo Sapiens
HSSDFDTQS

SEQ ID NO: 496029 - protein, 9 aa, Homo Sapiens
SGAATGFLK

SEQ ID NO: 496030 - protein, 9 aa, Homo Sapiens
KQACCQFLE

SEQ ID NO: 496031 - protein, 9 aa, Homo Sapiens
LIGGAGNAR

SEQ ID NO: 496032 - protein, 9 aa, Homo Sapiens
VVYKRSAVQ

SEQ ID NO: 496033 - protein, 9 aa, Homo Sapiens
PGPLGQSVA

SEQ ID NO: 496034 - protein, 9 aa, Homo Sapiens
KLIESNDTI

SEQ ID NO: 496035 - protein, 9 aa, Homo Sapiens
YPDCKLSSG

SEQ ID NO: 496036 - protein, 9 aa, Homo Sapiens
LENLGEASL

SEQ ID NO: 496037 - protein, 9 aa, Homo Sapiens
LLENQKNCS

SEQ ID NO: 496038 - protein, 9 aa, Homo Sapiens
LENDEDAAQ

SEQ ID NO: 496039 - protein, 9 aa, Homo Sapiens
NCEVKEPRH

SEQ ID NO: 496040 - protein, 9 aa, Homo Sapiens
TFFSKTGNG

SEQ ID NO: 496041 - protein, 9 aa, Homo Sapiens
RSAIRHCPS

SEQ ID NO: 496042 - protein, 9 aa, Homo Sapiens
PHIKKATQA

SEQ ID NO: 496043 - protein, 9 aa, Homo Sapiens
PPESPTRAL

SEQ ID NO: 496044 - protein, 9 aa, Homo Sapiens
LEMATSQYP

SEQ ID NO: 496045 - protein, 9 aa, Homo Sapiens
PQGFRIEIK

SEQ ID NO: 496046 - protein, 9 aa, Homo Sapiens
SHDEHPFPG

SEQ ID NO: 496047 - protein, 9 aa, Homo Sapiens
LKWDSCAAH

SEQ ID NO: 496048 - protein, 9 aa, Homo Sapiens
LNFLYGTMV

SEQ ID NO: 496049 - protein, 9 aa, Homo Sapiens
TINKKDHTL

SEQ ID NO: 496050 - protein, 9 aa, Homo Sapiens
LNTPALKKR

SEQ ID NO: 496051 - protein, 9 aa, Homo Sapiens
EQVTNFKEV

SEQ ID NO: 496052 - protein, 9 aa, Homo Sapiens
HITVFVPAW

SEQ ID NO: 496053 - protein, 9 aa, Homo Sapiens
LLSWKATGV

SEQ ID NO: 496054 - protein, 9 aa, Homo Sapiens
NIKKDELKK

SEQ ID NO: 496055 - protein, 9 aa, Homo Sapiens
QLSPLGFSG

SEQ ID NO: 496056 - protein, 9 aa, Homo Sapiens
KGGGQGGDP

SEQ ID NO: 496057 - protein, 9 aa, Homo Sapiens
SKARYLVCR

SEQ ID NO: 496058 - protein, 9 aa, Homo Sapiens
MLTYVVSHV

SEQ ID NO: 496059 - protein, 9 aa, Homo Sapiens
GYEGANMGF

SEQ ID NO: 496060 - protein, 9 aa, Homo Sapiens
LMSMLTSTT

SEQ ID NO: 496061 - protein, 9 aa, Homo Sapiens
YTKSVATHN

SEQ ID NO: 496062 - protein, 9 aa, Homo Sapiens
CSCTDNPLL

SEQ ID NO: 496063 - protein, 9 aa, Homo Sapiens
GIQTSCDDT

SEQ ID NO: 496064 - protein, 9 aa, Homo Sapiens
SEASELLHF

SEQ ID NO: 496065 - protein, 9 aa, Homo Sapiens
KPEEMMDDR

SEQ ID NO: 496066 - protein, 9 aa, Homo Sapiens
FNRKRLCKL

SEQ ID NO: 496067 - protein, 9 aa, Homo Sapiens
NSPSLKPPH

SEQ ID NO: 496068 - protein, 9 aa, Homo Sapiens
DSTITFPTL

SEQ ID NO: 496069 - protein, 9 aa, Homo Sapiens
YGSCSTFHS

SEQ ID NO: 496070 - protein, 9 aa, Homo Sapiens
SLLDETPPE

SEQ ID NO: 496071 - protein, 9 aa, Homo Sapiens
RGAIYFIPI

SEQ ID NO: 496072 - protein, 9 aa, Homo Sapiens
PRFPQNTID

SEQ ID NO: 496073 - protein, 9 aa, Homo Sapiens
FLEAHCLVQ

SEQ ID NO: 496074 - protein, 9 aa, Homo Sapiens
EGIRIEKSA

SEQ ID NO: 496075 - protein, 9 aa, Homo Sapiens
TVPGNGFAH

SEQ ID NO: 496076 - protein, 9 aa, Homo Sapiens
VEQVTNFKE

SEQ ID NO: 496077 - protein, 9 aa, Homo Sapiens
PSNDFQMMI

SEQ ID NO: 496078 - protein, 9 aa, Homo Sapiens
CESLRVVCR

SEQ ID NO: 496079 - protein, 9 aa, Homo Sapiens
SWKVAKIMM

SEQ ID NO: 496080 - protein, 9 aa, Homo Sapiens
LFTINKKDH

SEQ ID NO: 496081 - protein, 9 aa, Homo Sapiens
VDEDAHDSQ

SEQ ID NO: 496082 - protein, 9 aa, Homo Sapiens
EIDPSSGDI

SEQ ID NO: 496083 - protein, 9 aa, Homo Sapiens
LGFKIHPVE

SEQ ID NO: 496084 - protein, 9 aa, Homo Sapiens
VRHGKIKLS

SEQ ID NO: 496085 - protein, 9 aa, Homo Sapiens
GDLNTPALK

SEQ ID NO: 496086 - protein, 9 aa, Homo Sapiens
VTGWRETPG

SEQ ID NO: 496087 - protein, 9 aa, Homo Sapiens
GEIPQFLCD

SEQ ID NO: 496088 - protein, 9 aa, Homo Sapiens
EENPPGDLN

SEQ ID NO: 496089 - protein, 9 aa, Homo Sapiens
ENFELSLRV

SEQ ID NO: 496090 - protein, 9 aa, Homo Sapiens
IHPKLVKFY

SEQ ID NO: 496091 - protein, 9 aa, Homo Sapiens
ARILAPVLI

SEQ ID NO: 496092 - protein, 9 aa, Homo Sapiens
RSQASANLG

SEQ ID NO: 496093 - protein, 9 aa, Homo Sapiens
GKTMSCQGR

SEQ ID NO: 496094 - protein, 9 aa, Homo Sapiens
QQLDKCLKL

SEQ ID NO: 496095 - protein, 9 aa, Homo Sapiens
VELTAAETR

SEQ ID NO: 496096 - protein, 9 aa, Homo Sapiens
ITAGHFQNK

SEQ ID NO: 496097 - protein, 9 aa, Homo Sapiens
SYLRIFIAV

SEQ ID NO: 496098 - protein, 9 aa, Homo Sapiens
WRGRAKSPG

SEQ ID NO: 496099 - protein, 9 aa, Homo Sapiens
LDRETLQNP

SEQ ID NO: 496100 - protein, 9 aa, Homo Sapiens
FSKTGNGKH

SEQ ID NO: 496101 - protein, 9 aa, Homo Sapiens
PMDCIHIPK

SEQ ID NO: 496102 - protein, 9 aa, Homo Sapiens
TTTRVQHAL

SEQ ID NO: 496103 - protein, 9 aa, Homo Sapiens
LFTDGGEEK

SEQ ID NO: 496104 - protein, 9 aa, Homo Sapiens
DKDTEITCC

SEQ ID NO: 496105 - protein, 9 aa, Homo Sapiens
KESPATHSL

SEQ ID NO: 496106 - protein, 9 aa, Homo Sapiens
VEDIAAQED

SEQ ID NO: 496107 - protein, 9 aa, Homo Sapiens
TIDLRVLES

SEQ ID NO: 496108 - protein, 9 aa, Homo Sapiens
DCKLSSGNI

SEQ ID NO: 496109 - protein, 9 aa, Homo Sapiens
NRKRLCKLI

SEQ ID NO: 496110 - protein, 9 aa, Homo Sapiens
LKIISRYLR

SEQ ID NO: 496111 - protein, 9 aa, Homo Sapiens
INAKSICKL

SEQ ID NO: 496112 - protein, 9 aa, Homo Sapiens
CGVGLVTLT

SEQ ID NO: 496113 - protein, 9 aa, Homo Sapiens
FPVSFPLAY

SEQ ID NO: 496114 - protein, 9 aa, Homo Sapiens
ESRKHIEDK

SEQ ID NO: 496115 - protein, 9 aa, Homo Sapiens
MPCACGQEH

SEQ ID NO: 496116 - protein, 9 aa, Homo Sapiens
HPTEDPMPC

SEQ ID NO: 496117 - protein, 9 aa, Homo Sapiens
TPEGDWQRQ

SEQ ID NO: 496118 - protein, 9 aa, Homo Sapiens
LQNPKYELI

SEQ ID NO: 496119 - protein, 9 aa, Homo Sapiens
TIGIVPPER

SEQ ID NO: 496120 - protein, 9 aa, Homo Sapiens
INENMEHNE

SEQ ID NO: 496121 - protein, 9 aa, Homo Sapiens
FKEVCDEIK

SEQ ID NO: 496122 - protein, 9 aa, Homo Sapiens
HAKGVIHKD

SEQ ID NO: 496123 - protein, 9 aa, Homo Sapiens
LSRKMCQQE

SEQ ID NO: 496124 - protein, 9 aa, Homo Sapiens
WRETPGPTK

SEQ ID NO: 496125 - protein, 9 aa, Homo Sapiens
EIHNEPEER

SEQ ID NO: 496126 - protein, 9 aa, Homo Sapiens
FCRISSWRN

SEQ ID NO: 496127 - protein, 9 aa, Homo Sapiens
FPQNTIDLR

SEQ ID NO: 496128 - protein, 9 aa, Homo Sapiens
HSPSDLFPM

SEQ ID NO: 496129 - protein, 9 aa, Homo Sapiens
LIVAHSNPG

SEQ ID NO: 496130 - protein, 9 aa, Homo Sapiens
AKQKKLRFD

SEQ ID NO: 496131 - protein, 9 aa, Homo Sapiens
EQLLTILPK

SEQ ID NO: 496132 - protein, 9 aa, Homo Sapiens
TYGQTGDTT

SEQ ID NO: 496133 - protein, 9 aa, Homo Sapiens
SVDRSLLKL

SEQ ID NO: 496134 - protein, 9 aa, Homo Sapiens
GGGQSQLSS

SEQ ID NO: 496135 - protein, 9 aa, Homo Sapiens
EDKEEAMVV

SEQ ID NO: 496136 - protein, 9 aa, Homo Sapiens
LHFESIQTY

SEQ ID NO: 496137 - protein, 9 aa, Homo Sapiens
ALRWTRQKL

SEQ ID NO: 496138 - protein, 9 aa, Homo Sapiens
IYFIPIMED

SEQ ID NO: 496139 - protein, 9 aa, Homo Sapiens
GGVSLSLRH

SEQ ID NO: 496140 - protein, 9 aa, Homo Sapiens
CHDVNQCSS

SEQ ID NO: 496141 - protein, 9 aa, Homo Sapiens
SRASGVTGW

SEQ ID NO: 496142 - protein, 9 aa, Homo Sapiens
NSINELKQQ

SEQ ID NO: 496143 - protein, 9 aa, Homo Sapiens
RRSIPGAAE

SEQ ID NO: 496144 - protein, 9 aa, Homo Sapiens
VINAKSICK

SEQ ID NO: 496145 - protein, 9 aa, Homo Sapiens
IHLPGGVHY

SEQ ID NO: 496146 - protein, 9 aa, Homo Sapiens
TAVAQADPL

SEQ ID NO: 496147 - protein, 9 aa, Homo Sapiens
MSLFVLACK

SEQ ID NO: 496148 - protein, 9 aa, Homo Sapiens
RYLSLPGSL

SEQ ID NO: 496149 - protein, 9 aa, Homo Sapiens
MDCIHIPKS

SEQ ID NO: 496150 - protein, 9 aa, Homo Sapiens
ALQEEEKQS

SEQ ID NO: 496151 - protein, 9 aa, Homo Sapiens
FLIVAHSNP

SEQ ID NO: 496152 - protein, 9 aa, Homo Sapiens
FAQGEVFIG

SEQ ID NO: 496153 - protein, 9 aa, Homo Sapiens
TPPESPTRA

SEQ ID NO: 496154 - protein, 9 aa, Homo Sapiens
QSGYEGANM

SEQ ID NO: 496155 - protein, 9 aa, Homo Sapiens
GGENFELSL

SEQ ID NO: 496156 - protein, 9 aa, Homo Sapiens
DKTIAPCGA

SEQ ID NO: 496157 - protein, 9 aa, Homo Sapiens
PDCKLSSGN

SEQ ID NO: 496158 - protein, 9 aa, Homo Sapiens
WTLPNNTEE

SEQ ID NO: 496159 - protein, 9 aa, Homo Sapiens
NVQLELAQV

SEQ ID NO: 496160 - protein, 9 aa, Homo Sapiens
TNRVEAPRL

SEQ ID NO: 496161 - protein, 9 aa, Homo Sapiens
QGTFCSFDT

SEQ ID NO: 496162 - protein, 9 aa, Homo Sapiens
EGDWQRQWM

SEQ ID NO: 496163 - protein, 9 aa, Homo Sapiens
WNKVHHKTE

SEQ ID NO: 496164 - protein, 9 aa, Homo Sapiens
ECQLEVFLR

SEQ ID NO: 496165 - protein, 9 aa, Homo Sapiens
SSVPLAAVT

SEQ ID NO: 496166 - protein, 9 aa, Homo Sapiens
NGCHKLMYL

SEQ ID NO: 496167 - protein, 9 aa, Homo Sapiens
ILHAGFKMI

SEQ ID NO: 496168 - protein, 9 aa, Homo Sapiens
ECFQDPEKS

SEQ ID NO: 496169 - protein, 9 aa, Homo Sapiens
VVSHVPLGV

SEQ ID NO: 496170 - protein, 9 aa, Homo Sapiens
SDTEGLAQK

SEQ ID NO: 496171 - protein, 9 aa, Homo Sapiens
GLQCKHEFQ

SEQ ID NO: 496172 - protein, 9 aa, Homo Sapiens
MWRLWQSFQ

SEQ ID NO: 496173 - protein, 9 aa, Homo Sapiens
KSSFQTHIR

SEQ ID NO: 496174 - protein, 9 aa, Homo Sapiens
KNKEAEELA

SEQ ID NO: 496175 - protein, 9 aa, Homo Sapiens
QTMMKLIHP

SEQ ID NO: 496176 - protein, 9 aa, Homo Sapiens
NGFAHPFSI

SEQ ID NO: 496177 - protein, 9 aa, Homo Sapiens
HSIEIYVPE

SEQ ID NO: 496178 - protein, 9 aa, Homo Sapiens
SKTGNGKHV

SEQ ID NO: 496179 - protein, 9 aa, Homo Sapiens
DIRTLHPFW

SEQ ID NO: 496180 - protein, 9 aa, Homo Sapiens
KVNKVISSV

SEQ ID NO: 496181 - protein, 9 aa, Homo Sapiens
CGAGRNIGD

SEQ ID NO: 496182 - protein, 9 aa, Homo Sapiens
DLEGESVLE

SEQ ID NO: 496183 - protein, 9 aa, Homo Sapiens
LLLLWALPP

SEQ ID NO: 496184 - protein, 9 aa, Homo Sapiens
GPLSDFYSG

SEQ ID NO: 496185 - protein, 9 aa, Homo Sapiens
SSRPRGKRD

SEQ ID NO: 496186 - protein, 9 aa, Homo Sapiens
SRKHIEDKK

SEQ ID NO: 496187 - protein, 9 aa, Homo Sapiens
PTVQEDSEE

SEQ ID NO: 496188 - protein, 9 aa, Homo Sapiens
IRLTGNRLV

SEQ ID NO: 496189 - protein, 9 aa, Homo Sapiens
VKPEEMMDD

SEQ ID NO: 496190 - protein, 9 aa, Homo Sapiens
YGQTGDTTR

SEQ ID NO: 496191 - protein, 9 aa, Homo Sapiens
EKLGRGEFL

SEQ ID NO: 496192 - protein, 9 aa, Homo Sapiens
LGQSVAPIP

SEQ ID NO: 496193 - protein, 9 aa, Homo Sapiens
VGNGCLGSV

SEQ ID NO: 496194 - protein, 9 aa, Homo Sapiens
VTQSAKAPA

SEQ ID NO: 496195 - protein, 9 aa, Homo Sapiens
PGNKVSDMK

SEQ ID NO: 496196 - protein, 9 aa, Homo Sapiens
KAKLVGLEP

SEQ ID NO: 496197 - protein, 9 aa, Homo Sapiens
PQGGGAGGR

SEQ ID NO: 496198 - protein, 9 aa, Homo Sapiens
CIQFSIKLL

SEQ ID NO: 496199 - protein, 9 aa, Homo Sapiens
SILICSRHF

SEQ ID NO: 496200 - protein, 9 aa, Homo Sapiens
KKLRFDVFQ

SEQ ID NO: 496201 - protein, 9 aa, Homo Sapiens
KSAFLEAHC

SEQ ID NO: 496202 - protein, 9 aa, Homo Sapiens
CLCCQQSSC

SEQ ID NO: 496203 - protein, 9 aa, Homo Sapiens
NIVQYRELF

SEQ ID NO: 496204 - protein, 9 aa, Homo Sapiens
PGLCTPHQE

SEQ ID NO: 496205 - protein, 9 aa, Homo Sapiens
HLMPNLGSP

SEQ ID NO: 496206 - protein, 9 aa, Homo Sapiens
YTTVADRPH

SEQ ID NO: 496207 - protein, 9 aa, Homo Sapiens
PKDKSWKVA

SEQ ID NO: 496208 - protein, 9 aa, Homo Sapiens
WHESAKGKE

SEQ ID NO: 496209 - protein, 9 aa, Homo Sapiens
MSCQGRGRG

SEQ ID NO: 496210 - protein, 9 aa, Homo Sapiens
YYSRDSLGW

SEQ ID NO: 496211 - protein, 9 aa, Homo Sapiens
HGRLETTYG

SEQ ID NO: 496212 - protein, 9 aa, Homo Sapiens
KTHSEADYK

SEQ ID NO: 496213 - protein, 9 aa, Homo Sapiens
NVSKPLPKQ

SEQ ID NO: 496214 - protein, 9 aa, Homo Sapiens
TAAGVTRDF

SEQ ID NO: 496215 - protein, 9 aa, Homo Sapiens
GEASLQPSP

SEQ ID NO: 496216 - protein, 9 aa, Homo Sapiens
LQYGHMEEG

SEQ ID NO: 496217 - protein, 9 aa, Homo Sapiens
GILPTCQPT

SEQ ID NO: 496218 - protein, 9 aa, Homo Sapiens
FTNKIPDKG

SEQ ID NO: 496219 - protein, 9 aa, Homo Sapiens
VCACATLRE

SEQ ID NO: 496220 - protein, 9 aa, Homo Sapiens
THKQSESAH

SEQ ID NO: 496221 - protein, 9 aa, Homo Sapiens
DMYKLTFEL

SEQ ID NO: 496222 - protein, 9 aa, Homo Sapiens
EFFVDGLHS

SEQ ID NO: 496223 - protein, 9 aa, Homo Sapiens
GENFELSLR

SEQ ID NO: 496224 - protein, 9 aa, Homo Sapiens
RTMSLIAQD

SEQ ID NO: 496225 - protein, 9 aa, Homo Sapiens
AKSICKLAW

SEQ ID NO: 496226 - protein, 9 aa, Homo Sapiens
GDPSEKLQL

SEQ ID NO: 496227 - protein, 9 aa, Homo Sapiens
KEVNCLKSE

SEQ ID NO: 496228 - protein, 9 aa, Homo Sapiens
DMLTYVVSH

SEQ ID NO: 496229 - protein, 9 aa, Homo Sapiens
SNFLLTKLR

SEQ ID NO: 496230 - protein, 9 aa, Homo Sapiens
IKNWEKLGR

SEQ ID NO: 496231 - protein, 9 aa, Homo Sapiens
HLKTLKCLS

SEQ ID NO: 496232 - protein, 9 aa, Homo Sapiens
YIFSEDTTL

SEQ ID NO: 496233 - protein, 9 aa, Homo Sapiens
ILYNLILKK

SEQ ID NO: 496234 - protein, 9 aa, Homo Sapiens
ELGSNKMIK

SEQ ID NO: 496235 - protein, 9 aa, Homo Sapiens
APVTGMCYP

SEQ ID NO: 496236 - protein, 9 aa, Homo Sapiens
FFSKTGNGK

SEQ ID NO: 496237 - protein, 9 aa, Homo Sapiens
ACKDGWVDI

SEQ ID NO: 496238 - protein, 9 aa, Homo Sapiens
VPRGEVLDN

SEQ ID NO: 496239 - protein, 9 aa, Homo Sapiens
QPQGGGAGG

SEQ ID NO: 496240 - protein, 9 aa, Homo Sapiens
ESGNKKAEI

SEQ ID NO: 496241 - protein, 9 aa, Homo Sapiens
SRSAIRHCP

SEQ ID NO: 496242 - protein, 9 aa, Homo Sapiens
SFQTHIRIH

SEQ ID NO: 496243 - protein, 9 aa, Homo Sapiens
SIRLTGNRL

SEQ ID NO: 496244 - protein, 9 aa, Homo Sapiens
PVSFPLAYP

SEQ ID NO: 496245 - protein, 9 aa, Homo Sapiens
RERCRSPRR

SEQ ID NO: 496246 - protein, 9 aa, Homo Sapiens
RKDLGRCES

SEQ ID NO: 496247 - protein, 9 aa, Homo Sapiens
FPMSPSVYA

SEQ ID NO: 496248 - protein, 9 aa, Homo Sapiens
TCGGGVSLS

SEQ ID NO: 496249 - protein, 9 aa, Homo Sapiens
WIKNWEKLG

SEQ ID NO: 496250 - protein, 9 aa, Homo Sapiens
LSQARKSQK

SEQ ID NO: 496251 - protein, 9 aa, Homo Sapiens
SSCFLIVAH

SEQ ID NO: 496252 - protein, 9 aa, Homo Sapiens
EKYKEKCFI

SEQ ID NO: 496253 - protein, 9 aa, Homo Sapiens
HALPAGTYA

SEQ ID NO: 496254 - protein, 9 aa, Homo Sapiens
VDMQWVQIL

SEQ ID NO: 496255 - protein, 9 aa, Homo Sapiens
VESGNKKAE

SEQ ID NO: 496256 - protein, 9 aa, Homo Sapiens
GTGCRALVI

SEQ ID NO: 496257 - protein, 9 aa, Homo Sapiens
WTRQKLVEE

SEQ ID NO: 496258 - protein, 9 aa, Homo Sapiens
DGGEEKAQE

SEQ ID NO: 496259 - protein, 9 aa, Homo Sapiens
RKLDSQEHT

SEQ ID NO: 496260 - protein, 9 aa, Homo Sapiens
SSASSDGLH

SEQ ID NO: 496261 - protein, 9 aa, Homo Sapiens
LSRAERPLM

SEQ ID NO: 496262 - protein, 9 aa, Homo Sapiens
VGKVSDEMF

SEQ ID NO: 496263 - protein, 9 aa, Homo Sapiens
NWATFYNQE

SEQ ID NO: 496264 - protein, 9 aa, Homo Sapiens
TASLALASG

SEQ ID NO: 496265 - protein, 9 aa, Homo Sapiens
MLLRGNLQF

SEQ ID NO: 496266 - protein, 9 aa, Homo Sapiens
LLLSSLISP

SEQ ID NO: 496267 - protein, 9 aa, Homo Sapiens
WATFYNQEP

SEQ ID NO: 496268 - protein, 9 aa, Homo Sapiens
DSFDSCAEQ

SEQ ID NO: 496269 - protein, 9 aa, Homo Sapiens
KTQCIEFFL

SEQ ID NO: 496270 - protein, 9 aa, Homo Sapiens
AIFNEVSRL

SEQ ID NO: 496271 - protein, 9 aa, Homo Sapiens
IMSPKICGL

SEQ ID NO: 496272 - protein, 9 aa, Homo Sapiens
ATFYNQEPT

SEQ ID NO: 496273 - protein, 9 aa, Homo Sapiens
FLFLCCLLS

SEQ ID NO: 496274 - protein, 9 aa, Homo Sapiens
PLRYTNIMS

SEQ ID NO: 496275 - protein, 9 aa, Homo Sapiens
SDEMFLEAL

SEQ ID NO: 496276 - protein, 9 aa, Homo Sapiens
NILWGLPVQ

SEQ ID NO: 496277 - protein, 9 aa, Homo Sapiens
ASSDGLHPV

SEQ ID NO: 496278 - protein, 9 aa, Homo Sapiens
YSRLVQKAE

SEQ ID NO: 496279 - protein, 9 aa, Homo Sapiens
NDNPPIFPF

SEQ ID NO: 496280 - protein, 9 aa, Homo Sapiens
GKVSDEMFL

SEQ ID NO: 496281 - protein, 9 aa, Homo Sapiens
SNGRVKYTL

SEQ ID NO: 496282 - protein, 9 aa, Homo Sapiens
AFQNWATFY

SEQ ID NO: 496283 - protein, 9 aa, Homo Sapiens
VRVIFSNMS

SEQ ID NO: 496284 - protein, 9 aa, Homo Sapiens
QNWATFYNQ

SEQ ID NO: 496285 - protein, 9 aa, Homo Sapiens
ERPLMVLGS

SEQ ID NO: 496286 - protein, 9 aa, Homo Sapiens
VEASFEAVR

SEQ ID NO: 496287 - protein, 9 aa, Homo Sapiens
KLDSQEHTE

SEQ ID NO: 496288 - protein, 9 aa, Homo Sapiens
TFYNQEPTS

SEQ ID NO: 496289 - protein, 9 aa, Homo Sapiens
PENLFLKSN

SEQ ID NO: 496290 - protein, 9 aa, Homo Sapiens
CCLLSPLLK

SEQ ID NO: 496291 - protein, 9 aa, Homo Sapiens
SNMSSIYQF

SEQ ID NO: 496292 - protein, 9 aa, Homo Sapiens
SSTFDALSA

SEQ ID NO: 496293 - protein, 9 aa, Homo Sapiens
SDGLHPVIT

SEQ ID NO: 496294 - protein, 9 aa, Homo Sapiens
NLQFQRQPQ

SEQ ID NO: 496295 - protein, 9 aa, Homo Sapiens
APPVRDPVA

SEQ ID NO: 496296 - protein, 9 aa, Homo Sapiens
QVFNDCFPP

SEQ ID NO: 496297 - protein, 9 aa, Homo Sapiens
LSTLPPLRR

SEQ ID NO: 496298 - protein, 9 aa, Homo Sapiens
CCGGAGPPP

SEQ ID NO: 496299 - protein, 9 aa, Homo Sapiens
DSKKAGAEM

SEQ ID NO: 496300 - protein, 9 aa, Homo Sapiens
IFNEVSRLI

SEQ ID NO: 496301 - protein, 9 aa, Homo Sapiens
RYTNIMSPK

SEQ ID NO: 496302 - protein, 9 aa, Homo Sapiens
VSDEMFLEA

SEQ ID NO: 496303 - protein, 9 aa, Homo Sapiens
ASLALASGS

SEQ ID NO: 496304 - protein, 9 aa, Homo Sapiens
NMSSIYQFH

SEQ ID NO: 496305 - protein, 9 aa, Homo Sapiens
ANGSSFAAG

SEQ ID NO: 496306 - protein, 9 aa, Homo Sapiens
IHLQHNWLK

SEQ ID NO: 496307 - protein, 9 aa, Homo Sapiens
CAEQIPPCL

SEQ ID NO: 496308 - protein, 9 aa, Homo Sapiens
SASSDGLHP

SEQ ID NO: 496309 - protein, 9 aa, Homo Sapiens
LFFNYFQGF

SEQ ID NO: 496310 - protein, 9 aa, Homo Sapiens
CHPLRYTNI

SEQ ID NO: 496311 - protein, 9 aa, Homo Sapiens
SHMIAVTVL

SEQ ID NO: 496312 - protein, 9 aa, Homo Sapiens
STLPPLRRT

SEQ ID NO: 496313 - protein, 9 aa, Homo Sapiens
DWASYTLGI

SEQ ID NO: 496314 - protein, 9 aa, Homo Sapiens
RNCCCGGAG

SEQ ID NO: 496315 - protein, 9 aa, Homo Sapiens
MDLRRSLYA

SEQ ID NO: 496316 - protein, 9 aa, Homo Sapiens
EGLSQVFND

SEQ ID NO: 496317 - protein, 9 aa, Homo Sapiens
ICIHHALAT

SEQ ID NO: 496318 - protein, 9 aa, Homo Sapiens
LSRLWRIEI

SEQ ID NO: 496319 - protein, 9 aa, Homo Sapiens
KEQPPRDPS

SEQ ID NO: 496320 - protein, 9 aa, Homo Sapiens
KSNGRVKYT

SEQ ID NO: 496321 - protein, 9 aa, Homo Sapiens
RGNLQFQRQ

SEQ ID NO: 496322 - protein, 9 aa, Homo Sapiens
PATKTQCIE

SEQ ID NO: 496323 - protein, 9 aa, Homo Sapiens
ELLLSSLIS

SEQ ID NO: 496324 - protein, 9 aa, Homo Sapiens
FNYFQGFFV

SEQ ID NO: 496325 - protein, 9 aa, Homo Sapiens
LVQKAELTR

SEQ ID NO: 496326 - protein, 9 aa, Homo Sapiens
FLKSNGRVK

SEQ ID NO: 496327 - protein, 9 aa, Homo Sapiens
SFDSCAEQI

SEQ ID NO: 496328 - protein, 9 aa, Homo Sapiens
GALASSLLL

SEQ ID NO: 496329 - protein, 9 aa, Homo Sapiens
ALASGSGES

SEQ ID NO: 496330 - protein, 9 aa, Homo Sapiens
ALASSLLLP

SEQ ID NO: 496331 - protein, 9 aa, Homo Sapiens
SPPAHLALS

SEQ ID NO: 496332 - protein, 9 aa, Homo Sapiens
PPGVRKLDS

SEQ ID NO: 496333 - protein, 9 aa, Homo Sapiens
LDVLERCPH

SEQ ID NO: 496334 - protein, 9 aa, Homo Sapiens
QRAGHRRVL

SEQ ID NO: 496335 - protein, 9 aa, Homo Sapiens
FGPYHATVP

SEQ ID NO: 496336 - protein, 9 aa, Homo Sapiens
MMNDEVGSL

SEQ ID NO: 496337 - protein, 9 aa, Homo Sapiens
KAGAEMVKQ

SEQ ID NO: 496338 - protein, 9 aa, Homo Sapiens
CRQGFPNRE

SEQ ID NO: 496339 - protein, 9 aa, Homo Sapiens
EMVKQVEHP

SEQ ID NO: 496340 - protein, 9 aa, Homo Sapiens
ERCPHRPIL

SEQ ID NO: 496341 - protein, 9 aa, Homo Sapiens
VFNDCFPPE

SEQ ID NO: 496342 - protein, 9 aa, Homo Sapiens
VTAGPVPVQ

SEQ ID NO: 496343 - protein, 9 aa, Homo Sapiens
SFTPECVTA

SEQ ID NO: 496344 - protein, 9 aa, Homo Sapiens
ISMLLRGNL

SEQ ID NO: 496345 - protein, 9 aa, Homo Sapiens
ITLELEDLK

SEQ ID NO: 496346 - protein, 9 aa, Homo Sapiens
LYGTMLFMY

SEQ ID NO: 496347 - protein, 9 aa, Homo Sapiens
SQEHTEETL

SEQ ID NO: 496348 - protein, 9 aa, Homo Sapiens
PPLRRTRDL

SEQ ID NO: 496349 - protein, 9 aa, Homo Sapiens
NIMSPKICG

SEQ ID NO: 496350 - protein, 9 aa, Homo Sapiens
LGIFICLSC

SEQ ID NO: 496351 - protein, 9 aa, Homo Sapiens
SKKAGAEMV

SEQ ID NO: 496352 - protein, 9 aa, Homo Sapiens
NDCFPPEQD

SEQ ID NO: 496353 - protein, 9 aa, Homo Sapiens
VLERCPHRP

SEQ ID NO: 496354 - protein, 9 aa, Homo Sapiens
YLSRLWRIE

SEQ ID NO: 496355 - protein, 9 aa, Homo Sapiens
PPAHLALSH

SEQ ID NO: 496356 - protein, 9 aa, Homo Sapiens
VIVCLLANG

SEQ ID NO: 496357 - protein, 9 aa, Homo Sapiens
STAYMMNDE

SEQ ID NO: 496358 - protein, 9 aa, Homo Sapiens
MIAVTVLYG

SEQ ID NO: 496359 - protein, 9 aa, Homo Sapiens
IEFFLAPVK

SEQ ID NO: 496360 - protein, 9 aa, Homo Sapiens
LRRTRDLDP

SEQ ID NO: 496361 - protein, 9 aa, Homo Sapiens
TQRAGHRRV

SEQ ID NO: 496362 - protein, 9 aa, Homo Sapiens
AKVGVCMLM

SEQ ID NO: 496363 - protein, 9 aa, Homo Sapiens
RCPHRPILQ

SEQ ID NO: 496364 - protein, 9 aa, Homo Sapiens
DNPPIFPFG

SEQ ID NO: 496365 - protein, 9 aa, Homo Sapiens
WRIEIATYL

SEQ ID NO: 496366 - protein, 9 aa, Homo Sapiens
PSQDSAFQN

SEQ ID NO: 496367 - protein, 9 aa, Homo Sapiens
LFLCCLLSP

SEQ ID NO: 496368 - protein, 9 aa, Homo Sapiens
LRTVEASFE

SEQ ID NO: 496369 - protein, 9 aa, Homo Sapiens
CELFFNYFQ

SEQ ID NO: 496370 - protein, 9 aa, Homo Sapiens
FHSTAYMMN

SEQ ID NO: 496371 - protein, 9 aa, Homo Sapiens
DVLERCPHR

SEQ ID NO: 496372 - protein, 9 aa, Homo Sapiens
KKAGAEMVK

SEQ ID NO: 496373 - protein, 9 aa, Homo Sapiens
MAAKVGVCM

SEQ ID NO: 496374 - protein, 9 aa, Homo Sapiens
IFPFGPYHA

SEQ ID NO: 496375 - protein, 9 aa, Homo Sapiens
GVRKLDSQE

SEQ ID NO: 496376 - protein, 9 aa, Homo Sapiens
CEVRTVSFV

SEQ ID NO: 496377 - protein, 9 aa, Homo Sapiens
SASPAIPSN

SEQ ID NO: 496378 - protein, 9 aa, Homo Sapiens
LSQVFNDCF

SEQ ID NO: 496379 - protein, 9 aa, Homo Sapiens
VVRVIFSNM

SEQ ID NO: 496380 - protein, 9 aa, Homo Sapiens
ASPAIPSNT

SEQ ID NO: 496381 - protein, 9 aa, Homo Sapiens
AYMMNDEVG

SEQ ID NO: 496382 - protein, 9 aa, Homo Sapiens
TYSRLVQKA

SEQ ID NO: 496383 - protein, 9 aa, Homo Sapiens
LLANGSSFA

SEQ ID NO: 496384 - protein, 9 aa, Homo Sapiens
LDCEVRTVS

SEQ ID NO: 496385 - protein, 9 aa, Homo Sapiens
YDFDSKSPD

SEQ ID NO: 496386 - protein, 9 aa, Homo Sapiens
NGRVKYTLN

SEQ ID NO: 496387 - protein, 9 aa, Homo Sapiens
DGLHPVITP

SEQ ID NO: 496388 - protein, 9 aa, Homo Sapiens
VGLFLDCEV

SEQ ID NO: 496389 - protein, 9 aa, Homo Sapiens
RDPVAGKPT

SEQ ID NO: 496390 - protein, 9 aa, Homo Sapiens
VQYGWQYRT

SEQ ID NO: 496391 - protein, 9 aa, Homo Sapiens
SGSGESMMG

SEQ ID NO: 496392 - protein, 9 aa, Homo Sapiens
LRFDLYDFD

SEQ ID NO: 496393 - protein, 9 aa, Homo Sapiens
LGKCQKLQT

SEQ ID NO: 496394 - protein, 9 aa, Homo Sapiens
LWRIEIATY

SEQ ID NO: 496395 - protein, 9 aa, Homo Sapiens
QCIEFFLAP

SEQ ID NO: 496396 - protein, 9 aa, Homo Sapiens
LRYTNIMSP

SEQ ID NO: 496397 - protein, 9 aa, Homo Sapiens
PEKEQPPRD

SEQ ID NO: 496398 - protein, 9 aa, Homo Sapiens
YMMNDEVGS

SEQ ID NO: 496399 - protein, 9 aa, Homo Sapiens
RAGHRRVLS

SEQ ID NO: 496400 - protein, 9 aa, Homo Sapiens
VLSDVTHSA

SEQ ID NO: 496401 - protein, 9 aa, Homo Sapiens
LISPIAENS

SEQ ID NO: 496402 - protein, 9 aa, Homo Sapiens
GKCQKLQTA

SEQ ID NO: 496403 - protein, 9 aa, Homo Sapiens
ELEDLKREH

SEQ ID NO: 496404 - protein, 9 aa, Homo Sapiens
DPSQDSAFQ

SEQ ID NO: 496405 - protein, 9 aa, Homo Sapiens
AAKVGVCML

SEQ ID NO: 496406 - protein, 9 aa, Homo Sapiens
LLGNRNCCC

SEQ ID NO: 496407 - protein, 9 aa, Homo Sapiens
NPPIFPFGP

SEQ ID NO: 496408 - protein, 9 aa, Homo Sapiens
FNDCFPPEQ

SEQ ID NO: 496409 - protein, 9 aa, Homo Sapiens
TLGIFICLS

SEQ ID NO: 496410 - protein, 9 aa, Homo Sapiens
CPHRPILQA

SEQ ID NO: 496411 - protein, 9 aa, Homo Sapiens
ATKTQCIEF

SEQ ID NO: 496412 - protein, 9 aa, Homo Sapiens
VATDSFDSC

SEQ ID NO: 496413 - protein, 9 aa, Homo Sapiens
REVFQEFRQ

SEQ ID NO: 496414 - protein, 9 aa, Homo Sapiens
PVRDPVAGK

SEQ ID NO: 496415 - protein, 9 aa, Homo Sapiens
ILWGLPVQY

SEQ ID NO: 496416 - protein, 9 aa, Homo Sapiens
NMYLSRLWR

SEQ ID NO: 496417 - protein, 9 aa, Homo Sapiens
GLPVQYGWQ

SEQ ID NO: 496418 - protein, 9 aa, Homo Sapiens
ATDSFDSCA

SEQ ID NO: 496419 - protein, 9 aa, Homo Sapiens
VRDPVAGKP

SEQ ID NO: 496420 - protein, 9 aa, Homo Sapiens
AERPLMVLG

SEQ ID NO: 496421 - protein, 9 aa, Homo Sapiens
LEGLSQVFN

SEQ ID NO: 496422 - protein, 9 aa, Homo Sapiens
VSRLIIILT

SEQ ID NO: 496423 - protein, 9 aa, Homo Sapiens
VTPTYSRLV

SEQ ID NO: 496424 - protein, 9 aa, Homo Sapiens
ASFEAVRTL

SEQ ID NO: 496425 - protein, 9 aa, Homo Sapiens
SLALASGSG

SEQ ID NO: 496426 - protein, 9 aa, Homo Sapiens
LCCLLSPLL

SEQ ID NO: 496427 - protein, 9 aa, Homo Sapiens
DSQEHTEET

SEQ ID NO: 496428 - protein, 9 aa, Homo Sapiens
QPPRDPSQD

SEQ ID NO: 496429 - protein, 9 aa, Homo Sapiens
PELLLSSLI

SEQ ID NO: 496430 - protein, 9 aa, Homo Sapiens
DLKREHTSY

SEQ ID NO: 496431 - protein, 9 aa, Homo Sapiens
EVSRLIIIL

SEQ ID NO: 496432 - protein, 9 aa, Homo Sapiens
AKSNMDLRR

SEQ ID NO: 496433 - protein, 9 aa, Homo Sapiens
VIFSNMSSI

SEQ ID NO: 496434 - protein, 9 aa, Homo Sapiens
HPLRYTNIM

SEQ ID NO: 496435 - protein, 9 aa, Homo Sapiens
FPNREVFQE

SEQ ID NO: 496436 - protein, 9 aa, Homo Sapiens
FDALSASPA

SEQ ID NO: 496437 - protein, 9 aa, Homo Sapiens
PVAGKPTVT

SEQ ID NO: 496438 - protein, 9 aa, Homo Sapiens
DSAFQNWAT

SEQ ID NO: 496439 - protein, 9 aa, Homo Sapiens
LKNAICIHH

SEQ ID NO: 496440 - protein, 9 aa, Homo Sapiens
EKEQPPRDP

SEQ ID NO: 496441 - protein, 9 aa, Homo Sapiens
PPIFPFGPY

SEQ ID NO: 496442 - protein, 9 aa, Homo Sapiens
SSLISPIAE

SEQ ID NO: 496443 - protein, 9 aa, Homo Sapiens
GVCMLMTSD

SEQ ID NO: 496444 - protein, 9 aa, Homo Sapiens
LDSQEHTEE

SEQ ID NO: 496445 - protein, 9 aa, Homo Sapiens
CMNVGKVSD

SEQ ID NO: 496446 - protein, 9 aa, Homo Sapiens
QHNWLKEDA

SEQ ID NO: 496447 - protein, 9 aa, Homo Sapiens
AGPVPVQPS

SEQ ID NO: 496448 - protein, 9 aa, Homo Sapiens
PIFPFGPYH

SEQ ID NO: 496449 - protein, 9 aa, Homo Sapiens
GIFICLSCS

SEQ ID NO: 496450 - protein, 9 aa, Homo Sapiens
AHLALSHEV

SEQ ID NO: 496451 - protein, 9 aa, Homo Sapiens
FLDCEVRTV

SEQ ID NO: 496452 - protein, 9 aa, Homo Sapiens
TQCIEFFLA

SEQ ID NO: 496453 - protein, 9 aa, Homo Sapiens
EWLSTLPPL

SEQ ID NO: 496454 - protein, 9 aa, Homo Sapiens
FSNMSSIYQ

SEQ ID NO: 496455 - protein, 9 aa, Homo Sapiens
LHPVITPSW

SEQ ID NO: 496456 - protein, 9 aa, Homo Sapiens
FFNYFQGFF

SEQ ID NO: 496457 - protein, 9 aa, Homo Sapiens
WLKEDAVSA

SEQ ID NO: 496458 - protein, 9 aa, Homo Sapiens
GSLLGKCQK

SEQ ID NO: 496459 - protein, 9 aa, Homo Sapiens
LASSLLLPA

SEQ ID NO: 496460 - protein, 9 aa, Homo Sapiens
NQEPTSLQT

SEQ ID NO: 496461 - protein, 9 aa, Homo Sapiens
LLGKCQKLQ

SEQ ID NO: 496462 - protein, 9 aa, Homo Sapiens
PTYSRLVQK

SEQ ID NO: 496463 - protein, 9 aa, Homo Sapiens
NAICIHHAL

SEQ ID NO: 496464 - protein, 9 aa, Homo Sapiens
VAGKPTVTI

SEQ ID NO: 496465 - protein, 9 aa, Homo Sapiens
LSHEVDVVG

SEQ ID NO: 496466 - protein, 9 aa, Homo Sapiens
ENLFLKSNG

SEQ ID NO: 496467 - protein, 9 aa, Homo Sapiens
WGLPVQYGW

SEQ ID NO: 496468 - protein, 9 aa, Homo Sapiens
LKSNGRVKY

SEQ ID NO: 496469 - protein, 9 aa, Homo Sapiens
RLWRIEIAT

SEQ ID NO: 496470 - protein, 9 aa, Homo Sapiens
VRKLDSQEH

SEQ ID NO: 496471 - protein, 9 aa, Homo Sapiens
LQFQRQPQW

SEQ ID NO: 496472 - protein, 9 aa, Homo Sapiens
CVTAGPVPV

SEQ ID NO: 496473 - protein, 9 aa, Homo Sapiens
DALSASPAI

SEQ ID NO: 496474 - protein, 9 aa, Homo Sapiens
LALSHEVDV

SEQ ID NO: 496475 - protein, 9 aa, Homo Sapiens
LYDFDSKSP

SEQ ID NO: 496476 - protein, 9 aa, Homo Sapiens
CLLANGSSF

SEQ ID NO: 496477 - protein, 9 aa, Homo Sapiens
CIHHALATR

SEQ ID NO: 496478 - protein, 9 aa, Homo Sapiens
AGSLLGKCQ

SEQ ID NO: 496479 - protein, 9 aa, Homo Sapiens
LQHNWLKED

SEQ ID NO: 496480 - protein, 9 aa, Homo Sapiens
VGVCMLMTS

SEQ ID NO: 496481 - protein, 9 aa, Homo Sapiens
ETPGALASS

SEQ ID NO: 496482 - protein, 9 aa, Homo Sapiens
ILSRAERPL

SEQ ID NO: 496483 - protein, 9 aa, Homo Sapiens
NGSSFAAGI

SEQ ID NO: 496484 - protein, 9 aa, Homo Sapiens
CNVKAKSNM

SEQ ID NO: 496485 - protein, 9 aa, Homo Sapiens
ACMNVGKVS

SEQ ID NO: 496486 - protein, 9 aa, Homo Sapiens
FDLYDFDSK

SEQ ID NO: 496487 - protein, 9 aa, Homo Sapiens
TKTQCIEFF

SEQ ID NO: 496488 - protein, 9 aa, Homo Sapiens
DLYDFDSKS

SEQ ID NO: 496489 - protein, 9 aa, Homo Sapiens
EVFQEFRQR

SEQ ID NO: 496490 - protein, 9 aa, Homo Sapiens
LEDLKREHT

SEQ ID NO: 496491 - protein, 9 aa, Homo Sapiens
ESSASSDGL

SEQ ID NO: 496492 - protein, 9 aa, Homo Sapiens
QDEAGSLLG

SEQ ID NO: 496493 - protein, 9 aa, Homo Sapiens
VKAKSNMDL

SEQ ID NO: 496494 - protein, 9 aa, Homo Sapiens
RFDLYDFDS

SEQ ID NO: 496495 - protein, 9 aa, Homo Sapiens
SQDSAFQNW

SEQ ID NO: 496496 - protein, 9 aa, Homo Sapiens
TFDALSASP

SEQ ID NO: 496497 - protein, 9 aa, Homo Sapiens
YTLGIFICL

SEQ ID NO: 496498 - protein, 9 aa, Homo Sapiens
NDEVGSLVE

SEQ ID NO: 496499 - protein, 9 aa, Homo Sapiens
TVEASFEAV

SEQ ID NO: 496500 - protein, 9 aa, Homo Sapiens
DSCAEQIPP

SEQ ID NO: 496501 - protein, 9 aa, Homo Sapiens
MVKQVEHPL

SEQ ID NO: 496502 - protein, 9 aa, Homo Sapiens
RAERPLMVL

SEQ ID NO: 496503 - protein, 9 aa, Homo Sapiens
QNILWGLPV

SEQ ID NO: 496504 - protein, 9 aa, Homo Sapiens
EASFEAVRT

SEQ ID NO: 496505 - protein, 9 aa, Homo Sapiens
LLRGNLQFQ

SEQ ID NO: 496506 - protein, 9 aa, Homo Sapiens
PFGPYHATV

SEQ ID NO: 496507 - protein, 9 aa, Homo Sapiens
LANGSSFAA

SEQ ID NO: 496508 - protein, 9 aa, Homo Sapiens
RVIFSNMSS

SEQ ID NO: 496509 - protein, 9 aa, Homo Sapiens
HEVDVVGAV

SEQ ID NO: 496510 - protein, 9 aa, Homo Sapiens
GLHPVITPS

SEQ ID NO: 496511 - protein, 9 aa, Homo Sapiens
HLALSHEVD

SEQ ID NO: 496512 - protein, 9 aa, Homo Sapiens
QGFPNREVF

SEQ ID NO: 496513 - protein, 9 aa, Homo Sapiens
SRLWRIEIA

SEQ ID NO: 496514 - protein, 9 aa, Homo Sapiens
CVEILSRAE

SEQ ID NO: 496515 - protein, 9 aa, Homo Sapiens
TVLYGTMLF

SEQ ID NO: 496516 - protein, 9 aa, Homo Sapiens
TPECVTAGP

SEQ ID NO: 496517 - protein, 9 aa, Homo Sapiens
FPFGPYHAT

SEQ ID NO: 496518 - protein, 9 aa, Homo Sapiens
RRVLSDVTH

SEQ ID NO: 496519 - protein, 9 aa, Homo Sapiens
AGKPTVTIR

SEQ ID NO: 496520 - protein, 9 aa, Homo Sapiens
KSNMDLRRS

SEQ ID NO: 496521 - protein, 9 aa, Homo Sapiens
FTPECVTAG

SEQ ID NO: 496522 - protein, 9 aa, Homo Sapiens
SNMYLSRLW

SEQ ID NO: 496523 - protein, 9 aa, Homo Sapiens
SMLLRGNLQ

SEQ ID NO: 496524 - protein, 9 aa, Homo Sapiens
RLVQKAELT

SEQ ID NO: 496525 - protein, 9 aa, Homo Sapiens
CCCGGAGPP

SEQ ID NO: 496526 - protein, 9 aa, Homo Sapiens
IAVTVLYGT

SEQ ID NO: 496527 - protein, 9 aa, Homo Sapiens
AGHRRVLSD

SEQ ID NO: 496528 - protein, 9 aa, Homo Sapiens
LMAAKVGVC

SEQ ID NO: 496529 - protein, 9 aa, Homo Sapiens
DCEVRTVSF

SEQ ID NO: 496530 - protein, 9 aa, Homo Sapiens
PNREVFQEF

SEQ ID NO: 496531 - protein, 9 aa, Homo Sapiens
RQGFPNREV

SEQ ID NO: 496532 - protein, 9 aa, Homo Sapiens
SLLGKCQKL

SEQ ID NO: 496533 - protein, 9 aa, Homo Sapiens
MNDEVGSLV

SEQ ID NO: 496534 - protein, 9 aa, Homo Sapiens
WLSTLPPLR

SEQ ID NO: 496535 - protein, 9 aa, Homo Sapiens
TELKNAICI

SEQ ID NO: 496536 - protein, 9 aa, Homo Sapiens
TAYMMNDEV

SEQ ID NO: 496537 - protein, 9 aa, Homo Sapiens
YFQGFFVSI

SEQ ID NO: 496538 - protein, 9 aa, Homo Sapiens
TPTYSRLVQ

SEQ ID NO: 496539 - protein, 9 aa, Homo Sapiens
RPATKTQCI

SEQ ID NO: 496540 - protein, 9 aa, Homo Sapiens
LWGLPVQYG

SEQ ID NO: 496541 - protein, 9 aa, Homo Sapiens
TLELEDLKR

SEQ ID NO: 496542 - protein, 9 aa, Homo Sapiens
SYTLGIFIC

SEQ ID NO: 496543 - protein, 9 aa, Homo Sapiens
LRGNLQFQR

SEQ ID NO: 496544 - protein, 9 aa, Homo Sapiens
MYLSRLWRI

SEQ ID NO: 496545 - protein, 9 aa, Homo Sapiens
HLQHNWLKE

SEQ ID NO: 496546 - protein, 9 aa, Homo Sapiens
LGNRNCCCG

SEQ ID NO: 496547 - protein, 9 aa, Homo Sapiens
ISPIAENSP

SEQ ID NO: 496548 - protein, 9 aa, Homo Sapiens
PECVTAGPV

SEQ ID NO: 496549 - protein, 9 aa, Homo Sapiens
GLFLDCEVR

SEQ ID NO: 496550 - protein, 9 aa, Homo Sapiens
NEVSRLIII

SEQ ID NO: 496551 - protein, 9 aa, Homo Sapiens
DFFLFLCCL

SEQ ID NO: 496552 - protein, 9 aa, Homo Sapiens
ELKNAICIH

SEQ ID NO: 496553 - protein, 9 aa, Homo Sapiens
CGGAGPPPC

SEQ ID NO: 496554 - protein, 9 aa, Homo Sapiens
VTVLYGTML

SEQ ID NO: 496555 - protein, 9 aa, Homo Sapiens
KAKSNMDLR

SEQ ID NO: 496556 - protein, 9 aa, Homo Sapiens
ALSASPAIP

SEQ ID NO: 496557 - protein, 9 aa, Homo Sapiens
MNVGKVSDE

SEQ ID NO: 496558 - protein, 9 aa, Homo Sapiens
SHEVDVVGA

SEQ ID NO: 496559 - protein, 9 aa, Homo Sapiens
TAGPVPVQP

SEQ ID NO: 496560 - protein, 9 aa, Homo Sapiens
GFPNREVFQ

SEQ ID NO: 496561 - protein, 9 aa, Homo Sapiens
LLRTVEASF

SEQ ID NO: 496562 - protein, 9 aa, Homo Sapiens
GHRRVLSDV

SEQ ID NO: 496563 - protein, 9 aa, Homo Sapiens
LLSSLISPI

SEQ ID NO: 496564 - protein, 9 aa, Homo Sapiens
FFLFLCCLL

SEQ ID NO: 496565 - protein, 9 aa, Homo Sapiens
HSTAYMMND

SEQ ID NO: 496566 - protein, 9 aa, Homo Sapiens
PPRDPSQDS

SEQ ID NO: 496567 - protein, 9 aa, Homo Sapiens
TPGALASSL

SEQ ID NO: 496568 - protein, 9 aa, Homo Sapiens
LFLDCEVRT

SEQ ID NO: 496569 - protein, 9 aa, Homo Sapiens
RVLSDVTHS

SEQ ID NO: 496570 - protein, 9 aa, Homo Sapiens
STFDALSAS

SEQ ID NO: 496571 - protein, 9 aa, Homo Sapiens
NVKAKSNMD

SEQ ID NO: 496572 - protein, 9 aa, Homo Sapiens
GNLQFQRQP

SEQ ID NO: 496573 - protein, 9 aa, Homo Sapiens
AGAEMVKQV

SEQ ID NO: 496574 - protein, 9 aa, Homo Sapiens
LSASPAIPS

SEQ ID NO: 496575 - protein, 9 aa, Homo Sapiens
HNWLKEDAV

SEQ ID NO: 496576 - protein, 9 aa, Homo Sapiens
PVQYGWQYR

SEQ ID NO: 496577 - protein, 9 aa, Homo Sapiens
LSSLISPIA

SEQ ID NO: 496578 - protein, 9 aa, Homo Sapiens
NVGKVSDEM

SEQ ID NO: 496579 - protein, 9 aa, Homo Sapiens
NREVFQEFR

SEQ ID NO: 496580 - protein, 9 aa, Homo Sapiens
VVTPTYSRL

SEQ ID NO: 496581 - protein, 9 aa, Homo Sapiens
EVRTVSFVD

SEQ ID NO: 496582 - protein, 9 aa, Homo Sapiens
SRLIIILTS

SEQ ID NO: 496583 - protein, 9 aa, Homo Sapiens
LELEDLKRE

SEQ ID NO: 496584 - protein, 9 aa, Homo Sapiens
PLRRTRDLD

SEQ ID NO: 496585 - protein, 9 aa, Homo Sapiens
PPVRDPVAG

SEQ ID NO: 496586 - protein, 9 aa, Homo Sapiens
NWLKEDAVS

SEQ ID NO: 496587 - protein, 9 aa, Homo Sapiens
EDLKREHTS

SEQ ID NO: 496588 - protein, 9 aa, Homo Sapiens
PGVRKLDSQ

SEQ ID NO: 496589 - protein, 9 aa, Homo Sapiens
ALSHEVDVV

SEQ ID NO: 496590 - protein, 9 aa, Homo Sapiens
MSSIYQFHS

SEQ ID NO: 496591 - protein, 9 aa, Homo Sapiens
AICIHHALA

SEQ ID NO: 496592 - protein, 9 aa, Homo Sapiens
NMDLRRSLY

SEQ ID NO: 496593 - protein, 9 aa, Homo Sapiens
QDSAFQNWA

SEQ ID NO: 496594 - protein, 9 aa, Homo Sapiens
HCELFFNYF

SEQ ID NO: 496595 - protein, 9 aa, Homo Sapiens
KNAICIHHA

SEQ ID NO: 496596 - protein, 9 aa, Homo Sapiens
MHCELFFNY

SEQ ID NO: 496597 - protein, 9 aa, Homo Sapiens
GAEMVKQVE

SEQ ID NO: 496598 - protein, 9 aa, Homo Sapiens
FLCCLLSPL

SEQ ID NO: 496599 - protein, 9 aa, Homo Sapiens
LPVQYGWQY

SEQ ID NO: 496600 - protein, 9 aa, Homo Sapiens
ASGSGESMM

SEQ ID NO: 496601 - protein, 9 aa, Homo Sapiens
PAHLALSHE

SEQ ID NO: 496602 - protein, 9 aa, Homo Sapiens
RDPSQDSAF

SEQ ID NO: 496603 - protein, 9 aa, Homo Sapiens
PTASLALAS

SEQ ID NO: 496604 - protein, 9 aa, Homo Sapiens
TNIMSPKIC

SEQ ID NO: 496605 - protein, 9 aa, Homo Sapiens
LFLKSNGRV

SEQ ID NO: 496606 - protein, 9 aa, Homo Sapiens
SLISPIAEN

SEQ ID NO: 496607 - protein, 9 aa, Homo Sapiens
PRDPSQDSA

SEQ ID NO: 496608 - protein, 9 aa, Homo Sapiens
AITLELEDL

SEQ ID NO: 496609 - protein, 9 aa, Homo Sapiens
YTLDVLERC

SEQ ID NO: 496610 - protein, 9 aa, Homo Sapiens
EILSRAERP

SEQ ID NO: 496611 - protein, 9 aa, Homo Sapiens
AVTVLYGTM

SEQ ID NO: 496612 - protein, 9 aa, Homo Sapiens
IFSNMSSIY

SEQ ID NO: 496613 - protein, 9 aa, Homo Sapiens
VLYGTMLFM

SEQ ID NO: 496614 - protein, 9 aa, Homo Sapiens
VVIVCLLAN

SEQ ID NO: 496615 - protein, 9 aa, Homo Sapiens
IAIFNEVSR

SEQ ID NO: 496616 - protein, 9 aa, Homo Sapiens
VEILSRAER

SEQ ID NO: 496617 - protein, 9 aa, Homo Sapiens
GLSQVFNDC

SEQ ID NO: 496618 - protein, 9 aa, Homo Sapiens
SQVFNDCFP

SEQ ID NO: 496619 - protein, 9 aa, Homo Sapiens
ASYTLGIFI

SEQ ID NO: 496620 - protein, 9 aa, Homo Sapiens
RTVEASFEA

SEQ ID NO: 496621 - protein, 9 aa, Homo Sapiens
SRLVQKAEL

SEQ ID NO: 496622 - protein, 9 aa, Homo Sapiens
TDSFDSCAE

SEQ ID NO: 496623 - protein, 9 aa, Homo Sapiens
NLFLKSNGR

SEQ ID NO: 496624 - protein, 9 aa, Homo Sapiens
NCCCGGAGP

SEQ ID NO: 496625 - protein, 9 aa, Homo Sapiens
SNMDLRRSL

SEQ ID NO: 496626 - protein, 9 aa, Homo Sapiens
METPGALAS

SEQ ID NO: 496627 - protein, 9 aa, Homo Sapiens
SSDGLHPVI

SEQ ID NO: 496628 - protein, 9 aa, Homo Sapiens
DPVAGKPTV

SEQ ID NO: 496629 - protein, 9 aa, Homo Sapiens
FNEVSRLII

SEQ ID NO: 496630 - protein, 9 aa, Homo Sapiens
NRNCCCGGA

SEQ ID NO: 496631 - protein, 9 aa, Homo Sapiens
SRAERPLMV

SEQ ID NO: 496632 - protein, 9 aa, Homo Sapiens
YTNIMSPKI

SEQ ID NO: 496633 - protein, 9 aa, Homo Sapiens
SFEAVRTLL

SEQ ID NO: 496634 - protein, 9 aa, Homo Sapiens
IFICLSCSG

SEQ ID NO: 496635 - protein, 9 aa, Homo Sapiens
RLIIILTSY

SEQ ID NO: 496636 - protein, 9 aa, Homo Sapiens
FYNQEPTSL

SEQ ID NO: 496637 - protein, 9 aa, Homo Sapiens
AEMVKQVEH

SEQ ID NO: 496638 - protein, 9 aa, Homo Sapiens
NYFQGFFVS

SEQ ID NO: 496639 - protein, 9 aa, Homo Sapiens
LALASGSGE

SEQ ID NO: 496640 - protein, 9 aa, Homo Sapiens
DEAGSLLGK

SEQ ID NO: 496641 - protein, 9 aa, Homo Sapiens
PGALASSLL

SEQ ID NO: 496642 - protein, 9 aa, Homo Sapiens
HRRVLSDVT

SEQ ID NO: 496643 - protein, 9 aa, Homo Sapiens
EQPPRDPSQ

SEQ ID NO: 496644 - protein, 9 aa, Homo Sapiens
LASGSGESM

SEQ ID NO: 496645 - protein, 9 aa, Homo Sapiens
TLDVLERCP

SEQ ID NO: 496646 - protein, 9 aa, Homo Sapiens
DFDSKSPDL

SEQ ID NO: 496647 - protein, 9 aa, Homo Sapiens
HMIAVTVLY

SEQ ID NO: 496648 - protein, 9 aa, Homo Sapiens
KVGVCMLMT

SEQ ID NO: 496649 - protein, 9 aa, Homo Sapiens
LPPLRRTRD

SEQ ID NO: 496650 - protein, 9 aa, Homo Sapiens
SCAEQIPPC

SEQ ID NO: 496651 - protein, 9 aa, Homo Sapiens
KVSDEMFLE

SEQ ID NO: 496652 - protein, 9 aa, Homo Sapiens
FEAVRTLLA

SEQ ID NO: 496653 - protein, 9 aa, Homo Sapiens
ETELKNAIC

SEQ ID NO: 496654 - protein, 9 aa, Homo Sapiens
WASYTLGIF

SEQ ID NO: 496655 - protein, 9 aa, Homo Sapiens
NLRFDLYDF

SEQ ID NO: 496656 - protein, 9 aa, Homo Sapiens
FQNWATFYN

SEQ ID NO: 496657 - protein, 9 aa, Homo Sapiens
TLPPLRRTR

SEQ ID NO: 496658 - protein, 9 aa, Homo Sapiens
LERCPHRPI

SEQ ID NO: 496659 - protein, 9 aa, Homo Sapiens
VCLLANGSS

SEQ ID NO: 496660 - protein, 9 aa, Homo Sapiens
EAITLELED

SEQ ID NO: 496661 - protein, 9 aa, Homo Sapiens
ELFFNYFQG

SEQ ID NO: 496662 - protein, 9 aa, Homo Sapiens
SAFQNWATF

SEQ ID NO: 496663 - protein, 9 aa, Homo Sapiens
IVCLLANGS

SEQ ID NO: 496664 - protein, 9 aa, Homo Sapiens
GNRNCCCGG

SEQ ID NO: 496665 - protein, 9 aa, Homo Sapiens
EAGSLLGKC

SEQ ID NO: 496666 - protein, 9 aa, Homo Sapiens
PDFFLFLCC

SEQ ID NO: 496667 - protein, 9 aa, Homo Sapiens
FDSCAEQIP

SEQ ID NO: 496668 - protein, 9 aa, Homo Sapiens
CLLSPLLKA

SEQ ID NO: 496669 - protein, 9 aa, Homo Sapiens
YNQEPTSLQ

SEQ ID NO: 496670 - protein, 9 aa, Homo Sapiens
FDSKSPDLS

SEQ ID NO: 496671 - protein, 9 aa, Homo Sapiens
ECVTAGPVP

SEQ ID NO: 496672 - protein, 9 aa, Homo Sapiens
FIHLQHNWL

SEQ ID NO: 496673 - protein, 9 aa, Homo Sapiens
TFIHLQHNW

SEQ ID NO: 496674 - protein, 9 aa, Homo Sapiens
VRTVSFVDV

SEQ ID NO: 496675 - protein, 9 aa, Homo Sapiens
CIEFFLAPV

SEQ ID NO: 496676 - protein, 9 aa, Homo Sapiens
RNLDLINRK

SEQ ID NO: 496677 - protein, 9 aa, Homo Sapiens
GEYNLETSR

SEQ ID NO: 496678 - protein, 9 aa, Homo Sapiens
IWLLILSYV

SEQ ID NO: 496679 - protein, 9 aa, Homo Sapiens
TLRFFFNLS

SEQ ID NO: 496680 - protein, 9 aa, Homo Sapiens
MPIFQNISS

SEQ ID NO: 496681 - protein, 9 aa, Homo Sapiens
ELRVIIKKI

SEQ ID NO: 496682 - protein, 9 aa, Homo Sapiens
RGEGESQQN

SEQ ID NO: 496683 - protein, 9 aa, Homo Sapiens
VSFIELTSF

SEQ ID NO: 496684 - protein, 9 aa, Homo Sapiens
NQFVLIDLA

SEQ ID NO: 496685 - protein, 9 aa, Homo Sapiens
SGIAHALLR

SEQ ID NO: 496686 - protein, 9 aa, Homo Sapiens
LFATCLPKQ

SEQ ID NO: 496687 - protein, 9 aa, Homo Sapiens
APNSYGRRL

SEQ ID NO: 496688 - protein, 9 aa, Homo Sapiens
QRQKWGMTT

SEQ ID NO: 496689 - protein, 9 aa, Homo Sapiens
HATSLPVTN

SEQ ID NO: 496690 - protein, 9 aa, Homo Sapiens
EQEMLLFSL

SEQ ID NO: 496691 - protein, 9 aa, Homo Sapiens
VKITVPEKI

SEQ ID NO: 496692 - protein, 9 aa, Homo Sapiens
QRIGETPEL

SEQ ID NO: 496693 - protein, 9 aa, Homo Sapiens
KLRTRKSIN

SEQ ID NO: 496694 - protein, 9 aa, Homo Sapiens
GTAFSDDPE

SEQ ID NO: 496695 - protein, 9 aa, Homo Sapiens
QPYASRLSG

SEQ ID NO: 496696 - protein, 9 aa, Homo Sapiens
VTSRGITDL

SEQ ID NO: 496697 - protein, 9 aa, Homo Sapiens
STTAAPVEV

SEQ ID NO: 496698 - protein, 9 aa, Homo Sapiens
MSYTDNNCT

SEQ ID NO: 496699 - protein, 9 aa, Homo Sapiens
CAQEPAHAQ

SEQ ID NO: 496700 - protein, 9 aa, Homo Sapiens
EPATPVIKA

SEQ ID NO: 496701 - protein, 9 aa, Homo Sapiens
ELLRPRCPV

SEQ ID NO: 496702 - protein, 9 aa, Homo Sapiens
VFSLLVMAL

SEQ ID NO: 496703 - protein, 9 aa, Homo Sapiens
LDPRNLDLI

SEQ ID NO: 496704 - protein, 9 aa, Homo Sapiens
KEKTLVLGD

SEQ ID NO: 496705 - protein, 9 aa, Homo Sapiens
SSCMGGMNW

SEQ ID NO: 496706 - protein, 9 aa, Homo Sapiens
KKLRENCWT

SEQ ID NO: 496707 - protein, 9 aa, Homo Sapiens
TSDNGKDSL

SEQ ID NO: 496708 - protein, 9 aa, Homo Sapiens
CPVCDQLIF

SEQ ID NO: 496709 - protein, 9 aa, Homo Sapiens
RGITDLEIG

SEQ ID NO: 496710 - protein, 9 aa, Homo Sapiens
PRCPVCDQL

SEQ ID NO: 496711 - protein, 9 aa, Homo Sapiens
PAGCAQEPA

SEQ ID NO: 496712 - protein, 9 aa, Homo Sapiens
GEIQQFPVQ

SEQ ID NO: 496713 - protein, 9 aa, Homo Sapiens
KTPVKKARK

SEQ ID NO: 496714 - protein, 9 aa, Homo Sapiens
FGMPPPACA

SEQ ID NO: 496715 - protein, 9 aa, Homo Sapiens
VQVSAGPLA

SEQ ID NO: 496716 - protein, 9 aa, Homo Sapiens
AQRIGETPE

SEQ ID NO: 496717 - protein, 9 aa, Homo Sapiens
HGQTLEEDS

SEQ ID NO: 496718 - protein, 9 aa, Homo Sapiens
TTLRFFFNL

SEQ ID NO: 496719 - protein, 9 aa, Homo Sapiens
FLDPRNLDL

SEQ ID NO: 496720 - protein, 9 aa, Homo Sapiens
DIVKELPET

SEQ ID NO: 496721 - protein, 9 aa, Homo Sapiens
VSVQVSAGP

SEQ ID NO: 496722 - protein, 9 aa, Homo Sapiens
QDASCTHVL

SEQ ID NO: 496723 - protein, 9 aa, Homo Sapiens
ATCLPKQTV

SEQ ID NO: 496724 - protein, 9 aa, Homo Sapiens
SQQNLLTME

SEQ ID NO: 496725 - protein, 9 aa, Homo Sapiens
LRENCWTRG

SEQ ID NO: 496726 - protein, 9 aa, Homo Sapiens
RAAQGGGPG

SEQ ID NO: 496727 - protein, 9 aa, Homo Sapiens
INMANMEGS

SEQ ID NO: 496728 - protein, 9 aa, Homo Sapiens
LLVMALDRY

SEQ ID NO: 496729 - protein, 9 aa, Homo Sapiens
LIQVMMMGS

SEQ ID NO: 496730 - protein, 9 aa, Homo Sapiens
KTKIREKKL

SEQ ID NO: 496731 - protein, 9 aa, Homo Sapiens
EGSNSKILF

SEQ ID NO: 496732 - protein, 9 aa, Homo Sapiens
RCPVCDQLI

SEQ ID NO: 496733 - protein, 9 aa, Homo Sapiens
EMTMPIFQN

SEQ ID NO: 496734 - protein, 9 aa, Homo Sapiens
WQGCSAKSK

SEQ ID NO: 496735 - protein, 9 aa, Homo Sapiens
PTSIPQQQV

SEQ ID NO: 496736 - protein, 9 aa, Homo Sapiens
AFSDDPEGP

SEQ ID NO: 496737 - protein, 9 aa, Homo Sapiens
IAHALLRQA

SEQ ID NO: 496738 - protein, 9 aa, Homo Sapiens
GQVSEFEYD

SEQ ID NO: 496739 - protein, 9 aa, Homo Sapiens
VSSLWGAAY

SEQ ID NO: 496740 - protein, 9 aa, Homo Sapiens
SHVPSAAAH

SEQ ID NO: 496741 - protein, 9 aa, Homo Sapiens
VGNRGGCGS

SEQ ID NO: 496742 - protein, 9 aa, Homo Sapiens
TSLPVTNTS

SEQ ID NO: 496743 - protein, 9 aa, Homo Sapiens
THVLVFPTS

SEQ ID NO: 496744 - protein, 9 aa, Homo Sapiens
ANMEGSNSK

SEQ ID NO: 496745 - protein, 9 aa, Homo Sapiens
LTVEWSARS

SEQ ID NO: 496746 - protein, 9 aa, Homo Sapiens
DSSTLKLQV

SEQ ID NO: 496747 - protein, 9 aa, Homo Sapiens
VVQVVNIKA

SEQ ID NO: 496748 - protein, 9 aa, Homo Sapiens
SKPNTETQS

SEQ ID NO: 496749 - protein, 9 aa, Homo Sapiens
LHQKISRHK

SEQ ID NO: 496750 - protein, 9 aa, Homo Sapiens
PKLRTRKSI

SEQ ID NO: 496751 - protein, 9 aa, Homo Sapiens
AYAVQYWPE

SEQ ID NO: 496752 - protein, 9 aa, Homo Sapiens
NYIVQKKET

SEQ ID NO: 496753 - protein, 9 aa, Homo Sapiens
MEGSNSKIL

SEQ ID NO: 496754 - protein, 9 aa, Homo Sapiens
QYRKQSMPQ

SEQ ID NO: 496755 - protein, 9 aa, Homo Sapiens
FPNKPASHA

SEQ ID NO: 496756 - protein, 9 aa, Homo Sapiens
SLPVTNTSS

SEQ ID NO: 496757 - protein, 9 aa, Homo Sapiens
SYGRRLIQV

SEQ ID NO: 496758 - protein, 9 aa, Homo Sapiens
SHAMRSHTE

SEQ ID NO: 496759 - protein, 9 aa, Homo Sapiens
RRLIQVGRG

SEQ ID NO: 496760 - protein, 9 aa, Homo Sapiens
EPPAGCAQE

SEQ ID NO: 496761 - protein, 9 aa, Homo Sapiens
YEDCAGTAF

SEQ ID NO: 496762 - protein, 9 aa, Homo Sapiens
ITNLDVSFI

SEQ ID NO: 496763 - protein, 9 aa, Homo Sapiens
FLSNKKTCT

SEQ ID NO: 496764 - protein, 9 aa, Homo Sapiens
PTGRPKLRT

SEQ ID NO: 496765 - protein, 9 aa, Homo Sapiens
WRDGTPVMY

SEQ ID NO: 496766 - protein, 9 aa, Homo Sapiens
HTISVVQVV

SEQ ID NO: 496767 - protein, 9 aa, Homo Sapiens
CTHVLVFPT

SEQ ID NO: 496768 - protein, 9 aa, Homo Sapiens
KAQRIGETP

SEQ ID NO: 496769 - protein, 9 aa, Homo Sapiens
QGSVSVQVS

SEQ ID NO: 496770 - protein, 9 aa, Homo Sapiens
NLGRVGQVS

SEQ ID NO: 496771 - protein, 9 aa, Homo Sapiens
KPNTETQSS

SEQ ID NO: 496772 - protein, 9 aa, Homo Sapiens
MANMEGSNS

SEQ ID NO: 496773 - protein, 9 aa, Homo Sapiens
VLVFPTSST

SEQ ID NO: 496774 - protein, 9 aa, Homo Sapiens
PAAGLVGNR

SEQ ID NO: 496775 - protein, 9 aa, Homo Sapiens
NGKDSLAYS

SEQ ID NO: 496776 - protein, 9 aa, Homo Sapiens
TNGLCIWLL

SEQ ID NO: 496777 - protein, 9 aa, Homo Sapiens
PSTTAAPVE

SEQ ID NO: 496778 - protein, 9 aa, Homo Sapiens
RQKWGMTTR

SEQ ID NO: 496779 - protein, 9 aa, Homo Sapiens
TKKTIFMQK

SEQ ID NO: 496780 - protein, 9 aa, Homo Sapiens
GKTTLRFFF

SEQ ID NO: 496781 - protein, 9 aa, Homo Sapiens
ESQQNLLTM

SEQ ID NO: 496782 - protein, 9 aa, Homo Sapiens
GSVSVQVSA

SEQ ID NO: 496783 - protein, 9 aa, Homo Sapiens
GKDSLAYSA

SEQ ID NO: 496784 - protein, 9 aa, Homo Sapiens
EGESQQNLL

SEQ ID NO: 496785 - protein, 9 aa, Homo Sapiens
AEPATPVIK

SEQ ID NO: 496786 - protein, 9 aa, Homo Sapiens
QFPVQLNAG

SEQ ID NO: 496787 - protein, 9 aa, Homo Sapiens
GIAHALLRQ

SEQ ID NO: 496788 - protein, 9 aa, Homo Sapiens
RHITMPTSI

SEQ ID NO: 496789 - protein, 9 aa, Homo Sapiens
LTRIWQGCS

SEQ ID NO: 496790 - protein, 9 aa, Homo Sapiens
TKVLKPLSV

SEQ ID NO: 496791 - protein, 9 aa, Homo Sapiens
LTVTSRGIT

SEQ ID NO: 496792 - protein, 9 aa, Homo Sapiens
PKQTVLKIW

SEQ ID NO: 496793 - protein, 9 aa, Homo Sapiens
SCTHVLVFP

SEQ ID NO: 496794 - protein, 9 aa, Homo Sapiens
SGTAAVYFT

SEQ ID NO: 496795 - protein, 9 aa, Homo Sapiens
GFSANVRTI

SEQ ID NO: 496796 - protein, 9 aa, Homo Sapiens
NCWTRGLKS

SEQ ID NO: 496797 - protein, 9 aa, Homo Sapiens
FDSLPVKIT

SEQ ID NO: 496798 - protein, 9 aa, Homo Sapiens
DTTLNTVRT

SEQ ID NO: 496799 - protein, 9 aa, Homo Sapiens
TLVLGDVQR

SEQ ID NO: 496800 - protein, 9 aa, Homo Sapiens
IHVSPDFKH

SEQ ID NO: 496801 - protein, 9 aa, Homo Sapiens
HWLPAAGLV

SEQ ID NO: 496802 - protein, 9 aa, Homo Sapiens
GLVGNRGGC

SEQ ID NO: 496803 - protein, 9 aa, Homo Sapiens
ISRHKPREC

SEQ ID NO: 496804 - protein, 9 aa, Homo Sapiens
KSSPMEMTM

SEQ ID NO: 496805 - protein, 9 aa, Homo Sapiens
IELTSFPTE

SEQ ID NO: 496806 - protein, 9 aa, Homo Sapiens
PQEGHGRFL

SEQ ID NO: 496807 - protein, 9 aa, Homo Sapiens
KGFSANVRT

SEQ ID NO: 496808 - protein, 9 aa, Homo Sapiens
YTDNNCTDN

SEQ ID NO: 496809 - protein, 9 aa, Homo Sapiens
AGCAQEPAH

SEQ ID NO: 496810 - protein, 9 aa, Homo Sapiens
FFLDPRNLD

SEQ ID NO: 496811 - protein, 9 aa, Homo Sapiens
VLGDVQRDL

SEQ ID NO: 496812 - protein, 9 aa, Homo Sapiens
TNLDVSFIE

SEQ ID NO: 496813 - protein, 9 aa, Homo Sapiens
VRRAAQGGG

SEQ ID NO: 496814 - protein, 9 aa, Homo Sapiens
TNTGEIQQF

SEQ ID NO: 496815 - protein, 9 aa, Homo Sapiens
GMNWRPILT

SEQ ID NO: 496816 - protein, 9 aa, Homo Sapiens
LIQVGRGSA

SEQ ID NO: 496817 - protein, 9 aa, Homo Sapiens
TCKKTKIRE

SEQ ID NO: 496818 - protein, 9 aa, Homo Sapiens
AHGQTLEED

SEQ ID NO: 496819 - protein, 9 aa, Homo Sapiens
ETSGKTTLR

SEQ ID NO: 496820 - protein, 9 aa, Homo Sapiens
SDNGKDSLA

SEQ ID NO: 496821 - protein, 9 aa, Homo Sapiens
RRAAQGGGP

SEQ ID NO: 496822 - protein, 9 aa, Homo Sapiens
ESAYAVQYW

SEQ ID NO: 496823 - protein, 9 aa, Homo Sapiens
TVEWSARSE

SEQ ID NO: 496824 - protein, 9 aa, Homo Sapiens
PRMNQFVLI

SEQ ID NO: 496825 - protein, 9 aa, Homo Sapiens
ASRLSGPTC

SEQ ID NO: 496826 - protein, 9 aa, Homo Sapiens
VPSAAAHGA

SEQ ID NO: 496827 - protein, 9 aa, Homo Sapiens
KPASHAMRS

SEQ ID NO: 496828 - protein, 9 aa, Homo Sapiens
CWTRGLKSS

SEQ ID NO: 496829 - protein, 9 aa, Homo Sapiens
SSPMEMTMP

SEQ ID NO: 496830 - protein, 9 aa, Homo Sapiens
PLTVEWSAR

SEQ ID NO: 496831 - protein, 9 aa, Homo Sapiens
YWPEAEEYT

SEQ ID NO: 496832 - protein, 9 aa, Homo Sapiens
MNQFVLIDL

SEQ ID NO: 496833 - protein, 9 aa, Homo Sapiens
GEPPAGCAQ

SEQ ID NO: 496834 - protein, 9 aa, Homo Sapiens
AHGAWSWEW

SEQ ID NO: 496835 - protein, 9 aa, Homo Sapiens
SEQCAVRKG

SEQ ID NO: 496836 - protein, 9 aa, Homo Sapiens
SRLSGPTCK

SEQ ID NO: 496837 - protein, 9 aa, Homo Sapiens
WGMTTRFDS

SEQ ID NO: 496838 - protein, 9 aa, Homo Sapiens
NNCTDNFTP

SEQ ID NO: 496839 - protein, 9 aa, Homo Sapiens
PSAAAHGAW

SEQ ID NO: 496840 - protein, 9 aa, Homo Sapiens
TLQSSKPNT

SEQ ID NO: 496841 - protein, 9 aa, Homo Sapiens
GGVDVFSLL

SEQ ID NO: 496842 - protein, 9 aa, Homo Sapiens
IQQFPVQLN

SEQ ID NO: 496843 - protein, 9 aa, Homo Sapiens
DLTVTSRGI

SEQ ID NO: 496844 - protein, 9 aa, Homo Sapiens
PQDASCTHV

SEQ ID NO: 496845 - protein, 9 aa, Homo Sapiens
TCLPKQTVL

SEQ ID NO: 496846 - protein, 9 aa, Homo Sapiens
YASRLSGPT

SEQ ID NO: 496847 - protein, 9 aa, Homo Sapiens
EIQQFPVQL

SEQ ID NO: 496848 - protein, 9 aa, Homo Sapiens
MQKDTNPLE

SEQ ID NO: 496849 - protein, 9 aa, Homo Sapiens
NSENAHGQT

SEQ ID NO: 496850 - protein, 9 aa, Homo Sapiens
WGAAYPEVA

SEQ ID NO: 496851 - protein, 9 aa, Homo Sapiens
WRGEGESQQ

SEQ ID NO: 496852 - protein, 9 aa, Homo Sapiens
QQAWSPQVR

SEQ ID NO: 496853 - protein, 9 aa, Homo Sapiens
AEKTPVKKA

SEQ ID NO: 496854 - protein, 9 aa, Homo Sapiens
RHKPRECQE

SEQ ID NO: 496855 - protein, 9 aa, Homo Sapiens
YPEVACWPG

SEQ ID NO: 496856 - protein, 9 aa, Homo Sapiens
WRPILTIIT

SEQ ID NO: 496857 - protein, 9 aa, Homo Sapiens
TMPIFQNIS

SEQ ID NO: 496858 - protein, 9 aa, Homo Sapiens
SANVRTILQ

SEQ ID NO: 496859 - protein, 9 aa, Homo Sapiens
QAWSPQVRG

SEQ ID NO: 496860 - protein, 9 aa, Homo Sapiens
KQTVLKIWD

SEQ ID NO: 496861 - protein, 9 aa, Homo Sapiens
SSKPNTETQ

SEQ ID NO: 496862 - protein, 9 aa, Homo Sapiens
ENAHGQTLE

SEQ ID NO: 496863 - protein, 9 aa, Homo Sapiens
TVTSRGITD

SEQ ID NO: 496864 - protein, 9 aa, Homo Sapiens
NYMSYTDNN

SEQ ID NO: 496865 - protein, 9 aa, Homo Sapiens
SGEPPAGCA

SEQ ID NO: 496866 - protein, 9 aa, Homo Sapiens
TNYMSYTDN

SEQ ID NO: 496867 - protein, 9 aa, Homo Sapiens
QANEELRVI

SEQ ID NO: 496868 - protein, 9 aa, Homo Sapiens
LRTRKSINY

SEQ ID NO: 496869 - protein, 9 aa, Homo Sapiens
SAAAHGAWS

SEQ ID NO: 496870 - protein, 9 aa, Homo Sapiens
EELRVIIKK

SEQ ID NO: 496871 - protein, 9 aa, Homo Sapiens
SNFDSLPVK

SEQ ID NO: 496872 - protein, 9 aa, Homo Sapiens
TGEIQQFPV

SEQ ID NO: 496873 - protein, 9 aa, Homo Sapiens
SGPTCKVSR

SEQ ID NO: 496874 - protein, 9 aa, Homo Sapiens
LPAAGLVGN

SEQ ID NO: 496875 - protein, 9 aa, Homo Sapiens
NKPASHAMR

SEQ ID NO: 496876 - protein, 9 aa, Homo Sapiens
LSGEPPAGC

SEQ ID NO: 496877 - protein, 9 aa, Homo Sapiens
NTGEIQQFP

SEQ ID NO: 496878 - protein, 9 aa, Homo Sapiens
GQTLEEDSA

SEQ ID NO: 496879 - protein, 9 aa, Homo Sapiens
HGCLDIVKE

SEQ ID NO: 496880 - protein, 9 aa, Homo Sapiens
SNKKTCTLK

SEQ ID NO: 496881 - protein, 9 aa, Homo Sapiens
MPTSIPQQQ

SEQ ID NO: 496882 - protein, 9 aa, Homo Sapiens
LQVYPTSLT

SEQ ID NO: 496883 - protein, 9 aa, Homo Sapiens
SEKPEQEML

SEQ ID NO: 496884 - protein, 9 aa, Homo Sapiens
LPRMNQFVL

SEQ ID NO: 496885 - protein, 9 aa, Homo Sapiens
GRVGQVSEF

SEQ ID NO: 496886 - protein, 9 aa, Homo Sapiens
PNTETQSSI

SEQ ID NO: 496887 - protein, 9 aa, Homo Sapiens
NFDSLPVKI

SEQ ID NO: 496888 - protein, 9 aa, Homo Sapiens
VSAGPLAYA

SEQ ID NO: 496889 - protein, 9 aa, Homo Sapiens
HKGFSANVR

SEQ ID NO: 496890 - protein, 9 aa, Homo Sapiens
VIIKKIWKR

SEQ ID NO: 496891 - protein, 9 aa, Homo Sapiens
FKKLRENCW

SEQ ID NO: 496892 - protein, 9 aa, Homo Sapiens
TRFDSSFSR

SEQ ID NO: 496893 - protein, 9 aa, Homo Sapiens
VPMCDASEQ

SEQ ID NO: 496894 - protein, 9 aa, Homo Sapiens
DCAGTAFSD

SEQ ID NO: 496895 - protein, 9 aa, Homo Sapiens
SIPQQQVFG

SEQ ID NO: 496896 - protein, 9 aa, Homo Sapiens
LSPTGRPKL

SEQ ID NO: 496897 - protein, 9 aa, Homo Sapiens
SPPSTTAAP

SEQ ID NO: 496898 - protein, 9 aa, Homo Sapiens
HLDFGMPPP

SEQ ID NO: 496899 - protein, 9 aa, Homo Sapiens
PRNLDLINR

SEQ ID NO: 496900 - protein, 9 aa, Homo Sapiens
TGRPKLRTR

SEQ ID NO: 496901 - protein, 9 aa, Homo Sapiens
YSGIAHALL

SEQ ID NO: 496902 - protein, 9 aa, Homo Sapiens
EDCAGTAFS

SEQ ID NO: 496903 - protein, 9 aa, Homo Sapiens
KPLSVIMGV

SEQ ID NO: 496904 - protein, 9 aa, Homo Sapiens
LRPRCPVCD

SEQ ID NO: 496905 - protein, 9 aa, Homo Sapiens
VQVVNIKAK

SEQ ID NO: 496906 - protein, 9 aa, Homo Sapiens
TAAVYFTKK

SEQ ID NO: 496907 - protein, 9 aa, Homo Sapiens
TINMANMEG

SEQ ID NO: 496908 - protein, 9 aa, Homo Sapiens
ILHKGFSAN

SEQ ID NO: 496909 - protein, 9 aa, Homo Sapiens
EWRGEGESQ

SEQ ID NO: 496910 - protein, 9 aa, Homo Sapiens
QYWPEAEEY

SEQ ID NO: 496911 - protein, 9 aa, Homo Sapiens
QKDTNPLEK

SEQ ID NO: 496912 - protein, 9 aa, Homo Sapiens
TMPTSIPQQ

SEQ ID NO: 496913 - protein, 9 aa, Homo Sapiens
PPSTTAAPV

SEQ ID NO: 496914 - protein, 9 aa, Homo Sapiens
LHKGFSANV

SEQ ID NO: 496915 - protein, 9 aa, Homo Sapiens
DASEQCAVR

SEQ ID NO: 496916 - protein, 9 aa, Homo Sapiens
MTNGLCIWL

SEQ ID NO: 496917 - protein, 9 aa, Homo Sapiens
TLKLQVYPT

SEQ ID NO: 496918 - protein, 9 aa, Homo Sapiens
SSTLKLQVY

SEQ ID NO: 496919 - protein, 9 aa, Homo Sapiens
EMLLFSLFF

SEQ ID NO: 496920 - protein, 9 aa, Homo Sapiens
RHLDFGMPP

SEQ ID NO: 496921 - protein, 9 aa, Homo Sapiens
PVIKAVPEA

SEQ ID NO: 496922 - protein, 9 aa, Homo Sapiens
FLPRMNQFV

SEQ ID NO: 496923 - protein, 9 aa, Homo Sapiens
PSPPSTTAA

SEQ ID NO: 496924 - protein, 9 aa, Homo Sapiens
HVPSAAAHG

SEQ ID NO: 496925 - protein, 9 aa, Homo Sapiens
TKIREKKLQ

SEQ ID NO: 496926 - protein, 9 aa, Homo Sapiens
DSLPVKITV

SEQ ID NO: 496927 - protein, 9 aa, Homo Sapiens
ESGNLGRVG

SEQ ID NO: 496928 - protein, 9 aa, Homo Sapiens
GCAQEPAHA

SEQ ID NO: 496929 - protein, 9 aa, Homo Sapiens
PETSGKTTL

SEQ ID NO: 496930 - protein, 9 aa, Homo Sapiens
GAAYPEVAC

SEQ ID NO: 496931 - protein, 9 aa, Homo Sapiens
MPPPACAGP

SEQ ID NO: 496932 - protein, 9 aa, Homo Sapiens
QSMPQEGHG

SEQ ID NO: 496933 - protein, 9 aa, Homo Sapiens
HGAWSWEWY

SEQ ID NO: 496934 - protein, 9 aa, Homo Sapiens
ASEQCAVRK

SEQ ID NO: 496935 - protein, 9 aa, Homo Sapiens
VKKARKSAG

SEQ ID NO: 496936 - protein, 9 aa, Homo Sapiens
VIKAVPEAP

SEQ ID NO: 496937 - protein, 9 aa, Homo Sapiens
KYVFFLDPR

SEQ ID NO: 496938 - protein, 9 aa, Homo Sapiens
ATSLPVTNT

SEQ ID NO: 496939 - protein, 9 aa, Homo Sapiens
FSLLVMALD

SEQ ID NO: 496940 - protein, 9 aa, Homo Sapiens
RLSGPTCKV

SEQ ID NO: 496941 - protein, 9 aa, Homo Sapiens
KKTKIREKK

SEQ ID NO: 496942 - protein, 9 aa, Homo Sapiens
NMANMEGSN

SEQ ID NO: 496943 - protein, 9 aa, Homo Sapiens
YGRRLIQVG

SEQ ID NO: 496944 - protein, 9 aa, Homo Sapiens
EHGCLDIVK

SEQ ID NO: 496945 - protein, 9 aa, Homo Sapiens
LSGEYNLET

SEQ ID NO: 496946 - protein, 9 aa, Homo Sapiens
ATSDNGKDS

SEQ ID NO: 496947 - protein, 9 aa, Homo Sapiens
LPKQTVLKI

SEQ ID NO: 496948 - protein, 9 aa, Homo Sapiens
DNGKDSLAY

SEQ ID NO: 496949 - protein, 9 aa, Homo Sapiens
MNWRPILTI

SEQ ID NO: 496950 - protein, 9 aa, Homo Sapiens
PEACVIDDH

SEQ ID NO: 496951 - protein, 9 aa, Homo Sapiens
ITMPTSIPQ

SEQ ID NO: 496952 - protein, 9 aa, Homo Sapiens
TPVKKARKS

SEQ ID NO: 496953 - protein, 9 aa, Homo Sapiens
LLRPRCPVC

SEQ ID NO: 496954 - protein, 9 aa, Homo Sapiens
QEMLLFSLF

SEQ ID NO: 496955 - protein, 9 aa, Homo Sapiens
RWRDGTPVM

SEQ ID NO: 496956 - protein, 9 aa, Homo Sapiens
QQNLLTMEQ

SEQ ID NO: 496957 - protein, 9 aa, Homo Sapiens
GDVQRDLTQ

SEQ ID NO: 496958 - protein, 9 aa, Homo Sapiens
QTLEEDSAL

SEQ ID NO: 496959 - protein, 9 aa, Homo Sapiens
LQSSKPNTE

SEQ ID NO: 496960 - protein, 9 aa, Homo Sapiens
RRLIQVMMM

SEQ ID NO: 496961 - protein, 9 aa, Homo Sapiens
RVGQVSEFE

SEQ ID NO: 496962 - protein, 9 aa, Homo Sapiens
AAVYFTKKD

SEQ ID NO: 496963 - protein, 9 aa, Homo Sapiens
PEQEMLLFS

SEQ ID NO: 496964 - protein, 9 aa, Homo Sapiens
LVMALDRYV

SEQ ID NO: 496965 - protein, 9 aa, Homo Sapiens
DGTPVMYQN

SEQ ID NO: 496966 - protein, 9 aa, Homo Sapiens
RKQSMPQEG

SEQ ID NO: 496967 - protein, 9 aa, Homo Sapiens
KETKVLKPL

SEQ ID NO: 496968 - protein, 9 aa, Homo Sapiens
KLRENCWTR

SEQ ID NO: 496969 - protein, 9 aa, Homo Sapiens
SSLWGAAYP

SEQ ID NO: 496970 - protein, 9 aa, Homo Sapiens
RGLKSSPME

SEQ ID NO: 496971 - protein, 9 aa, Homo Sapiens
NTETQSSIK

SEQ ID NO: 496972 - protein, 9 aa, Homo Sapiens
KDSLAYSAL

SEQ ID NO: 496973 - protein, 9 aa, Homo Sapiens
EKPEQEMLL

SEQ ID NO: 496974 - protein, 9 aa, Homo Sapiens
NVRTILQND

SEQ ID NO: 496975 - protein, 9 aa, Homo Sapiens
AVQYWPEAE

SEQ ID NO: 496976 - protein, 9 aa, Homo Sapiens
PNSYGRRLI

SEQ ID NO: 496977 - protein, 9 aa, Homo Sapiens
TSGKTTLRF

SEQ ID NO: 496978 - protein, 9 aa, Homo Sapiens
GSGTAAVYF

SEQ ID NO: 496979 - protein, 9 aa, Homo Sapiens
DVFSLLVMA

SEQ ID NO: 496980 - protein, 9 aa, Homo Sapiens
GESQQNLLT

SEQ ID NO: 496981 - protein, 9 aa, Homo Sapiens
QVRGEICGV

SEQ ID NO: 496982 - protein, 9 aa, Homo Sapiens
VQYWPEAEE

SEQ ID NO: 496983 - protein, 9 aa, Homo Sapiens
ALPSLTNPL

SEQ ID NO: 496984 - protein, 9 aa, Homo Sapiens
AQGGGPGPG

SEQ ID NO: 496985 - protein, 9 aa, Homo Sapiens
GITDLEIGM

SEQ ID NO: 496986 - protein, 9 aa, Homo Sapiens
SPTGRPKLR

SEQ ID NO: 496987 - protein, 9 aa, Homo Sapiens
SLPVKITVP

SEQ ID NO: 496988 - protein, 9 aa, Homo Sapiens
HVLVFPTSS

SEQ ID NO: 496989 - protein, 9 aa, Homo Sapiens
TPVIKAVPE

SEQ ID NO: 496990 - protein, 9 aa, Homo Sapiens
ASCTHVLVF

SEQ ID NO: 496991 - protein, 9 aa, Homo Sapiens
ALHQKISRH

SEQ ID NO: 496992 - protein, 9 aa, Homo Sapiens
NLDVSFIEL

SEQ ID NO: 496993 - protein, 9 aa, Homo Sapiens
QGCSAKSKN

SEQ ID NO: 496994 - protein, 9 aa, Homo Sapiens
WLLILSYVG

SEQ ID NO: 496995 - protein, 9 aa, Homo Sapiens
NEELRVIIK

SEQ ID NO: 496996 - protein, 9 aa, Homo Sapiens
RGSGTAAVY

SEQ ID NO: 496997 - protein, 9 aa, Homo Sapiens
KSKNLLAWN

SEQ ID NO: 496998 - protein, 9 aa, Homo Sapiens
ASHAMRSHT

SEQ ID NO: 496999 - protein, 9 aa, Homo Sapiens
QVPMCDASE

SEQ ID NO: 497000 - protein, 9 aa, Homo Sapiens
ALYSGIAHA

SEQ ID NO: 497001 - protein, 9 aa, Homo Sapiens
TISVVQVVN

SEQ ID NO: 497002 - protein, 9 aa, Homo Sapiens
HITMPTSIP

SEQ ID NO: 497003 - protein, 9 aa, Homo Sapiens
NWRPILTII

SEQ ID NO: 497004 - protein, 9 aa, Homo Sapiens
SVQVSAGPL

SEQ ID NO: 497005 - protein, 9 aa, Homo Sapiens
EACVIDDHS

SEQ ID NO: 497006 - protein, 9 aa, Homo Sapiens
YFTKKDHTA

SEQ ID NO: 497007 - protein, 9 aa, Homo Sapiens
SYTDNNCTD

SEQ ID NO: 497008 - protein, 9 aa, Homo Sapiens
AAQGGGPGP

SEQ ID NO: 497009 - protein, 9 aa, Homo Sapiens
TLFATCLPK

SEQ ID NO: 497010 - protein, 9 aa, Homo Sapiens
KQSMPQEGH

SEQ ID NO: 497011 - protein, 9 aa, Homo Sapiens
CIWLLILSY

SEQ ID NO: 497012 - protein, 9 aa, Homo Sapiens
GMTTRFDSS

SEQ ID NO: 497013 - protein, 9 aa, Homo Sapiens
STLQSSKPN

SEQ ID NO: 497014 - protein, 9 aa, Homo Sapiens
AHALLRQAS

SEQ ID NO: 497015 - protein, 9 aa, Homo Sapiens
FDTTLNTVR

SEQ ID NO: 497016 - protein, 9 aa, Homo Sapiens
KWGMTTRFD

SEQ ID NO: 497017 - protein, 9 aa, Homo Sapiens
RIWQGCSAK

SEQ ID NO: 497018 - protein, 9 aa, Homo Sapiens
RAEPATPVI

SEQ ID NO: 497019 - protein, 9 aa, Homo Sapiens
IWQGCSAKS

SEQ ID NO: 497020 - protein, 9 aa, Homo Sapiens
DSLAYSALL

SEQ ID NO: 497021 - protein, 9 aa, Homo Sapiens
SAGPLAYAR

SEQ ID NO: 497022 - protein, 9 aa, Homo Sapiens
WPEAEEYTE

SEQ ID NO: 497023 - protein, 9 aa, Homo Sapiens
CTLKHLLGE

SEQ ID NO: 497024 - protein, 9 aa, Homo Sapiens
SVSVQVSAG

SEQ ID NO: 497025 - protein, 9 aa, Homo Sapiens
VDVFSLLVM

SEQ ID NO: 497026 - protein, 9 aa, Homo Sapiens
SLAYSALLK

SEQ ID NO: 497027 - protein, 9 aa, Homo Sapiens
AGLVGNRGG

SEQ ID NO: 497028 - protein, 9 aa, Homo Sapiens
LWGAAYPEV

SEQ ID NO: 497029 - protein, 9 aa, Homo Sapiens
TPVMYQNWD

SEQ ID NO: 497030 - protein, 9 aa, Homo Sapiens
PPAGCAQEP

SEQ ID NO: 497031 - protein, 9 aa, Homo Sapiens
KTTLRFFFN

SEQ ID NO: 497032 - protein, 9 aa, Homo Sapiens
LDIVKELPE

SEQ ID NO: 497033 - protein, 9 aa, Homo Sapiens
EWSARSESA

SEQ ID NO: 497034 - protein, 9 aa, Homo Sapiens
TRGLKSSPM

SEQ ID NO: 497035 - protein, 9 aa, Homo Sapiens
VYFTKKDHT

SEQ ID NO: 497036 - protein, 9 aa, Homo Sapiens
GVDVFSLLV

SEQ ID NO: 497037 - protein, 9 aa, Homo Sapiens
PNKPASHAM

SEQ ID NO: 497038 - protein, 9 aa, Homo Sapiens
WLPAAGLVG

SEQ ID NO: 497039 - protein, 9 aa, Homo Sapiens
PATPVIKAV

SEQ ID NO: 497040 - protein, 9 aa, Homo Sapiens
YMSYTDNNC

SEQ ID NO: 497041 - protein, 9 aa, Homo Sapiens
SPMEMTMPI

SEQ ID NO: 497042 - protein, 9 aa, Homo Sapiens
TLNTVRTVV

SEQ ID NO: 497043 - protein, 9 aa, Homo Sapiens
AFLSNKKTC

SEQ ID NO: 497044 - protein, 9 aa, Homo Sapiens
WSARSESAQ

SEQ ID NO: 497045 - protein, 9 aa, Homo Sapiens
ANVRTILQN

SEQ ID NO: 497046 - protein, 9 aa, Homo Sapiens
KTIFMQKDT

SEQ ID NO: 497047 - protein, 9 aa, Homo Sapiens
AKSKNLLAW

SEQ ID NO: 497048 - protein, 9 aa, Homo Sapiens
MTMPIFQNI

SEQ ID NO: 497049 - protein, 9 aa, Homo Sapiens
PYASRLSGP

SEQ ID NO: 497050 - protein, 9 aa, Homo Sapiens
VQKKETTST

SEQ ID NO: 497051 - protein, 9 aa, Homo Sapiens
TLEEDSALE

SEQ ID NO: 497052 - protein, 9 aa, Homo Sapiens
QISNYIVQK

SEQ ID NO: 497053 - protein, 9 aa, Homo Sapiens
FEHTISVVQ

SEQ ID NO: 497054 - protein, 9 aa, Homo Sapiens
LRTYLSGEY

SEQ ID NO: 497055 - protein, 9 aa, Homo Sapiens
VRGEICGVG

SEQ ID NO: 497056 - protein, 9 aa, Homo Sapiens
GRRLIQVGR

SEQ ID NO: 497057 - protein, 9 aa, Homo Sapiens
CDASEQCAV

SEQ ID NO: 497058 - protein, 9 aa, Homo Sapiens
DVARRKAQR

SEQ ID NO: 497059 - protein, 9 aa, Homo Sapiens
AMRSHTEVT

SEQ ID NO: 497060 - protein, 9 aa, Homo Sapiens
IFLPRMNQF

SEQ ID NO: 497061 - protein, 9 aa, Homo Sapiens
TDNNCTDNF

SEQ ID NO: 497062 - protein, 9 aa, Homo Sapiens
DFGMPPPAC

SEQ ID NO: 497063 - protein, 9 aa, Homo Sapiens
VLKPLSVIM

SEQ ID NO: 497064 - protein, 9 aa, Homo Sapiens
SFIELTSFP

SEQ ID NO: 497065 - protein, 9 aa, Homo Sapiens
SGNLGRVGQ

SEQ ID NO: 497066 - protein, 9 aa, Homo Sapiens
AAAHGAWSW

SEQ ID NO: 497067 - protein, 9 aa, Homo Sapiens
AAHGAWSWE

SEQ ID NO: 497068 - protein, 9 aa, Homo Sapiens
RALRTYLSG

SEQ ID NO: 497069 - protein, 9 aa, Homo Sapiens
EKTLVLGDV

SEQ ID NO: 497070 - protein, 9 aa, Homo Sapiens
KITVPEKIR

SEQ ID NO: 497071 - protein, 9 aa, Homo Sapiens
VKELPETVI

SEQ ID NO: 497072 - protein, 9 aa, Homo Sapiens
LRVIIKKIW

SEQ ID NO: 497073 - protein, 9 aa, Homo Sapiens
GGMNWRPIL

SEQ ID NO: 497074 - protein, 9 aa, Homo Sapiens
DASCTHVLV

SEQ ID NO: 497075 - protein, 9 aa, Homo Sapiens
SVVQVVNIK

SEQ ID NO: 497076 - protein, 9 aa, Homo Sapiens
SMPQEGHGR

SEQ ID NO: 497077 - protein, 9 aa, Homo Sapiens
AYPEVACWP

SEQ ID NO: 497078 - protein, 9 aa, Homo Sapiens
YGRRLIQVM

SEQ ID NO: 497079 - protein, 9 aa, Homo Sapiens
VMYQNWDTG

SEQ ID NO: 497080 - protein, 9 aa, Homo Sapiens
LKEKTLVLG

SEQ ID NO: 497081 - protein, 9 aa, Homo Sapiens
VIDDHSPDT

SEQ ID NO: 497082 - protein, 9 aa, Homo Sapiens
QEGHGRFLG

SEQ ID NO: 497083 - protein, 9 aa, Homo Sapiens
RMNQFVLID

SEQ ID NO: 497084 - protein, 9 aa, Homo Sapiens
ANEELRVII

SEQ ID NO: 497085 - protein, 9 aa, Homo Sapiens
CLPKQTVLK

SEQ ID NO: 497086 - protein, 9 aa, Homo Sapiens
KVLKPLSVI

SEQ ID NO: 497087 - protein, 9 aa, Homo Sapiens
PVKITVPEK

SEQ ID NO: 497088 - protein, 9 aa, Homo Sapiens
SPLTVEWSA

SEQ ID NO: 497089 - protein, 9 aa, Homo Sapiens
IKAVPEAPK

SEQ ID NO: 497090 - protein, 9 aa, Homo Sapiens
STLKLQVYP

SEQ ID NO: 497091 - protein, 9 aa, Homo Sapiens
TYLSGEYNL

SEQ ID NO: 497092 - protein, 9 aa, Homo Sapiens
TIFMQKDTN

SEQ ID NO: 497093 - protein, 9 aa, Homo Sapiens
LVGNRGGCG

SEQ ID NO: 497094 - protein, 9 aa, Homo Sapiens
SGEYNLETS

SEQ ID NO: 497095 - protein, 9 aa, Homo Sapiens
CQISNYIVQ

SEQ ID NO: 497096 - protein, 9 aa, Homo Sapiens
SAYAVQYWP

SEQ ID NO: 497097 - protein, 9 aa, Homo Sapiens
TTRFDSSFS

SEQ ID NO: 497098 - protein, 9 aa, Homo Sapiens
AAGLVGNRG

SEQ ID NO: 497099 - protein, 9 aa, Homo Sapiens
VGQVSEFEY

SEQ ID NO: 497100 - protein, 9 aa, Homo Sapiens
RPRCPVCDQ

SEQ ID NO: 497101 - protein, 9 aa, Homo Sapiens
HKPRECQEY

SEQ ID NO: 497102 - protein, 9 aa, Homo Sapiens
GQVPMCDAS

SEQ ID NO: 497103 - protein, 9 aa, Homo Sapiens
VEWSARSES

SEQ ID NO: 497104 - protein, 9 aa, Homo Sapiens
MLLFSLFFC

SEQ ID NO: 497105 - protein, 9 aa, Homo Sapiens
PQVRGEICG

SEQ ID NO: 497106 - protein, 9 aa, Homo Sapiens
NGLCIWLLI

SEQ ID NO: 497107 - protein, 9 aa, Homo Sapiens
FTCKKTKIR

SEQ ID NO: 497108 - protein, 9 aa, Homo Sapiens
TSPLTVEWS

SEQ ID NO: 497109 - protein, 9 aa, Homo Sapiens
MTTRFDSSF

SEQ ID NO: 497110 - protein, 9 aa, Homo Sapiens
RPKLRTRKS

SEQ ID NO: 497111 - protein, 9 aa, Homo Sapiens
LKPLSVIMG

SEQ ID NO: 497112 - protein, 9 aa, Homo Sapiens
FPVQLNAGQ

SEQ ID NO: 497113 - protein, 9 aa, Homo Sapiens
KTCTLKHLL

SEQ ID NO: 497114 - protein, 9 aa, Homo Sapiens
AGTAFSDDP

SEQ ID NO: 497115 - protein, 9 aa, Homo Sapiens
LSEKPEQEM

SEQ ID NO: 497116 - protein, 9 aa, Homo Sapiens
ETKVLKPLS

SEQ ID NO: 497117 - protein, 9 aa, Homo Sapiens
IPQQQVFGL

SEQ ID NO: 497118 - protein, 9 aa, Homo Sapiens
SLLVMALDR

SEQ ID NO: 497119 - protein, 9 aa, Homo Sapiens
GCLDIVKEL

SEQ ID NO: 497120 - protein, 9 aa, Homo Sapiens
KPEQEMLLF

SEQ ID NO: 497121 - protein, 9 aa, Homo Sapiens
QVYPTSLTK

SEQ ID NO: 497122 - protein, 9 aa, Homo Sapiens
YFEHTISVV

SEQ ID NO: 497123 - protein, 9 aa, Homo Sapiens
TSIPQQQVF

SEQ ID NO: 497124 - protein, 9 aa, Homo Sapiens
SARSESAQS

SEQ ID NO: 497125 - protein, 9 aa, Homo Sapiens
RLIQVMMMG

SEQ ID NO: 497126 - protein, 9 aa, Homo Sapiens
FMQKDTNPL

SEQ ID NO: 497127 - protein, 9 aa, Homo Sapiens
GTPVMYQNW

SEQ ID NO: 497128 - protein, 9 aa, Homo Sapiens
PASHAMRSH

SEQ ID NO: 497129 - protein, 9 aa, Homo Sapiens
LALYSGIAH

SEQ ID NO: 497130 - protein, 9 aa, Homo Sapiens
NAHGQTLEE

SEQ ID NO: 497131 - protein, 9 aa, Homo Sapiens
RTYLSGEYN

SEQ ID NO: 497132 - protein, 9 aa, Homo Sapiens
LDFGMPPPA

SEQ ID NO: 497133 - protein, 9 aa, Homo Sapiens
QKWGMTTRF

SEQ ID NO: 497134 - protein, 9 aa, Homo Sapiens
PIFQNISSD

SEQ ID NO: 497135 - protein, 9 aa, Homo Sapiens
ACVIDDHSP

SEQ ID NO: 497136 - protein, 9 aa, Homo Sapiens
EHTISVVQV

SEQ ID NO: 497137 - protein, 9 aa, Homo Sapiens
SRGITDLEI

SEQ ID NO: 497138 - protein, 9 aa, Homo Sapiens
PLSVIMGVF

SEQ ID NO: 497139 - protein, 9 aa, Homo Sapiens
CSAKSKNLL

SEQ ID NO: 497140 - protein, 9 aa, Homo Sapiens
PVKKARKSA

SEQ ID NO: 497141 - protein, 9 aa, Homo Sapiens
CKKTKIREK

SEQ ID NO: 497142 - protein, 9 aa, Homo Sapiens
AWSPQVRGE

SEQ ID NO: 497143 - protein, 9 aa, Homo Sapiens
FYFTCKKTK

SEQ ID NO: 497144 - protein, 9 aa, Homo Sapiens
FIELTSFPT

SEQ ID NO: 497145 - protein, 9 aa, Homo Sapiens
EKTPVKKAR

SEQ ID NO: 497146 - protein, 9 aa, Homo Sapiens
GLCIWLLIL

SEQ ID NO: 497147 - protein, 9 aa, Homo Sapiens
NQPYASRLS

SEQ ID NO: 497148 - protein, 9 aa, Homo Sapiens
TSRGITDLE

SEQ ID NO: 497149 - protein, 9 aa, Homo Sapiens
QSSKPNTET

SEQ ID NO: 497150 - protein, 9 aa, Homo Sapiens
HAMRSHTEV

SEQ ID NO: 497151 - protein, 9 aa, Homo Sapiens
SAKSKNLLA

SEQ ID NO: 497152 - protein, 9 aa, Homo Sapiens
CMGGMNWRP

SEQ ID NO: 497153 - protein, 9 aa, Homo Sapiens
NTINMANME

SEQ ID NO: 497154 - protein, 9 aa, Homo Sapiens
IFMQKDTNP

SEQ ID NO: 497155 - protein, 9 aa, Homo Sapiens
RGEICGVGP

SEQ ID NO: 497156 - protein, 9 aa, Homo Sapiens
GRRLIQVMM

SEQ ID NO: 497157 - protein, 9 aa, Homo Sapiens
RDGTPVMYQ

SEQ ID NO: 497158 - protein, 9 aa, Homo Sapiens
GRPKLRTRK

SEQ ID NO: 497159 - protein, 9 aa, Homo Sapiens
YIVQKKETT

SEQ ID NO: 497160 - protein, 9 aa, Homo Sapiens
SLWGAAYPE

SEQ ID NO: 497161 - protein, 9 aa, Homo Sapiens
CVIDDHSPD

SEQ ID NO: 497162 - protein, 9 aa, Homo Sapiens
HQKISRHKP

SEQ ID NO: 497163 - protein, 9 aa, Homo Sapiens
GLKSSPMEM

SEQ ID NO: 497164 - protein, 9 aa, Homo Sapiens
WSPQVRGEI

SEQ ID NO: 497165 - protein, 9 aa, Homo Sapiens
LDVSFIELT

SEQ ID NO: 497166 - protein, 9 aa, Homo Sapiens
KDTNPLEKE

SEQ ID NO: 497167 - protein, 9 aa, Homo Sapiens
ISNYIVQKK

SEQ ID NO: 497168 - protein, 9 aa, Homo Sapiens
VFFLDPRNL

SEQ ID NO: 497169 - protein, 9 aa, Homo Sapiens
LGRVGQVSE

SEQ ID NO: 497170 - protein, 9 aa, Homo Sapiens
YFTCKKTKI

SEQ ID NO: 497171 - protein, 9 aa, Homo Sapiens
PMEMTMPIF

SEQ ID NO: 497172 - protein, 9 aa, Homo Sapiens
PMCDASEQC

SEQ ID NO: 497173 - protein, 9 aa, Homo Sapiens
IVKELPETV

SEQ ID NO: 497174 - protein, 9 aa, Homo Sapiens
EFKKLRENC

SEQ ID NO: 497175 - protein, 9 aa, Homo Sapiens
HVSPDFKHM

SEQ ID NO: 497176 - protein, 9 aa, Homo Sapiens
VARRKAQRI

SEQ ID NO: 497177 - protein, 9 aa, Homo Sapiens
SFYFTCKKT

SEQ ID NO: 497178 - protein, 9 aa, Homo Sapiens
NSYGRRLIQ

SEQ ID NO: 497179 - protein, 9 aa, Homo Sapiens
IVQKKETTS

SEQ ID NO: 497180 - protein, 9 aa, Homo Sapiens
QKKETTSTT

SEQ ID NO: 497181 - protein, 9 aa, Homo Sapiens
LPVKITVPE

SEQ ID NO: 497182 - protein, 9 aa, Homo Sapiens
RRHLDFGMP

SEQ ID NO: 497183 - protein, 9 aa, Homo Sapiens
YVFFLDPRN

SEQ ID NO: 497184 - protein, 9 aa, Homo Sapiens
DVSFIELTS

SEQ ID NO: 497185 - protein, 9 aa, Homo Sapiens
SIFLPRMNQ

SEQ ID NO: 497186 - protein, 9 aa, Homo Sapiens
ARRKAQRIG

SEQ ID NO: 497187 - protein, 9 aa, Homo Sapiens
FSDDPEGPP

SEQ ID NO: 497188 - protein, 9 aa, Homo Sapiens
GCSAKSKNL

SEQ ID NO: 497189 - protein, 9 aa, Homo Sapiens
AAYPEVACW

SEQ ID NO: 497190 - protein, 9 aa, Homo Sapiens
LYSGIAHAL

SEQ ID NO: 497191 - protein, 9 aa, Homo Sapiens
GTAAVYFTK

SEQ ID NO: 497192 - protein, 9 aa, Homo Sapiens
CAGTAFSDD

SEQ ID NO: 497193 - protein, 9 aa, Homo Sapiens
ISVVQVVNI

SEQ ID NO: 497194 - protein, 9 aa, Homo Sapiens
QGGGPGPGR

SEQ ID NO: 497195 - protein, 9 aa, Homo Sapiens
MGGMNWRPI

SEQ ID NO: 497196 - protein, 9 aa, Homo Sapiens
AVYFTKKDH

SEQ ID NO: 497197 - protein, 9 aa, Homo Sapiens
TCTLKHLLG

SEQ ID NO: 497198 - protein, 9 aa, Homo Sapiens
GEGESQQNL

SEQ ID NO: 497199 - protein, 9 aa, Homo Sapiens
RRKAQRIGE

SEQ ID NO: 497200 - protein, 9 aa, Homo Sapiens
MCDASEQCA

SEQ ID NO: 497201 - protein, 9 aa, Homo Sapiens
DPRNLDLIN

SEQ ID NO: 497202 - protein, 9 aa, Homo Sapiens
VCDQLIFSW

SEQ ID NO: 497203 - protein, 9 aa, Homo Sapiens
MPQEGHGRF

SEQ ID NO: 497204 - protein, 9 aa, Homo Sapiens
RVIIKKIWK

SEQ ID NO: 497205 - protein, 9 aa, Homo Sapiens
ENCWTRGLK

SEQ ID NO: 497206 - protein, 9 aa, Homo Sapiens
PPPACAGPH

SEQ ID NO: 497207 - protein, 9 aa, Homo Sapiens
HGLTRIWQG

SEQ ID NO: 497208 - protein, 9 aa, Homo Sapiens
SENAHGQTL

SEQ ID NO: 497209 - protein, 9 aa, Homo Sapiens
YLSGEYNLE

SEQ ID NO: 497210 - protein, 9 aa, Homo Sapiens
RLIQVGRGS

SEQ ID NO: 497211 - protein, 9 aa, Homo Sapiens
MEMTMPIFQ

SEQ ID NO: 497212 - protein, 9 aa, Homo Sapiens
NKKTCTLKH

SEQ ID NO: 497213 - protein, 9 aa, Homo Sapiens
QVSAGPLAY

SEQ ID NO: 497214 - protein, 9 aa, Homo Sapiens
ITDLEIGMY

SEQ ID NO: 497215 - protein, 9 aa, Homo Sapiens
KLQVYPTSL

SEQ ID NO: 497216 - protein, 9 aa, Homo Sapiens
RKAQRIGET

SEQ ID NO: 497217 - protein, 9 aa, Homo Sapiens
QKISRHKPR

SEQ ID NO: 497218 - protein, 9 aa, Homo Sapiens
CLDIVKELP

SEQ ID NO: 497219 - protein, 9 aa, Homo Sapiens
NMEGSNSKI

SEQ ID NO: 497220 - protein, 9 aa, Homo Sapiens
QQFPVQLNA

SEQ ID NO: 497221 - protein, 9 aa, Homo Sapiens
PVMYQNWDT

SEQ ID NO: 497222 - protein, 9 aa, Homo Sapiens
GMPPPACAG

SEQ ID NO: 497223 - protein, 9 aa, Homo Sapiens
SNYIVQKKE

SEQ ID NO: 497224 - protein, 9 aa, Homo Sapiens
TAFSDDPEG

SEQ ID NO: 497225 - protein, 9 aa, Homo Sapiens
GNLGRVGQV

SEQ ID NO: 497226 - protein, 9 aa, Homo Sapiens
EQANEELRV

SEQ ID NO: 497227 - protein, 9 aa, Homo Sapiens
MYQNWDTGR

SEQ ID NO: 497228 - protein, 9 aa, Homo Sapiens
PDVARRKAQ

SEQ ID NO: 497229 - protein, 9 aa, Homo Sapiens
SGKTTLRFF

SEQ ID NO: 497230 - protein, 9 aa, Homo Sapiens
WTRGLKSSP

SEQ ID NO: 497231 - protein, 9 aa, Homo Sapiens
KKTCTLKHL

SEQ ID NO: 497232 - protein, 9 aa, Homo Sapiens
GLTRIWQGC

SEQ ID NO: 497233 - protein, 9 aa, Homo Sapiens
QFVLIDLAG

SEQ ID NO: 497234 - protein, 9 aa, Homo Sapiens
TRIWQGCSA

SEQ ID NO: 497235 - protein, 9 aa, Homo Sapiens
LVLGDVQRD

SEQ ID NO: 497236 - protein, 9 aa, Homo Sapiens
LSGPTCKVS

SEQ ID NO: 497237 - protein, 9 aa, Homo Sapiens
SPQVRGEIC

SEQ ID NO: 497238 - protein, 9 aa, Homo Sapiens
LCIWLLILS

SEQ ID NO: 497239 - protein, 9 aa, Homo Sapiens
NDSSTLKLQ

SEQ ID NO: 497240 - protein, 9 aa, Homo Sapiens
LRFFFNLSS

SEQ ID NO: 497241 - protein, 9 aa, Homo Sapiens
ATPVIKAVP

SEQ ID NO: 497242 - protein, 9 aa, Homo Sapiens
EEHGCLDIV

SEQ ID NO: 497243 - protein, 9 aa, Homo Sapiens
HALLRQASY

SEQ ID NO: 497244 - protein, 9 aa, Homo Sapiens
RENCWTRGL

SEQ ID NO: 497245 - protein, 9 aa, Homo Sapiens
YRKQSMPQE

SEQ ID NO: 497246 - protein, 9 aa, Homo Sapiens
KTLVLGDVQ

SEQ ID NO: 497247 - protein, 9 aa, Homo Sapiens
LKLQVYPTS

SEQ ID NO: 497248 - protein, 9 aa, Homo Sapiens
SRHKPRECQ

SEQ ID NO: 497249 - protein, 9 aa, Homo Sapiens
PVCDQLIFS

SEQ ID NO: 497250 - protein, 9 aa, Homo Sapiens
KISRHKPRE

SEQ ID NO: 497251 - protein, 9 aa, Homo Sapiens
YAVQYWPEA

SEQ ID NO: 497252 - protein, 9 aa, Homo Sapiens
ALRTYLSGE

SEQ ID NO: 497253 - protein, 9 aa, Homo Sapiens
SCMGGMNWR

SEQ ID NO: 497254 - protein, 9 aa, Homo Sapiens
LGDVQRDLT

SEQ ID NO: 497255 - protein, 9 aa, Homo Sapiens
IMTNGLCIW

SEQ ID NO: 497256 - protein, 9 aa, Homo Sapiens
KKETKVLKP

SEQ ID NO: 497257 - protein, 9 aa, Homo Sapiens
TTLNTVRTV

SEQ ID NO: 497258 - protein, 9 aa, Homo Sapiens
LKSSPMEMT

SEQ ID NO: 497259 - protein, 9 aa, Homo Sapiens
FSANVRTIL

SEQ ID NO: 497260 - protein, 9 aa, Homo Sapiens
LSNKKTCTL

SEQ ID NO: 497261 - protein, 9 aa, Homo Sapiens
LPSLTNPLL

SEQ ID NO: 497262 - protein, 9 aa, Homo Sapiens
KKTIFMQKD

SEQ ID NO: 497263 - protein, 9 aa, Homo Sapiens
DNNCTDNFT

SEQ ID NO: 497264 - protein, 9 aa, Homo Sapiens
FATCLPKQT

SEQ ID NO: 497265 - protein, 9 aa, Homo Sapiens
FHSHRTPDV

SEQ ID NO: 497266 - protein, 9 aa, Homo Sapiens
FVGSCLGDS

SEQ ID NO: 497267 - protein, 9 aa, Homo Sapiens
WAHDPHPGP

SEQ ID NO: 497268 - protein, 9 aa, Homo Sapiens
KVSLLVRGP

SEQ ID NO: 497269 - protein, 9 aa, Homo Sapiens
KMNDYAGQH

SEQ ID NO: 497270 - protein, 9 aa, Homo Sapiens
NQQAVEVLQ

SEQ ID NO: 497271 - protein, 9 aa, Homo Sapiens
PNHDTVRYL

SEQ ID NO: 497272 - protein, 9 aa, Homo Sapiens
LNGRQEERL

SEQ ID NO: 497273 - protein, 9 aa, Homo Sapiens
DNAYLMTEG

SEQ ID NO: 497274 - protein, 9 aa, Homo Sapiens
LGVVGENYG

SEQ ID NO: 497275 - protein, 9 aa, Homo Sapiens
WCVLRPECL

SEQ ID NO: 497276 - protein, 9 aa, Homo Sapiens
RCKFEGCER

SEQ ID NO: 497277 - protein, 9 aa, Homo Sapiens
IAQGKEIHS

SEQ ID NO: 497278 - protein, 9 aa, Homo Sapiens
LPEFSIGRI

SEQ ID NO: 497279 - protein, 9 aa, Homo Sapiens
GGKDAQAIH

SEQ ID NO: 497280 - protein, 9 aa, Homo Sapiens
VEAQSIAFT

SEQ ID NO: 497281 - protein, 9 aa, Homo Sapiens
PKPNHDTVR

SEQ ID NO: 497282 - protein, 9 aa, Homo Sapiens
SDWIDEIQT

SEQ ID NO: 497283 - protein, 9 aa, Homo Sapiens
QSPSHGRHG

SEQ ID NO: 497284 - protein, 9 aa, Homo Sapiens
QGKEIHSLM

SEQ ID NO: 497285 - protein, 9 aa, Homo Sapiens
QAKMQFYLV

SEQ ID NO: 497286 - protein, 9 aa, Homo Sapiens
AAKGTAKKL

SEQ ID NO: 497287 - protein, 9 aa, Homo Sapiens
KGTAKKLEN

SEQ ID NO: 497288 - protein, 9 aa, Homo Sapiens
RPKDEVYFK

SEQ ID NO: 497289 - protein, 9 aa, Homo Sapiens
EAWSILLRT

SEQ ID NO: 497290 - protein, 9 aa, Homo Sapiens
TKFCTRGEA

SEQ ID NO: 497291 - protein, 9 aa, Homo Sapiens
ILKIYQLMG

SEQ ID NO: 497292 - protein, 9 aa, Homo Sapiens
SGGPPISKA

SEQ ID NO: 497293 - protein, 9 aa, Homo Sapiens
QESSEESTP

SEQ ID NO: 497294 - protein, 9 aa, Homo Sapiens
NGVVFVGSC

SEQ ID NO: 497295 - protein, 9 aa, Homo Sapiens
QLMGHSNMD

SEQ ID NO: 497296 - protein, 9 aa, Homo Sapiens
LAFPDDMDL

SEQ ID NO: 497297 - protein, 9 aa, Homo Sapiens
DLMACTQTG

SEQ ID NO: 497298 - protein, 9 aa, Homo Sapiens
LIGLLPEFS

SEQ ID NO: 497299 - protein, 9 aa, Homo Sapiens
GEKPFRCKF

SEQ ID NO: 497300 - protein, 9 aa, Homo Sapiens
LTEDGLVRP

SEQ ID NO: 497301 - protein, 9 aa, Homo Sapiens
YFTKTRFIL

SEQ ID NO: 497302 - protein, 9 aa, Homo Sapiens
TLVGREQSS

SEQ ID NO: 497303 - protein, 9 aa, Homo Sapiens
EAAGLSCQV

SEQ ID NO: 497304 - protein, 9 aa, Homo Sapiens
SHNIGIAMH

SEQ ID NO: 497305 - protein, 9 aa, Homo Sapiens
SDSQAKMQF

SEQ ID NO: 497306 - protein, 9 aa, Homo Sapiens
LSCQVKHSS

SEQ ID NO: 497307 - protein, 9 aa, Homo Sapiens
NEAWSILLR

SEQ ID NO: 497308 - protein, 9 aa, Homo Sapiens
VGLTLVGRE

SEQ ID NO: 497309 - protein, 9 aa, Homo Sapiens
EQLLGGKDA

SEQ ID NO: 497310 - protein, 9 aa, Homo Sapiens
LKLTPVGST

SEQ ID NO: 497311 - protein, 9 aa, Homo Sapiens
GLTLVGREQ

SEQ ID NO: 497312 - protein, 9 aa, Homo Sapiens
VSLLASPDP

SEQ ID NO: 497313 - protein, 9 aa, Homo Sapiens
RGEAEPSPL

SEQ ID NO: 497314 - protein, 9 aa, Homo Sapiens
KLILWCVLR

SEQ ID NO: 497315 - protein, 9 aa, Homo Sapiens
NSLLDYDKV

SEQ ID NO: 497316 - protein, 9 aa, Homo Sapiens
DGNASLLGV

SEQ ID NO: 497317 - protein, 9 aa, Homo Sapiens
IMAVVAGTP

SEQ ID NO: 497318 - protein, 9 aa, Homo Sapiens
LSFNVSWRY

SEQ ID NO: 497319 - protein, 9 aa, Homo Sapiens
SGSGQSPSH

SEQ ID NO: 497320 - protein, 9 aa, Homo Sapiens
KILKANHLE

SEQ ID NO: 497321 - protein, 9 aa, Homo Sapiens
TVRYLLEHL

SEQ ID NO: 497322 - protein, 9 aa, Homo Sapiens
ELRRVHLGS

SEQ ID NO: 497323 - protein, 9 aa, Homo Sapiens
TSEMYSIPE

SEQ ID NO: 497324 - protein, 9 aa, Homo Sapiens
GSCLGDSQL

SEQ ID NO: 497325 - protein, 9 aa, Homo Sapiens
PESEQESSE

SEQ ID NO: 497326 - protein, 9 aa, Homo Sapiens
LLPEFSIGR

SEQ ID NO: 497327 - protein, 9 aa, Homo Sapiens
PRGLLSQLV

SEQ ID NO: 497328 - protein, 9 aa, Homo Sapiens
LMACTQTGS

SEQ ID NO: 497329 - protein, 9 aa, Homo Sapiens
MTAYWTNFA

SEQ ID NO: 497330 - protein, 9 aa, Homo Sapiens
TKWDDGERL

SEQ ID NO: 497331 - protein, 9 aa, Homo Sapiens
PISKAPTMD

SEQ ID NO: 497332 - protein, 9 aa, Homo Sapiens
DDMDLRVYG

SEQ ID NO: 497333 - protein, 9 aa, Homo Sapiens
QGSSDVIRH

SEQ ID NO: 497334 - protein, 9 aa, Homo Sapiens
NIGIAMHTE

SEQ ID NO: 497335 - protein, 9 aa, Homo Sapiens
PVYSAEIAE

SEQ ID NO: 497336 - protein, 9 aa, Homo Sapiens
YSIMAVVAG

SEQ ID NO: 497337 - protein, 9 aa, Homo Sapiens
TALAYAQQA

SEQ ID NO: 497338 - protein, 9 aa, Homo Sapiens
QAQVKELQA

SEQ ID NO: 497339 - protein, 9 aa, Homo Sapiens
KVSKEHNYT

SEQ ID NO: 497340 - protein, 9 aa, Homo Sapiens
YHLVTEIQK

SEQ ID NO: 497341 - protein, 9 aa, Homo Sapiens
RIRPGRRSS

SEQ ID NO: 497342 - protein, 9 aa, Homo Sapiens
SDTMVEPYN

SEQ ID NO: 497343 - protein, 9 aa, Homo Sapiens
SSDVIRHQV

SEQ ID NO: 497344 - protein, 9 aa, Homo Sapiens
RYMYFHFLN

SEQ ID NO: 497345 - protein, 9 aa, Homo Sapiens
IAPSGEIEI

SEQ ID NO: 497346 - protein, 9 aa, Homo Sapiens
AWKTKKTSF

SEQ ID NO: 497347 - protein, 9 aa, Homo Sapiens
SFLTTLTGI

SEQ ID NO: 497348 - protein, 9 aa, Homo Sapiens
LLVGQMDGS

SEQ ID NO: 497349 - protein, 9 aa, Homo Sapiens
SELRNMCDD

SEQ ID NO: 497350 - protein, 9 aa, Homo Sapiens
GNTALAYAQ

SEQ ID NO: 497351 - protein, 9 aa, Homo Sapiens
PKVSDTMVE

SEQ ID NO: 497352 - protein, 9 aa, Homo Sapiens
APHPESEQE

SEQ ID NO: 497353 - protein, 9 aa, Homo Sapiens
TVSKAMTAY

SEQ ID NO: 497354 - protein, 9 aa, Homo Sapiens
LWCVLRPEC

SEQ ID NO: 497355 - protein, 9 aa, Homo Sapiens
EDGLVRPVL

SEQ ID NO: 497356 - protein, 9 aa, Homo Sapiens
ASGGPPISK

SEQ ID NO: 497357 - protein, 9 aa, Homo Sapiens
KELQAQVEQ

SEQ ID NO: 497358 - protein, 9 aa, Homo Sapiens
RLQAQVKEL

SEQ ID NO: 497359 - protein, 9 aa, Homo Sapiens
NQMLSLLNG

SEQ ID NO: 497360 - protein, 9 aa, Homo Sapiens
KIKDLKEDR

SEQ ID NO: 497361 - protein, 9 aa, Homo Sapiens
ACTQTGSGK

SEQ ID NO: 497362 - protein, 9 aa, Homo Sapiens
PDLTEDGLV

SEQ ID NO: 497363 - protein, 9 aa, Homo Sapiens
KTKWDDGER

SEQ ID NO: 497364 - protein, 9 aa, Homo Sapiens
ISKAPTMDA

SEQ ID NO: 497365 - protein, 9 aa, Homo Sapiens
HTEQGLIVP

SEQ ID NO: 497366 - protein, 9 aa, Homo Sapiens
EASLKLTPV

SEQ ID NO: 497367 - protein, 9 aa, Homo Sapiens
CKFEGCERR

SEQ ID NO: 497368 - protein, 9 aa, Homo Sapiens
QHTGQTVLL

SEQ ID NO: 497369 - protein, 9 aa, Homo Sapiens
LSFLTTLTG

SEQ ID NO: 497370 - protein, 9 aa, Homo Sapiens
DAAPIVSLL

SEQ ID NO: 497371 - protein, 9 aa, Homo Sapiens
HPAAKGTAK

SEQ ID NO: 497372 - protein, 9 aa, Homo Sapiens
SHGRHGSGL

SEQ ID NO: 497373 - protein, 9 aa, Homo Sapiens
PVENRCALV

SEQ ID NO: 497374 - protein, 9 aa, Homo Sapiens
QDYPLHVEA

SEQ ID NO: 497375 - protein, 9 aa, Homo Sapiens
AKMQFYLVV

SEQ ID NO: 497376 - protein, 9 aa, Homo Sapiens
AVLAFPDDM

SEQ ID NO: 497377 - protein, 9 aa, Homo Sapiens
LTTLTGINI

SEQ ID NO: 497378 - protein, 9 aa, Homo Sapiens
KELFFDYRY

SEQ ID NO: 497379 - protein, 9 aa, Homo Sapiens
SPELLLVGQ

SEQ ID NO: 497380 - protein, 9 aa, Homo Sapiens
IYQLMGHSN

SEQ ID NO: 497381 - protein, 9 aa, Homo Sapiens
TGTKSGNKI

SEQ ID NO: 497382 - protein, 9 aa, Homo Sapiens
VRYLLEHLC

SEQ ID NO: 497383 - protein, 9 aa, Homo Sapiens
LLGVVGENY

SEQ ID NO: 497384 - protein, 9 aa, Homo Sapiens
SDVIRHQVT

SEQ ID NO: 497385 - protein, 9 aa, Homo Sapiens
THSMQVQCE

SEQ ID NO: 497386 - protein, 9 aa, Homo Sapiens
GLLSQLVNL

SEQ ID NO: 497387 - protein, 9 aa, Homo Sapiens
QVKELQAQV

SEQ ID NO: 497388 - protein, 9 aa, Homo Sapiens
GTAKKLENS

SEQ ID NO: 497389 - protein, 9 aa, Homo Sapiens
PSLVTGYGA

SEQ ID NO: 497390 - protein, 9 aa, Homo Sapiens
YYSIMAVVA

SEQ ID NO: 497391 - protein, 9 aa, Homo Sapiens
STFFKGPPY

SEQ ID NO: 497392 - protein, 9 aa, Homo Sapiens
LVVVGASGV

SEQ ID NO: 497393 - protein, 9 aa, Homo Sapiens
EDRENIPTD

SEQ ID NO: 497394 - protein, 9 aa, Homo Sapiens
ILLRTVYSV

SEQ ID NO: 497395 - protein, 9 aa, Homo Sapiens
ELSFLTTLT

SEQ ID NO: 497396 - protein, 9 aa, Homo Sapiens
SNLNKMNDY

SEQ ID NO: 497397 - protein, 9 aa, Homo Sapiens
TGQYCDRLY

SEQ ID NO: 497398 - protein, 9 aa, Homo Sapiens
WHSYHHPDQ

SEQ ID NO: 497399 - protein, 9 aa, Homo Sapiens
QVKHSSLGG

SEQ ID NO: 497400 - protein, 9 aa, Homo Sapiens
ILWCVLRPE

SEQ ID NO: 497401 - protein, 9 aa, Homo Sapiens
QEAQYHLVT

SEQ ID NO: 497402 - protein, 9 aa, Homo Sapiens
WIDEIQTPK

SEQ ID NO: 497403 - protein, 9 aa, Homo Sapiens
QQAVEVLQH

SEQ ID NO: 497404 - protein, 9 aa, Homo Sapiens
QYCDRLYVP

SEQ ID NO: 497405 - protein, 9 aa, Homo Sapiens
GLQEAQYHL

SEQ ID NO: 497406 - protein, 9 aa, Homo Sapiens
RPGRRSSNA

SEQ ID NO: 497407 - protein, 9 aa, Homo Sapiens
APSGEIEIE

SEQ ID NO: 497408 - protein, 9 aa, Homo Sapiens
KVSDTMVEP

SEQ ID NO: 497409 - protein, 9 aa, Homo Sapiens
RAIQAGKEL

SEQ ID NO: 497410 - protein, 9 aa, Homo Sapiens
KPVYSAEIA

SEQ ID NO: 497411 - protein, 9 aa, Homo Sapiens
TKKRKKYKR

SEQ ID NO: 497412 - protein, 9 aa, Homo Sapiens
AAPIVSLLA

SEQ ID NO: 497413 - protein, 9 aa, Homo Sapiens
RVNTAWKTK

SEQ ID NO: 497414 - protein, 9 aa, Homo Sapiens
MTKKKRVNT

SEQ ID NO: 497415 - protein, 9 aa, Homo Sapiens
GSGQSPSHG

SEQ ID NO: 497416 - protein, 9 aa, Homo Sapiens
SCQVKHSSL

SEQ ID NO: 497417 - protein, 9 aa, Homo Sapiens
DFERPFLTP

SEQ ID NO: 497418 - protein, 9 aa, Homo Sapiens
AAGLSCQVK

SEQ ID NO: 497419 - protein, 9 aa, Homo Sapiens
YCDRLYVPC

SEQ ID NO: 497420 - protein, 9 aa, Homo Sapiens
MKTKFCTRG

SEQ ID NO: 497421 - protein, 9 aa, Homo Sapiens
QKLILWCVL

SEQ ID NO: 497422 - protein, 9 aa, Homo Sapiens
EFDIKVSLL

SEQ ID NO: 497423 - protein, 9 aa, Homo Sapiens
LGLAQNHEN

SEQ ID NO: 497424 - protein, 9 aa, Homo Sapiens
ERPFLTPAG

SEQ ID NO: 497425 - protein, 9 aa, Homo Sapiens
KEDRENIPT

SEQ ID NO: 497426 - protein, 9 aa, Homo Sapiens
SGGRAWHSY

SEQ ID NO: 497427 - protein, 9 aa, Homo Sapiens
REQSSMQLR

SEQ ID NO: 497428 - protein, 9 aa, Homo Sapiens
LPQELRRVH

SEQ ID NO: 497429 - protein, 9 aa, Homo Sapiens
RAWHSYHHP

SEQ ID NO: 497430 - protein, 9 aa, Homo Sapiens
ERLFSGTNV

SEQ ID NO: 497431 - protein, 9 aa, Homo Sapiens
EMYSIPETV

SEQ ID NO: 497432 - protein, 9 aa, Homo Sapiens
GLSSGGRAW

SEQ ID NO: 497433 - protein, 9 aa, Homo Sapiens
MDLRVYGPA

SEQ ID NO: 497434 - protein, 9 aa, Homo Sapiens
RLITSSPTL

SEQ ID NO: 497435 - protein, 9 aa, Homo Sapiens
NGRQEERLR

SEQ ID NO: 497436 - protein, 9 aa, Homo Sapiens
GQMDGSLGL

SEQ ID NO: 497437 - protein, 9 aa, Homo Sapiens
VKEAITHSM

SEQ ID NO: 497438 - protein, 9 aa, Homo Sapiens
AQNHENQSR

SEQ ID NO: 497439 - protein, 9 aa, Homo Sapiens
IAMHTEQGL

SEQ ID NO: 497440 - protein, 9 aa, Homo Sapiens
KSGNKIFSR

SEQ ID NO: 497441 - protein, 9 aa, Homo Sapiens
SLLGVVGEN

SEQ ID NO: 497442 - protein, 9 aa, Homo Sapiens
RTEFNYFTK

SEQ ID NO: 497443 - protein, 9 aa, Homo Sapiens
FLTPAGHVT

SEQ ID NO: 497444 - protein, 9 aa, Homo Sapiens
RQAAASKLG

SEQ ID NO: 497445 - protein, 9 aa, Homo Sapiens
NKMNDYAGQ

SEQ ID NO: 497446 - protein, 9 aa, Homo Sapiens
EVLSFNVSW

SEQ ID NO: 497447 - protein, 9 aa, Homo Sapiens
NYTKENTIR

SEQ ID NO: 497448 - protein, 9 aa, Homo Sapiens
YQLMGHSNM

SEQ ID NO: 497449 - protein, 9 aa, Homo Sapiens
TEQNRRLQH

SEQ ID NO: 497450 - protein, 9 aa, Homo Sapiens
AVEVLQHTG

SEQ ID NO: 497451 - protein, 9 aa, Homo Sapiens
DDGERLFSG

SEQ ID NO: 497452 - protein, 9 aa, Homo Sapiens
AQGKEIHSL

SEQ ID NO: 497453 - protein, 9 aa, Homo Sapiens
VKELQAQVE

SEQ ID NO: 497454 - protein, 9 aa, Homo Sapiens
NHDTVRYLL

SEQ ID NO: 497455 - protein, 9 aa, Homo Sapiens
RDLMACTQT

SEQ ID NO: 497456 - protein, 9 aa, Homo Sapiens
KPNHDTVRY

SEQ ID NO: 497457 - protein, 9 aa, Homo Sapiens
VTGYGAYLA

SEQ ID NO: 497458 - protein, 9 aa, Homo Sapiens
PPISKAPTM

SEQ ID NO: 497459 - protein, 9 aa, Homo Sapiens
KISGVNGTY

SEQ ID NO: 497460 - protein, 9 aa, Homo Sapiens
GGRAWHSYH

SEQ ID NO: 497461 - protein, 9 aa, Homo Sapiens
SSYSSPATE

SEQ ID NO: 497462 - protein, 9 aa, Homo Sapiens
FNVSWRYEE

SEQ ID NO: 497463 - protein, 9 aa, Homo Sapiens
GFPGAAGWT

SEQ ID NO: 497464 - protein, 9 aa, Homo Sapiens
VAYEAPSLV

SEQ ID NO: 497465 - protein, 9 aa, Homo Sapiens
MPKPNHDTV

SEQ ID NO: 497466 - protein, 9 aa, Homo Sapiens
AISYYSIMA

SEQ ID NO: 497467 - protein, 9 aa, Homo Sapiens
GSSDVIRHQ

SEQ ID NO: 497468 - protein, 9 aa, Homo Sapiens
GRRSSNASL

SEQ ID NO: 497469 - protein, 9 aa, Homo Sapiens
IVSLLASPD

SEQ ID NO: 497470 - protein, 9 aa, Homo Sapiens
SQSRLITSS

SEQ ID NO: 497471 - protein, 9 aa, Homo Sapiens
PMVRQAAAS

SEQ ID NO: 497472 - protein, 9 aa, Homo Sapiens
ELRNMCDDH

SEQ ID NO: 497473 - protein, 9 aa, Homo Sapiens
AMPVFEKPV

SEQ ID NO: 497474 - protein, 9 aa, Homo Sapiens
KIFSRVEKS

SEQ ID NO: 497475 - protein, 9 aa, Homo Sapiens
IGDFERPFL

SEQ ID NO: 497476 - protein, 9 aa, Homo Sapiens
TGASGGPPI

SEQ ID NO: 497477 - protein, 9 aa, Homo Sapiens
HNYTKENTI

SEQ ID NO: 497478 - protein, 9 aa, Homo Sapiens
SRLITSSPT

SEQ ID NO: 497479 - protein, 9 aa, Homo Sapiens
CALVSEDQE

SEQ ID NO: 497480 - protein, 9 aa, Homo Sapiens
AAGWTGPPG

SEQ ID NO: 497481 - protein, 9 aa, Homo Sapiens
LKIYQLMGH

SEQ ID NO: 497482 - protein, 9 aa, Homo Sapiens
TKTRFILEE

SEQ ID NO: 497483 - protein, 9 aa, Homo Sapiens
AEMSDWIDE

SEQ ID NO: 497484 - protein, 9 aa, Homo Sapiens
LILWCVLRP

SEQ ID NO: 497485 - protein, 9 aa, Homo Sapiens
HPESEQESS

SEQ ID NO: 497486 - protein, 9 aa, Homo Sapiens
YSSPATEQN

SEQ ID NO: 497487 - protein, 9 aa, Homo Sapiens
YFKYYTPVP

SEQ ID NO: 497488 - protein, 9 aa, Homo Sapiens
EDAAPIVSL

SEQ ID NO: 497489 - protein, 9 aa, Homo Sapiens
TPVGSTASL

SEQ ID NO: 497490 - protein, 9 aa, Homo Sapiens
ITSEMYSIP

SEQ ID NO: 497491 - protein, 9 aa, Homo Sapiens
VYSAEIAES

SEQ ID NO: 497492 - protein, 9 aa, Homo Sapiens
YTKENTIRT

SEQ ID NO: 497493 - protein, 9 aa, Homo Sapiens
SCLGDSQLV

SEQ ID NO: 497494 - protein, 9 aa, Homo Sapiens
PLHVEAQSI

SEQ ID NO: 497495 - protein, 9 aa, Homo Sapiens
LLNGRQEER

SEQ ID NO: 497496 - protein, 9 aa, Homo Sapiens
LAQNHENQS

SEQ ID NO: 497497 - protein, 9 aa, Homo Sapiens
SKAMTAYWT

SEQ ID NO: 497498 - protein, 9 aa, Homo Sapiens
LYEFDIKVS

SEQ ID NO: 497499 - protein, 9 aa, Homo Sapiens
CLGDSQLVK

SEQ ID NO: 497500 - protein, 9 aa, Homo Sapiens
LLRKILKAN

SEQ ID NO: 497501 - protein, 9 aa, Homo Sapiens
IKVSLLVRG

SEQ ID NO: 497502 - protein, 9 aa, Homo Sapiens
KAMTAYWTN

SEQ ID NO: 497503 - protein, 9 aa, Homo Sapiens
ISGVNGTYI

SEQ ID NO: 497504 - protein, 9 aa, Homo Sapiens
AYEAPSLVT

SEQ ID NO: 497505 - protein, 9 aa, Homo Sapiens
VLQHTGQTV

SEQ ID NO: 497506 - protein, 9 aa, Homo Sapiens
LLDYDKVAA

SEQ ID NO: 497507 - protein, 9 aa, Homo Sapiens
EVYFKYYTP

SEQ ID NO: 497508 - protein, 9 aa, Homo Sapiens
SKEHNYTKE

SEQ ID NO: 497509 - protein, 9 aa, Homo Sapiens
ARQVSVAYN

SEQ ID NO: 497510 - protein, 9 aa, Homo Sapiens
NGTYICMVF

SEQ ID NO: 497511 - protein, 9 aa, Homo Sapiens
YEFDIKVSL

SEQ ID NO: 497512 - protein, 9 aa, Homo Sapiens
QQASSQECI

SEQ ID NO: 497513 - protein, 9 aa, Homo Sapiens
RRPQDSTFF

SEQ ID NO: 497514 - protein, 9 aa, Homo Sapiens
RLPQELRRV

SEQ ID NO: 497515 - protein, 9 aa, Homo Sapiens
TFFKGPPYP

SEQ ID NO: 497516 - protein, 9 aa, Homo Sapiens
SPKVSDTMV

SEQ ID NO: 497517 - protein, 9 aa, Homo Sapiens
TYICMVFEV

SEQ ID NO: 497518 - protein, 9 aa, Homo Sapiens
TAWKTKKTS

SEQ ID NO: 497519 - protein, 9 aa, Homo Sapiens
SGNKIFSRV

SEQ ID NO: 497520 - protein, 9 aa, Homo Sapiens
PNQNSLLDY

SEQ ID NO: 497521 - protein, 9 aa, Homo Sapiens
RLYVPCAPS

SEQ ID NO: 497522 - protein, 9 aa, Homo Sapiens
DLKEDRENI

SEQ ID NO: 497523 - protein, 9 aa, Homo Sapiens
NASLLGVVG

SEQ ID NO: 497524 - protein, 9 aa, Homo Sapiens
IRYMYFHFL

SEQ ID NO: 497525 - protein, 9 aa, Homo Sapiens
ELVRHHRYK

SEQ ID NO: 497526 - protein, 9 aa, Homo Sapiens
QAVEVLQHT

SEQ ID NO: 497527 - protein, 9 aa, Homo Sapiens
GREQSSMQL

SEQ ID NO: 497528 - protein, 9 aa, Homo Sapiens
HDTVRYLLE

SEQ ID NO: 497529 - protein, 9 aa, Homo Sapiens
AWLEMDSVL

SEQ ID NO: 497530 - protein, 9 aa, Homo Sapiens
DIKVSLLVR

SEQ ID NO: 497531 - protein, 9 aa, Homo Sapiens
IEIEGAPAV

SEQ ID NO: 497532 - protein, 9 aa, Homo Sapiens
DRPKDEVYF

SEQ ID NO: 497533 - protein, 9 aa, Homo Sapiens
ASLKLTPVG

SEQ ID NO: 497534 - protein, 9 aa, Homo Sapiens
DSQAKMQFY

SEQ ID NO: 497535 - protein, 9 aa, Homo Sapiens
SPATEQNRR

SEQ ID NO: 497536 - protein, 9 aa, Homo Sapiens
MYFHFLNST

SEQ ID NO: 497537 - protein, 9 aa, Homo Sapiens
GWTGPPGPS

SEQ ID NO: 497538 - protein, 9 aa, Homo Sapiens
FQGSSDVIR

SEQ ID NO: 497539 - protein, 9 aa, Homo Sapiens
ATEQNRRLQ

SEQ ID NO: 497540 - protein, 9 aa, Homo Sapiens
NKIFSRVEK

SEQ ID NO: 497541 - protein, 9 aa, Homo Sapiens
GNVERNIAQ

SEQ ID NO: 497542 - protein, 9 aa, Homo Sapiens
DTVRYLLEH

SEQ ID NO: 497543 - protein, 9 aa, Homo Sapiens
AKKLENSPG

SEQ ID NO: 497544 - protein, 9 aa, Homo Sapiens
LKANHLEDK

SEQ ID NO: 497545 - protein, 9 aa, Homo Sapiens
AGLSCQVKH

SEQ ID NO: 497546 - protein, 9 aa, Homo Sapiens
YAISYYSIM

SEQ ID NO: 497547 - protein, 9 aa, Homo Sapiens
VGQMDGSLG

SEQ ID NO: 497548 - protein, 9 aa, Homo Sapiens
LWAHDPHPG

SEQ ID NO: 497549 - protein, 9 aa, Homo Sapiens
QRAFPCTDC

SEQ ID NO: 497550 - protein, 9 aa, Homo Sapiens
EVAGAWLEM

SEQ ID NO: 497551 - protein, 9 aa, Homo Sapiens
QMLSLLNGR

SEQ ID NO: 497552 - protein, 9 aa, Homo Sapiens
LVRPVLAGI

SEQ ID NO: 497553 - protein, 9 aa, Homo Sapiens
NAYLMTEGS

SEQ ID NO: 497554 - protein, 9 aa, Homo Sapiens
EGTDGDNAY

SEQ ID NO: 497555 - protein, 9 aa, Homo Sapiens
ISYYSIMAV

SEQ ID NO: 497556 - protein, 9 aa, Homo Sapiens
PQELRRVHL

SEQ ID NO: 497557 - protein, 9 aa, Homo Sapiens
MHTEQGLIV

SEQ ID NO: 497558 - protein, 9 aa, Homo Sapiens
SVEGTDGDN

SEQ ID NO: 497559 - protein, 9 aa, Homo Sapiens
KLEASLKLT

SEQ ID NO: 497560 - protein, 9 aa, Homo Sapiens
NIAQGKEIH

SEQ ID NO: 497561 - protein, 9 aa, Homo Sapiens
DLTEDGLVR

SEQ ID NO: 497562 - protein, 9 aa, Homo Sapiens
AWHSYHHPD

SEQ ID NO: 497563 - protein, 9 aa, Homo Sapiens
TAYWTNFAK

SEQ ID NO: 497564 - protein, 9 aa, Homo Sapiens
PKDEVYFKY

SEQ ID NO: 497565 - protein, 9 aa, Homo Sapiens
PSSRLEVTR

SEQ ID NO: 497566 - protein, 9 aa, Homo Sapiens
VRHHRYKHT

SEQ ID NO: 497567 - protein, 9 aa, Homo Sapiens
FLTTLTGIN

SEQ ID NO: 497568 - protein, 9 aa, Homo Sapiens
YESFEVGAR

SEQ ID NO: 497569 - protein, 9 aa, Homo Sapiens
SPSHGRHGS

SEQ ID NO: 497570 - protein, 9 aa, Homo Sapiens
DRENIPTDK

SEQ ID NO: 497571 - protein, 9 aa, Homo Sapiens
ESFEVGARQ

SEQ ID NO: 497572 - protein, 9 aa, Homo Sapiens
GAAGWTGPP

SEQ ID NO: 497573 - protein, 9 aa, Homo Sapiens
NLNKMNDYA

SEQ ID NO: 497574 - protein, 9 aa, Homo Sapiens
PATEQNRRL

SEQ ID NO: 497575 - protein, 9 aa, Homo Sapiens
TPSDSQAKM

SEQ ID NO: 497576 - protein, 9 aa, Homo Sapiens
IKDLKEDRE

SEQ ID NO: 497577 - protein, 9 aa, Homo Sapiens
CVLRPECLA

SEQ ID NO: 497578 - protein, 9 aa, Homo Sapiens
MVEPYNATL

SEQ ID NO: 497579 - protein, 9 aa, Homo Sapiens
CEKEVLSFN

SEQ ID NO: 497580 - protein, 9 aa, Homo Sapiens
TSLGLAQNH

SEQ ID NO: 497581 - protein, 9 aa, Homo Sapiens
ITSSPTLIS

SEQ ID NO: 497582 - protein, 9 aa, Homo Sapiens
DGLVRPVLA

SEQ ID NO: 497583 - protein, 9 aa, Homo Sapiens
GLAQNHENQ

SEQ ID NO: 497584 - protein, 9 aa, Homo Sapiens
VGSCLGDSQ

SEQ ID NO: 497585 - protein, 8 aa, Homo Sapiens
SRSVALAV

SEQ ID NO: 497586 - protein, 9 aa, Homo Sapiens
HPGPGVSAG

SEQ ID NO: 497587 - protein, 9 aa, Homo Sapiens
DDTPMVRQA

SEQ ID NO: 497588 - protein, 9 aa, Homo Sapiens
RRSSNASLE

SEQ ID NO: 497589 - protein, 9 aa, Homo Sapiens
PQDSTFFKG

SEQ ID NO: 497590 - protein, 9 aa, Homo Sapiens
RPFLTPAGH

SEQ ID NO: 497591 - protein, 9 aa, Homo Sapiens
QEVAGAWLE

SEQ ID NO: 497592 - protein, 9 aa, Homo Sapiens
HENQSRKLD

SEQ ID NO: 497593 - protein, 9 aa, Homo Sapiens
TEFNYFTKT

SEQ ID NO: 497594 - protein, 9 aa, Homo Sapiens
SELSFLTTL

SEQ ID NO: 497595 - protein, 9 aa, Homo Sapiens
YVRPNQNSL

SEQ ID NO: 497596 - protein, 9 aa, Homo Sapiens
FNYFTKTRF

SEQ ID NO: 497597 - protein, 9 aa, Homo Sapiens
KFCTRGEAE

SEQ ID NO: 497598 - protein, 9 aa, Homo Sapiens
GLVRPVLAG

SEQ ID NO: 497599 - protein, 9 aa, Homo Sapiens
VNTAWKTKK

SEQ ID NO: 497600 - protein, 9 aa, Homo Sapiens
EHNYTKENT

SEQ ID NO: 497601 - protein, 9 aa, Homo Sapiens
ITHSMQVQC

SEQ ID NO: 497602 - protein, 9 aa, Homo Sapiens
DYPLHVEAQ

SEQ ID NO: 497603 - protein, 9 aa, Homo Sapiens
GERLFSGTN

SEQ ID NO: 497604 - protein, 9 aa, Homo Sapiens
PDVKYTQPD

SEQ ID NO: 497605 - protein, 9 aa, Homo Sapiens
TTSQSRLIT

SEQ ID NO: 497606 - protein, 9 aa, Homo Sapiens
KDLKEDREN

SEQ ID NO: 497607 - protein, 9 aa, Homo Sapiens
ELIGLLPEF

SEQ ID NO: 497608 - protein, 9 aa, Homo Sapiens
EKIKDLKED

SEQ ID NO: 497609 - protein, 9 aa, Homo Sapiens
LQHTGQTVL

SEQ ID NO: 497610 - protein, 9 aa, Homo Sapiens
ERNIAQGKE

SEQ ID NO: 497611 - protein, 9 aa, Homo Sapiens
DGERLFSGT

SEQ ID NO: 497612 - protein, 9 aa, Homo Sapiens
SLLASPDPR

SEQ ID NO: 497613 - protein, 9 aa, Homo Sapiens
LLGGKDAQA

SEQ ID NO: 497614 - protein, 9 aa, Homo Sapiens
ISNLNKMND

SEQ ID NO: 497615 - protein, 9 aa, Homo Sapiens
EVRRPQDST

SEQ ID NO: 497616 - protein, 9 aa, Homo Sapiens
FPCTDCGQS

SEQ ID NO: 497617 - protein, 9 aa, Homo Sapiens
TDGDNAYLM

SEQ ID NO: 497618 - protein, 9 aa, Homo Sapiens
IGIAMHTEQ

SEQ ID NO: 497619 - protein, 9 aa, Homo Sapiens
EKEVLSFNV

SEQ ID NO: 497620 - protein, 9 aa, Homo Sapiens
GAWLEMDSV

SEQ ID NO: 497621 - protein, 9 aa, Homo Sapiens
LQKLILWCV

SEQ ID NO: 497622 - protein, 9 aa, Homo Sapiens
LGGKDAQAI

SEQ ID NO: 497623 - protein, 9 aa, Homo Sapiens
TELIGLLPE

SEQ ID NO: 497624 - protein, 9 aa, Homo Sapiens
VQITSEMYS

SEQ ID NO: 497625 - protein, 9 aa, Homo Sapiens
TDCGQSFRL

SEQ ID NO: 497626 - protein, 9 aa, Homo Sapiens
PEQLLGGKD

SEQ ID NO: 497627 - protein, 9 aa, Homo Sapiens
KTKFCTRGE

SEQ ID NO: 497628 - protein, 9 aa, Homo Sapiens
TRGEAEPSP

SEQ ID NO: 497629 - protein, 9 aa, Homo Sapiens
IQDYPLHVE

SEQ ID NO: 497630 - protein, 9 aa, Homo Sapiens
RGLLSQLVN

SEQ ID NO: 497631 - protein, 9 aa, Homo Sapiens
HDPHPGPGV

SEQ ID NO: 497632 - protein, 9 aa, Homo Sapiens
YICMVFEVL

SEQ ID NO: 497633 - protein, 9 aa, Homo Sapiens
FRCKFEGCE

SEQ ID NO: 497634 - protein, 9 aa, Homo Sapiens
VNGTYICMV

SEQ ID NO: 497635 - protein, 9 aa, Homo Sapiens
KKLENSPGH

SEQ ID NO: 497636 - protein, 9 aa, Homo Sapiens
TQTGSGKTA

SEQ ID NO: 497637 - protein, 9 aa, Homo Sapiens
WPSSRLEVT

SEQ ID NO: 497638 - protein, 9 aa, Homo Sapiens
GAPHPESEQ

SEQ ID NO: 497639 - protein, 9 aa, Homo Sapiens
LPRGLLSQL

SEQ ID NO: 497640 - protein, 9 aa, Homo Sapiens
LTLVGREQS

SEQ ID NO: 497641 - protein, 9 aa, Homo Sapiens
SGVNGTYIC

SEQ ID NO: 497642 - protein, 9 aa, Homo Sapiens
RCALVSEDQ

SEQ ID NO: 497643 - protein, 9 aa, Homo Sapiens
GLSCQVKHS

SEQ ID NO: 497644 - protein, 9 aa, Homo Sapiens
VAPVENRCA

SEQ ID NO: 497645 - protein, 9 aa, Homo Sapiens
EFNYFTKTR

SEQ ID NO: 497646 - protein, 9 aa, Homo Sapiens
AITHSMQVQ

SEQ ID NO: 497647 - protein, 9 aa, Homo Sapiens
AGAWLEMDS

SEQ ID NO: 497648 - protein, 9 aa, Homo Sapiens
GEIEIEGAP

SEQ ID NO: 497649 - protein, 9 aa, Homo Sapiens
TAEMSDWID

SEQ ID NO: 497650 - protein, 9 aa, Homo Sapiens
SGQSPSHGR

SEQ ID NO: 497651 - protein, 9 aa, Homo Sapiens
KEVLSFNVS

SEQ ID NO: 497652 - protein, 9 aa, Homo Sapiens
LQEAQYHLV

SEQ ID NO: 497653 - protein, 9 aa, Homo Sapiens
TSGELVRHH

SEQ ID NO: 497654 - protein, 9 aa, Homo Sapiens
ALAYAQQAS

SEQ ID NO: 497655 - protein, 9 aa, Homo Sapiens
VTRMVVPLA

SEQ ID NO: 497656 - protein, 9 aa, Homo Sapiens
ENRCALVSE

SEQ ID NO: 497657 - protein, 9 aa, Homo Sapiens
RLFSGTNVN

SEQ ID NO: 497658 - protein, 9 aa, Homo Sapiens
TSSPTLISG

SEQ ID NO: 497659 - protein, 9 aa, Homo Sapiens
TGFPGAAGW

SEQ ID NO: 497660 - protein, 9 aa, Homo Sapiens
TTLTGINIR

SEQ ID NO: 497661 - protein, 9 aa, Homo Sapiens
TKKKRVNTA

SEQ ID NO: 497662 - protein, 9 aa, Homo Sapiens
VKYTQPDAA

SEQ ID NO: 497663 - protein, 9 aa, Homo Sapiens
SLLDYDKVA

SEQ ID NO: 497664 - protein, 9 aa, Homo Sapiens
KDEVYFKYY

SEQ ID NO: 497665 - protein, 9 aa, Homo Sapiens
GRDLMACTQ

SEQ ID NO: 497666 - protein, 9 aa, Homo Sapiens
VSLLVRGPG

SEQ ID NO: 497667 - protein, 9 aa, Homo Sapiens
GVNGTYICM

SEQ ID NO: 497668 - protein, 9 aa, Homo Sapiens
ESEQESSEE

SEQ ID NO: 497669 - protein, 9 aa, Homo Sapiens
VIRHQVTHT

SEQ ID NO: 497670 - protein, 9 aa, Homo Sapiens
EVGARQVSV

SEQ ID NO: 497671 - protein, 9 aa, Homo Sapiens
RTPDVKYTQ

SEQ ID NO: 497672 - protein, 9 aa, Homo Sapiens
FHFLNSTFK

SEQ ID NO: 497673 - protein, 9 aa, Homo Sapiens
QNSLLDYDK

SEQ ID NO: 497674 - protein, 9 aa, Homo Sapiens
SIMAVVAGT

SEQ ID NO: 497675 - protein, 9 aa, Homo Sapiens
APSLVTGYG

SEQ ID NO: 497676 - protein, 9 aa, Homo Sapiens
GARQVSVAY

SEQ ID NO: 497677 - protein, 9 aa, Homo Sapiens
LLASPDPRT

SEQ ID NO: 497678 - protein, 9 aa, Homo Sapiens
KIYQLMGHS

SEQ ID NO: 497679 - protein, 9 aa, Homo Sapiens
DVKYTQPDA

SEQ ID NO: 497680 - protein, 9 aa, Homo Sapiens
VRRPQDSTF

SEQ ID NO: 497681 - protein, 9 aa, Homo Sapiens
QYHLVTEIQ

SEQ ID NO: 497682 - protein, 9 aa, Homo Sapiens
LHVEAQSIA

SEQ ID NO: 497683 - protein, 9 aa, Homo Sapiens
LTPAGHVTN

SEQ ID NO: 497684 - protein, 9 aa, Homo Sapiens
GDNAYLMTE

SEQ ID NO: 497685 - protein, 9 aa, Homo Sapiens
SRLPQELRR

SEQ ID NO: 497686 - protein, 9 aa, Homo Sapiens
FEKPVYSAE

SEQ ID NO: 497687 - protein, 9 aa, Homo Sapiens
DDHIASEEP

SEQ ID NO: 497688 - protein, 9 aa, Homo Sapiens
SEMYSIPET

SEQ ID NO: 497689 - protein, 9 aa, Homo Sapiens
SLKLTPVGS

SEQ ID NO: 497690 - protein, 9 aa, Homo Sapiens
GIAMHTEQG

SEQ ID NO: 497691 - protein, 9 aa, Homo Sapiens
PTKKRKKYK

SEQ ID NO: 497692 - protein, 9 aa, Homo Sapiens
EQSSMQLRT

SEQ ID NO: 497693 - protein, 9 aa, Homo Sapiens
ELWAHDPHP

SEQ ID NO: 497694 - protein, 9 aa, Homo Sapiens
EQESSEEST

SEQ ID NO: 497695 - protein, 9 aa, Homo Sapiens
QIQDYPLHV

SEQ ID NO: 497696 - protein, 9 aa, Homo Sapiens
VLAFPDDMD

SEQ ID NO: 497697 - protein, 9 aa, Homo Sapiens
TPDVKYTQP

SEQ ID NO: 497698 - protein, 9 aa, Homo Sapiens
LRRVHLGSV

SEQ ID NO: 497699 - protein, 9 aa, Homo Sapiens
NMCDDHIAS

SEQ ID NO: 497700 - protein, 9 aa, Homo Sapiens
WLEMDSVLK

SEQ ID NO: 497701 - protein, 9 aa, Homo Sapiens
DHIASEEPA

SEQ ID NO: 497702 - protein, 9 aa, Homo Sapiens
LITSSPTLI

SEQ ID NO: 497703 - protein, 9 aa, Homo Sapiens
SSRLEVTRM

SEQ ID NO: 497704 - protein, 9 aa, Homo Sapiens
PFRCKFEGC

SEQ ID NO: 497705 - protein, 9 aa, Homo Sapiens
GDFERPFLT

SEQ ID NO: 497706 - protein, 9 aa, Homo Sapiens
FKYYTPVPC

SEQ ID NO: 497707 - protein, 9 aa, Homo Sapiens
MPVFEKPVY

SEQ ID NO: 497708 - protein, 9 aa, Homo Sapiens
KFEGCERRF

SEQ ID NO: 497709 - protein, 9 aa, Homo Sapiens
EKPVYSAEI

SEQ ID NO: 497710 - protein, 9 aa, Homo Sapiens
KAMTKKKRV

SEQ ID NO: 497711 - protein, 9 aa, Homo Sapiens
DSTFFKGPP

SEQ ID NO: 497712 - protein, 9 aa, Homo Sapiens
YAQQASSQE

SEQ ID NO: 497713 - protein, 9 aa, Homo Sapiens
TMVEPYNAT

SEQ ID NO: 497714 - protein, 9 aa, Homo Sapiens
DWIDEIQTP

SEQ ID NO: 497715 - protein, 9 aa, Homo Sapiens
GTDGDNAYL

SEQ ID NO: 497716 - protein, 9 aa, Homo Sapiens
HSMQVQCEQ

SEQ ID NO: 497717 - protein, 9 aa, Homo Sapiens
ESELSFLTT

SEQ ID NO: 497718 - protein, 9 aa, Homo Sapiens
LEVTRMVVP

SEQ ID NO: 497719 - protein, 9 aa, Homo Sapiens
SGEIEIEGA

SEQ ID NO: 497720 - protein, 9 aa, Homo Sapiens
GEAAGLSCQ

SEQ ID NO: 497721 - protein, 9 aa, Homo Sapiens
SGELVRHHR

SEQ ID NO: 497722 - protein, 9 aa, Homo Sapiens
SILLRTVYS

SEQ ID NO: 497723 - protein, 9 aa, Homo Sapiens
SLLNGRQEE

SEQ ID NO: 497724 - protein, 9 aa, Homo Sapiens
PSPKVSDTM

SEQ ID NO: 497725 - protein, 9 aa, Homo Sapiens
VRPNQNSLL

SEQ ID NO: 497726 - protein, 9 aa, Homo Sapiens
HLVTEIQKQ

SEQ ID NO: 497727 - protein, 9 aa, Homo Sapiens
SQAKMQFYL

SEQ ID NO: 497728 - protein, 9 aa, Homo Sapiens
IERLQAQVK

SEQ ID NO: 497729 - protein, 9 aa, Homo Sapiens
TAKKLENSP

SEQ ID NO: 497730 - protein, 9 aa, Homo Sapiens
RKILKANHL

SEQ ID NO: 497731 - protein, 9 aa, Homo Sapiens
WEIRYMYFH

SEQ ID NO: 497732 - protein, 9 aa, Homo Sapiens
RAFPCTDCG

SEQ ID NO: 497733 - protein, 9 aa, Homo Sapiens
APVENRCAL

SEQ ID NO: 497734 - protein, 9 aa, Homo Sapiens
RQRAFPCTD

SEQ ID NO: 497735 - protein, 9 aa, Homo Sapiens
HGRHGSGLG

SEQ ID NO: 497736 - protein, 9 aa, Homo Sapiens
MLSLLNGRQ

SEQ ID NO: 497737 - protein, 9 aa, Homo Sapiens
WDDGERLFS

SEQ ID NO: 497738 - protein, 9 aa, Homo Sapiens
GNKIFSRVE

SEQ ID NO: 497739 - protein, 9 aa, Homo Sapiens
FEVGARQVS

SEQ ID NO: 497740 - protein, 9 aa, Homo Sapiens
MTGTKSGNK

SEQ ID NO: 497741 - protein, 9 aa, Homo Sapiens
NTAWKTKKT

SEQ ID NO: 497742 - protein, 9 aa, Homo Sapiens
SSGGRAWHS

SEQ ID NO: 497743 - protein, 9 aa, Homo Sapiens
PDDMDLRVY

SEQ ID NO: 497744 - protein, 9 aa, Homo Sapiens
ISSYSSPAT

SEQ ID NO: 497745 - protein, 9 aa, Homo Sapiens
GELVRHHRY

SEQ ID NO: 497746 - protein, 9 aa, Homo Sapiens
AWSILLRTV

SEQ ID NO: 497747 - protein, 9 aa, Homo Sapiens
AFYNEAWSI

SEQ ID NO: 497748 - protein, 9 aa, Homo Sapiens
RPNQNSLLD

SEQ ID NO: 497749 - protein, 9 aa, Homo Sapiens
KTKKTSFSL

SEQ ID NO: 497750 - protein, 9 aa, Homo Sapiens
IEGAPAVQG

SEQ ID NO: 497751 - protein, 9 aa, Homo Sapiens
KWDDGERLF

SEQ ID NO: 497752 - protein, 9 aa, Homo Sapiens
MQVQCEQNW

SEQ ID NO: 497753 - protein, 9 aa, Homo Sapiens
SNSRIRPGR

SEQ ID NO: 497754 - protein, 9 aa, Homo Sapiens
KKRVNTAWK

SEQ ID NO: 497755 - protein, 9 aa, Homo Sapiens
DMDLRVYGP

SEQ ID NO: 497756 - protein, 9 aa, Homo Sapiens
PGAAGWTGP

SEQ ID NO: 497757 - protein, 9 aa, Homo Sapiens
KRVNTAWKT

SEQ ID NO: 497758 - protein, 9 aa, Homo Sapiens
WKTKKTSFS

SEQ ID NO: 497759 - protein, 9 aa, Homo Sapiens
KKKRVNTAW

SEQ ID NO: 497760 - protein, 9 aa, Homo Sapiens
FPGAAGWTG

SEQ ID NO: 497761 - protein, 9 aa, Homo Sapiens
KRKKYKRGH

SEQ ID NO: 497762 - protein, 9 aa, Homo Sapiens
KTRFILEEL

SEQ ID NO: 497763 - protein, 9 aa, Homo Sapiens
NYFTKTRFI

SEQ ID NO: 497764 - protein, 9 aa, Homo Sapiens
RPQDSTFFK

SEQ ID NO: 497765 - protein, 9 aa, Homo Sapiens
DTMVEPYNA

SEQ ID NO: 497766 - protein, 9 aa, Homo Sapiens
FTAEMSDWI

SEQ ID NO: 497767 - protein, 9 aa, Homo Sapiens
LQAQVKELQ

SEQ ID NO: 497768 - protein, 9 aa, Homo Sapiens
AKRAIQAGK

SEQ ID NO: 497769 - protein, 9 aa, Homo Sapiens
LVTGYGAYL

SEQ ID NO: 497770 - protein, 9 aa, Homo Sapiens
RAFQGSSDV

SEQ ID NO: 497771 - protein, 9 aa, Homo Sapiens
AHDPHPGPG

SEQ ID NO: 497772 - protein, 9 aa, Homo Sapiens
LESELSFLT

SEQ ID NO: 497773 - protein, 9 aa, Homo Sapiens
VSKAMTAYW

SEQ ID NO: 497774 - protein, 9 aa, Homo Sapiens
TESRLPQEL

SEQ ID NO: 497775 - protein, 9 aa, Homo Sapiens
LLSQLVNLF

SEQ ID NO: 497776 - protein, 9 aa, Homo Sapiens
LLQKLILWC

SEQ ID NO: 497777 - protein, 9 aa, Homo Sapiens
KLVVVGASG

SEQ ID NO: 497778 - protein, 9 aa, Homo Sapiens
VVFVGSCLG

SEQ ID NO: 497779 - protein, 9 aa, Homo Sapiens
SFEVGARQV

SEQ ID NO: 497780 - protein, 9 aa, Homo Sapiens
KEAITHSMQ

SEQ ID NO: 497781 - protein, 9 aa, Homo Sapiens
TKSGNKIFS

SEQ ID NO: 497782 - protein, 9 aa, Homo Sapiens
KAFISNLNK

SEQ ID NO: 497783 - protein, 9 aa, Homo Sapiens
LRNMCDDHI

SEQ ID NO: 497784 - protein, 9 aa, Homo Sapiens
EAQYHLVTE

SEQ ID NO: 497785 - protein, 9 aa, Homo Sapiens
MVRQAAASK

SEQ ID NO: 497786 - protein, 9 aa, Homo Sapiens
FTGQYCDRL

SEQ ID NO: 497787 - protein, 9 aa, Homo Sapiens
DEVYFKYYT

SEQ ID NO: 497788 - protein, 9 aa, Homo Sapiens
GASGGPPIS

SEQ ID NO: 497789 - protein, 9 aa, Homo Sapiens
PAAKGTAKK

SEQ ID NO: 497790 - protein, 9 aa, Homo Sapiens
RNMCDDHIA

SEQ ID NO: 497791 - protein, 9 aa, Homo Sapiens
ILKANHLED

SEQ ID NO: 497792 - protein, 9 aa, Homo Sapiens
GQYCDRLYV

SEQ ID NO: 497793 - protein, 9 aa, Homo Sapiens
YNEAWSILL

SEQ ID NO: 497794 - protein, 9 aa, Homo Sapiens
LNKMNDYAG

SEQ ID NO: 497795 - protein, 9 aa, Homo Sapiens
YPLHVEAQS

SEQ ID NO: 497796 - protein, 9 aa, Homo Sapiens
VGREQSSMQ

SEQ ID NO: 497797 - protein, 9 aa, Homo Sapiens
GTKSGNKIF

SEQ ID NO: 497798 - protein, 9 aa, Homo Sapiens
QAGKELFFD

SEQ ID NO: 497799 - protein, 9 aa, Homo Sapiens
LEASLKLTP

SEQ ID NO: 497800 - protein, 9 aa, Homo Sapiens
HKLLRKILK

SEQ ID NO: 497801 - protein, 9 aa, Homo Sapiens
DVRPEQLLG

SEQ ID NO: 497802 - protein, 9 aa, Homo Sapiens
RQVSVAYNS

SEQ ID NO: 497803 - protein, 9 aa, Homo Sapiens
GQSPSHGRH

SEQ ID NO: 497804 - protein, 9 aa, Homo Sapiens
YFHFLNSTF

SEQ ID NO: 497805 - protein, 9 aa, Homo Sapiens
LRKILKANH

SEQ ID NO: 497806 - protein, 9 aa, Homo Sapiens
PSHGRHGSG

SEQ ID NO: 497807 - protein, 9 aa, Homo Sapiens
AQQASSQEC

SEQ ID NO: 497808 - protein, 9 aa, Homo Sapiens
MSDWIDEIQ

SEQ ID NO: 497809 - protein, 9 aa, Homo Sapiens
PSGEIEIEG

SEQ ID NO: 497810 - protein, 9 aa, Homo Sapiens
ASLLGVVGE

SEQ ID NO: 497811 - protein, 9 aa, Homo Sapiens
VFVGSCLGD

SEQ ID NO: 497812 - protein, 9 aa, Homo Sapiens
SFNVSWRYE

SEQ ID NO: 497813 - protein, 9 aa, Homo Sapiens
AGWTGPPGP

SEQ ID NO: 497814 - protein, 9 aa, Homo Sapiens
HHRYKHTHE

SEQ ID NO: 497815 - protein, 9 aa, Homo Sapiens
GRQEERLRE

SEQ ID NO: 497816 - protein, 9 aa, Homo Sapiens
LKEDRENIP

SEQ ID NO: 497817 - protein, 9 aa, Homo Sapiens
EMSDWIDEI

SEQ ID NO: 497818 - protein, 9 aa, Homo Sapiens
SQLVNLFIL

SEQ ID NO: 497819 - protein, 9 aa, Homo Sapiens
SDDTPMVRQ

SEQ ID NO: 497820 - protein, 9 aa, Homo Sapiens
EAITHSMQV

SEQ ID NO: 497821 - protein, 9 aa, Homo Sapiens
FERPFLTPA

SEQ ID NO: 497822 - protein, 9 aa, Homo Sapiens
SLGLAQNHE

SEQ ID NO: 497823 - protein, 9 aa, Homo Sapiens
APIVSLLAS

SEQ ID NO: 497824 - protein, 9 aa, Homo Sapiens
QELRRVHLG

SEQ ID NO: 497825 - protein, 9 aa, Homo Sapiens
HRYKHTHEK

SEQ ID NO: 497826 - protein, 9 aa, Homo Sapiens
VSKEHNYTK

SEQ ID NO: 497827 - protein, 9 aa, Homo Sapiens
IRPGRRSSN

SEQ ID NO: 497828 - protein, 9 aa, Homo Sapiens
MACTQTGSG

SEQ ID NO: 497829 - protein, 9 aa, Homo Sapiens
ELPRGLLSQ

SEQ ID NO: 497830 - protein, 9 aa, Homo Sapiens
KEHNYTKEN

SEQ ID NO: 497831 - protein, 9 aa, Homo Sapiens
KPFRCKFEG

SEQ ID NO: 497832 - protein, 9 aa, Homo Sapiens
AFPDDMDLR

SEQ ID NO: 497833 - protein, 9 aa, Homo Sapiens
WTGPPGPSG

SEQ ID NO: 497834 - protein, 9 aa, Homo Sapiens
CTRGEAEPS

SEQ ID NO: 497835 - protein, 9 aa, Homo Sapiens
AMTAYWTNF

SEQ ID NO: 497836 - protein, 9 aa, Homo Sapiens
HNIGIAMHT

SEQ ID NO: 497837 - protein, 9 aa, Homo Sapiens
WSILLRTVY

SEQ ID NO: 497838 - protein, 9 aa, Homo Sapiens
NQNSLLDYD

SEQ ID NO: 497839 - protein, 9 aa, Homo Sapiens
ERLQAQVKE

SEQ ID NO: 497840 - protein, 9 aa, Homo Sapiens
GKELFFDYR

SEQ ID NO: 497841 - protein, 9 aa, Homo Sapiens
AELWAHDPH

SEQ ID NO: 497842 - protein, 9 aa, Homo Sapiens
VAGAWLEMD

SEQ ID NO: 497843 - protein, 9 aa, Homo Sapiens
EKVSKEHNY

SEQ ID NO: 497844 - protein, 9 aa, Homo Sapiens
HRTPDVKYT

SEQ ID NO: 497845 - protein, 9 aa, Homo Sapiens
AMTKKKRVN

SEQ ID NO: 497846 - protein, 9 aa, Homo Sapiens
QQEVAGAWL

SEQ ID NO: 497847 - protein, 9 aa, Homo Sapiens
LMGHSNMDC

SEQ ID NO: 497848 - protein, 9 aa, Homo Sapiens
PHPESEQES

SEQ ID NO: 497849 - protein, 9 aa, Homo Sapiens
HVEAQSIAF

SEQ ID NO: 497850 - protein, 9 aa, Homo Sapiens
FCTRGEAEP

SEQ ID NO: 497851 - protein, 9 aa, Homo Sapiens
EVTRMVVPL

SEQ ID NO: 497852 - protein, 9 aa, Homo Sapiens
QLVNLFILQ

SEQ ID NO: 497853 - protein, 9 aa, Homo Sapiens
DPHPGPGVS

SEQ ID NO: 497854 - protein, 9 aa, Homo Sapiens
RNIAQGKEI

SEQ ID NO: 497855 - protein, 9 aa, Homo Sapiens
KKRKKYKRG

SEQ ID NO: 497856 - protein, 9 aa, Homo Sapiens
QMDGSLGLI

SEQ ID NO: 497857 - protein, 9 aa, Homo Sapiens
EIEGAPAVQ

SEQ ID NO: 497858 - protein, 9 aa, Homo Sapiens
VRPVLAGIV

SEQ ID NO: 497859 - protein, 9 aa, Homo Sapiens
TDGNASLLG

SEQ ID NO: 497860 - protein, 9 aa, Homo Sapiens
QSRLITSSP

SEQ ID NO: 497861 - protein, 9 aa, Homo Sapiens
TPMVRQAAA

SEQ ID NO: 497862 - protein, 9 aa, Homo Sapiens
IDEIQTPKA

SEQ ID NO: 497863 - protein, 9 aa, Homo Sapiens
DVIRHQVTH

SEQ ID NO: 497864 - protein, 9 aa, Homo Sapiens
PCTDCGQSF

SEQ ID NO: 497865 - protein, 9 aa, Homo Sapiens
AFISNLNKM

SEQ ID NO: 497866 - protein, 9 aa, Homo Sapiens
SMQVQCEQN

SEQ ID NO: 497867 - protein, 9 aa, Homo Sapiens
VSDTMVEPY

SEQ ID NO: 497868 - protein, 9 aa, Homo Sapiens
LSQLVNLFI

SEQ ID NO: 497869 - protein, 9 aa, Homo Sapiens
AGKELFFDY

SEQ ID NO: 497870 - protein, 9 aa, Homo Sapiens
GGPPISKAP

SEQ ID NO: 497871 - protein, 9 aa, Homo Sapiens
KMQFYLVVA

SEQ ID NO: 497872 - protein, 9 aa, Homo Sapiens
KTELIGLLP

SEQ ID NO: 497873 - protein, 9 aa, Homo Sapiens
RPEQLLGGK

SEQ ID NO: 497874 - protein, 9 aa, Homo Sapiens
NTALAYAQQ

SEQ ID NO: 497875 - protein, 9 aa, Homo Sapiens
NVERNIAQG

SEQ ID NO: 497876 - protein, 9 aa, Homo Sapiens
DTPMVRQAA

SEQ ID NO: 497877 - protein, 9 aa, Homo Sapiens
GRAWHSYHH

SEQ ID NO: 497878 - protein, 9 aa, Homo Sapiens
VEVLQHTGQ

SEQ ID NO: 497879 - protein, 9 aa, Homo Sapiens
EVLQHTGQT

SEQ ID NO: 497880 - protein, 9 aa, Homo Sapiens
NSRIRPGRR

SEQ ID NO: 497881 - protein, 9 aa, Homo Sapiens
PSDSQAKMQ

SEQ ID NO: 497882 - protein, 9 aa, Homo Sapiens
FPDDMDLRV

SEQ ID NO: 497883 - protein, 9 aa, Homo Sapiens
EKPFRCKFE

SEQ ID NO: 497884 - protein, 9 aa, Homo Sapiens
MAVVAGTPQ

SEQ ID NO: 497885 - protein, 9 aa, Homo Sapiens
QNHENQSRK

SEQ ID NO: 497886 - protein, 9 aa, Homo Sapiens
CDRLYVPCA

SEQ ID NO: 497887 - protein, 9 aa, Homo Sapiens
VLSFNVSWR

SEQ ID NO: 497888 - protein, 9 aa, Homo Sapiens
LSLLNGRQE

SEQ ID NO: 497889 - protein, 9 aa, Homo Sapiens
SHKLLRKIL

SEQ ID NO: 497890 - protein, 9 aa, Homo Sapiens
KLLRKILKA

SEQ ID NO: 497891 - protein, 9 aa, Homo Sapiens
EVAPVENRC

SEQ ID NO: 497892 - protein, 9 aa, Homo Sapiens
DGDNAYLMT

SEQ ID NO: 497893 - protein, 9 aa, Homo Sapiens
FISNLNKMN

SEQ ID NO: 497894 - protein, 9 aa, Homo Sapiens
KRAIQAGKE

SEQ ID NO: 497895 - protein, 9 aa, Homo Sapiens
FYNEAWSIL

SEQ ID NO: 497896 - protein, 9 aa, Homo Sapiens
HFLNSTFKF

SEQ ID NO: 497897 - protein, 9 aa, Homo Sapiens
SQQEVAGAW

SEQ ID NO: 497898 - protein, 9 aa, Homo Sapiens
AFQGSSDVI

SEQ ID NO: 497899 - protein, 9 aa, Homo Sapiens
GVQITSEMY

SEQ ID NO: 497900 - protein, 9 aa, Homo Sapiens
RTVSKAMTA

SEQ ID NO: 497901 - protein, 9 aa, Homo Sapiens
SRIRPGRRS

SEQ ID NO: 497902 - protein, 9 aa, Homo Sapiens
QITSEMYSI

SEQ ID NO: 497903 - protein, 9 aa, Homo Sapiens
NRCALVSED

SEQ ID NO: 497904 - protein, 9 aa, Homo Sapiens
VFEKPVYSA

SEQ ID NO: 497905 - protein, 9 aa, Homo Sapiens
LVGREQSSM

SEQ ID NO: 497906 - protein, 9 aa, Homo Sapiens
SYSSPATEQ

SEQ ID NO: 497907 - protein, 9 aa, Homo Sapiens
VERNIAQGK

SEQ ID NO: 497908 - protein, 9 aa, Homo Sapiens
VEGTDGDNA

SEQ ID NO: 497909 - protein, 9 aa, Homo Sapiens
VWPSSRLEV

SEQ ID NO: 497910 - protein, 9 aa, Homo Sapiens
ELLLVGQMD

SEQ ID NO: 497911 - protein, 9 aa, Homo Sapiens
AQYHLVTEI

SEQ ID NO: 497912 - protein, 9 aa, Homo Sapiens
MGHSNMDCF

SEQ ID NO: 497913 - protein, 9 aa, Homo Sapiens
LVRHHRYKH

SEQ ID NO: 497914 - protein, 9 aa, Homo Sapiens
AGRDLMACT

SEQ ID NO: 497915 - protein, 9 aa, Homo Sapiens
GNASLLGVV

SEQ ID NO: 497916 - protein, 9 aa, Homo Sapiens
AKGTAKKLE

SEQ ID NO: 497917 - protein, 9 aa, Homo Sapiens
PIVSLLASP

SEQ ID NO: 497918 - protein, 9 aa, Homo Sapiens
AQVKELQAQ

SEQ ID NO: 497919 - protein, 9 aa, Homo Sapiens
EIEIEGAPA

SEQ ID NO: 497920 - protein, 9 aa, Homo Sapiens
QDSTFFKGP

SEQ ID NO: 497921 - protein, 9 aa, Homo Sapiens
AMHTEQGLI

SEQ ID NO: 497922 - protein, 9 aa, Homo Sapiens
DRTVSKAMT

SEQ ID NO: 497923 - protein, 9 aa, Homo Sapiens
SLLVRGPGI

SEQ ID NO: 497924 - protein, 9 aa, Homo Sapiens
LTPVGSTAS

SEQ ID NO: 497925 - protein, 9 aa, Homo Sapiens
VYFKYYTPV

SEQ ID NO: 497926 - protein, 9 aa, Homo Sapiens
SYYSIMAVV

SEQ ID NO: 497927 - protein, 9 aa, Homo Sapiens
RKAMTKKKR

SEQ ID NO: 497928 - protein, 9 aa, Homo Sapiens
SSPATEQNR

SEQ ID NO: 497929 - protein, 9 aa, Homo Sapiens
YEAPSLVTG

SEQ ID NO: 497930 - protein, 9 aa, Homo Sapiens
GTYICMVFE

SEQ ID NO: 497931 - protein, 9 aa, Homo Sapiens
PHPGPGVSA

SEQ ID NO: 497932 - protein, 9 aa, Homo Sapiens
TGVQITSEM

SEQ ID NO: 497933 - protein, 9 aa, Homo Sapiens
LVGQMDGSL

SEQ ID NO: 497934 - protein, 9 aa, Homo Sapiens
RLEVTRMVV

SEQ ID NO: 497935 - protein, 9 aa, Homo Sapiens
DRLYVPCAP

SEQ ID NO: 497936 - protein, 9 aa, Homo Sapiens
VRQAAASKL

SEQ ID NO: 497937 - protein, 9 aa, Homo Sapiens
EAPSLVTGY

SEQ ID NO: 497938 - protein, 9 aa, Homo Sapiens
AIQAGKELF

SEQ ID NO: 497939 - protein, 9 aa, Homo Sapiens
GFTGQYCDR

SEQ ID NO: 497940 - protein, 9 aa, Homo Sapiens
GLLPEFSIG

SEQ ID NO: 497941 - protein, 9 aa, Homo Sapiens
QAAASKLGE

SEQ ID NO: 497942 - protein, 9 aa, Homo Sapiens
AFPCTDCGQ

SEQ ID NO: 497943 - protein, 9 aa, Homo Sapiens
TEDGLVRPV

SEQ ID NO: 497944 - protein, 9 aa, Homo Sapiens
PGRRSSNAS

SEQ ID NO: 497945 - protein, 9 aa, Homo Sapiens
CQVKHSSLG

SEQ ID NO: 497946 - protein, 9 aa, Homo Sapiens
PTPSDSQAK

SEQ ID NO: 497947 - protein, 9 aa, Homo Sapiens
SLVTGYGAY

SEQ ID NO: 497948 - protein, 9 aa, Homo Sapiens
CTDCGQSFR

SEQ ID NO: 497949 - protein, 9 aa, Homo Sapiens
CTQTGSGKT

SEQ ID NO: 497950 - protein, 9 aa, Homo Sapiens
SKTELIGLL

SEQ ID NO: 497951 - protein, 9 aa, Homo Sapiens
SRLEVTRMV

SEQ ID NO: 497952 - protein, 9 aa, Homo Sapiens
FDIKVSLLV

SEQ ID NO: 497953 - protein, 9 aa, Homo Sapiens
MCDDHIASE

SEQ ID NO: 497954 - protein, 9 aa, Homo Sapiens
YKLVVVGAS

SEQ ID NO: 497955 - protein, 9 aa, Homo Sapiens
PVFEKPVYS

SEQ ID NO: 497956 - protein, 9 aa, Homo Sapiens
VGARQVSVA

SEQ ID NO: 497957 - protein, 9 aa, Homo Sapiens
QLLGGKDAQ

SEQ ID NO: 497958 - protein, 9 aa, Homo Sapiens
GVVFVGSCL

SEQ ID NO: 497959 - protein, 9 aa, Homo Sapiens
QTDGNASLL

SEQ ID NO: 497960 - protein, 9 aa, Homo Sapiens
KGLQEAQYH

SEQ ID NO: 497961 - protein, 9 aa, Homo Sapiens
LLLVGQMDG

SEQ ID NO: 497962 - protein, 9 aa, Homo Sapiens
LAYAQQASS

SEQ ID NO: 497963 - protein, 9 aa, Homo Sapiens
EIRYMYFHF

SEQ ID NO: 497964 - protein, 9 aa, Homo Sapiens
IQAGKELFF

SEQ ID NO: 497965 - protein, 9 aa, Homo Sapiens
VCEKEVLSF

SEQ ID NO: 497966 - protein, 9 aa, Homo Sapiens
LSSGGRAWH

SEQ ID NO: 497967 - protein, 9 aa, Homo Sapiens
RRQRAFPCT

SEQ ID NO: 497968 - protein, 9 aa, Homo Sapiens
GHSNMDCFI

SEQ ID NO: 497969 - protein, 9 aa, Homo Sapiens
CDDHIASEE

SEQ ID NO: 497970 - protein, 9 aa, Homo Sapiens
ESRLPQELR

SEQ ID NO: 497971 - protein, 9 aa, Homo Sapiens
PFLTPAGHV

SEQ ID NO: 497972 - protein, 9 aa, Homo Sapiens
KLTPVGSTA

SEQ ID NO: 497973 - protein, 9 aa, Homo Sapiens
HSHRTPDVK

SEQ ID NO: 497974 - protein, 9 aa, Homo Sapiens
SEQESSEES

SEQ ID NO: 497975 - protein, 9 aa, Homo Sapiens
NHENQSRKL

SEQ ID NO: 497976 - protein, 9 aa, Homo Sapiens
AYAQQASSQ

SEQ ID NO: 497977 - protein, 9 aa, Homo Sapiens
YMYFHFLNS

SEQ ID NO: 497978 - protein, 9 aa, Homo Sapiens
IGLLPEFSI

SEQ ID NO: 497979 - protein, 9 aa, Homo Sapiens
GPPISKAPT

SEQ ID NO: 497980 - protein, 9 aa, Homo Sapiens
MYSIPETVA

SEQ ID NO: 497981 - protein, 9 aa, Homo Sapiens
PELLLVGQM

SEQ ID NO: 497982 - protein, 9 aa, Homo Sapiens
TSQSRLITS

SEQ ID NO: 497983 - protein, 9 aa, Homo Sapiens
FTKTRFILE

SEQ ID NO: 497984 - protein, 9 aa, Homo Sapiens
VENRCALVS

SEQ ID NO: 497985 - protein, 9 aa, Homo Sapiens
VRPEQLLGG

SEQ ID NO: 497986 - protein, 9 aa, Homo Sapiens
RHHRYKHTH

SEQ ID NO: 497987 - protein, 9 aa, Homo Sapiens
SHRTPDVKY

SEQ ID NO: 497988 - protein, 9 aa, Homo Sapiens
SACISWAYY

SEQ ID NO: 497989 - protein, 9 aa, Homo Sapiens
PVAGKPHRY

SEQ ID NO: 497990 - protein, 9 aa, Homo Sapiens
ECSSICDYS

SEQ ID NO: 497991 - protein, 9 aa, Homo Sapiens
AKRIIWDSR

SEQ ID NO: 497992 - protein, 9 aa, Homo Sapiens
LDEEEEKAK

SEQ ID NO: 497993 - protein, 9 aa, Homo Sapiens
HYIRRLNQQ

SEQ ID NO: 497994 - protein, 9 aa, Homo Sapiens
RRRRFGRAP

SEQ ID NO: 497995 - protein, 9 aa, Homo Sapiens
QKVDVYNEG

SEQ ID NO: 497996 - protein, 9 aa, Homo Sapiens
DGKGSSRRP

SEQ ID NO: 497997 - protein, 9 aa, Homo Sapiens
EIIEAGDEI

SEQ ID NO: 497998 - protein, 9 aa, Homo Sapiens
GPLQEDDLE

SEQ ID NO: 497999 - protein, 9 aa, Homo Sapiens
LMFDMGLQK

SEQ ID NO: 498000 - protein, 9 aa, Homo Sapiens
WFFFQLLVK

SEQ ID NO: 498001 - protein, 9 aa, Homo Sapiens
VKRDLLPLR

SEQ ID NO: 498002 - protein, 9 aa, Homo Sapiens
RQMDRMKAR

SEQ ID NO: 498003 - protein, 9 aa, Homo Sapiens
NEHTDSSDA

SEQ ID NO: 498004 - protein, 9 aa, Homo Sapiens
TLRDDFDSY

SEQ ID NO: 498005 - protein, 9 aa, Homo Sapiens
PRDVAVAKE

SEQ ID NO: 498006 - protein, 9 aa, Homo Sapiens
NLTITLYNG

SEQ ID NO: 498007 - protein, 9 aa, Homo Sapiens
CKLNLSFNY

SEQ ID NO: 498008 - protein, 9 aa, Homo Sapiens
VKIKNIRFQ

SEQ ID NO: 498009 - protein, 9 aa, Homo Sapiens
FFTSAHPSR

SEQ ID NO: 498010 - protein, 9 aa, Homo Sapiens
MGLYGKTGR

SEQ ID NO: 498011 - protein, 9 aa, Homo Sapiens
AEQAEIIEA

SEQ ID NO: 498012 - protein, 9 aa, Homo Sapiens
GKPHRYVID

SEQ ID NO: 498013 - protein, 9 aa, Homo Sapiens
NDAFGTLQL

SEQ ID NO: 498014 - protein, 9 aa, Homo Sapiens
RAITRHEVR

SEQ ID NO: 498015 - protein, 9 aa, Homo Sapiens
LGRNTWKTL

SEQ ID NO: 498016 - protein, 9 aa, Homo Sapiens
PAMPPFPFW

SEQ ID NO: 498017 - protein, 9 aa, Homo Sapiens
SASCFSSTS

SEQ ID NO: 498018 - protein, 9 aa, Homo Sapiens
IKNIRFQVQ

SEQ ID NO: 498019 - protein, 9 aa, Homo Sapiens
TITLYNGSV

SEQ ID NO: 498020 - protein, 9 aa, Homo Sapiens
KDKDPHSER

SEQ ID NO: 498021 - protein, 9 aa, Homo Sapiens
VAEKMRQHC

SEQ ID NO: 498022 - protein, 9 aa, Homo Sapiens
KEAPAGPLQ

SEQ ID NO: 498023 - protein, 9 aa, Homo Sapiens
HKKELNKKL

SEQ ID NO: 498024 - protein, 9 aa, Homo Sapiens
RPRRSSPKR

SEQ ID NO: 498025 - protein, 9 aa, Homo Sapiens
RWKDICARI

SEQ ID NO: 498026 - protein, 9 aa, Homo Sapiens
IQTCQDNKV

SEQ ID NO: 498027 - protein, 9 aa, Homo Sapiens
QSSIPRADS

SEQ ID NO: 498028 - protein, 9 aa, Homo Sapiens
DKFYFKELG

SEQ ID NO: 498029 - protein, 9 aa, Homo Sapiens
LSSKSIEKL

SEQ ID NO: 498030 - protein, 9 aa, Homo Sapiens
TLTAVYTSL

SEQ ID NO: 498031 - protein, 9 aa, Homo Sapiens
SLHVTDTSA

SEQ ID NO: 498032 - protein, 9 aa, Homo Sapiens
SCYFISSKE

SEQ ID NO: 498033 - protein, 9 aa, Homo Sapiens
MPTEGACAP

SEQ ID NO: 498034 - protein, 9 aa, Homo Sapiens
YSCEMCILV

SEQ ID NO: 498035 - protein, 9 aa, Homo Sapiens
PDPSHNTEL

SEQ ID NO: 498036 - protein, 9 aa, Homo Sapiens
VLTENGCVY

SEQ ID NO: 498037 - protein, 9 aa, Homo Sapiens
ADSSASLEL

SEQ ID NO: 498038 - protein, 9 aa, Homo Sapiens
EDHKEEDLK

SEQ ID NO: 498039 - protein, 9 aa, Homo Sapiens
STDEYCASP

SEQ ID NO: 498040 - protein, 9 aa, Homo Sapiens
SKNQIKRLT

SEQ ID NO: 498041 - protein, 9 aa, Homo Sapiens
SMGLFCALR

SEQ ID NO: 498042 - protein, 9 aa, Homo Sapiens
AKAVDLIPW

SEQ ID NO: 498043 - protein, 9 aa, Homo Sapiens
PGEPDSPWM

SEQ ID NO: 498044 - protein, 9 aa, Homo Sapiens
LTLTNPVQN

SEQ ID NO: 498045 - protein, 9 aa, Homo Sapiens
RQLREQQRR

SEQ ID NO: 498046 - protein, 9 aa, Homo Sapiens
FNEEIEQIG

SEQ ID NO: 498047 - protein, 9 aa, Homo Sapiens
WIRDGNNIL

SEQ ID NO: 498048 - protein, 9 aa, Homo Sapiens
KLIKQRDYH

SEQ ID NO: 498049 - protein, 9 aa, Homo Sapiens
YIMIPNEIV

SEQ ID NO: 498050 - protein, 9 aa, Homo Sapiens
FFLCAMYVP

SEQ ID NO: 498051 - protein, 9 aa, Homo Sapiens
DVAVAKERD

SEQ ID NO: 498052 - protein, 9 aa, Homo Sapiens
PPQRDSYSQ

SEQ ID NO: 498053 - protein, 9 aa, Homo Sapiens
RSVHKKELN

SEQ ID NO: 498054 - protein, 9 aa, Homo Sapiens
LGGTPGPSS

SEQ ID NO: 498055 - protein, 9 aa, Homo Sapiens
KIRADLERQ

SEQ ID NO: 498056 - protein, 9 aa, Homo Sapiens
SPQNFLVLF

SEQ ID NO: 498057 - protein, 9 aa, Homo Sapiens
DILELSECL

SEQ ID NO: 498058 - protein, 9 aa, Homo Sapiens
IQRIPNMYY

SEQ ID NO: 498059 - protein, 9 aa, Homo Sapiens
PLRTPPYQE

SEQ ID NO: 498060 - protein, 9 aa, Homo Sapiens
PLRTPPYQG

SEQ ID NO: 498061 - protein, 9 aa, Homo Sapiens
PPFPFWMAP

SEQ ID NO: 498062 - protein, 9 aa, Homo Sapiens
KTFWRELPS

SEQ ID NO: 498063 - protein, 9 aa, Homo Sapiens
PLRTPPYQV

SEQ ID NO: 498064 - protein, 9 aa, Homo Sapiens
RALSRFQGM

SEQ ID NO: 498065 - protein, 9 aa, Homo Sapiens
MREMQQLLG

SEQ ID NO: 498066 - protein, 9 aa, Homo Sapiens
WRLHTGERP

SEQ ID NO: 498067 - protein, 9 aa, Homo Sapiens
DVDQFSDSS

SEQ ID NO: 498068 - protein, 9 aa, Homo Sapiens
SSGAAQGAG

SEQ ID NO: 498069 - protein, 9 aa, Homo Sapiens
QEPPKDGKL

SEQ ID NO: 498070 - protein, 9 aa, Homo Sapiens
VNGSRVKNL

SEQ ID NO: 498071 - protein, 9 aa, Homo Sapiens
SADLAPMKK

SEQ ID NO: 498072 - protein, 9 aa, Homo Sapiens
NIRFQVQIG

SEQ ID NO: 498073 - protein, 9 aa, Homo Sapiens
WAKSPPADD

SEQ ID NO: 498074 - protein, 9 aa, Homo Sapiens
SSICDYSEK

SEQ ID NO: 498075 - protein, 9 aa, Homo Sapiens
EHTDSSDAE

SEQ ID NO: 498076 - protein, 9 aa, Homo Sapiens
GDRMAKSLY

SEQ ID NO: 498077 - protein, 9 aa, Homo Sapiens
QLDEEEEKA

SEQ ID NO: 498078 - protein, 9 aa, Homo Sapiens
NAYSCEMCI

SEQ ID NO: 498079 - protein, 9 aa, Homo Sapiens
DPVKIKNIR

SEQ ID NO: 498080 - protein, 9 aa, Homo Sapiens
GVQDNPKAL

SEQ ID NO: 498081 - protein, 9 aa, Homo Sapiens
DLLPLRTPP

SEQ ID NO: 498082 - protein, 9 aa, Homo Sapiens
SGLPFERKR

SEQ ID NO: 498083 - protein, 9 aa, Homo Sapiens
KAVDLIPWM

SEQ ID NO: 498084 - protein, 9 aa, Homo Sapiens
FGMESSHSP

SEQ ID NO: 498085 - protein, 9 aa, Homo Sapiens
MDKFYFKEL

SEQ ID NO: 498086 - protein, 9 aa, Homo Sapiens
AMPPFPFWM

SEQ ID NO: 498087 - protein, 9 aa, Homo Sapiens
LCVFKDLLV

SEQ ID NO: 498088 - protein, 9 aa, Homo Sapiens
GTPGSPDAL

SEQ ID NO: 498089 - protein, 9 aa, Homo Sapiens
SPPSFPSGF

SEQ ID NO: 498090 - protein, 9 aa, Homo Sapiens
IKEKPKEEE

SEQ ID NO: 498091 - protein, 9 aa, Homo Sapiens
HWKQEKNDK

SEQ ID NO: 498092 - protein, 9 aa, Homo Sapiens
HVTDTSAAS

SEQ ID NO: 498093 - protein, 9 aa, Homo Sapiens
HWRLHTGER

SEQ ID NO: 498094 - protein, 9 aa, Homo Sapiens
PWKPQAVER

SEQ ID NO: 498095 - protein, 9 aa, Homo Sapiens
LQEDDLEPL

SEQ ID NO: 498096 - protein, 9 aa, Homo Sapiens
EKPKEEEMT

SEQ ID NO: 498097 - protein, 9 aa, Homo Sapiens
EQYYDPSDK

SEQ ID NO: 498098 - protein, 9 aa, Homo Sapiens
CYDIHECSE

SEQ ID NO: 498099 - protein, 9 aa, Homo Sapiens
EMREMQQLL

SEQ ID NO: 498100 - protein, 9 aa, Homo Sapiens
KRGASSSTS

SEQ ID NO: 498101 - protein, 9 aa, Homo Sapiens
QDDKIRWAS

SEQ ID NO: 498102 - protein, 9 aa, Homo Sapiens
EEKEKEDDE

SEQ ID NO: 498103 - protein, 9 aa, Homo Sapiens
LTAVYTSLG

SEQ ID NO: 498104 - protein, 9 aa, Homo Sapiens
YLTSKMLSL

SEQ ID NO: 498105 - protein, 9 aa, Homo Sapiens
KEKKGIVKQ

SEQ ID NO: 498106 - protein, 9 aa, Homo Sapiens
PSGFPVLRL

SEQ ID NO: 498107 - protein, 9 aa, Homo Sapiens
CVFKDLLVA

SEQ ID NO: 498108 - protein, 9 aa, Homo Sapiens
SGIHVAQKQ

SEQ ID NO: 498109 - protein, 9 aa, Homo Sapiens
ILDTWVAME

SEQ ID NO: 498110 - protein, 9 aa, Homo Sapiens
PKDGKLKDP

SEQ ID NO: 498111 - protein, 9 aa, Homo Sapiens
SQAFQLDQQ

SEQ ID NO: 498112 - protein, 9 aa, Homo Sapiens
LMRQMKEDT

SEQ ID NO: 498113 - protein, 9 aa, Homo Sapiens
KKRGASSST

SEQ ID NO: 498114 - protein, 9 aa, Homo Sapiens
LDTLIPDAK

SEQ ID NO: 498115 - protein, 9 aa, Homo Sapiens
PIKEIKEKP

SEQ ID NO: 498116 - protein, 9 aa, Homo Sapiens
LSTTLRSIQ

SEQ ID NO: 498117 - protein, 9 aa, Homo Sapiens
GDVAEQDVG

SEQ ID NO: 498118 - protein, 9 aa, Homo Sapiens
EPGEPKERK

SEQ ID NO: 498119 - protein, 9 aa, Homo Sapiens
SLPNDSKDI

SEQ ID NO: 498120 - protein, 9 aa, Homo Sapiens
MQSPSFYQN

SEQ ID NO: 498121 - protein, 9 aa, Homo Sapiens
TKQEKDFLW

SEQ ID NO: 498122 - protein, 9 aa, Homo Sapiens
FFFFFFPFF

SEQ ID NO: 498123 - protein, 9 aa, Homo Sapiens
KTIRFSFGS

SEQ ID NO: 498124 - protein, 9 aa, Homo Sapiens
FPSLCAQRM

SEQ ID NO: 498125 - protein, 9 aa, Homo Sapiens
PGSSLGSGD

SEQ ID NO: 498126 - protein, 9 aa, Homo Sapiens
PNAYSCEMC

SEQ ID NO: 498127 - protein, 9 aa, Homo Sapiens
AQRDYKKAI

SEQ ID NO: 498128 - protein, 9 aa, Homo Sapiens
QAKREETLK

SEQ ID NO: 498129 - protein, 9 aa, Homo Sapiens
CDPKATRVW

SEQ ID NO: 498130 - protein, 9 aa, Homo Sapiens
PQPENMQPQ

SEQ ID NO: 498131 - protein, 9 aa, Homo Sapiens
QGLTQLCKL

SEQ ID NO: 498132 - protein, 9 aa, Homo Sapiens
SVAQRDYKK

SEQ ID NO: 498133 - protein, 9 aa, Homo Sapiens
MKAMGIETS

SEQ ID NO: 498134 - protein, 9 aa, Homo Sapiens
NEIVQTLLD

SEQ ID NO: 498135 - protein, 9 aa, Homo Sapiens
EAFFGKDLV

SEQ ID NO: 498136 - protein, 9 aa, Homo Sapiens
EDYYNNLSA

SEQ ID NO: 498137 - protein, 9 aa, Homo Sapiens
EDVFSHRSL

SEQ ID NO: 498138 - protein, 9 aa, Homo Sapiens
LGLQKAHRP

SEQ ID NO: 498139 - protein, 9 aa, Homo Sapiens
TKPNRFKEV

SEQ ID NO: 498140 - protein, 9 aa, Homo Sapiens
LSWIRDGNN

SEQ ID NO: 498141 - protein, 9 aa, Homo Sapiens
LPSYLFGME

SEQ ID NO: 498142 - protein, 9 aa, Homo Sapiens
GTEAGAGAG

SEQ ID NO: 498143 - protein, 9 aa, Homo Sapiens
HAHRYRHPR

SEQ ID NO: 498144 - protein, 9 aa, Homo Sapiens
RADQMKAMG

SEQ ID NO: 498145 - protein, 9 aa, Homo Sapiens
STSRDSRSF

SEQ ID NO: 498146 - protein, 9 aa, Homo Sapiens
MRQHCDPHI

SEQ ID NO: 498147 - protein, 9 aa, Homo Sapiens
QHCDPHILQ

SEQ ID NO: 498148 - protein, 9 aa, Homo Sapiens
FKYAWFFFQ

SEQ ID NO: 498149 - protein, 9 aa, Homo Sapiens
HLRRHMQIH

SEQ ID NO: 498150 - protein, 9 aa, Homo Sapiens
KGSGFPDGK

SEQ ID NO: 498151 - protein, 9 aa, Homo Sapiens
GHATSLHVT

SEQ ID NO: 498152 - protein, 9 aa, Homo Sapiens
TEDMMRDRI

SEQ ID NO: 498153 - protein, 9 aa, Homo Sapiens
QLLVKSMAQ

SEQ ID NO: 498154 - protein, 9 aa, Homo Sapiens
IHHWRLHTG

SEQ ID NO: 498155 - protein, 9 aa, Homo Sapiens
TGSSGFIFS

SEQ ID NO: 498156 - protein, 9 aa, Homo Sapiens
AEKMRQHCD

SEQ ID NO: 498157 - protein, 9 aa, Homo Sapiens
LIAMINSLF

SEQ ID NO: 498158 - protein, 9 aa, Homo Sapiens
VAMEELVDE

SEQ ID NO: 498159 - protein, 9 aa, Homo Sapiens
QMKEDTEKF

SEQ ID NO: 498160 - protein, 9 aa, Homo Sapiens
LMNSLPPRP

SEQ ID NO: 498161 - protein, 9 aa, Homo Sapiens
RPGMRVAFC

SEQ ID NO: 498162 - protein, 9 aa, Homo Sapiens
PNDITAEEE

SEQ ID NO: 498163 - protein, 9 aa, Homo Sapiens
TLKAKKHVK

SEQ ID NO: 498164 - protein, 9 aa, Homo Sapiens
ANGGEKASR

SEQ ID NO: 498165 - protein, 9 aa, Homo Sapiens
KLRKLKEQS

SEQ ID NO: 498166 - protein, 9 aa, Homo Sapiens
VVAGHIADN

SEQ ID NO: 498167 - protein, 9 aa, Homo Sapiens
AFFGKDLVD

SEQ ID NO: 498168 - protein, 9 aa, Homo Sapiens
DNPKALVAP

SEQ ID NO: 498169 - protein, 9 aa, Homo Sapiens
MPCGVVVTL

SEQ ID NO: 498170 - protein, 9 aa, Homo Sapiens
TLLSLPWII

SEQ ID NO: 498171 - protein, 9 aa, Homo Sapiens
FQLDQQAFS

SEQ ID NO: 498172 - protein, 9 aa, Homo Sapiens
VILKTLKPK

SEQ ID NO: 498173 - protein, 9 aa, Homo Sapiens
YFEPNDITA

SEQ ID NO: 498174 - protein, 9 aa, Homo Sapiens
LVQCHALDG

SEQ ID NO: 498175 - protein, 9 aa, Homo Sapiens
KAVKRLATQ

SEQ ID NO: 498176 - protein, 9 aa, Homo Sapiens
IRVILKTLK

SEQ ID NO: 498177 - protein, 9 aa, Homo Sapiens
DTRQYHENM

SEQ ID NO: 498178 - protein, 9 aa, Homo Sapiens
HRCSQNTTS

SEQ ID NO: 498179 - protein, 9 aa, Homo Sapiens
IETLGDHSK

SEQ ID NO: 498180 - protein, 9 aa, Homo Sapiens
VLCVFKDLL

SEQ ID NO: 498181 - protein, 9 aa, Homo Sapiens
IFTKLGLQK

SEQ ID NO: 498182 - protein, 9 aa, Homo Sapiens
RSSSLIHHW

SEQ ID NO: 498183 - protein, 9 aa, Homo Sapiens
ASRETRPRR

SEQ ID NO: 498184 - protein, 9 aa, Homo Sapiens
HQTPSDVDQ

SEQ ID NO: 498185 - protein, 9 aa, Homo Sapiens
QSVPIQRIP

SEQ ID NO: 498186 - protein, 9 aa, Homo Sapiens
KRLATQDLK

SEQ ID NO: 498187 - protein, 9 aa, Homo Sapiens
TEAGAGAGA

SEQ ID NO: 498188 - protein, 9 aa, Homo Sapiens
EAAKAVDLI

SEQ ID NO: 498189 - protein, 9 aa, Homo Sapiens
PAAQVQRRW

SEQ ID NO: 498190 - protein, 9 aa, Homo Sapiens
GSKPEADIR

SEQ ID NO: 498191 - protein, 9 aa, Homo Sapiens
LKDPRKPSR

SEQ ID NO: 498192 - protein, 9 aa, Homo Sapiens
LEGQEDYYN

SEQ ID NO: 498193 - protein, 9 aa, Homo Sapiens
TQQSVPIQR

SEQ ID NO: 498194 - protein, 9 aa, Homo Sapiens
EGQEDYYNN

SEQ ID NO: 498195 - protein, 9 aa, Homo Sapiens
QEEQEEKEK

SEQ ID NO: 498196 - protein, 9 aa, Homo Sapiens
WMAPPLLSP

SEQ ID NO: 498197 - protein, 9 aa, Homo Sapiens
DHTLSQQDS

SEQ ID NO: 498198 - protein, 9 aa, Homo Sapiens
GLPFERKRD

SEQ ID NO: 498199 - protein, 9 aa, Homo Sapiens
KEDKINVYQ

SEQ ID NO: 498200 - protein, 9 aa, Homo Sapiens
VEKITEYKR

SEQ ID NO: 498201 - protein, 9 aa, Homo Sapiens
QYHENMKIN

SEQ ID NO: 498202 - protein, 9 aa, Homo Sapiens
MLKMGFEQQ

SEQ ID NO: 498203 - protein, 9 aa, Homo Sapiens
PPANGAPPP

SEQ ID NO: 498204 - protein, 9 aa, Homo Sapiens
SPHGELYAS

SEQ ID NO: 498205 - protein, 9 aa, Homo Sapiens
LSTVREQSS

SEQ ID NO: 498206 - protein, 9 aa, Homo Sapiens
NTWKTLAFS

SEQ ID NO: 498207 - protein, 9 aa, Homo Sapiens
TEKRADQMK

SEQ ID NO: 498208 - protein, 9 aa, Homo Sapiens
QAENDFRKG

SEQ ID NO: 498209 - protein, 9 aa, Homo Sapiens
LETKMYITK

SEQ ID NO: 498210 - protein, 9 aa, Homo Sapiens
HHTLLSLPW

SEQ ID NO: 498211 - protein, 9 aa, Homo Sapiens
PHGELYASG

SEQ ID NO: 498212 - protein, 9 aa, Homo Sapiens
NEGSYTCSV

SEQ ID NO: 498213 - protein, 9 aa, Homo Sapiens
LRTPPYQGD

SEQ ID NO: 498214 - protein, 9 aa, Homo Sapiens
DERLCNPQI

SEQ ID NO: 498215 - protein, 9 aa, Homo Sapiens
VAACLQLGP

SEQ ID NO: 498216 - protein, 9 aa, Homo Sapiens
FGKPCLLDN

SEQ ID NO: 498217 - protein, 9 aa, Homo Sapiens
QQDSIQKSP

SEQ ID NO: 498218 - protein, 9 aa, Homo Sapiens
AEIHSDSIT

SEQ ID NO: 498219 - protein, 9 aa, Homo Sapiens
LRTPPYQGT

SEQ ID NO: 498220 - protein, 9 aa, Homo Sapiens
AAEGQSYSY

SEQ ID NO: 498221 - protein, 9 aa, Homo Sapiens
FKTLEELAW

SEQ ID NO: 498222 - protein, 9 aa, Homo Sapiens
MGLFCALRH

SEQ ID NO: 498223 - protein, 9 aa, Homo Sapiens
TLYNGSVVE

SEQ ID NO: 498224 - protein, 9 aa, Homo Sapiens
TQLNEAHFK

SEQ ID NO: 498225 - protein, 9 aa, Homo Sapiens
TSLGNEGVI

SEQ ID NO: 498226 - protein, 9 aa, Homo Sapiens
ASVYPWKPQ

SEQ ID NO: 498227 - protein, 9 aa, Homo Sapiens
HSDSITLRD

SEQ ID NO: 498228 - protein, 9 aa, Homo Sapiens
IHAGSTMNF

SEQ ID NO: 498229 - protein, 9 aa, Homo Sapiens
QEELDFLFN

SEQ ID NO: 498230 - protein, 9 aa, Homo Sapiens
LHKDFKWYQ

SEQ ID NO: 498231 - protein, 9 aa, Homo Sapiens
NAAQPYLNL

SEQ ID NO: 498232 - protein, 9 aa, Homo Sapiens
YLTSCVNYM

SEQ ID NO: 498233 - protein, 9 aa, Homo Sapiens
PQRDSYSQS

SEQ ID NO: 498234 - protein, 9 aa, Homo Sapiens
VAEQDVGLG

SEQ ID NO: 498235 - protein, 9 aa, Homo Sapiens
LWWSAMPTE

SEQ ID NO: 498236 - protein, 9 aa, Homo Sapiens
MKELEESRQ

SEQ ID NO: 498237 - protein, 9 aa, Homo Sapiens
NDLRSVRSG

SEQ ID NO: 498238 - protein, 9 aa, Homo Sapiens
VEHTLVQCH

SEQ ID NO: 498239 - protein, 9 aa, Homo Sapiens
PLDTLIPDA

SEQ ID NO: 498240 - protein, 9 aa, Homo Sapiens
PPGYGPVGP

SEQ ID NO: 498241 - protein, 9 aa, Homo Sapiens
HGELYASGS

SEQ ID NO: 498242 - protein, 9 aa, Homo Sapiens
TNLHRDMSV

SEQ ID NO: 498243 - protein, 9 aa, Homo Sapiens
KEQSKRVSQ

SEQ ID NO: 498244 - protein, 9 aa, Homo Sapiens
TSRDSRSFF

SEQ ID NO: 498245 - protein, 9 aa, Homo Sapiens
SKPEADIRW

SEQ ID NO: 498246 - protein, 9 aa, Homo Sapiens
HACDDGGLI

SEQ ID NO: 498247 - protein, 9 aa, Homo Sapiens
CAMYVPICT

SEQ ID NO: 498248 - protein, 9 aa, Homo Sapiens
LSDDRRYDL

SEQ ID NO: 498249 - protein, 9 aa, Homo Sapiens
FQGLTQLCK

SEQ ID NO: 498250 - protein, 9 aa, Homo Sapiens
DYTAVKEDK

SEQ ID NO: 498251 - protein, 9 aa, Homo Sapiens
SSLGSGDDS

SEQ ID NO: 498252 - protein, 9 aa, Homo Sapiens
FVMDKFYFK

SEQ ID NO: 498253 - protein, 9 aa, Homo Sapiens
KILRDEVSL

SEQ ID NO: 498254 - protein, 9 aa, Homo Sapiens
LTSKNQIKR

SEQ ID NO: 498255 - protein, 9 aa, Homo Sapiens
TSAHPSRPC

SEQ ID NO: 498256 - protein, 9 aa, Homo Sapiens
PPKDGKLKD

SEQ ID NO: 498257 - protein, 9 aa, Homo Sapiens
GTEDSACIS

SEQ ID NO: 498258 - protein, 9 aa, Homo Sapiens
CEKRSVHKK

SEQ ID NO: 498259 - protein, 9 aa, Homo Sapiens
TLGDHSKLY

SEQ ID NO: 498260 - protein, 9 aa, Homo Sapiens
TSSASCFSS

SEQ ID NO: 498261 - protein, 9 aa, Homo Sapiens
RVIVPAGNL

SEQ ID NO: 498262 - protein, 9 aa, Homo Sapiens
GQEDYYNNL

SEQ ID NO: 498263 - protein, 9 aa, Homo Sapiens
SITLRDDFD

SEQ ID NO: 498264 - protein, 9 aa, Homo Sapiens
YGKTGRLFT

SEQ ID NO: 498265 - protein, 9 aa, Homo Sapiens
SEIVVAGHI

SEQ ID NO: 498266 - protein, 9 aa, Homo Sapiens
AVKEDKINV

SEQ ID NO: 498267 - protein, 9 aa, Homo Sapiens
AAQGAGAGL

SEQ ID NO: 498268 - protein, 9 aa, Homo Sapiens
PSADLAPMK

SEQ ID NO: 498269 - protein, 9 aa, Homo Sapiens
GEISIGTSP

SEQ ID NO: 498270 - protein, 9 aa, Homo Sapiens
GSPDALPAR

SEQ ID NO: 498271 - protein, 9 aa, Homo Sapiens
AQVQRRWVK

SEQ ID NO: 498272 - protein, 9 aa, Homo Sapiens
DQMKAMGIE

SEQ ID NO: 498273 - protein, 9 aa, Homo Sapiens
LHIDHGKPV

SEQ ID NO: 498274 - protein, 9 aa, Homo Sapiens
QLLGGQKSL

SEQ ID NO: 498275 - protein, 9 aa, Homo Sapiens
DLAPMKKPR

SEQ ID NO: 498276 - protein, 9 aa, Homo Sapiens
TIRFSFGSE

SEQ ID NO: 498277 - protein, 9 aa, Homo Sapiens
PGRGPGPKW

SEQ ID NO: 498278 - protein, 9 aa, Homo Sapiens
RRRHRCSQN

SEQ ID NO: 498279 - protein, 9 aa, Homo Sapiens
ADLAPMKKP

SEQ ID NO: 498280 - protein, 9 aa, Homo Sapiens
LLTLTNPVQ

SEQ ID NO: 498281 - protein, 9 aa, Homo Sapiens
TSKMLSLSA

SEQ ID NO: 498282 - protein, 9 aa, Homo Sapiens
HSAGDVAEQ

SEQ ID NO: 498283 - protein, 9 aa, Homo Sapiens
WSSAKNGWG

SEQ ID NO: 498284 - protein, 9 aa, Homo Sapiens
PSEMTEDMM

SEQ ID NO: 498285 - protein, 9 aa, Homo Sapiens
RGIICISTR

SEQ ID NO: 498286 - protein, 9 aa, Homo Sapiens
MKARQQKYK

SEQ ID NO: 498287 - protein, 9 aa, Homo Sapiens
HTLLSLPWI

SEQ ID NO: 498288 - protein, 9 aa, Homo Sapiens
AHPSRPCRM

SEQ ID NO: 498289 - protein, 9 aa, Homo Sapiens
HTLSQQDSI

SEQ ID NO: 498290 - protein, 9 aa, Homo Sapiens
TKAARRLGN

SEQ ID NO: 498291 - protein, 9 aa, Homo Sapiens
GMRVAFCYQ

SEQ ID NO: 498292 - protein, 9 aa, Homo Sapiens
RIYQRVHTG

SEQ ID NO: 498293 - protein, 9 aa, Homo Sapiens
IECSSICDY

SEQ ID NO: 498294 - protein, 9 aa, Homo Sapiens
PDGKGSSRR

SEQ ID NO: 498295 - protein, 9 aa, Homo Sapiens
CQDNKVVIG

SEQ ID NO: 498296 - protein, 9 aa, Homo Sapiens
HMQIHDRVE

SEQ ID NO: 498297 - protein, 9 aa, Homo Sapiens
EEKEKKGIV

SEQ ID NO: 498298 - protein, 9 aa, Homo Sapiens
SDSITLRDD

SEQ ID NO: 498299 - protein, 9 aa, Homo Sapiens
NEDHKEEDL

SEQ ID NO: 498300 - protein, 9 aa, Homo Sapiens
RDVAVAKER

SEQ ID NO: 498301 - protein, 9 aa, Homo Sapiens
SDGESVTHY

SEQ ID NO: 498302 - protein, 9 aa, Homo Sapiens
AMCNPREAQ

SEQ ID NO: 498303 - protein, 9 aa, Homo Sapiens
AECSSQLDE

SEQ ID NO: 498304 - protein, 9 aa, Homo Sapiens
KMRQHCDPH

SEQ ID NO: 498305 - protein, 9 aa, Homo Sapiens
LRALSRFQG

SEQ ID NO: 498306 - protein, 9 aa, Homo Sapiens
NFLLISNDL

SEQ ID NO: 498307 - protein, 9 aa, Homo Sapiens
EGQSYSYYC

SEQ ID NO: 498308 - protein, 9 aa, Homo Sapiens
KNDKILCEQ

SEQ ID NO: 498309 - protein, 9 aa, Homo Sapiens
ETLDFQEQI

SEQ ID NO: 498310 - protein, 9 aa, Homo Sapiens
DKPIAEAPF

SEQ ID NO: 498311 - protein, 9 aa, Homo Sapiens
WRHVVKDKL

SEQ ID NO: 498312 - protein, 9 aa, Homo Sapiens
EDTEKFRQW

SEQ ID NO: 498313 - protein, 9 aa, Homo Sapiens
ENGCVYTFG

SEQ ID NO: 498314 - protein, 9 aa, Homo Sapiens
PGYGPVGPI

SEQ ID NO: 498315 - protein, 9 aa, Homo Sapiens
EKEMRIYAT

SEQ ID NO: 498316 - protein, 9 aa, Homo Sapiens
TPVPVFLKL

SEQ ID NO: 498317 - protein, 9 aa, Homo Sapiens
CVILRYVNP

SEQ ID NO: 498318 - protein, 9 aa, Homo Sapiens
HPGWDRSQP

SEQ ID NO: 498319 - protein, 9 aa, Homo Sapiens
SSKEKVWSK

SEQ ID NO: 498320 - protein, 9 aa, Homo Sapiens
IVSPRDVAV

SEQ ID NO: 498321 - protein, 9 aa, Homo Sapiens
TLSWIRDGN

SEQ ID NO: 498322 - protein, 9 aa, Homo Sapiens
EAGAGTEAG

SEQ ID NO: 498323 - protein, 9 aa, Homo Sapiens
LWGNRLQYS

SEQ ID NO: 498324 - protein, 9 aa, Homo Sapiens
QQLKPGKKD

SEQ ID NO: 498325 - protein, 9 aa, Homo Sapiens
IMLHYARLG

SEQ ID NO: 498326 - protein, 9 aa, Homo Sapiens
HQQNKRKKP

SEQ ID NO: 498327 - protein, 9 aa, Homo Sapiens
DDTASTRLG

SEQ ID NO: 498328 - protein, 9 aa, Homo Sapiens
DICRPAHSV

SEQ ID NO: 498329 - protein, 9 aa, Homo Sapiens
PNDSKDILQ

SEQ ID NO: 498330 - protein, 9 aa, Homo Sapiens
AKNGESSGP

SEQ ID NO: 498331 - protein, 9 aa, Homo Sapiens
GHLRIYQRV

SEQ ID NO: 498332 - protein, 9 aa, Homo Sapiens
SEITKQEKD

SEQ ID NO: 498333 - protein, 9 aa, Homo Sapiens
GKTGRLFTE

SEQ ID NO: 498334 - protein, 9 aa, Homo Sapiens
PVKIKNIRF

SEQ ID NO: 498335 - protein, 9 aa, Homo Sapiens
THVCFCFRS

SEQ ID NO: 498336 - protein, 9 aa, Homo Sapiens
SWAYYSTVD

SEQ ID NO: 498337 - protein, 9 aa, Homo Sapiens
HCEFSADSS

SEQ ID NO: 498338 - protein, 9 aa, Homo Sapiens
ADQMKAMGI

SEQ ID NO: 498339 - protein, 9 aa, Homo Sapiens
EPPKDGKLK

SEQ ID NO: 498340 - protein, 9 aa, Homo Sapiens
NSMGLFCAL

SEQ ID NO: 498341 - protein, 9 aa, Homo Sapiens
IFEAWRHVV

SEQ ID NO: 498342 - protein, 9 aa, Homo Sapiens
QEEKEKEDD

SEQ ID NO: 498343 - protein, 9 aa, Homo Sapiens
RPAHSVLTL

SEQ ID NO: 498344 - protein, 9 aa, Homo Sapiens
GSTGHAPKW

SEQ ID NO: 498345 - protein, 9 aa, Homo Sapiens
PRKILRDEV

SEQ ID NO: 498346 - protein, 9 aa, Homo Sapiens
SLLEGQEDY

SEQ ID NO: 498347 - protein, 9 aa, Homo Sapiens
KTKIVVESK

SEQ ID NO: 498348 - protein, 9 aa, Homo Sapiens
SCEKRSVHK

SEQ ID NO: 498349 - protein, 9 aa, Homo Sapiens
EFSADSSAS

SEQ ID NO: 498350 - protein, 9 aa, Homo Sapiens
SSGFIFSPN

SEQ ID NO: 498351 - protein, 9 aa, Homo Sapiens
INSLFQEIE

SEQ ID NO: 498352 - protein, 9 aa, Homo Sapiens
ILTNTMKEL

SEQ ID NO: 498353 - protein, 9 aa, Homo Sapiens
DKILCEQCM

SEQ ID NO: 498354 - protein, 9 aa, Homo Sapiens
MKTIRFSFG

SEQ ID NO: 498355 - protein, 9 aa, Homo Sapiens
ARGSRRRRF

SEQ ID NO: 498356 - protein, 9 aa, Homo Sapiens
GARLSTTLR

SEQ ID NO: 498357 - protein, 9 aa, Homo Sapiens
DMKTIRFSF

SEQ ID NO: 498358 - protein, 9 aa, Homo Sapiens
DKLIKQRDY

SEQ ID NO: 498359 - protein, 9 aa, Homo Sapiens
MEIFSHMPG

SEQ ID NO: 498360 - protein, 9 aa, Homo Sapiens
NLRTRLPGR

SEQ ID NO: 498361 - protein, 9 aa, Homo Sapiens
FTSAHPSRP

SEQ ID NO: 498362 - protein, 9 aa, Homo Sapiens
KGCSNKSPM

SEQ ID NO: 498363 - protein, 9 aa, Homo Sapiens
ATSLHVTDT

SEQ ID NO: 498364 - protein, 9 aa, Homo Sapiens
KVDVYNEGS

SEQ ID NO: 498365 - protein, 9 aa, Homo Sapiens
PANGAPPPS

SEQ ID NO: 498366 - protein, 9 aa, Homo Sapiens
CGFGATVWE

SEQ ID NO: 498367 - protein, 9 aa, Homo Sapiens
TLIPDAKRI

SEQ ID NO: 498368 - protein, 9 aa, Homo Sapiens
KSSGSLFCV

SEQ ID NO: 498369 - protein, 9 aa, Homo Sapiens
LHVTDTSAA

SEQ ID NO: 498370 - protein, 9 aa, Homo Sapiens
GMPHHHTLL

SEQ ID NO: 498371 - protein, 9 aa, Homo Sapiens
FCFRSYVTH

SEQ ID NO: 498372 - protein, 9 aa, Homo Sapiens
RLSTTLRSI

SEQ ID NO: 498373 - protein, 9 aa, Homo Sapiens
LGGQKSLVA

SEQ ID NO: 498374 - protein, 9 aa, Homo Sapiens
YSVSFEQDD

SEQ ID NO: 498375 - protein, 9 aa, Homo Sapiens
EQQRRQQRE

SEQ ID NO: 498376 - protein, 9 aa, Homo Sapiens
KNGAALVLK

SEQ ID NO: 498377 - protein, 9 aa, Homo Sapiens
VREQSSIPR

SEQ ID NO: 498378 - protein, 9 aa, Homo Sapiens
NDITAEEEQ

SEQ ID NO: 498379 - protein, 9 aa, Homo Sapiens
PDAKRIIWD

SEQ ID NO: 498380 - protein, 9 aa, Homo Sapiens
SPWMGSGGT

SEQ ID NO: 498381 - protein, 9 aa, Homo Sapiens
RSKLERAIT

SEQ ID NO: 498382 - protein, 9 aa, Homo Sapiens
CISWAYYST

SEQ ID NO: 498383 - protein, 9 aa, Homo Sapiens
TRPRRSSPK

SEQ ID NO: 498384 - protein, 9 aa, Homo Sapiens
HTLVQCHAL

SEQ ID NO: 498385 - protein, 9 aa, Homo Sapiens
RHPRHIHKL

SEQ ID NO: 498386 - protein, 9 aa, Homo Sapiens
KEKPKEEEM

SEQ ID NO: 498387 - protein, 9 aa, Homo Sapiens
VTQQSVPIQ

SEQ ID NO: 498388 - protein, 9 aa, Homo Sapiens
LIEKYGVGY

SEQ ID NO: 498389 - protein, 9 aa, Homo Sapiens
KMLSLSAIL

SEQ ID NO: 498390 - protein, 9 aa, Homo Sapiens
DYYNNLSAS

SEQ ID NO: 498391 - protein, 9 aa, Homo Sapiens
GESVTHYIR

SEQ ID NO: 498392 - protein, 9 aa, Homo Sapiens
PVQNLTHVT

SEQ ID NO: 498393 - protein, 9 aa, Homo Sapiens
VPICTLEFL

SEQ ID NO: 498394 - protein, 9 aa, Homo Sapiens
EDEECSTDE

SEQ ID NO: 498395 - protein, 9 aa, Homo Sapiens
PKALVAPSL

SEQ ID NO: 498396 - protein, 9 aa, Homo Sapiens
THNEDHKEE

SEQ ID NO: 498397 - protein, 9 aa, Homo Sapiens
KNGESSGPP

SEQ ID NO: 498398 - protein, 9 aa, Homo Sapiens
ERQLQFYTK

SEQ ID NO: 498399 - protein, 9 aa, Homo Sapiens
KDFKWYQQW

SEQ ID NO: 498400 - protein, 9 aa, Homo Sapiens
ANNFLLISN

SEQ ID NO: 498401 - protein, 9 aa, Homo Sapiens
MLHYARLGR

SEQ ID NO: 498402 - protein, 9 aa, Homo Sapiens
HSSTPNSSK

SEQ ID NO: 498403 - protein, 9 aa, Homo Sapiens
QKQYRPDMI

SEQ ID NO: 498404 - protein, 9 aa, Homo Sapiens
GLQKQYRPD

SEQ ID NO: 498405 - protein, 9 aa, Homo Sapiens
ELDFLFNEE

SEQ ID NO: 498406 - protein, 9 aa, Homo Sapiens
DRMKARQQK

SEQ ID NO: 498407 - protein, 9 aa, Homo Sapiens
PTLSGTKCL

SEQ ID NO: 498408 - protein, 9 aa, Homo Sapiens
DLVDTSRQS

SEQ ID NO: 498409 - protein, 9 aa, Homo Sapiens
NSVFAHDLL

SEQ ID NO: 498410 - protein, 9 aa, Homo Sapiens
PLPKVPPWT

SEQ ID NO: 498411 - protein, 9 aa, Homo Sapiens
KDPHSERAL

SEQ ID NO: 498412 - protein, 9 aa, Homo Sapiens
RIHKSSPLD

SEQ ID NO: 498413 - protein, 9 aa, Homo Sapiens
TCATHLTSV

SEQ ID NO: 498414 - protein, 9 aa, Homo Sapiens
CDPHILQKP

SEQ ID NO: 498415 - protein, 9 aa, Homo Sapiens
SYLFGMESS

SEQ ID NO: 498416 - protein, 9 aa, Homo Sapiens
ALSLILHID

SEQ ID NO: 498417 - protein, 9 aa, Homo Sapiens
KHQDKEFFG

SEQ ID NO: 498418 - protein, 9 aa, Homo Sapiens
PRQEGAHPG

SEQ ID NO: 498419 - protein, 9 aa, Homo Sapiens
SYLSYLTSK

SEQ ID NO: 498420 - protein, 9 aa, Homo Sapiens
TPNSSKFSR

SEQ ID NO: 498421 - protein, 9 aa, Homo Sapiens
TRLGGTPGP

SEQ ID NO: 498422 - protein, 9 aa, Homo Sapiens
SYSQSGCRV

SEQ ID NO: 498423 - protein, 9 aa, Homo Sapiens
TKTKIVVES

SEQ ID NO: 498424 - protein, 9 aa, Homo Sapiens
NDFRKGPEP

SEQ ID NO: 498425 - protein, 9 aa, Homo Sapiens
WKDICARIF

SEQ ID NO: 498426 - protein, 9 aa, Homo Sapiens
NKSPMVPAT

SEQ ID NO: 498427 - protein, 9 aa, Homo Sapiens
KERKSLKLL

SEQ ID NO: 498428 - protein, 9 aa, Homo Sapiens
ESSKDKTFW

SEQ ID NO: 498429 - protein, 9 aa, Homo Sapiens
CKHQDKEFF

SEQ ID NO: 498430 - protein, 9 aa, Homo Sapiens
LTSGLWGNR

SEQ ID NO: 498431 - protein, 9 aa, Homo Sapiens
SKYERKHWE

SEQ ID NO: 498432 - protein, 9 aa, Homo Sapiens
PCLLDNVGE

SEQ ID NO: 498433 - protein, 9 aa, Homo Sapiens
IMVNGSRVK

SEQ ID NO: 498434 - protein, 9 aa, Homo Sapiens
QTHFKSKME

SEQ ID NO: 498435 - protein, 9 aa, Homo Sapiens
QWAKSPPAD

SEQ ID NO: 498436 - protein, 9 aa, Homo Sapiens
GYKFRPALD

SEQ ID NO: 498437 - protein, 9 aa, Homo Sapiens
RHMQIHDRV

SEQ ID NO: 498438 - protein, 9 aa, Homo Sapiens
TLKPKDVDA

SEQ ID NO: 498439 - protein, 9 aa, Homo Sapiens
FIFSPNFPH

SEQ ID NO: 498440 - protein, 9 aa, Homo Sapiens
SDVDQFSDS

SEQ ID NO: 498441 - protein, 9 aa, Homo Sapiens
CEFSADSSA

SEQ ID NO: 498442 - protein, 9 aa, Homo Sapiens
PPPPLMNSL

SEQ ID NO: 498443 - protein, 9 aa, Homo Sapiens
SVTHYIRRL

SEQ ID NO: 498444 - protein, 9 aa, Homo Sapiens
SFEQDDKIR

SEQ ID NO: 498445 - protein, 9 aa, Homo Sapiens
SWIRDGNNI

SEQ ID NO: 498446 - protein, 9 aa, Homo Sapiens
PLSEITKQE

SEQ ID NO: 498447 - protein, 9 aa, Homo Sapiens
CVNYMPEPE

SEQ ID NO: 498448 - protein, 9 aa, Homo Sapiens
RETRPRRSS

SEQ ID NO: 498449 - protein, 9 aa, Homo Sapiens
FYTKAARRL

SEQ ID NO: 498450 - protein, 9 aa, Homo Sapiens
EIVVAGHIA

SEQ ID NO: 498451 - protein, 9 aa, Homo Sapiens
LTSKMLSLS

SEQ ID NO: 498452 - protein, 9 aa, Homo Sapiens
VQAENDFRK

SEQ ID NO: 498453 - protein, 9 aa, Homo Sapiens
DEECSTDEY

SEQ ID NO: 498454 - protein, 9 aa, Homo Sapiens
FGIECSSIC

SEQ ID NO: 498455 - protein, 9 aa, Homo Sapiens
GRNTWKTLA

SEQ ID NO: 498456 - protein, 9 aa, Homo Sapiens
YLKALSSKS

SEQ ID NO: 498457 - protein, 9 aa, Homo Sapiens
TEYKRQNPT

SEQ ID NO: 498458 - protein, 9 aa, Homo Sapiens
AENDFRKGP

SEQ ID NO: 498459 - protein, 9 aa, Homo Sapiens
LSGTKCLCV

SEQ ID NO: 498460 - protein, 9 aa, Homo Sapiens
LSRFQGMRV

SEQ ID NO: 498461 - protein, 9 aa, Homo Sapiens
EKITEYKRQ

SEQ ID NO: 498462 - protein, 9 aa, Homo Sapiens
LFQEIEDDA

SEQ ID NO: 498463 - protein, 9 aa, Homo Sapiens
PMKKPRKSS

SEQ ID NO: 498464 - protein, 9 aa, Homo Sapiens
VFSEKEMRI

SEQ ID NO: 498465 - protein, 9 aa, Homo Sapiens
AVYTSLGNE

SEQ ID NO: 498466 - protein, 9 aa, Homo Sapiens
PCKDTVQNH

SEQ ID NO: 498467 - protein, 9 aa, Homo Sapiens
FRKGPEPES

SEQ ID NO: 498468 - protein, 9 aa, Homo Sapiens
KLVSPANGK

SEQ ID NO: 498469 - protein, 9 aa, Homo Sapiens
RFGRAPPEA

SEQ ID NO: 498470 - protein, 9 aa, Homo Sapiens
RQEEWTLRL

SEQ ID NO: 498471 - protein, 9 aa, Homo Sapiens
LTQLCKLNL

SEQ ID NO: 498472 - protein, 9 aa, Homo Sapiens
ANNDAFGTL

SEQ ID NO: 498473 - protein, 9 aa, Homo Sapiens
IQAVVMQGE

SEQ ID NO: 498474 - protein, 9 aa, Homo Sapiens
MYFKNKKVS

SEQ ID NO: 498475 - protein, 9 aa, Homo Sapiens
VNRRDRIHK

SEQ ID NO: 498476 - protein, 9 aa, Homo Sapiens
LGSGDDSGG

SEQ ID NO: 498477 - protein, 9 aa, Homo Sapiens
ALAEEIMLH

SEQ ID NO: 498478 - protein, 9 aa, Homo Sapiens
RVAFCYQIR

SEQ ID NO: 498479 - protein, 9 aa, Homo Sapiens
KDLVDTSRQ

SEQ ID NO: 498480 - protein, 9 aa, Homo Sapiens
HRDMSVSIS

SEQ ID NO: 498481 - protein, 9 aa, Homo Sapiens
ISHQQNKRK

SEQ ID NO: 498482 - protein, 9 aa, Homo Sapiens
AHPGWDRSQ

SEQ ID NO: 498483 - protein, 9 aa, Homo Sapiens
SCFSSTSYM

SEQ ID NO: 498484 - protein, 9 aa, Homo Sapiens
DVAEQDVGL

SEQ ID NO: 498485 - protein, 9 aa, Homo Sapiens
RLVRGIICI

SEQ ID NO: 498486 - protein, 9 aa, Homo Sapiens
WPDPSHNTE

SEQ ID NO: 498487 - protein, 9 aa, Homo Sapiens
PYLNLSNLD

SEQ ID NO: 498488 - protein, 9 aa, Homo Sapiens
SGDNSVFAH

SEQ ID NO: 498489 - protein, 9 aa, Homo Sapiens
STMNFFQNS

SEQ ID NO: 498490 - protein, 9 aa, Homo Sapiens
LRSIQPKTK

SEQ ID NO: 498491 - protein, 9 aa, Homo Sapiens
IIANNDAFG

SEQ ID NO: 498492 - protein, 9 aa, Homo Sapiens
KRQMDRMKA

SEQ ID NO: 498493 - protein, 9 aa, Homo Sapiens
QNLTHVTLF

SEQ ID NO: 498494 - protein, 9 aa, Homo Sapiens
FEPNDITAE

SEQ ID NO: 498495 - protein, 9 aa, Homo Sapiens
SSASCFSST

SEQ ID NO: 498496 - protein, 9 aa, Homo Sapiens
VNYMPEPEN

SEQ ID NO: 498497 - protein, 9 aa, Homo Sapiens
TVQNHDITG

SEQ ID NO: 498498 - protein, 9 aa, Homo Sapiens
KGIVKQDSL

SEQ ID NO: 498499 - protein, 9 aa, Homo Sapiens
GNLRTRLPG

SEQ ID NO: 498500 - protein, 9 aa, Homo Sapiens
FSWQSVLLS

SEQ ID NO: 498501 - protein, 9 aa, Homo Sapiens
ISSKEKVWS

SEQ ID NO: 498502 - protein, 9 aa, Homo Sapiens
GLTQLCKLN

SEQ ID NO: 498503 - protein, 9 aa, Homo Sapiens
MKEDTEKFR

SEQ ID NO: 498504 - protein, 9 aa, Homo Sapiens
SHRSLRKVP

SEQ ID NO: 498505 - protein, 9 aa, Homo Sapiens
VVASRQSST

SEQ ID NO: 498506 - protein, 9 aa, Homo Sapiens
QGRRRRHRC

SEQ ID NO: 498507 - protein, 9 aa, Homo Sapiens
RRHMQIHDR

SEQ ID NO: 498508 - protein, 9 aa, Homo Sapiens
AALSPLPKV

SEQ ID NO: 498509 - protein, 9 aa, Homo Sapiens
HECSEQPSV

SEQ ID NO: 498510 - protein, 9 aa, Homo Sapiens
EIKEKPKEE

SEQ ID NO: 498511 - protein, 9 aa, Homo Sapiens
LAPMKKPRK

SEQ ID NO: 498512 - protein, 9 aa, Homo Sapiens
QRRWVKKRH

SEQ ID NO: 498513 - protein, 9 aa, Homo Sapiens
VRFSPHGEL

SEQ ID NO: 498514 - protein, 9 aa, Homo Sapiens
RPALDNPYL

SEQ ID NO: 498515 - protein, 9 aa, Homo Sapiens
SEKEMRIYA

SEQ ID NO: 498516 - protein, 9 aa, Homo Sapiens
TLDFQEQIL

SEQ ID NO: 498517 - protein, 9 aa, Homo Sapiens
LKMGFEQQV

SEQ ID NO: 498518 - protein, 9 aa, Homo Sapiens
SAMPTEGAC

SEQ ID NO: 498519 - protein, 9 aa, Homo Sapiens
RCDPKATRV

SEQ ID NO: 498520 - protein, 9 aa, Homo Sapiens
RLCNPQIEW

SEQ ID NO: 498521 - protein, 9 aa, Homo Sapiens
LVSLGISFK

SEQ ID NO: 498522 - protein, 9 aa, Homo Sapiens
ILRDEVSLE

SEQ ID NO: 498523 - protein, 9 aa, Homo Sapiens
LFNEEIEQI

SEQ ID NO: 498524 - protein, 9 aa, Homo Sapiens
ALSSKSIEK

SEQ ID NO: 498525 - protein, 9 aa, Homo Sapiens
KWEVTHGEG

SEQ ID NO: 498526 - protein, 9 aa, Homo Sapiens
IVVAGHIAD

SEQ ID NO: 498527 - protein, 9 aa, Homo Sapiens
GNMEAAKAV

SEQ ID NO: 498528 - protein, 9 aa, Homo Sapiens
RHRCSQNTT

SEQ ID NO: 498529 - protein, 9 aa, Homo Sapiens
AVVMQGEIS

SEQ ID NO: 498530 - protein, 9 aa, Homo Sapiens
NFFQNSRYQ

SEQ ID NO: 498531 - protein, 9 aa, Homo Sapiens
VPYDICRPA

SEQ ID NO: 498532 - protein, 9 aa, Homo Sapiens
YSKYERKHW

SEQ ID NO: 498533 - protein, 9 aa, Homo Sapiens
PSKVLCVFK

SEQ ID NO: 498534 - protein, 9 aa, Homo Sapiens
IRQEEWTLR

SEQ ID NO: 498535 - protein, 9 aa, Homo Sapiens
LVLKERTQI

SEQ ID NO: 498536 - protein, 9 aa, Homo Sapiens
NGCVYTFGL

SEQ ID NO: 498537 - protein, 9 aa, Homo Sapiens
CFSSTSYMS

SEQ ID NO: 498538 - protein, 9 aa, Homo Sapiens
VVMQGEIST

SEQ ID NO: 498539 - protein, 9 aa, Homo Sapiens
YYDPSDKPI

SEQ ID NO: 498540 - protein, 9 aa, Homo Sapiens
AYSDVEHTL

SEQ ID NO: 498541 - protein, 9 aa, Homo Sapiens
CSTDEYCAS

SEQ ID NO: 498542 - protein, 9 aa, Homo Sapiens
FKEVVWSKF

SEQ ID NO: 498543 - protein, 9 aa, Homo Sapiens
ACISWAYYS

SEQ ID NO: 498544 - protein, 9 aa, Homo Sapiens
MRQMKEDTE

SEQ ID NO: 498545 - protein, 9 aa, Homo Sapiens
TWVVASRQS

SEQ ID NO: 498546 - protein, 9 aa, Homo Sapiens
TKCLCVCQS

SEQ ID NO: 498547 - protein, 9 aa, Homo Sapiens
TLSQQDSIQ

SEQ ID NO: 498548 - protein, 9 aa, Homo Sapiens
RGASSSTSR

SEQ ID NO: 498549 - protein, 9 aa, Homo Sapiens
STRLGGTPG

SEQ ID NO: 498550 - protein, 9 aa, Homo Sapiens
QSVLLSHQR

SEQ ID NO: 498551 - protein, 9 aa, Homo Sapiens
QDNPKALVA

SEQ ID NO: 498552 - protein, 9 aa, Homo Sapiens
QEDYYNNLS

SEQ ID NO: 498553 - protein, 9 aa, Homo Sapiens
EIMLHYARL

SEQ ID NO: 498554 - protein, 9 aa, Homo Sapiens
REAEEKEKK

SEQ ID NO: 498555 - protein, 9 aa, Homo Sapiens
STVREQSSI

SEQ ID NO: 498556 - protein, 9 aa, Homo Sapiens
PPELETKMY

SEQ ID NO: 498557 - protein, 9 aa, Homo Sapiens
SFGSEFRPL

SEQ ID NO: 498558 - protein, 9 aa, Homo Sapiens
MNSLPPRPP

SEQ ID NO: 498559 - protein, 9 aa, Homo Sapiens
SLGNEGVIY

SEQ ID NO: 498560 - protein, 9 aa, Homo Sapiens
SRRRRFGRA

SEQ ID NO: 498561 - protein, 9 aa, Homo Sapiens
NGSRVKNLV

SEQ ID NO: 498562 - protein, 9 aa, Homo Sapiens
SSQLDEEEE

SEQ ID NO: 498563 - protein, 9 aa, Homo Sapiens
LDFQEQILE

SEQ ID NO: 498564 - protein, 9 aa, Homo Sapiens
PTSNLVAAC

SEQ ID NO: 498565 - protein, 9 aa, Homo Sapiens
PGHQTPSDV

SEQ ID NO: 498566 - protein, 9 aa, Homo Sapiens
PIQRIPNMY

SEQ ID NO: 498567 - protein, 9 aa, Homo Sapiens
KLGLQKAHR

SEQ ID NO: 498568 - protein, 9 aa, Homo Sapiens
RRLYFPAAE

SEQ ID NO: 498569 - protein, 9 aa, Homo Sapiens
NYMPEPENS

SEQ ID NO: 498570 - protein, 9 aa, Homo Sapiens
SPMVPATLI

SEQ ID NO: 498571 - protein, 9 aa, Homo Sapiens
RDGNNILHS

SEQ ID NO: 498572 - protein, 9 aa, Homo Sapiens
VAQRDYKKA

SEQ ID NO: 498573 - protein, 9 aa, Homo Sapiens
DGLPGRRHK

SEQ ID NO: 498574 - protein, 9 aa, Homo Sapiens
CFRSYVTHH

SEQ ID NO: 498575 - protein, 9 aa, Homo Sapiens
IHSDSITLR

SEQ ID NO: 498576 - protein, 9 aa, Homo Sapiens
QLKRQMDRM

SEQ ID NO: 498577 - protein, 9 aa, Homo Sapiens
GVGYWAKIA

SEQ ID NO: 498578 - protein, 9 aa, Homo Sapiens
PPPSAAAAG

SEQ ID NO: 498579 - protein, 9 aa, Homo Sapiens
NLHRDMSVS

SEQ ID NO: 498580 - protein, 9 aa, Homo Sapiens
FLKLVSPAN

SEQ ID NO: 498581 - protein, 9 aa, Homo Sapiens
EITKQEKDF

SEQ ID NO: 498582 - protein, 9 aa, Homo Sapiens
TIHAGSTMN

SEQ ID NO: 498583 - protein, 9 aa, Homo Sapiens
ALDNPYLQL

SEQ ID NO: 498584 - protein, 9 aa, Homo Sapiens
DICARIFLI

SEQ ID NO: 498585 - protein, 9 aa, Homo Sapiens
EDVLITSCT

SEQ ID NO: 498586 - protein, 9 aa, Homo Sapiens
IKEIKEKPK

SEQ ID NO: 498587 - protein, 9 aa, Homo Sapiens
DDDLPRDLQ

SEQ ID NO: 498588 - protein, 9 aa, Homo Sapiens
DKINVYQGE

SEQ ID NO: 498589 - protein, 9 aa, Homo Sapiens
CLHCEFSAD

SEQ ID NO: 498590 - protein, 9 aa, Homo Sapiens
DMMRDRIEQ

SEQ ID NO: 498591 - protein, 9 aa, Homo Sapiens
KQEKDFLWS

SEQ ID NO: 498592 - protein, 9 aa, Homo Sapiens
LSECLDLQR

SEQ ID NO: 498593 - protein, 9 aa, Homo Sapiens
RQLQFYTKA

SEQ ID NO: 498594 - protein, 9 aa, Homo Sapiens
GAGTEAGAG

SEQ ID NO: 498595 - protein, 9 aa, Homo Sapiens
EKRSVHKKE

SEQ ID NO: 498596 - protein, 9 aa, Homo Sapiens
MNFFQNSRY

SEQ ID NO: 498597 - protein, 9 aa, Homo Sapiens
DHKEEDLKP

SEQ ID NO: 498598 - protein, 9 aa, Homo Sapiens
DETLDFQEQ

SEQ ID NO: 498599 - protein, 9 aa, Homo Sapiens
REMQQLLGG

SEQ ID NO: 498600 - protein, 9 aa, Homo Sapiens
CDYSEKIIK

SEQ ID NO: 498601 - protein, 9 aa, Homo Sapiens
AEIIEAGDE

SEQ ID NO: 498602 - protein, 9 aa, Homo Sapiens
KASRETRPR

SEQ ID NO: 498603 - protein, 9 aa, Homo Sapiens
NPVQNLTHV

SEQ ID NO: 498604 - protein, 9 aa, Homo Sapiens
FSCEKRSVH

SEQ ID NO: 498605 - protein, 9 aa, Homo Sapiens
ERLCNPQIE

SEQ ID NO: 498606 - protein, 9 aa, Homo Sapiens
GIPVAGKPH

SEQ ID NO: 498607 - protein, 9 aa, Homo Sapiens
KSIEKLPVF

SEQ ID NO: 498608 - protein, 9 aa, Homo Sapiens
SLPSYLFGM

SEQ ID NO: 498609 - protein, 9 aa, Homo Sapiens
FSPNFPHPY

SEQ ID NO: 498610 - protein, 9 aa, Homo Sapiens
TENGCVYTF

SEQ ID NO: 498611 - protein, 9 aa, Homo Sapiens
DAKRIIWDS

SEQ ID NO: 498612 - protein, 9 aa, Homo Sapiens
AHFKTLEEL

SEQ ID NO: 498613 - protein, 9 aa, Homo Sapiens
TNILDTWVA

SEQ ID NO: 498614 - protein, 9 aa, Homo Sapiens
AKREETLKA

SEQ ID NO: 498615 - protein, 9 aa, Homo Sapiens
KPEADIRWF

SEQ ID NO: 498616 - protein, 9 aa, Homo Sapiens
SFKCTMKEF

SEQ ID NO: 498617 - protein, 9 aa, Homo Sapiens
TWKTLAFSF

SEQ ID NO: 498618 - protein, 9 aa, Homo Sapiens
TESRWKDIC

SEQ ID NO: 498619 - protein, 9 aa, Homo Sapiens
NDERLCNPQ

SEQ ID NO: 498620 - protein, 9 aa, Homo Sapiens
PNPRQEGAH

SEQ ID NO: 498621 - protein, 9 aa, Homo Sapiens
ALALQWAKS

SEQ ID NO: 498622 - protein, 9 aa, Homo Sapiens
KINVYQGEV

SEQ ID NO: 498623 - protein, 9 aa, Homo Sapiens
GIICISTRK

SEQ ID NO: 498624 - protein, 9 aa, Homo Sapiens
GPVGPIGDK

SEQ ID NO: 498625 - protein, 9 aa, Homo Sapiens
PHHHTLLSL

SEQ ID NO: 498626 - protein, 9 aa, Homo Sapiens
MCNPREAQA

SEQ ID NO: 498627 - protein, 9 aa, Homo Sapiens
YKKAIKFYR

SEQ ID NO: 498628 - protein, 9 aa, Homo Sapiens
RKAVKRLAT

SEQ ID NO: 498629 - protein, 9 aa, Homo Sapiens
SDPVKIKNI

SEQ ID NO: 498630 - protein, 9 aa, Homo Sapiens
RNTWKTLAF

SEQ ID NO: 498631 - protein, 9 aa, Homo Sapiens
IVQTLLDLF

SEQ ID NO: 498632 - protein, 9 aa, Homo Sapiens
DSSASLELH

SEQ ID NO: 498633 - protein, 9 aa, Homo Sapiens
MDRMKARQQ

SEQ ID NO: 498634 - protein, 9 aa, Homo Sapiens
RQSSTVSRA

SEQ ID NO: 498635 - protein, 9 aa, Homo Sapiens
VDKLIKQRD

SEQ ID NO: 498636 - protein, 9 aa, Homo Sapiens
SPSFYQNNN

SEQ ID NO: 498637 - protein, 9 aa, Homo Sapiens
EKNDKILCE

SEQ ID NO: 498638 - protein, 9 aa, Homo Sapiens
EEQEEKEKE

SEQ ID NO: 498639 - protein, 9 aa, Homo Sapiens
PGMQSPSFY

SEQ ID NO: 498640 - protein, 9 aa, Homo Sapiens
VLKERTQIE

SEQ ID NO: 498641 - protein, 9 aa, Homo Sapiens
DNKLLLCDG

SEQ ID NO: 498642 - protein, 9 aa, Homo Sapiens
ICDYSEKII

SEQ ID NO: 498643 - protein, 9 aa, Homo Sapiens
TEKFRQWKQ

SEQ ID NO: 498644 - protein, 9 aa, Homo Sapiens
TEDSACISW

SEQ ID NO: 498645 - protein, 9 aa, Homo Sapiens
KFHMGLYGK

SEQ ID NO: 498646 - protein, 9 aa, Homo Sapiens
VSLGNGILE

SEQ ID NO: 498647 - protein, 9 aa, Homo Sapiens
GISFKCTMK

SEQ ID NO: 498648 - protein, 9 aa, Homo Sapiens
IFSHMPGES

SEQ ID NO: 498649 - protein, 9 aa, Homo Sapiens
IPVAGKPHR

SEQ ID NO: 498650 - protein, 9 aa, Homo Sapiens
VSFEQDDKI

SEQ ID NO: 498651 - protein, 9 aa, Homo Sapiens
SLGSGDDSG

SEQ ID NO: 498652 - protein, 9 aa, Homo Sapiens
VSPRDVAVA

SEQ ID NO: 498653 - protein, 9 aa, Homo Sapiens
HNEDHKEED

SEQ ID NO: 498654 - protein, 9 aa, Homo Sapiens
PSFYQNNNY

SEQ ID NO: 498655 - protein, 9 aa, Homo Sapiens
KEKVWSKSE

SEQ ID NO: 498656 - protein, 9 aa, Homo Sapiens
VMQGEISTI

SEQ ID NO: 498657 - protein, 9 aa, Homo Sapiens
DTWVAMEEL

SEQ ID NO: 498658 - protein, 9 aa, Homo Sapiens
SDDRRYDLF

SEQ ID NO: 498659 - protein, 9 aa, Homo Sapiens
KITEYKRQN

SEQ ID NO: 498660 - protein, 9 aa, Homo Sapiens
VAFCYQIRR

SEQ ID NO: 498661 - protein, 9 aa, Homo Sapiens
HMPGESCEN

SEQ ID NO: 498662 - protein, 9 aa, Homo Sapiens
EHIQTHFKS

SEQ ID NO: 498663 - protein, 9 aa, Homo Sapiens
RRHKKRTSI

SEQ ID NO: 498664 - protein, 9 aa, Homo Sapiens
RWVKKRHRR

SEQ ID NO: 498665 - protein, 9 aa, Homo Sapiens
EAPAGPLQE

SEQ ID NO: 498666 - protein, 9 aa, Homo Sapiens
PKVPPWTGE

SEQ ID NO: 498667 - protein, 9 aa, Homo Sapiens
MYVPICTLE

SEQ ID NO: 498668 - protein, 9 aa, Homo Sapiens
DTEKFRQWK

SEQ ID NO: 498669 - protein, 9 aa, Homo Sapiens
TAVKEDKIN

SEQ ID NO: 498670 - protein, 9 aa, Homo Sapiens
IYATEIILG

SEQ ID NO: 498671 - protein, 9 aa, Homo Sapiens
SRSCFNLSN

SEQ ID NO: 498672 - protein, 9 aa, Homo Sapiens
SQQDSIQKS

SEQ ID NO: 498673 - protein, 9 aa, Homo Sapiens
PRCDPKATR

SEQ ID NO: 498674 - protein, 9 aa, Homo Sapiens
QRIPNMYYT

SEQ ID NO: 498675 - protein, 9 aa, Homo Sapiens
GDNSVFAHD

SEQ ID NO: 498676 - protein, 9 aa, Homo Sapiens
QEQILEAAK

SEQ ID NO: 498677 - protein, 9 aa, Homo Sapiens
EADKCGFGA

SEQ ID NO: 498678 - protein, 9 aa, Homo Sapiens
MMRDRIEQV

SEQ ID NO: 498679 - protein, 9 aa, Homo Sapiens
NLVAACLQL

SEQ ID NO: 498680 - protein, 9 aa, Homo Sapiens
FPFWMAPPL

SEQ ID NO: 498681 - protein, 9 aa, Homo Sapiens
DRIHKSSPL

SEQ ID NO: 498682 - protein, 9 aa, Homo Sapiens
MVSIIFIRQ

SEQ ID NO: 498683 - protein, 9 aa, Homo Sapiens
TCQDNKVVI

SEQ ID NO: 498684 - protein, 9 aa, Homo Sapiens
KTHNEDHKE

SEQ ID NO: 498685 - protein, 9 aa, Homo Sapiens
SICDYSEKI

SEQ ID NO: 498686 - protein, 9 aa, Homo Sapiens
DTLIPDAKR

SEQ ID NO: 498687 - protein, 9 aa, Homo Sapiens
DSITLRDDF

SEQ ID NO: 498688 - protein, 9 aa, Homo Sapiens
CAEDEECST

SEQ ID NO: 498689 - protein, 9 aa, Homo Sapiens
DGESVTHYI

SEQ ID NO: 498690 - protein, 9 aa, Homo Sapiens
VDTSRQSKI

SEQ ID NO: 498691 - protein, 9 aa, Homo Sapiens
MQGEISTIL

SEQ ID NO: 498692 - protein, 9 aa, Homo Sapiens
YTYSVSFEQ

SEQ ID NO: 498693 - protein, 9 aa, Homo Sapiens
LRDEVSLED

SEQ ID NO: 498694 - protein, 9 aa, Homo Sapiens
VIVPAGNLR

SEQ ID NO: 498695 - protein, 9 aa, Homo Sapiens
YGPVGPIGD

SEQ ID NO: 498696 - protein, 9 aa, Homo Sapiens
FPFFFLRRS

SEQ ID NO: 498697 - protein, 9 aa, Homo Sapiens
GTKCLCVCQ

SEQ ID NO: 498698 - protein, 9 aa, Homo Sapiens
SGAAQGAGA

SEQ ID NO: 498699 - protein, 9 aa, Homo Sapiens
WWSAMPTEG

SEQ ID NO: 498700 - protein, 9 aa, Homo Sapiens
GEPDSPWMG

SEQ ID NO: 498701 - protein, 9 aa, Homo Sapiens
EIFSHMPGE

SEQ ID NO: 498702 - protein, 9 aa, Homo Sapiens
KQKDWILAY

SEQ ID NO: 498703 - protein, 9 aa, Homo Sapiens
LFCALRHAL

SEQ ID NO: 498704 - protein, 9 aa, Homo Sapiens
ERQLREQQR

SEQ ID NO: 498705 - protein, 9 aa, Homo Sapiens
SLFQEIEDD

SEQ ID NO: 498706 - protein, 9 aa, Homo Sapiens
GKGSSRRPT

SEQ ID NO: 498707 - protein, 9 aa, Homo Sapiens
DNVGEELDP

SEQ ID NO: 498708 - protein, 9 aa, Homo Sapiens
ETFEDVFSH

SEQ ID NO: 498709 - protein, 9 aa, Homo Sapiens
DTVQNHDIT

SEQ ID NO: 498710 - protein, 9 aa, Homo Sapiens
GAAEQAEII

SEQ ID NO: 498711 - protein, 9 aa, Homo Sapiens
GERKTKTKI

SEQ ID NO: 498712 - protein, 9 aa, Homo Sapiens
QKDWILAYS

SEQ ID NO: 498713 - protein, 9 aa, Homo Sapiens
GGHLRIYQR

SEQ ID NO: 498714 - protein, 9 aa, Homo Sapiens
IAECSSQLD

SEQ ID NO: 498715 - protein, 9 aa, Homo Sapiens
KPNRFKEVV

SEQ ID NO: 498716 - protein, 9 aa, Homo Sapiens
DGDRMAKSL

SEQ ID NO: 498717 - protein, 9 aa, Homo Sapiens
PENMQPQTR

SEQ ID NO: 498718 - protein, 9 aa, Homo Sapiens
NKRKKPPVA

SEQ ID NO: 498719 - protein, 9 aa, Homo Sapiens
SPLPKVPPW

SEQ ID NO: 498720 - protein, 9 aa, Homo Sapiens
AMINSLFQE

SEQ ID NO: 498721 - protein, 9 aa, Homo Sapiens
VRGIICIST

SEQ ID NO: 498722 - protein, 9 aa, Homo Sapiens
LCQCDKKRG

SEQ ID NO: 498723 - protein, 9 aa, Homo Sapiens
SSSGDNSVF

SEQ ID NO: 498724 - protein, 9 aa, Homo Sapiens
LRKLKEQSK

SEQ ID NO: 498725 - protein, 9 aa, Homo Sapiens
KYGVGYWAK

SEQ ID NO: 498726 - protein, 9 aa, Homo Sapiens
KDICARIFL

SEQ ID NO: 498727 - protein, 9 aa, Homo Sapiens
YSQSGCRVP

SEQ ID NO: 498728 - protein, 9 aa, Homo Sapiens
AGKPHRYVI

SEQ ID NO: 498729 - protein, 9 aa, Homo Sapiens
STGHAPKWE

SEQ ID NO: 498730 - protein, 9 aa, Homo Sapiens
QDVGLGINP

SEQ ID NO: 498731 - protein, 9 aa, Homo Sapiens
SSCYFISSK

SEQ ID NO: 498732 - protein, 9 aa, Homo Sapiens
DTMLKMGFE

SEQ ID NO: 498733 - protein, 9 aa, Homo Sapiens
STWVVASRQ

SEQ ID NO: 498734 - protein, 9 aa, Homo Sapiens
KGLTLSWIR

SEQ ID NO: 498735 - protein, 9 aa, Homo Sapiens
TCESSKDKT

SEQ ID NO: 498736 - protein, 9 aa, Homo Sapiens
HCDPHILQK

SEQ ID NO: 498737 - protein, 9 aa, Homo Sapiens
DPLSEITKQ

SEQ ID NO: 498738 - protein, 9 aa, Homo Sapiens
MQPQTRRTK

SEQ ID NO: 498739 - protein, 9 aa, Homo Sapiens
GVVLHKDFK

SEQ ID NO: 498740 - protein, 9 aa, Homo Sapiens
SSTPNSSKF

SEQ ID NO: 498741 - protein, 9 aa, Homo Sapiens
QTLSPRKIL

SEQ ID NO: 498742 - protein, 9 aa, Homo Sapiens
IAAMCNPRE

SEQ ID NO: 498743 - protein, 9 aa, Homo Sapiens
LLGGQKSLV

SEQ ID NO: 498744 - protein, 9 aa, Homo Sapiens
QQFFFFFFP

SEQ ID NO: 498745 - protein, 9 aa, Homo Sapiens
LTNPVQNLT

SEQ ID NO: 498746 - protein, 9 aa, Homo Sapiens
FSPHGELYA

SEQ ID NO: 498747 - protein, 9 aa, Homo Sapiens
SRFQGMRVV

SEQ ID NO: 498748 - protein, 9 aa, Homo Sapiens
KKLRKLKEQ

SEQ ID NO: 498749 - protein, 9 aa, Homo Sapiens
AQGAGAGLL

SEQ ID NO: 498750 - protein, 9 aa, Homo Sapiens
LKPGKKDKL

SEQ ID NO: 498751 - protein, 9 aa, Homo Sapiens
VSLGISFKC

SEQ ID NO: 498752 - protein, 9 aa, Homo Sapiens
KCGFGATVW

SEQ ID NO: 498753 - protein, 9 aa, Homo Sapiens
STCATHLTS

SEQ ID NO: 498754 - protein, 9 aa, Homo Sapiens
SDMKTIRFS

SEQ ID NO: 498755 - protein, 9 aa, Homo Sapiens
KSPMVPATL

SEQ ID NO: 498756 - protein, 9 aa, Homo Sapiens
QVQRRWVKK

SEQ ID NO: 498757 - protein, 9 aa, Homo Sapiens
NQIKRLTRP

SEQ ID NO: 498758 - protein, 9 aa, Homo Sapiens
TSLHVTDTS

SEQ ID NO: 498759 - protein, 9 aa, Homo Sapiens
KDTVQNHDI

SEQ ID NO: 498760 - protein, 9 aa, Homo Sapiens
FFFPFFFLR

SEQ ID NO: 498761 - protein, 9 aa, Homo Sapiens
LVRGIICIS

SEQ ID NO: 498762 - protein, 9 aa, Homo Sapiens
QRDYKKAIK

SEQ ID NO: 498763 - protein, 9 aa, Homo Sapiens
LPNDSKDIL

SEQ ID NO: 498764 - protein, 9 aa, Homo Sapiens
GLQKAHRPQ

SEQ ID NO: 498765 - protein, 9 aa, Homo Sapiens
ERKTKTKIV

SEQ ID NO: 498766 - protein, 9 aa, Homo Sapiens
LIPDAKRII

SEQ ID NO: 498767 - protein, 9 aa, Homo Sapiens
DPSHNTELA

SEQ ID NO: 498768 - protein, 9 aa, Homo Sapiens
RDPLSEITK

SEQ ID NO: 498769 - protein, 9 aa, Homo Sapiens
LGDHSKLYL

SEQ ID NO: 498770 - protein, 9 aa, Homo Sapiens
ECSSQLDEE

SEQ ID NO: 498771 - protein, 9 aa, Homo Sapiens
SSKSIEKLP

SEQ ID NO: 498772 - protein, 9 aa, Homo Sapiens
SRSFFTSAH

SEQ ID NO: 498773 - protein, 9 aa, Homo Sapiens
TSGLWGNRL

SEQ ID NO: 498774 - protein, 9 aa, Homo Sapiens
DTPSHLAPV

SEQ ID NO: 498775 - protein, 9 aa, Homo Sapiens
KPHRYVIDL

SEQ ID NO: 498776 - protein, 9 aa, Homo Sapiens
ICARIFLIA

SEQ ID NO: 498777 - protein, 9 aa, Homo Sapiens
SSGDNSVFA

SEQ ID NO: 498778 - protein, 9 aa, Homo Sapiens
VGPIGDKGQ

SEQ ID NO: 498779 - protein, 9 aa, Homo Sapiens
SRQSSTVSR

SEQ ID NO: 498780 - protein, 9 aa, Homo Sapiens
PELETKMYI

SEQ ID NO: 498781 - protein, 9 aa, Homo Sapiens
CWPDPSHNT

SEQ ID NO: 498782 - protein, 9 aa, Homo Sapiens
RKTKTKIVV

SEQ ID NO: 498783 - protein, 9 aa, Homo Sapiens
QEKNDKILC

SEQ ID NO: 498784 - protein, 9 aa, Homo Sapiens
PDALPARWG

SEQ ID NO: 498785 - protein, 9 aa, Homo Sapiens
KPCLLDNVG

SEQ ID NO: 498786 - protein, 9 aa, Homo Sapiens
KELGKYDMM

SEQ ID NO: 498787 - protein, 9 aa, Homo Sapiens
PFFFLRRSL

SEQ ID NO: 498788 - protein, 9 aa, Homo Sapiens
AEDHTLSQQ

SEQ ID NO: 498789 - protein, 9 aa, Homo Sapiens
GKLKDPRKP

SEQ ID NO: 498790 - protein, 9 aa, Homo Sapiens
HFKTLEELA

SEQ ID NO: 498791 - protein, 9 aa, Homo Sapiens
IHECSEQPS

SEQ ID NO: 498792 - protein, 9 aa, Homo Sapiens
ERFKIETLG

SEQ ID NO: 498793 - protein, 9 aa, Homo Sapiens
KGSSRRPTL

SEQ ID NO: 498794 - protein, 9 aa, Homo Sapiens
ETVCKHQDK

SEQ ID NO: 498795 - protein, 9 aa, Homo Sapiens
QMDRMKARQ

SEQ ID NO: 498796 - protein, 9 aa, Homo Sapiens
SPRKILRDE

SEQ ID NO: 498797 - protein, 9 aa, Homo Sapiens
YHENMKINQ

SEQ ID NO: 498798 - protein, 9 aa, Homo Sapiens
CSSQLDEEE

SEQ ID NO: 498799 - protein, 9 aa, Homo Sapiens
NAGLETPLC

SEQ ID NO: 498800 - protein, 9 aa, Homo Sapiens
RPPPPLMNS

SEQ ID NO: 498801 - protein, 9 aa, Homo Sapiens
LLCQCDKKR

SEQ ID NO: 498802 - protein, 9 aa, Homo Sapiens
ASENDERLC

SEQ ID NO: 498803 - protein, 9 aa, Homo Sapiens
VYPWKPQAV

SEQ ID NO: 498804 - protein, 9 aa, Homo Sapiens
EKYGVGYWA

SEQ ID NO: 498805 - protein, 9 aa, Homo Sapiens
EKKGIVKQD

SEQ ID NO: 498806 - protein, 9 aa, Homo Sapiens
CFGEGLSFL

SEQ ID NO: 498807 - protein, 9 aa, Homo Sapiens
FSEKEMRIY

SEQ ID NO: 498808 - protein, 9 aa, Homo Sapiens
GSTMNFFQN

SEQ ID NO: 498809 - protein, 9 aa, Homo Sapiens
IKRLTRPGS

SEQ ID NO: 498810 - protein, 9 aa, Homo Sapiens
YQGRRRRHR

SEQ ID NO: 498811 - protein, 9 aa, Homo Sapiens
GKKDKLFRK

SEQ ID NO: 498812 - protein, 9 aa, Homo Sapiens
IKELLAHSQ

SEQ ID NO: 498813 - protein, 9 aa, Homo Sapiens
ALMVSIIFI

SEQ ID NO: 498814 - protein, 9 aa, Homo Sapiens
EDSACISWA

SEQ ID NO: 498815 - protein, 9 aa, Homo Sapiens
DEEEEKAKN

SEQ ID NO: 498816 - protein, 9 aa, Homo Sapiens
TKMYITKGG

SEQ ID NO: 498817 - protein, 9 aa, Homo Sapiens
LTCESSKDK

SEQ ID NO: 498818 - protein, 9 aa, Homo Sapiens
LIKQRDYHQ

SEQ ID NO: 498819 - protein, 9 aa, Homo Sapiens
FCVILRYVN

SEQ ID NO: 498820 - protein, 9 aa, Homo Sapiens
SDKPIAEAP

SEQ ID NO: 498821 - protein, 9 aa, Homo Sapiens
GGEKASRET

SEQ ID NO: 498822 - protein, 9 aa, Homo Sapiens
ATRVWGPWM

SEQ ID NO: 498823 - protein, 9 aa, Homo Sapiens
WVAMEELVD

SEQ ID NO: 498824 - protein, 9 aa, Homo Sapiens
YPWKPQAVE

SEQ ID NO: 498825 - protein, 9 aa, Homo Sapiens
PHRYVIDLM

SEQ ID NO: 498826 - protein, 9 aa, Homo Sapiens
YTAVKEDKI

SEQ ID NO: 498827 - protein, 9 aa, Homo Sapiens
KAVESMPCG

SEQ ID NO: 498828 - protein, 9 aa, Homo Sapiens
EEDTPSHLA

SEQ ID NO: 498829 - protein, 9 aa, Homo Sapiens
LRRHMQIHD

SEQ ID NO: 498830 - protein, 9 aa, Homo Sapiens
DLPRDLQSL

SEQ ID NO: 498831 - protein, 9 aa, Homo Sapiens
SALAEEIML

SEQ ID NO: 498832 - protein, 9 aa, Homo Sapiens
FLLISNDLR

SEQ ID NO: 498833 - protein, 9 aa, Homo Sapiens
AQPYLNLSN

SEQ ID NO: 498834 - protein, 9 aa, Homo Sapiens
WKQEKNDKI

SEQ ID NO: 498835 - protein, 9 aa, Homo Sapiens
GHAPKWEVT

SEQ ID NO: 498836 - protein, 9 aa, Homo Sapiens
YMPEPENSA

SEQ ID NO: 498837 - protein, 9 aa, Homo Sapiens
AAMCNPREA

SEQ ID NO: 498838 - protein, 9 aa, Homo Sapiens
QSPSFYQNN

SEQ ID NO: 498839 - protein, 9 aa, Homo Sapiens
GRTCYDIHE

SEQ ID NO: 498840 - protein, 9 aa, Homo Sapiens
EEQLSKIRA

SEQ ID NO: 498841 - protein, 9 aa, Homo Sapiens
ITRHEVREI

SEQ ID NO: 498842 - protein, 9 aa, Homo Sapiens
LSQAFQLDQ

SEQ ID NO: 498843 - protein, 9 aa, Homo Sapiens
HSVAQRDYK

SEQ ID NO: 498844 - protein, 9 aa, Homo Sapiens
MSVSISVSN

SEQ ID NO: 498845 - protein, 9 aa, Homo Sapiens
FISSKEKVW

SEQ ID NO: 498846 - protein, 9 aa, Homo Sapiens
KSKMEIPPR

SEQ ID NO: 498847 - protein, 9 aa, Homo Sapiens
KMYITKGGL

SEQ ID NO: 498848 - protein, 9 aa, Homo Sapiens
QNHDITGKD

SEQ ID NO: 498849 - protein, 9 aa, Homo Sapiens
RQEGAHPGW

SEQ ID NO: 498850 - protein, 9 aa, Homo Sapiens
HIADNKQSS

SEQ ID NO: 498851 - protein, 9 aa, Homo Sapiens
EAEEKEKKG

SEQ ID NO: 498852 - protein, 9 aa, Homo Sapiens
RGPGPKWTS

SEQ ID NO: 498853 - protein, 9 aa, Homo Sapiens
LRTPPYQVH

SEQ ID NO: 498854 - protein, 9 aa, Homo Sapiens
DSRSFFTSA

SEQ ID NO: 498855 - protein, 9 aa, Homo Sapiens
KAYETVCKH

SEQ ID NO: 498856 - protein, 9 aa, Homo Sapiens
VYTSLGNEG

SEQ ID NO: 498857 - protein, 9 aa, Homo Sapiens
KEEDLKPTP

SEQ ID NO: 498858 - protein, 9 aa, Homo Sapiens
PKATRVWGP

SEQ ID NO: 498859 - protein, 9 aa, Homo Sapiens
KEDDEQTLH

SEQ ID NO: 498860 - protein, 9 aa, Homo Sapiens
TTLRSIQPK

SEQ ID NO: 498861 - protein, 9 aa, Homo Sapiens
SLIHHWRLH

SEQ ID NO: 498862 - protein, 9 aa, Homo Sapiens
GASSGAAQG

SEQ ID NO: 498863 - protein, 9 aa, Homo Sapiens
YEEDDNEHT

SEQ ID NO: 498864 - protein, 9 aa, Homo Sapiens
TLRSIQPKT

SEQ ID NO: 498865 - protein, 9 aa, Homo Sapiens
CNPQIEWQN

SEQ ID NO: 498866 - protein, 9 aa, Homo Sapiens
YTSLGNEGV

SEQ ID NO: 498867 - protein, 9 aa, Homo Sapiens
IHCVRFSPH

SEQ ID NO: 498868 - protein, 9 aa, Homo Sapiens
PDSPWMGSG

SEQ ID NO: 498869 - protein, 9 aa, Homo Sapiens
GCSNKSPMV

SEQ ID NO: 498870 - protein, 9 aa, Homo Sapiens
VPVFLKLVS

SEQ ID NO: 498871 - protein, 9 aa, Homo Sapiens
KALVAPSLN

SEQ ID NO: 498872 - protein, 9 aa, Homo Sapiens
LKEQSKRVS

SEQ ID NO: 498873 - protein, 9 aa, Homo Sapiens
TGHATSLHV

SEQ ID NO: 498874 - protein, 9 aa, Homo Sapiens
PEDVLITSC

SEQ ID NO: 498875 - protein, 9 aa, Homo Sapiens
SQSGCRVPR

SEQ ID NO: 498876 - protein, 9 aa, Homo Sapiens
DMSVSISVS

SEQ ID NO: 498877 - protein, 9 aa, Homo Sapiens
GIMVNGSRV

SEQ ID NO: 498878 - protein, 9 aa, Homo Sapiens
GPGPKWTSR

SEQ ID NO: 498879 - protein, 9 aa, Homo Sapiens
AEPPGSSLG

SEQ ID NO: 498880 - protein, 9 aa, Homo Sapiens
AGNLRTRLP

SEQ ID NO: 498881 - protein, 9 aa, Homo Sapiens
MQQLLGGQK

SEQ ID NO: 498882 - protein, 9 aa, Homo Sapiens
RHKKRTSIE

SEQ ID NO: 498883 - protein, 9 aa, Homo Sapiens
CNPREAQAG

SEQ ID NO: 498884 - protein, 9 aa, Homo Sapiens
PGEPKERKS

SEQ ID NO: 498885 - protein, 9 aa, Homo Sapiens
ICISTRKSR

SEQ ID NO: 498886 - protein, 9 aa, Homo Sapiens
RDSYSQSGC

SEQ ID NO: 498887 - protein, 9 aa, Homo Sapiens
FNLSNDIRV

SEQ ID NO: 498888 - protein, 9 aa, Homo Sapiens
LKTLKPKDV

SEQ ID NO: 498889 - protein, 9 aa, Homo Sapiens
AKSPPADDH

SEQ ID NO: 498890 - protein, 9 aa, Homo Sapiens
WQSVLLSHQ

SEQ ID NO: 498891 - protein, 9 aa, Homo Sapiens
SYLTSKMLS

SEQ ID NO: 498892 - protein, 9 aa, Homo Sapiens
KVVDKLIKQ

SEQ ID NO: 498893 - protein, 9 aa, Homo Sapiens
YDIHECSEQ

SEQ ID NO: 498894 - protein, 9 aa, Homo Sapiens
VGYWAKIAS

SEQ ID NO: 498895 - protein, 9 aa, Homo Sapiens
ASRQSSTVS

SEQ ID NO: 498896 - protein, 9 aa, Homo Sapiens
NSLFQEIED

SEQ ID NO: 498897 - protein, 9 aa, Homo Sapiens
EDDNEHTDS

SEQ ID NO: 498898 - protein, 9 aa, Homo Sapiens
LFSRVVPPD

SEQ ID NO: 498899 - protein, 9 aa, Homo Sapiens
RDLLPLRTP

SEQ ID NO: 498900 - protein, 9 aa, Homo Sapiens
RRDRIHKSS

SEQ ID NO: 498901 - protein, 9 aa, Homo Sapiens
LFGMESSHS

SEQ ID NO: 498902 - protein, 9 aa, Homo Sapiens
SRETRPRRS

SEQ ID NO: 498903 - protein, 9 aa, Homo Sapiens
GPGMQSPSF

SEQ ID NO: 498904 - protein, 9 aa, Homo Sapiens
DVKMEIFSH

SEQ ID NO: 498905 - protein, 9 aa, Homo Sapiens
RVQAENDFR

SEQ ID NO: 498906 - protein, 9 aa, Homo Sapiens
SGSLFCVIL

SEQ ID NO: 498907 - protein, 9 aa, Homo Sapiens
EIQTCQDNK

SEQ ID NO: 498908 - protein, 9 aa, Homo Sapiens
SKDKTFWRE

SEQ ID NO: 498909 - protein, 9 aa, Homo Sapiens
VESMPCGVV

SEQ ID NO: 498910 - protein, 9 aa, Homo Sapiens
ENDFRKGPE

SEQ ID NO: 498911 - protein, 9 aa, Homo Sapiens
LTNTMKELE

SEQ ID NO: 498912 - protein, 9 aa, Homo Sapiens
GNGILELKR

SEQ ID NO: 498913 - protein, 9 aa, Homo Sapiens
AKNGWGEEV

SEQ ID NO: 498914 - protein, 9 aa, Homo Sapiens
QSGCRVPRG

SEQ ID NO: 498915 - protein, 9 aa, Homo Sapiens
VEKVVDKLI

SEQ ID NO: 498916 - protein, 9 aa, Homo Sapiens
VCKHQDKEF

SEQ ID NO: 498917 - protein, 9 aa, Homo Sapiens
GAALVLKER

SEQ ID NO: 498918 - protein, 9 aa, Homo Sapiens
MDILELSEC

SEQ ID NO: 498919 - protein, 9 aa, Homo Sapiens
KLKDPRKPS

SEQ ID NO: 498920 - protein, 9 aa, Homo Sapiens
AAKAVDLIP

SEQ ID NO: 498921 - protein, 9 aa, Homo Sapiens
AHSVLTLQL

SEQ ID NO: 498922 - protein, 9 aa, Homo Sapiens
LPKVPPWTG

SEQ ID NO: 498923 - protein, 9 aa, Homo Sapiens
QTRRTKFTL

SEQ ID NO: 498924 - protein, 9 aa, Homo Sapiens
NRLQYSILG

SEQ ID NO: 498925 - protein, 9 aa, Homo Sapiens
PAHSVLTLQ

SEQ ID NO: 498926 - protein, 9 aa, Homo Sapiens
CLDLQRFHS

SEQ ID NO: 498927 - protein, 9 aa, Homo Sapiens
ESLPNDSKD

SEQ ID NO: 498928 - protein, 9 aa, Homo Sapiens
ILELKREEI

SEQ ID NO: 498929 - protein, 9 aa, Homo Sapiens
EQAKREETL

SEQ ID NO: 498930 - protein, 9 aa, Homo Sapiens
GKDLVDTSR

SEQ ID NO: 498931 - protein, 9 aa, Homo Sapiens
RFSPHGELY

SEQ ID NO: 498932 - protein, 9 aa, Homo Sapiens
EPIKEIKEK

SEQ ID NO: 498933 - protein, 9 aa, Homo Sapiens
GSSLGSGDD

SEQ ID NO: 498934 - protein, 9 aa, Homo Sapiens
LLFHPKQKD

SEQ ID NO: 498935 - protein, 9 aa, Homo Sapiens
MRIYATEII

SEQ ID NO: 498936 - protein, 9 aa, Homo Sapiens
ESVTHYIRR

SEQ ID NO: 498937 - protein, 9 aa, Homo Sapiens
RDSRSFFTS

SEQ ID NO: 498938 - protein, 9 aa, Homo Sapiens
GIECSSICD

SEQ ID NO: 498939 - protein, 9 aa, Homo Sapiens
GNRLQYSIL

SEQ ID NO: 498940 - protein, 9 aa, Homo Sapiens
FDGLPGRRH

SEQ ID NO: 498941 - protein, 9 aa, Homo Sapiens
QNSMGLFCA

SEQ ID NO: 498942 - protein, 9 aa, Homo Sapiens
TNTMKELEE

SEQ ID NO: 498943 - protein, 9 aa, Homo Sapiens
PKVVEKITE

SEQ ID NO: 498944 - protein, 9 aa, Homo Sapiens
QLCKLNLSF

SEQ ID NO: 498945 - protein, 9 aa, Homo Sapiens
LPFERKRDA

SEQ ID NO: 498946 - protein, 9 aa, Homo Sapiens
PAGNLRTRL

SEQ ID NO: 498947 - protein, 9 aa, Homo Sapiens
GMESSHSPY

SEQ ID NO: 498948 - protein, 9 aa, Homo Sapiens
LSLILHIDH

SEQ ID NO: 498949 - protein, 9 aa, Homo Sapiens
LGNEGVIYS

SEQ ID NO: 498950 - protein, 9 aa, Homo Sapiens
HVCFCFRSY

SEQ ID NO: 498951 - protein, 9 aa, Homo Sapiens
FPVLRLSPC

SEQ ID NO: 498952 - protein, 9 aa, Homo Sapiens
KCLCVCQSG

SEQ ID NO: 498953 - protein, 9 aa, Homo Sapiens
FIRQEEWTL

SEQ ID NO: 498954 - protein, 9 aa, Homo Sapiens
AEDEECSTD

SEQ ID NO: 498955 - protein, 9 aa, Homo Sapiens
GSSGFIFSP

SEQ ID NO: 498956 - protein, 9 aa, Homo Sapiens
LLISNDLRS

SEQ ID NO: 498957 - protein, 9 aa, Homo Sapiens
IPNAYSCEM

SEQ ID NO: 498958 - protein, 9 aa, Homo Sapiens
NVHACDDGG

SEQ ID NO: 498959 - protein, 9 aa, Homo Sapiens
PKWTSRSLL

SEQ ID NO: 498960 - protein, 9 aa, Homo Sapiens
ISWAYYSTV

SEQ ID NO: 498961 - protein, 9 aa, Homo Sapiens
SVSFEQDDK

SEQ ID NO: 498962 - protein, 9 aa, Homo Sapiens
RLYFPAAEG

SEQ ID NO: 498963 - protein, 9 aa, Homo Sapiens
PPPLMNSLP

SEQ ID NO: 498964 - protein, 9 aa, Homo Sapiens
MCSRGDEDN

SEQ ID NO: 498965 - protein, 9 aa, Homo Sapiens
FTKLGLQKA

SEQ ID NO: 498966 - protein, 9 aa, Homo Sapiens
ELLAHSQSL

SEQ ID NO: 498967 - protein, 9 aa, Homo Sapiens
AALALQWAK

SEQ ID NO: 498968 - protein, 9 aa, Homo Sapiens
YTALWWSAM

SEQ ID NO: 498969 - protein, 9 aa, Homo Sapiens
NTMKELEES

SEQ ID NO: 498970 - protein, 9 aa, Homo Sapiens
ISIGTSPQN

SEQ ID NO: 498971 - protein, 9 aa, Homo Sapiens
IANNDAFGT

SEQ ID NO: 498972 - protein, 9 aa, Homo Sapiens
FPSGFPVLR

SEQ ID NO: 498973 - protein, 9 aa, Homo Sapiens
LDGDRMAKS

SEQ ID NO: 498974 - protein, 9 aa, Homo Sapiens
SFPSGFPVL

SEQ ID NO: 498975 - protein, 9 aa, Homo Sapiens
IHVAQKQEP

SEQ ID NO: 498976 - protein, 9 aa, Homo Sapiens
EQDDKIRWA

SEQ ID NO: 498977 - protein, 9 aa, Homo Sapiens
LTLSWIRDG

SEQ ID NO: 498978 - protein, 9 aa, Homo Sapiens
NGGEKASRE

SEQ ID NO: 498979 - protein, 9 aa, Homo Sapiens
TCYDIHECS

SEQ ID NO: 498980 - protein, 9 aa, Homo Sapiens
KFYFKELGK

SEQ ID NO: 498981 - protein, 9 aa, Homo Sapiens
AAQPYLNLS

SEQ ID NO: 498982 - protein, 9 aa, Homo Sapiens
IRDGNNILH

SEQ ID NO: 498983 - protein, 9 aa, Homo Sapiens
AGPLQEDDL

SEQ ID NO: 498984 - protein, 9 aa, Homo Sapiens
PLFPSLCAQ

SEQ ID NO: 498985 - protein, 9 aa, Homo Sapiens
RRWVKKRHR

SEQ ID NO: 498986 - protein, 9 aa, Homo Sapiens
QMGANVHAC

SEQ ID NO: 498987 - protein, 9 aa, Homo Sapiens
LKERTQIEN

SEQ ID NO: 498988 - protein, 9 aa, Homo Sapiens
AEQDVGLGI

SEQ ID NO: 498989 - protein, 9 aa, Homo Sapiens
EKEKKGIVK

SEQ ID NO: 498990 - protein, 9 aa, Homo Sapiens
AITRHEVRE

SEQ ID NO: 498991 - protein, 9 aa, Homo Sapiens
LDNVGEELD

SEQ ID NO: 498992 - protein, 9 aa, Homo Sapiens
FFGKDLVDT

SEQ ID NO: 498993 - protein, 9 aa, Homo Sapiens
KDGKLKDPR

SEQ ID NO: 498994 - protein, 9 aa, Homo Sapiens
LIRVILKTL

SEQ ID NO: 498995 - protein, 9 aa, Homo Sapiens
FHMGLYGKT

SEQ ID NO: 498996 - protein, 9 aa, Homo Sapiens
GLSQAFQLD

SEQ ID NO: 498997 - protein, 9 aa, Homo Sapiens
IMIPNEIVQ

SEQ ID NO: 498998 - protein, 9 aa, Homo Sapiens
RQHCDPHIL

SEQ ID NO: 498999 - protein, 9 aa, Homo Sapiens
KREETLKAK

SEQ ID NO: 499000 - protein, 9 aa, Homo Sapiens
GRLVRGIIC

SEQ ID NO: 499001 - protein, 9 aa, Homo Sapiens
VSRTSSASC

SEQ ID NO: 499002 - protein, 9 aa, Homo Sapiens
FKSKMEIPP

SEQ ID NO: 499003 - protein, 9 aa, Homo Sapiens
SLGISFKCT

SEQ ID NO: 499004 - protein, 9 aa, Homo Sapiens
EEDDNEHTD

SEQ ID NO: 499005 - protein, 9 aa, Homo Sapiens
AGAGTEAGA

SEQ ID NO: 499006 - protein, 9 aa, Homo Sapiens
LPLRTPPYQ

SEQ ID NO: 499007 - protein, 9 aa, Homo Sapiens
RPCRMRLYQ

SEQ ID NO: 499008 - protein, 9 aa, Homo Sapiens
VAGHIADNK

SEQ ID NO: 499009 - protein, 9 aa, Homo Sapiens
PVFLKLVSP

SEQ ID NO: 499010 - protein, 9 aa, Homo Sapiens
NVEEQLSKI

SEQ ID NO: 499011 - protein, 9 aa, Homo Sapiens
RFFLCAMYV

SEQ ID NO: 499012 - protein, 9 aa, Homo Sapiens
LEEDTPSHL

SEQ ID NO: 499013 - protein, 9 aa, Homo Sapiens
FKDLLVAAI

SEQ ID NO: 499014 - protein, 9 aa, Homo Sapiens
VQNLTHVTL

SEQ ID NO: 499015 - protein, 9 aa, Homo Sapiens
HMGLYGKTG

SEQ ID NO: 499016 - protein, 9 aa, Homo Sapiens
KTSGSKPEA

SEQ ID NO: 499017 - protein, 9 aa, Homo Sapiens
QNGHVLLTV

SEQ ID NO: 499018 - protein, 9 aa, Homo Sapiens
TEHIQTHFK

SEQ ID NO: 499019 - protein, 9 aa, Homo Sapiens
TPSDVDQFS

SEQ ID NO: 499020 - protein, 9 aa, Homo Sapiens
CRPAHSVLT

SEQ ID NO: 499021 - protein, 9 aa, Homo Sapiens
AHSQSLSIR

SEQ ID NO: 499022 - protein, 9 aa, Homo Sapiens
EQESLPNDS

SEQ ID NO: 499023 - protein, 9 aa, Homo Sapiens
GAEAGAGTE

SEQ ID NO: 499024 - protein, 9 aa, Homo Sapiens
SLILHIDHG

SEQ ID NO: 499025 - protein, 9 aa, Homo Sapiens
SIPNAYSCE

SEQ ID NO: 499026 - protein, 9 aa, Homo Sapiens
DDLPRDLQS

SEQ ID NO: 499027 - protein, 9 aa, Homo Sapiens
YTKAARRLG

SEQ ID NO: 499028 - protein, 9 aa, Homo Sapiens
AFQGLTQLC

SEQ ID NO: 499029 - protein, 9 aa, Homo Sapiens
LQKAHRPQR

SEQ ID NO: 499030 - protein, 9 aa, Homo Sapiens
LQFYTKAAR

SEQ ID NO: 499031 - protein, 9 aa, Homo Sapiens
APPPSAAAA

SEQ ID NO: 499032 - protein, 9 aa, Homo Sapiens
YRHPRHIHK

SEQ ID NO: 499033 - protein, 9 aa, Homo Sapiens
VLDGDRMAK

SEQ ID NO: 499034 - protein, 9 aa, Homo Sapiens
TRHEVREIE

SEQ ID NO: 499035 - protein, 9 aa, Homo Sapiens
DERFKIETL

SEQ ID NO: 499036 - protein, 9 aa, Homo Sapiens
PALMVSIIF

SEQ ID NO: 499037 - protein, 9 aa, Homo Sapiens
GRGPGPKWT

SEQ ID NO: 499038 - protein, 9 aa, Homo Sapiens
THYIRRLNQ

SEQ ID NO: 499039 - protein, 9 aa, Homo Sapiens
TTAAQNGHV

SEQ ID NO: 499040 - protein, 9 aa, Homo Sapiens
KALSSKSIE

SEQ ID NO: 499041 - protein, 9 aa, Homo Sapiens
YDPSDKPIA

SEQ ID NO: 499042 - protein, 9 aa, Homo Sapiens
FKELGKYDM

SEQ ID NO: 499043 - protein, 9 aa, Homo Sapiens
DSGIHVAQK

SEQ ID NO: 499044 - protein, 9 aa, Homo Sapiens
GVCFGEGLS

SEQ ID NO: 499045 - protein, 9 aa, Homo Sapiens
TSKNQIKRL

SEQ ID NO: 499046 - protein, 9 aa, Homo Sapiens
NSALAEEIM

SEQ ID NO: 499047 - protein, 9 aa, Homo Sapiens
NGSVVERDS

SEQ ID NO: 499048 - protein, 9 aa, Homo Sapiens
EPCKDTVQN

SEQ ID NO: 499049 - protein, 9 aa, Homo Sapiens
LSPLPKVPP

SEQ ID NO: 499050 - protein, 9 aa, Homo Sapiens
AMPTEGACA

SEQ ID NO: 499051 - protein, 9 aa, Homo Sapiens
YFPAAEGQS

SEQ ID NO: 499052 - protein, 9 aa, Homo Sapiens
PLMNSLPPR

SEQ ID NO: 499053 - protein, 9 aa, Homo Sapiens
TLTNPVQNL

SEQ ID NO: 499054 - protein, 9 aa, Homo Sapiens
SQSLSIRVL

SEQ ID NO: 499055 - protein, 9 aa, Homo Sapiens
QEIQTCQDN

SEQ ID NO: 499056 - protein, 9 aa, Homo Sapiens
HATSLHVTD

SEQ ID NO: 499057 - protein, 9 aa, Homo Sapiens
HKSSPLDLA

SEQ ID NO: 499058 - protein, 9 aa, Homo Sapiens
SSSLIHHWR

SEQ ID NO: 499059 - protein, 9 aa, Homo Sapiens
RRRRHRCSQ

SEQ ID NO: 499060 - protein, 9 aa, Homo Sapiens
KYERKHWEV

SEQ ID NO: 499061 - protein, 9 aa, Homo Sapiens
SYQGRRRRH

SEQ ID NO: 499062 - protein, 9 aa, Homo Sapiens
REQSSIPRA

SEQ ID NO: 499063 - protein, 9 aa, Homo Sapiens
THFKSKMEI

SEQ ID NO: 499064 - protein, 9 aa, Homo Sapiens
VPAGNLRTR

SEQ ID NO: 499065 - protein, 9 aa, Homo Sapiens
GTSPQNFLV

SEQ ID NO: 499066 - protein, 9 aa, Homo Sapiens
EECSTDEYC

SEQ ID NO: 499067 - protein, 9 aa, Homo Sapiens
FSADSSASL

SEQ ID NO: 499068 - protein, 9 aa, Homo Sapiens
IQEIQTCQD

SEQ ID NO: 499069 - protein, 9 aa, Homo Sapiens
TSPQNFLVL

SEQ ID NO: 499070 - protein, 9 aa, Homo Sapiens
MLIAMINSL

SEQ ID NO: 499071 - protein, 9 aa, Homo Sapiens
DDRRYDLFS

SEQ ID NO: 499072 - protein, 9 aa, Homo Sapiens
KSSPLDLAS

SEQ ID NO: 499073 - protein, 9 aa, Homo Sapiens
HQDKEFFGL

SEQ ID NO: 499074 - protein, 9 aa, Homo Sapiens
DSPWMGSGG

SEQ ID NO: 499075 - protein, 9 aa, Homo Sapiens
SRDSRSFFT

SEQ ID NO: 499076 - protein, 9 aa, Homo Sapiens
EDKINVYQG

SEQ ID NO: 499077 - protein, 9 aa, Homo Sapiens
EPPGSSLGS

SEQ ID NO: 499078 - protein, 9 aa, Homo Sapiens
NGILELKRE

SEQ ID NO: 499079 - protein, 9 aa, Homo Sapiens
SPRDVAVAK

SEQ ID NO: 499080 - protein, 9 aa, Homo Sapiens
WVKKRHRRQ

SEQ ID NO: 499081 - protein, 9 aa, Homo Sapiens
HLRIYQRVH

SEQ ID NO: 499082 - protein, 9 aa, Homo Sapiens
ECSTDEYCA

SEQ ID NO: 499083 - protein, 9 aa, Homo Sapiens
RTGVQDNPK

SEQ ID NO: 499084 - protein, 9 aa, Homo Sapiens
VFLKLVSPA

SEQ ID NO: 499085 - protein, 9 aa, Homo Sapiens
YIVSPRDVA

SEQ ID NO: 499086 - protein, 9 aa, Homo Sapiens
MEAAKAVDL

SEQ ID NO: 499087 - protein, 9 aa, Homo Sapiens
ASTRLGGTP

SEQ ID NO: 499088 - protein, 9 aa, Homo Sapiens
EPNDITAEE

SEQ ID NO: 499089 - protein, 9 aa, Homo Sapiens
QPTSNLVAA

SEQ ID NO: 499090 - protein, 9 aa, Homo Sapiens
AVAKERDQD

SEQ ID NO: 499091 - protein, 9 aa, Homo Sapiens
ENDERLCNP

SEQ ID NO: 499092 - protein, 9 aa, Homo Sapiens
YDICRPAHS

SEQ ID NO: 499093 - protein, 9 aa, Homo Sapiens
HDDTASTRL

SEQ ID NO: 499094 - protein, 9 aa, Homo Sapiens
ELSECLDLQ

SEQ ID NO: 499095 - protein, 9 aa, Homo Sapiens
LEPAIFEAW

SEQ ID NO: 499096 - protein, 9 aa, Homo Sapiens
MKINQAMRK

SEQ ID NO: 499097 - protein, 9 aa, Homo Sapiens
SGSKPEADI

SEQ ID NO: 499098 - protein, 9 aa, Homo Sapiens
AYSCEMCIL

SEQ ID NO: 499099 - protein, 9 aa, Homo Sapiens
HPSRPCRMR

SEQ ID NO: 499100 - protein, 9 aa, Homo Sapiens
GKSSGSLFC

SEQ ID NO: 499101 - protein, 9 aa, Homo Sapiens
HHWRLHTGE

SEQ ID NO: 499102 - protein, 9 aa, Homo Sapiens
HPKQKDWIL

SEQ ID NO: 499103 - protein, 9 aa, Homo Sapiens
LSYLTSKML

SEQ ID NO: 499104 - protein, 9 aa, Homo Sapiens
GAHPGWDRS

SEQ ID NO: 499105 - protein, 9 aa, Homo Sapiens
EQLSKIRAD

SEQ ID NO: 499106 - protein, 9 aa, Homo Sapiens
FFFQLLVKS

SEQ ID NO: 499107 - protein, 9 aa, Homo Sapiens
NGAALVLKE

SEQ ID NO: 499108 - protein, 9 aa, Homo Sapiens
TALWWSAMP

SEQ ID NO: 499109 - protein, 9 aa, Homo Sapiens
FDMGLQKQY

SEQ ID NO: 499110 - protein, 9 aa, Homo Sapiens
LAEEIMLHY

SEQ ID NO: 499111 - protein, 9 aa, Homo Sapiens
RFGKPCLLD

SEQ ID NO: 499112 - protein, 9 aa, Homo Sapiens
LTSCVNYMP

SEQ ID NO: 499113 - protein, 9 aa, Homo Sapiens
EKVVDKLIK

SEQ ID NO: 499114 - protein, 9 aa, Homo Sapiens
QTCQDNKVV

SEQ ID NO: 499115 - protein, 9 aa, Homo Sapiens
DKTFWRELP

SEQ ID NO: 499116 - protein, 9 aa, Homo Sapiens
YLFGMESSH

SEQ ID NO: 499117 - protein, 9 aa, Homo Sapiens
AGDVAEQDV

SEQ ID NO: 499118 - protein, 9 aa, Homo Sapiens
FWMAPPLLS

SEQ ID NO: 499119 - protein, 9 aa, Homo Sapiens
DTNILDTWV

SEQ ID NO: 499120 - protein, 9 aa, Homo Sapiens
GPGRGPGPK

SEQ ID NO: 499121 - protein, 9 aa, Homo Sapiens
TYSVSFEQD

SEQ ID NO: 499122 - protein, 9 aa, Homo Sapiens
EKEKEDDEQ

SEQ ID NO: 499123 - protein, 9 aa, Homo Sapiens
SDVEHTLVQ

SEQ ID NO: 499124 - protein, 9 aa, Homo Sapiens
KLERAITRH

SEQ ID NO: 499125 - protein, 9 aa, Homo Sapiens
REETLKAKK

SEQ ID NO: 499126 - protein, 9 aa, Homo Sapiens
TRQYHENMK

SEQ ID NO: 499127 - protein, 9 aa, Homo Sapiens
ESMPCGVVV

SEQ ID NO: 499128 - protein, 9 aa, Homo Sapiens
PKERKSLKL

SEQ ID NO: 499129 - protein, 9 aa, Homo Sapiens
PCAEDEECS

SEQ ID NO: 499130 - protein, 9 aa, Homo Sapiens
RSYVTHHDP

SEQ ID NO: 499131 - protein, 9 aa, Homo Sapiens
KTKTKIVVE

SEQ ID NO: 499132 - protein, 9 aa, Homo Sapiens
VTHYIRRLN

SEQ ID NO: 499133 - protein, 9 aa, Homo Sapiens
RFKIETLGD

SEQ ID NO: 499134 - protein, 9 aa, Homo Sapiens
FLFNEEIEQ

SEQ ID NO: 499135 - protein, 9 aa, Homo Sapiens
HLEDSGIHV

SEQ ID NO: 499136 - protein, 9 aa, Homo Sapiens
GTNLHRDMS

SEQ ID NO: 499137 - protein, 9 aa, Homo Sapiens
SGVCFGEGL

SEQ ID NO: 499138 - protein, 9 aa, Homo Sapiens
NMKINQAMR

SEQ ID NO: 499139 - protein, 9 aa, Homo Sapiens
LPGRRHKKR

SEQ ID NO: 499140 - protein, 9 aa, Homo Sapiens
VYNEGSYTC

SEQ ID NO: 499141 - protein, 9 aa, Homo Sapiens
FGKDLVDTS

SEQ ID NO: 499142 - protein, 9 aa, Homo Sapiens
DVFSHRSLR

SEQ ID NO: 499143 - protein, 9 aa, Homo Sapiens
WGNRLQYSI

SEQ ID NO: 499144 - protein, 9 aa, Homo Sapiens
RKGPEPESV

SEQ ID NO: 499145 - protein, 9 aa, Homo Sapiens
GAEPPGSSL

SEQ ID NO: 499146 - protein, 9 aa, Homo Sapiens
LIHHWRLHT

SEQ ID NO: 499147 - protein, 9 aa, Homo Sapiens
TQLCKLNLS

SEQ ID NO: 499148 - protein, 9 aa, Homo Sapiens
PLQEDDLEP

SEQ ID NO: 499149 - protein, 9 aa, Homo Sapiens
FEQQVLDIL

SEQ ID NO: 499150 - protein, 9 aa, Homo Sapiens
IEGNMEAAK

SEQ ID NO: 499151 - protein, 9 aa, Homo Sapiens
TGYKFRPAL

SEQ ID NO: 499152 - protein, 9 aa, Homo Sapiens
MPHHHTLLS

SEQ ID NO: 499153 - protein, 9 aa, Homo Sapiens
NMQPQTRRT

SEQ ID NO: 499154 - protein, 9 aa, Homo Sapiens
QKAFSTCAT

SEQ ID NO: 499155 - protein, 9 aa, Homo Sapiens
PWMGSGGTT

SEQ ID NO: 499156 - protein, 9 aa, Homo Sapiens
LCKLNLSFN

SEQ ID NO: 499157 - protein, 9 aa, Homo Sapiens
SLEADKCGF

SEQ ID NO: 499158 - protein, 9 aa, Homo Sapiens
PPGSSLGSG

SEQ ID NO: 499159 - protein, 9 aa, Homo Sapiens
LRIYQRVHT

SEQ ID NO: 499160 - protein, 9 aa, Homo Sapiens
LCNPQIEWQ

SEQ ID NO: 499161 - protein, 9 aa, Homo Sapiens
IKKLRKLKE

SEQ ID NO: 499162 - protein, 9 aa, Homo Sapiens
DKDPHSERA

SEQ ID NO: 499163 - protein, 9 aa, Homo Sapiens
PVPVFLKLV

SEQ ID NO: 499164 - protein, 9 aa, Homo Sapiens
EIHSDSITL

SEQ ID NO: 499165 - protein, 9 aa, Homo Sapiens
EMTEDMMRD

SEQ ID NO: 499166 - protein, 9 aa, Homo Sapiens
QCDKKRGAS

SEQ ID NO: 499167 - protein, 9 aa, Homo Sapiens
SKVLCVFKD

SEQ ID NO: 499168 - protein, 9 aa, Homo Sapiens
GEPKERKSL

SEQ ID NO: 499169 - protein, 9 aa, Homo Sapiens
LREQQRRQQ

SEQ ID NO: 499170 - protein, 9 aa, Homo Sapiens
FGSYSKYER

SEQ ID NO: 499171 - protein, 9 aa, Homo Sapiens
GIHVAQKQE

SEQ ID NO: 499172 - protein, 9 aa, Homo Sapiens
PAIFEAWRH

SEQ ID NO: 499173 - protein, 9 aa, Homo Sapiens
GMQSPSFYQ

SEQ ID NO: 499174 - protein, 9 aa, Homo Sapiens
FPAAEGQSY

SEQ ID NO: 499175 - protein, 9 aa, Homo Sapiens
EQEEKEKED

SEQ ID NO: 499176 - protein, 9 aa, Homo Sapiens
KQEKNDKIL

SEQ ID NO: 499177 - protein, 9 aa, Homo Sapiens
SEMTEDMMR

SEQ ID NO: 499178 - protein, 9 aa, Homo Sapiens
GFPDGKGSS

SEQ ID NO: 499179 - protein, 9 aa, Homo Sapiens
VKRLATQDL

SEQ ID NO: 499180 - protein, 9 aa, Homo Sapiens
MYITKGGLV

SEQ ID NO: 499181 - protein, 9 aa, Homo Sapiens
VQNHDITGK

SEQ ID NO: 499182 - protein, 9 aa, Homo Sapiens
PQTRRTKFT

SEQ ID NO: 499183 - protein, 9 aa, Homo Sapiens
QQRRQQREL

SEQ ID NO: 499184 - protein, 9 aa, Homo Sapiens
HTDSSDAEN

SEQ ID NO: 499185 - protein, 9 aa, Homo Sapiens
KLKEQSKRV

SEQ ID NO: 499186 - protein, 9 aa, Homo Sapiens
RDMSVSISV

SEQ ID NO: 499187 - protein, 9 aa, Homo Sapiens
SSLIHHWRL

SEQ ID NO: 499188 - protein, 9 aa, Homo Sapiens
TLSLEADKC

SEQ ID NO: 499189 - protein, 9 aa, Homo Sapiens
LHCEFSADS

SEQ ID NO: 499190 - protein, 9 aa, Homo Sapiens
FCALRHALA

SEQ ID NO: 499191 - protein, 9 aa, Homo Sapiens
RVKNLVLTY

SEQ ID NO: 499192 - protein, 9 aa, Homo Sapiens
CAALTHMYF

SEQ ID NO: 499193 - protein, 9 aa, Homo Sapiens
RDLQSLSWL

SEQ ID NO: 499194 - protein, 9 aa, Homo Sapiens
ADKCGFGAT

SEQ ID NO: 499195 - protein, 9 aa, Homo Sapiens
EDSGIHVAQ

SEQ ID NO: 499196 - protein, 9 aa, Homo Sapiens
VFKDLLVAA

SEQ ID NO: 499197 - protein, 9 aa, Homo Sapiens
QIKRLTRPG

SEQ ID NO: 499198 - protein, 9 aa, Homo Sapiens
RLGGTPGPS

SEQ ID NO: 499199 - protein, 9 aa, Homo Sapiens
QPENMQPQT

SEQ ID NO: 499200 - protein, 9 aa, Homo Sapiens
PAPSGLPFE

SEQ ID NO: 499201 - protein, 9 aa, Homo Sapiens
DIHECSEQP

SEQ ID NO: 499202 - protein, 9 aa, Homo Sapiens
FQEQILEAA

SEQ ID NO: 499203 - protein, 9 aa, Homo Sapiens
KIKNIRFQV

SEQ ID NO: 499204 - protein, 9 aa, Homo Sapiens
GASSSTSRD

SEQ ID NO: 499205 - protein, 9 aa, Homo Sapiens
LEADKCGFG

SEQ ID NO: 499206 - protein, 9 aa, Homo Sapiens
EKMRQHCDP

SEQ ID NO: 499207 - protein, 9 aa, Homo Sapiens
FHHERLQYY

SEQ ID NO: 499208 - protein, 9 aa, Homo Sapiens
NRRDRIHKS

SEQ ID NO: 499209 - protein, 9 aa, Homo Sapiens
QALSLILHI

SEQ ID NO: 499210 - protein, 9 aa, Homo Sapiens
LNLSNLDVL

SEQ ID NO: 499211 - protein, 9 aa, Homo Sapiens
ITEYKRQNP

SEQ ID NO: 499212 - protein, 9 aa, Homo Sapiens
NHDITGKDC

SEQ ID NO: 499213 - protein, 9 aa, Homo Sapiens
ADNAGLETP

SEQ ID NO: 499214 - protein, 9 aa, Homo Sapiens
TPKVVEKIT

SEQ ID NO: 499215 - protein, 9 aa, Homo Sapiens
KRDLLPLRT

SEQ ID NO: 499216 - protein, 9 aa, Homo Sapiens
PFPFWMAPP

SEQ ID NO: 499217 - protein, 9 aa, Homo Sapiens
YNGSVVERD

SEQ ID NO: 499218 - protein, 9 aa, Homo Sapiens
HAGSTMNFF

SEQ ID NO: 499219 - protein, 9 aa, Homo Sapiens
CKTSGSKPE

SEQ ID NO: 499220 - protein, 9 aa, Homo Sapiens
QEDDLEPLT

SEQ ID NO: 499221 - protein, 9 aa, Homo Sapiens
GILELKREE

SEQ ID NO: 499222 - protein, 9 aa, Homo Sapiens
KWTSRSLLP

SEQ ID NO: 499223 - protein, 9 aa, Homo Sapiens
LILHIDHGK

SEQ ID NO: 499224 - protein, 9 aa, Homo Sapiens
QTPSDVDQF

SEQ ID NO: 499225 - protein, 9 aa, Homo Sapiens
AGTEAGAGA

SEQ ID NO: 499226 - protein, 9 aa, Homo Sapiens
LVASVYPWK

SEQ ID NO: 499227 - protein, 9 aa, Homo Sapiens
LLEGQEDYY

SEQ ID NO: 499228 - protein, 9 aa, Homo Sapiens
EPKERKSLK

SEQ ID NO: 499229 - protein, 9 aa, Homo Sapiens
AALTHMYFK

SEQ ID NO: 499230 - protein, 9 aa, Homo Sapiens
AIFEAWRHV

SEQ ID NO: 499231 - protein, 9 aa, Homo Sapiens
YLNLSNLDV

SEQ ID NO: 499232 - protein, 9 aa, Homo Sapiens
LALQWAKSP

SEQ ID NO: 499233 - protein, 9 aa, Homo Sapiens
PAGPLQEDD

SEQ ID NO: 499234 - protein, 9 aa, Homo Sapiens
ASILTNTMK

SEQ ID NO: 499235 - protein, 9 aa, Homo Sapiens
HAPKWEVTH

SEQ ID NO: 499236 - protein, 9 aa, Homo Sapiens
CARIFLIAS

SEQ ID NO: 499237 - protein, 9 aa, Homo Sapiens
SGLWGNRLQ

SEQ ID NO: 499238 - protein, 9 aa, Homo Sapiens
YGVGYWAKI

SEQ ID NO: 499239 - protein, 9 aa, Homo Sapiens
YYNNLSASK

SEQ ID NO: 499240 - protein, 9 aa, Homo Sapiens
MPPFPFWMA

SEQ ID NO: 499241 - protein, 9 aa, Homo Sapiens
SAEDHTLSQ

SEQ ID NO: 499242 - protein, 9 aa, Homo Sapiens
KEMRIYATE

SEQ ID NO: 499243 - protein, 9 aa, Homo Sapiens
SVSLGNGIL

SEQ ID NO: 499244 - protein, 9 aa, Homo Sapiens
QEEWTLRLL

SEQ ID NO: 499245 - protein, 9 aa, Homo Sapiens
SVHPEDVLI

SEQ ID NO: 499246 - protein, 9 aa, Homo Sapiens
HENMKINQA

SEQ ID NO: 499247 - protein, 9 aa, Homo Sapiens
PSGLPFERK

SEQ ID NO: 499248 - protein, 9 aa, Homo Sapiens
PGPKWTSRS

SEQ ID NO: 499249 - protein, 9 aa, Homo Sapiens
KDKTFWREL

SEQ ID NO: 499250 - protein, 9 aa, Homo Sapiens
SKDILQRLD

SEQ ID NO: 499251 - protein, 9 aa, Homo Sapiens
LKLVSPANG

SEQ ID NO: 499252 - protein, 9 aa, Homo Sapiens
SIIFIRQEE

SEQ ID NO: 499253 - protein, 9 aa, Homo Sapiens
FKCTMKEFS

SEQ ID NO: 499254 - protein, 9 aa, Homo Sapiens
EQAEIIEAG

SEQ ID NO: 499255 - protein, 9 aa, Homo Sapiens
GHQTPSDVD

SEQ ID NO: 499256 - protein, 9 aa, Homo Sapiens
QGEISTILN

SEQ ID NO: 499257 - protein, 9 aa, Homo Sapiens
HNTELAFES

SEQ ID NO: 499258 - protein, 9 aa, Homo Sapiens
IFIRQEEWT

SEQ ID NO: 499259 - protein, 9 aa, Homo Sapiens
DRMAKSLYE

SEQ ID NO: 499260 - protein, 9 aa, Homo Sapiens
GAAQGAGAG

SEQ ID NO: 499261 - protein, 9 aa, Homo Sapiens
NKLLLCDGC

SEQ ID NO: 499262 - protein, 9 aa, Homo Sapiens
APKWEVTHG

SEQ ID NO: 499263 - protein, 9 aa, Homo Sapiens
DFRKGPEPE

SEQ ID NO: 499264 - protein, 9 aa, Homo Sapiens
ERERQLREQ

SEQ ID NO: 499265 - protein, 9 aa, Homo Sapiens
EDMMRDRIE

SEQ ID NO: 499266 - protein, 9 aa, Homo Sapiens
LFHPKQKDW

SEQ ID NO: 499267 - protein, 9 aa, Homo Sapiens
SPDALPARW

SEQ ID NO: 499268 - protein, 9 aa, Homo Sapiens
PFWMAPPLL

SEQ ID NO: 499269 - protein, 9 aa, Homo Sapiens
GPPGYGPVG

SEQ ID NO: 499270 - protein, 9 aa, Homo Sapiens
EDTPSHLAP

SEQ ID NO: 499271 - protein, 9 aa, Homo Sapiens
FYFKELGKY

SEQ ID NO: 499272 - protein, 9 aa, Homo Sapiens
VDQFSDSSL

SEQ ID NO: 499273 - protein, 9 aa, Homo Sapiens
DFGSYSKYE

SEQ ID NO: 499274 - protein, 9 aa, Homo Sapiens
SGGHKRSFH

SEQ ID NO: 499275 - protein, 9 aa, Homo Sapiens
SRVKNLVLT

SEQ ID NO: 499276 - protein, 9 aa, Homo Sapiens
WKTLAFSFL

SEQ ID NO: 499277 - protein, 9 aa, Homo Sapiens
NDSKDILQR

SEQ ID NO: 499278 - protein, 9 aa, Homo Sapiens
PRHIHKLLA

SEQ ID NO: 499279 - protein, 9 aa, Homo Sapiens
LFPSLCAQR

SEQ ID NO: 499280 - protein, 9 aa, Homo Sapiens
GRPTLSGTK

SEQ ID NO: 499281 - protein, 9 aa, Homo Sapiens
IEKYGVGYW

SEQ ID NO: 499282 - protein, 9 aa, Homo Sapiens
FDIAAMCNP

SEQ ID NO: 499283 - protein, 9 aa, Homo Sapiens
QVSITGFFH

SEQ ID NO: 499284 - protein, 9 aa, Homo Sapiens
FRSYVTHHD

SEQ ID NO: 499285 - protein, 9 aa, Homo Sapiens
IGGFHHERL

SEQ ID NO: 499286 - protein, 9 aa, Homo Sapiens
LVYFEPNDI

SEQ ID NO: 499287 - protein, 9 aa, Homo Sapiens
SYSKYERKH

SEQ ID NO: 499288 - protein, 9 aa, Homo Sapiens
AKSLYEIRF

SEQ ID NO: 499289 - protein, 9 aa, Homo Sapiens
MPEPENSAL

SEQ ID NO: 499290 - protein, 9 aa, Homo Sapiens
YPTIGGFHH

SEQ ID NO: 499291 - protein, 9 aa, Homo Sapiens
RRRFGRAPP

SEQ ID NO: 499292 - protein, 9 aa, Homo Sapiens
QGARLSTTL

SEQ ID NO: 499293 - protein, 9 aa, Homo Sapiens
PEADIRWFK

SEQ ID NO: 499294 - protein, 9 aa, Homo Sapiens
VQTLLDLFF

SEQ ID NO: 499295 - protein, 9 aa, Homo Sapiens
QLQFYTKAA

SEQ ID NO: 499296 - protein, 9 aa, Homo Sapiens
GFPVLRLSP

SEQ ID NO: 499297 - protein, 9 aa, Homo Sapiens
SNKSPMVPA

SEQ ID NO: 499298 - protein, 9 aa, Homo Sapiens
SVPIQRIPN

SEQ ID NO: 499299 - protein, 9 aa, Homo Sapiens
FSHRSLRKV

SEQ ID NO: 499300 - protein, 9 aa, Homo Sapiens
SVHKKELNK

SEQ ID NO: 499301 - protein, 9 aa, Homo Sapiens
FPDGKGSSR

SEQ ID NO: 499302 - protein, 9 aa, Homo Sapiens
CGVVVTLRN

SEQ ID NO: 499303 - protein, 9 aa, Homo Sapiens
QQNKRKKPP

SEQ ID NO: 499304 - protein, 9 aa, Homo Sapiens
AMYVPICTL

SEQ ID NO: 499305 - protein, 9 aa, Homo Sapiens
DEDNKLLLC

SEQ ID NO: 499306 - protein, 9 aa, Homo Sapiens
RGLSQAFQL

SEQ ID NO: 499307 - protein, 9 aa, Homo Sapiens
PNQGWSSAK

SEQ ID NO: 499308 - protein, 9 aa, Homo Sapiens
GFIFSPNFP

SEQ ID NO: 499309 - protein, 9 aa, Homo Sapiens
PPLMNSLPP

SEQ ID NO: 499310 - protein, 9 aa, Homo Sapiens
SVYPWKPQA

SEQ ID NO: 499311 - protein, 9 aa, Homo Sapiens
LLAHSQSLS

SEQ ID NO: 499312 - protein, 9 aa, Homo Sapiens
MKKPRKSSM

SEQ ID NO: 499313 - protein, 9 aa, Homo Sapiens
TVCKHQDKE

SEQ ID NO: 499314 - protein, 9 aa, Homo Sapiens
YQRVHTGEK

SEQ ID NO: 499315 - protein, 9 aa, Homo Sapiens
THLTSVTLF

SEQ ID NO: 499316 - protein, 9 aa, Homo Sapiens
EGNMEAAKA

SEQ ID NO: 499317 - protein, 9 aa, Homo Sapiens
ILELSECLD

SEQ ID NO: 499318 - protein, 9 aa, Homo Sapiens
KRKKPPVAT

SEQ ID NO: 499319 - protein, 9 aa, Homo Sapiens
TFEDVFSHR

SEQ ID NO: 499320 - protein, 9 aa, Homo Sapiens
FKWYQQWKD

SEQ ID NO: 499321 - protein, 9 aa, Homo Sapiens
VKMEIFSHM

SEQ ID NO: 499322 - protein, 9 aa, Homo Sapiens
PGERKTKTK

SEQ ID NO: 499323 - protein, 9 aa, Homo Sapiens
FFQLLVKSM

SEQ ID NO: 499324 - protein, 9 aa, Homo Sapiens
DIAAMCNPR

SEQ ID NO: 499325 - protein, 9 aa, Homo Sapiens
VSITGFFHR

SEQ ID NO: 499326 - protein, 9 aa, Homo Sapiens
TNPVQNLTH

SEQ ID NO: 499327 - protein, 9 aa, Homo Sapiens
AACLQLGPQ

SEQ ID NO: 499328 - protein, 9 aa, Homo Sapiens
KRSVHKKEL

SEQ ID NO: 499329 - protein, 9 aa, Homo Sapiens
DDNEHTDSS

SEQ ID NO: 499330 - protein, 9 aa, Homo Sapiens
DGRTCYDIH

SEQ ID NO: 499331 - protein, 9 aa, Homo Sapiens
VASVYPWKP

SEQ ID NO: 499332 - protein, 9 aa, Homo Sapiens
WSAMPTEGA

SEQ ID NO: 499333 - protein, 9 aa, Homo Sapiens
PKWEVTHGE

SEQ ID NO: 499334 - protein, 9 aa, Homo Sapiens
LELSECLDL

SEQ ID NO: 499335 - protein, 9 aa, Homo Sapiens
EISTILNDA

SEQ ID NO: 499336 - protein, 9 aa, Homo Sapiens
KKVVSVHPE

SEQ ID NO: 499337 - protein, 9 aa, Homo Sapiens
GLWGNRLQY

SEQ ID NO: 499338 - protein, 9 aa, Homo Sapiens
CISTRKSRA

SEQ ID NO: 499339 - protein, 9 aa, Homo Sapiens
ARLSTTLRS

SEQ ID NO: 499340 - protein, 9 aa, Homo Sapiens
QQSVPIQRI

SEQ ID NO: 499341 - protein, 9 aa, Homo Sapiens
QRDSYSQSG

SEQ ID NO: 499342 - protein, 9 aa, Homo Sapiens
CFCFRSYVT

SEQ ID NO: 499343 - protein, 9 aa, Homo Sapiens
KSPPADDHH

SEQ ID NO: 499344 - protein, 9 aa, Homo Sapiens
IGTSPQNFL

SEQ ID NO: 499345 - protein, 9 aa, Homo Sapiens
LGNGILELK

SEQ ID NO: 499346 - protein, 9 aa, Homo Sapiens
AALVLKERT

SEQ ID NO: 499347 - protein, 9 aa, Homo Sapiens
GSRRRRFGR

SEQ ID NO: 499348 - protein, 9 aa, Homo Sapiens
FLCAMYVPI

SEQ ID NO: 499349 - protein, 9 aa, Homo Sapiens
SAKNGWGEE

SEQ ID NO: 499350 - protein, 9 aa, Homo Sapiens
TGVQDNPKA

SEQ ID NO: 499351 - protein, 9 aa, Homo Sapiens
PKQKDWILA

SEQ ID NO: 499352 - protein, 9 aa, Homo Sapiens
VVLHKDFKW

SEQ ID NO: 499353 - protein, 9 aa, Homo Sapiens
VSVHPEDVL

SEQ ID NO: 499354 - protein, 9 aa, Homo Sapiens
LRPGMRVAF

SEQ ID NO: 499355 - protein, 9 aa, Homo Sapiens
KTGRLFTES

SEQ ID NO: 499356 - protein, 9 aa, Homo Sapiens
RTSSASCFS

SEQ ID NO: 499357 - protein, 9 aa, Homo Sapiens
RGSRRRRFG

SEQ ID NO: 499358 - protein, 9 aa, Homo Sapiens
VCFGEGLSF

SEQ ID NO: 499359 - protein, 9 aa, Homo Sapiens
LVDTSRQSK

SEQ ID NO: 499360 - protein, 9 aa, Homo Sapiens
PLRALSRFQ

SEQ ID NO: 499361 - protein, 9 aa, Homo Sapiens
EDHTLSQQD

SEQ ID NO: 499362 - protein, 9 aa, Homo Sapiens
ANGAPPPSA

SEQ ID NO: 499363 - protein, 9 aa, Homo Sapiens
KEKEDDEQT

SEQ ID NO: 499364 - protein, 9 aa, Homo Sapiens
HVAQKQEPR

SEQ ID NO: 499365 - protein, 9 aa, Homo Sapiens
NLSNDIRVA

SEQ ID NO: 499366 - protein, 9 aa, Homo Sapiens
LSPRKILRD

SEQ ID NO: 499367 - protein, 9 aa, Homo Sapiens
VHACDDGGL

SEQ ID NO: 499368 - protein, 9 aa, Homo Sapiens
MADNAGLET

SEQ ID NO: 499369 - protein, 9 aa, Homo Sapiens
SKIRADLER

SEQ ID NO: 499370 - protein, 9 aa, Homo Sapiens
PSSSSSGDN

SEQ ID NO: 499371 - protein, 9 aa, Homo Sapiens
QLIIIANND

SEQ ID NO: 499372 - protein, 9 aa, Homo Sapiens
CFNLSNDIR

SEQ ID NO: 499373 - protein, 9 aa, Homo Sapiens
NPKALVAPS

SEQ ID NO: 499374 - protein, 9 aa, Homo Sapiens
SQLDEEEEK

SEQ ID NO: 499375 - protein, 9 aa, Homo Sapiens
GSGFPDGKG

SEQ ID NO: 499376 - protein, 9 aa, Homo Sapiens
KEVVWSKFN

SEQ ID NO: 499377 - protein, 9 aa, Homo Sapiens
LSNDIRVAI

SEQ ID NO: 499378 - protein, 9 aa, Homo Sapiens
QAHLRRHMQ

SEQ ID NO: 499379 - protein, 9 aa, Homo Sapiens
KATRVWGPW

SEQ ID NO: 499380 - protein, 9 aa, Homo Sapiens
QPYLNLSNL

SEQ ID NO: 499381 - protein, 9 aa, Homo Sapiens
VKLVYFEPN

SEQ ID NO: 499382 - protein, 9 aa, Homo Sapiens
NNFLLISND

SEQ ID NO: 499383 - protein, 9 aa, Homo Sapiens
RERQLREQQ

SEQ ID NO: 499384 - protein, 9 aa, Homo Sapiens
KRADQMKAM

SEQ ID NO: 499385 - protein, 9 aa, Homo Sapiens
HFKSKMEIP

SEQ ID NO: 499386 - protein, 9 aa, Homo Sapiens
TVREQSSIP

SEQ ID NO: 499387 - protein, 9 aa, Homo Sapiens
LHRDMSVSI

SEQ ID NO: 499388 - protein, 9 aa, Homo Sapiens
KIVVESKLT

SEQ ID NO: 499389 - protein, 9 aa, Homo Sapiens
RTCYDIHEC

SEQ ID NO: 499390 - protein, 9 aa, Homo Sapiens
RDRIHKSSP

SEQ ID NO: 499391 - protein, 9 aa, Homo Sapiens
RRFGRAPPE

SEQ ID NO: 499392 - protein, 9 aa, Homo Sapiens
QADETLDFQ

SEQ ID NO: 499393 - protein, 9 aa, Homo Sapiens
HLAPVSQQG

SEQ ID NO: 499394 - protein, 9 aa, Homo Sapiens
NSLPPRPPL

SEQ ID NO: 499395 - protein, 9 aa, Homo Sapiens
VQRRWVKKR

SEQ ID NO: 499396 - protein, 9 aa, Homo Sapiens
AYETVCKHQ

SEQ ID NO: 499397 - protein, 9 aa, Homo Sapiens
DALPARWGW

SEQ ID NO: 499398 - protein, 9 aa, Homo Sapiens
PNRFKEVVW

SEQ ID NO: 499399 - protein, 9 aa, Homo Sapiens
FYQNNNYGL

SEQ ID NO: 499400 - protein, 9 aa, Homo Sapiens
FEQDDKIRW

SEQ ID NO: 499401 - protein, 9 aa, Homo Sapiens
KVPPWTGEV

SEQ ID NO: 499402 - protein, 9 aa, Homo Sapiens
DLFSRVVPP

SEQ ID NO: 499403 - protein, 9 aa, Homo Sapiens
SLFCVILRY

SEQ ID NO: 499404 - protein, 9 aa, Homo Sapiens
EEIMLHYAR

SEQ ID NO: 499405 - protein, 9 aa, Homo Sapiens
ASSGAAQGA

SEQ ID NO: 499406 - protein, 9 aa, Homo Sapiens
KERTQIENG

SEQ ID NO: 499407 - protein, 9 aa, Homo Sapiens
YAWFFFQLL

SEQ ID NO: 499408 - protein, 9 aa, Homo Sapiens
ALPARWGWR

SEQ ID NO: 499409 - protein, 9 aa, Homo Sapiens
RKLKEQSKR

SEQ ID NO: 499410 - protein, 9 aa, Homo Sapiens
YIRRLNQQP

SEQ ID NO: 499411 - protein, 9 aa, Homo Sapiens
QPQTRRTKF

SEQ ID NO: 499412 - protein, 9 aa, Homo Sapiens
IQTHFKSKM

SEQ ID NO: 499413 - protein, 9 aa, Homo Sapiens
EKRADQMKA

SEQ ID NO: 499414 - protein, 9 aa, Homo Sapiens
EELDFLFNE

SEQ ID NO: 499415 - protein, 9 aa, Homo Sapiens
ATHLTSVTL

SEQ ID NO: 499416 - protein, 9 aa, Homo Sapiens
TMNFFQNSR

SEQ ID NO: 499417 - protein, 9 aa, Homo Sapiens
RQMKEDTEK

SEQ ID NO: 499418 - protein, 9 aa, Homo Sapiens
HHHTLLSLP

SEQ ID NO: 499419 - protein, 9 aa, Homo Sapiens
SKEKVWSKS

SEQ ID NO: 499420 - protein, 9 aa, Homo Sapiens
APAGPLQED

SEQ ID NO: 499421 - protein, 9 aa, Homo Sapiens
VYFEPNDIT

SEQ ID NO: 499422 - protein, 9 aa, Homo Sapiens
SMPCGVVVT

SEQ ID NO: 499423 - protein, 9 aa, Homo Sapiens
SHLAPVSQQ

SEQ ID NO: 499424 - protein, 9 aa, Homo Sapiens
VHKKELNKK

SEQ ID NO: 499425 - protein, 9 aa, Homo Sapiens
AWRHVVKDK

SEQ ID NO: 499426 - protein, 9 aa, Homo Sapiens
YFISSKEKV

SEQ ID NO: 499427 - protein, 9 aa, Homo Sapiens
GFHHERLQY

SEQ ID NO: 499428 - protein, 9 aa, Homo Sapiens
HKEEDLKPT

SEQ ID NO: 499429 - protein, 9 aa, Homo Sapiens
MKISHQQNK

SEQ ID NO: 499430 - protein, 9 aa, Homo Sapiens
KPIAEAPFK

SEQ ID NO: 499431 - protein, 9 aa, Homo Sapiens
ATQDLKLLA

SEQ ID NO: 499432 - protein, 9 aa, Homo Sapiens
QKAHRPQRE

SEQ ID NO: 499433 - protein, 9 aa, Homo Sapiens
SGFPDGKGS

SEQ ID NO: 499434 - protein, 9 aa, Homo Sapiens
EPDSPWMGS

SEQ ID NO: 499435 - protein, 9 aa, Homo Sapiens
DVEHTLVQC

SEQ ID NO: 499436 - protein, 9 aa, Homo Sapiens
IAMINSLFQ

SEQ ID NO: 499437 - protein, 9 aa, Homo Sapiens
IYLKALSSK

SEQ ID NO: 499438 - protein, 9 aa, Homo Sapiens
FFPFFFLRR

SEQ ID NO: 499439 - protein, 9 aa, Homo Sapiens
IVPAGNLRT

SEQ ID NO: 499440 - protein, 9 aa, Homo Sapiens
SFMSQAVDN

SEQ ID NO: 499441 - protein, 9 aa, Homo Sapiens
TIKKLRKLK

SEQ ID NO: 499442 - protein, 9 aa, Homo Sapiens
PGKKDKLFR

SEQ ID NO: 499443 - protein, 9 aa, Homo Sapiens
CSSICDYSE

SEQ ID NO: 499444 - protein, 9 aa, Homo Sapiens
PYDICRPAH

SEQ ID NO: 499445 - protein, 9 aa, Homo Sapiens
DNEHTDSSD

SEQ ID NO: 499446 - protein, 9 aa, Homo Sapiens
STGHATSLH

SEQ ID NO: 499447 - protein, 9 aa, Homo Sapiens
PSDKPIAEA

SEQ ID NO: 499448 - protein, 9 aa, Homo Sapiens
TKIVVESKL

SEQ ID NO: 499449 - protein, 9 aa, Homo Sapiens
PLEEDTPSH

SEQ ID NO: 499450 - protein, 9 aa, Homo Sapiens
RIYATEIIL

SEQ ID NO: 499451 - protein, 9 aa, Homo Sapiens
GLPGRRHKK

SEQ ID NO: 499452 - protein, 9 aa, Homo Sapiens
SQGGHLRIY

SEQ ID NO: 499453 - protein, 9 aa, Homo Sapiens
SNVEEQLSK

SEQ ID NO: 499454 - protein, 9 aa, Homo Sapiens
QESLPNDSK

SEQ ID NO: 499455 - protein, 9 aa, Homo Sapiens
RRYDLFSRV

SEQ ID NO: 499456 - protein, 9 aa, Homo Sapiens
LQKQYRPDM

SEQ ID NO: 499457 - protein, 9 aa, Homo Sapiens
FFFFPFFFL

SEQ ID NO: 499458 - protein, 9 aa, Homo Sapiens
DSACISWAY

SEQ ID NO: 499459 - protein, 9 aa, Homo Sapiens
PFERKRDAA

SEQ ID NO: 499460 - protein, 9 aa, Homo Sapiens
PMVPATLIR

SEQ ID NO: 499461 - protein, 9 aa, Homo Sapiens
MVPATLIRS

SEQ ID NO: 499462 - protein, 9 aa, Homo Sapiens
EPSADLAPM

SEQ ID NO: 499463 - protein, 9 aa, Homo Sapiens
VPSEMTEDM

SEQ ID NO: 499464 - protein, 9 aa, Homo Sapiens
SGTKCLCVC

SEQ ID NO: 499465 - protein, 9 aa, Homo Sapiens
EHTLVQCHA

SEQ ID NO: 499466 - protein, 9 aa, Homo Sapiens
IIFIRQEEW

SEQ ID NO: 499467 - protein, 9 aa, Homo Sapiens
NEAHFKTLE

SEQ ID NO: 499468 - protein, 9 aa, Homo Sapiens
PSHNTELAF

SEQ ID NO: 499469 - protein, 9 aa, Homo Sapiens
SQALSLILH

SEQ ID NO: 499470 - protein, 9 aa, Homo Sapiens
KEDTEKFRQ

SEQ ID NO: 499471 - protein, 9 aa, Homo Sapiens
SSTSRDSRS

SEQ ID NO: 499472 - protein, 9 aa, Homo Sapiens
GGFHHERLQ

SEQ ID NO: 499473 - protein, 9 aa, Homo Sapiens
ALWWSAMPT

SEQ ID NO: 499474 - protein, 9 aa, Homo Sapiens
QGAGAGLLL

SEQ ID NO: 499475 - protein, 9 aa, Homo Sapiens
FALSTVREQ

SEQ ID NO: 499476 - protein, 9 aa, Homo Sapiens
ASSSTSRDS

SEQ ID NO: 499477 - protein, 9 aa, Homo Sapiens
KTLAFSFLV

SEQ ID NO: 499478 - protein, 9 aa, Homo Sapiens
AKTHNEDHK

SEQ ID NO: 499479 - protein, 9 aa, Homo Sapiens
SGFPVLRLS

SEQ ID NO: 499480 - protein, 9 aa, Homo Sapiens
SLLFHPKQK

SEQ ID NO: 499481 - protein, 9 aa, Homo Sapiens
RKILRDEVS

SEQ ID NO: 499482 - protein, 9 aa, Homo Sapiens
ITLYNGSVV

SEQ ID NO: 499483 - protein, 9 aa, Homo Sapiens
YDLFSRVVP

SEQ ID NO: 499484 - protein, 9 aa, Homo Sapiens
ATHVCFCFR

SEQ ID NO: 499485 - protein, 9 aa, Homo Sapiens
KELEESRQK

SEQ ID NO: 499486 - protein, 9 aa, Homo Sapiens
SADSSASLE

SEQ ID NO: 499487 - protein, 9 aa, Homo Sapiens
TPGSPDALP

SEQ ID NO: 499488 - protein, 9 aa, Homo Sapiens
LLDNVGEEL

SEQ ID NO: 499489 - protein, 9 aa, Homo Sapiens
LNEAHFKTL

SEQ ID NO: 499490 - protein, 9 aa, Homo Sapiens
LEDSGIHVA

SEQ ID NO: 499491 - protein, 9 aa, Homo Sapiens
HPRHIHKLL

SEQ ID NO: 499492 - protein, 9 aa, Homo Sapiens
NNDAFGTLQ

SEQ ID NO: 499493 - protein, 9 aa, Homo Sapiens
KEIKEKPKE

SEQ ID NO: 499494 - protein, 9 aa, Homo Sapiens
FGRAPPEAE

SEQ ID NO: 499495 - protein, 9 aa, Homo Sapiens
SECLDLQRF

SEQ ID NO: 499496 - protein, 9 aa, Homo Sapiens
LLSLPWIIC

SEQ ID NO: 499497 - protein, 9 aa, Homo Sapiens
VVSVHPEDV

SEQ ID NO: 499498 - protein, 9 aa, Homo Sapiens
LTENGCVYT

SEQ ID NO: 499499 - protein, 9 aa, Homo Sapiens
RDYKKAIKF

SEQ ID NO: 499500 - protein, 9 aa, Homo Sapiens
SILTNTMKE

SEQ ID NO: 499501 - protein, 9 aa, Homo Sapiens
MIPNEIVQT

SEQ ID NO: 499502 - protein, 9 aa, Homo Sapiens
DFLFNEEIE

SEQ ID NO: 499503 - protein, 9 aa, Homo Sapiens
QQQLKPGKK

SEQ ID NO: 499504 - protein, 9 aa, Homo Sapiens
LRTRLPGRH

SEQ ID NO: 499505 - protein, 9 aa, Homo Sapiens
QYYDPSDKP

SEQ ID NO: 499506 - protein, 9 aa, Homo Sapiens
MRVAFCYQI

SEQ ID NO: 499507 - protein, 9 aa, Homo Sapiens
SSKDKTFWR

SEQ ID NO: 499508 - protein, 9 aa, Homo Sapiens
LAHSQSLSI

SEQ ID NO: 499509 - protein, 9 aa, Homo Sapiens
PSFPSGFPV

SEQ ID NO: 499510 - protein, 9 aa, Homo Sapiens
YITKGGLVL

SEQ ID NO: 499511 - protein, 9 aa, Homo Sapiens
DNSVFAHDL

SEQ ID NO: 499512 - protein, 9 aa, Homo Sapiens
RMKARQQKY

SEQ ID NO: 499513 - protein, 9 aa, Homo Sapiens
FLMFDMGLQ

SEQ ID NO: 499514 - protein, 9 aa, Homo Sapiens
HCVRFSPHG

SEQ ID NO: 499515 - protein, 9 aa, Homo Sapiens
RFQGMRVVV

SEQ ID NO: 499516 - protein, 9 aa, Homo Sapiens
KTLKPKDVD

SEQ ID NO: 499517 - protein, 9 aa, Homo Sapiens
FEDVFSHRS

SEQ ID NO: 499518 - protein, 9 aa, Homo Sapiens
ELETKMYIT

SEQ ID NO: 499519 - protein, 9 aa, Homo Sapiens
ESRWKDICA

SEQ ID NO: 499520 - protein, 9 aa, Homo Sapiens
ASCFSSTSY

SEQ ID NO: 499521 - protein, 9 aa, Homo Sapiens
SAHPSRPCR

SEQ ID NO: 499522 - protein, 9 aa, Homo Sapiens
AAEQAEIIE

SEQ ID NO: 499523 - protein, 9 aa, Homo Sapiens
HIQTHFKSK

SEQ ID NO: 499524 - protein, 9 aa, Homo Sapiens
IPDAKRIIW

SEQ ID NO: 499525 - protein, 9 aa, Homo Sapiens
NMEAAKAVD

SEQ ID NO: 499526 - protein, 9 aa, Homo Sapiens
KELLAHSQS

SEQ ID NO: 499527 - protein, 9 aa, Homo Sapiens
GKPCLLDNV

SEQ ID NO: 499528 - protein, 9 aa, Homo Sapiens
VLHKDFKWY

SEQ ID NO: 499529 - protein, 9 aa, Homo Sapiens
ECLDLQRFH

SEQ ID NO: 499530 - protein, 9 aa, Homo Sapiens
ETKMYITKG

SEQ ID NO: 499531 - protein, 9 aa, Homo Sapiens
APPEPGEPK

SEQ ID NO: 499532 - protein, 9 aa, Homo Sapiens
MAKSLYEIR

SEQ ID NO: 499533 - protein, 9 aa, Homo Sapiens
GSLFCVILR

SEQ ID NO: 499534 - protein, 9 aa, Homo Sapiens
AFQLDQQAF

SEQ ID NO: 499535 - protein, 9 aa, Homo Sapiens
LLPLRTPPY

SEQ ID NO: 499536 - protein, 9 aa, Homo Sapiens
AVKRLATQD

SEQ ID NO: 499537 - protein, 9 aa, Homo Sapiens
APMKKPRKS

SEQ ID NO: 499538 - protein, 9 aa, Homo Sapiens
KKAIKFYRE

SEQ ID NO: 499539 - protein, 9 aa, Homo Sapiens
GLFCALRHA

SEQ ID NO: 499540 - protein, 9 aa, Homo Sapiens
SGFIFSPNF

SEQ ID NO: 499541 - protein, 9 aa, Homo Sapiens
PVGPIGDKG

SEQ ID NO: 499542 - protein, 9 aa, Homo Sapiens
AQLIIIANN

SEQ ID NO: 499543 - protein, 9 aa, Homo Sapiens
FFFFFPFFF

SEQ ID NO: 499544 - protein, 9 aa, Homo Sapiens
DKKRGASSS

SEQ ID NO: 499545 - protein, 9 aa, Homo Sapiens
QGWSSAKNG

SEQ ID NO: 499546 - protein, 9 aa, Homo Sapiens
KSLYEIRFR

SEQ ID NO: 499547 - protein, 9 aa, Homo Sapiens
FRPALDNPY

SEQ ID NO: 499548 - protein, 9 aa, Homo Sapiens
KNIRFQVQI

SEQ ID NO: 499549 - protein, 9 aa, Homo Sapiens
FKIETLGDH

SEQ ID NO: 499550 - protein, 9 aa, Homo Sapiens
LMVSIIFIR

SEQ ID NO: 499551 - protein, 9 aa, Homo Sapiens
SRTSSASCF

SEQ ID NO: 499552 - protein, 9 aa, Homo Sapiens
PSDVDQFSD

SEQ ID NO: 499553 - protein, 9 aa, Homo Sapiens
LGPSIPNAY

SEQ ID NO: 499554 - protein, 9 aa, Homo Sapiens
CDDGGLIPL

SEQ ID NO: 499555 - protein, 9 aa, Homo Sapiens
QVEKVVDKL

SEQ ID NO: 499556 - protein, 9 aa, Homo Sapiens
KPKEEEMTE

SEQ ID NO: 499557 - protein, 9 aa, Homo Sapiens
PEPGEPKER

SEQ ID NO: 499558 - protein, 9 aa, Homo Sapiens
RMAKSLYEI

SEQ ID NO: 499559 - protein, 9 aa, Homo Sapiens
PHWKQEKND

SEQ ID NO: 499560 - protein, 9 aa, Homo Sapiens
SSSSGDNSV

SEQ ID NO: 499561 - protein, 9 aa, Homo Sapiens
TMKELEESR

SEQ ID NO: 499562 - protein, 9 aa, Homo Sapiens
YKFRPALDN

SEQ ID NO: 499563 - protein, 9 aa, Homo Sapiens
ALSPLPKVP

SEQ ID NO: 499564 - protein, 9 aa, Homo Sapiens
QQLLGGQKS

SEQ ID NO: 499565 - protein, 9 aa, Homo Sapiens
YFKELGKYD

SEQ ID NO: 499566 - protein, 9 aa, Homo Sapiens
EPAIFEAWR

SEQ ID NO: 499567 - protein, 9 aa, Homo Sapiens
EIVQTLLDL

SEQ ID NO: 499568 - protein, 9 aa, Homo Sapiens
DTASTRLGG

SEQ ID NO: 499569 - protein, 9 aa, Homo Sapiens
VTQLNEAHF

SEQ ID NO: 499570 - protein, 9 aa, Homo Sapiens
KRLTRPGSS

SEQ ID NO: 499571 - protein, 9 aa, Homo Sapiens
GSYSKYERK

SEQ ID NO: 499572 - protein, 9 aa, Homo Sapiens
AHRYRHPRH

SEQ ID NO: 499573 - protein, 9 aa, Homo Sapiens
AFDIAAMCN

SEQ ID NO: 499574 - protein, 9 aa, Homo Sapiens
DSCWPDPSH

SEQ ID NO: 499575 - protein, 9 aa, Homo Sapiens
NILDTWVAM

SEQ ID NO: 499576 - protein, 9 aa, Homo Sapiens
KAMGIETSD

SEQ ID NO: 499577 - protein, 9 aa, Homo Sapiens
GAPPPSAAA

SEQ ID NO: 499578 - protein, 9 aa, Homo Sapiens
VAGKPHRYV

SEQ ID NO: 499579 - protein, 9 aa, Homo Sapiens
ALQWAKSPP

SEQ ID NO: 499580 - protein, 9 aa, Homo Sapiens
ETLKAKKHV

SEQ ID NO: 499581 - protein, 9 aa, Homo Sapiens
LKRQMDRMK

SEQ ID NO: 499582 - protein, 9 aa, Homo Sapiens
TWVAMEELV

SEQ ID NO: 499583 - protein, 9 aa, Homo Sapiens
EKASRETRP

SEQ ID NO: 499584 - protein, 9 aa, Homo Sapiens
QAVVMQGEI

SEQ ID NO: 499585 - protein, 9 aa, Homo Sapiens
NRFKEVVWS

SEQ ID NO: 499586 - protein, 9 aa, Homo Sapiens
IFSPNFPHP

SEQ ID NO: 499587 - protein, 9 aa, Homo Sapiens
SFYQNNNYG

SEQ ID NO: 499588 - protein, 9 aa, Homo Sapiens
AAQVQRRWV

SEQ ID NO: 499589 - protein, 9 aa, Homo Sapiens
CESSKDKTF

SEQ ID NO: 499590 - protein, 9 aa, Homo Sapiens
KNQIKRLTR

SEQ ID NO: 499591 - protein, 9 aa, Homo Sapiens
VVDKLIKQR

SEQ ID NO: 499592 - protein, 9 aa, Homo Sapiens
IHTKPNRFK

SEQ ID NO: 499593 - protein, 9 aa, Homo Sapiens
LDTWVAMEE

SEQ ID NO: 499594 - protein, 9 aa, Homo Sapiens
ERAITRHEV

SEQ ID NO: 499595 - protein, 9 aa, Homo Sapiens
SHNTELAFE

SEQ ID NO: 499596 - protein, 9 aa, Homo Sapiens
QFFFFFFPF

SEQ ID NO: 499597 - protein, 9 aa, Homo Sapiens
GANVHACDD

SEQ ID NO: 499598 - protein, 9 aa, Homo Sapiens
ALVLKERTQ

SEQ ID NO: 499599 - protein, 9 aa, Homo Sapiens
SCFNLSNDI

SEQ ID NO: 499600 - protein, 9 aa, Homo Sapiens
QLNEAHFKT

SEQ ID NO: 499601 - protein, 9 aa, Homo Sapiens
AEEKEKKGI

SEQ ID NO: 499602 - protein, 9 aa, Homo Sapiens
KVVEKITEY

SEQ ID NO: 499603 - protein, 9 aa, Homo Sapiens
SNDLRSVRS

SEQ ID NO: 499604 - protein, 9 aa, Homo Sapiens
SRPCRMRLY

SEQ ID NO: 499605 - protein, 9 aa, Homo Sapiens
TASTRLGGT

SEQ ID NO: 499606 - protein, 9 aa, Homo Sapiens
VKEDKINVY

SEQ ID NO: 499607 - protein, 9 aa, Homo Sapiens
FKAVESMPC

SEQ ID NO: 499608 - protein, 9 aa, Homo Sapiens
EISIGTSPQ

SEQ ID NO: 499609 - protein, 9 aa, Homo Sapiens
THMYFKNKK

SEQ ID NO: 499610 - protein, 9 aa, Homo Sapiens
KMGFEQQVL

SEQ ID NO: 499611 - protein, 9 aa, Homo Sapiens
GRRRRHRCS

SEQ ID NO: 499612 - protein, 9 aa, Homo Sapiens
VHPEDVLIT

SEQ ID NO: 499613 - protein, 9 aa, Homo Sapiens
KLVYFEPND

SEQ ID NO: 499614 - protein, 9 aa, Homo Sapiens
GAALSPLPK

SEQ ID NO: 499615 - protein, 9 aa, Homo Sapiens
IRFQVQIGL

SEQ ID NO: 499616 - protein, 9 aa, Homo Sapiens
EQDVGLGIN

SEQ ID NO: 499617 - protein, 9 aa, Homo Sapiens
GDEDNKLLL

SEQ ID NO: 499618 - protein, 9 aa, Homo Sapiens
DKCGFGATV

SEQ ID NO: 499619 - protein, 9 aa, Homo Sapiens
QAEIIEAGD

SEQ ID NO: 499620 - protein, 9 aa, Homo Sapiens
EMQQLLGGQ

SEQ ID NO: 499621 - protein, 9 aa, Homo Sapiens
DKDFGSYSK

SEQ ID NO: 499622 - protein, 9 aa, Homo Sapiens
TPSHLAPVS

SEQ ID NO: 499623 - protein, 9 aa, Homo Sapiens
YNEGSYTCS

SEQ ID NO: 499624 - protein, 9 aa, Homo Sapiens
KDFGSYSKY

SEQ ID NO: 499625 - protein, 9 aa, Homo Sapiens
ISNDLRSVR

SEQ ID NO: 499626 - protein, 9 aa, Homo Sapiens
LFCVILRYV

SEQ ID NO: 499627 - protein, 9 aa, Homo Sapiens
MINSLFQEI

SEQ ID NO: 499628 - protein, 9 aa, Homo Sapiens
ISFKCTMKE

SEQ ID NO: 499629 - protein, 9 aa, Homo Sapiens
PALDNPYLQ

SEQ ID NO: 499630 - protein, 9 aa, Homo Sapiens
LPRDLQSLS

SEQ ID NO: 499631 - protein, 9 aa, Homo Sapiens
PTIGGFHHE

SEQ ID NO: 499632 - protein, 9 aa, Homo Sapiens
TQDLKLLAN

SEQ ID NO: 499633 - protein, 9 aa, Homo Sapiens
RRHRCSQNT

SEQ ID NO: 499634 - protein, 9 aa, Homo Sapiens
DSYSQSGCR

SEQ ID NO: 499635 - protein, 9 aa, Homo Sapiens
LSKIRADLE

SEQ ID NO: 499636 - protein, 9 aa, Homo Sapiens
MESSHSPYP

SEQ ID NO: 499637 - protein, 9 aa, Homo Sapiens
PGRRHKKRT

SEQ ID NO: 499638 - protein, 9 aa, Homo Sapiens
ETRPRRSSP

SEQ ID NO: 499639 - protein, 9 aa, Homo Sapiens
TSCVNYMPE

SEQ ID NO: 499640 - protein, 9 aa, Homo Sapiens
FQGMRVVVD

SEQ ID NO: 499641 - protein, 9 aa, Homo Sapiens
AGHIADNKQ

SEQ ID NO: 499642 - protein, 9 aa, Homo Sapiens
GHIADNKQS

SEQ ID NO: 499643 - protein, 9 aa, Homo Sapiens
LERAITRHE

SEQ ID NO: 499644 - protein, 9 aa, Homo Sapiens
EAHFKTLEE

SEQ ID NO: 499645 - protein, 9 aa, Homo Sapiens
DFKWYQQWK

SEQ ID NO: 499646 - protein, 9 aa, Homo Sapiens
SSSSSGDNS

SEQ ID NO: 499647 - protein, 9 aa, Homo Sapiens
RQNSMGLFC

SEQ ID NO: 499648 - protein, 9 aa, Homo Sapiens
TMLKMGFEQ

SEQ ID NO: 499649 - protein, 9 aa, Homo Sapiens
LKALSSKSI

SEQ ID NO: 499650 - protein, 9 aa, Homo Sapiens
FQLLVKSMA

SEQ ID NO: 499651 - protein, 9 aa, Homo Sapiens
LSQQDSIQK

SEQ ID NO: 499652 - protein, 9 aa, Homo Sapiens
SRWKDICAR

SEQ ID NO: 499653 - protein, 9 aa, Homo Sapiens
GEISTILND

SEQ ID NO: 499654 - protein, 9 aa, Homo Sapiens
VEEQLSKIR

SEQ ID NO: 499655 - protein, 9 aa, Homo Sapiens
WVVASRQSS

SEQ ID NO: 499656 - protein, 9 aa, Homo Sapiens
FEAWRHVVK

SEQ ID NO: 499657 - protein, 9 aa, Homo Sapiens
AEAGAGTEA

SEQ ID NO: 499658 - protein, 9 aa, Homo Sapiens
ENMKINQAM

SEQ ID NO: 499659 - protein, 9 aa, Homo Sapiens
LYNGSVVER

SEQ ID NO: 499660 - protein, 9 aa, Homo Sapiens
QEGAHPGWD

SEQ ID NO: 499661 - protein, 9 aa, Homo Sapiens
SITGFFHRK

SEQ ID NO: 499662 - protein, 9 aa, Homo Sapiens
RPALMVSII

SEQ ID NO: 499663 - protein, 9 aa, Homo Sapiens
LELKREEIT

SEQ ID NO: 499664 - protein, 9 aa, Homo Sapiens
VASRQSSTV

SEQ ID NO: 499665 - protein, 9 aa, Homo Sapiens
SHQQNKRKK

SEQ ID NO: 499666 - protein, 9 aa, Homo Sapiens
KVVSVHPED

SEQ ID NO: 499667 - protein, 9 aa, Homo Sapiens
PPEPGEPKE

SEQ ID NO: 499668 - protein, 9 aa, Homo Sapiens
QAFQLDQQA

SEQ ID NO: 499669 - protein, 9 aa, Homo Sapiens
MVNGSRVKN

SEQ ID NO: 499670 - protein, 9 aa, Homo Sapiens
AEGQSYSYY

SEQ ID NO: 499671 - protein, 9 aa, Homo Sapiens
TSGSKPEAD

SEQ ID NO: 499672 - protein, 9 aa, Homo Sapiens
AAQNGHVLL

SEQ ID NO: 499673 - protein, 9 aa, Homo Sapiens
FSTCATHLT

SEQ ID NO: 499674 - protein, 9 aa, Homo Sapiens
RQYHENMKI

SEQ ID NO: 499675 - protein, 9 aa, Homo Sapiens
RIQKVDVYN

SEQ ID NO: 499676 - protein, 9 aa, Homo Sapiens
DPKATRVWG

SEQ ID NO: 499677 - protein, 9 aa, Homo Sapiens
PSYLFGMES

SEQ ID NO: 499678 - protein, 9 aa, Homo Sapiens
SCVNYMPEP

SEQ ID NO: 499679 - protein, 9 aa, Homo Sapiens
RSFFTSAHP

SEQ ID NO: 499680 - protein, 9 aa, Homo Sapiens
RSCFNLSND

SEQ ID NO: 499681 - protein, 9 aa, Homo Sapiens
MQIHDRVEN

SEQ ID NO: 499682 - protein, 9 aa, Homo Sapiens
MGLQKQYRP

SEQ ID NO: 499683 - protein, 9 aa, Homo Sapiens
SFFTSAHPS

SEQ ID NO: 499684 - protein, 9 aa, Homo Sapiens
CSRGDEDNK

SEQ ID NO: 499685 - protein, 9 aa, Homo Sapiens
PNEIVQTLL

SEQ ID NO: 499686 - protein, 9 aa, Homo Sapiens
ITKQEKDFL

SEQ ID NO: 499687 - protein, 9 aa, Homo Sapiens
TGHAPKWEV

SEQ ID NO: 499688 - protein, 9 aa, Homo Sapiens
LPARWGWRH

SEQ ID NO: 499689 - protein, 9 aa, Homo Sapiens
GYWAKIASE

SEQ ID NO: 499690 - protein, 9 aa, Homo Sapiens
KKDKLFRKK

SEQ ID NO: 499691 - protein, 9 aa, Homo Sapiens
KPGKKDKLF

SEQ ID NO: 499692 - protein, 9 aa, Homo Sapiens
GLYGKTGRL

SEQ ID NO: 499693 - protein, 9 aa, Homo Sapiens
RPTLSGTKC

SEQ ID NO: 499694 - protein, 9 aa, Homo Sapiens
PGPPGYGPV

SEQ ID NO: 499695 - protein, 9 aa, Homo Sapiens
GYGPVGPIG

SEQ ID NO: 499696 - protein, 9 aa, Homo Sapiens
LYGKTGRLF

SEQ ID NO: 499697 - protein, 9 aa, Homo Sapiens
RFSFGSEFR

SEQ ID NO: 499698 - protein, 9 aa, Homo Sapiens
SDDDLPRDL

SEQ ID NO: 499699 - protein, 9 aa, Homo Sapiens
MFDMGLQKQ

SEQ ID NO: 499700 - protein, 9 aa, Homo Sapiens
TAAQNGHVL

SEQ ID NO: 499701 - protein, 9 aa, Homo Sapiens
NEEIEQIGR

SEQ ID NO: 499702 - protein, 9 aa, Homo Sapiens
ADETLDFQE

SEQ ID NO: 499703 - protein, 9 aa, Homo Sapiens
LNLTITLYN

SEQ ID NO: 499704 - protein, 9 aa, Homo Sapiens
DSKDILQRL

SEQ ID NO: 499705 - protein, 9 aa, Homo Sapiens
MTTAAQNGH

SEQ ID NO: 499706 - protein, 9 aa, Homo Sapiens
FHPKQKDWI

SEQ ID NO: 499707 - protein, 9 aa, Homo Sapiens
PPSFPSGFP

SEQ ID NO: 499708 - protein, 9 aa, Homo Sapiens
KAFSTCATH

SEQ ID NO: 499709 - protein, 9 aa, Homo Sapiens
VSIIFIRQE

SEQ ID NO: 499710 - protein, 9 aa, Homo Sapiens
PSIPNAYSC

SEQ ID NO: 499711 - protein, 9 aa, Homo Sapiens
SHMPGESCE

SEQ ID NO: 499712 - protein, 9 aa, Homo Sapiens
TLRPGMRVA

SEQ ID NO: 499713 - protein, 9 aa, Homo Sapiens
AGAEAGAGT

SEQ ID NO: 499714 - protein, 9 aa, Homo Sapiens
TLVQCHALD

SEQ ID NO: 499715 - protein, 9 aa, Homo Sapiens
CLLDNVGEE

SEQ ID NO: 499716 - protein, 9 aa, Homo Sapiens
WMGSGGTTP

SEQ ID NO: 499717 - protein, 9 aa, Homo Sapiens
LIIIANNDA

SEQ ID NO: 499718 - protein, 9 aa, Homo Sapiens
IHKSSPLDL

SEQ ID NO: 499719 - protein, 9 aa, Homo Sapiens
GSEIVVAGH

SEQ ID NO: 499720 - protein, 9 aa, Homo Sapiens
SLPPRPPLP

SEQ ID NO: 499721 - protein, 9 aa, Homo Sapiens
AHLRRHMQI

SEQ ID NO: 499722 - protein, 9 aa, Homo Sapiens
YLSYLTSKM

SEQ ID NO: 499723 - protein, 9 aa, Homo Sapiens
CQCDKKRGA

SEQ ID NO: 499724 - protein, 9 aa, Homo Sapiens
LYFPAAEGQ

SEQ ID NO: 499725 - protein, 9 aa, Homo Sapiens
PNSSKFSRK

SEQ ID NO: 499726 - protein, 9 aa, Homo Sapiens
KIETLGDHS

SEQ ID NO: 499727 - protein, 9 aa, Homo Sapiens
GRRHKKRTS

SEQ ID NO: 499728 - protein, 9 aa, Homo Sapiens
NDKILCEQC

SEQ ID NO: 499729 - protein, 9 aa, Homo Sapiens
QLREQQRRQ

SEQ ID NO: 499730 - protein, 9 aa, Homo Sapiens
QGGHLRIYQ

SEQ ID NO: 499731 - protein, 9 aa, Homo Sapiens
KISHQQNKR

SEQ ID NO: 499732 - protein, 9 aa, Homo Sapiens
PSHLAPVSQ

SEQ ID NO: 499733 - protein, 9 aa, Homo Sapiens
HPEDVLITS

SEQ ID NO: 499734 - protein, 9 aa, Homo Sapiens
VPIQRIPNM

SEQ ID NO: 499735 - protein, 9 aa, Homo Sapiens
QLSKIRADL

SEQ ID NO: 499736 - protein, 9 aa, Homo Sapiens
KGGAAEQAE

SEQ ID NO: 499737 - protein, 9 aa, Homo Sapiens
FERKRDAAA

SEQ ID NO: 499738 - protein, 9 aa, Homo Sapiens
SLGNGILEL

SEQ ID NO: 499739 - protein, 9 aa, Homo Sapiens
NPRQEGAHP

SEQ ID NO: 499740 - protein, 9 aa, Homo Sapiens
YWAKIASEL

SEQ ID NO: 499741 - protein, 9 aa, Homo Sapiens
DYKKAIKFY

SEQ ID NO: 499742 - protein, 9 aa, Homo Sapiens
IPNEIVQTL

SEQ ID NO: 499743 - protein, 9 aa, Homo Sapiens
ILKTLKPKD

SEQ ID NO: 499744 - protein, 9 aa, Homo Sapiens
VLLSHQRTH

SEQ ID NO: 499745 - protein, 9 aa, Homo Sapiens
CALRHALAK

SEQ ID NO: 499746 - protein, 9 aa, Homo Sapiens
VLTSKNQIK

SEQ ID NO: 499747 - protein, 9 aa, Homo Sapiens
TLSPRKILR

SEQ ID NO: 499748 - protein, 9 aa, Homo Sapiens
HHERLQYYF

SEQ ID NO: 499749 - protein, 9 aa, Homo Sapiens
HKKRTSIET

SEQ ID NO: 499750 - protein, 9 aa, Homo Sapiens
VAVAKERDQ

SEQ ID NO: 499751 - protein, 9 aa, Homo Sapiens
SENDERLCN

SEQ ID NO: 499752 - protein, 9 aa, Homo Sapiens
ACLQLGPQS

SEQ ID NO: 499753 - protein, 9 aa, Homo Sapiens
VFSHRSLRK

SEQ ID NO: 499754 - protein, 9 aa, Homo Sapiens
FSFGSEFRP

SEQ ID NO: 499755 - protein, 9 aa, Homo Sapiens
QGMRVVVDA

SEQ ID NO: 499756 - protein, 9 aa, Homo Sapiens
CKDTVQNHD

SEQ ID NO: 499757 - protein, 9 aa, Homo Sapiens
TGMPHHHTL

SEQ ID NO: 499758 - protein, 9 aa, Homo Sapiens
MGSGGTTPS

SEQ ID NO: 499759 - protein, 9 aa, Homo Sapiens
TLAFSFLVE

SEQ ID NO: 499760 - protein, 9 aa, Homo Sapiens
QFYTKAARR

SEQ ID NO: 499761 - protein, 9 aa, Homo Sapiens
ANVHACDDG

SEQ ID NO: 499762 - protein, 9 aa, Homo Sapiens
CYFISSKEK

SEQ ID NO: 499763 - protein, 9 aa, Homo Sapiens
LVAACLQLG

SEQ ID NO: 499764 - protein, 9 aa, Homo Sapiens
NGAPPPSAA

SEQ ID NO: 499765 - protein, 9 aa, Homo Sapiens
KMEIFSHMP

SEQ ID NO: 499766 - protein, 9 aa, Homo Sapiens
RGSTGHAPK

SEQ ID NO: 499767 - protein, 9 aa, Homo Sapiens
EETLKAKKH

SEQ ID NO: 499768 - protein, 9 aa, Homo Sapiens
RYRHPRHIH

SEQ ID NO: 499769 - protein, 9 aa, Homo Sapiens
AVESMPCGV

SEQ ID NO: 499770 - protein, 9 aa, Homo Sapiens
KAARRLGND

SEQ ID NO: 499771 - protein, 9 aa, Homo Sapiens
ICRPAHSVL

SEQ ID NO: 499772 - protein, 9 aa, Homo Sapiens
IICISTRKS

SEQ ID NO: 499773 - protein, 9 aa, Homo Sapiens
GIFTKLGLQ

SEQ ID NO: 499774 - protein, 9 aa, Homo Sapiens
VPSKVLCVF

SEQ ID NO: 499775 - protein, 9 aa, Homo Sapiens
IRFSFGSEF

SEQ ID NO: 499776 - protein, 9 aa, Homo Sapiens
VLVASVYPW

SEQ ID NO: 499777 - protein, 9 aa, Homo Sapiens
FMSQAVDNC

SEQ ID NO: 499778 - protein, 9 aa, Homo Sapiens
SRGDEDNKL

SEQ ID NO: 499779 - protein, 9 aa, Homo Sapiens
MGANVHACD

SEQ ID NO: 499780 - protein, 9 aa, Homo Sapiens
SKSIEKLPV

SEQ ID NO: 499781 - protein, 9 aa, Homo Sapiens
HMYFKNKKV

SEQ ID NO: 499782 - protein, 9 aa, Homo Sapiens
VVEKITEYK

SEQ ID NO: 499783 - protein, 9 aa, Homo Sapiens
GPKWTSRSL

SEQ ID NO: 499784 - protein, 9 aa, Homo Sapiens
ALTHMYFKN

SEQ ID NO: 499785 - protein, 9 aa, Homo Sapiens
PSRPCRMRL

SEQ ID NO: 499786 - protein, 9 aa, Homo Sapiens
DYEEDDNEH

SEQ ID NO: 499787 - protein, 9 aa, Homo Sapiens
EQSSIPRAD

SEQ ID NO: 499788 - protein, 9 aa, Homo Sapiens
EADIRWFKN

SEQ ID NO: 499789 - protein, 9 aa, Homo Sapiens
AVKRDLLPL

SEQ ID NO: 499790 - protein, 9 aa, Homo Sapiens
NDIRVAISK

SEQ ID NO: 499791 - protein, 9 aa, Homo Sapiens
EAFDIAAMC

SEQ ID NO: 499792 - protein, 9 aa, Homo Sapiens
DRRYDLFSR

SEQ ID NO: 499793 - protein, 9 aa, Homo Sapiens
RLATQDLKL

SEQ ID NO: 499794 - protein, 9 aa, Homo Sapiens
FGEISIGTS

SEQ ID NO: 499795 - protein, 9 aa, Homo Sapiens
DLMTTAAQN

SEQ ID NO: 499796 - protein, 9 aa, Homo Sapiens
FKNKKVSYL

SEQ ID NO: 499797 - protein, 9 aa, Homo Sapiens
LGISFKCTM

SEQ ID NO: 499798 - protein, 9 aa, Homo Sapiens
STPNSSKFS

SEQ ID NO: 499799 - protein, 9 aa, Homo Sapiens
QLKPGKKDK

SEQ ID NO: 499800 - protein, 9 aa, Homo Sapiens
EMRIYATEI

SEQ ID NO: 499801 - protein, 9 aa, Homo Sapiens
IYPTIGGFH

SEQ ID NO: 499802 - protein, 9 aa, Homo Sapiens
DNAAQPYLN

SEQ ID NO: 499803 - protein, 9 aa, Homo Sapiens
STTLRSIQP

SEQ ID NO: 499804 - protein, 9 aa, Homo Sapiens
HRYRHPRHI

SEQ ID NO: 499805 - protein, 9 aa, Homo Sapiens
HTVVLTENG

SEQ ID NO: 499806 - protein, 9 aa, Homo Sapiens
VVLTENGCV

SEQ ID NO: 499807 - protein, 9 aa, Homo Sapiens
LTITLYNGS

SEQ ID NO: 499808 - protein, 9 aa, Homo Sapiens
DPSDKPIAE

SEQ ID NO: 499809 - protein, 9 aa, Homo Sapiens
LMTTAAQNG

SEQ ID NO: 499810 - protein, 9 aa, Homo Sapiens
DGIPVAGKP

SEQ ID NO: 499811 - protein, 9 aa, Homo Sapiens
RHIHKLLAQ

SEQ ID NO: 499812 - protein, 9 aa, Homo Sapiens
PGMRVAFCY

SEQ ID NO: 499813 - protein, 9 aa, Homo Sapiens
RVILKTLKP

SEQ ID NO: 499814 - protein, 9 aa, Homo Sapiens
IIIANNDAF

SEQ ID NO: 499815 - protein, 9 aa, Homo Sapiens
HSQSLSIRV

SEQ ID NO: 499816 - protein, 9 aa, Homo Sapiens
VDVYNEGSY

SEQ ID NO: 499817 - protein, 9 aa, Homo Sapiens
RGDEDNKLL

SEQ ID NO: 499818 - protein, 9 aa, Homo Sapiens
QNKRKKPPV

SEQ ID NO: 499819 - protein, 9 aa, Homo Sapiens
ALSTVREQS

SEQ ID NO: 499820 - protein, 9 aa, Homo Sapiens
SIGTSPQNF

SEQ ID NO: 499821 - protein, 9 aa, Homo Sapiens
LDNPYLQLS

SEQ ID NO: 499822 - protein, 9 aa, Homo Sapiens
PRDLQSLSW

SEQ ID NO: 499823 - protein, 9 aa, Homo Sapiens
SWQSVLLSH

SEQ ID NO: 499824 - protein, 9 aa, Homo Sapiens
KDKLFRKKR

SEQ ID NO: 499825 - protein, 9 aa, Homo Sapiens
APSGLPFER

SEQ ID NO: 499826 - protein, 9 aa, Homo Sapiens
SVLLSHQRT

SEQ ID NO: 499827 - protein, 9 aa, Homo Sapiens
MTEDMMRDR

SEQ ID NO: 499828 - protein, 9 aa, Homo Sapiens
SAGDVAEQD

SEQ ID NO: 499829 - protein, 9 aa, Homo Sapiens
GEKASRETR

SEQ ID NO: 499830 - protein, 9 aa, Homo Sapiens
YSDVEHTLV

SEQ ID NO: 499831 - protein, 9 aa, Homo Sapiens
AQNGHVLLT

SEQ ID NO: 499832 - protein, 9 aa, Homo Sapiens
SKLERAITR

SEQ ID NO: 499833 - protein, 9 aa, Homo Sapiens
TSNLVAACL

SEQ ID NO: 499834 - protein, 9 aa, Homo Sapiens
LATQDLKLL

SEQ ID NO: 499835 - protein, 9 aa, Homo Sapiens
GSRVKNLVL

SEQ ID NO: 499836 - protein, 9 aa, Homo Sapiens
QSLSIRVLR

SEQ ID NO: 499837 - protein, 9 aa, Homo Sapiens
NQGWSSAKN

SEQ ID NO: 499838 - protein, 9 aa, Homo Sapiens
LAFSFLVEQ

SEQ ID NO: 499839 - protein, 9 aa, Homo Sapiens
KDWILAYSQ

SEQ ID NO: 499840 - protein, 9 aa, Homo Sapiens
CVRFSPHGE

SEQ ID NO: 499841 - protein, 9 aa, Homo Sapiens
YETVCKHQD

SEQ ID NO: 499842 - protein, 9 aa, Homo Sapiens
TGTNLHRDM

SEQ ID NO: 499843 - protein, 9 aa, Homo Sapiens
TLSGTKCLC

SEQ ID NO: 499844 - protein, 9 aa, Homo Sapiens
KKGIVKQDS

SEQ ID NO: 499845 - protein, 9 aa, Homo Sapiens
LGASSGAAQ

SEQ ID NO: 499846 - protein, 9 aa, Homo Sapiens
DMGLQKQYR

SEQ ID NO: 499847 - protein, 9 aa, Homo Sapiens
SCWPDPSHN

SEQ ID NO: 499848 - protein, 9 aa, Homo Sapiens
LCAMYVPIC

SEQ ID NO: 499849 - protein, 9 aa, Homo Sapiens
VQDNPKALV

SEQ ID NO: 499850 - protein, 9 aa, Homo Sapiens
LISNDLRSV

SEQ ID NO: 499851 - protein, 9 aa, Homo Sapiens
HRSLRKVPW

SEQ ID NO: 499852 - protein, 9 aa, Homo Sapiens
TTSDDDLPR

SEQ ID NO: 499853 - protein, 9 aa, Homo Sapiens
ACDDGGLIP

SEQ ID NO: 499854 - protein, 9 aa, Homo Sapiens
REQQRRQQR

SEQ ID NO: 499855 - protein, 9 aa, Homo Sapiens
PAAEGQSYS

SEQ ID NO: 499856 - protein, 9 aa, Homo Sapiens
DGKLKDPRK

SEQ ID NO: 499857 - protein, 9 aa, Homo Sapiens
AFSTCATHL

SEQ ID NO: 499858 - protein, 9 aa, Homo Sapiens
ALSRFQGMR

SEQ ID NO: 499859 - protein, 9 aa, Homo Sapiens
HTKPNRFKE

SEQ ID NO: 499860 - protein, 9 aa, Homo Sapiens
KYAWFFFQL

SEQ ID NO: 499861 - protein, 9 aa, Homo Sapiens
AEEIMLHYA

SEQ ID NO: 499862 - protein, 9 aa, Homo Sapiens
LTHMYFKNK

SEQ ID NO: 499863 - protein, 9 aa, Homo Sapiens
LTGSSGFIF

SEQ ID NO: 499864 - protein, 9 aa, Homo Sapiens
NIQEIQTCQ

SEQ ID NO: 499865 - protein, 9 aa, Homo Sapiens
SNDIRVAIS

SEQ ID NO: 499866 - protein, 9 aa, Homo Sapiens
MGFEQQVLD

SEQ ID NO: 499867 - protein, 9 aa, Homo Sapiens
SSGSLFCVI

SEQ ID NO: 499868 - protein, 9 aa, Homo Sapiens
LDLMTTAAQ

SEQ ID NO: 499869 - protein, 9 aa, Homo Sapiens
LSEITKQEK

SEQ ID NO: 499870 - protein, 9 aa, Homo Sapiens
FSHMPGESC

SEQ ID NO: 499871 - protein, 9 aa, Homo Sapiens
QPNQGWSSA

SEQ ID NO: 499872 - protein, 9 aa, Homo Sapiens
FTLRPGMRV

SEQ ID NO: 499873 - protein, 9 aa, Homo Sapiens
QLDQQAFSV

SEQ ID NO: 499874 - protein, 9 aa, Homo Sapiens
CATHLTSVT

SEQ ID NO: 499875 - protein, 9 aa, Homo Sapiens
EGAHPGWDR

SEQ ID NO: 499876 - protein, 9 aa, Homo Sapiens
LGVVLHKDF

SEQ ID NO: 499877 - protein, 9 aa, Homo Sapiens
FRGLSQAFQ

SEQ ID NO: 499878 - protein, 9 aa, Homo Sapiens
RYDLFSRVV

SEQ ID NO: 499879 - protein, 9 aa, Homo Sapiens
IQKVDVYNE

SEQ ID NO: 499880 - protein, 9 aa, Homo Sapiens
TKLGLQKAH

SEQ ID NO: 499881 - protein, 9 aa, Homo Sapiens
TAVYTSLGN

SEQ ID NO: 499882 - protein, 9 aa, Homo Sapiens
GGAAEQAEI

SEQ ID NO: 499883 - protein, 9 aa, Homo Sapiens
QIHDRVENY

SEQ ID NO: 499884 - protein, 9 aa, Homo Sapiens
MAKNGESSG

SEQ ID NO: 499885 - protein, 9 aa, Homo Sapiens
LQWAKSPPA

SEQ ID NO: 499886 - protein, 9 aa, Homo Sapiens
DHTVVLTEN

SEQ ID NO: 499887 - protein, 9 aa, Homo Sapiens
HIDHGKPVK

SEQ ID NO: 499888 - protein, 9 aa, Homo Sapiens
HKDFKWYQQ

SEQ ID NO: 499889 - protein, 9 aa, Homo Sapiens
RFKEVVWSK

SEQ ID NO: 499890 - protein, 9 aa, Homo Sapiens
ILHIDHGKP

SEQ ID NO: 499891 - protein, 9 aa, Homo Sapiens
LRTPPYQEP

SEQ ID NO: 499892 - protein, 9 aa, Homo Sapiens
SKMLSLSAI

SEQ ID NO: 499893 - protein, 9 aa, Homo Sapiens
KVLCVFKDL

SEQ ID NO: 499894 - protein, 9 aa, Homo Sapiens
LSLEADKCG

SEQ ID NO: 499895 - protein, 9 aa, Homo Sapiens
GFEQQVLDI

SEQ ID NO: 499896 - protein, 9 aa, Homo Sapiens
IYQRVHTGE

SEQ ID NO: 499897 - protein, 9 aa, Homo Sapiens
ITLRDDFDS

SEQ ID NO: 499898 - protein, 9 aa, Homo Sapiens
QSSTVSRAP

SEQ ID NO: 499899 - protein, 9 aa, Homo Sapiens
KFRPALDNP

SEQ ID NO: 499900 - protein, 9 aa, Homo Sapiens
CDKKRGASS

SEQ ID NO: 499901 - protein, 9 aa, Homo Sapiens
VCFCFRSYV

SEQ ID NO: 499902 - protein, 9 aa, Homo Sapiens
PGSPDALPA

SEQ ID NO: 499903 - protein, 9 aa, Homo Sapiens
FDNAAQPYL

SEQ ID NO: 499904 - protein, 9 aa, Homo Sapiens
LDFLFNEEI

SEQ ID NO: 499905 - protein, 9 aa, Homo Sapiens
GLTLSWIRD

SEQ ID NO: 499906 - protein, 9 aa, Homo Sapiens
DVYNEGSYT

SEQ ID NO: 499907 - protein, 9 aa, Homo Sapiens
EEQAKREET

SEQ ID NO: 499908 - protein, 9 aa, Homo Sapiens
SSAKNGWGE

SEQ ID NO: 499909 - protein, 9 aa, Homo Sapiens
VMDKFYFKE

SEQ ID NO: 499910 - protein, 9 aa, Homo Sapiens
ENMQPQTRR

SEQ ID NO: 499911 - protein, 9 aa, Homo Sapiens
EKEDDEQTL

SEQ ID NO: 499912 - protein, 9 aa, Homo Sapiens
EAWRHVVKD

SEQ ID NO: 499913 - protein, 9 aa, Homo Sapiens
WKPQAVERH

SEQ ID NO: 499914 - protein, 9 aa, Homo Sapiens
LKPKDVDAT

SEQ ID NO: 499915 - protein, 9 aa, Homo Sapiens
AWFFFQLLV

SEQ ID NO: 499916 - protein, 9 aa, Homo Sapiens
EDNKLLLCD

SEQ ID NO: 499917 - protein, 9 aa, Homo Sapiens
YFKNKKVSY

SEQ ID NO: 499918 - protein, 9 aa, Homo Sapiens
AGSTMNFFQ

SEQ ID NO: 499919 - protein, 9 aa, Homo Sapiens
KPAPSGLPF

SEQ ID NO: 499920 - protein, 9 aa, Homo Sapiens
EQQVLDILE

SEQ ID NO: 499921 - protein, 9 aa, Homo Sapiens
SNLVAACLQ

SEQ ID NO: 499922 - protein, 9 aa, Homo Sapiens
CSNKSPMVP

SEQ ID NO: 499923 - protein, 9 aa, Homo Sapiens
DNAGLETPL

SEQ ID NO: 499924 - protein, 9 aa, Homo Sapiens
PCGVVVTLR

SEQ ID NO: 499925 - protein, 9 aa, Homo Sapiens
QMKAMGIET

SEQ ID NO: 499926 - protein, 9 aa, Homo Sapiens
ETLGDHSKL

SEQ ID NO: 499927 - protein, 9 aa, Homo Sapiens
TSDDDLPRD

SEQ ID NO: 499928 - protein, 9 aa, Homo Sapiens
GWSSAKNGW

SEQ ID NO: 499929 - protein, 9 aa, Homo Sapiens
GPSIPNAYS

SEQ ID NO: 499930 - protein, 9 aa, Homo Sapiens
SSSTSRDSR

SEQ ID NO: 499931 - protein, 9 aa, Homo Sapiens
QLTSGLWGN

SEQ ID NO: 499932 - protein, 9 aa, Homo Sapiens
YVPICTLEF

SEQ ID NO: 499933 - protein, 9 aa, Homo Sapiens
DFQEQILEA

SEQ ID NO: 499934 - protein, 9 aa, Homo Sapiens
VKNLVLTYV

SEQ ID NO: 499935 - protein, 9 aa, Homo Sapiens
TVVLTENGC

SEQ ID NO: 499936 - protein, 9 aa, Homo Sapiens
TIGGFHHER

SEQ ID NO: 499937 - protein, 9 aa, Homo Sapiens
GNIQEIQTC

SEQ ID NO: 499938 - protein, 9 aa, Homo Sapiens
VHLEDSGIH

SEQ ID NO: 499939 - protein, 9 aa, Homo Sapiens
LVSPANGKG

SEQ ID NO: 499940 - protein, 9 aa, Homo Sapiens
QGIYLKNIQ

SEQ ID NO: 499941 - protein, 9 aa, Homo Sapiens
LSCRLQEAL

SEQ ID NO: 499942 - protein, 9 aa, Homo Sapiens
CHVRVASFY

SEQ ID NO: 499943 - protein, 9 aa, Homo Sapiens
IPGLWPGER

SEQ ID NO: 499944 - protein, 9 aa, Homo Sapiens
TNGPEKLAA

SEQ ID NO: 499945 - protein, 9 aa, Homo Sapiens
PEKLAAPSP

SEQ ID NO: 499946 - protein, 9 aa, Homo Sapiens
VEEEHYCNM

SEQ ID NO: 499947 - protein, 9 aa, Homo Sapiens
TLTGKIAQV

SEQ ID NO: 499948 - protein, 9 aa, Homo Sapiens
NILSELQRD

SEQ ID NO: 499949 - protein, 9 aa, Homo Sapiens
PACSPSKAA

SEQ ID NO: 499950 - protein, 9 aa, Homo Sapiens
KETTHHDAL

SEQ ID NO: 499951 - protein, 9 aa, Homo Sapiens
AQKNTELEE

SEQ ID NO: 499952 - protein, 9 aa, Homo Sapiens
RSKPESDGS

SEQ ID NO: 499953 - protein, 9 aa, Homo Sapiens
QRQSDEYSS

SEQ ID NO: 499954 - protein, 9 aa, Homo Sapiens
ICRYKDYRQ

SEQ ID NO: 499955 - protein, 9 aa, Homo Sapiens
SSATLNYQG

SEQ ID NO: 499956 - protein, 9 aa, Homo Sapiens
LQEYMALMI

SEQ ID NO: 499957 - protein, 9 aa, Homo Sapiens
HIEQLLAKR

SEQ ID NO: 499958 - protein, 9 aa, Homo Sapiens
VSFDPLLIT

SEQ ID NO: 499959 - protein, 9 aa, Homo Sapiens
GNGHCVESS

SEQ ID NO: 499960 - protein, 9 aa, Homo Sapiens
EINKYLMGK

SEQ ID NO: 499961 - protein, 9 aa, Homo Sapiens
YCNMLCCKF

SEQ ID NO: 499962 - protein, 9 aa, Homo Sapiens
LVDSAAVSE

SEQ ID NO: 499963 - protein, 9 aa, Homo Sapiens
GEAGTRGPK

SEQ ID NO: 499964 - protein, 9 aa, Homo Sapiens
QAHITRAPH

SEQ ID NO: 499965 - protein, 9 aa, Homo Sapiens
ECKDLIKLM

SEQ ID NO: 499966 - protein, 9 aa, Homo Sapiens
GDLKSRWNS

SEQ ID NO: 499967 - protein, 9 aa, Homo Sapiens
QLFTAWKLQ

SEQ ID NO: 499968 - protein, 9 aa, Homo Sapiens
RTELSEENM

SEQ ID NO: 499969 - protein, 9 aa, Homo Sapiens
IRIMRVLCI

SEQ ID NO: 499970 - protein, 9 aa, Homo Sapiens
STVCHRPEV

SEQ ID NO: 499971 - protein, 9 aa, Homo Sapiens
VGSQMVRSQ

SEQ ID NO: 499972 - protein, 9 aa, Homo Sapiens
HEMIQQTLN

SEQ ID NO: 499973 - protein, 9 aa, Homo Sapiens
NPKQRLGGG

SEQ ID NO: 499974 - protein, 9 aa, Homo Sapiens
ARLVDPGFG

SEQ ID NO: 499975 - protein, 9 aa, Homo Sapiens
LLIVLLLTI

SEQ ID NO: 499976 - protein, 9 aa, Homo Sapiens
DKKVPGKMY

SEQ ID NO: 499977 - protein, 9 aa, Homo Sapiens
KIRIDLASM

SEQ ID NO: 499978 - protein, 9 aa, Homo Sapiens
KWIVHGYVR

SEQ ID NO: 499979 - protein, 9 aa, Homo Sapiens
QSQVVTRPC

SEQ ID NO: 499980 - protein, 9 aa, Homo Sapiens
IPTSLAKCS

SEQ ID NO: 499981 - protein, 9 aa, Homo Sapiens
SEQEQPQGL

SEQ ID NO: 499982 - protein, 9 aa, Homo Sapiens
PGITIPDSQ

SEQ ID NO: 499983 - protein, 9 aa, Homo Sapiens
CSSTQWPKI

SEQ ID NO: 499984 - protein, 9 aa, Homo Sapiens
KWAFSMYNL

SEQ ID NO: 499985 - protein, 9 aa, Homo Sapiens
EKRAADYKI

SEQ ID NO: 499986 - protein, 9 aa, Homo Sapiens
GQVMNYKGD

SEQ ID NO: 499987 - protein, 9 aa, Homo Sapiens
LVDPGFGIY

SEQ ID NO: 499988 - protein, 9 aa, Homo Sapiens
KWNTKRIGS

SEQ ID NO: 499989 - protein, 9 aa, Homo Sapiens
DLVKGKRRD

SEQ ID NO: 499990 - protein, 9 aa, Homo Sapiens
SSEQEQPQG

SEQ ID NO: 499991 - protein, 9 aa, Homo Sapiens
KEAAQKRKE

SEQ ID NO: 499992 - protein, 9 aa, Homo Sapiens
LTITNCMLL

SEQ ID NO: 499993 - protein, 9 aa, Homo Sapiens
AFSMYNLDG

SEQ ID NO: 499994 - protein, 9 aa, Homo Sapiens
KKKTVGNDE

SEQ ID NO: 499995 - protein, 9 aa, Homo Sapiens
HSMAHQDLH

SEQ ID NO: 499996 - protein, 9 aa, Homo Sapiens
ILSCRLQEA

SEQ ID NO: 499997 - protein, 9 aa, Homo Sapiens
AWMAALVEA

SEQ ID NO: 499998 - protein, 9 aa, Homo Sapiens
PLKREPCKI

SEQ ID NO: 499999 - protein, 9 aa, Homo Sapiens
EEMNVGSQM

SEQ ID NO: 500000 - protein, 9 aa, Homo Sapiens
VQAVDKKWI

SEQ ID NO: 500001 - protein, 9 aa, Homo Sapiens
IHHTGEKPY

SEQ ID NO: 500002 - protein, 9 aa, Homo Sapiens
MKKQSDLVK

SEQ ID NO: 500003 - protein, 9 aa, Homo Sapiens
CGPVHGLIK

SEQ ID NO: 500004 - protein, 9 aa, Homo Sapiens
SALCHPPGA

SEQ ID NO: 500005 - protein, 9 aa, Homo Sapiens
DIIDIDYFK

SEQ ID NO: 500006 - protein, 9 aa, Homo Sapiens
WRKDAGFLL

SEQ ID NO: 500007 - protein, 9 aa, Homo Sapiens
LLASAEFQP

SEQ ID NO: 500008 - protein, 9 aa, Homo Sapiens
YIPNEVSES

SEQ ID NO: 500009 - protein, 9 aa, Homo Sapiens
SSPKKSCNK

SEQ ID NO: 500010 - protein, 9 aa, Homo Sapiens
DNEVPPPVS

SEQ ID NO: 500011 - protein, 9 aa, Homo Sapiens
SKVSYEIQK

SEQ ID NO: 500012 - protein, 9 aa, Homo Sapiens
EYMALMISR

SEQ ID NO: 500013 - protein, 9 aa, Homo Sapiens
KNPKQRLGG

SEQ ID NO: 500014 - protein, 9 aa, Homo Sapiens
PINMKTYRR

SEQ ID NO: 500015 - protein, 9 aa, Homo Sapiens
SQGQSQPLA

SEQ ID NO: 500016 - protein, 9 aa, Homo Sapiens
ACSSTQWPK

SEQ ID NO: 500017 - protein, 9 aa, Homo Sapiens
RAQPNGTPS

SEQ ID NO: 500018 - protein, 9 aa, Homo Sapiens
TCEVLVYFL

SEQ ID NO: 500019 - protein, 9 aa, Homo Sapiens
KKLHECNTQ

SEQ ID NO: 500020 - protein, 9 aa, Homo Sapiens
EGRPHGRGT

SEQ ID NO: 500021 - protein, 9 aa, Homo Sapiens
GLLEEMRNE

SEQ ID NO: 500022 - protein, 9 aa, Homo Sapiens
AGPMPPLIR

SEQ ID NO: 500023 - protein, 9 aa, Homo Sapiens
AGLLREWYM

SEQ ID NO: 500024 - protein, 9 aa, Homo Sapiens
NKDYPLFRE

SEQ ID NO: 500025 - protein, 9 aa, Homo Sapiens
AIPTSLAKC

SEQ ID NO: 500026 - protein, 9 aa, Homo Sapiens
DPVIGPVTI

SEQ ID NO: 500027 - protein, 9 aa, Homo Sapiens
QNYVADIEV

SEQ ID NO: 500028 - protein, 9 aa, Homo Sapiens
CPPHHLPTL

SEQ ID NO: 500029 - protein, 9 aa, Homo Sapiens
LRAKFQEYG

SEQ ID NO: 500030 - protein, 9 aa, Homo Sapiens
EKLAAPSPA

SEQ ID NO: 500031 - protein, 9 aa, Homo Sapiens
EKTSRALED

SEQ ID NO: 500032 - protein, 9 aa, Homo Sapiens
RLEEEWGLA

SEQ ID NO: 500033 - protein, 9 aa, Homo Sapiens
IAVNTINRN

SEQ ID NO: 500034 - protein, 9 aa, Homo Sapiens
IDYFKGLDG

SEQ ID NO: 500035 - protein, 9 aa, Homo Sapiens
LKREPCKIS

SEQ ID NO: 500036 - protein, 9 aa, Homo Sapiens
QDAVPRTEL

SEQ ID NO: 500037 - protein, 9 aa, Homo Sapiens
HSQEAQTTA

SEQ ID NO: 500038 - protein, 9 aa, Homo Sapiens
GDKPSLLAR

SEQ ID NO: 500039 - protein, 9 aa, Homo Sapiens
PAPITLREL

SEQ ID NO: 500040 - protein, 9 aa, Homo Sapiens
HHLPTLRKT

SEQ ID NO: 500041 - protein, 9 aa, Homo Sapiens
MFCGRGNNK

SEQ ID NO: 500042 - protein, 9 aa, Homo Sapiens
RYKDYRQPP

SEQ ID NO: 500043 - protein, 9 aa, Homo Sapiens
LGMSILQRI

SEQ ID NO: 500044 - protein, 9 aa, Homo Sapiens
GQSQPLAPT

SEQ ID NO: 500045 - protein, 9 aa, Homo Sapiens
DKVHNELKN

SEQ ID NO: 500046 - protein, 9 aa, Homo Sapiens
PTVFQNYVA

SEQ ID NO: 500047 - protein, 9 aa, Homo Sapiens
TVEWSARSE

SEQ ID NO: 500048 - protein, 9 aa, Homo Sapiens
KLEHRLEEV

SEQ ID NO: 500049 - protein, 9 aa, Homo Sapiens
AKHTIHHTG

SEQ ID NO: 500050 - protein, 9 aa, Homo Sapiens
LKLGQEFEE

SEQ ID NO: 500051 - protein, 9 aa, Homo Sapiens
RPSVLLLPM

SEQ ID NO: 500052 - protein, 9 aa, Homo Sapiens
PLTVEWSAR

SEQ ID NO: 500053 - protein, 9 aa, Homo Sapiens
ACSPSKAAV

SEQ ID NO: 500054 - protein, 9 aa, Homo Sapiens
IGSISFDFR

SEQ ID NO: 500055 - protein, 9 aa, Homo Sapiens
YDGTLRIVK

SEQ ID NO: 500056 - protein, 9 aa, Homo Sapiens
RCPGGTLVA

SEQ ID NO: 500057 - protein, 9 aa, Homo Sapiens
HWQDAVPRT

SEQ ID NO: 500058 - protein, 9 aa, Homo Sapiens
MGRNTSWGT

SEQ ID NO: 500059 - protein, 9 aa, Homo Sapiens
VQLPSPACS

SEQ ID NO: 500060 - protein, 9 aa, Homo Sapiens
FREFLRTEL

SEQ ID NO: 500061 - protein, 9 aa, Homo Sapiens
VRNHNGKNY

SEQ ID NO: 500062 - protein, 9 aa, Homo Sapiens
LSVGISIFF

SEQ ID NO: 500063 - protein, 9 aa, Homo Sapiens
IQLSEVDKS

SEQ ID NO: 500064 - protein, 9 aa, Homo Sapiens
PPARAQPNG

SEQ ID NO: 500065 - protein, 9 aa, Homo Sapiens
DRHSQEAQT

SEQ ID NO: 500066 - protein, 9 aa, Homo Sapiens
NEVPPPVSA

SEQ ID NO: 500067 - protein, 9 aa, Homo Sapiens
ALQYAGKHM

SEQ ID NO: 500068 - protein, 9 aa, Homo Sapiens
GKKLKKMVT

SEQ ID NO: 500069 - protein, 9 aa, Homo Sapiens
FPTHYPASF

SEQ ID NO: 500070 - protein, 9 aa, Homo Sapiens
RHVETNQQF

SEQ ID NO: 500071 - protein, 9 aa, Homo Sapiens
TCAYYMYLL

SEQ ID NO: 500072 - protein, 9 aa, Homo Sapiens
PMNLRVYSP

SEQ ID NO: 500073 - protein, 9 aa, Homo Sapiens
KIAQVVVST

SEQ ID NO: 500074 - protein, 9 aa, Homo Sapiens
ISNSESSAT

SEQ ID NO: 500075 - protein, 9 aa, Homo Sapiens
QIVSYKIIG

SEQ ID NO: 500076 - protein, 9 aa, Homo Sapiens
QGELSGDFE

SEQ ID NO: 500077 - protein, 9 aa, Homo Sapiens
GSSTDYDSE

SEQ ID NO: 500078 - protein, 9 aa, Homo Sapiens
PSNIKLQIP

SEQ ID NO: 500079 - protein, 9 aa, Homo Sapiens
AQDEKKTLN

SEQ ID NO: 500080 - protein, 9 aa, Homo Sapiens
LNLFSTKDS

SEQ ID NO: 500081 - protein, 9 aa, Homo Sapiens
EKHSMAHQD

SEQ ID NO: 500082 - protein, 9 aa, Homo Sapiens
PLLPMASGL

SEQ ID NO: 500083 - protein, 9 aa, Homo Sapiens
EGMSKRNRK

SEQ ID NO: 500084 - protein, 9 aa, Homo Sapiens
ASCRISNLL

SEQ ID NO: 500085 - protein, 9 aa, Homo Sapiens
SELQRDLNE

SEQ ID NO: 500086 - protein, 9 aa, Homo Sapiens
QLGRCPGGT

SEQ ID NO: 500087 - protein, 9 aa, Homo Sapiens
ITLKMEIAG

SEQ ID NO: 500088 - protein, 9 aa, Homo Sapiens
LKMEIAGPM

SEQ ID NO: 500089 - protein, 9 aa, Homo Sapiens
GGPDNKDYP

SEQ ID NO: 500090 - protein, 9 aa, Homo Sapiens
KPPTELEPQ

SEQ ID NO: 500091 - protein, 9 aa, Homo Sapiens
GHCVESSDQ

SEQ ID NO: 500092 - protein, 9 aa, Homo Sapiens
ESVSFDPLL

SEQ ID NO: 500093 - protein, 9 aa, Homo Sapiens
PRITNGPEK

SEQ ID NO: 500094 - protein, 9 aa, Homo Sapiens
YFSVESKTG

SEQ ID NO: 500095 - protein, 9 aa, Homo Sapiens
QLKQAEELW

SEQ ID NO: 500096 - protein, 9 aa, Homo Sapiens
PVPGPAPSP

SEQ ID NO: 500097 - protein, 9 aa, Homo Sapiens
YKVRAYIPN

SEQ ID NO: 500098 - protein, 9 aa, Homo Sapiens
IIRIMRVLC

SEQ ID NO: 500099 - protein, 9 aa, Homo Sapiens
MNVGSQMVR

SEQ ID NO: 500100 - protein, 9 aa, Homo Sapiens
SGGPDNKDY

SEQ ID NO: 500101 - protein, 9 aa, Homo Sapiens
SKAFAAQPV

SEQ ID NO: 500102 - protein, 9 aa, Homo Sapiens
NGSLLDFLK

SEQ ID NO: 500103 - protein, 9 aa, Homo Sapiens
VPFHDPVIG

SEQ ID NO: 500104 - protein, 9 aa, Homo Sapiens
GNATIILQD

SEQ ID NO: 500105 - protein, 9 aa, Homo Sapiens
SPACSSTQW

SEQ ID NO: 500106 - protein, 9 aa, Homo Sapiens
DYDSEQEAH

SEQ ID NO: 500107 - protein, 9 aa, Homo Sapiens
TEQLADGQV

SEQ ID NO: 500108 - protein, 9 aa, Homo Sapiens
LLAKRDLER

SEQ ID NO: 500109 - protein, 9 aa, Homo Sapiens
KLLAKDVPD

SEQ ID NO: 500110 - protein, 9 aa, Homo Sapiens
PVPMNLRVY

SEQ ID NO: 500111 - protein, 9 aa, Homo Sapiens
ESGMEDCVM

SEQ ID NO: 500112 - protein, 9 aa, Homo Sapiens
VAFGAGTHC

SEQ ID NO: 500113 - protein, 9 aa, Homo Sapiens
WAFSMYNLD

SEQ ID NO: 500114 - protein, 9 aa, Homo Sapiens
TEYMNNGSL

SEQ ID NO: 500115 - protein, 9 aa, Homo Sapiens
VEKSIINAC

SEQ ID NO: 500116 - protein, 9 aa, Homo Sapiens
SKPESDGSE

SEQ ID NO: 500117 - protein, 9 aa, Homo Sapiens
GEEGQDAGL

SEQ ID NO: 500118 - protein, 9 aa, Homo Sapiens
DAGLLREWY

SEQ ID NO: 500119 - protein, 9 aa, Homo Sapiens
AAKLLAKDV

SEQ ID NO: 500120 - protein, 9 aa, Homo Sapiens
SIGKAVPQP

SEQ ID NO: 500121 - protein, 9 aa, Homo Sapiens
PQPEIEGLL

SEQ ID NO: 500122 - protein, 9 aa, Homo Sapiens
TGDAEQPRE

SEQ ID NO: 500123 - protein, 9 aa, Homo Sapiens
IQKGSVAHR

SEQ ID NO: 500124 - protein, 9 aa, Homo Sapiens
KKLEHRLEE

SEQ ID NO: 500125 - protein, 9 aa, Homo Sapiens
LAGLLKKNP

SEQ ID NO: 500126 - protein, 9 aa, Homo Sapiens
IIDIDYFKG

SEQ ID NO: 500127 - protein, 9 aa, Homo Sapiens
ISDFENRSK

SEQ ID NO: 500128 - protein, 9 aa, Homo Sapiens
FENRSKPES

SEQ ID NO: 500129 - protein, 9 aa, Homo Sapiens
PTPVEFMGY

SEQ ID NO: 500130 - protein, 9 aa, Homo Sapiens
IMELRSRVF

SEQ ID NO: 500131 - protein, 9 aa, Homo Sapiens
LLQLTNTCA

SEQ ID NO: 500132 - protein, 9 aa, Homo Sapiens
TVFQNYVAD

SEQ ID NO: 500133 - protein, 9 aa, Homo Sapiens
VIPETSSHY

SEQ ID NO: 500134 - protein, 9 aa, Homo Sapiens
SPSDKVHNE

SEQ ID NO: 500135 - protein, 9 aa, Homo Sapiens
GSRASTQRR

SEQ ID NO: 500136 - protein, 9 aa, Homo Sapiens
AEINKYLMG

SEQ ID NO: 500137 - protein, 9 aa, Homo Sapiens
RITNGPEKL

SEQ ID NO: 500138 - protein, 9 aa, Homo Sapiens
GPVPGPAPS

SEQ ID NO: 500139 - protein, 9 aa, Homo Sapiens
RKDAGFLLY

SEQ ID NO: 500140 - protein, 9 aa, Homo Sapiens
GQVGRGLPV

SEQ ID NO: 500141 - protein, 9 aa, Homo Sapiens
PSCPPHHLP

SEQ ID NO: 500142 - protein, 9 aa, Homo Sapiens
IPQSAADIG

SEQ ID NO: 500143 - protein, 9 aa, Homo Sapiens
STQRRNDSI

SEQ ID NO: 500144 - protein, 9 aa, Homo Sapiens
IVLLLTILF

SEQ ID NO: 500145 - protein, 9 aa, Homo Sapiens
HGRGTPSSL

SEQ ID NO: 500146 - protein, 9 aa, Homo Sapiens
LADGQVGRG

SEQ ID NO: 500147 - protein, 9 aa, Homo Sapiens
VGILSCRLQ

SEQ ID NO: 500148 - protein, 9 aa, Homo Sapiens
SFPLLPMAS

SEQ ID NO: 500149 - protein, 9 aa, Homo Sapiens
ADGQVGRGL

SEQ ID NO: 500150 - protein, 9 aa, Homo Sapiens
EVGTVPTPV

SEQ ID NO: 500151 - protein, 9 aa, Homo Sapiens
ETNQQFEKD

SEQ ID NO: 500152 - protein, 9 aa, Homo Sapiens
LGRCPGGTL

SEQ ID NO: 500153 - protein, 9 aa, Homo Sapiens
KQHEDALHG

SEQ ID NO: 500154 - protein, 9 aa, Homo Sapiens
TSWGTLGSG

SEQ ID NO: 500155 - protein, 9 aa, Homo Sapiens
TMLQSHKLD

SEQ ID NO: 500156 - protein, 9 aa, Homo Sapiens
LLYKDHLPV

SEQ ID NO: 500157 - protein, 9 aa, Homo Sapiens
PEEKHSMAH

SEQ ID NO: 500158 - protein, 9 aa, Homo Sapiens
PVIGPVTIT

SEQ ID NO: 500159 - protein, 9 aa, Homo Sapiens
LQHSPISSD

SEQ ID NO: 500160 - protein, 9 aa, Homo Sapiens
KPESDGSEF

SEQ ID NO: 500161 - protein, 9 aa, Homo Sapiens
PPSCPPHHL

SEQ ID NO: 500162 - protein, 9 aa, Homo Sapiens
FLCPLRMAA

SEQ ID NO: 500163 - protein, 9 aa, Homo Sapiens
NQQFEKDNN

SEQ ID NO: 500164 - protein, 9 aa, Homo Sapiens
QQSGLKKLG

SEQ ID NO: 500165 - protein, 9 aa, Homo Sapiens
LKKLGQLTT

SEQ ID NO: 500166 - protein, 9 aa, Homo Sapiens
QKGSVAHRD

SEQ ID NO: 500167 - protein, 9 aa, Homo Sapiens
GDPACSPSK

SEQ ID NO: 500168 - protein, 9 aa, Homo Sapiens
PPHHLPTLR

SEQ ID NO: 500169 - protein, 9 aa, Homo Sapiens
FIWKHLQWI

SEQ ID NO: 500170 - protein, 9 aa, Homo Sapiens
RSSSEEPAE

SEQ ID NO: 500171 - protein, 9 aa, Homo Sapiens
DKEWCYKRV

SEQ ID NO: 500172 - protein, 9 aa, Homo Sapiens
RGHPTPLKR

SEQ ID NO: 500173 - protein, 9 aa, Homo Sapiens
LGLKAVVGE

SEQ ID NO: 500174 - protein, 9 aa, Homo Sapiens
GNDESVPTG

SEQ ID NO: 500175 - protein, 9 aa, Homo Sapiens
GKAVPQPKM

SEQ ID NO: 500176 - protein, 9 aa, Homo Sapiens
ARPKQPSNI

SEQ ID NO: 500177 - protein, 9 aa, Homo Sapiens
RAYIPNEVS

SEQ ID NO: 500178 - protein, 9 aa, Homo Sapiens
EDIRHYLFR

SEQ ID NO: 500179 - protein, 9 aa, Homo Sapiens
LSGTQDCSL

SEQ ID NO: 500180 - protein, 9 aa, Homo Sapiens
SVLLLPMRR

SEQ ID NO: 500181 - protein, 9 aa, Homo Sapiens
GNEVYVWIC

SEQ ID NO: 500182 - protein, 9 aa, Homo Sapiens
KYLMGKFPF

SEQ ID NO: 500183 - protein, 9 aa, Homo Sapiens
GSVCSAETK

SEQ ID NO: 500184 - protein, 9 aa, Homo Sapiens
LKRSSSEEP

SEQ ID NO: 500185 - protein, 9 aa, Homo Sapiens
HTEGVTVVW

SEQ ID NO: 500186 - protein, 9 aa, Homo Sapiens
RRFVRGPWP

SEQ ID NO: 500187 - protein, 9 aa, Homo Sapiens
FTLMTFLDR

SEQ ID NO: 500188 - protein, 9 aa, Homo Sapiens
NDESVPTGY

SEQ ID NO: 500189 - protein, 9 aa, Homo Sapiens
SMAHTHGLP

SEQ ID NO: 500190 - protein, 9 aa, Homo Sapiens
TLNLFSTKD

SEQ ID NO: 500191 - protein, 9 aa, Homo Sapiens
GKIAQVVVS

SEQ ID NO: 500192 - protein, 9 aa, Homo Sapiens
ASPRESPLP

SEQ ID NO: 500193 - protein, 9 aa, Homo Sapiens
AIIRGMMDE

SEQ ID NO: 500194 - protein, 9 aa, Homo Sapiens
QLSEVDKSK

SEQ ID NO: 500195 - protein, 9 aa, Homo Sapiens
VVLHKCLGC

SEQ ID NO: 500196 - protein, 9 aa, Homo Sapiens
VYFLRRLGS

SEQ ID NO: 500197 - protein, 9 aa, Homo Sapiens
FHDPVIGPV

SEQ ID NO: 500198 - protein, 9 aa, Homo Sapiens
RLLQIVSYK

SEQ ID NO: 500199 - protein, 9 aa, Homo Sapiens
RKINEDINL

SEQ ID NO: 500200 - protein, 9 aa, Homo Sapiens
AFGAGTHCY

SEQ ID NO: 500201 - protein, 9 aa, Homo Sapiens
SDLVKGKRR

SEQ ID NO: 500202 - protein, 9 aa, Homo Sapiens
DNKDYPLFR

SEQ ID NO: 500203 - protein, 9 aa, Homo Sapiens
ACLILTSQR

SEQ ID NO: 500204 - protein, 9 aa, Homo Sapiens
KEKRQAAQN

SEQ ID NO: 500205 - protein, 9 aa, Homo Sapiens
PLCGWRKDE

SEQ ID NO: 500206 - protein, 9 aa, Homo Sapiens
ASGKLRLLQ

SEQ ID NO: 500207 - protein, 9 aa, Homo Sapiens
HLPTLRKTQ

SEQ ID NO: 500208 - protein, 9 aa, Homo Sapiens
LCIARVLKL

SEQ ID NO: 500209 - protein, 9 aa, Homo Sapiens
AEIQDKKEI

SEQ ID NO: 500210 - protein, 9 aa, Homo Sapiens
RGLGSSTDY

SEQ ID NO: 500211 - protein, 9 aa, Homo Sapiens
PTELEPQPE

SEQ ID NO: 500212 - protein, 9 aa, Homo Sapiens
ALEGMSKRN

SEQ ID NO: 500213 - protein, 9 aa, Homo Sapiens
ATCHVRVAS

SEQ ID NO: 500214 - protein, 9 aa, Homo Sapiens
EFQPVPSIV

SEQ ID NO: 500215 - protein, 9 aa, Homo Sapiens
NIKLQIPKP

SEQ ID NO: 500216 - protein, 9 aa, Homo Sapiens
QSTTPTFIL

SEQ ID NO: 500217 - protein, 9 aa, Homo Sapiens
RLVDSAAVS

SEQ ID NO: 500218 - protein, 9 aa, Homo Sapiens
KVVLHKCLG

SEQ ID NO: 500219 - protein, 9 aa, Homo Sapiens
EDVTNNWNW

SEQ ID NO: 500220 - protein, 9 aa, Homo Sapiens
GSDCSQSNA

SEQ ID NO: 500221 - protein, 9 aa, Homo Sapiens
STSARARLV

SEQ ID NO: 500222 - protein, 9 aa, Homo Sapiens
TRAPFEDVT

SEQ ID NO: 500223 - protein, 9 aa, Homo Sapiens
YRRNIRKFV

SEQ ID NO: 500224 - protein, 9 aa, Homo Sapiens
KKTVGNDES

SEQ ID NO: 500225 - protein, 9 aa, Homo Sapiens
DLIAHHAQK

SEQ ID NO: 500226 - protein, 9 aa, Homo Sapiens
NNFLCPLRM

SEQ ID NO: 500227 - protein, 9 aa, Homo Sapiens
LMAKVKDSL

SEQ ID NO: 500228 - protein, 9 aa, Homo Sapiens
SHYGNFDIL

SEQ ID NO: 500229 - protein, 9 aa, Homo Sapiens
WQDAVPRTE

SEQ ID NO: 500230 - protein, 9 aa, Homo Sapiens
VLLLTILFR

SEQ ID NO: 500231 - protein, 9 aa, Homo Sapiens
VNKKLEHRL

SEQ ID NO: 500232 - protein, 9 aa, Homo Sapiens
LQRDLNEFV

SEQ ID NO: 500233 - protein, 9 aa, Homo Sapiens
QMTKEKRQA

SEQ ID NO: 500234 - protein, 9 aa, Homo Sapiens
VMNYKGDII

SEQ ID NO: 500235 - protein, 9 aa, Homo Sapiens
MMSQAIIRG

SEQ ID NO: 500236 - protein, 9 aa, Homo Sapiens
YSRCIPGLW

SEQ ID NO: 500237 - protein, 9 aa, Homo Sapiens
KIKKTDVKE

SEQ ID NO: 500238 - protein, 9 aa, Homo Sapiens
KDYRQPPWS

SEQ ID NO: 500239 - protein, 9 aa, Homo Sapiens
DEYSSPELV

SEQ ID NO: 500240 - protein, 9 aa, Homo Sapiens
KEKTWLRAP

SEQ ID NO: 500241 - protein, 9 aa, Homo Sapiens
GDVGQMFSC

SEQ ID NO: 500242 - protein, 9 aa, Homo Sapiens
ELLASAEFQ

SEQ ID NO: 500243 - protein, 9 aa, Homo Sapiens
IVKVSREMS

SEQ ID NO: 500244 - protein, 9 aa, Homo Sapiens
YTVQTISLF

SEQ ID NO: 500245 - protein, 9 aa, Homo Sapiens
AAWMAALVE

SEQ ID NO: 500246 - protein, 9 aa, Homo Sapiens
QTPINMKTY

SEQ ID NO: 500247 - protein, 9 aa, Homo Sapiens
TGKIAQVVV

SEQ ID NO: 500248 - protein, 9 aa, Homo Sapiens
RFVRGPWPP

SEQ ID NO: 500249 - protein, 9 aa, Homo Sapiens
LEPQPEIEG

SEQ ID NO: 500250 - protein, 9 aa, Homo Sapiens
GVTVVWPLL

SEQ ID NO: 500251 - protein, 9 aa, Homo Sapiens
GTQDCSLQH

SEQ ID NO: 500252 - protein, 9 aa, Homo Sapiens
SYEIQKGQA

SEQ ID NO: 500253 - protein, 9 aa, Homo Sapiens
HKDLIPQSA

SEQ ID NO: 500254 - protein, 9 aa, Homo Sapiens
YRKINEDIN

SEQ ID NO: 500255 - protein, 9 aa, Homo Sapiens
PGPAPSPAA

SEQ ID NO: 500256 - protein, 9 aa, Homo Sapiens
VGQLFTAWK

SEQ ID NO: 500257 - protein, 9 aa, Homo Sapiens
WICDPVHFK

SEQ ID NO: 500258 - protein, 9 aa, Homo Sapiens
LQRIAGEED

SEQ ID NO: 500259 - protein, 9 aa, Homo Sapiens
HYCNMLCCK

SEQ ID NO: 500260 - protein, 9 aa, Homo Sapiens
HNTRAPFED

SEQ ID NO: 500261 - protein, 9 aa, Homo Sapiens
PQSAADIGQ

SEQ ID NO: 500262 - protein, 9 aa, Homo Sapiens
SWGQRGKYP

SEQ ID NO: 500263 - protein, 9 aa, Homo Sapiens
ELTGSDCSQ

SEQ ID NO: 500264 - protein, 9 aa, Homo Sapiens
NHNGKNYHS

SEQ ID NO: 500265 - protein, 9 aa, Homo Sapiens
KDAGFLLYK

SEQ ID NO: 500266 - protein, 9 aa, Homo Sapiens
FLRTELSEE

SEQ ID NO: 500267 - protein, 9 aa, Homo Sapiens
AQVQSLFSL

SEQ ID NO: 500268 - protein, 9 aa, Homo Sapiens
STLTGKIAQ

SEQ ID NO: 500269 - protein, 9 aa, Homo Sapiens
KRSSSEEPA

SEQ ID NO: 500270 - protein, 9 aa, Homo Sapiens
GDAEQPREP

SEQ ID NO: 500271 - protein, 9 aa, Homo Sapiens
KELRAKFQE

SEQ ID NO: 500272 - protein, 9 aa, Homo Sapiens
VAKVGQLFT

SEQ ID NO: 500273 - protein, 9 aa, Homo Sapiens
MAHTHGLPS

SEQ ID NO: 500274 - protein, 9 aa, Homo Sapiens
ETSSHYGNF

SEQ ID NO: 500275 - protein, 9 aa, Homo Sapiens
ELWQYKVLV

SEQ ID NO: 500276 - protein, 9 aa, Homo Sapiens
CPPESVSFD

SEQ ID NO: 500277 - protein, 9 aa, Homo Sapiens
KSIINACLI

SEQ ID NO: 500278 - protein, 9 aa, Homo Sapiens
QGLNEDIRH

SEQ ID NO: 500279 - protein, 9 aa, Homo Sapiens
MYNLDGNGY

SEQ ID NO: 500280 - protein, 9 aa, Homo Sapiens
ELSEENMLF

SEQ ID NO: 500281 - protein, 9 aa, Homo Sapiens
PEEWDKRAK

SEQ ID NO: 500282 - protein, 9 aa, Homo Sapiens
GKPIEASIQ

SEQ ID NO: 500283 - protein, 9 aa, Homo Sapiens
AIKSADNEV

SEQ ID NO: 500284 - protein, 9 aa, Homo Sapiens
HKCLGCIWG

SEQ ID NO: 500285 - protein, 9 aa, Homo Sapiens
KDLIKLMLR

SEQ ID NO: 500286 - protein, 9 aa, Homo Sapiens
KAQVQSLFS

SEQ ID NO: 500287 - protein, 9 aa, Homo Sapiens
VGQMFSCRL

SEQ ID NO: 500288 - protein, 9 aa, Homo Sapiens
LYGDLKSRW

SEQ ID NO: 500289 - protein, 9 aa, Homo Sapiens
PVFFYLPEF

SEQ ID NO: 500290 - protein, 9 aa, Homo Sapiens
HRPEVLEQL

SEQ ID NO: 500291 - protein, 9 aa, Homo Sapiens
FVRGPWPPN

SEQ ID NO: 500292 - protein, 9 aa, Homo Sapiens
QGPVFSQAA

SEQ ID NO: 500293 - protein, 9 aa, Homo Sapiens
KMEIAGPMP

SEQ ID NO: 500294 - protein, 9 aa, Homo Sapiens
NSFPLLPMA

SEQ ID NO: 500295 - protein, 9 aa, Homo Sapiens
YTLLVCMAP

SEQ ID NO: 500296 - protein, 9 aa, Homo Sapiens
DRGPAPLCG

SEQ ID NO: 500297 - protein, 9 aa, Homo Sapiens
MLRKEAAQK

SEQ ID NO: 500298 - protein, 9 aa, Homo Sapiens
VHNELKNLE

SEQ ID NO: 500299 - protein, 9 aa, Homo Sapiens
KVPGKMYSN

SEQ ID NO: 500300 - protein, 9 aa, Homo Sapiens
HECNTQFQE

SEQ ID NO: 500301 - protein, 9 aa, Homo Sapiens
TVCHRPEVL

SEQ ID NO: 500302 - protein, 9 aa, Homo Sapiens
HYPASFQVY

SEQ ID NO: 500303 - protein, 9 aa, Homo Sapiens
GQRGKYPPD

SEQ ID NO: 500304 - protein, 9 aa, Homo Sapiens
EMRNEKLVT

SEQ ID NO: 500305 - protein, 9 aa, Homo Sapiens
LHPDPFIWK

SEQ ID NO: 500306 - protein, 9 aa, Homo Sapiens
KKVPGKMYS

SEQ ID NO: 500307 - protein, 9 aa, Homo Sapiens
MAPLGLKAV

SEQ ID NO: 500308 - protein, 9 aa, Homo Sapiens
PLVRLQELC

SEQ ID NO: 500309 - protein, 9 aa, Homo Sapiens
DEKRAADYK

SEQ ID NO: 500310 - protein, 9 aa, Homo Sapiens
HPDPFIWKH

SEQ ID NO: 500311 - protein, 9 aa, Homo Sapiens
KQLDSRYYP

SEQ ID NO: 500312 - protein, 9 aa, Homo Sapiens
FEDVTNNWN

SEQ ID NO: 500313 - protein, 9 aa, Homo Sapiens
MEIAGPMPP

SEQ ID NO: 500314 - protein, 9 aa, Homo Sapiens
LCPLRMAAS

SEQ ID NO: 500315 - protein, 9 aa, Homo Sapiens
ILQRIAGEE

SEQ ID NO: 500316 - protein, 9 aa, Homo Sapiens
DLIPQSAAD

SEQ ID NO: 500317 - protein, 9 aa, Homo Sapiens
QVGRGLPVQ

SEQ ID NO: 500318 - protein, 9 aa, Homo Sapiens
LLAGLLKKN

SEQ ID NO: 500319 - protein, 9 aa, Homo Sapiens
LVKGKRRDD

SEQ ID NO: 500320 - protein, 9 aa, Homo Sapiens
MRSTLTGKI

SEQ ID NO: 500321 - protein, 9 aa, Homo Sapiens
ENRSKPESD

SEQ ID NO: 500322 - protein, 9 aa, Homo Sapiens
NAVGILSCR

SEQ ID NO: 500323 - protein, 9 aa, Homo Sapiens
NEVYVWICD

SEQ ID NO: 500324 - protein, 9 aa, Homo Sapiens
PFEDVTNNW

SEQ ID NO: 500325 - protein, 9 aa, Homo Sapiens
HAQKNTELE

SEQ ID NO: 500326 - protein, 9 aa, Homo Sapiens
KQMNDEKRA

SEQ ID NO: 500327 - protein, 9 aa, Homo Sapiens
SSTQWPKIK

SEQ ID NO: 500328 - protein, 9 aa, Homo Sapiens
CYQGFAFPW

SEQ ID NO: 500329 - protein, 9 aa, Homo Sapiens
CRLQEALAA

SEQ ID NO: 500330 - protein, 9 aa, Homo Sapiens
THCYAIWRY

SEQ ID NO: 500331 - protein, 9 aa, Homo Sapiens
MAHQDLHSE

SEQ ID NO: 500332 - protein, 9 aa, Homo Sapiens
LSEVDKSKE

SEQ ID NO: 500333 - protein, 9 aa, Homo Sapiens
CHPPGAPGP

SEQ ID NO: 500334 - protein, 9 aa, Homo Sapiens
AFSKAFAAQ

SEQ ID NO: 500335 - protein, 9 aa, Homo Sapiens
QYKVRAYIP

SEQ ID NO: 500336 - protein, 9 aa, Homo Sapiens
YKEGGGSAN

SEQ ID NO: 500337 - protein, 9 aa, Homo Sapiens
HNGKNYHSE

SEQ ID NO: 500338 - protein, 9 aa, Homo Sapiens
TILFRMQAQ

SEQ ID NO: 500339 - protein, 9 aa, Homo Sapiens
PGQQSGLKK

SEQ ID NO: 500340 - protein, 9 aa, Homo Sapiens
WIDPEQLSS

SEQ ID NO: 500341 - protein, 9 aa, Homo Sapiens
QLDSRYYPE

SEQ ID NO: 500342 - protein, 9 aa, Homo Sapiens
VVWPLLHEF

SEQ ID NO: 500343 - protein, 9 aa, Homo Sapiens
RIMRVLCIA

SEQ ID NO: 500344 - protein, 9 aa, Homo Sapiens
YMVRNHNGK

SEQ ID NO: 500345 - protein, 9 aa, Homo Sapiens
VLLLPMRRE

SEQ ID NO: 500346 - protein, 9 aa, Homo Sapiens
KSADNEVPP

SEQ ID NO: 500347 - protein, 9 aa, Homo Sapiens
MEEEEMNVG

SEQ ID NO: 500348 - protein, 9 aa, Homo Sapiens
PTPLKREPC

SEQ ID NO: 500349 - protein, 9 aa, Homo Sapiens
APITLRELI

SEQ ID NO: 500350 - protein, 9 aa, Homo Sapiens
RHGLNKSRI

SEQ ID NO: 500351 - protein, 9 aa, Homo Sapiens
ISSGQVMNY

SEQ ID NO: 500352 - protein, 9 aa, Homo Sapiens
SSPELVKMV

SEQ ID NO: 500353 - protein, 9 aa, Homo Sapiens
VPPARAQPN

SEQ ID NO: 500354 - protein, 9 aa, Homo Sapiens
PKQPSNIKL

SEQ ID NO: 500355 - protein, 9 aa, Homo Sapiens
ASIQGELSG

SEQ ID NO: 500356 - protein, 9 aa, Homo Sapiens
THTIDKEWC

SEQ ID NO: 500357 - protein, 9 aa, Homo Sapiens
GKKLHECNT

SEQ ID NO: 500358 - protein, 9 aa, Homo Sapiens
FTAWKLQLL

SEQ ID NO: 500359 - protein, 9 aa, Homo Sapiens
QIESSKGTY

SEQ ID NO: 500360 - protein, 9 aa, Homo Sapiens
KKSKRNMND

SEQ ID NO: 500361 - protein, 9 aa, Homo Sapiens
YLLYARLEE

SEQ ID NO: 500362 - protein, 9 aa, Homo Sapiens
NRRRLKGES

SEQ ID NO: 500363 - protein, 9 aa, Homo Sapiens
AYSRCIPGL

SEQ ID NO: 500364 - protein, 9 aa, Homo Sapiens
VAGLKTMLQ

SEQ ID NO: 500365 - protein, 9 aa, Homo Sapiens
SCRLQEALA

SEQ ID NO: 500366 - protein, 9 aa, Homo Sapiens
SDFENRSKP

SEQ ID NO: 500367 - protein, 9 aa, Homo Sapiens
SNSESSATL

SEQ ID NO: 500368 - protein, 9 aa, Homo Sapiens
INMKTYRRN

SEQ ID NO: 500369 - protein, 9 aa, Homo Sapiens
EGQDAGLLR

SEQ ID NO: 500370 - protein, 9 aa, Homo Sapiens
NEDINLMIS

SEQ ID NO: 500371 - protein, 9 aa, Homo Sapiens
RNTSWGTLG

SEQ ID NO: 500372 - protein, 9 aa, Homo Sapiens
NEDIRHYLF

SEQ ID NO: 500373 - protein, 9 aa, Homo Sapiens
QKIRIDLAS

SEQ ID NO: 500374 - protein, 9 aa, Homo Sapiens
GRGHNTQSQ

SEQ ID NO: 500375 - protein, 9 aa, Homo Sapiens
QMFSCRLQD

SEQ ID NO: 500376 - protein, 9 aa, Homo Sapiens
SGDKPSLLA

SEQ ID NO: 500377 - protein, 9 aa, Homo Sapiens
GHPTPLKRE

SEQ ID NO: 500378 - protein, 9 aa, Homo Sapiens
LLVCMAPLT

SEQ ID NO: 500379 - protein, 9 aa, Homo Sapiens
QHWQDAVPR

SEQ ID NO: 500380 - protein, 9 aa, Homo Sapiens
ILPLLPHFC

SEQ ID NO: 500381 - protein, 9 aa, Homo Sapiens
LTVEWSARS

SEQ ID NO: 500382 - protein, 9 aa, Homo Sapiens
GLIKQHEDA

SEQ ID NO: 500383 - protein, 9 aa, Homo Sapiens
MKTYRRNIR

SEQ ID NO: 500384 - protein, 9 aa, Homo Sapiens
QGYSLVSGG

SEQ ID NO: 500385 - protein, 9 aa, Homo Sapiens
VRVASFYCE

SEQ ID NO: 500386 - protein, 9 aa, Homo Sapiens
IQEYMVRNH

SEQ ID NO: 500387 - protein, 9 aa, Homo Sapiens
KGKKLKKMV

SEQ ID NO: 500388 - protein, 9 aa, Homo Sapiens
ATRVQIGAR

SEQ ID NO: 500389 - protein, 9 aa, Homo Sapiens
VSLQEYMAL

SEQ ID NO: 500390 - protein, 9 aa, Homo Sapiens
VPGKMYSNN

SEQ ID NO: 500391 - protein, 9 aa, Homo Sapiens
GEVGTVPTP

SEQ ID NO: 500392 - protein, 9 aa, Homo Sapiens
VCHRPEVLE

SEQ ID NO: 500393 - protein, 9 aa, Homo Sapiens
YLKNIQSVK

SEQ ID NO: 500394 - protein, 9 aa, Homo Sapiens
VLVYFLRRL

SEQ ID NO: 500395 - protein, 9 aa, Homo Sapiens
AHITRAPHN

SEQ ID NO: 500396 - protein, 9 aa, Homo Sapiens
MIQQTLNLF

SEQ ID NO: 500397 - protein, 9 aa, Homo Sapiens
SAIPTSLAK

SEQ ID NO: 500398 - protein, 9 aa, Homo Sapiens
GCYQGFAFP

SEQ ID NO: 500399 - protein, 9 aa, Homo Sapiens
LPHFCVTYS

SEQ ID NO: 500400 - protein, 9 aa, Homo Sapiens
YVWICDPVH

SEQ ID NO: 500401 - protein, 9 aa, Homo Sapiens
LVCMAPLTN

SEQ ID NO: 500402 - protein, 9 aa, Homo Sapiens
KKGKKSKRN

SEQ ID NO: 500403 - protein, 9 aa, Homo Sapiens
PHHLPTLRK

SEQ ID NO: 500404 - protein, 9 aa, Homo Sapiens
IQGELSGDF

SEQ ID NO: 500405 - protein, 9 aa, Homo Sapiens
TVGNDESVP

SEQ ID NO: 500406 - protein, 9 aa, Homo Sapiens
TEGVTVVWP

SEQ ID NO: 500407 - protein, 9 aa, Homo Sapiens
ATLNYQGIL

SEQ ID NO: 500408 - protein, 9 aa, Homo Sapiens
GPAPSPAAP

SEQ ID NO: 500409 - protein, 9 aa, Homo Sapiens
QEYMALMIS

SEQ ID NO: 500410 - protein, 9 aa, Homo Sapiens
EALQKQLDS

SEQ ID NO: 500411 - protein, 9 aa, Homo Sapiens
SKGKKLKKM

SEQ ID NO: 500412 - protein, 9 aa, Homo Sapiens
SPELVKMVW

SEQ ID NO: 500413 - protein, 9 aa, Homo Sapiens
HFCVTYSRN

SEQ ID NO: 500414 - protein, 9 aa, Homo Sapiens
EDINLMISR

SEQ ID NO: 500415 - protein, 9 aa, Homo Sapiens
QDKKEIAEK

SEQ ID NO: 500416 - protein, 9 aa, Homo Sapiens
KTVPLVSKV

SEQ ID NO: 500417 - protein, 9 aa, Homo Sapiens
ECDEKTSRA

SEQ ID NO: 500418 - protein, 9 aa, Homo Sapiens
PLGLKAVVG

SEQ ID NO: 500419 - protein, 9 aa, Homo Sapiens
QDEKKTLNT

SEQ ID NO: 500420 - protein, 9 aa, Homo Sapiens
DESGGPDNK

SEQ ID NO: 500421 - protein, 9 aa, Homo Sapiens
LKGESGMED

SEQ ID NO: 500422 - protein, 9 aa, Homo Sapiens
EEGQDAGLL

SEQ ID NO: 500423 - protein, 9 aa, Homo Sapiens
LRVKTVPLV

SEQ ID NO: 500424 - protein, 9 aa, Homo Sapiens
AITLKMEIA

SEQ ID NO: 500425 - protein, 9 aa, Homo Sapiens
GRGNNKDKL

SEQ ID NO: 500426 - protein, 9 aa, Homo Sapiens
EMMSQAIIR

SEQ ID NO: 500427 - protein, 9 aa, Homo Sapiens
QPEIEGLLT

SEQ ID NO: 500428 - protein, 9 aa, Homo Sapiens
LGLHPDPFI

SEQ ID NO: 500429 - protein, 9 aa, Homo Sapiens
EVPRNDMNI

SEQ ID NO: 500430 - protein, 9 aa, Homo Sapiens
QDAGLLREW

SEQ ID NO: 500431 - protein, 9 aa, Homo Sapiens
GYVRVKSGL

SEQ ID NO: 500432 - protein, 9 aa, Homo Sapiens
ESGGPDNKD

SEQ ID NO: 500433 - protein, 9 aa, Homo Sapiens
ALMISRETE

SEQ ID NO: 500434 - protein, 9 aa, Homo Sapiens
IDPEQLSSP

SEQ ID NO: 500435 - protein, 9 aa, Homo Sapiens
HTIDKEWCY

SEQ ID NO: 500436 - protein, 9 aa, Homo Sapiens
AVRFNSLGL

SEQ ID NO: 500437 - protein, 9 aa, Homo Sapiens
MRNEKLVTL

SEQ ID NO: 500438 - protein, 9 aa, Homo Sapiens
REPSGAERG

SEQ ID NO: 500439 - protein, 9 aa, Homo Sapiens
VDSAAVSEG

SEQ ID NO: 500440 - protein, 9 aa, Homo Sapiens
NIKEKTWLR

SEQ ID NO: 500441 - protein, 9 aa, Homo Sapiens
QGQSQPLAP

SEQ ID NO: 500442 - protein, 9 aa, Homo Sapiens
QLAAAQDEK

SEQ ID NO: 500443 - protein, 9 aa, Homo Sapiens
DVGQMFSCR

SEQ ID NO: 500444 - protein, 9 aa, Homo Sapiens
VTVVWPLLH

SEQ ID NO: 500445 - protein, 9 aa, Homo Sapiens
LEEMRNEKL

SEQ ID NO: 500446 - protein, 9 aa, Homo Sapiens
KVSYEIQKG

SEQ ID NO: 500447 - protein, 9 aa, Homo Sapiens
KAVPQPKME

SEQ ID NO: 500448 - protein, 9 aa, Homo Sapiens
AKFQEYGPV

SEQ ID NO: 500449 - protein, 9 aa, Homo Sapiens
NFLCPLRMA

SEQ ID NO: 500450 - protein, 9 aa, Homo Sapiens
RLAKNEAAW

SEQ ID NO: 500451 - protein, 9 aa, Homo Sapiens
IKSADNEVP

SEQ ID NO: 500452 - protein, 9 aa, Homo Sapiens
RDPYTVQTI

SEQ ID NO: 500453 - protein, 9 aa, Homo Sapiens
CSQSNAEIE

SEQ ID NO: 500454 - protein, 9 aa, Homo Sapiens
PTSLAKCSA

SEQ ID NO: 500455 - protein, 9 aa, Homo Sapiens
GDRGPAPLC

SEQ ID NO: 500456 - protein, 9 aa, Homo Sapiens
LYARLEEEW

SEQ ID NO: 500457 - protein, 9 aa, Homo Sapiens
TIDKEWCYK

SEQ ID NO: 500458 - protein, 9 aa, Homo Sapiens
SAEFQPVPS

SEQ ID NO: 500459 - protein, 9 aa, Homo Sapiens
MFSCRLQDT

SEQ ID NO: 500460 - protein, 9 aa, Homo Sapiens
TGSDCSQSN

SEQ ID NO: 500461 - protein, 9 aa, Homo Sapiens
ILSELQRDL

SEQ ID NO: 500462 - protein, 9 aa, Homo Sapiens
LEGEPECDE

SEQ ID NO: 500463 - protein, 9 aa, Homo Sapiens
YNLDGNGYI

SEQ ID NO: 500464 - protein, 9 aa, Homo Sapiens
RVKSGLGLH

SEQ ID NO: 500465 - protein, 9 aa, Homo Sapiens
RGNNKDKLL

SEQ ID NO: 500466 - protein, 9 aa, Homo Sapiens
LLNIKEKTW

SEQ ID NO: 500467 - protein, 9 aa, Homo Sapiens
TDDKKVPGK

SEQ ID NO: 500468 - protein, 9 aa, Homo Sapiens
EEKHSMAHQ

SEQ ID NO: 500469 - protein, 9 aa, Homo Sapiens
QKQLDSRYY

SEQ ID NO: 500470 - protein, 9 aa, Homo Sapiens
VRHGLNKSR

SEQ ID NO: 500471 - protein, 9 aa, Homo Sapiens
ASERNQSTT

SEQ ID NO: 500472 - protein, 9 aa, Homo Sapiens
VGISIFFVV

SEQ ID NO: 500473 - protein, 9 aa, Homo Sapiens
RLKGESGME

SEQ ID NO: 500474 - protein, 9 aa, Homo Sapiens
EPQPEIEGL

SEQ ID NO: 500475 - protein, 9 aa, Homo Sapiens
ILVNNFLCP

SEQ ID NO: 500476 - protein, 9 aa, Homo Sapiens
NVRHGLNKS

SEQ ID NO: 500477 - protein, 9 aa, Homo Sapiens
GQLFTAWKL

SEQ ID NO: 500478 - protein, 9 aa, Homo Sapiens
QEIQKGSVA

SEQ ID NO: 500479 - protein, 9 aa, Homo Sapiens
VRVKSGLGL

SEQ ID NO: 500480 - protein, 9 aa, Homo Sapiens
PNRLVDSAA

SEQ ID NO: 500481 - protein, 9 aa, Homo Sapiens
ALVPFHDPV

SEQ ID NO: 500482 - protein, 9 aa, Homo Sapiens
PGDRGPAPL

SEQ ID NO: 500483 - protein, 9 aa, Homo Sapiens
KHKDLIPQS

SEQ ID NO: 500484 - protein, 9 aa, Homo Sapiens
LRLLQIVSY

SEQ ID NO: 500485 - protein, 9 aa, Homo Sapiens
DLKSRWNSV

SEQ ID NO: 500486 - protein, 9 aa, Homo Sapiens
VKVSREMSG

SEQ ID NO: 500487 - protein, 9 aa, Homo Sapiens
QPQGLWPPL

SEQ ID NO: 500488 - protein, 9 aa, Homo Sapiens
LQGIYLKNI

SEQ ID NO: 500489 - protein, 9 aa, Homo Sapiens
VQSLFSLFL

SEQ ID NO: 500490 - protein, 9 aa, Homo Sapiens
KNTEISLKL

SEQ ID NO: 500491 - protein, 9 aa, Homo Sapiens
TNCMLLESD

SEQ ID NO: 500492 - protein, 9 aa, Homo Sapiens
RPEVLEQLQ

SEQ ID NO: 500493 - protein, 9 aa, Homo Sapiens
LQYAGKHME

SEQ ID NO: 500494 - protein, 9 aa, Homo Sapiens
LMTFLDRFV

SEQ ID NO: 500495 - protein, 9 aa, Homo Sapiens
LDSRYYPEV

SEQ ID NO: 500496 - protein, 9 aa, Homo Sapiens
KTYRRNIRK

SEQ ID NO: 500497 - protein, 9 aa, Homo Sapiens
IEQLLAKRD

SEQ ID NO: 500498 - protein, 9 aa, Homo Sapiens
DYRQPPWSE

SEQ ID NO: 500499 - protein, 9 aa, Homo Sapiens
QVVTRPCQC

SEQ ID NO: 500500 - protein, 9 aa, Homo Sapiens
WLRAPPNAT

SEQ ID NO: 500501 - protein, 9 aa, Homo Sapiens
VQTISLFQA

SEQ ID NO: 500502 - protein, 9 aa, Homo Sapiens
QKNTELEEW

SEQ ID NO: 500503 - protein, 9 aa, Homo Sapiens
EQLLAKRDL

SEQ ID NO: 500504 - protein, 9 aa, Homo Sapiens
NKELRAKFQ

SEQ ID NO: 500505 - protein, 9 aa, Homo Sapiens
RGPWPPNQQ

SEQ ID NO: 500506 - protein, 9 aa, Homo Sapiens
EECKDLIKL

SEQ ID NO: 500507 - protein, 9 aa, Homo Sapiens
YVVQIRQGE

SEQ ID NO: 500508 - protein, 9 aa, Homo Sapiens
ELAFRIAVN

SEQ ID NO: 500509 - protein, 9 aa, Homo Sapiens
SINGKSLKE

SEQ ID NO: 500510 - protein, 9 aa, Homo Sapiens
EAAWMAALV

SEQ ID NO: 500511 - protein, 9 aa, Homo Sapiens
TPVFFYLPE

SEQ ID NO: 500512 - protein, 9 aa, Homo Sapiens
NKSRILSWG

SEQ ID NO: 500513 - protein, 9 aa, Homo Sapiens
SGMEDCVMA

SEQ ID NO: 500514 - protein, 9 aa, Homo Sapiens
LSWGQRGKY

SEQ ID NO: 500515 - protein, 9 aa, Homo Sapiens
LLPMRRESA

SEQ ID NO: 500516 - protein, 9 aa, Homo Sapiens
RARLVDPGF

SEQ ID NO: 500517 - protein, 9 aa, Homo Sapiens
ITRAPHNPG

SEQ ID NO: 500518 - protein, 9 aa, Homo Sapiens
LLLTILFRM

SEQ ID NO: 500519 - protein, 9 aa, Homo Sapiens
ESMKLMAKV

SEQ ID NO: 500520 - protein, 9 aa, Homo Sapiens
EVYVPTVFQ

SEQ ID NO: 500521 - protein, 9 aa, Homo Sapiens
PHGRGTPSS

SEQ ID NO: 500522 - protein, 9 aa, Homo Sapiens
CPGGTLVAR

SEQ ID NO: 500523 - protein, 9 aa, Homo Sapiens
KHLQWIVMI

SEQ ID NO: 500524 - protein, 9 aa, Homo Sapiens
NEKLVTLMT

SEQ ID NO: 500525 - protein, 9 aa, Homo Sapiens
YKGDIIVVY

SEQ ID NO: 500526 - protein, 9 aa, Homo Sapiens
PSDKVHNEL

SEQ ID NO: 500527 - protein, 9 aa, Homo Sapiens
PFIWKHLQW

SEQ ID NO: 500528 - protein, 9 aa, Homo Sapiens
PVHGLIKQH

SEQ ID NO: 500529 - protein, 9 aa, Homo Sapiens
VFSQAAAAQ

SEQ ID NO: 500530 - protein, 9 aa, Homo Sapiens
LAPTTKLSS

SEQ ID NO: 500531 - protein, 9 aa, Homo Sapiens
RLGSRASTQ

SEQ ID NO: 500532 - protein, 9 aa, Homo Sapiens
HILVNNFLC

SEQ ID NO: 500533 - protein, 9 aa, Homo Sapiens
CQTHTIDKE

SEQ ID NO: 500534 - protein, 9 aa, Homo Sapiens
PRESPLPSP

SEQ ID NO: 500535 - protein, 9 aa, Homo Sapiens
TRAPHNPGH

SEQ ID NO: 500536 - protein, 9 aa, Homo Sapiens
GKQMNDEKR

SEQ ID NO: 500537 - protein, 9 aa, Homo Sapiens
ENAVGILSC

SEQ ID NO: 500538 - protein, 9 aa, Homo Sapiens
NTEISLKLG

SEQ ID NO: 500539 - protein, 9 aa, Homo Sapiens
KNILSELQR

SEQ ID NO: 500540 - protein, 9 aa, Homo Sapiens
LLEQGYSLV

SEQ ID NO: 500541 - protein, 9 aa, Homo Sapiens
IINACLILT

SEQ ID NO: 500542 - protein, 9 aa, Homo Sapiens
DAEQPREPS

SEQ ID NO: 500543 - protein, 9 aa, Homo Sapiens
FCVTYSRNS

SEQ ID NO: 500544 - protein, 9 aa, Homo Sapiens
EQPREPSGA

SEQ ID NO: 500545 - protein, 9 aa, Homo Sapiens
TLAEINKYL

SEQ ID NO: 500546 - protein, 9 aa, Homo Sapiens
TPLKREPCK

SEQ ID NO: 500547 - protein, 9 aa, Homo Sapiens
LQPLGNGHC

SEQ ID NO: 500548 - protein, 9 aa, Homo Sapiens
VIGPVTITT

SEQ ID NO: 500549 - protein, 9 aa, Homo Sapiens
DIDYFKGLD

SEQ ID NO: 500550 - protein, 9 aa, Homo Sapiens
GPWPPNQQQ

SEQ ID NO: 500551 - protein, 9 aa, Homo Sapiens
SVSFDPLLI

SEQ ID NO: 500552 - protein, 9 aa, Homo Sapiens
RHSQEAQTT

SEQ ID NO: 500553 - protein, 9 aa, Homo Sapiens
EWSARSESA

SEQ ID NO: 500554 - protein, 9 aa, Homo Sapiens
FVVAYTIEK

SEQ ID NO: 500555 - protein, 9 aa, Homo Sapiens
LNIKEKTWL

SEQ ID NO: 500556 - protein, 9 aa, Homo Sapiens
TVPTPVEFM

SEQ ID NO: 500557 - protein, 9 aa, Homo Sapiens
LHEMIQQTL

SEQ ID NO: 500558 - protein, 9 aa, Homo Sapiens
NKDKLLLCD

SEQ ID NO: 500559 - protein, 9 aa, Homo Sapiens
LRKEAAQKR

SEQ ID NO: 500560 - protein, 9 aa, Homo Sapiens
KTGIIKTAL

SEQ ID NO: 500561 - protein, 9 aa, Homo Sapiens
PMRRESAGA

SEQ ID NO: 500562 - protein, 9 aa, Homo Sapiens
FCGRGNNKD

SEQ ID NO: 500563 - protein, 9 aa, Homo Sapiens
QKGVQHKRP

SEQ ID NO: 500564 - protein, 9 aa, Homo Sapiens
QDNSFPLLP

SEQ ID NO: 500565 - protein, 9 aa, Homo Sapiens
KVRAYIPNE

SEQ ID NO: 500566 - protein, 9 aa, Homo Sapiens
HRLAVRFNS

SEQ ID NO: 500567 - protein, 9 aa, Homo Sapiens
STSAFSKAF

SEQ ID NO: 500568 - protein, 9 aa, Homo Sapiens
MQRQLAAAQ

SEQ ID NO: 500569 - protein, 9 aa, Homo Sapiens
GTYKEGGGS

SEQ ID NO: 500570 - protein, 9 aa, Homo Sapiens
RQLGRCPGG

SEQ ID NO: 500571 - protein, 9 aa, Homo Sapiens
IKEKTWLRA

SEQ ID NO: 500572 - protein, 9 aa, Homo Sapiens
EWCYKRVCV

SEQ ID NO: 500573 - protein, 9 aa, Homo Sapiens
SPRESPLPS

SEQ ID NO: 500574 - protein, 9 aa, Homo Sapiens
FEKDNNTYE

SEQ ID NO: 500575 - protein, 9 aa, Homo Sapiens
KSGLGLHPD

SEQ ID NO: 500576 - protein, 9 aa, Homo Sapiens
EKRQAAQNE

SEQ ID NO: 500577 - protein, 9 aa, Homo Sapiens
LGNGHCVES

SEQ ID NO: 500578 - protein, 9 aa, Homo Sapiens
CDEKTSRAL

SEQ ID NO: 500579 - protein, 9 aa, Homo Sapiens
QAALSMAHT

SEQ ID NO: 500580 - protein, 9 aa, Homo Sapiens
NKNYTLLVC

SEQ ID NO: 500581 - protein, 9 aa, Homo Sapiens
SCPPHHLPT

SEQ ID NO: 500582 - protein, 9 aa, Homo Sapiens
LKTMLQSHK

SEQ ID NO: 500583 - protein, 9 aa, Homo Sapiens
TSAFSKAFA

SEQ ID NO: 500584 - protein, 9 aa, Homo Sapiens
KTLYLLYAR

SEQ ID NO: 500585 - protein, 9 aa, Homo Sapiens
TKEKRQAAQ

SEQ ID NO: 500586 - protein, 9 aa, Homo Sapiens
IQDKKEIAE

SEQ ID NO: 500587 - protein, 9 aa, Homo Sapiens
PQGLWPPLA

SEQ ID NO: 500588 - protein, 9 aa, Homo Sapiens
PGKMYSNNP

SEQ ID NO: 500589 - protein, 9 aa, Homo Sapiens
DPACSPSKA

SEQ ID NO: 500590 - protein, 9 aa, Homo Sapiens
VPRTELLSL

SEQ ID NO: 500591 - protein, 9 aa, Homo Sapiens
TFKNTEISL

SEQ ID NO: 500592 - protein, 9 aa, Homo Sapiens
IDKEWCYKR

SEQ ID NO: 500593 - protein, 9 aa, Homo Sapiens
DKKPEEWDK

SEQ ID NO: 500594 - protein, 9 aa, Homo Sapiens
LSELQRDLN

SEQ ID NO: 500595 - protein, 9 aa, Homo Sapiens
CPLRMAASS

SEQ ID NO: 500596 - protein, 9 aa, Homo Sapiens
TLYLLYARL

SEQ ID NO: 500597 - protein, 9 aa, Homo Sapiens
WPPNQQQPI

SEQ ID NO: 500598 - protein, 9 aa, Homo Sapiens
SFQVSSKVS

SEQ ID NO: 500599 - protein, 9 aa, Homo Sapiens
APLGLKAVV

SEQ ID NO: 500600 - protein, 9 aa, Homo Sapiens
TGYRDPYTV

SEQ ID NO: 500601 - protein, 9 aa, Homo Sapiens
MRVLCIARV

SEQ ID NO: 500602 - protein, 9 aa, Homo Sapiens
SMAHQDLHS

SEQ ID NO: 500603 - protein, 9 aa, Homo Sapiens
FKAKIKKTD

SEQ ID NO: 500604 - protein, 9 aa, Homo Sapiens
DFENRSKPE

SEQ ID NO: 500605 - protein, 9 aa, Homo Sapiens
WMAALVEAE

SEQ ID NO: 500606 - protein, 9 aa, Homo Sapiens
QFEKDNNTY

SEQ ID NO: 500607 - protein, 9 aa, Homo Sapiens
KPSLLARYV

SEQ ID NO: 500608 - protein, 9 aa, Homo Sapiens
KKNPKQRLG

SEQ ID NO: 500609 - protein, 9 aa, Homo Sapiens
GEPECDEKT

SEQ ID NO: 500610 - protein, 9 aa, Homo Sapiens
VEWSARSES

SEQ ID NO: 500611 - protein, 9 aa, Homo Sapiens
VQEIQKGSV

SEQ ID NO: 500612 - protein, 9 aa, Homo Sapiens
ITNGPEKLA

SEQ ID NO: 500613 - protein, 9 aa, Homo Sapiens
PEQLSSPKK

SEQ ID NO: 500614 - protein, 9 aa, Homo Sapiens
QSLFSLFLS

SEQ ID NO: 500615 - protein, 9 aa, Homo Sapiens
GDGGDVGQM

SEQ ID NO: 500616 - protein, 9 aa, Homo Sapiens
TSPLTVEWS

SEQ ID NO: 500617 - protein, 9 aa, Homo Sapiens
GLWPGERPG

SEQ ID NO: 500618 - protein, 9 aa, Homo Sapiens
QLQPLGNGH

SEQ ID NO: 500619 - protein, 9 aa, Homo Sapiens
RTELLSLQT

SEQ ID NO: 500620 - protein, 9 aa, Homo Sapiens
CIARVLKLL

SEQ ID NO: 500621 - protein, 9 aa, Homo Sapiens
PQELLASAE

SEQ ID NO: 500622 - protein, 9 aa, Homo Sapiens
RNEKLVTLM

SEQ ID NO: 500623 - protein, 9 aa, Homo Sapiens
AVDKKWIVH

SEQ ID NO: 500624 - protein, 9 aa, Homo Sapiens
QEQPQGLWP

SEQ ID NO: 500625 - protein, 9 aa, Homo Sapiens
DAGFLLYKD

SEQ ID NO: 500626 - protein, 9 aa, Homo Sapiens
HNELKNLEH

SEQ ID NO: 500627 - protein, 9 aa, Homo Sapiens
SARSESAQS

SEQ ID NO: 500628 - protein, 9 aa, Homo Sapiens
PGLWPGERP

SEQ ID NO: 500629 - protein, 9 aa, Homo Sapiens
KVHNELKNL

SEQ ID NO: 500630 - protein, 9 aa, Homo Sapiens
KAAVETQLA

SEQ ID NO: 500631 - protein, 9 aa, Homo Sapiens
KSRILSWGQ

SEQ ID NO: 500632 - protein, 9 aa, Homo Sapiens
SGLKKLGQL

SEQ ID NO: 500633 - protein, 9 aa, Homo Sapiens
PLVSKVDDI

SEQ ID NO: 500634 - protein, 9 aa, Homo Sapiens
CVTYSRNSS

SEQ ID NO: 500635 - protein, 9 aa, Homo Sapiens
NLMISRQRL

SEQ ID NO: 500636 - protein, 9 aa, Homo Sapiens
EYMNNGSLL

SEQ ID NO: 500637 - protein, 9 aa, Homo Sapiens
KTVGNDESV

SEQ ID NO: 500638 - protein, 9 aa, Homo Sapiens
VAAKLLAKD

SEQ ID NO: 500639 - protein, 9 aa, Homo Sapiens
TSSHYGNFD

SEQ ID NO: 500640 - protein, 9 aa, Homo Sapiens
RVQIGARGA

SEQ ID NO: 500641 - protein, 9 aa, Homo Sapiens
QSQPLAPTT

SEQ ID NO: 500642 - protein, 9 aa, Homo Sapiens
NATIILQDA

SEQ ID NO: 500643 - protein, 9 aa, Homo Sapiens
VDPGFGIYK

SEQ ID NO: 500644 - protein, 9 aa, Homo Sapiens
EEEHYCNML

SEQ ID NO: 500645 - protein, 9 aa, Homo Sapiens
SGQVMNYKG

SEQ ID NO: 500646 - protein, 9 aa, Homo Sapiens
GFLLYKDHL

SEQ ID NO: 500647 - protein, 9 aa, Homo Sapiens
GPVFSQAAA

SEQ ID NO: 500648 - protein, 9 aa, Homo Sapiens
GIFVQEIQK

SEQ ID NO: 500649 - protein, 9 aa, Homo Sapiens
VGNDESVPT

SEQ ID NO: 500650 - protein, 9 aa, Homo Sapiens
NGKSLKETT

SEQ ID NO: 500651 - protein, 9 aa, Homo Sapiens
NGPEKLAAP

SEQ ID NO: 500652 - protein, 9 aa, Homo Sapiens
KHTIHHTGE

SEQ ID NO: 500653 - protein, 9 aa, Homo Sapiens
RAGRCPGIT

SEQ ID NO: 500654 - protein, 9 aa, Homo Sapiens
GITIPDSQN

SEQ ID NO: 500655 - protein, 9 aa, Homo Sapiens
AFPWKCLLH

SEQ ID NO: 500656 - protein, 9 aa, Homo Sapiens
TPVEFMGYL

SEQ ID NO: 500657 - protein, 9 aa, Homo Sapiens
TQDCSLQHS

SEQ ID NO: 500658 - protein, 9 aa, Homo Sapiens
DAVPRTELL

SEQ ID NO: 500659 - protein, 9 aa, Homo Sapiens
PAPLCGWRK

SEQ ID NO: 500660 - protein, 9 aa, Homo Sapiens
GKKSKRNMN

SEQ ID NO: 500661 - protein, 9 aa, Homo Sapiens
FPWKCLLHS

SEQ ID NO: 500662 - protein, 9 aa, Homo Sapiens
LQDFTLMTF

SEQ ID NO: 500663 - protein, 9 aa, Homo Sapiens
ADNEVPPPV

SEQ ID NO: 500664 - protein, 9 aa, Homo Sapiens
EFLRTELSE

SEQ ID NO: 500665 - protein, 9 aa, Homo Sapiens
YVRVKSGLG

SEQ ID NO: 500666 - protein, 9 aa, Homo Sapiens
SQVVTRPCQ

SEQ ID NO: 500667 - protein, 9 aa, Homo Sapiens
IVTEYMNNG

SEQ ID NO: 500668 - protein, 9 aa, Homo Sapiens
LIKQHEDAL

SEQ ID NO: 500669 - protein, 9 aa, Homo Sapiens
MNIYPEYIL

SEQ ID NO: 500670 - protein, 9 aa, Homo Sapiens
EVYVWICDP

SEQ ID NO: 500671 - protein, 9 aa, Homo Sapiens
RGEVGTVPT

SEQ ID NO: 500672 - protein, 9 aa, Homo Sapiens
KQAEELWQY

SEQ ID NO: 500673 - protein, 9 aa, Homo Sapiens
KGTYKEGGG

SEQ ID NO: 500674 - protein, 9 aa, Homo Sapiens
LAKHTIHHT

SEQ ID NO: 500675 - protein, 9 aa, Homo Sapiens
GQQSGLKKL

SEQ ID NO: 500676 - protein, 9 aa, Homo Sapiens
IPETSSHYG

SEQ ID NO: 500677 - protein, 9 aa, Homo Sapiens
TITNCMLLE

SEQ ID NO: 500678 - protein, 9 aa, Homo Sapiens
LTGKIAQVV

SEQ ID NO: 500679 - protein, 9 aa, Homo Sapiens
DKPSLLARY

SEQ ID NO: 500680 - protein, 9 aa, Homo Sapiens
PPPPAPPLL

SEQ ID NO: 500681 - protein, 9 aa, Homo Sapiens
PWKCLLHSC

SEQ ID NO: 500682 - protein, 9 aa, Homo Sapiens
SEVDKSKEE

SEQ ID NO: 500683 - protein, 9 aa, Homo Sapiens
LNKALQYAG

SEQ ID NO: 500684 - protein, 9 aa, Homo Sapiens
VLHKCLGCI

SEQ ID NO: 500685 - protein, 9 aa, Homo Sapiens
EVLEQLQEQ

SEQ ID NO: 500686 - protein, 9 aa, Homo Sapiens
WNSVASPTS

SEQ ID NO: 500687 - protein, 9 aa, Homo Sapiens
LHECNTQFQ

SEQ ID NO: 500688 - protein, 9 aa, Homo Sapiens
VLCIARVLK

SEQ ID NO: 500689 - protein, 9 aa, Homo Sapiens
NTDRGSVCS

SEQ ID NO: 500690 - protein, 9 aa, Homo Sapiens
LLLPMRRES

SEQ ID NO: 500691 - protein, 9 aa, Homo Sapiens
GLLKKNPKQ

SEQ ID NO: 500692 - protein, 9 aa, Homo Sapiens
HDPVIGPVT

SEQ ID NO: 500693 - protein, 9 aa, Homo Sapiens
IKLMLRNER

SEQ ID NO: 500694 - protein, 9 aa, Homo Sapiens
KFQEYGPVI

SEQ ID NO: 500695 - protein, 9 aa, Homo Sapiens
AEQPREPSG

SEQ ID NO: 500696 - protein, 9 aa, Homo Sapiens
ALLEQGYSL

SEQ ID NO: 500697 - protein, 9 aa, Homo Sapiens
NKYLMGKFP

SEQ ID NO: 500698 - protein, 9 aa, Homo Sapiens
LKETTHHDA

SEQ ID NO: 500699 - protein, 9 aa, Homo Sapiens
KAFAAQPVP

SEQ ID NO: 500700 - protein, 9 aa, Homo Sapiens
KSGDKPSLL

SEQ ID NO: 500701 - protein, 9 aa, Homo Sapiens
LGSRASTQR

SEQ ID NO: 500702 - protein, 9 aa, Homo Sapiens
VGASPRESP

SEQ ID NO: 500703 - protein, 9 aa, Homo Sapiens
LFTAWKLQL

SEQ ID NO: 500704 - protein, 9 aa, Homo Sapiens
PITLRELIR

SEQ ID NO: 500705 - protein, 9 aa, Homo Sapiens
MVRNHNGKN

SEQ ID NO: 500706 - protein, 9 aa, Homo Sapiens
QVMNYKGDI

SEQ ID NO: 500707 - protein, 9 aa, Homo Sapiens
TCHVRVASF

SEQ ID NO: 500708 - protein, 9 aa, Homo Sapiens
MNNGSLLDF

SEQ ID NO: 500709 - protein, 9 aa, Homo Sapiens
VFQNYVADI

SEQ ID NO: 500710 - protein, 9 aa, Homo Sapiens
MNDEKRAAD

SEQ ID NO: 500711 - protein, 9 aa, Homo Sapiens
SQPLAPTTK

SEQ ID NO: 500712 - protein, 9 aa, Homo Sapiens
SPLTVEWSA

SEQ ID NO: 500713 - protein, 9 aa, Homo Sapiens
WPGERPGDR

SEQ ID NO: 500714 - protein, 9 aa, Homo Sapiens
ALCHPPGAP

SEQ ID NO: 500715 - protein, 9 aa, Homo Sapiens
TKRIGSISF

SEQ ID NO: 500716 - protein, 9 aa, Homo Sapiens
VWICDPVHF

SEQ ID NO: 500717 - protein, 9 aa, Homo Sapiens
FSKAFAAQP

SEQ ID NO: 500718 - protein, 9 aa, Homo Sapiens
RNQSTTPTF

SEQ ID NO: 500719 - protein, 9 aa, Homo Sapiens
LQIVSYKII

SEQ ID NO: 500720 - protein, 9 aa, Homo Sapiens
QYAGKHMED

SEQ ID NO: 500721 - protein, 9 aa, Homo Sapiens
KKLKKMVTN

SEQ ID NO: 500722 - protein, 9 aa, Homo Sapiens
VDKKWIVHG

SEQ ID NO: 500723 - protein, 9 aa, Homo Sapiens
VTGYVVQIR

SEQ ID NO: 500724 - protein, 9 aa, Homo Sapiens
IDLASMQII

SEQ ID NO: 500725 - protein, 9 aa, Homo Sapiens
SDCSQSNAE

SEQ ID NO: 500726 - protein, 9 aa, Homo Sapiens
EQPQGLWPP

SEQ ID NO: 500727 - protein, 9 aa, Homo Sapiens
FFVVAYTIE

SEQ ID NO: 500728 - protein, 9 aa, Homo Sapiens
PIEASIQGE

SEQ ID NO: 500729 - protein, 9 aa, Homo Sapiens
PSSEQEQPQ

SEQ ID NO: 500730 - protein, 9 aa, Homo Sapiens
QDFTLMTFL

SEQ ID NO: 500731 - protein, 9 aa, Homo Sapiens
LAFRIAVNT

SEQ ID NO: 500732 - protein, 9 aa, Homo Sapiens
SRILSWGQR

SEQ ID NO: 500733 - protein, 9 aa, Homo Sapiens
DPEQLSSPK

SEQ ID NO: 500734 - protein, 9 aa, Homo Sapiens
ITNCMLLES

SEQ ID NO: 500735 - protein, 9 aa, Homo Sapiens
EQTTCEVLV

SEQ ID NO: 500736 - protein, 9 aa, Homo Sapiens
QPNGTPSPG

SEQ ID NO: 500737 - protein, 9 aa, Homo Sapiens
TSLAKCSAL

SEQ ID NO: 500738 - protein, 9 aa, Homo Sapiens
SKGTYKEGG

SEQ ID NO: 500739 - protein, 9 aa, Homo Sapiens
QAAAAQHFT

SEQ ID NO: 500740 - protein, 9 aa, Homo Sapiens
HTIHHTGEK

SEQ ID NO: 500741 - protein, 9 aa, Homo Sapiens
LCQGLNEDI

SEQ ID NO: 500742 - protein, 9 aa, Homo Sapiens
INEDINLMI

SEQ ID NO: 500743 - protein, 9 aa, Homo Sapiens
GISIFFVVA

SEQ ID NO: 500744 - protein, 9 aa, Homo Sapiens
KSRWNSVAS

SEQ ID NO: 500745 - protein, 9 aa, Homo Sapiens
EQKNILSEL

SEQ ID NO: 500746 - protein, 9 aa, Homo Sapiens
SFQVYCDMR

SEQ ID NO: 500747 - protein, 9 aa, Homo Sapiens
YPASFQVYC

SEQ ID NO: 500748 - protein, 9 aa, Homo Sapiens
IIRGMMDEE

SEQ ID NO: 500749 - protein, 9 aa, Homo Sapiens
AGLKTMLQS

SEQ ID NO: 500750 - protein, 9 aa, Homo Sapiens
LPLLPHFCV

SEQ ID NO: 500751 - protein, 9 aa, Homo Sapiens
KMVTNDRSA

SEQ ID NO: 500752 - protein, 9 aa, Homo Sapiens
NYKGDIIVV

SEQ ID NO: 500753 - protein, 9 aa, Homo Sapiens
KRAKIPDPS

SEQ ID NO: 500754 - protein, 9 aa, Homo Sapiens
NYTLLVCMA

SEQ ID NO: 500755 - protein, 9 aa, Homo Sapiens
LKQAEELWQ

SEQ ID NO: 500756 - protein, 9 aa, Homo Sapiens
SSKVSYEIQ

SEQ ID NO: 500757 - protein, 9 aa, Homo Sapiens
SGKLRLLQI

SEQ ID NO: 500758 - protein, 9 aa, Homo Sapiens
NCMLLESDL

SEQ ID NO: 500759 - protein, 9 aa, Homo Sapiens
LPPASIGKA

SEQ ID NO: 500760 - protein, 9 aa, Homo Sapiens
RRRFVRGPW

SEQ ID NO: 500761 - protein, 9 aa, Homo Sapiens
GISNSESSA

SEQ ID NO: 500762 - protein, 9 aa, Homo Sapiens
HTHGLPSHM

SEQ ID NO: 500763 - protein, 9 aa, Homo Sapiens
PACSSTQWP

SEQ ID NO: 500764 - protein, 9 aa, Homo Sapiens
WPLLHEFVS

SEQ ID NO: 500765 - protein, 9 aa, Homo Sapiens
DGQVGRGLP

SEQ ID NO: 500766 - protein, 9 aa, Homo Sapiens
LKKMVTNDR

SEQ ID NO: 500767 - protein, 9 aa, Homo Sapiens
EQLADGQVG

SEQ ID NO: 500768 - protein, 9 aa, Homo Sapiens
LSSPKKSCN

SEQ ID NO: 500769 - protein, 9 aa, Homo Sapiens
LPKWNTKRI

SEQ ID NO: 500770 - protein, 9 aa, Homo Sapiens
RLTLAEINK

SEQ ID NO: 500771 - protein, 9 aa, Homo Sapiens
PLLPHFCVT

SEQ ID NO: 500772 - protein, 9 aa, Homo Sapiens
KKWIVHGYV

SEQ ID NO: 500773 - protein, 9 aa, Homo Sapiens
RIAVNTINR

SEQ ID NO: 500774 - protein, 9 aa, Homo Sapiens
KAQGPVFSQ

SEQ ID NO: 500775 - protein, 9 aa, Homo Sapiens
RFNSLGLLP

SEQ ID NO: 500776 - protein, 9 aa, Homo Sapiens
TQSQVVTRP

SEQ ID NO: 500777 - protein, 9 aa, Homo Sapiens
EKTWLRAPP

SEQ ID NO: 500778 - protein, 9 aa, Homo Sapiens
VYVPTVFQN

SEQ ID NO: 500779 - protein, 9 aa, Homo Sapiens
VTEYMNNGS

SEQ ID NO: 500780 - protein, 9 aa, Homo Sapiens
AHNTRAPFE

SEQ ID NO: 500781 - protein, 9 aa, Homo Sapiens
YQGFAFPWK

SEQ ID NO: 500782 - protein, 9 aa, Homo Sapiens
KGESGMEDC

SEQ ID NO: 500783 - protein, 9 aa, Homo Sapiens
PTHYPASFQ

SEQ ID NO: 500784 - protein, 9 aa, Homo Sapiens
GYVAAKLLA

SEQ ID NO: 500785 - protein, 9 aa, Homo Sapiens
TFIMELRSR

SEQ ID NO: 500786 - protein, 9 aa, Homo Sapiens
SDVRELTPV

SEQ ID NO: 500787 - protein, 9 aa, Homo Sapiens
EELAFRIAV

SEQ ID NO: 500788 - protein, 9 aa, Homo Sapiens
AMADALLEQ

SEQ ID NO: 500789 - protein, 9 aa, Homo Sapiens
GKSLKETTH

SEQ ID NO: 500790 - protein, 9 aa, Homo Sapiens
MTKEKRQAA

SEQ ID NO: 500791 - protein, 9 aa, Homo Sapiens
QRLEGRPHG

SEQ ID NO: 500792 - protein, 9 aa, Homo Sapiens
EGEPECDEK

SEQ ID NO: 500793 - protein, 9 aa, Homo Sapiens
VHGYVRVKS

SEQ ID NO: 500794 - protein, 9 aa, Homo Sapiens
CYAIWRYLY

SEQ ID NO: 500795 - protein, 9 aa, Homo Sapiens
IKLQIPKPL

SEQ ID NO: 500796 - protein, 9 aa, Homo Sapiens
EGNATIILQ

SEQ ID NO: 500797 - protein, 9 aa, Homo Sapiens
STEKPTIST

SEQ ID NO: 500798 - protein, 9 aa, Homo Sapiens
NGHCVESSD

SEQ ID NO: 500799 - protein, 9 aa, Homo Sapiens
CSLQHSPIS

SEQ ID NO: 500800 - protein, 9 aa, Homo Sapiens
NRSKPESDG

SEQ ID NO: 500801 - protein, 9 aa, Homo Sapiens
QLLAKRDLE

SEQ ID NO: 500802 - protein, 9 aa, Homo Sapiens
TKEEGNATI

SEQ ID NO: 500803 - protein, 9 aa, Homo Sapiens
PVEQMTKEK

SEQ ID NO: 500804 - protein, 9 aa, Homo Sapiens
RAPFEDVTN

SEQ ID NO: 500805 - protein, 9 aa, Homo Sapiens
QPLAPTTKL

SEQ ID NO: 500806 - protein, 9 aa, Homo Sapiens
DKKEIAEKK

SEQ ID NO: 500807 - protein, 9 aa, Homo Sapiens
LNEDIRHYL

SEQ ID NO: 500808 - protein, 9 aa, Homo Sapiens
TIHHTGEKP

SEQ ID NO: 500809 - protein, 9 aa, Homo Sapiens
LYKDHLPVS

SEQ ID NO: 500810 - protein, 9 aa, Homo Sapiens
KGVQHKRPS

SEQ ID NO: 500811 - protein, 9 aa, Homo Sapiens
KKVVLHKCL

SEQ ID NO: 500812 - protein, 9 aa, Homo Sapiens
RESPLPSPA

SEQ ID NO: 500813 - protein, 9 aa, Homo Sapiens
NVIPETSSH

SEQ ID NO: 500814 - protein, 9 aa, Homo Sapiens
STDYDSEQE

SEQ ID NO: 500815 - protein, 9 aa, Homo Sapiens
QSGLKKLGQ

SEQ ID NO: 500816 - protein, 9 aa, Homo Sapiens
SLKLGQEFE

SEQ ID NO: 500817 - protein, 9 aa, Homo Sapiens
ICDPVHFKT

SEQ ID NO: 500818 - protein, 9 aa, Homo Sapiens
QRGKYPPDC

SEQ ID NO: 500819 - protein, 9 aa, Homo Sapiens
MNYKGDIIV

SEQ ID NO: 500820 - protein, 9 aa, Homo Sapiens
QIGARGAPS

SEQ ID NO: 500821 - protein, 9 aa, Homo Sapiens
RPGDRGPAP

SEQ ID NO: 500822 - protein, 9 aa, Homo Sapiens
DCSQSNAEI

SEQ ID NO: 500823 - protein, 9 aa, Homo Sapiens
QELCLSGAC

SEQ ID NO: 500824 - protein, 9 aa, Homo Sapiens
EWDKRAKIP

SEQ ID NO: 500825 - protein, 9 aa, Homo Sapiens
VFFYLPEFL

SEQ ID NO: 500826 - protein, 9 aa, Homo Sapiens
VSYEIQKGQ

SEQ ID NO: 500827 - protein, 9 aa, Homo Sapiens
PETSSHYGN

SEQ ID NO: 500828 - protein, 9 aa, Homo Sapiens
AVPRTELLS

SEQ ID NO: 500829 - protein, 9 aa, Homo Sapiens
QQQAEIQDK

SEQ ID NO: 500830 - protein, 9 aa, Homo Sapiens
QVQSLFSLF

SEQ ID NO: 500831 - protein, 9 aa, Homo Sapiens
KVKDSLDIN

SEQ ID NO: 500832 - protein, 9 aa, Homo Sapiens
FAFPWKCLL

SEQ ID NO: 500833 - protein, 9 aa, Homo Sapiens
TVVWPLLHE

SEQ ID NO: 500834 - protein, 9 aa, Homo Sapiens
HGYVRVKSG

SEQ ID NO: 500835 - protein, 9 aa, Homo Sapiens
HHTGEKPYT

SEQ ID NO: 500836 - protein, 9 aa, Homo Sapiens
QTLQGIYLK

SEQ ID NO: 500837 - protein, 9 aa, Homo Sapiens
SAFSKAFAA

SEQ ID NO: 500838 - protein, 9 aa, Homo Sapiens
IWKHLQWIV

SEQ ID NO: 500839 - protein, 9 aa, Homo Sapiens
ITLRELIRT

SEQ ID NO: 500840 - protein, 9 aa, Homo Sapiens
CATRVQIGA

SEQ ID NO: 500841 - protein, 9 aa, Homo Sapiens
LEMMSQAII

SEQ ID NO: 500842 - protein, 9 aa, Homo Sapiens
SQAAAAQHF

SEQ ID NO: 500843 - protein, 9 aa, Homo Sapiens
RPKQPSNIK

SEQ ID NO: 500844 - protein, 9 aa, Homo Sapiens
VNNFLCPLR

SEQ ID NO: 500845 - protein, 9 aa, Homo Sapiens
EHYCNMLCC

SEQ ID NO: 500846 - protein, 9 aa, Homo Sapiens
LRGHPTPLK

SEQ ID NO: 500847 - protein, 9 aa, Homo Sapiens
QEYGPVIEC

SEQ ID NO: 500848 - protein, 9 aa, Homo Sapiens
LPMRRESAG

SEQ ID NO: 500849 - protein, 9 aa, Homo Sapiens
KINEDINLM

SEQ ID NO: 500850 - protein, 9 aa, Homo Sapiens
SLQEYMALM

SEQ ID NO: 500851 - protein, 9 aa, Homo Sapiens
HCATRVQIG

SEQ ID NO: 500852 - protein, 9 aa, Homo Sapiens
ESKTGIIKT

SEQ ID NO: 500853 - protein, 9 aa, Homo Sapiens
TVPLVSKVD

SEQ ID NO: 500854 - protein, 9 aa, Homo Sapiens
DAALKRSSS

SEQ ID NO: 500855 - protein, 9 aa, Homo Sapiens
VWPLLHEFV

SEQ ID NO: 500856 - protein, 9 aa, Homo Sapiens
KLMAKVKDS

SEQ ID NO: 500857 - protein, 9 aa, Homo Sapiens
LHCATRVQI

SEQ ID NO: 500858 - protein, 9 aa, Homo Sapiens
QAEIQDKKE

SEQ ID NO: 500859 - protein, 9 aa, Homo Sapiens
MRRESAGAD

SEQ ID NO: 500860 - protein, 9 aa, Homo Sapiens
EMNVGSQMV

SEQ ID NO: 500861 - protein, 9 aa, Homo Sapiens
YRDPYTVQT

SEQ ID NO: 500862 - protein, 9 aa, Homo Sapiens
QAEELWQYK

SEQ ID NO: 500863 - protein, 9 aa, Homo Sapiens
KNYTLLVCM

SEQ ID NO: 500864 - protein, 9 aa, Homo Sapiens
LVNASCRIS

SEQ ID NO: 500865 - protein, 9 aa, Homo Sapiens
GLKTMLQSH

SEQ ID NO: 500866 - protein, 9 aa, Homo Sapiens
VGKKLHECN

SEQ ID NO: 500867 - protein, 9 aa, Homo Sapiens
PKWNTKRIG

SEQ ID NO: 500868 - protein, 9 aa, Homo Sapiens
GRNTSWGTL

SEQ ID NO: 500869 - protein, 9 aa, Homo Sapiens
LLYARLEEE

SEQ ID NO: 500870 - protein, 9 aa, Homo Sapiens
APHNPGHVI

SEQ ID NO: 500871 - protein, 9 aa, Homo Sapiens
MSKRNRKRS

SEQ ID NO: 500872 - protein, 9 aa, Homo Sapiens
NQSTTPTFI

SEQ ID NO: 500873 - protein, 9 aa, Homo Sapiens
RRRLKGESG

SEQ ID NO: 500874 - protein, 9 aa, Homo Sapiens
ARAQPNGTP

SEQ ID NO: 500875 - protein, 9 aa, Homo Sapiens
MLLESDLKH

SEQ ID NO: 500876 - protein, 9 aa, Homo Sapiens
KAKIKKTDV

SEQ ID NO: 500877 - protein, 9 aa, Homo Sapiens
QHIEQLLAK

SEQ ID NO: 500878 - protein, 9 aa, Homo Sapiens
GNSPSDKVH

SEQ ID NO: 500879 - protein, 9 aa, Homo Sapiens
REFLRTELS

SEQ ID NO: 500880 - protein, 9 aa, Homo Sapiens
KEWCYKRVC

SEQ ID NO: 500881 - protein, 9 aa, Homo Sapiens
LQKGVQHKR

SEQ ID NO: 500882 - protein, 9 aa, Homo Sapiens
KDRHSQEAQ

SEQ ID NO: 500883 - protein, 9 aa, Homo Sapiens
QIRQGEEEE

SEQ ID NO: 500884 - protein, 9 aa, Homo Sapiens
RLSAIPTSL

SEQ ID NO: 500885 - protein, 9 aa, Homo Sapiens
SSKGTYKEG

SEQ ID NO: 500886 - protein, 9 aa, Homo Sapiens
SILQRIAGE

SEQ ID NO: 500887 - protein, 9 aa, Homo Sapiens
SDVNKKLEH

SEQ ID NO: 500888 - protein, 9 aa, Homo Sapiens
FLTITNCML

SEQ ID NO: 500889 - protein, 9 aa, Homo Sapiens
SCRISNLLA

SEQ ID NO: 500890 - protein, 9 aa, Homo Sapiens
GTLRIVKVS

SEQ ID NO: 500891 - protein, 9 aa, Homo Sapiens
VYVWICDPV

SEQ ID NO: 500892 - protein, 9 aa, Homo Sapiens
NDEKRAADY

SEQ ID NO: 500893 - protein, 9 aa, Homo Sapiens
MNLRVYSPH

SEQ ID NO: 500894 - protein, 9 aa, Homo Sapiens
PLQDFTLMT

SEQ ID NO: 500895 - protein, 9 aa, Homo Sapiens
EPSGAERGG

SEQ ID NO: 500896 - protein, 9 aa, Homo Sapiens
SPAAPPAQG

SEQ ID NO: 500897 - protein, 9 aa, Homo Sapiens
RILSWGQRG

SEQ ID NO: 500898 - protein, 9 aa, Homo Sapiens
ECPPESVSF

SEQ ID NO: 500899 - protein, 9 aa, Homo Sapiens
NSLGLLPRA

SEQ ID NO: 500900 - protein, 9 aa, Homo Sapiens
ALQKQLDSR

SEQ ID NO: 500901 - protein, 9 aa, Homo Sapiens
AVTGYVVQI

SEQ ID NO: 500902 - protein, 9 aa, Homo Sapiens
STTPTFILL

SEQ ID NO: 500903 - protein, 9 aa, Homo Sapiens
GLNKSRILS

SEQ ID NO: 500904 - protein, 9 aa, Homo Sapiens
LQKQLDSRY

SEQ ID NO: 500905 - protein, 9 aa, Homo Sapiens
ESKKKTVGN

SEQ ID NO: 500906 - protein, 9 aa, Homo Sapiens
YIVTEYMNN

SEQ ID NO: 500907 - protein, 9 aa, Homo Sapiens
PGERPGDRG

SEQ ID NO: 500908 - protein, 9 aa, Homo Sapiens
ALSMAHTHG

SEQ ID NO: 500909 - protein, 9 aa, Homo Sapiens
KRDLERAEV

SEQ ID NO: 500910 - protein, 9 aa, Homo Sapiens
QQAEIQDKK

SEQ ID NO: 500911 - protein, 9 aa, Homo Sapiens
HITRAPHNP

SEQ ID NO: 500912 - protein, 9 aa, Homo Sapiens
QDCSLQHSP

SEQ ID NO: 500913 - protein, 9 aa, Homo Sapiens
FQNYVADIE

SEQ ID NO: 500914 - protein, 9 aa, Homo Sapiens
RIDLASMQI

SEQ ID NO: 500915 - protein, 9 aa, Homo Sapiens
LPSPACSST

SEQ ID NO: 500916 - protein, 9 aa, Homo Sapiens
GPKGKQGEA

SEQ ID NO: 500917 - protein, 9 aa, Homo Sapiens
TRTFIMELR

SEQ ID NO: 500918 - protein, 9 aa, Homo Sapiens
DPYTVQTIS

SEQ ID NO: 500919 - protein, 9 aa, Homo Sapiens
ETTHHDALA

SEQ ID NO: 500920 - protein, 9 aa, Homo Sapiens
VQIRQGEEE

SEQ ID NO: 500921 - protein, 9 aa, Homo Sapiens
KRNRKRSVQ

SEQ ID NO: 500922 - protein, 9 aa, Homo Sapiens
SGTQDCSLQ

SEQ ID NO: 500923 - protein, 9 aa, Homo Sapiens
AGTRTFIME

SEQ ID NO: 500924 - protein, 9 aa, Homo Sapiens
PREPSGAER

SEQ ID NO: 500925 - protein, 9 aa, Homo Sapiens
QTTCEVLVY

SEQ ID NO: 500926 - protein, 9 aa, Homo Sapiens
PLGNGHCVE

SEQ ID NO: 500927 - protein, 9 aa, Homo Sapiens
FHGATCHVR

SEQ ID NO: 500928 - protein, 9 aa, Homo Sapiens
GFAFPWKCL

SEQ ID NO: 500929 - protein, 9 aa, Homo Sapiens
RQLAAAQDE

SEQ ID NO: 500930 - protein, 9 aa, Homo Sapiens
IAGPMPPLI

SEQ ID NO: 500931 - protein, 9 aa, Homo Sapiens
HLCQGLNED

SEQ ID NO: 500932 - protein, 9 aa, Homo Sapiens
PYTVQTISL

SEQ ID NO: 500933 - protein, 9 aa, Homo Sapiens
GATCHVRVA

SEQ ID NO: 500934 - protein, 9 aa, Homo Sapiens
AGFLLYKDH

SEQ ID NO: 500935 - protein, 9 aa, Homo Sapiens
DLIKLMLRN

SEQ ID NO: 500936 - protein, 9 aa, Homo Sapiens
DLASMQIIT

SEQ ID NO: 500937 - protein, 9 aa, Homo Sapiens
AAQDEKKTL

SEQ ID NO: 500938 - protein, 9 aa, Homo Sapiens
KQPSNIKLQ

SEQ ID NO: 500939 - protein, 9 aa, Homo Sapiens
YARLEEEWG

SEQ ID NO: 500940 - protein, 9 aa, Homo Sapiens
QPYFSVESK

SEQ ID NO: 500941 - protein, 9 aa, Homo Sapiens
LAEINKYLM

SEQ ID NO: 500942 - protein, 9 aa, Homo Sapiens
YLAKHTIHH

SEQ ID NO: 500943 - protein, 9 aa, Homo Sapiens
MSILQRIAG

SEQ ID NO: 500944 - protein, 9 aa, Homo Sapiens
QEAQTTARI

SEQ ID NO: 500945 - protein, 9 aa, Homo Sapiens
CLQTLQGIY

SEQ ID NO: 500946 - protein, 9 aa, Homo Sapiens
PECDEKTSR

SEQ ID NO: 500947 - protein, 9 aa, Homo Sapiens
VPGPAPSPA

SEQ ID NO: 500948 - protein, 9 aa, Homo Sapiens
NRKRSVQEG

SEQ ID NO: 500949 - protein, 9 aa, Homo Sapiens
KLMLRNERQ

SEQ ID NO: 500950 - protein, 9 aa, Homo Sapiens
ALKRSSSEE

SEQ ID NO: 500951 - protein, 9 aa, Homo Sapiens
ISLKLGQEF

SEQ ID NO: 500952 - protein, 9 aa, Homo Sapiens
KCLGCIWGQ

SEQ ID NO: 500953 - protein, 9 aa, Homo Sapiens
VKEVPRNDM

SEQ ID NO: 500954 - protein, 9 aa, Homo Sapiens
QEYMVRNHN

SEQ ID NO: 500955 - protein, 9 aa, Homo Sapiens
GTVPTPVEF

SEQ ID NO: 500956 - protein, 9 aa, Homo Sapiens
VRLQELCLS

SEQ ID NO: 500957 - protein, 9 aa, Homo Sapiens
PPTELEPQP

SEQ ID NO: 500958 - protein, 9 aa, Homo Sapiens
AKNEAAWMA

SEQ ID NO: 500959 - protein, 9 aa, Homo Sapiens
TDYDSEQEA

SEQ ID NO: 500960 - protein, 9 aa, Homo Sapiens
KDYPLFREL

SEQ ID NO: 500961 - protein, 9 aa, Homo Sapiens
ASTQRRNDS

SEQ ID NO: 500962 - protein, 9 aa, Homo Sapiens
WNTKRIGSI

SEQ ID NO: 500963 - protein, 9 aa, Homo Sapiens
EKSIINACL

SEQ ID NO: 500964 - protein, 9 aa, Homo Sapiens
ESSKGTYKE

SEQ ID NO: 500965 - protein, 9 aa, Homo Sapiens
RLQELCLSG

SEQ ID NO: 500966 - protein, 9 aa, Homo Sapiens
PLPPASIGK

SEQ ID NO: 500967 - protein, 9 aa, Homo Sapiens
DVNKKLEHR

SEQ ID NO: 500968 - protein, 9 aa, Homo Sapiens
RRLKGESGM

SEQ ID NO: 500969 - protein, 9 aa, Homo Sapiens
AGLLKKNPK

SEQ ID NO: 500970 - protein, 9 aa, Homo Sapiens
DYFKGLDGE

SEQ ID NO: 500971 - protein, 9 aa, Homo Sapiens
RSTLTGKIA

SEQ ID NO: 500972 - protein, 9 aa, Homo Sapiens
DALLEQGYS

SEQ ID NO: 500973 - protein, 9 aa, Homo Sapiens
RNDMNIYPE

SEQ ID NO: 500974 - protein, 9 aa, Homo Sapiens
SKRNMNDPY

SEQ ID NO: 500975 - protein, 9 aa, Homo Sapiens
WSARSESAQ

SEQ ID NO: 500976 - protein, 9 aa, Homo Sapiens
NEAAWMAAL

SEQ ID NO: 500977 - protein, 9 aa, Homo Sapiens
MQKHKDLIP

SEQ ID NO: 500978 - protein, 9 aa, Homo Sapiens
CRYKDYRQP

SEQ ID NO: 500979 - protein, 9 aa, Homo Sapiens
QFGPNRLVD

SEQ ID NO: 500980 - protein, 9 aa, Homo Sapiens
SKAAVETQL

SEQ ID NO: 500981 - protein, 9 aa, Homo Sapiens
SRASTQRRN

SEQ ID NO: 500982 - protein, 9 aa, Homo Sapiens
EEHYCNMLC

SEQ ID NO: 500983 - protein, 9 aa, Homo Sapiens
LAYSRCIPG

SEQ ID NO: 500984 - protein, 9 aa, Homo Sapiens
VHGLIKQHE

SEQ ID NO: 500985 - protein, 9 aa, Homo Sapiens
NDMNIYPEY

SEQ ID NO: 500986 - protein, 9 aa, Homo Sapiens
LGLLEEMRN

SEQ ID NO: 500987 - protein, 9 aa, Homo Sapiens
KSKRNMNDP

SEQ ID NO: 500988 - protein, 9 aa, Homo Sapiens
AQGPVFSQA

SEQ ID NO: 500989 - protein, 9 aa, Homo Sapiens
SSGQVMNYK

SEQ ID NO: 500990 - protein, 9 aa, Homo Sapiens
KALQYAGKH

SEQ ID NO: 500991 - protein, 9 aa, Homo Sapiens
DEKTSRALE

SEQ ID NO: 500992 - protein, 9 aa, Homo Sapiens
NRLSAIPTS

SEQ ID NO: 500993 - protein, 9 aa, Homo Sapiens
VPRNDMNIY

SEQ ID NO: 500994 - protein, 9 aa, Homo Sapiens
LTLAEINKY

SEQ ID NO: 500995 - protein, 9 aa, Homo Sapiens
TTPTFILLG

SEQ ID NO: 500996 - protein, 9 aa, Homo Sapiens
YMALMISRE

SEQ ID NO: 500997 - protein, 9 aa, Homo Sapiens
HNTQSQVVT

SEQ ID NO: 500998 - protein, 9 aa, Homo Sapiens
RVKTVPLVS

SEQ ID NO: 500999 - protein, 9 aa, Homo Sapiens
HKRPSEAQS

SEQ ID NO: 501000 - protein, 9 aa, Homo Sapiens
KTMLQSHKL

SEQ ID NO: 501001 - protein, 9 aa, Homo Sapiens
PVEEEHYCN

SEQ ID NO: 501002 - protein, 9 aa, Homo Sapiens
GGDVGQMFS

SEQ ID NO: 501003 - protein, 9 aa, Homo Sapiens
LQTLQGIYL

SEQ ID NO: 501004 - protein, 9 aa, Homo Sapiens
EQEQPQGLW

SEQ ID NO: 501005 - protein, 9 aa, Homo Sapiens
PASIGKAVP

SEQ ID NO: 501006 - protein, 9 aa, Homo Sapiens
DKKWIVHGY

SEQ ID NO: 501007 - protein, 9 aa, Homo Sapiens
VSKVDDIHA

SEQ ID NO: 501008 - protein, 9 aa, Homo Sapiens
ECNTQFQEK

SEQ ID NO: 501009 - protein, 9 aa, Homo Sapiens
VNASCRISN

SEQ ID NO: 501010 - protein, 9 aa, Homo Sapiens
LDLNKALQY

SEQ ID NO: 501011 - protein, 9 aa, Homo Sapiens
PRTELLSLQ

SEQ ID NO: 501012 - protein, 9 aa, Homo Sapiens
RIVKVSREM

SEQ ID NO: 501013 - protein, 9 aa, Homo Sapiens
IEASIQGEL

SEQ ID NO: 501014 - protein, 9 aa, Homo Sapiens
AALKRSSSE

SEQ ID NO: 501015 - protein, 9 aa, Homo Sapiens
ARLEEEWGL

SEQ ID NO: 501016 - protein, 9 aa, Homo Sapiens
QSHKLDNIK

SEQ ID NO: 501017 - protein, 9 aa, Homo Sapiens
KNMKKQSDL

SEQ ID NO: 501018 - protein, 9 aa, Homo Sapiens
PASFQVYCD

SEQ ID NO: 501019 - protein, 9 aa, Homo Sapiens
TLQGIYLKN

SEQ ID NO: 501020 - protein, 9 aa, Homo Sapiens
YVAAKLLAK

SEQ ID NO: 501021 - protein, 9 aa, Homo Sapiens
TSARARLVD

SEQ ID NO: 501022 - protein, 9 aa, Homo Sapiens
DAQWKAQVQ

SEQ ID NO: 501023 - protein, 9 aa, Homo Sapiens
LTGSDCSQS

SEQ ID NO: 501024 - protein, 9 aa, Homo Sapiens
LAKRDLERA

SEQ ID NO: 501025 - protein, 9 aa, Homo Sapiens
FSVESKTGI

SEQ ID NO: 501026 - protein, 9 aa, Homo Sapiens
MKLMAKVKD

SEQ ID NO: 501027 - protein, 9 aa, Homo Sapiens
LNKSRILSW

SEQ ID NO: 501028 - protein, 9 aa, Homo Sapiens
KSLKETTHH

SEQ ID NO: 501029 - protein, 9 aa, Homo Sapiens
KMYSNNPFW

SEQ ID NO: 501030 - protein, 9 aa, Homo Sapiens
KLRLLQIVS

SEQ ID NO: 501031 - protein, 9 aa, Homo Sapiens
IQQTLNLFS

SEQ ID NO: 501032 - protein, 9 aa, Homo Sapiens
TNQQFEKDN

SEQ ID NO: 501033 - protein, 9 aa, Homo Sapiens
VRGPWPPNQ

SEQ ID NO: 501034 - protein, 9 aa, Homo Sapiens
NKKLEHRLE

SEQ ID NO: 501035 - protein, 9 aa, Homo Sapiens
AALSMAHTH

SEQ ID NO: 501036 - protein, 9 aa, Homo Sapiens
LLTILFRMQ

SEQ ID NO: 501037 - protein, 9 aa, Homo Sapiens
AQTTARIAH

SEQ ID NO: 501038 - protein, 9 aa, Homo Sapiens
PDNKDYPLF

SEQ ID NO: 501039 - protein, 9 aa, Homo Sapiens
LASMQIITT

SEQ ID NO: 501040 - protein, 9 aa, Homo Sapiens
LASAEFQPV

SEQ ID NO: 501041 - protein, 9 aa, Homo Sapiens
INLMISRQR

SEQ ID NO: 501042 - protein, 9 aa, Homo Sapiens
LEGMSKRNR

SEQ ID NO: 501043 - protein, 9 aa, Homo Sapiens
EVDKSKEEL

SEQ ID NO: 501044 - protein, 9 aa, Homo Sapiens
QLTNTCAYY

SEQ ID NO: 501045 - protein, 9 aa, Homo Sapiens
RCPGITIPD

SEQ ID NO: 501046 - protein, 9 aa, Homo Sapiens
LKSRWNSVA

SEQ ID NO: 501047 - protein, 9 aa, Homo Sapiens
QLQKGVQHK

SEQ ID NO: 501048 - protein, 9 aa, Homo Sapiens
SVESKTGII

SEQ ID NO: 501049 - protein, 9 aa, Homo Sapiens
DNSFPLLPM

SEQ ID NO: 501050 - protein, 9 aa, Homo Sapiens
LHKCLGCIW

SEQ ID NO: 501051 - protein, 9 aa, Homo Sapiens
QGLWPPLAS

SEQ ID NO: 501052 - protein, 9 aa, Homo Sapiens
ELEPQPEIE

SEQ ID NO: 501053 - protein, 9 aa, Homo Sapiens
SKRNRKRSV

SEQ ID NO: 501054 - protein, 9 aa, Homo Sapiens
LLQIVSYKI

SEQ ID NO: 501055 - protein, 9 aa, Homo Sapiens
LMLRNERQF

SEQ ID NO: 501056 - protein, 9 aa, Homo Sapiens
PEVLEQLQE

SEQ ID NO: 501057 - protein, 9 aa, Homo Sapiens
DCSLQHSPI

SEQ ID NO: 501058 - protein, 9 aa, Homo Sapiens
KRIGSISFD

SEQ ID NO: 501059 - protein, 9 aa, Homo Sapiens
LLLQLTNTC

SEQ ID NO: 501060 - protein, 9 aa, Homo Sapiens
FKGLDGEGR

SEQ ID NO: 501061 - protein, 9 aa, Homo Sapiens
SATLNYQGI

SEQ ID NO: 501062 - protein, 9 aa, Homo Sapiens
SAVTGYVVQ

SEQ ID NO: 501063 - protein, 9 aa, Homo Sapiens
HGLNKSRIL

SEQ ID NO: 501064 - protein, 9 aa, Homo Sapiens
SKTGIIKTA

SEQ ID NO: 501065 - protein, 9 aa, Homo Sapiens
EQMTKEKRQ

SEQ ID NO: 501066 - protein, 9 aa, Homo Sapiens
QPLGNGHCV

SEQ ID NO: 501067 - protein, 9 aa, Homo Sapiens
SLKETTHHD

SEQ ID NO: 501068 - protein, 9 aa, Homo Sapiens
AAAQDEKKT

SEQ ID NO: 501069 - protein, 9 aa, Homo Sapiens
DPFIWKHLQ

SEQ ID NO: 501070 - protein, 9 aa, Homo Sapiens
KFLTITNCM

SEQ ID NO: 501071 - protein, 9 aa, Homo Sapiens
AEELAFRIA

SEQ ID NO: 501072 - protein, 9 aa, Homo Sapiens
QTTARIAHQ

SEQ ID NO: 501073 - protein, 9 aa, Homo Sapiens
QSDEYSSPE

SEQ ID NO: 501074 - protein, 9 aa, Homo Sapiens
HYGNFDILR

SEQ ID NO: 501075 - protein, 9 aa, Homo Sapiens
GTRTFIMEL

SEQ ID NO: 501076 - protein, 9 aa, Homo Sapiens
FRIAVNTIN

SEQ ID NO: 501077 - protein, 9 aa, Homo Sapiens
PRVVGASPR

SEQ ID NO: 501078 - protein, 9 aa, Homo Sapiens
GLKKLGQLT

SEQ ID NO: 501079 - protein, 9 aa, Homo Sapiens
FVQEIQKGS

SEQ ID NO: 501080 - protein, 9 aa, Homo Sapiens
INKYLMGKF

SEQ ID NO: 501081 - protein, 9 aa, Homo Sapiens
VPMNLRVYS

SEQ ID NO: 501082 - protein, 9 aa, Homo Sapiens
VVGASPRES

SEQ ID NO: 501083 - protein, 9 aa, Homo Sapiens
LQSHKLDNI

SEQ ID NO: 501084 - protein, 9 aa, Homo Sapiens
ADALLEQGY

SEQ ID NO: 501085 - protein, 9 aa, Homo Sapiens
GTHCYAIWR

SEQ ID NO: 501086 - protein, 9 aa, Homo Sapiens
HQDLHSEIT

SEQ ID NO: 501087 - protein, 9 aa, Homo Sapiens
RAPHNPGHV

SEQ ID NO: 501088 - protein, 9 aa, Homo Sapiens
DSAAVSEGS

SEQ ID NO: 501089 - protein, 9 aa, Homo Sapiens
VCMAPLTNE

SEQ ID NO: 501090 - protein, 9 aa, Homo Sapiens
ISIFFVVAY

SEQ ID NO: 501091 - protein, 9 aa, Homo Sapiens
KPEEWDKRA

SEQ ID NO: 501092 - protein, 9 aa, Homo Sapiens
CGRGNNKDK

SEQ ID NO: 501093 - protein, 9 aa, Homo Sapiens
LVRLQELCL

SEQ ID NO: 501094 - protein, 9 aa, Homo Sapiens
LKKNPKQRL

SEQ ID NO: 501095 - protein, 9 aa, Homo Sapiens
TIILQDAEV

SEQ ID NO: 501096 - protein, 9 aa, Homo Sapiens
QTLNLFSTK

SEQ ID NO: 501097 - protein, 9 aa, Homo Sapiens
AHTHGLPSH

SEQ ID NO: 501098 - protein, 9 aa, Homo Sapiens
RELTPVFFY

SEQ ID NO: 501099 - protein, 9 aa, Homo Sapiens
TRVQIGARG

SEQ ID NO: 501100 - protein, 9 aa, Homo Sapiens
QPREPSGAE

SEQ ID NO: 501101 - protein, 9 aa, Homo Sapiens
AKVKDSLDI

SEQ ID NO: 501102 - protein, 9 aa, Homo Sapiens
FKKVVLHKC

SEQ ID NO: 501103 - protein, 9 aa, Homo Sapiens
RLHCATRVQ

SEQ ID NO: 501104 - protein, 9 aa, Homo Sapiens
FIMELRSRV

SEQ ID NO: 501105 - protein, 9 aa, Homo Sapiens
AQRLEGRPH

SEQ ID NO: 501106 - protein, 9 aa, Homo Sapiens
AFRIAVNTI

SEQ ID NO: 501107 - protein, 9 aa, Homo Sapiens
RNHNGKNYH

SEQ ID NO: 501108 - protein, 9 aa, Homo Sapiens
NMLCCKFKH

SEQ ID NO: 501109 - protein, 9 aa, Homo Sapiens
DRGSVCSAE

SEQ ID NO: 501110 - protein, 9 aa, Homo Sapiens
RCIPGLWPG

SEQ ID NO: 501111 - protein, 9 aa, Homo Sapiens
GRPHGRGTP

SEQ ID NO: 501112 - protein, 9 aa, Homo Sapiens
EAGTRGPKG

SEQ ID NO: 501113 - protein, 9 aa, Homo Sapiens
LSMAHTHGL

SEQ ID NO: 501114 - protein, 9 aa, Homo Sapiens
DKSKEELTE

SEQ ID NO: 501115 - protein, 9 aa, Homo Sapiens
AQPNGTPSP

SEQ ID NO: 501116 - protein, 9 aa, Homo Sapiens
GYVVQIRQG

SEQ ID NO: 501117 - protein, 9 aa, Homo Sapiens
VEQMTKEKR

SEQ ID NO: 501118 - protein, 9 aa, Homo Sapiens
AVGILSCRL

SEQ ID NO: 501119 - protein, 9 aa, Homo Sapiens
VCSAETKFE

SEQ ID NO: 501120 - protein, 9 aa, Homo Sapiens
GPNRLVDSA

SEQ ID NO: 501121 - protein, 9 aa, Homo Sapiens
NMKKQSDLV

SEQ ID NO: 501122 - protein, 9 aa, Homo Sapiens
PYFSVESKT

SEQ ID NO: 501123 - protein, 9 aa, Homo Sapiens
QKNILSELQ

SEQ ID NO: 501124 - protein, 9 aa, Homo Sapiens
QMNDEKRAA

SEQ ID NO: 501125 - protein, 9 aa, Homo Sapiens
EEEEMNVGS

SEQ ID NO: 501126 - protein, 9 aa, Homo Sapiens
THGLPSHMG

SEQ ID NO: 501127 - protein, 9 aa, Homo Sapiens
GPAPLCGWR

SEQ ID NO: 501128 - protein, 9 aa, Homo Sapiens
GLGLHPDPF

SEQ ID NO: 501129 - protein, 9 aa, Homo Sapiens
LIAHHAQKN

SEQ ID NO: 501130 - protein, 9 aa, Homo Sapiens
NACLILTSQ

SEQ ID NO: 501131 - protein, 9 aa, Homo Sapiens
TLRIVKVSR

SEQ ID NO: 501132 - protein, 9 aa, Homo Sapiens
DLNKALQYA

SEQ ID NO: 501133 - protein, 9 aa, Homo Sapiens
QRRNDSIYE

SEQ ID NO: 501134 - protein, 9 aa, Homo Sapiens
QLPSPACSS

SEQ ID NO: 501135 - protein, 9 aa, Homo Sapiens
QHKRPSEAQ

SEQ ID NO: 501136 - protein, 9 aa, Homo Sapiens
QPSNIKLQI

SEQ ID NO: 501137 - protein, 9 aa, Homo Sapiens
TDRGSVCSA

SEQ ID NO: 501138 - protein, 9 aa, Homo Sapiens
GVQHKRPSE

SEQ ID NO: 501139 - protein, 9 aa, Homo Sapiens
DDKKVPGKM

SEQ ID NO: 501140 - protein, 9 aa, Homo Sapiens
LWPGERPGD

SEQ ID NO: 501141 - protein, 9 aa, Homo Sapiens
EIQDKKEIA

SEQ ID NO: 501142 - protein, 9 aa, Homo Sapiens
WDKRAKIPD

SEQ ID NO: 501143 - protein, 9 aa, Homo Sapiens
KLEALQKQL

SEQ ID NO: 501144 - protein, 9 aa, Homo Sapiens
SVCSAETKF

SEQ ID NO: 501145 - protein, 9 aa, Homo Sapiens
NSESSATLN

SEQ ID NO: 501146 - protein, 9 aa, Homo Sapiens
KRAADYKIL

SEQ ID NO: 501147 - protein, 9 aa, Homo Sapiens
KPIEASIQG

SEQ ID NO: 501148 - protein, 9 aa, Homo Sapiens
DNVRHGLNK

SEQ ID NO: 501149 - protein, 9 aa, Homo Sapiens
ILFRMQAQP

SEQ ID NO: 501150 - protein, 9 aa, Homo Sapiens
VGTVPTPVE

SEQ ID NO: 501151 - protein, 9 aa, Homo Sapiens
TQRRNDSIY

SEQ ID NO: 501152 - protein, 9 aa, Homo Sapiens
KNEAAWMAA

SEQ ID NO: 501153 - protein, 9 aa, Homo Sapiens
AYIPNEVSE

SEQ ID NO: 501154 - protein, 9 aa, Homo Sapiens
CHRPEVLEQ

SEQ ID NO: 501155 - protein, 9 aa, Homo Sapiens
SPKKSCNKT

SEQ ID NO: 501156 - protein, 9 aa, Homo Sapiens
QGEAGTRGP

SEQ ID NO: 501157 - protein, 9 aa, Homo Sapiens
LVQAVDKKW

SEQ ID NO: 501158 - protein, 9 aa, Homo Sapiens
GPVHGLIKQ

SEQ ID NO: 501159 - protein, 9 aa, Homo Sapiens
LRIVKVSRE

SEQ ID NO: 501160 - protein, 9 aa, Homo Sapiens
TAWKLQLLD

SEQ ID NO: 501161 - protein, 9 aa, Homo Sapiens
LEQGYSLVS

SEQ ID NO: 501162 - protein, 9 aa, Homo Sapiens
TEISLKLGQ

SEQ ID NO: 501163 - protein, 9 aa, Homo Sapiens
ERNQSTTPT

SEQ ID NO: 501164 - protein, 9 aa, Homo Sapiens
VPLVSKVDD

SEQ ID NO: 501165 - protein, 9 aa, Homo Sapiens
KSKEELTEH

SEQ ID NO: 501166 - protein, 9 aa, Homo Sapiens
SGLGLHPDP

SEQ ID NO: 501167 - protein, 9 aa, Homo Sapiens
PLAPTTKLS

SEQ ID NO: 501168 - protein, 9 aa, Homo Sapiens
LVSKVDDIH

SEQ ID NO: 501169 - protein, 9 aa, Homo Sapiens
PSKAAVETQ

SEQ ID NO: 501170 - protein, 9 aa, Homo Sapiens
SARARLVDP

SEQ ID NO: 501171 - protein, 9 aa, Homo Sapiens
EGVTVVWPL

SEQ ID NO: 501172 - protein, 9 aa, Homo Sapiens
SMYNLDGNG

SEQ ID NO: 501173 - protein, 9 aa, Homo Sapiens
LSEENMLFW

SEQ ID NO: 501174 - protein, 9 aa, Homo Sapiens
KVGQLFTAW

SEQ ID NO: 501175 - protein, 9 aa, Homo Sapiens
CAYYMYLLL

SEQ ID NO: 501176 - protein, 9 aa, Homo Sapiens
MVTNDRSAP

SEQ ID NO: 501177 - protein, 9 aa, Homo Sapiens
VRELTPVFF

SEQ ID NO: 501178 - protein, 9 aa, Homo Sapiens
LYLLYARLE

SEQ ID NO: 501179 - protein, 9 aa, Homo Sapiens
KGSVAHRDG

SEQ ID NO: 501180 - protein, 9 aa, Homo Sapiens
TLMTFLDRF

SEQ ID NO: 501181 - protein, 9 aa, Homo Sapiens
GRCPGGTLV

SEQ ID NO: 501182 - protein, 9 aa, Homo Sapiens
KEEGNATII

SEQ ID NO: 501183 - protein, 9 aa, Homo Sapiens
KRQAAQNEC

SEQ ID NO: 501184 - protein, 9 aa, Homo Sapiens
FQEYGPVIE

SEQ ID NO: 501185 - protein, 9 aa, Homo Sapiens
LGNTDRGSV

SEQ ID NO: 501186 - protein, 9 aa, Homo Sapiens
QSDLVKGKR

SEQ ID NO: 501187 - protein, 9 aa, Homo Sapiens
THYPASFQV

SEQ ID NO: 501188 - protein, 9 aa, Homo Sapiens
IMRVLCIAR

SEQ ID NO: 501189 - protein, 9 aa, Homo Sapiens
EYSSPELVK

SEQ ID NO: 501190 - protein, 9 aa, Homo Sapiens
AKVGQLFTA

SEQ ID NO: 501191 - protein, 9 aa, Homo Sapiens
LEGRPHGRG

SEQ ID NO: 501192 - protein, 9 aa, Homo Sapiens
CIPGLWPGE

SEQ ID NO: 501193 - protein, 9 aa, Homo Sapiens
GHNTQSQVV

SEQ ID NO: 501194 - protein, 9 aa, Homo Sapiens
TVQTISLFQ

SEQ ID NO: 501195 - protein, 9 aa, Homo Sapiens
GMSKRNRKR

SEQ ID NO: 501196 - protein, 9 aa, Homo Sapiens
EHRLEEVQF

SEQ ID NO: 501197 - protein, 9 aa, Homo Sapiens
LSAIPTSLA

SEQ ID NO: 501198 - protein, 9 aa, Homo Sapiens
GERPGDRGP

SEQ ID NO: 501199 - protein, 9 aa, Homo Sapiens
QLADGQVGR

SEQ ID NO: 501200 - protein, 9 aa, Homo Sapiens
LLKKNPKQR

SEQ ID NO: 501201 - protein, 9 aa, Homo Sapiens
KREPCKISF

SEQ ID NO: 501202 - protein, 9 aa, Homo Sapiens
NKGISPVPM

SEQ ID NO: 501203 - protein, 9 aa, Homo Sapiens
MSQAIIRGM

SEQ ID NO: 501204 - protein, 9 aa, Homo Sapiens
SIINACLIL

SEQ ID NO: 501205 - protein, 9 aa, Homo Sapiens
GQMFSCRLQ

SEQ ID NO: 501206 - protein, 9 aa, Homo Sapiens
ITIPDSQNH

SEQ ID NO: 501207 - protein, 9 aa, Homo Sapiens
RQPPWSENK

SEQ ID NO: 501208 - protein, 9 aa, Homo Sapiens
HPTPLKREP

SEQ ID NO: 501209 - protein, 9 aa, Homo Sapiens
RISNLLAEH

SEQ ID NO: 501210 - protein, 9 aa, Homo Sapiens
SSTDYDSEQ

SEQ ID NO: 501211 - protein, 9 aa, Homo Sapiens
AGTRGPKGS

SEQ ID NO: 501212 - protein, 9 aa, Homo Sapiens
FKNTEISLK

SEQ ID NO: 501213 - protein, 9 aa, Homo Sapiens
RGHNTQSQV

SEQ ID NO: 501214 - protein, 9 aa, Homo Sapiens
GISPVPMNL

SEQ ID NO: 501215 - protein, 9 aa, Homo Sapiens
WKHLQWIVM

SEQ ID NO: 501216 - protein, 9 aa, Homo Sapiens
GLHPDPFIW

SEQ ID NO: 501217 - protein, 9 aa, Homo Sapiens
PVFSQAAAA

SEQ ID NO: 501218 - protein, 9 aa, Homo Sapiens
GMSILQRIA

SEQ ID NO: 501219 - protein, 9 aa, Homo Sapiens
VSSKVSYEI

SEQ ID NO: 501220 - protein, 9 aa, Homo Sapiens
LWQYKVLVH

SEQ ID NO: 501221 - protein, 9 aa, Homo Sapiens
LAKNEAAWM

SEQ ID NO: 501222 - protein, 9 aa, Homo Sapiens
YAGKHMEDC

SEQ ID NO: 501223 - protein, 9 aa, Homo Sapiens
LIPQSAADI

SEQ ID NO: 501224 - protein, 9 aa, Homo Sapiens
SADNEVPPP

SEQ ID NO: 501225 - protein, 9 aa, Homo Sapiens
SQAIIRGMM

SEQ ID NO: 501226 - protein, 9 aa, Homo Sapiens
ASFQVYCDM

SEQ ID NO: 501227 - protein, 9 aa, Homo Sapiens
IAQVVVSTD

SEQ ID NO: 501228 - protein, 9 aa, Homo Sapiens
IDIDYFKGL

SEQ ID NO: 501229 - protein, 9 aa, Homo Sapiens
HRLEEVQFW

SEQ ID NO: 501230 - protein, 9 aa, Homo Sapiens
RGSVCSAET

SEQ ID NO: 501231 - protein, 9 aa, Homo Sapiens
KLKKMVTND

SEQ ID NO: 501232 - protein, 9 aa, Homo Sapiens
VPTVFQNYV

SEQ ID NO: 501233 - protein, 9 aa, Homo Sapiens
QTHTIDKEW

SEQ ID NO: 501234 - protein, 9 aa, Homo Sapiens
AEFQPVPSI

SEQ ID NO: 501235 - protein, 9 aa, Homo Sapiens
LTILFRMQA

SEQ ID NO: 501236 - protein, 9 aa, Homo Sapiens
NTSWGTLGS

SEQ ID NO: 501237 - protein, 9 aa, Homo Sapiens
QELLASAEF

SEQ ID NO: 501238 - protein, 9 aa, Homo Sapiens
YFKGLDGEG

SEQ ID NO: 501239 - protein, 9 aa, Homo Sapiens
LLEEMRNEK

SEQ ID NO: 501240 - protein, 9 aa, Homo Sapiens
PSVLLLPMR

SEQ ID NO: 501241 - protein, 9 aa, Homo Sapiens
ATIILQDAE

SEQ ID NO: 501242 - protein, 9 aa, Homo Sapiens
TLRELIRTI

SEQ ID NO: 501243 - protein, 9 aa, Homo Sapiens
QGFAFPWKC

SEQ ID NO: 501244 - protein, 9 aa, Homo Sapiens
EEWDKRAKI

SEQ ID NO: 501245 - protein, 9 aa, Homo Sapiens
ASAEFQPVP

SEQ ID NO: 501246 - protein, 9 aa, Homo Sapiens
HGATCHVRV

SEQ ID NO: 501247 - protein, 9 aa, Homo Sapiens
HHAQKNTEL

SEQ ID NO: 501248 - protein, 9 aa, Homo Sapiens
TYRRNIRKF

SEQ ID NO: 501249 - protein, 9 aa, Homo Sapiens
AFKAKIKKT

SEQ ID NO: 501250 - protein, 9 aa, Homo Sapiens
KQQQAEIQD

SEQ ID NO: 501251 - protein, 9 aa, Homo Sapiens
IESSKGTYK

SEQ ID NO: 501252 - protein, 9 aa, Homo Sapiens
KQGEAGTRG

SEQ ID NO: 501253 - protein, 9 aa, Homo Sapiens
MAKVKDSLD

SEQ ID NO: 501254 - protein, 9 aa, Homo Sapiens
NLDGNGYIS

SEQ ID NO: 501255 - protein, 9 aa, Homo Sapiens
NTQSQVVTR

SEQ ID NO: 501256 - protein, 9 aa, Homo Sapiens
GQDAGLLRE

SEQ ID NO: 501257 - protein, 9 aa, Homo Sapiens
IYLKNIQSV

SEQ ID NO: 501258 - protein, 9 aa, Homo Sapiens
GAGTHCYAI

SEQ ID NO: 501259 - protein, 9 aa, Homo Sapiens
RAADYKILG

SEQ ID NO: 501260 - protein, 9 aa, Homo Sapiens
SIFFVVAYT

SEQ ID NO: 501261 - protein, 9 aa, Homo Sapiens
KDKLLLCDG

SEQ ID NO: 501262 - protein, 9 aa, Homo Sapiens
EMIQQTLNL

SEQ ID NO: 501263 - protein, 9 aa, Homo Sapiens
YVPTVFQNY

SEQ ID NO: 501264 - protein, 9 aa, Homo Sapiens
TNTCAYYMY

SEQ ID NO: 501265 - protein, 9 aa, Homo Sapiens
SPSKAAVET

SEQ ID NO: 501266 - protein, 9 aa, Homo Sapiens
GASPRESPL

SEQ ID NO: 501267 - protein, 9 aa, Homo Sapiens
FQVSSKVSY

SEQ ID NO: 501268 - protein, 9 aa, Homo Sapiens
LLAYSRCIP

SEQ ID NO: 501269 - protein, 9 aa, Homo Sapiens
FSMYNLDGN

SEQ ID NO: 501270 - protein, 9 aa, Homo Sapiens
ISNLLAEHS

SEQ ID NO: 501271 - protein, 9 aa, Homo Sapiens
PSPAAPPAQ

SEQ ID NO: 501272 - protein, 9 aa, Homo Sapiens
TLVNASCRI

SEQ ID NO: 501273 - protein, 9 aa, Homo Sapiens
KVSREMSGM

SEQ ID NO: 501274 - protein, 9 aa, Homo Sapiens
GKQGEAGTR

SEQ ID NO: 501275 - protein, 9 aa, Homo Sapiens
NMKTYRRNI

SEQ ID NO: 501276 - protein, 9 aa, Homo Sapiens
KGLDGEGRG

SEQ ID NO: 501277 - protein, 9 aa, Homo Sapiens
VFPTHYPAS

SEQ ID NO: 501278 - protein, 9 aa, Homo Sapiens
CLILTSQRI

SEQ ID NO: 501279 - protein, 9 aa, Homo Sapiens
KQSDLVKGK

SEQ ID NO: 501280 - protein, 9 aa, Homo Sapiens
LEALQKQLD

SEQ ID NO: 501281 - protein, 9 aa, Homo Sapiens
SKKKTVGND

SEQ ID NO: 501282 - protein, 9 aa, Homo Sapiens
AGTHCYAIW

SEQ ID NO: 501283 - protein, 9 aa, Homo Sapiens
EVPPPVSAA

SEQ ID NO: 501284 - protein, 9 aa, Homo Sapiens
SSEEPAEIL

SEQ ID NO: 501285 - protein, 9 aa, Homo Sapiens
EEEMNVGSQ

SEQ ID NO: 501286 - protein, 9 aa, Homo Sapiens
DGGDVGQMF

SEQ ID NO: 501287 - protein, 9 aa, Homo Sapiens
PWPPNQQQP

SEQ ID NO: 501288 - protein, 9 aa, Homo Sapiens
FSQAAAAQH

SEQ ID NO: 501289 - protein, 9 aa, Homo Sapiens
SPVPMNLRV

SEQ ID NO: 501290 - protein, 9 aa, Homo Sapiens
CKDLIKLML

SEQ ID NO: 501291 - protein, 9 aa, Homo Sapiens
PAPSPAAPP

SEQ ID NO: 501292 - protein, 9 aa, Homo Sapiens
QWKAQVQSL

SEQ ID NO: 501293 - protein, 9 aa, Homo Sapiens
LCLSGACLT

SEQ ID NO: 501294 - protein, 9 aa, Homo Sapiens
LFKKVVLHK

SEQ ID NO: 501295 - protein, 9 aa, Homo Sapiens
YGDLKSRWN

SEQ ID NO: 501296 - protein, 9 aa, Homo Sapiens
EVLVYFLRR

SEQ ID NO: 501297 - protein, 9 aa, Homo Sapiens
EYMVRNHNG

SEQ ID NO: 501298 - protein, 9 aa, Homo Sapiens
LTNTCAYYM

SEQ ID NO: 501299 - protein, 9 aa, Homo Sapiens
AQWKAQVQS

SEQ ID NO: 501300 - protein, 9 aa, Homo Sapiens
QQTLNLFST

SEQ ID NO: 501301 - protein, 9 aa, Homo Sapiens
PNGTPSPGG

SEQ ID NO: 501302 - protein, 9 aa, Homo Sapiens
SERNQSTTP

SEQ ID NO: 501303 - protein, 9 aa, Homo Sapiens
ELQRDLNEF

SEQ ID NO: 501304 - protein, 9 aa, Homo Sapiens
IKQHEDALH

SEQ ID NO: 501305 - protein, 9 aa, Homo Sapiens
MSALCHPPG

SEQ ID NO: 501306 - protein, 9 aa, Homo Sapiens
KQLQKGVQH

SEQ ID NO: 501307 - protein, 9 aa, Homo Sapiens
MELRSRVFP

SEQ ID NO: 501308 - protein, 9 aa, Homo Sapiens
RLVDPGFGI

SEQ ID NO: 501309 - protein, 9 aa, Homo Sapiens
DADGYVAAK

SEQ ID NO: 501310 - protein, 9 aa, Homo Sapiens
NNKDKLLLC

SEQ ID NO: 501311 - protein, 9 aa, Homo Sapiens
QAGTRTFIM

SEQ ID NO: 501312 - protein, 9 aa, Homo Sapiens
GPEKLAAPS

SEQ ID NO: 501313 - protein, 9 aa, Homo Sapiens
FQKIRIDLA

SEQ ID NO: 501314 - protein, 9 aa, Homo Sapiens
ARAGRCPGI

SEQ ID NO: 501315 - protein, 9 aa, Homo Sapiens
SDKVHNELK

SEQ ID NO: 501316 - protein, 9 aa, Homo Sapiens
RPHGRGTPS

SEQ ID NO: 501317 - protein, 9 aa, Homo Sapiens
GTLVARPGM

SEQ ID NO: 501318 - protein, 9 aa, Homo Sapiens
KLGQLTTDF

SEQ ID NO: 501319 - protein, 9 aa, Homo Sapiens
TGYVVQIRQ

SEQ ID NO: 501320 - protein, 9 aa, Homo Sapiens
MASERNQST

SEQ ID NO: 501321 - protein, 9 aa, Homo Sapiens
LIKLMLRNE

SEQ ID NO: 501322 - protein, 9 aa, Homo Sapiens
VGRGLPVQP

SEQ ID NO: 501323 - protein, 9 aa, Homo Sapiens
HGLIKQHED

SEQ ID NO: 501324 - protein, 9 aa, Homo Sapiens
RVLCIARVL

SEQ ID NO: 501325 - protein, 9 aa, Homo Sapiens
DGTLRIVKV

SEQ ID NO: 501326 - protein, 9 aa, Homo Sapiens
SKEELTEHI

SEQ ID NO: 501327 - protein, 9 aa, Homo Sapiens
QRQLAAAQD

SEQ ID NO: 501328 - protein, 9 aa, Homo Sapiens
GYRDPYTVQ

SEQ ID NO: 501329 - protein, 9 aa, Homo Sapiens
PSPACSSTQ

SEQ ID NO: 501330 - protein, 9 aa, Homo Sapiens
TWLRAPPNA

SEQ ID NO: 501331 - protein, 9 aa, Homo Sapiens
KLHECNTQF

SEQ ID NO: 501332 - protein, 9 aa, Homo Sapiens
TFLDRFVYR

SEQ ID NO: 501333 - protein, 9 aa, Homo Sapiens
NGTPSPGGS

SEQ ID NO: 501334 - protein, 9 aa, Homo Sapiens
AKIKKTDVK

SEQ ID NO: 501335 - protein, 9 aa, Homo Sapiens
IILQDAEVH

SEQ ID NO: 501336 - protein, 9 aa, Homo Sapiens
CDPVHFKTF

SEQ ID NO: 501337 - protein, 9 aa, Homo Sapiens
GKLRLLQIV

SEQ ID NO: 501338 - protein, 9 aa, Homo Sapiens
AQLQPLGNG

SEQ ID NO: 501339 - protein, 9 aa, Homo Sapiens
IRIDLASMQ

SEQ ID NO: 501340 - protein, 9 aa, Homo Sapiens
EEGNATIIL

SEQ ID NO: 501341 - protein, 9 aa, Homo Sapiens
GRCPGITIP

SEQ ID NO: 501342 - protein, 9 aa, Homo Sapiens
NASCRISNL

SEQ ID NO: 501343 - protein, 9 aa, Homo Sapiens
VQHKRPSEA

SEQ ID NO: 501344 - protein, 9 aa, Homo Sapiens
QAIIRGMMD

SEQ ID NO: 501345 - protein, 9 aa, Homo Sapiens
RLEGRPHGR

SEQ ID NO: 501346 - protein, 9 aa, Homo Sapiens
NTKRIGSIS

SEQ ID NO: 501347 - protein, 9 aa, Homo Sapiens
GSQGQSQPL

SEQ ID NO: 501348 - protein, 9 aa, Homo Sapiens
HVRVASFYC

SEQ ID NO: 501349 - protein, 9 aa, Homo Sapiens
IFFVVAYTI

SEQ ID NO: 501350 - protein, 9 aa, Homo Sapiens
EIAGPMPPL

SEQ ID NO: 501351 - protein, 9 aa, Homo Sapiens
LEHRLEEVQ

SEQ ID NO: 501352 - protein, 9 aa, Homo Sapiens
AFLGMSILQ

SEQ ID NO: 501353 - protein, 9 aa, Homo Sapiens
LQLTNTCAY

SEQ ID NO: 501354 - protein, 9 aa, Homo Sapiens
SMKLMAKVK

SEQ ID NO: 501355 - protein, 9 aa, Homo Sapiens
IFVQEIQKG

SEQ ID NO: 501356 - protein, 9 aa, Homo Sapiens
PPASIGKAV

SEQ ID NO: 501357 - protein, 9 aa, Homo Sapiens
SESSATLNY

SEQ ID NO: 501358 - protein, 9 aa, Homo Sapiens
SVGISIFFV

SEQ ID NO: 501359 - protein, 9 aa, Homo Sapiens
APSPAAPPA

SEQ ID NO: 501360 - protein, 9 aa, Homo Sapiens
CFHGATCHV

SEQ ID NO: 501361 - protein, 9 aa, Homo Sapiens
HPPGAPGPP

SEQ ID NO: 501362 - protein, 9 aa, Homo Sapiens
CMLLESDLK

SEQ ID NO: 501363 - protein, 9 aa, Homo Sapiens
CPGITIPDS

SEQ ID NO: 501364 - protein, 9 aa, Homo Sapiens
RKEAAQKRK

SEQ ID NO: 501365 - protein, 9 aa, Homo Sapiens
VRAYIPNEV

SEQ ID NO: 501366 - protein, 9 aa, Homo Sapiens
YDSEQEAHK

SEQ ID NO: 501367 - protein, 9 aa, Homo Sapiens
WKAQVQSLF

SEQ ID NO: 501368 - protein, 9 aa, Homo Sapiens
HCYAIWRYL

SEQ ID NO: 501369 - protein, 9 aa, Homo Sapiens
GNTDRGSVC

SEQ ID NO: 501370 - protein, 9 aa, Homo Sapiens
RNRKRSVQE

SEQ ID NO: 501371 - protein, 9 aa, Homo Sapiens
PFHDPVIGP

SEQ ID NO: 501372 - protein, 9 aa, Homo Sapiens
AHHAQKNTE

SEQ ID NO: 501373 - protein, 9 aa, Homo Sapiens
GESGMEDCV

SEQ ID NO: 501374 - protein, 9 aa, Homo Sapiens
SDEYSSPEL

SEQ ID NO: 501375 - protein, 9 aa, Homo Sapiens
DGYVAAKLL

SEQ ID NO: 501376 - protein, 9 aa, Homo Sapiens
MQAHITRAP

SEQ ID NO: 501377 - protein, 9 aa, Homo Sapiens
QRIAGEEDH

SEQ ID NO: 501378 - protein, 9 aa, Homo Sapiens
GILSCRLQE

SEQ ID NO: 501379 - protein, 9 aa, Homo Sapiens
PESVSFDPL

SEQ ID NO: 501380 - protein, 9 aa, Homo Sapiens
CNTQFQEKS

SEQ ID NO: 501381 - protein, 9 aa, Homo Sapiens
RTFIMELRS

SEQ ID NO: 501382 - protein, 9 aa, Homo Sapiens
LVNNFLCPL

SEQ ID NO: 501383 - protein, 9 aa, Homo Sapiens
LCHPPGAPG

SEQ ID NO: 501384 - protein, 9 aa, Homo Sapiens
DVRELTPVF

SEQ ID NO: 501385 - protein, 9 aa, Homo Sapiens
ADGYVAAKL

SEQ ID NO: 501386 - protein, 9 aa, Homo Sapiens
FGPNRLVDS

SEQ ID NO: 501387 - protein, 9 aa, Homo Sapiens
YRQPPWSEN

SEQ ID NO: 501388 - protein, 9 aa, Homo Sapiens
SQEAQTTAR

SEQ ID NO: 501389 - protein, 9 aa, Homo Sapiens
AEELWQYKV

SEQ ID NO: 501390 - protein, 9 aa, Homo Sapiens
GESMKLMAK

SEQ ID NO: 501391 - protein, 9 aa, Homo Sapiens
MALMISRET

SEQ ID NO: 501392 - protein, 9 aa, Homo Sapiens
DIRHYLFRV

SEQ ID NO: 501393 - protein, 9 aa, Homo Sapiens
KKMVTNDRS

SEQ ID NO: 501394 - protein, 9 aa, Homo Sapiens
SLQHSPISS

SEQ ID NO: 501395 - protein, 9 aa, Homo Sapiens
GKMYSNNPF

SEQ ID NO: 501396 - protein, 9 aa, Homo Sapiens
RLAVRFNSL

SEQ ID NO: 501397 - protein, 9 aa, Homo Sapiens
VLEQLQEQT

SEQ ID NO: 501398 - protein, 9 aa, Homo Sapiens
VKSGLGLHP

SEQ ID NO: 501399 - protein, 9 aa, Homo Sapiens
KKLGQLTTD

SEQ ID NO: 501400 - protein, 9 aa, Homo Sapiens
AKRDLERAE

SEQ ID NO: 501401 - protein, 9 aa, Homo Sapiens
APFEDVTNN

SEQ ID NO: 501402 - protein, 9 aa, Homo Sapiens
LGSSTDYDS

SEQ ID NO: 501403 - protein, 9 aa, Homo Sapiens
GPDNKDYPL

SEQ ID NO: 501404 - protein, 9 aa, Homo Sapiens
SSSEEPAEI

SEQ ID NO: 501405 - protein, 9 aa, Homo Sapiens
EQLSSPKKS

SEQ ID NO: 501406 - protein, 9 aa, Homo Sapiens
RIGSISFDF

SEQ ID NO: 501407 - protein, 9 aa, Homo Sapiens
ELRAKFQEY

SEQ ID NO: 501408 - protein, 9 aa, Homo Sapiens
EAQTTARIA

SEQ ID NO: 501409 - protein, 9 aa, Homo Sapiens
MADALLEQG

SEQ ID NO: 501410 - protein, 9 aa, Homo Sapiens
VPTPVEFMG

SEQ ID NO: 501411 - protein, 9 aa, Homo Sapiens
PPESVSFDP

SEQ ID NO: 501412 - protein, 9 aa, Homo Sapiens
EAFKAKIKK

SEQ ID NO: 501413 - protein, 9 aa, Homo Sapiens
WIVHGYVRV

SEQ ID NO: 501414 - protein, 9 aa, Homo Sapiens
WQYKVLVHS

SEQ ID NO: 501415 - protein, 9 aa, Homo Sapiens
SQSNAEIEN

SEQ ID NO: 501416 - protein, 9 aa, Homo Sapiens
PRNDMNIYP

SEQ ID NO: 501417 - protein, 9 aa, Homo Sapiens
EEMRNEKLV

SEQ ID NO: 501418 - protein, 9 aa, Homo Sapiens
KGKKSKRNM

SEQ ID NO: 501419 - protein, 9 aa, Homo Sapiens
MPAPITLRE

SEQ ID NO: 501420 - protein, 9 aa, Homo Sapiens
AHQDLHSEI

SEQ ID NO: 501421 - protein, 9 aa, Homo Sapiens
FNSLGLLPR

SEQ ID NO: 501422 - protein, 9 aa, Homo Sapiens
PGGTLVARP

SEQ ID NO: 501423 - protein, 9 aa, Homo Sapiens
IAHHAQKNT

SEQ ID NO: 501424 - protein, 9 aa, Homo Sapiens
GLGSSTDYD

SEQ ID NO: 501425 - protein, 9 aa, Homo Sapiens
LVYFLRRLG

SEQ ID NO: 501426 - protein, 9 aa, Homo Sapiens
LLPHFCVTY

SEQ ID NO: 501427 - protein, 9 aa, Homo Sapiens
QVSSKVSYE

SEQ ID NO: 501428 - protein, 9 aa, Homo Sapiens
QPPWSENKY

SEQ ID NO: 501429 - protein, 9 aa, Homo Sapiens
WGQRGKYPP

SEQ ID NO: 501430 - protein, 9 aa, Homo Sapiens
LKWAFSMYN

SEQ ID NO: 501431 - protein, 9 aa, Homo Sapiens
FLLYKDHLP

SEQ ID NO: 501432 - protein, 9 aa, Homo Sapiens
EPECDEKTS

SEQ ID NO: 501433 - protein, 9 aa, Homo Sapiens
SIQGELSGD

SEQ ID NO: 501434 - protein, 9 aa, Homo Sapiens
NTCAYYMYL

SEQ ID NO: 501435 - protein, 9 aa, Homo Sapiens
VKTVPLVSK

SEQ ID NO: 501436 - protein, 9 aa, Homo Sapiens
ILSWGQRGK

SEQ ID NO: 501437 - protein, 9 aa, Homo Sapiens
AHRLAVRFN

SEQ ID NO: 501438 - protein, 9 aa, Homo Sapiens
KTWLRAPPN

SEQ ID NO: 501439 - protein, 9 aa, Homo Sapiens
QQFEKDNNT

SEQ ID NO: 501440 - protein, 9 aa, Homo Sapiens
LVPFHDPVI

SEQ ID NO: 501441 - protein, 9 aa, Homo Sapiens
GEAEAFKAK

SEQ ID NO: 501442 - protein, 9 aa, Homo Sapiens
AGRCPGITI

SEQ ID NO: 501443 - protein, 9 aa, Homo Sapiens
TAIKSADNE

SEQ ID NO: 501444 - protein, 9 aa, Homo Sapiens
ERPGDRGPA

SEQ ID NO: 501445 - protein, 9 aa, Homo Sapiens
CMAPLTNEI

SEQ ID NO: 501446 - protein, 9 aa, Homo Sapiens
NNGSLLDFL

SEQ ID NO: 501447 - protein, 9 aa, Homo Sapiens
ALEMMSQAI

SEQ ID NO: 501448 - protein, 9 aa, Homo Sapiens
INACLILTS

SEQ ID NO: 501449 - protein, 9 aa, Homo Sapiens
CQGLNEDIR

SEQ ID NO: 501450 - protein, 9 aa, Homo Sapiens
ELCLSGACL

SEQ ID NO: 501451 - protein, 9 aa, Homo Sapiens
GGTLVARPG

SEQ ID NO: 501452 - protein, 9 aa, Homo Sapiens
SRWNSVASP

SEQ ID NO: 501453 - protein, 9 aa, Homo Sapiens
YSSPELVKM

SEQ ID NO: 501454 - protein, 9 aa, Homo Sapiens
EAEAFKAKI

SEQ ID NO: 501455 - protein, 9 aa, Homo Sapiens
SRCIPGLWP

SEQ ID NO: 501456 - protein, 9 aa, Homo Sapiens
TYKEGGGSA

SEQ ID NO: 501457 - protein, 9 aa, Homo Sapiens
TLKMEIAGP

SEQ ID NO: 501458 - protein, 9 aa, Homo Sapiens
VQIGARGAP

SEQ ID NO: 501459 - protein, 9 aa, Homo Sapiens
CEVLVYFLR

SEQ ID NO: 501460 - protein, 9 aa, Homo Sapiens
FGAGTHCYA

SEQ ID NO: 501461 - protein, 9 aa, Homo Sapiens
DINLMISRQ

SEQ ID NO: 501462 - protein, 9 aa, Homo Sapiens
NRLVDSAAV

SEQ ID NO: 501463 - protein, 9 aa, Homo Sapiens
YNRLSAIPT

SEQ ID NO: 501464 - protein, 9 aa, Homo Sapiens
EELWQYKVL

SEQ ID NO: 501465 - protein, 9 aa, Homo Sapiens
YKDYRQPPW

SEQ ID NO: 501466 - protein, 9 aa, Homo Sapiens
AKLLAKDVP

SEQ ID NO: 501467 - protein, 9 aa, Homo Sapiens
SPPSCPPHH

SEQ ID NO: 501468 - protein, 9 aa, Homo Sapiens
AVGKKLHEC

SEQ ID NO: 501469 - protein, 9 aa, Homo Sapiens
CLSGACLTS

SEQ ID NO: 501470 - protein, 9 aa, Homo Sapiens
SDLIAHHAQ

SEQ ID NO: 501471 - protein, 9 aa, Homo Sapiens
TELSEENML

SEQ ID NO: 501472 - protein, 9 aa, Homo Sapiens
KHSMAHQDL

SEQ ID NO: 501473 - protein, 9 aa, Homo Sapiens
EIQKGSVAH

SEQ ID NO: 501474 - protein, 9 aa, Homo Sapiens
LAAAQDEKK

SEQ ID NO: 501475 - protein, 9 aa, Homo Sapiens
QWECPPESV

SEQ ID NO: 501476 - protein, 9 aa, Homo Sapiens
QKHKDLIPQ

SEQ ID NO: 501477 - protein, 9 aa, Homo Sapiens
DMNIYPEYI

SEQ ID NO: 501478 - protein, 9 aa, Homo Sapiens
KKQSDLVKG

SEQ ID NO: 501479 - protein, 9 aa, Homo Sapiens
ASMQIITTD

SEQ ID NO: 501480 - protein, 9 aa, Homo Sapiens
DKRAKIPDP

SEQ ID NO: 501481 - protein, 9 aa, Homo Sapiens
IGKAVPQPK

SEQ ID NO: 501482 - protein, 9 aa, Homo Sapiens
PHNPGHVIQ

SEQ ID NO: 501483 - protein, 9 aa, Homo Sapiens
LRTELSEEN

SEQ ID NO: 501484 - protein, 9 aa, Homo Sapiens
MLQSHKLDN

SEQ ID NO: 501485 - protein, 9 aa, Homo Sapiens
RWNSVASPT

SEQ ID NO: 501486 - protein, 9 aa, Homo Sapiens
QAVDKKWIV

SEQ ID NO: 501487 - protein, 9 aa, Homo Sapiens
RQSDEYSSP

SEQ ID NO: 501488 - protein, 9 aa, Homo Sapiens
SNIKLQIPK

SEQ ID NO: 501489 - protein, 9 aa, Homo Sapiens
LMISRETEN

SEQ ID NO: 501490 - protein, 9 aa, Homo Sapiens
CRISNLLAE

SEQ ID NO: 501491 - protein, 9 aa, Homo Sapiens
KGKQGEAGT

SEQ ID NO: 501492 - protein, 9 aa, Homo Sapiens
APLCGWRKD

SEQ ID NO: 501493 - protein, 9 aa, Homo Sapiens
GLNEDIRHY

SEQ ID NO: 501494 - protein, 9 aa, Homo Sapiens
NVGSQMVRS

SEQ ID NO: 501495 - protein, 9 aa, Homo Sapiens
GNNKDKLLL

SEQ ID NO: 501496 - protein, 9 aa, Homo Sapiens
AEAFKAKIK

SEQ ID NO: 501497 - protein, 9 aa, Homo Sapiens
PDPFIWKHL

SEQ ID NO: 501498 - protein, 9 aa, Homo Sapiens
ESSATLNYQ

SEQ ID NO: 501499 - protein, 9 aa, Homo Sapiens
VESKTGIIK

SEQ ID NO: 501500 - protein, 9 aa, Homo Sapiens
MDAALKRSS

SEQ ID NO: 501501 - protein, 9 aa, Homo Sapiens
YMNNGSLLD

SEQ ID NO: 501502 - protein, 9 aa, Homo Sapiens
EQGYSLVSG

SEQ ID NO: 501503 - protein, 9 aa, Homo Sapiens
FLGMSILQR

SEQ ID NO: 501504 - protein, 9 aa, Homo Sapiens
KDLIPQSAA

SEQ ID NO: 501505 - protein, 9 aa, Homo Sapiens
RGPAPLCGW

SEQ ID NO: 501506 - protein, 9 aa, Homo Sapiens
EASIQGELS

SEQ ID NO: 501507 - protein, 9 aa, Homo Sapiens
NSPSDKVHN

SEQ ID NO: 501508 - protein, 9 aa, Homo Sapiens
GIYLKNIQS

SEQ ID NO: 501509 - protein, 9 aa, Homo Sapiens
PARAQPNGT

SEQ ID NO: 501510 - protein, 9 aa, Homo Sapiens
TLLVCMAPL

SEQ ID NO: 501511 - protein, 9 aa, Homo Sapiens
WECPPESVS

SEQ ID NO: 501512 - protein, 9 aa, Homo Sapiens
VRFNSLGLL

SEQ ID NO: 501513 - protein, 9 aa, Homo Sapiens
ELTPVFFYL

SEQ ID NO: 501514 - protein, 9 aa, Homo Sapiens
NKALQYAGK

SEQ ID NO: 501515 - protein, 9 aa, Homo Sapiens
LQELCLSGA

SEQ ID NO: 501516 - protein, 9 aa, Homo Sapiens
IVHGYVRVK

SEQ ID NO: 501517 - protein, 9 aa, Homo Sapiens
PHFCVTYSR

SEQ ID NO: 501518 - protein, 9 aa, Homo Sapiens
KLAAPSPAA

SEQ ID NO: 501519 - protein, 9 aa, Homo Sapiens
TTCEVLVYF

SEQ ID NO: 501520 - protein, 9 aa, Homo Sapiens
TPINMKTYR

SEQ ID NO: 501521 - protein, 9 aa, Homo Sapiens
DFTLMTFLD

SEQ ID NO: 501522 - protein, 9 aa, Homo Sapiens
MTFLDRFVY

SEQ ID NO: 501523 - protein, 9 aa, Homo Sapiens
PKGKQGEAG

SEQ ID NO: 501524 - protein, 9 aa, Homo Sapiens
ISPVPMNLR

SEQ ID NO: 501525 - protein, 9 aa, Homo Sapiens
LAVRFNSLG

SEQ ID NO: 501526 - protein, 9 aa, Homo Sapiens
HVETNQQFE

SEQ ID NO: 501527 - protein, 9 aa, Homo Sapiens
KGISPVPMN

SEQ ID NO: 501528 - protein, 9 aa, Homo Sapiens
SYLAKHTIH

SEQ ID NO: 501529 - protein, 9 aa, Homo Sapiens
SSHYGNFDI

SEQ ID NO: 501530 - protein, 9 aa, Homo Sapiens
ARARLVDPG

SEQ ID NO: 501531 - protein, 9 aa, Homo Sapiens
GAEELAFRI

SEQ ID NO: 501532 - protein, 9 aa, Homo Sapiens
QSNAEIENL

SEQ ID NO: 501533 - protein, 9 aa, Homo Sapiens
TELEPQPEI

SEQ ID NO: 501534 - protein, 9 aa, Homo Sapiens
RAKFQEYGP

SEQ ID NO: 501535 - protein, 9 aa, Homo Sapiens
RASTQRRND

SEQ ID NO: 501536 - protein, 9 aa, Homo Sapiens
LIVLLLTIL

SEQ ID NO: 501537 - protein, 9 aa, Homo Sapiens
QLSSPKKSC

SEQ ID NO: 501538 - protein, 9 aa, Homo Sapiens
KEVPRNDMN

SEQ ID NO: 501539 - protein, 9 aa, Homo Sapiens
RVVGASPRE

SEQ ID NO: 501540 - protein, 9 aa, Homo Sapiens
VETNQQFEK

SEQ ID NO: 501541 - protein, 9 aa, Homo Sapiens
CNMLCCKFK

SEQ ID NO: 501542 - protein, 9 aa, Homo Sapiens
IPNEVSESM

SEQ ID NO: 501543 - protein, 9 aa, Homo Sapiens
VDKSKEELT

SEQ ID NO: 501544 - protein, 9 aa, Homo Sapiens
VVQIRQGEE

SEQ ID NO: 501545 - protein, 9 aa, Homo Sapiens
ASIGKAVPQ

SEQ ID NO: 501546 - protein, 9 aa, Homo Sapiens
KKPEEWDKR

SEQ ID NO: 501547 - protein, 9 aa, Homo Sapiens
CSPSKAAVE

SEQ ID NO: 501548 - protein, 9 aa, Homo Sapiens
LTPVFFYLP

SEQ ID NO: 501549 - protein, 9 aa, Homo Sapiens
NTRAPFEDV

SEQ ID NO: 501550 - protein, 9 aa, Homo Sapiens
FPLLPMASG

SEQ ID NO: 501551 - protein, 9 aa, Homo Sapiens
EISLKLGQE

SEQ ID NO: 501552 - protein, 9 aa, Homo Sapiens
TCKCSETKW

SEQ ID NO: 501553 - protein, 9 aa, Homo Sapiens
TLVAWAPDG

SEQ ID NO: 501554 - protein, 9 aa, Homo Sapiens
INTTVKEKE

SEQ ID NO: 501555 - protein, 9 aa, Homo Sapiens
CLNGYTPSH

SEQ ID NO: 501556 - protein, 9 aa, Homo Sapiens
PTSNRHINR

SEQ ID NO: 501557 - protein, 9 aa, Homo Sapiens
SQDKVQIEV

SEQ ID NO: 501558 - protein, 9 aa, Homo Sapiens
GYTPSHKRQ

SEQ ID NO: 501559 - protein, 9 aa, Homo Sapiens
CEARGSGTR

SEQ ID NO: 501560 - protein, 9 aa, Homo Sapiens
NSEVLRDSL

SEQ ID NO: 501561 - protein, 9 aa, Homo Sapiens
LFSDCNSTC

SEQ ID NO: 501562 - protein, 9 aa, Homo Sapiens
LTLEDVTFM

SEQ ID NO: 501563 - protein, 9 aa, Homo Sapiens
SWGPWEHCS

SEQ ID NO: 501564 - protein, 9 aa, Homo Sapiens
PSLLVLERR

SEQ ID NO: 501565 - protein, 9 aa, Homo Sapiens
ISASCPEPS

SEQ ID NO: 501566 - protein, 9 aa, Homo Sapiens
KFLHFGLQN

SEQ ID NO: 501567 - protein, 9 aa, Homo Sapiens
GSAPLVIVH

SEQ ID NO: 501568 - protein, 9 aa, Homo Sapiens
GEQGPSIKN

SEQ ID NO: 501569 - protein, 9 aa, Homo Sapiens
SLHNSKEER

SEQ ID NO: 501570 - protein, 9 aa, Homo Sapiens
SITEGSLRA

SEQ ID NO: 501571 - protein, 9 aa, Homo Sapiens
SRCEARGSG

SEQ ID NO: 501572 - protein, 9 aa, Homo Sapiens
TTQPDVSSP

SEQ ID NO: 501573 - protein, 9 aa, Homo Sapiens
WFQNDSELH

SEQ ID NO: 501574 - protein, 9 aa, Homo Sapiens
GLDAEGLGQ

SEQ ID NO: 501575 - protein, 9 aa, Homo Sapiens
TDVEQQMTA

SEQ ID NO: 501576 - protein, 9 aa, Homo Sapiens
PHEHPITLV

SEQ ID NO: 501577 - protein, 9 aa, Homo Sapiens
VSSPGVFNE

SEQ ID NO: 501578 - protein, 9 aa, Homo Sapiens
PMQKSKAEG

SEQ ID NO: 501579 - protein, 9 aa, Homo Sapiens
SLTLQDHLV

SEQ ID NO: 501580 - protein, 9 aa, Homo Sapiens
PAVEDSQAT

SEQ ID NO: 501581 - protein, 9 aa, Homo Sapiens
GPAPQGACE

SEQ ID NO: 501582 - protein, 9 aa, Homo Sapiens
EDVTAARRP

SEQ ID NO: 501583 - protein, 9 aa, Homo Sapiens
SHKRQASES

SEQ ID NO: 501584 - protein, 9 aa, Homo Sapiens
ALTLSFDYQ

SEQ ID NO: 501585 - protein, 9 aa, Homo Sapiens
SSWGPWEHC

SEQ ID NO: 501586 - protein, 9 aa, Homo Sapiens
KMNNSPNFE

SEQ ID NO: 501587 - protein, 9 aa, Homo Sapiens
DHQRERATA

SEQ ID NO: 501588 - protein, 9 aa, Homo Sapiens
LIQEFKEQK

SEQ ID NO: 501589 - protein, 9 aa, Homo Sapiens
AVVMPCVQK

SEQ ID NO: 501590 - protein, 9 aa, Homo Sapiens
GNTLSVPAP

SEQ ID NO: 501591 - protein, 9 aa, Homo Sapiens
LITQFKQEI

SEQ ID NO: 501592 - protein, 9 aa, Homo Sapiens
FNTTATAVI

SEQ ID NO: 501593 - protein, 9 aa, Homo Sapiens
SNRHINRNY

SEQ ID NO: 501594 - protein, 9 aa, Homo Sapiens
HDGRVKIGN

SEQ ID NO: 501595 - protein, 9 aa, Homo Sapiens
PIEVLLTPP

SEQ ID NO: 501596 - protein, 9 aa, Homo Sapiens
EGLERRPEN

SEQ ID NO: 501597 - protein, 9 aa, Homo Sapiens
STCKCSETK

SEQ ID NO: 501598 - protein, 9 aa, Homo Sapiens
CGLTKSVEV

SEQ ID NO: 501599 - protein, 9 aa, Homo Sapiens
CKLVIEEQF

SEQ ID NO: 501600 - protein, 9 aa, Homo Sapiens
DALELLCPW

SEQ ID NO: 501601 - protein, 9 aa, Homo Sapiens
DVTAARRPE

SEQ ID NO: 501602 - protein, 9 aa, Homo Sapiens
PDVSSPGVF

SEQ ID NO: 501603 - protein, 9 aa, Homo Sapiens
PQFNTTATA

SEQ ID NO: 501604 - protein, 9 aa, Homo Sapiens
WEHCSVSCG

SEQ ID NO: 501605 - protein, 9 aa, Homo Sapiens
YLTIMCKLQ

SEQ ID NO: 501606 - protein, 9 aa, Homo Sapiens
TFMNPHFGS

SEQ ID NO: 501607 - protein, 9 aa, Homo Sapiens
HHCFNSQGP

SEQ ID NO: 501608 - protein, 9 aa, Homo Sapiens
DGRLLCRPN

SEQ ID NO: 501609 - protein, 9 aa, Homo Sapiens
SANHIYHHC

SEQ ID NO: 501610 - protein, 9 aa, Homo Sapiens
QALPEPMQK

SEQ ID NO: 501611 - protein, 9 aa, Homo Sapiens
LINTTVKEK

SEQ ID NO: 501612 - protein, 9 aa, Homo Sapiens
LCWSLHNSK

SEQ ID NO: 501613 - protein, 9 aa, Homo Sapiens
INRNYEPLK

SEQ ID NO: 501614 - protein, 9 aa, Homo Sapiens
TDLPNALDE

SEQ ID NO: 501615 - protein, 9 aa, Homo Sapiens
LPEPMQKSK

SEQ ID NO: 501616 - protein, 9 aa, Homo Sapiens
HHFTDVEQQ

SEQ ID NO: 501617 - protein, 9 aa, Homo Sapiens
GNLGLLQQA

SEQ ID NO: 501618 - protein, 9 aa, Homo Sapiens
AGSDVVEME

SEQ ID NO: 501619 - protein, 9 aa, Homo Sapiens
ESGSDDFNV

SEQ ID NO: 501620 - protein, 9 aa, Homo Sapiens
FHERFRNLI

SEQ ID NO: 501621 - protein, 9 aa, Homo Sapiens
RCEARGSGT

SEQ ID NO: 501622 - protein, 9 aa, Homo Sapiens
VCFRGESCI

SEQ ID NO: 501623 - protein, 9 aa, Homo Sapiens
NGYTPSHKR

SEQ ID NO: 501624 - protein, 9 aa, Homo Sapiens
LVALNSEVL

SEQ ID NO: 501625 - protein, 9 aa, Homo Sapiens
QLGPTMKLK

SEQ ID NO: 501626 - protein, 9 aa, Homo Sapiens
QKHINKSLK

SEQ ID NO: 501627 - protein, 9 aa, Homo Sapiens
QATPLPLTS

SEQ ID NO: 501628 - protein, 9 aa, Homo Sapiens
WALSRCEAR

SEQ ID NO: 501629 - protein, 9 aa, Homo Sapiens
DGRVKIGNY

SEQ ID NO: 501630 - protein, 9 aa, Homo Sapiens
DWCLSVLHS

SEQ ID NO: 501631 - protein, 9 aa, Homo Sapiens
ALNSEVLRD

SEQ ID NO: 501632 - protein, 9 aa, Homo Sapiens
PDKMNNSPN

SEQ ID NO: 501633 - protein, 9 aa, Homo Sapiens
AAGNTLSVP

SEQ ID NO: 501634 - protein, 9 aa, Homo Sapiens
SFSSWPSAQ

SEQ ID NO: 501635 - protein, 9 aa, Homo Sapiens
NKTDLPNAL

SEQ ID NO: 501636 - protein, 9 aa, Homo Sapiens
RQGALPQES

SEQ ID NO: 501637 - protein, 9 aa, Homo Sapiens
LPAVEDSQA

SEQ ID NO: 501638 - protein, 9 aa, Homo Sapiens
HETTQPDVS

SEQ ID NO: 501639 - protein, 9 aa, Homo Sapiens
FSISGGQLG

SEQ ID NO: 501640 - protein, 9 aa, Homo Sapiens
FKEQKERAQ

SEQ ID NO: 501641 - protein, 9 aa, Homo Sapiens
LNGYTPSHK

SEQ ID NO: 501642 - protein, 9 aa, Homo Sapiens
EDWCLSVLH

SEQ ID NO: 501643 - protein, 9 aa, Homo Sapiens
VLVLGNKTD

SEQ ID NO: 501644 - protein, 9 aa, Homo Sapiens
GRAGRPQFN

SEQ ID NO: 501645 - protein, 9 aa, Homo Sapiens
ESCILHGDI

SEQ ID NO: 501646 - protein, 9 aa, Homo Sapiens
KYKFLHFGL

SEQ ID NO: 501647 - protein, 9 aa, Homo Sapiens
PLASSASST

SEQ ID NO: 501648 - protein, 9 aa, Homo Sapiens
QQMTAQHYV

SEQ ID NO: 501649 - protein, 9 aa, Homo Sapiens
WLQSVKDHQ

SEQ ID NO: 501650 - protein, 9 aa, Homo Sapiens
QATETSDEA

SEQ ID NO: 501651 - protein, 9 aa, Homo Sapiens
ALPAVEDSQ

SEQ ID NO: 501652 - protein, 9 aa, Homo Sapiens
DAGICRVVP

SEQ ID NO: 501653 - protein, 9 aa, Homo Sapiens
CLSVLHSYQ

SEQ ID NO: 501654 - protein, 9 aa, Homo Sapiens
KVIVFSQDK

SEQ ID NO: 501655 - protein, 9 aa, Homo Sapiens
PIVELRDKI

SEQ ID NO: 501656 - protein, 9 aa, Homo Sapiens
KLITQFKQE

SEQ ID NO: 501657 - protein, 9 aa, Homo Sapiens
ISYSGSAPL

SEQ ID NO: 501658 - protein, 9 aa, Homo Sapiens
GLTKSVEVL

SEQ ID NO: 501659 - protein, 9 aa, Homo Sapiens
CHQRQLRRQ

SEQ ID NO: 501660 - protein, 9 aa, Homo Sapiens
PSLTLQDHL

SEQ ID NO: 501661 - protein, 9 aa, Homo Sapiens
WEPPCGLTK

SEQ ID NO: 501662 - protein, 9 aa, Homo Sapiens
CGEGPCDSV

SEQ ID NO: 501663 - protein, 9 aa, Homo Sapiens
DCNSTCKCS

SEQ ID NO: 501664 - protein, 9 aa, Homo Sapiens
YKKIALTSD

SEQ ID NO: 501665 - protein, 9 aa, Homo Sapiens
LLVLERREV

SEQ ID NO: 501666 - protein, 9 aa, Homo Sapiens
GEGPCDSVT

SEQ ID NO: 501667 - protein, 9 aa, Homo Sapiens
ARKYKFLHF

SEQ ID NO: 501668 - protein, 9 aa, Homo Sapiens
PPIVELRDK

SEQ ID NO: 501669 - protein, 9 aa, Homo Sapiens
LTLQDHLVK

SEQ ID NO: 501670 - protein, 9 aa, Homo Sapiens
QDHLVKEIA

SEQ ID NO: 501671 - protein, 9 aa, Homo Sapiens
TQFKQEIRN

SEQ ID NO: 501672 - protein, 9 aa, Homo Sapiens
EGPCDSVTG

SEQ ID NO: 501673 - protein, 9 aa, Homo Sapiens
PSIGSAVPT

SEQ ID NO: 501674 - protein, 9 aa, Homo Sapiens
NCAVCNCGE

SEQ ID NO: 501675 - protein, 9 aa, Homo Sapiens
RGNLGLLQQ

SEQ ID NO: 501676 - protein, 9 aa, Homo Sapiens
TVKEKEIVC

SEQ ID NO: 501677 - protein, 9 aa, Homo Sapiens
HTLELVALN

SEQ ID NO: 501678 - protein, 9 aa, Homo Sapiens
LAHAMVVKP

SEQ ID NO: 501679 - protein, 9 aa, Homo Sapiens
MEQKHINKS

SEQ ID NO: 501680 - protein, 9 aa, Homo Sapiens
YHHCFNSQG

SEQ ID NO: 501681 - protein, 9 aa, Homo Sapiens
YKFLHFGLQ

SEQ ID NO: 501682 - protein, 9 aa, Homo Sapiens
RPQFNTTAT

SEQ ID NO: 501683 - protein, 9 aa, Homo Sapiens
PEPMQKSKA

SEQ ID NO: 501684 - protein, 9 aa, Homo Sapiens
CFRGESCIL

SEQ ID NO: 501685 - protein, 9 aa, Homo Sapiens
HCSVSCGGG

SEQ ID NO: 501686 - protein, 9 aa, Homo Sapiens
HNSKEERID

SEQ ID NO: 501687 - protein, 9 aa, Homo Sapiens
NIKFKAEVQ

SEQ ID NO: 501688 - protein, 9 aa, Homo Sapiens
MKEGLERRP

SEQ ID NO: 501689 - protein, 9 aa, Homo Sapiens
KTYSITEGS

SEQ ID NO: 501690 - protein, 9 aa, Homo Sapiens
CFNSQGPQQ

SEQ ID NO: 501691 - protein, 9 aa, Homo Sapiens
HQRQLRRQG

SEQ ID NO: 501692 - protein, 9 aa, Homo Sapiens
CNSTCKCSE

SEQ ID NO: 501693 - protein, 9 aa, Homo Sapiens
LEDVTFMNP

SEQ ID NO: 501694 - protein, 9 aa, Homo Sapiens
EITKQEKDF

SEQ ID NO: 501695 - protein, 9 aa, Homo Sapiens
EEETKSRVP

SEQ ID NO: 501696 - protein, 9 aa, Homo Sapiens
LRRQGALPQ

SEQ ID NO: 501697 - protein, 9 aa, Homo Sapiens
LSRCEARGS

SEQ ID NO: 501698 - protein, 9 aa, Homo Sapiens
RLLLSNPKG

SEQ ID NO: 501699 - protein, 9 aa, Homo Sapiens
QEIRNLSAV

SEQ ID NO: 501700 - protein, 9 aa, Homo Sapiens
KQEKDFLWS

SEQ ID NO: 501701 - protein, 9 aa, Homo Sapiens
YSPDKMNNS

SEQ ID NO: 501702 - protein, 9 aa, Homo Sapiens
CAVCNCGEG

SEQ ID NO: 501703 - protein, 9 aa, Homo Sapiens
CNCGEGPCD

SEQ ID NO: 501704 - protein, 9 aa, Homo Sapiens
ALSRCEARG

SEQ ID NO: 501705 - protein, 9 aa, Homo Sapiens
LGLCIPKPD

SEQ ID NO: 501706 - protein, 9 aa, Homo Sapiens
GFVKWKDYN

SEQ ID NO: 501707 - protein, 9 aa, Homo Sapiens
LSRSTGFVK

SEQ ID NO: 501708 - protein, 9 aa, Homo Sapiens
TERGCALTL

SEQ ID NO: 501709 - protein, 9 aa, Homo Sapiens
VTAARRPER

SEQ ID NO: 501710 - protein, 9 aa, Homo Sapiens
LDAEGLGQD

SEQ ID NO: 501711 - protein, 9 aa, Homo Sapiens
AYPLTHYIR

SEQ ID NO: 501712 - protein, 9 aa, Homo Sapiens
PLMKEGLER

SEQ ID NO: 501713 - protein, 9 aa, Homo Sapiens
AGNTLSVPA

SEQ ID NO: 501714 - protein, 9 aa, Homo Sapiens
PFTLRSFRY

SEQ ID NO: 501715 - protein, 9 aa, Homo Sapiens
DKVQIEVVQ

SEQ ID NO: 501716 - protein, 9 aa, Homo Sapiens
VIEEQFGPF

SEQ ID NO: 501717 - protein, 9 aa, Homo Sapiens
SDCNSTCKC

SEQ ID NO: 501718 - protein, 9 aa, Homo Sapiens
SQATETSDE

SEQ ID NO: 501719 - protein, 9 aa, Homo Sapiens
TKQEKDFLW

SEQ ID NO: 501720 - protein, 9 aa, Homo Sapiens
LTIMCKLQR

SEQ ID NO: 501721 - protein, 9 aa, Homo Sapiens
TRRAGSDVV

SEQ ID NO: 501722 - protein, 9 aa, Homo Sapiens
TKSVEVLCL

SEQ ID NO: 501723 - protein, 9 aa, Homo Sapiens
ISGGQLGPT

SEQ ID NO: 501724 - protein, 9 aa, Homo Sapiens
VFSQDKVQI

SEQ ID NO: 501725 - protein, 9 aa, Homo Sapiens
CAKQEPQRN

SEQ ID NO: 501726 - protein, 9 aa, Homo Sapiens
GICRVVPSD

SEQ ID NO: 501727 - protein, 9 aa, Homo Sapiens
RRQGALPQE

SEQ ID NO: 501728 - protein, 9 aa, Homo Sapiens
LKEQTAYPL

SEQ ID NO: 501729 - protein, 9 aa, Homo Sapiens
QNDSELHES

SEQ ID NO: 501730 - protein, 9 aa, Homo Sapiens
INSCTTSEH

SEQ ID NO: 501731 - protein, 9 aa, Homo Sapiens
CILHGDICD

SEQ ID NO: 501732 - protein, 9 aa, Homo Sapiens
PPCGLTKSV

SEQ ID NO: 501733 - protein, 9 aa, Homo Sapiens
CPEPSIGSA

SEQ ID NO: 501734 - protein, 9 aa, Homo Sapiens
QFKQEIRNL

SEQ ID NO: 501735 - protein, 9 aa, Homo Sapiens
IEEQFGPFI

SEQ ID NO: 501736 - protein, 9 aa, Homo Sapiens
LIKESGSDD

SEQ ID NO: 501737 - protein, 9 aa, Homo Sapiens
GVLAHAMVV

SEQ ID NO: 501738 - protein, 9 aa, Homo Sapiens
EKKANPSLL

SEQ ID NO: 501739 - protein, 9 aa, Homo Sapiens
NRHINRNYE

SEQ ID NO: 501740 - protein, 9 aa, Homo Sapiens
DSQATETSD

SEQ ID NO: 501741 - protein, 9 aa, Homo Sapiens
NPKDGRLLC

SEQ ID NO: 501742 - protein, 9 aa, Homo Sapiens
MEDVTAARR

SEQ ID NO: 501743 - protein, 9 aa, Homo Sapiens
QRNECFLQH

SEQ ID NO: 501744 - protein, 9 aa, Homo Sapiens
PFPFTLRSF

SEQ ID NO: 501745 - protein, 9 aa, Homo Sapiens
RLCWSLHNS

SEQ ID NO: 501746 - protein, 9 aa, Homo Sapiens
FHIKGVLAH

SEQ ID NO: 501747 - protein, 9 aa, Homo Sapiens
SSFSSWPSA

SEQ ID NO: 501748 - protein, 9 aa, Homo Sapiens
EETKSRVPG

SEQ ID NO: 501749 - protein, 9 aa, Homo Sapiens
TYSITEGSL

SEQ ID NO: 501750 - protein, 9 aa, Homo Sapiens
APLVIVHSS

SEQ ID NO: 501751 - protein, 9 aa, Homo Sapiens
HFTDVEQQM

SEQ ID NO: 501752 - protein, 9 aa, Homo Sapiens
HCFNSQGPQ

SEQ ID NO: 501753 - protein, 9 aa, Homo Sapiens
GRFAVVMPC

SEQ ID NO: 501754 - protein, 9 aa, Homo Sapiens
ALELLCPWA

SEQ ID NO: 501755 - protein, 9 aa, Homo Sapiens
KTDLPNALD

SEQ ID NO: 501756 - protein, 9 aa, Homo Sapiens
ILHGDICDM

SEQ ID NO: 501757 - protein, 9 aa, Homo Sapiens
EGLGQDHWN

SEQ ID NO: 501758 - protein, 9 aa, Homo Sapiens
GRPQFNTTA

SEQ ID NO: 501759 - protein, 9 aa, Homo Sapiens
RIKTYSITE

SEQ ID NO: 501760 - protein, 9 aa, Homo Sapiens
PKDGRLLCR

SEQ ID NO: 501761 - protein, 9 aa, Homo Sapiens
GEEETKSRV

SEQ ID NO: 501762 - protein, 9 aa, Homo Sapiens
TRGNLGLLQ

SEQ ID NO: 501763 - protein, 9 aa, Homo Sapiens
SLSRSTGFV

SEQ ID NO: 501764 - protein, 9 aa, Homo Sapiens
LQQAIALKA

SEQ ID NO: 501765 - protein, 9 aa, Homo Sapiens
KSRVPGSTR

SEQ ID NO: 501766 - protein, 9 aa, Homo Sapiens
VLHSYQAEH

SEQ ID NO: 501767 - protein, 9 aa, Homo Sapiens
SGSDDFNVW

SEQ ID NO: 501768 - protein, 9 aa, Homo Sapiens
AVEDSQATE

SEQ ID NO: 501769 - protein, 9 aa, Homo Sapiens
WSLHNSKEE

SEQ ID NO: 501770 - protein, 9 aa, Homo Sapiens
KEQTAYPLT

SEQ ID NO: 501771 - protein, 9 aa, Homo Sapiens
DKLSTKCVH

SEQ ID NO: 501772 - protein, 9 aa, Homo Sapiens
NSCTTSEHK

SEQ ID NO: 501773 - protein, 9 aa, Homo Sapiens
MQKSKAEGN

SEQ ID NO: 501774 - protein, 9 aa, Homo Sapiens
EHCSVSCGG

SEQ ID NO: 501775 - protein, 9 aa, Homo Sapiens
LLCPWAKES

SEQ ID NO: 501776 - protein, 9 aa, Homo Sapiens
RSTGFVKWK

SEQ ID NO: 501777 - protein, 9 aa, Homo Sapiens
AKKGEVLPG

SEQ ID NO: 501778 - protein, 9 aa, Homo Sapiens
FQNDSELHE

SEQ ID NO: 501779 - protein, 9 aa, Homo Sapiens
SWFQNDSEL

SEQ ID NO: 501780 - protein, 9 aa, Homo Sapiens
KESGSDDFN

SEQ ID NO: 501781 - protein, 9 aa, Homo Sapiens
NHIYHHCFN

SEQ ID NO: 501782 - protein, 9 aa, Homo Sapiens
KGVLAHAMV

SEQ ID NO: 501783 - protein, 9 aa, Homo Sapiens
KQEPQRNEC

SEQ ID NO: 501784 - protein, 9 aa, Homo Sapiens
EQQMTAQHY

SEQ ID NO: 501785 - protein, 9 aa, Homo Sapiens
EPSIGSAVP

SEQ ID NO: 501786 - protein, 9 aa, Homo Sapiens
SFRYCKKNQ

SEQ ID NO: 501787 - protein, 9 aa, Homo Sapiens
GSELKCPIE

SEQ ID NO: 501788 - protein, 9 aa, Homo Sapiens
QVQKLIQEF

SEQ ID NO: 501789 - protein, 9 aa, Homo Sapiens
ETTQPDVSS

SEQ ID NO: 501790 - protein, 9 aa, Homo Sapiens
GPWEHCSVS

SEQ ID NO: 501791 - protein, 9 aa, Homo Sapiens
FVKWKDYNC

SEQ ID NO: 501792 - protein, 9 aa, Homo Sapiens
IQEFKEQKE

SEQ ID NO: 501793 - protein, 9 aa, Homo Sapiens
SCPEPSIGS

SEQ ID NO: 501794 - protein, 9 aa, Homo Sapiens
LHPLMKEGL

SEQ ID NO: 501795 - protein, 9 aa, Homo Sapiens
SNPKGRMES

SEQ ID NO: 501796 - protein, 9 aa, Homo Sapiens
PCGLTKSVE

SEQ ID NO: 501797 - protein, 9 aa, Homo Sapiens
SGSELKCPI

SEQ ID NO: 501798 - protein, 9 aa, Homo Sapiens
PEIKVSWFQ

SEQ ID NO: 501799 - protein, 9 aa, Homo Sapiens
LFDPSLTLQ

SEQ ID NO: 501800 - protein, 9 aa, Homo Sapiens
TPSHKRQAS

SEQ ID NO: 501801 - protein, 9 aa, Homo Sapiens
HEHPITLVA

SEQ ID NO: 501802 - protein, 9 aa, Homo Sapiens
TFINSCTTS

SEQ ID NO: 501803 - protein, 9 aa, Homo Sapiens
LNSEVLRDS

SEQ ID NO: 501804 - protein, 9 aa, Homo Sapiens
EIKVSWFQN

SEQ ID NO: 501805 - protein, 9 aa, Homo Sapiens
ERFRNLIYV

SEQ ID NO: 501806 - protein, 9 aa, Homo Sapiens
CYLTIMCKL

SEQ ID NO: 501807 - protein, 9 aa, Homo Sapiens
SPPIVELRD

SEQ ID NO: 501808 - protein, 9 aa, Homo Sapiens
RKYKFLHFG

SEQ ID NO: 501809 - protein, 9 aa, Homo Sapiens
KCPIEVLLT

SEQ ID NO: 501810 - protein, 9 aa, Homo Sapiens
GSDDFNVWI

SEQ ID NO: 501811 - protein, 9 aa, Homo Sapiens
HPLMKEGLE

SEQ ID NO: 501812 - protein, 9 aa, Homo Sapiens
SSASSTESS

SEQ ID NO: 501813 - protein, 9 aa, Homo Sapiens
LTKSVEVLC

SEQ ID NO: 501814 - protein, 9 aa, Homo Sapiens
ERGCALTLS

SEQ ID NO: 501815 - protein, 9 aa, Homo Sapiens
SLIKESGSD

SEQ ID NO: 501816 - protein, 9 aa, Homo Sapiens
SYSGSAPLV

SEQ ID NO: 501817 - protein, 9 aa, Homo Sapiens
VKEKEIVCK

SEQ ID NO: 501818 - protein, 9 aa, Homo Sapiens
ALFSDCNST

SEQ ID NO: 501819 - protein, 9 aa, Homo Sapiens
PSHKRQASE

SEQ ID NO: 501820 - protein, 9 aa, Homo Sapiens
HLSEDENRL

SEQ ID NO: 501821 - protein, 9 aa, Homo Sapiens
FPFTLRSFR

SEQ ID NO: 501822 - protein, 9 aa, Homo Sapiens
AQTFINSCT

SEQ ID NO: 501823 - protein, 9 aa, Homo Sapiens
RSTQDKLST

SEQ ID NO: 501824 - protein, 9 aa, Homo Sapiens
FLHFGLQNG

SEQ ID NO: 501825 - protein, 9 aa, Homo Sapiens
ASCPEPSIG

SEQ ID NO: 501826 - protein, 9 aa, Homo Sapiens
ANPSLLVLE

SEQ ID NO: 501827 - protein, 9 aa, Homo Sapiens
PVSRIKTYS

SEQ ID NO: 501828 - protein, 9 aa, Homo Sapiens
GLCIPKPDV

SEQ ID NO: 501829 - protein, 9 aa, Homo Sapiens
NSTCKCSET

SEQ ID NO: 501830 - protein, 9 aa, Homo Sapiens
KEGLERRPE

SEQ ID NO: 501831 - protein, 9 aa, Homo Sapiens
ITACYLTIM

SEQ ID NO: 501832 - protein, 9 aa, Homo Sapiens
FTDALELLC

SEQ ID NO: 501833 - protein, 9 aa, Homo Sapiens
RLLCRPNKA

SEQ ID NO: 501834 - protein, 9 aa, Homo Sapiens
EFKEQKERA

SEQ ID NO: 501835 - protein, 9 aa, Homo Sapiens
NCGEGPCDS

SEQ ID NO: 501836 - protein, 9 aa, Homo Sapiens
DRSTQDKLS

SEQ ID NO: 501837 - protein, 9 aa, Homo Sapiens
LGLLQQAIA

SEQ ID NO: 501838 - protein, 9 aa, Homo Sapiens
MCKLQRNRL

SEQ ID NO: 501839 - protein, 9 aa, Homo Sapiens
ITKQEKDFL

SEQ ID NO: 501840 - protein, 9 aa, Homo Sapiens
SVKDHQRER

SEQ ID NO: 501841 - protein, 9 aa, Homo Sapiens
SDDFNVWIG

SEQ ID NO: 501842 - protein, 9 aa, Homo Sapiens
NTLSVPAPA

SEQ ID NO: 501843 - protein, 9 aa, Homo Sapiens
LNIKFKAEV

SEQ ID NO: 501844 - protein, 9 aa, Homo Sapiens
PAPQGACEG

SEQ ID NO: 501845 - protein, 9 aa, Homo Sapiens
GQATPLPLT

SEQ ID NO: 501846 - protein, 9 aa, Homo Sapiens
KGEVLPGEQ

SEQ ID NO: 501847 - protein, 9 aa, Homo Sapiens
PQGACEGRP

SEQ ID NO: 501848 - protein, 9 aa, Homo Sapiens
NKSLKELNC

SEQ ID NO: 501849 - protein, 9 aa, Homo Sapiens
FGPFIWIPS

SEQ ID NO: 501850 - protein, 9 aa, Homo Sapiens
ISAAGNTLS

SEQ ID NO: 501851 - protein, 9 aa, Homo Sapiens
SPDKMNNSP

SEQ ID NO: 501852 - protein, 9 aa, Homo Sapiens
ADAGICRVV

SEQ ID NO: 501853 - protein, 9 aa, Homo Sapiens
LSSFSSWPS

SEQ ID NO: 501854 - protein, 9 aa, Homo Sapiens
PLTHYIRRV

SEQ ID NO: 501855 - protein, 9 aa, Homo Sapiens
LELLCPWAK

SEQ ID NO: 501856 - protein, 9 aa, Homo Sapiens
GEVLPGEQG

SEQ ID NO: 501857 - protein, 9 aa, Homo Sapiens
QSVKDHQRE

SEQ ID NO: 501858 - protein, 9 aa, Homo Sapiens
TAYPLTHYI

SEQ ID NO: 501859 - protein, 9 aa, Homo Sapiens
ASSTESSFT

SEQ ID NO: 501860 - protein, 9 aa, Homo Sapiens
ACYLTIMCK

SEQ ID NO: 501861 - protein, 9 aa, Homo Sapiens
VSRIKTYSI

SEQ ID NO: 501862 - protein, 9 aa, Homo Sapiens
DFHIKGVLA

SEQ ID NO: 501863 - protein, 9 aa, Homo Sapiens
VIAQTFINS

SEQ ID NO: 501864 - protein, 9 aa, Homo Sapiens
SASCPEPSI

SEQ ID NO: 501865 - protein, 9 aa, Homo Sapiens
LASSASSTE

SEQ ID NO: 501866 - protein, 9 aa, Homo Sapiens
PLVIVHSSQ

SEQ ID NO: 501867 - protein, 9 aa, Homo Sapiens
ELVALNSEV

SEQ ID NO: 501868 - protein, 9 aa, Homo Sapiens
HKRQASESS

SEQ ID NO: 501869 - protein, 9 aa, Homo Sapiens
FMNPHFGSK

SEQ ID NO: 501870 - protein, 9 aa, Homo Sapiens
QGALPQESL

SEQ ID NO: 501871 - protein, 9 aa, Homo Sapiens
EALNIKFKA

SEQ ID NO: 501872 - protein, 9 aa, Homo Sapiens
STESSFTLA

SEQ ID NO: 501873 - protein, 9 aa, Homo Sapiens
DPSLTLQDH

SEQ ID NO: 501874 - protein, 9 aa, Homo Sapiens
VKWKDYNCD

SEQ ID NO: 501875 - protein, 9 aa, Homo Sapiens
ITLVAWAPD

SEQ ID NO: 501876 - protein, 9 aa, Homo Sapiens
QGACEGRPK

SEQ ID NO: 501877 - protein, 9 aa, Homo Sapiens
KLVIEEQFG

SEQ ID NO: 501878 - protein, 9 aa, Homo Sapiens
LRSFRYCKK

SEQ ID NO: 501879 - protein, 9 aa, Homo Sapiens
NPSLLVLER

SEQ ID NO: 501880 - protein, 9 aa, Homo Sapiens
TDALELLCP

SEQ ID NO: 501881 - protein, 9 aa, Homo Sapiens
PVLVLGNKT

SEQ ID NO: 501882 - protein, 9 aa, Homo Sapiens
HQRERATAS

SEQ ID NO: 501883 - protein, 9 aa, Homo Sapiens
LVIEEQFGP

SEQ ID NO: 501884 - protein, 9 aa, Homo Sapiens
AVIAQTFIN

SEQ ID NO: 501885 - protein, 9 aa, Homo Sapiens
RDFSISGGQ

SEQ ID NO: 501886 - protein, 9 aa, Homo Sapiens
VALNSEVLR

SEQ ID NO: 501887 - protein, 9 aa, Homo Sapiens
LMKEGLERR

SEQ ID NO: 501888 - protein, 9 aa, Homo Sapiens
SGGQLGPTM

SEQ ID NO: 501889 - protein, 9 aa, Homo Sapiens
STGFVKWKD

SEQ ID NO: 501890 - protein, 9 aa, Homo Sapiens
INKSLKELN

SEQ ID NO: 501891 - protein, 9 aa, Homo Sapiens
LHFGLQNGK

SEQ ID NO: 501892 - protein, 9 aa, Homo Sapiens
GNKTDLPNA

SEQ ID NO: 501893 - protein, 9 aa, Homo Sapiens
ITQFKQEIR

SEQ ID NO: 501894 - protein, 9 aa, Homo Sapiens
KVDRSTQDK

SEQ ID NO: 501895 - protein, 9 aa, Homo Sapiens
SSLVSLGLC

SEQ ID NO: 501896 - protein, 9 aa, Homo Sapiens
HIYHHCFNS

SEQ ID NO: 501897 - protein, 9 aa, Homo Sapiens
YPLTHYIRR

SEQ ID NO: 501898 - protein, 9 aa, Homo Sapiens
NLGLLQQAI

SEQ ID NO: 501899 - protein, 9 aa, Homo Sapiens
LLQQAIALK

SEQ ID NO: 501900 - protein, 9 aa, Homo Sapiens
HIKGVLAHA

SEQ ID NO: 501901 - protein, 9 aa, Homo Sapiens
LVSLGLCIP

SEQ ID NO: 501902 - protein, 9 aa, Homo Sapiens
QDHWNEMLA

SEQ ID NO: 501903 - protein, 9 aa, Homo Sapiens
EGEEETKSR

SEQ ID NO: 501904 - protein, 9 aa, Homo Sapiens
RAGSDVVEM

SEQ ID NO: 501905 - protein, 9 aa, Homo Sapiens
VKIGNYILG

SEQ ID NO: 501906 - protein, 9 aa, Homo Sapiens
NTTVKEKEI

SEQ ID NO: 501907 - protein, 9 aa, Homo Sapiens
DPLSEITKQ

SEQ ID NO: 501908 - protein, 9 aa, Homo Sapiens
TQPDVSSPG

SEQ ID NO: 501909 - protein, 9 aa, Homo Sapiens
DFSISGGQL

SEQ ID NO: 501910 - protein, 9 aa, Homo Sapiens
HSYQAEHGP

SEQ ID NO: 501911 - protein, 9 aa, Homo Sapiens
FSQDKVQIE

SEQ ID NO: 501912 - protein, 9 aa, Homo Sapiens
VEQQMTAQH

SEQ ID NO: 501913 - protein, 9 aa, Homo Sapiens
LQSVKDHQR

SEQ ID NO: 501914 - protein, 9 aa, Homo Sapiens
LVIVHSSQF

SEQ ID NO: 501915 - protein, 9 aa, Homo Sapiens
DCCAKQEPQ

SEQ ID NO: 501916 - protein, 9 aa, Homo Sapiens
AVCNCGEGP

SEQ ID NO: 501917 - protein, 9 aa, Homo Sapiens
NTTATAVIM

SEQ ID NO: 501918 - protein, 9 aa, Homo Sapiens
FINSCTTSE

SEQ ID NO: 501919 - protein, 9 aa, Homo Sapiens
LCIPKPDVI

SEQ ID NO: 501920 - protein, 9 aa, Homo Sapiens
AMEQKHINK

SEQ ID NO: 501921 - protein, 9 aa, Homo Sapiens
STQDKLSTK

SEQ ID NO: 501922 - protein, 9 aa, Homo Sapiens
PEPSIGSAV

SEQ ID NO: 501923 - protein, 9 aa, Homo Sapiens
RAGRPQFNT

SEQ ID NO: 501924 - protein, 9 aa, Homo Sapiens
GGPAPQGAC

SEQ ID NO: 501925 - protein, 9 aa, Homo Sapiens
KVSWFQNDS

SEQ ID NO: 501926 - protein, 9 aa, Homo Sapiens
ETKSRVPGS

SEQ ID NO: 501927 - protein, 9 aa, Homo Sapiens
RYSPDKMNN

SEQ ID NO: 501928 - protein, 9 aa, Homo Sapiens
STRYSPDKM

SEQ ID NO: 501929 - protein, 9 aa, Homo Sapiens
QPHEHPITL

SEQ ID NO: 501930 - protein, 9 aa, Homo Sapiens
TGFVKWKDY

SEQ ID NO: 501931 - protein, 9 aa, Homo Sapiens
FDPSLTLQD

SEQ ID NO: 501932 - protein, 9 aa, Homo Sapiens
LLLSNPKGR

SEQ ID NO: 501933 - protein, 9 aa, Homo Sapiens
LSEITKQEK

SEQ ID NO: 501934 - protein, 9 aa, Homo Sapiens
RSFRYCKKN

SEQ ID NO: 501935 - protein, 9 aa, Homo Sapiens
LTHYIRRVP

SEQ ID NO: 501936 - protein, 9 aa, Homo Sapiens
DAEGLGQDH

SEQ ID NO: 501937 - protein, 9 aa, Homo Sapiens
DVTFMNPHF

SEQ ID NO: 501938 - protein, 9 aa, Homo Sapiens
QKSKAEGNN

SEQ ID NO: 501939 - protein, 9 aa, Homo Sapiens
HFGLQNGKR

SEQ ID NO: 501940 - protein, 9 aa, Homo Sapiens
SAAGNTLSV

SEQ ID NO: 501941 - protein, 9 aa, Homo Sapiens
QLCEALNIK

SEQ ID NO: 501942 - protein, 9 aa, Homo Sapiens
RDPLSEITK

SEQ ID NO: 501943 - protein, 9 aa, Homo Sapiens
EDVTFMNPH

SEQ ID NO: 501944 - protein, 9 aa, Homo Sapiens
HPITLVAWA

SEQ ID NO: 501945 - protein, 9 aa, Homo Sapiens
SPLASSASS

SEQ ID NO: 501946 - protein, 9 aa, Homo Sapiens
PQRNECFLQ

SEQ ID NO: 501947 - protein, 9 aa, Homo Sapiens
LVAWAPDGE

SEQ ID NO: 501948 - protein, 9 aa, Homo Sapiens
RRAGSDVVE

SEQ ID NO: 501949 - protein, 9 aa, Homo Sapiens
NRNYEPLKT

SEQ ID NO: 501950 - protein, 9 aa, Homo Sapiens
NPKGRMESE

SEQ ID NO: 501951 - protein, 9 aa, Homo Sapiens
GLERRPENK

SEQ ID NO: 501952 - protein, 9 aa, Homo Sapiens
CALTLSFDY

SEQ ID NO: 501953 - protein, 9 aa, Homo Sapiens
DVSSPGVFN

SEQ ID NO: 501954 - protein, 9 aa, Homo Sapiens
WHHFTDVEQ

SEQ ID NO: 501955 - protein, 9 aa, Homo Sapiens
RQLRRQGAL

SEQ ID NO: 501956 - protein, 9 aa, Homo Sapiens
SDVVEMEAV

SEQ ID NO: 501957 - protein, 9 aa, Homo Sapiens
PCVQKLSSF

SEQ ID NO: 501958 - protein, 9 aa, Homo Sapiens
CIPKPDVIS

SEQ ID NO: 501959 - protein, 9 aa, Homo Sapiens
GNYILGDTL

SEQ ID NO: 501960 - protein, 9 aa, Homo Sapiens
TGQATPLPL

SEQ ID NO: 501961 - protein, 9 aa, Homo Sapiens
NYILGDTLG

SEQ ID NO: 501962 - protein, 9 aa, Homo Sapiens
KVQIEVVQL

SEQ ID NO: 501963 - protein, 9 aa, Homo Sapiens
QLRRQGALP

SEQ ID NO: 501964 - protein, 9 aa, Homo Sapiens
LTLSFDYQP

SEQ ID NO: 501965 - protein, 9 aa, Homo Sapiens
SEITKQEKD

SEQ ID NO: 501966 - protein, 9 aa, Homo Sapiens
TAARRPERR

SEQ ID NO: 501967 - protein, 9 aa, Homo Sapiens
LVLGNKTDL

SEQ ID NO: 501968 - protein, 9 aa, Homo Sapiens
ALPEPMQKS

SEQ ID NO: 501969 - protein, 9 aa, Homo Sapiens
SSTESSFTL

SEQ ID NO: 501970 - protein, 9 aa, Homo Sapiens
PTRRAGSDV

SEQ ID NO: 501971 - protein, 9 aa, Homo Sapiens
GGQLGPTMK

SEQ ID NO: 501972 - protein, 9 aa, Homo Sapiens
LLSNPKGRM

SEQ ID NO: 501973 - protein, 9 aa, Homo Sapiens
VLAHAMVVK

SEQ ID NO: 501974 - protein, 9 aa, Homo Sapiens
SLGLCIPKP

SEQ ID NO: 501975 - protein, 9 aa, Homo Sapiens
MPCVQKLSS

SEQ ID NO: 501976 - protein, 9 aa, Homo Sapiens
TKSRVPGST

SEQ ID NO: 501977 - protein, 9 aa, Homo Sapiens
KSVEVLCLL

SEQ ID NO: 501978 - protein, 9 aa, Homo Sapiens
EHPITLVAW

SEQ ID NO: 501979 - protein, 9 aa, Homo Sapiens
PKGRMESEE

SEQ ID NO: 501980 - protein, 9 aa, Homo Sapiens
TIMCKLQRN

SEQ ID NO: 501981 - protein, 9 aa, Homo Sapiens
TTVKEKEIV

SEQ ID NO: 501982 - protein, 9 aa, Homo Sapiens
WSSWGPWEH

SEQ ID NO: 501983 - protein, 9 aa, Homo Sapiens
LELVALNSE

SEQ ID NO: 501984 - protein, 9 aa, Homo Sapiens
MNPHFGSKR

SEQ ID NO: 501985 - protein, 9 aa, Homo Sapiens
SIGSAVPTS

SEQ ID NO: 501986 - protein, 9 aa, Homo Sapiens
WCLSVLHSY

SEQ ID NO: 501987 - protein, 9 aa, Homo Sapiens
LLCRPNKAG

SEQ ID NO: 501988 - protein, 9 aa, Homo Sapiens
VSWFQNDSE

SEQ ID NO: 501989 - protein, 9 aa, Homo Sapiens
GESCILHGD

SEQ ID NO: 501990 - protein, 9 aa, Homo Sapiens
HERFRNLIY

SEQ ID NO: 501991 - protein, 9 aa, Homo Sapiens
TLEDVTFMN

SEQ ID NO: 501992 - protein, 9 aa, Homo Sapiens
PQLCEALNI

SEQ ID NO: 501993 - protein, 9 aa, Homo Sapiens
RDKIQPEIL

SEQ ID NO: 501994 - protein, 9 aa, Homo Sapiens
GLLQQAIAL

SEQ ID NO: 501995 - protein, 9 aa, Homo Sapiens
CCAKQEPQR

SEQ ID NO: 501996 - protein, 9 aa, Homo Sapiens
LQDHLVKEI

SEQ ID NO: 501997 - protein, 9 aa, Homo Sapiens
PPTRRAGSD

SEQ ID NO: 501998 - protein, 9 aa, Homo Sapiens
IKTYSITEG

SEQ ID NO: 501999 - protein, 9 aa, Homo Sapiens
MADAGICRV

SEQ ID NO: 502000 - protein, 9 aa, Homo Sapiens
SRSTGFVKW

SEQ ID NO: 502001 - protein, 9 aa, Homo Sapiens
FRGESCILH

SEQ ID NO: 502002 - protein, 9 aa, Homo Sapiens
LHNSKEERI

SEQ ID NO: 502003 - protein, 9 aa, Homo Sapiens
IKGVLAHAM

SEQ ID NO: 502004 - protein, 9 aa, Homo Sapiens
ANHIYHHCF

SEQ ID NO: 502005 - protein, 9 aa, Homo Sapiens
LCRPNKAGE

SEQ ID NO: 502006 - protein, 9 aa, Homo Sapiens
PTDSEFFHE

SEQ ID NO: 502007 - protein, 9 aa, Homo Sapiens
ELLCPWAKE

SEQ ID NO: 502008 - protein, 9 aa, Homo Sapiens
KPTSNRHIN

SEQ ID NO: 502009 - protein, 9 aa, Homo Sapiens
SVLHSYQAE

SEQ ID NO: 502010 - protein, 9 aa, Homo Sapiens
TLQDHLVKE

SEQ ID NO: 502011 - protein, 9 aa, Homo Sapiens
VKDHQRERA

SEQ ID NO: 502012 - protein, 9 aa, Homo Sapiens
RGESCILHG

SEQ ID NO: 502013 - protein, 9 aa, Homo Sapiens
GRVKIGNYI

SEQ ID NO: 502014 - protein, 9 aa, Homo Sapiens
ALNIKFKAE

SEQ ID NO: 502015 - protein, 9 aa, Homo Sapiens
AQIISAAGN

SEQ ID NO: 502016 - protein, 9 aa, Homo Sapiens
QKLIQEFKE

SEQ ID NO: 502017 - protein, 9 aa, Homo Sapiens
SCILHGDIC

SEQ ID NO: 502018 - protein, 9 aa, Homo Sapiens
IKFKAEVQS

SEQ ID NO: 502019 - protein, 9 aa, Homo Sapiens
LSVLHSYQA

SEQ ID NO: 502020 - protein, 9 aa, Homo Sapiens
EQKHINKSL

SEQ ID NO: 502021 - protein, 9 aa, Homo Sapiens
AGICRVVPS

SEQ ID NO: 502022 - protein, 9 aa, Homo Sapiens
QEPQRNECF

SEQ ID NO: 502023 - protein, 9 aa, Homo Sapiens
LCEALNIKF

SEQ ID NO: 502024 - protein, 9 aa, Homo Sapiens
FAVVMPCVQ

SEQ ID NO: 502025 - protein, 9 aa, Homo Sapiens
VELRDKIQP

SEQ ID NO: 502026 - protein, 9 aa, Homo Sapiens
RVKIGNYIL

SEQ ID NO: 502027 - protein, 9 aa, Homo Sapiens
LGQDHWNEM

SEQ ID NO: 502028 - protein, 9 aa, Homo Sapiens
VLGNKTDLP

SEQ ID NO: 502029 - protein, 9 aa, Homo Sapiens
EPQRNECFL

SEQ ID NO: 502030 - protein, 9 aa, Homo Sapiens
FKQEIRNLS

SEQ ID NO: 502031 - protein, 9 aa, Homo Sapiens
EPMQKSKAE

SEQ ID NO: 502032 - protein, 9 aa, Homo Sapiens
IEVLLTPPT

SEQ ID NO: 502033 - protein, 9 aa, Homo Sapiens
IKESGSDDF

SEQ ID NO: 502034 - protein, 9 aa, Homo Sapiens
KHINKSLKE

SEQ ID NO: 502035 - protein, 9 aa, Homo Sapiens
KEKEIVCKC

SEQ ID NO: 502036 - protein, 9 aa, Homo Sapiens
FSDCNSTCK

SEQ ID NO: 502037 - protein, 9 aa, Homo Sapiens
EDSQATETS

SEQ ID NO: 502038 - protein, 9 aa, Homo Sapiens
GQDHWNEML

SEQ ID NO: 502039 - protein, 9 aa, Homo Sapiens
KQEIRNLSA

SEQ ID NO: 502040 - protein, 9 aa, Homo Sapiens
EHETTQPDV

SEQ ID NO: 502041 - protein, 9 aa, Homo Sapiens
LHSYQAEHG

SEQ ID NO: 502042 - protein, 9 aa, Homo Sapiens
KGRMESEEL

SEQ ID NO: 502043 - protein, 9 aa, Homo Sapiens
QEFKEQKER

SEQ ID NO: 502044 - protein, 9 aa, Homo Sapiens
RGCALTLSF

SEQ ID NO: 502045 - protein, 9 aa, Homo Sapiens
LRDKIQPEI

SEQ ID NO: 502046 - protein, 9 aa, Homo Sapiens
GCALTLSFD

SEQ ID NO: 502047 - protein, 9 aa, Homo Sapiens
SYLINTTVK

SEQ ID NO: 502048 - protein, 9 aa, Homo Sapiens
QFNTTATAV

SEQ ID NO: 502049 - protein, 9 aa, Homo Sapiens
EARGSGTRF

SEQ ID NO: 502050 - protein, 9 aa, Homo Sapiens
IVELRDKIQ

SEQ ID NO: 502051 - protein, 9 aa, Homo Sapiens
VSLGLCIPK

SEQ ID NO: 502052 - protein, 9 aa, Homo Sapiens
DVEQQMTAQ

SEQ ID NO: 502053 - protein, 9 aa, Homo Sapiens
KSKAEGNNQ

SEQ ID NO: 502054 - protein, 9 aa, Homo Sapiens
FSSWPSAQH

SEQ ID NO: 502055 - protein, 9 aa, Homo Sapiens
FTDVEQQMT

SEQ ID NO: 502056 - protein, 9 aa, Homo Sapiens
APQGACEGR

SEQ ID NO: 502057 - protein, 9 aa, Homo Sapiens
SEFFHERFR

SEQ ID NO: 502058 - protein, 9 aa, Homo Sapiens
IKVSWFQND

SEQ ID NO: 502059 - protein, 9 aa, Homo Sapiens
VVMPCVQKL

SEQ ID NO: 502060 - protein, 9 aa, Homo Sapiens
IGNYILGDT

SEQ ID NO: 502061 - protein, 9 aa, Homo Sapiens
PSLSSFSSW

SEQ ID NO: 502062 - protein, 9 aa, Homo Sapiens
TLRSFRYCK

SEQ ID NO: 502063 - protein, 9 aa, Homo Sapiens
VIVFSQDKV

SEQ ID NO: 502064 - protein, 9 aa, Homo Sapiens
LCPWAKESM

SEQ ID NO: 502065 - protein, 9 aa, Homo Sapiens
AKLITQFKQ

SEQ ID NO: 502066 - protein, 9 aa, Homo Sapiens
QPDVSSPGV

SEQ ID NO: 502067 - protein, 9 aa, Homo Sapiens
ARGSGTRFV

SEQ ID NO: 502068 - protein, 9 aa, Homo Sapiens
GSDVVEMEA

SEQ ID NO: 502069 - protein, 9 aa, Homo Sapiens
RHINRNYEP

SEQ ID NO: 502070 - protein, 9 aa, Homo Sapiens
CPWAKESMY

SEQ ID NO: 502071 - protein, 9 aa, Homo Sapiens
VMPCVQKLS

SEQ ID NO: 502072 - protein, 9 aa, Homo Sapiens
QDKVQIEVV

SEQ ID NO: 502073 - protein, 9 aa, Homo Sapiens
CREGGPAPQ

SEQ ID NO: 502074 - protein, 9 aa, Homo Sapiens
CRVVPSDLY

SEQ ID NO: 502075 - protein, 9 aa, Homo Sapiens
AEGLGQDHW

SEQ ID NO: 502076 - protein, 9 aa, Homo Sapiens
TEGEEETKS

SEQ ID NO: 502077 - protein, 9 aa, Homo Sapiens
QIISAAGNT

SEQ ID NO: 502078 - protein, 9 aa, Homo Sapiens
LRLLLSNPK

SEQ ID NO: 502079 - protein, 9 aa, Homo Sapiens
IVFSQDKVQ

SEQ ID NO: 502080 - protein, 9 aa, Homo Sapiens
YSITEGSLR

SEQ ID NO: 502081 - protein, 9 aa, Homo Sapiens
EEQFGPFIW

SEQ ID NO: 502082 - protein, 9 aa, Homo Sapiens
KDGRLLCRP

SEQ ID NO: 502083 - protein, 9 aa, Homo Sapiens
EQFGPFIWI

SEQ ID NO: 502084 - protein, 9 aa, Homo Sapiens
QQAIALKAE

SEQ ID NO: 502085 - protein, 9 aa, Homo Sapiens
TRYSPDKMN

SEQ ID NO: 502086 - protein, 9 aa, Homo Sapiens
FRYCKKNQL

SEQ ID NO: 502087 - protein, 9 aa, Homo Sapiens
WPPTRRAGS

SEQ ID NO: 502088 - protein, 9 aa, Homo Sapiens
GQLGPTMKL

SEQ ID NO: 502089 - protein, 9 aa, Homo Sapiens
TSNRHINRN

SEQ ID NO: 502090 - protein, 9 aa, Homo Sapiens
DSEFFHERF

SEQ ID NO: 502091 - protein, 9 aa, Homo Sapiens
LKCPIEVLL

SEQ ID NO: 502092 - protein, 9 aa, Homo Sapiens
DKIQPEILE

SEQ ID NO: 502093 - protein, 9 aa, Homo Sapiens
EVLPGEQGP

SEQ ID NO: 502094 - protein, 9 aa, Homo Sapiens
QTFINSCTT

SEQ ID NO: 502095 - protein, 9 aa, Homo Sapiens
REGGPAPQG

SEQ ID NO: 502096 - protein, 9 aa, Homo Sapiens
ASSASSTES

SEQ ID NO: 502097 - protein, 9 aa, Homo Sapiens
HINRNYEPL

SEQ ID NO: 502098 - protein, 9 aa, Homo Sapiens
CWSLHNSKE

SEQ ID NO: 502099 - protein, 9 aa, Homo Sapiens
QFGPFIWIP

SEQ ID NO: 502100 - protein, 9 aa, Homo Sapiens
ELRDKIQPE

SEQ ID NO: 502101 - protein, 9 aa, Homo Sapiens
IAQTFINSC

SEQ ID NO: 502102 - protein, 9 aa, Homo Sapiens
GRLLCRPNK

SEQ ID NO: 502103 - protein, 9 aa, Homo Sapiens
VTFMNPHFG

SEQ ID NO: 502104 - protein, 9 aa, Homo Sapiens
KKANPSLLV

SEQ ID NO: 502105 - protein, 9 aa, Homo Sapiens
TLSFDYQPN

SEQ ID NO: 502106 - protein, 9 aa, Homo Sapiens
VCNCGEGPC

SEQ ID NO: 502107 - protein, 9 aa, Homo Sapiens
LYRLCWSLH

SEQ ID NO: 502108 - protein, 9 aa, Homo Sapiens
LPGEQGPSI

SEQ ID NO: 502109 - protein, 9 aa, Homo Sapiens
PWEHCSVSC

SEQ ID NO: 502110 - protein, 9 aa, Homo Sapiens
FFHERFRNL

SEQ ID NO: 502111 - protein, 9 aa, Homo Sapiens
SLSSFSSWP

SEQ ID NO: 502112 - protein, 9 aa, Homo Sapiens
IYHHCFNSQ

SEQ ID NO: 502113 - protein, 9 aa, Homo Sapiens
TTEGEEETK

SEQ ID NO: 502114 - protein, 9 aa, Homo Sapiens
GLGQDHWNE

SEQ ID NO: 502115 - protein, 9 aa, Homo Sapiens
EQTAYPLTH

SEQ ID NO: 502116 - protein, 9 aa, Homo Sapiens
CRPNKAGET

SEQ ID NO: 502117 - protein, 9 aa, Homo Sapiens
KSLKELNCE

SEQ ID NO: 502118 - protein, 9 aa, Homo Sapiens
FTLRSFRYC

SEQ ID NO: 502119 - protein, 9 aa, Homo Sapiens
ASLIKESGS

SEQ ID NO: 502120 - protein, 9 aa, Homo Sapiens
YSGSAPLVI

SEQ ID NO: 502121 - protein, 9 aa, Homo Sapiens
CVQKLSSFQ

SEQ ID NO: 502122 - protein, 9 aa, Homo Sapiens
TLELVALNS

SEQ ID NO: 502123 - protein, 9 aa, Homo Sapiens
EFFHERFRN

SEQ ID NO: 502124 - protein, 9 aa, Homo Sapiens
MEKKANPSL

SEQ ID NO: 502125 - protein, 9 aa, Homo Sapiens
VLPGEQGPS

SEQ ID NO: 502126 - protein, 9 aa, Homo Sapiens
SLLVLERRE

SEQ ID NO: 502127 - protein, 9 aa, Homo Sapiens
VDRSTQDKL

SEQ ID NO: 502128 - protein, 9 aa, Homo Sapiens
LGNKTDLPN

SEQ ID NO: 502129 - protein, 9 aa, Homo Sapiens
PITLVAWAP

SEQ ID NO: 502130 - protein, 9 aa, Homo Sapiens
IISAAGNTL

SEQ ID NO: 502131 - protein, 9 aa, Homo Sapiens
HINKSLKEL

SEQ ID NO: 502132 - protein, 9 aa, Homo Sapiens
VEDSQATET

SEQ ID NO: 502133 - protein, 9 aa, Homo Sapiens
PLSEITKQE

SEQ ID NO: 502134 - protein, 9 aa, Homo Sapiens
SAPLVIVHS

SEQ ID NO: 502135 - protein, 9 aa, Homo Sapiens
PARKYKFLH

SEQ ID NO: 502136 - protein, 9 aa, Homo Sapiens
TDSEFFHER

SEQ ID NO: 502137 - protein, 9 aa, Homo Sapiens
KLIQEFKEQ

SEQ ID NO: 502138 - protein, 9 aa, Homo Sapiens
ICRVVPSDL

SEQ ID NO: 502139 - protein, 9 aa, Homo Sapiens
KIGNYILGD

SEQ ID NO: 502140 - protein, 9 aa, Homo Sapiens
QRQLRRQGA

SEQ ID NO: 502141 - protein, 9 aa, Homo Sapiens
LSFDYQPNP

SEQ ID NO: 502142 - protein, 9 aa, Homo Sapiens
YTPSHKRQA

SEQ ID NO: 502143 - protein, 9 aa, Homo Sapiens
VQKLIQEFK

SEQ ID NO: 502144 - protein, 9 aa, Homo Sapiens
QDKLSTKCV

SEQ ID NO: 502145 - protein, 9 aa, Homo Sapiens
KKGEVLPGE

SEQ ID NO: 502146 - protein, 9 aa, Homo Sapiens
LSTRYSPDK

SEQ ID NO: 502147 - protein, 9 aa, Homo Sapiens
YLINTTVKE

SEQ ID NO: 502148 - protein, 9 aa, Homo Sapiens
DDFHIKGVL

SEQ ID NO: 502149 - protein, 9 aa, Homo Sapiens
SASSTESSF

SEQ ID NO: 502150 - protein, 9 aa, Homo Sapiens
ELKCPIEVL

SEQ ID NO: 502151 - protein, 9 aa, Homo Sapiens
CEALNIKFK

SEQ ID NO: 502152 - protein, 9 aa, Homo Sapiens
SISGGQLGP

SEQ ID NO: 502153 - protein, 9 aa, Homo Sapiens
YRLCWSLHN

SEQ ID NO: 502154 - protein, 9 aa, Homo Sapiens
SELKCPIEV

SEQ ID NO: 502155 - protein, 9 aa, Homo Sapiens
RGSGTRFVP

SEQ ID NO: 502156 - protein, 9 aa, Homo Sapiens
KANPSLLVL

SEQ ID NO: 502157 - protein, 9 aa, Homo Sapiens
IMCKLQRNR

SEQ ID NO: 502158 - protein, 9 aa, Homo Sapiens
DKMNNSPNF

SEQ ID NO: 502159 - protein, 9 aa, Homo Sapiens
KLSTKCVHC

SEQ ID NO: 502160 - protein, 9 aa, Homo Sapiens
CPIEVLLTP

SEQ ID NO: 502161 - protein, 9 aa, Homo Sapiens
TACYLTIMC

SEQ ID NO: 502162 - protein, 9 aa, Homo Sapiens
AKQEPQRNE

SEQ ID NO: 502163 - protein, 9 aa, Homo Sapiens
KDHQRERAT

SEQ ID NO: 502164 - protein, 9 aa, Homo Sapiens
ELHPLMKEG

SEQ ID NO: 502165 - protein, 9 aa, Homo Sapiens
WGPWEHCSV

SEQ ID NO: 502166 - protein, 9 aa, Homo Sapiens
SGSAPLVIV

SEQ ID NO: 502167 - protein, 9 aa, Homo Sapiens
PGEQGPSIK

SEQ ID NO: 502168 - protein, 9 aa, Homo Sapiens
QTAYPLTHY

SEQ ID NO: 502169 - protein, 9 aa, Homo Sapiens
TQDKLSTKC

SEQ ID NO: 502170 - protein, 9 aa, Homo Sapiens
SRIKTYSIT

SEQ ID NO: 502171 - protein, 9 aa, Homo Sapiens
EPPCGLTKS

SEQ ID NO: 502172 - protein, 9 aa, Homo Sapiens
EGGPAPQGA

SEQ ID NO: 502173 - protein, 9 aa, Homo Sapiens
RFAVVMPCV

SEQ ID NO: 502174 - protein, 9 aa, Homo Sapiens
AGRPQFNTT

SEQ ID NO: 502175 - protein, 9 aa, Homo Sapiens
QRERATASM

SEQ ID NO: 502176 - protein, 9 aa, Homo Sapiens
LSNPKGRME

SEQ ID NO: 502177 - protein, 9 aa, Homo Sapiens
GENGVWGIA

SEQ ID NO: 502178 - protein, 9 aa, Homo Sapiens
LAGDEEHAV

SEQ ID NO: 502179 - protein, 9 aa, Homo Sapiens
VLTKETPET

SEQ ID NO: 502180 - protein, 9 aa, Homo Sapiens
KSFDQLDLP

SEQ ID NO: 502181 - protein, 9 aa, Homo Sapiens
NQSKLVINE

SEQ ID NO: 502182 - protein, 9 aa, Homo Sapiens
DSESTSLTG

SEQ ID NO: 502183 - protein, 9 aa, Homo Sapiens
DVIDGYNAQ

SEQ ID NO: 502184 - protein, 9 aa, Homo Sapiens
ECGKTFNCS

SEQ ID NO: 502185 - protein, 9 aa, Homo Sapiens
LKNKASMSP

SEQ ID NO: 502186 - protein, 9 aa, Homo Sapiens
VENLSIQMR

SEQ ID NO: 502187 - protein, 9 aa, Homo Sapiens
WGIAVDWVA

SEQ ID NO: 502188 - protein, 9 aa, Homo Sapiens
AGTSGCSKD

SEQ ID NO: 502189 - protein, 9 aa, Homo Sapiens
HLLCHYWIA

SEQ ID NO: 502190 - protein, 9 aa, Homo Sapiens
MSPVRLHFS

SEQ ID NO: 502191 - protein, 9 aa, Homo Sapiens
SVDQNMFRN

SEQ ID NO: 502192 - protein, 9 aa, Homo Sapiens
NGEINLVDI

SEQ ID NO: 502193 - protein, 9 aa, Homo Sapiens
STCSASCGH

SEQ ID NO: 502194 - protein, 9 aa, Homo Sapiens
YIHTHTFYV

SEQ ID NO: 502195 - protein, 9 aa, Homo Sapiens
RPSYPGANP

SEQ ID NO: 502196 - protein, 9 aa, Homo Sapiens
GQAGVSEMD

SEQ ID NO: 502197 - protein, 9 aa, Homo Sapiens
GINKRDKKN

SEQ ID NO: 502198 - protein, 9 aa, Homo Sapiens
HTREWPFKT

SEQ ID NO: 502199 - protein, 9 aa, Homo Sapiens
QPLSLHVGM

SEQ ID NO: 502200 - protein, 9 aa, Homo Sapiens
LNSNGYPDS

SEQ ID NO: 502201 - protein, 9 aa, Homo Sapiens
SPKPQAADI

SEQ ID NO: 502202 - protein, 9 aa, Homo Sapiens
LAFPDDMDL

SEQ ID NO: 502203 - protein, 9 aa, Homo Sapiens
YGEMVDCCA

SEQ ID NO: 502204 - protein, 9 aa, Homo Sapiens
FSNPNLCAD

SEQ ID NO: 502205 - protein, 9 aa, Homo Sapiens
EDASASSQG

SEQ ID NO: 502206 - protein, 9 aa, Homo Sapiens
NFRGTGALI

SEQ ID NO: 502207 - protein, 9 aa, Homo Sapiens
HMTEVVRHC

SEQ ID NO: 502208 - protein, 9 aa, Homo Sapiens
FHDKECRNA

SEQ ID NO: 502209 - protein, 9 aa, Homo Sapiens
MDNSSQDAL

SEQ ID NO: 502210 - protein, 9 aa, Homo Sapiens
PKGKVTKDS

SEQ ID NO: 502211 - protein, 9 aa, Homo Sapiens
ALVQYVVAA

SEQ ID NO: 502212 - protein, 9 aa, Homo Sapiens
GRPSYPGAN

SEQ ID NO: 502213 - protein, 9 aa, Homo Sapiens
RAQPKPDGE

SEQ ID NO: 502214 - protein, 9 aa, Homo Sapiens
QVDTQVTSG

SEQ ID NO: 502215 - protein, 9 aa, Homo Sapiens
SLECSFTET

SEQ ID NO: 502216 - protein, 9 aa, Homo Sapiens
CCILYVTKA

SEQ ID NO: 502217 - protein, 9 aa, Homo Sapiens
SETYTLFSK

SEQ ID NO: 502218 - protein, 9 aa, Homo Sapiens
EGNSKEPGG

SEQ ID NO: 502219 - protein, 9 aa, Homo Sapiens
LVQYVVAAA

SEQ ID NO: 502220 - protein, 9 aa, Homo Sapiens
YELHTREWP

SEQ ID NO: 502221 - protein, 9 aa, Homo Sapiens
NYMCPLNSN

SEQ ID NO: 502222 - protein, 9 aa, Homo Sapiens
CNPSCPNGS

SEQ ID NO: 502223 - protein, 9 aa, Homo Sapiens
IIADSFIYF

SEQ ID NO: 502224 - protein, 9 aa, Homo Sapiens
RALINSVDQ

SEQ ID NO: 502225 - protein, 9 aa, Homo Sapiens
NLMSTKEEL

SEQ ID NO: 502226 - protein, 9 aa, Homo Sapiens
FCGVYDQPY

SEQ ID NO: 502227 - protein, 9 aa, Homo Sapiens
EESELNAQY

SEQ ID NO: 502228 - protein, 9 aa, Homo Sapiens
KEYQQKTRE

SEQ ID NO: 502229 - protein, 9 aa, Homo Sapiens
NVSKEPGAG

SEQ ID NO: 502230 - protein, 9 aa, Homo Sapiens
SLFHDKECR

SEQ ID NO: 502231 - protein, 9 aa, Homo Sapiens
DRALINSVD

SEQ ID NO: 502232 - protein, 9 aa, Homo Sapiens
CSFTETESN

SEQ ID NO: 502233 - protein, 9 aa, Homo Sapiens
RSKSRSQFS

SEQ ID NO: 502234 - protein, 9 aa, Homo Sapiens
PPPSPHFTR

SEQ ID NO: 502235 - protein, 9 aa, Homo Sapiens
TELHNTLRT

SEQ ID NO: 502236 - protein, 9 aa, Homo Sapiens
FSSNLNHCG

SEQ ID NO: 502237 - protein, 9 aa, Homo Sapiens
CPLNSNGYP

SEQ ID NO: 502238 - protein, 9 aa, Homo Sapiens
KGPFTLESQ

SEQ ID NO: 502239 - protein, 9 aa, Homo Sapiens
ILQRTMTDA

SEQ ID NO: 502240 - protein, 9 aa, Homo Sapiens
LRNKTGVVT

SEQ ID NO: 502241 - protein, 9 aa, Homo Sapiens
VNHITRTTQ

SEQ ID NO: 502242 - protein, 9 aa, Homo Sapiens
TPVTGELDM

SEQ ID NO: 502243 - protein, 9 aa, Homo Sapiens
KSPANMAEK

SEQ ID NO: 502244 - protein, 9 aa, Homo Sapiens
FFHGCFSIG

SEQ ID NO: 502245 - protein, 9 aa, Homo Sapiens
VDRLPDGCL

SEQ ID NO: 502246 - protein, 9 aa, Homo Sapiens
GRGLARGGI

SEQ ID NO: 502247 - protein, 9 aa, Homo Sapiens
MKHTSLPIQ

SEQ ID NO: 502248 - protein, 9 aa, Homo Sapiens
AAAILLHAG

SEQ ID NO: 502249 - protein, 9 aa, Homo Sapiens
VIVSTDIKI

SEQ ID NO: 502250 - protein, 9 aa, Homo Sapiens
LCLQQNNKT

SEQ ID NO: 502251 - protein, 9 aa, Homo Sapiens
ALVSNLMST

SEQ ID NO: 502252 - protein, 9 aa, Homo Sapiens
HLQKLRNRV

SEQ ID NO: 502253 - protein, 9 aa, Homo Sapiens
AGKILWTRQ

SEQ ID NO: 502254 - protein, 9 aa, Homo Sapiens
CQPGFFLAS

SEQ ID NO: 502255 - protein, 9 aa, Homo Sapiens
YLPDLHRSK

SEQ ID NO: 502256 - protein, 9 aa, Homo Sapiens
MESEDETLL

SEQ ID NO: 502257 - protein, 9 aa, Homo Sapiens
GMLELLNNT

SEQ ID NO: 502258 - protein, 9 aa, Homo Sapiens
EMEESELNA

SEQ ID NO: 502259 - protein, 9 aa, Homo Sapiens
LASGTEHRV

SEQ ID NO: 502260 - protein, 9 aa, Homo Sapiens
CVAAAILLH

SEQ ID NO: 502261 - protein, 9 aa, Homo Sapiens
REKRRQLKQ

SEQ ID NO: 502262 - protein, 9 aa, Homo Sapiens
NVLTKETPE

SEQ ID NO: 502263 - protein, 9 aa, Homo Sapiens
CDVCSIGCI

SEQ ID NO: 502264 - protein, 9 aa, Homo Sapiens
LHTREWPFK

SEQ ID NO: 502265 - protein, 9 aa, Homo Sapiens
QHLWLSFDE

SEQ ID NO: 502266 - protein, 9 aa, Homo Sapiens
FKNIFWSHA

SEQ ID NO: 502267 - protein, 9 aa, Homo Sapiens
SAYLSLDDN

SEQ ID NO: 502268 - protein, 9 aa, Homo Sapiens
KRDKKNRTA

SEQ ID NO: 502269 - protein, 9 aa, Homo Sapiens
VDSILPESS

SEQ ID NO: 502270 - protein, 9 aa, Homo Sapiens
PDVSHTSRS

SEQ ID NO: 502271 - protein, 9 aa, Homo Sapiens
ENDNTDLDV

SEQ ID NO: 502272 - protein, 9 aa, Homo Sapiens
QAGVSEMDN

SEQ ID NO: 502273 - protein, 9 aa, Homo Sapiens
SEDSILSSK

SEQ ID NO: 502274 - protein, 9 aa, Homo Sapiens
RGLARGGIG

SEQ ID NO: 502275 - protein, 9 aa, Homo Sapiens
AQSANQGFE

SEQ ID NO: 502276 - protein, 9 aa, Homo Sapiens
PGAGGKETM

SEQ ID NO: 502277 - protein, 9 aa, Homo Sapiens
QKQCKDISC

SEQ ID NO: 502278 - protein, 9 aa, Homo Sapiens
CNECGNRNS

SEQ ID NO: 502279 - protein, 9 aa, Homo Sapiens
CSFVNKHCH

SEQ ID NO: 502280 - protein, 9 aa, Homo Sapiens
KRLGENDNT

SEQ ID NO: 502281 - protein, 9 aa, Homo Sapiens
SFSKVAREY

SEQ ID NO: 502282 - protein, 9 aa, Homo Sapiens
RTMTDAADC

SEQ ID NO: 502283 - protein, 9 aa, Homo Sapiens
SLSKVKLTN

SEQ ID NO: 502284 - protein, 9 aa, Homo Sapiens
PAPCPEGTS

SEQ ID NO: 502285 - protein, 9 aa, Homo Sapiens
LGQAGVSEM

SEQ ID NO: 502286 - protein, 9 aa, Homo Sapiens
TYSDSLRPP

SEQ ID NO: 502287 - protein, 9 aa, Homo Sapiens
RIIGHLMLK

SEQ ID NO: 502288 - protein, 9 aa, Homo Sapiens
NHCGMTHVA

SEQ ID NO: 502289 - protein, 9 aa, Homo Sapiens
VRHCPHHER

SEQ ID NO: 502290 - protein, 9 aa, Homo Sapiens
KKKEAPLAK

SEQ ID NO: 502291 - protein, 9 aa, Homo Sapiens
NVIFWLAGV

SEQ ID NO: 502292 - protein, 9 aa, Homo Sapiens
ERTIQRDGI

SEQ ID NO: 502293 - protein, 9 aa, Homo Sapiens
WTRQLFHRI

SEQ ID NO: 502294 - protein, 9 aa, Homo Sapiens
AALDNTYIG

SEQ ID NO: 502295 - protein, 9 aa, Homo Sapiens
SELVILLSP

SEQ ID NO: 502296 - protein, 9 aa, Homo Sapiens
VTRHFPPAP

SEQ ID NO: 502297 - protein, 9 aa, Homo Sapiens
DEANKRLLY

SEQ ID NO: 502298 - protein, 9 aa, Homo Sapiens
LLAGRAQPK

SEQ ID NO: 502299 - protein, 9 aa, Homo Sapiens
CKEAEATFK

SEQ ID NO: 502300 - protein, 9 aa, Homo Sapiens
FLRILCSYV

SEQ ID NO: 502301 - protein, 9 aa, Homo Sapiens
PSPHFTRRY

SEQ ID NO: 502302 - protein, 9 aa, Homo Sapiens
QPKPDGEAE

SEQ ID NO: 502303 - protein, 9 aa, Homo Sapiens
EVVRHCPHH

SEQ ID NO: 502304 - protein, 9 aa, Homo Sapiens
ETYGEMVDC

SEQ ID NO: 502305 - protein, 9 aa, Homo Sapiens
ASDHADSQN

SEQ ID NO: 502306 - protein, 9 aa, Homo Sapiens
RHKVTGLHY

SEQ ID NO: 502307 - protein, 9 aa, Homo Sapiens
IEMEESELN

SEQ ID NO: 502308 - protein, 9 aa, Homo Sapiens
QNEKVIVST

SEQ ID NO: 502309 - protein, 9 aa, Homo Sapiens
QPIILGGPS

SEQ ID NO: 502310 - protein, 9 aa, Homo Sapiens
FKRLGENDN

SEQ ID NO: 502311 - protein, 9 aa, Homo Sapiens
DKEYQQKTR

SEQ ID NO: 502312 - protein, 9 aa, Homo Sapiens
PIAGKILWT

SEQ ID NO: 502313 - protein, 9 aa, Homo Sapiens
MPSPSKARK

SEQ ID NO: 502314 - protein, 9 aa, Homo Sapiens
RPGPGKGAW

SEQ ID NO: 502315 - protein, 9 aa, Homo Sapiens
DSFSKVARE

SEQ ID NO: 502316 - protein, 9 aa, Homo Sapiens
LGENDNTDL

SEQ ID NO: 502317 - protein, 9 aa, Homo Sapiens
NMRKRERTI

SEQ ID NO: 502318 - protein, 9 aa, Homo Sapiens
WLCCLIIAD

SEQ ID NO: 502319 - protein, 9 aa, Homo Sapiens
ADRALINSV

SEQ ID NO: 502320 - protein, 9 aa, Homo Sapiens
TMTDAADCL

SEQ ID NO: 502321 - protein, 9 aa, Homo Sapiens
RPTAQDLAY

SEQ ID NO: 502322 - protein, 9 aa, Homo Sapiens
QKCNPSCPN

SEQ ID NO: 502323 - protein, 8 aa, Homo Sapiens
ATLSFVFL

SEQ ID NO: 502324 - protein, 9 aa, Homo Sapiens
VAAVAGPPP

SEQ ID NO: 502325 - protein, 9 aa, Homo Sapiens
LELLNNTAN

SEQ ID NO: 502326 - protein, 9 aa, Homo Sapiens
IYTHIYIHT

SEQ ID NO: 502327 - protein, 9 aa, Homo Sapiens
VPELKGCMP

SEQ ID NO: 502328 - protein, 9 aa, Homo Sapiens
GNGASSKAQ

SEQ ID NO: 502329 - protein, 9 aa, Homo Sapiens
ISWIQGCFD

SEQ ID NO: 502330 - protein, 9 aa, Homo Sapiens
QDLAYQHEV

SEQ ID NO: 502331 - protein, 9 aa, Homo Sapiens
EAANPISGH

SEQ ID NO: 502332 - protein, 9 aa, Homo Sapiens
YKRLIKVCS

SEQ ID NO: 502333 - protein, 9 aa, Homo Sapiens
ILGGPSPPT

SEQ ID NO: 502334 - protein, 9 aa, Homo Sapiens
NALETNIIL

SEQ ID NO: 502335 - protein, 9 aa, Homo Sapiens
DGINPSKQA

SEQ ID NO: 502336 - protein, 9 aa, Homo Sapiens
NKRDKKNRT

SEQ ID NO: 502337 - protein, 9 aa, Homo Sapiens
CKTIISTTS

SEQ ID NO: 502338 - protein, 9 aa, Homo Sapiens
LLRYANVEN

SEQ ID NO: 502339 - protein, 9 aa, Homo Sapiens
GPGKGAWNP

SEQ ID NO: 502340 - protein, 9 aa, Homo Sapiens
NPWLCNCDI

SEQ ID NO: 502341 - protein, 9 aa, Homo Sapiens
SFVNKHCHQ

SEQ ID NO: 502342 - protein, 9 aa, Homo Sapiens
GTGWPSYGE

SEQ ID NO: 502343 - protein, 9 aa, Homo Sapiens
RVAGPSKPK

SEQ ID NO: 502344 - protein, 9 aa, Homo Sapiens
EYIPLSRND

SEQ ID NO: 502345 - protein, 9 aa, Homo Sapiens
EDKVVHEWW

SEQ ID NO: 502346 - protein, 9 aa, Homo Sapiens
SALGLGLAL

SEQ ID NO: 502347 - protein, 9 aa, Homo Sapiens
LGSCQKCNP

SEQ ID NO: 502348 - protein, 9 aa, Homo Sapiens
AALGMGLAL

SEQ ID NO: 502349 - protein, 9 aa, Homo Sapiens
ELKGCMPHV

SEQ ID NO: 502350 - protein, 9 aa, Homo Sapiens
EMNFRGTGA

SEQ ID NO: 502351 - protein, 9 aa, Homo Sapiens
KSFGRGDNP

SEQ ID NO: 502352 - protein, 9 aa, Homo Sapiens
SILSSKSFD

SEQ ID NO: 502353 - protein, 9 aa, Homo Sapiens
CFSIGDLNE

SEQ ID NO: 502354 - protein, 9 aa, Homo Sapiens
PLLKRVDAD

SEQ ID NO: 502355 - protein, 9 aa, Homo Sapiens
DLHRSKQAL

SEQ ID NO: 502356 - protein, 9 aa, Homo Sapiens
PISLSKVKL

SEQ ID NO: 502357 - protein, 9 aa, Homo Sapiens
EAAELCLQQ

SEQ ID NO: 502358 - protein, 9 aa, Homo Sapiens
AELCLQQNN

SEQ ID NO: 502359 - protein, 9 aa, Homo Sapiens
LNHCGMTHV

SEQ ID NO: 502360 - protein, 9 aa, Homo Sapiens
KGCMPHVPY

SEQ ID NO: 502361 - protein, 9 aa, Homo Sapiens
SFSCKEAEA

SEQ ID NO: 502362 - protein, 9 aa, Homo Sapiens
GEINLVDIN

SEQ ID NO: 502363 - protein, 9 aa, Homo Sapiens
NSSHLSRNK

SEQ ID NO: 502364 - protein, 9 aa, Homo Sapiens
EEPPLSPRP

SEQ ID NO: 502365 - protein, 9 aa, Homo Sapiens
RKLLHLSLA

SEQ ID NO: 502366 - protein, 9 aa, Homo Sapiens
GVSEMDNSS

SEQ ID NO: 502367 - protein, 9 aa, Homo Sapiens
VSNLMSTKE

SEQ ID NO: 502368 - protein, 9 aa, Homo Sapiens
GAWNPNHLP

SEQ ID NO: 502369 - protein, 9 aa, Homo Sapiens
NIILSFVLM

SEQ ID NO: 502370 - protein, 9 aa, Homo Sapiens
MDERRRQER

SEQ ID NO: 502371 - protein, 9 aa, Homo Sapiens
SLPPKPQLE

SEQ ID NO: 502372 - protein, 9 aa, Homo Sapiens
PTAQDLAYQ

SEQ ID NO: 502373 - protein, 9 aa, Homo Sapiens
FLASGTEHR

SEQ ID NO: 502374 - protein, 9 aa, Homo Sapiens
LLVDSILPE

SEQ ID NO: 502375 - protein, 9 aa, Homo Sapiens
VSHTSRSSP

SEQ ID NO: 502376 - protein, 9 aa, Homo Sapiens
GAIQLELIP

SEQ ID NO: 502377 - protein, 9 aa, Homo Sapiens
IFSELVILL

SEQ ID NO: 502378 - protein, 9 aa, Homo Sapiens
ASGTEHRVC

SEQ ID NO: 502379 - protein, 9 aa, Homo Sapiens
VQVIFSELV

SEQ ID NO: 502380 - protein, 9 aa, Homo Sapiens
KIKSPANMA

SEQ ID NO: 502381 - protein, 9 aa, Homo Sapiens
KLEWKNQSK

SEQ ID NO: 502382 - protein, 9 aa, Homo Sapiens
AGPPPAAAE

SEQ ID NO: 502383 - protein, 9 aa, Homo Sapiens
PWLCNCDIL

SEQ ID NO: 502384 - protein, 9 aa, Homo Sapiens
RLPDGCLDA

SEQ ID NO: 502385 - protein, 9 aa, Homo Sapiens
ASMSPGLHP

SEQ ID NO: 502386 - protein, 9 aa, Homo Sapiens
AQDLAYQHE

SEQ ID NO: 502387 - protein, 9 aa, Homo Sapiens
IFLTGSCKG

SEQ ID NO: 502388 - protein, 9 aa, Homo Sapiens
GDWSTCSAS

SEQ ID NO: 502389 - protein, 9 aa, Homo Sapiens
LSHYLPDLH

SEQ ID NO: 502390 - protein, 9 aa, Homo Sapiens
SHTSRSSPS

SEQ ID NO: 502391 - protein, 9 aa, Homo Sapiens
SSNLNHCGM

SEQ ID NO: 502392 - protein, 9 aa, Homo Sapiens
MGLALGGGS

SEQ ID NO: 502393 - protein, 9 aa, Homo Sapiens
EIFNVLTKE

SEQ ID NO: 502394 - protein, 9 aa, Homo Sapiens
CNCDILYFR

SEQ ID NO: 502395 - protein, 9 aa, Homo Sapiens
GEMVDCCAK

SEQ ID NO: 502396 - protein, 9 aa, Homo Sapiens
YGTLQVFVR

SEQ ID NO: 502397 - protein, 9 aa, Homo Sapiens
VVTTTWERL

SEQ ID NO: 502398 - protein, 9 aa, Homo Sapiens
TSLPIQHLW

SEQ ID NO: 502399 - protein, 9 aa, Homo Sapiens
NTEEIFNVL

SEQ ID NO: 502400 - protein, 9 aa, Homo Sapiens
SRYHEAHQH

SEQ ID NO: 502401 - protein, 9 aa, Homo Sapiens
NAPRDPDPS

SEQ ID NO: 502402 - protein, 9 aa, Homo Sapiens
VLAFPDDMD

SEQ ID NO: 502403 - protein, 9 aa, Homo Sapiens
PLSLHVGML

SEQ ID NO: 502404 - protein, 9 aa, Homo Sapiens
GLARGGIGM

SEQ ID NO: 502405 - protein, 9 aa, Homo Sapiens
EAPLAKVPE

SEQ ID NO: 502406 - protein, 9 aa, Homo Sapiens
SKSFDQLDL

SEQ ID NO: 502407 - protein, 9 aa, Homo Sapiens
AGGLNLEPL

SEQ ID NO: 502408 - protein, 9 aa, Homo Sapiens
HFSAPCFCR

SEQ ID NO: 502409 - protein, 9 aa, Homo Sapiens
GGKETMEPG

SEQ ID NO: 502410 - protein, 9 aa, Homo Sapiens
SSVSEDASA

SEQ ID NO: 502411 - protein, 9 aa, Homo Sapiens
LTGSCKGKC

SEQ ID NO: 502412 - protein, 9 aa, Homo Sapiens
WQAGDWSTC

SEQ ID NO: 502413 - protein, 9 aa, Homo Sapiens
ERLSSSEET

SEQ ID NO: 502414 - protein, 9 aa, Homo Sapiens
SPGLHPGST

SEQ ID NO: 502415 - protein, 9 aa, Homo Sapiens
NIQHVKESV

SEQ ID NO: 502416 - protein, 9 aa, Homo Sapiens
LRILCSYVQ

SEQ ID NO: 502417 - protein, 9 aa, Homo Sapiens
LLQPLSLHV

SEQ ID NO: 502418 - protein, 9 aa, Homo Sapiens
VPKKKEAPL

SEQ ID NO: 502419 - protein, 9 aa, Homo Sapiens
TFLRILCSY

SEQ ID NO: 502420 - protein, 9 aa, Homo Sapiens
KGAWNPNHL

SEQ ID NO: 502421 - protein, 9 aa, Homo Sapiens
YTLFSKMGP

SEQ ID NO: 502422 - protein, 9 aa, Homo Sapiens
CRNAVSKYT

SEQ ID NO: 502423 - protein, 9 aa, Homo Sapiens
PSPKPQAAD

SEQ ID NO: 502424 - protein, 9 aa, Homo Sapiens
MELLSKALV

SEQ ID NO: 502425 - protein, 9 aa, Homo Sapiens
ISMLEQGKG

SEQ ID NO: 502426 - protein, 9 aa, Homo Sapiens
FLLFLKGSD

SEQ ID NO: 502427 - protein, 9 aa, Homo Sapiens
LHNTLRTLS

SEQ ID NO: 502428 - protein, 9 aa, Homo Sapiens
QHFGMLELL

SEQ ID NO: 502429 - protein, 9 aa, Homo Sapiens
KVTGLHYGT

SEQ ID NO: 502430 - protein, 9 aa, Homo Sapiens
ASASSQGSE

SEQ ID NO: 502431 - protein, 9 aa, Homo Sapiens
DVPGSGSAF

SEQ ID NO: 502432 - protein, 9 aa, Homo Sapiens
SGCSKDSLA

SEQ ID NO: 502433 - protein, 9 aa, Homo Sapiens
ILWTRQLFH

SEQ ID NO: 502434 - protein, 9 aa, Homo Sapiens
NPSCPNGSC

SEQ ID NO: 502435 - protein, 9 aa, Homo Sapiens
VAAAILLHA

SEQ ID NO: 502436 - protein, 9 aa, Homo Sapiens
GKGPFTLES

SEQ ID NO: 502437 - protein, 9 aa, Homo Sapiens
QRDGINPSK

SEQ ID NO: 502438 - protein, 9 aa, Homo Sapiens
YLLFSYNVI

SEQ ID NO: 502439 - protein, 9 aa, Homo Sapiens
CHYWIAVSH

SEQ ID NO: 502440 - protein, 9 aa, Homo Sapiens
KERPKGKVT

SEQ ID NO: 502441 - protein, 9 aa, Homo Sapiens
LPPKPQLEG

SEQ ID NO: 502442 - protein, 9 aa, Homo Sapiens
RMVDRLPDG

SEQ ID NO: 502443 - protein, 9 aa, Homo Sapiens
DVCSIGCII

SEQ ID NO: 502444 - protein, 9 aa, Homo Sapiens
ELPRSTTST

SEQ ID NO: 502445 - protein, 9 aa, Homo Sapiens
NKSFGRGDN

SEQ ID NO: 502446 - protein, 9 aa, Homo Sapiens
PEPCPSTIT

SEQ ID NO: 502447 - protein, 9 aa, Homo Sapiens
LEEKNIQVS

SEQ ID NO: 502448 - protein, 9 aa, Homo Sapiens
QHLQKLRNR

SEQ ID NO: 502449 - protein, 9 aa, Homo Sapiens
GNSKEPGGF

SEQ ID NO: 502450 - protein, 9 aa, Homo Sapiens
TGLHYGTLQ

SEQ ID NO: 502451 - protein, 9 aa, Homo Sapiens
VRPAPDNAP

SEQ ID NO: 502452 - protein, 9 aa, Homo Sapiens
SPAPCPEGT

SEQ ID NO: 502453 - protein, 9 aa, Homo Sapiens
LCNCDILYF

SEQ ID NO: 502454 - protein, 9 aa, Homo Sapiens
YPGANPNIC

SEQ ID NO: 502455 - protein, 9 aa, Homo Sapiens
GALQKLRKW

SEQ ID NO: 502456 - protein, 9 aa, Homo Sapiens
DQPYYYSDI

SEQ ID NO: 502457 - protein, 9 aa, Homo Sapiens
MLACSFVNK

SEQ ID NO: 502458 - protein, 9 aa, Homo Sapiens
IQYVNHITR

SEQ ID NO: 502459 - protein, 9 aa, Homo Sapiens
PIDTYSDSL

SEQ ID NO: 502460 - protein, 9 aa, Homo Sapiens
SHLSSHNRI

SEQ ID NO: 502461 - protein, 9 aa, Homo Sapiens
NSNGYPDSL

SEQ ID NO: 502462 - protein, 9 aa, Homo Sapiens
ISCDYLDFG

SEQ ID NO: 502463 - protein, 9 aa, Homo Sapiens
IHTHTFYVS

SEQ ID NO: 502464 - protein, 9 aa, Homo Sapiens
SCKGKCCRT

SEQ ID NO: 502465 - protein, 9 aa, Homo Sapiens
EERELPRST

SEQ ID NO: 502466 - protein, 9 aa, Homo Sapiens
MRLMTRERN

SEQ ID NO: 502467 - protein, 9 aa, Homo Sapiens
LEPLLKRVD

SEQ ID NO: 502468 - protein, 9 aa, Homo Sapiens
PQSPAPCPE

SEQ ID NO: 502469 - protein, 9 aa, Homo Sapiens
VSKEPGAGG

SEQ ID NO: 502470 - protein, 9 aa, Homo Sapiens
HTSLPIQHL

SEQ ID NO: 502471 - protein, 9 aa, Homo Sapiens
IIGHLMLKP

SEQ ID NO: 502472 - protein, 9 aa, Homo Sapiens
NDSGYPLDL

SEQ ID NO: 502473 - protein, 9 aa, Homo Sapiens
FFLAVNLLD

SEQ ID NO: 502474 - protein, 9 aa, Homo Sapiens
AGTLEGNSK

SEQ ID NO: 502475 - protein, 9 aa, Homo Sapiens
SLFRWYKKA

SEQ ID NO: 502476 - protein, 9 aa, Homo Sapiens
LKEERELPR

SEQ ID NO: 502477 - protein, 9 aa, Homo Sapiens
SSKSFDQLD

SEQ ID NO: 502478 - protein, 9 aa, Homo Sapiens
LLFSYNVIF

SEQ ID NO: 502479 - protein, 9 aa, Homo Sapiens
QKFRVDVPG

SEQ ID NO: 502480 - protein, 9 aa, Homo Sapiens
VWGIAVDWV

SEQ ID NO: 502481 - protein, 9 aa, Homo Sapiens
FPDDMDLRV

SEQ ID NO: 502482 - protein, 9 aa, Homo Sapiens
EPGAGGKET

SEQ ID NO: 502483 - protein, 9 aa, Homo Sapiens
PCPSTITPA

SEQ ID NO: 502484 - protein, 9 aa, Homo Sapiens
QRLYKIHFQ

SEQ ID NO: 502485 - protein, 9 aa, Homo Sapiens
MEESELNAQ

SEQ ID NO: 502486 - protein, 9 aa, Homo Sapiens
ALSETPNRK

SEQ ID NO: 502487 - protein, 9 aa, Homo Sapiens
LRKLLHLSL

SEQ ID NO: 502488 - protein, 9 aa, Homo Sapiens
AAVSRAGSM

SEQ ID NO: 502489 - protein, 9 aa, Homo Sapiens
GYPLDLNHS

SEQ ID NO: 502490 - protein, 9 aa, Homo Sapiens
VKESVPNGV

SEQ ID NO: 502491 - protein, 9 aa, Homo Sapiens
NSSVNDSGY

SEQ ID NO: 502492 - protein, 9 aa, Homo Sapiens
ANPNICDGN

SEQ ID NO: 502493 - protein, 9 aa, Homo Sapiens
ALWQVDTQV

SEQ ID NO: 502494 - protein, 9 aa, Homo Sapiens
PGANPNICD

SEQ ID NO: 502495 - protein, 9 aa, Homo Sapiens
ISVCQHESH

SEQ ID NO: 502496 - protein, 9 aa, Homo Sapiens
LSIQMRLMT

SEQ ID NO: 502497 - protein, 9 aa, Homo Sapiens
ILSSKSFDQ

SEQ ID NO: 502498 - protein, 9 aa, Homo Sapiens
PRATSQMLE

SEQ ID NO: 502499 - protein, 9 aa, Homo Sapiens
ANMAEKAKQ

SEQ ID NO: 502500 - protein, 9 aa, Homo Sapiens
GKETMEPGS

SEQ ID NO: 502501 - protein, 9 aa, Homo Sapiens
CVLQLGDVI

SEQ ID NO: 502502 - protein, 9 aa, Homo Sapiens
KEAPLAKVP

SEQ ID NO: 502503 - protein, 9 aa, Homo Sapiens
SETPNRKWV

SEQ ID NO: 502504 - protein, 9 aa, Homo Sapiens
IVSTDIKIE

SEQ ID NO: 502505 - protein, 9 aa, Homo Sapiens
TSNHLLCHY

SEQ ID NO: 502506 - protein, 9 aa, Homo Sapiens
VVRHCPHHE

SEQ ID NO: 502507 - protein, 9 aa, Homo Sapiens
CQHESHQAI

SEQ ID NO: 502508 - protein, 9 aa, Homo Sapiens
RYANVENTS

SEQ ID NO: 502509 - protein, 9 aa, Homo Sapiens
QQNNKTEVW

SEQ ID NO: 502510 - protein, 9 aa, Homo Sapiens
PGFFLASGT

SEQ ID NO: 502511 - protein, 9 aa, Homo Sapiens
SKSRSQFSS

SEQ ID NO: 502512 - protein, 9 aa, Homo Sapiens
PISVCQHES

SEQ ID NO: 502513 - protein, 9 aa, Homo Sapiens
DNAFTAPFH

SEQ ID NO: 502514 - protein, 9 aa, Homo Sapiens
PKPQLEGGR

SEQ ID NO: 502515 - protein, 9 aa, Homo Sapiens
DDNAFTAPF

SEQ ID NO: 502516 - protein, 9 aa, Homo Sapiens
PPLSPRPRD

SEQ ID NO: 502517 - protein, 9 aa, Homo Sapiens
HQCRIIGHL

SEQ ID NO: 502518 - protein, 9 aa, Homo Sapiens
VIDGYNAQY

SEQ ID NO: 502519 - protein, 9 aa, Homo Sapiens
SAPCFCRAF

SEQ ID NO: 502520 - protein, 9 aa, Homo Sapiens
GSGIGTPGQ

SEQ ID NO: 502521 - protein, 9 aa, Homo Sapiens
ASALGLGLA

SEQ ID NO: 502522 - protein, 9 aa, Homo Sapiens
LSRNDFFGV

SEQ ID NO: 502523 - protein, 9 aa, Homo Sapiens
CFYNHSWKQ

SEQ ID NO: 502524 - protein, 9 aa, Homo Sapiens
EVGAIQLEL

SEQ ID NO: 502525 - protein, 9 aa, Homo Sapiens
VRSKHPTLL

SEQ ID NO: 502526 - protein, 9 aa, Homo Sapiens
SDSLRPPYP

SEQ ID NO: 502527 - protein, 9 aa, Homo Sapiens
PNHLPCRPR

SEQ ID NO: 502528 - protein, 9 aa, Homo Sapiens
VTGELDMRK

SEQ ID NO: 502529 - protein, 9 aa, Homo Sapiens
LGGRPGPGK

SEQ ID NO: 502530 - protein, 9 aa, Homo Sapiens
AAAMTAPPG

SEQ ID NO: 502531 - protein, 9 aa, Homo Sapiens
KKFLLFLKG

SEQ ID NO: 502532 - protein, 9 aa, Homo Sapiens
ERELPRSTT

SEQ ID NO: 502533 - protein, 9 aa, Homo Sapiens
PPKPQLEGG

SEQ ID NO: 502534 - protein, 9 aa, Homo Sapiens
LSKAHQCRI

SEQ ID NO: 502535 - protein, 9 aa, Homo Sapiens
TIWYELHTR

SEQ ID NO: 502536 - protein, 9 aa, Homo Sapiens
GKVTKDSVT

SEQ ID NO: 502537 - protein, 9 aa, Homo Sapiens
HFGMLELLN

SEQ ID NO: 502538 - protein, 9 aa, Homo Sapiens
KILATFLRI

SEQ ID NO: 502539 - protein, 9 aa, Homo Sapiens
DPTFDYEMN

SEQ ID NO: 502540 - protein, 9 aa, Homo Sapiens
QLGDVIDGY

SEQ ID NO: 502541 - protein, 9 aa, Homo Sapiens
ARKEQKREK

SEQ ID NO: 502542 - protein, 9 aa, Homo Sapiens
NDNTDLDVI

SEQ ID NO: 502543 - protein, 9 aa, Homo Sapiens
AYSATSIVL

SEQ ID NO: 502544 - protein, 9 aa, Homo Sapiens
KLRNRVAPG

SEQ ID NO: 502545 - protein, 9 aa, Homo Sapiens
GPQPIILGG

SEQ ID NO: 502546 - protein, 9 aa, Homo Sapiens
LKLGALQKL

SEQ ID NO: 502547 - protein, 9 aa, Homo Sapiens
LEGNSKEPG

SEQ ID NO: 502548 - protein, 9 aa, Homo Sapiens
ERRRQERGL

SEQ ID NO: 502549 - protein, 9 aa, Homo Sapiens
LDNMRKRER

SEQ ID NO: 502550 - protein, 9 aa, Homo Sapiens
GAATVKMPS

SEQ ID NO: 502551 - protein, 9 aa, Homo Sapiens
NKTGVVTTT

SEQ ID NO: 502552 - protein, 9 aa, Homo Sapiens
PNTEEIFNV

SEQ ID NO: 502553 - protein, 9 aa, Homo Sapiens
KNIFWSHAI

SEQ ID NO: 502554 - protein, 9 aa, Homo Sapiens
LPESSYEVQ

SEQ ID NO: 502555 - protein, 9 aa, Homo Sapiens
TGEDVCHEL

SEQ ID NO: 502556 - protein, 9 aa, Homo Sapiens
TREWPFKTQ

SEQ ID NO: 502557 - protein, 9 aa, Homo Sapiens
PDNAPRDPD

SEQ ID NO: 502558 - protein, 9 aa, Homo Sapiens
EWQAGDWST

SEQ ID NO: 502559 - protein, 9 aa, Homo Sapiens
LSKVKLTNK

SEQ ID NO: 502560 - protein, 9 aa, Homo Sapiens
SIQMRLMTR

SEQ ID NO: 502561 - protein, 9 aa, Homo Sapiens
TSRSSPSIA

SEQ ID NO: 502562 - protein, 9 aa, Homo Sapiens
YQQKTREEL

SEQ ID NO: 502563 - protein, 9 aa, Homo Sapiens
SKEPGGFWG

SEQ ID NO: 502564 - protein, 9 aa, Homo Sapiens
EEIFNVLTK

SEQ ID NO: 502565 - protein, 9 aa, Homo Sapiens
RTIQRDGIN

SEQ ID NO: 502566 - protein, 9 aa, Homo Sapiens
KTGVVTTTW

SEQ ID NO: 502567 - protein, 9 aa, Homo Sapiens
SESTSLTGE

SEQ ID NO: 502568 - protein, 9 aa, Homo Sapiens
HVKESVPNG

SEQ ID NO: 502569 - protein, 9 aa, Homo Sapiens
GTSGCSKDS

SEQ ID NO: 502570 - protein, 9 aa, Homo Sapiens
SATFINSSG

SEQ ID NO: 502571 - protein, 9 aa, Homo Sapiens
VTGLHYGTL

SEQ ID NO: 502572 - protein, 9 aa, Homo Sapiens
TTSRTSQLQ

SEQ ID NO: 502573 - protein, 9 aa, Homo Sapiens
IQVSLEKQQ

SEQ ID NO: 502574 - protein, 9 aa, Homo Sapiens
LPEQHLQKL

SEQ ID NO: 502575 - protein, 9 aa, Homo Sapiens
LYKIHFQLL

SEQ ID NO: 502576 - protein, 9 aa, Homo Sapiens
TMSPVRLHF

SEQ ID NO: 502577 - protein, 9 aa, Homo Sapiens
GASTHFPYK

SEQ ID NO: 502578 - protein, 9 aa, Homo Sapiens
QMRLMTRER

SEQ ID NO: 502579 - protein, 9 aa, Homo Sapiens
PSYPSPKPQ

SEQ ID NO: 502580 - protein, 9 aa, Homo Sapiens
FSELVILLS

SEQ ID NO: 502581 - protein, 9 aa, Homo Sapiens
GRSRYHEAH

SEQ ID NO: 502582 - protein, 9 aa, Homo Sapiens
AGAATVKMP

SEQ ID NO: 502583 - protein, 9 aa, Homo Sapiens
VHHHGRSRY

SEQ ID NO: 502584 - protein, 9 aa, Homo Sapiens
LSLDDNAFT

SEQ ID NO: 502585 - protein, 9 aa, Homo Sapiens
TKHSLECSF

SEQ ID NO: 502586 - protein, 9 aa, Homo Sapiens
NARTSILEA

SEQ ID NO: 502587 - protein, 9 aa, Homo Sapiens
GKTFNCSST

SEQ ID NO: 502588 - protein, 9 aa, Homo Sapiens
SCKEAEATF

SEQ ID NO: 502589 - protein, 9 aa, Homo Sapiens
NKRLLYQRY

SEQ ID NO: 502590 - protein, 9 aa, Homo Sapiens
PGSLHIISW

SEQ ID NO: 502591 - protein, 9 aa, Homo Sapiens
WQVDTQVTS

SEQ ID NO: 502592 - protein, 9 aa, Homo Sapiens
PLAKVPEVP

SEQ ID NO: 502593 - protein, 9 aa, Homo Sapiens
KCNPSCPNG

SEQ ID NO: 502594 - protein, 9 aa, Homo Sapiens
HCPHHERCS

SEQ ID NO: 502595 - protein, 9 aa, Homo Sapiens
SNTAAAMTA

SEQ ID NO: 502596 - protein, 9 aa, Homo Sapiens
ALQKLRKWK

SEQ ID NO: 502597 - protein, 9 aa, Homo Sapiens
LSLHVGMLG

SEQ ID NO: 502598 - protein, 9 aa, Homo Sapiens
MKAPISLSK

SEQ ID NO: 502599 - protein, 9 aa, Homo Sapiens
HPHPPPSPH

SEQ ID NO: 502600 - protein, 9 aa, Homo Sapiens
TDPERLSSS

SEQ ID NO: 502601 - protein, 9 aa, Homo Sapiens
LEEKLEQNP

SEQ ID NO: 502602 - protein, 9 aa, Homo Sapiens
MTEVVRHCP

SEQ ID NO: 502603 - protein, 9 aa, Homo Sapiens
SRSQFSSRS

SEQ ID NO: 502604 - protein, 9 aa, Homo Sapiens
QKLRNRVAP

SEQ ID NO: 502605 - protein, 9 aa, Homo Sapiens
LCHYWIAVS

SEQ ID NO: 502606 - protein, 9 aa, Homo Sapiens
CLQNIQHVK

SEQ ID NO: 502607 - protein, 9 aa, Homo Sapiens
VTWIACFYN

SEQ ID NO: 502608 - protein, 9 aa, Homo Sapiens
KSHRVAGPS

SEQ ID NO: 502609 - protein, 9 aa, Homo Sapiens
RTIGNGASS

SEQ ID NO: 502610 - protein, 9 aa, Homo Sapiens
RGGIGMASI

SEQ ID NO: 502611 - protein, 9 aa, Homo Sapiens
REEEEEEDE

SEQ ID NO: 502612 - protein, 9 aa, Homo Sapiens
SSEITPTQS

SEQ ID NO: 502613 - protein, 9 aa, Homo Sapiens
DLAYQHEVR

SEQ ID NO: 502614 - protein, 9 aa, Homo Sapiens
FNCSSTLTN

SEQ ID NO: 502615 - protein, 9 aa, Homo Sapiens
HEDKVVHEW

SEQ ID NO: 502616 - protein, 9 aa, Homo Sapiens
KNIQVSLEK

SEQ ID NO: 502617 - protein, 9 aa, Homo Sapiens
ATFINSSGQ

SEQ ID NO: 502618 - protein, 9 aa, Homo Sapiens
FLALAALGM

SEQ ID NO: 502619 - protein, 9 aa, Homo Sapiens
CGVYDQPYY

SEQ ID NO: 502620 - protein, 9 aa, Homo Sapiens
GKLEWKNQS

SEQ ID NO: 502621 - protein, 9 aa, Homo Sapiens
EDEDDDDDP

SEQ ID NO: 502622 - protein, 9 aa, Homo Sapiens
RPAPDNAPR

SEQ ID NO: 502623 - protein, 9 aa, Homo Sapiens
LCQRLYKIH

SEQ ID NO: 502624 - protein, 9 aa, Homo Sapiens
HAICISSHV

SEQ ID NO: 502625 - protein, 9 aa, Homo Sapiens
GLHYGTLQV

SEQ ID NO: 502626 - protein, 9 aa, Homo Sapiens
SMSPGLHPG

SEQ ID NO: 502627 - protein, 9 aa, Homo Sapiens
QCRIIGHLM

SEQ ID NO: 502628 - protein, 9 aa, Homo Sapiens
ELLSKALVQ

SEQ ID NO: 502629 - protein, 9 aa, Homo Sapiens
PCDVCSIGC

SEQ ID NO: 502630 - protein, 9 aa, Homo Sapiens
SQPCDVCSI

SEQ ID NO: 502631 - protein, 9 aa, Homo Sapiens
ALDNTYIGK

SEQ ID NO: 502632 - protein, 9 aa, Homo Sapiens
ETVSATFIN

SEQ ID NO: 502633 - protein, 9 aa, Homo Sapiens
TYGEMVDCC

SEQ ID NO: 502634 - protein, 9 aa, Homo Sapiens
LQLGDVIDG

SEQ ID NO: 502635 - protein, 9 aa, Homo Sapiens
LRKPPISVC

SEQ ID NO: 502636 - protein, 9 aa, Homo Sapiens
KCNECGNRN

SEQ ID NO: 502637 - protein, 9 aa, Homo Sapiens
NLRNKTGVV

SEQ ID NO: 502638 - protein, 9 aa, Homo Sapiens
ARGGIGMAS

SEQ ID NO: 502639 - protein, 9 aa, Homo Sapiens
KFLLFLKGS

SEQ ID NO: 502640 - protein, 9 aa, Homo Sapiens
IKSPANMAE

SEQ ID NO: 502641 - protein, 9 aa, Homo Sapiens
AILLHAGGL

SEQ ID NO: 502642 - protein, 9 aa, Homo Sapiens
SHPTTSRTS

SEQ ID NO: 502643 - protein, 9 aa, Homo Sapiens
IHFQLLLLF

SEQ ID NO: 502644 - protein, 9 aa, Homo Sapiens
DSYKKLPEM

SEQ ID NO: 502645 - protein, 9 aa, Homo Sapiens
LASALGLGL

SEQ ID NO: 502646 - protein, 9 aa, Homo Sapiens
LGLALALQP

SEQ ID NO: 502647 - protein, 9 aa, Homo Sapiens
KGKVTKDSV

SEQ ID NO: 502648 - protein, 9 aa, Homo Sapiens
VDTQVTSGV

SEQ ID NO: 502649 - protein, 9 aa, Homo Sapiens
HTSRSSPSI

SEQ ID NO: 502650 - protein, 9 aa, Homo Sapiens
GSCQKCNPS

SEQ ID NO: 502651 - protein, 9 aa, Homo Sapiens
RLGENDNTD

SEQ ID NO: 502652 - protein, 9 aa, Homo Sapiens
HFPPAPLFP

SEQ ID NO: 502653 - protein, 9 aa, Homo Sapiens
PHPHPPPSP

SEQ ID NO: 502654 - protein, 9 aa, Homo Sapiens
LWVCVAAAI

SEQ ID NO: 502655 - protein, 9 aa, Homo Sapiens
ESEDETLLN

SEQ ID NO: 502656 - protein, 9 aa, Homo Sapiens
SKKSFSCKE

SEQ ID NO: 502657 - protein, 9 aa, Homo Sapiens
ELCLQQNNK

SEQ ID NO: 502658 - protein, 9 aa, Homo Sapiens
NTYIGKVSS

SEQ ID NO: 502659 - protein, 9 aa, Homo Sapiens
IGSLPPKPQ

SEQ ID NO: 502660 - protein, 9 aa, Homo Sapiens
ITPTQSCPP

SEQ ID NO: 502661 - protein, 9 aa, Homo Sapiens
SRSSPSIAV

SEQ ID NO: 502662 - protein, 9 aa, Homo Sapiens
NLVDINHWY

SEQ ID NO: 502663 - protein, 9 aa, Homo Sapiens
SEDASASSQ

SEQ ID NO: 502664 - protein, 9 aa, Homo Sapiens
TVSATFINS

SEQ ID NO: 502665 - protein, 9 aa, Homo Sapiens
AATVKMPSP

SEQ ID NO: 502666 - protein, 9 aa, Homo Sapiens
IPSNTAAAM

SEQ ID NO: 502667 - protein, 9 aa, Homo Sapiens
AICISSHVL

SEQ ID NO: 502668 - protein, 9 aa, Homo Sapiens
RCCILYVTK

SEQ ID NO: 502669 - protein, 9 aa, Homo Sapiens
SCIFIWTLD

SEQ ID NO: 502670 - protein, 9 aa, Homo Sapiens
DAADCLKVF

SEQ ID NO: 502671 - protein, 9 aa, Homo Sapiens
RYHEAHQHG

SEQ ID NO: 502672 - protein, 9 aa, Homo Sapiens
GVYDQPYYY

SEQ ID NO: 502673 - protein, 9 aa, Homo Sapiens
ILLRYANVE

SEQ ID NO: 502674 - protein, 9 aa, Homo Sapiens
QKREKRRQL

SEQ ID NO: 502675 - protein, 9 aa, Homo Sapiens
RALWQVDTQ

SEQ ID NO: 502676 - protein, 9 aa, Homo Sapiens
ESTSLTGED

SEQ ID NO: 502677 - protein, 9 aa, Homo Sapiens
SSLFRWYKK

SEQ ID NO: 502678 - protein, 9 aa, Homo Sapiens
HPTTSRTSQ

SEQ ID NO: 502679 - protein, 9 aa, Homo Sapiens
AAVAGPPPA

SEQ ID NO: 502680 - protein, 9 aa, Homo Sapiens
PHPPPSPHF

SEQ ID NO: 502681 - protein, 9 aa, Homo Sapiens
PDYDMESED

SEQ ID NO: 502682 - protein, 9 aa, Homo Sapiens
PPGAVKLEE

SEQ ID NO: 502683 - protein, 9 aa, Homo Sapiens
LGALQKLRK

SEQ ID NO: 502684 - protein, 9 aa, Homo Sapiens
KTFNCSSTL

SEQ ID NO: 502685 - protein, 9 aa, Homo Sapiens
ILSFVLMDI

SEQ ID NO: 502686 - protein, 9 aa, Homo Sapiens
LSNFFHGCF

SEQ ID NO: 502687 - protein, 9 aa, Homo Sapiens
SYKKLPEMD

SEQ ID NO: 502688 - protein, 9 aa, Homo Sapiens
KVIVSTDIK

SEQ ID NO: 502689 - protein, 9 aa, Homo Sapiens
CAPEPTDPE

SEQ ID NO: 502690 - protein, 9 aa, Homo Sapiens
APRATSQML

SEQ ID NO: 502691 - protein, 9 aa, Homo Sapiens
AGDWSTCSA

SEQ ID NO: 502692 - protein, 9 aa, Homo Sapiens
HRSKQALQE

SEQ ID NO: 502693 - protein, 9 aa, Homo Sapiens
PLNSNGYPD

SEQ ID NO: 502694 - protein, 9 aa, Homo Sapiens
LFSKMGPDS

SEQ ID NO: 502695 - protein, 9 aa, Homo Sapiens
YTHIYIHTH

SEQ ID NO: 502696 - protein, 9 aa, Homo Sapiens
FSYNVIFWL

SEQ ID NO: 502697 - protein, 9 aa, Homo Sapiens
FLAVNLLDR

SEQ ID NO: 502698 - protein, 9 aa, Homo Sapiens
GLKLGALQK

SEQ ID NO: 502699 - protein, 9 aa, Homo Sapiens
TAVPSDSYK

SEQ ID NO: 502700 - protein, 9 aa, Homo Sapiens
QKTYAGTLE

SEQ ID NO: 502701 - protein, 9 aa, Homo Sapiens
DKTELHNTL

SEQ ID NO: 502702 - protein, 9 aa, Homo Sapiens
ASSEITPTQ

SEQ ID NO: 502703 - protein, 9 aa, Homo Sapiens
NCSSTLTNH

SEQ ID NO: 502704 - protein, 9 aa, Homo Sapiens
NLNHCGMTH

SEQ ID NO: 502705 - protein, 9 aa, Homo Sapiens
GNPWLCNCD

SEQ ID NO: 502706 - protein, 9 aa, Homo Sapiens
QPGFFLASG

SEQ ID NO: 502707 - protein, 9 aa, Homo Sapiens
LETNIILSF

SEQ ID NO: 502708 - protein, 9 aa, Homo Sapiens
LQKLRKWKK

SEQ ID NO: 502709 - protein, 9 aa, Homo Sapiens
NEKVIVSTD

SEQ ID NO: 502710 - protein, 9 aa, Homo Sapiens
SKDSLAYSE

SEQ ID NO: 502711 - protein, 9 aa, Homo Sapiens
IILGGPSPP

SEQ ID NO: 502712 - protein, 9 aa, Homo Sapiens
QLSNFFHGC

SEQ ID NO: 502713 - protein, 9 aa, Homo Sapiens
ILYVTKADL

SEQ ID NO: 502714 - protein, 9 aa, Homo Sapiens
LWQVDTQVT

SEQ ID NO: 502715 - protein, 9 aa, Homo Sapiens
NSSGQFVSS

SEQ ID NO: 502716 - protein, 9 aa, Homo Sapiens
QLKEERELP

SEQ ID NO: 502717 - protein, 9 aa, Homo Sapiens
NECGNRNSV

SEQ ID NO: 502718 - protein, 9 aa, Homo Sapiens
HNVSKEPGA

SEQ ID NO: 502719 - protein, 9 aa, Homo Sapiens
EGFYQKTYA

SEQ ID NO: 502720 - protein, 9 aa, Homo Sapiens
KPQAADIYM

SEQ ID NO: 502721 - protein, 9 aa, Homo Sapiens
PDDMDLRVY

SEQ ID NO: 502722 - protein, 9 aa, Homo Sapiens
VYDQPYYYS

SEQ ID NO: 502723 - protein, 9 aa, Homo Sapiens
EPLLKRVDA

SEQ ID NO: 502724 - protein, 9 aa, Homo Sapiens
GSCKGKCCR

SEQ ID NO: 502725 - protein, 9 aa, Homo Sapiens
PTQSCPPMT

SEQ ID NO: 502726 - protein, 9 aa, Homo Sapiens
HPTLLWNLS

SEQ ID NO: 502727 - protein, 9 aa, Homo Sapiens
GCMPHVPYV

SEQ ID NO: 502728 - protein, 9 aa, Homo Sapiens
LSKALVQYV

SEQ ID NO: 502729 - protein, 9 aa, Homo Sapiens
GANPNICDG

SEQ ID NO: 502730 - protein, 9 aa, Homo Sapiens
DKVVHEWWG

SEQ ID NO: 502731 - protein, 9 aa, Homo Sapiens
ASGRIQYVN

SEQ ID NO: 502732 - protein, 9 aa, Homo Sapiens
WSQPCDVCS

SEQ ID NO: 502733 - protein, 9 aa, Homo Sapiens
VSRAGSMHR

SEQ ID NO: 502734 - protein, 9 aa, Homo Sapiens
INSSGQFVS

SEQ ID NO: 502735 - protein, 9 aa, Homo Sapiens
LCCLIIADS

SEQ ID NO: 502736 - protein, 9 aa, Homo Sapiens
FWSNGEINL

SEQ ID NO: 502737 - protein, 9 aa, Homo Sapiens
EKIFLTGSC

SEQ ID NO: 502738 - protein, 9 aa, Homo Sapiens
HSLECSFTE

SEQ ID NO: 502739 - protein, 9 aa, Homo Sapiens
RHFPPAPLF

SEQ ID NO: 502740 - protein, 9 aa, Homo Sapiens
LAALGMGLA

SEQ ID NO: 502741 - protein, 9 aa, Homo Sapiens
YIYTHIYIH

SEQ ID NO: 502742 - protein, 9 aa, Homo Sapiens
AGASTHFPY

SEQ ID NO: 502743 - protein, 9 aa, Homo Sapiens
IQMRLMTRE

SEQ ID NO: 502744 - protein, 9 aa, Homo Sapiens
RETYGEMVD

SEQ ID NO: 502745 - protein, 9 aa, Homo Sapiens
YDQPYYYSD

SEQ ID NO: 502746 - protein, 9 aa, Homo Sapiens
MSPGLHPGS

SEQ ID NO: 502747 - protein, 9 aa, Homo Sapiens
SQYGGTGWP

SEQ ID NO: 502748 - protein, 9 aa, Homo Sapiens
WGSGIGTPG

SEQ ID NO: 502749 - protein, 9 aa, Homo Sapiens
LDDNAFTAP

SEQ ID NO: 502750 - protein, 9 aa, Homo Sapiens
NPNHLPCRP

SEQ ID NO: 502751 - protein, 9 aa, Homo Sapiens
LLKRVDADA

SEQ ID NO: 502752 - protein, 9 aa, Homo Sapiens
LNAQYLQNT

SEQ ID NO: 502753 - protein, 9 aa, Homo Sapiens
FWGSGIGTP

SEQ ID NO: 502754 - protein, 9 aa, Homo Sapiens
DSLAYSESE

SEQ ID NO: 502755 - protein, 9 aa, Homo Sapiens
KFRVDVPGS

SEQ ID NO: 502756 - protein, 9 aa, Homo Sapiens
DPERLSSSE

SEQ ID NO: 502757 - protein, 9 aa, Homo Sapiens
RNSSVNDSG

SEQ ID NO: 502758 - protein, 9 aa, Homo Sapiens
CQSCIFIWT

SEQ ID NO: 502759 - protein, 9 aa, Homo Sapiens
HIISWIQGC

SEQ ID NO: 502760 - protein, 9 aa, Homo Sapiens
DSQNMWIKD

SEQ ID NO: 502761 - protein, 9 aa, Homo Sapiens
VTKADLVAG

SEQ ID NO: 502762 - protein, 9 aa, Homo Sapiens
PERALWQVD

SEQ ID NO: 502763 - protein, 9 aa, Homo Sapiens
MVDRLPDGC

SEQ ID NO: 502764 - protein, 9 aa, Homo Sapiens
PVQVIFSEL

SEQ ID NO: 502765 - protein, 9 aa, Homo Sapiens
YLSLDDNAF

SEQ ID NO: 502766 - protein, 9 aa, Homo Sapiens
SRAGSMHRE

SEQ ID NO: 502767 - protein, 9 aa, Homo Sapiens
RPRDGAYAA

SEQ ID NO: 502768 - protein, 9 aa, Homo Sapiens
GRIQYVNHI

SEQ ID NO: 502769 - protein, 9 aa, Homo Sapiens
LHVGMLGEK

SEQ ID NO: 502770 - protein, 9 aa, Homo Sapiens
SMGPQPIIL

SEQ ID NO: 502771 - protein, 9 aa, Homo Sapiens
VGSHLAELL

SEQ ID NO: 502772 - protein, 9 aa, Homo Sapiens
TSILEAANP

SEQ ID NO: 502773 - protein, 9 aa, Homo Sapiens
FPPAPLFPH

SEQ ID NO: 502774 - protein, 9 aa, Homo Sapiens
ILATFLRIL

SEQ ID NO: 502775 - protein, 9 aa, Homo Sapiens
GFPSSHFSA

SEQ ID NO: 502776 - protein, 9 aa, Homo Sapiens
LQRTMTDAA

SEQ ID NO: 502777 - protein, 9 aa, Homo Sapiens
TLEEKNIQV

SEQ ID NO: 502778 - protein, 9 aa, Homo Sapiens
EEKNIQVSL

SEQ ID NO: 502779 - protein, 9 aa, Homo Sapiens
MTAPPGPGA

SEQ ID NO: 502780 - protein, 9 aa, Homo Sapiens
TSLTGEDVC

SEQ ID NO: 502781 - protein, 9 aa, Homo Sapiens
DSLFHDKEC

SEQ ID NO: 502782 - protein, 9 aa, Homo Sapiens
FKPCEYIPL

SEQ ID NO: 502783 - protein, 9 aa, Homo Sapiens
PDLHRSKQA

SEQ ID NO: 502784 - protein, 9 aa, Homo Sapiens
GSHLAELLH

SEQ ID NO: 502785 - protein, 9 aa, Homo Sapiens
TDAADCLKV

SEQ ID NO: 502786 - protein, 9 aa, Homo Sapiens
RKRERTIQR

SEQ ID NO: 502787 - protein, 9 aa, Homo Sapiens
QSCIFIWTL

SEQ ID NO: 502788 - protein, 9 aa, Homo Sapiens
VDQNMFRNF

SEQ ID NO: 502789 - protein, 9 aa, Homo Sapiens
NHLPCRPRP

SEQ ID NO: 502790 - protein, 9 aa, Homo Sapiens
YVNHITRTT

SEQ ID NO: 502791 - protein, 9 aa, Homo Sapiens
QYGGTGWPS

SEQ ID NO: 502792 - protein, 9 aa, Homo Sapiens
WIACFYNHS

SEQ ID NO: 502793 - protein, 9 aa, Homo Sapiens
ACFYNHSWK

SEQ ID NO: 502794 - protein, 9 aa, Homo Sapiens
DNTDLDVIR

SEQ ID NO: 502795 - protein, 9 aa, Homo Sapiens
GHEDKVVHE

SEQ ID NO: 502796 - protein, 9 aa, Homo Sapiens
CILYVTKAD

SEQ ID NO: 502797 - protein, 9 aa, Homo Sapiens
KPPISVCQH

SEQ ID NO: 502798 - protein, 9 aa, Homo Sapiens
HGCFSIGDL

SEQ ID NO: 502799 - protein, 9 aa, Homo Sapiens
LDNTYIGKV

SEQ ID NO: 502800 - protein, 9 aa, Homo Sapiens
MGPQPIILG

SEQ ID NO: 502801 - protein, 9 aa, Homo Sapiens
KSFSCKEAE

SEQ ID NO: 502802 - protein, 9 aa, Homo Sapiens
MSTKEELMK

SEQ ID NO: 502803 - protein, 9 aa, Homo Sapiens
TRQLFHRIQ

SEQ ID NO: 502804 - protein, 9 aa, Homo Sapiens
ALGMGLALG

SEQ ID NO: 502805 - protein, 9 aa, Homo Sapiens
ITPAPAQQK

SEQ ID NO: 502806 - protein, 9 aa, Homo Sapiens
KAGAATVKM

SEQ ID NO: 502807 - protein, 9 aa, Homo Sapiens
NMWIKDGTS

SEQ ID NO: 502808 - protein, 9 aa, Homo Sapiens
AAELCLQQN

SEQ ID NO: 502809 - protein, 9 aa, Homo Sapiens
TVKMPSPSK

SEQ ID NO: 502810 - protein, 9 aa, Homo Sapiens
IACFYNHSW

SEQ ID NO: 502811 - protein, 9 aa, Homo Sapiens
LWTRQLFHR

SEQ ID NO: 502812 - protein, 9 aa, Homo Sapiens
LFWSNGEIN

SEQ ID NO: 502813 - protein, 9 aa, Homo Sapiens
ESELNAQYL

SEQ ID NO: 502814 - protein, 9 aa, Homo Sapiens
AFPDDMDLR

SEQ ID NO: 502815 - protein, 9 aa, Homo Sapiens
LTSNHLLCH

SEQ ID NO: 502816 - protein, 9 aa, Homo Sapiens
PSTITPAPA

SEQ ID NO: 502817 - protein, 9 aa, Homo Sapiens
LTGEDVCHE

SEQ ID NO: 502818 - protein, 9 aa, Homo Sapiens
SQTDKTELH

SEQ ID NO: 502819 - protein, 9 aa, Homo Sapiens
HRTIGNGAS

SEQ ID NO: 502820 - protein, 9 aa, Homo Sapiens
SILEAANPI

SEQ ID NO: 502821 - protein, 9 aa, Homo Sapiens
SDHADSQNM

SEQ ID NO: 502822 - protein, 9 aa, Homo Sapiens
EAQKSHRVA

SEQ ID NO: 502823 - protein, 9 aa, Homo Sapiens
QYVNHITRT

SEQ ID NO: 502824 - protein, 9 aa, Homo Sapiens
KNKASMSPG

SEQ ID NO: 502825 - protein, 9 aa, Homo Sapiens
ILEAANPIS

SEQ ID NO: 502826 - protein, 9 aa, Homo Sapiens
SKALVSNLM

SEQ ID NO: 502827 - protein, 9 aa, Homo Sapiens
QLELIPARP

SEQ ID NO: 502828 - protein, 9 aa, Homo Sapiens
HLSSHNRIH

SEQ ID NO: 502829 - protein, 9 aa, Homo Sapiens
CLIIADSFI

SEQ ID NO: 502830 - protein, 9 aa, Homo Sapiens
EYQQKTREE

SEQ ID NO: 502831 - protein, 9 aa, Homo Sapiens
SNLNHCGMT

SEQ ID NO: 502832 - protein, 9 aa, Homo Sapiens
KAKPGAAEP

SEQ ID NO: 502833 - protein, 9 aa, Homo Sapiens
SKAHQCRII

SEQ ID NO: 502834 - protein, 9 aa, Homo Sapiens
HYGTLQVFV

SEQ ID NO: 502835 - protein, 9 aa, Homo Sapiens
VDCCAKQEP

SEQ ID NO: 502836 - protein, 9 aa, Homo Sapiens
LINSVDQNM

SEQ ID NO: 502837 - protein, 9 aa, Homo Sapiens
TRHFPPAPL

SEQ ID NO: 502838 - protein, 9 aa, Homo Sapiens
IISWIQGCF

SEQ ID NO: 502839 - protein, 9 aa, Homo Sapiens
GQQKFRVDV

SEQ ID NO: 502840 - protein, 9 aa, Homo Sapiens
FSAPCFCRA

SEQ ID NO: 502841 - protein, 9 aa, Homo Sapiens
HWMKAPISL

SEQ ID NO: 502842 - protein, 9 aa, Homo Sapiens
KEPGGFWGS

SEQ ID NO: 502843 - protein, 9 aa, Homo Sapiens
EFALSETPN

SEQ ID NO: 502844 - protein, 9 aa, Homo Sapiens
LNLEPLLKR

SEQ ID NO: 502845 - protein, 9 aa, Homo Sapiens
IAGKILWTR

SEQ ID NO: 502846 - protein, 9 aa, Homo Sapiens
HGIGENGVW

SEQ ID NO: 502847 - protein, 9 aa, Homo Sapiens
KREKRRQLK

SEQ ID NO: 502848 - protein, 9 aa, Homo Sapiens
VSEMDNSSQ

SEQ ID NO: 502849 - protein, 9 aa, Homo Sapiens
IQLELIPAR

SEQ ID NO: 502850 - protein, 9 aa, Homo Sapiens
TSQLQTSRS

SEQ ID NO: 502851 - protein, 9 aa, Homo Sapiens
LQNEKVIVS

SEQ ID NO: 502852 - protein, 9 aa, Homo Sapiens
HLGSCQKCN

SEQ ID NO: 502853 - protein, 9 aa, Homo Sapiens
KAHQCRIIG

SEQ ID NO: 502854 - protein, 9 aa, Homo Sapiens
FGFDTETFF

SEQ ID NO: 502855 - protein, 9 aa, Homo Sapiens
KETMEPGSS

SEQ ID NO: 502856 - protein, 9 aa, Homo Sapiens
DQHFGMLEL

SEQ ID NO: 502857 - protein, 9 aa, Homo Sapiens
SHFSAPCFC

SEQ ID NO: 502858 - protein, 9 aa, Homo Sapiens
STHFPYKRL

SEQ ID NO: 502859 - protein, 9 aa, Homo Sapiens
APQSPAPCP

SEQ ID NO: 502860 - protein, 9 aa, Homo Sapiens
TGVVTTTWE

SEQ ID NO: 502861 - protein, 9 aa, Homo Sapiens
GVWGIAVDW

SEQ ID NO: 502862 - protein, 9 aa, Homo Sapiens
GRAQPKPDG

SEQ ID NO: 502863 - protein, 9 aa, Homo Sapiens
SLHVGMLGE

SEQ ID NO: 502864 - protein, 9 aa, Homo Sapiens
ATVKMPSPS

SEQ ID NO: 502865 - protein, 9 aa, Homo Sapiens
AVAGPPPAA

SEQ ID NO: 502866 - protein, 9 aa, Homo Sapiens
VRLHFSNPN

SEQ ID NO: 502867 - protein, 9 aa, Homo Sapiens
IILSFVLMD

SEQ ID NO: 502868 - protein, 9 aa, Homo Sapiens
KEVGAIQLE

SEQ ID NO: 502869 - protein, 9 aa, Homo Sapiens
DKKNRTALH

SEQ ID NO: 502870 - protein, 9 aa, Homo Sapiens
KIHFQLLLL

SEQ ID NO: 502871 - protein, 9 aa, Homo Sapiens
LFSYNVIFW

SEQ ID NO: 502872 - protein, 9 aa, Homo Sapiens
LPDLHRSKQ

SEQ ID NO: 502873 - protein, 9 aa, Homo Sapiens
LIIADSFIY

SEQ ID NO: 502874 - protein, 9 aa, Homo Sapiens
EWKNQSKLV

SEQ ID NO: 502875 - protein, 9 aa, Homo Sapiens
KTELHNTLR

SEQ ID NO: 502876 - protein, 9 aa, Homo Sapiens
NTDLDVIRE

SEQ ID NO: 502877 - protein, 9 aa, Homo Sapiens
ADSQNMWIK

SEQ ID NO: 502878 - protein, 9 aa, Homo Sapiens
ILGTSVGSH

SEQ ID NO: 502879 - protein, 9 aa, Homo Sapiens
EEEPPLSPR

SEQ ID NO: 502880 - protein, 9 aa, Homo Sapiens
WLCNCDILY

SEQ ID NO: 502881 - protein, 9 aa, Homo Sapiens
MSVFCGVYD

SEQ ID NO: 502882 - protein, 9 aa, Homo Sapiens
KEERELPRS

SEQ ID NO: 502883 - protein, 9 aa, Homo Sapiens
SVFCGVYDQ

SEQ ID NO: 502884 - protein, 9 aa, Homo Sapiens
DSILSSKSF

SEQ ID NO: 502885 - protein, 9 aa, Homo Sapiens
LSLASNHPA

SEQ ID NO: 502886 - protein, 9 aa, Homo Sapiens
PILGTSVGS

SEQ ID NO: 502887 - protein, 9 aa, Homo Sapiens
EMDNSSQDA

SEQ ID NO: 502888 - protein, 9 aa, Homo Sapiens
RLHFSNPNL

SEQ ID NO: 502889 - protein, 9 aa, Homo Sapiens
PAPQSPAPC

SEQ ID NO: 502890 - protein, 9 aa, Homo Sapiens
EITPTQSCP

SEQ ID NO: 502891 - protein, 9 aa, Homo Sapiens
ESETYTLFS

SEQ ID NO: 502892 - protein, 9 aa, Homo Sapiens
CKILATFLR

SEQ ID NO: 502893 - protein, 9 aa, Homo Sapiens
GCSKDSLAY

SEQ ID NO: 502894 - protein, 9 aa, Homo Sapiens
QSPAPCPEG

SEQ ID NO: 502895 - protein, 9 aa, Homo Sapiens
LEQGKGPFT

SEQ ID NO: 502896 - protein, 9 aa, Homo Sapiens
LFRWYKKAK

SEQ ID NO: 502897 - protein, 9 aa, Homo Sapiens
NTAAAMTAP

SEQ ID NO: 502898 - protein, 9 aa, Homo Sapiens
DVSHTSRSS

SEQ ID NO: 502899 - protein, 9 aa, Homo Sapiens
PTLLWNLSD

SEQ ID NO: 502900 - protein, 9 aa, Homo Sapiens
TWIACFYNH

SEQ ID NO: 502901 - protein, 9 aa, Homo Sapiens
CQKCNPSCP

SEQ ID NO: 502902 - protein, 9 aa, Homo Sapiens
PDNPQHFDR

SEQ ID NO: 502903 - protein, 9 aa, Homo Sapiens
SPVRLHFSN

SEQ ID NO: 502904 - protein, 9 aa, Homo Sapiens
KHPTLLWNL

SEQ ID NO: 502905 - protein, 9 aa, Homo Sapiens
HRVAGPSKP

SEQ ID NO: 502906 - protein, 9 aa, Homo Sapiens
YIGKVSSYI

SEQ ID NO: 502907 - protein, 9 aa, Homo Sapiens
DWSTCSASC

SEQ ID NO: 502908 - protein, 9 aa, Homo Sapiens
SGTEHRVCR

SEQ ID NO: 502909 - protein, 9 aa, Homo Sapiens
EMVDCCAKQ

SEQ ID NO: 502910 - protein, 9 aa, Homo Sapiens
TDKTELHNT

SEQ ID NO: 502911 - protein, 9 aa, Homo Sapiens
VPSDSYKKL

SEQ ID NO: 502912 - protein, 9 aa, Homo Sapiens
NLEPLLKRV

SEQ ID NO: 502913 - protein, 9 aa, Homo Sapiens
ELVTRHFPP

SEQ ID NO: 502914 - protein, 9 aa, Homo Sapiens
MTDAADCLK

SEQ ID NO: 502915 - protein, 9 aa, Homo Sapiens
FWSHAICIS

SEQ ID NO: 502916 - protein, 9 aa, Homo Sapiens
TSHPTTSRT

SEQ ID NO: 502917 - protein, 9 aa, Homo Sapiens
LVDSILPES

SEQ ID NO: 502918 - protein, 9 aa, Homo Sapiens
GSQYGGTGW

SEQ ID NO: 502919 - protein, 9 aa, Homo Sapiens
LQPLSLHVG

SEQ ID NO: 502920 - protein, 9 aa, Homo Sapiens
PTTSRTSQL

SEQ ID NO: 502921 - protein, 9 aa, Homo Sapiens
TYTLFSKMG

SEQ ID NO: 502922 - protein, 9 aa, Homo Sapiens
SLRPPYPTA

SEQ ID NO: 502923 - protein, 9 aa, Homo Sapiens
KYLLFSYNV

SEQ ID NO: 502924 - protein, 9 aa, Homo Sapiens
SVEAQKSHR

SEQ ID NO: 502925 - protein, 9 aa, Homo Sapiens
LVEAPRATS

SEQ ID NO: 502926 - protein, 9 aa, Homo Sapiens
ACSFVNKHC

SEQ ID NO: 502927 - protein, 9 aa, Homo Sapiens
FPYKRLIKV

SEQ ID NO: 502928 - protein, 9 aa, Homo Sapiens
EEDEDDDDD

SEQ ID NO: 502929 - protein, 9 aa, Homo Sapiens
VAGPPPAAA

SEQ ID NO: 502930 - protein, 9 aa, Homo Sapiens
YNVIFWLAG

SEQ ID NO: 502931 - protein, 9 aa, Homo Sapiens
GPFTLESQV

SEQ ID NO: 502932 - protein, 9 aa, Homo Sapiens
QSANQGFEA

SEQ ID NO: 502933 - protein, 9 aa, Homo Sapiens
QTDKTELHN

SEQ ID NO: 502934 - protein, 9 aa, Homo Sapiens
VIFSELVIL

SEQ ID NO: 502935 - protein, 9 aa, Homo Sapiens
LSRNKSFGR

SEQ ID NO: 502936 - protein, 9 aa, Homo Sapiens
HGLKLGALQ

SEQ ID NO: 502937 - protein, 9 aa, Homo Sapiens
AVKLEEKLE

SEQ ID NO: 502938 - protein, 9 aa, Homo Sapiens
MCPLNSNGY

SEQ ID NO: 502939 - protein, 9 aa, Homo Sapiens
NGASSKAQQ

SEQ ID NO: 502940 - protein, 9 aa, Homo Sapiens
DTETFFLAV

SEQ ID NO: 502941 - protein, 9 aa, Homo Sapiens
SKALVQYVV

SEQ ID NO: 502942 - protein, 9 aa, Homo Sapiens
GSSSTSHPT

SEQ ID NO: 502943 - protein, 9 aa, Homo Sapiens
AIQLELIPA

SEQ ID NO: 502944 - protein, 9 aa, Homo Sapiens
MDKEYQQKT

SEQ ID NO: 502945 - protein, 9 aa, Homo Sapiens
YTLREVDMV

SEQ ID NO: 502946 - protein, 9 aa, Homo Sapiens
FPSSHFSAP

SEQ ID NO: 502947 - protein, 9 aa, Homo Sapiens
LRYANVENT

SEQ ID NO: 502948 - protein, 9 aa, Homo Sapiens
AHQCRIIGH

SEQ ID NO: 502949 - protein, 9 aa, Homo Sapiens
FGWLCCLII

SEQ ID NO: 502950 - protein, 9 aa, Homo Sapiens
SPRPRDGAY

SEQ ID NO: 502951 - protein, 9 aa, Homo Sapiens
SHAICISSH

SEQ ID NO: 502952 - protein, 9 aa, Homo Sapiens
PEPTDPERL

SEQ ID NO: 502953 - protein, 9 aa, Homo Sapiens
RATSQMLEV

SEQ ID NO: 502954 - protein, 9 aa, Homo Sapiens
AHILLRYAN

SEQ ID NO: 502955 - protein, 9 aa, Homo Sapiens
WSNGEINLV

SEQ ID NO: 502956 - protein, 9 aa, Homo Sapiens
QHVKESVPN

SEQ ID NO: 502957 - protein, 9 aa, Homo Sapiens
SDSYKKLPE

SEQ ID NO: 502958 - protein, 9 aa, Homo Sapiens
AMTAPPGPG

SEQ ID NO: 502959 - protein, 9 aa, Homo Sapiens
PTFDYEMNF

SEQ ID NO: 502960 - protein, 9 aa, Homo Sapiens
FSKVAREYT

SEQ ID NO: 502961 - protein, 9 aa, Homo Sapiens
PLSPRPRDG

SEQ ID NO: 502962 - protein, 9 aa, Homo Sapiens
SKVAREYTD

SEQ ID NO: 502963 - protein, 9 aa, Homo Sapiens
EKRRQLKQQ

SEQ ID NO: 502964 - protein, 9 aa, Homo Sapiens
TAQDLAYQH

SEQ ID NO: 502965 - protein, 9 aa, Homo Sapiens
LAKVPEVPK

SEQ ID NO: 502966 - protein, 9 aa, Homo Sapiens
TFNCSSTLT

SEQ ID NO: 502967 - protein, 9 aa, Homo Sapiens
NCDILYFRR

SEQ ID NO: 502968 - protein, 9 aa, Homo Sapiens
RSSPSIAVK

SEQ ID NO: 502969 - protein, 9 aa, Homo Sapiens
CIFIWTLDP

SEQ ID NO: 502970 - protein, 9 aa, Homo Sapiens
LPRSTTSTI

SEQ ID NO: 502971 - protein, 9 aa, Homo Sapiens
PESSYEVQV

SEQ ID NO: 502972 - protein, 9 aa, Homo Sapiens
MDLRVYGPA

SEQ ID NO: 502973 - protein, 9 aa, Homo Sapiens
QSKLVINEL

SEQ ID NO: 502974 - protein, 9 aa, Homo Sapiens
SFTETESNY

SEQ ID NO: 502975 - protein, 9 aa, Homo Sapiens
VCQHESHQA

SEQ ID NO: 502976 - protein, 9 aa, Homo Sapiens
CKEAAVSRA

SEQ ID NO: 502977 - protein, 9 aa, Homo Sapiens
LCKTIISTT

SEQ ID NO: 502978 - protein, 9 aa, Homo Sapiens
RCSHLSSHN

SEQ ID NO: 502979 - protein, 9 aa, Homo Sapiens
PLLQPLSLH

SEQ ID NO: 502980 - protein, 9 aa, Homo Sapiens
PKKKEAPLA

SEQ ID NO: 502981 - protein, 9 aa, Homo Sapiens
VIMLACSFV

SEQ ID NO: 502982 - protein, 9 aa, Homo Sapiens
LMSTKEELM

SEQ ID NO: 502983 - protein, 9 aa, Homo Sapiens
DILYFRRWL

SEQ ID NO: 502984 - protein, 9 aa, Homo Sapiens
GDEEHAVLL

SEQ ID NO: 502985 - protein, 9 aa, Homo Sapiens
KKKFLLFLK

SEQ ID NO: 502986 - protein, 9 aa, Homo Sapiens
LLFLKGSDR

SEQ ID NO: 502987 - protein, 9 aa, Homo Sapiens
WKNQSKLVI

SEQ ID NO: 502988 - protein, 9 aa, Homo Sapiens
ETMEPGSSS

SEQ ID NO: 502989 - protein, 9 aa, Homo Sapiens
YMCPLNSNG

SEQ ID NO: 502990 - protein, 9 aa, Homo Sapiens
RNKTGVVTT

SEQ ID NO: 502991 - protein, 9 aa, Homo Sapiens
AELCKTIIS

SEQ ID NO: 502992 - protein, 9 aa, Homo Sapiens
TREELSRQP

SEQ ID NO: 502993 - protein, 9 aa, Homo Sapiens
VGAIQLELI

SEQ ID NO: 502994 - protein, 9 aa, Homo Sapiens
LYQRYGKRV

SEQ ID NO: 502995 - protein, 9 aa, Homo Sapiens
QAGDWSTCS

SEQ ID NO: 502996 - protein, 9 aa, Homo Sapiens
YHEAHQHGK

SEQ ID NO: 502997 - protein, 9 aa, Homo Sapiens
TEVVRHCPH

SEQ ID NO: 502998 - protein, 9 aa, Homo Sapiens
KDISCDYLD

SEQ ID NO: 502999 - protein, 9 aa, Homo Sapiens
TLFSKMGPD

SEQ ID NO: 503000 - protein, 9 aa, Homo Sapiens
DLLAGDEEH

SEQ ID NO: 503001 - protein, 9 aa, Homo Sapiens
QCKDISCDY

SEQ ID NO: 503002 - protein, 9 aa, Homo Sapiens
KALVSNLMS

SEQ ID NO: 503003 - protein, 9 aa, Homo Sapiens
DHADSQNMW

SEQ ID NO: 503004 - protein, 9 aa, Homo Sapiens
AVPSDSYKK

SEQ ID NO: 503005 - protein, 9 aa, Homo Sapiens
KIFLTGSCK

SEQ ID NO: 503006 - protein, 9 aa, Homo Sapiens
AVLAFPDDM

SEQ ID NO: 503007 - protein, 9 aa, Homo Sapiens
SYPSPKPQA

SEQ ID NO: 503008 - protein, 9 aa, Homo Sapiens
RHCPHHERC

SEQ ID NO: 503009 - protein, 9 aa, Homo Sapiens
GTLEGNSKE

SEQ ID NO: 503010 - protein, 9 aa, Homo Sapiens
LFHRTIGNG

SEQ ID NO: 503011 - protein, 9 aa, Homo Sapiens
EKNIQVSLE

SEQ ID NO: 503012 - protein, 9 aa, Homo Sapiens
SRTSQLQTS

SEQ ID NO: 503013 - protein, 9 aa, Homo Sapiens
FSKMGPDSK

SEQ ID NO: 503014 - protein, 9 aa, Homo Sapiens
LEAANPISG

SEQ ID NO: 503015 - protein, 9 aa, Homo Sapiens
GMGLALGGG

SEQ ID NO: 503016 - protein, 9 aa, Homo Sapiens
RIQYVNHIT

SEQ ID NO: 503017 - protein, 9 aa, Homo Sapiens
HDKECRNAV

SEQ ID NO: 503018 - protein, 9 aa, Homo Sapiens
EPGGFWGSG

SEQ ID NO: 503019 - protein, 9 aa, Homo Sapiens
HFPYKRLIK

SEQ ID NO: 503020 - protein, 9 aa, Homo Sapiens
PGKGAWNPN

SEQ ID NO: 503021 - protein, 9 aa, Homo Sapiens
QQKTREELS

SEQ ID NO: 503022 - protein, 9 aa, Homo Sapiens
TYIGKVSSY

SEQ ID NO: 503023 - protein, 9 aa, Homo Sapiens
CSIGCIIFE

SEQ ID NO: 503024 - protein, 9 aa, Homo Sapiens
VKMPSPSKA

SEQ ID NO: 503025 - protein, 9 aa, Homo Sapiens
GGRPGPGKG

SEQ ID NO: 503026 - protein, 9 aa, Homo Sapiens
EEKLEQNPQ

SEQ ID NO: 503027 - protein, 9 aa, Homo Sapiens
SYPGANPNI

SEQ ID NO: 503028 - protein, 9 aa, Homo Sapiens
SVSEDASAS

SEQ ID NO: 503029 - protein, 9 aa, Homo Sapiens
GWSQPCDVC

SEQ ID NO: 503030 - protein, 9 aa, Homo Sapiens
GPPPAAAEV

SEQ ID NO: 503031 - protein, 9 aa, Homo Sapiens
LGMGLALGG

SEQ ID NO: 503032 - protein, 9 aa, Homo Sapiens
AEGFYQKTY

SEQ ID NO: 503033 - protein, 9 aa, Homo Sapiens
TLPEQHLQK

SEQ ID NO: 503034 - protein, 9 aa, Homo Sapiens
LLCHYWIAV

SEQ ID NO: 503035 - protein, 9 aa, Homo Sapiens
SLDDNAFTA

SEQ ID NO: 503036 - protein, 9 aa, Homo Sapiens
FGMLELLNN

SEQ ID NO: 503037 - protein, 9 aa, Homo Sapiens
CRPRPVQNL

SEQ ID NO: 503038 - protein, 9 aa, Homo Sapiens
LPIQHLWLS

SEQ ID NO: 503039 - protein, 9 aa, Homo Sapiens
WVPELKGCM

SEQ ID NO: 503040 - protein, 9 aa, Homo Sapiens
CRIIGHLML

SEQ ID NO: 503041 - protein, 9 aa, Homo Sapiens
SYNVIFWLA

SEQ ID NO: 503042 - protein, 9 aa, Homo Sapiens
ALRMVDRLP

SEQ ID NO: 503043 - protein, 9 aa, Homo Sapiens
MPVQVIFSE

SEQ ID NO: 503044 - protein, 9 aa, Homo Sapiens
YQRYGKRVI

SEQ ID NO: 503045 - protein, 9 aa, Homo Sapiens
FHVTWIACF

SEQ ID NO: 503046 - protein, 9 aa, Homo Sapiens
MLEQGKGPF

SEQ ID NO: 503047 - protein, 9 aa, Homo Sapiens
PKPDGEAET

SEQ ID NO: 503048 - protein, 9 aa, Homo Sapiens
CPGSLHIIS

SEQ ID NO: 503049 - protein, 9 aa, Homo Sapiens
GLNLEPLLK

SEQ ID NO: 503050 - protein, 9 aa, Homo Sapiens
GCFSIGDLN

SEQ ID NO: 503051 - protein, 9 aa, Homo Sapiens
LHYGTLQVF

SEQ ID NO: 503052 - protein, 9 aa, Homo Sapiens
EVRSKHPTL

SEQ ID NO: 503053 - protein, 9 aa, Homo Sapiens
TFINSSGQF

SEQ ID NO: 503054 - protein, 9 aa, Homo Sapiens
SSVNDSGYP

SEQ ID NO: 503055 - protein, 9 aa, Homo Sapiens
HPPPSPHFT

SEQ ID NO: 503056 - protein, 9 aa, Homo Sapiens
CSHLSSHNR

SEQ ID NO: 503057 - protein, 9 aa, Homo Sapiens
LECSFTETE

SEQ ID NO: 503058 - protein, 9 aa, Homo Sapiens
GSLHIISWI

SEQ ID NO: 503059 - protein, 9 aa, Homo Sapiens
FNVLTKETP

SEQ ID NO: 503060 - protein, 9 aa, Homo Sapiens
IFWSHAICI

SEQ ID NO: 503061 - protein, 9 aa, Homo Sapiens
GINPSKQAS

SEQ ID NO: 503062 - protein, 9 aa, Homo Sapiens
PQPIILGGP

SEQ ID NO: 503063 - protein, 9 aa, Homo Sapiens
PEQHLQKLR

SEQ ID NO: 503064 - protein, 9 aa, Homo Sapiens
CGKTFNCSS

SEQ ID NO: 503065 - protein, 9 aa, Homo Sapiens
KLKNKASMS

SEQ ID NO: 503066 - protein, 9 aa, Homo Sapiens
MTPGLMTPV

SEQ ID NO: 503067 - protein, 9 aa, Homo Sapiens
KVTKDSVTL

SEQ ID NO: 503068 - protein, 9 aa, Homo Sapiens
NAQYLQNTF

SEQ ID NO: 503069 - protein, 9 aa, Homo Sapiens
HVTWIACFY

SEQ ID NO: 503070 - protein, 9 aa, Homo Sapiens
VFCGVYDQP

SEQ ID NO: 503071 - protein, 9 aa, Homo Sapiens
ENLSIQMRL

SEQ ID NO: 503072 - protein, 9 aa, Homo Sapiens
RPERALWQV

SEQ ID NO: 503073 - protein, 9 aa, Homo Sapiens
TFFLAVNLL

SEQ ID NO: 503074 - protein, 9 aa, Homo Sapiens
FAALLAQSA

SEQ ID NO: 503075 - protein, 9 aa, Homo Sapiens
RKPPISVCQ

SEQ ID NO: 503076 - protein, 9 aa, Homo Sapiens
RVRPAPDNA

SEQ ID NO: 503077 - protein, 9 aa, Homo Sapiens
APISLSKVK

SEQ ID NO: 503078 - protein, 9 aa, Homo Sapiens
ETYTLFSKM

SEQ ID NO: 503079 - protein, 9 aa, Homo Sapiens
TPNRKWVVF

SEQ ID NO: 503080 - protein, 9 aa, Homo Sapiens
CPEGTSTSP

SEQ ID NO: 503081 - protein, 9 aa, Homo Sapiens
SRNKSFGRG

SEQ ID NO: 503082 - protein, 9 aa, Homo Sapiens
FYQKTYAGT

SEQ ID NO: 503083 - protein, 9 aa, Homo Sapiens
TITPAPAQQ

SEQ ID NO: 503084 - protein, 9 aa, Homo Sapiens
SPDNPQHFD

SEQ ID NO: 503085 - protein, 9 aa, Homo Sapiens
RSQFSSRSR

SEQ ID NO: 503086 - protein, 9 aa, Homo Sapiens
DAALDNTYI

SEQ ID NO: 503087 - protein, 9 aa, Homo Sapiens
KILWTRQLF

SEQ ID NO: 503088 - protein, 9 aa, Homo Sapiens
SIVLSDKTL

SEQ ID NO: 503089 - protein, 9 aa, Homo Sapiens
TITSSAELC

SEQ ID NO: 503090 - protein, 9 aa, Homo Sapiens
ARTSILEAA

SEQ ID NO: 503091 - protein, 9 aa, Homo Sapiens
SQNMWIKDG

SEQ ID NO: 503092 - protein, 9 aa, Homo Sapiens
EQPDYDMES

SEQ ID NO: 503093 - protein, 9 aa, Homo Sapiens
KNQSKLVIN

SEQ ID NO: 503094 - protein, 9 aa, Homo Sapiens
GKILWTRQL

SEQ ID NO: 503095 - protein, 9 aa, Homo Sapiens
TSRTSQLQT

SEQ ID NO: 503096 - protein, 9 aa, Homo Sapiens
FALSETPNR

SEQ ID NO: 503097 - protein, 9 aa, Homo Sapiens
RAGSMHRER

SEQ ID NO: 503098 - protein, 9 aa, Homo Sapiens
DYDMESEDE

SEQ ID NO: 503099 - protein, 9 aa, Homo Sapiens
ITSSAELCK

SEQ ID NO: 503100 - protein, 9 aa, Homo Sapiens
LHRSKQALQ

SEQ ID NO: 503101 - protein, 9 aa, Homo Sapiens
TASGRIQYV

SEQ ID NO: 503102 - protein, 9 aa, Homo Sapiens
PELKGCMPH

SEQ ID NO: 503103 - protein, 9 aa, Homo Sapiens
KQCKDISCD

SEQ ID NO: 503104 - protein, 9 aa, Homo Sapiens
VKLEEKLEQ

SEQ ID NO: 503105 - protein, 9 aa, Homo Sapiens
LKGSDRIPI

SEQ ID NO: 503106 - protein, 9 aa, Homo Sapiens
PSSHFSAPC

SEQ ID NO: 503107 - protein, 9 aa, Homo Sapiens
AALLAQSAN

SEQ ID NO: 503108 - protein, 9 aa, Homo Sapiens
YVTKADLVA

SEQ ID NO: 503109 - protein, 9 aa, Homo Sapiens
DTYSDSLRP

SEQ ID NO: 503110 - protein, 9 aa, Homo Sapiens
AQPKPDGEA

SEQ ID NO: 503111 - protein, 9 aa, Homo Sapiens
KMPSPSKAR

SEQ ID NO: 503112 - protein, 9 aa, Homo Sapiens
PLSRNDFFG

SEQ ID NO: 503113 - protein, 9 aa, Homo Sapiens
LSSHNRIHT

SEQ ID NO: 503114 - protein, 9 aa, Homo Sapiens
FINSSGQFV

SEQ ID NO: 503115 - protein, 9 aa, Homo Sapiens
GGTGWPSYG

SEQ ID NO: 503116 - protein, 9 aa, Homo Sapiens
QLEGGRICE

SEQ ID NO: 503117 - protein, 9 aa, Homo Sapiens
FIWTLDPTS

SEQ ID NO: 503118 - protein, 9 aa, Homo Sapiens
STSHPTTSR

SEQ ID NO: 503119 - protein, 9 aa, Homo Sapiens
QRTMTDAAD

SEQ ID NO: 503120 - protein, 9 aa, Homo Sapiens
SVGSHLAEL

SEQ ID NO: 503121 - protein, 9 aa, Homo Sapiens
FHRTIGNGA

SEQ ID NO: 503122 - protein, 9 aa, Homo Sapiens
ATFLRILCS

SEQ ID NO: 503123 - protein, 9 aa, Homo Sapiens
PQHFDRATC

SEQ ID NO: 503124 - protein, 9 aa, Homo Sapiens
MNFRGTGAL

SEQ ID NO: 503125 - protein, 9 aa, Homo Sapiens
PSNTAAAMT

SEQ ID NO: 503126 - protein, 9 aa, Homo Sapiens
DYEMNFRGT

SEQ ID NO: 503127 - protein, 9 aa, Homo Sapiens
AGDEEHAVL

SEQ ID NO: 503128 - protein, 9 aa, Homo Sapiens
CKDISCDYL

SEQ ID NO: 503129 - protein, 9 aa, Homo Sapiens
QGKGPFTLE

SEQ ID NO: 503130 - protein, 9 aa, Homo Sapiens
SLHIISWIQ

SEQ ID NO: 503131 - protein, 9 aa, Homo Sapiens
LATFLRILC

SEQ ID NO: 503132 - protein, 9 aa, Homo Sapiens
IFNVLTKET

SEQ ID NO: 503133 - protein, 9 aa, Homo Sapiens
FSCKEAEAT

SEQ ID NO: 503134 - protein, 9 aa, Homo Sapiens
GLMTPVTGE

SEQ ID NO: 503135 - protein, 9 aa, Homo Sapiens
ANVENTSVF

SEQ ID NO: 503136 - protein, 9 aa, Homo Sapiens
KRRQLKQQL

SEQ ID NO: 503137 - protein, 9 aa, Homo Sapiens
HFDRATCVL

SEQ ID NO: 503138 - protein, 9 aa, Homo Sapiens
SSHFSAPCF

SEQ ID NO: 503139 - protein, 9 aa, Homo Sapiens
GTIWYELHT

SEQ ID NO: 503140 - protein, 9 aa, Homo Sapiens
WQKQCKDIS

SEQ ID NO: 503141 - protein, 9 aa, Homo Sapiens
FDTETFFLA

SEQ ID NO: 503142 - protein, 9 aa, Homo Sapiens
VPEPCPSTI

SEQ ID NO: 503143 - protein, 9 aa, Homo Sapiens
GFDTETFFL

SEQ ID NO: 503144 - protein, 9 aa, Homo Sapiens
FRVDVPGSG

SEQ ID NO: 503145 - protein, 9 aa, Homo Sapiens
KHSLECSFT

SEQ ID NO: 503146 - protein, 9 aa, Homo Sapiens
LKGCMPHVP

SEQ ID NO: 503147 - protein, 9 aa, Homo Sapiens
ELCQRLYKI

SEQ ID NO: 503148 - protein, 9 aa, Homo Sapiens
LQKLRNRVA

SEQ ID NO: 503149 - protein, 9 aa, Homo Sapiens
SSAELCKTI

SEQ ID NO: 503150 - protein, 9 aa, Homo Sapiens
INKRDKKNR

SEQ ID NO: 503151 - protein, 9 aa, Homo Sapiens
DNPQHFDRA

SEQ ID NO: 503152 - protein, 9 aa, Homo Sapiens
EINLVDINH

SEQ ID NO: 503153 - protein, 9 aa, Homo Sapiens
DNMRKRERT

SEQ ID NO: 503154 - protein, 9 aa, Homo Sapiens
LQQNNKTEV

SEQ ID NO: 503155 - protein, 9 aa, Homo Sapiens
SKHPTLLWN

SEQ ID NO: 503156 - protein, 9 aa, Homo Sapiens
SRSKSRSQF

SEQ ID NO: 503157 - protein, 9 aa, Homo Sapiens
LQNIQHVKE

SEQ ID NO: 503158 - protein, 9 aa, Homo Sapiens
NGYPDSLAL

SEQ ID NO: 503159 - protein, 9 aa, Homo Sapiens
LLAGDEEHA

SEQ ID NO: 503160 - protein, 9 aa, Homo Sapiens
NRNSVLVIH

SEQ ID NO: 503161 - protein, 9 aa, Homo Sapiens
SEITPTQSC

SEQ ID NO: 503162 - protein, 9 aa, Homo Sapiens
PCPEGTSTS

SEQ ID NO: 503163 - protein, 9 aa, Homo Sapiens
DNTYIGKVS

SEQ ID NO: 503164 - protein, 9 aa, Homo Sapiens
PKPQAADIY

SEQ ID NO: 503165 - protein, 9 aa, Homo Sapiens
RSRYHEAHQ

SEQ ID NO: 503166 - protein, 9 aa, Homo Sapiens
TLLWNLSDF

SEQ ID NO: 503167 - protein, 9 aa, Homo Sapiens
HHGRSRYHE

SEQ ID NO: 503168 - protein, 9 aa, Homo Sapiens
HILLRYANV

SEQ ID NO: 503169 - protein, 9 aa, Homo Sapiens
ELCKTIIST

SEQ ID NO: 503170 - protein, 9 aa, Homo Sapiens
QKLRKWKKS

SEQ ID NO: 503171 - protein, 9 aa, Homo Sapiens
DSILPESSY

SEQ ID NO: 503172 - protein, 9 aa, Homo Sapiens
EDDDDDPTE

SEQ ID NO: 503173 - protein, 9 aa, Homo Sapiens
NPNICDGNF

SEQ ID NO: 503174 - protein, 9 aa, Homo Sapiens
SSSTSHPTT

SEQ ID NO: 503175 - protein, 9 aa, Homo Sapiens
RLYKIHFQL

SEQ ID NO: 503176 - protein, 9 aa, Homo Sapiens
YKKIKSPAN

SEQ ID NO: 503177 - protein, 9 aa, Homo Sapiens
ETFFLAVNL

SEQ ID NO: 503178 - protein, 9 aa, Homo Sapiens
AGGKETMEP

SEQ ID NO: 503179 - protein, 9 aa, Homo Sapiens
AVSRAGSMH

SEQ ID NO: 503180 - protein, 9 aa, Homo Sapiens
PVTGELDMR

SEQ ID NO: 503181 - protein, 9 aa, Homo Sapiens
TYAGTLEGN

SEQ ID NO: 503182 - protein, 9 aa, Homo Sapiens
CPSTITPAP

SEQ ID NO: 503183 - protein, 9 aa, Homo Sapiens
KPQLEGGRI

SEQ ID NO: 503184 - protein, 9 aa, Homo Sapiens
VSATFINSS

SEQ ID NO: 503185 - protein, 9 aa, Homo Sapiens
TIQRDGINP

SEQ ID NO: 503186 - protein, 9 aa, Homo Sapiens
TIGNGASSK

SEQ ID NO: 503187 - protein, 9 aa, Homo Sapiens
AQKSHRVAG

SEQ ID NO: 503188 - protein, 9 aa, Homo Sapiens
TASSEITPT

SEQ ID NO: 503189 - protein, 9 aa, Homo Sapiens
GENDNTDLD

SEQ ID NO: 503190 - protein, 9 aa, Homo Sapiens
RILCSYVQI

SEQ ID NO: 503191 - protein, 9 aa, Homo Sapiens
IWYELHTRE

SEQ ID NO: 503192 - protein, 9 aa, Homo Sapiens
EPGSSSTSH

SEQ ID NO: 503193 - protein, 9 aa, Homo Sapiens
RVDVPGSGS

SEQ ID NO: 503194 - protein, 9 aa, Homo Sapiens
PQLEGGRIC

SEQ ID NO: 503195 - protein, 9 aa, Homo Sapiens
SEMDNSSQD

SEQ ID NO: 503196 - protein, 9 aa, Homo Sapiens
HPHPHPPPS

SEQ ID NO: 503197 - protein, 9 aa, Homo Sapiens
GLGLALALQ

SEQ ID NO: 503198 - protein, 9 aa, Homo Sapiens
EQKREKRRQ

SEQ ID NO: 503199 - protein, 9 aa, Homo Sapiens
TNIILSFVL

SEQ ID NO: 503200 - protein, 9 aa, Homo Sapiens
VNKHCHQQA

SEQ ID NO: 503201 - protein, 9 aa, Homo Sapiens
TPTQSCPPM

SEQ ID NO: 503202 - protein, 9 aa, Homo Sapiens
GPILGTSVG

SEQ ID NO: 503203 - protein, 9 aa, Homo Sapiens
HLSLASNHP

SEQ ID NO: 503204 - protein, 9 aa, Homo Sapiens
YIPLSRNDF

SEQ ID NO: 503205 - protein, 9 aa, Homo Sapiens
EAPRATSQM

SEQ ID NO: 503206 - protein, 9 aa, Homo Sapiens
LVTRHFPPA

SEQ ID NO: 503207 - protein, 9 aa, Homo Sapiens
DRLPDGCLD

SEQ ID NO: 503208 - protein, 9 aa, Homo Sapiens
TGSCKGKCC

SEQ ID NO: 503209 - protein, 9 aa, Homo Sapiens
THFPYKRLI

SEQ ID NO: 503210 - protein, 9 aa, Homo Sapiens
EAAVSRAGS

SEQ ID NO: 503211 - protein, 9 aa, Homo Sapiens
ARVRPAPDN

SEQ ID NO: 503212 - protein, 9 aa, Homo Sapiens
QPCDVCSIG

SEQ ID NO: 503213 - protein, 9 aa, Homo Sapiens
PSSVSEDAS

SEQ ID NO: 503214 - protein, 9 aa, Homo Sapiens
WSTCSASCG

SEQ ID NO: 503215 - protein, 9 aa, Homo Sapiens
KTYAGTLEG

SEQ ID NO: 503216 - protein, 9 aa, Homo Sapiens
IAYSATSIV

SEQ ID NO: 503217 - protein, 9 aa, Homo Sapiens
KRLLYQRYG

SEQ ID NO: 503218 - protein, 9 aa, Homo Sapiens
SGIGTPGQG

SEQ ID NO: 503219 - protein, 9 aa, Homo Sapiens
KVENLSIQM

SEQ ID NO: 503220 - protein, 9 aa, Homo Sapiens
CQRLYKIHF

SEQ ID NO: 503221 - protein, 9 aa, Homo Sapiens
YKIHFQLLL

SEQ ID NO: 503222 - protein, 9 aa, Homo Sapiens
KGSDRIPIY

SEQ ID NO: 503223 - protein, 9 aa, Homo Sapiens
LPDGCLDAD

SEQ ID NO: 503224 - protein, 9 aa, Homo Sapiens
LNLRNKTGV

SEQ ID NO: 503225 - protein, 9 aa, Homo Sapiens
GAVKLEEKL

SEQ ID NO: 503226 - protein, 9 aa, Homo Sapiens
ILPESSYEV

SEQ ID NO: 503227 - protein, 9 aa, Homo Sapiens
HKVTGLHYG

SEQ ID NO: 503228 - protein, 9 aa, Homo Sapiens
QLFHRTIGN

SEQ ID NO: 503229 - protein, 9 aa, Homo Sapiens
MDQHFGMLE

SEQ ID NO: 503230 - protein, 9 aa, Homo Sapiens
WNPNHLPCR

SEQ ID NO: 503231 - protein, 9 aa, Homo Sapiens
ETNIILSFV

SEQ ID NO: 503232 - protein, 9 aa, Homo Sapiens
FAHILLRYA

SEQ ID NO: 503233 - protein, 9 aa, Homo Sapiens
IFIWTLDPT

SEQ ID NO: 503234 - protein, 9 aa, Homo Sapiens
LSSKSFDQL

SEQ ID NO: 503235 - protein, 9 aa, Homo Sapiens
DERRRQERG

SEQ ID NO: 503236 - protein, 9 aa, Homo Sapiens
GGLNLEPLL

SEQ ID NO: 503237 - protein, 9 aa, Homo Sapiens
GIGMASIDL

SEQ ID NO: 503238 - protein, 9 aa, Homo Sapiens
NELVTRHFP

SEQ ID NO: 503239 - protein, 9 aa, Homo Sapiens
NLSIQMRLM

SEQ ID NO: 503240 - protein, 9 aa, Homo Sapiens
PGLMTPVTG

SEQ ID NO: 503241 - protein, 9 aa, Homo Sapiens
YSDSLRPPY

SEQ ID NO: 503242 - protein, 9 aa, Homo Sapiens
YSATSIVLS

SEQ ID NO: 503243 - protein, 9 aa, Homo Sapiens
IGNGASSKA

SEQ ID NO: 503244 - protein, 9 aa, Homo Sapiens
SNFFHGCFS

SEQ ID NO: 503245 - protein, 9 aa, Homo Sapiens
LLHLSLASN

SEQ ID NO: 503246 - protein, 9 aa, Homo Sapiens
SQFSSRSRS

SEQ ID NO: 503247 - protein, 9 aa, Homo Sapiens
SHLSRNKSF

SEQ ID NO: 503248 - protein, 9 aa, Homo Sapiens
ESSYEVQVR

SEQ ID NO: 503249 - protein, 9 aa, Homo Sapiens
CCLIIADSF

SEQ ID NO: 503250 - protein, 9 aa, Homo Sapiens
LSETPNRKW

SEQ ID NO: 503251 - protein, 9 aa, Homo Sapiens
DKEVGAIQL

SEQ ID NO: 503252 - protein, 9 aa, Homo Sapiens
GFYQKTYAG

SEQ ID NO: 503253 - protein, 9 aa, Homo Sapiens
KEPGAGGKE

SEQ ID NO: 503254 - protein, 9 aa, Homo Sapiens
YDMESEDET

SEQ ID NO: 503255 - protein, 9 aa, Homo Sapiens
INLVDINHW

SEQ ID NO: 503256 - protein, 9 aa, Homo Sapiens
LLSKALVQY

SEQ ID NO: 503257 - protein, 9 aa, Homo Sapiens
DISCDYLDF

SEQ ID NO: 503258 - protein, 9 aa, Homo Sapiens
ECKEAAVSR

SEQ ID NO: 503259 - protein, 9 aa, Homo Sapiens
LFHDKECRN

SEQ ID NO: 503260 - protein, 9 aa, Homo Sapiens
ENGVWGIAV

SEQ ID NO: 503261 - protein, 9 aa, Homo Sapiens
TGWPSYGED

SEQ ID NO: 503262 - protein, 9 aa, Homo Sapiens
DDMDLRVYG

SEQ ID NO: 503263 - protein, 9 aa, Homo Sapiens
KKNRTALHL

SEQ ID NO: 503264 - protein, 9 aa, Homo Sapiens
KAPISLSKV

SEQ ID NO: 503265 - protein, 9 aa, Homo Sapiens
VEAQKSHRV

SEQ ID NO: 503266 - protein, 9 aa, Homo Sapiens
ERALWQVDT

SEQ ID NO: 503267 - protein, 9 aa, Homo Sapiens
APCPEGTST

SEQ ID NO: 503268 - protein, 9 aa, Homo Sapiens
TLEGNSKEP

SEQ ID NO: 503269 - protein, 9 aa, Homo Sapiens
ACQSCIFIW

SEQ ID NO: 503270 - protein, 9 aa, Homo Sapiens
AWNPNHLPC

SEQ ID NO: 503271 - protein, 9 aa, Homo Sapiens
KLEEKLEQN

SEQ ID NO: 503272 - protein, 9 aa, Homo Sapiens
AAILLHAGG

SEQ ID NO: 503273 - protein, 9 aa, Homo Sapiens
IYIYTHIYI

SEQ ID NO: 503274 - protein, 9 aa, Homo Sapiens
NIQVSLEKQ

SEQ ID NO: 503275 - protein, 9 aa, Homo Sapiens
MVDCCAKQE

SEQ ID NO: 503276 - protein, 9 aa, Homo Sapiens
ANQGFEAVY

SEQ ID NO: 503277 - protein, 9 aa, Homo Sapiens
EMDQHFGML

SEQ ID NO: 503278 - protein, 9 aa, Homo Sapiens
QQKFRVDVP

SEQ ID NO: 503279 - protein, 9 aa, Homo Sapiens
QVSLEKQQM

SEQ ID NO: 503280 - protein, 9 aa, Homo Sapiens
AVACQSCIF

SEQ ID NO: 503281 - protein, 9 aa, Homo Sapiens
YKKAKPGAA

SEQ ID NO: 503282 - protein, 9 aa, Homo Sapiens
ELNAQYLQN

SEQ ID NO: 503283 - protein, 9 aa, Homo Sapiens
GNRNSVLVI

SEQ ID NO: 503284 - protein, 9 aa, Homo Sapiens
DKECRNAVS

SEQ ID NO: 503285 - protein, 9 aa, Homo Sapiens
YEMNFRGTG

SEQ ID NO: 503286 - protein, 9 aa, Homo Sapiens
FLKGSDRIP

SEQ ID NO: 503287 - protein, 9 aa, Homo Sapiens
ELHTREWPF

SEQ ID NO: 503288 - protein, 9 aa, Homo Sapiens
LAQSANQGF

SEQ ID NO: 503289 - protein, 9 aa, Homo Sapiens
KSKKSFSCK

SEQ ID NO: 503290 - protein, 9 aa, Homo Sapiens
ELHNTLRTL

SEQ ID NO: 503291 - protein, 9 aa, Homo Sapiens
TDSFSKVAR

SEQ ID NO: 503292 - protein, 9 aa, Homo Sapiens
PIILGGPSP

SEQ ID NO: 503293 - protein, 9 aa, Homo Sapiens
SFHVTWIAC

SEQ ID NO: 503294 - protein, 9 aa, Homo Sapiens
TKDSVTLLP

SEQ ID NO: 503295 - protein, 9 aa, Homo Sapiens
IADSFIYFL

SEQ ID NO: 503296 - protein, 9 aa, Homo Sapiens
ATSQMLEVM

SEQ ID NO: 503297 - protein, 9 aa, Homo Sapiens
CDILYFRRW

SEQ ID NO: 503298 - protein, 9 aa, Homo Sapiens
LFLKGSDRI

SEQ ID NO: 503299 - protein, 9 aa, Homo Sapiens
PPISVCQHE

SEQ ID NO: 503300 - protein, 9 aa, Homo Sapiens
CEYIPLSRN

SEQ ID NO: 503301 - protein, 9 aa, Homo Sapiens
HLSRNKSFG

SEQ ID NO: 503302 - protein, 9 aa, Homo Sapiens
VEAAELCLQ

SEQ ID NO: 503303 - protein, 9 aa, Homo Sapiens
DSLRPPYPT

SEQ ID NO: 503304 - protein, 9 aa, Homo Sapiens
VACQSCIFI

SEQ ID NO: 503305 - protein, 9 aa, Homo Sapiens
LSPRPRDGA

SEQ ID NO: 503306 - protein, 9 aa, Homo Sapiens
NFFHGCFSI

SEQ ID NO: 503307 - protein, 9 aa, Homo Sapiens
NSKEPGGFW

SEQ ID NO: 503308 - protein, 9 aa, Homo Sapiens
EPTDPERLS

SEQ ID NO: 503309 - protein, 9 aa, Homo Sapiens
APLAKVPEV

SEQ ID NO: 503310 - protein, 9 aa, Homo Sapiens
QLGGRPGPG

SEQ ID NO: 503311 - protein, 9 aa, Homo Sapiens
WYELHTREW

SEQ ID NO: 503312 - protein, 9 aa, Homo Sapiens
SNGYPDSLA

SEQ ID NO: 503313 - protein, 9 aa, Homo Sapiens
SVCQHESHQ

SEQ ID NO: 503314 - protein, 9 aa, Homo Sapiens
RNKSFGRGD

SEQ ID NO: 503315 - protein, 9 aa, Homo Sapiens
SLTGEDVCH

SEQ ID NO: 503316 - protein, 9 aa, Homo Sapiens
ETPNRKWVV

SEQ ID NO: 503317 - protein, 9 aa, Homo Sapiens
PVRLHFSNP

SEQ ID NO: 503318 - protein, 9 aa, Homo Sapiens
FDYEMNFRG

SEQ ID NO: 503319 - protein, 9 aa, Homo Sapiens
DTAVPSDSY

SEQ ID NO: 503320 - protein, 9 aa, Homo Sapiens
APCFCRAFG

SEQ ID NO: 503321 - protein, 9 aa, Homo Sapiens
QKSHRVAGP

SEQ ID NO: 503322 - protein, 9 aa, Homo Sapiens
KRERTIQRD

SEQ ID NO: 503323 - protein, 9 aa, Homo Sapiens
VPGSGSAFI

SEQ ID NO: 503324 - protein, 9 aa, Homo Sapiens
SATSIVLSD

SEQ ID NO: 503325 - protein, 9 aa, Homo Sapiens
SAELCKTII

SEQ ID NO: 503326 - protein, 9 aa, Homo Sapiens
KEQKREKRR

SEQ ID NO: 503327 - protein, 9 aa, Homo Sapiens
VNDSGYPLD

SEQ ID NO: 503328 - protein, 9 aa, Homo Sapiens
QNIQHVKES

SEQ ID NO: 503329 - protein, 9 aa, Homo Sapiens
DEDDDDDPT

SEQ ID NO: 503330 - protein, 9 aa, Homo Sapiens
NMAEKAKQI

SEQ ID NO: 503331 - protein, 9 aa, Homo Sapiens
KESVPNGVE

SEQ ID NO: 503332 - protein, 9 aa, Homo Sapiens
ALETNIILS

SEQ ID NO: 503333 - protein, 9 aa, Homo Sapiens
RTSILEAAN

SEQ ID NO: 503334 - protein, 9 aa, Homo Sapiens
RPKGKVTKD

SEQ ID NO: 503335 - protein, 9 aa, Homo Sapiens
RSKHPTLLW

SEQ ID NO: 503336 - protein, 9 aa, Homo Sapiens
NLTSNHLLC

SEQ ID NO: 503337 - protein, 9 aa, Homo Sapiens
ASTHFPYKR

SEQ ID NO: 503338 - protein, 9 aa, Homo Sapiens
GKGAWNPNH

SEQ ID NO: 503339 - protein, 9 aa, Homo Sapiens
ISLSKVKLT

SEQ ID NO: 503340 - protein, 9 aa, Homo Sapiens
VCSIGCIIF

SEQ ID NO: 503341 - protein, 9 aa, Homo Sapiens
PPSPHFTRR

SEQ ID NO: 503342 - protein, 9 aa, Homo Sapiens
SFSSNLNHC

SEQ ID NO: 503343 - protein, 9 aa, Homo Sapiens
KAEGFYQKT

SEQ ID NO: 503344 - protein, 9 aa, Homo Sapiens
VSLEKQQMM

SEQ ID NO: 503345 - protein, 9 aa, Homo Sapiens
LEWKNQSKL

SEQ ID NO: 503346 - protein, 9 aa, Homo Sapiens
TSMGPQPII

SEQ ID NO: 503347 - protein, 9 aa, Homo Sapiens
WVCVAAAIL

SEQ ID NO: 503348 - protein, 9 aa, Homo Sapiens
HLPCRPRPV

SEQ ID NO: 503349 - protein, 9 aa, Homo Sapiens
KDSLAYSES

SEQ ID NO: 503350 - protein, 9 aa, Homo Sapiens
PGSSSTSHP

SEQ ID NO: 503351 - protein, 9 aa, Homo Sapiens
QKTREELSR

SEQ ID NO: 503352 - protein, 9 aa, Homo Sapiens
GTSVGSHLA

SEQ ID NO: 503353 - protein, 9 aa, Homo Sapiens
IQHLWLSFD

SEQ ID NO: 503354 - protein, 9 aa, Homo Sapiens
LLYQRYGKR

SEQ ID NO: 503355 - protein, 9 aa, Homo Sapiens
KLGALQKLR

SEQ ID NO: 503356 - protein, 9 aa, Homo Sapiens
KECRNAVSK

SEQ ID NO: 503357 - protein, 9 aa, Homo Sapiens
KVAREYTDL

SEQ ID NO: 503358 - protein, 9 aa, Homo Sapiens
GRPGPGKGA

SEQ ID NO: 503359 - protein, 9 aa, Homo Sapiens
YPIDTYSDS

SEQ ID NO: 503360 - protein, 9 aa, Homo Sapiens
SSHLSRNKS

SEQ ID NO: 503361 - protein, 9 aa, Homo Sapiens
IGENGVWGI

SEQ ID NO: 503362 - protein, 9 aa, Homo Sapiens
HIYIHTHTF

SEQ ID NO: 503363 - protein, 9 aa, Homo Sapiens
VDVPGSGSA

SEQ ID NO: 503364 - protein, 9 aa, Homo Sapiens
IHIGQKPRM

SEQ ID NO: 503365 - protein, 9 aa, Homo Sapiens
LASNHPASS

SEQ ID NO: 503366 - protein, 9 aa, Homo Sapiens
TSVGSHLAE

SEQ ID NO: 503367 - protein, 9 aa, Homo Sapiens
STITPAPAQ

SEQ ID NO: 503368 - protein, 9 aa, Homo Sapiens
SNGEINLVD

SEQ ID NO: 503369 - protein, 9 aa, Homo Sapiens
KPCEYIPLS

SEQ ID NO: 503370 - protein, 9 aa, Homo Sapiens
SSPSIAVKA

SEQ ID NO: 503371 - protein, 9 aa, Homo Sapiens
RWYKKAKPG

SEQ ID NO: 503372 - protein, 9 aa, Homo Sapiens
VEAPRATSQ

SEQ ID NO: 503373 - protein, 9 aa, Homo Sapiens
IPLSRNDFF

SEQ ID NO: 503374 - protein, 9 aa, Homo Sapiens
SHNRIHTGE

SEQ ID NO: 503375 - protein, 9 aa, Homo Sapiens
PIQHLWLSF

SEQ ID NO: 503376 - protein, 9 aa, Homo Sapiens
NGVWGIAVD

SEQ ID NO: 503377 - protein, 9 aa, Homo Sapiens
SVNDSGYPL

SEQ ID NO: 503378 - protein, 9 aa, Homo Sapiens
HVGMLGEKL

SEQ ID NO: 503379 - protein, 9 aa, Homo Sapiens
ALLAQSANQ

SEQ ID NO: 503380 - protein, 9 aa, Homo Sapiens
VDAALDNTY

SEQ ID NO: 503381 - protein, 9 aa, Homo Sapiens
TSIVLSDKT

SEQ ID NO: 503382 - protein, 9 aa, Homo Sapiens
YPSPKPQAA

SEQ ID NO: 503383 - protein, 9 aa, Homo Sapiens
SSHNRIHTG

SEQ ID NO: 503384 - protein, 9 aa, Homo Sapiens
GFFLASGTE

SEQ ID NO: 503385 - protein, 9 aa, Homo Sapiens
SLPIQHLWL

SEQ ID NO: 503386 - protein, 9 aa, Homo Sapiens
VLSDKTLYK

SEQ ID NO: 503387 - protein, 9 aa, Homo Sapiens
LMTPVTGEL

SEQ ID NO: 503388 - protein, 9 aa, Homo Sapiens
RDGINPSKQ

SEQ ID NO: 503389 - protein, 9 aa, Homo Sapiens
FRWYKKAKP

SEQ ID NO: 503390 - protein, 9 aa, Homo Sapiens
SPANMAEKA

SEQ ID NO: 503391 - protein, 9 aa, Homo Sapiens
HNTLRTLSS

SEQ ID NO: 503392 - protein, 9 aa, Homo Sapiens
QNSPDNPQH

SEQ ID NO: 503393 - protein, 9 aa, Homo Sapiens
SKEPGAGGK

SEQ ID NO: 503394 - protein, 9 aa, Homo Sapiens
FFLASGTEH

SEQ ID NO: 503395 - protein, 9 aa, Homo Sapiens
EPCPSTITP

SEQ ID NO: 503396 - protein, 9 aa, Homo Sapiens
TQSCPPMTV

SEQ ID NO: 503397 - protein, 9 aa, Homo Sapiens
CSSTLTNHK

SEQ ID NO: 503398 - protein, 9 aa, Homo Sapiens
KKIKSPANM

SEQ ID NO: 503399 - protein, 9 aa, Homo Sapiens
RLLYQRYGK

SEQ ID NO: 503400 - protein, 9 aa, Homo Sapiens
CGMTHVASV

SEQ ID NO: 503401 - protein, 9 aa, Homo Sapiens
RKEQKREKR

SEQ ID NO: 503402 - protein, 9 aa, Homo Sapiens
KPDGEAETR

SEQ ID NO: 503403 - protein, 9 aa, Homo Sapiens
YANVENTSV

SEQ ID NO: 503404 - protein, 9 aa, Homo Sapiens
LHIISWIQG

SEQ ID NO: 503405 - protein, 9 aa, Homo Sapiens
DYTLREVDM

SEQ ID NO: 503406 - protein, 9 aa, Homo Sapiens
SILPESSYE

SEQ ID NO: 503407 - protein, 9 aa, Homo Sapiens
YKCNECGNR

SEQ ID NO: 503408 - protein, 9 aa, Homo Sapiens
TETFFLAVN

SEQ ID NO: 503409 - protein, 9 aa, Homo Sapiens
FSSRSRSRS

SEQ ID NO: 503410 - protein, 9 aa, Homo Sapiens
LLAQSANQG

SEQ ID NO: 503411 - protein, 9 aa, Homo Sapiens
IQHVKESVP

SEQ ID NO: 503412 - protein, 9 aa, Homo Sapiens
ILLHAGGLA

SEQ ID NO: 503413 - protein, 9 aa, Homo Sapiens
MLELLNNTA

SEQ ID NO: 503414 - protein, 9 aa, Homo Sapiens
DMESEDETL

SEQ ID NO: 503415 - protein, 9 aa, Homo Sapiens
PGGFWGSGI

SEQ ID NO: 503416 - protein, 9 aa, Homo Sapiens
EMDERRRQE

SEQ ID NO: 503417 - protein, 9 aa, Homo Sapiens
SNLMSTKEE

SEQ ID NO: 503418 - protein, 9 aa, Homo Sapiens
ECGNRNSVL

SEQ ID NO: 503419 - protein, 9 aa, Homo Sapiens
GSLPPKPQL

SEQ ID NO: 503420 - protein, 9 aa, Homo Sapiens
PCEYIPLSR

SEQ ID NO: 503421 - protein, 9 aa, Homo Sapiens
SWIQGCFDA

SEQ ID NO: 503422 - protein, 9 aa, Homo Sapiens
EQGKGPFTL

SEQ ID NO: 503423 - protein, 9 aa, Homo Sapiens
FLTGSCKGK

SEQ ID NO: 503424 - protein, 9 aa, Homo Sapiens
QHMTEVVRH

SEQ ID NO: 503425 - protein, 9 aa, Homo Sapiens
KTDSFSKVA

SEQ ID NO: 503426 - protein, 9 aa, Homo Sapiens
PSDSYKKLP

SEQ ID NO: 503427 - protein, 9 aa, Homo Sapiens
DASASSQGS

SEQ ID NO: 503428 - protein, 9 aa, Homo Sapiens
ECSFTETES

SEQ ID NO: 503429 - protein, 9 aa, Homo Sapiens
YQKTYAGTL

SEQ ID NO: 503430 - protein, 9 aa, Homo Sapiens
NAFTAPFHR

SEQ ID NO: 503431 - protein, 9 aa, Homo Sapiens
INSVDQNMF

SEQ ID NO: 503432 - protein, 9 aa, Homo Sapiens
EKVIVSTDI

SEQ ID NO: 503433 - protein, 9 aa, Homo Sapiens
IYIHTHTFY

SEQ ID NO: 503434 - protein, 9 aa, Homo Sapiens
MEPGSSSTS

SEQ ID NO: 503435 - protein, 9 aa, Homo Sapiens
HCGMTHVAS

SEQ ID NO: 503436 - protein, 9 aa, Homo Sapiens
PTDPERLSS

SEQ ID NO: 503437 - protein, 9 aa, Homo Sapiens
KASMSPGLH

SEQ ID NO: 503438 - protein, 9 aa, Homo Sapiens
PGAVKLEEK

SEQ ID NO: 503439 - protein, 9 aa, Homo Sapiens
GDVIDGYNA

SEQ ID NO: 503440 - protein, 9 aa, Homo Sapiens
EANKRLLYQ

SEQ ID NO: 503441 - protein, 9 aa, Homo Sapiens
KVVHEWWGI

SEQ ID NO: 503442 - protein, 9 aa, Homo Sapiens
VSEDASASS

SEQ ID NO: 503443 - protein, 9 aa, Homo Sapiens
HADSQNMWI

SEQ ID NO: 503444 - protein, 9 aa, Homo Sapiens
STSLTGEDV

SEQ ID NO: 503445 - protein, 9 aa, Homo Sapiens
EGRGLARGG

SEQ ID NO: 503446 - protein, 9 aa, Homo Sapiens
KTREELSRQ

SEQ ID NO: 503447 - protein, 9 aa, Homo Sapiens
TAAAMTAPP

SEQ ID NO: 503448 - protein, 9 aa, Homo Sapiens
QPDYDMESE

SEQ ID NO: 503449 - protein, 9 aa, Homo Sapiens
MLDNMRKRE

SEQ ID NO: 503450 - protein, 9 aa, Homo Sapiens
MTPVTGELD

SEQ ID NO: 503451 - protein, 9 aa, Homo Sapiens
TKADLVAGN

SEQ ID NO: 503452 - protein, 9 aa, Homo Sapiens
EQHLQKLRN

SEQ ID NO: 503453 - protein, 9 aa, Homo Sapiens
DEEHAVLLC

SEQ ID NO: 503454 - protein, 9 aa, Homo Sapiens
KECGKTFNC

SEQ ID NO: 503455 - protein, 9 aa, Homo Sapiens
PERLSSSEE

SEQ ID NO: 503456 - protein, 9 aa, Homo Sapiens
LSFVLMDIQ

SEQ ID NO: 503457 - protein, 9 aa, Homo Sapiens
EEWVPELKG

SEQ ID NO: 503458 - protein, 9 aa, Homo Sapiens
APDNAPRDP

SEQ ID NO: 503459 - protein, 9 aa, Homo Sapiens
IMLACSFVN

SEQ ID NO: 503460 - protein, 9 aa, Homo Sapiens
SCDYLDFGI

SEQ ID NO: 503461 - protein, 9 aa, Homo Sapiens
PAPDNAPRD

SEQ ID NO: 503462 - protein, 9 aa, Homo Sapiens
TSSAELCKT

SEQ ID NO: 503463 - protein, 9 aa, Homo Sapiens
GWLCCLIIA

SEQ ID NO: 503464 - protein, 9 aa, Homo Sapiens
QFSSRSRSR

SEQ ID NO: 503465 - protein, 9 aa, Homo Sapiens
PRPRDGAYA

SEQ ID NO: 503466 - protein, 9 aa, Homo Sapiens
IVLSDKTLY

SEQ ID NO: 503467 - protein, 9 aa, Homo Sapiens
VVHEWWGIH

SEQ ID NO: 503468 - protein, 9 aa, Homo Sapiens
WSHAICISS

SEQ ID NO: 503469 - protein, 9 aa, Homo Sapiens
YAGTLEGNS

SEQ ID NO: 503470 - protein, 9 aa, Homo Sapiens
KLLHLSLAS

SEQ ID NO: 503471 - protein, 9 aa, Homo Sapiens
SKLVINELK

SEQ ID NO: 503472 - protein, 9 aa, Homo Sapiens
SLASNHPAS

SEQ ID NO: 503473 - protein, 9 aa, Homo Sapiens
CSKDSLAYS

SEQ ID NO: 503474 - protein, 9 aa, Homo Sapiens
MRKRERTIQ

SEQ ID NO: 503475 - protein, 9 aa, Homo Sapiens
KKSFSCKEA

SEQ ID NO: 503476 - protein, 9 aa, Homo Sapiens
GIGTPGQGP

SEQ ID NO: 503477 - protein, 9 aa, Homo Sapiens
IQRDGINPS

SEQ ID NO: 503478 - protein, 9 aa, Homo Sapiens
SNHLLCHYW

SEQ ID NO: 503479 - protein, 9 aa, Homo Sapiens
LHLSLASNH

SEQ ID NO: 503480 - protein, 9 aa, Homo Sapiens
TLLASALGL

SEQ ID NO: 503481 - protein, 9 aa, Homo Sapiens
SHRVAGPSK

SEQ ID NO: 503482 - protein, 9 aa, Homo Sapiens
SNELVTRHF

SEQ ID NO: 503483 - protein, 9 aa, Homo Sapiens
CCVLQLGDV

SEQ ID NO: 503484 - protein, 9 aa, Homo Sapiens
GIGENGVWG

SEQ ID NO: 503485 - protein, 9 aa, Homo Sapiens
HGRSRYHEA

SEQ ID NO: 503486 - protein, 9 aa, Homo Sapiens
KHTSLPIQH

SEQ ID NO: 503487 - protein, 9 aa, Homo Sapiens
DSGYPLDLN

SEQ ID NO: 503488 - protein, 9 aa, Homo Sapiens
DMDLRVYGP

SEQ ID NO: 503489 - protein, 9 aa, Homo Sapiens
AGVSEMDNS

SEQ ID NO: 503490 - protein, 9 aa, Homo Sapiens
ANKRLLYQR

SEQ ID NO: 503491 - protein, 9 aa, Homo Sapiens
SSTSHPTTS

SEQ ID NO: 503492 - protein, 9 aa, Homo Sapiens
LLWNLSDFY

SEQ ID NO: 503493 - protein, 9 aa, Homo Sapiens
ATSIVLSDK

SEQ ID NO: 503494 - protein, 9 aa, Homo Sapiens
VIFWLAGVV

SEQ ID NO: 503495 - protein, 9 aa, Homo Sapiens
KEAAVSRAG

SEQ ID NO: 503496 - protein, 9 aa, Homo Sapiens
YGGTGWPSY

SEQ ID NO: 503497 - protein, 9 aa, Homo Sapiens
PGPGKGAWN

SEQ ID NO: 503498 - protein, 9 aa, Homo Sapiens
PANMAEKAK

SEQ ID NO: 503499 - protein, 9 aa, Homo Sapiens
LGDVIDGYN

SEQ ID NO: 503500 - protein, 9 aa, Homo Sapiens
ALAALGMGL

SEQ ID NO: 503501 - protein, 9 aa, Homo Sapiens
LACSFVNKH

SEQ ID NO: 503502 - protein, 9 aa, Homo Sapiens
ALINSVDQN

SEQ ID NO: 503503 - protein, 9 aa, Homo Sapiens
DNAPRDPDP

SEQ ID NO: 503504 - protein, 9 aa, Homo Sapiens
IDTYSDSLR

SEQ ID NO: 503505 - protein, 9 aa, Homo Sapiens
TPGLMTPVT

SEQ ID NO: 503506 - protein, 9 aa, Homo Sapiens
LAGRAQPKP

SEQ ID NO: 503507 - protein, 9 aa, Homo Sapiens
EPPLSPRPR

SEQ ID NO: 503508 - protein, 9 aa, Homo Sapiens
TEEIFNVLT

SEQ ID NO: 503509 - protein, 9 aa, Homo Sapiens
VCVAAAILL

SEQ ID NO: 503510 - protein, 9 aa, Homo Sapiens
PCRPRPVQN

SEQ ID NO: 503511 - protein, 9 aa, Homo Sapiens
LGTSVGSHL

SEQ ID NO: 503512 - protein, 9 aa, Homo Sapiens
SQMLEVMFK

SEQ ID NO: 503513 - protein, 9 aa, Homo Sapiens
SMLEQGKGP

SEQ ID NO: 503514 - protein, 9 aa, Homo Sapiens
GEKIFLTGS

SEQ ID NO: 503515 - protein, 9 aa, Homo Sapiens
CGNRNSVLV

SEQ ID NO: 503516 - protein, 9 aa, Homo Sapiens
AGRAQPKPD

SEQ ID NO: 503517 - protein, 9 aa, Homo Sapiens
NSPDNPQHF

SEQ ID NO: 503518 - protein, 9 aa, Homo Sapiens
QDKEVGAIQ

SEQ ID NO: 503519 - protein, 9 aa, Homo Sapiens
VAREYTDLE

SEQ ID NO: 503520 - protein, 9 aa, Homo Sapiens
GEDVCHELE

SEQ ID NO: 503521 - protein, 9 aa, Homo Sapiens
KADLVAGNG

SEQ ID NO: 503522 - protein, 9 aa, Homo Sapiens
PRSTTSTIE

SEQ ID NO: 503523 - protein, 9 aa, Homo Sapiens
GVVTTTWER

SEQ ID NO: 503524 - protein, 9 aa, Homo Sapiens
LPCRPRPVQ

SEQ ID NO: 503525 - protein, 9 aa, Homo Sapiens
NHLLCHYWI

SEQ ID NO: 503526 - protein, 9 aa, Homo Sapiens
AYLSLDDNA

SEQ ID NO: 503527 - protein, 9 aa, Homo Sapiens
TCSASCGHG

SEQ ID NO: 503528 - protein, 9 aa, Homo Sapiens
IMLDNMRKR

SEQ ID NO: 503529 - protein, 9 aa, Homo Sapiens
QNMWIKDGT

SEQ ID NO: 503530 - protein, 9 aa, Homo Sapiens
CLQQNNKTE

SEQ ID NO: 503531 - protein, 9 aa, Homo Sapiens
HYLPDLHRS

SEQ ID NO: 503532 - protein, 9 aa, Homo Sapiens
PYKRLIKVC

SEQ ID NO: 503533 - protein, 9 aa, Homo Sapiens
WYKKAKPGA

SEQ ID NO: 503534 - protein, 9 aa, Homo Sapiens
RELPRSTTS

SEQ ID NO: 503535 - protein, 9 aa, Homo Sapiens
GKSKKSFSC

SEQ ID NO: 503536 - protein, 9 aa, Homo Sapiens
GAGGKETME

SEQ ID NO: 503537 - protein, 9 aa, Homo Sapiens
NIFWSHAIC

SEQ ID NO: 503538 - protein, 9 aa, Homo Sapiens
KALVQYVVA

SEQ ID NO: 503539 - protein, 9 aa, Homo Sapiens
YKKLPEMDI

SEQ ID NO: 503540 - protein, 9 aa, Homo Sapiens
EDSILSSKS

SEQ ID NO: 503541 - protein, 9 aa, Homo Sapiens
MPSSVSEDA

SEQ ID NO: 503542 - protein, 9 aa, Homo Sapiens
SCQKCNPSC

SEQ ID NO: 503543 - protein, 9 aa, Homo Sapiens
TSQMLEVMF

SEQ ID NO: 503544 - protein, 9 aa, Homo Sapiens
LYVTKADLV

SEQ ID NO: 503545 - protein, 9 aa, Homo Sapiens
VTKDSVTLL

SEQ ID NO: 503546 - protein, 9 aa, Homo Sapiens
KKAKPGAAE

SEQ ID NO: 503547 - protein, 9 aa, Homo Sapiens
PRPVQNLAA

SEQ ID NO: 503548 - protein, 9 aa, Homo Sapiens
HFSNPNLCA

SEQ ID NO: 503549 - protein, 9 aa, Homo Sapiens
NRKWVVFDG

SEQ ID NO: 503550 - protein, 9 aa, Homo Sapiens
RERTIQRDG

SEQ ID NO: 503551 - protein, 9 aa, Homo Sapiens
NEQPDYDME

SEQ ID NO: 503552 - protein, 9 aa, Homo Sapiens
VSTDIKIEF

SEQ ID NO: 503553 - protein, 9 aa, Homo Sapiens
STDIKIEFI

SEQ ID NO: 503554 - protein, 9 aa, Homo Sapiens
SHYLPDLHR

SEQ ID NO: 503555 - protein, 9 aa, Homo Sapiens
AAMTAPPGP

SEQ ID NO: 503556 - protein, 9 aa, Homo Sapiens
TMEPGSSST

SEQ ID NO: 503557 - protein, 9 aa, Homo Sapiens
AADCLKVFM

SEQ ID NO: 503558 - protein, 9 aa, Homo Sapiens
FHGCFSIGD

SEQ ID NO: 503559 - protein, 9 aa, Homo Sapiens
QHFDRATCV

SEQ ID NO: 503560 - protein, 9 aa, Homo Sapiens
SELNAQYLQ

SEQ ID NO: 503561 - protein, 9 aa, Homo Sapiens
WMELLSKAL

SEQ ID NO: 503562 - protein, 9 aa, Homo Sapiens
LRETYGEMV

SEQ ID NO: 503563 - protein, 9 aa, Homo Sapiens
GGFWGSGIG

SEQ ID NO: 503564 - protein, 9 aa, Homo Sapiens
LHFSNPNLC

SEQ ID NO: 503565 - protein, 9 aa, Homo Sapiens
RTSQLQTSR

SEQ ID NO: 503566 - protein, 9 aa, Homo Sapiens
SRGSQYGGT

SEQ ID NO: 503567 - protein, 9 aa, Homo Sapiens
ECRNAVSKY

SEQ ID NO: 503568 - protein, 9 aa, Homo Sapiens
NSVDQNMFR

SEQ ID NO: 503569 - protein, 9 aa, Homo Sapiens
KNRTALHLA

SEQ ID NO: 503570 - protein, 9 aa, Homo Sapiens
FTETESNYC

SEQ ID NO: 503571 - protein, 9 aa, Homo Sapiens
LNARTSILE

SEQ ID NO: 503572 - protein, 9 aa, Homo Sapiens
LARGGIGMA

SEQ ID NO: 503573 - protein, 9 aa, Homo Sapiens
LVSNLMSTK

SEQ ID NO: 503574 - protein, 9 aa, Homo Sapiens
SESETYTLF

SEQ ID NO: 503575 - protein, 9 aa, Homo Sapiens
APEPTDPER

SEQ ID NO: 503576 - protein, 9 aa, Homo Sapiens
FVNKHCHQQ

SEQ ID NO: 503577 - protein, 9 aa, Homo Sapiens
SGRIQYVNH

SEQ ID NO: 503578 - protein, 9 aa, Homo Sapiens
PSYPGANPN

SEQ ID NO: 503579 - protein, 9 aa, Homo Sapiens
LRMVDRLPD

SEQ ID NO: 503580 - protein, 9 aa, Homo Sapiens
PDGCLDADA

SEQ ID NO: 503581 - protein, 9 aa, Homo Sapiens
VLQLGDVID

SEQ ID NO: 503582 - protein, 9 aa, Homo Sapiens
NKASMSPGL

SEQ ID NO: 503583 - protein, 9 aa, Homo Sapiens
GFWGSGIGT

SEQ ID NO: 503584 - protein, 9 aa, Homo Sapiens
EWVPELKGC

SEQ ID NO: 503585 - protein, 9 aa, Homo Sapiens
LGLGLALAL

SEQ ID NO: 503586 - protein, 9 aa, Homo Sapiens
SKTDSFSKV

SEQ ID NO: 503587 - protein, 9 aa, Homo Sapiens
SANQGFEAV

SEQ ID NO: 503588 - protein, 9 aa, Homo Sapiens
KSRSQFSSR

SEQ ID NO: 503589 - protein, 9 aa, Homo Sapiens
THIYIHTHT

SEQ ID NO: 503590 - protein, 9 aa, Homo Sapiens
RPRPVQNLA

SEQ ID NO: 503591 - protein, 9 aa, Homo Sapiens
WMKAPISLS

SEQ ID NO: 503592 - protein, 9 aa, Homo Sapiens
HHHGRSRYH

SEQ ID NO: 503593 - protein, 9 aa, Homo Sapiens
GGIGMASID

SEQ ID NO: 503594 - protein, 9 aa, Homo Sapiens
QVIFSELVI

SEQ ID NO: 503595 - protein, 9 aa, Homo Sapiens
LALAALGMG

SEQ ID NO: 503596 - protein, 9 aa, Homo Sapiens
TSGCSKDSL

SEQ ID NO: 503597 - protein, 9 aa, Homo Sapiens
NPQHFDRAT

SEQ ID NO: 503598 - protein, 9 aa, Homo Sapiens
PNRKWVVFD

SEQ ID NO: 503599 - protein, 9 aa, Homo Sapiens
KKEAPLAKV

SEQ ID NO: 503600 - protein, 9 aa, Homo Sapiens
ERPKGKVTK

SEQ ID NO: 503601 - protein, 9 aa, Homo Sapiens
SGYPLDLNH

SEQ ID NO: 503602 - protein, 9 aa, Homo Sapiens
TFDYEMNFR

SEQ ID NO: 503603 - protein, 9 aa, Homo Sapiens
RGSQYGGTG

SEQ ID NO: 503604 - protein, 9 aa, Homo Sapiens
TFGDCGVLE

SEQ ID NO: 503605 - protein, 9 aa, Homo Sapiens
GVVGVKIPR

SEQ ID NO: 503606 - protein, 9 aa, Homo Sapiens
DLRSKIGKW

SEQ ID NO: 503607 - protein, 9 aa, Homo Sapiens
TAACRPRWP

SEQ ID NO: 503608 - protein, 9 aa, Homo Sapiens
VDEMRNYIS

SEQ ID NO: 503609 - protein, 9 aa, Homo Sapiens
NLSSALRQS

SEQ ID NO: 503610 - protein, 9 aa, Homo Sapiens
AKCPPHRST

SEQ ID NO: 503611 - protein, 9 aa, Homo Sapiens
GPGLSGHGE

SEQ ID NO: 503612 - protein, 9 aa, Homo Sapiens
IIARIHING

SEQ ID NO: 503613 - protein, 9 aa, Homo Sapiens
VAQQAVLLG

SEQ ID NO: 503614 - protein, 9 aa, Homo Sapiens
LDRKRRERE

SEQ ID NO: 503615 - protein, 9 aa, Homo Sapiens
GAPSAPAAR

SEQ ID NO: 503616 - protein, 9 aa, Homo Sapiens
LQKFGGGLR

SEQ ID NO: 503617 - protein, 9 aa, Homo Sapiens
ISSFLHMNG

SEQ ID NO: 503618 - protein, 9 aa, Homo Sapiens
AEIGSNMND

SEQ ID NO: 503619 - protein, 9 aa, Homo Sapiens
PLESVRQIY

SEQ ID NO: 503620 - protein, 9 aa, Homo Sapiens
SGFLRPSGD

SEQ ID NO: 503621 - protein, 9 aa, Homo Sapiens
KKPRLEDVS

SEQ ID NO: 503622 - protein, 9 aa, Homo Sapiens
FAGVVGVKI

SEQ ID NO: 503623 - protein, 9 aa, Homo Sapiens
RPPSPPASP

SEQ ID NO: 503624 - protein, 9 aa, Homo Sapiens
DYNLSSALR

SEQ ID NO: 503625 - protein, 9 aa, Homo Sapiens
SKKPQKPIT

SEQ ID NO: 503626 - protein, 9 aa, Homo Sapiens
PEPPKTRMH

SEQ ID NO: 503627 - protein, 9 aa, Homo Sapiens
RQLPPRPPS

SEQ ID NO: 503628 - protein, 9 aa, Homo Sapiens
FHLVAQAAL

SEQ ID NO: 503629 - protein, 9 aa, Homo Sapiens
SVRQIYSEH

SEQ ID NO: 503630 - protein, 9 aa, Homo Sapiens
SGSMALQKF

SEQ ID NO: 503631 - protein, 9 aa, Homo Sapiens
KDSPHHLQE

SEQ ID NO: 503632 - protein, 9 aa, Homo Sapiens
SEGREVTTA

SEQ ID NO: 503633 - protein, 9 aa, Homo Sapiens
SGESLTLQC

SEQ ID NO: 503634 - protein, 9 aa, Homo Sapiens
GVIANLLQG

SEQ ID NO: 503635 - protein, 9 aa, Homo Sapiens
DSHEIQIYE

SEQ ID NO: 503636 - protein, 9 aa, Homo Sapiens
PGEARAPLE

SEQ ID NO: 503637 - protein, 9 aa, Homo Sapiens
RAPLESVRQ

SEQ ID NO: 503638 - protein, 9 aa, Homo Sapiens
PAVVDTAVI

SEQ ID NO: 503639 - protein, 9 aa, Homo Sapiens
GLIEIIKIN

SEQ ID NO: 503640 - protein, 9 aa, Homo Sapiens
GLAAAPRGP

SEQ ID NO: 503641 - protein, 9 aa, Homo Sapiens
SYQVDEMRN

SEQ ID NO: 503642 - protein, 9 aa, Homo Sapiens
ETEGSSATG

SEQ ID NO: 503643 - protein, 9 aa, Homo Sapiens
PADDMEGPK

SEQ ID NO: 503644 - protein, 9 aa, Homo Sapiens
SQTLKPVLC

SEQ ID NO: 503645 - protein, 9 aa, Homo Sapiens
ASQTPGTDK

SEQ ID NO: 503646 - protein, 9 aa, Homo Sapiens
RHGGVAQQA

SEQ ID NO: 503647 - protein, 9 aa, Homo Sapiens
AAAVVMVVR

SEQ ID NO: 503648 - protein, 9 aa, Homo Sapiens
PPHRSTQED

SEQ ID NO: 503649 - protein, 9 aa, Homo Sapiens
RCAAPPRSA

SEQ ID NO: 503650 - protein, 9 aa, Homo Sapiens
NIGLIEIIK

SEQ ID NO: 503651 - protein, 9 aa, Homo Sapiens
PQKPITRPG

SEQ ID NO: 503652 - protein, 9 aa, Homo Sapiens
EFTEEEKKT

SEQ ID NO: 503653 - protein, 9 aa, Homo Sapiens
DLEILKSLC

SEQ ID NO: 503654 - protein, 9 aa, Homo Sapiens
VQKCSEVNH

SEQ ID NO: 503655 - protein, 9 aa, Homo Sapiens
CFVSDNSLN

SEQ ID NO: 503656 - protein, 9 aa, Homo Sapiens
APGSSPPRS

SEQ ID NO: 503657 - protein, 9 aa, Homo Sapiens
DYLNGSIFQ

SEQ ID NO: 503658 - protein, 9 aa, Homo Sapiens
GFELTHKND

SEQ ID NO: 503659 - protein, 9 aa, Homo Sapiens
QQHPQDMVL

SEQ ID NO: 503660 - protein, 9 aa, Homo Sapiens
RRLQVTTKI

SEQ ID NO: 503661 - protein, 9 aa, Homo Sapiens
DFFKLEWDM

SEQ ID NO: 503662 - protein, 9 aa, Homo Sapiens
LKRADAGNG

SEQ ID NO: 503663 - protein, 9 aa, Homo Sapiens
LSRYGFGLT

SEQ ID NO: 503664 - protein, 9 aa, Homo Sapiens
VVSKTGALE

SEQ ID NO: 503665 - protein, 9 aa, Homo Sapiens
IERRPPLPS

SEQ ID NO: 503666 - protein, 9 aa, Homo Sapiens
FIPVLPAPS

SEQ ID NO: 503667 - protein, 9 aa, Homo Sapiens
AGEGIGDEI

SEQ ID NO: 503668 - protein, 9 aa, Homo Sapiens
IAELNNINI

SEQ ID NO: 503669 - protein, 9 aa, Homo Sapiens
FCLESDLTI

SEQ ID NO: 503670 - protein, 9 aa, Homo Sapiens
SKGVFGAGP

SEQ ID NO: 503671 - protein, 9 aa, Homo Sapiens
PQLRGLLGW

SEQ ID NO: 503672 - protein, 9 aa, Homo Sapiens
RTVQELIKC

SEQ ID NO: 503673 - protein, 9 aa, Homo Sapiens
PPPAPRQLP

SEQ ID NO: 503674 - protein, 9 aa, Homo Sapiens
RTASRPGPS

SEQ ID NO: 503675 - protein, 9 aa, Homo Sapiens
ANGLAAAPR

SEQ ID NO: 503676 - protein, 9 aa, Homo Sapiens
RGSSGFLRP

SEQ ID NO: 503677 - protein, 9 aa, Homo Sapiens
GVRAGEGIG

SEQ ID NO: 503678 - protein, 9 aa, Homo Sapiens
RRPGHDGQR

SEQ ID NO: 503679 - protein, 9 aa, Homo Sapiens
SWGCWATTG

SEQ ID NO: 503680 - protein, 9 aa, Homo Sapiens
ADDMEGPKQ

SEQ ID NO: 503681 - protein, 9 aa, Homo Sapiens
GFNWKLNFH

SEQ ID NO: 503682 - protein, 9 aa, Homo Sapiens
ILAEGRLSG

SEQ ID NO: 503683 - protein, 9 aa, Homo Sapiens
PRLEDVSPF

SEQ ID NO: 503684 - protein, 9 aa, Homo Sapiens
MRRKDSPHH

SEQ ID NO: 503685 - protein, 9 aa, Homo Sapiens
HPAVVDTAV

SEQ ID NO: 503686 - protein, 9 aa, Homo Sapiens
LMKHPAVVD

SEQ ID NO: 503687 - protein, 9 aa, Homo Sapiens
NLLQGDGCH

SEQ ID NO: 503688 - protein, 9 aa, Homo Sapiens
STKVGDKGI

SEQ ID NO: 503689 - protein, 9 aa, Homo Sapiens
VDTSSVSSG

SEQ ID NO: 503690 - protein, 9 aa, Homo Sapiens
QEVQQRQQH

SEQ ID NO: 503691 - protein, 9 aa, Homo Sapiens
KHPAVVDTA

SEQ ID NO: 503692 - protein, 9 aa, Homo Sapiens
GEGHTRWHQ

SEQ ID NO: 503693 - protein, 9 aa, Homo Sapiens
SYVVSRPQL

SEQ ID NO: 503694 - protein, 9 aa, Homo Sapiens
GFESLKRAD

SEQ ID NO: 503695 - protein, 9 aa, Homo Sapiens
AEFDSHEIQ

SEQ ID NO: 503696 - protein, 9 aa, Homo Sapiens
IKSANNLPG

SEQ ID NO: 503697 - protein, 9 aa, Homo Sapiens
WHQPGRPGK

SEQ ID NO: 503698 - protein, 9 aa, Homo Sapiens
WGNSGCRCP

SEQ ID NO: 503699 - protein, 9 aa, Homo Sapiens
QIGFESLKR

SEQ ID NO: 503700 - protein, 9 aa, Homo Sapiens
MCNTRFSDA

SEQ ID NO: 503701 - protein, 9 aa, Homo Sapiens
PQLPRQQHP

SEQ ID NO: 503702 - protein, 9 aa, Homo Sapiens
NHPGWLKVS

SEQ ID NO: 503703 - protein, 9 aa, Homo Sapiens
APPRSAAAA

SEQ ID NO: 503704 - protein, 9 aa, Homo Sapiens
ASRGHPETP

SEQ ID NO: 503705 - protein, 9 aa, Homo Sapiens
IHINGENSE

SEQ ID NO: 503706 - protein, 9 aa, Homo Sapiens
VISYIMALH

SEQ ID NO: 503707 - protein, 9 aa, Homo Sapiens
NMFPQLDNE

SEQ ID NO: 503708 - protein, 9 aa, Homo Sapiens
AADCAQSWR

SEQ ID NO: 503709 - protein, 9 aa, Homo Sapiens
SFARRTASR

SEQ ID NO: 503710 - protein, 9 aa, Homo Sapiens
GGSSCCSQS

SEQ ID NO: 503711 - protein, 9 aa, Homo Sapiens
NPDQIQVGH

SEQ ID NO: 503712 - protein, 9 aa, Homo Sapiens
SHSLAWNFV

SEQ ID NO: 503713 - protein, 9 aa, Homo Sapiens
GPPRPARWG

SEQ ID NO: 503714 - protein, 9 aa, Homo Sapiens
GCWATTGAN

SEQ ID NO: 503715 - protein, 9 aa, Homo Sapiens
RMHSLRPEP

SEQ ID NO: 503716 - protein, 9 aa, Homo Sapiens
RHPRPAKTP

SEQ ID NO: 503717 - protein, 9 aa, Homo Sapiens
QHGQVSYIS

SEQ ID NO: 503718 - protein, 9 aa, Homo Sapiens
LIIFLAEVA

SEQ ID NO: 503719 - protein, 9 aa, Homo Sapiens
GLWFTVDPG

SEQ ID NO: 503720 - protein, 9 aa, Homo Sapiens
SRSGQAQHG

SEQ ID NO: 503721 - protein, 9 aa, Homo Sapiens
GPSTSRSGS

SEQ ID NO: 503722 - protein, 9 aa, Homo Sapiens
NNINIFWLT

SEQ ID NO: 503723 - protein, 9 aa, Homo Sapiens
ETGFHLVAQ

SEQ ID NO: 503724 - protein, 9 aa, Homo Sapiens
VEDTSTDSI

SEQ ID NO: 503725 - protein, 9 aa, Homo Sapiens
SLAWNFVLQ

SEQ ID NO: 503726 - protein, 9 aa, Homo Sapiens
MAVWCAHVE

SEQ ID NO: 503727 - protein, 9 aa, Homo Sapiens
VKGPLLFPK

SEQ ID NO: 503728 - protein, 9 aa, Homo Sapiens
LIWCLIIFL

SEQ ID NO: 503729 - protein, 9 aa, Homo Sapiens
RVEVAAGPP

SEQ ID NO: 503730 - protein, 9 aa, Homo Sapiens
MKHPAVVDT

SEQ ID NO: 503731 - protein, 9 aa, Homo Sapiens
DAFFVFQLS

SEQ ID NO: 503732 - protein, 9 aa, Homo Sapiens
WPSSRCAAP

SEQ ID NO: 503733 - protein, 9 aa, Homo Sapiens
SSKGTIHLC

SEQ ID NO: 503734 - protein, 9 aa, Homo Sapiens
VLGLQVDPA

SEQ ID NO: 503735 - protein, 9 aa, Homo Sapiens
RISSFLHMN

SEQ ID NO: 503736 - protein, 9 aa, Homo Sapiens
GHPETPRGP

SEQ ID NO: 503737 - protein, 9 aa, Homo Sapiens
QKVKQSFDL

SEQ ID NO: 503738 - protein, 9 aa, Homo Sapiens
PFDLRSKIG

SEQ ID NO: 503739 - protein, 9 aa, Homo Sapiens
MHLSLVEFH

SEQ ID NO: 503740 - protein, 9 aa, Homo Sapiens
SQSCNESSY

SEQ ID NO: 503741 - protein, 9 aa, Homo Sapiens
RPGPSTSRS

SEQ ID NO: 503742 - protein, 9 aa, Homo Sapiens
GSSPLRTGA

SEQ ID NO: 503743 - protein, 9 aa, Homo Sapiens
LRPSGDMLK

SEQ ID NO: 503744 - protein, 9 aa, Homo Sapiens
VVSCLPVLE

SEQ ID NO: 503745 - protein, 9 aa, Homo Sapiens
QRVLALCYV

SEQ ID NO: 503746 - protein, 9 aa, Homo Sapiens
LIVLVISYI

SEQ ID NO: 503747 - protein, 9 aa, Homo Sapiens
NNAAADLRK

SEQ ID NO: 503748 - protein, 9 aa, Homo Sapiens
SPCAMERVL

SEQ ID NO: 503749 - protein, 9 aa, Homo Sapiens
AMRRKDSPH

SEQ ID NO: 503750 - protein, 9 aa, Homo Sapiens
AMEGHLMIA

SEQ ID NO: 503751 - protein, 9 aa, Homo Sapiens
PFPSAKCHL

SEQ ID NO: 503752 - protein, 9 aa, Homo Sapiens
PHHLQEKCL

SEQ ID NO: 503753 - protein, 9 aa, Homo Sapiens
GNSGCRCPR

SEQ ID NO: 503754 - protein, 9 aa, Homo Sapiens
ECRVRSVDV

SEQ ID NO: 503755 - protein, 9 aa, Homo Sapiens
TIKGTADFF

SEQ ID NO: 503756 - protein, 9 aa, Homo Sapiens
EVNHMNAHN

SEQ ID NO: 503757 - protein, 9 aa, Homo Sapiens
MEDHLYIIG

SEQ ID NO: 503758 - protein, 9 aa, Homo Sapiens
SLKRADAGN

SEQ ID NO: 503759 - protein, 9 aa, Homo Sapiens
KVSPLTRYA

SEQ ID NO: 503760 - protein, 9 aa, Homo Sapiens
IERYQEVEE

SEQ ID NO: 503761 - protein, 9 aa, Homo Sapiens
RTARPLRPR

SEQ ID NO: 503762 - protein, 9 aa, Homo Sapiens
FVTQLKVFT

SEQ ID NO: 503763 - protein, 9 aa, Homo Sapiens
ARWGNSGCR

SEQ ID NO: 503764 - protein, 9 aa, Homo Sapiens
FMDANQSFK

SEQ ID NO: 503765 - protein, 9 aa, Homo Sapiens
LPANQTPPR

SEQ ID NO: 503766 - protein, 9 aa, Homo Sapiens
LMGHGVCIG

SEQ ID NO: 503767 - protein, 9 aa, Homo Sapiens
EEKKTIKGT

SEQ ID NO: 503768 - protein, 9 aa, Homo Sapiens
TPTRRPAAP

SEQ ID NO: 503769 - protein, 9 aa, Homo Sapiens
FADSYSENS

SEQ ID NO: 503770 - protein, 9 aa, Homo Sapiens
PTSHQKAQI

SEQ ID NO: 503771 - protein, 9 aa, Homo Sapiens
PPMREVAEA

SEQ ID NO: 503772 - protein, 9 aa, Homo Sapiens
RLQVTTKIL

SEQ ID NO: 503773 - protein, 9 aa, Homo Sapiens
GIQLSGGQK

SEQ ID NO: 503774 - protein, 9 aa, Homo Sapiens
VYMDRGLGY

SEQ ID NO: 503775 - protein, 9 aa, Homo Sapiens
KPLFSLEFC

SEQ ID NO: 503776 - protein, 9 aa, Homo Sapiens
KCSEVNHMN

SEQ ID NO: 503777 - protein, 9 aa, Homo Sapiens
SMALQKFGG

SEQ ID NO: 503778 - protein, 9 aa, Homo Sapiens
NYVFWTDYL

SEQ ID NO: 503779 - protein, 9 aa, Homo Sapiens
RSPCAMERV

SEQ ID NO: 503780 - protein, 9 aa, Homo Sapiens
NFHVSNHPG

SEQ ID NO: 503781 - protein, 9 aa, Homo Sapiens
CNTRFSDAI

SEQ ID NO: 503782 - protein, 9 aa, Homo Sapiens
ARPCPPTAA

SEQ ID NO: 503783 - protein, 9 aa, Homo Sapiens
LNGSIFQLD

SEQ ID NO: 503784 - protein, 9 aa, Homo Sapiens
HLMIAFLPT

SEQ ID NO: 503785 - protein, 9 aa, Homo Sapiens
HFQERVDKV

SEQ ID NO: 503786 - protein, 9 aa, Homo Sapiens
PRQLPPRPP

SEQ ID NO: 503787 - protein, 9 aa, Homo Sapiens
SHSPLKRSP

SEQ ID NO: 503788 - protein, 9 aa, Homo Sapiens
PPGRSASAR

SEQ ID NO: 503789 - protein, 9 aa, Homo Sapiens
AVENYVKDS

SEQ ID NO: 503790 - protein, 9 aa, Homo Sapiens
KKYHFQERV

SEQ ID NO: 503791 - protein, 9 aa, Homo Sapiens
QNSSVTSCL

SEQ ID NO: 503792 - protein, 9 aa, Homo Sapiens
AWNFVLQER

SEQ ID NO: 503793 - protein, 9 aa, Homo Sapiens
ANLLQGDGC

SEQ ID NO: 503794 - protein, 9 aa, Homo Sapiens
FGAGPGLSG

SEQ ID NO: 503795 - protein, 9 aa, Homo Sapiens
TVDDFLPFD

SEQ ID NO: 503796 - protein, 9 aa, Homo Sapiens
HRSLRTPPP

SEQ ID NO: 503797 - protein, 9 aa, Homo Sapiens
MCAVESYPK

SEQ ID NO: 503798 - protein, 9 aa, Homo Sapiens
LFFIYAALV

SEQ ID NO: 503799 - protein, 9 aa, Homo Sapiens
QASGEGPCP

SEQ ID NO: 503800 - protein, 9 aa, Homo Sapiens
FLRPSGDML

SEQ ID NO: 503801 - protein, 9 aa, Homo Sapiens
LAPGPSQTL

SEQ ID NO: 503802 - protein, 9 aa, Homo Sapiens
RALDKVTSV

SEQ ID NO: 503803 - protein, 9 aa, Homo Sapiens
NFTVEDTST

SEQ ID NO: 503804 - protein, 9 aa, Homo Sapiens
SVSTPNLLQ

SEQ ID NO: 503805 - protein, 9 aa, Homo Sapiens
SAFLVTEVS

SEQ ID NO: 503806 - protein, 9 aa, Homo Sapiens
QSWRHPGPA

SEQ ID NO: 503807 - protein, 9 aa, Homo Sapiens
PAPAHRHVR

SEQ ID NO: 503808 - protein, 9 aa, Homo Sapiens
TISGKTPKQ

SEQ ID NO: 503809 - protein, 9 aa, Homo Sapiens
TARPLRPRP

SEQ ID NO: 503810 - protein, 9 aa, Homo Sapiens
YETEGSSAT

SEQ ID NO: 503811 - protein, 9 aa, Homo Sapiens
SALRQSVLQ

SEQ ID NO: 503812 - protein, 9 aa, Homo Sapiens
FTVDPGADA

SEQ ID NO: 503813 - protein, 9 aa, Homo Sapiens
TSITVFHGT

SEQ ID NO: 503814 - protein, 9 aa, Homo Sapiens
EGVRTVQEL

SEQ ID NO: 503815 - protein, 9 aa, Homo Sapiens
PSGDMLKGT

SEQ ID NO: 503816 - protein, 9 aa, Homo Sapiens
TVKLKELLL

SEQ ID NO: 503817 - protein, 9 aa, Homo Sapiens
RNNQLRRLQ

SEQ ID NO: 503818 - protein, 9 aa, Homo Sapiens
RKSGEPPKR

SEQ ID NO: 503819 - protein, 9 aa, Homo Sapiens
ARSPTRTRR

SEQ ID NO: 503820 - protein, 9 aa, Homo Sapiens
HICQHLPQL

SEQ ID NO: 503821 - protein, 9 aa, Homo Sapiens
DKGIQLSGG

SEQ ID NO: 503822 - protein, 9 aa, Homo Sapiens
LLDNRGVMT

SEQ ID NO: 503823 - protein, 9 aa, Homo Sapiens
ENSQFCFCG

SEQ ID NO: 503824 - protein, 9 aa, Homo Sapiens
KCPPHRSTQ

SEQ ID NO: 503825 - protein, 9 aa, Homo Sapiens
QLRGLLGWG

SEQ ID NO: 503826 - protein, 9 aa, Homo Sapiens
SKGTIHLCD

SEQ ID NO: 503827 - protein, 9 aa, Homo Sapiens
VPPTGDSGG

SEQ ID NO: 503828 - protein, 9 aa, Homo Sapiens
GMERSPCAM

SEQ ID NO: 503829 - protein, 9 aa, Homo Sapiens
KSHSLAWNF

SEQ ID NO: 503830 - protein, 9 aa, Homo Sapiens
AKTPTRRPA

SEQ ID NO: 503831 - protein, 9 aa, Homo Sapiens
FDSHEIQIY

SEQ ID NO: 503832 - protein, 9 aa, Homo Sapiens
SLTLTTLDG

SEQ ID NO: 503833 - protein, 9 aa, Homo Sapiens
VFWTDYLNG

SEQ ID NO: 503834 - protein, 9 aa, Homo Sapiens
EDHLYIIGS

SEQ ID NO: 503835 - protein, 9 aa, Homo Sapiens
GPKQAICAR

SEQ ID NO: 503836 - protein, 9 aa, Homo Sapiens
FINEKKYHF

SEQ ID NO: 503837 - protein, 9 aa, Homo Sapiens
GHDGQRPSG

SEQ ID NO: 503838 - protein, 9 aa, Homo Sapiens
DSLIVYLVV

SEQ ID NO: 503839 - protein, 9 aa, Homo Sapiens
VCIGLMAAA

SEQ ID NO: 503840 - protein, 9 aa, Homo Sapiens
TEGVFDNLS

SEQ ID NO: 503841 - protein, 9 aa, Homo Sapiens
GVGLAPGPS

SEQ ID NO: 503842 - protein, 9 aa, Homo Sapiens
FLKHKAVNN

SEQ ID NO: 503843 - protein, 9 aa, Homo Sapiens
RWHQPGRPG

SEQ ID NO: 503844 - protein, 9 aa, Homo Sapiens
VDRFNWELW

SEQ ID NO: 503845 - protein, 9 aa, Homo Sapiens
TMAVWCAHV

SEQ ID NO: 503846 - protein, 9 aa, Homo Sapiens
MALQKFGGG

SEQ ID NO: 503847 - protein, 9 aa, Homo Sapiens
EMNLKPKEV

SEQ ID NO: 503848 - protein, 9 aa, Homo Sapiens
ADEDERDEH

SEQ ID NO: 503849 - protein, 9 aa, Homo Sapiens
LSPGEARAP

SEQ ID NO: 503850 - protein, 9 aa, Homo Sapiens
LSLVEFHLK

SEQ ID NO: 503851 - protein, 9 aa, Homo Sapiens
EFNPEHFMD

SEQ ID NO: 503852 - protein, 9 aa, Homo Sapiens
KYSSNITTH

SEQ ID NO: 503853 - protein, 9 aa, Homo Sapiens
QIAPKSPPR

SEQ ID NO: 503854 - protein, 9 aa, Homo Sapiens
PRTARPSAA

SEQ ID NO: 503855 - protein, 9 aa, Homo Sapiens
PGPSTSRSG

SEQ ID NO: 503856 - protein, 9 aa, Homo Sapiens
GDGCHSDDQ

SEQ ID NO: 503857 - protein, 9 aa, Homo Sapiens
RCPPPATAT

SEQ ID NO: 503858 - protein, 9 aa, Homo Sapiens
ETPRGPRPG

SEQ ID NO: 503859 - protein, 9 aa, Homo Sapiens
WLKVSPLTR

SEQ ID NO: 503860 - protein, 9 aa, Homo Sapiens
RMLTEGVFD

SEQ ID NO: 503861 - protein, 9 aa, Homo Sapiens
SLDIIARIH

SEQ ID NO: 503862 - protein, 9 aa, Homo Sapiens
AGVGLAPGP

SEQ ID NO: 503863 - protein, 9 aa, Homo Sapiens
AISVTRIGV

SEQ ID NO: 503864 - protein, 9 aa, Homo Sapiens
SARPGAPGR

SEQ ID NO: 503865 - protein, 9 aa, Homo Sapiens
AGVVGVKIP

SEQ ID NO: 503866 - protein, 9 aa, Homo Sapiens
DRINAQKQW

SEQ ID NO: 503867 - protein, 9 aa, Homo Sapiens
GSQQNFVRM

SEQ ID NO: 503868 - protein, 9 aa, Homo Sapiens
DPAPAHRHV

SEQ ID NO: 503869 - protein, 9 aa, Homo Sapiens
SAAPGPRRH

SEQ ID NO: 503870 - protein, 9 aa, Homo Sapiens
QWEPVCANN

SEQ ID NO: 503871 - protein, 9 aa, Homo Sapiens
GPGGIQTMA

SEQ ID NO: 503872 - protein, 9 aa, Homo Sapiens
DDMEGPKQA

SEQ ID NO: 503873 - protein, 9 aa, Homo Sapiens
HAGTFGDCG

SEQ ID NO: 503874 - protein, 9 aa, Homo Sapiens
SPKSRPSGF

SEQ ID NO: 503875 - protein, 9 aa, Homo Sapiens
EIQQAWIVQ

SEQ ID NO: 503876 - protein, 9 aa, Homo Sapiens
PPASPRTAR

SEQ ID NO: 503877 - protein, 9 aa, Homo Sapiens
LFPLDRVPG

SEQ ID NO: 503878 - protein, 9 aa, Homo Sapiens
LGSSPLRTG

SEQ ID NO: 503879 - protein, 9 aa, Homo Sapiens
VLCRSEGRE

SEQ ID NO: 503880 - protein, 9 aa, Homo Sapiens
FQRVLALCY

SEQ ID NO: 503881 - protein, 9 aa, Homo Sapiens
RALQDLQVE

SEQ ID NO: 503882 - protein, 9 aa, Homo Sapiens
FSVSTPNLL

SEQ ID NO: 503883 - protein, 9 aa, Homo Sapiens
GSSPPRSPP

SEQ ID NO: 503884 - protein, 9 aa, Homo Sapiens
WKLNFHWYP

SEQ ID NO: 503885 - protein, 9 aa, Homo Sapiens
FVLIWCLII

SEQ ID NO: 503886 - protein, 9 aa, Homo Sapiens
GNIGLIEII

SEQ ID NO: 503887 - protein, 9 aa, Homo Sapiens
PRQQHPQDM

SEQ ID NO: 503888 - protein, 9 aa, Homo Sapiens
VLIWCLIIF

SEQ ID NO: 503889 - protein, 9 aa, Homo Sapiens
PPLCMLPPG

SEQ ID NO: 503890 - protein, 9 aa, Homo Sapiens
HQLLVRHGG

SEQ ID NO: 503891 - protein, 9 aa, Homo Sapiens
HHLQEKCLL

SEQ ID NO: 503892 - protein, 9 aa, Homo Sapiens
AARSPTRTR

SEQ ID NO: 503893 - protein, 9 aa, Homo Sapiens
VVRPVATLS

SEQ ID NO: 503894 - protein, 9 aa, Homo Sapiens
LVVSCLPVL

SEQ ID NO: 503895 - protein, 9 aa, Homo Sapiens
LPPRPPSPP

SEQ ID NO: 503896 - protein, 9 aa, Homo Sapiens
AQHLAEIGS

SEQ ID NO: 503897 - protein, 9 aa, Homo Sapiens
LLRNNQLRR

SEQ ID NO: 503898 - protein, 9 aa, Homo Sapiens
LLVRHGGVA

SEQ ID NO: 503899 - protein, 9 aa, Homo Sapiens
QLKVFTPKS

SEQ ID NO: 503900 - protein, 9 aa, Homo Sapiens
ELTHKNDCL

SEQ ID NO: 503901 - protein, 9 aa, Homo Sapiens
RLYMEQGSP

SEQ ID NO: 503902 - protein, 9 aa, Homo Sapiens
NMDEIERYQ

SEQ ID NO: 503903 - protein, 9 aa, Homo Sapiens
YEVPSIVPP

SEQ ID NO: 503904 - protein, 9 aa, Homo Sapiens
VPGAPGGGQ

SEQ ID NO: 503905 - protein, 9 aa, Homo Sapiens
GPPMREVAE

SEQ ID NO: 503906 - protein, 9 aa, Homo Sapiens
FKYSSNITT

SEQ ID NO: 503907 - protein, 9 aa, Homo Sapiens
EQNSSVTSC

SEQ ID NO: 503908 - protein, 9 aa, Homo Sapiens
GRCCNRPCG

SEQ ID NO: 503909 - protein, 9 aa, Homo Sapiens
VFHGTILFL

SEQ ID NO: 503910 - protein, 9 aa, Homo Sapiens
FMEYIEGRE

SEQ ID NO: 503911 - protein, 9 aa, Homo Sapiens
QSLGSSPLR

SEQ ID NO: 503912 - protein, 9 aa, Homo Sapiens
EYGDIIVTL

SEQ ID NO: 503913 - protein, 9 aa, Homo Sapiens
TTRGRRKSG

SEQ ID NO: 503914 - protein, 9 aa, Homo Sapiens
APSAPAARS

SEQ ID NO: 503915 - protein, 9 aa, Homo Sapiens
FRLLSQASW

SEQ ID NO: 503916 - protein, 9 aa, Homo Sapiens
YHIRFISEL

SEQ ID NO: 503917 - protein, 9 aa, Homo Sapiens
PSSRCAAPP

SEQ ID NO: 503918 - protein, 9 aa, Homo Sapiens
MEYIEGREL

SEQ ID NO: 503919 - protein, 9 aa, Homo Sapiens
RPCPPTAAC

SEQ ID NO: 503920 - protein, 9 aa, Homo Sapiens
LALLLSFQL

SEQ ID NO: 503921 - protein, 9 aa, Homo Sapiens
IAEGVRTVQ

SEQ ID NO: 503922 - protein, 9 aa, Homo Sapiens
HLAEIGSNM

SEQ ID NO: 503923 - protein, 9 aa, Homo Sapiens
SSASQHGQD

SEQ ID NO: 503924 - protein, 9 aa, Homo Sapiens
YPKPEISWT

SEQ ID NO: 503925 - protein, 9 aa, Homo Sapiens
ITVFHGTIL

SEQ ID NO: 503926 - protein, 9 aa, Homo Sapiens
KCLLRNNQL

SEQ ID NO: 503927 - protein, 9 aa, Homo Sapiens
LFADSYSEN

SEQ ID NO: 503928 - protein, 9 aa, Homo Sapiens
LEFCSPGET

SEQ ID NO: 503929 - protein, 9 aa, Homo Sapiens
AGEGHTRWH

SEQ ID NO: 503930 - protein, 9 aa, Homo Sapiens
WTDYLNGSI

SEQ ID NO: 503931 - protein, 9 aa, Homo Sapiens
VRTVQELIK

SEQ ID NO: 503932 - protein, 9 aa, Homo Sapiens
FKLEWDMKI

SEQ ID NO: 503933 - protein, 9 aa, Homo Sapiens
RLEDVSPFV

SEQ ID NO: 503934 - protein, 9 aa, Homo Sapiens
RTPPGRSAS

SEQ ID NO: 503935 - protein, 9 aa, Homo Sapiens
AQAQADSLI

SEQ ID NO: 503936 - protein, 9 aa, Homo Sapiens
LKDKDENVK

SEQ ID NO: 503937 - protein, 9 aa, Homo Sapiens
HFTKDLEIL

SEQ ID NO: 503938 - protein, 9 aa, Homo Sapiens
HSLAWNFVL

SEQ ID NO: 503939 - protein, 9 aa, Homo Sapiens
SRCAAPPRS

SEQ ID NO: 503940 - protein, 9 aa, Homo Sapiens
DQRDPPADD

SEQ ID NO: 503941 - protein, 9 aa, Homo Sapiens
CSPGETEDK

SEQ ID NO: 503942 - protein, 9 aa, Homo Sapiens
SLHAMEGHL

SEQ ID NO: 503943 - protein, 9 aa, Homo Sapiens
TIHLCDMRS

SEQ ID NO: 503944 - protein, 9 aa, Homo Sapiens
ISGKTPKQY

SEQ ID NO: 503945 - protein, 9 aa, Homo Sapiens
KYILFGNMA

SEQ ID NO: 503946 - protein, 9 aa, Homo Sapiens
FFVFQLSQE

SEQ ID NO: 503947 - protein, 9 aa, Homo Sapiens
NRKLSMEDH

SEQ ID NO: 503948 - protein, 9 aa, Homo Sapiens
GLSGHGEPL

SEQ ID NO: 503949 - protein, 9 aa, Homo Sapiens
RWPSSRCAA

SEQ ID NO: 503950 - protein, 9 aa, Homo Sapiens
DERDEHQLL

SEQ ID NO: 503951 - protein, 9 aa, Homo Sapiens
QLDNEATRK

SEQ ID NO: 503952 - protein, 9 aa, Homo Sapiens
LRTPPPPPA

SEQ ID NO: 503953 - protein, 9 aa, Homo Sapiens
SCCWGRCCN

SEQ ID NO: 503954 - protein, 9 aa, Homo Sapiens
KARPWLMSA

SEQ ID NO: 503955 - protein, 9 aa, Homo Sapiens
PKTRMHSLR

SEQ ID NO: 503956 - protein, 9 aa, Homo Sapiens
PLKRSPKSR

SEQ ID NO: 503957 - protein, 9 aa, Homo Sapiens
WRHPGPAVV

SEQ ID NO: 503958 - protein, 9 aa, Homo Sapiens
INIFWLTCQ

SEQ ID NO: 503959 - protein, 9 aa, Homo Sapiens
KAQIAPKSP

SEQ ID NO: 503960 - protein, 9 aa, Homo Sapiens
RCCNRPCGA

SEQ ID NO: 503961 - protein, 9 aa, Homo Sapiens
VLPAPSLTM

SEQ ID NO: 503962 - protein, 9 aa, Homo Sapiens
GGVAQQAVL

SEQ ID NO: 503963 - protein, 9 aa, Homo Sapiens
GFHLVAQAA

SEQ ID NO: 503964 - protein, 9 aa, Homo Sapiens
PPRPARWGN

SEQ ID NO: 503965 - protein, 9 aa, Homo Sapiens
PFPPILVER

SEQ ID NO: 503966 - protein, 9 aa, Homo Sapiens
CMHLSLVEF

SEQ ID NO: 503967 - protein, 9 aa, Homo Sapiens
HLCDMRSSA

SEQ ID NO: 503968 - protein, 9 aa, Homo Sapiens
RPCGARCSW

SEQ ID NO: 503969 - protein, 9 aa, Homo Sapiens
VYSSWAPGE

SEQ ID NO: 503970 - protein, 9 aa, Homo Sapiens
SYSENSQFC

SEQ ID NO: 503971 - protein, 9 aa, Homo Sapiens
LIEIIKINP

SEQ ID NO: 503972 - protein, 9 aa, Homo Sapiens
SPLRTGAAS

SEQ ID NO: 503973 - protein, 9 aa, Homo Sapiens
TRNAEFDSH

SEQ ID NO: 503974 - protein, 9 aa, Homo Sapiens
RADAGNGIR

SEQ ID NO: 503975 - protein, 9 aa, Homo Sapiens
PQYCLKLLE

SEQ ID NO: 503976 - protein, 9 aa, Homo Sapiens
PPILVERPE

SEQ ID NO: 503977 - protein, 9 aa, Homo Sapiens
QEKCLLRNN

SEQ ID NO: 503978 - protein, 9 aa, Homo Sapiens
SSLKTSFAR

SEQ ID NO: 503979 - protein, 9 aa, Homo Sapiens
FVFQLSQEI

SEQ ID NO: 503980 - protein, 9 aa, Homo Sapiens
LHLVVSCLP

SEQ ID NO: 503981 - protein, 9 aa, Homo Sapiens
GLLEKLLDN

SEQ ID NO: 503982 - protein, 9 aa, Homo Sapiens
RQQHICQHL

SEQ ID NO: 503983 - protein, 9 aa, Homo Sapiens
KEVFLAQGT

SEQ ID NO: 503984 - protein, 9 aa, Homo Sapiens
RSASARPHR

SEQ ID NO: 503985 - protein, 9 aa, Homo Sapiens
KNDCLDIDE

SEQ ID NO: 503986 - protein, 9 aa, Homo Sapiens
NISVDTSSV

SEQ ID NO: 503987 - protein, 9 aa, Homo Sapiens
GKVFIPVLP

SEQ ID NO: 503988 - protein, 9 aa, Homo Sapiens
RKLSMEDHL

SEQ ID NO: 503989 - protein, 9 aa, Homo Sapiens
KGTIHLCDM

SEQ ID NO: 503990 - protein, 9 aa, Homo Sapiens
SRGHPETPR

SEQ ID NO: 503991 - protein, 9 aa, Homo Sapiens
CCWGRCCNR

SEQ ID NO: 503992 - protein, 9 aa, Homo Sapiens
GDKGIQLSG

SEQ ID NO: 503993 - protein, 9 aa, Homo Sapiens
RPAKTPTRR

SEQ ID NO: 503994 - protein, 9 aa, Homo Sapiens
LDNRGVMTD

SEQ ID NO: 503995 - protein, 9 aa, Homo Sapiens
KLNFHWYPV

SEQ ID NO: 503996 - protein, 9 aa, Homo Sapiens
VQASRISSF

SEQ ID NO: 503997 - protein, 9 aa, Homo Sapiens
QPGPMVASG

SEQ ID NO: 503998 - protein, 9 aa, Homo Sapiens
DNRGVMTDE

SEQ ID NO: 503999 - protein, 9 aa, Homo Sapiens
TQPEHDVPV

SEQ ID NO: 504000 - protein, 9 aa, Homo Sapiens
LSFQLREKI

SEQ ID NO: 504001 - protein, 9 aa, Homo Sapiens
PRGPRPGGP

SEQ ID NO: 504002 - protein, 9 aa, Homo Sapiens
FIYAALVVE

SEQ ID NO: 504003 - protein, 9 aa, Homo Sapiens
RQQHPQDMV

SEQ ID NO: 504004 - protein, 9 aa, Homo Sapiens
QYCLKLLEE

SEQ ID NO: 504005 - protein, 9 aa, Homo Sapiens
ASGESLTLQ

SEQ ID NO: 504006 - protein, 9 aa, Homo Sapiens
GVRTVQELI

SEQ ID NO: 504007 - protein, 9 aa, Homo Sapiens
LQDLQVEAD

SEQ ID NO: 504008 - protein, 9 aa, Homo Sapiens
SDYPQQNNA

SEQ ID NO: 504009 - protein, 9 aa, Homo Sapiens
ARRTASRPG

SEQ ID NO: 504010 - protein, 9 aa, Homo Sapiens
QAFFKLQKV

SEQ ID NO: 504011 - protein, 9 aa, Homo Sapiens
TEAFVIATL

SEQ ID NO: 504012 - protein, 9 aa, Homo Sapiens
VNISVDTSS

SEQ ID NO: 504013 - protein, 9 aa, Homo Sapiens
YNLSSALRQ

SEQ ID NO: 504014 - protein, 9 aa, Homo Sapiens
CNRPCGARC

SEQ ID NO: 504015 - protein, 9 aa, Homo Sapiens
VFCGDPGIL

SEQ ID NO: 504016 - protein, 9 aa, Homo Sapiens
EMRNYISNS

SEQ ID NO: 504017 - protein, 9 aa, Homo Sapiens
CLLRNNQLR

SEQ ID NO: 504018 - protein, 9 aa, Homo Sapiens
LGLQVDPAP

SEQ ID NO: 504019 - protein, 9 aa, Homo Sapiens
SPASRGHPE

SEQ ID NO: 504020 - protein, 9 aa, Homo Sapiens
TSLGHSKDK

SEQ ID NO: 504021 - protein, 9 aa, Homo Sapiens
KGIQLSGGQ

SEQ ID NO: 504022 - protein, 9 aa, Homo Sapiens
ATSSLKTSF

SEQ ID NO: 504023 - protein, 9 aa, Homo Sapiens
GVCIGLMAA

SEQ ID NO: 504024 - protein, 9 aa, Homo Sapiens
LVAQAALKL

SEQ ID NO: 504025 - protein, 9 aa, Homo Sapiens
ALGSQQNFV

SEQ ID NO: 504026 - protein, 9 aa, Homo Sapiens
CQPDIKSSS

SEQ ID NO: 504027 - protein, 9 aa, Homo Sapiens
ALVCRTNGL

SEQ ID NO: 504028 - protein, 9 aa, Homo Sapiens
MLPPGPEPP

SEQ ID NO: 504029 - protein, 9 aa, Homo Sapiens
GTIHLCDMR

SEQ ID NO: 504030 - protein, 9 aa, Homo Sapiens
SSSKGTIHL

SEQ ID NO: 504031 - protein, 9 aa, Homo Sapiens
FVIATLQNP

SEQ ID NO: 504032 - protein, 9 aa, Homo Sapiens
RSEGREVTT

SEQ ID NO: 504033 - protein, 9 aa, Homo Sapiens
KDLEILKSL

SEQ ID NO: 504034 - protein, 9 aa, Homo Sapiens
SATGFTSSL

SEQ ID NO: 504035 - protein, 9 aa, Homo Sapiens
LVISYIMAL

SEQ ID NO: 504036 - protein, 9 aa, Homo Sapiens
KYELAVDRF

SEQ ID NO: 504037 - protein, 9 aa, Homo Sapiens
PPTAACRPR

SEQ ID NO: 504038 - protein, 9 aa, Homo Sapiens
KGVFGAGPG

SEQ ID NO: 504039 - protein, 9 aa, Homo Sapiens
DCAQSWRHP

SEQ ID NO: 504040 - protein, 9 aa, Homo Sapiens
PLDRVPGAP

SEQ ID NO: 504041 - protein, 9 aa, Homo Sapiens
TRTPPGRSA

SEQ ID NO: 504042 - protein, 9 aa, Homo Sapiens
YCMHLSLVE

SEQ ID NO: 504043 - protein, 9 aa, Homo Sapiens
FWTNPQYCL

SEQ ID NO: 504044 - protein, 9 aa, Homo Sapiens
PSAAPGPRR

SEQ ID NO: 504045 - protein, 9 aa, Homo Sapiens
KLDAFFVFQ

SEQ ID NO: 504046 - protein, 9 aa, Homo Sapiens
GHLMIAFLP

SEQ ID NO: 504047 - protein, 9 aa, Homo Sapiens
YMDRGLGYS

SEQ ID NO: 504048 - protein, 9 aa, Homo Sapiens
HRSTQEDGS

SEQ ID NO: 504049 - protein, 9 aa, Homo Sapiens
PPYEVPSIV

SEQ ID NO: 504050 - protein, 9 aa, Homo Sapiens
FCSPGETED

SEQ ID NO: 504051 - protein, 9 aa, Homo Sapiens
EDERDEHQL

SEQ ID NO: 504052 - protein, 9 aa, Homo Sapiens
LAWNFVLQE

SEQ ID NO: 504053 - protein, 9 aa, Homo Sapiens
EVAEAAAVV

SEQ ID NO: 504054 - protein, 9 aa, Homo Sapiens
RALFPLDRV

SEQ ID NO: 504055 - protein, 9 aa, Homo Sapiens
IGLIEIIKI

SEQ ID NO: 504056 - protein, 9 aa, Homo Sapiens
TENSEEYGD

SEQ ID NO: 504057 - protein, 9 aa, Homo Sapiens
RCPRARRSA

SEQ ID NO: 504058 - protein, 9 aa, Homo Sapiens
TRGRRKSGE

SEQ ID NO: 504059 - protein, 9 aa, Homo Sapiens
EGSSATGFT

SEQ ID NO: 504060 - protein, 9 aa, Homo Sapiens
DVLPDQEVQ

SEQ ID NO: 504061 - protein, 9 aa, Homo Sapiens
PYEVPSIVP

SEQ ID NO: 504062 - protein, 9 aa, Homo Sapiens
LKVFTPKSH

SEQ ID NO: 504063 - protein, 9 aa, Homo Sapiens
QAWIVQNAV

SEQ ID NO: 504064 - protein, 9 aa, Homo Sapiens
DQIQVGHFL

SEQ ID NO: 504065 - protein, 9 aa, Homo Sapiens
QHICQHLPQ

SEQ ID NO: 504066 - protein, 9 aa, Homo Sapiens
AVLLGEDGP

SEQ ID NO: 504067 - protein, 9 aa, Homo Sapiens
PDQIQVGHF

SEQ ID NO: 504068 - protein, 9 aa, Homo Sapiens
RREREALLQ

SEQ ID NO: 504069 - protein, 9 aa, Homo Sapiens
PGFELTHKN

SEQ ID NO: 504070 - protein, 9 aa, Homo Sapiens
SPRTARPSA

SEQ ID NO: 504071 - protein, 9 aa, Homo Sapiens
GVARVEVAA

SEQ ID NO: 504072 - protein, 9 aa, Homo Sapiens
QKPITRPGN

SEQ ID NO: 504073 - protein, 9 aa, Homo Sapiens
QAIDRINAQ

SEQ ID NO: 504074 - protein, 9 aa, Homo Sapiens
MDEIERYQE

SEQ ID NO: 504075 - protein, 9 aa, Homo Sapiens
HFMDANQSF

SEQ ID NO: 504076 - protein, 9 aa, Homo Sapiens
PMVASGESL

SEQ ID NO: 504077 - protein, 9 aa, Homo Sapiens
ERLKNPDQI

SEQ ID NO: 504078 - protein, 9 aa, Homo Sapiens
VTQLKVFTP

SEQ ID NO: 504079 - protein, 9 aa, Homo Sapiens
EVQQRQQHI

SEQ ID NO: 504080 - protein, 9 aa, Homo Sapiens
FENNIYCQP

SEQ ID NO: 504081 - protein, 9 aa, Homo Sapiens
DNEATRKAY

SEQ ID NO: 504082 - protein, 9 aa, Homo Sapiens
LQVEADKKK

SEQ ID NO: 504083 - protein, 9 aa, Homo Sapiens
QAQHLAEIG

SEQ ID NO: 504084 - protein, 9 aa, Homo Sapiens
PPAPRQLPP

SEQ ID NO: 504085 - protein, 9 aa, Homo Sapiens
YGFGLTQPE

SEQ ID NO: 504086 - protein, 9 aa, Homo Sapiens
DKTVKLKEL

SEQ ID NO: 504087 - protein, 9 aa, Homo Sapiens
NSQFCFCGH

SEQ ID NO: 504088 - protein, 9 aa, Homo Sapiens
GPMVASGES

SEQ ID NO: 504089 - protein, 9 aa, Homo Sapiens
ESVRQIYSE

SEQ ID NO: 504090 - protein, 9 aa, Homo Sapiens
YCQPDIKSS

SEQ ID NO: 504091 - protein, 9 aa, Homo Sapiens
CWRKITVDD

SEQ ID NO: 504092 - protein, 9 aa, Homo Sapiens
RCSWTAARP

SEQ ID NO: 504093 - protein, 9 aa, Homo Sapiens
DSYSENSQF

SEQ ID NO: 504094 - protein, 9 aa, Homo Sapiens
PPLLRNKKY

SEQ ID NO: 504095 - protein, 9 aa, Homo Sapiens
PPSPPASPR

SEQ ID NO: 504096 - protein, 9 aa, Homo Sapiens
VHAGTFGDC

SEQ ID NO: 504097 - protein, 9 aa, Homo Sapiens
LDIIARIHI

SEQ ID NO: 504098 - protein, 9 aa, Homo Sapiens
LRNNQLRRL

SEQ ID NO: 504099 - protein, 9 aa, Homo Sapiens
PKSHSPLKR

SEQ ID NO: 504100 - protein, 9 aa, Homo Sapiens
LQERLTSIL

SEQ ID NO: 504101 - protein, 9 aa, Homo Sapiens
GEMNLKPKE

SEQ ID NO: 504102 - protein, 9 aa, Homo Sapiens
CLKDKDENV

SEQ ID NO: 504103 - protein, 9 aa, Homo Sapiens
SFSALVCRT

SEQ ID NO: 504104 - protein, 9 aa, Homo Sapiens
ISYIMALHF

SEQ ID NO: 504105 - protein, 9 aa, Homo Sapiens
SPARWLSSP

SEQ ID NO: 504106 - protein, 9 aa, Homo Sapiens
VRAGEGIGD

SEQ ID NO: 504107 - protein, 9 aa, Homo Sapiens
LPRRPGHDG

SEQ ID NO: 504108 - protein, 9 aa, Homo Sapiens
QAQHGQVSY

SEQ ID NO: 504109 - protein, 9 aa, Homo Sapiens
VENYVKDSL

SEQ ID NO: 504110 - protein, 9 aa, Homo Sapiens
PSEGGVARV

SEQ ID NO: 504111 - protein, 9 aa, Homo Sapiens
PSPASRGHP

SEQ ID NO: 504112 - protein, 9 aa, Homo Sapiens
SASARPHRS

SEQ ID NO: 504113 - protein, 9 aa, Homo Sapiens
VVGVKIPRY

SEQ ID NO: 504114 - protein, 9 aa, Homo Sapiens
IEIIKINPK

SEQ ID NO: 504115 - protein, 9 aa, Homo Sapiens
LKPVLCRSE

SEQ ID NO: 504116 - protein, 9 aa, Homo Sapiens
NGLAAAPRG

SEQ ID NO: 504117 - protein, 9 aa, Homo Sapiens
SWTLRILTL

SEQ ID NO: 504118 - protein, 9 aa, Homo Sapiens
PRPPSPPAS

SEQ ID NO: 504119 - protein, 9 aa, Homo Sapiens
SLATGISAF

SEQ ID NO: 504120 - protein, 9 aa, Homo Sapiens
HKAVNNYCP

SEQ ID NO: 504121 - protein, 9 aa, Homo Sapiens
PSSLATGIS

SEQ ID NO: 504122 - protein, 9 aa, Homo Sapiens
GGIQTMAVW

SEQ ID NO: 504123 - protein, 9 aa, Homo Sapiens
KKTIKGTAD

SEQ ID NO: 504124 - protein, 9 aa, Homo Sapiens
RFSDAILEY

SEQ ID NO: 504125 - protein, 9 aa, Homo Sapiens
ARPSAAPGP

SEQ ID NO: 504126 - protein, 9 aa, Homo Sapiens
ALRRSPFPS

SEQ ID NO: 504127 - protein, 9 aa, Homo Sapiens
RINAQKQWL

SEQ ID NO: 504128 - protein, 9 aa, Homo Sapiens
NPEHFMDAN

SEQ ID NO: 504129 - protein, 9 aa, Homo Sapiens
FQERVDKVK

SEQ ID NO: 504130 - protein, 9 aa, Homo Sapiens
DEHQLLVRH

SEQ ID NO: 504131 - protein, 9 aa, Homo Sapiens
VMVVRPVAT

SEQ ID NO: 504132 - protein, 9 aa, Homo Sapiens
QKSKVSKVE

SEQ ID NO: 504133 - protein, 9 aa, Homo Sapiens
FFQRVLALC

SEQ ID NO: 504134 - protein, 9 aa, Homo Sapiens
LSSALRQSV

SEQ ID NO: 504135 - protein, 9 aa, Homo Sapiens
SLVYSSWAP

SEQ ID NO: 504136 - protein, 9 aa, Homo Sapiens
FVLQERLKT

SEQ ID NO: 504137 - protein, 9 aa, Homo Sapiens
PRPAKTPTR

SEQ ID NO: 504138 - protein, 9 aa, Homo Sapiens
TLSPGEARA

SEQ ID NO: 504139 - protein, 9 aa, Homo Sapiens
NVATSKILQ

SEQ ID NO: 504140 - protein, 9 aa, Homo Sapiens
YCVQGTTSA

SEQ ID NO: 504141 - protein, 9 aa, Homo Sapiens
QIYSEHNYC

SEQ ID NO: 504142 - protein, 9 aa, Homo Sapiens
TCLKDKDEN

SEQ ID NO: 504143 - protein, 9 aa, Homo Sapiens
FESLKRADA

SEQ ID NO: 504144 - protein, 9 aa, Homo Sapiens
LQVTTKILF

SEQ ID NO: 504145 - protein, 9 aa, Homo Sapiens
PKSRPSGFN

SEQ ID NO: 504146 - protein, 9 aa, Homo Sapiens
YPGFELTHK

SEQ ID NO: 504147 - protein, 9 aa, Homo Sapiens
GHGVCIGLM

SEQ ID NO: 504148 - protein, 9 aa, Homo Sapiens
RIHINGENS

SEQ ID NO: 504149 - protein, 9 aa, Homo Sapiens
ERSPCAMER

SEQ ID NO: 504150 - protein, 9 aa, Homo Sapiens
GPRPGGPPR

SEQ ID NO: 504151 - protein, 9 aa, Homo Sapiens
TNPQYCLKL

SEQ ID NO: 504152 - protein, 9 aa, Homo Sapiens
ESYPKPEIS

SEQ ID NO: 504153 - protein, 9 aa, Homo Sapiens
LGHSKDKNS

SEQ ID NO: 504154 - protein, 9 aa, Homo Sapiens
EGIHTGEKP

SEQ ID NO: 504155 - protein, 9 aa, Homo Sapiens
PVLRECRVR

SEQ ID NO: 504156 - protein, 9 aa, Homo Sapiens
QETGFHLVA

SEQ ID NO: 504157 - protein, 9 aa, Homo Sapiens
VLRECRVRS

SEQ ID NO: 504158 - protein, 9 aa, Homo Sapiens
DYPQQNNAA

SEQ ID NO: 504159 - protein, 9 aa, Homo Sapiens
RQAQHLAEI

SEQ ID NO: 504160 - protein, 9 aa, Homo Sapiens
EGGVARVEV

SEQ ID NO: 504161 - protein, 9 aa, Homo Sapiens
NEATRKAYY

SEQ ID NO: 504162 - protein, 9 aa, Homo Sapiens
LVYSSWAPG

SEQ ID NO: 504163 - protein, 9 aa, Homo Sapiens
SSNITTHKK

SEQ ID NO: 504164 - protein, 9 aa, Homo Sapiens
STPNLLQER

SEQ ID NO: 504165 - protein, 9 aa, Homo Sapiens
VLVISYIMA

SEQ ID NO: 504166 - protein, 9 aa, Homo Sapiens
YGDIIVTLK

SEQ ID NO: 504167 - protein, 9 aa, Homo Sapiens
ELAVDRFNW

SEQ ID NO: 504168 - protein, 9 aa, Homo Sapiens
MEQGSPEAV

SEQ ID NO: 504169 - protein, 9 aa, Homo Sapiens
FHWYPVPQR

SEQ ID NO: 504170 - protein, 9 aa, Homo Sapiens
QVDPAPAHR

SEQ ID NO: 504171 - protein, 9 aa, Homo Sapiens
FVDNVATSK

SEQ ID NO: 504172 - protein, 9 aa, Homo Sapiens
DENVKKNAS

SEQ ID NO: 504173 - protein, 9 aa, Homo Sapiens
DKYELAVDR

SEQ ID NO: 504174 - protein, 9 aa, Homo Sapiens
NLLQERLTS

SEQ ID NO: 504175 - protein, 9 aa, Homo Sapiens
GPCPQASGE

SEQ ID NO: 504176 - protein, 9 aa, Homo Sapiens
LRECRVRSV

SEQ ID NO: 504177 - protein, 9 aa, Homo Sapiens
AAATSSLKT

SEQ ID NO: 504178 - protein, 9 aa, Homo Sapiens
CQHLPQLPR

SEQ ID NO: 504179 - protein, 9 aa, Homo Sapiens
PGRRSCCWG

SEQ ID NO: 504180 - protein, 9 aa, Homo Sapiens
YVGVRAGEG

SEQ ID NO: 504181 - protein, 9 aa, Homo Sapiens
TGDSGGPPR

SEQ ID NO: 504182 - protein, 9 aa, Homo Sapiens
SPLKRSPKS

SEQ ID NO: 504183 - protein, 9 aa, Homo Sapiens
DRGLGYSYP

SEQ ID NO: 504184 - protein, 9 aa, Homo Sapiens
RYGFGLTQP

SEQ ID NO: 504185 - protein, 9 aa, Homo Sapiens
GYCVQGTTS

SEQ ID NO: 504186 - protein, 9 aa, Homo Sapiens
THKNDCLDI

SEQ ID NO: 504187 - protein, 9 aa, Homo Sapiens
TGESLVYSS

SEQ ID NO: 504188 - protein, 9 aa, Homo Sapiens
KVGDKGIQL

SEQ ID NO: 504189 - protein, 9 aa, Homo Sapiens
DEMRNYISN

SEQ ID NO: 504190 - protein, 9 aa, Homo Sapiens
REVAEAAAV

SEQ ID NO: 504191 - protein, 9 aa, Homo Sapiens
EVPSIVPPA

SEQ ID NO: 504192 - protein, 9 aa, Homo Sapiens
GALGSQQNF

SEQ ID NO: 504193 - protein, 9 aa, Homo Sapiens
VLGNIGLIE

SEQ ID NO: 504194 - protein, 9 aa, Homo Sapiens
ASDYPQQNN

SEQ ID NO: 504195 - protein, 9 aa, Homo Sapiens
GPVLRECRV

SEQ ID NO: 504196 - protein, 9 aa, Homo Sapiens
KTFCLESDL

SEQ ID NO: 504197 - protein, 9 aa, Homo Sapiens
PHRSTQEDG

SEQ ID NO: 504198 - protein, 9 aa, Homo Sapiens
WNFVLQERL

SEQ ID NO: 504199 - protein, 9 aa, Homo Sapiens
FWTDYLNGS

SEQ ID NO: 504200 - protein, 9 aa, Homo Sapiens
TDYLNGSIF

SEQ ID NO: 504201 - protein, 9 aa, Homo Sapiens
VQGTTSANT

SEQ ID NO: 504202 - protein, 9 aa, Homo Sapiens
VEVAAGPPM

SEQ ID NO: 504203 - protein, 9 aa, Homo Sapiens
TPNLLQERL

SEQ ID NO: 504204 - protein, 9 aa, Homo Sapiens
EDYNLSSAL

SEQ ID NO: 504205 - protein, 9 aa, Homo Sapiens
IIFLAEVAA

SEQ ID NO: 504206 - protein, 9 aa, Homo Sapiens
VGVKIPRYC

SEQ ID NO: 504207 - protein, 9 aa, Homo Sapiens
IYCQPDIKS

SEQ ID NO: 504208 - protein, 9 aa, Homo Sapiens
PPPATATRT

SEQ ID NO: 504209 - protein, 9 aa, Homo Sapiens
PLCMLPPGP

SEQ ID NO: 504210 - protein, 9 aa, Homo Sapiens
FPKARPWLM

SEQ ID NO: 504211 - protein, 9 aa, Homo Sapiens
AGPPMREVA

SEQ ID NO: 504212 - protein, 9 aa, Homo Sapiens
VTTAIERRP

SEQ ID NO: 504213 - protein, 9 aa, Homo Sapiens
DVQETGFHL

SEQ ID NO: 504214 - protein, 9 aa, Homo Sapiens
RDSGLWFTV

SEQ ID NO: 504215 - protein, 9 aa, Homo Sapiens
YVVSRPQLR

SEQ ID NO: 504216 - protein, 9 aa, Homo Sapiens
FCGDPGILA

SEQ ID NO: 504217 - protein, 9 aa, Homo Sapiens
CAAPPRSAA

SEQ ID NO: 504218 - protein, 9 aa, Homo Sapiens
MFPQLDNEA

SEQ ID NO: 504219 - protein, 9 aa, Homo Sapiens
EKCLLRNNQ

SEQ ID NO: 504220 - protein, 9 aa, Homo Sapiens
GFNFHVSNH

SEQ ID NO: 504221 - protein, 9 aa, Homo Sapiens
NRGVMTDES

SEQ ID NO: 504222 - protein, 9 aa, Homo Sapiens
HPETPRGPR

SEQ ID NO: 504223 - protein, 9 aa, Homo Sapiens
RRPAAPRTA

SEQ ID NO: 504224 - protein, 9 aa, Homo Sapiens
GPSQTLKPV

SEQ ID NO: 504225 - protein, 9 aa, Homo Sapiens
SYIMALHFF

SEQ ID NO: 504226 - protein, 9 aa, Homo Sapiens
KTPTRRPAA

SEQ ID NO: 504227 - protein, 9 aa, Homo Sapiens
GSEQNSSVT

SEQ ID NO: 504228 - protein, 9 aa, Homo Sapiens
SPTRTRRLP

SEQ ID NO: 504229 - protein, 9 aa, Homo Sapiens
CMLPPGPEP

SEQ ID NO: 504230 - protein, 9 aa, Homo Sapiens
IFENNIYCQ

SEQ ID NO: 504231 - protein, 9 aa, Homo Sapiens
KYETEGSSA

SEQ ID NO: 504232 - protein, 9 aa, Homo Sapiens
FQVYMDRGL

SEQ ID NO: 504233 - protein, 9 aa, Homo Sapiens
YPQQNNAAA

SEQ ID NO: 504234 - protein, 9 aa, Homo Sapiens
SGLWFTVDP

SEQ ID NO: 504235 - protein, 9 aa, Homo Sapiens
HQKAQIAPK

SEQ ID NO: 504236 - protein, 9 aa, Homo Sapiens
AAPRTARPL

SEQ ID NO: 504237 - protein, 9 aa, Homo Sapiens
RVQKCSEVN

SEQ ID NO: 504238 - protein, 9 aa, Homo Sapiens
EILKSLCRI

SEQ ID NO: 504239 - protein, 9 aa, Homo Sapiens
QNFVRMKEA

SEQ ID NO: 504240 - protein, 9 aa, Homo Sapiens
VFTPKSHSP

SEQ ID NO: 504241 - protein, 9 aa, Homo Sapiens
PAARSPTRT

SEQ ID NO: 504242 - protein, 9 aa, Homo Sapiens
TPRGPRPGG

SEQ ID NO: 504243 - protein, 9 aa, Homo Sapiens
LEKLLDNRG

SEQ ID NO: 504244 - protein, 9 aa, Homo Sapiens
MHSLRPEPP

SEQ ID NO: 504245 - protein, 9 aa, Homo Sapiens
SSCCSQSCN

SEQ ID NO: 504246 - protein, 9 aa, Homo Sapiens
CLESDLTIH

SEQ ID NO: 504247 - protein, 9 aa, Homo Sapiens
LLSQASWTL

SEQ ID NO: 504248 - protein, 9 aa, Homo Sapiens
KLEWDMKIN

SEQ ID NO: 504249 - protein, 9 aa, Homo Sapiens
IARIHINGE

SEQ ID NO: 504250 - protein, 9 aa, Homo Sapiens
HWYPVPQRE

SEQ ID NO: 504251 - protein, 9 aa, Homo Sapiens
KDESSTVLM

SEQ ID NO: 504252 - protein, 9 aa, Homo Sapiens
SRSGSSWGC

SEQ ID NO: 504253 - protein, 9 aa, Homo Sapiens
ANQTPPRCP

SEQ ID NO: 504254 - protein, 9 aa, Homo Sapiens
LDSGSEQNS

SEQ ID NO: 504255 - protein, 9 aa, Homo Sapiens
CRCPRARRS

SEQ ID NO: 504256 - protein, 9 aa, Homo Sapiens
KTIKGTADF

SEQ ID NO: 504257 - protein, 9 aa, Homo Sapiens
LLQERLTSI

SEQ ID NO: 504258 - protein, 9 aa, Homo Sapiens
SVYHSGSSS

SEQ ID NO: 504259 - protein, 9 aa, Homo Sapiens
PRRHPRPAK

SEQ ID NO: 504260 - protein, 9 aa, Homo Sapiens
RVGKVFIPV

SEQ ID NO: 504261 - protein, 9 aa, Homo Sapiens
TGISAFLVT

SEQ ID NO: 504262 - protein, 9 aa, Homo Sapiens
RAADCAQSW

SEQ ID NO: 504263 - protein, 9 aa, Homo Sapiens
FTNKILSFP

SEQ ID NO: 504264 - protein, 9 aa, Homo Sapiens
NQTPPRCPP

SEQ ID NO: 504265 - protein, 9 aa, Homo Sapiens
GCHSDDQRD

SEQ ID NO: 504266 - protein, 9 aa, Homo Sapiens
CPPPATATR

SEQ ID NO: 504267 - protein, 9 aa, Homo Sapiens
TQLKVFTPK

SEQ ID NO: 504268 - protein, 9 aa, Homo Sapiens
GESLVYSSW

SEQ ID NO: 504269 - protein, 9 aa, Homo Sapiens
RSGQAQHGQ

SEQ ID NO: 504270 - protein, 9 aa, Homo Sapiens
GQDAILYLQ

SEQ ID NO: 504271 - protein, 9 aa, Homo Sapiens
VQETGFHLV

SEQ ID NO: 504272 - protein, 9 aa, Homo Sapiens
IEGRELFER

SEQ ID NO: 504273 - protein, 9 aa, Homo Sapiens
EIGSNMNDL

SEQ ID NO: 504274 - protein, 9 aa, Homo Sapiens
APGPSQTLK

SEQ ID NO: 504275 - protein, 9 aa, Homo Sapiens
EDTEAFVIA

SEQ ID NO: 504276 - protein, 9 aa, Homo Sapiens
LQEKCLLRN

SEQ ID NO: 504277 - protein, 9 aa, Homo Sapiens
CWGRCCNRP

SEQ ID NO: 504278 - protein, 9 aa, Homo Sapiens
ERYQEVEED

SEQ ID NO: 504279 - protein, 9 aa, Homo Sapiens
YRVQKCSEV

SEQ ID NO: 504280 - protein, 9 aa, Homo Sapiens
RDPPADDME

SEQ ID NO: 504281 - protein, 9 aa, Homo Sapiens
REALLQSIG

SEQ ID NO: 504282 - protein, 9 aa, Homo Sapiens
ITRPGNKFQ

SEQ ID NO: 504283 - protein, 9 aa, Homo Sapiens
RYAPGSSPP

SEQ ID NO: 504284 - protein, 9 aa, Homo Sapiens
TSFARRTAS

SEQ ID NO: 504285 - protein, 9 aa, Homo Sapiens
MDANQSFKK

SEQ ID NO: 504286 - protein, 9 aa, Homo Sapiens
REVTTAIER

SEQ ID NO: 504287 - protein, 9 aa, Homo Sapiens
SPPLCMLPP

SEQ ID NO: 504288 - protein, 9 aa, Homo Sapiens
ANNGITYIS

SEQ ID NO: 504289 - protein, 9 aa, Homo Sapiens
PGAPGRRSC

SEQ ID NO: 504290 - protein, 9 aa, Homo Sapiens
QVHASQTPG

SEQ ID NO: 504291 - protein, 9 aa, Homo Sapiens
NINIFWLTC

SEQ ID NO: 504292 - protein, 9 aa, Homo Sapiens
NSGCRCPRA

SEQ ID NO: 504293 - protein, 9 aa, Homo Sapiens
PRPARWGNS

SEQ ID NO: 504294 - protein, 9 aa, Homo Sapiens
TEDFFKLEW

SEQ ID NO: 504295 - protein, 9 aa, Homo Sapiens
IDRINAQKQ

SEQ ID NO: 504296 - protein, 9 aa, Homo Sapiens
RSPKSRPSG

SEQ ID NO: 504297 - protein, 9 aa, Homo Sapiens
HPQDMVLGL

SEQ ID NO: 504298 - protein, 9 aa, Homo Sapiens
LRDSGLWFT

SEQ ID NO: 504299 - protein, 9 aa, Homo Sapiens
AQIAPKSPP

SEQ ID NO: 504300 - protein, 9 aa, Homo Sapiens
YRLYMEQGS

SEQ ID NO: 504301 - protein, 9 aa, Homo Sapiens
IFVLIWCLI

SEQ ID NO: 504302 - protein, 9 aa, Homo Sapiens
ARPGAPGRR

SEQ ID NO: 504303 - protein, 9 aa, Homo Sapiens
LEILKSLCR

SEQ ID NO: 504304 - protein, 9 aa, Homo Sapiens
PVATLSPGE

SEQ ID NO: 504305 - protein, 9 aa, Homo Sapiens
TLTTLDGGS

SEQ ID NO: 504306 - protein, 9 aa, Homo Sapiens
PASPRTARP

SEQ ID NO: 504307 - protein, 9 aa, Homo Sapiens
TLGKSCFVS

SEQ ID NO: 504308 - protein, 9 aa, Homo Sapiens
KDENVKKNA

SEQ ID NO: 504309 - protein, 9 aa, Homo Sapiens
DIQIELQQK

SEQ ID NO: 504310 - protein, 9 aa, Homo Sapiens
YVVSKTGAL

SEQ ID NO: 504311 - protein, 9 aa, Homo Sapiens
SITVFHGTI

SEQ ID NO: 504312 - protein, 9 aa, Homo Sapiens
KTLIKSANN

SEQ ID NO: 504313 - protein, 9 aa, Homo Sapiens
WLSSPPSLG

SEQ ID NO: 504314 - protein, 9 aa, Homo Sapiens
LIVYLVVAL

SEQ ID NO: 504315 - protein, 9 aa, Homo Sapiens
EDGPVLREC

SEQ ID NO: 504316 - protein, 9 aa, Homo Sapiens
SVDVLPDQE

SEQ ID NO: 504317 - protein, 9 aa, Homo Sapiens
TTRNAEFDS

SEQ ID NO: 504318 - protein, 9 aa, Homo Sapiens
RRKDSPHHL

SEQ ID NO: 504319 - protein, 9 aa, Homo Sapiens
VRSVDVLPD

SEQ ID NO: 504320 - protein, 9 aa, Homo Sapiens
PPRSAAAAT

SEQ ID NO: 504321 - protein, 9 aa, Homo Sapiens
ENVKKNAST

SEQ ID NO: 504322 - protein, 9 aa, Homo Sapiens
ESQWEPVCA

SEQ ID NO: 504323 - protein, 9 aa, Homo Sapiens
FAYYVVSKT

SEQ ID NO: 504324 - protein, 9 aa, Homo Sapiens
CSQSCNESS

SEQ ID NO: 504325 - protein, 9 aa, Homo Sapiens
HSLRPEPPD

SEQ ID NO: 504326 - protein, 9 aa, Homo Sapiens
HGGVAQQAV

SEQ ID NO: 504327 - protein, 9 aa, Homo Sapiens
WRKITVDDF

SEQ ID NO: 504328 - protein, 9 aa, Homo Sapiens
SWTAARPCP

SEQ ID NO: 504329 - protein, 9 aa, Homo Sapiens
RARRSARPG

SEQ ID NO: 504330 - protein, 9 aa, Homo Sapiens
VAAGPPMRE

SEQ ID NO: 504331 - protein, 9 aa, Homo Sapiens
NTEFLKHKA

SEQ ID NO: 504332 - protein, 9 aa, Homo Sapiens
SSSFRYHEG

SEQ ID NO: 504333 - protein, 9 aa, Homo Sapiens
LESVRQIYS

SEQ ID NO: 504334 - protein, 9 aa, Homo Sapiens
ADCAQSWRH

SEQ ID NO: 504335 - protein, 9 aa, Homo Sapiens
RAGEGIGDE

SEQ ID NO: 504336 - protein, 9 aa, Homo Sapiens
TRWHQPGRP

SEQ ID NO: 504337 - protein, 9 aa, Homo Sapiens
TVFHGTILF

SEQ ID NO: 504338 - protein, 9 aa, Homo Sapiens
LMIAFLPTI

SEQ ID NO: 504339 - protein, 9 aa, Homo Sapiens
CLALLLSFQ

SEQ ID NO: 504340 - protein, 9 aa, Homo Sapiens
SRRRLRKGR

SEQ ID NO: 504341 - protein, 9 aa, Homo Sapiens
PKEVFLAQG

SEQ ID NO: 504342 - protein, 9 aa, Homo Sapiens
ARWLSSPPS

SEQ ID NO: 504343 - protein, 9 aa, Homo Sapiens
PFVTQLKVF

SEQ ID NO: 504344 - protein, 9 aa, Homo Sapiens
STSRSGSSW

SEQ ID NO: 504345 - protein, 9 aa, Homo Sapiens
RGVIANLLQ

SEQ ID NO: 504346 - protein, 9 aa, Homo Sapiens
GSFSALVCR

SEQ ID NO: 504347 - protein, 9 aa, Homo Sapiens
VMAVENYVK

SEQ ID NO: 504348 - protein, 9 aa, Homo Sapiens
DMEGPKQAI

SEQ ID NO: 504349 - protein, 9 aa, Homo Sapiens
LPWLVGPFP

SEQ ID NO: 504350 - protein, 9 aa, Homo Sapiens
AAGPPMREV

SEQ ID NO: 504351 - protein, 9 aa, Homo Sapiens
VKIPRYCLF

SEQ ID NO: 504352 - protein, 9 aa, Homo Sapiens
SNITTHKKI

SEQ ID NO: 504353 - protein, 9 aa, Homo Sapiens
VIANLLQGD

SEQ ID NO: 504354 - protein, 9 aa, Homo Sapiens
CVQGTTSAN

SEQ ID NO: 504355 - protein, 9 aa, Homo Sapiens
RPVATLSPG

SEQ ID NO: 504356 - protein, 9 aa, Homo Sapiens
DYHIRFISE

SEQ ID NO: 504357 - protein, 9 aa, Homo Sapiens
PPSPASRGH

SEQ ID NO: 504358 - protein, 9 aa, Homo Sapiens
LVVELFGKL

SEQ ID NO: 504359 - protein, 9 aa, Homo Sapiens
TQIGYCVQG

SEQ ID NO: 504360 - protein, 9 aa, Homo Sapiens
AELNNINIF

SEQ ID NO: 504361 - protein, 9 aa, Homo Sapiens
ASHLTSITV

SEQ ID NO: 504362 - protein, 9 aa, Homo Sapiens
LSMEDHLYI

SEQ ID NO: 504363 - protein, 9 aa, Homo Sapiens
RVRSVDVLP

SEQ ID NO: 504364 - protein, 9 aa, Homo Sapiens
SEHNYCRLI

SEQ ID NO: 504365 - protein, 9 aa, Homo Sapiens
LTRYAPGSS

SEQ ID NO: 504366 - protein, 9 aa, Homo Sapiens
RAPSPARWL

SEQ ID NO: 504367 - protein, 9 aa, Homo Sapiens
FTPKSHSPL

SEQ ID NO: 504368 - protein, 9 aa, Homo Sapiens
LLQGDGCHS

SEQ ID NO: 504369 - protein, 9 aa, Homo Sapiens
GRSASARPH

SEQ ID NO: 504370 - protein, 9 aa, Homo Sapiens
PPADDMEGP

SEQ ID NO: 504371 - protein, 9 aa, Homo Sapiens
PQQNNAAAD

SEQ ID NO: 504372 - protein, 9 aa, Homo Sapiens
APAARSPTR

SEQ ID NO: 504373 - protein, 9 aa, Homo Sapiens
TTGANGLAA

SEQ ID NO: 504374 - protein, 9 aa, Homo Sapiens
DGCHSDDQR

SEQ ID NO: 504375 - protein, 9 aa, Homo Sapiens
GVKIPRYCL

SEQ ID NO: 504376 - protein, 9 aa, Homo Sapiens
RRPPLPSEG

SEQ ID NO: 504377 - protein, 9 aa, Homo Sapiens
SPFVTQLKV

SEQ ID NO: 504378 - protein, 9 aa, Homo Sapiens
ERDEHQLLV

SEQ ID NO: 504379 - protein, 9 aa, Homo Sapiens
VQPPYEVPS

SEQ ID NO: 504380 - protein, 9 aa, Homo Sapiens
MVASGESLT

SEQ ID NO: 504381 - protein, 9 aa, Homo Sapiens
GCWRKITVD

SEQ ID NO: 504382 - protein, 9 aa, Homo Sapiens
DTAVISSPD

SEQ ID NO: 504383 - protein, 9 aa, Homo Sapiens
QIRDYHIRF

SEQ ID NO: 504384 - protein, 9 aa, Homo Sapiens
QVDEMRNYI

SEQ ID NO: 504385 - protein, 9 aa, Homo Sapiens
GEEDTEAFV

SEQ ID NO: 504386 - protein, 9 aa, Homo Sapiens
HINGENSEV

SEQ ID NO: 504387 - protein, 9 aa, Homo Sapiens
PLLRNKKYI

SEQ ID NO: 504388 - protein, 9 aa, Homo Sapiens
LEWDMKINC

SEQ ID NO: 504389 - protein, 9 aa, Homo Sapiens
SEVNHMNAH

SEQ ID NO: 504390 - protein, 9 aa, Homo Sapiens
QEKLDAFFV

SEQ ID NO: 504391 - protein, 9 aa, Homo Sapiens
LSLTLTTLD

SEQ ID NO: 504392 - protein, 9 aa, Homo Sapiens
GDSGGPPRA

SEQ ID NO: 504393 - protein, 9 aa, Homo Sapiens
YIEGRELFE

SEQ ID NO: 504394 - protein, 9 aa, Homo Sapiens
CGDPGILAE

SEQ ID NO: 504395 - protein, 9 aa, Homo Sapiens
VGLAPGPSQ

SEQ ID NO: 504396 - protein, 9 aa, Homo Sapiens
ENSEEYGDI

SEQ ID NO: 504397 - protein, 9 aa, Homo Sapiens
GPGAPSAPA

SEQ ID NO: 504398 - protein, 9 aa, Homo Sapiens
VIATLQNPD

SEQ ID NO: 504399 - protein, 9 aa, Homo Sapiens
KLQKVKQSF

SEQ ID NO: 504400 - protein, 9 aa, Homo Sapiens
EGRELFERI

SEQ ID NO: 504401 - protein, 9 aa, Homo Sapiens
VRGVIANLL

SEQ ID NO: 504402 - protein, 9 aa, Homo Sapiens
NKILSFPQL

SEQ ID NO: 504403 - protein, 9 aa, Homo Sapiens
TDSILVKWE

SEQ ID NO: 504404 - protein, 9 aa, Homo Sapiens
APSPARWLS

SEQ ID NO: 504405 - protein, 9 aa, Homo Sapiens
QIELQQKSK

SEQ ID NO: 504406 - protein, 9 aa, Homo Sapiens
ITVDDFLPF

SEQ ID NO: 504407 - protein, 9 aa, Homo Sapiens
GTGMERSPC

SEQ ID NO: 504408 - protein, 9 aa, Homo Sapiens
NIYCQPDIK

SEQ ID NO: 504409 - protein, 9 aa, Homo Sapiens
TSTDSILVK

SEQ ID NO: 504410 - protein, 9 aa, Homo Sapiens
DHLYIIGSD

SEQ ID NO: 504411 - protein, 9 aa, Homo Sapiens
GEDGPVLRE

SEQ ID NO: 504412 - protein, 9 aa, Homo Sapiens
ASRISSFLH

SEQ ID NO: 504413 - protein, 9 aa, Homo Sapiens
PTRRPAAPR

SEQ ID NO: 504414 - protein, 9 aa, Homo Sapiens
GSRRRLRKG

SEQ ID NO: 504415 - protein, 9 aa, Homo Sapiens
SFLHMNGMP

SEQ ID NO: 504416 - protein, 9 aa, Homo Sapiens
LDASGHHGH

SEQ ID NO: 504417 - protein, 9 aa, Homo Sapiens
SGSEQNSSV

SEQ ID NO: 504418 - protein, 9 aa, Homo Sapiens
SGGPPRAAH

SEQ ID NO: 504419 - protein, 9 aa, Homo Sapiens
RRSCCWGRC

SEQ ID NO: 504420 - protein, 9 aa, Homo Sapiens
GPRRHPRPA

SEQ ID NO: 504421 - protein, 9 aa, Homo Sapiens
SRISSFLHM

SEQ ID NO: 504422 - protein, 9 aa, Homo Sapiens
PCPQASGEG

SEQ ID NO: 504423 - protein, 9 aa, Homo Sapiens
NRPCGARCS

SEQ ID NO: 504424 - protein, 9 aa, Homo Sapiens
VDTAVISSP

SEQ ID NO: 504425 - protein, 9 aa, Homo Sapiens
AVVDTAVIS

SEQ ID NO: 504426 - protein, 9 aa, Homo Sapiens
HRHVRGVIA

SEQ ID NO: 504427 - protein, 9 aa, Homo Sapiens
RGLGYSYPV

SEQ ID NO: 504428 - protein, 9 aa, Homo Sapiens
CGKTFCLES

SEQ ID NO: 504429 - protein, 9 aa, Homo Sapiens
GGPPRPARW

SEQ ID NO: 504430 - protein, 9 aa, Homo Sapiens
PTGDSGGPP

SEQ ID NO: 504431 - protein, 9 aa, Homo Sapiens
PDQEVQQRQ

SEQ ID NO: 504432 - protein, 9 aa, Homo Sapiens
RTARPSAAP

SEQ ID NO: 504433 - protein, 9 aa, Homo Sapiens
RGPRPGGPP

SEQ ID NO: 504434 - protein, 9 aa, Homo Sapiens
VGPFPPILV

SEQ ID NO: 504435 - protein, 9 aa, Homo Sapiens
PRRPGHDGQ

SEQ ID NO: 504436 - protein, 9 aa, Homo Sapiens
NWKLNFHWY

SEQ ID NO: 504437 - protein, 9 aa, Homo Sapiens
FLIVLVISY

SEQ ID NO: 504438 - protein, 9 aa, Homo Sapiens
VQQRQQHIC

SEQ ID NO: 504439 - protein, 9 aa, Homo Sapiens
RPARWGNSG

SEQ ID NO: 504440 - protein, 9 aa, Homo Sapiens
PAHRHVRGV

SEQ ID NO: 504441 - protein, 9 aa, Homo Sapiens
EGIGDEIED

SEQ ID NO: 504442 - protein, 9 aa, Homo Sapiens
VGPVNISVD

SEQ ID NO: 504443 - protein, 9 aa, Homo Sapiens
LTSITVFHG

SEQ ID NO: 504444 - protein, 9 aa, Homo Sapiens
YYVVSKTGA

SEQ ID NO: 504445 - protein, 9 aa, Homo Sapiens
WLVGPFPPI

SEQ ID NO: 504446 - protein, 9 aa, Homo Sapiens
PPATATRTP

SEQ ID NO: 504447 - protein, 9 aa, Homo Sapiens
CLIIFLAEV

SEQ ID NO: 504448 - protein, 9 aa, Homo Sapiens
EFFQRVLAL

SEQ ID NO: 504449 - protein, 9 aa, Homo Sapiens
QPPYEVPSI

SEQ ID NO: 504450 - protein, 9 aa, Homo Sapiens
SMEDHLYII

SEQ ID NO: 504451 - protein, 9 aa, Homo Sapiens
LESDLTIHQ

SEQ ID NO: 504452 - protein, 9 aa, Homo Sapiens
QRQQHICQH

SEQ ID NO: 504453 - protein, 9 aa, Homo Sapiens
CWATTGANG

SEQ ID NO: 504454 - protein, 9 aa, Homo Sapiens
YAALVVELF

SEQ ID NO: 504455 - protein, 9 aa, Homo Sapiens
RSVDVLPDQ

SEQ ID NO: 504456 - protein, 9 aa, Homo Sapiens
GPVNISVDT

SEQ ID NO: 504457 - protein, 9 aa, Homo Sapiens
APGPRRHPR

SEQ ID NO: 504458 - protein, 9 aa, Homo Sapiens
GEPPKRKKR

SEQ ID NO: 504459 - protein, 9 aa, Homo Sapiens
YQVDEMRNY

SEQ ID NO: 504460 - protein, 9 aa, Homo Sapiens
SLEFCSPGE

SEQ ID NO: 504461 - protein, 9 aa, Homo Sapiens
SASQHGQDA

SEQ ID NO: 504462 - protein, 9 aa, Homo Sapiens
YAPGSSPPR

SEQ ID NO: 504463 - protein, 9 aa, Homo Sapiens
SLKTSFARR

SEQ ID NO: 504464 - protein, 9 aa, Homo Sapiens
GSYQVDEMR

SEQ ID NO: 504465 - protein, 9 aa, Homo Sapiens
EIERYQEVE

SEQ ID NO: 504466 - protein, 9 aa, Homo Sapiens
VRHGGVAQQ

SEQ ID NO: 504467 - protein, 9 aa, Homo Sapiens
GEARAPLES

SEQ ID NO: 504468 - protein, 9 aa, Homo Sapiens
LTHKNDCLD

SEQ ID NO: 504469 - protein, 9 aa, Homo Sapiens
VESYPKPEI

SEQ ID NO: 504470 - protein, 9 aa, Homo Sapiens
QAQADSLIV

SEQ ID NO: 504471 - protein, 9 aa, Homo Sapiens
SKDKNSKQT

SEQ ID NO: 504472 - protein, 9 aa, Homo Sapiens
IVYLVVALA

SEQ ID NO: 504473 - protein, 9 aa, Homo Sapiens
AALVVELFG

SEQ ID NO: 504474 - protein, 9 aa, Homo Sapiens
KSGEPPKRK

SEQ ID NO: 504475 - protein, 9 aa, Homo Sapiens
WTNPQYCLK

SEQ ID NO: 504476 - protein, 9 aa, Homo Sapiens
YILFGNMAE

SEQ ID NO: 504477 - protein, 9 aa, Homo Sapiens
LRGLLGWGY

SEQ ID NO: 504478 - protein, 9 aa, Homo Sapiens
SLRTPPPPP

SEQ ID NO: 504479 - protein, 9 aa, Homo Sapiens
SQHGQDAIL

SEQ ID NO: 504480 - protein, 9 aa, Homo Sapiens
EHNYCRLIL

SEQ ID NO: 504481 - protein, 9 aa, Homo Sapiens
DLDRKRRER

SEQ ID NO: 504482 - protein, 9 aa, Homo Sapiens
SALVCRTNG

SEQ ID NO: 504483 - protein, 9 aa, Homo Sapiens
HSPLKRSPK

SEQ ID NO: 504484 - protein, 9 aa, Homo Sapiens
AHRHVRGVI

SEQ ID NO: 504485 - protein, 9 aa, Homo Sapiens
KPVLCRSEG

SEQ ID NO: 504486 - protein, 9 aa, Homo Sapiens
KYHFQERVD

SEQ ID NO: 504487 - protein, 9 aa, Homo Sapiens
APGRRSCCW

SEQ ID NO: 504488 - protein, 9 aa, Homo Sapiens
CGPGGIQTM

SEQ ID NO: 504489 - protein, 9 aa, Homo Sapiens
IQAIDRINA

SEQ ID NO: 504490 - protein, 9 aa, Homo Sapiens
DKVTSVYHS

SEQ ID NO: 504491 - protein, 9 aa, Homo Sapiens
LCMLPPGPE

SEQ ID NO: 504492 - protein, 9 aa, Homo Sapiens
IQTMAVWCA

SEQ ID NO: 504493 - protein, 9 aa, Homo Sapiens
TLYYRLYME

SEQ ID NO: 504494 - protein, 9 aa, Homo Sapiens
PASRGHPET

SEQ ID NO: 504495 - protein, 9 aa, Homo Sapiens
AVESYPKPE

SEQ ID NO: 504496 - protein, 9 aa, Homo Sapiens
SSWAPGEPN

SEQ ID NO: 504497 - protein, 9 aa, Homo Sapiens
TGANGLAAA

SEQ ID NO: 504498 - protein, 9 aa, Homo Sapiens
AQAFFKLQK

SEQ ID NO: 504499 - protein, 9 aa, Homo Sapiens
ERRPPLPSE

SEQ ID NO: 504500 - protein, 9 aa, Homo Sapiens
NTRFSDAIL

SEQ ID NO: 504501 - protein, 9 aa, Homo Sapiens
SKILQTDLS

SEQ ID NO: 504502 - protein, 9 aa, Homo Sapiens
RPQLRGLLG

SEQ ID NO: 504503 - protein, 9 aa, Homo Sapiens
MLTEGVFDN

SEQ ID NO: 504504 - protein, 9 aa, Homo Sapiens
HKNDCLDID

SEQ ID NO: 504505 - protein, 9 aa, Homo Sapiens
PVLCRSEGR

SEQ ID NO: 504506 - protein, 9 aa, Homo Sapiens
PSAPAARSP

SEQ ID NO: 504507 - protein, 9 aa, Homo Sapiens
HLQEKCLLR

SEQ ID NO: 504508 - protein, 9 aa, Homo Sapiens
EVAAGPPMR

SEQ ID NO: 504509 - protein, 9 aa, Homo Sapiens
GPLLFPKAR

SEQ ID NO: 504510 - protein, 9 aa, Homo Sapiens
ASARPHRSL

SEQ ID NO: 504511 - protein, 9 aa, Homo Sapiens
QLRMLTEGV

SEQ ID NO: 504512 - protein, 9 aa, Homo Sapiens
PANQTPPRC

SEQ ID NO: 504513 - protein, 9 aa, Homo Sapiens
QQNFVRMKE

SEQ ID NO: 504514 - protein, 9 aa, Homo Sapiens
CAMERVLKV

SEQ ID NO: 504515 - protein, 9 aa, Homo Sapiens
SWRHPGPAV

SEQ ID NO: 504516 - protein, 9 aa, Homo Sapiens
DEDERDEHQ

SEQ ID NO: 504517 - protein, 9 aa, Homo Sapiens
RWLSSPPSL

SEQ ID NO: 504518 - protein, 9 aa, Homo Sapiens
FNWKLNFHW

SEQ ID NO: 504519 - protein, 9 aa, Homo Sapiens
PRSPPAGVG

SEQ ID NO: 504520 - protein, 9 aa, Homo Sapiens
NFVRMKEAL

SEQ ID NO: 504521 - protein, 9 aa, Homo Sapiens
GRRSCCWGR

SEQ ID NO: 504522 - protein, 9 aa, Homo Sapiens
GLQVDPAPA

SEQ ID NO: 504523 - protein, 9 aa, Homo Sapiens
LRNKKYILF

SEQ ID NO: 504524 - protein, 9 aa, Homo Sapiens
VGKVFIPVL

SEQ ID NO: 504525 - protein, 9 aa, Homo Sapiens
ASRPGPSTS

SEQ ID NO: 504526 - protein, 9 aa, Homo Sapiens
TRYAPGSSP

SEQ ID NO: 504527 - protein, 9 aa, Homo Sapiens
LRMLTEGVF

SEQ ID NO: 504528 - protein, 9 aa, Homo Sapiens
RSTQEDGSM

SEQ ID NO: 504529 - protein, 9 aa, Homo Sapiens
IGKWCHHRF

SEQ ID NO: 504530 - protein, 9 aa, Homo Sapiens
HSKDKNSKQ

SEQ ID NO: 504531 - protein, 9 aa, Homo Sapiens
SSEDYNLSS

SEQ ID NO: 504532 - protein, 9 aa, Homo Sapiens
PCGARCSWT

SEQ ID NO: 504533 - protein, 9 aa, Homo Sapiens
GGVARVEVA

SEQ ID NO: 504534 - protein, 9 aa, Homo Sapiens
RPGHDGQRP

SEQ ID NO: 504535 - protein, 9 aa, Homo Sapiens
ELQQKSKVS

SEQ ID NO: 504536 - protein, 9 aa, Homo Sapiens
DKNSKQTCI

SEQ ID NO: 504537 - protein, 9 aa, Homo Sapiens
VLPDQEVQQ

SEQ ID NO: 504538 - protein, 9 aa, Homo Sapiens
RRRLRKGRS

SEQ ID NO: 504539 - protein, 9 aa, Homo Sapiens
SSALRQSVL

SEQ ID NO: 504540 - protein, 9 aa, Homo Sapiens
QDLQVEADK

SEQ ID NO: 504541 - protein, 9 aa, Homo Sapiens
PPKTRMHSL

SEQ ID NO: 504542 - protein, 9 aa, Homo Sapiens
FHFTKDLEI

SEQ ID NO: 504543 - protein, 9 aa, Homo Sapiens
EPPKTRMHS

SEQ ID NO: 504544 - protein, 9 aa, Homo Sapiens
VSCLPVLEK

SEQ ID NO: 504545 - protein, 9 aa, Homo Sapiens
SCNESSYCL

SEQ ID NO: 504546 - protein, 9 aa, Homo Sapiens
KVFTPKSHS

SEQ ID NO: 504547 - protein, 9 aa, Homo Sapiens
LRRLQVTTK

SEQ ID NO: 504548 - protein, 9 aa, Homo Sapiens
VTSVYHSGS

SEQ ID NO: 504549 - protein, 9 aa, Homo Sapiens
TEEEKKTIK

SEQ ID NO: 504550 - protein, 9 aa, Homo Sapiens
FKLQKVKQS

SEQ ID NO: 504551 - protein, 9 aa, Homo Sapiens
LPSEGGVAR

SEQ ID NO: 504552 - protein, 9 aa, Homo Sapiens
NKKYILFGN

SEQ ID NO: 504553 - protein, 9 aa, Homo Sapiens
FPSAKCHLA

SEQ ID NO: 504554 - protein, 9 aa, Homo Sapiens
CTLYYRLYM

SEQ ID NO: 504555 - protein, 9 aa, Homo Sapiens
MGLKPGEAY

SEQ ID NO: 504556 - protein, 9 aa, Homo Sapiens
APRGPGAPS

SEQ ID NO: 504557 - protein, 9 aa, Homo Sapiens
ATTGANGLA

SEQ ID NO: 504558 - protein, 9 aa, Homo Sapiens
IAPKSPPRL

SEQ ID NO: 504559 - protein, 9 aa, Homo Sapiens
VASGESLTL

SEQ ID NO: 504560 - protein, 9 aa, Homo Sapiens
KKYILFGNM

SEQ ID NO: 504561 - protein, 9 aa, Homo Sapiens
EHQLLVRHG

SEQ ID NO: 504562 - protein, 9 aa, Homo Sapiens
SQQNFVRMK

SEQ ID NO: 504563 - protein, 9 aa, Homo Sapiens
ARIHINGEN

SEQ ID NO: 504564 - protein, 9 aa, Homo Sapiens
PSAKCHLAR

SEQ ID NO: 504565 - protein, 9 aa, Homo Sapiens
LRSKIGKWC

SEQ ID NO: 504566 - protein, 9 aa, Homo Sapiens
EVMAVENYV

SEQ ID NO: 504567 - protein, 9 aa, Homo Sapiens
PRARRSARP

SEQ ID NO: 504568 - protein, 9 aa, Homo Sapiens
IWCLIIFLA

SEQ ID NO: 504569 - protein, 9 aa, Homo Sapiens
RPHRSLRTP

SEQ ID NO: 504570 - protein, 9 aa, Homo Sapiens
WDMKINCSG

SEQ ID NO: 504571 - protein, 9 aa, Homo Sapiens
QIQVGHFLF

SEQ ID NO: 504572 - protein, 9 aa, Homo Sapiens
KTRMHSLRP

SEQ ID NO: 504573 - protein, 9 aa, Homo Sapiens
AYYVVSKTG

SEQ ID NO: 504574 - protein, 9 aa, Homo Sapiens
DEEFFQRVL

SEQ ID NO: 504575 - protein, 9 aa, Homo Sapiens
PETPRGPRP

SEQ ID NO: 504576 - protein, 9 aa, Homo Sapiens
KAFKYSSNI

SEQ ID NO: 504577 - protein, 9 aa, Homo Sapiens
AFFVFQLSQ

SEQ ID NO: 504578 - protein, 9 aa, Homo Sapiens
EAAAVVMVV

SEQ ID NO: 504579 - protein, 9 aa, Homo Sapiens
DTEAFVIAT

SEQ ID NO: 504580 - protein, 9 aa, Homo Sapiens
GKSCFVSDN

SEQ ID NO: 504581 - protein, 9 aa, Homo Sapiens
QHLPQLPRQ

SEQ ID NO: 504582 - protein, 9 aa, Homo Sapiens
CRPRWPSSR

SEQ ID NO: 504583 - protein, 9 aa, Homo Sapiens
SGEPPKRKK

SEQ ID NO: 504584 - protein, 9 aa, Homo Sapiens
LDKVTSVYH

SEQ ID NO: 504585 - protein, 9 aa, Homo Sapiens
LDAFFVFQL

SEQ ID NO: 504586 - protein, 9 aa, Homo Sapiens
RVPGAPGGG

SEQ ID NO: 504587 - protein, 9 aa, Homo Sapiens
RVLALCYVI

SEQ ID NO: 504588 - protein, 9 aa, Homo Sapiens
KLLDNRGVM

SEQ ID NO: 504589 - protein, 9 aa, Homo Sapiens
PTAACRPRW

SEQ ID NO: 504590 - protein, 9 aa, Homo Sapiens
KSRPSGFNF

SEQ ID NO: 504591 - protein, 9 aa, Homo Sapiens
QHPQDMVLG

SEQ ID NO: 504592 - protein, 9 aa, Homo Sapiens
QQAWIVQNA

SEQ ID NO: 504593 - protein, 9 aa, Homo Sapiens
ATGISAFLV

SEQ ID NO: 504594 - protein, 9 aa, Homo Sapiens
RTRRLPANQ

SEQ ID NO: 504595 - protein, 9 aa, Homo Sapiens
RRHPRPAKT

SEQ ID NO: 504596 - protein, 9 aa, Homo Sapiens
AVNMDEIER

SEQ ID NO: 504597 - protein, 9 aa, Homo Sapiens
RGHPETPRG

SEQ ID NO: 504598 - protein, 9 aa, Homo Sapiens
PYCMHLSLV

SEQ ID NO: 504599 - protein, 9 aa, Homo Sapiens
IQLSGGQKQ

SEQ ID NO: 504600 - protein, 9 aa, Homo Sapiens
NYVKDSLQW

SEQ ID NO: 504601 - protein, 9 aa, Homo Sapiens
AAAPRGPGA

SEQ ID NO: 504602 - protein, 9 aa, Homo Sapiens
PRCPPPATA

SEQ ID NO: 504603 - protein, 9 aa, Homo Sapiens
GANGLAAAP

SEQ ID NO: 504604 - protein, 9 aa, Homo Sapiens
NAEFDSHEI

SEQ ID NO: 504605 - protein, 9 aa, Homo Sapiens
AEGVRTVQE

SEQ ID NO: 504606 - protein, 9 aa, Homo Sapiens
RTPPPPPAP

SEQ ID NO: 504607 - protein, 9 aa, Homo Sapiens
VATSKILQT

SEQ ID NO: 504608 - protein, 9 aa, Homo Sapiens
EKIFAYYVV

SEQ ID NO: 504609 - protein, 9 aa, Homo Sapiens
SPFPSAKCH

SEQ ID NO: 504610 - protein, 9 aa, Homo Sapiens
AEIGQEIQQ

SEQ ID NO: 504611 - protein, 9 aa, Homo Sapiens
EPVCANNGI

SEQ ID NO: 504612 - protein, 9 aa, Homo Sapiens
ISVDTSSVS

SEQ ID NO: 504613 - protein, 9 aa, Homo Sapiens
ARVEVAAGP

SEQ ID NO: 504614 - protein, 9 aa, Homo Sapiens
EKKPRLEDV

SEQ ID NO: 504615 - protein, 9 aa, Homo Sapiens
SKIGKWCHH

SEQ ID NO: 504616 - protein, 9 aa, Homo Sapiens
VRPVATLSP

SEQ ID NO: 504617 - protein, 9 aa, Homo Sapiens
STDSILVKW

SEQ ID NO: 504618 - protein, 9 aa, Homo Sapiens
SSLATGISA

SEQ ID NO: 504619 - protein, 9 aa, Homo Sapiens
VLLGEDGPV

SEQ ID NO: 504620 - protein, 9 aa, Homo Sapiens
SFVDNVATS

SEQ ID NO: 504621 - protein, 9 aa, Homo Sapiens
VFIPVLPAP

SEQ ID NO: 504622 - protein, 9 aa, Homo Sapiens
IYSEHNYCR

SEQ ID NO: 504623 - protein, 9 aa, Homo Sapiens
RNAEFDSHE

SEQ ID NO: 504624 - protein, 9 aa, Homo Sapiens
AAVVMVVRP

SEQ ID NO: 504625 - protein, 9 aa, Homo Sapiens
LFSLEFCSP

SEQ ID NO: 504626 - protein, 9 aa, Homo Sapiens
VMTLGKSCF

SEQ ID NO: 504627 - protein, 9 aa, Homo Sapiens
KAVNNYCPW

SEQ ID NO: 504628 - protein, 9 aa, Homo Sapiens
PGGIQTMAV

SEQ ID NO: 504629 - protein, 9 aa, Homo Sapiens
LSSPPSLGG

SEQ ID NO: 504630 - protein, 9 aa, Homo Sapiens
GREVTTAIE

SEQ ID NO: 504631 - protein, 9 aa, Homo Sapiens
PGLSGHGEP

SEQ ID NO: 504632 - protein, 9 aa, Homo Sapiens
LTLTTLDGG

SEQ ID NO: 504633 - protein, 9 aa, Homo Sapiens
VGVRAGEGI

SEQ ID NO: 504634 - protein, 9 aa, Homo Sapiens
PPPPPAPRQ

SEQ ID NO: 504635 - protein, 9 aa, Homo Sapiens
PATATRTPP

SEQ ID NO: 504636 - protein, 9 aa, Homo Sapiens
MAVENYVKD

SEQ ID NO: 504637 - protein, 9 aa, Homo Sapiens
TTLDGGSPP

SEQ ID NO: 504638 - protein, 9 aa, Homo Sapiens
TATRTPPGR

SEQ ID NO: 504639 - protein, 9 aa, Homo Sapiens
FRYHEGIHT

SEQ ID NO: 504640 - protein, 9 aa, Homo Sapiens
RECRVRSVD

SEQ ID NO: 504641 - protein, 9 aa, Homo Sapiens
LDRVPGAPG

SEQ ID NO: 504642 - protein, 9 aa, Homo Sapiens
VFGAGPGLS

SEQ ID NO: 504643 - protein, 9 aa, Homo Sapiens
QQNNAAADL

SEQ ID NO: 504644 - protein, 9 aa, Homo Sapiens
IGQEIQQAW

SEQ ID NO: 504645 - protein, 9 aa, Homo Sapiens
PVLPAPSLT

SEQ ID NO: 504646 - protein, 9 aa, Homo Sapiens
LVGPFPPIL

SEQ ID NO: 504647 - protein, 9 aa, Homo Sapiens
VFQLSQEIK

SEQ ID NO: 504648 - protein, 9 aa, Homo Sapiens
KKPQKPITR

SEQ ID NO: 504649 - protein, 9 aa, Homo Sapiens
LYYRLYMEQ

SEQ ID NO: 504650 - protein, 9 aa, Homo Sapiens
IGFESLKRA

SEQ ID NO: 504651 - protein, 9 aa, Homo Sapiens
QTPGTDKEL

SEQ ID NO: 504652 - protein, 9 aa, Homo Sapiens
KDKNSKQTC

SEQ ID NO: 504653 - protein, 9 aa, Homo Sapiens
PPAGVGLAP

SEQ ID NO: 504654 - protein, 9 aa, Homo Sapiens
KDKDENVKK

SEQ ID NO: 504655 - protein, 9 aa, Homo Sapiens
PRTARPLRP

SEQ ID NO: 504656 - protein, 9 aa, Homo Sapiens
KFGGGLRQR

SEQ ID NO: 504657 - protein, 9 aa, Homo Sapiens
KITVDDFLP

SEQ ID NO: 504658 - protein, 9 aa, Homo Sapiens
KPITRPGNK

SEQ ID NO: 504659 - protein, 9 aa, Homo Sapiens
QEIQQAWIV

SEQ ID NO: 504660 - protein, 9 aa, Homo Sapiens
ARRSARPGA

SEQ ID NO: 504661 - protein, 9 aa, Homo Sapiens
SDDQRDPPA

SEQ ID NO: 504662 - protein, 9 aa, Homo Sapiens
LALCYVISG

SEQ ID NO: 504663 - protein, 9 aa, Homo Sapiens
QNKQVHASQ

SEQ ID NO: 504664 - protein, 9 aa, Homo Sapiens
SENSQFCFC

SEQ ID NO: 504665 - protein, 9 aa, Homo Sapiens
APYCMHLSL

SEQ ID NO: 504666 - protein, 9 aa, Homo Sapiens
QQPVQPPYE

SEQ ID NO: 504667 - protein, 9 aa, Homo Sapiens
DPPADDMEG

SEQ ID NO: 504668 - protein, 9 aa, Homo Sapiens
PVNISVDTS

SEQ ID NO: 504669 - protein, 9 aa, Homo Sapiens
PAGVGLAPG

SEQ ID NO: 504670 - protein, 9 aa, Homo Sapiens
EEDTEAFVI

SEQ ID NO: 504671 - protein, 9 aa, Homo Sapiens
VCRTNGLTK

SEQ ID NO: 504672 - protein, 9 aa, Homo Sapiens
IGSNMNDLK

SEQ ID NO: 504673 - protein, 9 aa, Homo Sapiens
TNKILSFPQ

SEQ ID NO: 504674 - protein, 9 aa, Homo Sapiens
RIGVVLFDF

SEQ ID NO: 504675 - protein, 9 aa, Homo Sapiens
VDVLPDQEV

SEQ ID NO: 504676 - protein, 9 aa, Homo Sapiens
FHVSNHPGW

SEQ ID NO: 504677 - protein, 9 aa, Homo Sapiens
RPSGFNFHV

SEQ ID NO: 504678 - protein, 9 aa, Homo Sapiens
RGSMCNTRF

SEQ ID NO: 504679 - protein, 9 aa, Homo Sapiens
QLLVRHGGV

SEQ ID NO: 504680 - protein, 9 aa, Homo Sapiens
QNNAAADLR

SEQ ID NO: 504681 - protein, 9 aa, Homo Sapiens
EHFMDANQS

SEQ ID NO: 504682 - protein, 9 aa, Homo Sapiens
QSCNESSYC

SEQ ID NO: 504683 - protein, 9 aa, Homo Sapiens
CLPVLEKEL

SEQ ID NO: 504684 - protein, 9 aa, Homo Sapiens
TEFLKHKAV

SEQ ID NO: 504685 - protein, 9 aa, Homo Sapiens
GDIIVTLKS

SEQ ID NO: 504686 - protein, 9 aa, Homo Sapiens
KTVKLKELL

SEQ ID NO: 504687 - protein, 9 aa, Homo Sapiens
FTEEEKKTI

SEQ ID NO: 504688 - protein, 9 aa, Homo Sapiens
NLKPKEVFL

SEQ ID NO: 504689 - protein, 9 aa, Homo Sapiens
ATGFTSSLS

SEQ ID NO: 504690 - protein, 9 aa, Homo Sapiens
IPRYCLFGN

SEQ ID NO: 504691 - protein, 9 aa, Homo Sapiens
PQASGEGPC

SEQ ID NO: 504692 - protein, 9 aa, Homo Sapiens
GSSATGFTS

SEQ ID NO: 504693 - protein, 9 aa, Homo Sapiens
VLDASGHHG

SEQ ID NO: 504694 - protein, 9 aa, Homo Sapiens
KTSFARRTA

SEQ ID NO: 504695 - protein, 9 aa, Homo Sapiens
LKNPDQIQV

SEQ ID NO: 504696 - protein, 9 aa, Homo Sapiens
EIIKINPKL

SEQ ID NO: 504697 - protein, 9 aa, Homo Sapiens
PGHDGQRPS

SEQ ID NO: 504698 - protein, 9 aa, Homo Sapiens
AQSWRHPGP

SEQ ID NO: 504699 - protein, 9 aa, Homo Sapiens
KRGSMCNTR

SEQ ID NO: 504700 - protein, 9 aa, Homo Sapiens
TSKILQTDL

SEQ ID NO: 504701 - protein, 9 aa, Homo Sapiens
VTRIGVVLF

SEQ ID NO: 504702 - protein, 9 aa, Homo Sapiens
ILKSLCRIM

SEQ ID NO: 504703 - protein, 9 aa, Homo Sapiens
ESLKRADAG

SEQ ID NO: 504704 - protein, 9 aa, Homo Sapiens
TVQELIKCQ

SEQ ID NO: 504705 - protein, 9 aa, Homo Sapiens
ALQDLQVEA

SEQ ID NO: 504706 - protein, 9 aa, Homo Sapiens
DSPHHLQEK

SEQ ID NO: 504707 - protein, 9 aa, Homo Sapiens
YELAVDRFN

SEQ ID NO: 504708 - protein, 9 aa, Homo Sapiens
EKLLDNRGV

SEQ ID NO: 504709 - protein, 9 aa, Homo Sapiens
GHTRWHQPG

SEQ ID NO: 504710 - protein, 9 aa, Homo Sapiens
LHAMEGHLM

SEQ ID NO: 504711 - protein, 9 aa, Homo Sapiens
LWFTVDPGA

SEQ ID NO: 504712 - protein, 9 aa, Homo Sapiens
SAPYCMHLS

SEQ ID NO: 504713 - protein, 9 aa, Homo Sapiens
RPGAPGRRS

SEQ ID NO: 504714 - protein, 9 aa, Homo Sapiens
LGKSCFVSD

SEQ ID NO: 504715 - protein, 9 aa, Homo Sapiens
APPSPASRG

SEQ ID NO: 504716 - protein, 9 aa, Homo Sapiens
EKLDAFFVF

SEQ ID NO: 504717 - protein, 9 aa, Homo Sapiens
TFCLESDLT

SEQ ID NO: 504718 - protein, 9 aa, Homo Sapiens
VQELIKCQE

SEQ ID NO: 504719 - protein, 9 aa, Homo Sapiens
GSSGFLRPS

SEQ ID NO: 504720 - protein, 9 aa, Homo Sapiens
RSARPGAPG

SEQ ID NO: 504721 - protein, 9 aa, Homo Sapiens
IVLVISYIM

SEQ ID NO: 504722 - protein, 9 aa, Homo Sapiens
HLVVSCLPV

SEQ ID NO: 504723 - protein, 9 aa, Homo Sapiens
MGHGVCIGL

SEQ ID NO: 504724 - protein, 9 aa, Homo Sapiens
PKQYEREYN

SEQ ID NO: 504725 - protein, 9 aa, Homo Sapiens
EWDMKINCS

SEQ ID NO: 504726 - protein, 9 aa, Homo Sapiens
PPPPAPRQL

SEQ ID NO: 504727 - protein, 9 aa, Homo Sapiens
ATLSPGEAR

SEQ ID NO: 504728 - protein, 9 aa, Homo Sapiens
RKRREREAL

SEQ ID NO: 504729 - protein, 9 aa, Homo Sapiens
LQQKSKVSK

SEQ ID NO: 504730 - protein, 9 aa, Homo Sapiens
GHSKDKNSK

SEQ ID NO: 504731 - protein, 9 aa, Homo Sapiens
EYIEGRELF

SEQ ID NO: 504732 - protein, 9 aa, Homo Sapiens
SSWGCWATT

SEQ ID NO: 504733 - protein, 9 aa, Homo Sapiens
LNFHWYPVP

SEQ ID NO: 504734 - protein, 9 aa, Homo Sapiens
LLEKLLDNR

SEQ ID NO: 504735 - protein, 9 aa, Homo Sapiens
DRVPGAPGG

SEQ ID NO: 504736 - protein, 9 aa, Homo Sapiens
GLGYSYPVD

SEQ ID NO: 504737 - protein, 9 aa, Homo Sapiens
REGPCPQAS

SEQ ID NO: 504738 - protein, 9 aa, Homo Sapiens
YLNGSIFQL

SEQ ID NO: 504739 - protein, 9 aa, Homo Sapiens
VEADKKKQK

SEQ ID NO: 504740 - protein, 9 aa, Homo Sapiens
VLMGHGVCI

SEQ ID NO: 504741 - protein, 9 aa, Homo Sapiens
DTSSVSSGY

SEQ ID NO: 504742 - protein, 9 aa, Homo Sapiens
TRRPAAPRT

SEQ ID NO: 504743 - protein, 9 aa, Homo Sapiens
SANNLPGEY

SEQ ID NO: 504744 - protein, 9 aa, Homo Sapiens
CSEVNHMNA

SEQ ID NO: 504745 - protein, 9 aa, Homo Sapiens
EGREVTTAI

SEQ ID NO: 504746 - protein, 9 aa, Homo Sapiens
AVQASRISS

SEQ ID NO: 504747 - protein, 9 aa, Homo Sapiens
PARWLSSPP

SEQ ID NO: 504748 - protein, 9 aa, Homo Sapiens
SRPGPSTSR

SEQ ID NO: 504749 - protein, 9 aa, Homo Sapiens
LAEGRLSGK

SEQ ID NO: 504750 - protein, 9 aa, Homo Sapiens
DQEVQQRQQ

SEQ ID NO: 504751 - protein, 9 aa, Homo Sapiens
LRRSPFPSA

SEQ ID NO: 504752 - protein, 9 aa, Homo Sapiens
DIIARIHIN

SEQ ID NO: 504753 - protein, 9 aa, Homo Sapiens
QKFGGGLRQ

SEQ ID NO: 504754 - protein, 9 aa, Homo Sapiens
LFPKARPWL

SEQ ID NO: 504755 - protein, 9 aa, Homo Sapiens
TPPRCPPPA

SEQ ID NO: 504756 - protein, 9 aa, Homo Sapiens
AAPGPRRHP

SEQ ID NO: 504757 - protein, 9 aa, Homo Sapiens
ESLVYSSWA

SEQ ID NO: 504758 - protein, 9 aa, Homo Sapiens
KTPKQYERE

SEQ ID NO: 504759 - protein, 9 aa, Homo Sapiens
KHKAVNNYC

SEQ ID NO: 504760 - protein, 9 aa, Homo Sapiens
RWGNSGCRC

SEQ ID NO: 504761 - protein, 9 aa, Homo Sapiens
AVDRFNWEL

SEQ ID NO: 504762 - protein, 9 aa, Homo Sapiens
ISVTRIGVV

SEQ ID NO: 504763 - protein, 9 aa, Homo Sapiens
VSRPQLRGL

SEQ ID NO: 504764 - protein, 9 aa, Homo Sapiens
CCSQSCNES

SEQ ID NO: 504765 - protein, 9 aa, Homo Sapiens
RHVRGVIAN

SEQ ID NO: 504766 - protein, 9 aa, Homo Sapiens
SWAPGEPND

SEQ ID NO: 504767 - protein, 9 aa, Homo Sapiens
IRDYHIRFI

SEQ ID NO: 504768 - protein, 9 aa, Homo Sapiens
KIPRYCLFG

SEQ ID NO: 504769 - protein, 9 aa, Homo Sapiens
VQPGPMVAS

SEQ ID NO: 504770 - protein, 9 aa, Homo Sapiens
PELSLTLTT

SEQ ID NO: 504771 - protein, 9 aa, Homo Sapiens
RKITVDDFL

SEQ ID NO: 504772 - protein, 9 aa, Homo Sapiens
WGCWATTGA

SEQ ID NO: 504773 - protein, 9 aa, Homo Sapiens
GCRCPRARR

SEQ ID NO: 504774 - protein, 9 aa, Homo Sapiens
KRSPKSRPS

SEQ ID NO: 504775 - protein, 9 aa, Homo Sapiens
TPPGRSASA

SEQ ID NO: 504776 - protein, 9 aa, Homo Sapiens
LCRSEGREV

SEQ ID NO: 504777 - protein, 9 aa, Homo Sapiens
PVCANNGIT

SEQ ID NO: 504778 - protein, 9 aa, Homo Sapiens
MVVRPVATL

SEQ ID NO: 504779 - protein, 9 aa, Homo Sapiens
NSEEYGDII

SEQ ID NO: 504780 - protein, 9 aa, Homo Sapiens
PFFTNKILS

SEQ ID NO: 504781 - protein, 9 aa, Homo Sapiens
EAFVIATLQ

SEQ ID NO: 504782 - protein, 9 aa, Homo Sapiens
MDRGLGYSY

SEQ ID NO: 504783 - protein, 9 aa, Homo Sapiens
VVDTAVISS

SEQ ID NO: 504784 - protein, 9 aa, Homo Sapiens
HREGPCPQA

SEQ ID NO: 504785 - protein, 9 aa, Homo Sapiens
AAPRGPGAP

SEQ ID NO: 504786 - protein, 9 aa, Homo Sapiens
SFRYHEGIH

SEQ ID NO: 504787 - protein, 9 aa, Homo Sapiens
LTQPEHDVP

SEQ ID NO: 504788 - protein, 9 aa, Homo Sapiens
TRPGNKFQG

SEQ ID NO: 504789 - protein, 9 aa, Homo Sapiens
DSRSGQAQH

SEQ ID NO: 504790 - protein, 9 aa, Homo Sapiens
TSHQKAQIA

SEQ ID NO: 504791 - protein, 9 aa, Homo Sapiens
RPSAAPGPR

SEQ ID NO: 504792 - protein, 9 aa, Homo Sapiens
HDGQRPSGG

SEQ ID NO: 504793 - protein, 9 aa, Homo Sapiens
GVFGAGPGL

SEQ ID NO: 504794 - protein, 9 aa, Homo Sapiens
GTFGDCGVL

SEQ ID NO: 504795 - protein, 9 aa, Homo Sapiens
KSCFVSDNS

SEQ ID NO: 504796 - protein, 9 aa, Homo Sapiens
LTTLDGGSP

SEQ ID NO: 504797 - protein, 9 aa, Homo Sapiens
EKKTIKGTA

SEQ ID NO: 504798 - protein, 9 aa, Homo Sapiens
DMVLGLQVD

SEQ ID NO: 504799 - protein, 9 aa, Homo Sapiens
EARAPLESV

SEQ ID NO: 504800 - protein, 9 aa, Homo Sapiens
FPQLDNEAT

SEQ ID NO: 504801 - protein, 9 aa, Homo Sapiens
YSSWAPGEP

SEQ ID NO: 504802 - protein, 9 aa, Homo Sapiens
DIIVTLKST

SEQ ID NO: 504803 - protein, 9 aa, Homo Sapiens
NKQVHASQT

SEQ ID NO: 504804 - protein, 9 aa, Homo Sapiens
RSPFPSAKC

SEQ ID NO: 504805 - protein, 9 aa, Homo Sapiens
CPQASGEGP

SEQ ID NO: 504806 - protein, 9 aa, Homo Sapiens
SLGHSKDKN

SEQ ID NO: 504807 - protein, 9 aa, Homo Sapiens
LQVDPAPAH

SEQ ID NO: 504808 - protein, 9 aa, Homo Sapiens
PWLVGPFPP

SEQ ID NO: 504809 - protein, 9 aa, Homo Sapiens
LAEIGSNMN

SEQ ID NO: 504810 - protein, 9 aa, Homo Sapiens
KPQKPITRP

SEQ ID NO: 504811 - protein, 9 aa, Homo Sapiens
IGLMAAACA

SEQ ID NO: 504812 - protein, 9 aa, Homo Sapiens
FSALVCRTN

SEQ ID NO: 504813 - protein, 9 aa, Homo Sapiens
QHLAEIGSN

SEQ ID NO: 504814 - protein, 9 aa, Homo Sapiens
KIGKWCHHR

SEQ ID NO: 504815 - protein, 9 aa, Homo Sapiens
PGPRRHPRP

SEQ ID NO: 504816 - protein, 9 aa, Homo Sapiens
SSATGFTSS

SEQ ID NO: 504817 - protein, 9 aa, Homo Sapiens
TGMERSPCA

SEQ ID NO: 504818 - protein, 9 aa, Homo Sapiens
NVMTLGKSC

SEQ ID NO: 504819 - protein, 9 aa, Homo Sapiens
AGPGLSGHG

SEQ ID NO: 504820 - protein, 9 aa, Homo Sapiens
HLVAQAALK

SEQ ID NO: 504821 - protein, 9 aa, Homo Sapiens
ECGKTFCLE

SEQ ID NO: 504822 - protein, 9 aa, Homo Sapiens
ITTHKKIHT

SEQ ID NO: 504823 - protein, 9 aa, Homo Sapiens
AAPPRSAAA

SEQ ID NO: 504824 - protein, 9 aa, Homo Sapiens
TSVYHSGSS

SEQ ID NO: 504825 - protein, 9 aa, Homo Sapiens
ESDLTIHQR

SEQ ID NO: 504826 - protein, 9 aa, Homo Sapiens
TFWTNPQYC

SEQ ID NO: 504827 - protein, 9 aa, Homo Sapiens
QQAVLLGED

SEQ ID NO: 504828 - protein, 9 aa, Homo Sapiens
WAISVTRIG

SEQ ID NO: 504829 - protein, 9 aa, Homo Sapiens
DLQVEADKK

SEQ ID NO: 504830 - protein, 9 aa, Homo Sapiens
EGPKQAICA

SEQ ID NO: 504831 - protein, 9 aa, Homo Sapiens
PARWGNSGC

SEQ ID NO: 504832 - protein, 9 aa, Homo Sapiens
RGPGAPSAP

SEQ ID NO: 504833 - protein, 9 aa, Homo Sapiens
LEDVSPFVT

SEQ ID NO: 504834 - protein, 9 aa, Homo Sapiens
VDDFLPFDE

SEQ ID NO: 504835 - protein, 9 aa, Homo Sapiens
SPGEARAPL

SEQ ID NO: 504836 - protein, 9 aa, Homo Sapiens
IELQQKSKV

SEQ ID NO: 504837 - protein, 9 aa, Homo Sapiens
DNVATSKIL

SEQ ID NO: 504838 - protein, 9 aa, Homo Sapiens
TAARPCPPT

SEQ ID NO: 504839 - protein, 9 aa, Homo Sapiens
DPLSPPLCM

SEQ ID NO: 504840 - protein, 9 aa, Homo Sapiens
SQTPGTDKE

SEQ ID NO: 504841 - protein, 9 aa, Homo Sapiens
NEKKYHFQE

SEQ ID NO: 504842 - protein, 9 aa, Homo Sapiens
PGGPPRPAR

SEQ ID NO: 504843 - protein, 9 aa, Homo Sapiens
ENYVKDSLQ

SEQ ID NO: 504844 - protein, 9 aa, Homo Sapiens
RNKKYILFG

SEQ ID NO: 504845 - protein, 9 aa, Homo Sapiens
ERMIQAIDR

SEQ ID NO: 504846 - protein, 9 aa, Homo Sapiens
FGGGLRQRR

SEQ ID NO: 504847 - protein, 9 aa, Homo Sapiens
LQKVKQSFD

SEQ ID NO: 504848 - protein, 9 aa, Homo Sapiens
EDFFKLEWD

SEQ ID NO: 504849 - protein, 9 aa, Homo Sapiens
RPGGPPRPA

SEQ ID NO: 504850 - protein, 9 aa, Homo Sapiens
EDTSTDSIL

SEQ ID NO: 504851 - protein, 9 aa, Homo Sapiens
SSPLRTGAA

SEQ ID NO: 504852 - protein, 9 aa, Homo Sapiens
VAEAAAVVM

SEQ ID NO: 504853 - protein, 9 aa, Homo Sapiens
EEYGDIIVT

SEQ ID NO: 504854 - protein, 9 aa, Homo Sapiens
SGCRCPRAR

SEQ ID NO: 504855 - protein, 9 aa, Homo Sapiens
GAPGRRSCC

SEQ ID NO: 504856 - protein, 9 aa, Homo Sapiens
IHLCDMRSS

SEQ ID NO: 504857 - protein, 9 aa, Homo Sapiens
SCLPVLEKE

SEQ ID NO: 504858 - protein, 9 aa, Homo Sapiens
VQIRDYHIR

SEQ ID NO: 504859 - protein, 9 aa, Homo Sapiens
KNPDQIQVG

SEQ ID NO: 504860 - protein, 9 aa, Homo Sapiens
RRSARPGAP

SEQ ID NO: 504861 - protein, 9 aa, Homo Sapiens
VSPFVTQLK

SEQ ID NO: 504862 - protein, 9 aa, Homo Sapiens
NNIYCQPDI

SEQ ID NO: 504863 - protein, 9 aa, Homo Sapiens
QLPPRPPSP

SEQ ID NO: 504864 - protein, 9 aa, Homo Sapiens
MYVGVRAGE

SEQ ID NO: 504865 - protein, 9 aa, Homo Sapiens
APRTARPLR

SEQ ID NO: 504866 - protein, 9 aa, Homo Sapiens
QTMAVWCAH

SEQ ID NO: 504867 - protein, 9 aa, Homo Sapiens
PCAMERVLK

SEQ ID NO: 504868 - protein, 9 aa, Homo Sapiens
PKPEISWTR

SEQ ID NO: 504869 - protein, 9 aa, Homo Sapiens
PGSSPPRSP

SEQ ID NO: 504870 - protein, 9 aa, Homo Sapiens
AARPCPPTA

SEQ ID NO: 504871 - protein, 9 aa, Homo Sapiens
QVTTKILFQ

SEQ ID NO: 504872 - protein, 9 aa, Homo Sapiens
VATLSPGEA

SEQ ID NO: 504873 - protein, 9 aa, Homo Sapiens
RLPFFTNKI

SEQ ID NO: 504874 - protein, 9 aa, Homo Sapiens
PRSAAAATS

SEQ ID NO: 504875 - protein, 9 aa, Homo Sapiens
QLRRLQVTT

SEQ ID NO: 504876 - protein, 9 aa, Homo Sapiens
FFKLQKVKQ

SEQ ID NO: 504877 - protein, 9 aa, Homo Sapiens
APAHRHVRG

SEQ ID NO: 504878 - protein, 9 aa, Homo Sapiens
EGHTRWHQP

SEQ ID NO: 504879 - protein, 9 aa, Homo Sapiens
YIMALHFFF

SEQ ID NO: 504880 - protein, 9 aa, Homo Sapiens
QRDPPADDM

SEQ ID NO: 504881 - protein, 9 aa, Homo Sapiens
CRTNGLTKP

SEQ ID NO: 504882 - protein, 9 aa, Homo Sapiens
ANNLPGEYN

SEQ ID NO: 504883 - protein, 9 aa, Homo Sapiens
LGEDGPVLR

SEQ ID NO: 504884 - protein, 9 aa, Homo Sapiens
ATATRTPPG

SEQ ID NO: 504885 - protein, 9 aa, Homo Sapiens
PPLPSEGGV

SEQ ID NO: 504886 - protein, 9 aa, Homo Sapiens
QDAILYLQT

SEQ ID NO: 504887 - protein, 9 aa, Homo Sapiens
ARCSWTAAR

SEQ ID NO: 504888 - protein, 9 aa, Homo Sapiens
MTLGKSCFV

SEQ ID NO: 504889 - protein, 9 aa, Homo Sapiens
MEGHLMIAF

SEQ ID NO: 504890 - protein, 9 aa, Homo Sapiens
QIGYCVQGT

SEQ ID NO: 504891 - protein, 9 aa, Homo Sapiens
FELTHKNDC

SEQ ID NO: 504892 - protein, 9 aa, Homo Sapiens
SAPAARSPT

SEQ ID NO: 504893 - protein, 9 aa, Homo Sapiens
ARPLRPRPR

SEQ ID NO: 504894 - protein, 9 aa, Homo Sapiens
KSHSPLKRS

SEQ ID NO: 504895 - protein, 9 aa, Homo Sapiens
PGILAEGRL

SEQ ID NO: 504896 - protein, 9 aa, Homo Sapiens
TPKQYEREY

SEQ ID NO: 504897 - protein, 9 aa, Homo Sapiens
RLLSQASWT

SEQ ID NO: 504898 - protein, 9 aa, Homo Sapiens
YHEGIHTGE

SEQ ID NO: 504899 - protein, 9 aa, Homo Sapiens
PTRTRRLPA

SEQ ID NO: 504900 - protein, 9 aa, Homo Sapiens
AQADSLIVY

SEQ ID NO: 504901 - protein, 9 aa, Homo Sapiens
NSSVTSCLE

SEQ ID NO: 504902 - protein, 9 aa, Homo Sapiens
VDPAPAHRH

SEQ ID NO: 504903 - protein, 9 aa, Homo Sapiens
VSPLTRYAP

SEQ ID NO: 504904 - protein, 9 aa, Homo Sapiens
AIDRINAQK

SEQ ID NO: 504905 - protein, 9 aa, Homo Sapiens
GQAQHGQVS

SEQ ID NO: 504906 - protein, 9 aa, Homo Sapiens
RFNWELWCR

SEQ ID NO: 504907 - protein, 9 aa, Homo Sapiens
NPQYCLKLL

SEQ ID NO: 504908 - protein, 9 aa, Homo Sapiens
KPFDLRSKI

SEQ ID NO: 504909 - protein, 9 aa, Homo Sapiens
GVAQQAVLL

SEQ ID NO: 504910 - protein, 9 aa, Homo Sapiens
KTISGKTPK

SEQ ID NO: 504911 - protein, 9 aa, Homo Sapiens
SGFNFHVSN

SEQ ID NO: 504912 - protein, 9 aa, Homo Sapiens
QDMVLGLQV

SEQ ID NO: 504913 - protein, 9 aa, Homo Sapiens
SAAAATSSL

SEQ ID NO: 504914 - protein, 9 aa, Homo Sapiens
ASPRTARPS

SEQ ID NO: 504915 - protein, 9 aa, Homo Sapiens
QASRISSFL

SEQ ID NO: 504916 - protein, 9 aa, Homo Sapiens
FVRMKEALR

SEQ ID NO: 504917 - protein, 9 aa, Homo Sapiens
KQVHASQTP

SEQ ID NO: 504918 - protein, 9 aa, Homo Sapiens
STVLMGLKP

SEQ ID NO: 504919 - protein, 9 aa, Homo Sapiens
ELSLTLTTL

SEQ ID NO: 504920 - protein, 9 aa, Homo Sapiens
RPAAPRTAR

SEQ ID NO: 504921 - protein, 9 aa, Homo Sapiens
AQQAVLLGE

SEQ ID NO: 504922 - protein, 9 aa, Homo Sapiens
SNHPGWLKV

SEQ ID NO: 504923 - protein, 9 aa, Homo Sapiens
AVVMVVRPV

SEQ ID NO: 504924 - protein, 9 aa, Homo Sapiens
PHREGPCPQ

SEQ ID NO: 504925 - protein, 9 aa, Homo Sapiens
MNLKPKEVF

SEQ ID NO: 504926 - protein, 9 aa, Homo Sapiens
EGHLMIAFL

SEQ ID NO: 504927 - protein, 9 aa, Homo Sapiens
TARPSAAPG

SEQ ID NO: 504928 - protein, 9 aa, Homo Sapiens
VVELFGKLV

SEQ ID NO: 504929 - protein, 9 aa, Homo Sapiens
GLAPGPSQT

SEQ ID NO: 504930 - protein, 9 aa, Homo Sapiens
SQASWTLRI

SEQ ID NO: 504931 - protein, 9 aa, Homo Sapiens
TKVGDKGIQ

SEQ ID NO: 504932 - protein, 9 aa, Homo Sapiens
SPHHLQEKC

SEQ ID NO: 504933 - protein, 9 aa, Homo Sapiens
EIAELNNIN

SEQ ID NO: 504934 - protein, 9 aa, Homo Sapiens
SARPHRSLR

SEQ ID NO: 504935 - protein, 9 aa, Homo Sapiens
PSQTLKPVL

SEQ ID NO: 504936 - protein, 9 aa, Homo Sapiens
IQIELQQKS

SEQ ID NO: 504937 - protein, 9 aa, Homo Sapiens
KPEISWTRN

SEQ ID NO: 504938 - protein, 9 aa, Homo Sapiens
PGRSASARP

SEQ ID NO: 504939 - protein, 9 aa, Homo Sapiens
HPGWLKVSP

SEQ ID NO: 504940 - protein, 9 aa, Homo Sapiens
DRKRREREA

SEQ ID NO: 504941 - protein, 9 aa, Homo Sapiens
KCAKCPPHR

SEQ ID NO: 504942 - protein, 9 aa, Homo Sapiens
ICQHLPQLP

SEQ ID NO: 504943 - protein, 9 aa, Homo Sapiens
QVYMDRGLG

SEQ ID NO: 504944 - protein, 9 aa, Homo Sapiens
PRPGGPPRP

SEQ ID NO: 504945 - protein, 9 aa, Homo Sapiens
SQWEPVCAN

SEQ ID NO: 504946 - protein, 9 aa, Homo Sapiens
KRREREALL

SEQ ID NO: 504947 - protein, 9 aa, Homo Sapiens
EVTTAIERR

SEQ ID NO: 504948 - protein, 9 aa, Homo Sapiens
CPPHRSTQE

SEQ ID NO: 504949 - protein, 9 aa, Homo Sapiens
SSAPYCMHL

SEQ ID NO: 504950 - protein, 9 aa, Homo Sapiens
LKHKAVNNY

SEQ ID NO: 504951 - protein, 9 aa, Homo Sapiens
DPGILAEGR

SEQ ID NO: 504952 - protein, 9 aa, Homo Sapiens
YSEHNYCRL

SEQ ID NO: 504953 - protein, 9 aa, Homo Sapiens
FSLEFCSPG

SEQ ID NO: 504954 - protein, 9 aa, Homo Sapiens
NNQLRRLQV

SEQ ID NO: 504955 - protein, 9 aa, Homo Sapiens
VNMDEIERY

SEQ ID NO: 504956 - protein, 9 aa, Homo Sapiens
SLGSSPLRT

SEQ ID NO: 504957 - protein, 9 aa, Homo Sapiens
PSGFNFHVS

SEQ ID NO: 504958 - protein, 9 aa, Homo Sapiens
KNLHLVVSC

SEQ ID NO: 504959 - protein, 9 aa, Homo Sapiens
PEHFMDANQ

SEQ ID NO: 504960 - protein, 9 aa, Homo Sapiens
SSFRYHEGI

SEQ ID NO: 504961 - protein, 9 aa, Homo Sapiens
SGSSWGCWA

SEQ ID NO: 504962 - protein, 9 aa, Homo Sapiens
DVSPFVTQL

SEQ ID NO: 504963 - protein, 9 aa, Homo Sapiens
PGWLKVSPL

SEQ ID NO: 504964 - protein, 9 aa, Homo Sapiens
INEKKYHFQ

SEQ ID NO: 504965 - protein, 9 aa, Homo Sapiens
ALLLSFQLR

SEQ ID NO: 504966 - protein, 9 aa, Homo Sapiens
SHEIQIYEE

SEQ ID NO: 504967 - protein, 9 aa, Homo Sapiens
VRAVHAGTF

SEQ ID NO: 504968 - protein, 9 aa, Homo Sapiens
RSPTRTRRL

SEQ ID NO: 504969 - protein, 9 aa, Homo Sapiens
PVQPPYEVP

SEQ ID NO: 504970 - protein, 9 aa, Homo Sapiens
PGPSQTLKP

SEQ ID NO: 504971 - protein, 9 aa, Homo Sapiens
NQLRRLQVT

SEQ ID NO: 504972 - protein, 9 aa, Homo Sapiens
GFLRPSGDM

SEQ ID NO: 504973 - protein, 9 aa, Homo Sapiens
PSPARWLSS

SEQ ID NO: 504974 - protein, 9 aa, Homo Sapiens
HTRWHQPGR

SEQ ID NO: 504975 - protein, 9 aa, Homo Sapiens
DEIERYQEV

SEQ ID NO: 504976 - protein, 9 aa, Homo Sapiens
QHGQDAILY

SEQ ID NO: 504977 - protein, 9 aa, Homo Sapiens
RSKIGKWCH

SEQ ID NO: 504978 - protein, 9 aa, Homo Sapiens
GSSCCSQSC

SEQ ID NO: 504979 - protein, 9 aa, Homo Sapiens
QRALQDLQV

SEQ ID NO: 504980 - protein, 9 aa, Homo Sapiens
RRLPANQTP

SEQ ID NO: 504981 - protein, 9 aa, Homo Sapiens
ALDKVTSVY

SEQ ID NO: 504982 - protein, 9 aa, Homo Sapiens
QQHICQHLP

SEQ ID NO: 504983 - protein, 9 aa, Homo Sapiens
LLLSFQLRE

SEQ ID NO: 504984 - protein, 9 aa, Homo Sapiens
SLIVYLVVA

SEQ ID NO: 504985 - protein, 9 aa, Homo Sapiens
RKDSPHHLQ

SEQ ID NO: 504986 - protein, 9 aa, Homo Sapiens
TLDGGSPPR

SEQ ID NO: 504987 - protein, 9 aa, Homo Sapiens
WTLRILTLE

SEQ ID NO: 504988 - protein, 9 aa, Homo Sapiens
NAAADLRKT

SEQ ID NO: 504989 - protein, 9 aa, Homo Sapiens
FGLTQPEHD

SEQ ID NO: 504990 - protein, 9 aa, Homo Sapiens
TAIERRPPL

SEQ ID NO: 504991 - protein, 9 aa, Homo Sapiens
SMCNTRFSD

SEQ ID NO: 504992 - protein, 9 aa, Homo Sapiens
QKAQIAPKS

SEQ ID NO: 504993 - protein, 9 aa, Homo Sapiens
PMREVAEAA

SEQ ID NO: 504994 - protein, 9 aa, Homo Sapiens
SCFVSDNSL

SEQ ID NO: 504995 - protein, 9 aa, Homo Sapiens
EGPCPQASG

SEQ ID NO: 504996 - protein, 9 aa, Homo Sapiens
SSSASQHGQ

SEQ ID NO: 504997 - protein, 9 aa, Homo Sapiens
PLSPPLCML

SEQ ID NO: 504998 - protein, 9 aa, Homo Sapiens
IGYCVQGTT

SEQ ID NO: 504999 - protein, 9 aa, Homo Sapiens
ESSTVLMGL

SEQ ID NO: 505000 - protein, 9 aa, Homo Sapiens
SPPAGVGLA

SEQ ID NO: 505001 - protein, 9 aa, Homo Sapiens
GISAFLVTE

SEQ ID NO: 505002 - protein, 9 aa, Homo Sapiens
KIFAYYVVS

SEQ ID NO: 505003 - protein, 9 aa, Homo Sapiens
VARVEVAAG

SEQ ID NO: 505004 - protein, 9 aa, Homo Sapiens
LPDQEVQQR

SEQ ID NO: 505005 - protein, 9 aa, Homo Sapiens
QGTTSANTT

SEQ ID NO: 505006 - protein, 9 aa, Homo Sapiens
PAKTPTRRP

SEQ ID NO: 505007 - protein, 9 aa, Homo Sapiens
LPQLPRQQH

SEQ ID NO: 505008 - protein, 9 aa, Homo Sapiens
CANNGITYI

SEQ ID NO: 505009 - protein, 9 aa, Homo Sapiens
YSSSKGTIH

SEQ ID NO: 505010 - protein, 9 aa, Homo Sapiens
RGRRKSGEP

SEQ ID NO: 505011 - protein, 9 aa, Homo Sapiens
QMVQIRDYH

SEQ ID NO: 505012 - protein, 9 aa, Homo Sapiens
AFVIATLQN

SEQ ID NO: 505013 - protein, 9 aa, Homo Sapiens
KNSKQTCIR

SEQ ID NO: 505014 - protein, 9 aa, Homo Sapiens
GQSLGSSPL

SEQ ID NO: 505015 - protein, 9 aa, Homo Sapiens
GPFPPILVE

SEQ ID NO: 505016 - protein, 9 aa, Homo Sapiens
NNLPGEYNE

SEQ ID NO: 505017 - protein, 9 aa, Homo Sapiens
SSFLHMNGM

SEQ ID NO: 505018 - protein, 9 aa, Homo Sapiens
EQMVQIRDY

SEQ ID NO: 505019 - protein, 9 aa, Homo Sapiens
EFDSHEIQI

SEQ ID NO: 505020 - protein, 9 aa, Homo Sapiens
QEFNPEHFM

SEQ ID NO: 505021 - protein, 9 aa, Homo Sapiens
EEFFQRVLA

SEQ ID NO: 505022 - protein, 9 aa, Homo Sapiens
IANLLQGDG

SEQ ID NO: 505023 - protein, 9 aa, Homo Sapiens
LKVSPLTRY

SEQ ID NO: 505024 - protein, 9 aa, Homo Sapiens
MVLGLQVDP

SEQ ID NO: 505025 - protein, 9 aa, Homo Sapiens
NITTHKKIH

SEQ ID NO: 505026 - protein, 9 aa, Homo Sapiens
TEGSSATGF

SEQ ID NO: 505027 - protein, 9 aa, Homo Sapiens
VLMGLKPGE

SEQ ID NO: 505028 - protein, 9 aa, Homo Sapiens
LDNEATRKA

SEQ ID NO: 505029 - protein, 9 aa, Homo Sapiens
YSENSQFCF

SEQ ID NO: 505030 - protein, 9 aa, Homo Sapiens
AGTFGDCGV

SEQ ID NO: 505031 - protein, 9 aa, Homo Sapiens
SSPPRSPPA

SEQ ID NO: 505032 - protein, 9 aa, Homo Sapiens
ATRTPPGRS

SEQ ID NO: 505033 - protein, 9 aa, Homo Sapiens
LLSFQLREK

SEQ ID NO: 505034 - protein, 9 aa, Homo Sapiens
PLRTGAASR

SEQ ID NO: 505035 - protein, 9 aa, Homo Sapiens
SPPRSPPAG

SEQ ID NO: 505036 - protein, 9 aa, Homo Sapiens
QPVQPPYEV

SEQ ID NO: 505037 - protein, 9 aa, Homo Sapiens
KRADAGNGI

SEQ ID NO: 505038 - protein, 9 aa, Homo Sapiens
VSTPNLLQE

SEQ ID NO: 505039 - protein, 9 aa, Homo Sapiens
HSDDQRDPP

SEQ ID NO: 505040 - protein, 9 aa, Homo Sapiens
PAPRQLPPR

SEQ ID NO: 505041 - protein, 9 aa, Homo Sapiens
FFKLEWDMK

SEQ ID NO: 505042 - protein, 9 aa, Homo Sapiens
RPLRPRPRR

SEQ ID NO: 505043 - protein, 9 aa, Homo Sapiens
VGDKGIQLS

SEQ ID NO: 505044 - protein, 9 aa, Homo Sapiens
VVSRPQLRG

SEQ ID NO: 505045 - protein, 9 aa, Homo Sapiens
SVDTSSVSS

SEQ ID NO: 505046 - protein, 9 aa, Homo Sapiens
LATGISAFL

SEQ ID NO: 505047 - protein, 9 aa, Homo Sapiens
LNMFPQLDN

SEQ ID NO: 505048 - protein, 9 aa, Homo Sapiens
CLKLLEEDD

SEQ ID NO: 505049 - protein, 9 aa, Homo Sapiens
PPTGDSGGP

SEQ ID NO: 505050 - protein, 9 aa, Homo Sapiens
RPPLPSEGG

SEQ ID NO: 505051 - protein, 9 aa, Homo Sapiens
RLPANQTPP

SEQ ID NO: 505052 - protein, 9 aa, Homo Sapiens
SAKCHLARC

SEQ ID NO: 505053 - protein, 9 aa, Homo Sapiens
FDLRSKIGK

SEQ ID NO: 505054 - protein, 9 aa, Homo Sapiens
HLSLVEFHL

SEQ ID NO: 505055 - protein, 9 aa, Homo Sapiens
WGRCCNRPC

SEQ ID NO: 505056 - protein, 9 aa, Homo Sapiens
VVMVVRPVA

SEQ ID NO: 505057 - protein, 9 aa, Homo Sapiens
GKTFCLESD

SEQ ID NO: 505058 - protein, 9 aa, Homo Sapiens
AQHGQVSYI

SEQ ID NO: 505059 - protein, 9 aa, Homo Sapiens
LKPKEVFLA

SEQ ID NO: 505060 - protein, 9 aa, Homo Sapiens
CRSEGREVT

SEQ ID NO: 505061 - protein, 9 aa, Homo Sapiens
SRYGFGLTQ

SEQ ID NO: 505062 - protein, 9 aa, Homo Sapiens
YHFQERVDK

SEQ ID NO: 505063 - protein, 9 aa, Homo Sapiens
PRGPGAPSA

SEQ ID NO: 505064 - protein, 9 aa, Homo Sapiens
LGSQQNFVR

SEQ ID NO: 505065 - protein, 9 aa, Homo Sapiens
PLTRYAPGS

SEQ ID NO: 505066 - protein, 9 aa, Homo Sapiens
NVKKNASTL

SEQ ID NO: 505067 - protein, 9 aa, Homo Sapiens
EEEKKTIKG

SEQ ID NO: 505068 - protein, 9 aa, Homo Sapiens
QAVLLGEDG

SEQ ID NO: 505069 - protein, 9 aa, Homo Sapiens
MRNYISNSA

SEQ ID NO: 505070 - protein, 9 aa, Homo Sapiens
KPKEVFLAQ

SEQ ID NO: 505071 - protein, 9 aa, Homo Sapiens
HASQTPGTD

SEQ ID NO: 505072 - protein, 9 aa, Homo Sapiens
LSQASWTLR

SEQ ID NO: 505073 - protein, 9 aa, Homo Sapiens
SYPKPEISW

SEQ ID NO: 505074 - protein, 9 aa, Homo Sapiens
QGSRRRLRK

SEQ ID NO: 505075 - protein, 9 aa, Homo Sapiens
QTPPRCPPP

SEQ ID NO: 505076 - protein, 9 aa, Homo Sapiens
FFIYAALVV

SEQ ID NO: 505077 - protein, 9 aa, Homo Sapiens
PCPPTAACR

SEQ ID NO: 505078 - protein, 9 aa, Homo Sapiens
PGPMVASGE

SEQ ID NO: 505079 - protein, 9 aa, Homo Sapiens
QVEADKKKQ

SEQ ID NO: 505080 - protein, 9 aa, Homo Sapiens
RRLRKGRSQ

SEQ ID NO: 505081 - protein, 9 aa, Homo Sapiens
ENNIYCQPD

SEQ ID NO: 505082 - protein, 9 aa, Homo Sapiens
RSGSSWGCW

SEQ ID NO: 505083 - protein, 9 aa, Homo Sapiens
FEKIFAYYV

SEQ ID NO: 505084 - protein, 9 aa, Homo Sapiens
LPFFTNKIL

SEQ ID NO: 505085 - protein, 9 aa, Homo Sapiens
GSSWGCWAT

SEQ ID NO: 505086 - protein, 9 aa, Homo Sapiens
PPRCPPPAT

SEQ ID NO: 505087 - protein, 9 aa, Homo Sapiens
VYHSGSSSS

SEQ ID NO: 505088 - protein, 9 aa, Homo Sapiens
PLLFPKARP

SEQ ID NO: 505089 - protein, 9 aa, Homo Sapiens
AKTLIKSAN

SEQ ID NO: 505090 - protein, 9 aa, Homo Sapiens
KVTSVYHSG

SEQ ID NO: 505091 - protein, 9 aa, Homo Sapiens
RLKNPDQIQ

SEQ ID NO: 505092 - protein, 9 aa, Homo Sapiens
HLPQLPRQQ

SEQ ID NO: 505093 - protein, 9 aa, Homo Sapiens
SEDYNLSSA

SEQ ID NO: 505094 - protein, 9 aa, Homo Sapiens
CIGLMAAAC

SEQ ID NO: 505095 - protein, 9 aa, Homo Sapiens
PLFSLEFCS

SEQ ID NO: 505096 - protein, 9 aa, Homo Sapiens
VTTKILFQI

SEQ ID NO: 505097 - protein, 9 aa, Homo Sapiens
QLPRQQHPQ

SEQ ID NO: 505098 - protein, 9 aa, Homo Sapiens
WCLIIFLAE

SEQ ID NO: 505099 - protein, 9 aa, Homo Sapiens
FFTNKILSF

SEQ ID NO: 505100 - protein, 9 aa, Homo Sapiens
LQGDGCHSD

SEQ ID NO: 505101 - protein, 9 aa, Homo Sapiens
QQKSKVSKV

SEQ ID NO: 505102 - protein, 9 aa, Homo Sapiens
EFCSPGETE

SEQ ID NO: 505103 - protein, 9 aa, Homo Sapiens
LVCRTNGLT

SEQ ID NO: 505104 - protein, 9 aa, Homo Sapiens
SHLTSITVF

SEQ ID NO: 505105 - protein, 9 aa, Homo Sapiens
SEGGVARVE

SEQ ID NO: 505106 - protein, 9 aa, Homo Sapiens
TLIKSANNL

SEQ ID NO: 505107 - protein, 9 aa, Homo Sapiens
FNPEHFMDA

SEQ ID NO: 505108 - protein, 9 aa, Homo Sapiens
FTKDLEILK

SEQ ID NO: 505109 - protein, 9 aa, Homo Sapiens
LPRQQHPQD

SEQ ID NO: 505110 - protein, 9 aa, Homo Sapiens
SGQAQHGQV

SEQ ID NO: 505111 - protein, 9 aa, Homo Sapiens
TLKPVLCRS

SEQ ID NO: 505112 - protein, 9 aa, Homo Sapiens
YYRLYMEQG

SEQ ID NO: 505113 - protein, 9 aa, Homo Sapiens
KLSMEDHLY

SEQ ID NO: 505114 - protein, 9 aa, Homo Sapiens
GSMALQKFG

SEQ ID NO: 505115 - protein, 9 aa, Homo Sapiens
HLYIIGSDI

SEQ ID NO: 505116 - protein, 9 aa, Homo Sapiens
EDVSPFVTQ

SEQ ID NO: 505117 - protein, 9 aa, Homo Sapiens
TTAIERRPP

SEQ ID NO: 505118 - protein, 9 aa, Homo Sapiens
VHASQTPGT

SEQ ID NO: 505119 - protein, 9 aa, Homo Sapiens
QADSLIVYL

SEQ ID NO: 505120 - protein, 9 aa, Homo Sapiens
AVHAGTFGD

SEQ ID NO: 505121 - protein, 9 aa, Homo Sapiens
SHQKAQIAP

SEQ ID NO: 505122 - protein, 9 aa, Homo Sapiens
ACRPRWPSS

SEQ ID NO: 505123 - protein, 9 aa, Homo Sapiens
GEGIGDEIE

SEQ ID NO: 505124 - protein, 9 aa, Homo Sapiens
FPLDRVPGA

SEQ ID NO: 505125 - protein, 9 aa, Homo Sapiens
LMGLKPGEA

SEQ ID NO: 505126 - protein, 9 aa, Homo Sapiens
PQLDNEATR

SEQ ID NO: 505127 - protein, 9 aa, Homo Sapiens
DESSTVLMG

SEQ ID NO: 505128 - protein, 9 aa, Homo Sapiens
EDKTVKLKE

SEQ ID NO: 505129 - protein, 9 aa, Homo Sapiens
LVWAISVTR

SEQ ID NO: 505130 - protein, 9 aa, Homo Sapiens
AAAATSSLK

SEQ ID NO: 505131 - protein, 9 aa, Homo Sapiens
CPRARRSAR

SEQ ID NO: 505132 - protein, 9 aa, Homo Sapiens
PSTSRSGSS

SEQ ID NO: 505133 - protein, 9 aa, Homo Sapiens
SEEYGDIIV

SEQ ID NO: 505134 - protein, 9 aa, Homo Sapiens
YIFENNIYC

SEQ ID NO: 505135 - protein, 9 aa, Homo Sapiens
LGNIGLIEI

SEQ ID NO: 505136 - protein, 9 aa, Homo Sapiens
SVTRIGVVL

SEQ ID NO: 505137 - protein, 9 aa, Homo Sapiens
VRQIYSEHN

SEQ ID NO: 505138 - protein, 9 aa, Homo Sapiens
TSRSGSSWG

SEQ ID NO: 505139 - protein, 9 aa, Homo Sapiens
TPPPPPAPR

SEQ ID NO: 505140 - protein, 9 aa, Homo Sapiens
SRPQLRGLL

SEQ ID NO: 505141 - protein, 9 aa, Homo Sapiens
AACRPRWPS

SEQ ID NO: 505142 - protein, 9 aa, Homo Sapiens
LKTSFARRT

SEQ ID NO: 505143 - protein, 9 aa, Homo Sapiens
YCLKLLEED

SEQ ID NO: 505144 - protein, 9 aa, Homo Sapiens
AFKYSSNIT

SEQ ID NO: 505145 - protein, 9 aa, Homo Sapiens
DGPVLRECR

SEQ ID NO: 505146 - protein, 9 aa, Homo Sapiens
RDYHIRFIS

SEQ ID NO: 505147 - protein, 9 aa, Homo Sapiens
PRWPSSRCA

SEQ ID NO: 505148 - protein, 9 aa, Homo Sapiens
VSNHPGWLK

SEQ ID NO: 505149 - protein, 9 aa, Homo Sapiens
KILSFPQLG

SEQ ID NO: 505150 - protein, 9 aa, Homo Sapiens
MGCWRKITV

SEQ ID NO: 505151 - protein, 9 aa, Homo Sapiens
GLTQPEHDV

SEQ ID NO: 505152 - protein, 9 aa, Homo Sapiens
RYHEGIHTG

SEQ ID NO: 505153 - protein, 9 aa, Homo Sapiens
MIQAIDRIN

SEQ ID NO: 505154 - protein, 9 aa, Homo Sapiens
RRSPFPSAK

SEQ ID NO: 505155 - protein, 9 aa, Homo Sapiens
TVDPGADAS

SEQ ID NO: 505156 - protein, 9 aa, Homo Sapiens
RVRAVHAGT

SEQ ID NO: 505157 - protein, 9 aa, Homo Sapiens
HEGIHTGEK

SEQ ID NO: 505158 - protein, 9 aa, Homo Sapiens
YVFWTDYLN

SEQ ID NO: 505159 - protein, 9 aa, Homo Sapiens
EKKYHFQER

SEQ ID NO: 505160 - protein, 9 aa, Homo Sapiens
QKCSEVNHM

SEQ ID NO: 505161 - protein, 9 aa, Homo Sapiens
SSRCAAPPR

SEQ ID NO: 505162 - protein, 9 aa, Homo Sapiens
PPRSPPAGV

SEQ ID NO: 505163 - protein, 9 aa, Homo Sapiens
SEQNSSVTS

SEQ ID NO: 505164 - protein, 9 aa, Homo Sapiens
MERSPCAME

SEQ ID NO: 505165 - protein, 9 aa, Homo Sapiens
KGSFSALVC

SEQ ID NO: 505166 - protein, 9 aa, Homo Sapiens
LFMEYIEGR

SEQ ID NO: 505167 - protein, 9 aa, Homo Sapiens
QASWTLRIL

SEQ ID NO: 505168 - protein, 9 aa, Homo Sapiens
LLGEDGPVL

SEQ ID NO: 505169 - protein, 9 aa, Homo Sapiens
GILAEGRLS

SEQ ID NO: 505170 - protein, 9 aa, Homo Sapiens
CGARCSWTA

SEQ ID NO: 505171 - protein, 9 aa, Homo Sapiens
GFGLTQPEH

SEQ ID NO: 505172 - protein, 9 aa, Homo Sapiens
AQCLALLLS

SEQ ID NO: 505173 - protein, 9 aa, Homo Sapiens
HGQDAILYL

SEQ ID NO: 505174 - protein, 9 aa, Homo Sapiens
EERLKNPDQ

SEQ ID NO: 505175 - protein, 9 aa, Homo Sapiens
LDSRSGQAQ

SEQ ID NO: 505176 - protein, 9 aa, Homo Sapiens
SSTVLMGLK

SEQ ID NO: 505177 - protein, 9 aa, Homo Sapiens
ILSFPQLGV

SEQ ID NO: 505178 - protein, 9 aa, Homo Sapiens
SPLTRYAPG

SEQ ID NO: 505179 - protein, 9 aa, Homo Sapiens
ARPHRSLRT

SEQ ID NO: 505180 - protein, 9 aa, Homo Sapiens
IGEMNLKPK

SEQ ID NO: 505181 - protein, 9 aa, Homo Sapiens
KGPLLFPKA

SEQ ID NO: 505182 - protein, 9 aa, Homo Sapiens
LSGHGEPLP

SEQ ID NO: 505183 - protein, 9 aa, Homo Sapiens
KVFIPVLPA

SEQ ID NO: 505184 - protein, 9 aa, Homo Sapiens
TRRLPANQT

SEQ ID NO: 505185 - protein, 9 aa, Homo Sapiens
FNFHVSNHP

SEQ ID NO: 505186 - protein, 9 aa, Homo Sapiens
NFVLQERLK

SEQ ID NO: 505187 - protein, 9 aa, Homo Sapiens
AEAAAVVMV

SEQ ID NO: 505188 - protein, 9 aa, Homo Sapiens
YSSNITTHK

SEQ ID NO: 505189 - protein, 9 aa, Homo Sapiens
FARRTASRP

SEQ ID NO: 505190 - protein, 9 aa, Homo Sapiens
RPRWPSSRC

SEQ ID NO: 505191 - protein, 9 aa, Homo Sapiens
GQEIQQAWI

SEQ ID NO: 505192 - protein, 9 aa, Homo Sapiens
GSMCNTRFS

SEQ ID NO: 505193 - protein, 9 aa, Homo Sapiens
ISAFLVTEV

SEQ ID NO: 505194 - protein, 9 aa, Homo Sapiens
PAPPSPASR

SEQ ID NO: 505195 - protein, 9 aa, Homo Sapiens
LNNINIFWL

SEQ ID NO: 505196 - protein, 9 aa, Homo Sapiens
SSGFLRPSG

SEQ ID NO: 505197 - protein, 9 aa, Homo Sapiens
AIERRPPLP

SEQ ID NO: 505198 - protein, 9 aa, Homo Sapiens
TVLMGLKPG

SEQ ID NO: 505199 - protein, 9 aa, Homo Sapiens
RSCCWGRCC

SEQ ID NO: 505200 - protein, 9 aa, Homo Sapiens
APLESVRQI

SEQ ID NO: 505201 - protein, 9 aa, Homo Sapiens
ASQHGQDAI

SEQ ID NO: 505202 - protein, 9 aa, Homo Sapiens
ADSYSENSQ

SEQ ID NO: 505203 - protein, 9 aa, Homo Sapiens
RDEHQLLVR

SEQ ID NO: 505204 - protein, 9 aa, Homo Sapiens
WEPVCANNG

SEQ ID NO: 505205 - protein, 9 aa, Homo Sapiens
LLFPKARPW

SEQ ID NO: 505206 - protein, 9 aa, Homo Sapiens
GRELFERIV

SEQ ID NO: 505207 - protein, 9 aa, Homo Sapiens
PNLLQERLT

SEQ ID NO: 505208 - protein, 9 aa, Homo Sapiens
PAAPRTARP

SEQ ID NO: 505209 - protein, 9 aa, Homo Sapiens
TRFSDAILE

SEQ ID NO: 505210 - protein, 9 aa, Homo Sapiens
TVEDTSTDS

SEQ ID NO: 505211 - protein, 9 aa, Homo Sapiens
GKTPKQYER

SEQ ID NO: 505212 - protein, 9 aa, Homo Sapiens
LAQAFFKLQ

SEQ ID NO: 505213 - protein, 9 aa, Homo Sapiens
IPVLPAPSL

SEQ ID NO: 505214 - protein, 9 aa, Homo Sapiens
TRMHSLRPE

SEQ ID NO: 505215 - protein, 9 aa, Homo Sapiens
GDPGILAEG

SEQ ID NO: 505216 - protein, 9 aa, Homo Sapiens
KPRLEDVSP

SEQ ID NO: 505217 - protein, 9 aa, Homo Sapiens
DSGGPPRAA

SEQ ID NO: 505218 - protein, 9 aa, Homo Sapiens
ADSLIVYLV

SEQ ID NO: 505219 - protein, 9 aa, Homo Sapiens
SCCSQSCNE

SEQ ID NO: 505220 - protein, 9 aa, Homo Sapiens
LYMEQGSPE

SEQ ID NO: 505221 - protein, 9 aa, Homo Sapiens
IYAALVVEL

SEQ ID NO: 505222 - protein, 9 aa, Homo Sapiens
DDQRDPPAD

SEQ ID NO: 505223 - protein, 9 aa, Homo Sapiens
RSPPAGVGL

SEQ ID NO: 505224 - protein, 9 aa, Homo Sapiens
PHRSLRTPP

SEQ ID NO: 505225 - protein, 9 aa, Homo Sapiens
ARAPLESVR

SEQ ID NO: 505226 - protein, 9 aa, Homo Sapiens
GRRKSGEPP

SEQ ID NO: 505227 - protein, 9 aa, Homo Sapiens
DKDENVKKN

SEQ ID NO: 505228 - protein, 9 aa, Homo Sapiens
TSSLKTSFA

SEQ ID NO: 505229 - protein, 9 aa, Homo Sapiens
ALQKFGGGL

SEQ ID NO: 505230 - protein, 9 aa, Homo Sapiens
YVKDSLQWI

SEQ ID NO: 505231 - protein, 9 aa, Homo Sapiens
VNHMNAHNL

SEQ ID NO: 505232 - protein, 9 aa, Homo Sapiens
LAVDRFNWE

SEQ ID NO: 505233 - protein, 9 aa, Homo Sapiens
CAQSWRHPG

SEQ ID NO: 505234 - protein, 9 aa, Homo Sapiens
SSVTSCLEL

SEQ ID NO: 505235 - protein, 9 aa, Homo Sapiens
PKQAICARC

SEQ ID NO: 505236 - protein, 9 aa, Homo Sapiens
ELNNINIFW

SEQ ID NO: 505237 - protein, 9 aa, Homo Sapiens
CCNRPCGAR

SEQ ID NO: 505238 - protein, 9 aa, Homo Sapiens
LTEGVFDNL

SEQ ID NO: 505239 - protein, 9 aa, Homo Sapiens
SGKTPKQYE

SEQ ID NO: 505240 - protein, 9 aa, Homo Sapiens
QQRQQHICQ

SEQ ID NO: 505241 - protein, 9 aa, Homo Sapiens
KQYEREYNN

SEQ ID NO: 505242 - protein, 9 aa, Homo Sapiens
AATSSLKTS

SEQ ID NO: 505243 - protein, 9 aa, Homo Sapiens
NFHWYPVPQ

SEQ ID NO: 505244 - protein, 9 aa, Homo Sapiens
LSPPLCMLP

SEQ ID NO: 505245 - protein, 9 aa, Homo Sapiens
RRTASRPGP

SEQ ID NO: 505246 - protein, 9 aa, Homo Sapiens
LIKSANNLP

SEQ ID NO: 505247 - protein, 9 aa, Homo Sapiens
EREALLQSI

SEQ ID NO: 505248 - protein, 9 aa, Homo Sapiens
ALVVELFGK

SEQ ID NO: 505249 - protein, 9 aa, Homo Sapiens
REREALLQS

SEQ ID NO: 505250 - protein, 9 aa, Homo Sapiens
RSLRTPPPP

SEQ ID NO: 505251 - protein, 9 aa, Homo Sapiens
TRTRRLPAN

SEQ ID NO: 505252 - protein, 9 aa, Homo Sapiens
VWAISVTRI

SEQ ID NO: 505253 - protein, 9 aa, Homo Sapiens
AFFKLQKVK

SEQ ID NO: 505254 - protein, 9 aa, Homo Sapiens
APRQLPPRP

SEQ ID NO: 505255 - protein, 9 aa, Homo Sapiens
CRVRSVDVL

SEQ ID NO: 505256 - protein, 9 aa, Homo Sapiens
TPKSHSPLK

SEQ ID NO: 505257 - protein, 9 aa, Homo Sapiens
WTAARPCPP

SEQ ID NO: 505258 - protein, 9 aa, Homo Sapiens
HPRPAKTPT

SEQ ID NO: 505259 - protein, 9 aa, Homo Sapiens
HLTSITVFH

SEQ ID NO: 505260 - protein, 9 aa, Homo Sapiens
DSGSEQNSS

SEQ ID NO: 505261 - protein, 9 aa, Homo Sapiens
EFLKHKAVN

SEQ ID NO: 505262 - protein, 9 aa, Homo Sapiens
LLRNKKYIL

SEQ ID NO: 505263 - protein, 9 aa, Homo Sapiens
KNTEFLKHK

SEQ ID NO: 505264 - protein, 9 aa, Homo Sapiens
LAAAPRGPG

SEQ ID NO: 505265 - protein, 9 aa, Homo Sapiens
PITRPGNKF

SEQ ID NO: 505266 - protein, 9 aa, Homo Sapiens
EIGQEIQQA

SEQ ID NO: 505267 - protein, 9 aa, Homo Sapiens
LVRHGGVAQ

SEQ ID NO: 505268 - protein, 9 aa, Homo Sapiens
IQQAWIVQN

SEQ ID NO: 505269 - protein, 9 aa, Homo Sapiens
RQIYSEHNY

SEQ ID NO: 505270 - protein, 9 aa, Homo Sapiens
PKARPWLMS

SEQ ID NO: 505271 - protein, 9 aa, Homo Sapiens
FTVEDTSTD

SEQ ID NO: 505272 - protein, 9 aa, Homo Sapiens
LKRSPKSRP

SEQ ID NO: 505273 - protein, 9 aa, Homo Sapiens
DTSTDSILV

SEQ ID NO: 505274 - protein, 9 aa, Homo Sapiens
PQDMVLGLQ

SEQ ID NO: 505275 - protein, 9 aa, Homo Sapiens
RELFERIVD

SEQ ID NO: 505276 - protein, 9 aa, Homo Sapiens
TKDLEILKS

SEQ ID NO: 505277 - protein, 9 aa, Homo Sapiens
TASRPGPST

SEQ ID NO: 505278 - protein, 9 aa, Homo Sapiens
NQLRMLTEG

SEQ ID NO: 505279 - protein, 9 aa, Homo Sapiens
NLHLVVSCL

SEQ ID NO: 505280 - protein, 9 aa, Homo Sapiens
GAGPGLSGH

SEQ ID NO: 505281 - protein, 9 aa, Homo Sapiens
CAKCPPHRS

SEQ ID NO: 505282 - protein, 9 aa, Homo Sapiens
GIQTMAVWC

SEQ ID NO: 505283 - protein, 9 aa, Homo Sapiens
PLPSEGGVA

SEQ ID NO: 505284 - protein, 9 aa, Homo Sapiens
RMIQAIDRI

SEQ ID NO: 505285 - protein, 9 aa, Homo Sapiens
PSPPASPRT

SEQ ID NO: 505286 - protein, 9 aa, Homo Sapiens
RRKSGEPPK

SEQ ID NO: 505287 - protein, 9 aa, Homo Sapiens
PPRPPSPPA

SEQ ID NO: 505288 - protein, 9 aa, Homo Sapiens
CPPTAACRP

SEQ ID NO: 505289 - protein, 9 aa, Homo Sapiens
DSGLWFTVD

SEQ ID NO: 505290 - protein, 9 aa, Homo Sapiens
LGYSYPVDW

SEQ ID NO: 505291 - protein, 9 aa, Homo Sapiens
VDNVATSKI

SEQ ID NO: 505292 - protein, 9 aa, Homo Sapiens
KSANNLPGE

SEQ ID NO: 505293 - protein, 9 aa, Homo Sapiens
QGDGCHSDD

SEQ ID NO: 505294 - protein, 9 aa, Homo Sapiens
TGFHLVAQA

SEQ ID NO: 505295 - protein, 9 aa, Homo Sapiens
GTTSANTTL

SEQ ID NO: 505296 - protein, 9 aa, Homo Sapiens
SPPASPRTA

SEQ ID NO: 505297 - protein, 9 aa, Homo Sapiens
SRPSGFNFH

SEQ ID NO: 505298 - protein, 9 aa, Homo Sapiens
FPPILVERP

SEQ ID NO: 505299 - protein, 9 aa, Homo Sapiens
ASWTLRILT

SEQ ID NO: 505300 - protein, 9 aa, Homo Sapiens
QTLKPVLCR

SEQ ID NO: 505301 - protein, 9 aa, Homo Sapiens
QCLALLLSF

SEQ ID NO: 505302 - protein, 9 aa, Homo Sapiens
CAVESYPKP

SEQ ID NO: 505303 - protein, 9 aa, Homo Sapiens
QELIKCQEK

SEQ ID NO: 505304 - protein, 9 aa, Homo Sapiens
DRFNWELWC

SEQ ID NO: 505305 - protein, 9 aa, Homo Sapiens
MEGPKQAIC

SEQ ID NO: 505306 - protein, 9 aa, Homo Sapiens
CHSDDQRDP

SEQ ID NO: 505307 - protein, 9 aa, Homo Sapiens
ATSKILQTD

SEQ ID NO: 505308 - protein, 9 aa, Homo Sapiens
IFAYYVVSK

SEQ ID NO: 505309 - protein, 9 aa, Homo Sapiens
HGVCIGLMA

SEQ ID NO: 505310 - protein, 9 aa, Homo Sapiens
HVRGVIANL

SEQ ID NO: 505311 - protein, 9 aa, Homo Sapiens
HAMEGHLMI

SEQ ID NO: 505312 - protein, 9 aa, Homo Sapiens
GWLKVSPLT

SEQ ID NO: 505313 - protein, 9 aa, Homo Sapiens
HVSNHPGWL

SEQ ID NO: 505314 - protein, 9 aa, Homo Sapiens
VLALCYVIS

SEQ ID NO: 505315 - protein, 9 aa, Homo Sapiens
CSWTAARPC

SEQ ID NO: 505316 - protein, 9 aa, Homo Sapiens
NNQLRMLTE

SEQ ID NO: 505317 - protein, 9 aa, Homo Sapiens
RPSGDMLKG

SEQ ID NO: 505318 - protein, 9 aa, Homo Sapiens
RAVHAGTFG

SEQ ID NO: 505319 - protein, 9 aa, Homo Sapiens
WATTGANGL

SEQ ID NO: 505320 - protein, 9 aa, Homo Sapiens
REIAELNNI

SEQ ID NO: 505321 - protein, 9 aa, Homo Sapiens
SFQLREKIT

SEQ ID NO: 505322 - protein, 9 aa, Homo Sapiens
GARCSWTAA

SEQ ID NO: 505323 - protein, 9 aa, Homo Sapiens
RSAAAATSS

SEQ ID NO: 505324 - protein, 9 aa, Homo Sapiens
VCANNGITY

SEQ ID NO: 505325 - protein, 9 aa, Homo Sapiens
VKDSLQWIT

SEQ ID NO: 505326 - protein, 9 aa, Homo Sapiens
WFTVDPGAD

SEQ ID NO: 505327 - protein, 9 aa, Homo Sapiens
RYQEVEEDQ

SEQ ID NO: 505328 - protein, 9 aa, Homo Sapiens
GGPPRAAHG

SEQ ID NO: 505329 - protein, 9 aa, Homo Sapiens
MVQIRDYHI

SEQ ID NO: 505330 - protein, 9 aa, Homo Sapiens
TRIGVVLFD

SEQ ID NO: 505331 - protein, 9 aa, Homo Sapiens
EGSYQVDEM

SEQ ID NO: 505332 - protein, 9 aa, Homo Sapiens
EGVFDNLSN

SEQ ID NO: 505333 - protein, 9 aa, Homo Sapiens
ALFPLDRVP

SEQ ID NO: 505334 - protein, 9 aa, Homo Sapiens
MREVAEAAA

SEQ ID NO: 505335 - protein, 9 aa, Homo Sapiens
YMEQGSPEA

SEQ ID NO: 505336 - protein, 9 aa, Homo Sapiens
EAWSTHNTV

SEQ ID NO: 505337 - protein, 9 aa, Homo Sapiens
RPRSKQEAW

SEQ ID NO: 505338 - protein, 9 aa, Homo Sapiens
PGRPRSKQE

SEQ ID NO: 505339 - protein, 9 aa, Homo Sapiens
RSKQEAWST

SEQ ID NO: 505340 - protein, 9 aa, Homo Sapiens
GRPRSKQEA

SEQ ID NO: 505341 - protein, 9 aa, Homo Sapiens
KQEAWSTHN

SEQ ID NO: 505342 - protein, 9 aa, Homo Sapiens
SKQEAWSTH

SEQ ID NO: 505343 - protein, 9 aa, Homo Sapiens
PRSKQEAWS

SEQ ID NO: 505344 - protein, 9 aa, Homo Sapiens
QEAWSTHNT

SEQ ID NO: 505345 - protein, 9 aa, Homo Sapiens
GQRGQEGPM

SEQ ID NO: 505346 - protein, 9 aa, Homo Sapiens
LTGCSHFGH

SEQ ID NO: 505347 - protein, 9 aa, Homo Sapiens
LDSALQNVN

SEQ ID NO: 505348 - protein, 9 aa, Homo Sapiens
KTLANLLIS

SEQ ID NO: 505349 - protein, 9 aa, Homo Sapiens
ISFYCTQFT

SEQ ID NO: 505350 - protein, 9 aa, Homo Sapiens
AEATVCMVT

SEQ ID NO: 505351 - protein, 9 aa, Homo Sapiens
LKVSTRTSS

SEQ ID NO: 505352 - protein, 9 aa, Homo Sapiens
AAAVENCTP

SEQ ID NO: 505353 - protein, 9 aa, Homo Sapiens
GAHSPGAWW

SEQ ID NO: 505354 - protein, 9 aa, Homo Sapiens
EWLDVQHRT

SEQ ID NO: 505355 - protein, 9 aa, Homo Sapiens
YSSVIEPKS

SEQ ID NO: 505356 - protein, 9 aa, Homo Sapiens
RLQDQLDQR

SEQ ID NO: 505357 - protein, 9 aa, Homo Sapiens
AKKIKARMK

SEQ ID NO: 505358 - protein, 9 aa, Homo Sapiens
QLDQRGDHP

SEQ ID NO: 505359 - protein, 9 aa, Homo Sapiens
GLAHRTTGA

SEQ ID NO: 505360 - protein, 9 aa, Homo Sapiens
LTFREVVSS

SEQ ID NO: 505361 - protein, 9 aa, Homo Sapiens
PYVQMTKSY

SEQ ID NO: 505362 - protein, 9 aa, Homo Sapiens
HEYRLCHLP

SEQ ID NO: 505363 - protein, 9 aa, Homo Sapiens
QRCMDGFLC

SEQ ID NO: 505364 - protein, 9 aa, Homo Sapiens
DFVLDDLRC

SEQ ID NO: 505365 - protein, 9 aa, Homo Sapiens
NLIAVLGKH

SEQ ID NO: 505366 - protein, 9 aa, Homo Sapiens
IFMDHSDNP

SEQ ID NO: 505367 - protein, 9 aa, Homo Sapiens
RSKDVAVIT

SEQ ID NO: 505368 - protein, 9 aa, Homo Sapiens
KIKARMKFR

SEQ ID NO: 505369 - protein, 9 aa, Homo Sapiens
QNVNDMYLL

SEQ ID NO: 505370 - protein, 9 aa, Homo Sapiens
LKENQILVR

SEQ ID NO: 505371 - protein, 9 aa, Homo Sapiens
CHLPDCPPG

SEQ ID NO: 505372 - protein, 9 aa, Homo Sapiens
RMKFRAKEY

SEQ ID NO: 505373 - protein, 9 aa, Homo Sapiens
YWKKTLFII

SEQ ID NO: 505374 - protein, 9 aa, Homo Sapiens
KDVAVITES

SEQ ID NO: 505375 - protein, 9 aa, Homo Sapiens
PALEEGLTW

SEQ ID NO: 505376 - protein, 9 aa, Homo Sapiens
ARLQDQLDQ

SEQ ID NO: 505377 - protein, 9 aa, Homo Sapiens
RRNSAAAVE

SEQ ID NO: 505378 - protein, 9 aa, Homo Sapiens
EVVRHCPHH

SEQ ID NO: 505379 - protein, 9 aa, Homo Sapiens
TKVTAHHKH

SEQ ID NO: 505380 - protein, 9 aa, Homo Sapiens
SNKEQIQKI

SEQ ID NO: 505381 - protein, 9 aa, Homo Sapiens
KIPEELSLH

SEQ ID NO: 505382 - protein, 9 aa, Homo Sapiens
RLLENTQRS

SEQ ID NO: 505383 - protein, 9 aa, Homo Sapiens
TQCCPSAAL

SEQ ID NO: 505384 - protein, 9 aa, Homo Sapiens
HMTEVVRHC

SEQ ID NO: 505385 - protein, 9 aa, Homo Sapiens
GGSPSYGGG

SEQ ID NO: 505386 - protein, 9 aa, Homo Sapiens
DVQIILYSN

SEQ ID NO: 505387 - protein, 9 aa, Homo Sapiens
SEITSVDIN

SEQ ID NO: 505388 - protein, 9 aa, Homo Sapiens
YRLCHLPDC

SEQ ID NO: 505389 - protein, 9 aa, Homo Sapiens
MVTYTPMAP

SEQ ID NO: 505390 - protein, 9 aa, Homo Sapiens
DQSGGIFMD

SEQ ID NO: 505391 - protein, 9 aa, Homo Sapiens
AMKSSLERT

SEQ ID NO: 505392 - protein, 9 aa, Homo Sapiens
EELSLHDRA

SEQ ID NO: 505393 - protein, 9 aa, Homo Sapiens
LYVASWSAV

SEQ ID NO: 505394 - protein, 9 aa, Homo Sapiens
VTQCCPSAA

SEQ ID NO: 505395 - protein, 9 aa, Homo Sapiens
SPTLGNHAK

SEQ ID NO: 505396 - protein, 9 aa, Homo Sapiens
LFEVTQCCP

SEQ ID NO: 505397 - protein, 9 aa, Homo Sapiens
NRDVPHAQC

SEQ ID NO: 505398 - protein, 9 aa, Homo Sapiens
QACISFYCT

SEQ ID NO: 505399 - protein, 9 aa, Homo Sapiens
VTDFVAKVE

SEQ ID NO: 505400 - protein, 9 aa, Homo Sapiens
LAAGVFQPP

SEQ ID NO: 505401 - protein, 9 aa, Homo Sapiens
WLAAGVFQP

SEQ ID NO: 505402 - protein, 9 aa, Homo Sapiens
LSGMVIYCK

SEQ ID NO: 505403 - protein, 9 aa, Homo Sapiens
CGHHNCCGL

SEQ ID NO: 505404 - protein, 9 aa, Homo Sapiens
DVPHAQCVL

SEQ ID NO: 505405 - protein, 9 aa, Homo Sapiens
LYSNITKDT

SEQ ID NO: 505406 - protein, 9 aa, Homo Sapiens
ATVCMVTLE

SEQ ID NO: 505407 - protein, 9 aa, Homo Sapiens
KKIKARMKF

SEQ ID NO: 505408 - protein, 9 aa, Homo Sapiens
ELEWLDVQH

SEQ ID NO: 505409 - protein, 9 aa, Homo Sapiens
FLCGHQRVH

SEQ ID NO: 505410 - protein, 9 aa, Homo Sapiens
IEMLGHGAR

SEQ ID NO: 505411 - protein, 9 aa, Homo Sapiens
LGVQPGGGP

SEQ ID NO: 505412 - protein, 9 aa, Homo Sapiens
WDMTPVVGY

SEQ ID NO: 505413 - protein, 9 aa, Homo Sapiens
GHQRVHVTV

SEQ ID NO: 505414 - protein, 9 aa, Homo Sapiens
TVRAMSARL

SEQ ID NO: 505415 - protein, 9 aa, Homo Sapiens
VYIEMLGHG

SEQ ID NO: 505416 - protein, 9 aa, Homo Sapiens
HGARPDSPD

SEQ ID NO: 505417 - protein, 9 aa, Homo Sapiens
GGNFGGSPS

SEQ ID NO: 505418 - protein, 9 aa, Homo Sapiens
SLLQVEGSL

SEQ ID NO: 505419 - protein, 9 aa, Homo Sapiens
TAEATVCMV

SEQ ID NO: 505420 - protein, 9 aa, Homo Sapiens
VVSSQEFKQ

SEQ ID NO: 505421 - protein, 9 aa, Homo Sapiens
PQLDSALQN

SEQ ID NO: 505422 - protein, 9 aa, Homo Sapiens
VARGQLRLE

SEQ ID NO: 505423 - protein, 9 aa, Homo Sapiens
VDVNHFNIC

SEQ ID NO: 505424 - protein, 9 aa, Homo Sapiens
GLTAEDWQL

SEQ ID NO: 505425 - protein, 9 aa, Homo Sapiens
LLFEVTQCC

SEQ ID NO: 505426 - protein, 9 aa, Homo Sapiens
LEEGLTWEE

SEQ ID NO: 505427 - protein, 9 aa, Homo Sapiens
TVTDFVAKV

SEQ ID NO: 505428 - protein, 9 aa, Homo Sapiens
GCRLLFLFL

SEQ ID NO: 505429 - protein, 9 aa, Homo Sapiens
AAGVFQPPP

SEQ ID NO: 505430 - protein, 9 aa, Homo Sapiens
SSVIEPKSM

SEQ ID NO: 505431 - protein, 9 aa, Homo Sapiens
EGPMGQRGQ

SEQ ID NO: 505432 - protein, 9 aa, Homo Sapiens
LLLASYEDG

SEQ ID NO: 505433 - protein, 9 aa, Homo Sapiens
ASYEDGSVV

SEQ ID NO: 505434 - protein, 9 aa, Homo Sapiens
NFGGSPSYG

SEQ ID NO: 505435 - protein, 8 aa, Homo Sapiens
GEPGPPSP

SEQ ID NO: 505436 - protein, 9 aa, Homo Sapiens
ESNKEQIQK

SEQ ID NO: 505437 - protein, 9 aa, Homo Sapiens
LRARLPRQR

SEQ ID NO: 505438 - protein, 9 aa, Homo Sapiens
RLLFLFLSP

SEQ ID NO: 505439 - protein, 9 aa, Homo Sapiens
RTLADTEAG

SEQ ID NO: 505440 - protein, 9 aa, Homo Sapiens
PTLGNHAKT

SEQ ID NO: 505441 - protein, 9 aa, Homo Sapiens
LAMKSSLER

SEQ ID NO: 505442 - protein, 9 aa, Homo Sapiens
ENQILVRAA

SEQ ID NO: 505443 - protein, 9 aa, Homo Sapiens
IPEELSLHD

SEQ ID NO: 505444 - protein, 9 aa, Homo Sapiens
AAVENCTPL

SEQ ID NO: 505445 - protein, 9 aa, Homo Sapiens
GRAFRLCFH

SEQ ID NO: 505446 - protein, 9 aa, Homo Sapiens
LWLAAGVFQ

SEQ ID NO: 505447 - protein, 9 aa, Homo Sapiens
MKSSLERTL

SEQ ID NO: 505448 - protein, 9 aa, Homo Sapiens
QPPPGLAHR

SEQ ID NO: 505449 - protein, 9 aa, Homo Sapiens
YSNITKDTN

SEQ ID NO: 505450 - protein, 9 aa, Homo Sapiens
GGLLHMPEE

SEQ ID NO: 505451 - protein, 9 aa, Homo Sapiens
ITSVDINGD

SEQ ID NO: 505452 - protein, 9 aa, Homo Sapiens
GLLHMPEEP

SEQ ID NO: 505453 - protein, 9 aa, Homo Sapiens
FSRRNSAAA

SEQ ID NO: 505454 - protein, 9 aa, Homo Sapiens
HCPHHERCS

SEQ ID NO: 505455 - protein, 9 aa, Homo Sapiens
AVITESIRM

SEQ ID NO: 505456 - protein, 9 aa, Homo Sapiens
GVQPGGGPV

SEQ ID NO: 505457 - protein, 9 aa, Homo Sapiens
LCGHQRVHV

SEQ ID NO: 505458 - protein, 9 aa, Homo Sapiens
QRADEQPSK

SEQ ID NO: 505459 - protein, 9 aa, Homo Sapiens
MTEVVRHCP

SEQ ID NO: 505460 - protein, 9 aa, Homo Sapiens
LHDRARTQK

SEQ ID NO: 505461 - protein, 9 aa, Homo Sapiens
YPVSSLLQV

SEQ ID NO: 505462 - protein, 9 aa, Homo Sapiens
EAYKHKGNT

SEQ ID NO: 505463 - protein, 9 aa, Homo Sapiens
VRAMSARLQ

SEQ ID NO: 505464 - protein, 9 aa, Homo Sapiens
LDVQHRTVA

SEQ ID NO: 505465 - protein, 9 aa, Homo Sapiens
SGGIFMDHS

SEQ ID NO: 505466 - protein, 9 aa, Homo Sapiens
LCETVTDFV

SEQ ID NO: 505467 - protein, 9 aa, Homo Sapiens
LGMSMYYQT

SEQ ID NO: 505468 - protein, 9 aa, Homo Sapiens
SGLTAEDWQ

SEQ ID NO: 505469 - protein, 9 aa, Homo Sapiens
ILVRAAFLE

SEQ ID NO: 505470 - protein, 9 aa, Homo Sapiens
RPLLLASYE

SEQ ID NO: 505471 - protein, 9 aa, Homo Sapiens
CRECPEGHM

SEQ ID NO: 505472 - protein, 9 aa, Homo Sapiens
KHKGNTSGF

SEQ ID NO: 505473 - protein, 9 aa, Homo Sapiens
KSMINFWSE

SEQ ID NO: 505474 - protein, 9 aa, Homo Sapiens
PEPTNLTSS

SEQ ID NO: 505475 - protein, 9 aa, Homo Sapiens
QEGPMGPRG

SEQ ID NO: 505476 - protein, 9 aa, Homo Sapiens
PEGHMVTYT

SEQ ID NO: 505477 - protein, 9 aa, Homo Sapiens
FPLKVSTRT

SEQ ID NO: 505478 - protein, 9 aa, Homo Sapiens
QRGQEGPMG

SEQ ID NO: 505479 - protein, 9 aa, Homo Sapiens
DVAVITESI

SEQ ID NO: 505480 - protein, 9 aa, Homo Sapiens
LERTLADTE

SEQ ID NO: 505481 - protein, 9 aa, Homo Sapiens
GVFQPPPGL

SEQ ID NO: 505482 - protein, 9 aa, Homo Sapiens
MKDVQIILY

SEQ ID NO: 505483 - protein, 9 aa, Homo Sapiens
HFGHIFPSS

SEQ ID NO: 505484 - protein, 9 aa, Homo Sapiens
PVENLFPEP

SEQ ID NO: 505485 - protein, 9 aa, Homo Sapiens
VFQPPPGLA

SEQ ID NO: 505486 - protein, 9 aa, Homo Sapiens
SMPPELSTT

SEQ ID NO: 505487 - protein, 9 aa, Homo Sapiens
QLLLLLAAE

SEQ ID NO: 505488 - protein, 9 aa, Homo Sapiens
RGAVLRLGV

SEQ ID NO: 505489 - protein, 9 aa, Homo Sapiens
VEYPLCCLV

SEQ ID NO: 505490 - protein, 9 aa, Homo Sapiens
NVPTESGDL

SEQ ID NO: 505491 - protein, 9 aa, Homo Sapiens
EMLGHGARP

SEQ ID NO: 505492 - protein, 9 aa, Homo Sapiens
VQSLHPVLR

SEQ ID NO: 505493 - protein, 9 aa, Homo Sapiens
LGVARGQLR

SEQ ID NO: 505494 - protein, 9 aa, Homo Sapiens
HRTTGAHSP

SEQ ID NO: 505495 - protein, 9 aa, Homo Sapiens
VQHRTVAGV

SEQ ID NO: 505496 - protein, 9 aa, Homo Sapiens
LYPVSSLLQ

SEQ ID NO: 505497 - protein, 9 aa, Homo Sapiens
LSTTVMETT

SEQ ID NO: 505498 - protein, 9 aa, Homo Sapiens
QHGGLLHMP

SEQ ID NO: 505499 - protein, 9 aa, Homo Sapiens
SRRNSAAAV

SEQ ID NO: 505500 - protein, 9 aa, Homo Sapiens
VLRLGVARG

SEQ ID NO: 505501 - protein, 9 aa, Homo Sapiens
MVTLEKMSA

SEQ ID NO: 505502 - protein, 9 aa, Homo Sapiens
GCSHFGHIF

SEQ ID NO: 505503 - protein, 9 aa, Homo Sapiens
AYKHKGNTS

SEQ ID NO: 505504 - protein, 9 aa, Homo Sapiens
MTKSYPSKL

SEQ ID NO: 505505 - protein, 9 aa, Homo Sapiens
FQPPPGLAH

SEQ ID NO: 505506 - protein, 9 aa, Homo Sapiens
GQEGPMGPR

SEQ ID NO: 505507 - protein, 9 aa, Homo Sapiens
QHRTVAGVL

SEQ ID NO: 505508 - protein, 9 aa, Homo Sapiens
KVTAHHKHH

SEQ ID NO: 505509 - protein, 9 aa, Homo Sapiens
DQRGDHPLT

SEQ ID NO: 505510 - protein, 9 aa, Homo Sapiens
LIPVDVNHF

SEQ ID NO: 505511 - protein, 9 aa, Homo Sapiens
EPADLRARL

SEQ ID NO: 505512 - protein, 9 aa, Homo Sapiens
HSPGAWWGF

SEQ ID NO: 505513 - protein, 9 aa, Homo Sapiens
GYSLATGFS

SEQ ID NO: 505514 - protein, 9 aa, Homo Sapiens
RADEQPSKR

SEQ ID NO: 505515 - protein, 9 aa, Homo Sapiens
QTILLDSNW

SEQ ID NO: 505516 - protein, 9 aa, Homo Sapiens
VAVITESIR

SEQ ID NO: 505517 - protein, 9 aa, Homo Sapiens
ALEEGLTWE

SEQ ID NO: 505518 - protein, 9 aa, Homo Sapiens
CCGLYPVSS

SEQ ID NO: 505519 - protein, 9 aa, Homo Sapiens
TADQSGGIF

SEQ ID NO: 505520 - protein, 9 aa, Homo Sapiens
TPVVGYSLA

SEQ ID NO: 505521 - protein, 9 aa, Homo Sapiens
TGCSHFGHI

SEQ ID NO: 505522 - protein, 9 aa, Homo Sapiens
SLWLAAGVF

SEQ ID NO: 505523 - protein, 9 aa, Homo Sapiens
SPGAWWGFG

SEQ ID NO: 505524 - protein, 9 aa, Homo Sapiens
QLDSALQNV

SEQ ID NO: 505525 - protein, 9 aa, Homo Sapiens
GHLSGCRLL

SEQ ID NO: 505526 - protein, 9 aa, Homo Sapiens
RNLIAVLGK

SEQ ID NO: 505527 - protein, 9 aa, Homo Sapiens
CGLYPVSSL

SEQ ID NO: 505528 - protein, 9 aa, Homo Sapiens
LELEWLDVQ

SEQ ID NO: 505529 - protein, 9 aa, Homo Sapiens
EPTNLTSSV

SEQ ID NO: 505530 - protein, 9 aa, Homo Sapiens
YFGNRDVPH

SEQ ID NO: 505531 - protein, 9 aa, Homo Sapiens
RAMSARLQL

SEQ ID NO: 505532 - protein, 9 aa, Homo Sapiens
DWQLTARAR

SEQ ID NO: 505533 - protein, 9 aa, Homo Sapiens
PLKVSTRTS

SEQ ID NO: 505534 - protein, 9 aa, Homo Sapiens
SRPLLLASY

SEQ ID NO: 505535 - protein, 9 aa, Homo Sapiens
RHFAKTISN

SEQ ID NO: 505536 - protein, 9 aa, Homo Sapiens
QRGDHPLTP

SEQ ID NO: 505537 - protein, 9 aa, Homo Sapiens
RECPEGHMV

SEQ ID NO: 505538 - protein, 9 aa, Homo Sapiens
YMRHFAKTI

SEQ ID NO: 505539 - protein, 9 aa, Homo Sapiens
WLDVQHRTV

SEQ ID NO: 505540 - protein, 9 aa, Homo Sapiens
PELSTTVME

SEQ ID NO: 505541 - protein, 9 aa, Homo Sapiens
CEAYKHKGN

SEQ ID NO: 505542 - protein, 9 aa, Homo Sapiens
SGCRLLFLF

SEQ ID NO: 505543 - protein, 9 aa, Homo Sapiens
TTSMPPELS

SEQ ID NO: 505544 - protein, 9 aa, Homo Sapiens
SYGGGRGGY

SEQ ID NO: 505545 - protein, 9 aa, Homo Sapiens
KARMKFRAK

SEQ ID NO: 505546 - protein, 9 aa, Homo Sapiens
YLYWKKTLF

SEQ ID NO: 505547 - protein, 9 aa, Homo Sapiens
VLPALESNK

SEQ ID NO: 505548 - protein, 9 aa, Homo Sapiens
VLGKHDLSE

SEQ ID NO: 505549 - protein, 9 aa, Homo Sapiens
DVQHRTVAG

SEQ ID NO: 505550 - protein, 9 aa, Homo Sapiens
LANLLISNY

SEQ ID NO: 505551 - protein, 9 aa, Homo Sapiens
RVHVTVRAM

SEQ ID NO: 505552 - protein, 9 aa, Homo Sapiens
AVENCTPLS

SEQ ID NO: 505553 - protein, 9 aa, Homo Sapiens
SCEAYKHKG

SEQ ID NO: 505554 - protein, 9 aa, Homo Sapiens
ECPEGHMVT

SEQ ID NO: 505555 - protein, 9 aa, Homo Sapiens
EDWQLTARA

SEQ ID NO: 505556 - protein, 9 aa, Homo Sapiens
VDINGDGVT

SEQ ID NO: 505557 - protein, 9 aa, Homo Sapiens
SPSYGGGRG

SEQ ID NO: 505558 - protein, 9 aa, Homo Sapiens
ARLQLHQHG

SEQ ID NO: 505559 - protein, 9 aa, Homo Sapiens
PADLRARLP

SEQ ID NO: 505560 - protein, 9 aa, Homo Sapiens
VGYSLATGF

SEQ ID NO: 505561 - protein, 9 aa, Homo Sapiens
PLCCLVLVA

SEQ ID NO: 505562 - protein, 9 aa, Homo Sapiens
APQLLLLLA

SEQ ID NO: 505563 - protein, 9 aa, Homo Sapiens
ALGSPTLGN

SEQ ID NO: 505564 - protein, 9 aa, Homo Sapiens
VITESIRMA

SEQ ID NO: 505565 - protein, 9 aa, Homo Sapiens
TLGNHAKTE

SEQ ID NO: 505566 - protein, 9 aa, Homo Sapiens
SHEYRLCHL

SEQ ID NO: 505567 - protein, 9 aa, Homo Sapiens
VLDDLRCYS

SEQ ID NO: 505568 - protein, 9 aa, Homo Sapiens
GDLWILGDV

SEQ ID NO: 505569 - protein, 9 aa, Homo Sapiens
PPGLAHRTT

SEQ ID NO: 505570 - protein, 9 aa, Homo Sapiens
GSLWLAAGV

SEQ ID NO: 505571 - protein, 9 aa, Homo Sapiens
PVDVNHFNI

SEQ ID NO: 505572 - protein, 9 aa, Homo Sapiens
HMVTYTPMA

SEQ ID NO: 505573 - protein, 9 aa, Homo Sapiens
EVLVEYPLC

SEQ ID NO: 505574 - protein, 9 aa, Homo Sapiens
VHVTVRAMS

SEQ ID NO: 505575 - protein, 9 aa, Homo Sapiens
LDDLRCYSV

SEQ ID NO: 505576 - protein, 9 aa, Homo Sapiens
LISNYISFT

SEQ ID NO: 505577 - protein, 9 aa, Homo Sapiens
QSGGIFMDH

SEQ ID NO: 505578 - protein, 9 aa, Homo Sapiens
QMTKSYPSK

SEQ ID NO: 505579 - protein, 9 aa, Homo Sapiens
GKHDLSEHD

SEQ ID NO: 505580 - protein, 9 aa, Homo Sapiens
GHHNCCGLY

SEQ ID NO: 505581 - protein, 9 aa, Homo Sapiens
CMVTLEKMS

SEQ ID NO: 505582 - protein, 9 aa, Homo Sapiens
CISFYCTQF

SEQ ID NO: 505583 - protein, 9 aa, Homo Sapiens
RHQLYVASW

SEQ ID NO: 505584 - protein, 9 aa, Homo Sapiens
PKSMINFWS

SEQ ID NO: 505585 - protein, 9 aa, Homo Sapiens
SSKFYLYWK

SEQ ID NO: 505586 - protein, 9 aa, Homo Sapiens
VGHYMRHFA

SEQ ID NO: 505587 - protein, 9 aa, Homo Sapiens
SLHDRARTQ

SEQ ID NO: 505588 - protein, 9 aa, Homo Sapiens
AVLGKHDLS

SEQ ID NO: 505589 - protein, 9 aa, Homo Sapiens
RDVPHAQCV

SEQ ID NO: 505590 - protein, 9 aa, Homo Sapiens
TSVDINGDG

SEQ ID NO: 505591 - protein, 9 aa, Homo Sapiens
FYLYWKKTL

SEQ ID NO: 505592 - protein, 9 aa, Homo Sapiens
MNVPTESGD

SEQ ID NO: 505593 - protein, 9 aa, Homo Sapiens
CPEGHMVTY

SEQ ID NO: 505594 - protein, 9 aa, Homo Sapiens
GHPGPPGDH

SEQ ID NO: 505595 - protein, 9 aa, Homo Sapiens
RLKENQILV

SEQ ID NO: 505596 - protein, 9 aa, Homo Sapiens
KHDLSEHDG

SEQ ID NO: 505597 - protein, 9 aa, Homo Sapiens
ELSLHDRAR

SEQ ID NO: 505598 - protein, 9 aa, Homo Sapiens
ENLFPEPTN

SEQ ID NO: 505599 - protein, 9 aa, Homo Sapiens
FRLCFHLIQ

SEQ ID NO: 505600 - protein, 9 aa, Homo Sapiens
AFRLCFHLI

SEQ ID NO: 505601 - protein, 9 aa, Homo Sapiens
DSALQNVND

SEQ ID NO: 505602 - protein, 9 aa, Homo Sapiens
HNCCGLYPV

SEQ ID NO: 505603 - protein, 9 aa, Homo Sapiens
TSMPPELST

SEQ ID NO: 505604 - protein, 9 aa, Homo Sapiens
VENLFPEPT

SEQ ID NO: 505605 - protein, 9 aa, Homo Sapiens
PTESGDLWI

SEQ ID NO: 505606 - protein, 9 aa, Homo Sapiens
FREVVSSQE

SEQ ID NO: 505607 - protein, 9 aa, Homo Sapiens
LVCGHHNCC

SEQ ID NO: 505608 - protein, 9 aa, Homo Sapiens
LLQVEGSLW

SEQ ID NO: 505609 - protein, 9 aa, Homo Sapiens
HHKHHGKQD

SEQ ID NO: 505610 - protein, 9 aa, Homo Sapiens
WSAVAQIAL

SEQ ID NO: 505611 - protein, 9 aa, Homo Sapiens
HLSGCRLLF

SEQ ID NO: 505612 - protein, 9 aa, Homo Sapiens
HFNICKPKK

SEQ ID NO: 505613 - protein, 9 aa, Homo Sapiens
GNFGGSPSY

SEQ ID NO: 505614 - protein, 9 aa, Homo Sapiens
LENTQRSEE

SEQ ID NO: 505615 - protein, 9 aa, Homo Sapiens
PPEPYVQMT

SEQ ID NO: 505616 - protein, 9 aa, Homo Sapiens
VIEPKSMIN

SEQ ID NO: 505617 - protein, 9 aa, Homo Sapiens
ERTLADTEA

SEQ ID NO: 505618 - protein, 9 aa, Homo Sapiens
LAQELSGMV

SEQ ID NO: 505619 - protein, 9 aa, Homo Sapiens
TESIRMAMG

SEQ ID NO: 505620 - protein, 9 aa, Homo Sapiens
QPGGGPVSV

SEQ ID NO: 505621 - protein, 9 aa, Homo Sapiens
ALQNVNDMY

SEQ ID NO: 505622 - protein, 9 aa, Homo Sapiens
AGEKGHPGP

SEQ ID NO: 505623 - protein, 9 aa, Homo Sapiens
DLRARLPRQ

SEQ ID NO: 505624 - protein, 9 aa, Homo Sapiens
QLTGCSHFG

SEQ ID NO: 505625 - protein, 9 aa, Homo Sapiens
GMSMYYQTI

SEQ ID NO: 505626 - protein, 9 aa, Homo Sapiens
PQLLLLLAA

SEQ ID NO: 505627 - protein, 9 aa, Homo Sapiens
TAHHKHHGK

SEQ ID NO: 505628 - protein, 9 aa, Homo Sapiens
MSARLQLHQ

SEQ ID NO: 505629 - protein, 9 aa, Homo Sapiens
SAAAVENCT

SEQ ID NO: 505630 - protein, 9 aa, Homo Sapiens
HDRARTQKK

SEQ ID NO: 505631 - protein, 9 aa, Homo Sapiens
KSSLERTLA

SEQ ID NO: 505632 - protein, 9 aa, Homo Sapiens
CETVTDFVA

SEQ ID NO: 505633 - protein, 9 aa, Homo Sapiens
DGVAELGVQ

SEQ ID NO: 505634 - protein, 9 aa, Homo Sapiens
TFREVVSSQ

SEQ ID NO: 505635 - protein, 9 aa, Homo Sapiens
LYWKKTLFI

SEQ ID NO: 505636 - protein, 9 aa, Homo Sapiens
FGNRDVPHA

SEQ ID NO: 505637 - protein, 9 aa, Homo Sapiens
GIFMDHSDN

SEQ ID NO: 505638 - protein, 9 aa, Homo Sapiens
RLVCGHHNC

SEQ ID NO: 505639 - protein, 9 aa, Homo Sapiens
SKFYLYWKK

SEQ ID NO: 505640 - protein, 9 aa, Homo Sapiens
PPELSTTVM

SEQ ID NO: 505641 - protein, 9 aa, Homo Sapiens
QHMTEVVRH

SEQ ID NO: 505642 - protein, 9 aa, Homo Sapiens
TTGAHSPGA

SEQ ID NO: 505643 - protein, 9 aa, Homo Sapiens
LGKHDLSEH

SEQ ID NO: 505644 - protein, 9 aa, Homo Sapiens
QRSEETSRS

SEQ ID NO: 505645 - protein, 9 aa, Homo Sapiens
LCCLVLVAQ

SEQ ID NO: 505646 - protein, 9 aa, Homo Sapiens
RALGSPTLG

SEQ ID NO: 505647 - protein, 9 aa, Homo Sapiens
INGDGVTDV

SEQ ID NO: 505648 - protein, 9 aa, Homo Sapiens
LQLHQHGGL

SEQ ID NO: 505649 - protein, 9 aa, Homo Sapiens
HPGPPGDHE

SEQ ID NO: 505650 - protein, 9 aa, Homo Sapiens
AGVFQPPPG

SEQ ID NO: 505651 - protein, 9 aa, Homo Sapiens
PSYGGGRGG

SEQ ID NO: 505652 - protein, 9 aa, Homo Sapiens
FGGSPSYGG

SEQ ID NO: 505653 - protein, 9 aa, Homo Sapiens
QCCPSAALP

SEQ ID NO: 505654 - protein, 9 aa, Homo Sapiens
GVAELGVQP

SEQ ID NO: 505655 - protein, 9 aa, Homo Sapiens
SFYCTQFTE

SEQ ID NO: 505656 - protein, 9 aa, Homo Sapiens
NLFPEPTNL

SEQ ID NO: 505657 - protein, 9 aa, Homo Sapiens
FEVTQCCPS

SEQ ID NO: 505658 - protein, 9 aa, Homo Sapiens
MKFRAKEYE

SEQ ID NO: 505659 - protein, 9 aa, Homo Sapiens
YKHKGNTSG

SEQ ID NO: 505660 - protein, 9 aa, Homo Sapiens
HQACISFYC

SEQ ID NO: 505661 - protein, 9 aa, Homo Sapiens
LAHRTTGAH

SEQ ID NO: 505662 - protein, 9 aa, Homo Sapiens
QELSGMVIY

SEQ ID NO: 505663 - protein, 9 aa, Homo Sapiens
LTAEDWQLT

SEQ ID NO: 505664 - protein, 9 aa, Homo Sapiens
LHQHGGLLH

SEQ ID NO: 505665 - protein, 9 aa, Homo Sapiens
PGLAHRTTG

SEQ ID NO: 505666 - protein, 9 aa, Homo Sapiens
DEQPSKRPR

SEQ ID NO: 505667 - protein, 9 aa, Homo Sapiens
EFPLKVSTR

SEQ ID NO: 505668 - protein, 9 aa, Homo Sapiens
FVLDDLRCY

SEQ ID NO: 505669 - protein, 9 aa, Homo Sapiens
AQELSGMVI

SEQ ID NO: 505670 - protein, 9 aa, Homo Sapiens
HQRVHVTVR

SEQ ID NO: 505671 - protein, 9 aa, Homo Sapiens
EPKSMINFW

SEQ ID NO: 505672 - protein, 9 aa, Homo Sapiens
LKFFHKSEA

SEQ ID NO: 505673 - protein, 9 aa, Homo Sapiens
CYSVDLRYT

SEQ ID NO: 505674 - protein, 9 aa, Homo Sapiens
ADEQPSKRP

SEQ ID NO: 505675 - protein, 9 aa, Homo Sapiens
RLAQELSGM

SEQ ID NO: 505676 - protein, 9 aa, Homo Sapiens
EVLPALESN

SEQ ID NO: 505677 - protein, 9 aa, Homo Sapiens
LLISNYISF

SEQ ID NO: 505678 - protein, 9 aa, Homo Sapiens
DSHEYRLCH

SEQ ID NO: 505679 - protein, 9 aa, Homo Sapiens
LVRAAFLEK

SEQ ID NO: 505680 - protein, 9 aa, Homo Sapiens
CGRAFRLCF

SEQ ID NO: 505681 - protein, 9 aa, Homo Sapiens
DHQACISFY

SEQ ID NO: 505682 - protein, 9 aa, Homo Sapiens
LSLHDRART

SEQ ID NO: 505683 - protein, 9 aa, Homo Sapiens
TLCETVTDF

SEQ ID NO: 505684 - protein, 9 aa, Homo Sapiens
ARQLTGCSH

SEQ ID NO: 505685 - protein, 9 aa, Homo Sapiens
MLGHGARPD

SEQ ID NO: 505686 - protein, 9 aa, Homo Sapiens
LESSKFYLY

SEQ ID NO: 505687 - protein, 9 aa, Homo Sapiens
VNHFNICKP

SEQ ID NO: 505688 - protein, 9 aa, Homo Sapiens
YSLATGFSP

SEQ ID NO: 505689 - protein, 9 aa, Homo Sapiens
LGSPTLGNH

SEQ ID NO: 505690 - protein, 9 aa, Homo Sapiens
ADQSGGIFM

SEQ ID NO: 505691 - protein, 9 aa, Homo Sapiens
LFPEPTNLT

SEQ ID NO: 505692 - protein, 9 aa, Homo Sapiens
YPLCCLVLV

SEQ ID NO: 505693 - protein, 9 aa, Homo Sapiens
IILYSNITK

SEQ ID NO: 505694 - protein, 9 aa, Homo Sapiens
EYRLCHLPD

SEQ ID NO: 505695 - protein, 9 aa, Homo Sapiens
RCMDGFLCG

SEQ ID NO: 505696 - protein, 9 aa, Homo Sapiens
VEGSLWLAA

SEQ ID NO: 505697 - protein, 9 aa, Homo Sapiens
LLHMPEEPA

SEQ ID NO: 505698 - protein, 9 aa, Homo Sapiens
PEEPADLRA

SEQ ID NO: 505699 - protein, 9 aa, Homo Sapiens
VAELGVQPG

SEQ ID NO: 505700 - protein, 9 aa, Homo Sapiens
PMGQRGQEG

SEQ ID NO: 505701 - protein, 9 aa, Homo Sapiens
AHSPGAWWG

SEQ ID NO: 505702 - protein, 9 aa, Homo Sapiens
QVEGSLWLA

SEQ ID NO: 505703 - protein, 9 aa, Homo Sapiens
DVNHFNICK

SEQ ID NO: 505704 - protein, 9 aa, Homo Sapiens
GMVIYCKSV

SEQ ID NO: 505705 - protein, 9 aa, Homo Sapiens
ESSKFYLYW

SEQ ID NO: 505706 - protein, 9 aa, Homo Sapiens
SSRPLLLAS

SEQ ID NO: 505707 - protein, 9 aa, Homo Sapiens
SALQNVNDM

SEQ ID NO: 505708 - protein, 9 aa, Homo Sapiens
HKGNTSGFY

SEQ ID NO: 505709 - protein, 9 aa, Homo Sapiens
PPAAASVQS

SEQ ID NO: 505710 - protein, 9 aa, Homo Sapiens
ENTQRSEET

SEQ ID NO: 505711 - protein, 9 aa, Homo Sapiens
KFYLYWKKT

SEQ ID NO: 505712 - protein, 9 aa, Homo Sapiens
RLCHLPDCP

SEQ ID NO: 505713 - protein, 9 aa, Homo Sapiens
QILVRAAFL

SEQ ID NO: 505714 - protein, 9 aa, Homo Sapiens
RTTGAHSPG

SEQ ID NO: 505715 - protein, 9 aa, Homo Sapiens
MTPVVGYSL

SEQ ID NO: 505716 - protein, 9 aa, Homo Sapiens
DSTKVTAHH

SEQ ID NO: 505717 - protein, 9 aa, Homo Sapiens
LEWLDVQHR

SEQ ID NO: 505718 - protein, 9 aa, Homo Sapiens
VVGYSLATG

SEQ ID NO: 505719 - protein, 9 aa, Homo Sapiens
ANLLISNYI

SEQ ID NO: 505720 - protein, 9 aa, Homo Sapiens
RPRLLENTQ

SEQ ID NO: 505721 - protein, 9 aa, Homo Sapiens
GSPTLGNHA

SEQ ID NO: 505722 - protein, 9 aa, Homo Sapiens
STAEATVCM

SEQ ID NO: 505723 - protein, 9 aa, Homo Sapiens
ASVQSLHPV

SEQ ID NO: 505724 - protein, 9 aa, Homo Sapiens
GLYPVSSLL

SEQ ID NO: 505725 - protein, 9 aa, Homo Sapiens
LRLGVARGQ

SEQ ID NO: 505726 - protein, 9 aa, Homo Sapiens
SSLLQVEGS

SEQ ID NO: 505727 - protein, 9 aa, Homo Sapiens
MAEFPLKVS

SEQ ID NO: 505728 - protein, 9 aa, Homo Sapiens
LDQRGDHPL

SEQ ID NO: 505729 - protein, 9 aa, Homo Sapiens
KENQILVRA

SEQ ID NO: 505730 - protein, 9 aa, Homo Sapiens
HAGEKGHPG

SEQ ID NO: 505731 - protein, 9 aa, Homo Sapiens
MDGFLCGHQ

SEQ ID NO: 505732 - protein, 9 aa, Homo Sapiens
VSSLLQVEG

SEQ ID NO: 505733 - protein, 9 aa, Homo Sapiens
RADHQACIS

SEQ ID NO: 505734 - protein, 9 aa, Homo Sapiens
CGHQRVHVT

SEQ ID NO: 505735 - protein, 9 aa, Homo Sapiens
EGHMVTYTP

SEQ ID NO: 505736 - protein, 9 aa, Homo Sapiens
HGGLLHMPE

SEQ ID NO: 505737 - protein, 9 aa, Homo Sapiens
TLANLLISN

SEQ ID NO: 505738 - protein, 9 aa, Homo Sapiens
IKARMKFRA

SEQ ID NO: 505739 - protein, 9 aa, Homo Sapiens
VQIILYSNI

SEQ ID NO: 505740 - protein, 9 aa, Homo Sapiens
ELSTTVMET

SEQ ID NO: 505741 - protein, 9 aa, Homo Sapiens
ARMKFRAKE

SEQ ID NO: 505742 - protein, 9 aa, Homo Sapiens
HFAKTISNV

SEQ ID NO: 505743 - protein, 9 aa, Homo Sapiens
SKDVAVITE

SEQ ID NO: 505744 - protein, 9 aa, Homo Sapiens
VTVRAMSAR

SEQ ID NO: 505745 - protein, 9 aa, Homo Sapiens
ILKFFHKSE

SEQ ID NO: 505746 - protein, 9 aa, Homo Sapiens
PRLLENTQR

SEQ ID NO: 505747 - protein, 9 aa, Homo Sapiens
PVVGYSLAT

SEQ ID NO: 505748 - protein, 9 aa, Homo Sapiens
VCGHHNCCG

SEQ ID NO: 505749 - protein, 9 aa, Homo Sapiens
ITESIRMAM

SEQ ID NO: 505750 - protein, 9 aa, Homo Sapiens
KFRAKEYES

SEQ ID NO: 505751 - protein, 9 aa, Homo Sapiens
EITSVDING

SEQ ID NO: 505752 - protein, 9 aa, Homo Sapiens
SYEDGSVVL

SEQ ID NO: 505753 - protein, 9 aa, Homo Sapiens
LLASYEDGS

SEQ ID NO: 505754 - protein, 9 aa, Homo Sapiens
LGNHAKTES

SEQ ID NO: 505755 - protein, 9 aa, Homo Sapiens
ACISFYCTQ

SEQ ID NO: 505756 - protein, 9 aa, Homo Sapiens
RHCPHHERC

SEQ ID NO: 505757 - protein, 9 aa, Homo Sapiens
HLPDCPPGA

SEQ ID NO: 505758 - protein, 9 aa, Homo Sapiens
VPTESGDLW

SEQ ID NO: 505759 - protein, 9 aa, Homo Sapiens
AKTLCETVT

SEQ ID NO: 505760 - protein, 9 aa, Homo Sapiens
CCPSAALPR

SEQ ID NO: 505761 - protein, 9 aa, Homo Sapiens
HVTVRAMSA

SEQ ID NO: 505762 - protein, 9 aa, Homo Sapiens
SVIEPKSMI

SEQ ID NO: 505763 - protein, 9 aa, Homo Sapiens
KEVLPALES

SEQ ID NO: 505764 - protein, 9 aa, Homo Sapiens
MSMYYQTIL

SEQ ID NO: 505765 - protein, 9 aa, Homo Sapiens
TPPPAAASV

SEQ ID NO: 505766 - protein, 9 aa, Homo Sapiens
SMYYQTILL

SEQ ID NO: 505767 - protein, 9 aa, Homo Sapiens
TESGDLWIL

SEQ ID NO: 505768 - protein, 9 aa, Homo Sapiens
GARPDSPDP

SEQ ID NO: 505769 - protein, 9 aa, Homo Sapiens
IPVDVNHFN

SEQ ID NO: 505770 - protein, 9 aa, Homo Sapiens
QIVGHYMRH

SEQ ID NO: 505771 - protein, 9 aa, Homo Sapiens
NSAAAVENC

SEQ ID NO: 505772 - protein, 9 aa, Homo Sapiens
LQVEGSLWL

SEQ ID NO: 505773 - protein, 9 aa, Homo Sapiens
CCLVLVAQV

SEQ ID NO: 505774 - protein, 9 aa, Homo Sapiens
FTYFGNRDV

SEQ ID NO: 505775 - protein, 9 aa, Homo Sapiens
KDVQIILYS

SEQ ID NO: 505776 - protein, 9 aa, Homo Sapiens
NHFNICKPK

SEQ ID NO: 505777 - protein, 9 aa, Homo Sapiens
ILYSNITKD

SEQ ID NO: 505778 - protein, 9 aa, Homo Sapiens
DMTPVVGYS

SEQ ID NO: 505779 - protein, 9 aa, Homo Sapiens
CFHLIQHRR

SEQ ID NO: 505780 - protein, 9 aa, Homo Sapiens
LQNVNDMYL

SEQ ID NO: 505781 - protein, 9 aa, Homo Sapiens
PVSSLLQVE

SEQ ID NO: 505782 - protein, 9 aa, Homo Sapiens
SWSAVAQIA

SEQ ID NO: 505783 - protein, 9 aa, Homo Sapiens
QDQLDQRGD

SEQ ID NO: 505784 - protein, 9 aa, Homo Sapiens
FMDHSDNPL

SEQ ID NO: 505785 - protein, 9 aa, Homo Sapiens
LESNKEQIQ

SEQ ID NO: 505786 - protein, 9 aa, Homo Sapiens
VCMVTLEKM

SEQ ID NO: 505787 - protein, 9 aa, Homo Sapiens
VASWSAVAQ

SEQ ID NO: 505788 - protein, 9 aa, Homo Sapiens
HMPEEPADL

SEQ ID NO: 505789 - protein, 9 aa, Homo Sapiens
YVASWSAVA

SEQ ID NO: 505790 - protein, 9 aa, Homo Sapiens
SHFGHIFPS

SEQ ID NO: 505791 - protein, 9 aa, Homo Sapiens
DGFLCGHQR

SEQ ID NO: 505792 - protein, 9 aa, Homo Sapiens
KGNTSGFYY

SEQ ID NO: 505793 - protein, 9 aa, Homo Sapiens
GHAGEKGHP

SEQ ID NO: 505794 - protein, 9 aa, Homo Sapiens
CPSAALPRC

SEQ ID NO: 505795 - protein, 9 aa, Homo Sapiens
KTLCETVTD

SEQ ID NO: 505796 - protein, 9 aa, Homo Sapiens
AAASVQSLH

SEQ ID NO: 505797 - protein, 9 aa, Homo Sapiens
VQPGGGPVS

SEQ ID NO: 505798 - protein, 9 aa, Homo Sapiens
RLGVARGQL

SEQ ID NO: 505799 - protein, 9 aa, Homo Sapiens
TDFVAKVEK

SEQ ID NO: 505800 - protein, 9 aa, Homo Sapiens
LSGCRLLFL

SEQ ID NO: 505801 - protein, 9 aa, Homo Sapiens
VLVEYPLCC

SEQ ID NO: 505802 - protein, 9 aa, Homo Sapiens
MPEEPADLR

SEQ ID NO: 505803 - protein, 9 aa, Homo Sapiens
VLGMSMYYQ

SEQ ID NO: 505804 - protein, 9 aa, Homo Sapiens
QLHQHGGLL

SEQ ID NO: 505805 - protein, 9 aa, Homo Sapiens
LRLAQELSG

SEQ ID NO: 505806 - protein, 9 aa, Homo Sapiens
AEDWQLTAR

SEQ ID NO: 505807 - protein, 9 aa, Homo Sapiens
GVARGQLRL

SEQ ID NO: 505808 - protein, 9 aa, Homo Sapiens
IEPKSMINF

SEQ ID NO: 505809 - protein, 9 aa, Homo Sapiens
YQTILLDSN

SEQ ID NO: 505810 - protein, 9 aa, Homo Sapiens
EATVCMVTL

SEQ ID NO: 505811 - protein, 9 aa, Homo Sapiens
DLWILGDVF

SEQ ID NO: 505812 - protein, 9 aa, Homo Sapiens
PTNLTSSVL

SEQ ID NO: 505813 - protein, 9 aa, Homo Sapiens
ISNYISFTG

SEQ ID NO: 505814 - protein, 9 aa, Homo Sapiens
HYMRHFAKT

SEQ ID NO: 505815 - protein, 9 aa, Homo Sapiens
SSLERTLAD

SEQ ID NO: 505816 - protein, 9 aa, Homo Sapiens
LVEYPLCCL

SEQ ID NO: 505817 - protein, 9 aa, Homo Sapiens
HKHHGKQDV

SEQ ID NO: 505818 - protein, 9 aa, Homo Sapiens
RQLTGCSHF

SEQ ID NO: 505819 - protein, 9 aa, Homo Sapiens
VPHAQCVLC

SEQ ID NO: 505820 - protein, 9 aa, Homo Sapiens
LASYEDGSV

SEQ ID NO: 505821 - protein, 9 aa, Homo Sapiens
STKVTAHHK

SEQ ID NO: 505822 - protein, 9 aa, Homo Sapiens
NSGLTAEDW

SEQ ID NO: 505823 - protein, 9 aa, Homo Sapiens
EVTQCCPSA

SEQ ID NO: 505824 - protein, 9 aa, Homo Sapiens
EPYVQMTKS

SEQ ID NO: 505825 - protein, 9 aa, Homo Sapiens
VTAHHKHHG

SEQ ID NO: 505826 - protein, 9 aa, Homo Sapiens
SGMVIYCKS

SEQ ID NO: 505827 - protein, 9 aa, Homo Sapiens
ELGVQPGGG

SEQ ID NO: 505828 - protein, 9 aa, Homo Sapiens
AELGVQPGG

SEQ ID NO: 505829 - protein, 9 aa, Homo Sapiens
LPALESNKE

SEQ ID NO: 505830 - protein, 9 aa, Homo Sapiens
ECGRAFRLC

SEQ ID NO: 505831 - protein, 9 aa, Homo Sapiens
RCYSVDLRY

SEQ ID NO: 505832 - protein, 9 aa, Homo Sapiens
TEVVRHCPH

SEQ ID NO: 505833 - protein, 9 aa, Homo Sapiens
VSSQEFKQG

SEQ ID NO: 505834 - protein, 9 aa, Homo Sapiens
SVDINGDGV

SEQ ID NO: 505835 - protein, 9 aa, Homo Sapiens
AEFPLKVST

SEQ ID NO: 505836 - protein, 9 aa, Homo Sapiens
CRLLFLFLS

SEQ ID NO: 505837 - protein, 9 aa, Homo Sapiens
LHMPEEPAD

SEQ ID NO: 505838 - protein, 9 aa, Homo Sapiens
MQRADEQPS

SEQ ID NO: 505839 - protein, 9 aa, Homo Sapiens
HQLYVASWS

SEQ ID NO: 505840 - protein, 9 aa, Homo Sapiens
GGIFMDHSD

SEQ ID NO: 505841 - protein, 9 aa, Homo Sapiens
GNRDVPHAQ

SEQ ID NO: 505842 - protein, 9 aa, Homo Sapiens
ADLRARLPR

SEQ ID NO: 505843 - protein, 9 aa, Homo Sapiens
SSQEFKQGE

SEQ ID NO: 505844 - protein, 9 aa, Homo Sapiens
LRCYSVDLR

SEQ ID NO: 505845 - protein, 9 aa, Homo Sapiens
DLRCYSVDL

SEQ ID NO: 505846 - protein, 9 aa, Homo Sapiens
DDLRCYSVD

SEQ ID NO: 505847 - protein, 9 aa, Homo Sapiens
CSHFGHIFP

SEQ ID NO: 505848 - protein, 9 aa, Homo Sapiens
QSCEAYKHK

SEQ ID NO: 505849 - protein, 9 aa, Homo Sapiens
DGHAGEKGH

SEQ ID NO: 505850 - protein, 9 aa, Homo Sapiens
NCCGLYPVS

SEQ ID NO: 505851 - protein, 9 aa, Homo Sapiens
LGHGARPDS

SEQ ID NO: 505852 - protein, 9 aa, Homo Sapiens
AHHKHHGKQ

SEQ ID NO: 505853 - protein, 9 aa, Homo Sapiens
QRVHVTVRA

SEQ ID NO: 505854 - protein, 9 aa, Homo Sapiens
TAEDWQLTA

SEQ ID NO: 505855 - protein, 9 aa, Homo Sapiens
RNSAAAVEN

SEQ ID NO: 505856 - protein, 9 aa, Homo Sapiens
PPPEPYVQM

SEQ ID NO: 505857 - protein, 9 aa, Homo Sapiens
RAFRLCFHL

SEQ ID NO: 505858 - protein, 9 aa, Homo Sapiens
IVGHYMRHF

SEQ ID NO: 505859 - protein, 9 aa, Homo Sapiens
AVLRLGVAR

SEQ ID NO: 505860 - protein, 9 aa, Homo Sapiens
EGSLWLAAG

SEQ ID NO: 505861 - protein, 9 aa, Homo Sapiens
ALESNKEQI

SEQ ID NO: 505862 - protein, 9 aa, Homo Sapiens
PPPGLAHRT

SEQ ID NO: 505863 - protein, 9 aa, Homo Sapiens
SQEFKQGED

SEQ ID NO: 505864 - protein, 9 aa, Homo Sapiens
MRHFAKTIS

SEQ ID NO: 505865 - protein, 9 aa, Homo Sapiens
PLLLASYED

SEQ ID NO: 505866 - protein, 9 aa, Homo Sapiens
GHYMRHFAK

SEQ ID NO: 505867 - protein, 9 aa, Homo Sapiens
DQLDQRGDH

SEQ ID NO: 505868 - protein, 9 aa, Homo Sapiens
LIAVLGKHD

SEQ ID NO: 505869 - protein, 9 aa, Homo Sapiens
GPMGQRGQE

SEQ ID NO: 505870 - protein, 9 aa, Homo Sapiens
NVNDMYLLL

SEQ ID NO: 505871 - protein, 9 aa, Homo Sapiens
ASWSAVAQI

SEQ ID NO: 505872 - protein, 9 aa, Homo Sapiens
NTQRSEETS

SEQ ID NO: 505873 - protein, 9 aa, Homo Sapiens
ESGDLWILG

SEQ ID NO: 505874 - protein, 9 aa, Homo Sapiens
YYQTILLDS

SEQ ID NO: 505875 - protein, 9 aa, Homo Sapiens
SGDLWILGD

SEQ ID NO: 505876 - protein, 9 aa, Homo Sapiens
TYFGNRDVP

SEQ ID NO: 505877 - protein, 9 aa, Homo Sapiens
LQDQLDQRG

SEQ ID NO: 505878 - protein, 9 aa, Homo Sapiens
DINGDGVTD

SEQ ID NO: 505879 - protein, 9 aa, Homo Sapiens
RGQEGPMGP

SEQ ID NO: 505880 - protein, 9 aa, Homo Sapiens
TQRSEETSR

SEQ ID NO: 505881 - protein, 9 aa, Homo Sapiens
PEPYVQMTK

SEQ ID NO: 505882 - protein, 9 aa, Homo Sapiens
GFLCGHQRV

SEQ ID NO: 505883 - protein, 9 aa, Homo Sapiens
VRHCPHHER

SEQ ID NO: 505884 - protein, 9 aa, Homo Sapiens
VVRHCPHHE

SEQ ID NO: 505885 - protein, 9 aa, Homo Sapiens
EEPADLRAR

SEQ ID NO: 505886 - protein, 9 aa, Homo Sapiens
CMDGFLCGH

SEQ ID NO: 505887 - protein, 9 aa, Homo Sapiens
VQMTKSYPS

SEQ ID NO: 505888 - protein, 9 aa, Homo Sapiens
GSPSYGGGR

SEQ ID NO: 505889 - protein, 9 aa, Homo Sapiens
IAVLGKHDL

SEQ ID NO: 505890 - protein, 9 aa, Homo Sapiens
HQHGGLLHM

SEQ ID NO: 505891 - protein, 9 aa, Homo Sapiens
ADHQACISF

SEQ ID NO: 505892 - protein, 9 aa, Homo Sapiens
PEELSLHDR

SEQ ID NO: 505893 - protein, 9 aa, Homo Sapiens
TVCMVTLEK

SEQ ID NO: 505894 - protein, 9 aa, Homo Sapiens
YVQMTKSYP

SEQ ID NO: 505895 - protein, 9 aa, Homo Sapiens
MGQRGQEGP

SEQ ID NO: 505896 - protein, 9 aa, Homo Sapiens
REVVSSQEF

SEQ ID NO: 505897 - protein, 9 aa, Homo Sapiens
WQLTARARA

SEQ ID NO: 505898 - protein, 9 aa, Homo Sapiens
SVQSLHPVL

SEQ ID NO: 505899 - protein, 9 aa, Homo Sapiens
LCFHLIQHR

SEQ ID NO: 505900 - protein, 9 aa, Homo Sapiens
PAAASVQSL

SEQ ID NO: 505901 - protein, 9 aa, Homo Sapiens
QTTSMPPEL

SEQ ID NO: 505902 - protein, 9 aa, Homo Sapiens
SLERTLADT

SEQ ID NO: 505903 - protein, 9 aa, Homo Sapiens
MPPELSTTV

SEQ ID NO: 505904 - protein, 9 aa, Homo Sapiens
RRLKENQIL

SEQ ID NO: 505905 - protein, 9 aa, Homo Sapiens
AASVQSLHP

SEQ ID NO: 505906 - protein, 9 aa, Homo Sapiens
PPPAAASVQ

SEQ ID NO: 505907 - protein, 9 aa, Homo Sapiens
EVVSSQEFK

SEQ ID NO: 505908 - protein, 9 aa, Homo Sapiens
RLCFHLIQH

SEQ ID NO: 505909 - protein, 9 aa, Homo Sapiens
GHMVTYTPM

SEQ ID NO: 505910 - protein, 9 aa, Homo Sapiens
KGHPGPPGD

SEQ ID NO: 505911 - protein, 9 aa, Homo Sapiens
GAVLRLGVA

SEQ ID NO: 505912 - protein, 9 aa, Homo Sapiens
QIILYSNIT

SEQ ID NO: 505913 - protein, 9 aa, Homo Sapiens
AMSARLQLH

SEQ ID NO: 505914 - protein, 9 aa, Homo Sapiens
EYPLCCLVL

SEQ ID NO: 505915 - protein, 9 aa, Homo Sapiens
SMINFWSEN

SEQ ID NO: 505916 - protein, 9 aa, Homo Sapiens
NLLISNYIS

SEQ ID NO: 505917 - protein, 9 aa, Homo Sapiens
PALESNKEQ

SEQ ID NO: 505918 - protein, 9 aa, Homo Sapiens
LCHLPDCPP

SEQ ID NO: 505919 - protein, 9 aa, Homo Sapiens
AHRTTGAHS

SEQ ID NO: 505920 - protein, 9 aa, Homo Sapiens
PKTLANLLI

SEQ ID NO: 505921 - protein, 9 aa, Homo Sapiens
RLQLHQHGG

SEQ ID NO: 505922 - protein, 9 aa, Homo Sapiens
NQILVRAAF

SEQ ID NO: 505923 - protein, 9 aa, Homo Sapiens
HHNCCGLYP

SEQ ID NO: 505924 - protein, 9 aa, Homo Sapiens
TGAHSPGAW

SEQ ID NO: 505925 - protein, 9 aa, Homo Sapiens
ELSGMVIYC

SEQ ID NO: 505926 - protein, 9 aa, Homo Sapiens
SARLQLHQH

SEQ ID NO: 505927 - protein, 9 aa, Homo Sapiens
ETVTDFVAK

SEQ ID NO: 505928 - protein, 9 aa, Homo Sapiens
FNICKPKKK

SEQ ID NO: 505929 - protein, 9 aa, Homo Sapiens
NGDGVTDVL

SEQ ID NO: 505930 - protein, 9 aa, Homo Sapiens
GHGARPDSP

SEQ ID NO: 505931 - protein, 9 aa, Homo Sapiens
YIEMLGHGA

SEQ ID NO: 505932 - protein, 9 aa, Homo Sapiens
QLYVASWSA

SEQ ID NO: 505933 - protein, 9 aa, Homo Sapiens
MYYQTILLD

SEQ ID NO: 505934 - protein, 9 aa, Homo Sapiens
FPEPTNLTS

SEQ ID NO: 505935 - protein, 9 aa, Homo Sapiens
LLENTQRSE

SEQ ID NO: 505936 - protein, 9 aa, Homo Sapiens
KNTSQVSLH

SEQ ID NO: 505937 - protein, 9 aa, Homo Sapiens
ELHFIKRQE

SEQ ID NO: 505938 - protein, 9 aa, Homo Sapiens
SPLAAANVL

SEQ ID NO: 505939 - protein, 9 aa, Homo Sapiens
ISKYDKYGF

SEQ ID NO: 505940 - protein, 9 aa, Homo Sapiens
IIRDLGTLA

SEQ ID NO: 505941 - protein, 9 aa, Homo Sapiens
EVATNLGPP

SEQ ID NO: 505942 - protein, 9 aa, Homo Sapiens
ILSPSVAQK

SEQ ID NO: 505943 - protein, 9 aa, Homo Sapiens
QAHAVNVIM

SEQ ID NO: 505944 - protein, 9 aa, Homo Sapiens
VTLYYTCLK

SEQ ID NO: 505945 - protein, 9 aa, Homo Sapiens
LFTEKQRMR

SEQ ID NO: 505946 - protein, 9 aa, Homo Sapiens
KHKEDIYLS

SEQ ID NO: 505947 - protein, 9 aa, Homo Sapiens
GSAFYRESV

SEQ ID NO: 505948 - protein, 9 aa, Homo Sapiens
FVTLYYTCL

SEQ ID NO: 505949 - protein, 9 aa, Homo Sapiens
AFKHFQCNR

SEQ ID NO: 505950 - protein, 9 aa, Homo Sapiens
FQSSALMAL

SEQ ID NO: 505951 - protein, 9 aa, Homo Sapiens
RRTYLEAWR

SEQ ID NO: 505952 - protein, 9 aa, Homo Sapiens
NKKKWYESA

SEQ ID NO: 505953 - protein, 9 aa, Homo Sapiens
VQLTHDKVK

SEQ ID NO: 505954 - protein, 9 aa, Homo Sapiens
SRTEIPAFL

SEQ ID NO: 505955 - protein, 9 aa, Homo Sapiens
KGFPVFSKM

SEQ ID NO: 505956 - protein, 9 aa, Homo Sapiens
VFFLFPHLV

SEQ ID NO: 505957 - protein, 9 aa, Homo Sapiens
VEKFMDSSV

SEQ ID NO: 505958 - protein, 9 aa, Homo Sapiens
DDMGLVLRS

SEQ ID NO: 505959 - protein, 9 aa, Homo Sapiens
NLRAIKWSN

SEQ ID NO: 505960 - protein, 9 aa, Homo Sapiens
AWEDVEDVT

SEQ ID NO: 505961 - protein, 9 aa, Homo Sapiens
YPSAGVERV

SEQ ID NO: 505962 - protein, 9 aa, Homo Sapiens
LSPISKYDK

SEQ ID NO: 505963 - protein, 9 aa, Homo Sapiens
VLKHKEDIY

SEQ ID NO: 505964 - protein, 9 aa, Homo Sapiens
YPIFVLLHT

SEQ ID NO: 505965 - protein, 9 aa, Homo Sapiens
SVFSHDPLL

SEQ ID NO: 505966 - protein, 9 aa, Homo Sapiens
EPEVLQDSQ

SEQ ID NO: 505967 - protein, 9 aa, Homo Sapiens
GFPVFSKMH

SEQ ID NO: 505968 - protein, 9 aa, Homo Sapiens
VLLQVTREE

SEQ ID NO: 505969 - protein, 9 aa, Homo Sapiens
PILYVFLNN

SEQ ID NO: 505970 - protein, 9 aa, Homo Sapiens
TEIPAFLVN

SEQ ID NO: 505971 - protein, 9 aa, Homo Sapiens
FLDWMHLEP

SEQ ID NO: 505972 - protein, 9 aa, Homo Sapiens
CKDYVLNVT

SEQ ID NO: 505973 - protein, 9 aa, Homo Sapiens
PTKFTIKNQ

SEQ ID NO: 505974 - protein, 9 aa, Homo Sapiens
EDLDDATAQ

SEQ ID NO: 505975 - protein, 9 aa, Homo Sapiens
KTEAENTNK

SEQ ID NO: 505976 - protein, 9 aa, Homo Sapiens
VVLLQVTRE

SEQ ID NO: 505977 - protein, 9 aa, Homo Sapiens
HGERNIPRV

SEQ ID NO: 505978 - protein, 9 aa, Homo Sapiens
PHHKPLMGE

SEQ ID NO: 505979 - protein, 9 aa, Homo Sapiens
RIELHRNPP

SEQ ID NO: 505980 - protein, 9 aa, Homo Sapiens
VPEAEAHEE

SEQ ID NO: 505981 - protein, 9 aa, Homo Sapiens
NKGDRMATS

SEQ ID NO: 505982 - protein, 9 aa, Homo Sapiens
GGWGGKGSQ

SEQ ID NO: 505983 - protein, 9 aa, Homo Sapiens
FLVNCKCQD

SEQ ID NO: 505984 - protein, 9 aa, Homo Sapiens
EGSLSLAAM

SEQ ID NO: 505985 - protein, 9 aa, Homo Sapiens
CGKAFRQNL

SEQ ID NO: 505986 - protein, 9 aa, Homo Sapiens
ELSYDNIRV

SEQ ID NO: 505987 - protein, 9 aa, Homo Sapiens
PGAPATAKP

SEQ ID NO: 505988 - protein, 9 aa, Homo Sapiens
HLVLVDDDG

SEQ ID NO: 505989 - protein, 9 aa, Homo Sapiens
FSHCKDYVL

SEQ ID NO: 505990 - protein, 9 aa, Homo Sapiens
LELLPTTEG

SEQ ID NO: 505991 - protein, 9 aa, Homo Sapiens
PPQEIRGPH

SEQ ID NO: 505992 - protein, 9 aa, Homo Sapiens
SRWTTPNHH

SEQ ID NO: 505993 - protein, 9 aa, Homo Sapiens
NRCKKSFAL

SEQ ID NO: 505994 - protein, 9 aa, Homo Sapiens
WVHASPQHV

SEQ ID NO: 505995 - protein, 9 aa, Homo Sapiens
PLLVTLDQV

SEQ ID NO: 505996 - protein, 9 aa, Homo Sapiens
CGGLLIRRN

SEQ ID NO: 505997 - protein, 9 aa, Homo Sapiens
LQAHAGAVL

SEQ ID NO: 505998 - protein, 9 aa, Homo Sapiens
LEQLQAHAG

SEQ ID NO: 505999 - protein, 9 aa, Homo Sapiens
EQQPSCTDD

SEQ ID NO: 506000 - protein, 9 aa, Homo Sapiens
AEAHEEWSC

SEQ ID NO: 506001 - protein, 9 aa, Homo Sapiens
DATAQEEAD

SEQ ID NO: 506002 - protein, 9 aa, Homo Sapiens
LRRVKELML

SEQ ID NO: 506003 - protein, 9 aa, Homo Sapiens
LENQFFTRT

SEQ ID NO: 506004 - protein, 9 aa, Homo Sapiens
TTLAPQGAT

SEQ ID NO: 506005 - protein, 9 aa, Homo Sapiens
IQLPGNQLI

SEQ ID NO: 506006 - protein, 9 aa, Homo Sapiens
FGPPGTSKT

SEQ ID NO: 506007 - protein, 9 aa, Homo Sapiens
SCTDDLPLC

SEQ ID NO: 506008 - protein, 9 aa, Homo Sapiens
SRKAVARLE

SEQ ID NO: 506009 - protein, 9 aa, Homo Sapiens
KEFLDWMHL

SEQ ID NO: 506010 - protein, 9 aa, Homo Sapiens
HVIFQMHKE

SEQ ID NO: 506011 - protein, 9 aa, Homo Sapiens
QGSPLAAAN

SEQ ID NO: 506012 - protein, 9 aa, Homo Sapiens
PSCTDDLPL

SEQ ID NO: 506013 - protein, 9 aa, Homo Sapiens
RASLSSHAR

SEQ ID NO: 506014 - protein, 9 aa, Homo Sapiens
DDAWEDVED

SEQ ID NO: 506015 - protein, 9 aa, Homo Sapiens
WNSVLKIIE

SEQ ID NO: 506016 - protein, 9 aa, Homo Sapiens
SSALMALQE

SEQ ID NO: 506017 - protein, 9 aa, Homo Sapiens
RNAGKQSRS

SEQ ID NO: 506018 - protein, 9 aa, Homo Sapiens
QEPNLCLFG

SEQ ID NO: 506019 - protein, 9 aa, Homo Sapiens
LCSMAPECC

SEQ ID NO: 506020 - protein, 9 aa, Homo Sapiens
AVFRKSSYG

SEQ ID NO: 506021 - protein, 9 aa, Homo Sapiens
TQTWHPCPT

SEQ ID NO: 506022 - protein, 9 aa, Homo Sapiens
EAIAKAKEH

SEQ ID NO: 506023 - protein, 9 aa, Homo Sapiens
KFMDSSVED

SEQ ID NO: 506024 - protein, 9 aa, Homo Sapiens
GGATFDVTM

SEQ ID NO: 506025 - protein, 9 aa, Homo Sapiens
QVKKYFVTL

SEQ ID NO: 506026 - protein, 9 aa, Homo Sapiens
TQKASAGDG

SEQ ID NO: 506027 - protein, 9 aa, Homo Sapiens
CTDDLPLCH

SEQ ID NO: 506028 - protein, 9 aa, Homo Sapiens
ADCKCDSGC

SEQ ID NO: 506029 - protein, 9 aa, Homo Sapiens
SAQTFTLDS

SEQ ID NO: 506030 - protein, 9 aa, Homo Sapiens
RTYLEAWRA

SEQ ID NO: 506031 - protein, 9 aa, Homo Sapiens
PEISVKEFL

SEQ ID NO: 506032 - protein, 9 aa, Homo Sapiens
DWDKMDNPN

SEQ ID NO: 506033 - protein, 9 aa, Homo Sapiens
DKMDNPNFI

SEQ ID NO: 506034 - protein, 9 aa, Homo Sapiens
ARKALFPVH

SEQ ID NO: 506035 - protein, 9 aa, Homo Sapiens
SGARIELHR

SEQ ID NO: 506036 - protein, 9 aa, Homo Sapiens
GNSRGEWKC

SEQ ID NO: 506037 - protein, 9 aa, Homo Sapiens
RDLGTLAQV

SEQ ID NO: 506038 - protein, 9 aa, Homo Sapiens
TNKKGFPVF

SEQ ID NO: 506039 - protein, 9 aa, Homo Sapiens
LHRNPPPNA

SEQ ID NO: 506040 - protein, 9 aa, Homo Sapiens
AKRFRLIVG

SEQ ID NO: 506041 - protein, 9 aa, Homo Sapiens
GQDVYIVQS

SEQ ID NO: 506042 - protein, 9 aa, Homo Sapiens
MGHPPQEIR

SEQ ID NO: 506043 - protein, 9 aa, Homo Sapiens
GHPPQEIRG

SEQ ID NO: 506044 - protein, 9 aa, Homo Sapiens
PLAAANVLK

SEQ ID NO: 506045 - protein, 9 aa, Homo Sapiens
ISVAISLEG

SEQ ID NO: 506046 - protein, 9 aa, Homo Sapiens
VSFESKEAV

SEQ ID NO: 506047 - protein, 9 aa, Homo Sapiens
VELSYDNIR

SEQ ID NO: 506048 - protein, 9 aa, Homo Sapiens
QKLTKKTLI

SEQ ID NO: 506049 - protein, 9 aa, Homo Sapiens
EGVVWTKDV

SEQ ID NO: 506050 - protein, 9 aa, Homo Sapiens
YTPVFLAKP

SEQ ID NO: 506051 - protein, 9 aa, Homo Sapiens
KEIPSLHQE

SEQ ID NO: 506052 - protein, 9 aa, Homo Sapiens
MWALVLAFF

SEQ ID NO: 506053 - protein, 9 aa, Homo Sapiens
GFDTRASLS

SEQ ID NO: 506054 - protein, 9 aa, Homo Sapiens
TLIKEYTEE

SEQ ID NO: 506055 - protein, 9 aa, Homo Sapiens
EGSPEPGRQ

SEQ ID NO: 506056 - protein, 9 aa, Homo Sapiens
QGGGWGGKG

SEQ ID NO: 506057 - protein, 9 aa, Homo Sapiens
QSHSEANTY

SEQ ID NO: 506058 - protein, 9 aa, Homo Sapiens
TKKTLIKEY

SEQ ID NO: 506059 - protein, 9 aa, Homo Sapiens
ESFTPHHKP

SEQ ID NO: 506060 - protein, 9 aa, Homo Sapiens
QSEQEVATN

SEQ ID NO: 506061 - protein, 9 aa, Homo Sapiens
EIGESVRGQ

SEQ ID NO: 506062 - protein, 9 aa, Homo Sapiens
DFLENQFFT

SEQ ID NO: 506063 - protein, 9 aa, Homo Sapiens
KMDNPNFIP

SEQ ID NO: 506064 - protein, 9 aa, Homo Sapiens
YVFLNNGIK

SEQ ID NO: 506065 - protein, 9 aa, Homo Sapiens
LNPILYVFL

SEQ ID NO: 506066 - protein, 9 aa, Homo Sapiens
ITREIVSGL

SEQ ID NO: 506067 - protein, 9 aa, Homo Sapiens
GVVWTKDVL

SEQ ID NO: 506068 - protein, 9 aa, Homo Sapiens
EHRQQQAEL

SEQ ID NO: 506069 - protein, 9 aa, Homo Sapiens
EGCPGPLLV

SEQ ID NO: 506070 - protein, 9 aa, Homo Sapiens
SHLKMMCCN

SEQ ID NO: 506071 - protein, 9 aa, Homo Sapiens
ELHRNPPPN

SEQ ID NO: 506072 - protein, 9 aa, Homo Sapiens
EETATWILS

SEQ ID NO: 506073 - protein, 9 aa, Homo Sapiens
EITREIVSG

SEQ ID NO: 506074 - protein, 9 aa, Homo Sapiens
GEETATWIL

SEQ ID NO: 506075 - protein, 9 aa, Homo Sapiens
SPISKYDKY

SEQ ID NO: 506076 - protein, 9 aa, Homo Sapiens
FPHLVLVDD

SEQ ID NO: 506077 - protein, 9 aa, Homo Sapiens
LQDSQDRCY

SEQ ID NO: 506078 - protein, 9 aa, Homo Sapiens
GTCDQSFKC

SEQ ID NO: 506079 - protein, 9 aa, Homo Sapiens
IIFGPPGTS

SEQ ID NO: 506080 - protein, 9 aa, Homo Sapiens
VFSHDPLLL

SEQ ID NO: 506081 - protein, 9 aa, Homo Sapiens
LVLVDDDGI

SEQ ID NO: 506082 - protein, 9 aa, Homo Sapiens
SFKCNSDFI

SEQ ID NO: 506083 - protein, 9 aa, Homo Sapiens
MLVVLLQVT

SEQ ID NO: 506084 - protein, 9 aa, Homo Sapiens
SWRVYHADC

SEQ ID NO: 506085 - protein, 9 aa, Homo Sapiens
TCPGVVLKH

SEQ ID NO: 506086 - protein, 9 aa, Homo Sapiens
PENQIITLT

SEQ ID NO: 506087 - protein, 9 aa, Homo Sapiens
TAKPGTSGS

SEQ ID NO: 506088 - protein, 9 aa, Homo Sapiens
RESVYPSQP

SEQ ID NO: 506089 - protein, 9 aa, Homo Sapiens
CGPESFTPH

SEQ ID NO: 506090 - protein, 9 aa, Homo Sapiens
EKEIPSLHQ

SEQ ID NO: 506091 - protein, 9 aa, Homo Sapiens
LCLTRHQRI

SEQ ID NO: 506092 - protein, 9 aa, Homo Sapiens
VFWTYQDEE

SEQ ID NO: 506093 - protein, 9 aa, Homo Sapiens
FDVTMRFLY

SEQ ID NO: 506094 - protein, 9 aa, Homo Sapiens
VDLKWNSVL

SEQ ID NO: 506095 - protein, 9 aa, Homo Sapiens
QSARNFKEQ

SEQ ID NO: 506096 - protein, 9 aa, Homo Sapiens
GSSWEMGSM

SEQ ID NO: 506097 - protein, 9 aa, Homo Sapiens
TWILSPSVA

SEQ ID NO: 506098 - protein, 9 aa, Homo Sapiens
IKWSNMEDR

SEQ ID NO: 506099 - protein, 9 aa, Homo Sapiens
KMLVVLLQV

SEQ ID NO: 506100 - protein, 9 aa, Homo Sapiens
VKAQSCQLC

SEQ ID NO: 506101 - protein, 9 aa, Homo Sapiens
LKHKEDIYL

SEQ ID NO: 506102 - protein, 9 aa, Homo Sapiens
AQLRRIIKL

SEQ ID NO: 506103 - protein, 9 aa, Homo Sapiens
PRPLQEEVL

SEQ ID NO: 506104 - protein, 9 aa, Homo Sapiens
WHPCPTKFT

SEQ ID NO: 506105 - protein, 9 aa, Homo Sapiens
PGVVLKHKE

SEQ ID NO: 506106 - protein, 9 aa, Homo Sapiens
TEAENTNKA

SEQ ID NO: 506107 - protein, 9 aa, Homo Sapiens
GEITREIVS

SEQ ID NO: 506108 - protein, 9 aa, Homo Sapiens
GVYQQPYYY

SEQ ID NO: 506109 - protein, 9 aa, Homo Sapiens
QPGSPPCSL

SEQ ID NO: 506110 - protein, 9 aa, Homo Sapiens
RCRGVTNTL

SEQ ID NO: 506111 - protein, 9 aa, Homo Sapiens
HLLMPENQI

SEQ ID NO: 506112 - protein, 9 aa, Homo Sapiens
LQVTREEDD

SEQ ID NO: 506113 - protein, 9 aa, Homo Sapiens
QEEVLVVRP

SEQ ID NO: 506114 - protein, 9 aa, Homo Sapiens
QAFWEVQEL

SEQ ID NO: 506115 - protein, 9 aa, Homo Sapiens
ATMYVDLFS

SEQ ID NO: 506116 - protein, 9 aa, Homo Sapiens
IDTDHPDIH

SEQ ID NO: 506117 - protein, 9 aa, Homo Sapiens
TLAPQGATT

SEQ ID NO: 506118 - protein, 9 aa, Homo Sapiens
TGNSRGEWK

SEQ ID NO: 506119 - protein, 9 aa, Homo Sapiens
GRTNITDEE

SEQ ID NO: 506120 - protein, 9 aa, Homo Sapiens
YRDADIQTD

SEQ ID NO: 506121 - protein, 9 aa, Homo Sapiens
LKLAGWQCP

SEQ ID NO: 506122 - protein, 9 aa, Homo Sapiens
PPGTSKTVT

SEQ ID NO: 506123 - protein, 9 aa, Homo Sapiens
PRGFFAFHA

SEQ ID NO: 506124 - protein, 9 aa, Homo Sapiens
KYGFLTVPD

SEQ ID NO: 506125 - protein, 9 aa, Homo Sapiens
LSKNAVHGV

SEQ ID NO: 506126 - protein, 9 aa, Homo Sapiens
LFRYLDYNK

SEQ ID NO: 506127 - protein, 9 aa, Homo Sapiens
VKFQCSRKA

SEQ ID NO: 506128 - protein, 9 aa, Homo Sapiens
KLTKKTLIK

SEQ ID NO: 506129 - protein, 9 aa, Homo Sapiens
GKGSQNYHQ

SEQ ID NO: 506130 - protein, 9 aa, Homo Sapiens
TDYRDADIQ

SEQ ID NO: 506131 - protein, 9 aa, Homo Sapiens
QPSCTDDLP

SEQ ID NO: 506132 - protein, 9 aa, Homo Sapiens
NSHLKMMCC

SEQ ID NO: 506133 - protein, 9 aa, Homo Sapiens
AQTFTLDSL

SEQ ID NO: 506134 - protein, 9 aa, Homo Sapiens
VIMDAETAY

SEQ ID NO: 506135 - protein, 9 aa, Homo Sapiens
ATAKPGTSG

SEQ ID NO: 506136 - protein, 9 aa, Homo Sapiens
TNLGPPSRT

SEQ ID NO: 506137 - protein, 9 aa, Homo Sapiens
QSYSEDFLE

SEQ ID NO: 506138 - protein, 9 aa, Homo Sapiens
IGESVRGQD

SEQ ID NO: 506139 - protein, 9 aa, Homo Sapiens
SAGVERVFY

SEQ ID NO: 506140 - protein, 9 aa, Homo Sapiens
ELDSSVTKV

SEQ ID NO: 506141 - protein, 9 aa, Homo Sapiens
KELHFIKRQ

SEQ ID NO: 506142 - protein, 9 aa, Homo Sapiens
AQLGGNKGD

SEQ ID NO: 506143 - protein, 9 aa, Homo Sapiens
IKLIAGGGL

SEQ ID NO: 506144 - protein, 9 aa, Homo Sapiens
FLENQFFTR

SEQ ID NO: 506145 - protein, 9 aa, Homo Sapiens
DNPNFIPFG

SEQ ID NO: 506146 - protein, 9 aa, Homo Sapiens
HASPQHVVV

SEQ ID NO: 506147 - protein, 9 aa, Homo Sapiens
KRFRLIVGK

SEQ ID NO: 506148 - protein, 9 aa, Homo Sapiens
MPENQIITL

SEQ ID NO: 506149 - protein, 9 aa, Homo Sapiens
AGFDTRASL

SEQ ID NO: 506150 - protein, 9 aa, Homo Sapiens
AERLQAFWE

SEQ ID NO: 506151 - protein, 9 aa, Homo Sapiens
QSSALMALQ

SEQ ID NO: 506152 - protein, 9 aa, Homo Sapiens
TDFLLAKKA

SEQ ID NO: 506153 - protein, 9 aa, Homo Sapiens
ESTILLHIS

SEQ ID NO: 506154 - protein, 9 aa, Homo Sapiens
ARNFKEQSQ

SEQ ID NO: 506155 - protein, 9 aa, Homo Sapiens
YSEDFLENQ

SEQ ID NO: 506156 - protein, 9 aa, Homo Sapiens
STILLHISD

SEQ ID NO: 506157 - protein, 9 aa, Homo Sapiens
KEALIQLPG

SEQ ID NO: 506158 - protein, 9 aa, Homo Sapiens
HKEDIYLSI

SEQ ID NO: 506159 - protein, 9 aa, Homo Sapiens
GTKVLLVFW

SEQ ID NO: 506160 - protein, 9 aa, Homo Sapiens
VHASPQHVV

SEQ ID NO: 506161 - protein, 9 aa, Homo Sapiens
SVKFQCSRK

SEQ ID NO: 506162 - protein, 9 aa, Homo Sapiens
TVELSYDNI

SEQ ID NO: 506163 - protein, 9 aa, Homo Sapiens
KQSRSRSKE

SEQ ID NO: 506164 - protein, 9 aa, Homo Sapiens
TKVLLVFWT

SEQ ID NO: 506165 - protein, 9 aa, Homo Sapiens
GDLFRYLDY

SEQ ID NO: 506166 - protein, 9 aa, Homo Sapiens
EAQLRRIIK

SEQ ID NO: 506167 - protein, 9 aa, Homo Sapiens
ELVELSPEK

SEQ ID NO: 506168 - protein, 9 aa, Homo Sapiens
SVKEFLDWM

SEQ ID NO: 506169 - protein, 9 aa, Homo Sapiens
LVTLDQVAA

SEQ ID NO: 506170 - protein, 9 aa, Homo Sapiens
MDNPNFIPF

SEQ ID NO: 506171 - protein, 9 aa, Homo Sapiens
SLCFDIEGH

SEQ ID NO: 506172 - protein, 9 aa, Homo Sapiens
QNLKRNYSY

SEQ ID NO: 506173 - protein, 9 aa, Homo Sapiens
RYLDYNKDG

SEQ ID NO: 506174 - protein, 9 aa, Homo Sapiens
LLHISDIIP

SEQ ID NO: 506175 - protein, 9 aa, Homo Sapiens
YGYWPKKDI

SEQ ID NO: 506176 - protein, 9 aa, Homo Sapiens
SGGADDAWE

SEQ ID NO: 506177 - protein, 9 aa, Homo Sapiens
TRASLSSHA

SEQ ID NO: 506178 - protein, 9 aa, Homo Sapiens
PGTKVLLVF

SEQ ID NO: 506179 - protein, 9 aa, Homo Sapiens
GWGGKGSQN

SEQ ID NO: 506180 - protein, 9 aa, Homo Sapiens
AYTPVFLAK

SEQ ID NO: 506181 - protein, 9 aa, Homo Sapiens
SLHQEKTKL

SEQ ID NO: 506182 - protein, 9 aa, Homo Sapiens
SATMYVDLF

SEQ ID NO: 506183 - protein, 9 aa, Homo Sapiens
SHCKDYVLN

SEQ ID NO: 506184 - protein, 9 aa, Homo Sapiens
KKGFPVFSK

SEQ ID NO: 506185 - protein, 9 aa, Homo Sapiens
LAPQGATTP

SEQ ID NO: 506186 - protein, 9 aa, Homo Sapiens
EALIQLPGN

SEQ ID NO: 506187 - protein, 9 aa, Homo Sapiens
DLIDPCTCE

SEQ ID NO: 506188 - protein, 9 aa, Homo Sapiens
LSICTTEGR

SEQ ID NO: 506189 - protein, 9 aa, Homo Sapiens
LHISDIIPE

SEQ ID NO: 506190 - protein, 9 aa, Homo Sapiens
IADVFKAKN

SEQ ID NO: 506191 - protein, 9 aa, Homo Sapiens
AMQLVSKIP

SEQ ID NO: 506192 - protein, 9 aa, Homo Sapiens
CPGPLLVTL

SEQ ID NO: 506193 - protein, 9 aa, Homo Sapiens
DSLYGDLFR

SEQ ID NO: 506194 - protein, 9 aa, Homo Sapiens
AQFVGLERN

SEQ ID NO: 506195 - protein, 9 aa, Homo Sapiens
DHNSLSEQQ

SEQ ID NO: 506196 - protein, 9 aa, Homo Sapiens
AFLVNCKCQ

SEQ ID NO: 506197 - protein, 9 aa, Homo Sapiens
DQSFKCNSD

SEQ ID NO: 506198 - protein, 9 aa, Homo Sapiens
QQHQHQQQH

SEQ ID NO: 506199 - protein, 9 aa, Homo Sapiens
MAYRIDDKC

SEQ ID NO: 506200 - protein, 9 aa, Homo Sapiens
STQLDHNSL

SEQ ID NO: 506201 - protein, 9 aa, Homo Sapiens
TATWILSPS

SEQ ID NO: 506202 - protein, 9 aa, Homo Sapiens
ADIQTDPYS

SEQ ID NO: 506203 - protein, 9 aa, Homo Sapiens
LVFWTYQDE

SEQ ID NO: 506204 - protein, 9 aa, Homo Sapiens
RAERLQAFW

SEQ ID NO: 506205 - protein, 9 aa, Homo Sapiens
FFAFHASLL

SEQ ID NO: 506206 - protein, 9 aa, Homo Sapiens
PSAGVERVF

SEQ ID NO: 506207 - protein, 9 aa, Homo Sapiens
LDSLRLRMY

SEQ ID NO: 506208 - protein, 9 aa, Homo Sapiens
LSPNYPIFV

SEQ ID NO: 506209 - protein, 9 aa, Homo Sapiens
EIPAFLVNC

SEQ ID NO: 506210 - protein, 9 aa, Homo Sapiens
HFQCNRCKK

SEQ ID NO: 506211 - protein, 9 aa, Homo Sapiens
SICTTEGRR

SEQ ID NO: 506212 - protein, 9 aa, Homo Sapiens
YPASTQLDH

SEQ ID NO: 506213 - protein, 9 aa, Homo Sapiens
VKEFLDWMH

SEQ ID NO: 506214 - protein, 9 aa, Homo Sapiens
AVFTVELSY

SEQ ID NO: 506215 - protein, 9 aa, Homo Sapiens
ASPQHVVVT

SEQ ID NO: 506216 - protein, 9 aa, Homo Sapiens
FRKSSYGYH

SEQ ID NO: 506217 - protein, 9 aa, Homo Sapiens
QLGGNKGDR

SEQ ID NO: 506218 - protein, 9 aa, Homo Sapiens
ILSICTTEG

SEQ ID NO: 506219 - protein, 9 aa, Homo Sapiens
LHFIKRQEA

SEQ ID NO: 506220 - protein, 9 aa, Homo Sapiens
SGPGAPATA

SEQ ID NO: 506221 - protein, 9 aa, Homo Sapiens
LVDPEGVVW

SEQ ID NO: 506222 - protein, 9 aa, Homo Sapiens
LLPTTEGTP

SEQ ID NO: 506223 - protein, 9 aa, Homo Sapiens
CSQEPNLCL

SEQ ID NO: 506224 - protein, 9 aa, Homo Sapiens
SFESKEAVD

SEQ ID NO: 506225 - protein, 9 aa, Homo Sapiens
ALQGLPVAG

SEQ ID NO: 506226 - protein, 9 aa, Homo Sapiens
VTNTLAQIR

SEQ ID NO: 506227 - protein, 9 aa, Homo Sapiens
PATQPGSPP

SEQ ID NO: 506228 - protein, 9 aa, Homo Sapiens
KKYFVTLYY

SEQ ID NO: 506229 - protein, 9 aa, Homo Sapiens
MMCCNCVSD

SEQ ID NO: 506230 - protein, 9 aa, Homo Sapiens
SSKKLRARK

SEQ ID NO: 506231 - protein, 9 aa, Homo Sapiens
FQLEQLQAH

SEQ ID NO: 506232 - protein, 9 aa, Homo Sapiens
GLLIRRNFV

SEQ ID NO: 506233 - protein, 9 aa, Homo Sapiens
LCFDIEGHH

SEQ ID NO: 506234 - protein, 9 aa, Homo Sapiens
TLAQVHAEN

SEQ ID NO: 506235 - protein, 9 aa, Homo Sapiens
RPLQEEVLV

SEQ ID NO: 506236 - protein, 9 aa, Homo Sapiens
ATAQEEADL

SEQ ID NO: 506237 - protein, 9 aa, Homo Sapiens
DQSHSEANT

SEQ ID NO: 506238 - protein, 9 aa, Homo Sapiens
IMGHPPQEI

SEQ ID NO: 506239 - protein, 9 aa, Homo Sapiens
PLELLPTTE

SEQ ID NO: 506240 - protein, 9 aa, Homo Sapiens
SYSEDFLEN

SEQ ID NO: 506241 - protein, 9 aa, Homo Sapiens
VPLELLPTT

SEQ ID NO: 506242 - protein, 9 aa, Homo Sapiens
EIPSLHQEK

SEQ ID NO: 506243 - protein, 9 aa, Homo Sapiens
TSQVSLHRF

SEQ ID NO: 506244 - protein, 9 aa, Homo Sapiens
LHVIFQMHK

SEQ ID NO: 506245 - protein, 9 aa, Homo Sapiens
ADDAWEDVE

SEQ ID NO: 506246 - protein, 9 aa, Homo Sapiens
WTQQSARNF

SEQ ID NO: 506247 - protein, 9 aa, Homo Sapiens
FKHFQCNRC

SEQ ID NO: 506248 - protein, 9 aa, Homo Sapiens
DMGLVLRSL

SEQ ID NO: 506249 - protein, 9 aa, Homo Sapiens
CAHGFLKVP

SEQ ID NO: 506250 - protein, 9 aa, Homo Sapiens
QFPAVPLEL

SEQ ID NO: 506251 - protein, 9 aa, Homo Sapiens
KKTLIKEYT

SEQ ID NO: 506252 - protein, 9 aa, Homo Sapiens
GAGFDTRAS

SEQ ID NO: 506253 - protein, 9 aa, Homo Sapiens
VATNLGPPS

SEQ ID NO: 506254 - protein, 9 aa, Homo Sapiens
RAIKWSNME

SEQ ID NO: 506255 - protein, 9 aa, Homo Sapiens
ATATTLAPQ

SEQ ID NO: 506256 - protein, 9 aa, Homo Sapiens
SSAVFRKSS

SEQ ID NO: 506257 - protein, 9 aa, Homo Sapiens
KENAAGSPI

SEQ ID NO: 506258 - protein, 9 aa, Homo Sapiens
ISILSICTT

SEQ ID NO: 506259 - protein, 9 aa, Homo Sapiens
MQLVSKIPD

SEQ ID NO: 506260 - protein, 9 aa, Homo Sapiens
KGAQLGGNK

SEQ ID NO: 506261 - protein, 9 aa, Homo Sapiens
TISILSICT

SEQ ID NO: 506262 - protein, 9 aa, Homo Sapiens
VSKIPDMSV

SEQ ID NO: 506263 - protein, 9 aa, Homo Sapiens
SISVAISLE

SEQ ID NO: 506264 - protein, 9 aa, Homo Sapiens
SSVTKVLGS

SEQ ID NO: 506265 - protein, 9 aa, Homo Sapiens
RGGRKSISV

SEQ ID NO: 506266 - protein, 9 aa, Homo Sapiens
LLVFWTYQD

SEQ ID NO: 506267 - protein, 9 aa, Homo Sapiens
CPGVVLKHK

SEQ ID NO: 506268 - protein, 9 aa, Homo Sapiens
KAQSCQLCG

SEQ ID NO: 506269 - protein, 9 aa, Homo Sapiens
LLVTLDQVA

SEQ ID NO: 506270 - protein, 9 aa, Homo Sapiens
VEGSPEPGR

SEQ ID NO: 506271 - protein, 9 aa, Homo Sapiens
VYHADCKCD

SEQ ID NO: 506272 - protein, 9 aa, Homo Sapiens
KDFQQKELH

SEQ ID NO: 506273 - protein, 9 aa, Homo Sapiens
QLQAHAGAV

SEQ ID NO: 506274 - protein, 9 aa, Homo Sapiens
PEKEIPSLH

SEQ ID NO: 506275 - protein, 9 aa, Homo Sapiens
ELESVPEAE

SEQ ID NO: 506276 - protein, 9 aa, Homo Sapiens
YDFWIDTDH

SEQ ID NO: 506277 - protein, 9 aa, Homo Sapiens
DKYGFLTVP

SEQ ID NO: 506278 - protein, 9 aa, Homo Sapiens
STYRMPSVL

SEQ ID NO: 506279 - protein, 9 aa, Homo Sapiens
ASTSHATHL

SEQ ID NO: 506280 - protein, 9 aa, Homo Sapiens
SVTKVLGSP

SEQ ID NO: 506281 - protein, 9 aa, Homo Sapiens
AGWTPRGFF

SEQ ID NO: 506282 - protein, 9 aa, Homo Sapiens
AFWEVQELK

SEQ ID NO: 506283 - protein, 9 aa, Homo Sapiens
THDKVKAQS

SEQ ID NO: 506284 - protein, 9 aa, Homo Sapiens
SKYDKYGFL

SEQ ID NO: 506285 - protein, 9 aa, Homo Sapiens
EVEGSPEPG

SEQ ID NO: 506286 - protein, 9 aa, Homo Sapiens
LVDFGSRKA

SEQ ID NO: 506287 - protein, 9 aa, Homo Sapiens
PAPQKASGG

SEQ ID NO: 506288 - protein, 9 aa, Homo Sapiens
PAMQLVSKI

SEQ ID NO: 506289 - protein, 9 aa, Homo Sapiens
FQQKELHFI

SEQ ID NO: 506290 - protein, 9 aa, Homo Sapiens
GKAFRQNLC

SEQ ID NO: 506291 - protein, 9 aa, Homo Sapiens
EIADVFKAK

SEQ ID NO: 506292 - protein, 9 aa, Homo Sapiens
CEKVSLIDM

SEQ ID NO: 506293 - protein, 9 aa, Homo Sapiens
QKELHFIKR

SEQ ID NO: 506294 - protein, 9 aa, Homo Sapiens
ANVLKPQDS

SEQ ID NO: 506295 - protein, 9 aa, Homo Sapiens
NESAHNRRE

SEQ ID NO: 506296 - protein, 9 aa, Homo Sapiens
PQHVVVTRN

SEQ ID NO: 506297 - protein, 9 aa, Homo Sapiens
LRSLAASSA

SEQ ID NO: 506298 - protein, 9 aa, Homo Sapiens
YRESVYPSQ

SEQ ID NO: 506299 - protein, 9 aa, Homo Sapiens
LKEALIQLP

SEQ ID NO: 506300 - protein, 9 aa, Homo Sapiens
DIAVTPLKL

SEQ ID NO: 506301 - protein, 9 aa, Homo Sapiens
SLYGDLFRY

SEQ ID NO: 506302 - protein, 9 aa, Homo Sapiens
RLRMYLLAH

SEQ ID NO: 506303 - protein, 9 aa, Homo Sapiens
DSSVTKVLG

SEQ ID NO: 506304 - protein, 9 aa, Homo Sapiens
FFLFPHLVL

SEQ ID NO: 506305 - protein, 9 aa, Homo Sapiens
QEHGHERKI

SEQ ID NO: 506306 - protein, 9 aa, Homo Sapiens
TEKQRMRYF

SEQ ID NO: 506307 - protein, 9 aa, Homo Sapiens
ILYVFLNNG

SEQ ID NO: 506308 - protein, 9 aa, Homo Sapiens
NYSYFLGLS

SEQ ID NO: 506309 - protein, 9 aa, Homo Sapiens
SLAAMSPSF

SEQ ID NO: 506310 - protein, 9 aa, Homo Sapiens
FWEVQELKS

SEQ ID NO: 506311 - protein, 9 aa, Homo Sapiens
LSPEKLPEE

SEQ ID NO: 506312 - protein, 9 aa, Homo Sapiens
FCGVYQQPY

SEQ ID NO: 506313 - protein, 9 aa, Homo Sapiens
QGLPVAGGG

SEQ ID NO: 506314 - protein, 9 aa, Homo Sapiens
CKNKKKWYE

SEQ ID NO: 506315 - protein, 9 aa, Homo Sapiens
PYNSVKFQC

SEQ ID NO: 506316 - protein, 9 aa, Homo Sapiens
RKSISVAIS

SEQ ID NO: 506317 - protein, 9 aa, Homo Sapiens
KNAVHGVLK

SEQ ID NO: 506318 - protein, 9 aa, Homo Sapiens
EGEVEGSPE

SEQ ID NO: 506319 - protein, 9 aa, Homo Sapiens
LFDMSRINH

SEQ ID NO: 506320 - protein, 9 aa, Homo Sapiens
KKLRARKAL

SEQ ID NO: 506321 - protein, 9 aa, Homo Sapiens
EFLDWMHLE

SEQ ID NO: 506322 - protein, 9 aa, Homo Sapiens
WTKDVLFES

SEQ ID NO: 506323 - protein, 9 aa, Homo Sapiens
CGVYQQPYY

SEQ ID NO: 506324 - protein, 9 aa, Homo Sapiens
ANTYQSLVE

SEQ ID NO: 506325 - protein, 9 aa, Homo Sapiens
NSRGEWKCE

SEQ ID NO: 506326 - protein, 9 aa, Homo Sapiens
KQRMRYFLS

SEQ ID NO: 506327 - protein, 9 aa, Homo Sapiens
CIDIDECSQ

SEQ ID NO: 506328 - protein, 9 aa, Homo Sapiens
PRRRTYLEA

SEQ ID NO: 506329 - protein, 9 aa, Homo Sapiens
KEHGERNIP

SEQ ID NO: 506330 - protein, 9 aa, Homo Sapiens
MYLLAHSAG

SEQ ID NO: 506331 - protein, 9 aa, Homo Sapiens
HPPQEIRGP

SEQ ID NO: 506332 - protein, 9 aa, Homo Sapiens
ATWEGEVEG

SEQ ID NO: 506333 - protein, 9 aa, Homo Sapiens
EDVEDVTEE

SEQ ID NO: 506334 - protein, 9 aa, Homo Sapiens
LIDPCTCEK

SEQ ID NO: 506335 - protein, 9 aa, Homo Sapiens
YWPKKDIVQ

SEQ ID NO: 506336 - protein, 9 aa, Homo Sapiens
QQSARNFKE

SEQ ID NO: 506337 - protein, 9 aa, Homo Sapiens
LFPHLVLVD

SEQ ID NO: 506338 - protein, 9 aa, Homo Sapiens
SHLTSAQTF

SEQ ID NO: 506339 - protein, 9 aa, Homo Sapiens
GYWPKKDIV

SEQ ID NO: 506340 - protein, 9 aa, Homo Sapiens
LLLGSSSFP

SEQ ID NO: 506341 - protein, 9 aa, Homo Sapiens
TTQKASAGD

SEQ ID NO: 506342 - protein, 9 aa, Homo Sapiens
KAVARLEKA

SEQ ID NO: 506343 - protein, 9 aa, Homo Sapiens
TCDQSFKCN

SEQ ID NO: 506344 - protein, 9 aa, Homo Sapiens
TREIVSGLL

SEQ ID NO: 506345 - protein, 9 aa, Homo Sapiens
MGSHLTSAQ

SEQ ID NO: 506346 - protein, 9 aa, Homo Sapiens
QCICTGNSR

SEQ ID NO: 506347 - protein, 9 aa, Homo Sapiens
HERKISFPQ

SEQ ID NO: 506348 - protein, 9 aa, Homo Sapiens
VKKYFVTLY

SEQ ID NO: 506349 - protein, 9 aa, Homo Sapiens
KSVEKFMDS

SEQ ID NO: 506350 - protein, 9 aa, Homo Sapiens
DYVLNVTEE

SEQ ID NO: 506351 - protein, 9 aa, Homo Sapiens
KEENSHLKM

SEQ ID NO: 506352 - protein, 9 aa, Homo Sapiens
KALFPVHSV

SEQ ID NO: 506353 - protein, 9 aa, Homo Sapiens
HEGSLSLAA

SEQ ID NO: 506354 - protein, 9 aa, Homo Sapiens
KDLLFKDCA

SEQ ID NO: 506355 - protein, 9 aa, Homo Sapiens
ALTDFLLAK

SEQ ID NO: 506356 - protein, 9 aa, Homo Sapiens
GVLKAVYDS

SEQ ID NO: 506357 - protein, 9 aa, Homo Sapiens
MQLKLLFRD

SEQ ID NO: 506358 - protein, 9 aa, Homo Sapiens
WYESALQEA

SEQ ID NO: 506359 - protein, 9 aa, Homo Sapiens
EKQRMRYFL

SEQ ID NO: 506360 - protein, 9 aa, Homo Sapiens
DSLRLRMYL

SEQ ID NO: 506361 - protein, 9 aa, Homo Sapiens
GHERKISFP

SEQ ID NO: 506362 - protein, 9 aa, Homo Sapiens
ATFDVTMRF

SEQ ID NO: 506363 - protein, 9 aa, Homo Sapiens
AGSPIMRKW

SEQ ID NO: 506364 - protein, 9 aa, Homo Sapiens
YFNFRYPSA

SEQ ID NO: 506365 - protein, 9 aa, Homo Sapiens
HQEKTKLEP

SEQ ID NO: 506366 - protein, 9 aa, Homo Sapiens
ILLHISDII

SEQ ID NO: 506367 - protein, 9 aa, Homo Sapiens
SHSEANTYQ

SEQ ID NO: 506368 - protein, 9 aa, Homo Sapiens
AIAKAKEHG

SEQ ID NO: 506369 - protein, 9 aa, Homo Sapiens
LKWNSVLKI

SEQ ID NO: 506370 - protein, 9 aa, Homo Sapiens
SLFSSGPYK

SEQ ID NO: 506371 - protein, 9 aa, Homo Sapiens
SALMALQEA

SEQ ID NO: 506372 - protein, 9 aa, Homo Sapiens
MPSVLNRHH

SEQ ID NO: 506373 - protein, 9 aa, Homo Sapiens
INSLCFDIE

SEQ ID NO: 506374 - protein, 9 aa, Homo Sapiens
RKGAQLGGN

SEQ ID NO: 506375 - protein, 9 aa, Homo Sapiens
VGEITREIV

SEQ ID NO: 506376 - protein, 9 aa, Homo Sapiens
GELDSSVTK

SEQ ID NO: 506377 - protein, 9 aa, Homo Sapiens
KCNSDFINH

SEQ ID NO: 506378 - protein, 9 aa, Homo Sapiens
TPLKLAGWQ

SEQ ID NO: 506379 - protein, 9 aa, Homo Sapiens
AASALQGLP

SEQ ID NO: 506380 - protein, 9 aa, Homo Sapiens
GYDFWIDTD

SEQ ID NO: 506381 - protein, 9 aa, Homo Sapiens
PPAKRFRLI

SEQ ID NO: 506382 - protein, 9 aa, Homo Sapiens
VRGQDVYIV

SEQ ID NO: 506383 - protein, 9 aa, Homo Sapiens
SYDNIRVKW

SEQ ID NO: 506384 - protein, 9 aa, Homo Sapiens
LSLAAMSPS

SEQ ID NO: 506385 - protein, 9 aa, Homo Sapiens
EANTYQSLV

SEQ ID NO: 506386 - protein, 9 aa, Homo Sapiens
YHADCKCDS

SEQ ID NO: 506387 - protein, 9 aa, Homo Sapiens
WRVYHADCK

SEQ ID NO: 506388 - protein, 9 aa, Homo Sapiens
RDGSAFYRE

SEQ ID NO: 506389 - protein, 9 aa, Homo Sapiens
QLVSKIPDM

SEQ ID NO: 506390 - protein, 9 aa, Homo Sapiens
FLFENESAH

SEQ ID NO: 506391 - protein, 9 aa, Homo Sapiens
QVTREEDDV

SEQ ID NO: 506392 - protein, 9 aa, Homo Sapiens
IRGPHPPGG

SEQ ID NO: 506393 - protein, 9 aa, Homo Sapiens
LLMPENQII

SEQ ID NO: 506394 - protein, 9 aa, Homo Sapiens
WTPRGFFAF

SEQ ID NO: 506395 - protein, 9 aa, Homo Sapiens
FESKEAVDI

SEQ ID NO: 506396 - protein, 9 aa, Homo Sapiens
LKNTSQVSL

SEQ ID NO: 506397 - protein, 9 aa, Homo Sapiens
SILSICTTE

SEQ ID NO: 506398 - protein, 9 aa, Homo Sapiens
RQNLCLTRH

SEQ ID NO: 506399 - protein, 9 aa, Homo Sapiens
ESIVGEITR

SEQ ID NO: 506400 - protein, 9 aa, Homo Sapiens
AVHGVLKAV

SEQ ID NO: 506401 - protein, 9 aa, Homo Sapiens
PGNQLIDYK

SEQ ID NO: 506402 - protein, 9 aa, Homo Sapiens
PAVPLELLP

SEQ ID NO: 506403 - protein, 9 aa, Homo Sapiens
LDWDKMDNP

SEQ ID NO: 506404 - protein, 9 aa, Homo Sapiens
NMEDRHGGC

SEQ ID NO: 506405 - protein, 9 aa, Homo Sapiens
DVTMRFLYE

SEQ ID NO: 506406 - protein, 9 aa, Homo Sapiens
LSDKQMAYR

SEQ ID NO: 506407 - protein, 9 aa, Homo Sapiens
GSHLTSAQT

SEQ ID NO: 506408 - protein, 9 aa, Homo Sapiens
PMWALVLAF

SEQ ID NO: 506409 - protein, 9 aa, Homo Sapiens
VDPEGVVWT

SEQ ID NO: 506410 - protein, 9 aa, Homo Sapiens
EEVLVVRPL

SEQ ID NO: 506411 - protein, 9 aa, Homo Sapiens
LRRIIKLIA

SEQ ID NO: 506412 - protein, 9 aa, Homo Sapiens
NLCLTRHQR

SEQ ID NO: 506413 - protein, 9 aa, Homo Sapiens
LFEVQWQLA

SEQ ID NO: 506414 - protein, 9 aa, Homo Sapiens
GVTNTLAQI

SEQ ID NO: 506415 - protein, 9 aa, Homo Sapiens
DMSRINHYQ

SEQ ID NO: 506416 - protein, 9 aa, Homo Sapiens
GESVRGQDV

SEQ ID NO: 506417 - protein, 9 aa, Homo Sapiens
LLFKDCAHG

SEQ ID NO: 506418 - protein, 9 aa, Homo Sapiens
VVASRWTTP

SEQ ID NO: 506419 - protein, 9 aa, Homo Sapiens
CPTKFTIKN

SEQ ID NO: 506420 - protein, 9 aa, Homo Sapiens
SASTSHATH

SEQ ID NO: 506421 - protein, 9 aa, Homo Sapiens
ENESAHNRR

SEQ ID NO: 506422 - protein, 9 aa, Homo Sapiens
FSIIRDLGT

SEQ ID NO: 506423 - protein, 9 aa, Homo Sapiens
QLEQLQAHA

SEQ ID NO: 506424 - protein, 9 aa, Homo Sapiens
RKVRQEHGH

SEQ ID NO: 506425 - protein, 9 aa, Homo Sapiens
LQEEVLVVR

SEQ ID NO: 506426 - protein, 9 aa, Homo Sapiens
DFGSRKAVA

SEQ ID NO: 506427 - protein, 9 aa, Homo Sapiens
IQNLKRNYS

SEQ ID NO: 506428 - protein, 9 aa, Homo Sapiens
ALVDFGSRK

SEQ ID NO: 506429 - protein, 9 aa, Homo Sapiens
WEVQELKSK

SEQ ID NO: 506430 - protein, 9 aa, Homo Sapiens
IVGEITREI

SEQ ID NO: 506431 - protein, 9 aa, Homo Sapiens
NLGPPSRTP

SEQ ID NO: 506432 - protein, 9 aa, Homo Sapiens
VWVHASPQH

SEQ ID NO: 506433 - protein, 9 aa, Homo Sapiens
EAENTNKAA

SEQ ID NO: 506434 - protein, 9 aa, Homo Sapiens
LQGLPVAGG

SEQ ID NO: 506435 - protein, 9 aa, Homo Sapiens
GPSKFCGGL

SEQ ID NO: 506436 - protein, 9 aa, Homo Sapiens
SHEGSLSLA

SEQ ID NO: 506437 - protein, 9 aa, Homo Sapiens
ISDIIPESV

SEQ ID NO: 506438 - protein, 9 aa, Homo Sapiens
LYGDLFRYL

SEQ ID NO: 506439 - protein, 9 aa, Homo Sapiens
IMRKWLNPR

SEQ ID NO: 506440 - protein, 9 aa, Homo Sapiens
GSPIMRKWL

SEQ ID NO: 506441 - protein, 9 aa, Homo Sapiens
KYFVTLYYT

SEQ ID NO: 506442 - protein, 9 aa, Homo Sapiens
SDKQMAYRI

SEQ ID NO: 506443 - protein, 9 aa, Homo Sapiens
SRSRNAGKQ

SEQ ID NO: 506444 - protein, 9 aa, Homo Sapiens
LAGWQCPEC

SEQ ID NO: 506445 - protein, 9 aa, Homo Sapiens
HDPLLLGSS

SEQ ID NO: 506446 - protein, 9 aa, Homo Sapiens
TKVLGSPRI

SEQ ID NO: 506447 - protein, 9 aa, Homo Sapiens
SVLKIIEKA

SEQ ID NO: 506448 - protein, 9 aa, Homo Sapiens
MVVPAMQLV

SEQ ID NO: 506449 - protein, 9 aa, Homo Sapiens
KAFRQNLCL

SEQ ID NO: 506450 - protein, 9 aa, Homo Sapiens
DLKWNSVLK

SEQ ID NO: 506451 - protein, 9 aa, Homo Sapiens
FTPHHKPLM

SEQ ID NO: 506452 - protein, 9 aa, Homo Sapiens
VLVVRPLQP

SEQ ID NO: 506453 - protein, 9 aa, Homo Sapiens
KKWYESALQ

SEQ ID NO: 506454 - protein, 9 aa, Homo Sapiens
GSLSLAAMS

SEQ ID NO: 506455 - protein, 9 aa, Homo Sapiens
ESALQEACL

SEQ ID NO: 506456 - protein, 9 aa, Homo Sapiens
GGNKGDRMA

SEQ ID NO: 506457 - protein, 9 aa, Homo Sapiens
KVKAQSCQL

SEQ ID NO: 506458 - protein, 9 aa, Homo Sapiens
GKEGHFEMR

SEQ ID NO: 506459 - protein, 9 aa, Homo Sapiens
SVRGQDVYI

SEQ ID NO: 506460 - protein, 9 aa, Homo Sapiens
GATFDVTMR

SEQ ID NO: 506461 - protein, 9 aa, Homo Sapiens
YDNIRVKWF

SEQ ID NO: 506462 - protein, 9 aa, Homo Sapiens
RYPSAGVER

SEQ ID NO: 506463 - protein, 9 aa, Homo Sapiens
FRYPSAGVE

SEQ ID NO: 506464 - protein, 9 aa, Homo Sapiens
RRRTYLEAW

SEQ ID NO: 506465 - protein, 9 aa, Homo Sapiens
STSHATHLP

SEQ ID NO: 506466 - protein, 9 aa, Homo Sapiens
QTDYRDADI

SEQ ID NO: 506467 - protein, 9 aa, Homo Sapiens
QMAYRIDDK

SEQ ID NO: 506468 - protein, 9 aa, Homo Sapiens
HLSPNYPIF

SEQ ID NO: 506469 - protein, 9 aa, Homo Sapiens
CICTGNSRG

SEQ ID NO: 506470 - protein, 9 aa, Homo Sapiens
RVYHADCKC

SEQ ID NO: 506471 - protein, 9 aa, Homo Sapiens
DTRASLSSH

SEQ ID NO: 506472 - protein, 9 aa, Homo Sapiens
DKVKAQSCQ

SEQ ID NO: 506473 - protein, 9 aa, Homo Sapiens
KSISVAISL

SEQ ID NO: 506474 - protein, 9 aa, Homo Sapiens
AANVLKPQD

SEQ ID NO: 506475 - protein, 9 aa, Homo Sapiens
GEVEGSPEP

SEQ ID NO: 506476 - protein, 9 aa, Homo Sapiens
VASRWTTPN

SEQ ID NO: 506477 - protein, 9 aa, Homo Sapiens
QSFKCNSDF

SEQ ID NO: 506478 - protein, 9 aa, Homo Sapiens
IIICEIADV

SEQ ID NO: 506479 - protein, 9 aa, Homo Sapiens
VVWTKDVLF

SEQ ID NO: 506480 - protein, 9 aa, Homo Sapiens
KVLLVFWTY

SEQ ID NO: 506481 - protein, 9 aa, Homo Sapiens
TMRFLYECP

SEQ ID NO: 506482 - protein, 9 aa, Homo Sapiens
QTWHPCPTK

SEQ ID NO: 506483 - protein, 9 aa, Homo Sapiens
WPKKDIVQI

SEQ ID NO: 506484 - protein, 9 aa, Homo Sapiens
ALFPRRRTY

SEQ ID NO: 506485 - protein, 9 aa, Homo Sapiens
QSGARIELH

SEQ ID NO: 506486 - protein, 9 aa, Homo Sapiens
QKASAGDGS

SEQ ID NO: 506487 - protein, 9 aa, Homo Sapiens
FYRESVYPS

SEQ ID NO: 506488 - protein, 9 aa, Homo Sapiens
QEIRGPHPP

SEQ ID NO: 506489 - protein, 9 aa, Homo Sapiens
ARIELHRNP

SEQ ID NO: 506490 - protein, 9 aa, Homo Sapiens
AGKQSRSRS

SEQ ID NO: 506491 - protein, 9 aa, Homo Sapiens
NAAGSPIMR

SEQ ID NO: 506492 - protein, 9 aa, Homo Sapiens
KHFQCNRCK

SEQ ID NO: 506493 - protein, 9 aa, Homo Sapiens
HRQQQAELL

SEQ ID NO: 506494 - protein, 9 aa, Homo Sapiens
IFGPPGTSK

SEQ ID NO: 506495 - protein, 9 aa, Homo Sapiens
WDRSPRRGT

SEQ ID NO: 506496 - protein, 9 aa, Homo Sapiens
EPEIWDRSP

SEQ ID NO: 506497 - protein, 9 aa, Homo Sapiens
GPLLVTLDQ

SEQ ID NO: 506498 - protein, 9 aa, Homo Sapiens
WEDVEDVTE

SEQ ID NO: 506499 - protein, 9 aa, Homo Sapiens
LPPAKRFRL

SEQ ID NO: 506500 - protein, 9 aa, Homo Sapiens
MSATMYVDL

SEQ ID NO: 506501 - protein, 9 aa, Homo Sapiens
QSCAYTPVF

SEQ ID NO: 506502 - protein, 9 aa, Homo Sapiens
SNMEDRHGG

SEQ ID NO: 506503 - protein, 9 aa, Homo Sapiens
ITDEESEQA

SEQ ID NO: 506504 - protein, 9 aa, Homo Sapiens
TSSASTSHA

SEQ ID NO: 506505 - protein, 9 aa, Homo Sapiens
IPAFLVNCK

SEQ ID NO: 506506 - protein, 9 aa, Homo Sapiens
GARIELHRN

SEQ ID NO: 506507 - protein, 9 aa, Homo Sapiens
TSKTVTLVE

SEQ ID NO: 506508 - protein, 9 aa, Homo Sapiens
LSPSVAQKA

SEQ ID NO: 506509 - protein, 9 aa, Homo Sapiens
LDDATAQEE

SEQ ID NO: 506510 - protein, 9 aa, Homo Sapiens
GLGSSWEMG

SEQ ID NO: 506511 - protein, 9 aa, Homo Sapiens
ISHEGSLSL

SEQ ID NO: 506512 - protein, 9 aa, Homo Sapiens
CAEPEIWDR

SEQ ID NO: 506513 - protein, 9 aa, Homo Sapiens
EISVKEFLD

SEQ ID NO: 506514 - protein, 9 aa, Homo Sapiens
FLFDMSRIN

SEQ ID NO: 506515 - protein, 9 aa, Homo Sapiens
HLDWDKMDN

SEQ ID NO: 506516 - protein, 9 aa, Homo Sapiens
KSSAVFRKS

SEQ ID NO: 506517 - protein, 9 aa, Homo Sapiens
TNITDEESE

SEQ ID NO: 506518 - protein, 9 aa, Homo Sapiens
KVDLKWNSV

SEQ ID NO: 506519 - protein, 9 aa, Homo Sapiens
KKKWYESAL

SEQ ID NO: 506520 - protein, 9 aa, Homo Sapiens
FRQNLCLTR

SEQ ID NO: 506521 - protein, 9 aa, Homo Sapiens
IELHRNPPP

SEQ ID NO: 506522 - protein, 9 aa, Homo Sapiens
ATTLAPQGA

SEQ ID NO: 506523 - protein, 9 aa, Homo Sapiens
TDDMGLVLR

SEQ ID NO: 506524 - protein, 9 aa, Homo Sapiens
FDMSRINHY

SEQ ID NO: 506525 - protein, 9 aa, Homo Sapiens
VLNVTEEFL

SEQ ID NO: 506526 - protein, 9 aa, Homo Sapiens
VYQQPYYYS

SEQ ID NO: 506527 - protein, 9 aa, Homo Sapiens
PLKLAGWQC

SEQ ID NO: 506528 - protein, 9 aa, Homo Sapiens
SKKLRARKA

SEQ ID NO: 506529 - protein, 9 aa, Homo Sapiens
GSLFEVQWQ

SEQ ID NO: 506530 - protein, 9 aa, Homo Sapiens
LTDFLLAKK

SEQ ID NO: 506531 - protein, 9 aa, Homo Sapiens
ASALQGLPV

SEQ ID NO: 506532 - protein, 9 aa, Homo Sapiens
DLSDKQMAY

SEQ ID NO: 506533 - protein, 9 aa, Homo Sapiens
GKDLLFKDC

SEQ ID NO: 506534 - protein, 9 aa, Homo Sapiens
NSVKFQCSR

SEQ ID NO: 506535 - protein, 9 aa, Homo Sapiens
VEEHRQQQA

SEQ ID NO: 506536 - protein, 9 aa, Homo Sapiens
QLTHDKVKA

SEQ ID NO: 506537 - protein, 9 aa, Homo Sapiens
EEHRQQQAE

SEQ ID NO: 506538 - protein, 9 aa, Homo Sapiens
DYRDADIQT

SEQ ID NO: 506539 - protein, 9 aa, Homo Sapiens
AHNRRESTD

SEQ ID NO: 506540 - protein, 9 aa, Homo Sapiens
DIDECSQEP

SEQ ID NO: 506541 - protein, 9 aa, Homo Sapiens
EKKTTQKAS

SEQ ID NO: 506542 - protein, 9 aa, Homo Sapiens
QAHAGAVLM

SEQ ID NO: 506543 - protein, 9 aa, Homo Sapiens
GTLAQVHAE

SEQ ID NO: 506544 - protein, 9 aa, Homo Sapiens
VLRSLAASS

SEQ ID NO: 506545 - protein, 9 aa, Homo Sapiens
TPHHKPLMG

SEQ ID NO: 506546 - protein, 9 aa, Homo Sapiens
RFQSSALMA

SEQ ID NO: 506547 - protein, 9 aa, Homo Sapiens
VDFGSRKAV

SEQ ID NO: 506548 - protein, 9 aa, Homo Sapiens
FSHDPLLLG

SEQ ID NO: 506549 - protein, 9 aa, Homo Sapiens
ESVRGQDVY

SEQ ID NO: 506550 - protein, 9 aa, Homo Sapiens
FLFPHLVLV

SEQ ID NO: 506551 - protein, 9 aa, Homo Sapiens
GCPGPLLVT

SEQ ID NO: 506552 - protein, 9 aa, Homo Sapiens
SEANTYQSL

SEQ ID NO: 506553 - protein, 9 aa, Homo Sapiens
KLRARKALF

SEQ ID NO: 506554 - protein, 9 aa, Homo Sapiens
TDTSSASTS

SEQ ID NO: 506555 - protein, 9 aa, Homo Sapiens
LSYDNIRVK

SEQ ID NO: 506556 - protein, 9 aa, Homo Sapiens
DRFLFDMSR

SEQ ID NO: 506557 - protein, 9 aa, Homo Sapiens
SPRRSLGLT

SEQ ID NO: 506558 - protein, 9 aa, Homo Sapiens
GSPLAAANV

SEQ ID NO: 506559 - protein, 9 aa, Homo Sapiens
TPRGFFAFH

SEQ ID NO: 506560 - protein, 9 aa, Homo Sapiens
FKSVEKFMD

SEQ ID NO: 506561 - protein, 9 aa, Homo Sapiens
LAAANVLKP

SEQ ID NO: 506562 - protein, 9 aa, Homo Sapiens
GPPATQPGS

SEQ ID NO: 506563 - protein, 9 aa, Homo Sapiens
RRIIKLIAG

SEQ ID NO: 506564 - protein, 9 aa, Homo Sapiens
QRLQHLCSM

SEQ ID NO: 506565 - protein, 9 aa, Homo Sapiens
RDADIQTDP

SEQ ID NO: 506566 - protein, 9 aa, Homo Sapiens
HQQQHQQQQ

SEQ ID NO: 506567 - protein, 9 aa, Homo Sapiens
TNTLAQIRR

SEQ ID NO: 506568 - protein, 9 aa, Homo Sapiens
AFRQNLCLT

SEQ ID NO: 506569 - protein, 9 aa, Homo Sapiens
VIFQMHKEE

SEQ ID NO: 506570 - protein, 9 aa, Homo Sapiens
CFDIEGHHM

SEQ ID NO: 506571 - protein, 9 aa, Homo Sapiens
CKCDSGCVD

SEQ ID NO: 506572 - protein, 9 aa, Homo Sapiens
ESKEAVDIH

SEQ ID NO: 506573 - protein, 9 aa, Homo Sapiens
LYVFLNNGI

SEQ ID NO: 506574 - protein, 9 aa, Homo Sapiens
VTPLKLAGW

SEQ ID NO: 506575 - protein, 9 aa, Homo Sapiens
GAQLGGNKG

SEQ ID NO: 506576 - protein, 9 aa, Homo Sapiens
RLQHLCSMA

SEQ ID NO: 506577 - protein, 9 aa, Homo Sapiens
TYLEAWRAC

SEQ ID NO: 506578 - protein, 9 aa, Homo Sapiens
RHLLMPENQ

SEQ ID NO: 506579 - protein, 9 aa, Homo Sapiens
KDYVLNVTE

SEQ ID NO: 506580 - protein, 9 aa, Homo Sapiens
MHKEEVPVE

SEQ ID NO: 506581 - protein, 9 aa, Homo Sapiens
YYGYWPKKD

SEQ ID NO: 506582 - protein, 9 aa, Homo Sapiens
PGPLLVTLD

SEQ ID NO: 506583 - protein, 9 aa, Homo Sapiens
MPWFKSVEK

SEQ ID NO: 506584 - protein, 9 aa, Homo Sapiens
FINSLCFDI

SEQ ID NO: 506585 - protein, 9 aa, Homo Sapiens
DCKCDSGCV

SEQ ID NO: 506586 - protein, 9 aa, Homo Sapiens
GSRKAVARL

SEQ ID NO: 506587 - protein, 9 aa, Homo Sapiens
PGTSKTVTL

SEQ ID NO: 506588 - protein, 9 aa, Homo Sapiens
NPNFIPFGG

SEQ ID NO: 506589 - protein, 9 aa, Homo Sapiens
AEPEIWDRS

SEQ ID NO: 506590 - protein, 9 aa, Homo Sapiens
DLGTLAQVH

SEQ ID NO: 506591 - protein, 9 aa, Homo Sapiens
CQSYSEDFL

SEQ ID NO: 506592 - protein, 9 aa, Homo Sapiens
EDFLENQFF

SEQ ID NO: 506593 - protein, 9 aa, Homo Sapiens
WGSVEEHRQ

SEQ ID NO: 506594 - protein, 9 aa, Homo Sapiens
HQHQQQHQQ

SEQ ID NO: 506595 - protein, 9 aa, Homo Sapiens
PEKLPEEDD

SEQ ID NO: 506596 - protein, 9 aa, Homo Sapiens
GPESFTPHH

SEQ ID NO: 506597 - protein, 9 aa, Homo Sapiens
GDMASTTPM

SEQ ID NO: 506598 - protein, 9 aa, Homo Sapiens
LVLRSLAAS

SEQ ID NO: 506599 - protein, 9 aa, Homo Sapiens
MRYFLSTLP

SEQ ID NO: 506600 - protein, 9 aa, Homo Sapiens
IDPCTCEKV

SEQ ID NO: 506601 - protein, 9 aa, Homo Sapiens
SAHNRREST

SEQ ID NO: 506602 - protein, 9 aa, Homo Sapiens
PWFKSVEKF

SEQ ID NO: 506603 - protein, 9 aa, Homo Sapiens
PNYPIFVLL

SEQ ID NO: 506604 - protein, 9 aa, Homo Sapiens
AAGSPIMRK

SEQ ID NO: 506605 - protein, 9 aa, Homo Sapiens
YDKYGFLTV

SEQ ID NO: 506606 - protein, 9 aa, Homo Sapiens
THLSPNYPI

SEQ ID NO: 506607 - protein, 9 aa, Homo Sapiens
SQVSLHRFE

SEQ ID NO: 506608 - protein, 9 aa, Homo Sapiens
PSKFCGGLL

SEQ ID NO: 506609 - protein, 9 aa, Homo Sapiens
HGVLKAVYD

SEQ ID NO: 506610 - protein, 9 aa, Homo Sapiens
MDAETAYPN

SEQ ID NO: 506611 - protein, 9 aa, Homo Sapiens
VVLKHKEDI

SEQ ID NO: 506612 - protein, 9 aa, Homo Sapiens
GVLKTEAEN

SEQ ID NO: 506613 - protein, 9 aa, Homo Sapiens
VCPYNSVKF

SEQ ID NO: 506614 - protein, 9 aa, Homo Sapiens
VLLVFWTYQ

SEQ ID NO: 506615 - protein, 9 aa, Homo Sapiens
ENSHLKMMC

SEQ ID NO: 506616 - protein, 9 aa, Homo Sapiens
LVGKSSAVF

SEQ ID NO: 506617 - protein, 9 aa, Homo Sapiens
LVVRPLQPR

SEQ ID NO: 506618 - protein, 9 aa, Homo Sapiens
HFIKRQEAE

SEQ ID NO: 506619 - protein, 9 aa, Homo Sapiens
ITISILSIC

SEQ ID NO: 506620 - protein, 9 aa, Homo Sapiens
KASAGDGSQ

SEQ ID NO: 506621 - protein, 9 aa, Homo Sapiens
WEAQLRRII

SEQ ID NO: 506622 - protein, 9 aa, Homo Sapiens
KFQCSRKAS

SEQ ID NO: 506623 - protein, 9 aa, Homo Sapiens
KESIVGEIT

SEQ ID NO: 506624 - protein, 9 aa, Homo Sapiens
FENESAHNR

SEQ ID NO: 506625 - protein, 9 aa, Homo Sapiens
LQAFWEVQE

SEQ ID NO: 506626 - protein, 9 aa, Homo Sapiens
HHKPLMGEA

SEQ ID NO: 506627 - protein, 9 aa, Homo Sapiens
YVDLFSQYF

SEQ ID NO: 506628 - protein, 9 aa, Homo Sapiens
SSWEMGSMD

SEQ ID NO: 506629 - protein, 9 aa, Homo Sapiens
NVIMDAETA

SEQ ID NO: 506630 - protein, 9 aa, Homo Sapiens
KAKEHGERN

SEQ ID NO: 506631 - protein, 9 aa, Homo Sapiens
VDQSHSEAN

SEQ ID NO: 506632 - protein, 9 aa, Homo Sapiens
DLDDATAQE

SEQ ID NO: 506633 - protein, 9 aa, Homo Sapiens
CRGVTNTLA

SEQ ID NO: 506634 - protein, 9 aa, Homo Sapiens
NAVHGVLKA

SEQ ID NO: 506635 - protein, 9 aa, Homo Sapiens
HRGGRKSIS

SEQ ID NO: 506636 - protein, 9 aa, Homo Sapiens
PPPPPAPQK

SEQ ID NO: 506637 - protein, 9 aa, Homo Sapiens
IMDAETAYP

SEQ ID NO: 506638 - protein, 9 aa, Homo Sapiens
VMSATMYVD

SEQ ID NO: 506639 - protein, 9 aa, Homo Sapiens
EEYYGYWPK

SEQ ID NO: 506640 - protein, 9 aa, Homo Sapiens
RSPRRGTSP

SEQ ID NO: 506641 - protein, 9 aa, Homo Sapiens
EKFMDSSVE

SEQ ID NO: 506642 - protein, 9 aa, Homo Sapiens
SVFCGVYQQ

SEQ ID NO: 506643 - protein, 9 aa, Homo Sapiens
TFDVTMRFL

SEQ ID NO: 506644 - protein, 9 aa, Homo Sapiens
HADCKCDSG

SEQ ID NO: 506645 - protein, 9 aa, Homo Sapiens
PRRSLGLTL

SEQ ID NO: 506646 - protein, 9 aa, Homo Sapiens
EHGERNIPR

SEQ ID NO: 506647 - protein, 9 aa, Homo Sapiens
SEQEVATNL

SEQ ID NO: 506648 - protein, 9 aa, Homo Sapiens
CTCEKVSLI

SEQ ID NO: 506649 - protein, 9 aa, Homo Sapiens
PEQSCAYTP

SEQ ID NO: 506650 - protein, 9 aa, Homo Sapiens
IQTDPYSAE

SEQ ID NO: 506651 - protein, 9 aa, Homo Sapiens
FWTYQDEEL

SEQ ID NO: 506652 - protein, 9 aa, Homo Sapiens
SPEKLPEED

SEQ ID NO: 506653 - protein, 9 aa, Homo Sapiens
EYYGYWPKK

SEQ ID NO: 506654 - protein, 9 aa, Homo Sapiens
ENQIITLTV

SEQ ID NO: 506655 - protein, 9 aa, Homo Sapiens
VLKTEAENT

SEQ ID NO: 506656 - protein, 9 aa, Homo Sapiens
LMALQEACE

SEQ ID NO: 506657 - protein, 9 aa, Homo Sapiens
KGSQNYHQG

SEQ ID NO: 506658 - protein, 9 aa, Homo Sapiens
AVTPLKLAG

SEQ ID NO: 506659 - protein, 9 aa, Homo Sapiens
SAFYRESVY

SEQ ID NO: 506660 - protein, 9 aa, Homo Sapiens
VDIHAVDGT

SEQ ID NO: 506661 - protein, 9 aa, Homo Sapiens
SSASTSHAT

SEQ ID NO: 506662 - protein, 9 aa, Homo Sapiens
HGYDFWIDT

SEQ ID NO: 506663 - protein, 9 aa, Homo Sapiens
GKQSRSRSK

SEQ ID NO: 506664 - protein, 9 aa, Homo Sapiens
VTLDQVAAG

SEQ ID NO: 506665 - protein, 9 aa, Homo Sapiens
SPIMRKWLN

SEQ ID NO: 506666 - protein, 9 aa, Homo Sapiens
PLPPAKRFR

SEQ ID NO: 506667 - protein, 9 aa, Homo Sapiens
VVPAMQLVS

SEQ ID NO: 506668 - protein, 9 aa, Homo Sapiens
LPGNQLIDY

SEQ ID NO: 506669 - protein, 9 aa, Homo Sapiens
KGVLKTEAE

SEQ ID NO: 506670 - protein, 9 aa, Homo Sapiens
TQQSARNFK

SEQ ID NO: 506671 - protein, 9 aa, Homo Sapiens
HLKMMCCNC

SEQ ID NO: 506672 - protein, 9 aa, Homo Sapiens
YQQPYYYSD

SEQ ID NO: 506673 - protein, 9 aa, Homo Sapiens
VTDDMGLVL

SEQ ID NO: 506674 - protein, 9 aa, Homo Sapiens
LGGNKGDRM

SEQ ID NO: 506675 - protein, 9 aa, Homo Sapiens
TLYYTCLKS

SEQ ID NO: 506676 - protein, 9 aa, Homo Sapiens
FNFRYPSAG

SEQ ID NO: 506677 - protein, 9 aa, Homo Sapiens
QRDYDVVAS

SEQ ID NO: 506678 - protein, 9 aa, Homo Sapiens
SRGEWKCER

SEQ ID NO: 506679 - protein, 9 aa, Homo Sapiens
PPPPAPQKA

SEQ ID NO: 506680 - protein, 9 aa, Homo Sapiens
VWTKDVLFE

SEQ ID NO: 506681 - protein, 9 aa, Homo Sapiens
VLQDSQDRC

SEQ ID NO: 506682 - protein, 9 aa, Homo Sapiens
LDSSVTKVL

SEQ ID NO: 506683 - protein, 9 aa, Homo Sapiens
SKFCGGLLI

SEQ ID NO: 506684 - protein, 9 aa, Homo Sapiens
RTNITDEES

SEQ ID NO: 506685 - protein, 9 aa, Homo Sapiens
VPAMQLVSK

SEQ ID NO: 506686 - protein, 9 aa, Homo Sapiens
DIIICEIAD

SEQ ID NO: 506687 - protein, 9 aa, Homo Sapiens
LESVPEAEA

SEQ ID NO: 506688 - protein, 9 aa, Homo Sapiens
KEGHFEMRP

SEQ ID NO: 506689 - protein, 9 aa, Homo Sapiens
ELSPEKLPE

SEQ ID NO: 506690 - protein, 9 aa, Homo Sapiens
YDVVASRWT

SEQ ID NO: 506691 - protein, 9 aa, Homo Sapiens
ETATWILSP

SEQ ID NO: 506692 - protein, 9 aa, Homo Sapiens
VTMRFLYEC

SEQ ID NO: 506693 - protein, 9 aa, Homo Sapiens
TCEKVSLID

SEQ ID NO: 506694 - protein, 9 aa, Homo Sapiens
VNVIMDAET

SEQ ID NO: 506695 - protein, 9 aa, Homo Sapiens
HKEEVPVEI

SEQ ID NO: 506696 - protein, 9 aa, Homo Sapiens
KMMCCNCVS

SEQ ID NO: 506697 - protein, 9 aa, Homo Sapiens
GSVEEHRQQ

SEQ ID NO: 506698 - protein, 9 aa, Homo Sapiens
TAQEEADLR

SEQ ID NO: 506699 - protein, 9 aa, Homo Sapiens
QQPSCTDDL

SEQ ID NO: 506700 - protein, 9 aa, Homo Sapiens
DIEGHHMYS

SEQ ID NO: 506701 - protein, 9 aa, Homo Sapiens
DGSAFYRES

SEQ ID NO: 506702 - protein, 9 aa, Homo Sapiens
TMLGRTNIT

SEQ ID NO: 506703 - protein, 9 aa, Homo Sapiens
TDHPDIHPA

SEQ ID NO: 506704 - protein, 9 aa, Homo Sapiens
ERLQAFWEV

SEQ ID NO: 506705 - protein, 9 aa, Homo Sapiens
DADIQTDPY

SEQ ID NO: 506706 - protein, 9 aa, Homo Sapiens
MYVDLFSQY

SEQ ID NO: 506707 - protein, 9 aa, Homo Sapiens
HNRRESTDL

SEQ ID NO: 506708 - protein, 9 aa, Homo Sapiens
PEAEAHEEW

SEQ ID NO: 506709 - protein, 9 aa, Homo Sapiens
EGHFEMRPN

SEQ ID NO: 506710 - protein, 9 aa, Homo Sapiens
AKAKEHGER

SEQ ID NO: 506711 - protein, 9 aa, Homo Sapiens
NYPIFVLLH

SEQ ID NO: 506712 - protein, 9 aa, Homo Sapiens
QHVVVTRNR

SEQ ID NO: 506713 - protein, 9 aa, Homo Sapiens
ATWILSPSV

SEQ ID NO: 506714 - protein, 9 aa, Homo Sapiens
SAVFRKSSY

SEQ ID NO: 506715 - protein, 9 aa, Homo Sapiens
RMPSVLNRH

SEQ ID NO: 506716 - protein, 9 aa, Homo Sapiens
AIKWSNMED

SEQ ID NO: 506717 - protein, 9 aa, Homo Sapiens
VKELMLSSN

SEQ ID NO: 506718 - protein, 9 aa, Homo Sapiens
FSSGPYKKD

SEQ ID NO: 506719 - protein, 9 aa, Homo Sapiens
DSTYRMPSV

SEQ ID NO: 506720 - protein, 9 aa, Homo Sapiens
RDYDVVASR

SEQ ID NO: 506721 - protein, 9 aa, Homo Sapiens
RGFFAFHAS

SEQ ID NO: 506722 - protein, 9 aa, Homo Sapiens
DPLLLGSSS

SEQ ID NO: 506723 - protein, 9 aa, Homo Sapiens
DWWTQQSAR

SEQ ID NO: 506724 - protein, 9 aa, Homo Sapiens
WIDTDHPDI

SEQ ID NO: 506725 - protein, 9 aa, Homo Sapiens
KWNSVLKII

SEQ ID NO: 506726 - protein, 9 aa, Homo Sapiens
PEIWDRSPR

SEQ ID NO: 506727 - protein, 9 aa, Homo Sapiens
DFQQKELHF

SEQ ID NO: 506728 - protein, 9 aa, Homo Sapiens
GHFEMRPNV

SEQ ID NO: 506729 - protein, 9 aa, Homo Sapiens
YNSVKFQCS

SEQ ID NO: 506730 - protein, 9 aa, Homo Sapiens
VFTVELSYD

SEQ ID NO: 506731 - protein, 9 aa, Homo Sapiens
SWEMGSMDE

SEQ ID NO: 506732 - protein, 9 aa, Homo Sapiens
EIRGPHPPG

SEQ ID NO: 506733 - protein, 9 aa, Homo Sapiens
DPEGVVWTK

SEQ ID NO: 506734 - protein, 9 aa, Homo Sapiens
AVPLELLPT

SEQ ID NO: 506735 - protein, 9 aa, Homo Sapiens
LAKKATIQK

SEQ ID NO: 506736 - protein, 9 aa, Homo Sapiens
ADVFKAKNL

SEQ ID NO: 506737 - protein, 9 aa, Homo Sapiens
NAGKQSRSR

SEQ ID NO: 506738 - protein, 9 aa, Homo Sapiens
KYFNFRYPS

SEQ ID NO: 506739 - protein, 9 aa, Homo Sapiens
CTTEGRRRA

SEQ ID NO: 506740 - protein, 9 aa, Homo Sapiens
FSKMHQRLI

SEQ ID NO: 506741 - protein, 9 aa, Homo Sapiens
EIWDRSPRR

SEQ ID NO: 506742 - protein, 9 aa, Homo Sapiens
QLKLLFRDV

SEQ ID NO: 506743 - protein, 9 aa, Homo Sapiens
SAGDGSQTR

SEQ ID NO: 506744 - protein, 9 aa, Homo Sapiens
IAKAKEHGE

SEQ ID NO: 506745 - protein, 9 aa, Homo Sapiens
YLLAHSAGA

SEQ ID NO: 506746 - protein, 9 aa, Homo Sapiens
QQPYYYSDI

SEQ ID NO: 506747 - protein, 9 aa, Homo Sapiens
VFSKMHQRL

SEQ ID NO: 506748 - protein, 9 aa, Homo Sapiens
KQMAYRIDD

SEQ ID NO: 506749 - protein, 9 aa, Homo Sapiens
ATNLGPPSR

SEQ ID NO: 506750 - protein, 9 aa, Homo Sapiens
CAYTPVFLA

SEQ ID NO: 506751 - protein, 9 aa, Homo Sapiens
LHRGGRKSI

SEQ ID NO: 506752 - protein, 9 aa, Homo Sapiens
RQEHGHERK

SEQ ID NO: 506753 - protein, 9 aa, Homo Sapiens
DCAHGFLKV

SEQ ID NO: 506754 - protein, 9 aa, Homo Sapiens
PEGVVWTKD

SEQ ID NO: 506755 - protein, 9 aa, Homo Sapiens
VFCGVYQQP

SEQ ID NO: 506756 - protein, 9 aa, Homo Sapiens
SKTVTLVEA

SEQ ID NO: 506757 - protein, 9 aa, Homo Sapiens
WQRLQHLCS

SEQ ID NO: 506758 - protein, 9 aa, Homo Sapiens
LSGPGAPAT

SEQ ID NO: 506759 - protein, 9 aa, Homo Sapiens
NLKNTSQVS

SEQ ID NO: 506760 - protein, 9 aa, Homo Sapiens
FCGGLLIRR

SEQ ID NO: 506761 - protein, 9 aa, Homo Sapiens
ESAHNRRES

SEQ ID NO: 506762 - protein, 9 aa, Homo Sapiens
SFTPHHKPL

SEQ ID NO: 506763 - protein, 9 aa, Homo Sapiens
YRMPSVLNR

SEQ ID NO: 506764 - protein, 9 aa, Homo Sapiens
KELMLSSNQ

SEQ ID NO: 506765 - protein, 9 aa, Homo Sapiens
SKNAVHGVL

SEQ ID NO: 506766 - protein, 9 aa, Homo Sapiens
NVLKPQDSP

SEQ ID NO: 506767 - protein, 9 aa, Homo Sapiens
ICEIADVFK

SEQ ID NO: 506768 - protein, 9 aa, Homo Sapiens
ASTTPMWAL

SEQ ID NO: 506769 - protein, 9 aa, Homo Sapiens
QLSKNAVHG

SEQ ID NO: 506770 - protein, 9 aa, Homo Sapiens
KVLGSPRIV

SEQ ID NO: 506771 - protein, 9 aa, Homo Sapiens
EKDLSDKQM

SEQ ID NO: 506772 - protein, 9 aa, Homo Sapiens
GDYFGKEGH

SEQ ID NO: 506773 - protein, 9 aa, Homo Sapiens
TLTHSFGPS

SEQ ID NO: 506774 - protein, 9 aa, Homo Sapiens
GAPATAKPG

SEQ ID NO: 506775 - protein, 9 aa, Homo Sapiens
AKKATIQKL

SEQ ID NO: 506776 - protein, 9 aa, Homo Sapiens
QEEYYGYWP

SEQ ID NO: 506777 - protein, 9 aa, Homo Sapiens
KEAVDIHAV

SEQ ID NO: 506778 - protein, 9 aa, Homo Sapiens
PCPTKFTIK

SEQ ID NO: 506779 - protein, 9 aa, Homo Sapiens
PASTQLDHN

SEQ ID NO: 506780 - protein, 9 aa, Homo Sapiens
FPRRRTYLE

SEQ ID NO: 506781 - protein, 9 aa, Homo Sapiens
NITDEESEQ

SEQ ID NO: 506782 - protein, 9 aa, Homo Sapiens
LTSAQTFTL

SEQ ID NO: 506783 - protein, 9 aa, Homo Sapiens
GPPGTSKTV

SEQ ID NO: 506784 - protein, 9 aa, Homo Sapiens
ASAGDGSQT

SEQ ID NO: 506785 - protein, 9 aa, Homo Sapiens
DTDHPDIHP

SEQ ID NO: 506786 - protein, 9 aa, Homo Sapiens
LGTLAQVHA

SEQ ID NO: 506787 - protein, 9 aa, Homo Sapiens
TSAQTFTLD

SEQ ID NO: 506788 - protein, 9 aa, Homo Sapiens
YFVTLYYTC

SEQ ID NO: 506789 - protein, 9 aa, Homo Sapiens
ISVKEFLDW

SEQ ID NO: 506790 - protein, 9 aa, Homo Sapiens
EKLPEEDDD

SEQ ID NO: 506791 - protein, 9 aa, Homo Sapiens
TEPEQSCAY

SEQ ID NO: 506792 - protein, 9 aa, Homo Sapiens
IDIDECSQE

SEQ ID NO: 506793 - protein, 9 aa, Homo Sapiens
SFNLKNTSQ

SEQ ID NO: 506794 - protein, 9 aa, Homo Sapiens
HAGAVLMGM

SEQ ID NO: 506795 - protein, 9 aa, Homo Sapiens
WQLAQLEAR

SEQ ID NO: 506796 - protein, 9 aa, Homo Sapiens
PPPAPQKAS

SEQ ID NO: 506797 - protein, 9 aa, Homo Sapiens
QTHLSPNYP

SEQ ID NO: 506798 - protein, 9 aa, Homo Sapiens
QLRRIIKLI

SEQ ID NO: 506799 - protein, 9 aa, Homo Sapiens
QHQQQHQQQ

SEQ ID NO: 506800 - protein, 9 aa, Homo Sapiens
CDQSFKCNS

SEQ ID NO: 506801 - protein, 9 aa, Homo Sapiens
WDKMDNPNF

SEQ ID NO: 506802 - protein, 9 aa, Homo Sapiens
CNSDFINHQ

SEQ ID NO: 506803 - protein, 9 aa, Homo Sapiens
TQLDHNSLS

SEQ ID NO: 506804 - protein, 9 aa, Homo Sapiens
SATWEGEVE

SEQ ID NO: 506805 - protein, 9 aa, Homo Sapiens
SGPYKKDDE

SEQ ID NO: 506806 - protein, 9 aa, Homo Sapiens
LGLTLTHSF

SEQ ID NO: 506807 - protein, 9 aa, Homo Sapiens
AQEEADLRF

SEQ ID NO: 506808 - protein, 9 aa, Homo Sapiens
CSMAPECCV

SEQ ID NO: 506809 - protein, 9 aa, Homo Sapiens
EQLQAHAGA

SEQ ID NO: 506810 - protein, 9 aa, Homo Sapiens
LQHLCSMAP

SEQ ID NO: 506811 - protein, 9 aa, Homo Sapiens
RARKALFPV

SEQ ID NO: 506812 - protein, 9 aa, Homo Sapiens
LFKDCAHGF

SEQ ID NO: 506813 - protein, 9 aa, Homo Sapiens
PLQEEVLVV

SEQ ID NO: 506814 - protein, 9 aa, Homo Sapiens
VLKIIEKAC

SEQ ID NO: 506815 - protein, 9 aa, Homo Sapiens
YVLNVTEEF

SEQ ID NO: 506816 - protein, 9 aa, Homo Sapiens
HSEANTYQS

SEQ ID NO: 506817 - protein, 9 aa, Homo Sapiens
KVDQSHSEA

SEQ ID NO: 506818 - protein, 9 aa, Homo Sapiens
VVFFLFPHL

SEQ ID NO: 506819 - protein, 9 aa, Homo Sapiens
HFEMRPNVK

SEQ ID NO: 506820 - protein, 9 aa, Homo Sapiens
DGLGSSWEM

SEQ ID NO: 506821 - protein, 9 aa, Homo Sapiens
LRLRMYLLA

SEQ ID NO: 506822 - protein, 9 aa, Homo Sapiens
PPAPQKASG

SEQ ID NO: 506823 - protein, 9 aa, Homo Sapiens
KYDKYGFLT

SEQ ID NO: 506824 - protein, 9 aa, Homo Sapiens
TATTLAPQG

SEQ ID NO: 506825 - protein, 9 aa, Homo Sapiens
GRKSISVAI

SEQ ID NO: 506826 - protein, 9 aa, Homo Sapiens
VELSPEKLP

SEQ ID NO: 506827 - protein, 9 aa, Homo Sapiens
LQCICTGNS

SEQ ID NO: 506828 - protein, 9 aa, Homo Sapiens
DPCTCEKVS

SEQ ID NO: 506829 - protein, 9 aa, Homo Sapiens
FKCNSDFIN

SEQ ID NO: 506830 - protein, 9 aa, Homo Sapiens
SPQHVVVTR

SEQ ID NO: 506831 - protein, 9 aa, Homo Sapiens
GVVLKHKED

SEQ ID NO: 506832 - protein, 9 aa, Homo Sapiens
LLIRRNFVL

SEQ ID NO: 506833 - protein, 9 aa, Homo Sapiens
LKRNYSYFL

SEQ ID NO: 506834 - protein, 9 aa, Homo Sapiens
NSLCFDIEG

SEQ ID NO: 506835 - protein, 9 aa, Homo Sapiens
QQKELHFIK

SEQ ID NO: 506836 - protein, 9 aa, Homo Sapiens
ESVYPSQPA

SEQ ID NO: 506837 - protein, 9 aa, Homo Sapiens
PESFTPHHK

SEQ ID NO: 506838 - protein, 9 aa, Homo Sapiens
RVKELMLSS

SEQ ID NO: 506839 - protein, 9 aa, Homo Sapiens
DVVASRWTT

SEQ ID NO: 506840 - protein, 9 aa, Homo Sapiens
NWGSVEEHR

SEQ ID NO: 506841 - protein, 9 aa, Homo Sapiens
VTQTWHPCP

SEQ ID NO: 506842 - protein, 9 aa, Homo Sapiens
FRLIVGKDS

SEQ ID NO: 506843 - protein, 9 aa, Homo Sapiens
EAHEEWSCQ

SEQ ID NO: 506844 - protein, 9 aa, Homo Sapiens
HCKDYVLNV

SEQ ID NO: 506845 - protein, 9 aa, Homo Sapiens
LMPENQIIT

SEQ ID NO: 506846 - protein, 9 aa, Homo Sapiens
GGKGSQNYH

SEQ ID NO: 506847 - protein, 9 aa, Homo Sapiens
HGHERKISF

SEQ ID NO: 506848 - protein, 9 aa, Homo Sapiens
SSGPYKKDD

SEQ ID NO: 506849 - protein, 9 aa, Homo Sapiens
TQPGSPPCS

SEQ ID NO: 506850 - protein, 9 aa, Homo Sapiens
AAANVLKPQ

SEQ ID NO: 506851 - protein, 9 aa, Homo Sapiens
PRHLLMPEN

SEQ ID NO: 506852 - protein, 9 aa, Homo Sapiens
SHATHLPVT

SEQ ID NO: 506853 - protein, 9 aa, Homo Sapiens
KADRFLFDM

SEQ ID NO: 506854 - protein, 9 aa, Homo Sapiens
PVFSKMHQR

SEQ ID NO: 506855 - protein, 9 aa, Homo Sapiens
IWDRSPRRG

SEQ ID NO: 506856 - protein, 9 aa, Homo Sapiens
AFYRESVYP

SEQ ID NO: 506857 - protein, 9 aa, Homo Sapiens
KWSNMEDRH

SEQ ID NO: 506858 - protein, 9 aa, Homo Sapiens
QLPGNQLID

SEQ ID NO: 506859 - protein, 9 aa, Homo Sapiens
ECSQEPNLC

SEQ ID NO: 506860 - protein, 9 aa, Homo Sapiens
FNLKNTSQV

SEQ ID NO: 506861 - protein, 9 aa, Homo Sapiens
ALIQLPGNQ

SEQ ID NO: 506862 - protein, 9 aa, Homo Sapiens
RKAVARLEK

SEQ ID NO: 506863 - protein, 9 aa, Homo Sapiens
QTFTLDSLK

SEQ ID NO: 506864 - protein, 9 aa, Homo Sapiens
QRMRYFLST

SEQ ID NO: 506865 - protein, 9 aa, Homo Sapiens
VFRKSSYGY

SEQ ID NO: 506866 - protein, 9 aa, Homo Sapiens
VNQKLTKKT

SEQ ID NO: 506867 - protein, 9 aa, Homo Sapiens
KKATIQKLL

SEQ ID NO: 506868 - protein, 9 aa, Homo Sapiens
TWEGEVEGS

SEQ ID NO: 506869 - protein, 9 aa, Homo Sapiens
DIQTDPYSA

SEQ ID NO: 506870 - protein, 9 aa, Homo Sapiens
EHGHERKIS

SEQ ID NO: 506871 - protein, 9 aa, Homo Sapiens
GTSKTVTLV

SEQ ID NO: 506872 - protein, 9 aa, Homo Sapiens
CTGNSRGEW

SEQ ID NO: 506873 - protein, 9 aa, Homo Sapiens
SNKGVLKTE

SEQ ID NO: 506874 - protein, 9 aa, Homo Sapiens
VRQEHGHER

SEQ ID NO: 506875 - protein, 9 aa, Homo Sapiens
LWQRLQHLC

SEQ ID NO: 506876 - protein, 9 aa, Homo Sapiens
PAFLVNCKC

SEQ ID NO: 506877 - protein, 9 aa, Homo Sapiens
QHLCSMAPE

SEQ ID NO: 506878 - protein, 9 aa, Homo Sapiens
IIKLIAGGG

SEQ ID NO: 506879 - protein, 9 aa, Homo Sapiens
ENAAGSPIM

SEQ ID NO: 506880 - protein, 9 aa, Homo Sapiens
KEEVPVEIV

SEQ ID NO: 506881 - protein, 9 aa, Homo Sapiens
PPATQPGSP

SEQ ID NO: 506882 - protein, 9 aa, Homo Sapiens
HRNPPPNAD

SEQ ID NO: 506883 - protein, 9 aa, Homo Sapiens
SCAYTPVFL

SEQ ID NO: 506884 - protein, 9 aa, Homo Sapiens
PAKRFRLIV

SEQ ID NO: 506885 - protein, 9 aa, Homo Sapiens
NTLAQIRRQ

SEQ ID NO: 506886 - protein, 9 aa, Homo Sapiens
LSSATATTL

SEQ ID NO: 506887 - protein, 9 aa, Homo Sapiens
RIIKLIAGG

SEQ ID NO: 506888 - protein, 9 aa, Homo Sapiens
FTEKQRMRY

SEQ ID NO: 506889 - protein, 9 aa, Homo Sapiens
LDSDSTYRM

SEQ ID NO: 506890 - protein, 9 aa, Homo Sapiens
PATAKPGTS

SEQ ID NO: 506891 - protein, 9 aa, Homo Sapiens
EQSCAYTPV

SEQ ID NO: 506892 - protein, 9 aa, Homo Sapiens
QEVATNLGP

SEQ ID NO: 506893 - protein, 9 aa, Homo Sapiens
GPGAPATAK

SEQ ID NO: 506894 - protein, 9 aa, Homo Sapiens
TMYVDLFSQ

SEQ ID NO: 506895 - protein, 9 aa, Homo Sapiens
GNKGDRMAT

SEQ ID NO: 506896 - protein, 9 aa, Homo Sapiens
GADDAWEDV

SEQ ID NO: 506897 - protein, 9 aa, Homo Sapiens
KVRQEHGHE

SEQ ID NO: 506898 - protein, 9 aa, Homo Sapiens
RYFLSTLPT

SEQ ID NO: 506899 - protein, 9 aa, Homo Sapiens
PLLLGSSSF

SEQ ID NO: 506900 - protein, 9 aa, Homo Sapiens
KTLIKEYTE

SEQ ID NO: 506901 - protein, 9 aa, Homo Sapiens
LTKKTLIKE

SEQ ID NO: 506902 - protein, 9 aa, Homo Sapiens
ASLSSHARA

SEQ ID NO: 506903 - protein, 9 aa, Homo Sapiens
FGSRKAVAR

SEQ ID NO: 506904 - protein, 9 aa, Homo Sapiens
ELMLSSNQI

SEQ ID NO: 506905 - protein, 9 aa, Homo Sapiens
SEDFLENQF

SEQ ID NO: 506906 - protein, 9 aa, Homo Sapiens
ICTGNSRGE

SEQ ID NO: 506907 - protein, 9 aa, Homo Sapiens
SVEKFMDSS

SEQ ID NO: 506908 - protein, 9 aa, Homo Sapiens
QNLCLTRHQ

SEQ ID NO: 506909 - protein, 9 aa, Homo Sapiens
SVPEAEAHE

SEQ ID NO: 506910 - protein, 9 aa, Homo Sapiens
PSLHQEKTK

SEQ ID NO: 506911 - protein, 9 aa, Homo Sapiens
QFVGLERNF

SEQ ID NO: 506912 - protein, 9 aa, Homo Sapiens
FEVQWQLAQ

SEQ ID NO: 506913 - protein, 9 aa, Homo Sapiens
LQSEQQPSC

SEQ ID NO: 506914 - protein, 9 aa, Homo Sapiens
LFSSGPYKK

SEQ ID NO: 506915 - protein, 9 aa, Homo Sapiens
MLGRTNITD

SEQ ID NO: 506916 - protein, 9 aa, Homo Sapiens
SLGLTLTHS

SEQ ID NO: 506917 - protein, 9 aa, Homo Sapiens
DLLFKDCAH

SEQ ID NO: 506918 - protein, 9 aa, Homo Sapiens
SIVGEITRE

SEQ ID NO: 506919 - protein, 9 aa, Homo Sapiens
QHQHQQQHQ

SEQ ID NO: 506920 - protein, 9 aa, Homo Sapiens
LGRTNITDE

SEQ ID NO: 506921 - protein, 9 aa, Homo Sapiens
GQTHLSPNY

SEQ ID NO: 506922 - protein, 9 aa, Homo Sapiens
DMASTTPMW

SEQ ID NO: 506923 - protein, 9 aa, Homo Sapiens
SRNAGKQSR

SEQ ID NO: 506924 - protein, 9 aa, Homo Sapiens
DYDVVASRW

SEQ ID NO: 506925 - protein, 9 aa, Homo Sapiens
FRYLDYNKD

SEQ ID NO: 506926 - protein, 9 aa, Homo Sapiens
VSFNLKNTS

SEQ ID NO: 506927 - protein, 9 aa, Homo Sapiens
SLSLAAMSP

SEQ ID NO: 506928 - protein, 9 aa, Homo Sapiens
SIIRDLGTL

SEQ ID NO: 506929 - protein, 9 aa, Homo Sapiens
LIQLPGNQL

SEQ ID NO: 506930 - protein, 9 aa, Homo Sapiens
GLTLTHSFG

SEQ ID NO: 506931 - protein, 9 aa, Homo Sapiens
KKDDEEADA

SEQ ID NO: 506932 - protein, 9 aa, Homo Sapiens
WWTQQSARN

SEQ ID NO: 506933 - protein, 9 aa, Homo Sapiens
DFWIDTDHP

SEQ ID NO: 506934 - protein, 9 aa, Homo Sapiens
PQEIRGPHP

SEQ ID NO: 506935 - protein, 9 aa, Homo Sapiens
GGGWGGKGS

SEQ ID NO: 506936 - protein, 9 aa, Homo Sapiens
LDHNSLSEQ

SEQ ID NO: 506937 - protein, 9 aa, Homo Sapiens
SVEEHRQQQ

SEQ ID NO: 506938 - protein, 9 aa, Homo Sapiens
LGSSWEMGS

SEQ ID NO: 506939 - protein, 9 aa, Homo Sapiens
SDIIPESVT

SEQ ID NO: 506940 - protein, 9 aa, Homo Sapiens
AVDIHAVDG

SEQ ID NO: 506941 - protein, 9 aa, Homo Sapiens
PLGPPATQP

SEQ ID NO: 506942 - protein, 9 aa, Homo Sapiens
FAFHASLLP

SEQ ID NO: 506943 - protein, 9 aa, Homo Sapiens
PYKKDDEEA

SEQ ID NO: 506944 - protein, 9 aa, Homo Sapiens
TSHATHLPV

SEQ ID NO: 506945 - protein, 9 aa, Homo Sapiens
PCTCEKVSL

SEQ ID NO: 506946 - protein, 9 aa, Homo Sapiens
LVSKIPDMS

SEQ ID NO: 506947 - protein, 9 aa, Homo Sapiens
EGSLFEVQW

SEQ ID NO: 506948 - protein, 9 aa, Homo Sapiens
QLDHNSLSE

SEQ ID NO: 506949 - protein, 9 aa, Homo Sapiens
RRVKELMLS

SEQ ID NO: 506950 - protein, 9 aa, Homo Sapiens
WEMGSMDEA

SEQ ID NO: 506951 - protein, 9 aa, Homo Sapiens
DYFGKEGHF

SEQ ID NO: 506952 - protein, 9 aa, Homo Sapiens
NSVLKIIEK

SEQ ID NO: 506953 - protein, 9 aa, Homo Sapiens
AVNVIMDAE

SEQ ID NO: 506954 - protein, 9 aa, Homo Sapiens
FKDCAHGFL

SEQ ID NO: 506955 - protein, 9 aa, Homo Sapiens
IPLPPAKRF

SEQ ID NO: 506956 - protein, 9 aa, Homo Sapiens
QWQLAQLEA

SEQ ID NO: 506957 - protein, 9 aa, Homo Sapiens
KWYESALQE

SEQ ID NO: 506958 - protein, 9 aa, Homo Sapiens
HDKVKAQSC

SEQ ID NO: 506959 - protein, 9 aa, Homo Sapiens
MLSSNQITQ

SEQ ID NO: 506960 - protein, 9 aa, Homo Sapiens
NPILYVFLN

SEQ ID NO: 506961 - protein, 9 aa, Homo Sapiens
WSNMEDRHG

SEQ ID NO: 506962 - protein, 9 aa, Homo Sapiens
FRDGLGSSW

SEQ ID NO: 506963 - protein, 9 aa, Homo Sapiens
DKQMAYRID

SEQ ID NO: 506964 - protein, 9 aa, Homo Sapiens
KLAGWQCPE

SEQ ID NO: 506965 - protein, 9 aa, Homo Sapiens
PHLVLVDDD

SEQ ID NO: 506966 - protein, 9 aa, Homo Sapiens
GGLLIRRNF

SEQ ID NO: 506967 - protein, 9 aa, Homo Sapiens
NKKGFPVFS

SEQ ID NO: 506968 - protein, 9 aa, Homo Sapiens
VQWQLAQLE

SEQ ID NO: 506969 - protein, 9 aa, Homo Sapiens
GPYKKDDEE

SEQ ID NO: 506970 - protein, 9 aa, Homo Sapiens
LRFQSSALM

SEQ ID NO: 506971 - protein, 9 aa, Homo Sapiens
DSDSTYRMP

SEQ ID NO: 506972 - protein, 9 aa, Homo Sapiens
WILSPSVAQ

SEQ ID NO: 506973 - protein, 9 aa, Homo Sapiens
DDATAQEEA

SEQ ID NO: 506974 - protein, 9 aa, Homo Sapiens
IVMSATMYV

SEQ ID NO: 506975 - protein, 9 aa, Homo Sapiens
IFQMHKEEV

SEQ ID NO: 506976 - protein, 9 aa, Homo Sapiens
KTTQKASAG

SEQ ID NO: 506977 - protein, 9 aa, Homo Sapiens
SEQQPSCTD

SEQ ID NO: 506978 - protein, 9 aa, Homo Sapiens
LFPRRRTYL

SEQ ID NO: 506979 - protein, 9 aa, Homo Sapiens
FGKEGHFEM

SEQ ID NO: 506980 - protein, 9 aa, Homo Sapiens
FDTRASLSS

SEQ ID NO: 506981 - protein, 9 aa, Homo Sapiens
RMRYFLSTL

SEQ ID NO: 506982 - protein, 9 aa, Homo Sapiens
GWTPRGFFA

SEQ ID NO: 506983 - protein, 9 aa, Homo Sapiens
LKMMCCNCV

SEQ ID NO: 506984 - protein, 9 aa, Homo Sapiens
RSLGLTLTH

SEQ ID NO: 506985 - protein, 9 aa, Homo Sapiens
NQKLTKKTL

SEQ ID NO: 506986 - protein, 9 aa, Homo Sapiens
SALQGLPVA

SEQ ID NO: 506987 - protein, 9 aa, Homo Sapiens
LLAKKATIQ

SEQ ID NO: 506988 - protein, 9 aa, Homo Sapiens
QCNRCKKSF

SEQ ID NO: 506989 - protein, 9 aa, Homo Sapiens
SAFKHFQCN

SEQ ID NO: 506990 - protein, 9 aa, Homo Sapiens
GQGGGWGGK

SEQ ID NO: 506991 - protein, 9 aa, Homo Sapiens
LTLTHSFGP

SEQ ID NO: 506992 - protein, 9 aa, Homo Sapiens
KRCRGVTNT

SEQ ID NO: 506993 - protein, 9 aa, Homo Sapiens
DFLLAKKAT

SEQ ID NO: 506994 - protein, 9 aa, Homo Sapiens
RNYSYFLGL

SEQ ID NO: 506995 - protein, 9 aa, Homo Sapiens
GGRKSISVA

SEQ ID NO: 506996 - protein, 9 aa, Homo Sapiens
FQCNRCKKS

SEQ ID NO: 506997 - protein, 9 aa, Homo Sapiens
RRSLGLTLT

SEQ ID NO: 506998 - protein, 9 aa, Homo Sapiens
ELLPTTEGT

SEQ ID NO: 506999 - protein, 9 aa, Homo Sapiens
KFCGGLLIR

SEQ ID NO: 507000 - protein, 9 aa, Homo Sapiens
LVVLLQVTR

SEQ ID NO: 507001 - protein, 9 aa, Homo Sapiens
MGLVLRSLA

SEQ ID NO: 507002 - protein, 9 aa, Homo Sapiens
ASRWTTPNH

SEQ ID NO: 507003 - protein, 9 aa, Homo Sapiens
KLRRVKELM

SEQ ID NO: 507004 - protein, 9 aa, Homo Sapiens
TYRMPSVLN

SEQ ID NO: 507005 - protein, 9 aa, Homo Sapiens
EVLQDSQDR

SEQ ID NO: 507006 - protein, 9 aa, Homo Sapiens
LDWMHLEPQ

SEQ ID NO: 507007 - protein, 9 aa, Homo Sapiens
LHQEKTKLE

SEQ ID NO: 507008 - protein, 9 aa, Homo Sapiens
SDSTYRMPS

SEQ ID NO: 507009 - protein, 9 aa, Homo Sapiens
WGGKGSQNY

SEQ ID NO: 507010 - protein, 9 aa, Homo Sapiens
SLFEVQWQL

SEQ ID NO: 507011 - protein, 9 aa, Homo Sapiens
AHAVNVIMD

SEQ ID NO: 507012 - protein, 9 aa, Homo Sapiens
HPCPTKFTI

SEQ ID NO: 507013 - protein, 9 aa, Homo Sapiens
FPAVPLELL

SEQ ID NO: 507014 - protein, 9 aa, Homo Sapiens
LRAIKWSNM

SEQ ID NO: 507015 - protein, 9 aa, Homo Sapiens
QSEQQPSCT

SEQ ID NO: 507016 - protein, 9 aa, Homo Sapiens
QEEADLRFC

SEQ ID NO: 507017 - protein, 9 aa, Homo Sapiens
YSYFLGLSD

SEQ ID NO: 507018 - protein, 9 aa, Homo Sapiens
FTVELSYDN

SEQ ID NO: 507019 - protein, 9 aa, Homo Sapiens
ADRFLFDMS

SEQ ID NO: 507020 - protein, 9 aa, Homo Sapiens
RFLFDMSRI

SEQ ID NO: 507021 - protein, 9 aa, Homo Sapiens
RDGLGSSWE

SEQ ID NO: 507022 - protein, 9 aa, Homo Sapiens
KDLIDPCTC

SEQ ID NO: 507023 - protein, 9 aa, Homo Sapiens
TPMWALVLA

SEQ ID NO: 507024 - protein, 9 aa, Homo Sapiens
FQMHKEEVP

SEQ ID NO: 507025 - protein, 9 aa, Homo Sapiens
HLTSAQTFT

SEQ ID NO: 507026 - protein, 9 aa, Homo Sapiens
CNRCKKSFA

SEQ ID NO: 507027 - protein, 9 aa, Homo Sapiens
AHAGAVLMG

SEQ ID NO: 507028 - protein, 9 aa, Homo Sapiens
WFKSVEKFM

SEQ ID NO: 507029 - protein, 9 aa, Homo Sapiens
HAVNVIMDA

SEQ ID NO: 507030 - protein, 9 aa, Homo Sapiens
FDIEGHHMY

SEQ ID NO: 507031 - protein, 9 aa, Homo Sapiens
GGADDAWED

SEQ ID NO: 507032 - protein, 9 aa, Homo Sapiens
WGGATFDVT

SEQ ID NO: 507033 - protein, 9 aa, Homo Sapiens
RLQAFWEVQ

SEQ ID NO: 507034 - protein, 9 aa, Homo Sapiens
EAEAHEEWS

SEQ ID NO: 507035 - protein, 9 aa, Homo Sapiens
LRARKALFP

SEQ ID NO: 507036 - protein, 9 aa, Homo Sapiens
GKSSAVFRK

SEQ ID NO: 507037 - protein, 9 aa, Homo Sapiens
RKALFPVHS

SEQ ID NO: 507038 - protein, 9 aa, Homo Sapiens
ALMALQEAC

SEQ ID NO: 507039 - protein, 9 aa, Homo Sapiens
GLVLRSLAA

SEQ ID NO: 507040 - protein, 9 aa, Homo Sapiens
AKADRFLFD

SEQ ID NO: 507041 - protein, 9 aa, Homo Sapiens
LVWVHASPQ

SEQ ID NO: 507042 - protein, 9 aa, Homo Sapiens
TILLHISDI

SEQ ID NO: 507043 - protein, 9 aa, Homo Sapiens
IIQNLKRNY

SEQ ID NO: 507044 - protein, 9 aa, Homo Sapiens
QPLGPPATQ

SEQ ID NO: 507045 - protein, 9 aa, Homo Sapiens
EAVDIHAVD

SEQ ID NO: 507046 - protein, 9 aa, Homo Sapiens
KNKKKWYES

SEQ ID NO: 507047 - protein, 9 aa, Homo Sapiens
CCLNPILYV

SEQ ID NO: 507048 - protein, 9 aa, Homo Sapiens
TTPMWALVL

SEQ ID NO: 507049 - protein, 9 aa, Homo Sapiens
PEVLQDSQD

SEQ ID NO: 507050 - protein, 9 aa, Homo Sapiens
KRNYSYFLG

SEQ ID NO: 507051 - protein, 9 aa, Homo Sapiens
DTSSASTSH

SEQ ID NO: 507052 - protein, 9 aa, Homo Sapiens
FLLAKKATI

SEQ ID NO: 507053 - protein, 9 aa, Homo Sapiens
IEGHHMYSG

SEQ ID NO: 507054 - protein, 9 aa, Homo Sapiens
IICEIADVF

SEQ ID NO: 507055 - protein, 9 aa, Homo Sapiens
RMYLLAHSA

SEQ ID NO: 507056 - protein, 9 aa, Homo Sapiens
HNSLSEQQQ

SEQ ID NO: 507057 - protein, 9 aa, Homo Sapiens
LAAMSPSFS

SEQ ID NO: 507058 - protein, 9 aa, Homo Sapiens
SKEAVDIHA

SEQ ID NO: 507059 - protein, 9 aa, Homo Sapiens
NKGVLKTEA

SEQ ID NO: 507060 - protein, 9 aa, Homo Sapiens
ICTTEGRRR

SEQ ID NO: 507061 - protein, 9 aa, Homo Sapiens
SHDPLLLGS

SEQ ID NO: 507062 - protein, 9 aa, Homo Sapiens
SLSSHARAH

SEQ ID NO: 507063 - protein, 9 aa, Homo Sapiens
LYYTCLKSQ

SEQ ID NO: 507064 - protein, 9 aa, Homo Sapiens
WEGEVEGSP

SEQ ID NO: 507065 - protein, 9 aa, Homo Sapiens
HLCSMAPEC

SEQ ID NO: 507066 - protein, 9 aa, Homo Sapiens
LTHDKVKAQ

SEQ ID NO: 507067 - protein, 9 aa, Homo Sapiens
SLRLRMYLL

SEQ ID NO: 507068 - protein, 9 aa, Homo Sapiens
IDECSQEPN

SEQ ID NO: 507069 - protein, 9 aa, Homo Sapiens
KLPEEDDDF

SEQ ID NO: 507070 - protein, 9 aa, Homo Sapiens
QVCPYNSVK

SEQ ID NO: 507071 - protein, 9 aa, Homo Sapiens
GFFAFHASL

SEQ ID NO: 507072 - protein, 9 aa, Homo Sapiens
RGVTNTLAQ

SEQ ID NO: 507073 - protein, 9 aa, Homo Sapiens
LLQVTREED

SEQ ID NO: 507074 - protein, 9 aa, Homo Sapiens
RGQDVYIVQ

SEQ ID NO: 507075 - protein, 9 aa, Homo Sapiens
MASTTPMWA

SEQ ID NO: 507076 - protein, 9 aa, Homo Sapiens
LGPPATQPG

SEQ ID NO: 507077 - protein, 9 aa, Homo Sapiens
LNVTEEFLE

SEQ ID NO: 507078 - protein, 9 aa, Homo Sapiens
AKEHGERNI

SEQ ID NO: 507079 - protein, 9 aa, Homo Sapiens
VTKVLGSPR

SEQ ID NO: 507080 - protein, 9 aa, Homo Sapiens
LLGSSSFPF

SEQ ID NO: 507081 - protein, 9 aa, Homo Sapiens
NFRYPSAGV

SEQ ID NO: 507082 - protein, 9 aa, Homo Sapiens
YGDLFRYLD

SEQ ID NO: 507083 - protein, 9 aa, Homo Sapiens
DRSPRRGTS

SEQ ID NO: 507084 - protein, 9 aa, Homo Sapiens
MAASALQGL

SEQ ID NO: 507085 - protein, 9 aa, Homo Sapiens
LKTEAENTN

SEQ ID NO: 507086 - protein, 9 aa, Homo Sapiens
VIVMSATMY

SEQ ID NO: 507087 - protein, 9 aa, Homo Sapiens
YLEAWRACR

SEQ ID NO: 507088 - protein, 9 aa, Homo Sapiens
IAVTPLKLA

SEQ ID NO: 507089 - protein, 9 aa, Homo Sapiens
LFENESAHN

SEQ ID NO: 507090 - protein, 9 aa, Homo Sapiens
SATATTLAP

SEQ ID NO: 507091 - protein, 9 aa, Homo Sapiens
HISDIIPES

SEQ ID NO: 507092 - protein, 9 aa, Homo Sapiens
FWIDTDHPD

SEQ ID NO: 507093 - protein, 9 aa, Homo Sapiens
KKTTQKASA

SEQ ID NO: 507094 - protein, 9 aa, Homo Sapiens
RSRNAGKQS

SEQ ID NO: 507095 - protein, 9 aa, Homo Sapiens
DLFRYLDYN

SEQ ID NO: 507096 - protein, 9 aa, Homo Sapiens
RNFKEQSQC

SEQ ID NO: 507097 - protein, 9 aa, Homo Sapiens
YFGKEGHFE

SEQ ID NO: 507098 - protein, 9 aa, Homo Sapiens
DDIIICEIA

SEQ ID NO: 507099 - protein, 9 aa, Homo Sapiens
KDLSDKQMA

SEQ ID NO: 507100 - protein, 9 aa, Homo Sapiens
SQEPNLCLF

SEQ ID NO: 507101 - protein, 9 aa, Homo Sapiens
SPNYPIFVL

SEQ ID NO: 507102 - protein, 9 aa, Homo Sapiens
GAQFVGLER

SEQ ID NO: 507103 - protein, 9 aa, Homo Sapiens
YKKDDEEAD

SEQ ID NO: 507104 - protein, 9 aa, Homo Sapiens
LVELSPEKL

SEQ ID NO: 507105 - protein, 9 aa, Homo Sapiens
MSVFCGVYQ

SEQ ID NO: 507106 - protein, 9 aa, Homo Sapiens
EVQWQLAQL

SEQ ID NO: 507107 - protein, 9 aa, Homo Sapiens
SARNFKEQS

SEQ ID NO: 507108 - protein, 9 aa, Homo Sapiens
FPVFSKMHQ

SEQ ID NO: 507109 - protein, 9 aa, Homo Sapiens
NNWGSVEEH

SEQ ID NO: 507110 - protein, 9 aa, Homo Sapiens
NLKRNYSYF

SEQ ID NO: 507111 - protein, 9 aa, Homo Sapiens
VGKSSAVFR

SEQ ID NO: 507112 - protein, 9 aa, Homo Sapiens
DAWEDVEDV

SEQ ID NO: 507113 - protein, 9 aa, Homo Sapiens
APATAKPGT

SEQ ID NO: 507114 - protein, 9 aa, Homo Sapiens
CPYNSVKFQ

SEQ ID NO: 507115 - protein, 9 aa, Homo Sapiens
KDCAHGFLK

SEQ ID NO: 507116 - protein, 9 aa, Homo Sapiens
VTREEDDVV

SEQ ID NO: 507117 - protein, 9 aa, Homo Sapiens
LKRCRGVTN

SEQ ID NO: 507118 - protein, 9 aa, Homo Sapiens
YESALQEAC

SEQ ID NO: 507119 - protein, 9 aa, Homo Sapiens
EENSHLKMM

SEQ ID NO: 507120 - protein, 9 aa, Homo Sapiens
TSRTEIPAF

SEQ ID NO: 507121 - protein, 9 aa, Homo Sapiens
STTPMWALV

SEQ ID NO: 507122 - protein, 9 aa, Homo Sapiens
RFRLIVGKD

SEQ ID NO: 507123 - protein, 9 aa, Homo Sapiens
EQEVATNLG

SEQ ID NO: 507124 - protein, 9 aa, Homo Sapiens
QDVYIVQSG

SEQ ID NO: 507125 - protein, 9 aa, Homo Sapiens
ASTQLDHNS

SEQ ID NO: 507126 - protein, 9 aa, Homo Sapiens
RTEIPAFLV

SEQ ID NO: 507127 - protein, 9 aa, Homo Sapiens
MPRHLLMPE

SEQ ID NO: 507128 - protein, 9 aa, Homo Sapiens
LRMYLLAHS

SEQ ID NO: 507129 - protein, 9 aa, Homo Sapiens
QMHKEEVPV

SEQ ID NO: 507130 - protein, 9 aa, Homo Sapiens
EVLVVRPLQ

SEQ ID NO: 507131 - protein, 9 aa, Homo Sapiens
CEIADVFKA

SEQ ID NO: 507132 - protein, 9 aa, Homo Sapiens
VHGVLKAVY

SEQ ID NO: 507133 - protein, 9 aa, Homo Sapiens
SSATATTLA

SEQ ID NO: 507134 - protein, 9 aa, Homo Sapiens
IRDLGTLAQ

SEQ ID NO: 507135 - protein, 9 aa, Homo Sapiens
VFLNNGIKA

SEQ ID NO: 507136 - protein, 9 aa, Homo Sapiens
QSRSRSKEK

SEQ ID NO: 507137 - protein, 9 aa, Homo Sapiens
IPSLHQEKT

SEQ ID NO: 507138 - protein, 9 aa, Homo Sapiens
TWHPCPTKF

SEQ ID NO: 507139 - protein, 9 aa, Homo Sapiens
PIMRKWLNP

SEQ ID NO: 507140 - protein, 9 aa, Homo Sapiens
EPEQSCAYT

SEQ ID NO: 507141 - protein, 9 aa, Homo Sapiens
TDEESEQAT

SEQ ID NO: 507142 - protein, 9 aa, Homo Sapiens
ATQPGSPPC

SEQ ID NO: 507143 - protein, 9 aa, Homo Sapiens
PISKYDKYG

SEQ ID NO: 507144 - protein, 9 aa, Homo Sapiens
RQEEYYGYW

SEQ ID NO: 507145 - protein, 9 aa, Homo Sapiens
DECSQEPNL

SEQ ID NO: 507146 - protein, 9 aa, Homo Sapiens
DLRFQSSAL

SEQ ID NO: 507147 - protein, 9 aa, Homo Sapiens
ESVPEAEAH

SEQ ID NO: 507148 - protein, 9 aa, Homo Sapiens
PYVIYRVNI

SEQ ID NO: 507149 - protein, 9 aa, Homo Sapiens
RDIKKFGGP

SEQ ID NO: 507150 - protein, 9 aa, Homo Sapiens
TIFCSSEIS

SEQ ID NO: 507151 - protein, 9 aa, Homo Sapiens
KLYEEHDMF

SEQ ID NO: 507152 - protein, 9 aa, Homo Sapiens
QVLGPVAAS

SEQ ID NO: 507153 - protein, 9 aa, Homo Sapiens
MGGHSFQHS

SEQ ID NO: 507154 - protein, 9 aa, Homo Sapiens
EWSNWSCCS

SEQ ID NO: 507155 - protein, 9 aa, Homo Sapiens
PLLGASLGG

SEQ ID NO: 507156 - protein, 9 aa, Homo Sapiens
EGCSHNSSY

SEQ ID NO: 507157 - protein, 9 aa, Homo Sapiens
IAPQFLKSK

SEQ ID NO: 507158 - protein, 9 aa, Homo Sapiens
IVEKWRGSE

SEQ ID NO: 507159 - protein, 9 aa, Homo Sapiens
CISYGRQAP

SEQ ID NO: 507160 - protein, 9 aa, Homo Sapiens
TSAILASFK

SEQ ID NO: 507161 - protein, 9 aa, Homo Sapiens
ERERARARR

SEQ ID NO: 507162 - protein, 9 aa, Homo Sapiens
DAPAPPKAE

SEQ ID NO: 507163 - protein, 9 aa, Homo Sapiens
PGSSFQTKS

SEQ ID NO: 507164 - protein, 9 aa, Homo Sapiens
HQIVCQWKY

SEQ ID NO: 507165 - protein, 9 aa, Homo Sapiens
ADHAPLQQS

SEQ ID NO: 507166 - protein, 9 aa, Homo Sapiens
KKIHAGEKP

SEQ ID NO: 507167 - protein, 9 aa, Homo Sapiens
KNHSADFDP

SEQ ID NO: 507168 - protein, 9 aa, Homo Sapiens
AALAINSSP

SEQ ID NO: 507169 - protein, 9 aa, Homo Sapiens
DEKDARCFQ

SEQ ID NO: 507170 - protein, 9 aa, Homo Sapiens
NSLGPSISK

SEQ ID NO: 507171 - protein, 9 aa, Homo Sapiens
LYPDVDPEH

SEQ ID NO: 507172 - protein, 9 aa, Homo Sapiens
HGGNLKTRE

SEQ ID NO: 507173 - protein, 9 aa, Homo Sapiens
LLGASLGGI

SEQ ID NO: 507174 - protein, 9 aa, Homo Sapiens
LISGICAAG

SEQ ID NO: 507175 - protein, 9 aa, Homo Sapiens
ELRTPSEKI

SEQ ID NO: 507176 - protein, 9 aa, Homo Sapiens
WQKAELGRF

SEQ ID NO: 507177 - protein, 9 aa, Homo Sapiens
YRIIDCDGT

SEQ ID NO: 507178 - protein, 9 aa, Homo Sapiens
RKKFKENYA

SEQ ID NO: 507179 - protein, 9 aa, Homo Sapiens
GCLHDSVLS

SEQ ID NO: 507180 - protein, 9 aa, Homo Sapiens
VTALQLMEQ

SEQ ID NO: 507181 - protein, 9 aa, Homo Sapiens
IPKNNPRGA

SEQ ID NO: 507182 - protein, 9 aa, Homo Sapiens
PKAKDAPAP

SEQ ID NO: 507183 - protein, 9 aa, Homo Sapiens
GKDKELYNI

SEQ ID NO: 507184 - protein, 9 aa, Homo Sapiens
AENNILDTD

SEQ ID NO: 507185 - protein, 9 aa, Homo Sapiens
NVLPPSTEG

SEQ ID NO: 507186 - protein, 9 aa, Homo Sapiens
HYREQLIAR

SEQ ID NO: 507187 - protein, 9 aa, Homo Sapiens
TCRTCRHQL

SEQ ID NO: 507188 - protein, 9 aa, Homo Sapiens
HQLAGQSFY

SEQ ID NO: 507189 - protein, 9 aa, Homo Sapiens
TEKLYEEHD

SEQ ID NO: 507190 - protein, 9 aa, Homo Sapiens
MEAFWQKAE

SEQ ID NO: 507191 - protein, 9 aa, Homo Sapiens
ARFDKVVSQ

SEQ ID NO: 507192 - protein, 9 aa, Homo Sapiens
FVPRNLLLL

SEQ ID NO: 507193 - protein, 9 aa, Homo Sapiens
IKKFGGPNK

SEQ ID NO: 507194 - protein, 9 aa, Homo Sapiens
SDSGCLHDS

SEQ ID NO: 507195 - protein, 9 aa, Homo Sapiens
LLLTDYISK

SEQ ID NO: 507196 - protein, 9 aa, Homo Sapiens
KELDREVYL

SEQ ID NO: 507197 - protein, 9 aa, Homo Sapiens
FQTKSNLFE

SEQ ID NO: 507198 - protein, 9 aa, Homo Sapiens
TTSAILASF

SEQ ID NO: 507199 - protein, 9 aa, Homo Sapiens
EYVPLVEEE

SEQ ID NO: 507200 - protein, 9 aa, Homo Sapiens
VEEELKIGQ

SEQ ID NO: 507201 - protein, 9 aa, Homo Sapiens
FDKVVSQGL

SEQ ID NO: 507202 - protein, 9 aa, Homo Sapiens
STSSAENNI

SEQ ID NO: 507203 - protein, 9 aa, Homo Sapiens
LSQTCFRQW

SEQ ID NO: 507204 - protein, 9 aa, Homo Sapiens
CCKHDGRPR

SEQ ID NO: 507205 - protein, 9 aa, Homo Sapiens
HPYDMGGHS

SEQ ID NO: 507206 - protein, 9 aa, Homo Sapiens
SEWSNWSCC

SEQ ID NO: 507207 - protein, 9 aa, Homo Sapiens
VLFDSELSR

SEQ ID NO: 507208 - protein, 9 aa, Homo Sapiens
GHSFQHSVD

SEQ ID NO: 507209 - protein, 9 aa, Homo Sapiens
PRNLLLLLH

SEQ ID NO: 507210 - protein, 9 aa, Homo Sapiens
ILDTDDHFK

SEQ ID NO: 507211 - protein, 9 aa, Homo Sapiens
GSKMRQISL

SEQ ID NO: 507212 - protein, 9 aa, Homo Sapiens
LSEWSNWSC

SEQ ID NO: 507213 - protein, 9 aa, Homo Sapiens
GVVLNIGTV

SEQ ID NO: 507214 - protein, 9 aa, Homo Sapiens
YASNIDGFL

SEQ ID NO: 507215 - protein, 9 aa, Homo Sapiens
AGVACVEEP

SEQ ID NO: 507216 - protein, 9 aa, Homo Sapiens
ISGWEPLLV

SEQ ID NO: 507217 - protein, 9 aa, Homo Sapiens
ALCMSLLGL

SEQ ID NO: 507218 - protein, 9 aa, Homo Sapiens
GCLITEECR

SEQ ID NO: 507219 - protein, 9 aa, Homo Sapiens
GAAALPACC

SEQ ID NO: 507220 - protein, 9 aa, Homo Sapiens
DSLSCAQHQ

SEQ ID NO: 507221 - protein, 9 aa, Homo Sapiens
SNDIAPQFL

SEQ ID NO: 507222 - protein, 9 aa, Homo Sapiens
NPWCQVILL

SEQ ID NO: 507223 - protein, 9 aa, Homo Sapiens
LAKNHSADF

SEQ ID NO: 507224 - protein, 9 aa, Homo Sapiens
PSSDSGCLH

SEQ ID NO: 507225 - protein, 9 aa, Homo Sapiens
GKPSDYCIV

SEQ ID NO: 507226 - protein, 9 aa, Homo Sapiens
RQGAKVPYG

SEQ ID NO: 507227 - protein, 9 aa, Homo Sapiens
ISGICAAGS

SEQ ID NO: 507228 - protein, 9 aa, Homo Sapiens
LLRNTSAWS

SEQ ID NO: 507229 - protein, 9 aa, Homo Sapiens
ILNSYAGVA

SEQ ID NO: 507230 - protein, 9 aa, Homo Sapiens
ARCFQLKIA

SEQ ID NO: 507231 - protein, 9 aa, Homo Sapiens
ASFKEQELQ

SEQ ID NO: 507232 - protein, 9 aa, Homo Sapiens
LFDSELSRT

SEQ ID NO: 507233 - protein, 9 aa, Homo Sapiens
RLSQTCFRQ

SEQ ID NO: 507234 - protein, 9 aa, Homo Sapiens
FLPGSSFQT

SEQ ID NO: 507235 - protein, 9 aa, Homo Sapiens
NLKTREPTN

SEQ ID NO: 507236 - protein, 9 aa, Homo Sapiens
LRTPSEKIW

SEQ ID NO: 507237 - protein, 9 aa, Homo Sapiens
APLQQSFVV

SEQ ID NO: 507238 - protein, 9 aa, Homo Sapiens
DIKKFGGPN

SEQ ID NO: 507239 - protein, 9 aa, Homo Sapiens
EALVQRFRK

SEQ ID NO: 507240 - protein, 9 aa, Homo Sapiens
PPSTEGDIG

SEQ ID NO: 507241 - protein, 9 aa, Homo Sapiens
CQWKYKDDD

SEQ ID NO: 507242 - protein, 9 aa, Homo Sapiens
YLRQAKPRK

SEQ ID NO: 507243 - protein, 9 aa, Homo Sapiens
DSYSAYIPK

SEQ ID NO: 507244 - protein, 9 aa, Homo Sapiens
FQNQKVIVD

SEQ ID NO: 507245 - protein, 9 aa, Homo Sapiens
GTSLVNPVP

SEQ ID NO: 507246 - protein, 9 aa, Homo Sapiens
EHKKIHAGE

SEQ ID NO: 507247 - protein, 9 aa, Homo Sapiens
YRPHCYICF

SEQ ID NO: 507248 - protein, 9 aa, Homo Sapiens
DSNDIAPQF

SEQ ID NO: 507249 - protein, 9 aa, Homo Sapiens
QNQKVIVDT

SEQ ID NO: 507250 - protein, 9 aa, Homo Sapiens
SPQSSMRTR

SEQ ID NO: 507251 - protein, 9 aa, Homo Sapiens
AKNHSADFD

SEQ ID NO: 507252 - protein, 9 aa, Homo Sapiens
APKAKDAPA

SEQ ID NO: 507253 - protein, 9 aa, Homo Sapiens
KLTIFCSSE

SEQ ID NO: 507254 - protein, 9 aa, Homo Sapiens
PCQHLLSLT

SEQ ID NO: 507255 - protein, 9 aa, Homo Sapiens
VGDEAQSKL

SEQ ID NO: 507256 - protein, 9 aa, Homo Sapiens
ATNPAKPLL

SEQ ID NO: 507257 - protein, 9 aa, Homo Sapiens
LERERARAR

SEQ ID NO: 507258 - protein, 9 aa, Homo Sapiens
PPPGTSLVN

SEQ ID NO: 507259 - protein, 9 aa, Homo Sapiens
VLNIGTVDI

SEQ ID NO: 507260 - protein, 9 aa, Homo Sapiens
EDLQLPSTS

SEQ ID NO: 507261 - protein, 9 aa, Homo Sapiens
YISKEDSCW

SEQ ID NO: 507262 - protein, 9 aa, Homo Sapiens
QGLWLAKPS

SEQ ID NO: 507263 - protein, 9 aa, Homo Sapiens
LTIFCSSEI

SEQ ID NO: 507264 - protein, 9 aa, Homo Sapiens
DHYREQLIA

SEQ ID NO: 507265 - protein, 9 aa, Homo Sapiens
NFNSLGPSI

SEQ ID NO: 507266 - protein, 9 aa, Homo Sapiens
AAEDLQLPS

SEQ ID NO: 507267 - protein, 9 aa, Homo Sapiens
GNLKTREPT

SEQ ID NO: 507268 - protein, 9 aa, Homo Sapiens
NIVDSNDIA

SEQ ID NO: 507269 - protein, 9 aa, Homo Sapiens
RHTCVSFFP

SEQ ID NO: 507270 - protein, 9 aa, Homo Sapiens
KSQCVLGSF

SEQ ID NO: 507271 - protein, 9 aa, Homo Sapiens
YVIYRVNIP

SEQ ID NO: 507272 - protein, 9 aa, Homo Sapiens
RFRKVKQHT

SEQ ID NO: 507273 - protein, 9 aa, Homo Sapiens
PWCQVILLP

SEQ ID NO: 507274 - protein, 9 aa, Homo Sapiens
DSALCMSLL

SEQ ID NO: 507275 - protein, 9 aa, Homo Sapiens
GKIGVVLNI

SEQ ID NO: 507276 - protein, 9 aa, Homo Sapiens
YPFHQFHDS

SEQ ID NO: 507277 - protein, 9 aa, Homo Sapiens
LSEITKQEK

SEQ ID NO: 507278 - protein, 9 aa, Homo Sapiens
KFWYLRQAK

SEQ ID NO: 507279 - protein, 9 aa, Homo Sapiens
HMLCISYGR

SEQ ID NO: 507280 - protein, 9 aa, Homo Sapiens
EELKIGQHK

SEQ ID NO: 507281 - protein, 9 aa, Homo Sapiens
LWYNLTVEA

SEQ ID NO: 507282 - protein, 9 aa, Homo Sapiens
EMLLLTDYI

SEQ ID NO: 507283 - protein, 9 aa, Homo Sapiens
AELKFWYLR

SEQ ID NO: 507284 - protein, 9 aa, Homo Sapiens
EKSPQTQSC

SEQ ID NO: 507285 - protein, 9 aa, Homo Sapiens
LKTREPTNT

SEQ ID NO: 507286 - protein, 9 aa, Homo Sapiens
AQEEVLFDS

SEQ ID NO: 507287 - protein, 9 aa, Homo Sapiens
FFPEPISPE

SEQ ID NO: 507288 - protein, 9 aa, Homo Sapiens
AILASFKEQ

SEQ ID NO: 507289 - protein, 9 aa, Homo Sapiens
LSHSAKSYA

SEQ ID NO: 507290 - protein, 9 aa, Homo Sapiens
ELYNIKRGE

SEQ ID NO: 507291 - protein, 9 aa, Homo Sapiens
SHGGNLKTR

SEQ ID NO: 507292 - protein, 9 aa, Homo Sapiens
HKKIHAGEK

SEQ ID NO: 507293 - protein, 9 aa, Homo Sapiens
DHAPLQQSF

SEQ ID NO: 507294 - protein, 9 aa, Homo Sapiens
LPQGLWLAK

SEQ ID NO: 507295 - protein, 9 aa, Homo Sapiens
NSYAGVACV

SEQ ID NO: 507296 - protein, 9 aa, Homo Sapiens
ASLGGIIYL

SEQ ID NO: 507297 - protein, 9 aa, Homo Sapiens
ENNILDTDD

SEQ ID NO: 507298 - protein, 9 aa, Homo Sapiens
CMSLLGLNQ

SEQ ID NO: 507299 - protein, 9 aa, Homo Sapiens
YAGVACVEE

SEQ ID NO: 507300 - protein, 9 aa, Homo Sapiens
CQVILLPQP

SEQ ID NO: 507301 - protein, 9 aa, Homo Sapiens
SAWSVMLDR

SEQ ID NO: 507302 - protein, 9 aa, Homo Sapiens
APLLGASLG

SEQ ID NO: 507303 - protein, 9 aa, Homo Sapiens
SAYIPKNNP

SEQ ID NO: 507304 - protein, 9 aa, Homo Sapiens
QSSMRTRSP

SEQ ID NO: 507305 - protein, 9 aa, Homo Sapiens
CWQHGAGVR

SEQ ID NO: 507306 - protein, 9 aa, Homo Sapiens
FSDSLSCAQ

SEQ ID NO: 507307 - protein, 9 aa, Homo Sapiens
VIVDTLITK

SEQ ID NO: 507308 - protein, 9 aa, Homo Sapiens
ACCKHDGRP

SEQ ID NO: 507309 - protein, 9 aa, Homo Sapiens
HEEICENLS

SEQ ID NO: 507310 - protein, 9 aa, Homo Sapiens
RIIDCDGTD

SEQ ID NO: 507311 - protein, 9 aa, Homo Sapiens
SAENNILDT

SEQ ID NO: 507312 - protein, 9 aa, Homo Sapiens
CVSFFPEPI

SEQ ID NO: 507313 - protein, 9 aa, Homo Sapiens
FWQKAELGR

SEQ ID NO: 507314 - protein, 9 aa, Homo Sapiens
LASFKEQEL

SEQ ID NO: 507315 - protein, 9 aa, Homo Sapiens
PLQQSFVVM

SEQ ID NO: 507316 - protein, 9 aa, Homo Sapiens
LYNIKRGES

SEQ ID NO: 507317 - protein, 9 aa, Homo Sapiens
SKKGSKMRQ

SEQ ID NO: 507318 - protein, 9 aa, Homo Sapiens
EAFWQKAEL

SEQ ID NO: 507319 - protein, 9 aa, Homo Sapiens
TALQLMEQN

SEQ ID NO: 507320 - protein, 9 aa, Homo Sapiens
QASGSPPVK

SEQ ID NO: 507321 - protein, 9 aa, Homo Sapiens
SAILASFKE

SEQ ID NO: 507322 - protein, 9 aa, Homo Sapiens
QIVCQWKYK

SEQ ID NO: 507323 - protein, 9 aa, Homo Sapiens
QRLSQTCFR

SEQ ID NO: 507324 - protein, 9 aa, Homo Sapiens
QSFVVMEHC

SEQ ID NO: 507325 - protein, 9 aa, Homo Sapiens
QLLAQRLSQ

SEQ ID NO: 507326 - protein, 9 aa, Homo Sapiens
SHMLCISYG

SEQ ID NO: 507327 - protein, 9 aa, Homo Sapiens
KQEKDFLWS

SEQ ID NO: 507328 - protein, 9 aa, Homo Sapiens
SYAGVACVE

SEQ ID NO: 507329 - protein, 9 aa, Homo Sapiens
ELKDAATNP

SEQ ID NO: 507330 - protein, 9 aa, Homo Sapiens
EVLFDSELS

SEQ ID NO: 507331 - protein, 9 aa, Homo Sapiens
TEHWMRQEA

SEQ ID NO: 507332 - protein, 9 aa, Homo Sapiens
DHTKLIISG

SEQ ID NO: 507333 - protein, 9 aa, Homo Sapiens
KAKDAPAPP

SEQ ID NO: 507334 - protein, 9 aa, Homo Sapiens
YVPLVEEEL

SEQ ID NO: 507335 - protein, 9 aa, Homo Sapiens
LGVLLGRQR

SEQ ID NO: 507336 - protein, 9 aa, Homo Sapiens
MAAALAINS

SEQ ID NO: 507337 - protein, 9 aa, Homo Sapiens
HFVDHYREQ

SEQ ID NO: 507338 - protein, 9 aa, Homo Sapiens
AVAFFVPRN

SEQ ID NO: 507339 - protein, 9 aa, Homo Sapiens
GASSPVQVL

SEQ ID NO: 507340 - protein, 9 aa, Homo Sapiens
INKVFKELR

SEQ ID NO: 507341 - protein, 9 aa, Homo Sapiens
TKQEKDFLW

SEQ ID NO: 507342 - protein, 9 aa, Homo Sapiens
DILNSYAGV

SEQ ID NO: 507343 - protein, 9 aa, Homo Sapiens
PACCKHDGR

SEQ ID NO: 507344 - protein, 9 aa, Homo Sapiens
KPGLPQGLW

SEQ ID NO: 507345 - protein, 9 aa, Homo Sapiens
CRHQLAGQS

SEQ ID NO: 507346 - protein, 9 aa, Homo Sapiens
GVYSYPSIT

SEQ ID NO: 507347 - protein, 9 aa, Homo Sapiens
VAPLLGASL

SEQ ID NO: 507348 - protein, 9 aa, Homo Sapiens
YSNFNSLGP

SEQ ID NO: 507349 - protein, 9 aa, Homo Sapiens
YRVNIPLPP

SEQ ID NO: 507350 - protein, 9 aa, Homo Sapiens
IVDTLITKL

SEQ ID NO: 507351 - protein, 9 aa, Homo Sapiens
WYLRQAKPR

SEQ ID NO: 507352 - protein, 9 aa, Homo Sapiens
RPCQHLLSL

SEQ ID NO: 507353 - protein, 9 aa, Homo Sapiens
TDYISKEDS

SEQ ID NO: 507354 - protein, 9 aa, Homo Sapiens
LQASGSPPV

SEQ ID NO: 507355 - protein, 9 aa, Homo Sapiens
AYIPKNNPR

SEQ ID NO: 507356 - protein, 9 aa, Homo Sapiens
GLYPDVDPE

SEQ ID NO: 507357 - protein, 9 aa, Homo Sapiens
QEEVLFDSE

SEQ ID NO: 507358 - protein, 9 aa, Homo Sapiens
GEKLTIFCS

SEQ ID NO: 507359 - protein, 9 aa, Homo Sapiens
NPTLGVLLG

SEQ ID NO: 507360 - protein, 9 aa, Homo Sapiens
LNIGTVDIS

SEQ ID NO: 507361 - protein, 9 aa, Homo Sapiens
YSPRVLISG

SEQ ID NO: 507362 - protein, 9 aa, Homo Sapiens
ASGSPPVKS

SEQ ID NO: 507363 - protein, 9 aa, Homo Sapiens
SPVQVLGPV

SEQ ID NO: 507364 - protein, 9 aa, Homo Sapiens
EKLTIFCSS

SEQ ID NO: 507365 - protein, 9 aa, Homo Sapiens
VIYRVNIPL

SEQ ID NO: 507366 - protein, 9 aa, Homo Sapiens
KSNHLAKNH

SEQ ID NO: 507367 - protein, 9 aa, Homo Sapiens
LPGSSFQTK

SEQ ID NO: 507368 - protein, 9 aa, Homo Sapiens
QQSFVVMEH

SEQ ID NO: 507369 - protein, 9 aa, Homo Sapiens
DYCIVEKWR

SEQ ID NO: 507370 - protein, 9 aa, Homo Sapiens
LDDNVFMPL

SEQ ID NO: 507371 - protein, 9 aa, Homo Sapiens
VDPEHVGAF

SEQ ID NO: 507372 - protein, 9 aa, Homo Sapiens
SLLGLNQVG

SEQ ID NO: 507373 - protein, 9 aa, Homo Sapiens
RVLISGICA

SEQ ID NO: 507374 - protein, 9 aa, Homo Sapiens
LPYSPRVLI

SEQ ID NO: 507375 - protein, 9 aa, Homo Sapiens
RTPSEKIWP

SEQ ID NO: 507376 - protein, 9 aa, Homo Sapiens
YEMLLLTDY

SEQ ID NO: 507377 - protein, 9 aa, Homo Sapiens
YGDHTKLII

SEQ ID NO: 507378 - protein, 9 aa, Homo Sapiens
NYASNIDGF

SEQ ID NO: 507379 - protein, 9 aa, Homo Sapiens
RNTSAWSVM

SEQ ID NO: 507380 - protein, 9 aa, Homo Sapiens
AATNPAKPL

SEQ ID NO: 507381 - protein, 9 aa, Homo Sapiens
SKLGILTLK

SEQ ID NO: 507382 - protein, 9 aa, Homo Sapiens
CRTCRHQLA

SEQ ID NO: 507383 - protein, 9 aa, Homo Sapiens
DLQLPSTSF

SEQ ID NO: 507384 - protein, 9 aa, Homo Sapiens
CDHEEICEN

SEQ ID NO: 507385 - protein, 9 aa, Homo Sapiens
ALQLMEQNP

SEQ ID NO: 507386 - protein, 9 aa, Homo Sapiens
PRLFLNPWC

SEQ ID NO: 507387 - protein, 9 aa, Homo Sapiens
NNILDTDDH

SEQ ID NO: 507388 - protein, 9 aa, Homo Sapiens
KVTVGPRTS

SEQ ID NO: 507389 - protein, 9 aa, Homo Sapiens
GHCDFCRDI

SEQ ID NO: 507390 - protein, 9 aa, Homo Sapiens
QPADSASSS

SEQ ID NO: 507391 - protein, 9 aa, Homo Sapiens
RHQLAGQSF

SEQ ID NO: 507392 - protein, 9 aa, Homo Sapiens
TSSAENNIL

SEQ ID NO: 507393 - protein, 9 aa, Homo Sapiens
LAQRLSQTC

SEQ ID NO: 507394 - protein, 9 aa, Homo Sapiens
HCYICFTPR

SEQ ID NO: 507395 - protein, 9 aa, Homo Sapiens
SQTCFRQWR

SEQ ID NO: 507396 - protein, 9 aa, Homo Sapiens
SDYCIVEKW

SEQ ID NO: 507397 - protein, 9 aa, Homo Sapiens
PSTEGDIGI

SEQ ID NO: 507398 - protein, 9 aa, Homo Sapiens
RTLDDNVFM

SEQ ID NO: 507399 - protein, 9 aa, Homo Sapiens
NILDTDDHF

SEQ ID NO: 507400 - protein, 9 aa, Homo Sapiens
KVVSQGLLG

SEQ ID NO: 507401 - protein, 9 aa, Homo Sapiens
CRDIKKFGG

SEQ ID NO: 507402 - protein, 9 aa, Homo Sapiens
PVKSPTDPK

SEQ ID NO: 507403 - protein, 9 aa, Homo Sapiens
GASLGGIIY

SEQ ID NO: 507404 - protein, 9 aa, Homo Sapiens
FFVPRNLLL

SEQ ID NO: 507405 - protein, 9 aa, Homo Sapiens
AKVPYGIVP

SEQ ID NO: 507406 - protein, 9 aa, Homo Sapiens
LGLNQVGCA

SEQ ID NO: 507407 - protein, 9 aa, Homo Sapiens
LLTDYISKE

SEQ ID NO: 507408 - protein, 9 aa, Homo Sapiens
ALPACCKHD

SEQ ID NO: 507409 - protein, 9 aa, Homo Sapiens
AINSSPSVR

SEQ ID NO: 507410 - protein, 9 aa, Homo Sapiens
KDAPAPPKA

SEQ ID NO: 507411 - protein, 9 aa, Homo Sapiens
IGPGVGPDS

SEQ ID NO: 507412 - protein, 9 aa, Homo Sapiens
SSAENNILD

SEQ ID NO: 507413 - protein, 9 aa, Homo Sapiens
AWSVMLDRA

SEQ ID NO: 507414 - protein, 9 aa, Homo Sapiens
KRKKFKENY

SEQ ID NO: 507415 - protein, 9 aa, Homo Sapiens
DKELYNIKR

SEQ ID NO: 507416 - protein, 9 aa, Homo Sapiens
LVEEELKIG

SEQ ID NO: 507417 - protein, 9 aa, Homo Sapiens
IDCDGTDMF

SEQ ID NO: 507418 - protein, 9 aa, Homo Sapiens
KTREPTNTL

SEQ ID NO: 507419 - protein, 9 aa, Homo Sapiens
FNSLGPSIS

SEQ ID NO: 507420 - protein, 9 aa, Homo Sapiens
SLGGIIYLV

SEQ ID NO: 507421 - protein, 9 aa, Homo Sapiens
DNVFMPLYP

SEQ ID NO: 507422 - protein, 9 aa, Homo Sapiens
EEVLFDSEL

SEQ ID NO: 507423 - protein, 9 aa, Homo Sapiens
INIVDSNDI

SEQ ID NO: 507424 - protein, 9 aa, Homo Sapiens
ELKFWYLRQ

SEQ ID NO: 507425 - protein, 9 aa, Homo Sapiens
CTEKLYEEH

SEQ ID NO: 507426 - protein, 9 aa, Homo Sapiens
SPPPGTSLV

SEQ ID NO: 507427 - protein, 9 aa, Homo Sapiens
GPDSEVWGI

SEQ ID NO: 507428 - protein, 9 aa, Homo Sapiens
LRNTSAWSV

SEQ ID NO: 507429 - protein, 9 aa, Homo Sapiens
FCRDIKKFG

SEQ ID NO: 507430 - protein, 9 aa, Homo Sapiens
VSVVQEGCS

SEQ ID NO: 507431 - protein, 9 aa, Homo Sapiens
LQQSFVVME

SEQ ID NO: 507432 - protein, 9 aa, Homo Sapiens
DKGKDKELY

SEQ ID NO: 507433 - protein, 9 aa, Homo Sapiens
KNNPRGASI

SEQ ID NO: 507434 - protein, 9 aa, Homo Sapiens
RKQMEAFWQ

SEQ ID NO: 507435 - protein, 9 aa, Homo Sapiens
VFKELRTPS

SEQ ID NO: 507436 - protein, 9 aa, Homo Sapiens
EERKVTVGP

SEQ ID NO: 507437 - protein, 9 aa, Homo Sapiens
RVNIPLPPT

SEQ ID NO: 507438 - protein, 9 aa, Homo Sapiens
FLNPWCQVI

SEQ ID NO: 507439 - protein, 9 aa, Homo Sapiens
SKCWQHGAG

SEQ ID NO: 507440 - protein, 9 aa, Homo Sapiens
EITKQEKDF

SEQ ID NO: 507441 - protein, 9 aa, Homo Sapiens
VEYRIIDCD

SEQ ID NO: 507442 - protein, 9 aa, Homo Sapiens
SSSLTEHKK

SEQ ID NO: 507443 - protein, 9 aa, Homo Sapiens
ECRGEGGIL

SEQ ID NO: 507444 - protein, 9 aa, Homo Sapiens
PTLGVLLGR

SEQ ID NO: 507445 - protein, 9 aa, Homo Sapiens
ELKIGQHKP

SEQ ID NO: 507446 - protein, 9 aa, Homo Sapiens
QNPEFIFAC

SEQ ID NO: 507447 - protein, 9 aa, Homo Sapiens
EEICENLSL

SEQ ID NO: 507448 - protein, 9 aa, Homo Sapiens
LVQRFRKVK

SEQ ID NO: 507449 - protein, 9 aa, Homo Sapiens
SFVVMEHCL

SEQ ID NO: 507450 - protein, 9 aa, Homo Sapiens
TLGVLLGRQ

SEQ ID NO: 507451 - protein, 9 aa, Homo Sapiens
ELLSKCWQH

SEQ ID NO: 507452 - protein, 9 aa, Homo Sapiens
KVPYGIVPK

SEQ ID NO: 507453 - protein, 9 aa, Homo Sapiens
AKDAPAPPK

SEQ ID NO: 507454 - protein, 9 aa, Homo Sapiens
VFLPGSSFQ

SEQ ID NO: 507455 - protein, 9 aa, Homo Sapiens
NVTYRPHCY

SEQ ID NO: 507456 - protein, 9 aa, Homo Sapiens
SLVNPVPSP

SEQ ID NO: 507457 - protein, 9 aa, Homo Sapiens
KSYAGLVGG

SEQ ID NO: 507458 - protein, 9 aa, Homo Sapiens
SSFQTKSNL

SEQ ID NO: 507459 - protein, 9 aa, Homo Sapiens
SNFNSLGPS

SEQ ID NO: 507460 - protein, 9 aa, Homo Sapiens
DSGCLHDSV

SEQ ID NO: 507461 - protein, 9 aa, Homo Sapiens
LDEKDARCF

SEQ ID NO: 507462 - protein, 9 aa, Homo Sapiens
DFCRDIKKF

SEQ ID NO: 507463 - protein, 9 aa, Homo Sapiens
ISMAAALAI

SEQ ID NO: 507464 - protein, 9 aa, Homo Sapiens
GGAAALPAC

SEQ ID NO: 507465 - protein, 9 aa, Homo Sapiens
VNPVPSPSP

SEQ ID NO: 507466 - protein, 9 aa, Homo Sapiens
QLDEKDARC

SEQ ID NO: 507467 - protein, 9 aa, Homo Sapiens
KGSKMRQIS

SEQ ID NO: 507468 - protein, 9 aa, Homo Sapiens
RTCRHQLAG

SEQ ID NO: 507469 - protein, 9 aa, Homo Sapiens
QGAKVPYGI

SEQ ID NO: 507470 - protein, 9 aa, Homo Sapiens
WSNWSCCSK

SEQ ID NO: 507471 - protein, 9 aa, Homo Sapiens
VLLGRQRLL

SEQ ID NO: 507472 - protein, 9 aa, Homo Sapiens
SPRVLISGI

SEQ ID NO: 507473 - protein, 9 aa, Homo Sapiens
ERARARRKL

SEQ ID NO: 507474 - protein, 9 aa, Homo Sapiens
QPSHGGNLK

SEQ ID NO: 507475 - protein, 9 aa, Homo Sapiens
GAGCLITEE

SEQ ID NO: 507476 - protein, 9 aa, Homo Sapiens
EHWMRQEAQ

SEQ ID NO: 507477 - protein, 9 aa, Homo Sapiens
KENYASNID

SEQ ID NO: 507478 - protein, 9 aa, Homo Sapiens
EQGKIGVVL

SEQ ID NO: 507479 - protein, 9 aa, Homo Sapiens
ARRNPTLGV

SEQ ID NO: 507480 - protein, 9 aa, Homo Sapiens
ITKQEKDFL

SEQ ID NO: 507481 - protein, 9 aa, Homo Sapiens
SDSLSCAQH

SEQ ID NO: 507482 - protein, 9 aa, Homo Sapiens
KDAATNPAK

SEQ ID NO: 507483 - protein, 9 aa, Homo Sapiens
MRQEAQGAR

SEQ ID NO: 507484 - protein, 9 aa, Homo Sapiens
AFQNQKVIV

SEQ ID NO: 507485 - protein, 9 aa, Homo Sapiens
LTEHKKIHA

SEQ ID NO: 507486 - protein, 9 aa, Homo Sapiens
RNLLLLLHY

SEQ ID NO: 507487 - protein, 9 aa, Homo Sapiens
FHQFHDSHR

SEQ ID NO: 507488 - protein, 9 aa, Homo Sapiens
YDMGGHSFQ

SEQ ID NO: 507489 - protein, 9 aa, Homo Sapiens
HRARFDKVV

SEQ ID NO: 507490 - protein, 9 aa, Homo Sapiens
PADSASSSP

SEQ ID NO: 507491 - protein, 9 aa, Homo Sapiens
RRNPTLGVL

SEQ ID NO: 507492 - protein, 9 aa, Homo Sapiens
PCDHEEICE

SEQ ID NO: 507493 - protein, 9 aa, Homo Sapiens
CMPYPFHQF

SEQ ID NO: 507494 - protein, 9 aa, Homo Sapiens
GGNLKTREP

SEQ ID NO: 507495 - protein, 9 aa, Homo Sapiens
TVGPRTSAR

SEQ ID NO: 507496 - protein, 9 aa, Homo Sapiens
SGCLHDSVL

SEQ ID NO: 507497 - protein, 9 aa, Homo Sapiens
RPHCYICFT

SEQ ID NO: 507498 - protein, 9 aa, Homo Sapiens
NTSAWSVML

SEQ ID NO: 507499 - protein, 9 aa, Homo Sapiens
AFFVPRNLL

SEQ ID NO: 507500 - protein, 9 aa, Homo Sapiens
DDNVFMPLY

SEQ ID NO: 507501 - protein, 9 aa, Homo Sapiens
HTKLIISGW

SEQ ID NO: 507502 - protein, 9 aa, Homo Sapiens
ALAINSSPS

SEQ ID NO: 507503 - protein, 9 aa, Homo Sapiens
QLLHFVDHY

SEQ ID NO: 507504 - protein, 9 aa, Homo Sapiens
YEELLSKCW

SEQ ID NO: 507505 - protein, 9 aa, Homo Sapiens
WSCCSKSCG

SEQ ID NO: 507506 - protein, 9 aa, Homo Sapiens
SALCMSLLG

SEQ ID NO: 507507 - protein, 9 aa, Homo Sapiens
VDHYREQLI

SEQ ID NO: 507508 - protein, 9 aa, Homo Sapiens
NYSNFNSLG

SEQ ID NO: 507509 - protein, 9 aa, Homo Sapiens
PGLPQGLWL

SEQ ID NO: 507510 - protein, 9 aa, Homo Sapiens
ICENLSLKN

SEQ ID NO: 507511 - protein, 9 aa, Homo Sapiens
KGNVLPPST

SEQ ID NO: 507512 - protein, 9 aa, Homo Sapiens
AALPACCKH

SEQ ID NO: 507513 - protein, 9 aa, Homo Sapiens
EELLSKCWQ

SEQ ID NO: 507514 - protein, 9 aa, Homo Sapiens
GLRKPGLPQ

SEQ ID NO: 507515 - protein, 9 aa, Homo Sapiens
EPSSPQSSM

SEQ ID NO: 507516 - protein, 9 aa, Homo Sapiens
KCWQHGAGV

SEQ ID NO: 507517 - protein, 9 aa, Homo Sapiens
KDARCFQLK

SEQ ID NO: 507518 - protein, 9 aa, Homo Sapiens
GAMRKSQCV

SEQ ID NO: 507519 - protein, 9 aa, Homo Sapiens
AEDLQLPST

SEQ ID NO: 507520 - protein, 9 aa, Homo Sapiens
MWENYSNFN

SEQ ID NO: 507521 - protein, 9 aa, Homo Sapiens
PDVDPEHVG

SEQ ID NO: 507522 - protein, 9 aa, Homo Sapiens
SRHTCVSFF

SEQ ID NO: 507523 - protein, 9 aa, Homo Sapiens
QLMEQNPEF

SEQ ID NO: 507524 - protein, 9 aa, Homo Sapiens
DMGGHSFQH

SEQ ID NO: 507525 - protein, 9 aa, Homo Sapiens
CSHNSSYIQ

SEQ ID NO: 507526 - protein, 9 aa, Homo Sapiens
HAPLQQSFV

SEQ ID NO: 507527 - protein, 9 aa, Homo Sapiens
HWMRQEAQG

SEQ ID NO: 507528 - protein, 9 aa, Homo Sapiens
NKVFKELRT

SEQ ID NO: 507529 - protein, 9 aa, Homo Sapiens
STEGDIGIR

SEQ ID NO: 507530 - protein, 9 aa, Homo Sapiens
RMRRTLDDN

SEQ ID NO: 507531 - protein, 9 aa, Homo Sapiens
VNIPLPPTS

SEQ ID NO: 507532 - protein, 9 aa, Homo Sapiens
VLPPSTEGD

SEQ ID NO: 507533 - protein, 9 aa, Homo Sapiens
NDIAPQFLK

SEQ ID NO: 507534 - protein, 9 aa, Homo Sapiens
AMSHMLCIS

SEQ ID NO: 507535 - protein, 9 aa, Homo Sapiens
SAQEEVLFD

SEQ ID NO: 507536 - protein, 9 aa, Homo Sapiens
ARARRKLLE

SEQ ID NO: 507537 - protein, 9 aa, Homo Sapiens
QGKIGVVLN

SEQ ID NO: 507538 - protein, 9 aa, Homo Sapiens
TAPKAKDAP

SEQ ID NO: 507539 - protein, 9 aa, Homo Sapiens
PSITYSFVL

SEQ ID NO: 507540 - protein, 9 aa, Homo Sapiens
SAELKFWYL

SEQ ID NO: 507541 - protein, 9 aa, Homo Sapiens
NKGGRPCQH

SEQ ID NO: 507542 - protein, 9 aa, Homo Sapiens
RCFQLKIAE

SEQ ID NO: 507543 - protein, 9 aa, Homo Sapiens
SKMRQISLS

SEQ ID NO: 507544 - protein, 9 aa, Homo Sapiens
LITEECRGE

SEQ ID NO: 507545 - protein, 9 aa, Homo Sapiens
KHRARFDKV

SEQ ID NO: 507546 - protein, 9 aa, Homo Sapiens
PYGIVPKNL

SEQ ID NO: 507547 - protein, 9 aa, Homo Sapiens
EQNPEFIFA

SEQ ID NO: 507548 - protein, 9 aa, Homo Sapiens
INSSPSVRS

SEQ ID NO: 507549 - protein, 9 aa, Homo Sapiens
AQRLSQTCF

SEQ ID NO: 507550 - protein, 9 aa, Homo Sapiens
DREVYLWYN

SEQ ID NO: 507551 - protein, 9 aa, Homo Sapiens
TKLIISGWE

SEQ ID NO: 507552 - protein, 9 aa, Homo Sapiens
LGHGLYPDV

SEQ ID NO: 507553 - protein, 9 aa, Homo Sapiens
LQLPSTSFA

SEQ ID NO: 507554 - protein, 9 aa, Homo Sapiens
ITEECRGEG

SEQ ID NO: 507555 - protein, 9 aa, Homo Sapiens
YAGLVGGGE

SEQ ID NO: 507556 - protein, 9 aa, Homo Sapiens
LSKCWQHGA

SEQ ID NO: 507557 - protein, 9 aa, Homo Sapiens
SFQTKSNLF

SEQ ID NO: 507558 - protein, 9 aa, Homo Sapiens
GGRPCQHLL

SEQ ID NO: 507559 - protein, 9 aa, Homo Sapiens
VPYGIVPKN

SEQ ID NO: 507560 - protein, 9 aa, Homo Sapiens
VKSPTDPKA

SEQ ID NO: 507561 - protein, 9 aa, Homo Sapiens
MRLGEKLTI

SEQ ID NO: 507562 - protein, 9 aa, Homo Sapiens
DARCFQLKI

SEQ ID NO: 507563 - protein, 9 aa, Homo Sapiens
PYSPRVLIS

SEQ ID NO: 507564 - protein, 9 aa, Homo Sapiens
DPLSEITKQ

SEQ ID NO: 507565 - protein, 9 aa, Homo Sapiens
SAEALVQRF

SEQ ID NO: 507566 - protein, 9 aa, Homo Sapiens
YLWYNLTVE

SEQ ID NO: 507567 - protein, 9 aa, Homo Sapiens
ASSPVQVLG

SEQ ID NO: 507568 - protein, 9 aa, Homo Sapiens
LFLNPWCQV

SEQ ID NO: 507569 - protein, 9 aa, Homo Sapiens
LPYVIYRVN

SEQ ID NO: 507570 - protein, 9 aa, Homo Sapiens
PLSEITKQE

SEQ ID NO: 507571 - protein, 9 aa, Homo Sapiens
YGIVPKNLT

SEQ ID NO: 507572 - protein, 9 aa, Homo Sapiens
PFHQFHDSH

SEQ ID NO: 507573 - protein, 9 aa, Homo Sapiens
IVCQWKYKD

SEQ ID NO: 507574 - protein, 9 aa, Homo Sapiens
PQLLHFVDH

SEQ ID NO: 507575 - protein, 9 aa, Homo Sapiens
RKSQCVLGS

SEQ ID NO: 507576 - protein, 9 aa, Homo Sapiens
KFKENYASN

SEQ ID NO: 507577 - protein, 9 aa, Homo Sapiens
VYSYPSITY

SEQ ID NO: 507578 - protein, 9 aa, Homo Sapiens
RPSSDSGCL

SEQ ID NO: 507579 - protein, 9 aa, Homo Sapiens
VQEGCSHNS

SEQ ID NO: 507580 - protein, 9 aa, Homo Sapiens
TSAWSVMLD

SEQ ID NO: 507581 - protein, 9 aa, Homo Sapiens
PGTSLVNPV

SEQ ID NO: 507582 - protein, 9 aa, Homo Sapiens
KVIVDTLIT

SEQ ID NO: 507583 - protein, 9 aa, Homo Sapiens
QTQSCTDSG

SEQ ID NO: 507584 - protein, 9 aa, Homo Sapiens
MRKSQCVLG

SEQ ID NO: 507585 - protein, 9 aa, Homo Sapiens
QSCTDSGAE

SEQ ID NO: 507586 - protein, 9 aa, Homo Sapiens
SITYSFVLR

SEQ ID NO: 507587 - protein, 9 aa, Homo Sapiens
PLVEEELKI

SEQ ID NO: 507588 - protein, 9 aa, Homo Sapiens
AKSYAGLVG

SEQ ID NO: 507589 - protein, 9 aa, Homo Sapiens
CFQLKIAEL

SEQ ID NO: 507590 - protein, 9 aa, Homo Sapiens
WCQVILLPQ

SEQ ID NO: 507591 - protein, 9 aa, Homo Sapiens
KTAPKAKDA

SEQ ID NO: 507592 - protein, 9 aa, Homo Sapiens
LLAQRLSQT

SEQ ID NO: 507593 - protein, 9 aa, Homo Sapiens
SSMRTRSPS

SEQ ID NO: 507594 - protein, 9 aa, Homo Sapiens
TIHQIVCQW

SEQ ID NO: 507595 - protein, 9 aa, Homo Sapiens
KGKDKELYN

SEQ ID NO: 507596 - protein, 9 aa, Homo Sapiens
KQMEAFWQK

SEQ ID NO: 507597 - protein, 9 aa, Homo Sapiens
RDPLSEITK

SEQ ID NO: 507598 - protein, 9 aa, Homo Sapiens
SVVQEGCSH

SEQ ID NO: 507599 - protein, 9 aa, Homo Sapiens
VYLWYNLTV

SEQ ID NO: 507600 - protein, 9 aa, Homo Sapiens
PHCYICFTP

SEQ ID NO: 507601 - protein, 9 aa, Homo Sapiens
SLTEHKKIH

SEQ ID NO: 507602 - protein, 9 aa, Homo Sapiens
RNPTLGVLL

SEQ ID NO: 507603 - protein, 9 aa, Homo Sapiens
AFWQKAELG

SEQ ID NO: 507604 - protein, 9 aa, Homo Sapiens
VQRFRKVKQ

SEQ ID NO: 507605 - protein, 9 aa, Homo Sapiens
AGCLITEEC

SEQ ID NO: 507606 - protein, 9 aa, Homo Sapiens
KELRTPSEK

SEQ ID NO: 507607 - protein, 9 aa, Homo Sapiens
TNPAKPLLS

SEQ ID NO: 507608 - protein, 9 aa, Homo Sapiens
IHQIVCQWK

SEQ ID NO: 507609 - protein, 9 aa, Homo Sapiens
YIPKNNPRG

SEQ ID NO: 507610 - protein, 9 aa, Homo Sapiens
FKEQELQFE

SEQ ID NO: 507611 - protein, 9 aa, Homo Sapiens
SGSPPVKSP

SEQ ID NO: 507612 - protein, 9 aa, Homo Sapiens
FKELRTPSE

SEQ ID NO: 507613 - protein, 9 aa, Homo Sapiens
HLAKNHSAD

SEQ ID NO: 507614 - protein, 9 aa, Homo Sapiens
LMEQNPEFI

SEQ ID NO: 507615 - protein, 9 aa, Homo Sapiens
WMRQEAQGA

SEQ ID NO: 507616 - protein, 9 aa, Homo Sapiens
AQSKLGILT

SEQ ID NO: 507617 - protein, 9 aa, Homo Sapiens
KDKELYNIK

SEQ ID NO: 507618 - protein, 9 aa, Homo Sapiens
VACVEEPND

SEQ ID NO: 507619 - protein, 9 aa, Homo Sapiens
VDTLITKLM

SEQ ID NO: 507620 - protein, 9 aa, Homo Sapiens
DAATNPAKP

SEQ ID NO: 507621 - protein, 9 aa, Homo Sapiens
NPAKPLLSY

SEQ ID NO: 507622 - protein, 9 aa, Homo Sapiens
HKSKKGSKM

SEQ ID NO: 507623 - protein, 9 aa, Homo Sapiens
RKTAPKAKD

SEQ ID NO: 507624 - protein, 9 aa, Homo Sapiens
HSFQHSVDL

SEQ ID NO: 507625 - protein, 9 aa, Homo Sapiens
IGVVLNIGT

SEQ ID NO: 507626 - protein, 9 aa, Homo Sapiens
SEITKQEKD

SEQ ID NO: 507627 - protein, 9 aa, Homo Sapiens
VPLVEEELK

SEQ ID NO: 507628 - protein, 9 aa, Homo Sapiens
YICFTPRGI

SEQ ID NO: 507629 - protein, 9 aa, Homo Sapiens
IVDSNDIAP

SEQ ID NO: 507630 - protein, 9 aa, Homo Sapiens
CLITEECRG

SEQ ID NO: 507631 - protein, 9 aa, Homo Sapiens
CDGTDMFDI

SEQ ID NO: 507632 - protein, 9 aa, Homo Sapiens
GNVLPPSTE

SEQ ID NO: 507633 - protein, 9 aa, Homo Sapiens
PYDMGGHSF

SEQ ID NO: 507634 - protein, 9 aa, Homo Sapiens
EKLYEEHDM

SEQ ID NO: 507635 - protein, 9 aa, Homo Sapiens
HQFHDSHRY

SEQ ID NO: 507636 - protein, 9 aa, Homo Sapiens
ATTIHQIVC

SEQ ID NO: 507637 - protein, 9 aa, Homo Sapiens
LIISGWEPL

SEQ ID NO: 507638 - protein, 9 aa, Homo Sapiens
TQSCTDSGA

SEQ ID NO: 507639 - protein, 9 aa, Homo Sapiens
KAFSDSLSC

SEQ ID NO: 507640 - protein, 9 aa, Homo Sapiens
VLISGICAA

SEQ ID NO: 507641 - protein, 9 aa, Homo Sapiens
HCDFCRDIK

SEQ ID NO: 507642 - protein, 9 aa, Homo Sapiens
GPGVGPDSE

SEQ ID NO: 507643 - protein, 9 aa, Homo Sapiens
LHDSVLSGQ

SEQ ID NO: 507644 - protein, 9 aa, Homo Sapiens
LLSKCWQHG

SEQ ID NO: 507645 - protein, 9 aa, Homo Sapiens
KKGSKMRQI

SEQ ID NO: 507646 - protein, 9 aa, Homo Sapiens
SFFPEPISP

SEQ ID NO: 507647 - protein, 9 aa, Homo Sapiens
ERKQMEAFW

SEQ ID NO: 507648 - protein, 9 aa, Homo Sapiens
NQKVIVDTL

SEQ ID NO: 507649 - protein, 9 aa, Homo Sapiens
AAALAINSS

SEQ ID NO: 507650 - protein, 9 aa, Homo Sapiens
EVEYRIIDC

SEQ ID NO: 507651 - protein, 9 aa, Homo Sapiens
LTCMPYPFH

SEQ ID NO: 507652 - protein, 9 aa, Homo Sapiens
KLIISGWEP

SEQ ID NO: 507653 - protein, 9 aa, Homo Sapiens
EEERKVTVG

SEQ ID NO: 507654 - protein, 9 aa, Homo Sapiens
EECRGEGGI

SEQ ID NO: 507655 - protein, 9 aa, Homo Sapiens
SASSSPAPS

SEQ ID NO: 507656 - protein, 9 aa, Homo Sapiens
RRTLDDNVF

SEQ ID NO: 507657 - protein, 9 aa, Homo Sapiens
DHEEICENL

SEQ ID NO: 507658 - protein, 9 aa, Homo Sapiens
FGCCGAMRK

SEQ ID NO: 507659 - protein, 9 aa, Homo Sapiens
TCRHQLAGQ

SEQ ID NO: 507660 - protein, 9 aa, Homo Sapiens
EAQSKLGIL

SEQ ID NO: 507661 - protein, 9 aa, Homo Sapiens
LGILTLKYP

SEQ ID NO: 507662 - protein, 9 aa, Homo Sapiens
GCSHNSSYI

SEQ ID NO: 507663 - protein, 9 aa, Homo Sapiens
MLLLTDYIS

SEQ ID NO: 507664 - protein, 9 aa, Homo Sapiens
SYPSITYSF

SEQ ID NO: 507665 - protein, 9 aa, Homo Sapiens
FKENYASNI

SEQ ID NO: 507666 - protein, 9 aa, Homo Sapiens
YPSITYSFV

SEQ ID NO: 507667 - protein, 9 aa, Homo Sapiens
RRCITEHWM

SEQ ID NO: 507668 - protein, 9 aa, Homo Sapiens
IYRVNIPLP

SEQ ID NO: 507669 - protein, 9 aa, Homo Sapiens
WSVMLDRAE

SEQ ID NO: 507670 - protein, 9 aa, Homo Sapiens
LSCAQHQRL

SEQ ID NO: 507671 - protein, 9 aa, Homo Sapiens
RKVTVGPRT

SEQ ID NO: 507672 - protein, 9 aa, Homo Sapiens
VQVLGPVAA

SEQ ID NO: 507673 - protein, 9 aa, Homo Sapiens
GVGPDSEVW

SEQ ID NO: 507674 - protein, 9 aa, Homo Sapiens
PSHGGNLKT

SEQ ID NO: 507675 - protein, 9 aa, Homo Sapiens
KGGRPCQHL

SEQ ID NO: 507676 - protein, 9 aa, Homo Sapiens
PSAQEEVLF

SEQ ID NO: 507677 - protein, 9 aa, Homo Sapiens
SMAAALAIN

SEQ ID NO: 507678 - protein, 9 aa, Homo Sapiens
KVFKELRTP

SEQ ID NO: 507679 - protein, 9 aa, Homo Sapiens
EEELKIGQH

SEQ ID NO: 507680 - protein, 9 aa, Homo Sapiens
IIDCDGTDM

SEQ ID NO: 507681 - protein, 9 aa, Homo Sapiens
RLGEKLTIF

SEQ ID NO: 507682 - protein, 9 aa, Homo Sapiens
ENYASNIDG

SEQ ID NO: 507683 - protein, 9 aa, Homo Sapiens
MRTRSPSPD

SEQ ID NO: 507684 - protein, 9 aa, Homo Sapiens
RARARRKLL

SEQ ID NO: 507685 - protein, 9 aa, Homo Sapiens
QKVIVDTLI

SEQ ID NO: 507686 - protein, 9 aa, Homo Sapiens
CLHDSVLSG

SEQ ID NO: 507687 - protein, 9 aa, Homo Sapiens
GAKVPYGIV

SEQ ID NO: 507688 - protein, 9 aa, Homo Sapiens
DKGNVLPPS

SEQ ID NO: 507689 - protein, 9 aa, Homo Sapiens
GSPPVKSPT

SEQ ID NO: 507690 - protein, 9 aa, Homo Sapiens
ELSHSAKSY

SEQ ID NO: 507691 - protein, 9 aa, Homo Sapiens
DGVYSYPSI

SEQ ID NO: 507692 - protein, 9 aa, Homo Sapiens
SLSCAQHQR

SEQ ID NO: 507693 - protein, 9 aa, Homo Sapiens
TEECRGEGG

SEQ ID NO: 507694 - protein, 9 aa, Homo Sapiens
VPRNLLLLL

SEQ ID NO: 507695 - protein, 9 aa, Homo Sapiens
KPHKSKKGS

SEQ ID NO: 507696 - protein, 9 aa, Homo Sapiens
QSKLGILTL

SEQ ID NO: 507697 - protein, 9 aa, Homo Sapiens
TYRPHCYIC

SEQ ID NO: 507698 - protein, 9 aa, Homo Sapiens
SAVAFFVPR

SEQ ID NO: 507699 - protein, 9 aa, Homo Sapiens
EVFLPGSSF

SEQ ID NO: 507700 - protein, 9 aa, Homo Sapiens
GRPCQHLLS

SEQ ID NO: 507701 - protein, 9 aa, Homo Sapiens
DCDGTDMFD

SEQ ID NO: 507702 - protein, 9 aa, Homo Sapiens
LRKPGLPQG

SEQ ID NO: 507703 - protein, 9 aa, Homo Sapiens
KKFKENYAS

SEQ ID NO: 507704 - protein, 9 aa, Homo Sapiens
FTCRTCRHQ

SEQ ID NO: 507705 - protein, 9 aa, Homo Sapiens
SNHLAKNHS

SEQ ID NO: 507706 - protein, 9 aa, Homo Sapiens
GVACVEEPN

SEQ ID NO: 507707 - protein, 9 aa, Homo Sapiens
KLGILTLKY

SEQ ID NO: 507708 - protein, 9 aa, Homo Sapiens
SNWSCCSKS

SEQ ID NO: 507709 - protein, 9 aa, Homo Sapiens
ERKVTVGPR

SEQ ID NO: 507710 - protein, 9 aa, Homo Sapiens
SYAGLVGGG

SEQ ID NO: 507711 - protein, 9 aa, Homo Sapiens
GKAFSDSLS

SEQ ID NO: 507712 - protein, 9 aa, Homo Sapiens
IISGWEPLL

SEQ ID NO: 507713 - protein, 9 aa, Homo Sapiens
RCITEHWMR

SEQ ID NO: 507714 - protein, 9 aa, Homo Sapiens
YPDVDPEHV

SEQ ID NO: 507715 - protein, 9 aa, Homo Sapiens
TLDDNVFMP

SEQ ID NO: 507716 - protein, 9 aa, Homo Sapiens
MEQNPEFIF

SEQ ID NO: 507717 - protein, 9 aa, Homo Sapiens
EEKSNHLAK

SEQ ID NO: 507718 - protein, 9 aa, Homo Sapiens
GGSAAEDLQ

SEQ ID NO: 507719 - protein, 9 aa, Homo Sapiens
LGEKLTIFC

SEQ ID NO: 507720 - protein, 9 aa, Homo Sapiens
SSSPAPSTG

SEQ ID NO: 507721 - protein, 9 aa, Homo Sapiens
ILPYVIYRV

SEQ ID NO: 507722 - protein, 9 aa, Homo Sapiens
PYPFHQFHD

SEQ ID NO: 507723 - protein, 9 aa, Homo Sapiens
SFKEQELQF

SEQ ID NO: 507724 - protein, 9 aa, Homo Sapiens
ISYGRQAPV

SEQ ID NO: 507725 - protein, 9 aa, Homo Sapiens
CDFCRDIKK

SEQ ID NO: 507726 - protein, 9 aa, Homo Sapiens
SPPVKSPTD

SEQ ID NO: 507727 - protein, 9 aa, Homo Sapiens
GDEAQSKLG

SEQ ID NO: 507728 - protein, 9 aa, Homo Sapiens
LLGLNQVGC

SEQ ID NO: 507729 - protein, 9 aa, Homo Sapiens
KPSDYCIVE

SEQ ID NO: 507730 - protein, 9 aa, Homo Sapiens
RDGVYSYPS

SEQ ID NO: 507731 - protein, 9 aa, Homo Sapiens
QTCFRQWRQ

SEQ ID NO: 507732 - protein, 9 aa, Homo Sapiens
PRVLISGIC

SEQ ID NO: 507733 - protein, 9 aa, Homo Sapiens
PHKSKKGSK

SEQ ID NO: 507734 - protein, 9 aa, Homo Sapiens
HPCDHEEIC

SEQ ID NO: 507735 - protein, 9 aa, Homo Sapiens
SEEERKVTV

SEQ ID NO: 507736 - protein, 9 aa, Homo Sapiens
PSSPQSSMR

SEQ ID NO: 507737 - protein, 9 aa, Homo Sapiens
FWYLRQAKP

SEQ ID NO: 507738 - protein, 9 aa, Homo Sapiens
RERARARRK

SEQ ID NO: 507739 - protein, 9 aa, Homo Sapiens
LCISYGRQA

SEQ ID NO: 507740 - protein, 9 aa, Homo Sapiens
CQHLLSLTR

SEQ ID NO: 507741 - protein, 9 aa, Homo Sapiens
DSEVWGIPP

SEQ ID NO: 507742 - protein, 9 aa, Homo Sapiens
VVQEGCSHN

SEQ ID NO: 507743 - protein, 9 aa, Homo Sapiens
ILASFKEQE

SEQ ID NO: 507744 - protein, 9 aa, Homo Sapiens
VAFFVPRNL

SEQ ID NO: 507745 - protein, 9 aa, Homo Sapiens
LLHFVDHYR

SEQ ID NO: 507746 - protein, 9 aa, Homo Sapiens
QEGCSHNSS

SEQ ID NO: 507747 - protein, 9 aa, Homo Sapiens
ASSSPAPST

SEQ ID NO: 507748 - protein, 9 aa, Homo Sapiens
PQPADSASS

SEQ ID NO: 507749 - protein, 9 aa, Homo Sapiens
DVDPEHVGA

SEQ ID NO: 507750 - protein, 9 aa, Homo Sapiens
CFTCRTCRH

SEQ ID NO: 507751 - protein, 9 aa, Homo Sapiens
PSDYCIVEK

SEQ ID NO: 507752 - protein, 9 aa, Homo Sapiens
PDSEVWGIP

SEQ ID NO: 507753 - protein, 9 aa, Homo Sapiens
TTIHQIVCQ

SEQ ID NO: 507754 - protein, 9 aa, Homo Sapiens
WENYSNFNS

SEQ ID NO: 507755 - protein, 9 aa, Homo Sapiens
YSYPSITYS

SEQ ID NO: 507756 - protein, 9 aa, Homo Sapiens
LNSYAGVAC

SEQ ID NO: 507757 - protein, 9 aa, Homo Sapiens
PVQVLGPVA

SEQ ID NO: 507758 - protein, 9 aa, Homo Sapiens
GLPQGLWLA

SEQ ID NO: 507759 - protein, 9 aa, Homo Sapiens
AMRKSQCVL

SEQ ID NO: 507760 - protein, 9 aa, Homo Sapiens
IFCSSEISF

SEQ ID NO: 507761 - protein, 9 aa, Homo Sapiens
EICENLSLK

SEQ ID NO: 507762 - protein, 9 aa, Homo Sapiens
AAALPACCK

SEQ ID NO: 507763 - protein, 9 aa, Homo Sapiens
EYRIIDCDG

SEQ ID NO: 507764 - protein, 9 aa, Homo Sapiens
MLCISYGRQ

SEQ ID NO: 507765 - protein, 9 aa, Homo Sapiens
NWSCCSKSC

SEQ ID NO: 507766 - protein, 9 aa, Homo Sapiens
GSSFQTKSN

SEQ ID NO: 507767 - protein, 9 aa, Homo Sapiens
EKSNHLAKN

SEQ ID NO: 507768 - protein, 9 aa, Homo Sapiens
PQGLWLAKP

SEQ ID NO: 507769 - protein, 9 aa, Homo Sapiens
SHNSSYIQN

SEQ ID NO: 507770 - protein, 9 aa, Homo Sapiens
LGPVAASTE

SEQ ID NO: 507771 - protein, 9 aa, Homo Sapiens
NVFMPLYPK

SEQ ID NO: 507772 - protein, 9 aa, Homo Sapiens
VEKWRGSER

SEQ ID NO: 507773 - protein, 9 aa, Homo Sapiens
SYGRQAPVG

SEQ ID NO: 507774 - protein, 9 aa, Homo Sapiens
ELDREVYLW

SEQ ID NO: 507775 - protein, 9 aa, Homo Sapiens
MRRTLDDNV

SEQ ID NO: 507776 - protein, 9 aa, Homo Sapiens
DIAPQFLKS

SEQ ID NO: 507777 - protein, 9 aa, Homo Sapiens
GRQGAKVPY

SEQ ID NO: 507778 - protein, 9 aa, Homo Sapiens
INKGGRPCQ

SEQ ID NO: 507779 - protein, 9 aa, Homo Sapiens
LKFWYLRQA

SEQ ID NO: 507780 - protein, 9 aa, Homo Sapiens
LGASLGGII

SEQ ID NO: 507781 - protein, 9 aa, Homo Sapiens
YSAYIPKNN

SEQ ID NO: 507782 - protein, 9 aa, Homo Sapiens
VCQWKYKDD

SEQ ID NO: 507783 - protein, 9 aa, Homo Sapiens
TEHKKIHAG

SEQ ID NO: 507784 - protein, 9 aa, Homo Sapiens
CITEHWMRQ

SEQ ID NO: 507785 - protein, 9 aa, Homo Sapiens
CENLSLKNG

SEQ ID NO: 507786 - protein, 9 aa, Homo Sapiens
PHPYDMGGH

SEQ ID NO: 507787 - protein, 9 aa, Homo Sapiens
EDEKSPQTQ

SEQ ID NO: 507788 - protein, 9 aa, Homo Sapiens
GDHTKLIIS

SEQ ID NO: 507789 - protein, 9 aa, Homo Sapiens
DKVVSQGLL

SEQ ID NO: 507790 - protein, 9 aa, Homo Sapiens
VTVGPRTSA

SEQ ID NO: 507791 - protein, 9 aa, Homo Sapiens
VVAPLLGAS

SEQ ID NO: 507792 - protein, 9 aa, Homo Sapiens
WQHGAGVRH

SEQ ID NO: 507793 - protein, 9 aa, Homo Sapiens
LPPSTEGDI

SEQ ID NO: 507794 - protein, 9 aa, Homo Sapiens
EKDARCFQL

SEQ ID NO: 507795 - protein, 9 aa, Homo Sapiens
KELYNIKRG

SEQ ID NO: 507796 - protein, 9 aa, Homo Sapiens
DEKSPQTQS

SEQ ID NO: 507797 - protein, 9 aa, Homo Sapiens
LNPWCQVIL

SEQ ID NO: 507798 - protein, 9 aa, Homo Sapiens
MSHMLCISY

SEQ ID NO: 507799 - protein, 9 aa, Homo Sapiens
SSPVQVLGP

SEQ ID NO: 507800 - protein, 9 aa, Homo Sapiens
CGAMRKSQC

SEQ ID NO: 507801 - protein, 9 aa, Homo Sapiens
RKPGLPQGL

SEQ ID NO: 507802 - protein, 9 aa, Homo Sapiens
ASAELKFWY

SEQ ID NO: 507803 - protein, 9 aa, Homo Sapiens
SSLTEHKKI

SEQ ID NO: 507804 - protein, 9 aa, Homo Sapiens
LTDYISKED

SEQ ID NO: 507805 - protein, 9 aa, Homo Sapiens
LQLMEQNPE

SEQ ID NO: 507806 - protein, 9 aa, Homo Sapiens
QLPSTSFAL

SEQ ID NO: 507807 - protein, 9 aa, Homo Sapiens
LAINSSPSV

SEQ ID NO: 507808 - protein, 9 aa, Homo Sapiens
PPGTSLVNP

SEQ ID NO: 507809 - protein, 9 aa, Homo Sapiens
SSDSGCLHD

SEQ ID NO: 507810 - protein, 9 aa, Homo Sapiens
SPQPADSAS

SEQ ID NO: 507811 - protein, 9 aa, Homo Sapiens
LCMSLLGLN

SEQ ID NO: 507812 - protein, 9 aa, Homo Sapiens
ITEHWMRQE

SEQ ID NO: 507813 - protein, 9 aa, Homo Sapiens
SYSAYIPKN

SEQ ID NO: 507814 - protein, 9 aa, Homo Sapiens
SMRTRSPSP

SEQ ID NO: 507815 - protein, 9 aa, Homo Sapiens
VVLNIGTVD

SEQ ID NO: 507816 - protein, 9 aa, Homo Sapiens
REVYLWYNL

SEQ ID NO: 507817 - protein, 9 aa, Homo Sapiens
LPACCKHDG

SEQ ID NO: 507818 - protein, 9 aa, Homo Sapiens
VLGPVAAST

SEQ ID NO: 507819 - protein, 9 aa, Homo Sapiens
CGKAFSDSL

SEQ ID NO: 507820 - protein, 9 aa, Homo Sapiens
EVYLWYNLT

SEQ ID NO: 507821 - protein, 9 aa, Homo Sapiens
HSAKSYAGL

SEQ ID NO: 507822 - protein, 9 aa, Homo Sapiens
NHLAKNHSA

SEQ ID NO: 507823 - protein, 9 aa, Homo Sapiens
AEALVQRFR

SEQ ID NO: 507824 - protein, 9 aa, Homo Sapiens
DSASSSPAP

SEQ ID NO: 507825 - protein, 9 aa, Homo Sapiens
HTCVSFFPE

SEQ ID NO: 507826 - protein, 9 aa, Homo Sapiens
SHSAKSYAG

SEQ ID NO: 507827 - protein, 9 aa, Homo Sapiens
SCCSKSCGS

SEQ ID NO: 507828 - protein, 9 aa, Homo Sapiens
LVNPVPSPS

SEQ ID NO: 507829 - protein, 9 aa, Homo Sapiens
VSFFPEPIS

SEQ ID NO: 507830 - protein, 9 aa, Homo Sapiens
QMEAFWQKA

SEQ ID NO: 507831 - protein, 9 aa, Homo Sapiens
VDSNDIAPQ

SEQ ID NO: 507832 - protein, 9 aa, Homo Sapiens
VGPDSEVWG

SEQ ID NO: 507833 - protein, 9 aa, Homo Sapiens
SSAEALVQR

SEQ ID NO: 507834 - protein, 9 aa, Homo Sapiens
CCSKSCGSG

SEQ ID NO: 507835 - protein, 9 aa, Homo Sapiens
ADSASSSPA

SEQ ID NO: 507836 - protein, 9 aa, Homo Sapiens
LLLRNTSAW

SEQ ID NO: 507837 - protein, 9 aa, Homo Sapiens
CCGAMRKSQ

SEQ ID NO: 507838 - protein, 9 aa, Homo Sapiens
SPQTQSCTD

SEQ ID NO: 507839 - protein, 9 aa, Homo Sapiens
SSPQSSMRT

SEQ ID NO: 507840 - protein, 9 aa, Homo Sapiens
CIVEKWRGS

SEQ ID NO: 507841 - protein, 9 aa, Homo Sapiens
KKHRARFDK

SEQ ID NO: 507842 - protein, 9 aa, Homo Sapiens
GIGPGVGPD

SEQ ID NO: 507843 - protein, 9 aa, Homo Sapiens
VTYRPHCYI

SEQ ID NO: 507844 - protein, 9 aa, Homo Sapiens
PPVKSPTDP

SEQ ID NO: 507845 - protein, 9 aa, Homo Sapiens
RARFDKVVS

SEQ ID NO: 507846 - protein, 9 aa, Homo Sapiens
MPYPFHQFH

SEQ ID NO: 507847 - protein, 9 aa, Homo Sapiens
KSPQTQSCT

SEQ ID NO: 507848 - protein, 9 aa, Homo Sapiens
PKNNPRGAS

SEQ ID NO: 507849 - protein, 9 aa, Homo Sapiens
KSKKGSKMR

SEQ ID NO: 507850 - protein, 9 aa, Homo Sapiens
YNIKRGESG

SEQ ID NO: 507851 - protein, 9 aa, Homo Sapiens
DEAQSKLGI

SEQ ID NO: 507852 - protein, 9 aa, Homo Sapiens
SAKSYAGLV

SEQ ID NO: 507853 - protein, 9 aa, Homo Sapiens
LHFVDHYRE

SEQ ID NO: 507854 - protein, 9 aa, Homo Sapiens
ENYSNFNSL

SEQ ID NO: 507855 - protein, 9 aa, Homo Sapiens
PQTQSCTDS

SEQ ID NO: 507856 - protein, 9 aa, Homo Sapiens
LDREVYLWY

SEQ ID NO: 507857 - protein, 9 aa, Homo Sapiens
GSRHTCVSF

SEQ ID NO: 507858 - protein, 9 aa, Homo Sapiens
HGLYPDVDP

SEQ ID NO: 507859 - protein, 9 aa, Homo Sapiens
FDSELSRTY

SEQ ID NO: 507860 - protein, 9 aa, Homo Sapiens
RFDKVVSQG

SEQ ID NO: 507861 - protein, 9 aa, Homo Sapiens
HINKGGRPC

SEQ ID NO: 507862 - protein, 9 aa, Homo Sapiens
AELKDAATN

SEQ ID NO: 507863 - protein, 9 aa, Homo Sapiens
ALVQRFRKV

SEQ ID NO: 507864 - protein, 9 aa, Homo Sapiens
MSLLGLNQV

SEQ ID NO: 507865 - protein, 9 aa, Homo Sapiens
RLFLNPWCQ

SEQ ID NO: 507866 - protein, 9 aa, Homo Sapiens
GSAAEDLQL

SEQ ID NO: 507867 - protein, 9 aa, Homo Sapiens
PQSSMRTRS

SEQ ID NO: 507868 - protein, 9 aa, Homo Sapiens
CYICFTPRG

SEQ ID NO: 507869 - protein, 9 aa, Homo Sapiens
DYISKEDSC

SEQ ID NO: 507870 - protein, 9 aa, Homo Sapiens
SAAEDLQLP

SEQ ID NO: 507871 - protein, 9 aa, Homo Sapiens
GGHSFQHSV

SEQ ID NO: 507872 - protein, 9 aa, Homo Sapiens
PGVGPDSEV

SEQ ID NO: 507873 - protein, 9 aa, Homo Sapiens
FVDHYREQL

SEQ ID NO: 507874 - protein, 9 aa, Homo Sapiens
KIGVVLNIG

SEQ ID NO: 507875 - protein, 9 aa, Homo Sapiens
AFSDSLSCA

SEQ ID NO: 507876 - protein, 9 aa, Homo Sapiens
GVLLGRQRL

SEQ ID NO: 507877 - protein, 9 aa, Homo Sapiens
TSLVNPVPS

SEQ ID NO: 507878 - protein, 9 aa, Homo Sapiens
GHGLYPDVD

SEQ ID NO: 507879 - protein, 9 aa, Homo Sapiens
LKDAATNPA

SEQ ID NO: 507880 - protein, 9 aa, Homo Sapiens
GCCGAMRKS

SEQ ID NO: 507881 - protein, 9 aa, Homo Sapiens
TCVSFFPEP

SEQ ID NO: 507882 - protein, 9 aa, Homo Sapiens
QRFRKVKQH

SEQ ID NO: 507883 - protein, 9 aa, Homo Sapiens
TCMPYPFHQ

SEQ ID NO: 507884 - protein, 9 aa, Homo Sapiens
GYPNVSIHN

SEQ ID NO: 507885 - protein, 9 aa, Homo Sapiens
TLNKTEQGG

SEQ ID NO: 507886 - protein, 9 aa, Homo Sapiens
IYFDFWFQM

SEQ ID NO: 507887 - protein, 9 aa, Homo Sapiens
VFSFAAVMG

SEQ ID NO: 507888 - protein, 9 aa, Homo Sapiens
CDGEACFKW

SEQ ID NO: 507889 - protein, 9 aa, Homo Sapiens
CVMLTTFNE

SEQ ID NO: 507890 - protein, 9 aa, Homo Sapiens
AQNTCVMLT

SEQ ID NO: 507891 - protein, 9 aa, Homo Sapiens
DGAVGKTFL

SEQ ID NO: 507892 - protein, 9 aa, Homo Sapiens
IYVIYFDFW

SEQ ID NO: 507893 - protein, 9 aa, Homo Sapiens
ICWIHDVDF

SEQ ID NO: 507894 - protein, 9 aa, Homo Sapiens
KNMIYVIYF

SEQ ID NO: 507895 - protein, 9 aa, Homo Sapiens
SFLSQHDIS

SEQ ID NO: 507896 - protein, 9 aa, Homo Sapiens
ENLICWIHD

SEQ ID NO: 507897 - protein, 9 aa, Homo Sapiens
KLFCLTDLA

SEQ ID NO: 507898 - protein, 9 aa, Homo Sapiens
MARKLIHLK

SEQ ID NO: 507899 - protein, 9 aa, Homo Sapiens
GTMGNVFSF

SEQ ID NO: 507900 - protein, 9 aa, Homo Sapiens
DKVRTAKFF

SEQ ID NO: 507901 - protein, 9 aa, Homo Sapiens
QQNSGRMNP

SEQ ID NO: 507902 - protein, 9 aa, Homo Sapiens
LKKTWDKVR

SEQ ID NO: 507903 - protein, 9 aa, Homo Sapiens
YATHAILNS

SEQ ID NO: 507904 - protein, 9 aa, Homo Sapiens
TCVMLTTFN

SEQ ID NO: 507905 - protein, 9 aa, Homo Sapiens
QGGRNALLS

SEQ ID NO: 507906 - protein, 9 aa, Homo Sapiens
EAEQEKEKD

SEQ ID NO: 507907 - protein, 9 aa, Homo Sapiens
YVINNLQPD

SEQ ID NO: 507908 - protein, 9 aa, Homo Sapiens
LFLCCLLSP

SEQ ID NO: 507909 - protein, 9 aa, Homo Sapiens
VINNLQPDT

SEQ ID NO: 507910 - protein, 9 aa, Homo Sapiens
AGNGGAPEG

SEQ ID NO: 507911 - protein, 9 aa, Homo Sapiens
KAVELMNRT

SEQ ID NO: 507912 - protein, 9 aa, Homo Sapiens
CGEPYRQGS

SEQ ID NO: 507913 - protein, 9 aa, Homo Sapiens
QLLTPEEEF

SEQ ID NO: 507914 - protein, 9 aa, Homo Sapiens
NVFSFAAVM

SEQ ID NO: 507915 - protein, 9 aa, Homo Sapiens
GKVTSYVIN

SEQ ID NO: 507916 - protein, 9 aa, Homo Sapiens
NAVYLCDGE

SEQ ID NO: 507917 - protein, 9 aa, Homo Sapiens
VLFIVYSES

SEQ ID NO: 507918 - protein, 9 aa, Homo Sapiens
RKLIHLKPA

SEQ ID NO: 507919 - protein, 9 aa, Homo Sapiens
KEAQNTCVM

SEQ ID NO: 507920 - protein, 9 aa, Homo Sapiens
EQHGMFTIS

SEQ ID NO: 507921 - protein, 9 aa, Homo Sapiens
MIYVIYFDF

SEQ ID NO: 507922 - protein, 9 aa, Homo Sapiens
LLLHKCCQL

SEQ ID NO: 507923 - protein, 9 aa, Homo Sapiens
GSQTGCGEP

SEQ ID NO: 507924 - protein, 9 aa, Homo Sapiens
PTITAVTKG

SEQ ID NO: 507925 - protein, 9 aa, Homo Sapiens
KFYIPDINS

SEQ ID NO: 507926 - protein, 9 aa, Homo Sapiens
EQSKEVTEF

SEQ ID NO: 507927 - protein, 9 aa, Homo Sapiens
FLFLCCLLS

SEQ ID NO: 507928 - protein, 9 aa, Homo Sapiens
ETSGDFQLL

SEQ ID NO: 507929 - protein, 9 aa, Homo Sapiens
RQQNSGRMN

SEQ ID NO: 507930 - protein, 9 aa, Homo Sapiens
TKGSCVVAW

SEQ ID NO: 507931 - protein, 9 aa, Homo Sapiens
KSKFSFLSQ

SEQ ID NO: 507932 - protein, 9 aa, Homo Sapiens
PHKCSVRLS

SEQ ID NO: 507933 - protein, 9 aa, Homo Sapiens
NPMGTASGS

SEQ ID NO: 507934 - protein, 9 aa, Homo Sapiens
PDFFLFLCC

SEQ ID NO: 507935 - protein, 9 aa, Homo Sapiens
SGRMNPMGT

SEQ ID NO: 507936 - protein, 9 aa, Homo Sapiens
MNPMGTASG

SEQ ID NO: 507937 - protein, 9 aa, Homo Sapiens
QLAGNGGAP

SEQ ID NO: 507938 - protein, 9 aa, Homo Sapiens
EAQNTCVML

SEQ ID NO: 507939 - protein, 9 aa, Homo Sapiens
SYVINNLQP

SEQ ID NO: 507940 - protein, 9 aa, Homo Sapiens
EKEKDSLGA

SEQ ID NO: 507941 - protein, 9 aa, Homo Sapiens
AENLICWIH

SEQ ID NO: 507942 - protein, 9 aa, Homo Sapiens
LHKCCQLWL

SEQ ID NO: 507943 - protein, 9 aa, Homo Sapiens
EKHAGYKFS

SEQ ID NO: 507944 - protein, 9 aa, Homo Sapiens
AGYKFSAPV

SEQ ID NO: 507945 - protein, 9 aa, Homo Sapiens
FCLTDLALL

SEQ ID NO: 507946 - protein, 9 aa, Homo Sapiens
ATHAILNSP

SEQ ID NO: 507947 - protein, 9 aa, Homo Sapiens
SGDDAYATH

SEQ ID NO: 507948 - protein, 9 aa, Homo Sapiens
VGKVTSYVI

SEQ ID NO: 507949 - protein, 9 aa, Homo Sapiens
LGPLLLHKC

SEQ ID NO: 507950 - protein, 9 aa, Homo Sapiens
ELMNRTEMP

SEQ ID NO: 507951 - protein, 8 aa, Homo Sapiens
SDSGEQNY

SEQ ID NO: 507952 - protein, 9 aa, Homo Sapiens
CPHKCSVRL

SEQ ID NO: 507953 - protein, 9 aa, Homo Sapiens
VNEQSKEVT

SEQ ID NO: 507954 - protein, 9 aa, Homo Sapiens
KVTSYVINN

SEQ ID NO: 507955 - protein, 9 aa, Homo Sapiens
LICWIHDVD

SEQ ID NO: 507956 - protein, 9 aa, Homo Sapiens
QDGCTFQLL

SEQ ID NO: 507957 - protein, 9 aa, Homo Sapiens
RLKKTWDKV

SEQ ID NO: 507958 - protein, 9 aa, Homo Sapiens
VESQLHLRC

SEQ ID NO: 507959 - protein, 9 aa, Homo Sapiens
GAVGKTFLL

SEQ ID NO: 507960 - protein, 9 aa, Homo Sapiens
LALLCFFCD

SEQ ID NO: 507961 - protein, 9 aa, Homo Sapiens
KCCQLWLLS

SEQ ID NO: 507962 - protein, 9 aa, Homo Sapiens
TMGNVFSFA

SEQ ID NO: 507963 - protein, 9 aa, Homo Sapiens
FLSQHDISF

SEQ ID NO: 507964 - protein, 9 aa, Homo Sapiens
PGQDGCTFQ

SEQ ID NO: 507965 - protein, 9 aa, Homo Sapiens
VVITDGCHD

SEQ ID NO: 507966 - protein, 9 aa, Homo Sapiens
CTFQLLTPE

SEQ ID NO: 507967 - protein, 9 aa, Homo Sapiens
RVKNMIYVI

SEQ ID NO: 507968 - protein, 9 aa, Homo Sapiens
SLNVGPWSK

SEQ ID NO: 507969 - protein, 9 aa, Homo Sapiens
EPYRQGSPC

SEQ ID NO: 507970 - protein, 9 aa, Homo Sapiens
PNVSIHNFT

SEQ ID NO: 507971 - protein, 9 aa, Homo Sapiens
HGMFTISDH

SEQ ID NO: 507972 - protein, 9 aa, Homo Sapiens
QNTCVMLTT

SEQ ID NO: 507973 - protein, 9 aa, Homo Sapiens
CFLVESQLH

SEQ ID NO: 507974 - protein, 9 aa, Homo Sapiens
YPNVSIHNF

SEQ ID NO: 507975 - protein, 9 aa, Homo Sapiens
LNKTEQGGR

SEQ ID NO: 507976 - protein, 9 aa, Homo Sapiens
GEPYRQGSP

SEQ ID NO: 507977 - protein, 9 aa, Homo Sapiens
SIHNFTTSW

SEQ ID NO: 507978 - protein, 9 aa, Homo Sapiens
CCGVCGVLF

SEQ ID NO: 507979 - protein, 9 aa, Homo Sapiens
FSFLSQHDI

SEQ ID NO: 507980 - protein, 9 aa, Homo Sapiens
DGEACFKWY

SEQ ID NO: 507981 - protein, 9 aa, Homo Sapiens
ESKMIEKHA

SEQ ID NO: 507982 - protein, 9 aa, Homo Sapiens
FLVESQLHL

SEQ ID NO: 507983 - protein, 9 aa, Homo Sapiens
LNVGPWSKC

SEQ ID NO: 507984 - protein, 9 aa, Homo Sapiens
EYTFSLNVG

SEQ ID NO: 507985 - protein, 9 aa, Homo Sapiens
GDDAYATHA

SEQ ID NO: 507986 - protein, 9 aa, Homo Sapiens
EQGGRNALL

SEQ ID NO: 507987 - protein, 9 aa, Homo Sapiens
KTFLLISYT

SEQ ID NO: 507988 - protein, 9 aa, Homo Sapiens
ITAVTKGSC

SEQ ID NO: 507989 - protein, 9 aa, Homo Sapiens
HKCCQLWLL

SEQ ID NO: 507990 - protein, 9 aa, Homo Sapiens
CCLLSPLLK

SEQ ID NO: 507991 - protein, 9 aa, Homo Sapiens
GAENLICWI

SEQ ID NO: 507992 - protein, 9 aa, Homo Sapiens
TSYVINNLQ

SEQ ID NO: 507993 - protein, 9 aa, Homo Sapiens
NSGRMNPMG

SEQ ID NO: 507994 - protein, 9 aa, Homo Sapiens
CGVCGVLFI

SEQ ID NO: 507995 - protein, 9 aa, Homo Sapiens
VYLCDGEAC

SEQ ID NO: 507996 - protein, 9 aa, Homo Sapiens
LHLRCVKFQ

SEQ ID NO: 507997 - protein, 9 aa, Homo Sapiens
THAILNSPS

SEQ ID NO: 507998 - protein, 9 aa, Homo Sapiens
YTFSLNVGP

SEQ ID NO: 507999 - protein, 9 aa, Homo Sapiens
RGKPLIMYS

SEQ ID NO: 508000 - protein, 9 aa, Homo Sapiens
YRKSKFSFL

SEQ ID NO: 508001 - protein, 9 aa, Homo Sapiens
KLEGDDSLD

SEQ ID NO: 508002 - protein, 9 aa, Homo Sapiens
NLICWIHDV

SEQ ID NO: 508003 - protein, 9 aa, Homo Sapiens
FLCCLLSPL

SEQ ID NO: 508004 - protein, 9 aa, Homo Sapiens
EEYTFSLNV

SEQ ID NO: 508005 - protein, 9 aa, Homo Sapiens
AVNEQSKEV

SEQ ID NO: 508006 - protein, 9 aa, Homo Sapiens
LEGDDSLDM

SEQ ID NO: 508007 - protein, 9 aa, Homo Sapiens
VKLFCLTDL

SEQ ID NO: 508008 - protein, 9 aa, Homo Sapiens
DVGENNRRG

SEQ ID NO: 508009 - protein, 9 aa, Homo Sapiens
VTSYVINNL

SEQ ID NO: 508010 - protein, 9 aa, Homo Sapiens
CGVLFIVYS

SEQ ID NO: 508011 - protein, 9 aa, Homo Sapiens
TFSLNVGPW

SEQ ID NO: 508012 - protein, 9 aa, Homo Sapiens
NMIYVIYFD

SEQ ID NO: 508013 - protein, 9 aa, Homo Sapiens
NRTEMPCQA

SEQ ID NO: 508014 - protein, 9 aa, Homo Sapiens
QTGCGEPYR

SEQ ID NO: 508015 - protein, 9 aa, Homo Sapiens
LVESQLHLR

SEQ ID NO: 508016 - protein, 9 aa, Homo Sapiens
ESQLHLRCV

SEQ ID NO: 508017 - protein, 9 aa, Homo Sapiens
DSLDMNCTL

SEQ ID NO: 508018 - protein, 9 aa, Homo Sapiens
PLLLHKCCQ

SEQ ID NO: 508019 - protein, 9 aa, Homo Sapiens
RRGKPLIMY

SEQ ID NO: 508020 - protein, 9 aa, Homo Sapiens
TGCGEPYRQ

SEQ ID NO: 508021 - protein, 9 aa, Homo Sapiens
TDLALLCFF

SEQ ID NO: 508022 - protein, 9 aa, Homo Sapiens
EEEYTFSLN

SEQ ID NO: 508023 - protein, 9 aa, Homo Sapiens
TFLLISYTT

SEQ ID NO: 508024 - protein, 9 aa, Homo Sapiens
PTLNKTEQG

SEQ ID NO: 508025 - protein, 9 aa, Homo Sapiens
GNVFSFAAV

SEQ ID NO: 508026 - protein, 9 aa, Homo Sapiens
HAGYKFSAP

SEQ ID NO: 508027 - protein, 9 aa, Homo Sapiens
GCGEPYRQG

SEQ ID NO: 508028 - protein, 9 aa, Homo Sapiens
TETSGDFQL

SEQ ID NO: 508029 - protein, 9 aa, Homo Sapiens
VITDGCHDP

SEQ ID NO: 508030 - protein, 9 aa, Homo Sapiens
AVELMNRTE

SEQ ID NO: 508031 - protein, 9 aa, Homo Sapiens
MKAVNEQSK

SEQ ID NO: 508032 - protein, 9 aa, Homo Sapiens
GAPEGSLDV

SEQ ID NO: 508033 - protein, 9 aa, Homo Sapiens
GRMNPMGTA

SEQ ID NO: 508034 - protein, 9 aa, Homo Sapiens
GDDSLDMNC

SEQ ID NO: 508035 - protein, 9 aa, Homo Sapiens
LKPAIRNQI

SEQ ID NO: 508036 - protein, 9 aa, Homo Sapiens
ISDHPPEQR

SEQ ID NO: 508037 - protein, 9 aa, Homo Sapiens
QKAVELMNR

SEQ ID NO: 508038 - protein, 9 aa, Homo Sapiens
RKSKFSFLS

SEQ ID NO: 508039 - protein, 9 aa, Homo Sapiens
VELMNRTEM

SEQ ID NO: 508040 - protein, 9 aa, Homo Sapiens
FYRKSKFSF

SEQ ID NO: 508041 - protein, 9 aa, Homo Sapiens
NTCVMLTTF

SEQ ID NO: 508042 - protein, 9 aa, Homo Sapiens
CLTDLALLC

SEQ ID NO: 508043 - protein, 9 aa, Homo Sapiens
DINSRMAGQ

SEQ ID NO: 508044 - protein, 9 aa, Homo Sapiens
EGTETSGDF

SEQ ID NO: 508045 - protein, 9 aa, Homo Sapiens
LTDLALLCF

SEQ ID NO: 508046 - protein, 9 aa, Homo Sapiens
VSRLKKTWD

SEQ ID NO: 508047 - protein, 9 aa, Homo Sapiens
LMNRTEMPC

SEQ ID NO: 508048 - protein, 9 aa, Homo Sapiens
KMIEKHAGY

SEQ ID NO: 508049 - protein, 9 aa, Homo Sapiens
FQKAVELMN

SEQ ID NO: 508050 - protein, 9 aa, Homo Sapiens
AVYLCDGEA

SEQ ID NO: 508051 - protein, 9 aa, Homo Sapiens
LCCLLSPLL

SEQ ID NO: 508052 - protein, 9 aa, Homo Sapiens
YVIYFDFWF

SEQ ID NO: 508053 - protein, 9 aa, Homo Sapiens
TDGCHDPRD

SEQ ID NO: 508054 - protein, 9 aa, Homo Sapiens
LKLEGDDSL

SEQ ID NO: 508055 - protein, 9 aa, Homo Sapiens
SKFSFLSQH

SEQ ID NO: 508056 - protein, 9 aa, Homo Sapiens
GPLLLHKCC

SEQ ID NO: 508057 - protein, 9 aa, Homo Sapiens
VGKTFLLIS

SEQ ID NO: 508058 - protein, 9 aa, Homo Sapiens
PDINSRMAG

SEQ ID NO: 508059 - protein, 9 aa, Homo Sapiens
VGENNRRGK

SEQ ID NO: 508060 - protein, 9 aa, Homo Sapiens
AGAENLICW

SEQ ID NO: 508061 - protein, 9 aa, Homo Sapiens
LLHKCCQLW

SEQ ID NO: 508062 - protein, 9 aa, Homo Sapiens
KFSFLSQHD

SEQ ID NO: 508063 - protein, 9 aa, Homo Sapiens
FAVVITDGC

SEQ ID NO: 508064 - protein, 9 aa, Homo Sapiens
LLKLEGDDS

SEQ ID NO: 508065 - protein, 9 aa, Homo Sapiens
AVGKTFLLI

SEQ ID NO: 508066 - protein, 9 aa, Homo Sapiens
DGCTFQLLT

SEQ ID NO: 508067 - protein, 9 aa, Homo Sapiens
VTKGSCVVA

SEQ ID NO: 508068 - protein, 9 aa, Homo Sapiens
KTEQGGRNA

SEQ ID NO: 508069 - protein, 9 aa, Homo Sapiens
GQDGCTFQL

SEQ ID NO: 508070 - protein, 9 aa, Homo Sapiens
GCHDPRDDD

SEQ ID NO: 508071 - protein, 9 aa, Homo Sapiens
SQTGCGEPY

SEQ ID NO: 508072 - protein, 9 aa, Homo Sapiens
LFIVYSESK

SEQ ID NO: 508073 - protein, 9 aa, Homo Sapiens
NVGPWSKCR

SEQ ID NO: 508074 - protein, 9 aa, Homo Sapiens
TVGKVTSYV

SEQ ID NO: 508075 - protein, 9 aa, Homo Sapiens
KLIHLKPAI

SEQ ID NO: 508076 - protein, 9 aa, Homo Sapiens
LRGTMGNVF

SEQ ID NO: 508077 - protein, 9 aa, Homo Sapiens
TAGYPNVSI

SEQ ID NO: 508078 - protein, 9 aa, Homo Sapiens
GSCVVAWKP

SEQ ID NO: 508079 - protein, 9 aa, Homo Sapiens
SCPHKCSVR

SEQ ID NO: 508080 - protein, 9 aa, Homo Sapiens
GMFTISDHP

SEQ ID NO: 508081 - protein, 9 aa, Homo Sapiens
RMNPMGTAS

SEQ ID NO: 508082 - protein, 9 aa, Homo Sapiens
ELRGTMGNV

SEQ ID NO: 508083 - protein, 9 aa, Homo Sapiens
PEQHGMFTI

SEQ ID NO: 508084 - protein, 9 aa, Homo Sapiens
VCCGVCGVL

SEQ ID NO: 508085 - protein, 9 aa, Homo Sapiens
NEQSKEVTE

SEQ ID NO: 508086 - protein, 9 aa, Homo Sapiens
DLALLCFFC

SEQ ID NO: 508087 - protein, 9 aa, Homo Sapiens
ARKLIHLKP

SEQ ID NO: 508088 - protein, 9 aa, Homo Sapiens
AYATHAILN

SEQ ID NO: 508089 - protein, 9 aa, Homo Sapiens
VIYFDFWFQ

SEQ ID NO: 508090 - protein, 9 aa, Homo Sapiens
ITDGCHDPR

SEQ ID NO: 508091 - protein, 9 aa, Homo Sapiens
TFQLLTPEE

SEQ ID NO: 508092 - protein, 9 aa, Homo Sapiens
YLCDGEACF

SEQ ID NO: 508093 - protein, 9 aa, Homo Sapiens
DAYATHAIL

SEQ ID NO: 508094 - protein, 9 aa, Homo Sapiens
QNSGRMNPM

SEQ ID NO: 508095 - protein, 9 aa, Homo Sapiens
ENAVYLCDG

SEQ ID NO: 508096 - protein, 9 aa, Homo Sapiens
SRLKKTWDK

SEQ ID NO: 508097 - protein, 9 aa, Homo Sapiens
KVKFYIPDI

SEQ ID NO: 508098 - protein, 9 aa, Homo Sapiens
DDAYATHAI

SEQ ID NO: 508099 - protein, 9 aa, Homo Sapiens
MNRTEMPCQ

SEQ ID NO: 508100 - protein, 9 aa, Homo Sapiens
WDKVRTAKF

SEQ ID NO: 508101 - protein, 9 aa, Homo Sapiens
ENNRRGKPL

SEQ ID NO: 508102 - protein, 9 aa, Homo Sapiens
KTAGYPNVS

SEQ ID NO: 508103 - protein, 9 aa, Homo Sapiens
GGRNALLSD

SEQ ID NO: 508104 - protein, 9 aa, Homo Sapiens
LIHLKPAIR

SEQ ID NO: 508105 - protein, 9 aa, Homo Sapiens
VSIHNFTTS

SEQ ID NO: 508106 - protein, 9 aa, Homo Sapiens
LCDGEACFK

SEQ ID NO: 508107 - protein, 9 aa, Homo Sapiens
TWDKVRTAK

SEQ ID NO: 508108 - protein, 9 aa, Homo Sapiens
KGSCVVAWK

SEQ ID NO: 508109 - protein, 9 aa, Homo Sapiens
NRRGKPLIM

SEQ ID NO: 508110 - protein, 9 aa, Homo Sapiens
VKNMIYVIY

SEQ ID NO: 508111 - protein, 9 aa, Homo Sapiens
WAGAENLIC

SEQ ID NO: 508112 - protein, 9 aa, Homo Sapiens
TSGDFQLLS

SEQ ID NO: 508113 - protein, 9 aa, Homo Sapiens
SQLHLRCVK

SEQ ID NO: 508114 - protein, 9 aa, Homo Sapiens
MFTISDHPP

SEQ ID NO: 508115 - protein, 9 aa, Homo Sapiens
MIEKHAGYK

SEQ ID NO: 508116 - protein, 9 aa, Homo Sapiens
GDGAVGKTF

SEQ ID NO: 508117 - protein, 9 aa, Homo Sapiens
VCGVLFIVY

SEQ ID NO: 508118 - protein, 9 aa, Homo Sapiens
DFFLFLCCL

SEQ ID NO: 508119 - protein, 9 aa, Homo Sapiens
IEKHAGYKF

SEQ ID NO: 508120 - protein, 9 aa, Homo Sapiens
DGCHDPRDD

SEQ ID NO: 508121 - protein, 9 aa, Homo Sapiens
GVCGVLFIV

SEQ ID NO: 508122 - protein, 9 aa, Homo Sapiens
NVSIHNFTT

SEQ ID NO: 508123 - protein, 9 aa, Homo Sapiens
TEQGGRNAL

SEQ ID NO: 508124 - protein, 9 aa, Homo Sapiens
KTWDKVRTA

SEQ ID NO: 508125 - protein, 9 aa, Homo Sapiens
CHDPRDDDL

SEQ ID NO: 508126 - protein, 9 aa, Homo Sapiens
EQEKEKDSL

SEQ ID NO: 508127 - protein, 9 aa, Homo Sapiens
KEAEQEKEK

SEQ ID NO: 508128 - protein, 9 aa, Homo Sapiens
IPDINSRMA

SEQ ID NO: 508129 - protein, 9 aa, Homo Sapiens
KHAGYKFSA

SEQ ID NO: 508130 - protein, 9 aa, Homo Sapiens
LKEAQNTCV

SEQ ID NO: 508131 - protein, 9 aa, Homo Sapiens
MGNVFSFAA

SEQ ID NO: 508132 - protein, 9 aa, Homo Sapiens
AMKAVNEQS

SEQ ID NO: 508133 - protein, 9 aa, Homo Sapiens
YIPDINSRM

SEQ ID NO: 508134 - protein, 9 aa, Homo Sapiens
AEQEKEKDS

SEQ ID NO: 508135 - protein, 9 aa, Homo Sapiens
TITAVTKGS

SEQ ID NO: 508136 - protein, 9 aa, Homo Sapiens
GGAPEGSLD

SEQ ID NO: 508137 - protein, 9 aa, Homo Sapiens
HAILNSPSS

SEQ ID NO: 508138 - protein, 9 aa, Homo Sapiens
GKTFLLISY

SEQ ID NO: 508139 - protein, 9 aa, Homo Sapiens
APEGSLDVL

SEQ ID NO: 508140 - protein, 9 aa, Homo Sapiens
KDSLGAGTH

SEQ ID NO: 508141 - protein, 9 aa, Homo Sapiens
SLDMNCTLP

SEQ ID NO: 508142 - protein, 9 aa, Homo Sapiens
CLLSPLLKA

SEQ ID NO: 508143 - protein, 9 aa, Homo Sapiens
KEKDSLGAG

SEQ ID NO: 508144 - protein, 9 aa, Homo Sapiens
PWAGAENLI

SEQ ID NO: 508145 - protein, 9 aa, Homo Sapiens
QHGMFTISD

SEQ ID NO: 508146 - protein, 9 aa, Homo Sapiens
GTETSGDFQ

SEQ ID NO: 508147 - protein, 9 aa, Homo Sapiens
VKFYIPDIN

SEQ ID NO: 508148 - protein, 9 aa, Homo Sapiens
FTISDHPPE

SEQ ID NO: 508149 - protein, 9 aa, Homo Sapiens
IHLKPAIRN

SEQ ID NO: 508150 - protein, 9 aa, Homo Sapiens
GNGGAPEGS

SEQ ID NO: 508151 - protein, 9 aa, Homo Sapiens
HLRCVKFQE

SEQ ID NO: 508152 - protein, 9 aa, Homo Sapiens
GENNRRGKP

SEQ ID NO: 508153 - protein, 9 aa, Homo Sapiens
GEACFKWYS

SEQ ID NO: 508154 - protein, 9 aa, Homo Sapiens
SKEVTEFGN

SEQ ID NO: 508155 - protein, 9 aa, Homo Sapiens
QEKEKDSLG

SEQ ID NO: 508156 - protein, 9 aa, Homo Sapiens
GCTFQLLTP

SEQ ID NO: 508157 - protein, 9 aa, Homo Sapiens
EKDSLGAGT

SEQ ID NO: 508158 - protein, 9 aa, Homo Sapiens
AVVITDGCH

SEQ ID NO: 508159 - protein, 9 aa, Homo Sapiens
EGDDSLDMN

SEQ ID NO: 508160 - protein, 9 aa, Homo Sapiens
INSRMAGQY

SEQ ID NO: 508161 - protein, 9 aa, Homo Sapiens
NGGAPEGSL

SEQ ID NO: 508162 - protein, 9 aa, Homo Sapiens
FLLISYTTN

SEQ ID NO: 508163 - protein, 9 aa, Homo Sapiens
VMLTTFNEI

SEQ ID NO: 508164 - protein, 9 aa, Homo Sapiens
KAVNEQSKE

SEQ ID NO: 508165 - protein, 9 aa, Homo Sapiens
FYIPDINSR

SEQ ID NO: 508166 - protein, 9 aa, Homo Sapiens
QSKEVTEFG

SEQ ID NO: 508167 - protein, 9 aa, Homo Sapiens
GVLFIVYSE

SEQ ID NO: 508168 - protein, 9 aa, Homo Sapiens
PLGPLLLHK

SEQ ID NO: 508169 - protein, 9 aa, Homo Sapiens
AGYPNVSIH

SEQ ID NO: 508170 - protein, 9 aa, Homo Sapiens
FFLFLCCLL

SEQ ID NO: 508171 - protein, 9 aa, Homo Sapiens
FSLNVGPWS

SEQ ID NO: 508172 - protein, 9 aa, Homo Sapiens
RGTMGNVFS

SEQ ID NO: 508173 - protein, 9 aa, Homo Sapiens
DDSLDMNCT

SEQ ID NO: 508174 - protein, 9 aa, Homo Sapiens
NKTEQGGRN

SEQ ID NO: 508175 - protein, 9 aa, Homo Sapiens
TISDHPPEQ

SEQ ID NO: 508176 - protein, 9 aa, Homo Sapiens
SKMIEKHAG

SEQ ID NO: 508177 - protein, 9 aa, Homo Sapiens
TAVTKGSCV

SEQ ID NO: 508178 - protein, 9 aa, Homo Sapiens
LDVGENNRR

SEQ ID NO: 508179 - protein, 9 aa, Homo Sapiens
HLKPAIRNQ

SEQ ID NO: 508180 - protein, 9 aa, Homo Sapiens
QQLAGNGGA

SEQ ID NO: 508181 - protein, 9 aa, Homo Sapiens
KKTWDKVRT

SEQ ID NO: 508182 - protein, 9 aa, Homo Sapiens
FQLLTPEEE

SEQ ID NO: 508183 - protein, 9 aa, Homo Sapiens
AVTKGSCVV

SEQ ID NO: 508184 - protein, 9 aa, Homo Sapiens
LAGNGGAPE

SEQ ID NO: 508185 - protein, 9 aa, Homo Sapiens
QLHLRCVKF

SEQ ID NO: 508186 - protein, 9 aa, Homo Sapiens
LFCLTDLAL

SEQ ID NO: 508187 - protein, 9 aa, Homo Sapiens
TLAFPGGGL

SEQ ID NO: 508188 - protein, 9 aa, Homo Sapiens
SQSYNIEQI

SEQ ID NO: 508189 - protein, 9 aa, Homo Sapiens
HQHKLCFRR

SEQ ID NO: 508190 - protein, 9 aa, Homo Sapiens
HLTRARRCP

SEQ ID NO: 508191 - protein, 9 aa, Homo Sapiens
KSNMGTSVD

SEQ ID NO: 508192 - protein, 9 aa, Homo Sapiens
QRSTFAPVL

SEQ ID NO: 508193 - protein, 9 aa, Homo Sapiens
WHQHKLCFR

SEQ ID NO: 508194 - protein, 9 aa, Homo Sapiens
EKMLTKELL

SEQ ID NO: 508195 - protein, 9 aa, Homo Sapiens
AYQACCKER

SEQ ID NO: 508196 - protein, 9 aa, Homo Sapiens
DFDTHTSSN

SEQ ID NO: 508197 - protein, 9 aa, Homo Sapiens
ESKRVLSLP

SEQ ID NO: 508198 - protein, 9 aa, Homo Sapiens
EAIGDMLAL

SEQ ID NO: 508199 - protein, 9 aa, Homo Sapiens
REMHLQDTT

SEQ ID NO: 508200 - protein, 9 aa, Homo Sapiens
SHLCANGST

SEQ ID NO: 508201 - protein, 9 aa, Homo Sapiens
KPKKATVAA

SEQ ID NO: 508202 - protein, 9 aa, Homo Sapiens
DTQHWVLGL

SEQ ID NO: 508203 - protein, 9 aa, Homo Sapiens
GNCTVLQVV

SEQ ID NO: 508204 - protein, 9 aa, Homo Sapiens
AGTPENSIL

SEQ ID NO: 508205 - protein, 9 aa, Homo Sapiens
WWQKNGSQV

SEQ ID NO: 508206 - protein, 9 aa, Homo Sapiens
LCANGSTCT

SEQ ID NO: 508207 - protein, 9 aa, Homo Sapiens
HSHLTRARR

SEQ ID NO: 508208 - protein, 9 aa, Homo Sapiens
PEYITLNYD

SEQ ID NO: 508209 - protein, 9 aa, Homo Sapiens
YFILQTYVP

SEQ ID NO: 508210 - protein, 9 aa, Homo Sapiens
RREMHLQDT

SEQ ID NO: 508211 - protein, 9 aa, Homo Sapiens
LQTYVPSIL

SEQ ID NO: 508212 - protein, 9 aa, Homo Sapiens
RHSHLTRAR

SEQ ID NO: 508213 - protein, 9 aa, Homo Sapiens
RNSFELRVC

SEQ ID NO: 508214 - protein, 9 aa, Homo Sapiens
KVPKAGCSN

SEQ ID NO: 508215 - protein, 9 aa, Homo Sapiens
EEWYNRLHI

SEQ ID NO: 508216 - protein, 9 aa, Homo Sapiens
DGSPSLEYT

SEQ ID NO: 508217 - protein, 9 aa, Homo Sapiens
PHGILGPKE

SEQ ID NO: 508218 - protein, 9 aa, Homo Sapiens
LSVVCIVGE

SEQ ID NO: 508219 - protein, 9 aa, Homo Sapiens
DIVTMVKGI

SEQ ID NO: 508220 - protein, 9 aa, Homo Sapiens
VLYCKVPKA

SEQ ID NO: 508221 - protein, 9 aa, Homo Sapiens
GWWQKNGSQ

SEQ ID NO: 508222 - protein, 9 aa, Homo Sapiens
RRPRHSHLT

SEQ ID NO: 508223 - protein, 9 aa, Homo Sapiens
IQQVSIEEI

SEQ ID NO: 508224 - protein, 9 aa, Homo Sapiens
DKCGHENIH

SEQ ID NO: 508225 - protein, 9 aa, Homo Sapiens
VKQRSTFAP

SEQ ID NO: 508226 - protein, 9 aa, Homo Sapiens
GTSVDHDDS

SEQ ID NO: 508227 - protein, 9 aa, Homo Sapiens
NYNDQLLGY

SEQ ID NO: 508228 - protein, 9 aa, Homo Sapiens
LGNWLAVRF

SEQ ID NO: 508229 - protein, 9 aa, Homo Sapiens
VAARIQKLK

SEQ ID NO: 508230 - protein, 9 aa, Homo Sapiens
VRFGNELEK

SEQ ID NO: 508231 - protein, 9 aa, Homo Sapiens
CRGDGSPSL

SEQ ID NO: 508232 - protein, 9 aa, Homo Sapiens
YCKVPKAGC

SEQ ID NO: 508233 - protein, 9 aa, Homo Sapiens
AGEQGPHGI

SEQ ID NO: 508234 - protein, 9 aa, Homo Sapiens
GKSNLTKHE

SEQ ID NO: 508235 - protein, 9 aa, Homo Sapiens
YVPSILITI

SEQ ID NO: 508236 - protein, 9 aa, Homo Sapiens
QTIKFLKHR

SEQ ID NO: 508237 - protein, 9 aa, Homo Sapiens
PGGGLVTAS

SEQ ID NO: 508238 - protein, 9 aa, Homo Sapiens
ACCKERFFS

SEQ ID NO: 508239 - protein, 9 aa, Homo Sapiens
HTSSNYNDQ

SEQ ID NO: 508240 - protein, 9 aa, Homo Sapiens
QACCKERFF

SEQ ID NO: 508241 - protein, 9 aa, Homo Sapiens
EGTTGTTKK

SEQ ID NO: 508242 - protein, 9 aa, Homo Sapiens
INFGEISGT

SEQ ID NO: 508243 - protein, 9 aa, Homo Sapiens
CLSHLCANG

SEQ ID NO: 508244 - protein, 9 aa, Homo Sapiens
KSNLTKHEK

SEQ ID NO: 508245 - protein, 9 aa, Homo Sapiens
CFRGQTIKF

SEQ ID NO: 508246 - protein, 9 aa, Homo Sapiens
LEYTLFRLQ

SEQ ID NO: 508247 - protein, 9 aa, Homo Sapiens
VVCIVGEES

SEQ ID NO: 508248 - protein, 9 aa, Homo Sapiens
KEEIKILKK

SEQ ID NO: 508249 - protein, 9 aa, Homo Sapiens
SSWDSQSYN

SEQ ID NO: 508250 - protein, 9 aa, Homo Sapiens
VAATPKKSA

SEQ ID NO: 508251 - protein, 9 aa, Homo Sapiens
TSSNYNDQL

SEQ ID NO: 508252 - protein, 9 aa, Homo Sapiens
SNMGTSVDH

SEQ ID NO: 508253 - protein, 9 aa, Homo Sapiens
HLARDVMKE

SEQ ID NO: 508254 - protein, 9 aa, Homo Sapiens
QASGVAARI

SEQ ID NO: 508255 - protein, 9 aa, Homo Sapiens
NWLAVRFGN

SEQ ID NO: 508256 - protein, 9 aa, Homo Sapiens
CNRTFLVLG

SEQ ID NO: 508257 - protein, 9 aa, Homo Sapiens
NCTVLQVVE

SEQ ID NO: 508258 - protein, 9 aa, Homo Sapiens
VESKRVLSL

SEQ ID NO: 508259 - protein, 9 aa, Homo Sapiens
NQLSNLAQH

SEQ ID NO: 508260 - protein, 9 aa, Homo Sapiens
QKNGSQVCI

SEQ ID NO: 508261 - protein, 9 aa, Homo Sapiens
TEGLLKYFT

SEQ ID NO: 508262 - protein, 9 aa, Homo Sapiens
HLCANGSTC

SEQ ID NO: 508263 - protein, 9 aa, Homo Sapiens
EHLARDVMK

SEQ ID NO: 508264 - protein, 9 aa, Homo Sapiens
TVAATPKKS

SEQ ID NO: 508265 - protein, 9 aa, Homo Sapiens
SPADTQHWV

SEQ ID NO: 508266 - protein, 9 aa, Homo Sapiens
QNKKEAEEP

SEQ ID NO: 508267 - protein, 9 aa, Homo Sapiens
ALSQTGFSY

SEQ ID NO: 508268 - protein, 9 aa, Homo Sapiens
LRWGASKKA

SEQ ID NO: 508269 - protein, 9 aa, Homo Sapiens
APSPADTQH

SEQ ID NO: 508270 - protein, 9 aa, Homo Sapiens
GYFILQTYV

SEQ ID NO: 508271 - protein, 9 aa, Homo Sapiens
STEYKVISH

SEQ ID NO: 508272 - protein, 9 aa, Homo Sapiens
KFLKHRFSP

SEQ ID NO: 508273 - protein, 9 aa, Homo Sapiens
AAAEAALSQ

SEQ ID NO: 508274 - protein, 9 aa, Homo Sapiens
GSQVCIQRG

SEQ ID NO: 508275 - protein, 9 aa, Homo Sapiens
EKESDTPIQ

SEQ ID NO: 508276 - protein, 9 aa, Homo Sapiens
QSYNIEQIC

SEQ ID NO: 508277 - protein, 9 aa, Homo Sapiens
SNLTKHEKI

SEQ ID NO: 508278 - protein, 9 aa, Homo Sapiens
KRVLSLPET

SEQ ID NO: 508279 - protein, 9 aa, Homo Sapiens
QDEGTTGTT

SEQ ID NO: 508280 - protein, 9 aa, Homo Sapiens
SAGTPENSI

SEQ ID NO: 508281 - protein, 9 aa, Homo Sapiens
LQNKKEAEE

SEQ ID NO: 508282 - protein, 9 aa, Homo Sapiens
QTYVPSILI

SEQ ID NO: 508283 - protein, 9 aa, Homo Sapiens
LTKHEKIHI

SEQ ID NO: 508284 - protein, 9 aa, Homo Sapiens
KNGSQVCIQ

SEQ ID NO: 508285 - protein, 9 aa, Homo Sapiens
TQHWVLGLH

SEQ ID NO: 508286 - protein, 9 aa, Homo Sapiens
SGKSNLTKH

SEQ ID NO: 508287 - protein, 9 aa, Homo Sapiens
DKLVCNRTF

SEQ ID NO: 508288 - protein, 9 aa, Homo Sapiens
ARIQKLKVG

SEQ ID NO: 508289 - protein, 9 aa, Homo Sapiens
QHKLCFRRP

SEQ ID NO: 508290 - protein, 9 aa, Homo Sapiens
NKKEAEEPG

SEQ ID NO: 508291 - protein, 9 aa, Homo Sapiens
KLCFRRPIE

SEQ ID NO: 508292 - protein, 9 aa, Homo Sapiens
TEYKVISHW

SEQ ID NO: 508293 - protein, 9 aa, Homo Sapiens
ITLNYDSDA

SEQ ID NO: 508294 - protein, 9 aa, Homo Sapiens
RKQQDEGTT

SEQ ID NO: 508295 - protein, 9 aa, Homo Sapiens
LEVVDVNEN

SEQ ID NO: 508296 - protein, 9 aa, Homo Sapiens
VLPDIVTMV

SEQ ID NO: 508297 - protein, 9 aa, Homo Sapiens
DEGTTGTTK

SEQ ID NO: 508298 - protein, 9 aa, Homo Sapiens
TVINFGEIS

SEQ ID NO: 508299 - protein, 9 aa, Homo Sapiens
GKAPEYITL

SEQ ID NO: 508300 - protein, 9 aa, Homo Sapiens
PVQVTFQTP

SEQ ID NO: 508301 - protein, 9 aa, Homo Sapiens
DSQSYNIEQ

SEQ ID NO: 508302 - protein, 9 aa, Homo Sapiens
AYWLLEKML

SEQ ID NO: 508303 - protein, 9 aa, Homo Sapiens
SKRVLSLPE

SEQ ID NO: 508304 - protein, 9 aa, Homo Sapiens
GNSLLRWGA

SEQ ID NO: 508305 - protein, 9 aa, Homo Sapiens
WTDACLSHL

SEQ ID NO: 508306 - protein, 9 aa, Homo Sapiens
KSTEYKVIS

SEQ ID NO: 508307 - protein, 9 aa, Homo Sapiens
VCNRTFLVL

SEQ ID NO: 508308 - protein, 9 aa, Homo Sapiens
VTMVKGIGN

SEQ ID NO: 508309 - protein, 9 aa, Homo Sapiens
QEVIRQAGV

SEQ ID NO: 508310 - protein, 9 aa, Homo Sapiens
NSFELRVCA

SEQ ID NO: 508311 - protein, 9 aa, Homo Sapiens
AIEDEKQEL

SEQ ID NO: 508312 - protein, 9 aa, Homo Sapiens
VLLATEGLL

SEQ ID NO: 508313 - protein, 9 aa, Homo Sapiens
KGPVESKRV

SEQ ID NO: 508314 - protein, 9 aa, Homo Sapiens
LLRWGASKK

SEQ ID NO: 508315 - protein, 9 aa, Homo Sapiens
PKKATVAAT

SEQ ID NO: 508316 - protein, 9 aa, Homo Sapiens
SFVELEVVD

SEQ ID NO: 508317 - protein, 9 aa, Homo Sapiens
KQRSTFAPV

SEQ ID NO: 508318 - protein, 9 aa, Homo Sapiens
RGQTIKFLK

SEQ ID NO: 508319 - protein, 9 aa, Homo Sapiens
TKHEKIHIG

SEQ ID NO: 508320 - protein, 9 aa, Homo Sapiens
VTFQTPISS

SEQ ID NO: 508321 - protein, 9 aa, Homo Sapiens
RIQKLKVGD

SEQ ID NO: 508322 - protein, 9 aa, Homo Sapiens
MWWHQHKLC

SEQ ID NO: 508323 - protein, 9 aa, Homo Sapiens
GLIMDRTEH

SEQ ID NO: 508324 - protein, 9 aa, Homo Sapiens
TFQTPISSS

SEQ ID NO: 508325 - protein, 9 aa, Homo Sapiens
NSLLRWGAS

SEQ ID NO: 508326 - protein, 9 aa, Homo Sapiens
FSGKSNLTK

SEQ ID NO: 508327 - protein, 9 aa, Homo Sapiens
FQTPISSSS

SEQ ID NO: 508328 - protein, 9 aa, Homo Sapiens
LLATEGLLK

SEQ ID NO: 508329 - protein, 9 aa, Homo Sapiens
LRRPRHSHL

SEQ ID NO: 508330 - protein, 9 aa, Homo Sapiens
AKRKQQDEG

SEQ ID NO: 508331 - protein, 9 aa, Homo Sapiens
DTHTSSNYN

SEQ ID NO: 508332 - protein, 9 aa, Homo Sapiens
DVKSGNCTV

SEQ ID NO: 508333 - protein, 9 aa, Homo Sapiens
KKEAEEPGP

SEQ ID NO: 508334 - protein, 9 aa, Homo Sapiens
LAFPGGGLV

SEQ ID NO: 508335 - protein, 9 aa, Homo Sapiens
CTVLQVVEA

SEQ ID NO: 508336 - protein, 9 aa, Homo Sapiens
DRWSAGTPE

SEQ ID NO: 508337 - protein, 9 aa, Homo Sapiens
MLALSVSTP

SEQ ID NO: 508338 - protein, 9 aa, Homo Sapiens
GRNSFELRV

SEQ ID NO: 508339 - protein, 9 aa, Homo Sapiens
TEHLARDVM

SEQ ID NO: 508340 - protein, 9 aa, Homo Sapiens
LQDTTRFCP

SEQ ID NO: 508341 - protein, 9 aa, Homo Sapiens
PDIVTMVKG

SEQ ID NO: 508342 - protein, 9 aa, Homo Sapiens
IRAIEDEKQ

SEQ ID NO: 508343 - protein, 9 aa, Homo Sapiens
LNYDSDAMS

SEQ ID NO: 508344 - protein, 9 aa, Homo Sapiens
KKPKKATVA

SEQ ID NO: 508345 - protein, 9 aa, Homo Sapiens
LLSVVCIVG

SEQ ID NO: 508346 - protein, 9 aa, Homo Sapiens
SGNCTVLQV

SEQ ID NO: 508347 - protein, 9 aa, Homo Sapiens
QGPHGILGP

SEQ ID NO: 508348 - protein, 9 aa, Homo Sapiens
LTRARRCPG

SEQ ID NO: 508349 - protein, 9 aa, Homo Sapiens
RRKFVLLAT

SEQ ID NO: 508350 - protein, 9 aa, Homo Sapiens
EEIKILKKA

SEQ ID NO: 508351 - protein, 9 aa, Homo Sapiens
ATEGLLKYF

SEQ ID NO: 508352 - protein, 9 aa, Homo Sapiens
VKGIGNGFP

SEQ ID NO: 508353 - protein, 9 aa, Homo Sapiens
SVDHDDSFM

SEQ ID NO: 508354 - protein, 9 aa, Homo Sapiens
IVTMVKGIG

SEQ ID NO: 508355 - protein, 9 aa, Homo Sapiens
NRRTLAFPG

SEQ ID NO: 508356 - protein, 9 aa, Homo Sapiens
MNRRTLAFP

SEQ ID NO: 508357 - protein, 9 aa, Homo Sapiens
IQGWWQKNG

SEQ ID NO: 508358 - protein, 9 aa, Homo Sapiens
NRTFLVLGL

SEQ ID NO: 508359 - protein, 9 aa, Homo Sapiens
WWHQHKLCF

SEQ ID NO: 508360 - protein, 9 aa, Homo Sapiens
GIGDVLQEV

SEQ ID NO: 508361 - protein, 9 aa, Homo Sapiens
DTPIQQVSI

SEQ ID NO: 508362 - protein, 9 aa, Homo Sapiens
ACLSHLCAN

SEQ ID NO: 508363 - protein, 9 aa, Homo Sapiens
YNIEQICLG

SEQ ID NO: 508364 - protein, 9 aa, Homo Sapiens
QVCIQRGQT

SEQ ID NO: 508365 - protein, 9 aa, Homo Sapiens
KFVLLATEG

SEQ ID NO: 508366 - protein, 9 aa, Homo Sapiens
RGDGSPSLE

SEQ ID NO: 508367 - protein, 9 aa, Homo Sapiens
VSFVELEVV

SEQ ID NO: 508368 - protein, 9 aa, Homo Sapiens
SHLTRARRC

SEQ ID NO: 508369 - protein, 9 aa, Homo Sapiens
RWGASKKAL

SEQ ID NO: 508370 - protein, 9 aa, Homo Sapiens
CGHENIHLK

SEQ ID NO: 508371 - protein, 9 aa, Homo Sapiens
LLGRNSFEL

SEQ ID NO: 508372 - protein, 9 aa, Homo Sapiens
SPSLEYTLF

SEQ ID NO: 508373 - protein, 9 aa, Homo Sapiens
IVGIWWTVI

SEQ ID NO: 508374 - protein, 9 aa, Homo Sapiens
FNQLSNLAQ

SEQ ID NO: 508375 - protein, 9 aa, Homo Sapiens
LQEVIRQAG

SEQ ID NO: 508376 - protein, 9 aa, Homo Sapiens
SAVKQRSTF

SEQ ID NO: 508377 - protein, 9 aa, Homo Sapiens
ENIHLKISC

SEQ ID NO: 508378 - protein, 9 aa, Homo Sapiens
HLQDTTRFC

SEQ ID NO: 508379 - protein, 9 aa, Homo Sapiens
VVKLLSVVC

SEQ ID NO: 508380 - protein, 9 aa, Homo Sapiens
CKVPKAGCS

SEQ ID NO: 508381 - protein, 9 aa, Homo Sapiens
YKVISHWTN

SEQ ID NO: 508382 - protein, 9 aa, Homo Sapiens
WTVINFGEI

SEQ ID NO: 508383 - protein, 9 aa, Homo Sapiens
YWLLEKMLT

SEQ ID NO: 508384 - protein, 9 aa, Homo Sapiens
KAPEYITLN

SEQ ID NO: 508385 - protein, 9 aa, Homo Sapiens
KLGNSLLRW

SEQ ID NO: 508386 - protein, 9 aa, Homo Sapiens
LSHLCANGS

SEQ ID NO: 508387 - protein, 9 aa, Homo Sapiens
LSSVSTGHT

SEQ ID NO: 508388 - protein, 9 aa, Homo Sapiens
PSPADTQHW

SEQ ID NO: 508389 - protein, 9 aa, Homo Sapiens
QVTFQTPIS

SEQ ID NO: 508390 - protein, 9 aa, Homo Sapiens
LAVRFGNEL

SEQ ID NO: 508391 - protein, 9 aa, Homo Sapiens
IGDMLALSV

SEQ ID NO: 508392 - protein, 9 aa, Homo Sapiens
MGTSVDHDD

SEQ ID NO: 508393 - protein, 9 aa, Homo Sapiens
AADVKSGNC

SEQ ID NO: 508394 - protein, 9 aa, Homo Sapiens
EWYNRLHIT

SEQ ID NO: 508395 - protein, 9 aa, Homo Sapiens
KAYWLLEKM

SEQ ID NO: 508396 - protein, 9 aa, Homo Sapiens
QGWWQKNGS

SEQ ID NO: 508397 - protein, 9 aa, Homo Sapiens
KQQDEGTTG

SEQ ID NO: 508398 - protein, 9 aa, Homo Sapiens
KMLTKELLE

SEQ ID NO: 508399 - protein, 9 aa, Homo Sapiens
LATEGLLKY

SEQ ID NO: 508400 - protein, 9 aa, Homo Sapiens
CCKERFFSE

SEQ ID NO: 508401 - protein, 9 aa, Homo Sapiens
RPRHSHLTR

SEQ ID NO: 508402 - protein, 9 aa, Homo Sapiens
QDKLVCNRT

SEQ ID NO: 508403 - protein, 9 aa, Homo Sapiens
DACLSHLCA

SEQ ID NO: 508404 - protein, 9 aa, Homo Sapiens
ADTQHWVLG

SEQ ID NO: 508405 - protein, 9 aa, Homo Sapiens
SFELRVCAC

SEQ ID NO: 508406 - protein, 9 aa, Homo Sapiens
AEAALSQTG

SEQ ID NO: 508407 - protein, 9 aa, Homo Sapiens
NGSQVCIQR

SEQ ID NO: 508408 - protein, 9 aa, Homo Sapiens
TYVPSILIT

SEQ ID NO: 508409 - protein, 9 aa, Homo Sapiens
HEAIGDMLA

SEQ ID NO: 508410 - protein, 9 aa, Homo Sapiens
ELEVVDVNE

SEQ ID NO: 508411 - protein, 9 aa, Homo Sapiens
PENSILNAY

SEQ ID NO: 508412 - protein, 9 aa, Homo Sapiens
FHEAIGDML

SEQ ID NO: 508413 - protein, 9 aa, Homo Sapiens
AIGDMLALS

SEQ ID NO: 508414 - protein, 9 aa, Homo Sapiens
FELRVCACP

SEQ ID NO: 508415 - protein, 9 aa, Homo Sapiens
LGRNSFELR

SEQ ID NO: 508416 - protein, 9 aa, Homo Sapiens
SLLRWGASK

SEQ ID NO: 508417 - protein, 9 aa, Homo Sapiens
IQKLKVGDR

SEQ ID NO: 508418 - protein, 9 aa, Homo Sapiens
GFHEAIGDM

SEQ ID NO: 508419 - protein, 9 aa, Homo Sapiens
DELQNKKEA

SEQ ID NO: 508420 - protein, 9 aa, Homo Sapiens
HENIHLKIS

SEQ ID NO: 508421 - protein, 9 aa, Homo Sapiens
LYCKVPKAG

SEQ ID NO: 508422 - protein, 9 aa, Homo Sapiens
PRHSHLTRA

SEQ ID NO: 508423 - protein, 9 aa, Homo Sapiens
SYNIEQICL

SEQ ID NO: 508424 - protein, 9 aa, Homo Sapiens
EYKVISHWT

SEQ ID NO: 508425 - protein, 9 aa, Homo Sapiens
SVVCIVGEE

SEQ ID NO: 508426 - protein, 9 aa, Homo Sapiens
RENEAYQAC

SEQ ID NO: 508427 - protein, 9 aa, Homo Sapiens
RFGNELEKG

SEQ ID NO: 508428 - protein, 9 aa, Homo Sapiens
SNYNDQLLG

SEQ ID NO: 508429 - protein, 9 aa, Homo Sapiens
WLLEKMLTK

SEQ ID NO: 508430 - protein, 9 aa, Homo Sapiens
EDEKQELAK

SEQ ID NO: 508431 - protein, 9 aa, Homo Sapiens
GVAARIQKL

SEQ ID NO: 508432 - protein, 9 aa, Homo Sapiens
ILQTYVPSI

SEQ ID NO: 508433 - protein, 9 aa, Homo Sapiens
EQGPHGILG

SEQ ID NO: 508434 - protein, 9 aa, Homo Sapiens
TSVDHDDSF

SEQ ID NO: 508435 - protein, 9 aa, Homo Sapiens
NLAQHRRIH

SEQ ID NO: 508436 - protein, 9 aa, Homo Sapiens
GAKRKQQDE

SEQ ID NO: 508437 - protein, 9 aa, Homo Sapiens
GILGPKEKG

SEQ ID NO: 508438 - protein, 9 aa, Homo Sapiens
HGILGPKEK

SEQ ID NO: 508439 - protein, 9 aa, Homo Sapiens
AARIQKLKV

SEQ ID NO: 508440 - protein, 9 aa, Homo Sapiens
IGDVLQEVI

SEQ ID NO: 508441 - protein, 9 aa, Homo Sapiens
SAGIGDVLQ

SEQ ID NO: 508442 - protein, 9 aa, Homo Sapiens
RWSAGTPEN

SEQ ID NO: 508443 - protein, 9 aa, Homo Sapiens
ISAVKQRST

SEQ ID NO: 508444 - protein, 9 aa, Homo Sapiens
NMGTSVDHD

SEQ ID NO: 508445 - protein, 9 aa, Homo Sapiens
APEYITLNY

SEQ ID NO: 508446 - protein, 9 aa, Homo Sapiens
EIDELQNKK

SEQ ID NO: 508447 - protein, 9 aa, Homo Sapiens
RAIEDEKQE

SEQ ID NO: 508448 - protein, 9 aa, Homo Sapiens
RTEHLARDV

SEQ ID NO: 508449 - protein, 9 aa, Homo Sapiens
YNRLHITWD

SEQ ID NO: 508450 - protein, 9 aa, Homo Sapiens
SKEEIKILK

SEQ ID NO: 508451 - protein, 9 aa, Homo Sapiens
IKILKKAQK

SEQ ID NO: 508452 - protein, 9 aa, Homo Sapiens
PSLEYTLFR

SEQ ID NO: 508453 - protein, 9 aa, Homo Sapiens
SVSFVELEV

SEQ ID NO: 508454 - protein, 9 aa, Homo Sapiens
AVRFGNELE

SEQ ID NO: 508455 - protein, 9 aa, Homo Sapiens
GPVESKRVL

SEQ ID NO: 508456 - protein, 9 aa, Homo Sapiens
NIEQICLGA

SEQ ID NO: 508457 - protein, 9 aa, Homo Sapiens
RHRVLYCKV

SEQ ID NO: 508458 - protein, 9 aa, Homo Sapiens
GQTIKFLKH

SEQ ID NO: 508459 - protein, 9 aa, Homo Sapiens
STFAPVLRP

SEQ ID NO: 508460 - protein, 9 aa, Homo Sapiens
NRLHITWDP

SEQ ID NO: 508461 - protein, 9 aa, Homo Sapiens
IHLKISCTN

SEQ ID NO: 508462 - protein, 9 aa, Homo Sapiens
GTPENSILN

SEQ ID NO: 508463 - protein, 9 aa, Homo Sapiens
ELQNKKEAE

SEQ ID NO: 508464 - protein, 9 aa, Homo Sapiens
KCGHENIHL

SEQ ID NO: 508465 - protein, 9 aa, Homo Sapiens
SLEYTLFRL

SEQ ID NO: 508466 - protein, 9 aa, Homo Sapiens
GKSNMGTSV

SEQ ID NO: 508467 - protein, 9 aa, Homo Sapiens
ASGVAARIQ

SEQ ID NO: 508468 - protein, 9 aa, Homo Sapiens
TDACLSHLC

SEQ ID NO: 508469 - protein, 9 aa, Homo Sapiens
VLQEVIRQA

SEQ ID NO: 508470 - protein, 9 aa, Homo Sapiens
LEKESDTPI

SEQ ID NO: 508471 - protein, 9 aa, Homo Sapiens
AFPGGGLVT

SEQ ID NO: 508472 - protein, 9 aa, Homo Sapiens
SWDSQSYNI

SEQ ID NO: 508473 - protein, 9 aa, Homo Sapiens
DQDKLVCNR

SEQ ID NO: 508474 - protein, 9 aa, Homo Sapiens
KVISHWTNQ

SEQ ID NO: 508475 - protein, 9 aa, Homo Sapiens
KLVCNRTFL

SEQ ID NO: 508476 - protein, 9 aa, Homo Sapiens
EKQELAKLR

SEQ ID NO: 508477 - protein, 9 aa, Homo Sapiens
ISHWTNQLH

SEQ ID NO: 508478 - protein, 9 aa, Homo Sapiens
VKSGNCTVL

SEQ ID NO: 508479 - protein, 9 aa, Homo Sapiens
IAPSPADTQ

SEQ ID NO: 508480 - protein, 9 aa, Homo Sapiens
VCIQRGQTH

SEQ ID NO: 508481 - protein, 9 aa, Homo Sapiens
FRGQTIKFL

SEQ ID NO: 508482 - protein, 9 aa, Homo Sapiens
GDMLALSVS

SEQ ID NO: 508483 - protein, 9 aa, Homo Sapiens
RDQDKLVCN

SEQ ID NO: 508484 - protein, 9 aa, Homo Sapiens
IKFLKHRFS

SEQ ID NO: 508485 - protein, 9 aa, Homo Sapiens
KQELAKLRR

SEQ ID NO: 508486 - protein, 9 aa, Homo Sapiens
ADVKSGNCT

SEQ ID NO: 508487 - protein, 9 aa, Homo Sapiens
DRTEHLARD

SEQ ID NO: 508488 - protein, 9 aa, Homo Sapiens
HITWDPPSS

SEQ ID NO: 508489 - protein, 9 aa, Homo Sapiens
YITLNYDSD

SEQ ID NO: 508490 - protein, 9 aa, Homo Sapiens
VKLLSVVCI

SEQ ID NO: 508491 - protein, 9 aa, Homo Sapiens
WYNRLHITW

SEQ ID NO: 508492 - protein, 9 aa, Homo Sapiens
FVELEVVDV

SEQ ID NO: 508493 - protein, 9 aa, Homo Sapiens
KISKEEIKI

SEQ ID NO: 508494 - protein, 9 aa, Homo Sapiens
WQKNGSQVC

SEQ ID NO: 508495 - protein, 9 aa, Homo Sapiens
SDTPIQQVS

SEQ ID NO: 508496 - protein, 9 aa, Homo Sapiens
FILQTYVPS

SEQ ID NO: 508497 - protein, 9 aa, Homo Sapiens
KRKQQDEGT

SEQ ID NO: 508498 - protein, 9 aa, Homo Sapiens
IEDEKQELA

SEQ ID NO: 508499 - protein, 9 aa, Homo Sapiens
QLSNLAQHR

SEQ ID NO: 508500 - protein, 9 aa, Homo Sapiens
ELRVCACPG

SEQ ID NO: 508501 - protein, 9 aa, Homo Sapiens
WSAGTPENS

SEQ ID NO: 508502 - protein, 9 aa, Homo Sapiens
DKAYWLLEK

SEQ ID NO: 508503 - protein, 9 aa, Homo Sapiens
KATVAATPK

SEQ ID NO: 508504 - protein, 9 aa, Homo Sapiens
TFAPVLRPP

SEQ ID NO: 508505 - protein, 9 aa, Homo Sapiens
WGASKKALS

SEQ ID NO: 508506 - protein, 9 aa, Homo Sapiens
VISHWTNQL

SEQ ID NO: 508507 - protein, 9 aa, Homo Sapiens
FGNELEKGL

SEQ ID NO: 508508 - protein, 9 aa, Homo Sapiens
RAAAEAALS

SEQ ID NO: 508509 - protein, 9 aa, Homo Sapiens
RTLAFPGGG

SEQ ID NO: 508510 - protein, 9 aa, Homo Sapiens
SHWTNQLHL

SEQ ID NO: 508511 - protein, 9 aa, Homo Sapiens
VINFGEISG

SEQ ID NO: 508512 - protein, 9 aa, Homo Sapiens
VPSILITIL

SEQ ID NO: 508513 - protein, 9 aa, Homo Sapiens
GSPSLEYTL

SEQ ID NO: 508514 - protein, 9 aa, Homo Sapiens
KKATVAATP

SEQ ID NO: 508515 - protein, 9 aa, Homo Sapiens
PIQQVSIEE

SEQ ID NO: 508516 - protein, 9 aa, Homo Sapiens
LKISKEEIK

SEQ ID NO: 508517 - protein, 9 aa, Homo Sapiens
LIAPSPADT

SEQ ID NO: 508518 - protein, 9 aa, Homo Sapiens
GDVLQEVIR

SEQ ID NO: 508519 - protein, 9 aa, Homo Sapiens
THTSSNYND

SEQ ID NO: 508520 - protein, 9 aa, Homo Sapiens
PVESKRVLS

SEQ ID NO: 508521 - protein, 9 aa, Homo Sapiens
GHENIHLKI

SEQ ID NO: 508522 - protein, 9 aa, Homo Sapiens
TDVVKLLSV

SEQ ID NO: 508523 - protein, 9 aa, Homo Sapiens
GPHGILGPK

SEQ ID NO: 508524 - protein, 9 aa, Homo Sapiens
LIQGWWQKN

SEQ ID NO: 508525 - protein, 9 aa, Homo Sapiens
LIMDRTEHL

SEQ ID NO: 508526 - protein, 9 aa, Homo Sapiens
ISKEEIKIL

SEQ ID NO: 508527 - protein, 9 aa, Homo Sapiens
FLKHRFSPN

SEQ ID NO: 508528 - protein, 9 aa, Homo Sapiens
QQDEGTTGT

SEQ ID NO: 508529 - protein, 9 aa, Homo Sapiens
IWWTVINFG

SEQ ID NO: 508530 - protein, 9 aa, Homo Sapiens
TLNYDSDAM

SEQ ID NO: 508531 - protein, 9 aa, Homo Sapiens
KESDTPIQQ

SEQ ID NO: 508532 - protein, 9 aa, Homo Sapiens
NLTKHEKIH

SEQ ID NO: 508533 - protein, 9 aa, Homo Sapiens
WDSQSYNIE

SEQ ID NO: 508534 - protein, 9 aa, Homo Sapiens
TIKFLKHRF

SEQ ID NO: 508535 - protein, 9 aa, Homo Sapiens
RRTLAFPGG

SEQ ID NO: 508536 - protein, 9 aa, Homo Sapiens
GEQGPHGIL

SEQ ID NO: 508537 - protein, 9 aa, Homo Sapiens
ESDTPIQQV

SEQ ID NO: 508538 - protein, 9 aa, Homo Sapiens
SNLAQHRRI

SEQ ID NO: 508539 - protein, 9 aa, Homo Sapiens
DVLQEVIRQ

SEQ ID NO: 508540 - protein, 9 aa, Homo Sapiens
QELAKLRRT

SEQ ID NO: 508541 - protein, 9 aa, Homo Sapiens
VELEVVDVN

SEQ ID NO: 508542 - protein, 9 aa, Homo Sapiens
RLHITWDPP

SEQ ID NO: 508543 - protein, 9 aa, Homo Sapiens
AGIGDVLQE

SEQ ID NO: 508544 - protein, 9 aa, Homo Sapiens
MHLQDTTRF

SEQ ID NO: 508545 - protein, 9 aa, Homo Sapiens
LRAAAEAAL

SEQ ID NO: 508546 - protein, 9 aa, Homo Sapiens
TPIQQVSIE

SEQ ID NO: 508547 - protein, 9 aa, Homo Sapiens
VRREMHLQD

SEQ ID NO: 508548 - protein, 9 aa, Homo Sapiens
LLEKMLTKE

SEQ ID NO: 508549 - protein, 9 aa, Homo Sapiens
QDTTRFCPK

SEQ ID NO: 508550 - protein, 9 aa, Homo Sapiens
MDRTEHLAR

SEQ ID NO: 508551 - protein, 9 aa, Homo Sapiens
KSGNCTVLQ

SEQ ID NO: 508552 - protein, 9 aa, Homo Sapiens
EAYQACCKE

SEQ ID NO: 508553 - protein, 9 aa, Homo Sapiens
LSSVSFVEL

SEQ ID NO: 508554 - protein, 9 aa, Homo Sapiens
DVVKLLSVV

SEQ ID NO: 508555 - protein, 9 aa, Homo Sapiens
EMHLQDTTR

SEQ ID NO: 508556 - protein, 9 aa, Homo Sapiens
PISSSSTSA

SEQ ID NO: 508557 - protein, 9 aa, Homo Sapiens
RSTFAPVLR

SEQ ID NO: 508558 - protein, 9 aa, Homo Sapiens
YQACCKERF

SEQ ID NO: 508559 - protein, 9 aa, Homo Sapiens
IDELQNKKE

SEQ ID NO: 508560 - protein, 9 aa, Homo Sapiens
KLKISKEEI

SEQ ID NO: 508561 - protein, 9 aa, Homo Sapiens
NIHLKISCT

SEQ ID NO: 508562 - protein, 9 aa, Homo Sapiens
VDRWSAGTP

SEQ ID NO: 508563 - protein, 9 aa, Homo Sapiens
SGVAARIQK

SEQ ID NO: 508564 - protein, 9 aa, Homo Sapiens
EAALSQTGF

SEQ ID NO: 508565 - protein, 9 aa, Homo Sapiens
ATVAATPKK

SEQ ID NO: 508566 - protein, 9 aa, Homo Sapiens
WWTVINFGE

SEQ ID NO: 508567 - protein, 9 aa, Homo Sapiens
VEIDELQNK

SEQ ID NO: 508568 - protein, 9 aa, Homo Sapiens
NEAYQACCK

SEQ ID NO: 508569 - protein, 9 aa, Homo Sapiens
LEKMLTKEL

SEQ ID NO: 508570 - protein, 9 aa, Homo Sapiens
VGIWWTVIN

SEQ ID NO: 508571 - protein, 9 aa, Homo Sapiens
SEEWYNRLH

SEQ ID NO: 508572 - protein, 9 aa, Homo Sapiens
LRVCACPGR

SEQ ID NO: 508573 - protein, 9 aa, Homo Sapiens
DRHRVLYCK

SEQ ID NO: 508574 - protein, 9 aa, Homo Sapiens
AAEAALSQT

SEQ ID NO: 508575 - protein, 9 aa, Homo Sapiens
DMLALSVST

SEQ ID NO: 508576 - protein, 9 aa, Homo Sapiens
TMVKGIGNG

SEQ ID NO: 508577 - protein, 9 aa, Homo Sapiens
SQVCIQRGQ

SEQ ID NO: 508578 - protein, 9 aa, Homo Sapiens
LSQTGFSYD

SEQ ID NO: 508579 - protein, 9 aa, Homo Sapiens
FDTHTSSNY

SEQ ID NO: 508580 - protein, 9 aa, Homo Sapiens
IMDRTEHLA

SEQ ID NO: 508581 - protein, 9 aa, Homo Sapiens
CWPYLTAET

SEQ ID NO: 508582 - protein, 9 aa, Homo Sapiens
SSVSFVELE

SEQ ID NO: 508583 - protein, 9 aa, Homo Sapiens
HKLCFRRPI

SEQ ID NO: 508584 - protein, 9 aa, Homo Sapiens
WLAVRFGNE

SEQ ID NO: 508585 - protein, 9 aa, Homo Sapiens
SSNYNDQLL

SEQ ID NO: 508586 - protein, 9 aa, Homo Sapiens
EYITLNYDS

SEQ ID NO: 508587 - protein, 9 aa, Homo Sapiens
TPENSILNA

SEQ ID NO: 508588 - protein, 9 aa, Homo Sapiens
LGNSLLRWG

SEQ ID NO: 508589 - protein, 9 aa, Homo Sapiens
AALSQTGFS

SEQ ID NO: 508590 - protein, 9 aa, Homo Sapiens
RVLSLPETL

SEQ ID NO: 508591 - protein, 9 aa, Homo Sapiens
VDHDDSFMK

SEQ ID NO: 508592 - protein, 9 aa, Homo Sapiens
FPGGGLVTA

SEQ ID NO: 508593 - protein, 9 aa, Homo Sapiens
LHITWDPPS

SEQ ID NO: 508594 - protein, 9 aa, Homo Sapiens
LSNLAQHRR

SEQ ID NO: 508595 - protein, 9 aa, Homo Sapiens
AVKQRSTFA

SEQ ID NO: 508596 - protein, 9 aa, Homo Sapiens
ILGPKEKGE

SEQ ID NO: 508597 - protein, 9 aa, Homo Sapiens
FVLLATEGL

SEQ ID NO: 508598 - protein, 9 aa, Homo Sapiens
TPISSSSTS

SEQ ID NO: 508599 - protein, 9 aa, Homo Sapiens
KLLSVVCIV

SEQ ID NO: 508600 - protein, 9 aa, Homo Sapiens
EVRREMHLQ

SEQ ID NO: 508601 - protein, 9 aa, Homo Sapiens
DEKQELAKL

SEQ ID NO: 508602 - protein, 9 aa, Homo Sapiens
LVCNRTFLV

SEQ ID NO: 508603 - protein, 9 aa, Homo Sapiens
AKKPKKATV

SEQ ID NO: 508604 - protein, 9 aa, Homo Sapiens
RKFVLLATE

SEQ ID NO: 508605 - protein, 9 aa, Homo Sapiens
GNWLAVRFG

SEQ ID NO: 508606 - protein, 9 aa, Homo Sapiens
VLSLPETLT

SEQ ID NO: 508607 - protein, 9 aa, Homo Sapiens
PADTQHWVL

SEQ ID NO: 508608 - protein, 9 aa, Homo Sapiens
KHEKIHIGE

SEQ ID NO: 508609 - protein, 9 aa, Homo Sapiens
YDKCGHENI

SEQ ID NO: 508610 - protein, 9 aa, Homo Sapiens
QTPISSSST

SEQ ID NO: 508611 - protein, 9 aa, Homo Sapiens
LPDIVTMVK

SEQ ID NO: 508612 - protein, 9 aa, Homo Sapiens
ENEAYQACC

SEQ ID NO: 508613 - protein, 9 aa, Homo Sapiens
VQVTFQTPI

SEQ ID NO: 508614 - protein, 9 aa, Homo Sapiens
RVLYCKVPK

SEQ ID NO: 508615 - protein, 9 aa, Homo Sapiens
EIKILKKAQ

SEQ ID NO: 508616 - protein, 9 aa, Homo Sapiens
GIWWTVINF

SEQ ID NO: 508617 - protein, 9 aa, Homo Sapiens
HRVLYCKVP

SEQ ID NO: 508618 - protein, 9 aa, Homo Sapiens
MVKGIGNGF

SEQ ID NO: 508619 - protein, 9 aa, Homo Sapiens
GDGSPSLEY

SEQ ID NO: 508620 - protein, 9 aa, Homo Sapiens
EAKVRLGQA

SEQ ID NO: 508621 - protein, 9 aa, Homo Sapiens
TQLNHSLKE

SEQ ID NO: 508622 - protein, 9 aa, Homo Sapiens
LKTESERLK

SEQ ID NO: 508623 - protein, 9 aa, Homo Sapiens
FRELLCCAL

SEQ ID NO: 508624 - protein, 9 aa, Homo Sapiens
WEWLHRFRG

SEQ ID NO: 508625 - protein, 9 aa, Homo Sapiens
LNPHLEGQP

SEQ ID NO: 508626 - protein, 9 aa, Homo Sapiens
QFVALLPNM

SEQ ID NO: 508627 - protein, 9 aa, Homo Sapiens
IRNIEWFCI

SEQ ID NO: 508628 - protein, 9 aa, Homo Sapiens
KVKCLPLIS

SEQ ID NO: 508629 - protein, 9 aa, Homo Sapiens
FIRPRFWAQ

SEQ ID NO: 508630 - protein, 9 aa, Homo Sapiens
EIRNIEWFC

SEQ ID NO: 508631 - protein, 9 aa, Homo Sapiens
STCYGGYKT

SEQ ID NO: 508632 - protein, 9 aa, Homo Sapiens
KIKPFKRFL

SEQ ID NO: 508633 - protein, 9 aa, Homo Sapiens
SNGTGYVTL

SEQ ID NO: 508634 - protein, 9 aa, Homo Sapiens
GLESEAQSL

SEQ ID NO: 508635 - protein, 9 aa, Homo Sapiens
SPYGARHQC

SEQ ID NO: 508636 - protein, 9 aa, Homo Sapiens
WWGDMATGT

SEQ ID NO: 508637 - protein, 9 aa, Homo Sapiens
ETHTSFGMP

SEQ ID NO: 508638 - protein, 9 aa, Homo Sapiens
STFQETCPY

SEQ ID NO: 508639 - protein, 9 aa, Homo Sapiens
DDKTKGHDT

SEQ ID NO: 508640 - protein, 9 aa, Homo Sapiens
SGDIGKKKI

SEQ ID NO: 508641 - protein, 9 aa, Homo Sapiens
KADGKNPDI

SEQ ID NO: 508642 - protein, 9 aa, Homo Sapiens
GSEQPPMGG

SEQ ID NO: 508643 - protein, 9 aa, Homo Sapiens
VLCTRSVSI

SEQ ID NO: 508644 - protein, 9 aa, Homo Sapiens
RSLWEWLHR

SEQ ID NO: 508645 - protein, 9 aa, Homo Sapiens
NPRVTWNKK

SEQ ID NO: 508646 - protein, 9 aa, Homo Sapiens
DACKKFQDA

SEQ ID NO: 508647 - protein, 9 aa, Homo Sapiens
SRNSGSRHH

SEQ ID NO: 508648 - protein, 9 aa, Homo Sapiens
WYKTGHVAL

SEQ ID NO: 508649 - protein, 9 aa, Homo Sapiens
RLQPEECTE

SEQ ID NO: 508650 - protein, 9 aa, Homo Sapiens
YVLMSSVVT

SEQ ID NO: 508651 - protein, 9 aa, Homo Sapiens
FDYIATYFS

SEQ ID NO: 508652 - protein, 9 aa, Homo Sapiens
TGALPYAFT

SEQ ID NO: 508653 - protein, 9 aa, Homo Sapiens
AMRQRIRQE

SEQ ID NO: 508654 - protein, 9 aa, Homo Sapiens
LPPNAPVSD

SEQ ID NO: 508655 - protein, 9 aa, Homo Sapiens
TNFCIFITD

SEQ ID NO: 508656 - protein, 9 aa, Homo Sapiens
CIFITDGVS

SEQ ID NO: 508657 - protein, 9 aa, Homo Sapiens
FVALLPNMT

SEQ ID NO: 508658 - protein, 9 aa, Homo Sapiens
PEAKNLTNQ

SEQ ID NO: 508659 - protein, 9 aa, Homo Sapiens
SQALPGVYL

SEQ ID NO: 508660 - protein, 9 aa, Homo Sapiens
VRGDGLPEK

SEQ ID NO: 508661 - protein, 9 aa, Homo Sapiens
AHRCCRVAD

SEQ ID NO: 508662 - protein, 9 aa, Homo Sapiens
LPGHPDIQW

SEQ ID NO: 508663 - protein, 9 aa, Homo Sapiens
LHVAAAEEH

SEQ ID NO: 508664 - protein, 9 aa, Homo Sapiens
RDQHKYRYR

SEQ ID NO: 508665 - protein, 9 aa, Homo Sapiens
DVMDNQLKS

SEQ ID NO: 508666 - protein, 9 aa, Homo Sapiens
ALANAKSRR

SEQ ID NO: 508667 - protein, 9 aa, Homo Sapiens
SSAMNLAPV

SEQ ID NO: 508668 - protein, 9 aa, Homo Sapiens
AVKALTSKA

SEQ ID NO: 508669 - protein, 9 aa, Homo Sapiens
DMATGTPIL

SEQ ID NO: 508670 - protein, 9 aa, Homo Sapiens
VAAAEEHIE

SEQ ID NO: 508671 - protein, 9 aa, Homo Sapiens
KHKSSDKEF

SEQ ID NO: 508672 - protein, 9 aa, Homo Sapiens
ALAPTPAPS

SEQ ID NO: 508673 - protein, 9 aa, Homo Sapiens
VKLATLADL

SEQ ID NO: 508674 - protein, 9 aa, Homo Sapiens
ASEHCISRG

SEQ ID NO: 508675 - protein, 9 aa, Homo Sapiens
EEEEGPFHF

SEQ ID NO: 508676 - protein, 9 aa, Homo Sapiens
LNAVQASAK

SEQ ID NO: 508677 - protein, 9 aa, Homo Sapiens
LNTIEKYVQ

SEQ ID NO: 508678 - protein, 9 aa, Homo Sapiens
ESLQPEPSD

SEQ ID NO: 508679 - protein, 9 aa, Homo Sapiens
KHQKRLQQF

SEQ ID NO: 508680 - protein, 9 aa, Homo Sapiens
LKAVKRKIQ

SEQ ID NO: 508681 - protein, 9 aa, Homo Sapiens
MDNQLKSMW

SEQ ID NO: 508682 - protein, 9 aa, Homo Sapiens
PYSIIQRIC

SEQ ID NO: 508683 - protein, 9 aa, Homo Sapiens
IKTAKAQLA

SEQ ID NO: 508684 - protein, 9 aa, Homo Sapiens
DSVISTELC

SEQ ID NO: 508685 - protein, 9 aa, Homo Sapiens
FMSHIVGPL

SEQ ID NO: 508686 - protein, 9 aa, Homo Sapiens
TQLNIHVAR

SEQ ID NO: 508687 - protein, 9 aa, Homo Sapiens
APGQFVALL

SEQ ID NO: 508688 - protein, 9 aa, Homo Sapiens
LDGQEYVVQ

SEQ ID NO: 508689 - protein, 9 aa, Homo Sapiens
CLNPHLEGQ

SEQ ID NO: 508690 - protein, 9 aa, Homo Sapiens
NISGTLYMN

SEQ ID NO: 508691 - protein, 9 aa, Homo Sapiens
HMAGFVQFR

SEQ ID NO: 508692 - protein, 9 aa, Homo Sapiens
YGGYKTGQC

SEQ ID NO: 508693 - protein, 9 aa, Homo Sapiens
SKVKCLPLI

SEQ ID NO: 508694 - protein, 9 aa, Homo Sapiens
KLMRTLPRG

SEQ ID NO: 508695 - protein, 9 aa, Homo Sapiens
LKQACGFDY

SEQ ID NO: 508696 - protein, 9 aa, Homo Sapiens
EAKNLTNQM

SEQ ID NO: 508697 - protein, 9 aa, Homo Sapiens
RTQLNHSLK

SEQ ID NO: 508698 - protein, 9 aa, Homo Sapiens
QAFSQGEVI

SEQ ID NO: 508699 - protein, 9 aa, Homo Sapiens
SRIINPLRL

SEQ ID NO: 508700 - protein, 9 aa, Homo Sapiens
GKNPDILTH

SEQ ID NO: 508701 - protein, 9 aa, Homo Sapiens
SSCLPPNAP

SEQ ID NO: 508702 - protein, 9 aa, Homo Sapiens
ALPYAFTLG

SEQ ID NO: 508703 - protein, 9 aa, Homo Sapiens
CNTQLNIHV

SEQ ID NO: 508704 - protein, 9 aa, Homo Sapiens
KDRDRFTRR

SEQ ID NO: 508705 - protein, 9 aa, Homo Sapiens
TKVDKSEAK

SEQ ID NO: 508706 - protein, 9 aa, Homo Sapiens
CFWVSLAQG

SEQ ID NO: 508707 - protein, 9 aa, Homo Sapiens
QDYMYWTDW

SEQ ID NO: 508708 - protein, 9 aa, Homo Sapiens
GFADLAVIL

SEQ ID NO: 508709 - protein, 9 aa, Homo Sapiens
LTQYQDYMY

SEQ ID NO: 508710 - protein, 9 aa, Homo Sapiens
GTAYTPETH

SEQ ID NO: 508711 - protein, 9 aa, Homo Sapiens
LSNHKVMKA

SEQ ID NO: 508712 - protein, 9 aa, Homo Sapiens
YGARHQCAY

SEQ ID NO: 508713 - protein, 9 aa, Homo Sapiens
RPAGDSEQE

SEQ ID NO: 508714 - protein, 9 aa, Homo Sapiens
HDDKSTFQE

SEQ ID NO: 508715 - protein, 9 aa, Homo Sapiens
TCLNPHLEG

SEQ ID NO: 508716 - protein, 9 aa, Homo Sapiens
PIPVTDASS

SEQ ID NO: 508717 - protein, 9 aa, Homo Sapiens
SKTQKVSKI

SEQ ID NO: 508718 - protein, 9 aa, Homo Sapiens
GEEFGLVEQ

SEQ ID NO: 508719 - protein, 9 aa, Homo Sapiens
EQNVLQHSA

SEQ ID NO: 508720 - protein, 9 aa, Homo Sapiens
LLFMMLAAL

SEQ ID NO: 508721 - protein, 9 aa, Homo Sapiens
TGHVALRLI

SEQ ID NO: 508722 - protein, 9 aa, Homo Sapiens
SARTSAWGL

SEQ ID NO: 508723 - protein, 9 aa, Homo Sapiens
AAKKVPAQE

SEQ ID NO: 508724 - protein, 9 aa, Homo Sapiens
LALRCQSPY

SEQ ID NO: 508725 - protein, 9 aa, Homo Sapiens
ARSLWEWLH

SEQ ID NO: 508726 - protein, 9 aa, Homo Sapiens
FIKIFTLAF

SEQ ID NO: 508727 - protein, 9 aa, Homo Sapiens
ADDKDDSGA

SEQ ID NO: 508728 - protein, 9 aa, Homo Sapiens
GREEGSPVE

SEQ ID NO: 508729 - protein, 9 aa, Homo Sapiens
LQLTQLQLK

SEQ ID NO: 508730 - protein, 9 aa, Homo Sapiens
DKSTFQETC

SEQ ID NO: 508731 - protein, 9 aa, Homo Sapiens
KPSGPWRVC

SEQ ID NO: 508732 - protein, 9 aa, Homo Sapiens
CLPLISASR

SEQ ID NO: 508733 - protein, 9 aa, Homo Sapiens
TSKLGTDLA

SEQ ID NO: 508734 - protein, 9 aa, Homo Sapiens
TPIGLPRPI

SEQ ID NO: 508735 - protein, 9 aa, Homo Sapiens
NVEVLNTIE

SEQ ID NO: 508736 - protein, 9 aa, Homo Sapiens
ESFMSHIVG

SEQ ID NO: 508737 - protein, 9 aa, Homo Sapiens
IVGFADLAV

SEQ ID NO: 508738 - protein, 9 aa, Homo Sapiens
QEEDDERRG

SEQ ID NO: 508739 - protein, 9 aa, Homo Sapiens
LGLLETQIT

SEQ ID NO: 508740 - protein, 9 aa, Homo Sapiens
GTLYMNRLG

SEQ ID NO: 508741 - protein, 9 aa, Homo Sapiens
TKQEKDFLW

SEQ ID NO: 508742 - protein, 9 aa, Homo Sapiens
EECTETLDS

SEQ ID NO: 508743 - protein, 9 aa, Homo Sapiens
VMDNQLKSM

SEQ ID NO: 508744 - protein, 9 aa, Homo Sapiens
SFHFRKPSV

SEQ ID NO: 508745 - protein, 9 aa, Homo Sapiens
SKHQKIHTG

SEQ ID NO: 508746 - protein, 9 aa, Homo Sapiens
KEAMNEIRA

SEQ ID NO: 508747 - protein, 9 aa, Homo Sapiens
RQAPRLNYL

SEQ ID NO: 508748 - protein, 9 aa, Homo Sapiens
GTLAAIIHE

SEQ ID NO: 508749 - protein, 9 aa, Homo Sapiens
MKADPDGDG

SEQ ID NO: 508750 - protein, 9 aa, Homo Sapiens
RPRFWAQPC

SEQ ID NO: 508751 - protein, 9 aa, Homo Sapiens
LAPSLAKAG

SEQ ID NO: 508752 - protein, 9 aa, Homo Sapiens
SEFQAKVQK

SEQ ID NO: 508753 - protein, 9 aa, Homo Sapiens
VLRVKGANG

SEQ ID NO: 508754 - protein, 9 aa, Homo Sapiens
AQPGQPVHA

SEQ ID NO: 508755 - protein, 9 aa, Homo Sapiens
SDSSFEVSG

SEQ ID NO: 508756 - protein, 9 aa, Homo Sapiens
GKPGRGPLE

SEQ ID NO: 508757 - protein, 9 aa, Homo Sapiens
SELSSLKHL

SEQ ID NO: 508758 - protein, 9 aa, Homo Sapiens
YSSCDRVGT

SEQ ID NO: 508759 - protein, 9 aa, Homo Sapiens
ELLRTQLNH

SEQ ID NO: 508760 - protein, 9 aa, Homo Sapiens
IIHEAGLPL

SEQ ID NO: 508761 - protein, 9 aa, Homo Sapiens
QDRVPLYSQ

SEQ ID NO: 508762 - protein, 9 aa, Homo Sapiens
ISSTSKLGT

SEQ ID NO: 508763 - protein, 9 aa, Homo Sapiens
GTVWLEWRH

SEQ ID NO: 508764 - protein, 9 aa, Homo Sapiens
AHPPLCLKL

SEQ ID NO: 508765 - protein, 9 aa, Homo Sapiens
GDQILPEAK

SEQ ID NO: 508766 - protein, 9 aa, Homo Sapiens
MLLARDIRS

SEQ ID NO: 508767 - protein, 9 aa, Homo Sapiens
TSEFQAKVQ

SEQ ID NO: 508768 - protein, 9 aa, Homo Sapiens
CGARGKPGR

SEQ ID NO: 508769 - protein, 9 aa, Homo Sapiens
SRRPRNNRR

SEQ ID NO: 508770 - protein, 9 aa, Homo Sapiens
QETCPYCFQ

SEQ ID NO: 508771 - protein, 9 aa, Homo Sapiens
YEDAVHFGA

SEQ ID NO: 508772 - protein, 9 aa, Homo Sapiens
DQEGPPPHG

SEQ ID NO: 508773 - protein, 9 aa, Homo Sapiens
AGGNDSMPV

SEQ ID NO: 508774 - protein, 9 aa, Homo Sapiens
LSSLKHLED

SEQ ID NO: 508775 - protein, 9 aa, Homo Sapiens
DLESKTVSE

SEQ ID NO: 508776 - protein, 9 aa, Homo Sapiens
LQRAVGDTN

SEQ ID NO: 508777 - protein, 9 aa, Homo Sapiens
HPDIQWTNL

SEQ ID NO: 508778 - protein, 9 aa, Homo Sapiens
GGYKTGQCI

SEQ ID NO: 508779 - protein, 9 aa, Homo Sapiens
SSTEETVFP

SEQ ID NO: 508780 - protein, 9 aa, Homo Sapiens
IPKVLADNG

SEQ ID NO: 508781 - protein, 9 aa, Homo Sapiens
GDQAFSQGE

SEQ ID NO: 508782 - protein, 9 aa, Homo Sapiens
SAYLPGHPD

SEQ ID NO: 508783 - protein, 9 aa, Homo Sapiens
KSTFQETCP

SEQ ID NO: 508784 - protein, 9 aa, Homo Sapiens
DNDPQEPWC

SEQ ID NO: 508785 - protein, 9 aa, Homo Sapiens
QLDFSKVKC

SEQ ID NO: 508786 - protein, 9 aa, Homo Sapiens
IRPRFWAQP

SEQ ID NO: 508787 - protein, 9 aa, Homo Sapiens
QAKVQKDAD

SEQ ID NO: 508788 - protein, 9 aa, Homo Sapiens
YIQQDNSQR

SEQ ID NO: 508789 - protein, 9 aa, Homo Sapiens
LARDIRSCL

SEQ ID NO: 508790 - protein, 9 aa, Homo Sapiens
LLETQITSH

SEQ ID NO: 508791 - protein, 9 aa, Homo Sapiens
QAHRCCRVA

SEQ ID NO: 508792 - protein, 9 aa, Homo Sapiens
DGSRNSGSR

SEQ ID NO: 508793 - protein, 9 aa, Homo Sapiens
VGTQERGLP

SEQ ID NO: 508794 - protein, 9 aa, Homo Sapiens
VNRVGTFIL

SEQ ID NO: 508795 - protein, 9 aa, Homo Sapiens
PSSPENGNK

SEQ ID NO: 508796 - protein, 9 aa, Homo Sapiens
GCFWVSLAQ

SEQ ID NO: 508797 - protein, 9 aa, Homo Sapiens
RTLPRGLSS

SEQ ID NO: 508798 - protein, 9 aa, Homo Sapiens
AKWAEDRTG

SEQ ID NO: 508799 - protein, 9 aa, Homo Sapiens
AFTVNVPFC

SEQ ID NO: 508800 - protein, 9 aa, Homo Sapiens
SYVQDRVPL

SEQ ID NO: 508801 - protein, 9 aa, Homo Sapiens
QKIQALQTA

SEQ ID NO: 508802 - protein, 9 aa, Homo Sapiens
AIIHEAGLP

SEQ ID NO: 508803 - protein, 9 aa, Homo Sapiens
LRISSNSFV

SEQ ID NO: 508804 - protein, 9 aa, Homo Sapiens
NRVGTFILV

SEQ ID NO: 508805 - protein, 9 aa, Homo Sapiens
DKTKGHDTD

SEQ ID NO: 508806 - protein, 9 aa, Homo Sapiens
PPTITESNS

SEQ ID NO: 508807 - protein, 9 aa, Homo Sapiens
ATGTPILRL

SEQ ID NO: 508808 - protein, 9 aa, Homo Sapiens
RLPRLWSFR

SEQ ID NO: 508809 - protein, 9 aa, Homo Sapiens
MAGFVQFRQ

SEQ ID NO: 508810 - protein, 9 aa, Homo Sapiens
AVGDTNRAL

SEQ ID NO: 508811 - protein, 9 aa, Homo Sapiens
RAQGPNGGL

SEQ ID NO: 508812 - protein, 9 aa, Homo Sapiens
QNDDKTKGH

SEQ ID NO: 508813 - protein, 9 aa, Homo Sapiens
LALKNGAVY

SEQ ID NO: 508814 - protein, 9 aa, Homo Sapiens
TIIECSSAR

SEQ ID NO: 508815 - protein, 9 aa, Homo Sapiens
CRVADRTGH

SEQ ID NO: 508816 - protein, 9 aa, Homo Sapiens
WKNEQVLVV

SEQ ID NO: 508817 - protein, 9 aa, Homo Sapiens
ITESNSNEA

SEQ ID NO: 508818 - protein, 9 aa, Homo Sapiens
DRTGFPWID

SEQ ID NO: 508819 - protein, 9 aa, Homo Sapiens
DSMPVHLHV

SEQ ID NO: 508820 - protein, 9 aa, Homo Sapiens
RSKEVRGDG

SEQ ID NO: 508821 - protein, 9 aa, Homo Sapiens
REQIEHHPT

SEQ ID NO: 508822 - protein, 9 aa, Homo Sapiens
NGGLTASTY

SEQ ID NO: 508823 - protein, 9 aa, Homo Sapiens
NDFIRPRFW

SEQ ID NO: 508824 - protein, 9 aa, Homo Sapiens
QPSSCLPPN

SEQ ID NO: 508825 - protein, 9 aa, Homo Sapiens
CGKVFNQSL

SEQ ID NO: 508826 - protein, 9 aa, Homo Sapiens
TPIPVTDAS

SEQ ID NO: 508827 - protein, 9 aa, Homo Sapiens
NLDSGRTST

SEQ ID NO: 508828 - protein, 9 aa, Homo Sapiens
PDHAPGQFV

SEQ ID NO: 508829 - protein, 9 aa, Homo Sapiens
HVAAAEEHI

SEQ ID NO: 508830 - protein, 9 aa, Homo Sapiens
LDGIDAAGS

SEQ ID NO: 508831 - protein, 9 aa, Homo Sapiens
PGSEQPPMG

SEQ ID NO: 508832 - protein, 9 aa, Homo Sapiens
QEGVMEEAE

SEQ ID NO: 508833 - protein, 9 aa, Homo Sapiens
QARLEELPH

SEQ ID NO: 508834 - protein, 9 aa, Homo Sapiens
VARAQPGQP

SEQ ID NO: 508835 - protein, 9 aa, Homo Sapiens
LEELPHEDE

SEQ ID NO: 508836 - protein, 9 aa, Homo Sapiens
PSLAPVPVS

SEQ ID NO: 508837 - protein, 9 aa, Homo Sapiens
AAGSQPEPG

SEQ ID NO: 508838 - protein, 9 aa, Homo Sapiens
ECGKVFNQS

SEQ ID NO: 508839 - protein, 9 aa, Homo Sapiens
EYFILKESN

SEQ ID NO: 508840 - protein, 9 aa, Homo Sapiens
FLQPHQREA

SEQ ID NO: 508841 - protein, 9 aa, Homo Sapiens
RNPREDGEK

SEQ ID NO: 508842 - protein, 9 aa, Homo Sapiens
KVQDNSDKI

SEQ ID NO: 508843 - protein, 9 aa, Homo Sapiens
SPLNFLRIS

SEQ ID NO: 508844 - protein, 9 aa, Homo Sapiens
DQGYTTLAT

SEQ ID NO: 508845 - protein, 9 aa, Homo Sapiens
VCLQLLILC

SEQ ID NO: 508846 - protein, 9 aa, Homo Sapiens
GANGMILGG

SEQ ID NO: 508847 - protein, 9 aa, Homo Sapiens
GTQERGLPP

SEQ ID NO: 508848 - protein, 9 aa, Homo Sapiens
EANGCILYK

SEQ ID NO: 508849 - protein, 9 aa, Homo Sapiens
PDACKKFQD

SEQ ID NO: 508850 - protein, 9 aa, Homo Sapiens
LGKGCEADS

SEQ ID NO: 508851 - protein, 9 aa, Homo Sapiens
EEFALRDQH

SEQ ID NO: 508852 - protein, 9 aa, Homo Sapiens
GPFHFLPDV

SEQ ID NO: 508853 - protein, 9 aa, Homo Sapiens
NVLQHSAAQ

SEQ ID NO: 508854 - protein, 9 aa, Homo Sapiens
CYSKTQKVS

SEQ ID NO: 508855 - protein, 9 aa, Homo Sapiens
RDGRDRQAL

SEQ ID NO: 508856 - protein, 9 aa, Homo Sapiens
DRVGTQERG

SEQ ID NO: 508857 - protein, 9 aa, Homo Sapiens
SSHHLHSYI

SEQ ID NO: 508858 - protein, 9 aa, Homo Sapiens
PDGTAFLAL

SEQ ID NO: 508859 - protein, 9 aa, Homo Sapiens
RIWWGDMAT

SEQ ID NO: 508860 - protein, 9 aa, Homo Sapiens
LYTSSSHHL

SEQ ID NO: 508861 - protein, 9 aa, Homo Sapiens
DVHIPSNGT

SEQ ID NO: 508862 - protein, 9 aa, Homo Sapiens
LAKAGPPAD

SEQ ID NO: 508863 - protein, 9 aa, Homo Sapiens
AAAEEHIEV

SEQ ID NO: 508864 - protein, 9 aa, Homo Sapiens
VNLWYKTGH

SEQ ID NO: 508865 - protein, 9 aa, Homo Sapiens
THIPEEKQD

SEQ ID NO: 508866 - protein, 9 aa, Homo Sapiens
FQAKVQKDA

SEQ ID NO: 508867 - protein, 9 aa, Homo Sapiens
QAWRDGRDR

SEQ ID NO: 508868 - protein, 9 aa, Homo Sapiens
YEPVPDDDQ

SEQ ID NO: 508869 - protein, 9 aa, Homo Sapiens
LQESFMSHI

SEQ ID NO: 508870 - protein, 9 aa, Homo Sapiens
EYGTAYTPE

SEQ ID NO: 508871 - protein, 9 aa, Homo Sapiens
FEVSGANPW

SEQ ID NO: 508872 - protein, 9 aa, Homo Sapiens
EMGFEKFFQ

SEQ ID NO: 508873 - protein, 9 aa, Homo Sapiens
LMSSVVTIC

SEQ ID NO: 508874 - protein, 9 aa, Homo Sapiens
IAKVMVAQH

SEQ ID NO: 508875 - protein, 9 aa, Homo Sapiens
RPELPSEIS

SEQ ID NO: 508876 - protein, 9 aa, Homo Sapiens
RVGTAARRH

SEQ ID NO: 508877 - protein, 9 aa, Homo Sapiens
RSKMIDRNP

SEQ ID NO: 508878 - protein, 9 aa, Homo Sapiens
NEQVLVVCK

SEQ ID NO: 508879 - protein, 9 aa, Homo Sapiens
ILDRTRKGA

SEQ ID NO: 508880 - protein, 9 aa, Homo Sapiens
LPEAKVRLG

SEQ ID NO: 508881 - protein, 9 aa, Homo Sapiens
EQVLVVCKQ

SEQ ID NO: 508882 - protein, 9 aa, Homo Sapiens
QEPWCYTTD

SEQ ID NO: 508883 - protein, 9 aa, Homo Sapiens
TMKPEEILR

SEQ ID NO: 508884 - protein, 9 aa, Homo Sapiens
IKIFTLAFF

SEQ ID NO: 508885 - protein, 9 aa, Homo Sapiens
EADSKKKRP

SEQ ID NO: 508886 - protein, 9 aa, Homo Sapiens
CLPPNAPVS

SEQ ID NO: 508887 - protein, 9 aa, Homo Sapiens
ARGKPGRGP

SEQ ID NO: 508888 - protein, 9 aa, Homo Sapiens
GGQTSERKK

SEQ ID NO: 508889 - protein, 9 aa, Homo Sapiens
GIGVSPAMS

SEQ ID NO: 508890 - protein, 9 aa, Homo Sapiens
FTVNVPFCG

SEQ ID NO: 508891 - protein, 9 aa, Homo Sapiens
RRPRNNRRN

SEQ ID NO: 508892 - protein, 9 aa, Homo Sapiens
HGNPLTSRF

SEQ ID NO: 508893 - protein, 9 aa, Homo Sapiens
FDYTSKLQR

SEQ ID NO: 508894 - protein, 9 aa, Homo Sapiens
GNNQILQHH

SEQ ID NO: 508895 - protein, 9 aa, Homo Sapiens
WMSDISECV

SEQ ID NO: 508896 - protein, 9 aa, Homo Sapiens
ADNGHNSDC

SEQ ID NO: 508897 - protein, 9 aa, Homo Sapiens
MKPEEILRL

SEQ ID NO: 508898 - protein, 9 aa, Homo Sapiens
VIGIGIQEE

SEQ ID NO: 508899 - protein, 9 aa, Homo Sapiens
ARWQDIQNY

SEQ ID NO: 508900 - protein, 9 aa, Homo Sapiens
AGSQPEPGQ

SEQ ID NO: 508901 - protein, 9 aa, Homo Sapiens
AWRGMSPEV

SEQ ID NO: 508902 - protein, 9 aa, Homo Sapiens
RCCRVADRT

SEQ ID NO: 508903 - protein, 9 aa, Homo Sapiens
RTRKGAILS

SEQ ID NO: 508904 - protein, 9 aa, Homo Sapiens
AGDPPKELR

SEQ ID NO: 508905 - protein, 9 aa, Homo Sapiens
AVIGIGIQE

SEQ ID NO: 508906 - protein, 9 aa, Homo Sapiens
RLLFHPEQL

SEQ ID NO: 508907 - protein, 9 aa, Homo Sapiens
GHPDIQWTN

SEQ ID NO: 508908 - protein, 9 aa, Homo Sapiens
RKHTVLCQQ

SEQ ID NO: 508909 - protein, 9 aa, Homo Sapiens
QGYTTLATS

SEQ ID NO: 508910 - protein, 9 aa, Homo Sapiens
GKVFNQSLT

SEQ ID NO: 508911 - protein, 9 aa, Homo Sapiens
VYLPDGTAF

SEQ ID NO: 508912 - protein, 9 aa, Homo Sapiens
SPYQTQNQW

SEQ ID NO: 508913 - protein, 9 aa, Homo Sapiens
RERNNNTDT

SEQ ID NO: 508914 - protein, 9 aa, Homo Sapiens
TQKVSKIET

SEQ ID NO: 508915 - protein, 9 aa, Homo Sapiens
NCVLNSDVL

SEQ ID NO: 508916 - protein, 9 aa, Homo Sapiens
IQQDNSQRK

SEQ ID NO: 508917 - protein, 9 aa, Homo Sapiens
KQHTQKSVN

SEQ ID NO: 508918 - protein, 9 aa, Homo Sapiens
SSVVTICVI

SEQ ID NO: 508919 - protein, 9 aa, Homo Sapiens
GSAYLPGHP

SEQ ID NO: 508920 - protein, 9 aa, Homo Sapiens
CCALVRARP

SEQ ID NO: 508921 - protein, 9 aa, Homo Sapiens
AFKIPYSII

SEQ ID NO: 508922 - protein, 9 aa, Homo Sapiens
SSSHHLHSY

SEQ ID NO: 508923 - protein, 9 aa, Homo Sapiens
SEITKQEKD

SEQ ID NO: 508924 - protein, 9 aa, Homo Sapiens
QLNHSLKEI

SEQ ID NO: 508925 - protein, 9 aa, Homo Sapiens
DGKNPDILT

SEQ ID NO: 508926 - protein, 9 aa, Homo Sapiens
LYMNRLGSG

SEQ ID NO: 508927 - protein, 9 aa, Homo Sapiens
DFYCILSLN

SEQ ID NO: 508928 - protein, 9 aa, Homo Sapiens
NGTGYVTLL

SEQ ID NO: 508929 - protein, 9 aa, Homo Sapiens
KQIKQRERN

SEQ ID NO: 508930 - protein, 9 aa, Homo Sapiens
AFVLKSVFC

SEQ ID NO: 508931 - protein, 9 aa, Homo Sapiens
QRKRKHLPD

SEQ ID NO: 508932 - protein, 9 aa, Homo Sapiens
VPTCLNPHL

SEQ ID NO: 508933 - protein, 9 aa, Homo Sapiens
LAARIVEDC

SEQ ID NO: 508934 - protein, 9 aa, Homo Sapiens
HRYLLFMML

SEQ ID NO: 508935 - protein, 9 aa, Homo Sapiens
VKCLPLISA

SEQ ID NO: 508936 - protein, 9 aa, Homo Sapiens
MGFEKFFQV

SEQ ID NO: 508937 - protein, 9 aa, Homo Sapiens
KNAMRQRIR

SEQ ID NO: 508938 - protein, 9 aa, Homo Sapiens
EILRLREEL

SEQ ID NO: 508939 - protein, 9 aa, Homo Sapiens
VPFCGPNKV

SEQ ID NO: 508940 - protein, 9 aa, Homo Sapiens
KGSWPLEFK

SEQ ID NO: 508941 - protein, 9 aa, Homo Sapiens
QLCQAGEEE

SEQ ID NO: 508942 - protein, 9 aa, Homo Sapiens
HERIHTGKT

SEQ ID NO: 508943 - protein, 9 aa, Homo Sapiens
QAGEEEFLE

SEQ ID NO: 508944 - protein, 9 aa, Homo Sapiens
RMFDVGGQT

SEQ ID NO: 508945 - protein, 9 aa, Homo Sapiens
DKPSGPWRV

SEQ ID NO: 508946 - protein, 9 aa, Homo Sapiens
LLHKHKSSD

SEQ ID NO: 508947 - protein, 9 aa, Homo Sapiens
LAPVLGTSP

SEQ ID NO: 508948 - protein, 9 aa, Homo Sapiens
QEGPPPHGP

SEQ ID NO: 508949 - protein, 9 aa, Homo Sapiens
TEETVFPKI

SEQ ID NO: 508950 - protein, 9 aa, Homo Sapiens
AVVSSAMNL

SEQ ID NO: 508951 - protein, 9 aa, Homo Sapiens
SFMSHIVGP

SEQ ID NO: 508952 - protein, 9 aa, Homo Sapiens
LAAIIHEAG

SEQ ID NO: 508953 - protein, 9 aa, Homo Sapiens
YSIIQRICA

SEQ ID NO: 508954 - protein, 9 aa, Homo Sapiens
DEEDEADDK

SEQ ID NO: 508955 - protein, 9 aa, Homo Sapiens
NWKNEQVLV

SEQ ID NO: 508956 - protein, 9 aa, Homo Sapiens
NGMILGGPQ

SEQ ID NO: 508957 - protein, 9 aa, Homo Sapiens
DIGKKKIKP

SEQ ID NO: 508958 - protein, 9 aa, Homo Sapiens
CKDEDEGDQ

SEQ ID NO: 508959 - protein, 9 aa, Homo Sapiens
AWRDGRDRQ

SEQ ID NO: 508960 - protein, 9 aa, Homo Sapiens
ERLKQHTQK

SEQ ID NO: 508961 - protein, 9 aa, Homo Sapiens
RVEHPMLEN

SEQ ID NO: 508962 - protein, 9 aa, Homo Sapiens
PNPRVTWNK

SEQ ID NO: 508963 - protein, 9 aa, Homo Sapiens
VGTAARRHA

SEQ ID NO: 508964 - protein, 9 aa, Homo Sapiens
HEDEDANLD

SEQ ID NO: 508965 - protein, 9 aa, Homo Sapiens
QLNLTPIGL

SEQ ID NO: 508966 - protein, 9 aa, Homo Sapiens
LTNQMLTIN

SEQ ID NO: 508967 - protein, 9 aa, Homo Sapiens
MIDRNPRED

SEQ ID NO: 508968 - protein, 9 aa, Homo Sapiens
SPPRLPRLW

SEQ ID NO: 508969 - protein, 9 aa, Homo Sapiens
EDFYCILSL

SEQ ID NO: 508970 - protein, 9 aa, Homo Sapiens
SSGDIGKKK

SEQ ID NO: 508971 - protein, 9 aa, Homo Sapiens
APSLAPVPV

SEQ ID NO: 508972 - protein, 9 aa, Homo Sapiens
LSVNFGATV

SEQ ID NO: 508973 - protein, 9 aa, Homo Sapiens
FWVSLAQGE

SEQ ID NO: 508974 - protein, 9 aa, Homo Sapiens
NGAVYLVIN

SEQ ID NO: 508975 - protein, 9 aa, Homo Sapiens
LNSDVLQPG

SEQ ID NO: 508976 - protein, 9 aa, Homo Sapiens
INKMLCSKD

SEQ ID NO: 508977 - protein, 9 aa, Homo Sapiens
PIGLPRPIR

SEQ ID NO: 508978 - protein, 9 aa, Homo Sapiens
LCGTPGYVA

SEQ ID NO: 508979 - protein, 9 aa, Homo Sapiens
TNRALSASS

SEQ ID NO: 508980 - protein, 9 aa, Homo Sapiens
KVMVAQHDV

SEQ ID NO: 508981 - protein, 9 aa, Homo Sapiens
GGSAYLPGH

SEQ ID NO: 508982 - protein, 9 aa, Homo Sapiens
ARLLPNLTV

SEQ ID NO: 508983 - protein, 9 aa, Homo Sapiens
MAGDQAFSQ

SEQ ID NO: 508984 - protein, 9 aa, Homo Sapiens
AKVRLGQAG

SEQ ID NO: 508985 - protein, 9 aa, Homo Sapiens
YTPETHTSF

SEQ ID NO: 508986 - protein, 9 aa, Homo Sapiens
RELLCCALV

SEQ ID NO: 508987 - protein, 9 aa, Homo Sapiens
LYRKLIVKE

SEQ ID NO: 508988 - protein, 9 aa, Homo Sapiens
LVVAEGGTV

SEQ ID NO: 508989 - protein, 9 aa, Homo Sapiens
PCYSKTQKV

SEQ ID NO: 508990 - protein, 9 aa, Homo Sapiens
GVVARAQPG

SEQ ID NO: 508991 - protein, 9 aa, Homo Sapiens
GSPVELERL

SEQ ID NO: 508992 - protein, 9 aa, Homo Sapiens
LCLKLKYQS

SEQ ID NO: 508993 - protein, 9 aa, Homo Sapiens
LSPLLNIQK

SEQ ID NO: 508994 - protein, 9 aa, Homo Sapiens
PPCFHGARD

SEQ ID NO: 508995 - protein, 9 aa, Homo Sapiens
ACNTQLNIH

SEQ ID NO: 508996 - protein, 9 aa, Homo Sapiens
LEKVQDNSD

SEQ ID NO: 508997 - protein, 9 aa, Homo Sapiens
LDQTQIQEF

SEQ ID NO: 508998 - protein, 9 aa, Homo Sapiens
CQSPYGARH

SEQ ID NO: 508999 - protein, 9 aa, Homo Sapiens
IEWFCIEKL

SEQ ID NO: 509000 - protein, 9 aa, Homo Sapiens
VPDDDQTTT

SEQ ID NO: 509001 - protein, 9 aa, Homo Sapiens
ETVFPKIKS

SEQ ID NO: 509002 - protein, 9 aa, Homo Sapiens
YTSSSHHLH

SEQ ID NO: 509003 - protein, 9 aa, Homo Sapiens
YAQFAIINE

SEQ ID NO: 509004 - protein, 9 aa, Homo Sapiens
SVFSMLDQT

SEQ ID NO: 509005 - protein, 9 aa, Homo Sapiens
LQLKRKSLD

SEQ ID NO: 509006 - protein, 9 aa, Homo Sapiens
WRVCLQALE

SEQ ID NO: 509007 - protein, 9 aa, Homo Sapiens
KDEDEGDQA

SEQ ID NO: 509008 - protein, 9 aa, Homo Sapiens
SVVTICVIH

SEQ ID NO: 509009 - protein, 9 aa, Homo Sapiens
PLNFLRISS

SEQ ID NO: 509010 - protein, 9 aa, Homo Sapiens
RRPAGDSEQ

SEQ ID NO: 509011 - protein, 9 aa, Homo Sapiens
LFTRGKDRD

SEQ ID NO: 509012 - protein, 9 aa, Homo Sapiens
SQAWRDGRD

SEQ ID NO: 509013 - protein, 9 aa, Homo Sapiens
GTAARRHAA

SEQ ID NO: 509014 - protein, 9 aa, Homo Sapiens
SSPENGNKS

SEQ ID NO: 509015 - protein, 9 aa, Homo Sapiens
AEDRTGFPW

SEQ ID NO: 509016 - protein, 9 aa, Homo Sapiens
GYKTGQCIK

SEQ ID NO: 509017 - protein, 9 aa, Homo Sapiens
LAEQHHRTS

SEQ ID NO: 509018 - protein, 9 aa, Homo Sapiens
LQAFVLKSV

SEQ ID NO: 509019 - protein, 9 aa, Homo Sapiens
ADVMDNQLK

SEQ ID NO: 509020 - protein, 9 aa, Homo Sapiens
LNLDSGRTS

SEQ ID NO: 509021 - protein, 9 aa, Homo Sapiens
LPMSYCYAI

SEQ ID NO: 509022 - protein, 9 aa, Homo Sapiens
FQVYEKIKA

SEQ ID NO: 509023 - protein, 9 aa, Homo Sapiens
RLVLTCMAK

SEQ ID NO: 509024 - protein, 9 aa, Homo Sapiens
ARRHAASQS

SEQ ID NO: 509025 - protein, 9 aa, Homo Sapiens
NRRNAPPVR

SEQ ID NO: 509026 - protein, 9 aa, Homo Sapiens
YLQRIGIGV

SEQ ID NO: 509027 - protein, 9 aa, Homo Sapiens
VLTCMAKGS

SEQ ID NO: 509028 - protein, 9 aa, Homo Sapiens
KAARTCAHE

SEQ ID NO: 509029 - protein, 9 aa, Homo Sapiens
TGQHRLLFH

SEQ ID NO: 509030 - protein, 9 aa, Homo Sapiens
LYSQGARPK

SEQ ID NO: 509031 - protein, 9 aa, Homo Sapiens
RRAQGPNGG

SEQ ID NO: 509032 - protein, 9 aa, Homo Sapiens
INPLRLFVK

SEQ ID NO: 509033 - protein, 9 aa, Homo Sapiens
PEAKVRLGQ

SEQ ID NO: 509034 - protein, 9 aa, Homo Sapiens
MSYCYAIRL

SEQ ID NO: 509035 - protein, 9 aa, Homo Sapiens
VLVVCKQLG

SEQ ID NO: 509036 - protein, 9 aa, Homo Sapiens
ALGKGCEAD

SEQ ID NO: 509037 - protein, 9 aa, Homo Sapiens
KTDICKDED

SEQ ID NO: 509038 - protein, 9 aa, Homo Sapiens
SLWEWLHRF

SEQ ID NO: 509039 - protein, 9 aa, Homo Sapiens
ELPSEISPI

SEQ ID NO: 509040 - protein, 9 aa, Homo Sapiens
NYLIGAAPI

SEQ ID NO: 509041 - protein, 9 aa, Homo Sapiens
IQQKIQALQ

SEQ ID NO: 509042 - protein, 9 aa, Homo Sapiens
AVHFGALND

SEQ ID NO: 509043 - protein, 9 aa, Homo Sapiens
PGKRTIIEC
